United States Patent 11,640,849 (METHODS FOR HISTOLOGICAL DIAGNOSIS AND TREATMENT OF DISEASES) - sequence listing, part 77

SEQ ID NO: 2941015 - protein, 23 aa, Entamoeba invadens
HEEHPKYIALYIDLLLRRVGPGK

SEQ ID NO: 2941016 - protein, 25 aa, Entamoeba invadens
HEEKDMNMAFGFYVECLKKLDEEVY

SEQ ID NO: 2941017 - protein, 22 aa, Entamoeba invadens
HEELMKMKGFYHALASQQFGTN

SEQ ID NO: 2941018 - protein, 19 aa, Entamoeba invadens
HEEVKRKLDVLSLNMTTQT

SEQ ID NO: 2941019 - protein, 19 aa, Entamoeba invadens
HEFIPKNRIKGHTREKFPP

SEQ ID NO: 2941020 - protein, 17 aa, Entamoeba invadens
HEFSCPKCSSRKIQETQ

SEQ ID NO: 2941021 - protein, 23 aa, Entamoeba invadens
HEFSGFAKFVFFDGNKREDIGNV

SEQ ID NO: 2941022 - protein, 17 aa, Entamoeba invadens
HEFTSLIIPTTLRCIGT

SEQ ID NO: 2941023 - protein, 24 aa, Entamoeba invadens
HEFYTFPFSYCLCLGNDFIKKLSI

SEQ ID NO: 2941024 - protein, 25 aa, Entamoeba invadens
HEGDHDCEYCFAEGYSVSEEFINEK

SEQ ID NO: 2941025 - protein, 18 aa, Entamoeba invadens
HEGDKRWCESNFVNMKGM

SEQ ID NO: 2941026 - protein, 26 aa, Entamoeba invadens
HEGILKKEWFASLLLYTDSLEIESGK

SEQ ID NO: 2941027 - protein, 18 aa, Entamoeba invadens
HEHLLKNPFGLFSTKVPL

SEQ ID NO: 2941028 - protein, 28 aa, Entamoeba invadens
HEIAKYCNAKEFFKYQCENDKVIVSTVA

SEQ ID NO: 2941029 - protein, 18 aa, Entamoeba invadens
HEICAMMYYVFSNGQSDK

SEQ ID NO: 2941030 - protein, 22 aa, Entamoeba invadens
HEIDLSPILKYTENVEVYVNFL

SEQ ID NO: 2941031 - protein, 25 aa, Entamoeba invadens
HEIFDSPPYLAWFVNVWKMVDEMVN

SEQ ID NO: 2941032 - protein, 21 aa, Entamoeba invadens
HEKCALLLNRIFNINRIYQEW

SEQ ID NO: 2941033 - protein, 21 aa, Entamoeba invadens
HEKCQICIGEKCKKCEEKLLV

SEQ ID NO: 2941034 - protein, 21 aa, Entamoeba invadens
HEKEFDCLRSMEIEEKINVVK

SEQ ID NO: 2941035 - protein, 24 aa, Entamoeba invadens
HEKKELVNCIPLILFDEYDRPRVS

SEQ ID NO: 2941036 - protein, 23 aa, Entamoeba invadens
HEKLELYGNLFFLLQTEPVYLAR

SEQ ID NO: 2941037 - protein, 25 aa, Entamoeba invadens
HELEFGFKCIFILVKGSVEKSNKTT

SEQ ID NO: 2941038 - protein, 25 aa, Entamoeba invadens
HELEFGFKCIFILVRGSVTQANKTK

SEQ ID NO: 2941039 - protein, 25 aa, Entamoeba invadens
HELLEKDYRGILGLPPKKIHMNYRE

SEQ ID NO: 2941040 - protein, 24 aa, Entamoeba invadens
HELNIPFKHLLPFYYNLKTPLIPT

SEQ ID NO: 2941041 - protein, 26 aa, Entamoeba invadens
HELNSLCVMMVFSLLISRDAKLKQIC

SEQ ID NO: 2941042 - protein, 24 aa, Entamoeba invadens
HELQKTFQWKRVYGNRKALYKEEK

SEQ ID NO: 2941043 - protein, 21 aa, Entamoeba invadens
HELSAWLPLQSTDLVKAQTHI

SEQ ID NO: 2941044 - protein, 18 aa, Entamoeba invadens
HELTRLEIIGGVESEITP

SEQ ID NO: 2941045 - protein, 20 aa, Entamoeba invadens
HEMMNTLLLANYVVQNSPTF

SEQ ID NO: 2941046 - protein, 18 aa, Entamoeba invadens
HENFKWKIFGVKILGDCL

SEQ ID NO: 2941047 - protein, 28 aa, Entamoeba invadens
HENGKRFKPCFVCGKLGHNTNKCPQKEK

SEQ ID NO: 2941048 - protein, 24 aa, Entamoeba invadens
HEPKRSAAEIALTELHAGGKFNQN

SEQ ID NO: 2941049 - protein, 17 aa, Entamoeba invadens
HEQPCAPTTNPLAPSFA

SEQ ID NO: 2941050 - protein, 23 aa, Entamoeba invadens
HERAEKCHRWRIDKDRYKDELEN

SEQ ID NO: 2941051 - protein, 26 aa, Entamoeba invadens
HERCMKCYKCGCRLYSTSDIYEHKHE

SEQ ID NO: 2941052 - protein, 17 aa, Entamoeba invadens
HERFKDEINFLVQGKYE

SEQ ID NO: 2941053 - protein, 17 aa, Entamoeba invadens
HESFTEMMRVLKSVLVE

SEQ ID NO: 2941054 - protein, 18 aa, Entamoeba invadens
HETLQLIEVLVCNRDTAI

SEQ ID NO: 2941055 - protein, 30 aa, Entamoeba invadens
HETRKMTVKWGFHNECIWKYNNEIYNEIMT

SEQ ID NO: 2941056 - protein, 24 aa, Entamoeba invadens
HETYDEACCFVLNTMKDMILITTK

SEQ ID NO: 2941057 - protein, 24 aa, Entamoeba invadens
HEVECPICGITKVVTVRPKFLVKN

SEQ ID NO: 2941058 - protein, 17 aa, Entamoeba invadens
HEVHPGEAFGVMEDAGY

SEQ ID NO: 2941059 - protein, 17 aa, Entamoeba invadens
HEVKMLVTRHKKMVDPE

SEQ ID NO: 2941060 - protein, 21 aa, Entamoeba invadens
HEVPEPLIIIELITEEYDYKK

SEQ ID NO: 2941061 - protein, 21 aa, Entamoeba invadens
HEYNVPFPYLFSELSVAIQSD

SEQ ID NO: 2941062 - protein, 23 aa, Entamoeba invadens
HEYPDIHWHFIGRLQSNKVHLLV

SEQ ID NO: 2941063 - protein, 25 aa, Entamoeba invadens
HFALFLTDLMRFFRRNVVLECLDRY

SEQ ID NO: 2941064 - protein, 23 aa, Entamoeba invadens
HFDELCKLMKYKNGYYSVNRESE

SEQ ID NO: 2941065 - protein, 25 aa, Entamoeba invadens
HFDELCKLMKYKNGYYSVNRESEVE

SEQ ID NO: 2941066 - protein, 17 aa, Entamoeba invadens
HFDEMPCDVVANVYKRF

SEQ ID NO: 2941067 - protein, 19 aa, Entamoeba invadens
HFDIFKPEPNVLLFRRKRN

SEQ ID NO: 2941068 - protein, 18 aa, Entamoeba invadens
HFDMKAYCVFYCNQDVRI

SEQ ID NO: 2941069 - protein, 20 aa, Entamoeba invadens
HFECTIETYLLTAALLDDYL

SEQ ID NO: 2941070 - protein, 25 aa, Entamoeba invadens
HFEEKWPGYEFEVHGLVAKNGKFFI

SEQ ID NO: 2941071 - protein, 18 aa, Entamoeba invadens
HFEELPMLSTLMNLQTFD

SEQ ID NO: 2941072 - protein, 25 aa, Entamoeba invadens
HFEERWPGYEFEVHGLVKKNNNFFI

SEQ ID NO: 2941073 - protein, 22 aa, Entamoeba invadens
HFEGGESYKVIFGKNYHERCMK

SEQ ID NO: 2941074 - protein, 22 aa, Entamoeba invadens
HFEGKFPKCQIDTFNSCNNLKN

SEQ ID NO: 2941075 - protein, 19 aa, Entamoeba invadens
HFEGKFPKCQIETFNSCNN

SEQ ID NO: 2941076 - protein, 19 aa, Entamoeba invadens
HFEGYKVDKVRIIKHATES

SEQ ID NO: 2941077 - protein, 17 aa, Entamoeba invadens
HFFNRKKIKGIQNIIFY

SEQ ID NO: 2941078 - protein, 26 aa, Entamoeba invadens
HFFVCNLCGIILDKNCGNDGEYPCKP

SEQ ID NO: 2941079 - protein, 19 aa, Entamoeba invadens
HFFVYTIAGKPAFSRYGSD

SEQ ID NO: 2941080 - protein, 31 aa, Entamoeba invadens
HFFYNIFITLKFLWKYFCNGLCDSLIHCNCI

SEQ ID NO: 2941081 - protein, 21 aa, Entamoeba invadens
HFGEWERYHFLVQNLVALVFY

SEQ ID NO: 2941082 - protein, 19 aa, Entamoeba invadens
HFGKFFEFFDHVARLIPSM

SEQ ID NO: 2941083 - protein, 17 aa, Entamoeba invadens
HFHFCQSLYRRVLTMGL

SEQ ID NO: 2941084 - protein, 18 aa, Entamoeba invadens
HFHKHLKLHYSIPDEIFS

SEQ ID NO: 2941085 - protein, 25 aa, Entamoeba invadens
HFHVDHCAALPYLVLERNYKGKILM

SEQ ID NO: 2941086 - protein, 22 aa, Entamoeba invadens
HFHVHFCSIYSPLFKSANVNIG

SEQ ID NO: 2941087 - protein, 17 aa, Entamoeba invadens
HFIFSLDSKGLFPAPTR

SEQ ID NO: 2941088 - protein, 18 aa, Entamoeba invadens
HFINAILCQMCNDDEIGA

SEQ ID NO: 2941089 - protein, 27 aa, Entamoeba invadens
HFIWGKGCAFGPCSHPEFDVAVNKTRS

SEQ ID NO: 2941090 - protein, 17 aa, Entamoeba invadens
HFKEMCYDEHVCTSQVM

SEQ ID NO: 2941091 - protein, 20 aa, Entamoeba invadens
HFKNECRQIVYGIVTEFSNQ

SEQ ID NO: 2941092 - protein, 20 aa, Entamoeba invadens
HFKRFRYFFQAALKKNEPTC

SEQ ID NO: 2941093 - protein, 17 aa, Entamoeba invadens
HFKSFCCTRRYLPESKT

SEQ ID NO: 2941094 - protein, 19 aa, Entamoeba invadens
HFKSSVGLSKKTVDTDFNL

SEQ ID NO: 2941095 - protein, 18 aa, Entamoeba invadens
HFLAEIASGLWYLHFCKH

SEQ ID NO: 2941096 - protein, 25 aa, Entamoeba invadens
HFLMDLLQLFGYVFLSWRRFASGRL

SEQ ID NO: 2941097 - protein, 18 aa, Entamoeba invadens
HFLSECCIPRSPNPLQQF

SEQ ID NO: 2941098 - protein, 17 aa, Entamoeba invadens
HFLVKRAKKANFLKPFS

SEQ ID NO: 2941099 - protein, 19 aa, Entamoeba invadens
HFLWEEGRITFKKSKQSTY

SEQ ID NO: 2941100 - protein, 26 aa, Entamoeba invadens
HFLYCNHLCIVFELLGSNIYQMLQEN

SEQ ID NO: 2941101 - protein, 22 aa, Entamoeba invadens
HFLYFMMRTIFTKYAETVFSVF

SEQ ID NO: 2941102 - protein, 25 aa, Entamoeba invadens
HFLYNRHVCIVFELLGKSLYEVERH

SEQ ID NO: 2941103 - protein, 25 aa, Entamoeba invadens
HFLYNRHVCVVFELLGLNLYDVLRI

SEQ ID NO: 2941104 - protein, 22 aa, Entamoeba invadens
HFMERKIVCLSSVRFLIFDEAD

SEQ ID NO: 2941105 - protein, 17 aa, Entamoeba invadens
HFMLDFLRELGYKSETT

SEQ ID NO: 2941106 - protein, 19 aa, Entamoeba invadens
HFNPFRVGLETKRISEDVS

SEQ ID NO: 2941107 - protein, 19 aa, Entamoeba invadens
HFNPRCPYCNTSMLVTEFY

SEQ ID NO: 2941108 - protein, 24 aa, Entamoeba invadens
HFNSLRFPHCHDVITKEKHLMFFF

SEQ ID NO: 2941109 - protein, 19 aa, Entamoeba invadens
HFNSMTWEPPCELLDCGTT

SEQ ID NO: 2941110 - protein, 18 aa, Entamoeba invadens
HFNSMTWEPPCELLDSGK

SEQ ID NO: 2941111 - protein, 24 aa, Entamoeba invadens
HFNVKFKYYLLNKMVTIWYEVDNA

SEQ ID NO: 2941112 - protein, 18 aa, Entamoeba invadens
HFPLEVLRWKKLDEKMAL

SEQ ID NO: 2941113 - protein, 18 aa, Entamoeba invadens
HFPNIETLHLWKKHNENF

SEQ ID NO: 2941114 - protein, 23 aa, Entamoeba invadens
HFPSVNWNISFSKYIKILEQYYN

SEQ ID NO: 2941115 - protein, 19 aa, Entamoeba invadens
HFQIVMKYFLYKQDYINSM

SEQ ID NO: 2941116 - protein, 20 aa, Entamoeba invadens
HFRVRCLSSSLGMSLMQSSV

SEQ ID NO: 2941117 - protein, 29 aa, Entamoeba invadens
HFSGSWRKFVICVIAWKISSSNCLRARAL

SEQ ID NO: 2941118 - protein, 25 aa, Entamoeba invadens
HFSGVKWIFWDVCGQQKFRNLWRSY

SEQ ID NO: 2941119 - protein, 25 aa, Entamoeba invadens
HFSLLRFTVIFAEQFFVTIDPKNLK

SEQ ID NO: 2941120 - protein, 25 aa, Entamoeba invadens
HFSPDTIAVFCFDETLLSFLPSISC

SEQ ID NO: 2941121 - protein, 20 aa, Entamoeba invadens
HFVKLKLRYDNNISSFRISP

SEQ ID NO: 2941122 - protein, 17 aa, Entamoeba invadens
HFVSCVKFGVKDPTINV

SEQ ID NO: 2941123 - protein, 19 aa, Entamoeba invadens
HFVVYSIKVELTLHMQIIE

SEQ ID NO: 2941124 - protein, 19 aa, Entamoeba invadens
HFYGAVFARKKCLRLKFCL

SEQ ID NO: 2941125 - protein, 19 aa, Entamoeba invadens
HFYGAVFARKKCLRVKICL

SEQ ID NO: 2941126 - protein, 25 aa, Entamoeba invadens
HGAHSCYFCNFVAAASFIKELTEKS

SEQ ID NO: 2941127 - protein, 19 aa, Entamoeba invadens
HGAYKFKPGMHPRIRLDIL

SEQ ID NO: 2941128 - protein, 19 aa, Entamoeba invadens
HGCCSLESISLPLSVSRIN

SEQ ID NO: 2941129 - protein, 29 aa, Entamoeba invadens
HGCYFHYTQCIWRCVQRCGLSMYYTPNSV

SEQ ID NO: 2941130 - protein, 27 aa, Entamoeba invadens
HGDELKDFILRKLINGERMSLFSPTFR

SEQ ID NO: 2941131 - protein, 27 aa, Entamoeba invadens
HGDVRYAINVLQTFCKCGMSIGEKNED

SEQ ID NO: 2941132 - protein, 17 aa, Entamoeba invadens
HGEIMCLNNTLDVQNST

SEQ ID NO: 2941133 - protein, 20 aa, Entamoeba invadens
HGEMCPCNWMPGKDTVKPCQ

SEQ ID NO: 2941134 - protein, 22 aa, Entamoeba invadens
HGEQTFEILIKMMSDKENEETA

SEQ ID NO: 2941135 - protein, 26 aa, Entamoeba invadens
HGFKYYKEFYQILVWYEVDYFTVNNN

SEQ ID NO: 2941136 - protein, 18 aa, Entamoeba invadens
HGFPSRMTVGKMLELVSG

SEQ ID NO: 2941137 - protein, 17 aa, Entamoeba invadens
HGFYRKPTFHLTGPYGV

SEQ ID NO: 2941138 - protein, 19 aa, Entamoeba invadens
HGGAVVRRNGKIMNQSGIN

SEQ ID NO: 2941139 - protein, 19 aa, Entamoeba invadens
HGGAVVRSNGKIMSQSGIN

SEQ ID NO: 2941140 - protein, 22 aa, Entamoeba invadens
HGGHAIHKACEMMKNNEMQGVD

SEQ ID NO: 2941141 - protein, 17 aa, Entamoeba invadens
HGGISPKLLQLSQLTKI

SEQ ID NO: 2941142 - protein, 23 aa, Entamoeba invadens
HGHGDHLFGIFSLLKMKQGNLLI

SEQ ID NO: 2941143 - protein, 37 aa, Entamoeba invadens
HGIEHRCVIGILDIFGFEIFPVNGFEQFCINYVNEKL

SEQ ID NO: 2941144 - protein, 18 aa, Entamoeba invadens
HGILMTWTSGNNWRCEVE

SEQ ID NO: 2941145 - protein, 24 aa, Entamoeba invadens
HGIQRFKTVYIDRIEKGMIDPKAT

SEQ ID NO: 2941146 - protein, 26 aa, Entamoeba invadens
HGKIAGILLPYVVRFNGSFVEEKYKT

SEQ ID NO: 2941147 - protein, 24 aa, Entamoeba invadens
HGKKFVTSVPFEFGEDQTLLLGLL

SEQ ID NO: 2941148 - protein, 23 aa, Entamoeba invadens
HGKRYICTQCLLLDPTFDVKKLE

SEQ ID NO: 2941149 - protein, 31 aa, Entamoeba invadens
HGKTRKVFVGYCILIMKTLYNFCKAKEKTNS

SEQ ID NO: 2941150 - protein, 19 aa, Entamoeba invadens
HGKYGLFPLAKGVTLPLEK

SEQ ID NO: 2941151 - protein, 18 aa, Entamoeba invadens
HGLDLLLFLLKRQQLKVE

SEQ ID NO: 2941152 - protein, 21 aa, Entamoeba invadens
HGLLCQLHFIDPIPKNQPVLV

SEQ ID NO: 2941153 - protein, 26 aa, Entamoeba invadens
HGLLDKIMFCYGVGYKKARKENGPVY

SEQ ID NO: 2941154 - protein, 23 aa, Entamoeba invadens
HGLPCPQLAPIISQRLCELLKET

SEQ ID NO: 2941155 - protein, 24 aa, Entamoeba invadens
HGMLLSCFSAFWIETNGNVNFNMC

SEQ ID NO: 2941156 - protein, 24 aa, Entamoeba invadens
HGMLLSCFSAFWVETNGDVNFNMC

SEQ ID NO: 2941157 - protein, 24 aa, Entamoeba invadens
HGMLLSCFSAFWVETNGNVNFNVC

SEQ ID NO: 2941158 - protein, 24 aa, Entamoeba invadens
HGMLLSCFSAFWVGTNGNVNFNVC

SEQ ID NO: 2941159 - protein, 17 aa, Entamoeba invadens
HGNGVSVGRVLLPKESS

SEQ ID NO: 2941160 - protein, 24 aa, Entamoeba invadens
HGNIKSSILTQEFVRSHDYAALAD

SEQ ID NO: 2941161 - protein, 20 aa, Entamoeba invadens
HGPNQRCLRCMNRDYKKQEE

SEQ ID NO: 2941162 - protein, 24 aa, Entamoeba invadens
HGPPGCGKTLLAEAIAGEVGVPFI

SEQ ID NO: 2941163 - protein, 21 aa, Entamoeba invadens
HGQSAILMALRYNHPDVALLI

SEQ ID NO: 2941164 - protein, 19 aa, Entamoeba invadens
HGRQTVRHLFDIRKAGNEL

SEQ ID NO: 2941165 - protein, 25 aa, Entamoeba invadens
HGSCIAKFAFVPCMKPTGSIFDVIN

SEQ ID NO: 2941166 - protein, 24 aa, Entamoeba invadens
HGSFGMVYKGTWLGTTAVAMKEIQ

SEQ ID NO: 2941167 - protein, 17 aa, Entamoeba invadens
HGSPLMYFLNMFPKPFA

SEQ ID NO: 2941168 - protein, 23 aa, Entamoeba invadens
HGTGKICHCIQCDYKGNIDVVLP

SEQ ID NO: 2941169 - protein, 25 aa, Entamoeba invadens
HGVIKGMFKTAAFGAQYLRDETKAP

SEQ ID NO: 2941170 - protein, 19 aa, Entamoeba invadens
HGVITCNTCVLCKQKREDS

SEQ ID NO: 2941171 - protein, 26 aa, Entamoeba invadens
HGVIYDERCDLFSIGVVLYEMITCKV

SEQ ID NO: 2941172 - protein, 23 aa, Entamoeba invadens
HGVKFKLDFAECYWNSRLETEHT

SEQ ID NO: 2941173 - protein, 32 aa, Entamoeba invadens
HGVKGLKDLGVRELVYKPAFICGCIQQEDSKN

SEQ ID NO: 2941174 - protein, 21 aa, Entamoeba invadens
HGVPLSCVLSYFQIDQQIDFL

SEQ ID NO: 2941175 - protein, 26 aa, Entamoeba invadens
HGVSLFPYSVCARSRDSDVVSVPTRI

SEQ ID NO: 2941176 - protein, 17 aa, Entamoeba invadens
HGVTFGGIYLSALCNNY

SEQ ID NO: 2941177 - protein, 27 aa, Entamoeba invadens
HGVTLHFKRFPFFFAYLKEAAGSELVW

SEQ ID NO: 2941178 - protein, 17 aa, Entamoeba invadens
HGYDIQSLCFVHPEFFI

SEQ ID NO: 2941179 - protein, 18 aa, Entamoeba invadens
HHAVERFQGSVPQRATSK

SEQ ID NO: 2941180 - protein, 18 aa, Entamoeba invadens
HHFARSFHFLFPVKPFVL

SEQ ID NO: 2941181 - protein, 18 aa, Entamoeba invadens
HHFSSRYSQSYVQRMAEK

SEQ ID NO: 2941182 - protein, 27 aa, Entamoeba invadens
HHFTYQRLKEITLFTCENGIYLLVTQL

SEQ ID NO: 2941183 - protein, 24 aa, Entamoeba invadens
HHGKSLCIWPNLEETYSITTKRFM

SEQ ID NO: 2941184 - protein, 22 aa, Entamoeba invadens
HHGSHKYVFFWQPKITGEVNKS

SEQ ID NO: 2941185 - protein, 23 aa, Entamoeba invadens
HHILECDDIYIAMQLLKAPADKL

SEQ ID NO: 2941186 - protein, 23 aa, Entamoeba invadens
HHIPIIQARIVFLLKGGKTEEAL

SEQ ID NO: 2941187 - protein, 17 aa, Entamoeba invadens
HHIPITISFGITDEGIP

SEQ ID NO: 2941188 - protein, 18 aa, Entamoeba invadens
HHIQNVFWWSDNESTWEK

SEQ ID NO: 2941189 - protein, 22 aa, Entamoeba invadens
HHISVLIKRMFVSIKEASRLLL

SEQ ID NO: 2941190 - protein, 25 aa, Entamoeba invadens
HHKSLRLLQYPVINCILAGHNVLVL

SEQ ID NO: 2941191 - protein, 17 aa, Entamoeba invadens
HHLFPPFVKTCLDVLST

SEQ ID NO: 2941192 - protein, 19 aa, Entamoeba invadens
HHLNLLKILKLNQDLNSVE

SEQ ID NO: 2941193 - protein, 20 aa, Entamoeba invadens
HHNPTLIVLCHIIEDMASYY

SEQ ID NO: 2941194 - protein, 18 aa, Entamoeba invadens
HHPCFKEGHPELLSKIHR

SEQ ID NO: 2941195 - protein, 24 aa, Entamoeba invadens
HHPNICSFFDYFVDDCCFLVMEFC

SEQ ID NO: 2941196 - protein, 23 aa, Entamoeba invadens
HHPNLYYNCCHYRKIEPKTDLYY

SEQ ID NO: 2941197 - protein, 20 aa, Entamoeba invadens
HHPTDFVIFISFKESQVIYR

SEQ ID NO: 2941198 - protein, 18 aa, Entamoeba invadens
HHPYIIKLYEVIDGKDGR

SEQ ID NO: 2941199 - protein, 25 aa, Entamoeba invadens
HHQAFKCVYSFREIRNYQSEQECVL

SEQ ID NO: 2941200 - protein, 25 aa, Entamoeba invadens
HHSRTNTLFCLSKFKPPQSPLPQKL

SEQ ID NO: 2941201 - protein, 19 aa, Entamoeba invadens
HIAVHLSYVGIGYCGFASS

SEQ ID NO: 2941202 - protein, 18 aa, Entamoeba invadens
HICSSCLETIAKHITQVG

SEQ ID NO: 2941203 - protein, 17 aa, Entamoeba invadens
HICTACFAPYVTSSDLK

SEQ ID NO: 2941204 - protein, 24 aa, Entamoeba invadens
HIDETCKWASALYQQCVVMGNLQY

SEQ ID NO: 2941205 - protein, 23 aa, Entamoeba invadens
HIDHMGGLLSFLFSNVLGNCRVY

SEQ ID NO: 2941206 - protein, 20 aa, Entamoeba invadens
HIEGGLTFFQLFRGLMKYSR

SEQ ID NO: 2941207 - protein, 21 aa, Entamoeba invadens
HIEVCDAIRACQFIETHENVL

SEQ ID NO: 2941208 - protein, 17 aa, Entamoeba invadens
HIFMDRNTFYSFSPETL

SEQ ID NO: 2941209 - protein, 25 aa, Entamoeba invadens
HIFVSLGGVCLSDIQYTQSFATFLK

SEQ ID NO: 2941210 - protein, 18 aa, Entamoeba invadens
HIGEDITFHIKIESRSSQ

SEQ ID NO: 2941211 - protein, 30 aa, Entamoeba invadens
HIGNLDCFVQFAISLGVKVYGINGTDLMDK

SEQ ID NO: 2941212 - protein, 17 aa, Entamoeba invadens
HIGSFFLDGSDWDVTKG

SEQ ID NO: 2941213 - protein, 18 aa, Entamoeba invadens
HIGVVFSLQGFVAAENIG

SEQ ID NO: 2941214 - protein, 22 aa, Entamoeba invadens
HIHFVCGNWVFPNGFENTELYV

SEQ ID NO: 2941215 - protein, 29 aa, Entamoeba invadens
HIHNCYRYVEKYGRLYVNAAMKINPPQSK

SEQ ID NO: 2941216 - protein, 32 aa, Entamoeba invadens
HIHRLSLSKKVIWCGDMNVVLRWSDLAKPKEW

SEQ ID NO: 2941217 - protein, 17 aa, Entamoeba invadens
HIHYPCYLQFMKNHPHD

SEQ ID NO: 2941218 - protein, 25 aa, Entamoeba invadens
HIIDLCSLTNFLGVFSVQIPQDTIN

SEQ ID NO: 2941219 - protein, 22 aa, Entamoeba invadens
HIIKHYLEHITFLRKYETEHPT

SEQ ID NO: 2941220 - protein, 23 aa, Entamoeba invadens
HIINETPIEIAIEAGTAEPHTII

SEQ ID NO: 2941221 - protein, 26 aa, Entamoeba invadens
HIIPGYFKYVIKYEIDYQKYLKSKTE

SEQ ID NO: 2941222 - protein, 25 aa, Entamoeba invadens
HIIYSQRLDKVWSLKDDVKVKISYI

SEQ ID NO: 2941223 - protein, 22 aa, Entamoeba invadens
HIKALEAQKKMALDDKTEAEKT

SEQ ID NO: 2941224 - protein, 23 aa, Entamoeba invadens
HIKALEAQKKMALDNKAEAEKTA

SEQ ID NO: 2941225 - protein, 22 aa, Entamoeba invadens
HIKLTDFGLCTGFHRIDTSVTL

SEQ ID NO: 2941226 - protein, 24 aa, Entamoeba invadens
HIKNVYCLSSSFFVKDEQKVAERR

SEQ ID NO: 2941227 - protein, 19 aa, Entamoeba invadens
HIKTLPSKEIMPISVSKTF

SEQ ID NO: 2941228 - protein, 18 aa, Entamoeba invadens
HILFIKHFYLNVLQLPPD

SEQ ID NO: 2941229 - protein, 21 aa, Entamoeba invadens
HILKLKASMDHRCRNFGNFIM

SEQ ID NO: 2941230 - protein, 19 aa, Entamoeba invadens
HILKMTNLIDLASLQHNDT

SEQ ID NO: 2941231 - protein, 22 aa, Entamoeba invadens
HILRYIPFLFEYSSNIKTLSGS

SEQ ID NO: 2941232 - protein, 18 aa, Entamoeba invadens
HIMFTCKKFRLFTNEYTE

SEQ ID NO: 2941233 - protein, 20 aa, Entamoeba invadens
HIMIVCKYFNSFNDFVQLMI

SEQ ID NO: 2941234 - protein, 23 aa, Entamoeba invadens
HIMLKRSFMSFTLSEELTKELSK

SEQ ID NO: 2941235 - protein, 20 aa, Entamoeba invadens
HINDKIVLVSVDIRKGVTSE

SEQ ID NO: 2941236 - protein, 18 aa, Entamoeba invadens
HINRGSLVLSNIETIILD

SEQ ID NO: 2941237 - protein, 33 aa, Entamoeba invadens
HIPHGRCVAVLLPHVIRYNGIIPRKLSMWPKYN

SEQ ID NO: 2941238 - protein, 30 aa, Entamoeba invadens
HIPHGRCVAVLLPHVIRYNGVVPRKLAMWP

SEQ ID NO: 2941239 - protein, 22 aa, Entamoeba invadens
HIPIVLCGNKSDLESVRTVSIE

SEQ ID NO: 2941240 - protein, 18 aa, Entamoeba invadens
HIPIVMCGNKSDLESDRE

SEQ ID NO: 2941241 - protein, 21 aa, Entamoeba invadens
HIPNCECFIGDFAFSNCSKLV

SEQ ID NO: 2941242 - protein, 23 aa, Entamoeba invadens
HIPSGVEITDWFQLVGDGEEAIG

SEQ ID NO: 2941243 - protein, 25 aa, Entamoeba invadens
HIQKIPKSCFENCVNLKNIALSCNL

SEQ ID NO: 2941244 - protein, 17 aa, Entamoeba invadens
HIQVFPVVVLKLLEKSM

SEQ ID NO: 2941245 - protein, 19 aa, Entamoeba invadens
HIRALFKKEAEDFLKSCPV

SEQ ID NO: 2941246 - protein, 17 aa, Entamoeba invadens
HIRKFKGIIGLENKLIP

SEQ ID NO: 2941247 - protein, 25 aa, Entamoeba invadens
HISALFKKEAEDFLKSCPVKKLTLN

SEQ ID NO: 2941248 - protein, 21 aa, Entamoeba invadens
HISIFRKGVLLFDLGLTTITL

SEQ ID NO: 2941249 - protein, 23 aa, Entamoeba invadens
HISKKEVCFRLNNTQGEKMAKEL

SEQ ID NO: 2941250 - protein, 17 aa, Entamoeba invadens
HISRVFYNGALLFQTDE

SEQ ID NO: 2941251 - protein, 17 aa, Entamoeba invadens
HITALKYLAEYCPNKVW

SEQ ID NO: 2941252 - protein, 17 aa, Entamoeba invadens
HITCAAVINKMDECKQT

SEQ ID NO: 2941253 - protein, 20 aa, Entamoeba invadens
HITDQNFELITGKFFIENTG

SEQ ID NO: 2941254 - protein, 19 aa, Entamoeba invadens
HITHAITLMQERVVELETM

SEQ ID NO: 2941255 - protein, 23 aa, Entamoeba invadens
HIVECVLTFLNLFNDLRSTAADV

SEQ ID NO: 2941256 - protein, 26 aa, Entamoeba invadens
HIVEGIFRIPGERKLADAMVKMIEKR

SEQ ID NO: 2941257 - protein, 25 aa, Entamoeba invadens
HIVGIDELECVLSIEDEDFCVTDIG

SEQ ID NO: 2941258 - protein, 17 aa, Entamoeba invadens
HIVMIGSECFADCPNLK

SEQ ID NO: 2941259 - protein, 24 aa, Entamoeba invadens
HIVNPISCAFCYAYNGHTSQVTSI

SEQ ID NO: 2941260 - protein, 17 aa, Entamoeba invadens
HIWGELAEFRRFRDGRM

SEQ ID NO: 2941261 - protein, 20 aa, Entamoeba invadens
HIYHYKRYNMSSVDVLHIII

SEQ ID NO: 2941262 - protein, 17 aa, Entamoeba invadens
HKAALAFLAAYTGPITV

SEQ ID NO: 2941263 - protein, 23 aa, Entamoeba invadens
HKACFKCSVCGRPLDGYLMKGNV

SEQ ID NO: 2941264 - protein, 21 aa, Entamoeba invadens
HKALEIRVFLLSGCLIHLPTL

SEQ ID NO: 2941265 - protein, 25 aa, Entamoeba invadens
HKAVVSLLIECLRRIKTIENNDLVI

SEQ ID NO: 2941266 - protein, 17 aa, Entamoeba invadens
HKDDFFCETMSSYKIKQ

SEQ ID NO: 2941267 - protein, 18 aa, Entamoeba invadens
HKDPRIVTTNPRRIGAES

SEQ ID NO: 2941268 - protein, 18 aa, Entamoeba invadens
HKDVGIVLVEIANRILPK

SEQ ID NO: 2941269 - protein, 24 aa, Entamoeba invadens
HKDVIPTFDGCIERMSKRIDEIAQ

SEQ ID NO: 2941270 - protein, 22 aa, Entamoeba invadens
HKECLPIVICGNKSDLEMDRRV

SEQ ID NO: 2941271 - protein, 23 aa, Entamoeba invadens
HKEIPATCIKSAFAHAASVENDK

SEQ ID NO: 2941272 - protein, 17 aa, Entamoeba invadens
HKEIYCVILRYELNGNF

SEQ ID NO: 2941273 - protein, 22 aa, Entamoeba invadens
HKEMPSMEIEPPKELQENKEFR

SEQ ID NO: 2941274 - protein, 25 aa, Entamoeba invadens
HKEQRPETPAVFTPRNEETFFYQSS

SEQ ID NO: 2941275 - protein, 22 aa, Entamoeba invadens
HKERLNVLLFKILQEISNGLAE

SEQ ID NO: 2941276 - protein, 23 aa, Entamoeba invadens
HKEVKSEGIVLFDYEAKNDFELS

SEQ ID NO: 2941277 - protein, 18 aa, Entamoeba invadens
HKEVLPFIQEMVPTQLLI

SEQ ID NO: 2941278 - protein, 25 aa, Entamoeba invadens
HKFFRGVKFQLIRNIPPPIVPQVKG

SEQ ID NO: 2941279 - protein, 20 aa, Entamoeba invadens
HKFGSVLYKPIRQVGDDIPD

SEQ ID NO: 2941280 - protein, 31 aa, Entamoeba invadens
HKFHGPKGVGCLFIRAGRPIIPLLHGGEQMG

SEQ ID NO: 2941281 - protein, 19 aa, Entamoeba invadens
HKFLNLPILDFQKQILEKM

SEQ ID NO: 2941282 - protein, 25 aa, Entamoeba invadens
HKFPRIDADTLLPVTTHLNGRKEEW

SEQ ID NO: 2941283 - protein, 35 aa, Entamoeba invadens
HKFSSKIFCLGDFFLFYKTHEIFDKSVCEKVEEFT

SEQ ID NO: 2941284 - protein, 18 aa, Entamoeba invadens
HKFWRYEPVIGTGVVVPK

SEQ ID NO: 2941285 - protein, 34 aa, Entamoeba invadens
HKFYRGKIQIMPKCTLCGFNWFNAYYTPGVSRIS

SEQ ID NO: 2941286 - protein, 20 aa, Entamoeba invadens
HKGEVIKFARILCNEMENSH

SEQ ID NO: 2941287 - protein, 20 aa, Entamoeba invadens
HKGFPEGLFTYLTRNTLDDK

SEQ ID NO: 2941288 - protein, 18 aa, Entamoeba invadens
HKHYPFNKEWLLRDITEH

SEQ ID NO: 2941289 - protein, 21 aa, Entamoeba invadens
HKIDEGCFFMNTEITTIDIPD

SEQ ID NO: 2941290 - protein, 19 aa, Entamoeba invadens
HKIFYVFELLVNRLGFIHR

SEQ ID NO: 2941291 - protein, 17 aa, Entamoeba invadens
HKIGAAFHLPTMVDVLQ

SEQ ID NO: 2941292 - protein, 19 aa, Entamoeba invadens
HKIGRRPEIIVGDMDSIDK

SEQ ID NO: 2941293 - protein, 21 aa, Entamoeba invadens
HKIHLERYLDLLIDGVQVDLA

SEQ ID NO: 2941294 - protein, 18 aa, Entamoeba invadens
HKIIPWDVDVYITPVVRA

SEQ ID NO: 2941295 - protein, 21 aa, Entamoeba invadens
HKIPNCYVCNPQVKNMEKIMS

SEQ ID NO: 2941296 - protein, 23 aa, Entamoeba invadens
HKISEFLNQISLFLLEENTQNLS

SEQ ID NO: 2941297 - protein, 23 aa, Entamoeba invadens
HKIWIKRICCNTEYKKVKEKTSK

SEQ ID NO: 2941298 - protein, 18 aa, Entamoeba invadens
HKIYVAYKERKGGVVSVM

SEQ ID NO: 2941299 - protein, 19 aa, Entamoeba invadens
HKKFDGVEIKVNYDLTDES

SEQ ID NO: 2941300 - protein, 23 aa, Entamoeba invadens
HKKGPRGYIRPQLTMEEFAALGI

SEQ ID NO: 2941301 - protein, 19 aa, Entamoeba invadens
HKKIVLVLNKCDLVPTWAT

SEQ ID NO: 2941302 - protein, 18 aa, Entamoeba invadens
HKKKRKASFAERPFGVPK

SEQ ID NO: 2941303 - protein, 30 aa, Entamoeba invadens
HKKLIEVLNNWGIQVFLPFFDESKFIELVR

SEQ ID NO: 2941304 - protein, 26 aa, Entamoeba invadens
HKKMILRLYKGVPISVRQSLWRAMLH

SEQ ID NO: 2941305 - protein, 32 aa, Entamoeba invadens
HKKNKNVRCSLDILNCRKVVLINTKYNNITIT

SEQ ID NO: 2941306 - protein, 24 aa, Entamoeba invadens
HKKNKWCECGEFVLQNCLESILVM

SEQ ID NO: 2941307 - protein, 23 aa, Entamoeba invadens
HKKNLTLVERFCAEKPHKQSPQP

SEQ ID NO: 2941308 - protein, 21 aa, Entamoeba invadens
HKKQLVKVFALRQNEWTVTGT

SEQ ID NO: 2941309 - protein, 21 aa, Entamoeba invadens
HKKQRIALHAEIEEATKTHKP

SEQ ID NO: 2941310 - protein, 20 aa, Entamoeba invadens
HKKREIGYEISIQLANQYQR

SEQ ID NO: 2941311 - protein, 28 aa, Entamoeba invadens
HKKSGEIVMKMRIKLMLDTAKGIQYLHA

SEQ ID NO: 2941312 - protein, 20 aa, Entamoeba invadens
HKKSKLAYHEQFVLMLTFFH

SEQ ID NO: 2941313 - protein, 19 aa, Entamoeba invadens
HKKSLLARENRTALTKMLN

SEQ ID NO: 2941314 - protein, 22 aa, Entamoeba invadens
HKKSRVPGDVLWKSQKDLADDE

SEQ ID NO: 2941315 - protein, 25 aa, Entamoeba invadens
HKLIELIEPITLLKKCFMGKRNSRA

SEQ ID NO: 2941316 - protein, 18 aa, Entamoeba invadens
HKLKGEAVVFPFGFHCTG

SEQ ID NO: 2941317 - protein, 17 aa, Entamoeba invadens
HKLKLQIWDTGTVQNYC

SEQ ID NO: 2941318 - protein, 19 aa, Entamoeba invadens
HKLLCGRPHHHVRGKLNGR

SEQ ID NO: 2941319 - protein, 21 aa, Entamoeba invadens
HKLPCKVGITASAPGFFNCQG

SEQ ID NO: 2941320 - protein, 19 aa, Entamoeba invadens
HKLPKEERSDGSGGTKEVH

SEQ ID NO: 2941321 - protein, 17 aa, Entamoeba invadens
HKLSGKIVPPFLMLCVV

SEQ ID NO: 2941322 - protein, 17 aa, Entamoeba invadens
HKLWECRKTLNELRKHK

SEQ ID NO: 2941323 - protein, 17 aa, Entamoeba invadens
HKLWPTIAQIVPNIILL

SEQ ID NO: 2941324 - protein, 25 aa, Entamoeba invadens
HKMDLLKQQFCYVAEDIEQEKNKSY

SEQ ID NO: 2941325 - protein, 27 aa, Entamoeba invadens
HKMPFPVDLVWELTKAMQAYCLMQEDI

SEQ ID NO: 2941326 - protein, 17 aa, Entamoeba invadens
HKMSWRVNGPQSGMIQK

SEQ ID NO: 2941327 - protein, 27 aa, Entamoeba invadens
HKNDVRPNELLYMYFPVVQRRSDAFNL

SEQ ID NO: 2941328 - protein, 17 aa, Entamoeba invadens
HKNLYVFLVKFISNLIL

SEQ ID NO: 2941329 - protein, 17 aa, Entamoeba invadens
HKNQHGFTPLGTAVNNR

SEQ ID NO: 2941330 - protein, 28 aa, Entamoeba invadens
HKNSETNFVFSVYSAFWILSDGTINIHP

SEQ ID NO: 2941331 - protein, 22 aa, Entamoeba invadens
HKNVNCCFCCSEDFKKYSEKRV

SEQ ID NO: 2941332 - protein, 28 aa, Entamoeba invadens
HKPEAFYIVDCPLKQMYNVLYVIGTIED

SEQ ID NO: 2941333 - protein, 26 aa, Entamoeba invadens
HKPVEIEFFKPLTLIQGPNGAGKTTL

SEQ ID NO: 2941334 - protein, 19 aa, Entamoeba invadens
HKPVSGVFKVCLQQINQVK

SEQ ID NO: 2941335 - protein, 24 aa, Entamoeba invadens
HKQTRVRASVCSKMQEYEVANEAI

SEQ ID NO: 2941336 - protein, 20 aa, Entamoeba invadens
HKQWDCPQKKCLSDLQKAEE

SEQ ID NO: 2941337 - protein, 23 aa, Entamoeba invadens
HKRCDPDFIHAMGYVKEATAYAN

SEQ ID NO: 2941338 - protein, 23 aa, Entamoeba invadens
HKRGESWIASFGTRKDKDETNSE

SEQ ID NO: 2941339 - protein, 19 aa, Entamoeba invadens
HKRLNRLIKVYNIATNMTS

SEQ ID NO: 2941340 - protein, 17 aa, Entamoeba invadens
HKRVVVHDILRSRSLSF

SEQ ID NO: 2941341 - protein, 18 aa, Entamoeba invadens
HKSLPADRKVLCEDQKAF

SEQ ID NO: 2941342 - protein, 18 aa, Entamoeba invadens
HKSMKADKSLAYFNNAVQ

SEQ ID NO: 2941343 - protein, 20 aa, Entamoeba invadens
HKSVELQRTLDLQKKSIEMI

SEQ ID NO: 2941344 - protein, 29 aa, Entamoeba invadens
HKSWKKRWFQTTPRNPFRLDYYTNDSCTT

SEQ ID NO: 2941345 - protein, 34 aa, Entamoeba invadens
HKTDLYATVMSIEFLENLFVKSLIDYETYVKQCT

SEQ ID NO: 2941346 - protein, 17 aa, Entamoeba invadens
HKTELPKQISRDINSEQ

SEQ ID NO: 2941347 - protein, 23 aa, Entamoeba invadens
HKTLDRKDLAGIMVNGKVHSVVD

SEQ ID NO: 2941348 - protein, 30 aa, Entamoeba invadens
HKTLNLDRLFVDEIRQMITLGLIDDNSNQN

SEQ ID NO: 2941349 - protein, 24 aa, Entamoeba invadens
HKTLRKIGNFAFSKCKKLTQILVP

SEQ ID NO: 2941350 - protein, 25 aa, Entamoeba invadens
HKTMSKCHWRLMKLFEERLSTACVA

SEQ ID NO: 2941351 - protein, 18 aa, Entamoeba invadens
HKTTRFVYEIEFQGRVES

SEQ ID NO: 2941352 - protein, 17 aa, Entamoeba invadens
HKTTRKPLNLKFATKKK

SEQ ID NO: 2941353 - protein, 30 aa, Entamoeba invadens
HKTVQQIIMRLKWNSQKNDITWESYCAQNI

SEQ ID NO: 2941354 - protein, 25 aa, Entamoeba invadens
HKVCVKFFATWCPSCQKALPIALEI

SEQ ID NO: 2941355 - protein, 21 aa, Entamoeba invadens
HKVLMCEPYEHLKTWKFSDET

SEQ ID NO: 2941356 - protein, 27 aa, Entamoeba invadens
HKVVFSKFFIKKMFLEKVCQQVKIVVL

SEQ ID NO: 2941357 - protein, 17 aa, Entamoeba invadens
HKYRGVATHLIFKTSKT

SEQ ID NO: 2941358 - protein, 19 aa, Entamoeba invadens
HKYYSVWMGFEKQRSNLMC

SEQ ID NO: 2941359 - protein, 20 aa, Entamoeba invadens
HLAEGKMLFLVETLLTDSFI

SEQ ID NO: 2941360 - protein, 20 aa, Entamoeba invadens
HLAIFRPDVQLFMTGTTTLC

SEQ ID NO: 2941361 - protein, 26 aa, Entamoeba invadens
HLALRPETLGELALFAMSLVPPKQSA

SEQ ID NO: 2941362 - protein, 24 aa, Entamoeba invadens
HLALRSGIIDLIFFYQMLGHSTCN

SEQ ID NO: 2941363 - protein, 23 aa, Entamoeba invadens
HLCCARGTVNLLEYLCESYKELI

SEQ ID NO: 2941364 - protein, 24 aa, Entamoeba invadens
HLCECVKQNTAFDFLVELVQNKMA

SEQ ID NO: 2941365 - protein, 23 aa, Entamoeba invadens
HLCSFKGKMWAKVFIKSKPGRYG

SEQ ID NO: 2941366 - protein, 36 aa, Entamoeba invadens
HLCSYKGHMWAKVFIKSKPRRYGIKFWMCADCETGM

SEQ ID NO: 2941367 - protein, 23 aa, Entamoeba invadens
HLDEKKMIMAFEEFKIVQKQYEA

SEQ ID NO: 2941368 - protein, 18 aa, Entamoeba invadens
HLDEVFAVDWSNDGSTVA

SEQ ID NO: 2941369 - protein, 26 aa, Entamoeba invadens
HLDTSFKSIMIYIYWYPQVKNSLAQK

SEQ ID NO: 2941370 - protein, 17 aa, Entamoeba invadens
HLDVISVGGGRLQFFSF

SEQ ID NO: 2941371 - protein, 18 aa, Entamoeba invadens
HLEELTGFADYRIPQLLL

SEQ ID NO: 2941372 - protein, 18 aa, Entamoeba invadens
HLELMNSLIETFKDYFEV

SEQ ID NO: 2941373 - protein, 22 aa, Entamoeba invadens
HLESAPGLLILYLVSLHQPLLP

SEQ ID NO: 2941374 - protein, 21 aa, Entamoeba invadens
HLESFMFFYFIKLKEVTLPRG

SEQ ID NO: 2941375 - protein, 20 aa, Entamoeba invadens
HLESIKIPFEQLVNLFYLTI

SEQ ID NO: 2941376 - protein, 27 aa, Entamoeba invadens
HLESLEMLWEMNSNFTLEPNDQVETLF

SEQ ID NO: 2941377 - protein, 19 aa, Entamoeba invadens
HLETLMIYNTFDYFYSQIV

SEQ ID NO: 2941378 - protein, 17 aa, Entamoeba invadens
HLFDSRLNYGVQCFMHS

SEQ ID NO: 2941379 - protein, 20 aa, Entamoeba invadens
HLFESIEIENCISWEFEGKS

SEQ ID NO: 2941380 - protein, 20 aa, Entamoeba invadens
HLFETRSFIDTEEFEQLPFI

SEQ ID NO: 2941381 - protein, 24 aa, Entamoeba invadens
HLFPRLSTFKAQNCMLFIVEQFPN

SEQ ID NO: 2941382 - protein, 18 aa, Entamoeba invadens
HLFTFEFHEQRKLKAQED

SEQ ID NO: 2941383 - protein, 17 aa, Entamoeba invadens
HLGAGCFVKCKNLSVIN

SEQ ID NO: 2941384 - protein, 18 aa, Entamoeba invadens
HLGCDKTYVSLRYLRAHE

SEQ ID NO: 2941385 - protein, 23 aa, Entamoeba invadens
HLGEGKYFISYTLPAVKGKYFIN

SEQ ID NO: 2941386 - protein, 24 aa, Entamoeba invadens
HLGFHKRTLFLFNDVLLFTSKVDK

SEQ ID NO: 2941387 - protein, 23 aa, Entamoeba invadens
HLHIFRYAFEILTKRLIDDRKTV

SEQ ID NO: 2941388 - protein, 20 aa, Entamoeba invadens
HLHYNYTYRPNFEILNPTGN

SEQ ID NO: 2941389 - protein, 19 aa, Entamoeba invadens
HLICRDCLFSIVKSQVEKG

SEQ ID NO: 2941390 - protein, 36 aa, Entamoeba invadens
HLIGHSLGGLYLRQAIPLLVKRGVFNSTCIPFSFLT

SEQ ID NO: 2941391 - protein, 24 aa, Entamoeba invadens
HLIIYRITLAWVRDIYNKTIPKAL

SEQ ID NO: 2941392 - protein, 20 aa, Entamoeba invadens
HLIVYQVEERWGWKEIDESP

SEQ ID NO: 2941393 - protein, 25 aa, Entamoeba invadens
HLKAIKTPSPRRVRVRSRSSSSPLR

SEQ ID NO: 2941394 - protein, 17 aa, Entamoeba invadens
HLKCIKKEEGIGFECIS

SEQ ID NO: 2941395 - protein, 24 aa, Entamoeba invadens
HLKEGLRPFLLFNYLENNCGNDMK

SEQ ID NO: 2941396 - protein, 23 aa, Entamoeba invadens
HLKHKRRWLWTTKRRLRRLQRTN

SEQ ID NO: 2941397 - protein, 31 aa, Entamoeba invadens
HLKMVCGSLLFKDSHPMFWEVACILQDKTYL

SEQ ID NO: 2941398 - protein, 19 aa, Entamoeba invadens
HLKQCFICGKYGHEKNDCP

SEQ ID NO: 2941399 - protein, 32 aa, Entamoeba invadens
HLLAVCGPVFEHLRLTHVYSLDDIPSFYGDKI

SEQ ID NO: 2941400 - protein, 19 aa, Entamoeba invadens
HLLCECGGSLFVDEIGQFA

SEQ ID NO: 2941401 - protein, 21 aa, Entamoeba invadens
HLLCLKREMNCIVLVFRGTLS

SEQ ID NO: 2941402 - protein, 24 aa, Entamoeba invadens
HLLIDLLIVRGGYEFDSKYTEGKS

SEQ ID NO: 2941403 - protein, 17 aa, Entamoeba invadens
HLLLCGQPGIGKTTSIH

SEQ ID NO: 2941404 - protein, 18 aa, Entamoeba invadens
HLLLKYFTKIRVVFNPAK

SEQ ID NO: 2941405 - protein, 22 aa, Entamoeba invadens
HLLMDILEEFGFYFSNTLSSGK

SEQ ID NO: 2941406 - protein, 36 aa, Entamoeba invadens
HLLQPLDVGIFCYCKNEMRRSFEFITSELRREEIEK

SEQ ID NO: 2941407 - protein, 25 aa, Entamoeba invadens
HLLSALKSSVQYVLNRSIKIVFIVD

SEQ ID NO: 2941408 - protein, 23 aa, Entamoeba invadens
HLLYEVSKTWVFEKSVDQEIEQK

SEQ ID NO: 2941409 - protein, 30 aa, Entamoeba invadens
HLMDDKKFECPFCFQDMKNAKDLQKHVASV

SEQ ID NO: 2941410 - protein, 21 aa, Entamoeba invadens
HLMIFGKIRVLTCVNDAGENQ

SEQ ID NO: 2941411 - protein, 23 aa, Entamoeba invadens
HLMSDLLLSFNVFVEIEKEEGEG

SEQ ID NO: 2941412 - protein, 19 aa, Entamoeba invadens
HLNDIPLLFLADQLSDSVA

SEQ ID NO: 2941413 - protein, 23 aa, Entamoeba invadens
HLNFSLPPSPSFKERFSVNSVKQ

SEQ ID NO: 2941414 - protein, 17 aa, Entamoeba invadens
HLNHFLLVLVPTHLTEM

SEQ ID NO: 2941415 - protein, 30 aa, Entamoeba invadens
HLNLFLTDFKACFKHSMPHISTHHSERTRY

SEQ ID NO: 2941416 - protein, 17 aa, Entamoeba invadens
HLNSLGCQINPSEIGSW

SEQ ID NO: 2941417 - protein, 26 aa, Entamoeba invadens
HLNTLRFVKCANINLKNVPKCESLVI

SEQ ID NO: 2941418 - protein, 22 aa, Entamoeba invadens
HLPETIRVMDCVRVRRLFDAHT

SEQ ID NO: 2941419 - protein, 24 aa, Entamoeba invadens
HLPKARLSYSPKFSFPESKGSSLS

SEQ ID NO: 2941420 - protein, 22 aa, Entamoeba invadens
HLPKCVKSLLLKNEYITNSFER

SEQ ID NO: 2941421 - protein, 25 aa, Entamoeba invadens
HLQLQNVFVLLVIVRGKMVLYEYLD

SEQ ID NO: 2941422 - protein, 19 aa, Entamoeba invadens
HLQSCKKLKRIVGKIRGDQ

SEQ ID NO: 2941423 - protein, 18 aa, Entamoeba invadens
HLQSCKKLKTIVGKMRGV

SEQ ID NO: 2941424 - protein, 25 aa, Entamoeba invadens
HLSAEQIRALKRCTLVSHATLSRDS

SEQ ID NO: 2941425 - protein, 25 aa, Entamoeba invadens
HLSAEQIRALKRCTLVSHATLSRES

SEQ ID NO: 2941426 - protein, 21 aa, Entamoeba invadens
HLSHWGELYSVPLQHALNFHK

SEQ ID NO: 2941427 - protein, 25 aa, Entamoeba invadens
HLSIKRFKFSAPTAKTKLMDKIGKM

SEQ ID NO: 2941428 - protein, 23 aa, Entamoeba invadens
HLSKISKLLSQWVVLSPLSVIPV

SEQ ID NO: 2941429 - protein, 20 aa, Entamoeba invadens
HLSLRSENYLMISKQVVLCF

SEQ ID NO: 2941430 - protein, 27 aa, Entamoeba invadens
HLTEYLTFGTVMVWSCFTAADDKFKIT

SEQ ID NO: 2941431 - protein, 19 aa, Entamoeba invadens
HLTPEMKEMIQLLVQHCEI

SEQ ID NO: 2941432 - protein, 25 aa, Entamoeba invadens
HLTSMCVAGFFAKSAIDISMYTTLC

SEQ ID NO: 2941433 - protein, 24 aa, Entamoeba invadens
HLTSYFYREFYRIIVHEEVDYKTA

SEQ ID NO: 2941434 - protein, 19 aa, Entamoeba invadens
HLVASCLGDIGAIMALYIH

SEQ ID NO: 2941435 - protein, 24 aa, Entamoeba invadens
HLVFRQTRCANCGQEFTDSESEYP

SEQ ID NO: 2941436 - protein, 20 aa, Entamoeba invadens
HLVLLASMELCLKVDPKKTR

SEQ ID NO: 2941437 - protein, 24 aa, Entamoeba invadens
HLVLQRRIVALGFPIAEQSSLILY

SEQ ID NO: 2941438 - protein, 37 aa, Entamoeba invadens
HLVQYINCLPLQFIEKLCKRRLPTFSKIVSTMQVDEF

SEQ ID NO: 2941439 - protein, 26 aa, Entamoeba invadens
HLVSFMKSRSVGMIKTGRVEKQEKVL

SEQ ID NO: 2941440 - protein, 23 aa, Entamoeba invadens
HLWNVYFKFVYDGLMDEFKMHLL

SEQ ID NO: 2941441 - protein, 19 aa, Entamoeba invadens
HLYGPAMLACFPLQDILSL

SEQ ID NO: 2941442 - protein, 23 aa, Entamoeba invadens
HLYYLQCFFSTFNFDLNALTSLT

SEQ ID NO: 2941443 - protein, 21 aa, Entamoeba invadens
HMDYKNVFSFVFNGKDGEMFA

SEQ ID NO: 2941444 - protein, 32 aa, Entamoeba invadens
HMFFVECLPIPPSRFRPLNRFGNMISDNPQTS

SEQ ID NO: 2941445 - protein, 46 aa, Entamoeba invadens
HMHLTEIFKRLDFENLLSCRLVCKRWKEILFFFPLKHTLFTKNSIG

SEQ ID NO: 2941446 - protein, 24 aa, Entamoeba invadens
HMITQLKLDLMHKSDMDKLLEQKS

SEQ ID NO: 2941447 - protein, 19 aa, Entamoeba invadens
HMKTRRAVSLQAKIQNVVI

SEQ ID NO: 2941448 - protein, 22 aa, Entamoeba invadens
HMMLVCKYFQSFDDFIQVMSVS

SEQ ID NO: 2941449 - protein, 17 aa, Entamoeba invadens
HMMVCVKYFNSIDDYIS

SEQ ID NO: 2941450 - protein, 19 aa, Entamoeba invadens
HMNSFIKLEFEPKQGKRCE

SEQ ID NO: 2941451 - protein, 32 aa, Entamoeba invadens
HMNVTCDICLKKCCVGCSVNTTIAPTLIMGIQ

SEQ ID NO: 2941452 - protein, 18 aa, Entamoeba invadens
HMNVWRYGEIFDENEGKE

SEQ ID NO: 2941453 - protein, 21 aa, Entamoeba invadens
HMRSVKVLKDFDTVVTAATKP

SEQ ID NO: 2941454 - protein, 28 aa, Entamoeba invadens
HMTCANCGYQFCWLCMAPYTSNHFRNGK

SEQ ID NO: 2941455 - protein, 27 aa, Entamoeba invadens
HMTCKCGYQFCWLCMQKYTSTHFLSNT

SEQ ID NO: 2941456 - protein, 27 aa, Entamoeba invadens
HMTCPKCHGEWCWMCRGDWKTHGEKTG

SEQ ID NO: 2941457 - protein, 17 aa, Entamoeba invadens
HMTEAFVDLDSWTSQLS

SEQ ID NO: 2941458 - protein, 20 aa, Entamoeba invadens
HNCAPFISKLYTLVNAPEYS

SEQ ID NO: 2941459 - protein, 23 aa, Entamoeba invadens
HNCITLLPNCITLYPEQNEIAFA

SEQ ID NO: 2941460 - protein, 21 aa, Entamoeba invadens
HNCPKRFGMMRPKDARSCEDI

SEQ ID NO: 2941461 - protein, 18 aa, Entamoeba invadens
HNDASLDNGESWYDEEVR

SEQ ID NO: 2941462 - protein, 22 aa, Entamoeba invadens
HNDPRFLGILNCEHSKKHTNSA

SEQ ID NO: 2941463 - protein, 19 aa, Entamoeba invadens
HNDWNGWIPSFIFNTFGPS

SEQ ID NO: 2941464 - protein, 20 aa, Entamoeba invadens
HNEKGCLGGGVGTYYSLGQI

SEQ ID NO: 2941465 - protein, 18 aa, Entamoeba invadens
  misc_feature (14)..(15): Xaa can be any naturally occurring amino acid
HNERCVLQDVFVYXXEES

SEQ ID NO: 2941466 - protein, 31 aa, Entamoeba invadens
HNEVMELKGNVRVFCRVRPPMKRDGTAVDVI

SEQ ID NO: 2941467 - protein, 28 aa, Entamoeba invadens
HNFEILREVSLFLIEISTNFTSVEEKCD

SEQ ID NO: 2941468 - protein, 21 aa, Entamoeba invadens
HNFFGLCAIVFAFHKVPDFGY

SEQ ID NO: 2941469 - protein, 24 aa, Entamoeba invadens
HNFNFKFIENFKCKTQIFMPNETK

SEQ ID NO: 2941470 - protein, 23 aa, Entamoeba invadens
HNFYCSAGANFPAIVGKESIMKD

SEQ ID NO: 2941471 - protein, 26 aa, Entamoeba invadens
HNGAEKRVLFLLSDCLLLTKREDRLL

SEQ ID NO: 2941472 - protein, 42 aa, Entamoeba invadens
HNGCYVPYMFSNRFPQIFYDMLSRDGGSLGIKEALYQSFDAL

SEQ ID NO: 2941473 - protein, 25 aa, Entamoeba invadens
HNGLYCSYCPACCHTDCSDKAALDA

SEQ ID NO: 2941474 - protein, 17 aa, Entamoeba invadens
HNHCYRLEQVHGEFEYS

SEQ ID NO: 2941475 - protein, 18 aa, Entamoeba invadens
HNHGFSIQTIRKFIQQIL

SEQ ID NO: 2941476 - protein, 17 aa, Entamoeba invadens
HNHRALYYLGMCYLSGI

SEQ ID NO: 2941477 - protein, 17 aa, Entamoeba invadens
HNIDFVIHFAALKAVGE

SEQ ID NO: 2941478 - protein, 28 aa, Entamoeba invadens
HNIEEVFDLIHRCIRRIITEGQPANKIG

SEQ ID NO: 2941479 - protein, 18 aa, Entamoeba invadens
HNIEIGICTKKDGFKVFT

SEQ ID NO: 2941480 - protein, 24 aa, Entamoeba invadens
HNIHIGDPCNFNLSLETFDEVIVS

SEQ ID NO: 2941481 - protein, 20 aa, Entamoeba invadens
HNIIKVPVYDGSKIQNQVEE

SEQ ID NO: 2941482 - protein, 25 aa, Entamoeba invadens
HNKKCKRFAMTLSRTLNAEIFKISV

SEQ ID NO: 2941483 - protein, 22 aa, Entamoeba invadens
HNKKCVWSAFYASKQHNKLLKD

SEQ ID NO: 2941484 - protein, 22 aa, Entamoeba invadens
HNKKCVWSAFYASKQHNKVLKD

SEQ ID NO: 2941485 - protein, 21 aa, Entamoeba invadens
HNKLKLFLGVSRALSTQKSIK

SEQ ID NO: 2941486 - protein, 21 aa, Entamoeba invadens
HNKRIRMMVSLVCNQDVYTSD

SEQ ID NO: 2941487 - protein, 33 aa, Entamoeba invadens
HNLPHGFACAVFSEAFLRLCEKQAIVGDRLRDA

SEQ ID NO: 2941488 - protein, 18 aa, Entamoeba invadens
HNLTHIGTSCFKKCEKLE

SEQ ID NO: 2941489 - protein, 24 aa, Entamoeba invadens
HNMFKLYIEKGISFLNNYIKANKN

SEQ ID NO: 2941490 - protein, 21 aa, Entamoeba invadens
HNMGSITLKHFIMLFNQDKTK

SEQ ID NO: 2941491 - protein, 22 aa, Entamoeba invadens
HNMKIELPPIIEIEEAHKLSFS

SEQ ID NO: 2941492 - protein, 19 aa, Entamoeba invadens
HNMLRFEKILISFLEEDEW

SEQ ID NO: 2941493 - protein, 19 aa, Entamoeba invadens
HNPGWKFTEYELRGIPLRI

SEQ ID NO: 2941494 - protein, 21 aa, Entamoeba invadens
HNPTDCKYQFQFFDSQRRDLE

SEQ ID NO: 2941495 - protein, 24 aa, Entamoeba invadens
HNQLYFRVVFCVDVDTKIDIDSKY

SEQ ID NO: 2941496 - protein, 24 aa, Entamoeba invadens
HNQLYFRVVFCVDVDTNIDIDSKY

SEQ ID NO: 2941497 - protein, 27 aa, Entamoeba invadens
HNQNTLWYFCEFLHQIILKKDINKMDE

SEQ ID NO: 2941498 - protein, 18 aa, Entamoeba invadens
HNRELRITIETARIKLEN

SEQ ID NO: 2941499 - protein, 18 aa, Entamoeba invadens
HNRFNLIHRNIKPSNFLI

SEQ ID NO: 2941500 - protein, 23 aa, Entamoeba invadens
HNRHTLEFFLCVSKSCCEAFKML

SEQ ID NO: 2941501 - protein, 25 aa, Entamoeba invadens
HNRYIPWITLSRIFYLSLMHKYPSQ

SEQ ID NO: 2941502 - protein, 18 aa, Entamoeba invadens
HNTCTVVVQKFCAVSKDA

SEQ ID NO: 2941503 - protein, 19 aa, Entamoeba invadens
HNVEAFKGALTTARHVAAL

SEQ ID NO: 2941504 - protein, 24 aa, Entamoeba invadens
HNVIKIGYSCFKGCSSLKEIYCTS

SEQ ID NO: 2941505 - protein, 17 aa, Entamoeba invadens
HNVKTLGKWCFAGCTSL

SEQ ID NO: 2941506 - protein, 18 aa, Entamoeba invadens
HNVLENIALIVLDDIQHI

SEQ ID NO: 2941507 - protein, 24 aa, Entamoeba invadens
HNVSFKPGRFSSGASQTVGKRVAM

SEQ ID NO: 2941508 - protein, 19 aa, Entamoeba invadens
HNVTLCVLATSFPCAEVFN

SEQ ID NO: 2941509 - protein, 24 aa, Entamoeba invadens
HNYCPLPPTWNLLGFCGSHTSSLL

SEQ ID NO: 2941510 - protein, 25 aa, Entamoeba invadens
HNYIPPEIYKGAVVKQKMTKQIEQL

SEQ ID NO: 2941511 - protein, 21 aa, Entamoeba invadens
HNYLLDILRICGFFFESTYPK

SEQ ID NO: 2941512 - protein, 27 aa, Entamoeba invadens
HNYVKNIFLWKLFEVHHLSTNMRSRGY

SEQ ID NO: 2941513 - protein, 17 aa, Entamoeba invadens
HPCELSYTAKLITMVEG

SEQ ID NO: 2941514 - protein, 25 aa, Entamoeba invadens
HPDCFKCPLCHAVIGAKDYKIRDKQ

SEQ ID NO: 2941515 - protein, 22 aa, Entamoeba invadens
HPDFRNSLSNLCCEINTSFLNV

SEQ ID NO: 2941516 - protein, 19 aa, Entamoeba invadens
HPDLFKGLLNELFYVVFVS

SEQ ID NO: 2941517 - protein, 25 aa, Entamoeba invadens
HPDWDLKCIALAPAAAFTREIATCK

SEQ ID NO: 2941518 - protein, 18 aa, Entamoeba invadens
HPDYPKFPIVAGASCPLG

SEQ ID NO: 2941519 - protein, 23 aa, Entamoeba invadens
HPEFRMAMKDGELVIWDSVHPCY

SEQ ID NO: 2941520 - protein, 17 aa, Entamoeba invadens
HPEHAAILWRISRFNGM

SEQ ID NO: 2941521 - protein, 17 aa, Entamoeba invadens
HPEILDGVSAKKCTVTG

SEQ ID NO: 2941522 - protein, 17 aa, Entamoeba invadens
HPELIAGYLGRGSARAM

SEQ ID NO: 2941523 - protein, 22 aa, Entamoeba invadens
HPELKATFCMKILGVKKNPQSP

SEQ ID NO: 2941524 - protein, 19 aa, Entamoeba invadens
HPFAKNFPDKYMVESEYFQ

SEQ ID NO: 2941525 - protein, 24 aa, Entamoeba invadens
HPFIKSGECVKDFFNRAKHSTFVE

SEQ ID NO: 2941526 - protein, 24 aa, Entamoeba invadens
HPFKELRIAASTLLRQLVDVVTKA

SEQ ID NO: 2941527 - protein, 19 aa, Entamoeba invadens
HPFSVLKIKPLQTTNQPTP

SEQ ID NO: 2941528 - protein, 17 aa, Entamoeba invadens
HPFVIRNWVSVNLADST

SEQ ID NO: 2941529 - protein, 23 aa, Entamoeba invadens
HPFVKYFMRGMRVTLATDAPMHS

SEQ ID NO: 2941530 - protein, 18 aa, Entamoeba invadens
HPGAKIDSHFFIDHGVGV

SEQ ID NO: 2941531 - protein, 20 aa, Entamoeba invadens
HPGEAFGVMEDAGYILSQFY

SEQ ID NO: 2941532 - protein, 17 aa, Entamoeba invadens
HPGMELVTFQNKDGTTH

SEQ ID NO: 2941533 - protein, 17 aa, Entamoeba invadens
HPGRTKYLQTYRLGTNV

SEQ ID NO: 2941534 - protein, 17 aa, Entamoeba invadens
HPIEYARQVTLVVSEKF

SEQ ID NO: 2941535 - protein, 20 aa, Entamoeba invadens
HPIFAIKEGYTLSEKMEEKS

SEQ ID NO: 2941536 - protein, 23 aa, Entamoeba invadens
HPIRAIPYIPLFGQPLKVVMVCH

SEQ ID NO: 2941537 - protein, 25 aa, Entamoeba invadens
HPKFRKPRVASTAGHFEFDIIHYAG

SEQ ID NO: 2941538 - protein, 23 aa, Entamoeba invadens
HPKKLLCPLYFMGFCPYGKQCKY

SEQ ID NO: 2941539 - protein, 26 aa, Entamoeba invadens
HPKTLLNFFFDIFLYLGRHDNFIAAI

SEQ ID NO: 2941540 - protein, 17 aa, Entamoeba invadens
HPLALKVTTEYTFIFNP

SEQ ID NO: 2941541 - protein, 26 aa, Entamoeba invadens
HPLHMRYGIEEMKGLQIPNLQIKNAM

SEQ ID NO: 2941542 - protein, 23 aa, Entamoeba invadens
HPLKKLAELDVFYVGLLTNYRMI

SEQ ID NO: 2941543 - protein, 19 aa, Entamoeba invadens
HPLMYPDFVIGDRDKNADL

SEQ ID NO: 2941544 - protein, 19 aa, Entamoeba invadens
HPLTDYVFIVIEMDLDDIK

SEQ ID NO: 2941545 - protein, 22 aa, Entamoeba invadens
HPMDKHALSYCFISTADSELDR

SEQ ID NO: 2941546 - protein, 25 aa, Entamoeba invadens
HPMVSMSFLPLGHVFAIVLEMTIYR

SEQ ID NO: 2941547 - protein, 25 aa, Entamoeba invadens
HPNIKRTDGIFALIMTPTRELTQQV

SEQ ID NO: 2941548 - protein, 17 aa, Entamoeba invadens
HPNILKCYGFGSIKSTL

SEQ ID NO: 2941549 - protein, 19 aa, Entamoeba invadens
HPNITCICKHWSLIYSNHE

SEQ ID NO: 2941550 - protein, 23 aa, Entamoeba invadens
HPNWPLKCYGFASALCLSLNIST

SEQ ID NO: 2941551 - protein, 19 aa, Entamoeba invadens
HPNYQYFAQLCESYNQILH

SEQ ID NO: 2941552 - protein, 23 aa, Entamoeba invadens
HPPCLPAGRVVQMITNVAIPLTK

SEQ ID NO: 2941553 - protein, 21 aa, Entamoeba invadens
HPPSMRCPNCLPPDPEEQKKK

SEQ ID NO: 2941554 - protein, 26 aa, Entamoeba invadens
HPPVFSPYGPLPMYQPFPMCNPFQYQ

SEQ ID NO: 2941555 - protein, 36 aa, Entamoeba invadens
HPQCFVANVNCKLCGKPFSFPKMEFKIYNDQAYHPL

SEQ ID NO: 2941556 - protein, 19 aa, Entamoeba invadens
HPQLEFEYELYKLLTSGEK

SEQ ID NO: 2941557 - protein, 20 aa, Entamoeba invadens
HPRVVLLDCNLEYTKGESQT

SEQ ID NO: 2941558 - protein, 20 aa, Entamoeba invadens
HPSANDFLRMDCVNISNFYN

SEQ ID NO: 2941559 - protein, 22 aa, Entamoeba invadens
HPSHCVGVLFLSGLIDVAFPLP

SEQ ID NO: 2941560 - protein, 23 aa, Entamoeba invadens
HPSLVLQHLFRLCMSSNIDDLYK

SEQ ID NO: 2941561 - protein, 30 aa, Entamoeba invadens
HPSTVNGLKAWKLAKPLAEKGKEFDNNMKY

SEQ ID NO: 2941562 - protein, 26 aa, Entamoeba invadens
HPTERKCLFVRKSIMPVNRYTCVAGF

SEQ ID NO: 2941563 - protein, 18 aa, Entamoeba invadens
HPTHEILNFVSSTGETAL

SEQ ID NO: 2941564 - protein, 18 aa, Entamoeba invadens
HPTHFKNFVDGFFEVIVS

SEQ ID NO: 2941565 - protein, 20 aa, Entamoeba invadens
HPTLLKIFYKLRGVQNSFDL

SEQ ID NO: 2941566 - protein, 19 aa, Entamoeba invadens
HPVEIFGNQCIQDIQTKIT

SEQ ID NO: 2941567 - protein, 19 aa, Entamoeba invadens
HPVTHCEVIDGVSVDDVIT

SEQ ID NO: 2941568 - protein, 19 aa, Entamoeba invadens
HPWEILLQKLVIYLPKTQN

SEQ ID NO: 2941569 - protein, 19 aa, Entamoeba invadens
HPYELELFYSQTITNLDIP

SEQ ID NO: 2941570 - protein, 19 aa, Entamoeba invadens
HPYVFKSKLPITLVLELDD

SEQ ID NO: 2941571 - protein, 23 aa, Entamoeba invadens
HQANFFFHFFAFVRKLNKQEHME

SEQ ID NO: 2941572 - protein, 17 aa, Entamoeba invadens
HQCFRECSNLSSVTIPS

SEQ ID NO: 2941573 - protein, 31 aa, Entamoeba invadens
HQELYWSGVVGLNFERFVFRGLSCQFDEAGL

SEQ ID NO: 2941574 - protein, 21 aa, Entamoeba invadens
HQGNIKVCFRPSSVVASKVNE

SEQ ID NO: 2941575 - protein, 19 aa, Entamoeba invadens
HQGSWRTVKRILYVHINGI

SEQ ID NO: 2941576 - protein, 18 aa, Entamoeba invadens
HQHKFAAKEGDLIDGKTF

SEQ ID NO: 2941577 - protein, 26 aa, Entamoeba invadens
HQHVPFPIILIFALNKWRQEHNTTGI

SEQ ID NO: 2941578 - protein, 24 aa, Entamoeba invadens
HQIETVCLLLLMKVKYPDRIHLLR

SEQ ID NO: 2941579 - protein, 20 aa, Entamoeba invadens
HQIPSKRFCVDKTEIVCLVT

SEQ ID NO: 2941580 - protein, 18 aa, Entamoeba invadens
HQKAMIIISALKFLQFVI

SEQ ID NO: 2941581 - protein, 27 aa, Entamoeba invadens
HQKELIEIFKARILYFSHKLAVILRKE

SEQ ID NO: 2941582 - protein, 23 aa, Entamoeba invadens
HQKISTIVNVEWENGVLYVTNYR

SEQ ID NO: 2941583 - protein, 24 aa, Entamoeba invadens
HQLPFLKCSRVMYQYQMKTKSYIF

SEQ ID NO: 2941584 - protein, 24 aa, Entamoeba invadens
HQLTLYEFEMFKAIEAKEMLGNAW

SEQ ID NO: 2941585 - protein, 22 aa, Entamoeba invadens
HQREYIVALGRLCYSIHLKGGL

SEQ ID NO: 2941586 - protein, 17 aa, Entamoeba invadens
HQSAINVVKCWNRKILT

SEQ ID NO: 2941587 - protein, 25 aa, Entamoeba invadens
HQSLPMLEMHIAYVMDHLVDALCYI

SEQ ID NO: 2941588 - protein, 35 aa, Entamoeba invadens
HQTDLRVGEIIHIIFLEERFTYILPDTISLTNTSP

SEQ ID NO: 2941589 - protein, 18 aa, Entamoeba invadens
HQVCISPIEVKSPQQNSK

SEQ ID NO: 2941590 - protein, 19 aa, Entamoeba invadens
HQVEGIKFMYNCVMRGDDS

SEQ ID NO: 2941591 - protein, 19 aa, Entamoeba invadens
HQVEKWCEVVFEECMVVVR

SEQ ID NO: 2941592 - protein, 25 aa, Entamoeba invadens
HRDANRSALGFSYLLRMAEGIGYNF

SEQ ID NO: 2941593 - protein, 19 aa, Entamoeba invadens
HRDARAYVAAVKWLNTHYS

SEQ ID NO: 2941594 - protein, 24 aa, Entamoeba invadens
HRDELCYTRFLSVNANARINSKYS

SEQ ID NO: 2941595 - protein, 25 aa, Entamoeba invadens
HRDIKPEHFLVFSLDINDKVNAKLT

SEQ ID NO: 2941596 - protein, 18 aa, Entamoeba invadens
HRDIPLCRYGGMLENSTN

SEQ ID NO: 2941597 - protein, 26 aa, Entamoeba invadens
HRDPHIWLRRGLFFCHRDINPILDDV

SEQ ID NO: 2941598 - protein, 18 aa, Entamoeba invadens
HREEQTWETLLFQRGEYL

SEQ ID NO: 2941599 - protein, 20 aa, Entamoeba invadens
HRELARKVGQRVVALREEIN

SEQ ID NO: 2941600 - protein, 18 aa, Entamoeba invadens
HRFNRLTMSVGRRNNHLN

SEQ ID NO: 2941601 - protein, 27 aa, Entamoeba invadens
HRGAKNFFSALCQIVLEQIDQRTPGLF

SEQ ID NO: 2941602 - protein, 21 aa, Entamoeba invadens
HRGEPIFDYVLLAFNNGELTA

SEQ ID NO: 2941603 - protein, 24 aa, Entamoeba invadens
HRGFRAEALMALADVYQYKEADPM

SEQ ID NO: 2941604 - protein, 28 aa, Entamoeba invadens
HRHEKADVWSLGMICYFIATGDHPFKTN

SEQ ID NO: 2941605 - protein, 30 aa, Entamoeba invadens
HRIAIVCAFCPDRFFGFTFNDTITDHKVDT

SEQ ID NO: 2941606 - protein, 24 aa, Entamoeba invadens
HRILCVGGTRGDLLFWNVDYQEKM

SEQ ID NO: 2941607 - protein, 19 aa, Entamoeba invadens
HRINGVAVGSFFDYFMPYE

SEQ ID NO: 2941608 - protein, 28 aa, Entamoeba invadens
HRIPSACFKACFRLSKIHFESKISSFGK

SEQ ID NO: 2941609 - protein, 20 aa, Entamoeba invadens
HRKACLESVHLFKLSEENNL

SEQ ID NO: 2941610 - protein, 17 aa, Entamoeba invadens
HRKCFKTVQFLKIKQLR

SEQ ID NO: 2941611 - protein, 17 aa, Entamoeba invadens
HRKIVIDLATNFLPKQK

SEQ ID NO: 2941612 - protein, 21 aa, Entamoeba invadens
HRKTPFYYSCMDLLTRIFVGM

SEQ ID NO: 2941613 - protein, 17 aa, Entamoeba invadens
HRLCLFKNEKEKEKDKD

SEQ ID NO: 2941614 - protein, 19 aa, Entamoeba invadens
HRLGLFLNDGVDLFHVSGH

SEQ ID NO: 2941615 - protein, 18 aa, Entamoeba invadens
HRLIKAAIAERARNEVLK

SEQ ID NO: 2941616 - protein, 17 aa, Entamoeba invadens
HRLKISRPISDKLSETT

SEQ ID NO: 2941617 - protein, 17 aa, Entamoeba invadens
HRLKNTLGMDIYSFTEL

SEQ ID NO: 2941618 - protein, 17 aa, Entamoeba invadens
HRLRVSITQSSKYKLNE

SEQ ID NO: 2941619 - protein, 17 aa, Entamoeba invadens
HRQCACCSICKRFSDIK

SEQ ID NO: 2941620 - protein, 20 aa, Entamoeba invadens
HRQCSKCIICDKFSDLKKCP

SEQ ID NO: 2941621 - protein, 17 aa, Entamoeba invadens
HRQGIVVLLDIVHSHTS

SEQ ID NO: 2941622 - protein, 21 aa, Entamoeba invadens
HRRDSFRASKAMQERVLNHPK

SEQ ID NO: 2941623 - protein, 23 aa, Entamoeba invadens
HRRKVIVEFVAFVFGQAESMDDA

SEQ ID NO: 2941624 - protein, 27 aa, Entamoeba invadens
HRSFDCATPLLIQWTYQAMINEFLGIN

SEQ ID NO: 2941625 - protein, 17 aa, Entamoeba invadens
HRTLCNINCSFVIFEID

SEQ ID NO: 2941626 - protein, 26 aa, Entamoeba invadens
HRVEVPRFLKEIGDFAFCRCTNLVYL

SEQ ID NO: 2941627 - protein, 17 aa, Entamoeba invadens
HRVFEKLGAQQTFQEMR

SEQ ID NO: 2941628 - protein, 18 aa, Entamoeba invadens
HRVHKECYLEILKDRDSC

SEQ ID NO: 2941629 - protein, 22 aa, Entamoeba invadens
HRVKILRIFNRNVFVFTNNLLL

SEQ ID NO: 2941630 - protein, 31 aa, Entamoeba invadens
HRVVYLLNDLACWDDIKFLLDNKVKVETPKP

SEQ ID NO: 2941631 - protein, 21 aa, Entamoeba invadens
HRVWYEWMVVTPLITKIFNSS

SEQ ID NO: 2941632 - protein, 27 aa, Entamoeba invadens
HSAFKPLPFFKDFITLVGSHKEDTENA

SEQ ID NO: 2941633 - protein, 18 aa, Entamoeba invadens
HSALMWWNTHFALGNSAD

SEQ ID NO: 2941634 - protein, 25 aa, Entamoeba invadens
HSATSRPTVVSAFRQCGLEFKVSSH

SEQ ID NO: 2941635 - protein, 20 aa, Entamoeba invadens
HSCFRDCSLNSITIPSSVTL

SEQ ID NO: 2941636 - protein, 19 aa, Entamoeba invadens
HSCFRECSLSSITIPSSVT

SEQ ID NO: 2941637 - protein, 20 aa, Entamoeba invadens
HSCFRNCSLSSITIPLSVTL

SEQ ID NO: 2941638 - protein, 17 aa, Entamoeba invadens
HSCVMRRIISVATEGDN

SEQ ID NO: 2941639 - protein, 18 aa, Entamoeba invadens
HSDFNFSSQQIFVLEDQS

SEQ ID NO: 2941640 - protein, 18 aa, Entamoeba invadens
HSDGSVCIICHNGNLFDK

SEQ ID NO: 2941641 - protein, 18 aa, Entamoeba invadens
HSDIPLKIIGKSLLNDTL

SEQ ID NO: 2941642 - protein, 25 aa, Entamoeba invadens
HSECFVCTKCKSPFASPQFFQKDGN

SEQ ID NO: 2941643 - protein, 22 aa, Entamoeba invadens
HSELKPYILRRMKKEVEKSLPP

SEQ ID NO: 2941644 - protein, 19 aa, Entamoeba invadens
HSERAFVCLNICLCECIQR

SEQ ID NO: 2941645 - protein, 24 aa, Entamoeba invadens
HSFAISLCYFIIPYFSANHNFRKL

SEQ ID NO: 2941646 - protein, 21 aa, Entamoeba invadens
HSFAMCFYLTRVVLPNNLLKI

SEQ ID NO: 2941647 - protein, 19 aa, Entamoeba invadens
HSFIPYAISQPFFLLTKTS

SEQ ID NO: 2941648 - protein, 22 aa, Entamoeba invadens
HSFLKINIWCDVSYSFTQMHKD

SEQ ID NO: 2941649 - protein, 17 aa, Entamoeba invadens
HSFSECRSLSSVTIPSS

SEQ ID NO: 2941650 - protein, 19 aa, Entamoeba invadens
HSFVLPFFNILLIEQSNTV

SEQ ID NO: 2941651 - protein, 24 aa, Entamoeba invadens
HSFVPQLPSCVARKGVDSTQHTQL

SEQ ID NO: 2941652 - protein, 33 aa, Entamoeba invadens
HSGFISYLLCCPRLEEWTDYSIAVVTILDDLFQ

SEQ ID NO: 2941653 - protein, 23 aa, Entamoeba invadens
HSGGMLGGWKFSNFKDGVFSEVF

SEQ ID NO: 2941654 - protein, 19 aa, Entamoeba invadens
HSGHVKWNESLYSVSVTRY

SEQ ID NO: 2941655 - protein, 26 aa, Entamoeba invadens
HSGKCSPRTPRSCRELTDSPLESPRY

SEQ ID NO: 2941656 - protein, 19 aa, Entamoeba invadens
HSGMYLVNFGFVYKETDFD

SEQ ID NO: 2941657 - protein, 23 aa, Entamoeba invadens
HSGPLPKRQSVLLQYTKPSENIE

SEQ ID NO: 2941658 - protein, 18 aa, Entamoeba invadens
HSGTDCSRFCASQFPECF

SEQ ID NO: 2941659 - protein, 25 aa, Entamoeba invadens
HSIGCGPTLWLAREIQNGKMAKKGL

SEQ ID NO: 2941660 - protein, 25 aa, Entamoeba invadens
HSILFLAECEKAFILLMDRRGVKIT

SEQ ID NO: 2941661 - protein, 17 aa, Entamoeba invadens
HSILLLDFACFDECKAY

SEQ ID NO: 2941662 - protein, 25 aa, Entamoeba invadens
HSITEMSEGFAIYIKNLPPYKNEDI

SEQ ID NO: 2941663 - protein, 23 aa, Entamoeba invadens
HSIYPNHLLMRFKNIQHQQSGVF

SEQ ID NO: 2941664 - protein, 18 aa, Entamoeba invadens
HSKIAFKDTSVGFFSPNP

SEQ ID NO: 2941665 - protein, 21 aa, Entamoeba invadens
HSKIRMSEMFTQCHIGSSLIN

SEQ ID NO: 2941666 - protein, 20 aa, Entamoeba invadens
HSKLIAPRHIVHRGREIEPV

SEQ ID NO: 2941667 - protein, 19 aa, Entamoeba invadens
HSKLREIHPIMQHANILFS

SEQ ID NO: 2941668 - protein, 25 aa, Entamoeba invadens
HSKLWKLYFEIAFETNFDAFLFVVS

SEQ ID NO: 2941669 - protein, 22 aa, Entamoeba invadens
HSLHYKRVVVSPFYSSINYIMF

SEQ ID NO: 2941670 - protein, 25 aa, Entamoeba invadens
HSLLMREFLSLCLVKDPDQRARATT

SEQ ID NO: 2941671 - protein, 25 aa, Entamoeba invadens
HSLPDCVFYGNHLVSYTVPDNIQNE

SEQ ID NO: 2941672 - protein, 25 aa, Entamoeba invadens
HSLPDCVFYGNHLVSYTVPDNIQSL

SEQ ID NO: 2941673 - protein, 25 aa, Entamoeba invadens
HSLQEIGAFCFKIAANWNNFIFQNR

SEQ ID NO: 2941674 - protein, 26 aa, Entamoeba invadens
HSLQEIGAFCFKNCSKLEQLYFPKSL

SEQ ID NO: 2941675 - protein, 20 aa, Entamoeba invadens
HSLQIPNFVTWLPDFCFENA

SEQ ID NO: 2941676 - protein, 20 aa, Entamoeba invadens
HSLVFKRITGKFEFLSLSLP

SEQ ID NO: 2941677 - protein, 30 aa, Entamoeba invadens
HSLVKSEELGECEICKNGVMEVECSCCHKK

SEQ ID NO: 2941678 - protein, 21 aa, Entamoeba invadens
HSMFLAFSLLYLGSQGATQKE

SEQ ID NO: 2941679 - protein, 24 aa, Entamoeba invadens
HSNRRVFRTSELVGLLKDTAYVSC

SEQ ID NO: 2941680 - protein, 21 aa, Entamoeba invadens
HSNTTCSIIGLFKAKMKVLAV

SEQ ID NO: 2941681 - protein, 17 aa, Entamoeba invadens
HSPNVVLFIGMAMSQNL

SEQ ID NO: 2941682 - protein, 23 aa, Entamoeba invadens
HSPTTCPVERSFNKIGQLDRANM

SEQ ID NO: 2941683 - protein, 18 aa, Entamoeba invadens
HSQGYWLCVVDMDGSNIL

SEQ ID NO: 2941684 - protein, 22 aa, Entamoeba invadens
HSRGPSCAYMLNFAFQNPKYKD

SEQ ID NO: 2941685 - protein, 25 aa, Entamoeba invadens
HSRRAVSCRFPFKGIIPSQIDEELK

SEQ ID NO: 2941686 - protein, 20 aa, Entamoeba invadens
HSSFKLPLNFNINSKCNVDE

SEQ ID NO: 2941687 - protein, 25 aa, Entamoeba invadens
HSTIYKRIFWYQVKYKKFKANASEN

SEQ ID NO: 2941688 - protein, 19 aa, Entamoeba invadens
HSTLHAFAHWTWVQSKGNL

SEQ ID NO: 2941689 - protein, 35 aa, Entamoeba invadens
HSTQISKWSLVRCNCCGTDCALISDGEVIVNPIMK

SEQ ID NO: 2941690 - protein, 27 aa, Entamoeba invadens
HSVAEELLKLSIKFFNAVVDKKKFNKK

SEQ ID NO: 2941691 - protein, 17 aa, Entamoeba invadens
HSVKLFDVRNWEWKEVE

SEQ ID NO: 2941692 - protein, 24 aa, Entamoeba invadens
HSVNMRTALRISYEEQLSYKSSVL

SEQ ID NO: 2941693 - protein, 23 aa, Entamoeba invadens
HSVPLPALEYILSKAREINSELV

SEQ ID NO: 2941694 - protein, 24 aa, Entamoeba invadens
HSVTKIGAFAFRKCASLRHVDIPE

SEQ ID NO: 2941695 - protein, 18 aa, Entamoeba invadens
HSVVKEIILLPSTPQDGE

SEQ ID NO: 2941696 - protein, 19 aa, Entamoeba invadens
HSVWLPCNMKIESLSISEI

SEQ ID NO: 2941697 - protein, 27 aa, Entamoeba invadens
HSYLLKIGTRVPICYQDQMYYKKMYGD

SEQ ID NO: 2941698 - protein, 20 aa, Entamoeba invadens
HSYNGFACLMQISTRSEDFV

SEQ ID NO: 2941699 - protein, 27 aa, Entamoeba invadens
HSYYIPKGWFQSFIIPLYVGQPVTAKL

SEQ ID NO: 2941700 - protein, 25 aa, Entamoeba invadens
HSYYNRYAAFYIKIYANEATSRRAQ

SEQ ID NO: 2941701 - protein, 24 aa, Entamoeba invadens
HTAARLGLDMVLERCVEIYPDSIE

SEQ ID NO: 2941702 - protein, 24 aa, Entamoeba invadens
HTALNARCSILAAANPSNGNYNVK

SEQ ID NO: 2941703 - protein, 24 aa, Entamoeba invadens
HTAPINVVKCFNRKIVTGGDDHLL

SEQ ID NO: 2941704 - protein, 25 aa, Entamoeba invadens
HTAVFPFGVSLWFSKYFEKAGKFEK

SEQ ID NO: 2941705 - protein, 43 aa, Entamoeba invadens
HTCLPLIKDWIHLRRHQLLFNACERFDIEEFWKAVEGKSNVAI

SEQ ID NO: 2941706 - protein, 24 aa, Entamoeba invadens
HTCNCFCHALGLFKIKLTRPDTVF

SEQ ID NO: 2941707 - protein, 19 aa, Entamoeba invadens
HTDRSKCCVCKEPFDEKDV

SEQ ID NO: 2941708 - protein, 22 aa, Entamoeba invadens
HTDVIWSLKCHEDLPIIASASE

SEQ ID NO: 2941709 - protein, 19 aa, Entamoeba invadens
HTEKFCKYLTTYYLHESIS

SEQ ID NO: 2941710 - protein, 17 aa, Entamoeba invadens
HTELRVDIKKGRIEKLI

SEQ ID NO: 2941711 - protein, 19 aa, Entamoeba invadens
HTETICMCMYVYNYYLYPS

SEQ ID NO: 2941712 - protein, 26 aa, Entamoeba invadens
HTETYAPLCVLSFPSSNPKLINENAL

SEQ ID NO: 2941713 - protein, 18 aa, Entamoeba invadens
HTFCYELRTNPSEGNVLL

SEQ ID NO: 2941714 - protein, 18 aa, Entamoeba invadens
HTFFLGNESLEFTSKQID

SEQ ID NO: 2941715 - protein, 17 aa, Entamoeba invadens
HTFKIFKTIGMKEVDID

SEQ ID NO: 2941716 - protein, 26 aa, Entamoeba invadens
HTGIGVGSVKLWRVAFNVFIEDLYIR

SEQ ID NO: 2941717 - protein, 25 aa, Entamoeba invadens
HTGSYECRLCLTIHVSEANYLAHTQ

SEQ ID NO: 2941718 - protein, 18 aa, Entamoeba invadens
HTIERWVGMLGGYSVVRP

SEQ ID NO: 2941719 - protein, 23 aa, Entamoeba invadens
HTILRVVGGWVRDKLLGRESHDI

SEQ ID NO: 2941720 - protein, 25 aa, Entamoeba invadens
HTKDIFYRTTVVLAENVKILGKNTF

SEQ ID NO: 2941721 - protein, 25 aa, Entamoeba invadens
HTKFLRLFGLSRFSFNTIFENCEIL

SEQ ID NO: 2941722 - protein, 20 aa, Entamoeba invadens
HTKKVFLTYLLSNVESVTAL

SEQ ID NO: 2941723 - protein, 23 aa, Entamoeba invadens
HTKLIVKTLCEWSFAYRPSNTKK

SEQ ID NO: 2941724 - protein, 24 aa, Entamoeba invadens
HTKLPRGGILVFLTGKREIEDVCT

SEQ ID NO: 2941725 - protein, 18 aa, Entamoeba invadens
HTKNGLKEKVMKITLSAR

SEQ ID NO: 2941726 - protein, 21 aa, Entamoeba invadens
HTKSPISFHFIPFSPIFGRLS

SEQ ID NO: 2941727 - protein, 24 aa, Entamoeba invadens
HTLECIRHWKKWRIIQNGLSTIAS

SEQ ID NO: 2941728 - protein, 23 aa, Entamoeba invadens
HTLFKATFFPTWEGLFWEKSSGF

SEQ ID NO: 2941729 - protein, 17 aa, Entamoeba invadens
HTLIRPDFDDIKGPFPY

SEQ ID NO: 2941730 - protein, 24 aa, Entamoeba invadens
HTLNKSVLLYTLFNAIHNSELVYD

SEQ ID NO: 2941731 - protein, 17 aa, Entamoeba invadens
HTLPLSGRFHKSFENMK

SEQ ID NO: 2941732 - protein, 22 aa, Entamoeba invadens
HTLPTFKSLLLFHIIEKNGDTN

SEQ ID NO: 2941733 - protein, 17 aa, Entamoeba invadens
HTMCGLLVSHINSVPPI

SEQ ID NO: 2941734 - protein, 19 aa, Entamoeba invadens
HTMYLKVGFELTGERCEFN

SEQ ID NO: 2941735 - protein, 21 aa, Entamoeba invadens
HTNDPCAIFDIPALQTYPDGR

SEQ ID NO: 2941736 - protein, 28 aa, Entamoeba invadens
HTNDPIWMCMDGFKLWINMSECIEIFDT

SEQ ID NO: 2941737 - protein, 17 aa, Entamoeba invadens
HTPFVLSYYKYWTELVP

SEQ ID NO: 2941738 - protein, 18 aa, Entamoeba invadens
HTPLDCPVVEPGDYEPDD

SEQ ID NO: 2941739 - protein, 25 aa, Entamoeba invadens
HTPMPYFVFCFTNVFSVGQIVGDAV

SEQ ID NO: 2941740 - protein, 19 aa, Entamoeba invadens
HTQFKSNFVKFFATKGKLN

SEQ ID NO: 2941741 - protein, 19 aa, Entamoeba invadens
HTRIFCSEIRRSLDGAKPD

SEQ ID NO: 2941742 - protein, 21 aa, Entamoeba invadens
HTSELPLDLILSTNASNEEFL

SEQ ID NO: 2941743 - protein, 17 aa, Entamoeba invadens
HTSIFFNKVEFIDNLII

SEQ ID NO: 2941744 - protein, 23 aa, Entamoeba invadens
HTSNCNHYAYYIGNIKIECYKCK

SEQ ID NO: 2941745 - protein, 18 aa, Entamoeba invadens
HTSNRFGHESCATLFAQK

SEQ ID NO: 2941746 - protein, 25 aa, Entamoeba invadens
HTTCHRCVTCLTLIEGNPPLPQEQC

SEQ ID NO: 2941747 - protein, 24 aa, Entamoeba invadens
HTTKLVSCINCFTSLKYEVVHQWK

SEQ ID NO: 2941748 - protein, 17 aa, Entamoeba invadens
HTTKRVAALAATYIINY

SEQ ID NO: 2941749 - protein, 17 aa, Entamoeba invadens
HTTKRVASMAATYIIDY

SEQ ID NO: 2941750 - protein, 18 aa, Entamoeba invadens
HTTLKFNVANILYTLKDL

SEQ ID NO: 2941751 - protein, 19 aa, Entamoeba invadens
HTTPGMFYNLLDTMEKSGV

SEQ ID NO: 2941752 - protein, 22 aa, Entamoeba invadens
HTVNMGKPISMVGVINKDLVSF

SEQ ID NO: 2941753 - protein, 18 aa, Entamoeba invadens
HVCSVCFKLQTPYRTFVA

SEQ ID NO: 2941754 - protein, 24 aa, Entamoeba invadens
HVDSESSAHVYLRLKDKDTLDTIP

SEQ ID NO: 2941755 - protein, 17 aa, Entamoeba invadens
HVDVWRIVVLDPRGSIP

SEQ ID NO: 2941756 - protein, 24 aa, Entamoeba invadens
HVECCASVVNLLFDLIVTKRGSEM

SEQ ID NO: 2941757 - protein, 23 aa, Entamoeba invadens
HVEKALNSFAFKNLKKLEIYSIN

SEQ ID NO: 2941758 - protein, 19 aa, Entamoeba invadens
HVEKLLGKKTRAFEKTTDT

SEQ ID NO: 2941759 - protein, 23 aa, Entamoeba invadens
HVELLKICRDILLGERAYSKTVL

SEQ ID NO: 2941760 - protein, 24 aa, Entamoeba invadens
HVFSKCLSQFKFVFTVDDCYEAYD

SEQ ID NO: 2941761 - protein, 17 aa, Entamoeba invadens
HVGDMLNYINWSGYIKG

SEQ ID NO: 2941762 - protein, 17 aa, Entamoeba invadens
HVGGMLVSHSYVIPEVG

SEQ ID NO: 2941763 - protein, 22 aa, Entamoeba invadens
HVGWLDDYRLIIVTRKRYIYMY

SEQ ID NO: 2941764 - protein, 23 aa, Entamoeba invadens
HVHAGCICMAIANRRLNTFCDIK

SEQ ID NO: 2941765 - protein, 25 aa, Entamoeba invadens
HVICPFKTYSCKDIYSYSYKDNSFK

SEQ ID NO: 2941766 - protein, 22 aa, Entamoeba invadens
HVIFHLRLVSQYSRQNLMDVSN

SEQ ID NO: 2941767 - protein, 19 aa, Entamoeba invadens
HVIIGNFFVKKCVTVNGKK

SEQ ID NO: 2941768 - protein, 20 aa, Entamoeba invadens
HVILCASALLVLDMHCRLIE

SEQ ID NO: 2941769 - protein, 25 aa, Entamoeba invadens
HVIMGEDLFTMFTATAFKKQVELNL

SEQ ID NO: 2941770 - protein, 20 aa, Entamoeba invadens
HVIVPVERFDVIKIPRPNDF

SEQ ID NO: 2941771 - protein, 18 aa, Entamoeba invadens
HVIYIGDRCFERCLNLVH

SEQ ID NO: 2941772 - protein, 29 aa, Entamoeba invadens
HVKADIKKREMLLVGIGLGFYLESSLEEA

SEQ ID NO: 2941773 - protein, 18 aa, Entamoeba invadens
HVKAQPLSVSKMVLPEFK

SEQ ID NO: 2941774 - protein, 18 aa, Entamoeba invadens
HVKCTHLCVSLDLLDNFK

SEQ ID NO: 2941775 - protein, 24 aa, Entamoeba invadens
HVKLARRYVLEWEAYVKHQGLLRK

SEQ ID NO: 2941776 - protein, 20 aa, Entamoeba invadens
HVKLCTLAVSLGCVDTLIEH

SEQ ID NO: 2941777 - protein, 22 aa, Entamoeba invadens
HVKTIGTYCFYKCCVLESIEIP

SEQ ID NO: 2941778 - protein, 23 aa, Entamoeba invadens
HVLCDGRTLFTLFQIIKNAIPNE

SEQ ID NO: 2941779 - protein, 20 aa, Entamoeba invadens
HVLEGVTLIKSHCYLNDMDL

SEQ ID NO: 2941780 - protein, 21 aa, Entamoeba invadens
HVLERPSDVAFLSLDPPSVPK

SEQ ID NO: 2941781 - protein, 31 aa, Entamoeba invadens
HVLHAWFHLKILRLFTDSVLHYGLPTKYDLI

SEQ ID NO: 2941782 - protein, 17 aa, Entamoeba invadens
HVLHSFISLPTIKMTLQ

SEQ ID NO: 2941783 - protein, 19 aa, Entamoeba invadens
HVLLEMISKTPIIMRDGGL

SEQ ID NO: 2941784 - protein, 20 aa, Entamoeba invadens
HVLSLRMLFAVVGTIENLQF

SEQ ID NO: 2941785 - protein, 21 aa, Entamoeba invadens
HVMGGRGAPNFKLFEDLCLRA

SEQ ID NO: 2941786 - protein, 18 aa, Entamoeba invadens
HVMLLKTLTIAGRTCNLY

SEQ ID NO: 2941787 - protein, 17 aa, Entamoeba invadens
HVMSCVGYRAKQFETKS

SEQ ID NO: 2941788 - protein, 24 aa, Entamoeba invadens
HVNCKRLTKVMSFQTEKAVCCCCG

SEQ ID NO: 2941789 - protein, 25 aa, Entamoeba invadens
HVNLEFGCFLCEKCAELHQLTFSQT

SEQ ID NO: 2941790 - protein, 21 aa, Entamoeba invadens
HVPIVLCGNKSDLESARIVPI

SEQ ID NO: 2941791 - protein, 25 aa, Entamoeba invadens
HVPKEIAAITHGFVKGAMKGVDVEN

SEQ ID NO: 2941792 - protein, 19 aa, Entamoeba invadens
HVPLLRQIIYDDFVQGNIV

SEQ ID NO: 2941793 - protein, 22 aa, Entamoeba invadens
HVPSNCIIEIYIQHREFVIRTF

SEQ ID NO: 2941794 - protein, 21 aa, Entamoeba invadens
HVPTMKTCLGKINMMIQDTEG

SEQ ID NO: 2941795 - protein, 27 aa, Entamoeba invadens
HVQNVKLCLDAGYQLLNIPRLLDENYV

SEQ ID NO: 2941796 - protein, 20 aa, Entamoeba invadens
HVRALECQRMELGEKDDSGR

SEQ ID NO: 2941797 - protein, 26 aa, Entamoeba invadens
HVRVKGKEKIICWSLTKEQQDSNDFN

SEQ ID NO: 2941798 - protein, 24 aa, Entamoeba invadens
HVSDRLFHSAFVEFENSSSVERAM

SEQ ID NO: 2941799 - protein, 17 aa, Entamoeba invadens
HVSESWFYTEITERENM

SEQ ID NO: 2941800 - protein, 25 aa, Entamoeba invadens
HVSKLDLLIFFSEIRIFSNTIVDLL

SEQ ID NO: 2941801 - protein, 21 aa, Entamoeba invadens
HVTEILPTIFLTSRHSAEDEL

SEQ ID NO: 2941802 - protein, 23 aa, Entamoeba invadens
HVTIRLIYCSSFTISNSNDILCD

SEQ ID NO: 2941803 - protein, 18 aa, Entamoeba invadens
HVTLIASRVKACYENTHD

SEQ ID NO: 2941804 - protein, 21 aa, Entamoeba invadens
HVVEMKVPLIVSVETGKKWGS

SEQ ID NO: 2941805 - protein, 24 aa, Entamoeba invadens
HVVFPDKYQSAAFPALLLFIRNNG

SEQ ID NO: 2941806 - protein, 19 aa, Entamoeba invadens
HVVGQEVKFLNSIDSACSI

SEQ ID NO: 2941807 - protein, 17 aa, Entamoeba invadens
HVVIKQSSFIVVIVSET

SEQ ID NO: 2941808 - protein, 18 aa, Entamoeba invadens
HVVQLLLTACPQIIDTSA

SEQ ID NO: 2941809 - protein, 23 aa, Entamoeba invadens
HVVQRYPISMVVGKKYKRMMLYI

SEQ ID NO: 2941810 - protein, 20 aa, Entamoeba invadens
HVVRDAWRQLYYAVYNMPTR

SEQ ID NO: 2941811 - protein, 25 aa, Entamoeba invadens
HVYMFDWYMVWFSRILPCDFLYAVF

SEQ ID NO: 2941812 - protein, 19 aa, Entamoeba invadens
HWATVISQLPRIGLLRLFV

SEQ ID NO: 2941813 - protein, 23 aa, Entamoeba invadens
HWAVKLEGLFLKLWTTAFGATKP

SEQ ID NO: 2941814 - protein, 20 aa, Entamoeba invadens
HWCQRKRFLSGRREKEAYRL

SEQ ID NO: 2941815 - protein, 26 aa, Entamoeba invadens
HWDKEFPLKRCCSSTELPIFADKTLN

SEQ ID NO: 2941816 - protein, 17 aa, Entamoeba invadens
HWFYGKPGCGKSFTARK

SEQ ID NO: 2941817 - protein, 20 aa, Entamoeba invadens
HWHREISEWTDLNVILYSGS

SEQ ID NO: 2941818 - protein, 25 aa, Entamoeba invadens
HWIDSCPRKSAMFLMIAANQYFSAD

SEQ ID NO: 2941819 - protein, 24 aa, Entamoeba invadens
HWIFPLRLVGRTNPDRQLKELQYS

SEQ ID NO: 2941820 - protein, 29 aa, Entamoeba invadens
HWLTFHSGYDFGYFLKLLTCEKLPSNIDL

SEQ ID NO: 2941821 - protein, 19 aa, Entamoeba invadens
HWNCVSSFSIFKRQNYKKL

SEQ ID NO: 2941822 - protein, 21 aa, Entamoeba invadens
HWQLVHRRSVTFVDLLNSMSN

SEQ ID NO: 2941823 - protein, 20 aa, Entamoeba invadens
HWRHPNIVGFEGCWIFDNRV

SEQ ID NO: 2941824 - protein, 17 aa, Entamoeba invadens
HWVKKKANYVVRVEEYE

SEQ ID NO: 2941825 - protein, 20 aa, Entamoeba invadens
HWWKGISFTPVKVKNDMSLA

SEQ ID NO: 2941826 - protein, 18 aa, Entamoeba invadens
HYAIKYKIPEMVPLICVW

SEQ ID NO: 2941827 - protein, 23 aa, Entamoeba invadens
HYCFDGCSNLSFIELKGNIEKYG

SEQ ID NO: 2941828 - protein, 30 aa, Entamoeba invadens
HYEFPETVLRCLPKLPFEITDEYLKGRRDF

SEQ ID NO: 2941829 - protein, 21 aa, Entamoeba invadens
HYEPKCRMMVVGTKTDCRTDE

SEQ ID NO: 2941830 - protein, 24 aa, Entamoeba invadens
HYEVMKSCILMGVIRIINEENMKV

SEQ ID NO: 2941831 - protein, 23 aa, Entamoeba invadens
HYFNRLVPVLILEIAEKFPRNLQ

SEQ ID NO: 2941832 - protein, 28 aa, Entamoeba invadens
HYFSNCLVDGKWLCFNDRTVSESDNENW

SEQ ID NO: 2941833 - protein, 17 aa, Entamoeba invadens
HYICYEFMMDASPLLAL

SEQ ID NO: 2941834 - protein, 31 aa, Entamoeba invadens
HYIICQLRCNGVLEGIRITRLGYPNRIIYNE

SEQ ID NO: 2941835 - protein, 25 aa, Entamoeba invadens
HYIIPNKISDEWITIGLRDYLAEQF

SEQ ID NO: 2941836 - protein, 26 aa, Entamoeba invadens
HYKGITAEFWKTFQSKAYKKDQNYIE

SEQ ID NO: 2941837 - protein, 32 aa, Entamoeba invadens
HYKYDIFMFGIKMMIMLFTWTSSKTDFQEFNE

SEQ ID NO: 2941838 - protein, 21 aa, Entamoeba invadens
HYLEDMLLFKGFKMENDGENR

SEQ ID NO: 2941839 - protein, 24 aa, Entamoeba invadens
HYNMKLYCRFYCKQDVRILKEGHI

SEQ ID NO: 2941840 - protein, 20 aa, Entamoeba invadens
HYPQKLFLAMIHTMPNKIQN

SEQ ID NO: 2941841 - protein, 18 aa, Entamoeba invadens
HYQCAICHAEFTGGSSIE

SEQ ID NO: 2941842 - protein, 19 aa, Entamoeba invadens
HYQLMLSKRLLYKGYDLDS

SEQ ID NO: 2941843 - protein, 19 aa, Entamoeba invadens
HYRAPEIILGLPYTCAIDM

SEQ ID NO: 2941844 - protein, 17 aa, Entamoeba invadens
HYRAPEIVFNMKYTNAI

SEQ ID NO: 2941845 - protein, 18 aa, Entamoeba invadens
HYRSPEVILGIKYNSAID

SEQ ID NO: 2941846 - protein, 19 aa, Entamoeba invadens
HYRSPEVILGLPYSTAIDM

SEQ ID NO: 2941847 - protein, 25 aa, Entamoeba invadens
HYRSPEVILGLPYSTAIDMWSFGCM

SEQ ID NO: 2941848 - protein, 24 aa, Entamoeba invadens
HYSNTRFLYIATISNMLFDCYSEM

SEQ ID NO: 2941849 - protein, 18 aa, Entamoeba invadens
HYYTFPVFNKYNGKYIYK

SEQ ID NO: 2941850 - protein, 17 aa, Entamoeba invadens
IAAGAKLFHVVCDSDAT

SEQ ID NO: 2941851 - protein, 26 aa, Entamoeba invadens
IAALDDFKSLLILLKRKCEDDGKEIL

SEQ ID NO: 2941852 - protein, 24 aa, Entamoeba invadens
IAANCGKRLLGIDADGVKKFTNYG

SEQ ID NO: 2941853 - protein, 24 aa, Entamoeba invadens
IAANELYITIGIALDAQRVDVIKR

SEQ ID NO: 2941854 - protein, 23 aa, Entamoeba invadens
IAANEVDYLLAYMAGKLPGGADL

SEQ ID NO: 2941855 - protein, 18 aa, Entamoeba invadens
IAATSCSVERSFSQLSRV

SEQ ID NO: 2941856 - protein, 20 aa, Entamoeba invadens
IAAVKRNIWKRLLHINEEQF

SEQ ID NO: 2941857 - protein, 27 aa, Entamoeba invadens
IAAYCPFLSNIELRMCTQITDNGVDLL

SEQ ID NO: 2941858 - protein, 17 aa, Entamoeba invadens
IACFFSRENNMSSFSDP

SEQ ID NO: 2941859 - protein, 17 aa, Entamoeba invadens
IACGCCSSVCPVGAIIF

SEQ ID NO: 2941860 - protein, 17 aa, Entamoeba invadens
IACLSSLHALSTLDVSN

SEQ ID NO: 2941861 - protein, 29 aa, Entamoeba invadens
IADDAEQLFSCAFSGTKLRNLKLPNKSII

SEQ ID NO: 2941862 - protein, 25 aa, Entamoeba invadens
IADFAISFYTLFCEMVGPFLLYEIE

SEQ ID NO: 2941863 - protein, 20 aa, Entamoeba invadens
IADIELEFSRTQVNKATMHH

SEQ ID NO: 2941864 - protein, 20 aa, Entamoeba invadens
IADIWSCGVVLYVMAFGLMP

SEQ ID NO: 2941865 - protein, 20 aa, Entamoeba invadens
IADLGKFVGRCMGEQLHQYY

SEQ ID NO: 2941866 - protein, 19 aa, Entamoeba invadens
IADYGFCRSINGNTERGLV

SEQ ID NO: 2941867 - protein, 17 aa, Entamoeba invadens
IAEEWKVSFFETSAKSR

SEQ ID NO: 2941868 - protein, 24 aa, Entamoeba invadens
IAEGCTGLQGFFIYNSVGGGTGSG

SEQ ID NO: 2941869 - protein, 17 aa, Entamoeba invadens
IAEIKAIMPGAVVVTPK

SEQ ID NO: 2941870 - protein, 26 aa, Entamoeba invadens
IAEILKGQCGLCFTKLSKDELMKYFK

SEQ ID NO: 2941871 - protein, 22 aa, Entamoeba invadens
IAEITFRAVTFEKKVQMAEQEN

SEQ ID NO: 2941872 - protein, 17 aa, Entamoeba invadens
IAEKVYLETVPAFRYEL

SEQ ID NO: 2941873 - protein, 17 aa, Entamoeba invadens
IAEKYMAVYRNLVKNLP

SEQ ID NO: 2941874 - protein, 22 aa, Entamoeba invadens
IAELKPHKSGVVGINKLNQIYF

SEQ ID NO: 2941875 - protein, 19 aa, Entamoeba invadens
IAELTIFGPIDFDYLPTTI

SEQ ID NO: 2941876 - protein, 19 aa, Entamoeba invadens
IAENILLGVFPKINCFDDD

SEQ ID NO: 2941877 - protein, 26 aa, Entamoeba invadens
IAEPVKDKRAFLFTLRTKDEIGETTE

SEQ ID NO: 2941878 - protein, 19 aa, Entamoeba invadens
IAEQFIWFMEQAVKSFLAL

SEQ ID NO: 2941879 - protein, 18 aa, Entamoeba invadens
IAESILFTLIVFGKEKYF

SEQ ID NO: 2941880 - protein, 25 aa, Entamoeba invadens
IAEYFFDKRMFQLLHEIINAVLSSP

SEQ ID NO: 2941881 - protein, 32 aa, Entamoeba invadens
IAFGMKEWAEELGATCFTHWFQPLSSSTARKY

SEQ ID NO: 2941882 - protein, 31 aa, Entamoeba invadens
IAFIKAVTFFACVRLSELVLPLSLFSIQDNA

SEQ ID NO: 2941883 - protein, 20 aa, Entamoeba invadens
IAFPCTLIKLDKACFSSCTD

SEQ ID NO: 2941884 - protein, 31 aa, Entamoeba invadens
IAFSEQFMKSLPLLWKNIYRNNLGLCERPSF

SEQ ID NO: 2941885 - protein, 18 aa, Entamoeba invadens
IAGDCIFSVISGKNVFYI

SEQ ID NO: 2941886 - protein, 18 aa, Entamoeba invadens
IAGDCIFSVISGKSVFYI

SEQ ID NO: 2941887 - protein, 26 aa, Entamoeba invadens
IAGDLPRLLKHLSIVRKVGQDISCLF

SEQ ID NO: 2941888 - protein, 21 aa, Entamoeba invadens
IAGGVIKLVLKTTGATGNKMR

SEQ ID NO: 2941889 - protein, 21 aa, Entamoeba invadens
IAGGVTYRPTDKVTIGANGKY

SEQ ID NO: 2941890 - protein, 17 aa, Entamoeba invadens
IAGIKGWNKKIEITAKV

SEQ ID NO: 2941891 - protein, 18 aa, Entamoeba invadens
IAGKDGKIKFSIENATHT

SEQ ID NO: 2941892 - protein, 17 aa, Entamoeba invadens
IAGKPAFSRYGSDVELA

SEQ ID NO: 2941893 - protein, 19 aa, Entamoeba invadens
IAGMSSVLEVGDWKLQNDM

SEQ ID NO: 2941894 - protein, 23 aa, Entamoeba invadens
IAGSMLKGAIRLVSKCGANNVER

SEQ ID NO: 2941895 - protein, 17 aa, Entamoeba invadens
IAGTFVLLEEVLGIERI

SEQ ID NO: 2941896 - protein, 26 aa, Entamoeba invadens
IAGYLGRGSARAMSGDLKRALTDFDK

SEQ ID NO: 2941897 - protein, 19 aa, Entamoeba invadens
IAHDEITKVLGIVTDPFLE

SEQ ID NO: 2941898 - protein, 17 aa, Entamoeba invadens
IAHVLKGILSGLFYLHS

SEQ ID NO: 2941899 - protein, 26 aa, Entamoeba invadens
IAHYCKKCGYPFIQLDGSVPAQKRTQ

SEQ ID NO: 2941900 - protein, 17 aa, Entamoeba invadens
IAIEEGKPMALMTSYNK

SEQ ID NO: 2941901 - protein, 17 aa, Entamoeba invadens
IAIIKLFTYLVELNVDL

SEQ ID NO: 2941902 - protein, 24 aa, Entamoeba invadens
IAILCGEYLFGVVVTKPVQIYGDC

SEQ ID NO: 2941903 - protein, 17 aa, Entamoeba invadens
IAKDFFVEKKPENVDET

SEQ ID NO: 2941904 - protein, 26 aa, Entamoeba invadens
IAKDFLMKMSFSFDSDFPLEDMVGKT

SEQ ID NO: 2941905 - protein, 17 aa, Entamoeba invadens
IAKDMGKHLIVGIYDDE

SEQ ID NO: 2941906 - protein, 22 aa, Entamoeba invadens
IAKELADKLAREEAERLEKERL

SEQ ID NO: 2941907 - protein, 25 aa, Entamoeba invadens
IAKFWPGALTIIFPRAKGVPDEVTA

SEQ ID NO: 2941908 - protein, 23 aa, Entamoeba invadens
IAKGDYYGLLGLGTVRYEATEDD

SEQ ID NO: 2941909 - protein, 24 aa, Entamoeba invadens
IAKGIELFKIRYMMIYKYSEDKMV

SEQ ID NO: 2941910 - protein, 25 aa, Entamoeba invadens
IAKGKFMTCCMMYRGDVAPHDVSLA

SEQ ID NO: 2941911 - protein, 21 aa, Entamoeba invadens
IAKHKTLKTVVLILTCTNALE

SEQ ID NO: 2941912 - protein, 21 aa, Entamoeba invadens
IAKIPSFEFNLQIEKTVRHQI

SEQ ID NO: 2941913 - protein, 18 aa, Entamoeba invadens
IAKISLKQFRVEYTTTQY

SEQ ID NO: 2941914 - protein, 25 aa, Entamoeba invadens
IAKKECYSRNPSKFDGVDDMSQLTQ

SEQ ID NO: 2941915 - protein, 17 aa, Entamoeba invadens
IAKKRVLEEKKEMTKKV

SEQ ID NO: 2941916 - protein, 34 aa, Entamoeba invadens
IAKKYKPTLLVAVPRFYEKLLVRLNEVLKTSKLA

SEQ ID NO: 2941917 - protein, 19 aa, Entamoeba invadens
IAKLKAKYETELEGIETEK

SEQ ID NO: 2941918 - protein, 22 aa, Entamoeba invadens
IAKLPVLLLYKVKVKVEDRRLT

SEQ ID NO: 2941919 - protein, 17 aa, Entamoeba invadens
IAKMKGMAERAKAEEER

SEQ ID NO: 2941920 - protein, 19 aa, Entamoeba invadens
IAKSRAKTISRNRMTITGY

SEQ ID NO: 2941921 - protein, 18 aa, Entamoeba invadens
IAKTTIKRPEQHSNDTTN

SEQ ID NO: 2941922 - protein, 21 aa, Entamoeba invadens
IAKYGKKFLIGYQEGKEYHLG

SEQ ID NO: 2941923 - protein, 17 aa, Entamoeba invadens
IAKYTAFVKKMIGVDVN

SEQ ID NO: 2941924 - protein, 33 aa, Entamoeba invadens
IALANEYHWQYPLGEFVRYCIQNDIDPALEMIR

SEQ ID NO: 2941925 - protein, 17 aa, Entamoeba invadens
IALEMKADVDFRIFLDI

SEQ ID NO: 2941926 - protein, 19 aa, Entamoeba invadens
IALFNCAKDLLVYQDPLDV

SEQ ID NO: 2941927 - protein, 21 aa, Entamoeba invadens
IALGDGCGWGTKSSIAARQAV

SEQ ID NO: 2941928 - protein, 24 aa, Entamoeba invadens
IALHRPELKYMLSLDSTSITVLIY

SEQ ID NO: 2941929 - protein, 21 aa, Entamoeba invadens
IALKLIPHAQFTFKKVWVAFA

SEQ ID NO: 2941930 - protein, 21 aa, Entamoeba invadens
IALKNLCEYHVNIHFGKFFEF

SEQ ID NO: 2941931 - protein, 24 aa, Entamoeba invadens
IALKVLRPLLSVPLPSMATYRLAV

SEQ ID NO: 2941932 - protein, 19 aa, Entamoeba invadens
IALSLVGGFVFLRLFCPAM

SEQ ID NO: 2941933 - protein, 19 aa, Entamoeba invadens
IAMERRSIFMFGHNLERGE

SEQ ID NO: 2941934 - protein, 26 aa, Entamoeba invadens
IAMIFTCVSLICVKKKIGELAEFVWR

SEQ ID NO: 2941935 - protein, 19 aa, Entamoeba invadens
IAMNRCCMRPMAPPRDVII

SEQ ID NO: 2941936 - protein, 31 aa, Entamoeba invadens
IAMYKDGFCFRLFPIDFVRFNIVSKTKAFYF

SEQ ID NO: 2941937 - protein, 23 aa, Entamoeba invadens
IANELKQGFFASCYKKMDGFILM

SEQ ID NO: 2941938 - protein, 20 aa, Entamoeba invadens
IANGRLIIEIVINILGLNDT

SEQ ID NO: 2941939 - protein, 18 aa, Entamoeba invadens
IANLCNKVSNGFTLNQFD

SEQ ID NO: 2941940 - protein, 18 aa, Entamoeba invadens
IANLPAVVKRCLQNKKAI

SEQ ID NO: 2941941 - protein, 24 aa, Entamoeba invadens
IANNCFYHNEFLKSVNIPNGVTSI

SEQ ID NO: 2941942 - protein, 17 aa, Entamoeba invadens
IANSTYKFDNFRVSPNL

SEQ ID NO: 2941943 - protein, 22 aa, Entamoeba invadens
IANSVFGYDVVDKFYSYQTTFK

SEQ ID NO: 2941944 - protein, 23 aa, Entamoeba invadens
IAPLGEECVVLILLIKSAGAESI

SEQ ID NO: 2941945 - protein, 22 aa, Entamoeba invadens
IAPNCKYCAIKGNFDLENISFN

SEQ ID NO: 2941946 - protein, 25 aa, Entamoeba invadens
IAPQDNLFCSAIVHFTSDDALNKFN

SEQ ID NO: 2941947 - protein, 17 aa, Entamoeba invadens
IAQEIHSSEILVFNLIN

SEQ ID NO: 2941948 - protein, 17 aa, Entamoeba invadens
IAQHYGIQFVIIKTLME

SEQ ID NO: 2941949 - protein, 24 aa, Entamoeba invadens
IAQIFCALNEDFIKNAEYLPDFVR

SEQ ID NO: 2941950 - protein, 18 aa, Entamoeba invadens
IAQLISMIETMRVEAKKL

SEQ ID NO: 2941951 - protein, 23 aa, Entamoeba invadens
IAQMPFICRKFHSALVSQNGNLI

SEQ ID NO: 2941952 - protein, 19 aa, Entamoeba invadens
IAQNDFLRKYESFITDDDP

SEQ ID NO: 2941953 - protein, 19 aa, Entamoeba invadens
IAQRIGVSTLDWDVTLCRI

SEQ ID NO: 2941954 - protein, 24 aa, Entamoeba invadens
IAQYRKSMKVEYLYSVQRNFLKTF

SEQ ID NO: 2941955 - protein, 19 aa, Entamoeba invadens
IARALCNEPELLLMDEPTG

SEQ ID NO: 2941956 - protein, 21 aa, Entamoeba invadens
IARATELFLIDLIKKTNAIAE

SEQ ID NO: 2941957 - protein, 17 aa, Entamoeba invadens
IARELRTLFISNSAAAN

SEQ ID NO: 2941958 - protein, 20 aa, Entamoeba invadens
IARFFRVVIVDALFIGYGLT

SEQ ID NO: 2941959 - protein, 19 aa, Entamoeba invadens
IARIERPDGTIVWDENDKN

SEQ ID NO: 2941960 - protein, 20 aa, Entamoeba invadens
IARLFFFLRTIDDAINLVLV

SEQ ID NO: 2941961 - protein, 28 aa, Entamoeba invadens
IARPIMSSLLLCYTLYLDTVNDKWLQIR

SEQ ID NO: 2941962 - protein, 26 aa, Entamoeba invadens
IASDLHCLFCEVSALTGQSINECFVK

SEQ ID NO: 2941963 - protein, 26 aa, Entamoeba invadens
IASEQDIKSYLSLRRAIIEGKSYDNI

SEQ ID NO: 2941964 - protein, 35 aa, Entamoeba invadens
IASFKRGGVVIRMIDNRMRIYISINDAQVFMNEYH

SEQ ID NO: 2941965 - protein, 17 aa, Entamoeba invadens
IASFRRAGMVSRLTNNR

SEQ ID NO: 2941966 - protein, 18 aa, Entamoeba invadens
IASKCKTMSAGPKMEYVW

SEQ ID NO: 2941967 - protein, 18 aa, Entamoeba invadens
IASSGRKEHISAYLSKWD

SEQ ID NO: 2941968 - protein, 26 aa, Entamoeba invadens
IASTVFRYFIELAVKISKGPSLMTPN

SEQ ID NO: 2941969 - protein, 24 aa, Entamoeba invadens
IASYIFMYPIFKGYKFYGRFDNHV

SEQ ID NO: 2941970 - protein, 23 aa, Entamoeba invadens
IASYKRSGVVGVNIDKIKRRFVS

SEQ ID NO: 2941971 - protein, 24 aa, Entamoeba invadens
IASYKRSGVVGVNIGKIKRMFFSI

SEQ ID NO: 2941972 - protein, 25 aa, Entamoeba invadens
IASYKRSGVVGVNIGKIKRMFVSIK

SEQ ID NO: 2941973 - protein, 17 aa, Entamoeba invadens
IATDVAKGLGVIHKMGY

SEQ ID NO: 2941974 - protein, 17 aa, Entamoeba invadens
IATFTTDVSFNMKTVVF

SEQ ID NO: 2941975 - protein, 23 aa, Entamoeba invadens
IATHLKYGVKMNGSIRRVVVPLF

SEQ ID NO: 2941976 - protein, 23 aa, Entamoeba invadens
IATKYKFGVLYAAAGQTTEDEFF

SEQ ID NO: 2941977 - protein, 23 aa, Entamoeba invadens
IATLPPERSIRMLQRCPTTEIIS

SEQ ID NO: 2941978 - protein, 23 aa, Entamoeba invadens
IATMKIGGVTYRLTKGAKPHFLE

SEQ ID NO: 2941979 - protein, 20 aa, Entamoeba invadens
IATQQMKIIFQGLAGLQALK

SEQ ID NO: 2941980 - protein, 19 aa, Entamoeba invadens
IAVEPLENLYCLNNLVQNI

SEQ ID NO: 2941981 - protein, 18 aa, Entamoeba invadens
IAVGSTLQLPDCSSTCKI

SEQ ID NO: 2941982 - protein, 17 aa, Entamoeba invadens
IAVGTLVGFYVFTVGDQ

SEQ ID NO: 2941983 - protein, 25 aa, Entamoeba invadens
IAVIKEFFTKMGLPDVKFKPAYNPY

SEQ ID NO: 2941984 - protein, 23 aa, Entamoeba invadens
IAVISCLSFLAGVPNLEILEKHK

SEQ ID NO: 2941985 - protein, 24 aa, Entamoeba invadens
IAVKHTCKVLYGFVTRNPSIYKQI

SEQ ID NO: 2941986 - protein, 23 aa, Entamoeba invadens
IAVKSLRVNPWFSSSSDIEKFHY

SEQ ID NO: 2941987 - protein, 20 aa, Entamoeba invadens
IAVLKLCVFNDVKLSGDEIA

SEQ ID NO: 2941988 - protein, 21 aa, Entamoeba invadens
IAVSCPKAFGPLGTDALKVVF

SEQ ID NO: 2941989 - protein, 17 aa, Entamoeba invadens
IAVSINPHGPWCLIPTD

SEQ ID NO: 2941990 - protein, 18 aa, Entamoeba invadens
IAVTWEVLASLGQLRYAQ

SEQ ID NO: 2941991 - protein, 28 aa, Entamoeba invadens
IAVYCLKDTYLPIRLIKKLMSLVNGVEM

SEQ ID NO: 2941992 - protein, 20 aa, Entamoeba invadens
IAWNDVMLQYALKRLEDRDF

SEQ ID NO: 2941993 - protein, 22 aa, Entamoeba invadens
IAWNVLPPDVFMKLFRQDIAVA

SEQ ID NO: 2941994 - protein, 17 aa, Entamoeba invadens
IAYSGIGLVRSYKEIEF

SEQ ID NO: 2941995 - protein, 23 aa, Entamoeba invadens
ICAAYSYELAKYGITLGLTNYAA

SEQ ID NO: 2941996 - protein, 19 aa, Entamoeba invadens
ICAESPFLQPEEMIKIGFV

SEQ ID NO: 2941997 - protein, 20 aa, Entamoeba invadens
ICAICKYLAEEIYKKTNELS

SEQ ID NO: 2941998 - protein, 21 aa, Entamoeba invadens
ICAQLKFSQFDKIVRGEKDFG

SEQ ID NO: 2941999 - protein, 18 aa, Entamoeba invadens
ICCIVQCLAIDKTSGKKL

SEQ ID NO: 2942000 - protein, 18 aa, Entamoeba invadens
ICCKHALSQVVNVFKAER

SEQ ID NO: 2942001 - protein, 24 aa, Entamoeba invadens
ICCVKGFQFKFFMSYIDLDLTKKD

SEQ ID NO: 2942002 - protein, 22 aa, Entamoeba invadens
ICDCKQNAFDYGGSTKNIVGDV

SEQ ID NO: 2942003 - protein, 19 aa, Entamoeba invadens
ICDFAPFKPFYLPDDNPYD

SEQ ID NO: 2942004 - protein, 26 aa, Entamoeba invadens
ICDGISSGNIHMCGDLPNILRNKFNV

SEQ ID NO: 2942005 - protein, 19 aa, Entamoeba invadens
ICDGLACDLLWSDPDDNVS

SEQ ID NO: 2942006 - protein, 28 aa, Entamoeba invadens
ICDGNLKLILGLLWTLILKYQISKNKMD

SEQ ID NO: 2942007 - protein, 18 aa, Entamoeba invadens
ICDKGEYKSGLMVISEDT

SEQ ID NO: 2942008 - protein, 19 aa, Entamoeba invadens
ICDLWDCAHVLATQTVPQN

SEQ ID NO: 2942009 - protein, 22 aa, Entamoeba invadens
ICDSDASPGMGIFAEKTSQNTL

SEQ ID NO: 2942010 - protein, 18 aa, Entamoeba invadens
ICDSLEITALAKVWQENE

SEQ ID NO: 2942011 - protein, 26 aa, Entamoeba invadens
ICDTVLYTVGYRFMGNIPKFELVLTL

SEQ ID NO: 2942012 - protein, 19 aa, Entamoeba invadens
ICEELKILPVDIGTLNPTT

SEQ ID NO: 2942013 - protein, 33 aa, Entamoeba invadens
ICEENCLTFSKSIKRVLAVLSDVTSLCKLVKAK

SEQ ID NO: 2942014 - protein, 17 aa, Entamoeba invadens
ICEHVKNAPTNVLNNIY

SEQ ID NO: 2942015 - protein, 18 aa, Entamoeba invadens
ICEIGDFCFKDHTIRTPT

SEQ ID NO: 2942016 - protein, 19 aa, Entamoeba invadens
ICEIGDFCFKDHTIWTPTQ

SEQ ID NO: 2942017 - protein, 18 aa, Entamoeba invadens
ICELCGSSSQRLEIVVKK

SEQ ID NO: 2942018 - protein, 19 aa, Entamoeba invadens
ICFCGCTSLEITILKSKEY

SEQ ID NO: 2942019 - protein, 25 aa, Entamoeba invadens
ICFDATFQCTFDWFEQMSSLRVISL

SEQ ID NO: 2942020 - protein, 17 aa, Entamoeba invadens
ICFTQSDSFVFGKIFRE

SEQ ID NO: 2942021 - protein, 17 aa, Entamoeba invadens
ICGESVVAFLDGNKKKV

SEQ ID NO: 2942022 - protein, 18 aa, Entamoeba invadens
ICGGGDYERSPLVITTTP

SEQ ID NO: 2942023 - protein, 17 aa, Entamoeba invadens
ICGHFFMSCDIKNIDLG

SEQ ID NO: 2942024 - protein, 18 aa, Entamoeba invadens
ICGLGNYCFAWCSYLTSV

SEQ ID NO: 2942025 - protein, 18 aa, Entamoeba invadens
ICGMNFPPEQIGAIFDAI

SEQ ID NO: 2942026 - protein, 18 aa, Entamoeba invadens
ICGNKCDLELNRIVTTDK

SEQ ID NO: 2942027 - protein, 22 aa, Entamoeba invadens
ICGTKADLPCVVDENIIDKFIC

SEQ ID NO: 2942028 - protein, 17 aa, Entamoeba invadens
ICHFVKYSKTDREKYGN

SEQ ID NO: 2942029 - protein, 17 aa, Entamoeba invadens
ICHFVKYTKTDREKCGN

SEQ ID NO: 2942030 - protein, 17 aa, Entamoeba invadens
ICHPRAILEITTLIRRI

SEQ ID NO: 2942031 - protein, 23 aa, Entamoeba invadens
ICHQRYEFDPAYWGNKSPEVKDL

SEQ ID NO: 2942032 - protein, 21 aa, Entamoeba invadens
ICHVPKCTPENLAEAEAKREK

SEQ ID NO: 2942033 - protein, 22 aa, Entamoeba invadens
ICIDMAEGLLFLQEHAITHGGL

SEQ ID NO: 2942034 - protein, 20 aa, Entamoeba invadens
ICIEYSRYQTIFSLYKSIGK

SEQ ID NO: 2942035 - protein, 26 aa, Entamoeba invadens
ICIKCGKCAKACPYTAIIKKTIPCMA

SEQ ID NO: 2942036 - protein, 22 aa, Entamoeba invadens
ICINAFKCSEWETSIFEFLNLE

SEQ ID NO: 2942037 - protein, 17 aa, Entamoeba invadens
ICIPTSVTFISWNFTYC

SEQ ID NO: 2942038 - protein, 23 aa, Entamoeba invadens
ICISDDFGSFSLFGIGPNLATSY

SEQ ID NO: 2942039 - protein, 23 aa, Entamoeba invadens
ICITIPDSVGFLKLMEVNKTDDM

SEQ ID NO: 2942040 - protein, 20 aa, Entamoeba invadens
ICIVRSIFDLFFGYCDGQKF

SEQ ID NO: 2942041 - protein, 25 aa, Entamoeba invadens
ICKDILKRLRRVLSSKPDEHHFQTY

SEQ ID NO: 2942042 - protein, 19 aa, Entamoeba invadens
ICKDRRTADDMALSLQTLK

SEQ ID NO: 2942043 - protein, 23 aa, Entamoeba invadens
ICKRARIAKTNAYLVSYLRDQMP

SEQ ID NO: 2942044 - protein, 17 aa, Entamoeba invadens
ICLEKGYFFNSRLARKS

SEQ ID NO: 2942045 - protein, 20 aa, Entamoeba invadens
ICLIQKIDILNFFTIENYCG

SEQ ID NO: 2942046 - protein, 25 aa, Entamoeba invadens
ICLKETEKMFSLLFPHSKVIRITAT

SEQ ID NO: 2942047 - protein, 21 aa, Entamoeba invadens
ICLLSPFCKITLKKPSRRSSV

SEQ ID NO: 2942048 - protein, 21 aa, Entamoeba invadens
ICLVGDMSVGKTCVVNRLVKD

SEQ ID NO: 2942049 - protein, 18 aa, Entamoeba invadens
ICLVTEFAEYGSLQDLMK

SEQ ID NO: 2942050 - protein, 17 aa, Entamoeba invadens
ICMGAVLRGINFTDASY

SEQ ID NO: 2942051 - protein, 17 aa, Entamoeba invadens
ICMVTEFAHYGSLQNLM

SEQ ID NO: 2942052 - protein, 17 aa, Entamoeba invadens
ICNIGLYSRSGVCFSCE

SEQ ID NO: 2942053 - protein, 19 aa, Entamoeba invadens
ICNNCFYQCQSLCCVTVPS

SEQ ID NO: 2942054 - protein, 23 aa, Entamoeba invadens
ICNNCIHKSPSPERLINCTTTVS

SEQ ID NO: 2942055 - protein, 17 aa, Entamoeba invadens
ICNSGLLTINTTGFRKM

SEQ ID NO: 2942056 - protein, 23 aa, Entamoeba invadens
ICNYSLLGKTCMLIRFSQNSFDT

SEQ ID NO: 2942057 - protein, 18 aa, Entamoeba invadens
ICPICYDQTCDIVLDCGH

SEQ ID NO: 2942058 - protein, 24 aa, Entamoeba invadens
ICPLTKRRFVEPYKSKVCGHIFSK

SEQ ID NO: 2942059 - protein, 17 aa, Entamoeba invadens
ICQWTNLAMSDIIYDSA

SEQ ID NO: 2942060 - protein, 19 aa, Entamoeba invadens
ICRKYSRFVQNEFFSYESK

SEQ ID NO: 2942061 - protein, 18 aa, Entamoeba invadens
ICSFVRQLNIYGFRKLET

SEQ ID NO: 2942062 - protein, 18 aa, Entamoeba invadens
ICSRYYRAPELIFGATKY

SEQ ID NO: 2942063 - protein, 21 aa, Entamoeba invadens
ICSSPSLPSINTFHGLVPQID

SEQ ID NO: 2942064 - protein, 17 aa, Entamoeba invadens
ICTAADMSMGFDLNEFD

SEQ ID NO: 2942065 - protein, 22 aa, Entamoeba invadens
ICTLCVNGFVLNDDRECISSDN

SEQ ID NO: 2942066 - protein, 17 aa, Entamoeba invadens
ICTLGDSTFESCVALNV

SEQ ID NO: 2942067 - protein, 17 aa, Entamoeba invadens
ICTNCTKGVLDFNGNCI

SEQ ID NO: 2942068 - protein, 23 aa, Entamoeba invadens
ICTSLDHFTFCFVEKKCYSDNEE

SEQ ID NO: 2942069 - protein, 19 aa, Entamoeba invadens
ICVHYELTHATLLMQYPRQ

SEQ ID NO: 2942070 - protein, 17 aa, Entamoeba invadens
ICVKGELAFMTEGLKNE

SEQ ID NO: 2942071 - protein, 25 aa, Entamoeba invadens
ICVLYEVLRYTIGIYGVIGLTPKNL

SEQ ID NO: 2942072 - protein, 18 aa, Entamoeba invadens
ICVNDFIAVDYTSSSVVV

SEQ ID NO: 2942073 - protein, 19 aa, Entamoeba invadens
ICVYENMGFTANIYGNSHN

SEQ ID NO: 2942074 - protein, 29 aa, Entamoeba invadens
ICYEEGKMLSLGCGHYFCSNCWNERISTL

SEQ ID NO: 2942075 - protein, 23 aa, Entamoeba invadens
ICYEIGRHLICLISSKERLLDTI

SEQ ID NO: 2942076 - protein, 17 aa, Entamoeba invadens
ICYPVALNKAVRFKENK

SEQ ID NO: 2942077 - protein, 19 aa, Entamoeba invadens
ICYTDLYSPKCAVCGKSLC

SEQ ID NO: 2942078 - protein, 18 aa, Entamoeba invadens
ICYTKFYGIFQILIFIFS

SEQ ID NO: 2942079 - protein, 26 aa, Entamoeba invadens
IDAEMCLNESLALKADFDFQEQLIAL

SEQ ID NO: 2942080 - protein, 23 aa, Entamoeba invadens
IDAEMLFNVPFSSYLVDTEQLNK

SEQ ID NO: 2942081 - protein, 18 aa, Entamoeba invadens
IDAEWCDPETGMANVEHP

SEQ ID NO: 2942082 - protein, 20 aa, Entamoeba invadens
IDAIDCFGETLVPDQMGNWI

SEQ ID NO: 2942083 - protein, 17 aa, Entamoeba invadens
IDAINMFSGGINFHSKR

SEQ ID NO: 2942084 - protein, 29 aa, Entamoeba invadens
IDAIPPTKRWGALIPIGFITPEADCPVTN

SEQ ID NO: 2942085 - protein, 18 aa, Entamoeba invadens
IDAKNCGIQTKFKENCVV

SEQ ID NO: 2942086 - protein, 17 aa, Entamoeba invadens
IDAKPFVFRKKTTEKIE

SEQ ID NO: 2942087 - protein, 27 aa, Entamoeba invadens
IDAKYKYLQLCMTLRSYGMNIYAGGIE

SEQ ID NO: 2942088 - protein, 18 aa, Entamoeba invadens
IDAQRMLTGFGVSLQTAK

SEQ ID NO: 2942089 - protein, 23 aa, Entamoeba invadens
IDARAACWMKEMFDEKNLEIVKF

SEQ ID NO: 2942090 - protein, 23 aa, Entamoeba invadens
IDARALDNFDFLKVHKKLFKLPK

SEQ ID NO: 2942091 - protein, 22 aa, Entamoeba invadens
IDARVGAMNFVRSSMQFRAKLF

SEQ ID NO: 2942092 - protein, 19 aa, Entamoeba invadens
IDASICSENSMGFLPNIMS

SEQ ID NO: 2942093 - protein, 19 aa, Entamoeba invadens
IDASRSFSCQTMFDYHNKS

SEQ ID NO: 2942094 - protein, 26 aa, Entamoeba invadens
IDASVLSGKFTHTWPPVTSEGNLHDD

SEQ ID NO: 2942095 - protein, 22 aa, Entamoeba invadens
IDAVIVLENFKTIKINQGEEKF

SEQ ID NO: 2942096 - protein, 23 aa, Entamoeba invadens
IDAVPELVWKGSVTFTEQGQLCI

SEQ ID NO: 2942097 - protein, 18 aa, Entamoeba invadens
IDCGAFVFCSSLKGLEIP

SEQ ID NO: 2942098 - protein, 24 aa, Entamoeba invadens
IDCGGDITPAMNFVRSKGLQTCTE

SEQ ID NO: 2942099 - protein, 23 aa, Entamoeba invadens
IDCKVMKEFLTTLLSHLTNKPKI

SEQ ID NO: 2942100 - protein, 19 aa, Entamoeba invadens
IDCNKFDTFSFKQCNNTIF

SEQ ID NO: 2942101 - protein, 20 aa, Entamoeba invadens
IDDACFSECYVLEQINIPKN

SEQ ID NO: 2942102 - protein, 24 aa, Entamoeba invadens
IDDCLDLGGGVGRVTKDVLSRYFK

SEQ ID NO: 2942103 - protein, 17 aa, Entamoeba invadens
IDDELFGKVRNFYKRDQ

SEQ ID NO: 2942104 - protein, 24 aa, Entamoeba invadens
IDDFAADVRLTFKNAMKYNPPRNM

SEQ ID NO: 2942105 - protein, 17 aa, Entamoeba invadens
IDDFCFKECTALSSIEF

SEQ ID NO: 2942106 - protein, 22 aa, Entamoeba invadens
IDDGCFCRCRSLSSVTIPSSVK

SEQ ID NO: 2942107 - protein, 19 aa, Entamoeba invadens
IDDKCLKRGIKDTMKTATT

SEQ ID NO: 2942108 - protein, 25 aa, Entamoeba invadens
IDDKLKNRFGCVITEKVEREATWVA

SEQ ID NO: 2942109 - protein, 23 aa, Entamoeba invadens
IDDLDFLPSNPFVPTEDSKDSKE

SEQ ID NO: 2942110 - protein, 21 aa, Entamoeba invadens
IDDNEFLKMCCDQFGCRCLQK

SEQ ID NO: 2942111 - protein, 19 aa, Entamoeba invadens
IDDPSWNDFDRLMANVERK

SEQ ID NO: 2942112 - protein, 25 aa, Entamoeba invadens
IDDQEFKPLCSMPKGDEIFKQLIEF

SEQ ID NO: 2942113 - protein, 18 aa, Entamoeba invadens
IDDTESFLQYIIAKNDKL

SEQ ID NO: 2942114 - protein, 19 aa, Entamoeba invadens
IDDTYPLVYKMLTHMGKKG

SEQ ID NO: 2942115 - protein, 26 aa, Entamoeba invadens
IDDVKEGFIPQEYVEMARTSNIAINL

SEQ ID NO: 2942116 - protein, 20 aa, Entamoeba invadens
IDEDISFKVFINTGGIPKLC

SEQ ID NO: 2942117 - protein, 17 aa, Entamoeba invadens
IDEGCFFNNTELTKIEI

SEQ ID NO: 2942118 - protein, 25 aa, Entamoeba invadens
IDEGCFYKCCRLNIVTISFGVKSIG

SEQ ID NO: 2942119 - protein, 25 aa, Entamoeba invadens
IDEKDLQECFYYFDTNGDNMLTAEQ

SEQ ID NO: 2942120 - protein, 19 aa, Entamoeba invadens
IDEKIVFHRQVILLVQTET

SEQ ID NO: 2942121 - protein, 18 aa, Entamoeba invadens
IDELRLFQCFSREEDVMV

SEQ ID NO: 2942122 - protein, 22 aa, Entamoeba invadens
IDELRLFQCFSREEDVMVRDEF

SEQ ID NO: 2942123 - protein, 23 aa, Entamoeba invadens
IDENGALKALGCYKKNNEKINDW

SEQ ID NO: 2942124 - protein, 21 aa, Entamoeba invadens
IDENLLLCFKKRVLENKNIHR

SEQ ID NO: 2942125 - protein, 21 aa, Entamoeba invadens
IDENYRVTGILNIEERIDETL

SEQ ID NO: 2942126 - protein, 22 aa, Entamoeba invadens
IDESIPCFEKWTSVHGKVVLLY

SEQ ID NO: 2942127 - protein, 20 aa, Entamoeba invadens
IDEYLKRISTVVVKSDDFEK

SEQ ID NO: 2942128 - protein, 23 aa, Entamoeba invadens
IDFADHLARAVVIIGAPYQQTSP

SEQ ID NO: 2942129 - protein, 17 aa, Entamoeba invadens
IDFCELKQIKVNSGVTA

SEQ ID NO: 2942130 - protein, 22 aa, Entamoeba invadens
IDFFKIVVWYPVNFRLANKHNK

SEQ ID NO: 2942131 - protein, 23 aa, Entamoeba invadens
IDFFRINIWFGVEYTFAQLHSDT

SEQ ID NO: 2942132 - protein, 24 aa, Entamoeba invadens
IDFGDNLARVVIIVGIPYPNLGDL

SEQ ID NO: 2942133 - protein, 18 aa, Entamoeba invadens
IDFGFVINLRPKFDANRF

SEQ ID NO: 2942134 - protein, 20 aa, Entamoeba invadens
IDFHCAVTLLLLITQTPPLS

SEQ ID NO: 2942135 - protein, 17 aa, Entamoeba invadens
IDFKEIVGTKCLTVNRN

SEQ ID NO: 2942136 - protein, 17 aa, Entamoeba invadens
IDFLKKSFQCVSLDLIG

SEQ ID NO: 2942137 - protein, 23 aa, Entamoeba invadens
IDFLSCSKTFLFIQFNKKNIIEK

SEQ ID NO: 2942138 - protein, 18 aa, Entamoeba invadens
IDFNWSIKNTENVEIVES

SEQ ID NO: 2942139 - protein, 20 aa, Entamoeba invadens
IDFPNPWSIAQFICSNKRLP

SEQ ID NO: 2942140 - protein, 22 aa, Entamoeba invadens
IDFQEFWGAVGDDVRKLGEQQV

SEQ ID NO: 2942141 - protein, 19 aa, Entamoeba invadens
IDFQYCYTTQFSTVPIEFS

SEQ ID NO: 2942142 - protein, 26 aa, Entamoeba invadens
IDFRMKRMEFEGMMYRLQLWDTAGQE

SEQ ID NO: 2942143 - protein, 21 aa, Entamoeba invadens
IDFSDSFCRPQLEAEYIRGLN

SEQ ID NO: 2942144 - protein, 19 aa, Entamoeba invadens
IDFSDVCYEQFKTLQKLSL

SEQ ID NO: 2942145 - protein, 30 aa, Entamoeba invadens
IDFSKFPLPSFCFNQELLIFGKFLEFKKNK

SEQ ID NO: 2942146 - protein, 21 aa, Entamoeba invadens
IDFSKNCLRVKGEEVPFLTNT

SEQ ID NO: 2942147 - protein, 33 aa, Entamoeba invadens
IDFSMEYPRPDFWAKLFNYLKKGLIDISKFTDN

SEQ ID NO: 2942148 - protein, 22 aa, Entamoeba invadens
IDFSMKRPNVFEFASIEEEMPL

SEQ ID NO: 2942149 - protein, 26 aa, Entamoeba invadens
IDFSVCFRWIVLLFKREFRREECLEL

SEQ ID NO: 2942150 - protein, 23 aa, Entamoeba invadens
IDFSVRWVELFTSYLCNELLCLL

SEQ ID NO: 2942151 - protein, 17 aa, Entamoeba invadens
IDFVIHFAALKAVGESV

SEQ ID NO: 2942152 - protein, 19 aa, Entamoeba invadens
IDGECSFTHLAMEMENFVL

SEQ ID NO: 2942153 - protein, 19 aa, Entamoeba invadens
IDGKIFRKIISLKAIPAEK

SEQ ID NO: 2942154 - protein, 20 aa, Entamoeba invadens
IDGKLPLEYALHLKLPLMVK

SEQ ID NO: 2942155 - protein, 31 aa, Entamoeba invadens
IDGKMTKKCFLGVKCQGEYFVTEQRNIVGNI

SEQ ID NO: 2942156 - protein, 17 aa, Entamoeba invadens
IDGKVCMNVALVENGLA

SEQ ID NO: 2942157 - protein, 26 aa, Entamoeba invadens
IDGLSQFFSMYTCFQSFRTGLSDLDK

SEQ ID NO: 2942158 - protein, 25 aa, Entamoeba invadens
IDGRELEMLYGLHCETCASKVNISL

SEQ ID NO: 2942159 - protein, 23 aa, Entamoeba invadens
IDGRKISVAVAFKRPEKPTEVKT

SEQ ID NO: 2942160 - protein, 25 aa, Entamoeba invadens
IDGSLELCDICLSEILKRTQLTVSD

SEQ ID NO: 2942161 - protein, 20 aa, Entamoeba invadens
IDGVCPVAKMVQQRKRRFTP

SEQ ID NO: 2942162 - protein, 17 aa, Entamoeba invadens
IDGYILIDGQCQTCQYY

SEQ ID NO: 2942163 - protein, 17 aa, Entamoeba invadens
IDGYWNVQFEIDFTEKT

SEQ ID NO: 2942164 - protein, 19 aa, Entamoeba invadens
IDHIFKYIIIGEVSVGKSC

SEQ ID NO: 2942165 - protein, 19 aa, Entamoeba invadens
IDHIFSADELEYFNAYSKE

SEQ ID NO: 2942166 - protein, 24 aa, Entamoeba invadens
IDHVGKLSAALLYEKYVDFEKANG

SEQ ID NO: 2942167 - protein, 17 aa, Entamoeba invadens
IDIDCFEFAAIKTYYLT

SEQ ID NO: 2942168 - protein, 20 aa, Entamoeba invadens
IDIDLDFPFYKTFFKGKKTT

SEQ ID NO: 2942169 - protein, 17 aa, Entamoeba invadens
IDIFKMAILNLANSDQL

SEQ ID NO: 2942170 - protein, 20 aa, Entamoeba invadens
IDIGSIVRFVLSYGSYPHDV

SEQ ID NO: 2942171 - protein, 18 aa, Entamoeba invadens
IDILNVYIVHYVRENPEV

SEQ ID NO: 2942172 - protein, 20 aa, Entamoeba invadens
IDINSWRTKHWVNYSETNST

SEQ ID NO: 2942173 - protein, 30 aa, Entamoeba invadens
IDIPHYITVIGFKCLFGNETLGGFDIPPSV

SEQ ID NO: 2942174 - protein, 23 aa, Entamoeba invadens
IDIPKCRIIEQLSVFLTNKVIYA

SEQ ID NO: 2942175 - protein, 23 aa, Entamoeba invadens
IDIPLRLSGIGANCFAQCSSLKY

SEQ ID NO: 2942176 - protein, 21 aa, Entamoeba invadens
IDIPRSVSLLGKSAFYNCKSL

SEQ ID NO: 2942177 - protein, 36 aa, Entamoeba invadens
IDIRGDKMLLGLLYLLFKKYRMAVAKIVDQSGRTLS

SEQ ID NO: 2942178 - protein, 22 aa, Entamoeba invadens
IDIRQFARLMAILNKGFGKDAK

SEQ ID NO: 2942179 - protein, 17 aa, Entamoeba invadens
IDISLAFSITPNDETKI

SEQ ID NO: 2942180 - protein, 21 aa, Entamoeba invadens
IDITPKMAFDVINELRRSNVE

SEQ ID NO: 2942181 - protein, 26 aa, Entamoeba invadens
IDIWQLGCVFLQMLLRSPPFKGHSLS

SEQ ID NO: 2942182 - protein, 23 aa, Entamoeba invadens
IDIYCFGLTCFEICAERPLTSTE

SEQ ID NO: 2942183 - protein, 24 aa, Entamoeba invadens
IDIYRSAYNYILEDFYNKFGAMKK

SEQ ID NO: 2942184 - protein, 17 aa, Entamoeba invadens
IDKFCFEKCKSLKTIEL

SEQ ID NO: 2942185 - protein, 24 aa, Entamoeba invadens
IDKGIRIPLYLPSQVDPIINCCEE

SEQ ID NO: 2942186 - protein, 24 aa, Entamoeba invadens
IDKIPQRMGIIVGQSSYIYSLTRN

SEQ ID NO: 2942187 - protein, 24 aa, Entamoeba invadens
IDKKEFLCSPLVVQSSDITNCTRC

SEQ ID NO: 2942188 - protein, 21 aa, Entamoeba invadens
IDKKRAEGMLTGKVDGTYLVR

SEQ ID NO: 2942189 - protein, 18 aa, Entamoeba invadens
IDKLCLPNKLKVTNIEDL

SEQ ID NO: 2942190 - protein, 18 aa, Entamoeba invadens
IDKQLALELSELKQKKGV

SEQ ID NO: 2942191 - protein, 19 aa, Entamoeba invadens
IDKRLKTLEEWSSMKKGYS

SEQ ID NO: 2942192 - protein, 19 aa, Entamoeba invadens
IDKSLKFAIELENQSELHE

SEQ ID NO: 2942193 - protein, 27 aa, Entamoeba invadens
IDKSLVCGRDVFLDCPNLVKFNVIEKV

SEQ ID NO: 2942194 - protein, 26 aa, Entamoeba invadens
IDKSLVCGRDVFLDCPNLVKFNVIEN

SEQ ID NO: 2942195 - protein, 26 aa, Entamoeba invadens
IDKVCTSNSLYIFGVEFFVVDSSLNT

SEQ ID NO: 2942196 - protein, 17 aa, Entamoeba invadens
IDKVRINTAYTLFYAVR

SEQ ID NO: 2942197 - protein, 23 aa, Entamoeba invadens
IDKWPNLLPTILQWTQSPNDLQK

SEQ ID NO: 2942198 - protein, 22 aa, Entamoeba invadens
IDKYRDCYEITKHTKTVIRENV

SEQ ID NO: 2942199 - protein, 26 aa, Entamoeba invadens
IDLDEYKMVCCLTEISKILRGKDAQQ

SEQ ID NO: 2942200 - protein, 21 aa, Entamoeba invadens
IDLDMKASYFDRVKKSEEKIK

SEQ ID NO: 2942201 - protein, 23 aa, Entamoeba invadens
IDLELLKKWTGMRNLRVLYDKSM

SEQ ID NO: 2942202 - protein, 17 aa, Entamoeba invadens
IDLGEGITREMNDYIIT

SEQ ID NO: 2942203 - protein, 18 aa, Entamoeba invadens
IDLICKILAKTNEEQPNK

SEQ ID NO: 2942204 - protein, 28 aa, Entamoeba invadens
IDLIKFKGACDILFRSARRRLKSENSIT

SEQ ID NO: 2942205 - protein, 25 aa, Entamoeba invadens
IDLIKFKGACDILFSDSSKDEKVTT

SEQ ID NO: 2942206 - protein, 30 aa, Entamoeba invadens
IDLIYERIYIKAVKICSFKMEGLLDYLVDS

SEQ ID NO: 2942207 - protein, 20 aa, Entamoeba invadens
IDLKECYNLKFTCDNGAAYL

SEQ ID NO: 2942208 - protein, 23 aa, Entamoeba invadens
IDLKELDKRCQLIEDIISQIEKY

SEQ ID NO: 2942209 - protein, 25 aa, Entamoeba invadens
IDLKKGITALRVFDDNILFVATRKD

SEQ ID NO: 2942210 - protein, 24 aa, Entamoeba invadens
IDLKKYFCRICLSIFHGRVSMGVF

SEQ ID NO: 2942211 - protein, 17 aa, Entamoeba invadens
IDLKLIMENKVIGYQLF

SEQ ID NO: 2942212 - protein, 25 aa, Entamoeba invadens
IDLKPLQEWSGLKGHRVLYDSQKDG

SEQ ID NO: 2942213 - protein, 18 aa, Entamoeba invadens
IDLLREIMESALPFGHRM

SEQ ID NO: 2942214 - protein, 22 aa, Entamoeba invadens
IDLLRLNGYVFNTSFSSGKHNS

SEQ ID NO: 2942215 - protein, 18 aa, Entamoeba invadens
IDLNECYKVFFNSPQGAV

SEQ ID NO: 2942216 - protein, 19 aa, Entamoeba invadens
IDLNLRVKFMLNGAEGILY

SEQ ID NO: 2942217 - protein, 19 aa, Entamoeba invadens
IDLNVSWSKNHIICPLKKI

SEQ ID NO: 2942218 - protein, 22 aa, Entamoeba invadens
IDLPNLLTLVGERWCYSLQSVT

SEQ ID NO: 2942219 - protein, 32 aa, Entamoeba invadens
IDLPRIEKITLWNCTDPNYLYMMSQLLDGKDD

SEQ ID NO: 2942220 - protein, 27 aa, Entamoeba invadens
IDLPSDFLPVFSCLCGNDFTKTFCTDT

SEQ ID NO: 2942221 - protein, 22 aa, Entamoeba invadens
IDLSIAFNCIDEVLVACSQQLT

SEQ ID NO: 2942222 - protein, 25 aa, Entamoeba invadens
IDLSKYPFYGCCQLNNIYGYSFDIP

SEQ ID NO: 2942223 - protein, 19 aa, Entamoeba invadens
IDLTELGLIRSVRGVAYST

SEQ ID NO: 2942224 - protein, 19 aa, Entamoeba invadens
IDLTKAWFVNYKKPMEVML

SEQ ID NO: 2942225 - protein, 19 aa, Entamoeba invadens
IDLTQKYGYDFTIRGTRSS

SEQ ID NO: 2942226 - protein, 17 aa, Entamoeba invadens
IDMIVKLDVTRIYMQCL

SEQ ID NO: 2942227 - protein, 22 aa, Entamoeba invadens
IDMKLRVKICLDAAKDNILVFS

SEQ ID NO: 2942228 - protein, 22 aa, Entamoeba invadens
IDMKSPRILRGEGMTNKPFSMT

SEQ ID NO: 2942229 - protein, 19 aa, Entamoeba invadens
IDMLLKMKYPVVILHAVRL

SEQ ID NO: 2942230 - protein, 23 aa, Entamoeba invadens
IDMLVPFCDIVFGRPSKRTTTTL

SEQ ID NO: 2942231 - protein, 18 aa, Entamoeba invadens
IDMMLGFWTSKGCSSPTT

SEQ ID NO: 2942232 - protein, 25 aa, Entamoeba invadens
IDMMSFFEFLKKFNVNLTEVETRKV

SEQ ID NO: 2942233 - protein, 19 aa, Entamoeba invadens
IDMRYGIFNTLKILKLAHF

SEQ ID NO: 2942234 - protein, 18 aa, Entamoeba invadens
IDMWSLGCILPELLTTEP

SEQ ID NO: 2942235 - protein, 18 aa, Entamoeba invadens
IDNFGRWVSYSIKTAEGG

SEQ ID NO: 2942236 - protein, 22 aa, Entamoeba invadens
IDNKRIISTVLIREDDINEDVI

SEQ ID NO: 2942237 - protein, 25 aa, Entamoeba invadens
IDNSIKIYNSWLFECVPDVVKTNWK

SEQ ID NO: 2942238 - protein, 22 aa, Entamoeba invadens
IDNTCYPIAFLLLPNDTEETFV

SEQ ID NO: 2942239 - protein, 27 aa, Entamoeba invadens
IDNVCLGLYCFRRFKLKNYTSLLPLQK

SEQ ID NO: 2942240 - protein, 19 aa, Entamoeba invadens
IDNVDGIVVRKKGTKDHDQ

SEQ ID NO: 2942241 - protein, 20 aa, Entamoeba invadens
IDPALLRPGRFDCLIEIPKP

SEQ ID NO: 2942242 - protein, 23 aa, Entamoeba invadens
IDPDKRYVLVYSSDLLVSIFDIQ

SEQ ID NO: 2942243 - protein, 19 aa, Entamoeba invadens
IDPEKRYSIEQIEESSFTK

SEQ ID NO: 2942244 - protein, 19 aa, Entamoeba invadens
IDPETRFNAEQCLLHEFFG

SEQ ID NO: 2942245 - protein, 18 aa, Entamoeba invadens
IDPETRWTAKQALEHPFI

SEQ ID NO: 2942246 - protein, 31 aa, Entamoeba invadens
IDPIKFIADYAYKYFLLKNVHGAVTYFIRSF

SEQ ID NO: 2942247 - protein, 33 aa, Entamoeba invadens
IDPKELLKSGGRDLELIKVMRLKNNVVNQLDGF

SEQ ID NO: 2942248 - protein, 19 aa, Entamoeba invadens
IDPKLPCEIDDDSFKDIEL

SEQ ID NO: 2942249 - protein, 22 aa, Entamoeba invadens
IDPKSCKPMSSKKVQLTQLEQL

SEQ ID NO: 2942250 - protein, 26 aa, Entamoeba invadens
IDPLKGHAWCGVPLMLEDYTTPLPEQ

SEQ ID NO: 2942251 - protein, 19 aa, Entamoeba invadens
IDPPGCKDIDDALHCKLLP

SEQ ID NO: 2942252 - protein, 21 aa, Entamoeba invadens
IDPPPIILRAGIQQKLPEKCQ

SEQ ID NO: 2942253 - protein, 22 aa, Entamoeba invadens
IDPPRGCLLYGPPGTGKTMLAK

SEQ ID NO: 2942254 - protein, 19 aa, Entamoeba invadens
IDPSIPINIVEQIGIQKTV

SEQ ID NO: 2942255 - protein, 23 aa, Entamoeba invadens
IDPTELFMVYVFLFNNNVSPSGL

SEQ ID NO: 2942256 - protein, 20 aa, Entamoeba invadens
IDPTKCDPHDALLLETISLL

SEQ ID NO: 2942257 - protein, 24 aa, Entamoeba invadens
IDPVSRSLILAGFPNVGKSSLMNV

SEQ ID NO: 2942258 - protein, 20 aa, Entamoeba invadens
IDPYFYIIRPSDLVSERLNK

SEQ ID NO: 2942259 - protein, 17 aa, Entamoeba invadens
IDQERIVGMHIIGDNQI

SEQ ID NO: 2942260 - protein, 20 aa, Entamoeba invadens
IDQFCTFGFLIKSLEEVDAF

SEQ ID NO: 2942261 - protein, 17 aa, Entamoeba invadens
IDQLRAKYKAMICTNDF

SEQ ID NO: 2942262 - protein, 24 aa, Entamoeba invadens
IDQRTPGLFAFQILVVVATSNKER

SEQ ID NO: 2942263 - protein, 17 aa, Entamoeba invadens
IDQSCKYIPCIYVVNKI

SEQ ID NO: 2942264 - protein, 18 aa, Entamoeba invadens
IDQSCKYIPCIYVVNKID

SEQ ID NO: 2942265 - protein, 19 aa, Entamoeba invadens
IDQSLCMLGGMKEIRFETI

SEQ ID NO: 2942266 - protein, 19 aa, Entamoeba invadens
IDRCGGLSLNRTRLIMYQI

SEQ ID NO: 2942267 - protein, 34 aa, Entamoeba invadens
IDRDHYMCIVCFKRMSRGYACSHCLEDHQDINST

SEQ ID NO: 2942268 - protein, 24 aa, Entamoeba invadens
IDREEFKKFFKVLQSKIFDHAGDL

SEQ ID NO: 2942269 - protein, 21 aa, Entamoeba invadens
IDRFIKYRRGTIIAKSTEPDL

SEQ ID NO: 2942270 - protein, 26 aa, Entamoeba invadens
IDRFNKFIRRHFQVAAQQVMQQPPGA

SEQ ID NO: 2942271 - protein, 25 aa, Entamoeba invadens
IDRFREIPEIGVFSDMLWSDPLMYE

SEQ ID NO: 2942272 - protein, 21 aa, Entamoeba invadens
IDRFSSFETFQCVSKNCVTAL

SEQ ID NO: 2942273 - protein, 25 aa, Entamoeba invadens
IDRGFTYTLRLVFCGDEVTQGASRR

SEQ ID NO: 2942274 - protein, 27 aa, Entamoeba invadens
IDRGLFRSMCFKTFLKDYKKGEETDLM

SEQ ID NO: 2942275 - protein, 17 aa, Entamoeba invadens
IDRKTLKAFPALTTLNI

SEQ ID NO: 2942276 - protein, 18 aa, Entamoeba invadens
IDRKTLKAFPALTTLNIW

SEQ ID NO: 2942277 - protein, 17 aa, Entamoeba invadens
IDRLAVTITEEMETKFK

SEQ ID NO: 2942278 - protein, 18 aa, Entamoeba invadens
IDRLVAEMKLCYNEIEKK

SEQ ID NO: 2942279 - protein, 18 aa, Entamoeba invadens
IDRLVFEKSFSIDEATSH

SEQ ID NO: 2942280 - protein, 18 aa, Entamoeba invadens
IDRNLKLIVNGLKEHGYY

SEQ ID NO: 2942281 - protein, 19 aa, Entamoeba invadens
IDRNWTLNSTKYVMLKYRH

SEQ ID NO: 2942282 - protein, 27 aa, Entamoeba invadens
IDRPCLFGHLYNCEHNFVFADARIPTQ

SEQ ID NO: 2942283 - protein, 22 aa, Entamoeba invadens
IDRTRLVHIYLKMTDLLEKSKR

SEQ ID NO: 2942284 - protein, 19 aa, Entamoeba invadens
IDRVRSVEPDVFIMVVGNK

SEQ ID NO: 2942285 - protein, 27 aa, Entamoeba invadens
  misc_feature (22)..(23): Xaa can be any naturally occurring amino acid
IDRWTRWNTQNCCWRLSIERTXXLSST

SEQ ID NO: 2942286 - protein, 26 aa, Entamoeba invadens
IDRYKRDCIEFLKPNCEYAYVFEKTK

SEQ ID NO: 2942287 - protein, 18 aa, Entamoeba invadens
IDSAEFVAGLSEKLKKVS

SEQ ID NO: 2942288 - protein, 25 aa, Entamoeba invadens
IDSETKFNLFFSYHYYVDLLCESMA

SEQ ID NO: 2942289 - protein, 17 aa, Entamoeba invadens
IDSHVILLLFEYLAKGS

SEQ ID NO: 2942290 - protein, 18 aa, Entamoeba invadens
IDSLISLCEKMMATFSKL

SEQ ID NO: 2942291 - protein, 18 aa, Entamoeba invadens
IDSLKYVLSRLIETGDDY

SEQ ID NO: 2942292 - protein, 17 aa, Entamoeba invadens
IDSRSSFSNIPQRWIPE

SEQ ID NO: 2942293 - protein, 18 aa, Entamoeba invadens
IDSSVLYHTVFPPKMSQV

SEQ ID NO: 2942294 - protein, 17 aa, Entamoeba invadens
IDSTFMFFENRTMLVDE

SEQ ID NO: 2942295 - protein, 19 aa, Entamoeba invadens
IDSTMFVETFRVYFERMKE

SEQ ID NO: 2942296 - protein, 21 aa, Entamoeba invadens
IDSYKGKFLLINFSNLEQITW

SEQ ID NO: 2942297 - protein, 22 aa, Entamoeba invadens
IDTASSFLIYLPLNDWCSEINI

SEQ ID NO: 2942298 - protein, 28 aa, Entamoeba invadens
IDTFCKTRHPPLCFICYDCKTMKHFDNV

SEQ ID NO: 2942299 - protein, 25 aa, Entamoeba invadens
IDTGRLTRRFKHCGDEELSVTKLDM

SEQ ID NO: 2942300 - protein, 18 aa, Entamoeba invadens
IDTGTGRIICKFCYEEIQ

SEQ ID NO: 2942301 - protein, 30 aa, Entamoeba invadens
IDTNRYRICITFSTQCMIILFYTLPSCYPS

SEQ ID NO: 2942302 - protein, 20 aa, Entamoeba invadens
IDTPFLLSHRQFFIDLLPTL

SEQ ID NO: 2942303 - protein, 19 aa, Entamoeba invadens
IDTTFPLFKSEFVLNKLYR

SEQ ID NO: 2942304 - protein, 19 aa, Entamoeba invadens
IDVDLRGTLTIPSKCENCK

SEQ ID NO: 2942305 - protein, 28 aa, Entamoeba invadens
IDVFKCSRLAYCFDYFLASKPFKDLTGE

SEQ ID NO: 2942306 - protein, 26 aa, Entamoeba invadens
IDVGGRTAGLSGLLLAVVLAGRKHDG

SEQ ID NO: 2942307 - protein, 24 aa, Entamoeba invadens
IDVISFRYKPNWNAKQLSLLRGGK

SEQ ID NO: 2942308 - protein, 25 aa, Entamoeba invadens
IDVKNIRCAYHIDGIPDEKLMTTTR

SEQ ID NO: 2942309 - protein, 22 aa, Entamoeba invadens
IDVKNNFIGVAYNEVLKMIDKR

SEQ ID NO: 2942310 - protein, 29 aa, Entamoeba invadens
IDVLYPYVGPFWFDRMGWEPVEEEEDCLH

SEQ ID NO: 2942311 - protein, 19 aa, Entamoeba invadens
IDVMEWPSYVQAFFEKEIE

SEQ ID NO: 2942312 - protein, 25 aa, Entamoeba invadens
IDVMKFEFLGNVKLICELYKMKVVV

SEQ ID NO: 2942313 - protein, 31 aa, Entamoeba invadens
IDVPSGVLFCAKYAFKHCSALQQMCLNQNCV

SEQ ID NO: 2942314 - protein, 18 aa, Entamoeba invadens
IDVSFEIIKNDLKMYLLK

SEQ ID NO: 2942315 - protein, 24 aa, Entamoeba invadens
IDVSQRLNVIVSFIRTTREKREII

SEQ ID NO: 2942316 - protein, 23 aa, Entamoeba invadens
IDVWRLDESICLGDGDCPTHQHE

SEQ ID NO: 2942317 - protein, 24 aa, Entamoeba invadens
IDWNTSYCLPLFVISFRNHAAVSW

SEQ ID NO: 2942318 - protein, 25 aa, Entamoeba invadens
IDYGDSRLGYYIVMDLQGIDLSTFT

SEQ ID NO: 2942319 - protein, 21 aa, Entamoeba invadens
IDYGFSVVFQEIFVTPCKASQ

SEQ ID NO: 2942320 - protein, 17 aa, Entamoeba invadens
IDYGVFICESCALVHVT

SEQ ID NO: 2942321 - protein, 20 aa, Entamoeba invadens
IDYKVFLSLTCKYENRCQMK

SEQ ID NO: 2942322 - protein, 21 aa, Entamoeba invadens
IDYLPHYLFVQLNRFDSFGVD

SEQ ID NO: 2942323 - protein, 24 aa, Entamoeba invadens
IDYNPCLHGDCNQLYDYEDDTTQD

SEQ ID NO: 2942324 - protein, 18 aa, Entamoeba invadens
IDYYCFSGCISLENVKLP

SEQ ID NO: 2942325 - protein, 18 aa, Entamoeba invadens
IDYYCFSGCISLENVKLS

SEQ ID NO: 2942326 - protein, 23 aa, Entamoeba invadens
IDYYPAKVSIEYSKQFVPVLQTL

SEQ ID NO: 2942327 - protein, 19 aa, Entamoeba invadens
IEACKDYRFRRMKPVEFDN

SEQ ID NO: 2942328 - protein, 23 aa, Entamoeba invadens
IEADHIRSWVCKTIFETFICVNS

SEQ ID NO: 2942329 - protein, 19 aa, Entamoeba invadens
IEAFRPTRNIHLPRLEPSF

SEQ ID NO: 2942330 - protein, 19 aa, Entamoeba invadens
IEAGTIFGKDWKMIARSEF

SEQ ID NO: 2942331 - protein, 28 aa, Entamoeba invadens
IEAHGECVGMTTHLWKYSIVETEKEYPY

SEQ ID NO: 2942332 - protein, 25 aa, Entamoeba invadens
IEAIAWRYLPTTLKLKGTTQSDINT

SEQ ID NO: 2942333 - protein, 21 aa, Entamoeba invadens
IEAKGLEIFDCDQYPNVYDIR

SEQ ID NO: 2942334 - protein, 21 aa, Entamoeba invadens
IEAKKKLEIEKLAMKEDKMQF

SEQ ID NO: 2942335 - protein, 18 aa, Entamoeba invadens
IEALGLVKEEIKSPEPQN

SEQ ID NO: 2942336 - protein, 18 aa, Entamoeba invadens
IEALKKKLAEEIKKREAA

SEQ ID NO: 2942337 - protein, 18 aa, Entamoeba invadens
IEAMECFELETTNQVSQM

SEQ ID NO: 2942338 - protein, 17 aa, Entamoeba invadens
IEAMTRCEVKDSVLQDD

SEQ ID NO: 2942339 - protein, 18 aa, Entamoeba invadens
IEAPKPVKLFSGLPEDRE

SEQ ID NO: 2942340 - protein, 22 aa, Entamoeba invadens
IEAYFWKGEETPTFVAKRMVTQ

SEQ ID NO: 2942341 - protein, 20 aa, Entamoeba invadens
IEAYLWKGEETPTFVAKRIV

SEQ ID NO: 2942342 - protein, 23 aa, Entamoeba invadens
IECAKSKIFIGLFQSFRVLLSGD

SEQ ID NO: 2942343 - protein, 37 aa, Entamoeba invadens
IECGDCHKPMCFKCLEGKCKFCELGMIKIESNKNFAH

SEQ ID NO: 2942344 - protein, 18 aa, Entamoeba invadens
IECIPHCTFMKCYNLKKM

SEQ ID NO: 2942345 - protein, 17 aa, Entamoeba invadens
IECITKFIEIYTEYGQE

SEQ ID NO: 2942346 - protein, 19 aa, Entamoeba invadens
IECKQEVAASFALKQIAEF

SEQ ID NO: 2942347 - protein, 27 aa, Entamoeba invadens
IECPLCNLQFCSLKCKKAMEETHKHVA

SEQ ID NO: 2942348 - protein, 19 aa, Entamoeba invadens
IECSSLRSAPKASPPPTSW

SEQ ID NO: 2942349 - protein, 25 aa, Entamoeba invadens
IECTPEIIENITLKICEKMTNFIIG

SEQ ID NO: 2942350 - protein, 18 aa, Entamoeba invadens
IECVSAKGTFPVPEKDSV

SEQ ID NO: 2942351 - protein, 20 aa, Entamoeba invadens
IECYINWKIFAVVVKKWLGE

SEQ ID NO: 2942352 - protein, 25 aa, Entamoeba invadens
IECYKCKESNIFVIRYRREELKFYC

SEQ ID NO: 2942353 - protein, 24 aa, Entamoeba invadens
IEDCFFKYRFGRICEKEKNVKLDV

SEQ ID NO: 2942354 - protein, 23 aa, Entamoeba invadens
IEDDCVRMLNSAYRKWSNNNKSV

SEQ ID NO: 2942355 - protein, 29 aa, Entamoeba invadens
IEDFCFYECFGLSKVYLSFGITEFGQNCF

SEQ ID NO: 2942356 - protein, 30 aa, Entamoeba invadens
IEDFSVMIPDFFKEECGIYTGRFRVYDDEE

SEQ ID NO: 2942357 - protein, 20 aa, Entamoeba invadens
IEDGESLLMYITKKEEKGEA

SEQ ID NO: 2942358 - protein, 17 aa, Entamoeba invadens
IEDICEGIMGFVKMTTF

SEQ ID NO: 2942359 - protein, 17 aa, Entamoeba invadens
IEDIWKIIITQYARIHE

SEQ ID NO: 2942360 - protein, 24 aa, Entamoeba invadens
IEDKECLRNAKIVTDYYRLHGKLP

SEQ ID NO: 2942361 - protein, 25 aa, Entamoeba invadens
IEDPKRWAMDYVNAGASLVTFHIEA

SEQ ID NO: 2942362 - protein, 20 aa, Entamoeba invadens
IEDVEFLETLLFVIYSTFVS

SEQ ID NO: 2942363 - protein, 19 aa, Entamoeba invadens
IEEAFYTLVRSIRKQHTTT

SEQ ID NO: 2942364 - protein, 24 aa, Entamoeba invadens
IEEALAWVELKLESVTSVADECDL

SEQ ID NO: 2942365 - protein, 25 aa, Entamoeba invadens
IEEATARLKKQFGMELKEIKTSPQK

SEQ ID NO: 2942366 - protein, 18 aa, Entamoeba invadens
IEECKKYEEKRVIVLAGN

SEQ ID NO: 2942367 - protein, 20 aa, Entamoeba invadens
IEEECFNLIIARMKNVSKRK

SEQ ID NO: 2942368 - protein, 23 aa, Entamoeba invadens
IEEECFNLIIARMKSVSKRKAKM

SEQ ID NO: 2942369 - protein, 36 aa, Entamoeba invadens
IEEEMPLGLAIQFLAPRKRDIVCDIIEWAVLHNIQR

SEQ ID NO: 2942370 - protein, 26 aa, Entamoeba invadens
IEEEVPFKLCWDGLAKVSFSYLIFTN

SEQ ID NO: 2942371 - protein, 22 aa, Entamoeba invadens
IEEGAFCWCVELAKLHFDEEKI

SEQ ID NO: 2942372 - protein, 17 aa, Entamoeba invadens
IEEIKKQIAAIEAANEE

SEQ ID NO: 2942373 - protein, 27 aa, Entamoeba invadens
IEEILRRHFAEWGELEYIRVLPVRNIA

SEQ ID NO: 2942374 - protein, 18 aa, Entamoeba invadens
IEEIRIFLEKNPVDDQEA

SEQ ID NO: 2942375 - protein, 24 aa, Entamoeba invadens
IEEKEGGFEFGVYDRYMKGVNQLV

SEQ ID NO: 2942376 - protein, 24 aa, Entamoeba invadens
IEEKGSEGVSCYTLCEDNIFVSMP

SEQ ID NO: 2942377 - protein, 19 aa, Entamoeba invadens
IEEKITFVVCKDTKELISQ

SEQ ID NO: 2942378 - protein, 22 aa, Entamoeba invadens
IEEKKLKVEKEVVATMENTKMP

SEQ ID NO: 2942379 - protein, 25 aa, Entamoeba invadens
IEEKKRFNVCRFVKYTKEDRLKYGN

SEQ ID NO: 2942380 - protein, 23 aa, Entamoeba invadens
IEEKSICMNDFLAFNYENDQTPV

SEQ ID NO: 2942381 - protein, 20 aa, Entamoeba invadens
IEELCIRPQPNLIITDCPKL

SEQ ID NO: 2942382 - protein, 24 aa, Entamoeba invadens
IEELCPFALPPKRPEAEVLGCFTL

SEQ ID NO: 2942383 - protein, 17 aa, Entamoeba invadens
IEELLKKVDFALDNIEN

SEQ ID NO: 2942384 - protein, 25 aa, Entamoeba invadens
IEENKRLQLQLSELITTTNHYEIEK

SEQ ID NO: 2942385 - protein, 31 aa, Entamoeba invadens
IEETSRLVSLRCPYSIVKMKHPVRGQRCTHE

SEQ ID NO: 2942386 - protein, 19 aa, Entamoeba invadens
IEETVKWLGHTPCAVTYSS

SEQ ID NO: 2942387 - protein, 19 aa, Entamoeba invadens
IEETVSFLYQYAEYLFENA

SEQ ID NO: 2942388 - protein, 18 aa, Entamoeba invadens
IEEVMKKCMCSRLDISPL

SEQ ID NO: 2942389 - protein, 24 aa, Entamoeba invadens
IEEVRIAPWTSMNVLAKEVKGTIQ

SEQ ID NO: 2942390 - protein, 23 aa, Entamoeba invadens
IEFAAKVSVLKALELNGTTIDGK

SEQ ID NO: 2942391 - protein, 24 aa, Entamoeba invadens
IEFARIGLTSMVCFNQGDIGEYLR

SEQ ID NO: 2942392 - protein, 17 aa, Entamoeba invadens
IEFDKNTFKKELVKTKE

SEQ ID NO: 2942393 - protein, 18 aa, Entamoeba invadens
IEFDLKISVLPKETKLVI

SEQ ID NO: 2942394 - protein, 24 aa, Entamoeba invadens
IEFDMPAFATAPVIYQIEGVGEVN

SEQ ID NO: 2942395 - protein, 23 aa, Entamoeba invadens
IEFDMPSFAIAPVTYQIEGVGEV

SEQ ID NO: 2942396 - protein, 17 aa, Entamoeba invadens
IEFERELEKEKNILKTE

SEQ ID NO: 2942397 - protein, 24 aa, Entamoeba invadens
IEFIGAEAFANCFMLNEIEIPNKV

SEQ ID NO: 2942398 - protein, 26 aa, Entamoeba invadens
IEFLKQSGCETGIFVNDFIDLFEWLG

SEQ ID NO: 2942399 - protein, 30 aa, Entamoeba invadens
IEFLKTGKIRDWSCCTKLKEIVLTNFESEN

SEQ ID NO: 2942400 - protein, 22 aa, Entamoeba invadens
IEFLLFKASFLLKTVSRNDTDF

SEQ ID NO: 2942401 - protein, 21 aa, Entamoeba invadens
IEFLTIFDGFFLKKAPKMKSL

SEQ ID NO: 2942402 - protein, 17 aa, Entamoeba invadens
IEFMKSIGIDVNGFEPN

SEQ ID NO: 2942403 - protein, 26 aa, Entamoeba invadens
IEFPDIRSNFVFKGSIDYTIYKALKN

SEQ ID NO: 2942404 - protein, 24 aa, Entamoeba invadens
IEFRGKKKVSLCASPIDPLLHDDE

SEQ ID NO: 2942405 - protein, 20 aa, Entamoeba invadens
IEFSLKRQGTKFVIHEPAVF

SEQ ID NO: 2942406 - protein, 40 aa, Entamoeba invadens
IEFSMKRADAKFVIHSPAVFKLPGSEQYVVYGEPRNEIVD

SEQ ID NO: 2942407 - protein, 20 aa, Entamoeba invadens
IEFVCRKYANNIAKFPYNPI

SEQ ID NO: 2942408 - protein, 17 aa, Entamoeba invadens
IEGCKLEFIIGLIDQIC

SEQ ID NO: 2942409 - protein, 21 aa, Entamoeba invadens
IEGCLKYETKDRIPMGKVLAS

SEQ ID NO: 2942410 - protein, 19 aa, Entamoeba invadens
IEGEVVLYNVIEWDVKNGI

SEQ ID NO: 2942411 - protein, 17 aa, Entamoeba invadens
IEGFKRIVQAAATNGIL

SEQ ID NO: 2942412 - protein, 27 aa, Entamoeba invadens
IEGFYPVGFTDFVAWNECVEIISYHDV

SEQ ID NO: 2942413 - protein, 26 aa, Entamoeba invadens
IEGGGGDLFAAWAVQKIVGYTDEMNI

SEQ ID NO: 2942414 - protein, 24 aa, Entamoeba invadens
IEGIQCVRMREGGLVVFVVVFGVE

SEQ ID NO: 2942415 - protein, 18 aa, Entamoeba invadens
IEGIYRIVAHCLNTSVTL

SEQ ID NO: 2942416 - protein, 24 aa, Entamoeba invadens
IEGKHSFKYVKNMIQFLCSNNEGK

SEQ ID NO: 2942417 - protein, 25 aa, Entamoeba invadens
IEGKKVKCVIHRKGATRAFPPNHPV

SEQ ID NO: 2942418 - protein, 22 aa, Entamoeba invadens
IEGKRIIKEFNVALRQTEPDKI

SEQ ID NO: 2942419 - protein, 31 aa, Entamoeba invadens
IEGLNWLVFNWCRGKGCILADEMGLGKTVQV

SEQ ID NO: 2942420 - protein, 19 aa, Entamoeba invadens
IEGMKRVCGDITERNNEAA

SEQ ID NO: 2942421 - protein, 18 aa, Entamoeba invadens
IEGNAKFGKENRKKINSY

SEQ ID NO: 2942422 - protein, 17 aa, Entamoeba invadens
IEGRSLKGADFGGLSSD

SEQ ID NO: 2942423 - protein, 18 aa, Entamoeba invadens
IEGVLSIGTKPLYVSKKV

SEQ ID NO: 2942424 - protein, 17 aa, Entamoeba invadens
IEGYLKAKRTVKEYIPR

SEQ ID NO: 2942425 - protein, 17 aa, Entamoeba invadens
IEGYVPSIRRFEYKEYG

SEQ ID NO: 2942426 - protein, 17 aa, Entamoeba invadens
IEHDGIYDKILMKQQPQ

SEQ ID NO: 2942427 - protein, 20 aa, Entamoeba invadens
IEHFIIDIIHDFTEEKLSTF

SEQ ID NO: 2942428 - protein, 24 aa, Entamoeba invadens
IEHGLPPTGGWGLGIDRLSMLLAD

SEQ ID NO: 2942429 - protein, 33 aa, Entamoeba invadens
IEHLFKTNLRFSFKLMKGIVLYCNSDDGDMRVD

SEQ ID NO: 2942430 - protein, 19 aa, Entamoeba invadens
IEHLMSFRAMPNVVVLRPS

SEQ ID NO: 2942431 - protein, 17 aa, Entamoeba invadens
IEHLVCPSSLVSFDIIR

SEQ ID NO: 2942432 - protein, 18 aa, Entamoeba invadens
IEHMRLKERFKRTFSGGL

SEQ ID NO: 2942433 - protein, 26 aa, Entamoeba invadens
IEHRIKATYSFTRWCYIYKNVEDITN

SEQ ID NO: 2942434 - protein, 27 aa, Entamoeba invadens
IEHRIKATYSFTRWCYIYKNVEDITNN

SEQ ID NO: 2942435 - protein, 23 aa, Entamoeba invadens
IEHYAIDMLKLFPNIKTLYLPSY

SEQ ID NO: 2942436 - protein, 24 aa, Entamoeba invadens
IEIADKLRRGYVFQDTSLVENCLG

SEQ ID NO: 2942437 - protein, 24 aa, Entamoeba invadens
IEIAKFLTNFCVSGVSEISPPIEV

SEQ ID NO: 2942438 - protein, 23 aa, Entamoeba invadens
IEIDCPDKVMIKGLDLRNNESKV

SEQ ID NO: 2942439 - protein, 17 aa, Entamoeba invadens
IEIDKMMTVAEREQNEL

SEQ ID NO: 2942440 - protein, 24 aa, Entamoeba invadens
IEIEGNCFRDCTNLTSVRLSTTLT

SEQ ID NO: 2942441 - protein, 24 aa, Entamoeba invadens
IEIEMKLRIKLMLDSISGIIYLHT

SEQ ID NO: 2942442 - protein, 25 aa, Entamoeba invadens
IEIFKEFKPLFVTKLKFPGQFDIAF

SEQ ID NO: 2942443 - protein, 17 aa, Entamoeba invadens
IEIFPDDVVIKFTPEDK

SEQ ID NO: 2942444 - protein, 25 aa, Entamoeba invadens
IEIFPKAAKAVLDFVKKSVAGVENI

SEQ ID NO: 2942445 - protein, 17 aa, Entamoeba invadens
IEIIKMGFLEKLLKYNK

SEQ ID NO: 2942446 - protein, 21 aa, Entamoeba invadens
IEIILGLPYSCAIDMWSFGCV

SEQ ID NO: 2942447 - protein, 20 aa, Entamoeba invadens
IEIIPTLITQYWKTSFNEKI

SEQ ID NO: 2942448 - protein, 25 aa, Entamoeba invadens
IEIISREAFSKCYYLTQLVFSKNLK

SEQ ID NO: 2942449 - protein, 22 aa, Entamoeba invadens
IEIKGEFIFKGYFHDDVSTKEA

SEQ ID NO: 2942450 - protein, 22 aa, Entamoeba invadens
IEIKHPERLAAKTIQFLIVNEL

SEQ ID NO: 2942451 - protein, 24 aa, Entamoeba invadens
IEIKLSGTTKYNWISLGAYADKNM

SEQ ID NO: 2942452 - protein, 19 aa, Entamoeba invadens
IEIKRYLKKISFGAELKPE

SEQ ID NO: 2942453 - protein, 23 aa, Entamoeba invadens
IEILTEALFTYNRMFPTNNPHVV

SEQ ID NO: 2942454 - protein, 23 aa, Entamoeba invadens
IEIPEGLTSLGDDCFCGCGNLSK

SEQ ID NO: 2942455 - protein, 17 aa, Entamoeba invadens
IEIPENLKIDVKSVEQK

SEQ ID NO: 2942456 - protein, 24 aa, Entamoeba invadens
IEIPEQMTTFGIGAFYKAANLESV

SEQ ID NO: 2942457 - protein, 25 aa, Entamoeba invadens
IEIPKGKFFLPGFIDCHIHAPQYAT

SEQ ID NO: 2942458 - protein, 20 aa, Entamoeba invadens
IEIPKSVTFIGRNCFCHCTN

SEQ ID NO: 2942459 - protein, 17 aa, Entamoeba invadens
IEIPLKRVGEVEEIANA

SEQ ID NO: 2942460 - protein, 18 aa, Entamoeba invadens
IEIPRIVVQISDYCFSSC

SEQ ID NO: 2942461 - protein, 17 aa, Entamoeba invadens
IEIPSGVVWMEATFFGC

SEQ ID NO: 2942462 - protein, 17 aa, Entamoeba invadens
IEIPTYIKFIGDSCFEF

SEQ ID NO: 2942463 - protein, 17 aa, Entamoeba invadens
IEIPWKNIGAAFAVQRL

SEQ ID NO: 2942464 - protein, 17 aa, Entamoeba invadens
IEIQRIEMNTGRDFIPH

SEQ ID NO: 2942465 - protein, 19 aa, Entamoeba invadens
IEISPRLLAEQLYVTDLYL

SEQ ID NO: 2942466 - protein, 18 aa, Entamoeba invadens
IEISRPHSLLTLSASILS

SEQ ID NO: 2942467 - protein, 27 aa, Entamoeba invadens
IEITVEPVMTFEGFAVYSREEKFNEKK

SEQ ID NO: 2942468 - protein, 17 aa, Entamoeba invadens
IEKAKLFMVGKQIHIGD

SEQ ID NO: 2942469 - protein, 18 aa, Entamoeba invadens
IEKCFMCANAKGRQEMLK

SEQ ID NO: 2942470 - protein, 21 aa, Entamoeba invadens
IEKCKYHIVTIVVTLPEEETE

SEQ ID NO: 2942471 - protein, 25 aa, Entamoeba invadens
IEKCQICGKSFNFMNRKQFCIHCGL

SEQ ID NO: 2942472 - protein, 18 aa, Entamoeba invadens
IEKDGGFCTVKRDPCVVC

SEQ ID NO: 2942473 - protein, 27 aa, Entamoeba invadens
IEKDGILTFHFECRGVQYGFIVPELYI

SEQ ID NO: 2942474 - protein, 25 aa, Entamoeba invadens
IEKEKLRLLLPMRCDEFENQKRCYV

SEQ ID NO: 2942475 - protein, 17 aa, Entamoeba invadens
IEKERQQALMVHLQLTV

SEQ ID NO: 2942476 - protein, 24 aa, Entamoeba invadens
IEKETFVPFFGMQLEKYGEVYHTD

SEQ ID NO: 2942477 - protein, 23 aa, Entamoeba invadens
IEKEVCALLAAFFQSLNTLSENS

SEQ ID NO: 2942478 - protein, 26 aa, Entamoeba invadens
IEKFAFKNCYFLESLTFPKTLVKMED

SEQ ID NO: 2942479 - protein, 17 aa, Entamoeba invadens
IEKFGFNCFELCDKIKS

SEQ ID NO: 2942480 - protein, 17 aa, Entamoeba invadens
IEKGDDTHFCFLVIRNA

SEQ ID NO: 2942481 - protein, 26 aa, Entamoeba invadens
IEKGEMTCFFPFFGTCDDKKNLVDWF

SEQ ID NO: 2942482 - protein, 19 aa, Entamoeba invadens
IEKGFSYEKTMYWDEVAQY

SEQ ID NO: 2942483 - protein, 19 aa, Entamoeba invadens
IEKIPDVVEEIKVEKVEKK

SEQ ID NO: 2942484 - protein, 17 aa, Entamoeba invadens
IEKKFLISKTMTYHGES

SEQ ID NO: 2942485 - protein, 27 aa, Entamoeba invadens
IEKKTKCFICGLEGHLEGDCPKRLEIE

SEQ ID NO: 2942486 - protein, 23 aa, Entamoeba invadens
IEKLKPVFYGKVYAKYDTSKIGV

SEQ ID NO: 2942487 - protein, 19 aa, Entamoeba invadens
IEKLNCFELAKQLSGYIVR

SEQ ID NO: 2942488 - protein, 18 aa, Entamoeba invadens
IEKMGTTFYGCIVKKFLY

SEQ ID NO: 2942489 - protein, 22 aa, Entamoeba invadens
IEKMKPLLCDSNIDLQYSVLAA

SEQ ID NO: 2942490 - protein, 20 aa, Entamoeba invadens
IEKMVKCLNDYFVGNYTQFR

SEQ ID NO: 2942491 - protein, 18 aa, Entamoeba invadens
IEKQKIILISKMPRPLEL

SEQ ID NO: 2942492 - protein, 17 aa, Entamoeba invadens
IEKRACELLQSASESYL

SEQ ID NO: 2942493 - protein, 17 aa, Entamoeba invadens
IEKRAGIQTEKKQKSSK

SEQ ID NO: 2942494 - protein, 22 aa, Entamoeba invadens
IEKRAKIARNYIEQMQLNNKTY

SEQ ID NO: 2942495 - protein, 17 aa, Entamoeba invadens
IEKRGPVERSHIGFSST

SEQ ID NO: 2942496 - protein, 20 aa, Entamoeba invadens
IEKRRIEMITALQNLKKCNE

SEQ ID NO: 2942497 - protein, 21 aa, Entamoeba invadens
IEKRTVLLEGEEVVKTEKSTQ

SEQ ID NO: 2942498 - protein, 26 aa, Entamoeba invadens
IEKSCFEGCKLLFSYIEFHNKSNAIQ

SEQ ID NO: 2942499 - protein, 27 aa, Entamoeba invadens
IEKSDLCKRSGLHIAIIYNDGISVQTL

SEQ ID NO: 2942500 - protein, 24 aa, Entamoeba invadens
IEKTVKADSRFKVLQSLKGECKFT

SEQ ID NO: 2942501 - protein, 18 aa, Entamoeba invadens
IEKVAAWEVIIYSANYPI

SEQ ID NO: 2942502 - protein, 19 aa, Entamoeba invadens
IEKVFLIICQKMLQPQDQF

SEQ ID NO: 2942503 - protein, 19 aa, Entamoeba invadens
IEKVKKWFAKGFDDVASRY

SEQ ID NO: 2942504 - protein, 23 aa, Entamoeba invadens
IEKWKPSPTLEIVFDSDRDDPKT

SEQ ID NO: 2942505 - protein, 23 aa, Entamoeba invadens
IEKWTMNYPLGWEKKCLVDTTSI

SEQ ID NO: 2942506 - protein, 27 aa, Entamoeba invadens
IEKYGICCFNECKWLKGKINAPDNCFE

SEQ ID NO: 2942507 - protein, 26 aa, Entamoeba invadens
IEKYIKMLLLNKVICENCVVTINTLN

SEQ ID NO: 2942508 - protein, 18 aa, Entamoeba invadens
IEKYKFDIPVCGSGGVLT

SEQ ID NO: 2942509 - protein, 21 aa, Entamoeba invadens
IEKYLKYKGYLYERLDGSIRA

SEQ ID NO: 2942510 - protein, 36 aa, Entamoeba invadens
IEKYVESLRVYLSYILNCPYFVSRFPVFSSSKTLTD

SEQ ID NO: 2942511 - protein, 22 aa, Entamoeba invadens
IELAGGVGSWLGTLTLHQNKPV

SEQ ID NO: 2942512 - protein, 17 aa, Entamoeba invadens
IELFPKLETLYLPFELD

SEQ ID NO: 2942513 - protein, 17 aa, Entamoeba invadens
IELGEPIYKSVVSKKST

SEQ ID NO: 2942514 - protein, 19 aa, Entamoeba invadens
IELGNSCFNQCKSLVEIII

SEQ ID NO: 2942515 - protein, 28 aa, Entamoeba invadens
IELHRLLERWPLLEPTPALELLDFRFPD

SEQ ID NO: 2942516 - protein, 17 aa, Entamoeba invadens
IELIKDWGMIVCDEGHR

SEQ ID NO: 2942517 - protein, 24 aa, Entamoeba invadens
IELIKRIGMNAGIFKELCEDTFTL

SEQ ID NO: 2942518 - protein, 23 aa, Entamoeba invadens
IELKEGMSVLQFVDEIAEKKKYF

SEQ ID NO: 2942519 - protein, 25 aa, Entamoeba invadens
IELKGIKSVELFTGSPHVVIHFEAV

SEQ ID NO: 2942520 - protein, 25 aa, Entamoeba invadens
IELKGNVCKICIGRGHMAKCCPSWN

SEQ ID NO: 2942521 - protein, 18 aa, Entamoeba invadens
IELKNAKLLKSVAFVNCI

SEQ ID NO: 2942522 - protein, 26 aa, Entamoeba invadens
IELLKEWKSGMPLPMVFVSTSNSVIR

SEQ ID NO: 2942523 - protein, 18 aa, Entamoeba invadens
IELLMSVIHTICLREDIQ

SEQ ID NO: 2942524 - protein, 19 aa, Entamoeba invadens
IELMEKLDIIEVIKSESAK

SEQ ID NO: 2942525 - protein, 23 aa, Entamoeba invadens
IELNGVRIPERFILSQEKFQLVN

SEQ ID NO: 2942526 - protein, 18 aa, Entamoeba invadens
IELPLSIENDDNLIIKEY

SEQ ID NO: 2942527 - protein, 17 aa, Entamoeba invadens
IELPLTLFGELWEIFMA

SEQ ID NO: 2942528 - protein, 21 aa, Entamoeba invadens
IELPNTVSYLGEMCFSQCKKL

SEQ ID NO: 2942529 - protein, 25 aa, Entamoeba invadens
IELPPKFFSDQLFEFQQALLRELCL

SEQ ID NO: 2942530 - protein, 17 aa, Entamoeba invadens
IELSAKQSFWMKRVAYL

SEQ ID NO: 2942531 - protein, 19 aa, Entamoeba invadens
IELSAKYLPKFFKHNNFSS

SEQ ID NO: 2942532 - protein, 18 aa, Entamoeba invadens
IELSEHIPILLAGNKSDL

SEQ ID NO: 2942533 - protein, 19 aa, Entamoeba invadens
IELSLTFFEILSAEREGVK

SEQ ID NO: 2942534 - protein, 25 aa, Entamoeba invadens
IELTLRLALDGSKVAEAILVKNVDS

SEQ ID NO: 2942535 - protein, 29 aa, Entamoeba invadens
IELTNYFKYIEVFENLYFDEIAFKEDTVS

SEQ ID NO: 2942536 - protein, 24 aa, Entamoeba invadens
IELYCTTKILFGFWNEDLAKKFEK

SEQ ID NO: 2942537 - protein, 17 aa, Entamoeba invadens
IELYKILLKKPFSCYHN

SEQ ID NO: 2942538 - protein, 26 aa, Entamoeba invadens
IELYSTNILPRFLEQVLLSRDKVTQD

SEQ ID NO: 2942539 - protein, 18 aa, Entamoeba invadens
IEMCWMTEVLLKICETAA

SEQ ID NO: 2942540 - protein, 32 aa, Entamoeba invadens
IEMFERSKSLRFAIAVCNFIIPFLANNHEFKL

SEQ ID NO: 2942541 - protein, 22 aa, Entamoeba invadens
IEMIDKLKFEWEGKELKGEKLH

SEQ ID NO: 2942542 - protein, 28 aa, Entamoeba invadens
IEMIHMHLLASFAYRLMLLQKYPYPLFL

SEQ ID NO: 2942543 - protein, 20 aa, Entamoeba invadens
IEMIPLLLSEVFETNHDVSK

SEQ ID NO: 2942544 - protein, 24 aa, Entamoeba invadens
IEMKNSDDVWAFKTKREFEEDNNV

SEQ ID NO: 2942545 - protein, 23 aa, Entamoeba invadens
IEMKSCDYEKVIAKINEEIEQIK

SEQ ID NO: 2942546 - protein, 26 aa, Entamoeba invadens
IEMLKQFAIDGLNHWGSDSKGVGTTR

SEQ ID NO: 2942547 - protein, 21 aa, Entamoeba invadens
IEMMKRTLTLVSKNYSLFLNK

SEQ ID NO: 2942548 - protein, 18 aa, Entamoeba invadens
IEMPINCFEKSEKYQIIF

SEQ ID NO: 2942549 - protein, 17 aa, Entamoeba invadens
IEMSATLVSDAKIAGTS

SEQ ID NO: 2942550 - protein, 17 aa, Entamoeba invadens
IEMSQKYYIGFLNEMSR

SEQ ID NO: 2942551 - protein, 17 aa, Entamoeba invadens
IENAKKCAHMYRQQPAV

SEQ ID NO: 2942552 - protein, 27 aa, Entamoeba invadens
IENATPFQWSYSLAIEVLKYYFRSLPT

SEQ ID NO: 2942553 - protein, 19 aa, Entamoeba invadens
IENCRSLKILFLQRKSLNE

SEQ ID NO: 2942554 - protein, 18 aa, Entamoeba invadens
IENCSLLHFNRVLEDDTT

SEQ ID NO: 2942555 - protein, 21 aa, Entamoeba invadens
IENDVLWGFSFLSDNENNKIL

SEQ ID NO: 2942556 - protein, 19 aa, Entamoeba invadens
IENEKVIFFDIKKGYEKYD

SEQ ID NO: 2942557 - protein, 17 aa, Entamoeba invadens
IENELNDSDMLKAQKAD

SEQ ID NO: 2942558 - protein, 30 aa, Entamoeba invadens
IENFKLLLYPLHWVYVCVPILPRILLEYIT

SEQ ID NO: 2942559 - protein, 18 aa, Entamoeba invadens
IENFSALFTQVRNFYKHD

SEQ ID NO: 2942560 - protein, 21 aa, Entamoeba invadens
IENGVCVKCEYPCIHCSILTF

SEQ ID NO: 2942561 - protein, 19 aa, Entamoeba invadens
IENKCGAVFDLAKKYLEKV

SEQ ID NO: 2942562 - protein, 24 aa, Entamoeba invadens
IENKLADAEARFENVVKEKEEMNN

SEQ ID NO: 2942563 - protein, 19 aa, Entamoeba invadens
IENKTPCFWEYVLENRAKF

SEQ ID NO: 2942564 - protein, 26 aa, Entamoeba invadens
IENLKLKSVIILPQLMDEYYPRFKLN

SEQ ID NO: 2942565 - protein, 32 aa, Entamoeba invadens
IENLKSMIFPFEWCNICIDLIPYSLLDYLTSP

SEQ ID NO: 2942566 - protein, 33 aa, Entamoeba invadens
IENLLDLYKAWARSVRPGIPFEEILSQFYRLGK

SEQ ID NO: 2942567 - protein, 24 aa, Entamoeba invadens
IENLRRANLVFSFFPNEFRPNPRK

SEQ ID NO: 2942568 - protein, 33 aa, Entamoeba invadens
IENMKSMIFPLEWCNVCIDILPYSLLDFLSSPM

SEQ ID NO: 2942569 - protein, 26 aa, Entamoeba invadens
IENNPVACAWPYLFGENGIGIDQKDI

SEQ ID NO: 2942570 - protein, 26 aa, Entamoeba invadens
IENNVGFQLLKQMGFDQTQEYNTEQQ

SEQ ID NO: 2942571 - protein, 33 aa, Entamoeba invadens
IENPLYQHGCSWAWKLMDGYAPLMFNENTIELS

SEQ ID NO: 2942572 - protein, 20 aa, Entamoeba invadens
IENRTTFTLTRLLKKLQKTF

SEQ ID NO: 2942573 - protein, 30 aa, Entamoeba invadens
IENTPEFPRRFYLFVLKFFSKIFKTDFVVV

SEQ ID NO: 2942574 - protein, 25 aa, Entamoeba invadens
IENTPRVLKELSYSEYYYLKLYDGV

SEQ ID NO: 2942575 - protein, 22 aa, Entamoeba invadens
IENVIPFPLSLIVDDNATKRYQ

SEQ ID NO: 2942576 - protein, 24 aa, Entamoeba invadens
IENVVLYYKCDLLRENTIKTLDTI

SEQ ID NO: 2942577 - protein, 23 aa, Entamoeba invadens
IENVYKSPSWFWGISSIWFSLQD

SEQ ID NO: 2942578 - protein, 18 aa, Entamoeba invadens
IENYPPNPSRVFIRNGNI

SEQ ID NO: 2942579 - protein, 17 aa, Entamoeba invadens
IEPAKRFVGIEEDDGKR

SEQ ID NO: 2942580 - protein, 19 aa, Entamoeba invadens
IEPCRILETRLAELAVKKR

SEQ ID NO: 2942581 - protein, 17 aa, Entamoeba invadens
IEPEILYDSNLSGFDSR

SEQ ID NO: 2942582 - protein, 18 aa, Entamoeba invadens
IEPFLSCSDEEEASMNGQ

SEQ ID NO: 2942583 - protein, 19 aa, Entamoeba invadens
IEPKLNWKKHQKIDFTQAD

SEQ ID NO: 2942584 - protein, 21 aa, Entamoeba invadens
IEPKNECVMYDFTHEEPPQQE

SEQ ID NO: 2942585 - protein, 19 aa, Entamoeba invadens
IEPQFLKRTKSIVHKQSFV

SEQ ID NO: 2942586 - protein, 18 aa, Entamoeba invadens
IEPQMAVALLSSIDYKVV

SEQ ID NO: 2942587 - protein, 19 aa, Entamoeba invadens
IEPSFGIGRVLTGVLEHCF

SEQ ID NO: 2942588 - protein, 22 aa, Entamoeba invadens
IEPSVQYVFGIGLAPQSYPKNR

SEQ ID NO: 2942589 - protein, 24 aa, Entamoeba invadens
IEQFKKFFFDTVAVSYEFYLQMKA

SEQ ID NO: 2942590 - protein, 18 aa, Entamoeba invadens
IEQFKKLFFKTVAVSYAF

SEQ ID NO: 2942591 - protein, 18 aa, Entamoeba invadens
IEQHIKTKTVVQIRSHAQ

SEQ ID NO: 2942592 - protein, 22 aa, Entamoeba invadens
IEQLLTFYFSYEEIVADLESKG

SEQ ID NO: 2942593 - protein, 19 aa, Entamoeba invadens
IEQRKAGTVSREFLNERDT

SEQ ID NO: 2942594 - protein, 18 aa, Entamoeba invadens
IEQSCPYSDPVLVSSEAK

SEQ ID NO: 2942595 - protein, 24 aa, Entamoeba invadens
IEQVKSCGSYIFFKNNTKLMYIKM

SEQ ID NO: 2942596 - protein, 23 aa, Entamoeba invadens
IERARIVKDYALFLEHNKNLAEA

SEQ ID NO: 2942597 - protein, 19 aa, Entamoeba invadens
IERCTRYVVDAVKIPVYPK

SEQ ID NO: 2942598 - protein, 23 aa, Entamoeba invadens
IEREIKWPMKIGVGVNSTTALIA

SEQ ID NO: 2942599 - protein, 24 aa, Entamoeba invadens
IERGCVIGEPIVGYIRLTLQKPFN

SEQ ID NO: 2942600 - protein, 27 aa, Entamoeba invadens
IERIEKIFRIYLCFMMSEAGNVESIFD

SEQ ID NO: 2942601 - protein, 20 aa, Entamoeba invadens
IERIGYFSFFSCTSLTELEI

SEQ ID NO: 2942602 - protein, 25 aa, Entamoeba invadens
IERLFALYLPMMVGYQVYIAPDVLY

SEQ ID NO: 2942603 - protein, 26 aa, Entamoeba invadens
IERLFRDAEKYEIPVGKYVSYITSNL

SEQ ID NO: 2942604 - protein, 28 aa, Entamoeba invadens
IERLSSLYCKIEFIKIFIETFIEQNVDI

SEQ ID NO: 2942605 - protein, 18 aa, Entamoeba invadens
IERNGLCELCDPIFSSLI

SEQ ID NO: 2942606 - protein, 17 aa, Entamoeba invadens
IERRGEMSLEYLDKKIN

SEQ ID NO: 2942607 - protein, 20 aa, Entamoeba invadens
IERRIVCIVDSFFAKARPEI

SEQ ID NO: 2942608 - protein, 22 aa, Entamoeba invadens
IERRKMRVLLHLLVLGKLNSEE

SEQ ID NO: 2942609 - protein, 17 aa, Entamoeba invadens
IERTYGREIETFFCKGY

SEQ ID NO: 2942610 - protein, 21 aa, Entamoeba invadens
IERVCDACFFKVTGQRMCNEI

SEQ ID NO: 2942611 - protein, 20 aa, Entamoeba invadens
IERVSGKKIGPIVFDSNSQD

SEQ ID NO: 2942612 - protein, 19 aa, Entamoeba invadens
IERVVRYAFEASRKRKSCV

SEQ ID NO: 2942613 - protein, 21 aa, Entamoeba invadens
IESFILFTMAMKMVREFYAEA

SEQ ID NO: 2942614 - protein, 18 aa, Entamoeba invadens
IESFKLPYLNNLKKLHIK

SEQ ID NO: 2942615 - protein, 22 aa, Entamoeba invadens
IESGGSVKVIWERGDNNGSTKV

SEQ ID NO: 2942616 - protein, 25 aa, Entamoeba invadens
IESISFLNIYCKVEITTLNIPNRLK

SEQ ID NO: 2942617 - protein, 20 aa, Entamoeba invadens
IESKNDFKFVIGDLPVICDG

SEQ ID NO: 2942618 - protein, 23 aa, Entamoeba invadens
IESKRKYTLLEWIDEKTRFDKLE

SEQ ID NO: 2942619 - protein, 17 aa, Entamoeba invadens
IESLLLYNNTKFDIAKN

SEQ ID NO: 2942620 - protein, 18 aa, Entamoeba invadens
IESMLSLGQIRQYSSKNY

SEQ ID NO: 2942621 - protein, 28 aa, Entamoeba invadens
IESMTGKFGEIQKLISDHNYGEVPNGQK

SEQ ID NO: 2942622 - protein, 21 aa, Entamoeba invadens
IESPFKKHWQTFEYKLISSKK

SEQ ID NO: 2942623 - protein, 25 aa, Entamoeba invadens
IESQYPNALAFVFCYSITSSASFEE

SEQ ID NO: 2942624 - protein, 19 aa, Entamoeba invadens
IESRIVACSCAYRNNNHFK

SEQ ID NO: 2942625 - protein, 17 aa, Entamoeba invadens
IESRYYWVENVEEIHLT

SEQ ID NO: 2942626 - protein, 25 aa, Entamoeba invadens
IESVCLSDNLLFFFVKDAKSSKPHF

SEQ ID NO: 2942627 - protein, 17 aa, Entamoeba invadens
IESVIPILLRNFRESKS

SEQ ID NO: 2942628 - protein, 25 aa, Entamoeba invadens
IESYDYITVCFPKRFSVVDPPCSSF

SEQ ID NO: 2942629 - protein, 25 aa, Entamoeba invadens
IETARPLYAAALWYLDQWDDFGRVV

SEQ ID NO: 2942630 - protein, 26 aa, Entamoeba invadens
IETARPLYAAALWYLDRWDDFGKIVV

SEQ ID NO: 2942631 - protein, 27 aa, Entamoeba invadens
IETCCFDGCAFSSILLPSTLEHLGDKA

SEQ ID NO: 2942632 - protein, 33 aa, Entamoeba invadens
IETCGNPILFCRSVGYTGVFYLKNVNGHTKNIK

SEQ ID NO: 2942633 - protein, 17 aa, Entamoeba invadens
IETCIKKDGKTMKMKLN

SEQ ID NO: 2942634 - protein, 19 aa, Entamoeba invadens
IETCSKIRVNASIDHIANF

SEQ ID NO: 2942635 - protein, 28 aa, Entamoeba invadens
IETEGEFWKGCKASIIPDVTDAIQKKTK

SEQ ID NO: 2942636 - protein, 23 aa, Entamoeba invadens
IETETFLKCFDLFVENCQKLREL

SEQ ID NO: 2942637 - protein, 19 aa, Entamoeba invadens
IETFKNCRALLSIKVPQNV

SEQ ID NO: 2942638 - protein, 23 aa, Entamoeba invadens
IETGIRVVGGWVRDKVMRLESHD

SEQ ID NO: 2942639 - protein, 19 aa, Entamoeba invadens
IETIPCFSIKNNRYMDCER

SEQ ID NO: 2942640 - protein, 23 aa, Entamoeba invadens
IETKPCLPHFFEILGTTVTGCAV

SEQ ID NO: 2942641 - protein, 19 aa, Entamoeba invadens
IETKPKYFAKTLIVHELVK

SEQ ID NO: 2942642 - protein, 19 aa, Entamoeba invadens
IETLHIWSCNAETFGQNVA

SEQ ID NO: 2942643 - protein, 20 aa, Entamoeba invadens
IETLHLWKKHNENFGNGFIV

SEQ ID NO: 2942644 - protein, 20 aa, Entamoeba invadens
IETLHLWKKYNENFGNGFIV

SEQ ID NO: 2942645 - protein, 17 aa, Entamoeba invadens
IETLNFWNEKDFSKFLL

SEQ ID NO: 2942646 - protein, 21 aa, Entamoeba invadens
IETLPAPKKREGELIVDDDGF

SEQ ID NO: 2942647 - protein, 17 aa, Entamoeba invadens
IETLQCVDYMLGDANKV

SEQ ID NO: 2942648 - protein, 25 aa, Entamoeba invadens
IETLQLKKCRLMGITLPPSLTYLKA

SEQ ID NO: 2942649 - protein, 17 aa, Entamoeba invadens
IETLYLWNKNDENFGNG

SEQ ID NO: 2942650 - protein, 18 aa, Entamoeba invadens
IETMFKFMFNTTLIETNF

SEQ ID NO: 2942651 - protein, 24 aa, Entamoeba invadens
IETNEVILNIGFNGTFNQNVKTLK

SEQ ID NO: 2942652 - protein, 17 aa, Entamoeba invadens
IETPLSMELIKISECSI

SEQ ID NO: 2942653 - protein, 24 aa, Entamoeba invadens
IETQRPNCEYAWVFEKTKREKCKS

SEQ ID NO: 2942654 - protein, 20 aa, Entamoeba invadens
IETTRTALYLAKKNKCHTLW

SEQ ID NO: 2942655 - protein, 20 aa, Entamoeba invadens
IETYSGLTYFGESAFEECVH

SEQ ID NO: 2942656 - protein, 24 aa, Entamoeba invadens
IEVCCFRNCMSLVHISLPQTITLL

SEQ ID NO: 2942657 - protein, 25 aa, Entamoeba invadens
IEVECFQLFLSVEIFYNILTFSNKK

SEQ ID NO: 2942658 - protein, 23 aa, Entamoeba invadens
IEVEGCLFSKMLDGVENLGDLNF

SEQ ID NO: 2942659 - protein, 20 aa, Entamoeba invadens
IEVEGLFRVNGDQGFVRKKL

SEQ ID NO: 2942660 - protein, 18 aa, Entamoeba invadens
IEVFTWSASGQVIGEGLA

SEQ ID NO: 2942661 - protein, 23 aa, Entamoeba invadens
IEVIKKEGDWWLGELNGQQGYFP

SEQ ID NO: 2942662 - protein, 21 aa, Entamoeba invadens
IEVISHFLSGGGLKQFTDLFI

SEQ ID NO: 2942663 - protein, 17 aa, Entamoeba invadens
IEVKKIENWTDWWKIRQ

SEQ ID NO: 2942664 - protein, 31 aa, Entamoeba invadens
IEVKLIRTIFQIKVCNLDLCSTKEITFEEKE

SEQ ID NO: 2942665 - protein, 17 aa, Entamoeba invadens
IEVPRPIQIDVKIVLED

SEQ ID NO: 2942666 - protein, 20 aa, Entamoeba invadens
IEVQNWWKVLTTIFASSIKM

SEQ ID NO: 2942667 - protein, 17 aa, Entamoeba invadens
IEVSKLCANTVEFKIDS

SEQ ID NO: 2942668 - protein, 23 aa, Entamoeba invadens
IEVTVRQSLLFFYSDTDEVVKTM

SEQ ID NO: 2942669 - protein, 20 aa, Entamoeba invadens
IEVVGNYAIHNALISFTLRK

SEQ ID NO: 2942670 - protein, 21 aa, Entamoeba invadens
IEVVLDCLNYVISAVGENSLD

SEQ ID NO: 2942671 - protein, 23 aa, Entamoeba invadens
IEWLFLAALSKKYVKGIPDRMVK

SEQ ID NO: 2942672 - protein, 20 aa, Entamoeba invadens
IEWNLFRFVIITEDETTSSS

SEQ ID NO: 2942673 - protein, 25 aa, Entamoeba invadens
IEWYHKEIFDLWGYSDKRGDEMKEQ

SEQ ID NO: 2942674 - protein, 18 aa, Entamoeba invadens
IEYANLYTLFSIQKNCGI

SEQ ID NO: 2942675 - protein, 25 aa, Entamoeba invadens
IEYCEGKGCKNMWSFLSILSTTAKQ

SEQ ID NO: 2942676 - protein, 17 aa, Entamoeba invadens
IEYEAMCYIGVSEICIP

SEQ ID NO: 2942677 - protein, 19 aa, Entamoeba invadens
IEYIKEGFLKVSKEQNVIG

SEQ ID NO: 2942678 - protein, 18 aa, Entamoeba invadens
IEYLKVNPLPVLKCTVRA

SEQ ID NO: 2942679 - protein, 21 aa, Entamoeba invadens
IEYLTKLFANDNWMAKEKITY

SEQ ID NO: 2942680 - protein, 31 aa, Entamoeba invadens
IEYNGWKFLLAICYDVRFPVFLRNKESDLYD

SEQ ID NO: 2942681 - protein, 27 aa, Entamoeba invadens
IEYRLLWFRFDIRKLYLLRHGEPLEEL

SEQ ID NO: 2942682 - protein, 28 aa, Entamoeba invadens
IFACCSAFWLDRICNVTIHPYIQKFFKF

SEQ ID NO: 2942683 - protein, 25 aa, Entamoeba invadens
IFAFPENKLHYFIAACMLEQHRDVI

SEQ ID NO: 2942684 - protein, 25 aa, Entamoeba invadens
IFAVMKGMCDGGVYVPHSPSRFVGA

SEQ ID NO: 2942685 - protein, 24 aa, Entamoeba invadens
IFCGITAVVPLMMYCKAVGCKKAI

SEQ ID NO: 2942686 - protein, 18 aa, Entamoeba invadens
IFDCICKNENFFIATTNY

SEQ ID NO: 2942687 - protein, 17 aa, Entamoeba invadens
IFDCLLLPIQMKSLRKV

SEQ ID NO: 2942688 - protein, 24 aa, Entamoeba invadens
IFDDYCLYRAVLGSISLYCLYYTR

SEQ ID NO: 2942689 - protein, 19 aa, Entamoeba invadens
IFDFWQKLHLHTICLPVNV

SEQ ID NO: 2942690 - protein, 18 aa, Entamoeba invadens
IFDKCHKLTKITFSACNN

SEQ ID NO: 2942691 - protein, 18 aa, Entamoeba invadens
IFDNFGFDDDVKEQKVAP

SEQ ID NO: 2942692 - protein, 18 aa, Entamoeba invadens
IFDRCNRLLMLIDQIITS

SEQ ID NO: 2942693 - protein, 23 aa, Entamoeba invadens
IFDRLGESILRRKNIEKTTFELQ

SEQ ID NO: 2942694 - protein, 17 aa, Entamoeba invadens
IFECLQVFQFFHQLVIE

SEQ ID NO: 2942695 - protein, 19 aa, Entamoeba invadens
IFEEAKKFIEWEGLTDEEI

SEQ ID NO: 2942696 - protein, 21 aa, Entamoeba invadens
IFEEDPFCFVSESVRVLLLND

SEQ ID NO: 2942697 - protein, 26 aa, Entamoeba invadens
IFEELRNTLYFNLSLAFQKFMTQEIA

SEQ ID NO: 2942698 - protein, 25 aa, Entamoeba invadens
IFEGVFKWHVTMLITPEQRAYHALC

SEQ ID NO: 2942699 - protein, 18 aa, Entamoeba invadens
IFEIIRKVLKNGKLKPEL

SEQ ID NO: 2942700 - protein, 24 aa, Entamoeba invadens
IFEMPTEFLQLPPAPRNVVSNVVQ

SEQ ID NO: 2942701 - protein, 32 aa, Entamoeba invadens
IFEPKSSIYSFRFPLTRNYIFCHVLFVQIPHT

SEQ ID NO: 2942702 - protein, 23 aa, Entamoeba invadens
IFESKLPILEFCNIDTKRGKEDI

SEQ ID NO: 2942703 - protein, 18 aa, Entamoeba invadens
IFEYYGAADAERVVIAMG

SEQ ID NO: 2942704 - protein, 18 aa, Entamoeba invadens
IFFENLETLILWPQNNFL

SEQ ID NO: 2942705 - protein, 19 aa, Entamoeba invadens
IFFERDYIYVAGRYRKYSR

SEQ ID NO: 2942706 - protein, 18 aa, Entamoeba invadens
IFFEYCVEKEVGNSVENF

SEQ ID NO: 2942707 - protein, 21 aa, Entamoeba invadens
IFFLQRMVHHLTDKTLLSSIF

SEQ ID NO: 2942708 - protein, 18 aa, Entamoeba invadens
IFFNAAFPNREFTYPDKR

SEQ ID NO: 2942709 - protein, 19 aa, Entamoeba invadens
IFFQFLEAVHLVLVNGKNN

SEQ ID NO: 2942710 - protein, 19 aa, Entamoeba invadens
IFGDSIFDKCHKLTKITFS

SEQ ID NO: 2942711 - protein, 18 aa, Entamoeba invadens
IFGGDPFFDFVGDKSSKV

SEQ ID NO: 2942712 - protein, 18 aa, Entamoeba invadens
IFGMCLCFASEGIEIIRD

SEQ ID NO: 2942713 - protein, 23 aa, Entamoeba invadens
IFGNIPQIWGFQFTFAKELEDTL

SEQ ID NO: 2942714 - protein, 20 aa, Entamoeba invadens
IFGQLKFGIQSSFDTLLNNY

SEQ ID NO: 2942715 - protein, 18 aa, Entamoeba invadens
IFGRGGAVVHITSECKEV

SEQ ID NO: 2942716 - protein, 24 aa, Entamoeba invadens
IFGSTFSYICEILFSNDSDKELTE

SEQ ID NO: 2942717 - protein, 17 aa, Entamoeba invadens
IFHALAIVAKHDVRTLD

SEQ ID NO: 2942718 - protein, 19 aa, Entamoeba invadens
IFHKKLSWLKKFPKESEEL

SEQ ID NO: 2942719 - protein, 17 aa, Entamoeba invadens
IFHPIELICEFIEKLKK

SEQ ID NO: 2942720 - protein, 25 aa, Entamoeba invadens
IFHSSLACLVLFNVLNELKFNSAPH

SEQ ID NO: 2942721 - protein, 17 aa, Entamoeba invadens
IFIDLTKAWFVNYKKPM

SEQ ID NO: 2942722 - protein, 23 aa, Entamoeba invadens
IFIFPSGHVLLHMKAKTLTSKMK

SEQ ID NO: 2942723 - protein, 18 aa, Entamoeba invadens
IFIGGEWVERHLVGPMRS

SEQ ID NO: 2942724 - protein, 17 aa, Entamoeba invadens
IFIPKNSNFDWIISQAV

SEQ ID NO: 2942725 - protein, 21 aa, Entamoeba invadens
IFKDGRIVFNRNMVEVLGKNM

SEQ ID NO: 2942726 - protein, 23 aa, Entamoeba invadens
IFKDLKIKIPVLPFVRIVDDIAF

SEQ ID NO: 2942727 - protein, 17 aa, Entamoeba invadens
IFKGKFPQNRFGIPPDY

SEQ ID NO: 2942728 - protein, 25 aa, Entamoeba invadens
IFKKAFYNIVVWFSVDFETVDKNKG

SEQ ID NO: 2942729 - protein, 19 aa, Entamoeba invadens
IFKKQWFLEKIKKLRITPV

SEQ ID NO: 2942730 - protein, 26 aa, Entamoeba invadens
IFKKYKVKISPILPVALVNQIDVNLV

SEQ ID NO: 2942731 - protein, 23 aa, Entamoeba invadens
IFKNSRGRYVLAVGSTEFDMKLS

SEQ ID NO: 2942732 - protein, 23 aa, Entamoeba invadens
IFKPSLCGSYSRKLSLVYNNLDD

SEQ ID NO: 2942733 - protein, 28 aa, Entamoeba invadens
IFKTGLCLPLPLIRSFKYIEAQNFKVED

SEQ ID NO: 2942734 - protein, 23 aa, Entamoeba invadens
IFKTMKNVVCNEVFFGKEDYMKG

SEQ ID NO: 2942735 - protein, 21 aa, Entamoeba invadens
IFKVDADALAKVKEIKEKCTQ

SEQ ID NO: 2942736 - protein, 22 aa, Entamoeba invadens
IFKVEGTGVYPAKSVVSYGFGE

SEQ ID NO: 2942737 - protein, 32 aa, Entamoeba invadens
IFLANVLLYTWSEAVLLNFRVVSKSCLDAIKM

SEQ ID NO: 2942738 - protein, 18 aa, Entamoeba invadens
IFLHAAKLLGCTDMKKAI

SEQ ID NO: 2942739 - protein, 17 aa, Entamoeba invadens
IFLICFSVVSPPSFDNV

SEQ ID NO: 2942740 - protein, 19 aa, Entamoeba invadens
IFLKEVVKALGKINSPNKE

SEQ ID NO: 2942741 - protein, 25 aa, Entamoeba invadens
IFLKKLPVPLLYPLDKFVTEKETPK

SEQ ID NO: 2942742 - protein, 21 aa, Entamoeba invadens
IFLKSTEGFVNCFNVDSCGMY

SEQ ID NO: 2942743 - protein, 23 aa, Entamoeba invadens
IFLLCQRCELTVRKPSKQARVTT

SEQ ID NO: 2942744 - protein, 21 aa, Entamoeba invadens
IFLPKRSVVCYEIALYKIRYF

SEQ ID NO: 2942745 - protein, 17 aa, Entamoeba invadens
IFLPNTFYHFELYCHNK

SEQ ID NO: 2942746 - protein, 18 aa, Entamoeba invadens
IFLQINFGLAYLHSVHIL

SEQ ID NO: 2942747 - protein, 17 aa, Entamoeba invadens
IFLSHFNGLLIEFDDST

SEQ ID NO: 2942748 - protein, 19 aa, Entamoeba invadens
IFLSSPLGSFFSPRSPRKS

SEQ ID NO: 2942749 - protein, 26 aa, Entamoeba invadens
IFLTKVYGLLKCTNFTPNNIVSFLPY

SEQ ID NO: 2942750 - protein, 17 aa, Entamoeba invadens
IFMECFNLLQITFCGQL

SEQ ID NO: 2942751 - protein, 24 aa, Entamoeba invadens
IFMIHFPSKMKAFYMSKVPGHTDL

SEQ ID NO: 2942752 - protein, 17 aa, Entamoeba invadens
IFMVYDFFVNDGQFYTI

SEQ ID NO: 2942753 - protein, 18 aa, Entamoeba invadens
IFNKETFAFFDTTSDSKV

SEQ ID NO: 2942754 - protein, 24 aa, Entamoeba invadens
IFNKLLCSFICLNLTTGEQNNHKL

SEQ ID NO: 2942755 - protein, 17 aa, Entamoeba invadens
IFNRPYIGIDFLDVGRY

SEQ ID NO: 2942756 - protein, 26 aa, Entamoeba invadens
IFNTFWKLKGCALQFLEEPVLKGNTN

SEQ ID NO: 2942757 - protein, 26 aa, Entamoeba invadens
IFPPSLWKLSLCDKIQFLDGPFNSSL

SEQ ID NO: 2942758 - protein, 24 aa, Entamoeba invadens
IFPVQRIPRYILLMKEYIKNTDKE

SEQ ID NO: 2942759 - protein, 18 aa, Entamoeba invadens
IFPYANFYGVLNKELHNV

SEQ ID NO: 2942760 - protein, 17 aa, Entamoeba invadens
IFQCDWAKIDVNHNSSH

SEQ ID NO: 2942761 - protein, 19 aa, Entamoeba invadens
IFQCLKSAANVLLSKGFGV

SEQ ID NO: 2942762 - protein, 26 aa, Entamoeba invadens
IFQCVKDIIETIVFHFIHKNDKEIAV

SEQ ID NO: 2942763 - protein, 24 aa, Entamoeba invadens
IFQFDKAVCLFVFKNGQMEEFVKM

SEQ ID NO: 2942764 - protein, 25 aa, Entamoeba invadens
IFQGHEPFIFQALFVDWIIPKTSTK

SEQ ID NO: 2942765 - protein, 22 aa, Entamoeba invadens
IFQHELELFPNLETVKIRFFTP

SEQ ID NO: 2942766 - protein, 21 aa, Entamoeba invadens
IFQPMVFPHFFLRCKELKKLF

SEQ ID NO: 2942767 - protein, 24 aa, Entamoeba invadens
IFQQECTRNWAVCVLQRAYRSLLK

SEQ ID NO: 2942768 - protein, 33 aa, Entamoeba invadens
IFQSLDLAWSLLRTFPRDMLKRISNETLDKYYD

SEQ ID NO: 2942769 - protein, 22 aa, Entamoeba invadens
IFRDCKKLQKVEFAGMTEIGAS

SEQ ID NO: 2942770 - protein, 23 aa, Entamoeba invadens
IFRHVPFTVEFSASPLWLSKNSI

SEQ ID NO: 2942771 - protein, 21 aa, Entamoeba invadens
IFRKICVKLDDCKNLRAQELI

SEQ ID NO: 2942772 - protein, 18 aa, Entamoeba invadens
IFRLSVLKLPPQVETLFL

SEQ ID NO: 2942773 - protein, 17 aa, Entamoeba invadens
IFSDLEKIYAFNKGFCE

SEQ ID NO: 2942774 - protein, 25 aa, Entamoeba invadens
IFSFGITMYEVFGWCEAYQNDTFKF

SEQ ID NO: 2942775 - protein, 18 aa, Entamoeba invadens
IFSGVTSWSSLYHFTSDI

SEQ ID NO: 2942776 - protein, 18 aa, Entamoeba invadens
IFSGYPMYLHRMYQDVIN

SEQ ID NO: 2942777 - protein, 24 aa, Entamoeba invadens
IFSKELLVQFLVVFSQTYTYDYFL

SEQ ID NO: 2942778 - protein, 21 aa, Entamoeba invadens
IFSKKGYLFGSFHSSVPTEPS

SEQ ID NO: 2942779 - protein, 41 aa, Entamoeba invadens
IFSLGVTMLECFKWGEVYPKSEFKFAWDIVNFVTNGKRIKN

SEQ ID NO: 2942780 - protein, 24 aa, Entamoeba invadens
IFSQFFGGGGFGFGGRQRSGPRKG

SEQ ID NO: 2942781 - protein, 26 aa, Entamoeba invadens
IFTACLTTPLSMCFLDYYYSNDNIIS

SEQ ID NO: 2942782 - protein, 25 aa, Entamoeba invadens
IFTEIFKGRFRDVVDIQKVEELWRS

SEQ ID NO: 2942783 - protein, 23 aa, Entamoeba invadens
IFTFLCICKNCKDAVKRLKTSPF

SEQ ID NO: 2942784 - protein, 22 aa, Entamoeba invadens
IFTGAFCSACITDEGMAFIWGK

SEQ ID NO: 2942785 - protein, 25 aa, Entamoeba invadens
IFTMFKRNLEYNGGKVPFGVTQIGN

SEQ ID NO: 2942786 - protein, 18 aa, Entamoeba invadens
IFVCLGPGLRGSPFCYNF

SEQ ID NO: 2942787 - protein, 24 aa, Entamoeba invadens
IFVGMKFEVLSVALSISLPPIEKE

SEQ ID NO: 2942788 - protein, 29 aa, Entamoeba invadens
IFVPKSVKSVGRFCFYNSVGKENVIFEDK

SEQ ID NO: 2942789 - protein, 27 aa, Entamoeba invadens
IFVSKNCRDAVEMLYRNPCTTVDTPQT

SEQ ID NO: 2942790 - protein, 18 aa, Entamoeba invadens
IFYFPNLISSLLQEFITS

SEQ ID NO: 2942791 - protein, 25 aa, Entamoeba invadens
IFYHRELFENLPLKDFYFCESSNKL

SEQ ID NO: 2942792 - protein, 18 aa, Entamoeba invadens
IFYKCYSLSSVVIIETKK

SEQ ID NO: 2942793 - protein, 22 aa, Entamoeba invadens
IFYNCTFGYYGDARGPYRYHYE

SEQ ID NO: 2942794 - protein, 19 aa, Entamoeba invadens
IFYPGWLLSQMLLYGSLNV

SEQ ID NO: 2942795 - protein, 25 aa, Entamoeba invadens
IFYPNRAEWVLVCQGLIRMGLVPVP

SEQ ID NO: 2942796 - protein, 22 aa, Entamoeba invadens
IGACFDGAYVLIRNGGLSGKLL

SEQ ID NO: 2942797 - protein, 20 aa, Entamoeba invadens
IGAFCLCDVVSQFAILSNLM

SEQ ID NO: 2942798 - protein, 18 aa, Entamoeba invadens
IGAFPCIQLLTPNKTILS

SEQ ID NO: 2942799 - protein, 21 aa, Entamoeba invadens
IGAGCVGSFAALEFSKYKNLK

SEQ ID NO: 2942800 - protein, 23 aa, Entamoeba invadens
IGAGKSGSLFMFTKDSKYILKVI

SEQ ID NO: 2942801 - protein, 17 aa, Entamoeba invadens
IGAINSMAFFNVGKGDI

SEQ ID NO: 2942802 - protein, 31 aa, Entamoeba invadens
IGAKRPEMMGELLPYCLFVIKDKLQFPSIKQ

SEQ ID NO: 2942803 - protein, 19 aa, Entamoeba invadens
IGALECLEVRSVLQTLLTL

SEQ ID NO: 2942804 - protein, 24 aa, Entamoeba invadens
IGALKRGSEIVVCTPGRMIDILVT

SEQ ID NO: 2942805 - protein, 20 aa, Entamoeba invadens
IGANGYYQTKWEQLRRDTTV

SEQ ID NO: 2942806 - protein, 26 aa, Entamoeba invadens
IGAPAAAICRVHFPFYDSKIDPQQWG

SEQ ID NO: 2942807 - protein, 26 aa, Entamoeba invadens
IGAQMAGNVLRRFSATKVISKQITPE

SEQ ID NO: 2942808 - protein, 18 aa, Entamoeba invadens
IGASFFAGCERLNELVGF

SEQ ID NO: 2942809 - protein, 18 aa, Entamoeba invadens
IGASFPFPTTGAAKAVGK

SEQ ID NO: 2942810 - protein, 30 aa, Entamoeba invadens
IGASNALCGLMFPRDVEIRMFQFIQLDDIL

SEQ ID NO: 2942811 - protein, 29 aa, Entamoeba invadens
IGATGKNLGKFFLRCNKTTIGSGVVTEIK

SEQ ID NO: 2942812 - protein, 22 aa, Entamoeba invadens
IGATLKTLGCEALIDKKFVLAF

SEQ ID NO: 2942813 - protein, 18 aa, Entamoeba invadens
IGATNSMSAYRKSKPSAS

SEQ ID NO: 2942814 - protein, 19 aa, Entamoeba invadens
IGATVEYLSGMYILQSSSS

SEQ ID NO: 2942815 - protein, 21 aa, Entamoeba invadens
IGAVQRKSLYLVLSCVENGKY

SEQ ID NO: 2942816 - protein, 23 aa, Entamoeba invadens
IGAWYFGIEALKFVSLKKTTGTA

SEQ ID NO: 2942817 - protein, 28 aa, Entamoeba invadens
IGAYCPFLSQIELRMCTSITDNGVNILI

SEQ ID NO: 2942818 - protein, 18 aa, Entamoeba invadens
IGAYGMDIGDTFPHMLKE

SEQ ID NO: 2942819 - protein, 22 aa, Entamoeba invadens
IGCEVIKTWAMMGVASGNGEIY

SEQ ID NO: 2942820 - protein, 24 aa, Entamoeba invadens
IGCEVIKTWAMMGVGRGSGEIFIT

SEQ ID NO: 2942821 - protein, 18 aa, Entamoeba invadens
IGCFARVTATHFVTNTNP

SEQ ID NO: 2942822 - protein, 18 aa, Entamoeba invadens
IGCFKWVDLRSWISSTLV

SEQ ID NO: 2942823 - protein, 23 aa, Entamoeba invadens
IGCGFYPTTLKMFYTINGELVYS

SEQ ID NO: 2942824 - protein, 22 aa, Entamoeba invadens
IGCKVNEFLQVMYFACKSADEM

SEQ ID NO: 2942825 - protein, 26 aa, Entamoeba invadens
IGCMTAELFLGYPLFGATSEYNLLYK

SEQ ID NO: 2942826 - protein, 21 aa, Entamoeba invadens
IGCNFTCKFCQNWDISQCAAQ

SEQ ID NO: 2942827 - protein, 23 aa, Entamoeba invadens
IGCYDLPPEIPRDSCLYDLDTQF

SEQ ID NO: 2942828 - protein, 25 aa, Entamoeba invadens
IGDADIELIKSCEGYFKNWIQLTTY

SEQ ID NO: 2942829 - protein, 20 aa, Entamoeba invadens
IGDCCFKECINLTNVTIPSG

SEQ ID NO: 2942830 - protein, 18 aa, Entamoeba invadens
IGDCCFSGCLSLSNIEIS

SEQ ID NO: 2942831 - protein, 18 aa, Entamoeba invadens
IGDCRAFLYNGISGNFES

SEQ ID NO: 2942832 - protein, 17 aa, Entamoeba invadens
IGDCRTFLYSHINHHTS

SEQ ID NO: 2942833 - protein, 19 aa, Entamoeba invadens
IGDDCFNRCFSLASFDLPK

SEQ ID NO: 2942834 - protein, 25 aa, Entamoeba invadens
IGDEQNFGFGVSKFLTFLQAIGGYD

SEQ ID NO: 2942835 - protein, 20 aa, Entamoeba invadens
IGDEVWNFLSQMEELKRVDL

SEQ ID NO: 2942836 - protein, 18 aa, Entamoeba invadens
IGDFCFSNCIALTNIEFP

SEQ ID NO: 2942837 - protein, 18 aa, Entamoeba invadens
IGDGCFCECISLICVTIP

SEQ ID NO: 2942838 - protein, 21 aa, Entamoeba invadens
IGDGCFKNCRHLRSIRLSTHV

SEQ ID NO: 2942839 - protein, 21 aa, Entamoeba invadens
IGDGSFYICKSLVGVTIPPSV

SEQ ID NO: 2942840 - protein, 17 aa, Entamoeba invadens
IGDGYNWGAKVDDQETL

SEQ ID NO: 2942841 - protein, 23 aa, Entamoeba invadens
IGDIAMRAPMNWSLTKNYGQSEM

SEQ ID NO: 2942842 - protein, 18 aa, Entamoeba invadens
IGDKCFYKCVSLSNIEIP

SEQ ID NO: 2942843 - protein, 20 aa, Entamoeba invadens
IGDNCYRGATNLTTYHIPSG

SEQ ID NO: 2942844 - protein, 21 aa, Entamoeba invadens
IGDPCEIEFLVSRKKDLDVII

SEQ ID NO: 2942845 - protein, 23 aa, Entamoeba invadens
IGDPKCLSMLPEQLINVELMFLS

SEQ ID NO: 2942846 - protein, 20 aa, Entamoeba invadens
IGDQCFKACKSLINVTILSS

SEQ ID NO: 2942847 - protein, 20 aa, Entamoeba invadens
IGDQCFRQCTSLSNFTIPSS

SEQ ID NO: 2942848 - protein, 18 aa, Entamoeba invadens
IGDSCFSYCSSLSSVTIP

SEQ ID NO: 2942849 - protein, 21 aa, Entamoeba invadens
IGDSCFSYCYSLSSVTIPFGV

SEQ ID NO: 2942850 - protein, 23 aa, Entamoeba invadens
IGDSHCGKATLVRNVAQLCGSVL

SEQ ID NO: 2942851 - protein, 18 aa, Entamoeba invadens
IGDYCFCGCKKLETIALS

SEQ ID NO: 2942852 - protein, 17 aa, Entamoeba invadens
IGDYCFEDCDFRYNKKI

SEQ ID NO: 2942853 - protein, 22 aa, Entamoeba invadens
IGDYCFFKCISLTSIGIPPSIK

SEQ ID NO: 2942854 - protein, 18 aa, Entamoeba invadens
IGDYCFYNCKSLSNVILL

SEQ ID NO: 2942855 - protein, 21 aa, Entamoeba invadens
IGEAGFGLYLRNVRNTITDVK

SEQ ID NO: 2942856 - protein, 32 aa, Entamoeba invadens
IGEANPTRAVLCPKGGITLQLSIKFICGSHDF

SEQ ID NO: 2942857 - protein, 29 aa, Entamoeba invadens
IGECACCRKFLKRASCPDTVLCAMCNKEV

SEQ ID NO: 2942858 - protein, 19 aa, Entamoeba invadens
IGECCFFNCRSLKMLIIPK

SEQ ID NO: 2942859 - protein, 23 aa, Entamoeba invadens
IGEEMLKSMGWSEGKGVGKYEQG

SEQ ID NO: 2942860 - protein, 24 aa, Entamoeba invadens
IGEFCFKNCRKLSSISIPKSVSYI

SEQ ID NO: 2942861 - protein, 21 aa, Entamoeba invadens
IGEFIKYIYLNGTYRLDENCV

SEQ ID NO: 2942862 - protein, 22 aa, Entamoeba invadens
IGEGCCYHCESLKTLEIPRNVK

SEQ ID NO: 2942863 - protein, 25 aa, Entamoeba invadens
IGEIARSLYAATFGCINETIKMEEE

SEQ ID NO: 2942864 - protein, 28 aa, Entamoeba invadens
IGEIKETLVFPGRIAIVTEGVFRADFSL

SEQ ID NO: 2942865 - protein, 18 aa, Entamoeba invadens
IGEKCFYFNTTLINLTVP

SEQ ID NO: 2942866 - protein, 22 aa, Entamoeba invadens
IGEKCFYGNVAMTAVVIPNTIK

SEQ ID NO: 2942867 - protein, 20 aa, Entamoeba invadens
IGEKCFYSNLSLQQIKLPLA

SEQ ID NO: 2942868 - protein, 21 aa, Entamoeba invadens
IGEKPVEMTIEAGTAEPHTIT

SEQ ID NO: 2942869 - protein, 24 aa, Entamoeba invadens
IGEKRLPLDTAVDLLHQFYPQPNT

SEQ ID NO: 2942870 - protein, 25 aa, Entamoeba invadens
IGELKEVPPQVGFEVSQVQKIDLEE

SEQ ID NO: 2942871 - protein, 22 aa, Entamoeba invadens
IGELKSECVGVYENYVDMKENS

SEQ ID NO: 2942872 - protein, 22 aa, Entamoeba invadens
IGELSMIGLDFAKRGVKRVSIM

SEQ ID NO: 2942873 - protein, 18 aa, Entamoeba invadens
IGEMCFYDNTNLVEIVLP

SEQ ID NO: 2942874 - protein, 25 aa, Entamoeba invadens
IGEMKYRLLKDNALLERMIDVDVEA

SEQ ID NO: 2942875 - protein, 23 aa, Entamoeba invadens
IGENCFECCYSLSSIKLPKALLC

SEQ ID NO: 2942876 - protein, 29 aa, Entamoeba invadens
IGENKLDPIVFLKKCVTILSSKQNIILFD

SEQ ID NO: 2942877 - protein, 27 aa, Entamoeba invadens
IGERAFYGCEMLDAIDFLKYVKKVSYM

SEQ ID NO: 2942878 - protein, 27 aa, Entamoeba invadens
IGERAFYGCEMLDAIDFPKYVKKVSYM

SEQ ID NO: 2942879 - protein, 21 aa, Entamoeba invadens
IGESCFKTCYNITTLTLPSNL

SEQ ID NO: 2942880 - protein, 18 aa, Entamoeba invadens
IGESLRLTAKSIPQKEVI

SEQ ID NO: 2942881 - protein, 28 aa, Entamoeba invadens
IGESTWFKLGTEWFKTSPLVSSERVTVE

SEQ ID NO: 2942882 - protein, 30 aa, Entamoeba invadens
IGEYDSAVTYALRSGEYFHFTGNTDYANKM

SEQ ID NO: 2942883 - protein, 22 aa, Entamoeba invadens
IGEYSEVLDLIFYELQQSANRV

SEQ ID NO: 2942884 - protein, 18 aa, Entamoeba invadens
IGFDGLVMTDWFAGDSGV

SEQ ID NO: 2942885 - protein, 17 aa, Entamoeba invadens
IGFDVFMGAVNFDLQYF

SEQ ID NO: 2942886 - protein, 17 aa, Entamoeba invadens
IGFELIYKLYKNFITQM

SEQ ID NO: 2942887 - protein, 17 aa, Entamoeba invadens
IGFGDLNDVIFLSDSVD

SEQ ID NO: 2942888 - protein, 21 aa, Entamoeba invadens
IGGDYLKSLIVTFSDEETKEF

SEQ ID NO: 2942889 - protein, 25 aa, Entamoeba invadens
IGGFYKHLSEWSGLTRPKVVFFSNI

SEQ ID NO: 2942890 - protein, 17 aa, Entamoeba invadens
IGGLEMSYLNNIKGDTI

SEQ ID NO: 2942891 - protein, 22 aa, Entamoeba invadens
IGGLFVKMAPFLKIYGEYCKNY

SEQ ID NO: 2942892 - protein, 20 aa, Entamoeba invadens
IGGNCFRACSSLRNVILPSS

SEQ ID NO: 2942893 - protein, 22 aa, Entamoeba invadens
IGGPLDVLLNWALTPENSDYEF

SEQ ID NO: 2942894 - protein, 17 aa, Entamoeba invadens
IGGSGDFARNAYVSIFM

SEQ ID NO: 2942895 - protein, 17 aa, Entamoeba invadens
IGGTPLVKLNGVTDHSK

SEQ ID NO: 2942896 - protein, 20 aa, Entamoeba invadens
IGHFCFSMCLSLSEITIPTR

SEQ ID NO: 2942897 - protein, 21 aa, Entamoeba invadens
IGHFCFSMCLSLSEITIQTRV

SEQ ID NO: 2942898 - protein, 24 aa, Entamoeba invadens
IGHKKGKCVLVSGHDLFDMKKILE

SEQ ID NO: 2942899 - protein, 17 aa, Entamoeba invadens
IGHLCFFHCDSLSSVTI

SEQ ID NO: 2942900 - protein, 25 aa, Entamoeba invadens
IGHNVFPLLVGMELRYFDVVIYFPK

SEQ ID NO: 2942901 - protein, 32 aa, Entamoeba invadens
IGHSVGGLYIRLALPILLRRGIFNNPNYTLFN

SEQ ID NO: 2942902 - protein, 19 aa, Entamoeba invadens
IGIHYLPLICEEEVQTNSF

SEQ ID NO: 2942903 - protein, 18 aa, Entamoeba invadens
IGIKFKSDLSNFLYFEDR

SEQ ID NO: 2942904 - protein, 19 aa, Entamoeba invadens
IGIKSELPIDLNQPTHLEV

SEQ ID NO: 2942905 - protein, 20 aa, Entamoeba invadens
IGILKYGFGGGVLMEEDEQL

SEQ ID NO: 2942906 - protein, 28 aa, Entamoeba invadens
IGIPKSVTKIGVFSFRKCVTLREIEIPK

SEQ ID NO: 2942907 - protein, 18 aa, Entamoeba invadens
IGIYCFDQCIALSSVVLK

SEQ ID NO: 2942908 - protein, 18 aa, Entamoeba invadens
IGIYCFNQCIALSSVILK

SEQ ID NO: 2942909 - protein, 19 aa, Entamoeba invadens
IGKAELVVEFSMWDEMVLT

SEQ ID NO: 2942910 - protein, 18 aa, Entamoeba invadens
IGKCCFNECYNLSNVTIP

SEQ ID NO: 2942911 - protein, 19 aa, Entamoeba invadens
IGKCVLSIPTGEVKPTSFK

SEQ ID NO: 2942912 - protein, 19 aa, Entamoeba invadens
IGKEAIYTTGFWSSKEHLF

SEQ ID NO: 2942913 - protein, 18 aa, Entamoeba invadens
IGKECFTCGEMVFHPQMA

SEQ ID NO: 2942914 - protein, 18 aa, Entamoeba invadens
IGKEFQCNGSHKQDEENK

SEQ ID NO: 2942915 - protein, 17 aa, Entamoeba invadens
IGKELFVGAEILFQPSI

SEQ ID NO: 2942916 - protein, 28 aa, Entamoeba invadens
IGKGVLKVICKQFLREALNELVDEDIET

SEQ ID NO: 2942917 - protein, 19 aa, Entamoeba invadens
IGKHLKRKAGAAVVVARRG

SEQ ID NO: 2942918 - protein, 20 aa, Entamoeba invadens
IGKIKTFVVFPVRDNLLSWL

SEQ ID NO: 2942919 - protein, 20 aa, Entamoeba invadens
IGKKNCVKLAKFNTYDNCSF

SEQ ID NO: 2942920 - protein, 24 aa, Entamoeba invadens
IGKMCCSQCLQLKNLVLPNSIPEI

SEQ ID NO: 2942921 - protein, 18 aa, Entamoeba invadens
IGKMICDNMTLNLRFSLT

SEQ ID NO: 2942922 - protein, 22 aa, Entamoeba invadens
IGKRCAYIYKVAVKKGSKKPAV

SEQ ID NO: 2942923 - protein, 22 aa, Entamoeba invadens
IGKSCFRECHMLKNITLPHQLQ

SEQ ID NO: 2942924 - protein, 20 aa, Entamoeba invadens
IGKTCFKIASANCIGGCVSL

SEQ ID NO: 2942925 - protein, 25 aa, Entamoeba invadens
IGKTYDCWSSLKLPEESWTDTTIPF

SEQ ID NO: 2942926 - protein, 19 aa, Entamoeba invadens
IGLANCYGASFGIKCPVLN

SEQ ID NO: 2942927 - protein, 18 aa, Entamoeba invadens
IGLANWLLYLLKNYNTDI

SEQ ID NO: 2942928 - protein, 23 aa, Entamoeba invadens
IGLMMKMKVGVIYVKKDQNEENA

SEQ ID NO: 2942929 - protein, 17 aa, Entamoeba invadens
IGLPAKIQAVGRGSFCG

SEQ ID NO: 2942930 - protein, 19 aa, Entamoeba invadens
IGLSRAGRRTTLIGCIALS

SEQ ID NO: 2942931 - protein, 19 aa, Entamoeba invadens
IGLSRAGRRTTLIGCLALS

SEQ ID NO: 2942932 - protein, 37 aa, Entamoeba invadens
IGLVMFGTPFGWNWIPGISWYFYRGFLEPIVSAQPNA

SEQ ID NO: 2942933 - protein, 19 aa, Entamoeba invadens
IGLVRLMGRDAGFIALNAS

SEQ ID NO: 2942934 - protein, 22 aa, Entamoeba invadens
IGLYRFLEICFVVFNTNPGNGP

SEQ ID NO: 2942935 - protein, 17 aa, Entamoeba invadens
IGLYVCAGNAMTIKLPS

SEQ ID NO: 2942936 - protein, 30 aa, Entamoeba invadens
IGMDKFYVKECVLMGKKLHYEIDMITCSKN

SEQ ID NO: 2942937 - protein, 20 aa, Entamoeba invadens
IGNACFEGCFSLVAIQIPNT

SEQ ID NO: 2942938 - protein, 25 aa, Entamoeba invadens
IGNACGGVALLHCLVNNPLVQYFDD

SEQ ID NO: 2942939 - protein, 27 aa, Entamoeba invadens
IGNDVNLPLVFPVEVPRCDNVTEYIYG

SEQ ID NO: 2942940 - protein, 25 aa, Entamoeba invadens
IGNFCFCECRSLSSITIPLSVTSIG

SEQ ID NO: 2942941 - protein, 26 aa, Entamoeba invadens
IGNFLKFYLNSMIEPVVPFNQSRRFF

SEQ ID NO: 2942942 - protein, 21 aa, Entamoeba invadens
IGNGCFRGCSSLKSVTIPSSV

SEQ ID NO: 2942943 - protein, 17 aa, Entamoeba invadens
IGNGILRLERNSHQYFI

SEQ ID NO: 2942944 - protein, 24 aa, Entamoeba invadens
IGNGSFFLCTSLTSFIFPLSLRRI

SEQ ID NO: 2942945 - protein, 24 aa, Entamoeba invadens
IGNHCFCFCSSLSSVTIPSSVTSI

SEQ ID NO: 2942946 - protein, 17 aa, Entamoeba invadens
IGNHWVLISKELYGRTP

SEQ ID NO: 2942947 - protein, 18 aa, Entamoeba invadens
IGNLCFGECLSLMEISLS

SEQ ID NO: 2942948 - protein, 18 aa, Entamoeba invadens
IGNLPVVFLIEDSHYDVH

SEQ ID NO: 2942949 - protein, 19 aa, Entamoeba invadens
IGNLRGLYELDMSSNQMDM

SEQ ID NO: 2942950 - protein, 21 aa, Entamoeba invadens
IGNPLCSASLYHEAQLESLIV

SEQ ID NO: 2942951 - protein, 26 aa, Entamoeba invadens
IGNQVLRFYRRIIRDFLTRNYSASHT

SEQ ID NO: 2942952 - protein, 21 aa, Entamoeba invadens
IGNRWSPFLYSCVLGEERAFD

SEQ ID NO: 2942953 - protein, 22 aa, Entamoeba invadens
IGNSCFEKCNMLSIVIIPTSVK

SEQ ID NO: 2942954 - protein, 32 aa, Entamoeba invadens
IGNTFKLFIPFFKDYFYYISHYDTSSKIISKY

SEQ ID NO: 2942955 - protein, 17 aa, Entamoeba invadens
IGNVGGGISVVVRDTKN

SEQ ID NO: 2942956 - protein, 17 aa, Entamoeba invadens
IGNYCFIGCTSMTSVNI

SEQ ID NO: 2942957 - protein, 19 aa, Entamoeba invadens
IGNYCFSKCHSIRQMTLPY

SEQ ID NO: 2942958 - protein, 18 aa, Entamoeba invadens
IGPINTIMCYNRKLVTGG

SEQ ID NO: 2942959 - protein, 19 aa, Entamoeba invadens
IGPINTIMCYNRKLVTGGV

SEQ ID NO: 2942960 - protein, 22 aa, Entamoeba invadens
IGQEVKLGRRINMIMQTVFFKL

SEQ ID NO: 2942961 - protein, 23 aa, Entamoeba invadens
IGQFCFLNTKFTRIEIPDSVKEI

SEQ ID NO: 2942962 - protein, 19 aa, Entamoeba invadens
IGQICVMVHCGSRGLGHQV

SEQ ID NO: 2942963 - protein, 20 aa, Entamoeba invadens
IGQLKFQKKIVEWTNMCQYR

SEQ ID NO: 2942964 - protein, 21 aa, Entamoeba invadens
IGQSCFRGCSKLSSIEIPANV

SEQ ID NO: 2942965 - protein, 33 aa, Entamoeba invadens
IGQTFKLYLPFFKCYFFYISHYDSVNKLLSKYE

SEQ ID NO: 2942966 - protein, 23 aa, Entamoeba invadens
IGRDVKLGFGCFKGCNVLALRRR

SEQ ID NO: 2942967 - protein, 17 aa, Entamoeba invadens
IGREIDFSMEYPRPDFW

SEQ ID NO: 2942968 - protein, 17 aa, Entamoeba invadens
IGRIEMIVGHYGPFEKD

SEQ ID NO: 2942969 - protein, 20 aa, Entamoeba invadens
IGRNYDFMEVVRWFAERVDM

SEQ ID NO: 2942970 - protein, 17 aa, Entamoeba invadens
IGRSLIFGKDNRTIITT

SEQ ID NO: 2942971 - protein, 19 aa, Entamoeba invadens
IGRYAFCMCKTLFKEFPKY

SEQ ID NO: 2942972 - protein, 25 aa, Entamoeba invadens
IGSDRGEIYFINWNKKYTTWIDPRP

SEQ ID NO: 2942973 - protein, 21 aa, Entamoeba invadens
IGSECFSHCLSLSSIKGGEHV

SEQ ID NO: 2942974 - protein, 19 aa, Entamoeba invadens
IGSFCVLDSADFMLGSGGL

SEQ ID NO: 2942975 - protein, 27 aa, Entamoeba invadens
IGSGVFVDCRDAFAIGENFVVVGRTAF

SEQ ID NO: 2942976 - protein, 23 aa, Entamoeba invadens
IGSIFRVPSCISFLDYKKRQVKI

SEQ ID NO: 2942977 - protein, 23 aa, Entamoeba invadens
IGSKLYAIGSCCFRGCHNLEDLI

SEQ ID NO: 2942978 - protein, 19 aa, Entamoeba invadens
IGSKLYAIGSCCFSGCINL

SEQ ID NO: 2942979 - protein, 22 aa, Entamoeba invadens
IGSKWCSIASCLNNRTARATRN

SEQ ID NO: 2942980 - protein, 26 aa, Entamoeba invadens
IGSLGSEGRVLLSFWYIYKKCGNYSM

SEQ ID NO: 2942981 - protein, 18 aa, Entamoeba invadens
IGSMIGDIFSKIGKDGAV

SEQ ID NO: 2942982 - protein, 26 aa, Entamoeba invadens
IGSMNFKVTCVRSVYHSAFPNQIPQK

SEQ ID NO: 2942983 - protein, 25 aa, Entamoeba invadens
IGSTLRFVLPYGSFPFDVTVDTNYT

SEQ ID NO: 2942984 - protein, 25 aa, Entamoeba invadens
IGSTVRALRFIDCIIQMLQSTPFTQ

SEQ ID NO: 2942985 - protein, 17 aa, Entamoeba invadens
IGSYAFLHCEKLEDINV

SEQ ID NO: 2942986 - protein, 20 aa, Entamoeba invadens
IGTCCSGVKSDVDFAQVFLA

SEQ ID NO: 2942987 - protein, 17 aa, Entamoeba invadens
IGTETCKINREIKYTVT

SEQ ID NO: 2942988 - protein, 20 aa, Entamoeba invadens
IGTKMFLQILFGVILKSCTD

SEQ ID NO: 2942989 - protein, 22 aa, Entamoeba invadens
IGTRRKYYVGSEMKDVYDRSQF

SEQ ID NO: 2942990 - protein, 23 aa, Entamoeba invadens
IGTYPVEAGFVFKRIGEDLVGTY

SEQ ID NO: 2942991 - protein, 19 aa, Entamoeba invadens
IGVDLPITVKSATPQVPQW

SEQ ID NO: 2942992 - protein, 23 aa, Entamoeba invadens
IGVFAFKNCFAIEDITLPSSISV

SEQ ID NO: 2942993 - protein, 34 aa, Entamoeba invadens
IGVFKREYIYRSSLRSGDFLEFLKNAYKTVPNLT

SEQ ID NO: 2942994 - protein, 19 aa, Entamoeba invadens
IGVGGKMVVGFTCDEGLGL

SEQ ID NO: 2942995 - protein, 19 aa, Entamoeba invadens
IGVHNIWYGVPRKYDVPST

SEQ ID NO: 2942996 - protein, 25 aa, Entamoeba invadens
IGVIKNNAKKFVVLTDRGLREFECQ

SEQ ID NO: 2942997 - protein, 18 aa, Entamoeba invadens
IGVIQGAKGSCMVQKNRT

SEQ ID NO: 2942998 - protein, 29 aa, Entamoeba invadens
IGVKKSGWRFPLPLYRCIDYLERNNGAMT

SEQ ID NO: 2942999 - protein, 24 aa, Entamoeba invadens
IGVKRWPYRKILKVDREIQKNETI

SEQ ID NO: 2943000 - protein, 24 aa, Entamoeba invadens
IGVLGCPNFEGGIIVAAQIGCGAR

SEQ ID NO: 2943001 - protein, 18 aa, Entamoeba invadens
IGVLPRLDEFIKENEADP

SEQ ID NO: 2943002 - protein, 25 aa, Entamoeba invadens
IGVLQHFKDALVLFKEMLYNEKRQV

SEQ ID NO: 2943003 - protein, 17 aa, Entamoeba invadens
IGVPYIYMHLSIVDEYA

SEQ ID NO: 2943004 - protein, 18 aa, Entamoeba invadens
IGVQWIHNRLNLIHRDLK

SEQ ID NO: 2943005 - protein, 17 aa, Entamoeba invadens
IGVSCFGGCLNLEQIDM

SEQ ID NO: 2943006 - protein, 17 aa, Entamoeba invadens
IGVSLTISNVVTEDLAT

SEQ ID NO: 2943007 - protein, 17 aa, Entamoeba invadens
IGVSRPKFPNVIVDIQD

SEQ ID NO: 2943008 - protein, 17 aa, Entamoeba invadens
IGWELYSKDSIAFSAYV

SEQ ID NO: 2943009 - protein, 23 aa, Entamoeba invadens
IGYCCFCGCTSLKTVDVPSSVTE

SEQ ID NO: 2943010 - protein, 17 aa, Entamoeba invadens
IGYCYSYSFSALNDGEQ

SEQ ID NO: 2943011 - protein, 25 aa, Entamoeba invadens
IGYFWNCSMLSKIVIPLGITHLDDH

SEQ ID NO: 2943012 - protein, 22 aa, Entamoeba invadens
IGYKALKQFALRNNITTIFRGH

SEQ ID NO: 2943013 - protein, 25 aa, Entamoeba invadens
IGYKFELIKLISFVVVVDAREGGPK

SEQ ID NO: 2943014 - protein, 18 aa, Entamoeba invadens
IGYLCFFGCVSLEQLGVD

SEQ ID NO: 2943015 - protein, 18 aa, Entamoeba invadens
IGYLTDWATSQGLIIRKG

SEQ ID NO: 2943016 - protein, 24 aa, Entamoeba invadens
IGYPVLIPIMLKRSQFKVQLFDEV

SEQ ID NO: 2943017 - protein, 23 aa, Entamoeba invadens
IGYREIHLVINFVVNFTLDKFVN

SEQ ID NO: 2943018 - protein, 17 aa, Entamoeba invadens
IGYSLVVYVPFNSVSKE

SEQ ID NO: 2943019 - protein, 17 aa, Entamoeba invadens
IGYVFNTRLSKISKNTQ

SEQ ID NO: 2943020 - protein, 17 aa, Entamoeba invadens
IHAVEIFNVPVIAEGAF

SEQ ID NO: 2943021 - protein, 17 aa, Entamoeba invadens
IHCKDVKLRNCGVNRIE

SEQ ID NO: 2943022 - protein, 29 aa, Entamoeba invadens
IHCMCDGCGIGSAPKKAAWSAGQTAVSSL

SEQ ID NO: 2943023 - protein, 22 aa, Entamoeba invadens
IHCPTWLAPEVLLGQKFTQKSD

SEQ ID NO: 2943024 - protein, 25 aa, Entamoeba invadens
IHDFRVQPGFLQRTFYATKHHGDSA

SEQ ID NO: 2943025 - protein, 25 aa, Entamoeba invadens
IHDMRKPKEAFTHLKIQDNVVNSIE

SEQ ID NO: 2943026 - protein, 19 aa, Entamoeba invadens
IHEFLKPYQPISVDIPRYA

SEQ ID NO: 2943027 - protein, 26 aa, Entamoeba invadens
IHEPAVFKLPGAEQFVIYGEPKNEFM

SEQ ID NO: 2943028 - protein, 17 aa, Entamoeba invadens
IHEYKRQTLAILGTIWQ

SEQ ID NO: 2943029 - protein, 31 aa, Entamoeba invadens
IHFEARVVGLILKLCFEDGIVSENKIGLGTI

SEQ ID NO: 2943030 - protein, 25 aa, Entamoeba invadens
IHFKDHHLMCYPGDYDTFEATMQKR

SEQ ID NO: 2943031 - protein, 17 aa, Entamoeba invadens
IHFKKFLILDKLYVWEK

SEQ ID NO: 2943032 - protein, 26 aa, Entamoeba invadens
IHFLRQCRVLRRHGRLGKKVSLHLNE

SEQ ID NO: 2943033 - protein, 21 aa, Entamoeba invadens
IHFSGRFKVLGNYKIYLRFLT

SEQ ID NO: 2943034 - protein, 34 aa, Entamoeba invadens
IHGKKGILVMCRSESGKVFGFFSGGKVPETTEMK

SEQ ID NO: 2943035 - protein, 23 aa, Entamoeba invadens
IHGMPLACCVGIGPEKLNTVMTR

SEQ ID NO: 2943036 - protein, 17 aa, Entamoeba invadens
IHGRPEKYCVIDLPSDE

SEQ ID NO: 2943037 - protein, 21 aa, Entamoeba invadens
IHGTLGIDCFYLDDHKCVTLE

SEQ ID NO: 2943038 - protein, 17 aa, Entamoeba invadens
IHGYKSDLKRILEQAKH

SEQ ID NO: 2943039 - protein, 23 aa, Entamoeba invadens
IHHPDCFDNFIIHRKKPRFMQDY

SEQ ID NO: 2943040 - protein, 17 aa, Entamoeba invadens
IHIFKKEIPTFAANLSK

SEQ ID NO: 2943041 - protein, 23 aa, Entamoeba invadens
IHIRKELQIFTGIDSLHTDINTL

SEQ ID NO: 2943042 - protein, 19 aa, Entamoeba invadens
IHKIFKFAAKTVINGKLYE

SEQ ID NO: 2943043 - protein, 19 aa, Entamoeba invadens
IHKNIIRYFLLIHGDEKLF

SEQ ID NO: 2943044 - protein, 19 aa, Entamoeba invadens
IHLDKFCVRYSDLDDSIIS

SEQ ID NO: 2943045 - protein, 17 aa, Entamoeba invadens
IHLDKRLTVLPFKCFYC

SEQ ID NO: 2943046 - protein, 24 aa, Entamoeba invadens
IHLDKRLTVLPSECFSECKNLKEI

SEQ ID NO: 2943047 - protein, 25 aa, Entamoeba invadens
IHLEILPLPVSPLWVNIIEAQRERY

SEQ ID NO: 2943048 - protein, 25 aa, Entamoeba invadens
IHLFSVKPKFCRNGDQVTLKGPDSV

SEQ ID NO: 2943049 - protein, 17 aa, Entamoeba invadens
IHLKRFGNASGSFRDKV

SEQ ID NO: 2943050 - protein, 18 aa, Entamoeba invadens
IHMIKYCSERSIYPIPTT

SEQ ID NO: 2943051 - protein, 24 aa, Entamoeba invadens
IHMKAEEGIGLYLNGAKKWMDESA

SEQ ID NO: 2943052 - protein, 23 aa, Entamoeba invadens
IHNRDSFCGFDIRQSGQCMKIEF

SEQ ID NO: 2943053 - protein, 19 aa, Entamoeba invadens
IHPTVDFFLTHLVRRHPTS

SEQ ID NO: 2943054 - protein, 17 aa, Entamoeba invadens
IHRDIKCGNVLVSSDFQ

SEQ ID NO: 2943055 - protein, 24 aa, Entamoeba invadens
IHRDLKLANIFIHDMHVKIGDFGL

SEQ ID NO: 2943056 - protein, 22 aa, Entamoeba invadens
IHRMYFKVGFNLTGATTDFNGI

SEQ ID NO: 2943057 - protein, 24 aa, Entamoeba invadens
IHSKVPLWLSKIFNKSGITCSQVE

SEQ ID NO: 2943058 - protein, 17 aa, Entamoeba invadens
IHSPLCRTVKTLRDDGL

SEQ ID NO: 2943059 - protein, 17 aa, Entamoeba invadens
IHTAAQMVNFLPINKEM

SEQ ID NO: 2943060 - protein, 19 aa, Entamoeba invadens
IHTCDEWLVGYDKLQCLSK

SEQ ID NO: 2943061 - protein, 17 aa, Entamoeba invadens
IHTKTLFQFIKYISQVG

SEQ ID NO: 2943062 - protein, 17 aa, Entamoeba invadens
IHTLLNWNIMFNNGISF

SEQ ID NO: 2943063 - protein, 17 aa, Entamoeba invadens
IHTTIQMSSPIERITAL

SEQ ID NO: 2943064 - protein, 19 aa, Entamoeba invadens
IHVDFSQSIGKYGVKYDFI

SEQ ID NO: 2943065 - protein, 18 aa, Entamoeba invadens
IHVQNCPLLKRITNRRIG

SEQ ID NO: 2943066 - protein, 17 aa, Entamoeba invadens
IHYNVWSTRGMTVGAQV

SEQ ID NO: 2943067 - protein, 18 aa, Entamoeba invadens
IHYWRYRCHVDLDDILSD

SEQ ID NO: 2943068 - protein, 24 aa, Entamoeba invadens
IIADRRIGILPGEKAPVIKNPVGL

SEQ ID NO: 2943069 - protein, 17 aa, Entamoeba invadens
IIAELEKACPTVLYVPG

SEQ ID NO: 2943070 - protein, 24 aa, Entamoeba invadens
IIAKLAAGIADDFLTTSFLAANCP

SEQ ID NO: 2943071 - protein, 25 aa, Entamoeba invadens
IIAKRRPDLLDAKFLSSGSASVNYS

SEQ ID NO: 2943072 - protein, 26 aa, Entamoeba invadens
IIAQFCVQLGWDMMYAVFAAIVDRLN

SEQ ID NO: 2943073 - protein, 26 aa, Entamoeba invadens
IIARKRYGFPEALFNLAVIDITAEGI

SEQ ID NO: 2943074 - protein, 24 aa, Entamoeba invadens
IIASFKLGGVVIRMIDNRMRIYIS

SEQ ID NO: 2943075 - protein, 17 aa, Entamoeba invadens
IIASYLPLLQEWTKKKK

SEQ ID NO: 2943076 - protein, 24 aa, Entamoeba invadens
IIATKELRDILVLFYKRKDVNPFD

SEQ ID NO: 2943077 - protein, 18 aa, Entamoeba invadens
IICCCAFLSCGFESLTIP

SEQ ID NO: 2943078 - protein, 22 aa, Entamoeba invadens
IICDILRSKSRTFAALQKNETT

SEQ ID NO: 2943079 - protein, 32 aa, Entamoeba invadens
IICEYHGIRVWDCENLESFTELFTYPVEDNAI

SEQ ID NO: 2943080 - protein, 23 aa, Entamoeba invadens
IICGTKADLPCVVDENIIDKFIC

SEQ ID NO: 2943081 - protein, 22 aa, Entamoeba invadens
IICKCGKNLFDYGKSRLSVTGK

SEQ ID NO: 2943082 - protein, 18 aa, Entamoeba invadens
IICPHKTEFLMMLLENYR

SEQ ID NO: 2943083 - protein, 18 aa, Entamoeba invadens
IICTSIASVEQWRDEIRK

SEQ ID NO: 2943084 - protein, 23 aa, Entamoeba invadens
IICVKGMCTTLPSTSCIGDSILP

SEQ ID NO: 2943085 - protein, 25 aa, Entamoeba invadens
IIDENAIRWSLYERVEFFRSVIDSM

SEQ ID NO: 2943086 - protein, 23 aa, Entamoeba invadens
IIDFYRIVVWFNVDYTTVDMNSN

SEQ ID NO: 2943087 - protein, 18 aa, Entamoeba invadens
IIDGMLIAKWKKPGFGHL

SEQ ID NO: 2943088 - protein, 20 aa, Entamoeba invadens
IIDLRFPKHFLYTNQSHKSA

SEQ ID NO: 2943089 - protein, 18 aa, Entamoeba invadens
IIDNGCSMTKAGFGGDDA

SEQ ID NO: 2943090 - protein, 23 aa, Entamoeba invadens
IIDNLHCLIDLQFGELKERLISL

SEQ ID NO: 2943091 - protein, 19 aa, Entamoeba invadens
IIEAIKFSDEHGMSAHSTG

SEQ ID NO: 2943092 - protein, 18 aa, Entamoeba invadens
IIEAIKFSDKHGDVCPLN

SEQ ID NO: 2943093 - protein, 22 aa, Entamoeba invadens
IIECINIAISYFFEISQTEKFM

SEQ ID NO: 2943094 - protein, 18 aa, Entamoeba invadens
IIEGLSMMVYACSNSITQ

SEQ ID NO: 2943095 - protein, 18 aa, Entamoeba invadens
IIEKFCGAQFVMKIGKKL

SEQ ID NO: 2943096 - protein, 26 aa, Entamoeba invadens
IIEKKFLWDKVRVEGGAYDGSLSYQA

SEQ ID NO: 2943097 - protein, 24 aa, Entamoeba invadens
IIEKLKLTINEKVELEKTIENQNK

SEQ ID NO: 2943098 - protein, 19 aa, Entamoeba invadens
IIEKNKFALEDKADKSEDE

SEQ ID NO: 2943099 - protein, 18 aa, Entamoeba invadens
IIEKRNQIILSHQLIAFS

SEQ ID NO: 2943100 - protein, 24 aa, Entamoeba invadens
IIELDGSSLFAIFSNHDPKFPLVV

SEQ ID NO: 2943101 - protein, 19 aa, Entamoeba invadens
IIELTPPFEHCLREVQDAI

SEQ ID NO: 2943102 - protein, 26 aa, Entamoeba invadens
IIEPKDTAGIFVCYIKSLGEPLISSD

SEQ ID NO: 2943103 - protein, 17 aa, Entamoeba invadens
IIERVWRNGKLLYGSED

SEQ ID NO: 2943104 - protein, 17 aa, Entamoeba invadens
IIESVLMAVTYEAGDAD

SEQ ID NO: 2943105 - protein, 18 aa, Entamoeba invadens
IIEYDIVFGYIFDNTINN

SEQ ID NO: 2943106 - protein, 19 aa, Entamoeba invadens
IIFDSRLSGMDQRELKAQI

SEQ ID NO: 2943107 - protein, 19 aa, Entamoeba invadens
IIFEYARKDLVHFTLVNNS

SEQ ID NO: 2943108 - protein, 19 aa, Entamoeba invadens
IIFEYARKNLVHFTLVNNS

SEQ ID NO: 2943109 - protein, 19 aa, Entamoeba invadens
IIFIDEIDTVVGIRSGGSG

SEQ ID NO: 2943110 - protein, 19 aa, Entamoeba invadens
IIFIGKGYGLYRLDVLSGK

SEQ ID NO: 2943111 - protein, 22 aa, Entamoeba invadens
IIFKQFDEFYAIYKHSIAFPEL

SEQ ID NO: 2943112 - protein, 20 aa, Entamoeba invadens
IIFLAISLLYSHTGLQKNTM

SEQ ID NO: 2943113 - protein, 21 aa, Entamoeba invadens
IIFYFRFVPENVIRKTDNCKF

SEQ ID NO: 2943114 - protein, 18 aa, Entamoeba invadens
IIGCQRKIYPLLQEDSDL

SEQ ID NO: 2943115 - protein, 17 aa, Entamoeba invadens
IIGDSGVGKTCISSRLV

SEQ ID NO: 2943116 - protein, 19 aa, Entamoeba invadens
IIGEYCFNRCIKLKNVIIP

SEQ ID NO: 2943117 - protein, 18 aa, Entamoeba invadens
IIGKKCLFGYETLCSLKI

SEQ ID NO: 2943118 - protein, 19 aa, Entamoeba invadens
IIGKRVSRGRDWKWDEQDG

SEQ ID NO: 2943119 - protein, 22 aa, Entamoeba invadens
IIGLICCGDAKVSSSTIRNSEK

SEQ ID NO: 2943120 - protein, 25 aa, Entamoeba invadens
IIGTLKLGIRYNLGSVTCWHLYALI

SEQ ID NO: 2943121 - protein, 32 aa, Entamoeba invadens
IIGYGEMYLDCLLRDIRLMFGEFEMRVSDPMV

SEQ ID NO: 2943122 - protein, 17 aa, Entamoeba invadens
IIHCADSIFNITEKTIS

SEQ ID NO: 2943123 - protein, 32 aa, Entamoeba invadens
IIHLSGGCPKRLCFWLSTVLRVYAWTCMSKTR

SEQ ID NO: 2943124 - protein, 23 aa, Entamoeba invadens
IIHPLRYIYSLSNASTFTNTTVD

SEQ ID NO: 2943125 - protein, 20 aa, Entamoeba invadens
IIHRDLALRNVLWYEDASGL

SEQ ID NO: 2943126 - protein, 17 aa, Entamoeba invadens
IIHRKTPRYQLDHARAF

SEQ ID NO: 2943127 - protein, 22 aa, Entamoeba invadens
IIHTYLLKPFTFVPMRISSDYL

SEQ ID NO: 2943128 - protein, 25 aa, Entamoeba invadens
IIHVRPRVSHMVYMVMSFDHYYAEA

SEQ ID NO: 2943129 - protein, 19 aa, Entamoeba invadens
IIHYMKGYINSIVPVLYTF

SEQ ID NO: 2943130 - protein, 18 aa, Entamoeba invadens
IIICDWMGINLYYDSLLS

SEQ ID NO: 2943131 - protein, 19 aa, Entamoeba invadens
IIIDSKFGLLRKIKDAFNR

SEQ ID NO: 2943132 - protein, 25 aa, Entamoeba invadens
IIIEGWRVALKAAQERLGSMQFNVS

SEQ ID NO: 2943133 - protein, 28 aa, Entamoeba invadens
IIIGESCFKLCISLSVINIPDGVNTIGH

SEQ ID NO: 2943134 - protein, 23 aa, Entamoeba invadens
IIIRCYPGFQAAIVYRVAHVIYT

SEQ ID NO: 2943135 - protein, 17 aa, Entamoeba invadens
IIIVEAFQKRPAYSTLG

SEQ ID NO: 2943136 - protein, 19 aa, Entamoeba invadens
IIKAVKYLRFEKGVIVQDL

SEQ ID NO: 2943137 - protein, 22 aa, Entamoeba invadens
IIKDFNCGMFVRFNEDEDTHIV

SEQ ID NO: 2943138 - protein, 19 aa, Entamoeba invadens
IIKDMKFSVSPVVRVAVET

SEQ ID NO: 2943139 - protein, 18 aa, Entamoeba invadens
IIKEGKFTAGPGYEDIQR

SEQ ID NO: 2943140 - protein, 22 aa, Entamoeba invadens
IIKELMSILMMARDCRLSTPFK

SEQ ID NO: 2943141 - protein, 24 aa, Entamoeba invadens
IIKEMKTELSSLLLSKEKAVNDLL

SEQ ID NO: 2943142 - protein, 27 aa, Entamoeba invadens
IIKFKCISFKKLLFKFSTTAVKSIAVI

SEQ ID NO: 2943143 - protein, 20 aa, Entamoeba invadens
IIKGVRPCWSEDRYPYNEFI

SEQ ID NO: 2943144 - protein, 23 aa, Entamoeba invadens
IIKKCFKERTLAPVHEFVTATEL

SEQ ID NO: 2943145 - protein, 22 aa, Entamoeba invadens
IIKKNLTQMSAWANLQKYKLIF

SEQ ID NO: 2943146 - protein, 17 aa, Entamoeba invadens
IIKMCWKQKAEERIKVE

SEQ ID NO: 2943147 - protein, 26 aa, Entamoeba invadens
IIKMGFLEKLLKYNKLFFDSKEVKNS

SEQ ID NO: 2943148 - protein, 19 aa, Entamoeba invadens
IIKRCEKLTSVTFINQNIT

SEQ ID NO: 2943149 - protein, 17 aa, Entamoeba invadens
IIKSFPFKEHYNTEYSI

SEQ ID NO: 2943150 - protein, 29 aa, Entamoeba invadens
IIKSQLRFARSVYEGMEFSVNVITDKRVG

SEQ ID NO: 2943151 - protein, 27 aa, Entamoeba invadens
IIKVICFTENTFAKMFVFMFKQDFETT

SEQ ID NO: 2943152 - protein, 19 aa, Entamoeba invadens
IIKYCKANAARGCTSDGLQ

SEQ ID NO: 2943153 - protein, 27 aa, Entamoeba invadens
IILECTRLGLKTVWLGGTFTTSFFTAI

SEQ ID NO: 2943154 - protein, 20 aa, Entamoeba invadens
IILENRLSEVDYVFVKVDDT

SEQ ID NO: 2943155 - protein, 22 aa, Entamoeba invadens
IILGNCVEYFKDLCFANCVNLE

SEQ ID NO: 2943156 - protein, 24 aa, Entamoeba invadens
IILKDVLHGLSYLHQMKMIHRDIK

SEQ ID NO: 2943157 - protein, 25 aa, Entamoeba invadens
IILKRLSAEFPDMFTKCNLFCGVSA

SEQ ID NO: 2943158 - protein, 26 aa, Entamoeba invadens
IILLFCLKLQFPDRVSLLRGNHECRL

SEQ ID NO: 2943159 - protein, 27 aa, Entamoeba invadens
IILLICLKLQFPDRIHLLRGNHECRLM

SEQ ID NO: 2943160 - protein, 18 aa, Entamoeba invadens
IILLWGNPKNMDFSIYTK

SEQ ID NO: 2943161 - protein, 25 aa, Entamoeba invadens
IILNPHFCKLISWYDNEWGYSTRLV

SEQ ID NO: 2943162 - protein, 25 aa, Entamoeba invadens
IILNPHFCKLVSWYDNEWGYSTRLV

SEQ ID NO: 2943163 - protein, 25 aa, Entamoeba invadens
IILNPHFSKLIAWYDNEWGYSTRLV

SEQ ID NO: 2943164 - protein, 17 aa, Entamoeba invadens
IILPIIFDFLKKSPVNE

SEQ ID NO: 2943165 - protein, 30 aa, Entamoeba invadens
IILPKTLKTIGKFAFKNCVSLESVTFPKLL

SEQ ID NO: 2943166 - protein, 18 aa, Entamoeba invadens
IILPLTIRYKILLDATKG

SEQ ID NO: 2943167 - protein, 17 aa, Entamoeba invadens
IILSLKDFSMSFRAFTT

SEQ ID NO: 2943168 - protein, 17 aa, Entamoeba invadens
IILTPLMEIKRVYNELD

SEQ ID NO: 2943169 - protein, 17 aa, Entamoeba invadens
IILVEKMHDCFLTSIEQ

SEQ ID NO: 2943170 - protein, 20 aa, Entamoeba invadens
IIMLVSSWKAMGPINKEKKK

SEQ ID NO: 2943171 - protein, 20 aa, Entamoeba invadens
IIMQCLMVLTSITYLPYDIF

SEQ ID NO: 2943172 - protein, 24 aa, Entamoeba invadens
IIMRFGLHLIRLASFKEKYSHVGS

SEQ ID NO: 2943173 - protein, 17 aa, Entamoeba invadens
IINAIYFNGEWNEPFHI

SEQ ID NO: 2943174 - protein, 25 aa, Entamoeba invadens
IINCCEEIGLEFPLCSQCYQIIESA

SEQ ID NO: 2943175 - protein, 29 aa, Entamoeba invadens
IINELPLKYSTQIDIDWTYTILSMENITL

SEQ ID NO: 2943176 - protein, 18 aa, Entamoeba invadens
IINLFYFVYRNNFQPLPN

SEQ ID NO: 2943177 - protein, 18 aa, Entamoeba invadens
IINLPFKKQLIFKIHRTT

SEQ ID NO: 2943178 - protein, 17 aa, Entamoeba invadens
IINSYRLQMGMPELVDT

SEQ ID NO: 2943179 - protein, 19 aa, Entamoeba invadens
IINTLYFWVNAMSITKYVK

SEQ ID NO: 2943180 - protein, 25 aa, Entamoeba invadens
IIPCARRCCFACILTGAPSLLEPMY

SEQ ID NO: 2943181 - protein, 27 aa, Entamoeba invadens
IIPECDLLICCGDFSSGGKKETVESFA

SEQ ID NO: 2943182 - protein, 17 aa, Entamoeba invadens
IIPELKSLIPGCIAIRG

SEQ ID NO: 2943183 - protein, 20 aa, Entamoeba invadens
IIPHVIEPSFGIGRVLTGVL

SEQ ID NO: 2943184 - protein, 18 aa, Entamoeba invadens
IIPQLSKFNISFIKVKSF

SEQ ID NO: 2943185 - protein, 18 aa, Entamoeba invadens
IIPQYCFHNCQKLKNISL

SEQ ID NO: 2943186 - protein, 31 aa, Entamoeba invadens
IIPSNVITIYSWVFRNCVGLNSVVIPPKITL

SEQ ID NO: 2943187 - protein, 30 aa, Entamoeba invadens
IIPTIIVDIGSYIIRAGLSTTENDEPEVET

SEQ ID NO: 2943188 - protein, 23 aa, Entamoeba invadens
IIPYKVYQFRGFDLANMSFIKGH

SEQ ID NO: 2943189 - protein, 18 aa, Entamoeba invadens
IIQCKELDTSVLQNVEKI

SEQ ID NO: 2943190 - protein, 37 aa, Entamoeba invadens
IIQKGRGIELFGCIAKAIGKDAFRPYLEAVVNIIRQM

SEQ ID NO: 2943191 - protein, 18 aa, Entamoeba invadens
IIQNCLTYGISSCITCEP

SEQ ID NO: 2943192 - protein, 17 aa, Entamoeba invadens
IIRDNAVLWSWWREQLR

SEQ ID NO: 2943193 - protein, 19 aa, Entamoeba invadens
IIRKLLKATCVLRKRDYYN

SEQ ID NO: 2943194 - protein, 21 aa, Entamoeba invadens
IIRLKKLNGLITITVEMHQQM

SEQ ID NO: 2943195 - protein, 30 aa, Entamoeba invadens
IIRMYCKCLYFGIKPVFVFDGNTNTFLKES

SEQ ID NO: 2943196 - protein, 17 aa, Entamoeba invadens
IIRSMRMLEELLEQMVS

SEQ ID NO: 2943197 - protein, 21 aa, Entamoeba invadens
IIRTMCGQIKLSEEITNKLVG

SEQ ID NO: 2943198 - protein, 23 aa, Entamoeba invadens
IISAELCAKCGKPVAGGIKAIGK

SEQ ID NO: 2943199 - protein, 24 aa, Entamoeba invadens
IISCKHFFNGTGLQVLPRGNPEEE

SEQ ID NO: 2943200 - protein, 25 aa, Entamoeba invadens
IISEAKQLVAMIGMVVDYGKGKTGS

SEQ ID NO: 2943201 - protein, 18 aa, Entamoeba invadens
IISFYFPLVTSFHTLNSK

SEQ ID NO: 2943202 - protein, 17 aa, Entamoeba invadens
IISGLHITSETKELSLF

SEQ ID NO: 2943203 - protein, 18 aa, Entamoeba invadens
IISHLSRVGCKGSFITQD

SEQ ID NO: 2943204 - protein, 23 aa, Entamoeba invadens
IISIATHFFPFFVGVLQNQKDES

SEQ ID NO: 2943205 - protein, 25 aa, Entamoeba invadens
IISISCCAKLNMIMLLSEAGIHFFD

SEQ ID NO: 2943206 - protein, 26 aa, Entamoeba invadens
IISKLFPKPTRAIFFSQMLLPESVLT

SEQ ID NO: 2943207 - protein, 19 aa, Entamoeba invadens
IISKLGRNMFALFQSPSIS

SEQ ID NO: 2943208 - protein, 19 aa, Entamoeba invadens
IISNGLPLMPVVILEELFD

SEQ ID NO: 2943209 - protein, 21 aa, Entamoeba invadens
IISRASFENVEYFWIPEIRKH

SEQ ID NO: 2943210 - protein, 19 aa, Entamoeba invadens
IISSFDFHSSVFNYQLCSE

SEQ ID NO: 2943211 - protein, 26 aa, Entamoeba invadens
IISSFFPHCYSDFCVSTKRFDCENFR

SEQ ID NO: 2943212 - protein, 22 aa, Entamoeba invadens
IISSIFNLHFKMCSKELENVDA

SEQ ID NO: 2943213 - protein, 25 aa, Entamoeba invadens
IISTSIFFESLFKLKVVPKALIVPN

SEQ ID NO: 2943214 - protein, 18 aa, Entamoeba invadens
IITARKSLLLQIAEKKGK

SEQ ID NO: 2943215 - protein, 26 aa, Entamoeba invadens
IITDKFKLVVLLGMTVDYGKGLTGAV

SEQ ID NO: 2943216 - protein, 19 aa, Entamoeba invadens
IITDVCFCDSSVVLATTFG

SEQ ID NO: 2943217 - protein, 17 aa, Entamoeba invadens
IITELVLDFKLLKNYAH

SEQ ID NO: 2943218 - protein, 19 aa, Entamoeba invadens
IITFAFPIIQLVAPFVSFR

SEQ ID NO: 2943219 - protein, 20 aa, Entamoeba invadens
IITGKVLLIIPEFFQTEMKK

SEQ ID NO: 2943220 - protein, 24 aa, Entamoeba invadens
IITIPGMCFRGCNNLSSIIIPSSV

SEQ ID NO: 2943221 - protein, 18 aa, Entamoeba invadens
IITPKFSLVDSLIQNYDS

SEQ ID NO: 2943222 - protein, 18 aa, Entamoeba invadens
IITPPVNVVNLDFLTPAP

SEQ ID NO: 2943223 - protein, 19 aa, Entamoeba invadens
IITRPPWNYSMSKDQLDQN

SEQ ID NO: 2943224 - protein, 19 aa, Entamoeba invadens
IIVDGYRAGLKYFVEHTDD

SEQ ID NO: 2943225 - protein, 34 aa, Entamoeba invadens
IIVDTCDKLKCVKVPECVKELQLKDLAAYQTLDL

SEQ ID NO: 2943226 - protein, 18 aa, Entamoeba invadens
IIVLPSGEACEFEILLTL

SEQ ID NO: 2943227 - protein, 17 aa, Entamoeba invadens
IIVTYDFTAKPFTHKRR

SEQ ID NO: 2943228 - protein, 18 aa, Entamoeba invadens
IIVWKDLNGYAFRVYQKG

SEQ ID NO: 2943229 - protein, 24 aa, Entamoeba invadens
IIYGDGCFRGCSSLSDITIPSSVT

SEQ ID NO: 2943230 - protein, 18 aa, Entamoeba invadens
IIYIPWIVQQIGKGHYVT

SEQ ID NO: 2943231 - protein, 26 aa, Entamoeba invadens
IIYLMLRGGLKYDLLTYLATPDCHAL

SEQ ID NO: 2943232 - protein, 17 aa, Entamoeba invadens
IIYRQALFLSSLSYEDF

SEQ ID NO: 2943233 - protein, 21 aa, Entamoeba invadens
IKAAPCILSVLVAALDGLLKN

SEQ ID NO: 2943234 - protein, 21 aa, Entamoeba invadens
IKAATFYKCRALREITIPQSV

SEQ ID NO: 2943235 - protein, 23 aa, Entamoeba invadens
IKADLIVVLFIEIFRAIDSDMNG

SEQ ID NO: 2943236 - protein, 21 aa, Entamoeba invadens
IKAEEVPKCDCEVAVTQEEPV

SEQ ID NO: 2943237 - protein, 19 aa, Entamoeba invadens
IKAELMFGKCLLRYYQFEL

SEQ ID NO: 2943238 - protein, 17 aa, Entamoeba invadens
IKAEMKVIAKIYDGDFG

SEQ ID NO: 2943239 - protein, 19 aa, Entamoeba invadens
IKAFLTRVTGIKNITNHNY

SEQ ID NO: 2943240 - protein, 20 aa, Entamoeba invadens
IKAGVDASVSQVWRLPECCY

SEQ ID NO: 2943241 - protein, 19 aa, Entamoeba invadens
IKAHTIGKIIGLRNSTKNL

SEQ ID NO: 2943242 - protein, 25 aa, Entamoeba invadens
IKAITKFMFDGCTSLKTVDGLDNVN

SEQ ID NO: 2943243 - protein, 23 aa, Entamoeba invadens
IKAIYTINMEGVFFLKLEQDKMV

SEQ ID NO: 2943244 - protein, 19 aa, Entamoeba invadens
IKAKLPVVLTPQHHMLFVI

SEQ ID NO: 2943245 - protein, 29 aa, Entamoeba invadens
IKAKRFKTELYPFMIEFVNQIFSMYLTVF

SEQ ID NO: 2943246 - protein, 18 aa, Entamoeba invadens
IKALEAQKKMALDNKTDD

SEQ ID NO: 2943247 - protein, 17 aa, Entamoeba invadens
IKALNAKSLDESKLQEV

SEQ ID NO: 2943248 - protein, 25 aa, Entamoeba invadens
IKAMMGICRGCWILNEEWIEESLLR

SEQ ID NO: 2943249 - protein, 25 aa, Entamoeba invadens
IKAQEKLLMCELGEFVELDEYDNDV

SEQ ID NO: 2943250 - protein, 17 aa, Entamoeba invadens
IKAQYQLYLGFYDGNPA

SEQ ID NO: 2943251 - protein, 21 aa, Entamoeba invadens
IKARIINGVKYWVEYTWQMNI

SEQ ID NO: 2943252 - protein, 23 aa, Entamoeba invadens
IKASAMRSDWGVARGFNRGIAPE

SEQ ID NO: 2943253 - protein, 31 aa, Entamoeba invadens
IKASLPGIKLSNTFHWNYGFDSTFTSLILTY

SEQ ID NO: 2943254 - protein, 17 aa, Entamoeba invadens
IKATCCYVAQDFEAEKK

SEQ ID NO: 2943255 - protein, 27 aa, Entamoeba invadens
IKAVFRASQSIIRFDLPHLDHILHFIY

SEQ ID NO: 2943256 - protein, 18 aa, Entamoeba invadens
IKAVFVKCCENITIDNTL

SEQ ID NO: 2943257 - protein, 26 aa, Entamoeba invadens
IKAVNCGFIMMSWIMMEEMKLEKFEI

SEQ ID NO: 2943258 - protein, 18 aa, Entamoeba invadens
IKCCFVGDDNVGMTSLIH

SEQ ID NO: 2943259 - protein, 21 aa, Entamoeba invadens
IKCGYWFLMENVNFCNPTVLD

SEQ ID NO: 2943260 - protein, 25 aa, Entamoeba invadens
IKCIGACFDGAYVLIRNGGLSGKLL

SEQ ID NO: 2943261 - protein, 19 aa, Entamoeba invadens
IKCITKIFDDKHCEKVDEE

SEQ ID NO: 2943262 - protein, 24 aa, Entamoeba invadens
IKCKEIRGGNIIPCNTCVRTAAAA

SEQ ID NO: 2943263 - protein, 18 aa, Entamoeba invadens
IKCPVLKDKSFINSDHLT

SEQ ID NO: 2943264 - protein, 19 aa, Entamoeba invadens
IKCPVLNNKSFINFDHFTI

SEQ ID NO: 2943265 - protein, 17 aa, Entamoeba invadens
IKDCGDVNCVGRVHSFL

SEQ ID NO: 2943266 - protein, 26 aa, Entamoeba invadens
IKDELLRSIYSFGFDKPSAIQQRAIV

SEQ ID NO: 2943267 - protein, 17 aa, Entamoeba invadens
IKDESILIMPLKTEPET

SEQ ID NO: 2943268 - protein, 27 aa, Entamoeba invadens
IKDETKCYMKVTLVYPVVDSEPIREPQ

SEQ ID NO: 2943269 - protein, 24 aa, Entamoeba invadens
IKDFVKIKFCFRIILQKYFNEEKN

SEQ ID NO: 2943270 - protein, 17 aa, Entamoeba invadens
IKDHWGLLIKLKLFQSV

SEQ ID NO: 2943271 - protein, 26 aa, Entamoeba invadens
IKDKKCFVCGKKGHLSGSCPEKEQHK

SEQ ID NO: 2943272 - protein, 24 aa, Entamoeba invadens
IKDKMKGMCHFVATSVKELNDFIF

SEQ ID NO: 2943273 - protein, 18 aa, Entamoeba invadens
IKDLKFEPDCFIHDFIDI

SEQ ID NO: 2943274 - protein, 26 aa, Entamoeba invadens
IKDLVPKAVIHFLVFKTRDSIQKELI

SEQ ID NO: 2943275 - protein, 20 aa, Entamoeba invadens
IKDPNLFPLINPKKNKIEFD

SEQ ID NO: 2943276 - protein, 26 aa, Entamoeba invadens
IKDPYKFLERYLGFYVRLDSKEWPRD

SEQ ID NO: 2943277 - protein, 20 aa, Entamoeba invadens
IKDSETLFALVISVIGVSEC

SEQ ID NO: 2943278 - protein, 20 aa, Entamoeba invadens
IKDVDSLALFFKLADSNDDN

SEQ ID NO: 2943279 - protein, 28 aa, Entamoeba invadens
IKDVLRLNDKIGRIYAWKAEEAKSSYEP

SEQ ID NO: 2943280 - protein, 19 aa, Entamoeba invadens
IKDVLSFILPLIGKEEPSL

SEQ ID NO: 2943281 - protein, 22 aa, Entamoeba invadens
IKDYFAKCLQWILPSNGDDIYY

SEQ ID NO: 2943282 - protein, 20 aa, Entamoeba invadens
IKEAVELPLSHPELYEEIGI

SEQ ID NO: 2943283 - protein, 21 aa, Entamoeba invadens
IKEAVLCLMIGGSRKGLPDGT

SEQ ID NO: 2943284 - protein, 18 aa, Entamoeba invadens
IKEAYSYFERYESVAQAS

SEQ ID NO: 2943285 - protein, 19 aa, Entamoeba invadens
IKEDAVLRIFYQVCHAVAY

SEQ ID NO: 2943286 - protein, 22 aa, Entamoeba invadens
IKEDKGSHCSVGSTPLSGMFYQ

SEQ ID NO: 2943287 - protein, 18 aa, Entamoeba invadens
IKEDMCALSERLHATQEN

SEQ ID NO: 2943288 - protein, 22 aa, Entamoeba invadens
IKEDYCRRLVGSIKKGADITNK

SEQ ID NO: 2943289 - protein, 23 aa, Entamoeba invadens
IKEDYNNFILPDFLSDEIQSNVY

SEQ ID NO: 2943290 - protein, 24 aa, Entamoeba invadens
IKEEEGRIVLTWGKGELVGEKEKF

SEQ ID NO: 2943291 - protein, 17 aa, Entamoeba invadens
IKEELLDQVELIQKEHK

SEQ ID NO: 2943292 - protein, 23 aa, Entamoeba invadens
IKEEMKEAMVWWTSHSIEEKQTI

SEQ ID NO: 2943293 - protein, 23 aa, Entamoeba invadens
IKEFSRLSPMVLFQQSLYFWKTD

SEQ ID NO: 2943294 - protein, 19 aa, Entamoeba invadens
IKEFTQWKASHDKDGKAPT

SEQ ID NO: 2943295 - protein, 17 aa, Entamoeba invadens
IKEFVFAKIVEFKNEKL

SEQ ID NO: 2943296 - protein, 19 aa, Entamoeba invadens
IKEFYRPYTSPSVPHDSQR

SEQ ID NO: 2943297 - protein, 19 aa, Entamoeba invadens
IKEHMCYFASNFNEEIEKS

SEQ ID NO: 2943298 - protein, 21 aa, Entamoeba invadens
IKEIFIEKARRVFIDVNNDIK

SEQ ID NO: 2943299 - protein, 21 aa, Entamoeba invadens
IKEIFIEKARRVFIDVNNDVK

SEQ ID NO: 2943300 - protein, 22 aa, Entamoeba invadens
IKEIFIEKARRVFINANNDVKV

SEQ ID NO: 2943301 - protein, 17 aa, Entamoeba invadens
IKEIKQFIIKPHLYDEL

SEQ ID NO: 2943302 - protein, 24 aa, Entamoeba invadens
IKEIMVKQAVAYPFRKYDSLVEYY

SEQ ID NO: 2943303 - protein, 24 aa, Entamoeba invadens
IKEINIRGCFTIDLPQIDFQHKTI

SEQ ID NO: 2943304 - protein, 18 aa, Entamoeba invadens
IKEIPIGDEVVRIELWDT

SEQ ID NO: 2943305 - protein, 26 aa, Entamoeba invadens
IKEKFFKEKFVFFDLIDEMNAECPFE

SEQ ID NO: 2943306 - protein, 19 aa, Entamoeba invadens
IKEKLCYVSKDIAKERKNK

SEQ ID NO: 2943307 - protein, 20 aa, Entamoeba invadens
IKEKLVRPTYMATYEDEVYV

SEQ ID NO: 2943308 - protein, 19 aa, Entamoeba invadens
IKEKVKNLANDRYQLSSEK

SEQ ID NO: 2943309 - protein, 22 aa, Entamoeba invadens
IKELKASTIGKLICIKGTVIRA

SEQ ID NO: 2943310 - protein, 23 aa, Entamoeba invadens
IKELKDYPTIFIVANKIDTKSRT

SEQ ID NO: 2943311 - protein, 17 aa, Entamoeba invadens
IKELLKMTRKVGYSEEE

SEQ ID NO: 2943312 - protein, 31 aa, Entamoeba invadens
IKELNEALKHVSIELFVEIDETLKYQRNIEN

SEQ ID NO: 2943313 - protein, 22 aa, Entamoeba invadens
IKELRKVDIESIVEKNDFEDCQ

SEQ ID NO: 2943314 - protein, 17 aa, Entamoeba invadens
IKENCCDVCLNISNMLN

SEQ ID NO: 2943315 - protein, 26 aa, Entamoeba invadens
IKENESWDWKNEKFSDEEEIELGDYE

SEQ ID NO: 2943316 - protein, 19 aa, Entamoeba invadens
IKENLCSCTTDFATKRTQK

SEQ ID NO: 2943317 - protein, 24 aa, Entamoeba invadens
IKEPDRWYYGGGLYMGKKMPELCS

SEQ ID NO: 2943318 - protein, 17 aa, Entamoeba invadens
IKEPFIVNNDKINTTNI

SEQ ID NO: 2943319 - protein, 17 aa, Entamoeba invadens
IKEQNKVLCCPPLNRLD

SEQ ID NO: 2943320 - protein, 19 aa, Entamoeba invadens
IKERMALDMENGVTEQTAL

SEQ ID NO: 2943321 - protein, 21 aa, Entamoeba invadens
IKERMTSLVIGKIKTFVVFPV

SEQ ID NO: 2943322 - protein, 24 aa, Entamoeba invadens
IKERSGAIIPYEFFADMVNGLAEA

SEQ ID NO: 2943323 - protein, 19 aa, Entamoeba invadens
IKERVVSVLSMCVDHCNEL

SEQ ID NO: 2943324 - protein, 18 aa, Entamoeba invadens
IKESIGQDIVQIFHEELL

SEQ ID NO: 2943325 - protein, 17 aa, Entamoeba invadens
IKESKVKIEQEVVDLNN

SEQ ID NO: 2943326 - protein, 28 aa, Entamoeba invadens
IKESKVVKGREPDFCSRNFHVSHQCYVW

SEQ ID NO: 2943327 - protein, 22 aa, Entamoeba invadens
IKESLKTGLSFIDEVPTLREAI

SEQ ID NO: 2943328 - protein, 17 aa, Entamoeba invadens
IKESQKYIEFVKIENKQ

SEQ ID NO: 2943329 - protein, 18 aa, Entamoeba invadens
IKETESFASKNEVIKNSL

SEQ ID NO: 2943330 - protein, 19 aa, Entamoeba invadens
IKETPKHIDGFWVEVNNIP

SEQ ID NO: 2943331 - protein, 20 aa, Entamoeba invadens
IKETTEIVLFDLLRINTKMY

SEQ ID NO: 2943332 - protein, 20 aa, Entamoeba invadens
IKETYKIILTMRKQKEKMRE

SEQ ID NO: 2943333 - protein, 18 aa, Entamoeba invadens
IKEVKALLLRGVGVHHAG

SEQ ID NO: 2943334 - protein, 36 aa, Entamoeba invadens
IKEVVLRYVNCKDVVLPRKCRAFEIYNCEGKICAEQ

SEQ ID NO: 2943335 - protein, 22 aa, Entamoeba invadens
IKEVVNLSRFVKPESISFNTVA

SEQ ID NO: 2943336 - protein, 18 aa, Entamoeba invadens
IKEWCTLEIDGVNIEFLP

SEQ ID NO: 2943337 - protein, 25 aa, Entamoeba invadens
IKEYICAIDEVILSFHHRVLSKEKL

SEQ ID NO: 2943338 - protein, 21 aa, Entamoeba invadens
IKFDKKYFAFSLRSPNSPEPK

SEQ ID NO: 2943339 - protein, 17 aa, Entamoeba invadens
IKFENYFIATKYKFGVL

SEQ ID NO: 2943340 - protein, 30 aa, Entamoeba invadens
IKFEVKDKKCFLCGKTGHISLVCPEKDKYK

SEQ ID NO: 2943341 - protein, 26 aa, Entamoeba invadens
IKFILHIKGRLNYYASHDREMYFVQF

SEQ ID NO: 2943342 - protein, 25 aa, Entamoeba invadens
IKFKCSSELIGIKVPEHITALHNCC

SEQ ID NO: 2943343 - protein, 32 aa, Entamoeba invadens
IKFLFPRLVDRNKFILCGNGFVKKLNYSTFNC

SEQ ID NO: 2943344 - protein, 22 aa, Entamoeba invadens
IKFLNNYFHCFINFEKITRCVR

SEQ ID NO: 2943345 - protein, 27 aa, Entamoeba invadens
IKFPISFPIIYKTLRVDGDMSVKDSVQ

SEQ ID NO: 2943346 - protein, 25 aa, Entamoeba invadens
IKFQTELRTPIALILLFPNPFVFIV

SEQ ID NO: 2943347 - protein, 17 aa, Entamoeba invadens
IKFTVFEIEQLEKMKHI

SEQ ID NO: 2943348 - protein, 20 aa, Entamoeba invadens
IKFVRGVQVLSFLSNPPPVY

SEQ ID NO: 2943349 - protein, 21 aa, Entamoeba invadens
IKFWMCADCETGMTLNLQLYC

SEQ ID NO: 2943350 - protein, 19 aa, Entamoeba invadens
IKFYELLDLLGDRIELKGF

SEQ ID NO: 2943351 - protein, 18 aa, Entamoeba invadens
IKFYEMFFNNNLETSGYY

SEQ ID NO: 2943352 - protein, 17 aa, Entamoeba invadens
IKGDLWLNLSVQGKLHI

SEQ ID NO: 2943353 - protein, 19 aa, Entamoeba invadens
IKGDQMALFAIFDGHGGKE

SEQ ID NO: 2943354 - protein, 22 aa, Entamoeba invadens
IKGEFIPRAKFTKVSPEVVDLM

SEQ ID NO: 2943355 - protein, 20 aa, Entamoeba invadens
IKGELRGCIGCFSPEKPVYE

SEQ ID NO: 2943356 - protein, 21 aa, Entamoeba invadens
IKGETFINGKLSKTVKKADSC

SEQ ID NO: 2943357 - protein, 19 aa, Entamoeba invadens
IKGGMDVLFIDCRTQEMFR

SEQ ID NO: 2943358 - protein, 19 aa, Entamoeba invadens
IKGGTFWLTNLKRLDRLKD

SEQ ID NO: 2943359 - protein, 21 aa, Entamoeba invadens
IKGIFFRGYILDCIKTVLPDF

SEQ ID NO: 2943360 - protein, 18 aa, Entamoeba invadens
IKGKIGVVLVGESENNGR

SEQ ID NO: 2943361 - protein, 21 aa, Entamoeba invadens
IKGKKSVVLLMRMTNKNCYVV

SEQ ID NO: 2943362 - protein, 33 aa, Entamoeba invadens
IKGKLRMGVSVTRKFVCCGGVYVIENMNTPPNK

SEQ ID NO: 2943363 - protein, 24 aa, Entamoeba invadens
IKGLNYKTWFPFYNLYSNSYDGNK

SEQ ID NO: 2943364 - protein, 19 aa, Entamoeba invadens
IKGLTCYNGAVSVQEEQMF

SEQ ID NO: 2943365 - protein, 18 aa, Entamoeba invadens
IKGREWFCQNSCATNGDG

SEQ ID NO: 2943366 - protein, 33 aa, Entamoeba invadens
IKGSLKFGESTTRKFMCCGPMYWIPNLQEPPKE

SEQ ID NO: 2943367 - protein, 36 aa, Entamoeba invadens
IKGSLWSGDIHSFVCCFAEEQFFWVYKFVTDKKEDR

SEQ ID NO: 2943368 - protein, 19 aa, Entamoeba invadens
IKGTDIFLGTIDKNLKDTN

SEQ ID NO: 2943369 - protein, 17 aa, Entamoeba invadens
IKGVFMFFNVCYTQDDK

SEQ ID NO: 2943370 - protein, 17 aa, Entamoeba invadens
IKGVFMFFNVCYTQDNK

SEQ ID NO: 2943371 - protein, 22 aa, Entamoeba invadens
IKGVFRTANWSVFGLSERTNNR

SEQ ID NO: 2943372 - protein, 17 aa, Entamoeba invadens
IKHANVCVVGNRDAIEK

SEQ ID NO: 2943373 - protein, 20 aa, Entamoeba invadens
IKHATKFYAARMFVASMGLF

SEQ ID NO: 2943374 - protein, 25 aa, Entamoeba invadens
IKHDVLCSKCKGKGTKSGKDVKKCQ

SEQ ID NO: 2943375 - protein, 29 aa, Entamoeba invadens
IKHFFADICGGLWYLHFNKHVLHRDLKLE

SEQ ID NO: 2943376 - protein, 23 aa, Entamoeba invadens
IKHFPKLETLYIYTTMDDSFVEK

SEQ ID NO: 2943377 - protein, 19 aa, Entamoeba invadens
IKHICKNRGNLVFIVTGKN

SEQ ID NO: 2943378 - protein, 37 aa, Entamoeba invadens
IKHKILRKVFDIFFDKRHNCTIVRQMVVDIAIIILQQ

SEQ ID NO: 2943379 - protein, 26 aa, Entamoeba invadens
IKHLGEGKYFISYTLPAVKGDYNVNC

SEQ ID NO: 2943380 - protein, 19 aa, Entamoeba invadens
IKHLTDRLVALEQLVHSLS

SEQ ID NO: 2943381 - protein, 20 aa, Entamoeba invadens
IKHSIIYYKTIFIYFDTTPS

SEQ ID NO: 2943382 - protein, 19 aa, Entamoeba invadens
IKHYLNCTLPYYHLPNPFK

SEQ ID NO: 2943383 - protein, 18 aa, Entamoeba invadens
IKIAFATCEAPLMRGERY

SEQ ID NO: 2943384 - protein, 17 aa, Entamoeba invadens
IKIFPVTLSKSFLESDE

SEQ ID NO: 2943385 - protein, 20 aa, Entamoeba invadens
IKIGDGFGVICFTSAVDKDC

SEQ ID NO: 2943386 - protein, 26 aa, Entamoeba invadens
IKIGLRTSRRPELGDKFSSRHGQKGV

SEQ ID NO: 2943387 - protein, 24 aa, Entamoeba invadens
IKIGMLSKCFEPFMVDIVNAEATT

SEQ ID NO: 2943388 - protein, 20 aa, Entamoeba invadens
IKIHSYKDVFVVVVIIKDVV

SEQ ID NO: 2943389 - protein, 21 aa, Entamoeba invadens
IKIICKLFQEIIRKPKNSDGF

SEQ ID NO: 2943390 - protein, 18 aa, Entamoeba invadens
IKILAPLIRQLSAEDLNK

SEQ ID NO: 2943391 - protein, 22 aa, Entamoeba invadens
IKILFWSVELYFEEKNLDVDVL

SEQ ID NO: 2943392 - protein, 17 aa, Entamoeba invadens
IKILIQFANEKFQNGSI

SEQ ID NO: 2943393 - protein, 19 aa, Entamoeba invadens
IKILRDETRIVFENTEVIN

SEQ ID NO: 2943394 - protein, 23 aa, Entamoeba invadens
IKILRSKLAFFRQGMLEIAVLTA

SEQ ID NO: 2943395 - protein, 24 aa, Entamoeba invadens
IKINFYRIVVWFNVDYTTVDINSN

SEQ ID NO: 2943396 - protein, 25 aa, Entamoeba invadens
IKINKERSLCVASKRFDNPKKETIQ

SEQ ID NO: 2943397 - protein, 24 aa, Entamoeba invadens
IKINKKCHQTICSLHVNPFFLSIS

SEQ ID NO: 2943398 - protein, 19 aa, Entamoeba invadens
IKINLNAPVVFFHYDQNER

SEQ ID NO: 2943399 - protein, 31 aa, Entamoeba invadens
IKIPKLVKIIPKWCFAECIKLSRVNLSENLI

SEQ ID NO: 2943400 - protein, 17 aa, Entamoeba invadens
IKIPLSVKSMADDCFYN

SEQ ID NO: 2943401 - protein, 19 aa, Entamoeba invadens
IKIPVKFASEESMALDPDD

SEQ ID NO: 2943402 - protein, 17 aa, Entamoeba invadens
IKIPVKFASEMSTALDP

SEQ ID NO: 2943403 - protein, 17 aa, Entamoeba invadens
IKIPVKFASEMSTALNP

SEQ ID NO: 2943404 - protein, 21 aa, Entamoeba invadens
IKIRLPFPTPEISYYEDTDTD

SEQ ID NO: 2943405 - protein, 20 aa, Entamoeba invadens
IKISQLVPFDGCGHVLCRSC

SEQ ID NO: 2943406 - protein, 23 aa, Entamoeba invadens
IKIVFPFSKLFHCVRHIHRDLQI

SEQ ID NO: 2943407 - protein, 25 aa, Entamoeba invadens
IKIYKPSMKMFYTKIPFLGISHTFP

SEQ ID NO: 2943408 - protein, 19 aa, Entamoeba invadens
IKIYSANVLNKFDVIEFKV

SEQ ID NO: 2943409 - protein, 23 aa, Entamoeba invadens
IKKAREVGFVYTLNNRRRRIFNL

SEQ ID NO: 2943410 - protein, 17 aa, Entamoeba invadens
IKKCKLSTYSATRWNYM

SEQ ID NO: 2943411 - protein, 23 aa, Entamoeba invadens
IKKCKLSTYSATRWNYMANSSSA

SEQ ID NO: 2943412 - protein, 27 aa, Entamoeba invadens
IKKDGFKGAHRMFKNGIPINLTEIGDW

SEQ ID NO: 2943413 - protein, 17 aa, Entamoeba invadens
IKKDLSKIFSVRNVIEE

SEQ ID NO: 2943414 - protein, 17 aa, Entamoeba invadens
IKKDNFDTVIFFAKGKF

SEQ ID NO: 2943415 - protein, 17 aa, Entamoeba invadens
IKKDWRRFDPIEGGQRL

SEQ ID NO: 2943416 - protein, 17 aa, Entamoeba invadens
IKKEEGIGFECISQCPV

SEQ ID NO: 2943417 - protein, 22 aa, Entamoeba invadens
IKKEFQPCVLYNKITKRLEKID

SEQ ID NO: 2943418 - protein, 31 aa, Entamoeba invadens
IKKEHFDMALSEMKPAFGMDNNDVFPVLPDP

SEQ ID NO: 2943419 - protein, 22 aa, Entamoeba invadens
IKKEILVGYFVRPQHESEILRR

SEQ ID NO: 2943420 - protein, 22 aa, Entamoeba invadens
IKKENVVKCTYCQPTHSLLQNY

SEQ ID NO: 2943421 - protein, 17 aa, Entamoeba invadens
IKKFECTDAEIIHKVKP

SEQ ID NO: 2943422 - protein, 23 aa, Entamoeba invadens
IKKFKINAIIPTRLQCVIDALLV

SEQ ID NO: 2943423 - protein, 25 aa, Entamoeba invadens
IKKFKQHVLALINRHLHVMDITNES

SEQ ID NO: 2943424 - protein, 20 aa, Entamoeba invadens
IKKFNHKKFDGVEIKVNYDL

SEQ ID NO: 2943425 - protein, 18 aa, Entamoeba invadens
IKKFPGMVVGKDLKERAE

SEQ ID NO: 2943426 - protein, 25 aa, Entamoeba invadens
IKKFVPKKCILHHFSSRYSQSYVQR

SEQ ID NO: 2943427 - protein, 21 aa, Entamoeba invadens
IKKGEITSAKFIEEVAKKSAS

SEQ ID NO: 2943428 - protein, 23 aa, Entamoeba invadens
IKKHPFFKGFDWDNIFEQAPPYM

SEQ ID NO: 2943429 - protein, 17 aa, Entamoeba invadens
IKKIDYGLCSVKQNYGI

SEQ ID NO: 2943430 - protein, 28 aa, Entamoeba invadens
IKKIGYNEVRFSNFNVHTIRSCDIKFQI

SEQ ID NO: 2943431 - protein, 19 aa, Entamoeba invadens
IKKIIPFSLIGKKENQLKT

SEQ ID NO: 2943432 - protein, 18 aa, Entamoeba invadens
IKKITQIVRTEGELKGDY

SEQ ID NO: 2943433 - protein, 25 aa, Entamoeba invadens
IKKKEKEEKEILLKKEKEERIAKEK

SEQ ID NO: 2943434 - protein, 21 aa, Entamoeba invadens
IKKKITWDMAAQLVEYATATD

SEQ ID NO: 2943435 - protein, 25 aa, Entamoeba invadens
IKKLCDKYKPISYGISRFERNTDLG

SEQ ID NO: 2943436 - protein, 23 aa, Entamoeba invadens
IKKLDLFACETLAFIAHEAELPD

SEQ ID NO: 2943437 - protein, 23 aa, Entamoeba invadens
IKKLKYGCFYGCTDLKKIETPHR

SEQ ID NO: 2943438 - protein, 24 aa, Entamoeba invadens
IKKLQRDFCKILEANNTENIADLE

SEQ ID NO: 2943439 - protein, 24 aa, Entamoeba invadens
IKKLQVKFLFCSPVNKGVELVQRN

SEQ ID NO: 2943440 - protein, 20 aa, Entamoeba invadens
IKKPKRKTSRKRSSNLPAPV

SEQ ID NO: 2943441 - protein, 27 aa, Entamoeba invadens
IKKQLKTLRRLRIMNHILRHLKHKRRW

SEQ ID NO: 2943442 - protein, 23 aa, Entamoeba invadens
IKKRKCGILAKREPVFEWIKETI

SEQ ID NO: 2943443 - protein, 19 aa, Entamoeba invadens
IKKSDSAFVKQLKQRRARI

SEQ ID NO: 2943444 - protein, 19 aa, Entamoeba invadens
IKKSLNFVFKNIVYGEGDR

SEQ ID NO: 2943445 - protein, 27 aa, Entamoeba invadens
IKKSTVKCLKRVIPMLNENDFRGYVYS

SEQ ID NO: 2943446 - protein, 34 aa, Entamoeba invadens
IKKTDFKIHPSILPKIYPSTSIVFKSSDPSIVTV

SEQ ID NO: 2943447 - protein, 19 aa, Entamoeba invadens
IKKTFEFLKGGSLENQKNI

SEQ ID NO: 2943448 - protein, 21 aa, Entamoeba invadens
IKKTGNGFVFQGFAIGDLIYA

SEQ ID NO: 2943449 - protein, 20 aa, Entamoeba invadens
IKKTKEWVVEQILLKKYPAI

SEQ ID NO: 2943450 - protein, 26 aa, Entamoeba invadens
IKKTNGRIAQFKSLQTSPLQLVKKDG

SEQ ID NO: 2943451 - protein, 20 aa, Entamoeba invadens
IKKVCERCFDGCTSLKSVKI

SEQ ID NO: 2943452 - protein, 20 aa, Entamoeba invadens
IKKVCSRSVLIETVYEIWGE

SEQ ID NO: 2943453 - protein, 22 aa, Entamoeba invadens
IKKVFYEIVVWFNVEYTTVYTN

SEQ ID NO: 2943454 - protein, 20 aa, Entamoeba invadens
IKKVLSYALVEYWPGEKCRD

SEQ ID NO: 2943455 - protein, 19 aa, Entamoeba invadens
IKKVQSGFFTPRQDQLSSS

SEQ ID NO: 2943456 - protein, 25 aa, Entamoeba invadens
IKKVSLAEAIRFVKIIRGQSPVCGP

SEQ ID NO: 2943457 - protein, 20 aa, Entamoeba invadens
IKLAAVGAFAEFEEKGAKRV

SEQ ID NO: 2943458 - protein, 20 aa, Entamoeba invadens
IKLCPKCHKELFLVCDKGMA

SEQ ID NO: 2943459 - protein, 18 aa, Entamoeba invadens
IKLDVQIILKSATMGVRP

SEQ ID NO: 2943460 - protein, 17 aa, Entamoeba invadens
IKLELWDTCGQTDYLRV

SEQ ID NO: 2943461 - protein, 20 aa, Entamoeba invadens
IKLENVMLCGKSQNDLDKLS

SEQ ID NO: 2943462 - protein, 20 aa, Entamoeba invadens
IKLETLKAMFAIGSESLEPS

SEQ ID NO: 2943463 - protein, 17 aa, Entamoeba invadens
IKLFCTAMVDIIKHVLD

SEQ ID NO: 2943464 - protein, 18 aa, Entamoeba invadens
IKLFFKVMFLSVSHMDTF

SEQ ID NO: 2943465 - protein, 18 aa, Entamoeba invadens
IKLIDFGLAKNFRDEGLN

SEQ ID NO: 2943466 - protein, 24 aa, Entamoeba invadens
IKLIDFGSACFERSTLYSYIQSRH

SEQ ID NO: 2943467 - protein, 24 aa, Entamoeba invadens
IKLIDFGSACFERSTLYTYIQSRH

SEQ ID NO: 2943468 - protein, 26 aa, Entamoeba invadens
IKLKEILDFVLMCLQHDAYLSATTKS

SEQ ID NO: 2943469 - protein, 27 aa, Entamoeba invadens
IKLKIKRNRLTELEMMEKSLITKESEI

SEQ ID NO: 2943470 - protein, 23 aa, Entamoeba invadens
IKLKLCSEMALGVNWLHSAIGLV

SEQ ID NO: 2943471 - protein, 25 aa, Entamoeba invadens
IKLKSLMSPCCTFDTIHLVSLCLNK

SEQ ID NO: 2943472 - protein, 17 aa, Entamoeba invadens
IKLLEKGFFTLENSRDE

SEQ ID NO: 2943473 - protein, 23 aa, Entamoeba invadens
IKLLHLYCRASISTVDMLSTFFA

SEQ ID NO: 2943474 - protein, 19 aa, Entamoeba invadens
IKLLRFLKNDYIVRYIAST

SEQ ID NO: 2943475 - protein, 18 aa, Entamoeba invadens
IKLMGRSASHIALEASLQ

SEQ ID NO: 2943476 - protein, 24 aa, Entamoeba invadens
IKLNQGKHVICPLRTFRFDSQHYG

SEQ ID NO: 2943477 - protein, 24 aa, Entamoeba invadens
IKLNQGKHVICPLRTFRFDSQYYG

SEQ ID NO: 2943478 - protein, 24 aa, Entamoeba invadens
IKLNQGKRVICPLRTFRFDSQHYG

SEQ ID NO: 2943479 - protein, 19 aa, Entamoeba invadens
IKLNTLIIEKFVKKGSYKK

SEQ ID NO: 2943480 - protein, 20 aa, Entamoeba invadens
IKLPIEMSEYITNLKVEEKY

SEQ ID NO: 2943481 - protein, 19 aa, Entamoeba invadens
IKLPKMLKFIPDSCFSGCT

SEQ ID NO: 2943482 - protein, 18 aa, Entamoeba invadens
IKLPSDLPFWESSIAYNR

SEQ ID NO: 2943483 - protein, 19 aa, Entamoeba invadens
IKLPSIEALIFINLPIYGG

SEQ ID NO: 2943484 - protein, 21 aa, Entamoeba invadens
IKLPVLPAYEGCEKLTVLESR

SEQ ID NO: 2943485 - protein, 20 aa, Entamoeba invadens
IKLQCVKFSKSVLNISPTAF

SEQ ID NO: 2943486 - protein, 27 aa, Entamoeba invadens
IKLRKLRLSSIYNFFVVNIWYPVDYST

SEQ ID NO: 2943487 - protein, 19 aa, Entamoeba invadens
IKLRLEAFKEFVDTEKSLL

SEQ ID NO: 2943488 - protein, 24 aa, Entamoeba invadens
IKLSEGLNTLGFCRCFQLCETLEE

SEQ ID NO: 2943489 - protein, 31 aa, Entamoeba invadens
IKLSELENTFPLLSINIIYQLLRNFKVDEMD

SEQ ID NO: 2943490 - protein, 17 aa, Entamoeba invadens
IKLSELILYIRDNNGFK

SEQ ID NO: 2943491 - protein, 17 aa, Entamoeba invadens
IKLSGLTLPNFNGKLTF

SEQ ID NO: 2943492 - protein, 18 aa, Entamoeba invadens
IKLSKVCQDIIVYGICMF

SEQ ID NO: 2943493 - protein, 19 aa, Entamoeba invadens
IKLSQRFPSRVDATASTIT

SEQ ID NO: 2943494 - protein, 20 aa, Entamoeba invadens
IKLTDFGLCTGFHKDHESTY

SEQ ID NO: 2943495 - protein, 27 aa, Entamoeba invadens
IKMAMDCPEFFAVCIFRILDKNFEAKV

SEQ ID NO: 2943496 - protein, 19 aa, Entamoeba invadens
IKMAVKRIRIGQIEDTAPI

SEQ ID NO: 2943497 - protein, 20 aa, Entamoeba invadens
IKMFLLLLLFTFSQADFDLT

SEQ ID NO: 2943498 - protein, 17 aa, Entamoeba invadens
IKMKIIIDASKRILHLH

SEQ ID NO: 2943499 - protein, 26 aa, Entamoeba invadens
IKMKKAKEVVCHVWVPTISYSPLEEW

SEQ ID NO: 2943500 - protein, 20 aa, Entamoeba invadens
IKMLLKTVVDLIHISCITVH

SEQ ID NO: 2943501 - protein, 20 aa, Entamoeba invadens
IKMMKKCGTTLFYTSAKKDI

SEQ ID NO: 2943502 - protein, 20 aa, Entamoeba invadens
IKMMKKCGTTLFYTSAKNNI

SEQ ID NO: 2943503 - protein, 17 aa, Entamoeba invadens
IKMRALYDYEATDDTEL

SEQ ID NO: 2943504 - protein, 25 aa, Entamoeba invadens
IKMRDCTKCSFVLAQSSRVWSNTPT

SEQ ID NO: 2943505 - protein, 23 aa, Entamoeba invadens
IKMTDVMAFLPLVIQRYLNIAND

SEQ ID NO: 2943506 - protein, 25 aa, Entamoeba invadens
IKMTIPETLRIGGECYDNSKIASLN

SEQ ID NO: 2943507 - protein, 17 aa, Entamoeba invadens
IKMTLARYHTFFNGNFA

SEQ ID NO: 2943508 - protein, 23 aa, Entamoeba invadens
IKMVKVFAQWFCRKNRLVDYCDK

SEQ ID NO: 2943509 - protein, 18 aa, Entamoeba invadens
IKNAIFALFNVVFVANGQ

SEQ ID NO: 2943510 - protein, 20 aa, Entamoeba invadens
IKNCCFRECEYLREVDLPKS

SEQ ID NO: 2943511 - protein, 17 aa, Entamoeba invadens
IKNDLNLSIILDKLSDE

SEQ ID NO: 2943512 - protein, 20 aa, Entamoeba invadens
IKNDVVFRNALYATIPEIHS

SEQ ID NO: 2943513 - protein, 20 aa, Entamoeba invadens
IKNELRVLMKCWVVYYQDCG

SEQ ID NO: 2943514 - protein, 24 aa, Entamoeba invadens
IKNFIKRLIDSFLCQHIRTLLLST

SEQ ID NO: 2943515 - protein, 22 aa, Entamoeba invadens
IKNFWCSAHRVALTGEGLDKEP

SEQ ID NO: 2943516 - protein, 27 aa, Entamoeba invadens
IKNGLANPKWKATFVQLLATLPAESKV

SEQ ID NO: 2943517 - protein, 18 aa, Entamoeba invadens
IKNGVLVVFQEKKKKAEQ

SEQ ID NO: 2943518 - protein, 21 aa, Entamoeba invadens
IKNHESCLIHCPVANLSMKSG

SEQ ID NO: 2943519 - protein, 21 aa, Entamoeba invadens
IKNIEAFAFFNCKSLKRVQLP

SEQ ID NO: 2943520 - protein, 26 aa, Entamoeba invadens
IKNIGGDCFKECFNVCEIVLPSTLTA

SEQ ID NO: 2943521 - protein, 17 aa, Entamoeba invadens
IKNILAVVMIKGDAFEK

SEQ ID NO: 2943522 - protein, 33 aa, Entamoeba invadens
IKNKNCVIGNSIFENCDKLSVLEIPNYNTEMRL

SEQ ID NO: 2943523 - protein, 20 aa, Entamoeba invadens
IKNLGECFIYLNDDVFFNKP

SEQ ID NO: 2943524 - protein, 22 aa, Entamoeba invadens
IKNLRKEIDFMMLKQLKKLNLE

SEQ ID NO: 2943525 - protein, 20 aa, Entamoeba invadens
IKNLRTMLMARVNVYNKSKI

SEQ ID NO: 2943526 - protein, 25 aa, Entamoeba invadens
IKNLSSCAVFRASFITNEYAEKCSK

SEQ ID NO: 2943527 - protein, 20 aa, Entamoeba invadens
IKNPEFKTASVITENERTNS

SEQ ID NO: 2943528 - protein, 19 aa, Entamoeba invadens
IKNSCDFYESLKIPYRVVN

SEQ ID NO: 2943529 - protein, 30 aa, Entamoeba invadens
IKNSQAFDRWKKAEVILIDEISMISGELLE

SEQ ID NO: 2943530 - protein, 22 aa, Entamoeba invadens
IKNVMKLIPMISTFVTEKVGYS

SEQ ID NO: 2943531 - protein, 22 aa, Entamoeba invadens
IKPDNILVFLLDYNERVNAKLT

SEQ ID NO: 2943532 - protein, 22 aa, Entamoeba invadens
IKPDYILVFSLDLNDKVNAKLT

SEQ ID NO: 2943533 - protein, 27 aa, Entamoeba invadens
IKPERRFKGRLHPYVSVPDSVIVEALL

SEQ ID NO: 2943534 - protein, 20 aa, Entamoeba invadens
IKPFGIHCGDAVRIKNLQER

SEQ ID NO: 2943535 - protein, 31 aa, Entamoeba invadens
IKPHINKIFERCIKEDIALLYTTFSRCSNSR

SEQ ID NO: 2943536 - protein, 20 aa, Entamoeba invadens
IKPIEPAPFGMEPFGVKNEL

SEQ ID NO: 2943537 - protein, 20 aa, Entamoeba invadens
IKPKEIIPYSFPCVHGKKMM

SEQ ID NO: 2943538 - protein, 21 aa, Entamoeba invadens
IKPLCEKGKYISMIIAECSVE

SEQ ID NO: 2943539 - protein, 17 aa, Entamoeba invadens
IKPLLIVSTHYHQLCEE

SEQ ID NO: 2943540 - protein, 20 aa, Entamoeba invadens
IKPLSCFFYTIDNYRAVLNG

SEQ ID NO: 2943541 - protein, 17 aa, Entamoeba invadens
IKPPKGVILYGPPGTGK

SEQ ID NO: 2943542 - protein, 28 aa, Entamoeba invadens
IKPQTVLKCFLGVLYKRCEGNEIVEENE

SEQ ID NO: 2943543 - protein, 17 aa, Entamoeba invadens
IKPWMATAAIKSLREIG

SEQ ID NO: 2943544 - protein, 20 aa, Entamoeba invadens
IKPWTEEQFELFNENIDKIE

SEQ ID NO: 2943545 - protein, 18 aa, Entamoeba invadens
IKPYKTFVVAVCAKGRII

SEQ ID NO: 2943546 - protein, 25 aa, Entamoeba invadens
IKQEGFTLCCVEFFFTDVGQQRLPY

SEQ ID NO: 2943547 - protein, 28 aa, Entamoeba invadens
IKQEMWFFKNIFLVFGLQLGNNKTLIIN

SEQ ID NO: 2943548 - protein, 20 aa, Entamoeba invadens
IKQKLSSIMERVKFTKDIFV

SEQ ID NO: 2943549 - protein, 22 aa, Entamoeba invadens
IKQKRPIVFPNPGFIIQLYQYQ

SEQ ID NO: 2943550 - protein, 17 aa, Entamoeba invadens
IKQKTAFRRTQSNKRSQ

SEQ ID NO: 2943551 - protein, 25 aa, Entamoeba invadens
IKQLLMKAREAPFFEFVLNTESFGQ

SEQ ID NO: 2943552 - protein, 21 aa, Entamoeba invadens
IKQLTSARRIEFLQHTMQMVY

SEQ ID NO: 2943553 - protein, 22 aa, Entamoeba invadens
IKQREIDLLFSYEDNVMSGIQV

SEQ ID NO: 2943554 - protein, 20 aa, Entamoeba invadens
IKQRTCQTLEALEREAKESS

SEQ ID NO: 2943555 - protein, 17 aa, Entamoeba invadens
IKQSEISYVEFLEEFQN

SEQ ID NO: 2943556 - protein, 27 aa, Entamoeba invadens
IKQSFNCPICYKPLPVSEIVVDRKVQE

SEQ ID NO: 2943557 - protein, 17 aa, Entamoeba invadens
IKQWKYTTFCACPICAL

SEQ ID NO: 2943558 - protein, 23 aa, Entamoeba invadens
IKRAKAIGLTNCIAVFFTHGHYD

SEQ ID NO: 2943559 - protein, 17 aa, Entamoeba invadens
IKRARDMSDCKIQVESL

SEQ ID NO: 2943560 - protein, 25 aa, Entamoeba invadens
IKRDKLKSAHILPKLQNMNDGLNPD

SEQ ID NO: 2943561 - protein, 23 aa, Entamoeba invadens
IKRGEGDDLIILVGRDKQEELIY

SEQ ID NO: 2943562 - protein, 30 aa, Entamoeba invadens
IKRGKLLNFERFLMCILKSLNFQCVRAVYE

SEQ ID NO: 2943563 - protein, 25 aa, Entamoeba invadens
IKRIAPKLVGSVTCGCVMDKTLYIG

SEQ ID NO: 2943564 - protein, 18 aa, Entamoeba invadens
IKRIKSANFVTGDKVVSF

SEQ ID NO: 2943565 - protein, 23 aa, Entamoeba invadens
IKRKKKGKSVSVWSQHSRSVVFS

SEQ ID NO: 2943566 - protein, 18 aa, Entamoeba invadens
IKRNALLMRKIKTFLEEI

SEQ ID NO: 2943567 - protein, 17 aa, Entamoeba invadens
IKRQIPMEEELTKQNEM

SEQ ID NO: 2943568 - protein, 21 aa, Entamoeba invadens
IKRRCLRRPDNDFFGYRRLEN

SEQ ID NO: 2943569 - protein, 18 aa, Entamoeba invadens
IKRSCFKVLPNTLVLHLK

SEQ ID NO: 2943570 - protein, 20 aa, Entamoeba invadens
IKRSRVFRFKGFDEQERVVI

SEQ ID NO: 2943571 - protein, 17 aa, Entamoeba invadens
IKRVIMTGGASYMQALQ

SEQ ID NO: 2943572 - protein, 28 aa, Entamoeba invadens
IKRYFGRLKTVFAFARTKFVKEFENFDA

SEQ ID NO: 2943573 - protein, 28 aa, Entamoeba invadens
IKRYQCAICGMNVHKKCIKKLAIPCRPI

SEQ ID NO: 2943574 - protein, 18 aa, Entamoeba invadens
IKRYREIVRKNTDLAKAE

SEQ ID NO: 2943575 - protein, 17 aa, Entamoeba invadens
IKSAFEMIQNVAKEVND

SEQ ID NO: 2943576 - protein, 19 aa, Entamoeba invadens
IKSAHILDPNVTLGTVVKM

SEQ ID NO: 2943577 - protein, 25 aa, Entamoeba invadens
IKSALRLVGVLSHCSNDVVFLNTTR

SEQ ID NO: 2943578 - protein, 25 aa, Entamoeba invadens
IKSASRLVEEFSAFFQANVFSNVVI

SEQ ID NO: 2943579 - protein, 17 aa, Entamoeba invadens
IKSDLIFFTPRKKINAN

SEQ ID NO: 2943580 - protein, 18 aa, Entamoeba invadens
IKSDLQLKNELVNIERLN

SEQ ID NO: 2943581 - protein, 21 aa, Entamoeba invadens
IKSDNTLVVSLDFNDEVNGKL

SEQ ID NO: 2943582 - protein, 25 aa, Entamoeba invadens
IKSEEWFKDFDWEGLYQKKLTPSYI

SEQ ID NO: 2943583 - protein, 23 aa, Entamoeba invadens
IKSEIYTLICMCWQQEPKNRIPI

SEQ ID NO: 2943584 - protein, 17 aa, Entamoeba invadens
IKSELYVNGAAPVTIQC

SEQ ID NO: 2943585 - protein, 18 aa, Entamoeba invadens
IKSESVMVLCLLSNSKRG

SEQ ID NO: 2943586 - protein, 17 aa, Entamoeba invadens
IKSFYFCESVTQLKKVG

SEQ ID NO: 2943587 - protein, 18 aa, Entamoeba invadens
IKSGEGFGTEDEKLKDLN

SEQ ID NO: 2943588 - protein, 21 aa, Entamoeba invadens
IKSGRPVREIILEKGVLTKEQ

SEQ ID NO: 2943589 - protein, 18 aa, Entamoeba invadens
IKSIGRFCFSNSINENNI

SEQ ID NO: 2943590 - protein, 17 aa, Entamoeba invadens
IKSIRKYCFYKTPLEKV

SEQ ID NO: 2943591 - protein, 17 aa, Entamoeba invadens
IKSITGLFMRARPLHLN

SEQ ID NO: 2943592 - protein, 22 aa, Entamoeba invadens
IKSKLLHCSRLVLRDYYSKLLL

SEQ ID NO: 2943593 - protein, 23 aa, Entamoeba invadens
IKSKPGRYGIKFWMCADCETGMT

SEQ ID NO: 2943594 - protein, 24 aa, Entamoeba invadens
IKSKPGRYGIKFWMCADCETGMTL

SEQ ID NO: 2943595 - protein, 26 aa, Entamoeba invadens
IKSKPQRYGIKFWKEENQGFRVTIDM

SEQ ID NO: 2943596 - protein, 33 aa, Entamoeba invadens
IKSKPQRYGIKFWMCCDCGSGMVINLQMYCGKC

SEQ ID NO: 2943597 - protein, 17 aa, Entamoeba invadens
IKSLEVFNNTTQFPMYT

SEQ ID NO: 2943598 - protein, 26 aa, Entamoeba invadens
IKSLFPSCKIFVVYPYKKNKATHLRA

SEQ ID NO: 2943599 - protein, 20 aa, Entamoeba invadens
IKSLIPLLLGAQGRFEHDLG

SEQ ID NO: 2943600 - protein, 18 aa, Entamoeba invadens
IKSLLLMLEEARGWYSDD

SEQ ID NO: 2943601 - protein, 20 aa, Entamoeba invadens
IKSLPLLCFESCTKLKNFVI

SEQ ID NO: 2943602 - protein, 21 aa, Entamoeba invadens
IKSLRSENRLILSGSPIQNNL

SEQ ID NO: 2943603 - protein, 26 aa, Entamoeba invadens
IKSNLPRKAIPQVVYNLCWWIYTYGY

SEQ ID NO: 2943604 - protein, 18 aa, Entamoeba invadens
IKSPEEYFELVTEMHNSQ

SEQ ID NO: 2943605 - protein, 28 aa, Entamoeba invadens
IKSPLEIVASVNLCGRGDAEYVNRVKAL

SEQ ID NO: 2943606 - protein, 17 aa, Entamoeba invadens
IKSTGEFYVQNRMRDAF

SEQ ID NO: 2943607 - protein, 22 aa, Entamoeba invadens
IKSVFKEGRIFLDEKAFTEIGN

SEQ ID NO: 2943608 - protein, 17 aa, Entamoeba invadens
IKSVFTLINNSYFPESR

SEQ ID NO: 2943609 - protein, 21 aa, Entamoeba invadens
IKSVTWPKVYCQPVVVNDLKI

SEQ ID NO: 2943610 - protein, 25 aa, Entamoeba invadens
IKSVWKKYEEQIAMVSRVLTDYCTL

SEQ ID NO: 2943611 - protein, 25 aa, Entamoeba invadens
IKSYGKHLFYLFGVSEVIIPNTVTS

SEQ ID NO: 2943612 - protein, 32 aa, Entamoeba invadens
IKTAEKIFKERFYHIALHSGFYQKLSFGRPKQ

SEQ ID NO: 2943613 - protein, 30 aa, Entamoeba invadens
IKTAEKIFKERFYHIALHSGFYQKLSLLED

SEQ ID NO: 2943614 - protein, 19 aa, Entamoeba invadens
IKTCDGFVIVYAINSRTSF

SEQ ID NO: 2943615 - protein, 42 aa, Entamoeba invadens
IKTCLLCIESSPSFLVVELFDFYAVNSFKEMNYVVAELNCFE

SEQ ID NO: 2943616 - protein, 25 aa, Entamoeba invadens
IKTEKCQRRSCHISPSRINEEKKKK

SEQ ID NO: 2943617 - protein, 17 aa, Entamoeba invadens
IKTEKKLGEGLFGIVYK

SEQ ID NO: 2943618 - protein, 26 aa, Entamoeba invadens
IKTENVRSWVCREIFEEFISVGSVKE

SEQ ID NO: 2943619 - protein, 23 aa, Entamoeba invadens
IKTFECLPLAATISRSVGDFFCC

SEQ ID NO: 2943620 - protein, 24 aa, Entamoeba invadens
IKTFFKDHNFFGLCENQIHFFPQG

SEQ ID NO: 2943621 - protein, 19 aa, Entamoeba invadens
IKTFKILSYIEVKFDNEFL

SEQ ID NO: 2943622 - protein, 17 aa, Entamoeba invadens
IKTFVLHIKRLKKVTTA

SEQ ID NO: 2943623 - protein, 25 aa, Entamoeba invadens
IKTGKIKGIYVVGGCDGVRKERNYY

SEQ ID NO: 2943624 - protein, 17 aa, Entamoeba invadens
IKTGMTFEEAYNHVMKV

SEQ ID NO: 2943625 - protein, 21 aa, Entamoeba invadens
IKTIRFGQCERFIAISRNEKT

SEQ ID NO: 2943626 - protein, 23 aa, Entamoeba invadens
IKTKDGYYGWMIINVPLNIIDYV

SEQ ID NO: 2943627 - protein, 29 aa, Entamoeba invadens
IKTKEGYIWVKASLLGNGIIKMETVPRLN

SEQ ID NO: 2943628 - protein, 18 aa, Entamoeba invadens
IKTKEVVRWFQLQEAVLN

SEQ ID NO: 2943629 - protein, 19 aa, Entamoeba invadens
IKTLELWTLDTRIDISSLS

SEQ ID NO: 2943630 - protein, 17 aa, Entamoeba invadens
IKTLKIITFIEVNFDNE

SEQ ID NO: 2943631 - protein, 19 aa, Entamoeba invadens
IKTLNLWSFDDENFGNNLI

SEQ ID NO: 2943632 - protein, 21 aa, Entamoeba invadens
IKTLRSAIERGVRPPLPKTIS

SEQ ID NO: 2943633 - protein, 20 aa, Entamoeba invadens
IKTNEVFFTVLVVDLIKNWK

SEQ ID NO: 2943634 - protein, 23 aa, Entamoeba invadens
IKTNLKFSKDGKFYFYGNLHAVG

SEQ ID NO: 2943635 - protein, 21 aa, Entamoeba invadens
IKTPCLPKRFNSFDKELKSAL

SEQ ID NO: 2943636 - protein, 21 aa, Entamoeba invadens
IKTPDWRIRRTVAKQLGSLAE

SEQ ID NO: 2943637 - protein, 20 aa, Entamoeba invadens
IKTPKTGRDFTYFPSDCNVY

SEQ ID NO: 2943638 - protein, 19 aa, Entamoeba invadens
IKTPNVFEVLKPKPRRKET

SEQ ID NO: 2943639 - protein, 23 aa, Entamoeba invadens
IKTQDAWKTSRLVVKYDGIMVGM

SEQ ID NO: 2943640 - protein, 18 aa, Entamoeba invadens
IKTQHFLTKRIKQSQEKI

SEQ ID NO: 2943641 - protein, 24 aa, Entamoeba invadens
IKTQHFNAWWFSQYTPFKHKIREA

SEQ ID NO: 2943642 - protein, 20 aa, Entamoeba invadens
IKTRSVCLLPHTADRVSSIF

SEQ ID NO: 2943643 - protein, 18 aa, Entamoeba invadens
IKTTISLEEIIAKKYKKL

SEQ ID NO: 2943644 - protein, 28 aa, Entamoeba invadens
IKTTNLCGIGWRIGDYVYPLNMVVFANT

SEQ ID NO: 2943645 - protein, 18 aa, Entamoeba invadens
IKTVCNIYIEGIDGNTQS

SEQ ID NO: 2943646 - protein, 23 aa, Entamoeba invadens
IKTVGKLQTRVFFFTKQNETAKI

SEQ ID NO: 2943647 - protein, 21 aa, Entamoeba invadens
IKTYCWNKVCEELKQLDREVI

SEQ ID NO: 2943648 - protein, 23 aa, Entamoeba invadens
IKTYLVKVGDTFRCGVLTSANMS

SEQ ID NO: 2943649 - protein, 19 aa, Entamoeba invadens
IKVCKKFKAIPEMFHYNPI

SEQ ID NO: 2943650 - protein, 26 aa, Entamoeba invadens
IKVDKEWKGFVGLKLTVNSAVNLVQA

SEQ ID NO: 2943651 - protein, 17 aa, Entamoeba invadens
IKVELKRNVVIENEEDE

SEQ ID NO: 2943652 - protein, 17 aa, Entamoeba invadens
IKVEPKLDMELKSEITW

SEQ ID NO: 2943653 - protein, 17 aa, Entamoeba invadens
IKVGAPYVKILSEASLV

SEQ ID NO: 2943654 - protein, 27 aa, Entamoeba invadens
IKVHVHPTFRWGRDLGTIENFWLFISD

SEQ ID NO: 2943655 - protein, 24 aa, Entamoeba invadens
IKVIDFGSSCFEGNTLYTYIQSRH

SEQ ID NO: 2943656 - protein, 23 aa, Entamoeba invadens
IKVKELRESFCGVLNEALFNFLQ

SEQ ID NO: 2943657 - protein, 17 aa, Entamoeba invadens
IKVKILLNNEKVAKSPY

SEQ ID NO: 2943658 - protein, 24 aa, Entamoeba invadens
IKVMFIKFLANCFVTTPPEIFMHV

SEQ ID NO: 2943659 - protein, 35 aa, Entamoeba invadens
IKVNTRLNPVVSCDGFVFKVIPGVPVLADDMFYFW

SEQ ID NO: 2943660 - protein, 20 aa, Entamoeba invadens
IKVPSRRIVRSDSFQQRSQI

SEQ ID NO: 2943661 - protein, 18 aa, Entamoeba invadens
IKVTLCMDIGKAVQYLQS

SEQ ID NO: 2943662 - protein, 23 aa, Entamoeba invadens
IKVTSDIFYSLNFLENRNSNTCP

SEQ ID NO: 2943663 - protein, 17 aa, Entamoeba invadens
IKVVFPFASTKSNMFKR

SEQ ID NO: 2943664 - protein, 30 aa, Entamoeba invadens
IKVVLKKEFFRIIVWFNVDFETVDRNKNRN

SEQ ID NO: 2943665 - protein, 22 aa, Entamoeba invadens
IKYAKMVFRVIFMKVLEMTDFT

SEQ ID NO: 2943666 - protein, 21 aa, Entamoeba invadens
IKYDKGKIVLPNATNVVVANE

SEQ ID NO: 2943667 - protein, 17 aa, Entamoeba invadens
IKYGGASKRPIEIFPKA

SEQ ID NO: 2943668 - protein, 17 aa, Entamoeba invadens
IKYIWGFEETASVCRNV

SEQ ID NO: 2943669 - protein, 24 aa, Entamoeba invadens
IKYLPRHVLIPAFLMDSNTQTNRH

SEQ ID NO: 2943670 - protein, 18 aa, Entamoeba invadens
IKYLRAFDKEVRRFPNLH

SEQ ID NO: 2943671 - protein, 19 aa, Entamoeba invadens
IKYLRVLDISRCIGIKIIS

SEQ ID NO: 2943672 - protein, 18 aa, Entamoeba invadens
IKYLSSLKHENIISLLHV

SEQ ID NO: 2943673 - protein, 25 aa, Entamoeba invadens
IKYTKLNGFKGIRVISKTVEIAEEK

SEQ ID NO: 2943674 - protein, 26 aa, Entamoeba invadens
IKYVERIPGICFVEVSGKYFRMSEFI

SEQ ID NO: 2943675 - protein, 18 aa, Entamoeba invadens
ILAIKDFCFNRCCNLTSF

SEQ ID NO: 2943676 - protein, 18 aa, Entamoeba invadens
ILALEYIHSLGCIHRDLK

SEQ ID NO: 2943677 - protein, 26 aa, Entamoeba invadens
ILANPHVANFFAIRAQYYNKLRKPNA

SEQ ID NO: 2943678 - protein, 17 aa, Entamoeba invadens
ILAYVLRPSNKSLLIEK

SEQ ID NO: 2943679 - protein, 22 aa, Entamoeba invadens
ILCAFKGVEGEAMLWDLNKHGI

SEQ ID NO: 2943680 - protein, 22 aa, Entamoeba invadens
ILCANVNGGVLAVCNTFFTKEN

SEQ ID NO: 2943681 - protein, 25 aa, Entamoeba invadens
ILCDKGSVCIEGFVATSIINKIIEN

SEQ ID NO: 2943682 - protein, 22 aa, Entamoeba invadens
ILCDPSCSGSGILERKNLGEKM

SEQ ID NO: 2943683 - protein, 17 aa, Entamoeba invadens
ILCESGADVNHSVNNGA

SEQ ID NO: 2943684 - protein, 25 aa, Entamoeba invadens
ILCFKECYCLSEIHCSNTLKMLPTS

SEQ ID NO: 2943685 - protein, 40 aa, Entamoeba invadens
ILCTDCINCVLSIDCEICDKFEFKDCPNFTFNFLNTNNKN

SEQ ID NO: 2943686 - protein, 21 aa, Entamoeba invadens
ILDGFVKYALLKRPLLHQKLW

SEQ ID NO: 2943687 - protein, 17 aa, Entamoeba invadens
ILDGLFVQYMPRAICPN

SEQ ID NO: 2943688 - protein, 17 aa, Entamoeba invadens
ILDIAGFEIFRENSFEQ

SEQ ID NO: 2943689 - protein, 27 aa, Entamoeba invadens
ILDMSPRTSYNYRVALINSNYSLFNSL

SEQ ID NO: 2943690 - protein, 18 aa, Entamoeba invadens
ILDMVFSVFETKDSLFPG

SEQ ID NO: 2943691 - protein, 21 aa, Entamoeba invadens
ILDNACEKCRAVVCSATQQVL

SEQ ID NO: 2943692 - protein, 23 aa, Entamoeba invadens
ILDPALLRPGRIDRKIEFPNPKE

SEQ ID NO: 2943693 - protein, 20 aa, Entamoeba invadens
ILDQCLFKVVLDAMKSPHVL

SEQ ID NO: 2943694 - protein, 20 aa, Entamoeba invadens
ILDRLGVKYGDFCANKKQTC

SEQ ID NO: 2943695 - protein, 24 aa, Entamoeba invadens
ILDTICLDHPIFGIPLTEVVAHPF

SEQ ID NO: 2943696 - protein, 30 aa, Entamoeba invadens
ILDTRCTNILLPHCLKIIGMFTGTEHSNKI

SEQ ID NO: 2943697 - protein, 22 aa, Entamoeba invadens
ILDTRMTEFSAFAKIVLNDPNC

SEQ ID NO: 2943698 - protein, 24 aa, Entamoeba invadens
ILDVRKLIYLLGMVPGYDFERIID

SEQ ID NO: 2943699 - protein, 18 aa, Entamoeba invadens
ILEDGNEIGFYFQEPYIF

SEQ ID NO: 2943700 - protein, 33 aa, Entamoeba invadens
ILEGKKWNRRWVVLKKNCLMIFKSAGEGQTMVV

SEQ ID NO: 2943701 - protein, 24 aa, Entamoeba invadens
ILEGPEKWRVCAHIEENCIGCGSC

SEQ ID NO: 2943702 - protein, 27 aa, Entamoeba invadens
ILEKYGCGSCGPRGFYGTTLEHLSIED

SEQ ID NO: 2943703 - protein, 19 aa, Entamoeba invadens
ILENCGFSFEEKKTKKANV

SEQ ID NO: 2943704 - protein, 19 aa, Entamoeba invadens
ILEQAKHAPVQVIKVPEDS

SEQ ID NO: 2943705 - protein, 18 aa, Entamoeba invadens
ILEQDGCSSKHYYYTKTD

SEQ ID NO: 2943706 - protein, 23 aa, Entamoeba invadens
ILEQVFPLFPRNAFTKYIDTELH

SEQ ID NO: 2943707 - protein, 21 aa, Entamoeba invadens
ILESLKIAFLSFGTFEDVLKH

SEQ ID NO: 2943708 - protein, 21 aa, Entamoeba invadens
ILESLNLVNLMSVVHILVCVD

SEQ ID NO: 2943709 - protein, 18 aa, Entamoeba invadens
ILESLVMMEKFFQYCEKT

SEQ ID NO: 2943710 - protein, 23 aa, Entamoeba invadens
ILEVKYLLNVDHYFKIDKITHQN

SEQ ID NO: 2943711 - protein, 19 aa, Entamoeba invadens
ILEVMGMPDPDEWPEFNTL

SEQ ID NO: 2943712 - protein, 32 aa, Entamoeba invadens
ILFASEVAGGFLVQFDYGGLVLDSVVKKPQML

SEQ ID NO: 2943713 - protein, 19 aa, Entamoeba invadens
ILFCNLETLLKGAKSFAEQ

SEQ ID NO: 2943714 - protein, 17 aa, Entamoeba invadens
ILFECVRISAEEEKIRM

SEQ ID NO: 2943715 - protein, 26 aa, Entamoeba invadens
ILFFFPKLETLYFCAVSTRLRKVSSN

SEQ ID NO: 2943716 - protein, 24 aa, Entamoeba invadens
ILFFFPKLETLYFRAVSTRLRKMS

SEQ ID NO: 2943717 - protein, 20 aa, Entamoeba invadens
ILFKKELLTIETFDLLIPKI

SEQ ID NO: 2943718 - protein, 18 aa, Entamoeba invadens
ILFLRQFNALAFPILRLL

SEQ ID NO: 2943719 - protein, 18 aa, Entamoeba invadens
ILFPVELIDYINMYNRTQ

SEQ ID NO: 2943720 - protein, 17 aa, Entamoeba invadens
ILFQPSIIGEEGLGIHH

SEQ ID NO: 2943721 - protein, 17 aa, Entamoeba invadens
ILFTWNFIHQQRDVLDF

SEQ ID NO: 2943722 - protein, 19 aa, Entamoeba invadens
ILFVLRYMIDAGIVGCSWV

SEQ ID NO: 2943723 - protein, 17 aa, Entamoeba invadens
ILFVSPFNVVKETKKAL

SEQ ID NO: 2943724 - protein, 19 aa, Entamoeba invadens
ILGAGCFENCYSLKKIEIP

SEQ ID NO: 2943725 - protein, 19 aa, Entamoeba invadens
ILGDCLCDLYQLHNVRKVV

SEQ ID NO: 2943726 - protein, 22 aa, Entamoeba invadens
ILGDGCFKNCISLVSITLPSNL

SEQ ID NO: 2943727 - protein, 27 aa, Entamoeba invadens
ILGDYKYCRFCEGEPYETKVCYLPIVN

SEQ ID NO: 2943728 - protein, 18 aa, Entamoeba invadens
ILGEKIVNIRACPVEGNK

SEQ ID NO: 2943729 - protein, 24 aa, Entamoeba invadens
ILGFKYLRSLMRATSMITGGNFIP

SEQ ID NO: 2943730 - protein, 18 aa, Entamoeba invadens
ILGFSVNDTISWWVLECS

SEQ ID NO: 2943731 - protein, 23 aa, Entamoeba invadens
ILGKCDLFEGCESLRIFEFGQDY

SEQ ID NO: 2943732 - protein, 29 aa, Entamoeba invadens
ILGKTHFTSCCFQGCKHLKQGDVDKIPRH

SEQ ID NO: 2943733 - protein, 23 aa, Entamoeba invadens
ILGKVDLFEGCISLRSLHFGANV

SEQ ID NO: 2943734 - protein, 24 aa, Entamoeba invadens
ILGLLKELFVKYIQRSELIENQDE

SEQ ID NO: 2943735 - protein, 17 aa, Entamoeba invadens
ILGMVGIVLTSSTILLD

SEQ ID NO: 2943736 - protein, 27 aa, Entamoeba invadens
ILGSATFKAALGFKVNIGLGLGIESFN

SEQ ID NO: 2943737 - protein, 25 aa, Entamoeba invadens
ILGVNKRFFLALRRLKENNQMTTSI

SEQ ID NO: 2943738 - protein, 30 aa, Entamoeba invadens
ILGYAKSLCTLKCAMFVNNWYVPMEIDTLR

SEQ ID NO: 2943739 - protein, 17 aa, Entamoeba invadens
ILHEKYPHLPFFFHCRS

SEQ ID NO: 2943740 - protein, 18 aa, Entamoeba invadens
ILHFKSPTLITSKDFLIT

SEQ ID NO: 2943741 - protein, 19 aa, Entamoeba invadens
ILHIKRFEFDYETMDRIKL

SEQ ID NO: 2943742 - protein, 22 aa, Entamoeba invadens
ILHLPRVGRLDVVVQISHVCVN

SEQ ID NO: 2943743 - protein, 19 aa, Entamoeba invadens
ILHMYRLTQQFIVDAFLRI

SEQ ID NO: 2943744 - protein, 17 aa, Entamoeba invadens
ILHRDFKSLNVLVTAKY

SEQ ID NO: 2943745 - protein, 18 aa, Entamoeba invadens
ILHRDIKPGNLLVFSLNL

SEQ ID NO: 2943746 - protein, 19 aa, Entamoeba invadens
ILHRVHFSLFKNCTTESYD

SEQ ID NO: 2943747 - protein, 25 aa, Entamoeba invadens
ILHVICPHPLHFLCSNGKDIFGASY

SEQ ID NO: 2943748 - protein, 18 aa, Entamoeba invadens
ILHVYSLHSKTSSATFHG

SEQ ID NO: 2943749 - protein, 23 aa, Entamoeba invadens
ILIAWLEVRGTVFTDNKLLFYVM

SEQ ID NO: 2943750 - protein, 26 aa, Entamoeba invadens
ILIEIAEKFCGAVFKLKNGKKSNVCI

SEQ ID NO: 2943751 - protein, 18 aa, Entamoeba invadens
ILIEVVGRYCVQKRDTNV

SEQ ID NO: 2943752 - protein, 17 aa, Entamoeba invadens
ILIHCRNGWDITCQLIS

SEQ ID NO: 2943753 - protein, 18 aa, Entamoeba invadens
ILIHKSLVHKNVVSYVGS

SEQ ID NO: 2943754 - protein, 24 aa, Entamoeba invadens
ILIICPLTLISHWVSEAHRFVPFF

SEQ ID NO: 2943755 - protein, 17 aa, Entamoeba invadens
ILIKLVMQGVKKVEDNN

SEQ ID NO: 2943756 - protein, 22 aa, Entamoeba invadens
ILIKTCGKGLLAKKIGLSQFIG

SEQ ID NO: 2943757 - protein, 21 aa, Entamoeba invadens
ILIMKCTKLEVSISAVDMIYC

SEQ ID NO: 2943758 - protein, 23 aa, Entamoeba invadens
ILINLCKEMMEILSKLLPIDNIG

SEQ ID NO: 2943759 - protein, 25 aa, Entamoeba invadens
ILISGFYLRIFQTIELCVKNKDPNT

SEQ ID NO: 2943760 - protein, 21 aa, Entamoeba invadens
ILITFKFMWKFCCDGLCDSIY

SEQ ID NO: 2943761 - protein, 22 aa, Entamoeba invadens
ILITSARLIFRVQRQSGTSESD

SEQ ID NO: 2943762 - protein, 20 aa, Entamoeba invadens
ILIVKCKKLEVSISAVDMIN

SEQ ID NO: 2943763 - protein, 20 aa, Entamoeba invadens
ILIVKCTKLEVSISAVDMIN

SEQ ID NO: 2943764 - protein, 17 aa, Entamoeba invadens
ILIWIKLKCLGFKTTLG

SEQ ID NO: 2943765 - protein, 26 aa, Entamoeba invadens
ILKAEGFKMKCFICGQTDHMSPQCKQ

SEQ ID NO: 2943766 - protein, 19 aa, Entamoeba invadens
ILKEKFCKPTKTKRDEETR

SEQ ID NO: 2943767 - protein, 26 aa, Entamoeba invadens
ILKEKVCKWEYLKSLLTPSLTFIFSC

SEQ ID NO: 2943768 - protein, 24 aa, Entamoeba invadens
ILKFFPLLETIYISSIVNNVDKEL

SEQ ID NO: 2943769 - protein, 26 aa, Entamoeba invadens
ILKGGELRPGKGFNLQPHPFVQNALS

SEQ ID NO: 2943770 - protein, 24 aa, Entamoeba invadens
ILKHYGHKGIMEYESTLSRDILPG

SEQ ID NO: 2943771 - protein, 17 aa, Entamoeba invadens
ILKICYCSSLKSLKLPT

SEQ ID NO: 2943772 - protein, 30 aa, Entamoeba invadens
ILKIGLNAEDKLNCELECVVARAVIGWKNW

SEQ ID NO: 2943773 - protein, 18 aa, Entamoeba invadens
ILKIYRLFSTRYLDNEFL

SEQ ID NO: 2943774 - protein, 23 aa, Entamoeba invadens
ILKKCEENLRVIVGYNGNLLKEL

SEQ ID NO: 2943775 - protein, 22 aa, Entamoeba invadens
ILKNSVKVISSRHIITIRFTCQ

SEQ ID NO: 2943776 - protein, 26 aa, Entamoeba invadens
ILKQGHSKFRYMCLEYLNINVDKVIS

SEQ ID NO: 2943777 - protein, 17 aa, Entamoeba invadens
ILKRHEYRLRKLVEKAK

SEQ ID NO: 2943778 - protein, 24 aa, Entamoeba invadens
ILKRKELLKGLKQVQTLAVRENTV

SEQ ID NO: 2943779 - protein, 17 aa, Entamoeba invadens
ILKRNKEKFQFSKQQNK

SEQ ID NO: 2943780 - protein, 25 aa, Entamoeba invadens
ILKSICEGVQLLGLMKSNITFTVQL

SEQ ID NO: 2943781 - protein, 18 aa, Entamoeba invadens
ILKSTAFKDLLLKEIIID

SEQ ID NO: 2943782 - protein, 22 aa, Entamoeba invadens
ILKVCKCTKVGLRYESEKKVLT

SEQ ID NO: 2943783 - protein, 39 aa, Entamoeba invadens
ILKVICIDGTMYLDEFLCKKLGGLFVKHFTSCGSCKESP

SEQ ID NO: 2943784 - protein, 26 aa, Entamoeba invadens
ILKWLTELLYPYQLVLSSIDKMMENF

SEQ ID NO: 2943785 - protein, 18 aa, Entamoeba invadens
ILKYEFQVDIVINSGCAG

SEQ ID NO: 2943786 - protein, 18 aa, Entamoeba invadens
ILKYFPKLELLQVDPVTA

SEQ ID NO: 2943787 - protein, 26 aa, Entamoeba invadens
ILLDFKTLRYFPNIETLHLWNEEDKN

SEQ ID NO: 2943788 - protein, 17 aa, Entamoeba invadens
ILLDILVELGYHFQTKV

SEQ ID NO: 2943789 - protein, 24 aa, Entamoeba invadens
ILLDTVDVLYIWVGSKCAVQTRKL

SEQ ID NO: 2943790 - protein, 30 aa, Entamoeba invadens
ILLEGLRKLWWKAMDYLSAKTMNKRKKEFN

SEQ ID NO: 2943791 - protein, 17 aa, Entamoeba invadens
ILLENGIGIDHTDVTNN

SEQ ID NO: 2943792 - protein, 22 aa, Entamoeba invadens
ILLEQFPLCFLDKIDDKVLHRV

SEQ ID NO: 2943793 - protein, 17 aa, Entamoeba invadens
ILLFFDLSIGPSFVSLD

SEQ ID NO: 2943794 - protein, 25 aa, Entamoeba invadens
ILLGNGYGFAVDWWSYGTLIYEMLL

SEQ ID NO: 2943795 - protein, 25 aa, Entamoeba invadens
ILLKENRPYPIIKIADFGMARNELF

SEQ ID NO: 2943796 - protein, 21 aa, Entamoeba invadens
ILLLNGVVIPTRIGSQELELM

SEQ ID NO: 2943797 - protein, 20 aa, Entamoeba invadens
ILLNKELLQNLVMISLSNTI

SEQ ID NO: 2943798 - protein, 17 aa, Entamoeba invadens
ILLNRDLLNSLAVIATA

SEQ ID NO: 2943799 - protein, 19 aa, Entamoeba invadens
ILLQTGSPVVKSAMLAQAS

SEQ ID NO: 2943800 - protein, 24 aa, Entamoeba invadens
ILLSEFAALLARFCQTPEELKEGF

SEQ ID NO: 2943801 - protein, 19 aa, Entamoeba invadens
ILLVKCFIGVELKKNEINT

SEQ ID NO: 2943802 - protein, 18 aa, Entamoeba invadens
ILLYMKTVINFEGEKANS

SEQ ID NO: 2943803 - protein, 29 aa, Entamoeba invadens
ILLYPKENICVFPYNSVIYTLSFIVNKVC

SEQ ID NO: 2943804 - protein, 21 aa, Entamoeba invadens
ILLYYCSTFIDPLTTQLFYIY

SEQ ID NO: 2943805 - protein, 18 aa, Entamoeba invadens
ILMCSILKADYEGTYLTA

SEQ ID NO: 2943806 - protein, 18 aa, Entamoeba invadens
ILMDLLRDVGFDLDTKTT

SEQ ID NO: 2943807 - protein, 19 aa, Entamoeba invadens
ILMELSCTLLSHNFPMKCN

SEQ ID NO: 2943808 - protein, 18 aa, Entamoeba invadens
ILMHKTCEGQHAVIQFRH

SEQ ID NO: 2943809 - protein, 21 aa, Entamoeba invadens
ILMITCVFNTLGNKLIVLNNI

SEQ ID NO: 2943810 - protein, 18 aa, Entamoeba invadens
ILMVIEFMSGGELYDQII

SEQ ID NO: 2943811 - protein, 21 aa, Entamoeba invadens
ILNCKYRLCAFAFSNCKLLKS

SEQ ID NO: 2943812 - protein, 18 aa, Entamoeba invadens
ILNDLDFNTAISGTTDDD

SEQ ID NO: 2943813 - protein, 18 aa, Entamoeba invadens
ILNELGFLVTNLCNNAPY

SEQ ID NO: 2943814 - protein, 22 aa, Entamoeba invadens
ILNGKIRMSELLFDQQKTENTF

SEQ ID NO: 2943815 - protein, 25 aa, Entamoeba invadens
ILNITVLILQEFVKYVDVIQKIPYS

SEQ ID NO: 2943816 - protein, 24 aa, Entamoeba invadens
ILNPIKFDLQFGQNRAFIVSVKDN

SEQ ID NO: 2943817 - protein, 17 aa, Entamoeba invadens
ILNSCENLNKFTLPKSV

SEQ ID NO: 2943818 - protein, 17 aa, Entamoeba invadens
ILNSCLGKNMFVECENI

SEQ ID NO: 2943819 - protein, 25 aa, Entamoeba invadens
ILNSKELFLLLLTFLKHAFDYKTLY

SEQ ID NO: 2943820 - protein, 30 aa, Entamoeba invadens
ILNVKFKTAIFFKAIASIGLYLAGRSEEDI

SEQ ID NO: 2943821 - protein, 17 aa, Entamoeba invadens
ILNYSFENCHTLKQINL

SEQ ID NO: 2943822 - protein, 20 aa, Entamoeba invadens
ILNYYFNWRKDMKLTVEVHW

SEQ ID NO: 2943823 - protein, 18 aa, Entamoeba invadens
ILPCLQRKTFAIKNYEKV

SEQ ID NO: 2943824 - protein, 25 aa, Entamoeba invadens
ILPKALRTIGYKAFYNCSKLKNVDF

SEQ ID NO: 2943825 - protein, 22 aa, Entamoeba invadens
ILPKLFIPRDRFSFEQMEAINL

SEQ ID NO: 2943826 - protein, 17 aa, Entamoeba invadens
ILPLGAVIFRISNSSTF

SEQ ID NO: 2943827 - protein, 18 aa, Entamoeba invadens
ILPLIKLSFTSVIFDKYK

SEQ ID NO: 2943828 - protein, 24 aa, Entamoeba invadens
ILPLREVMKNAPIVEGEYGKMSIF

SEQ ID NO: 2943829 - protein, 24 aa, Entamoeba invadens
ILPPHLTELGNFAFDDCGSLKEIK

SEQ ID NO: 2943830 - protein, 27 aa, Entamoeba invadens
ILPPISSRCIKFRFNALPQETVFEHLT

SEQ ID NO: 2943831 - protein, 21 aa, Entamoeba invadens
ILPQLIRFLPITSDHEEEENV

SEQ ID NO: 2943832 - protein, 17 aa, Entamoeba invadens
ILPRHVHILQKIDLRMD

SEQ ID NO: 2943833 - protein, 21 aa, Entamoeba invadens
ILPRKCKLLTMKRPEGSEVNL

SEQ ID NO: 2943834 - protein, 35 aa, Entamoeba invadens
ILPRLTACGHLYCWKCLLQFFVLCPAPHKCPVCNA

SEQ ID NO: 2943835 - protein, 22 aa, Entamoeba invadens
ILPSAKRVLFWAQIGNKRRKML

SEQ ID NO: 2943836 - protein, 25 aa, Entamoeba invadens
ILPSLCTFGNLPFRKTAKRYGCDVT

SEQ ID NO: 2943837 - protein, 18 aa, Entamoeba invadens
ILPVKRMLHPKIRAQVDK

SEQ ID NO: 2943838 - protein, 17 aa, Entamoeba invadens
ILQELDFGMGVTQFCAE

SEQ ID NO: 2943839 - protein, 20 aa, Entamoeba invadens
ILQHIDCFDIFGNDEECVDT

SEQ ID NO: 2943840 - protein, 28 aa, Entamoeba invadens
ILQKLKHPFIVKLECTFESPSHHLLIMT

SEQ ID NO: 2943841 - protein, 25 aa, Entamoeba invadens
ILQLKRQLLDFGFFAEVVGSDVNAK

SEQ ID NO: 2943842 - protein, 20 aa, Entamoeba invadens
ILQLLCYKFPKDMSEEEELG

SEQ ID NO: 2943843 - protein, 25 aa, Entamoeba invadens
ILQLMASLVKFFLYKNTNLHSTMFN

SEQ ID NO: 2943844 - protein, 24 aa, Entamoeba invadens
ILQNAFEIIKGVQFFGLGFPVQER

SEQ ID NO: 2943845 - protein, 24 aa, Entamoeba invadens
ILQRVCAMLNDPTHTIVLMCLQTS

SEQ ID NO: 2943846 - protein, 28 aa, Entamoeba invadens
ILQVDWYIRLLVQHDFNRIIPVLKTRTY

SEQ ID NO: 2943847 - protein, 20 aa, Entamoeba invadens
ILRDRARVGEEVNQEYLHVI

SEQ ID NO: 2943848 - protein, 18 aa, Entamoeba invadens
ILREAICKHIIVMVVPCC

SEQ ID NO: 2943849 - protein, 26 aa, Entamoeba invadens
ILREKFILKPLMDVEKILKRQAVVEF

SEQ ID NO: 2943850 - protein, 21 aa, Entamoeba invadens
ILRFFPKLQTLYFSSFSNNLK

SEQ ID NO: 2943851 - protein, 25 aa, Entamoeba invadens
ILRFPNFLYDFSINIFDVKLLPDIL

SEQ ID NO: 2943852 - protein, 18 aa, Entamoeba invadens
ILRGRNLPVADITTSDPY

SEQ ID NO: 2943853 - protein, 24 aa, Entamoeba invadens
ILRKFCFCDCKVLSEVVLPKYLKM

SEQ ID NO: 2943854 - protein, 17 aa, Entamoeba invadens
ILRKGVQNSPLWTHANQ

SEQ ID NO: 2943855 - protein, 22 aa, Entamoeba invadens
ILRLKREAISLVTLNTEKQSSK

SEQ ID NO: 2943856 - protein, 22 aa, Entamoeba invadens
ILRNVKRFKNWVLSRQNSTPLL

SEQ ID NO: 2943857 - protein, 19 aa, Entamoeba invadens
ILRQKCEILKEDYDKMNQI

SEQ ID NO: 2943858 - protein, 28 aa, Entamoeba invadens
ILRSKTRFGDPMAKLFKRRKEKEESAKI

SEQ ID NO: 2943859 - protein, 21 aa, Entamoeba invadens
ILRSTLPPAKIVEVVTQILNK

SEQ ID NO: 2943860 - protein, 17 aa, Entamoeba invadens
ILRTMKGLNTFDFRPHC

SEQ ID NO: 2943861 - protein, 19 aa, Entamoeba invadens
ILRYLGILLYMGAHHDVIN

SEQ ID NO: 2943862 - protein, 22 aa, Entamoeba invadens
ILRYRKMIGADDVLVFTDIKKK

SEQ ID NO: 2943863 - protein, 18 aa, Entamoeba invadens
ILSACGLVNYLNKDIKQE

SEQ ID NO: 2943864 - protein, 25 aa, Entamoeba invadens
ILSCGKEAIPFLPIQVDYLHLNLQT

SEQ ID NO: 2943865 - protein, 17 aa, Entamoeba invadens
ILSEAFCTFFASREVYV

SEQ ID NO: 2943866 - protein, 24 aa, Entamoeba invadens
ILSEAKGDFLFTEKPFALNFGRVQ

SEQ ID NO: 2943867 - protein, 20 aa, Entamoeba invadens
ILSGDAMRLYLLVDATGLVQ

SEQ ID NO: 2943868 - protein, 19 aa, Entamoeba invadens
ILSGGKLPSFFLEKKEPLW

SEQ ID NO: 2943869 - protein, 25 aa, Entamoeba invadens
ILSKLKKGLYYSFVLMLKTFRYKSE

SEQ ID NO: 2943870 - protein, 24 aa, Entamoeba invadens
ILSKSIEVLPAWAKLDATAVSQTK

SEQ ID NO: 2943871 - protein, 19 aa, Entamoeba invadens
ILSLWKLQIAPSCDSDEWK

SEQ ID NO: 2943872 - protein, 18 aa, Entamoeba invadens
ILSMPPFDNNGIRRPFTV

SEQ ID NO: 2943873 - protein, 30 aa, Entamoeba invadens
ILSNKIKVFGARAFAGCRLLEKIDIPTSLE

SEQ ID NO: 2943874 - protein, 18 aa, Entamoeba invadens
ILSPKIVVIPVNITPKTE

SEQ ID NO: 2943875 - protein, 25 aa, Entamoeba invadens
ILSPVGPYFKGGFKAIKLETSGKYI

SEQ ID NO: 2943876 - protein, 26 aa, Entamoeba invadens
ILSQFYRLGKNEIIVDWLRNNEGLER

SEQ ID NO: 2943877 - protein, 23 aa, Entamoeba invadens
ILSSEIKTFCDLYDLTSQELHDI

SEQ ID NO: 2943878 - protein, 24 aa, Entamoeba invadens
ILSTEVVDGIALLKVSVSSIELMW

SEQ ID NO: 2943879 - protein, 19 aa, Entamoeba invadens
ILSVMSCQFVDEIVDGIDT

SEQ ID NO: 2943880 - protein, 26 aa, Entamoeba invadens
ILSVYYPRIVPILQILLRSVEDKIVS

SEQ ID NO: 2943881 - protein, 17 aa, Entamoeba invadens
ILTDLGIQFDQLKENVV

SEQ ID NO: 2943882 - protein, 17 aa, Entamoeba invadens
ILTEDRSLIGIFETTLR

SEQ ID NO: 2943883 - protein, 20 aa, Entamoeba invadens
ILTEHPRLFPNDVDVNVTRR

SEQ ID NO: 2943884 - protein, 27 aa, Entamoeba invadens
ILTKLPIYCFRCCYNLQHVTFPSHILS

SEQ ID NO: 2943885 - protein, 17 aa, Entamoeba invadens
ILTLKYPIEHGIVNNWD

SEQ ID NO: 2943886 - protein, 18 aa, Entamoeba invadens
ILTRPEFELVALNDPFMD

SEQ ID NO: 2943887 - protein, 18 aa, Entamoeba invadens
ILTRPEFELVALNDPFMN

SEQ ID NO: 2943888 - protein, 19 aa, Entamoeba invadens
ILTSTIFFYSGYGTLSSVL

SEQ ID NO: 2943889 - protein, 18 aa, Entamoeba invadens
ILTTIALCITEGNVRRLF

SEQ ID NO: 2943890 - protein, 18 aa, Entamoeba invadens
ILTYEMMVGIPPFYSEDE

SEQ ID NO: 2943891 - protein, 18 aa, Entamoeba invadens
ILVCAWRMGVIDYETAFA

SEQ ID NO: 2943892 - protein, 25 aa, Entamoeba invadens
ILVCKLCKGGYAFKENTGMCLDSKE

SEQ ID NO: 2943893 - protein, 20 aa, Entamoeba invadens
ILVIPEFLTRLSNIEELDFT

SEQ ID NO: 2943894 - protein, 19 aa, Entamoeba invadens
ILVKLKTTILYGLTSQQIT

SEQ ID NO: 2943895 - protein, 19 aa, Entamoeba invadens
ILVKVAVIGGEVYTKKSYS

SEQ ID NO: 2943896 - protein, 21 aa, Entamoeba invadens
ILVNGMLRRGDRIVVCGMQGP

SEQ ID NO: 2943897 - protein, 17 aa, Entamoeba invadens
ILVPIACCVLLKSVDND

SEQ ID NO: 2943898 - protein, 17 aa, Entamoeba invadens
ILVYKPSPLYILDEVDA

SEQ ID NO: 2943899 - protein, 19 aa, Entamoeba invadens
ILYAGTWGNLIARIDNELH

SEQ ID NO: 2943900 - protein, 19 aa, Entamoeba invadens
ILYDSRLDGLNGRVLNSKV

SEQ ID NO: 2943901 - protein, 24 aa, Entamoeba invadens
ILYELCTLTRAFSGSNVGEVVQKI

SEQ ID NO: 2943902 - protein, 27 aa, Entamoeba invadens
ILYGKGAGCGPTLYLAYKIQKQLKTGS

SEQ ID NO: 2943903 - protein, 21 aa, Entamoeba invadens
ILYGSVIVERGMFLFGKTENS

SEQ ID NO: 2943904 - protein, 24 aa, Entamoeba invadens
ILYHLCTKAWPFGCQKDSFFEGMT

SEQ ID NO: 2943905 - protein, 18 aa, Entamoeba invadens
ILYLFALKICYPDNIKML

SEQ ID NO: 2943906 - protein, 29 aa, Entamoeba invadens
ILYPPRGDEELRLKLTDLILEGFTSNEIF

SEQ ID NO: 2943907 - protein, 26 aa, Entamoeba invadens
ILYRIEMKEMIERATKKITFNEAIKE

SEQ ID NO: 2943908 - protein, 26 aa, Entamoeba invadens
ILYRIEMKEMIERATKKITVNEAIKE

SEQ ID NO: 2943909 - protein, 18 aa, Entamoeba invadens
ILYRLPILQKQNWKKALL

SEQ ID NO: 2943910 - protein, 18 aa, Entamoeba invadens
IMCSGCTVKNNYVHDVFP

SEQ ID NO: 2943911 - protein, 32 aa, Entamoeba invadens
IMDKEQIFDVGLKINMHITKRLIIDKTFVLKP

SEQ ID NO: 2943912 - protein, 24 aa, Entamoeba invadens
IMDPGMYLVCYYRTLNVTTVSPPI

SEQ ID NO: 2943913 - protein, 18 aa, Entamoeba invadens
IMEKRSKKVVWNGESAAQ

SEQ ID NO: 2943914 - protein, 18 aa, Entamoeba invadens
IMENVHLLIDFYTIIPSN

SEQ ID NO: 2943915 - protein, 28 aa, Entamoeba invadens
IMERVKFTKDIFVSKELMSQVFPDSLPE

SEQ ID NO: 2943916 - protein, 23 aa, Entamoeba invadens
IMEYARGGSLGDIIKAKPVLDID

SEQ ID NO: 2943917 - protein, 24 aa, Entamoeba invadens
IMFLYEPPPGFSLEEKIEERMKEK

SEQ ID NO: 2943918 - protein, 25 aa, Entamoeba invadens
IMFNREMKYQLGIPKQFVTAPNAEL

SEQ ID NO: 2943919 - protein, 23 aa, Entamoeba invadens
IMGDFRRVFEVGPVFRAENSNTR

SEQ ID NO: 2943920 - protein, 21 aa, Entamoeba invadens
IMGGGRGFPGLSISKDMEGQT

SEQ ID NO: 2943921 - protein, 26 aa, Entamoeba invadens
IMGTPFSRMFFYIRDLMKYLQTIGAE

SEQ ID NO: 2943922 - protein, 30 aa, Entamoeba invadens
IMHKTVLVVVLTLCKWMAAFPHDFLDQCDK

SEQ ID NO: 2943923 - protein, 25 aa, Entamoeba invadens
IMIGESSVGKTCCMNRYTTNEFSDM

SEQ ID NO: 2943924 - protein, 28 aa, Entamoeba invadens
IMIKMPAFTCSVFKKFNKESGRRNKLQK

SEQ ID NO: 2943925 - protein, 19 aa, Entamoeba invadens
IMIVCKYLNTFSDLVNIEM

SEQ ID NO: 2943926 - protein, 18 aa, Entamoeba invadens
IMIVWKYFDNITDLINLE

SEQ ID NO: 2943927 - protein, 18 aa, Entamoeba invadens
IMKPSLQTFDSFRNEVTK

SEQ ID NO: 2943928 - protein, 22 aa, Entamoeba invadens
IMKYCAKHSVFAGRKEASYYYS

SEQ ID NO: 2943929 - protein, 18 aa, Entamoeba invadens
IMKYCNKANISRMIDCLN

SEQ ID NO: 2943930 - protein, 18 aa, Entamoeba invadens
IMLEGHFNVVRSVAIHPK

SEQ ID NO: 2943931 - protein, 24 aa, Entamoeba invadens
IMLKASGLSGHIITFVAGPCTEGP

SEQ ID NO: 2943932 - protein, 22 aa, Entamoeba invadens
IMLKGVVCTAYIDNIDESKVIT

SEQ ID NO: 2943933 - protein, 18 aa, Entamoeba invadens
IMLMRFFSSVGIPFSQIR

SEQ ID NO: 2943934 - protein, 24 aa, Entamoeba invadens
IMNCTFRQLKLFRCNELVSVQIPT

SEQ ID NO: 2943935 - protein, 25 aa, Entamoeba invadens
IMNFFKINICFGQWKEEEIPKETKF

SEQ ID NO: 2943936 - protein, 21 aa, Entamoeba invadens
IMNKFCQIVAMTSTFVSIQFN

SEQ ID NO: 2943937 - protein, 30 aa, Entamoeba invadens
IMPIQRLPRYKLLLEQLIKFTPPTHCDFDN

SEQ ID NO: 2943938 - protein, 22 aa, Entamoeba invadens
IMPISRKFLQTLFTKKTPENTK

SEQ ID NO: 2943939 - protein, 18 aa, Entamoeba invadens
IMPLRSFIVSLNIPVHQK

SEQ ID NO: 2943940 - protein, 24 aa, Entamoeba invadens
IMPVQRLPRYNLLLTDLLKNTPQT

SEQ ID NO: 2943941 - protein, 25 aa, Entamoeba invadens
IMPVQRLPRYNLLLTDLVKNTEETH

SEQ ID NO: 2943942 - protein, 22 aa, Entamoeba invadens
IMPVQRTPRYVLLIQEVLKHTS

SEQ ID NO: 2943943 - protein, 28 aa, Entamoeba invadens
IMPVQRVPRYRLLLEDLLKNTPDGTEGK

SEQ ID NO: 2943944 - protein, 30 aa, Entamoeba invadens
IMQHANILFSLSFVETLCRYGEDLQYWPEE

SEQ ID NO: 2943945 - protein, 31 aa, Entamoeba invadens
IMQHLSEAWRCWKANIPWKVQGLPEPIENMI

SEQ ID NO: 2943946 - protein, 24 aa, Entamoeba invadens
IMRLCHHPNIIECFGFTELNVSIG

SEQ ID NO: 2943947 - protein, 19 aa, Entamoeba invadens
IMRLNVLVIAFVLGGEKKT

SEQ ID NO: 2943948 - protein, 34 aa, Entamoeba invadens
IMRRSMVDYTPTFIKRKIIESGNALKFENVQREA

SEQ ID NO: 2943949 - protein, 20 aa, Entamoeba invadens
IMSDCKFIASNVLYSENKDN

SEQ ID NO: 2943950 - protein, 17 aa, Entamoeba invadens
IMSDFDALKAFWKYSRQ

SEQ ID NO: 2943951 - protein, 19 aa, Entamoeba invadens
IMSFLIFPVQRIPRYILLM

SEQ ID NO: 2943952 - protein, 24 aa, Entamoeba invadens
IMSKTLRWIFVGGKGGVGKTTTAC

SEQ ID NO: 2943953 - protein, 26 aa, Entamoeba invadens
IMSRDWKERHVLLVFFHEAMNMKAND

SEQ ID NO: 2943954 - protein, 19 aa, Entamoeba invadens
IMSSFPYFVEISVPVVTPT

SEQ ID NO: 2943955 - protein, 20 aa, Entamoeba invadens
IMTNEFLKNAVKLIFLNKMD

SEQ ID NO: 2943956 - protein, 19 aa, Entamoeba invadens
IMTNLQFARYYNFMTKSTE

SEQ ID NO: 2943957 - protein, 20 aa, Entamoeba invadens
IMVISCYFKTIKDFKNVQLV

SEQ ID NO: 2943958 - protein, 17 aa, Entamoeba invadens
IMYKLKYIRASPTKPPT

SEQ ID NO: 2943959 - protein, 23 aa, Entamoeba invadens
INAETLLEGFVFLSNTFESTQSE

SEQ ID NO: 2943960 - protein, 18 aa, Entamoeba invadens
INAFGMCLSLLEIKIPKL

SEQ ID NO: 2943961 - protein, 17 aa, Entamoeba invadens
INALCYMECSALKNTGL

SEQ ID NO: 2943962 - protein, 25 aa, Entamoeba invadens
INALMCKNEHSLYQFNLLDFYSRTL

SEQ ID NO: 2943963 - protein, 18 aa, Entamoeba invadens
INAPCGMPQSDKNVIQNV

SEQ ID NO: 2943964 - protein, 30 aa, Entamoeba invadens
INCGGCMRACPFAAILPRSNLLDVLQRLHK

SEQ ID NO: 2943965 - protein, 17 aa, Entamoeba invadens
INCKFDKMFFAKNLKVM

SEQ ID NO: 2943966 - protein, 23 aa, Entamoeba invadens
INCKGKMLWVLSTLADVFVFSKT

SEQ ID NO: 2943967 - protein, 25 aa, Entamoeba invadens
INCKYGDDCVFDFLSDLDSNSVVYF

SEQ ID NO: 2943968 - protein, 24 aa, Entamoeba invadens
INCLACDKEHMAIGFVTTQCSQCI

SEQ ID NO: 2943969 - protein, 18 aa, Entamoeba invadens
INCPMTLINFPSLKERIV

SEQ ID NO: 2943970 - protein, 17 aa, Entamoeba invadens
INCRGTVELEEKEEFDK

SEQ ID NO: 2943971 - protein, 19 aa, Entamoeba invadens
INCTETLQFPDDVEISPDA

SEQ ID NO: 2943972 - protein, 31 aa, Entamoeba invadens
INCVDLAGSENCKRAGVLGDKVKQIEGMAIN

SEQ ID NO: 2943973 - protein, 20 aa, Entamoeba invadens
INDCMNVLINSWKKAGESAF

SEQ ID NO: 2943974 - protein, 17 aa, Entamoeba invadens
INDKIAVIALDITSGQQ

SEQ ID NO: 2943975 - protein, 17 aa, Entamoeba invadens
INDKLTAINAERTKQKK

SEQ ID NO: 2943976 - protein, 22 aa, Entamoeba invadens
INDMRLLSSVCMYGAGVCHLYL

SEQ ID NO: 2943977 - protein, 23 aa, Entamoeba invadens
INDRAKVGMRVGRDEGRGNFVGI

SEQ ID NO: 2943978 - protein, 26 aa, Entamoeba invadens
INDSFHLFNAIALFIGNIAFVNNNSE

SEQ ID NO: 2943979 - protein, 25 aa, Entamoeba invadens
INDSGRLWVGLARWHIRQGRVESGI

SEQ ID NO: 2943980 - protein, 21 aa, Entamoeba invadens
INDVCFKADADIILSVGEDSR

SEQ ID NO: 2943981 - protein, 22 aa, Entamoeba invadens
INEALTLFSQEQMETLQEVAMI

SEQ ID NO: 2943982 - protein, 25 aa, Entamoeba invadens
INEFFKKWLEALNVMLKSENVEVVY

SEQ ID NO: 2943983 - protein, 18 aa, Entamoeba invadens
INEFKRFAPNKGQLPQIV

SEQ ID NO: 2943984 - protein, 18 aa, Entamoeba invadens
INEFMSYFFNMMNKLEEI

SEQ ID NO: 2943985 - protein, 17 aa, Entamoeba invadens
INEIFEVISKRLLEMCN

SEQ ID NO: 2943986 - protein, 20 aa, Entamoeba invadens
INEIIQWYGPFSVAVNGNVD

SEQ ID NO: 2943987 - protein, 19 aa, Entamoeba invadens
INEKDRLTMYVTQKDDQLQ

SEQ ID NO: 2943988 - protein, 24 aa, Entamoeba invadens
INELKFVEYFKVNLIDILNTEQRT

SEQ ID NO: 2943989 - protein, 24 aa, Entamoeba invadens
INELKKKCLEDGAHIVETKNQIVT

SEQ ID NO: 2943990 - protein, 17 aa, Entamoeba invadens
INELNLLKQMSQEEVEG

SEQ ID NO: 2943991 - protein, 19 aa, Entamoeba invadens
INEMIYAAMALKLPSLDVA

SEQ ID NO: 2943992 - protein, 26 aa, Entamoeba invadens
INEMKFKDQAVWMLNAMWPKDGDSKA

SEQ ID NO: 2943993 - protein, 19 aa, Entamoeba invadens
INEMLWLVMEYMDGGCLTD

SEQ ID NO: 2943994 - protein, 19 aa, Entamoeba invadens
INEMWLNCDADFLSGEKYS

SEQ ID NO: 2943995 - protein, 20 aa, Entamoeba invadens
INESMPFLTFDPRSAEESFL

SEQ ID NO: 2943996 - protein, 18 aa, Entamoeba invadens
INETFPALVAFIHEDPIT

SEQ ID NO: 2943997 - protein, 25 aa, Entamoeba invadens
INETPRHFFCIIVWYKVSYEDAQIN

SEQ ID NO: 2943998 - protein, 20 aa, Entamoeba invadens
INEVCLASFLEFMRGTITEP

SEQ ID NO: 2943999 - protein, 23 aa, Entamoeba invadens
INEVPTWAQSFVKKGWNKSQNRR

SEQ ID NO: 2944000 - protein, 17 aa, Entamoeba invadens
INFCELKTIEVKSGVTN

SEQ ID NO: 2944001 - protein, 28 aa, Entamoeba invadens
INFEKCRVLSGLICSIVRYQNTPYIIKH

SEQ ID NO: 2944002 - protein, 18 aa, Entamoeba invadens
INFFRIIIWFEVDYSFSL

SEQ ID NO: 2944003 - protein, 25 aa, Entamoeba invadens
INFGTSRPRINTMLRNMMNKAVGTH

SEQ ID NO: 2944004 - protein, 24 aa, Entamoeba invadens
INFIGNGACGLVMEVEKNGVRYAM

SEQ ID NO: 2944005 - protein, 17 aa, Entamoeba invadens
INFLKFNSIYNCSEYFC

SEQ ID NO: 2944006 - protein, 21 aa, Entamoeba invadens
INFMPQFKGKSIIEIRYEDYK

SEQ ID NO: 2944007 - protein, 17 aa, Entamoeba invadens
INFPLCVSPTLAEIKMG

SEQ ID NO: 2944008 - protein, 24 aa, Entamoeba invadens
INFQPKYVQTSLFYKDENLTKLFA

SEQ ID NO: 2944009 - protein, 23 aa, Entamoeba invadens
INFQRRVVYHLNEYLLHSTPTTE

SEQ ID NO: 2944010 - protein, 21 aa, Entamoeba invadens
INFTLALSLLMLKKYEDALKI

SEQ ID NO: 2944011 - protein, 25 aa, Entamoeba invadens
INFYDFKILLILQGQLGCAFSFVVD

SEQ ID NO: 2944012 - protein, 21 aa, Entamoeba invadens
INGGFCPFEEIDLMNTIDSIN

SEQ ID NO: 2944013 - protein, 18 aa, Entamoeba invadens
INGGSCLRPMTRQYYSRT

SEQ ID NO: 2944014 - protein, 21 aa, Entamoeba invadens
INGMDKISCIFIVCTQAVYVV

SEQ ID NO: 2944015 - protein, 19 aa, Entamoeba invadens
INGPKEMKVPPGVKEIYCV

SEQ ID NO: 2944016 - protein, 20 aa, Entamoeba invadens
INGTVTWNQFGIAEFEDGDL

SEQ ID NO: 2944017 - protein, 29 aa, Entamoeba invadens
INGVKPFGPRFVSISADRSIQIWDPNAVT

SEQ ID NO: 2944018 - protein, 19 aa, Entamoeba invadens
INHFERFKSLLDITVVVPT

SEQ ID NO: 2944019 - protein, 17 aa, Entamoeba invadens
INIEKCFDQTNNVVLSY

SEQ ID NO: 2944020 - protein, 19 aa, Entamoeba invadens
INIIARPQTNFVFDNENFE

SEQ ID NO: 2944021 - protein, 17 aa, Entamoeba invadens
INIKHRVKMMLDGANGI

SEQ ID NO: 2944022 - protein, 22 aa, Entamoeba invadens
INIKLRVKIVLDDANGISYLHE

SEQ ID NO: 2944023 - protein, 19 aa, Entamoeba invadens
INIKNGRISPVSKEISLST

SEQ ID NO: 2944024 - protein, 19 aa, Entamoeba invadens
INILNEFPEELIGVEGLVS

SEQ ID NO: 2944025 - protein, 17 aa, Entamoeba invadens
INIPLQYIENYNFTPKV

SEQ ID NO: 2944026 - protein, 22 aa, Entamoeba invadens
INIQNALICLRIILSKFKDETL

SEQ ID NO: 2944027 - protein, 25 aa, Entamoeba invadens
INIRKALCKGFFMQSAHIIKGKYQI

SEQ ID NO: 2944028 - protein, 25 aa, Entamoeba invadens
INISRCFGDLFILLPDDLETLYIEN

SEQ ID NO: 2944029 - protein, 18 aa, Entamoeba invadens
INITRKVADFAVAMEDAI

SEQ ID NO: 2944030 - protein, 20 aa, Entamoeba invadens
INITSPRISKIIFSPTDEIN

SEQ ID NO: 2944031 - protein, 18 aa, Entamoeba invadens
INIWDRVKKSLVNSLGSP

SEQ ID NO: 2944032 - protein, 25 aa, Entamoeba invadens
INKDKLKSGLALLLKQKDDLQNKIC

SEQ ID NO: 2944033 - protein, 24 aa, Entamoeba invadens
INKDYPAVVGLLFELLDRLEKMQQ

SEQ ID NO: 2944034 - protein, 17 aa, Entamoeba invadens
INKFMFECIDSNHDGVL

SEQ ID NO: 2944035 - protein, 17 aa, Entamoeba invadens
INKGCFEFCNALVDVQL

SEQ ID NO: 2944036 - protein, 32 aa, Entamoeba invadens
INKGFEWIKKRGITILKNLICTFEKLYKNIKT

SEQ ID NO: 2944037 - protein, 17 aa, Entamoeba invadens
INKIFLKARHETKEIYL

SEQ ID NO: 2944038 - protein, 18 aa, Entamoeba invadens
INKIRILGYDLKNVNKYE

SEQ ID NO: 2944039 - protein, 17 aa, Entamoeba invadens
INKKCFEAVQTMFTNSF

SEQ ID NO: 2944040 - protein, 24 aa, Entamoeba invadens
INKKCIRVMKRLQINPLVIEKTRN

SEQ ID NO: 2944041 - protein, 26 aa, Entamoeba invadens
INKKCSSCLSGLYINPFIDVSVQSFS

SEQ ID NO: 2944042 - protein, 21 aa, Entamoeba invadens
INKKCVLCLSLMKENVSLDND

SEQ ID NO: 2944043 - protein, 30 aa, Entamoeba invadens
INKKTLLLFHVWANGFFKESIGTLKVEMTD

SEQ ID NO: 2944044 - protein, 17 aa, Entamoeba invadens
INKMLSCAGADRLQTGM

SEQ ID NO: 2944045 - protein, 23 aa, Entamoeba invadens
INKRARAGCGIDVLVHVVVAYVP

SEQ ID NO: 2944046 - protein, 29 aa, Entamoeba invadens
INKRNAVFTKMFYQIVVWFNVDYTTVYNN

SEQ ID NO: 2944047 - protein, 23 aa, Entamoeba invadens
INKRVCVTDGYMFFFDDTNETSY

SEQ ID NO: 2944048 - protein, 18 aa, Entamoeba invadens
INKRYFVQLLEQYHAVKR

SEQ ID NO: 2944049 - protein, 21 aa, Entamoeba invadens
INKSKIGFELLVEGSELLKVM

SEQ ID NO: 2944050 - protein, 18 aa, Entamoeba invadens
INKTMCLVILIGEIYVKE

SEQ ID NO: 2944051 - protein, 23 aa, Entamoeba invadens
INKVEGMMFFFSDVLIFSKVINP

SEQ ID NO: 2944052 - protein, 27 aa, Entamoeba invadens
INKYCYSCFEVRKCIMQAISDWGIKTN

SEQ ID NO: 2944053 - protein, 17 aa, Entamoeba invadens
INLCAAHDIIKECPNSE

SEQ ID NO: 2944054 - protein, 25 aa, Entamoeba invadens
INLCKVMAMKCCKQVDFISYPSRHA

SEQ ID NO: 2944055 - protein, 20 aa, Entamoeba invadens
INLEIETFVLFKEPREALYS

SEQ ID NO: 2944056 - protein, 19 aa, Entamoeba invadens
INLEYSKGFGADIFDEAKQ

SEQ ID NO: 2944057 - protein, 19 aa, Entamoeba invadens
INLFISRKYQPIYYLQQLA

SEQ ID NO: 2944058 - protein, 23 aa, Entamoeba invadens
INLFNGEKCCIGRSPKEADGVYT

SEQ ID NO: 2944059 - protein, 17 aa, Entamoeba invadens
INLGAYLLIEFFEEEDG

SEQ ID NO: 2944060 - protein, 22 aa, Entamoeba invadens
INLKQLVIYSFCEFQKTNLNEV

SEQ ID NO: 2944061 - protein, 18 aa, Entamoeba invadens
INLKRLFQVKGQRRPYVK

SEQ ID NO: 2944062 - protein, 18 aa, Entamoeba invadens
INLKRRINGAPHFALGNK

SEQ ID NO: 2944063 - protein, 26 aa, Entamoeba invadens
INLKTVNGFEAFTCSWCDKLVEVALP

SEQ ID NO: 2944064 - protein, 21 aa, Entamoeba invadens
INLMKIGGFIDAVRVLFYGKF

SEQ ID NO: 2944065 - protein, 17 aa, Entamoeba invadens
INLNFQTKTGRWNITKI

SEQ ID NO: 2944066 - protein, 24 aa, Entamoeba invadens
INLPADLLVMITYIEKMDMFYDNI

SEQ ID NO: 2944067 - protein, 26 aa, Entamoeba invadens
INLPESISYLGPFCFGGCTSLREINI

SEQ ID NO: 2944068 - protein, 19 aa, Entamoeba invadens
INLPIYGGGIVFYDEVTKN

SEQ ID NO: 2944069 - protein, 25 aa, Entamoeba invadens
INLPKDLIVMISYIGKMEIHYPLIE

SEQ ID NO: 2944070 - protein, 25 aa, Entamoeba invadens
INLPSELLTMISFIGKMEDEYPAID

SEQ ID NO: 2944071 - protein, 28 aa, Entamoeba invadens
INLQSVVQCMVCVYPTSVDVERFFSKLK

SEQ ID NO: 2944072 - protein, 25 aa, Entamoeba invadens
INLRCYFGTKILNGFNVPTSVTEIN

SEQ ID NO: 2944073 - protein, 23 aa, Entamoeba invadens
INLRVFECGSVFCTKTITQNFIN

SEQ ID NO: 2944074 - protein, 22 aa, Entamoeba invadens
INLSNTFLPFVAHYTSLSSTIN

SEQ ID NO: 2944075 - protein, 18 aa, Entamoeba invadens
INLSRLISSPSLKKVILY

SEQ ID NO: 2944076 - protein, 17 aa, Entamoeba invadens
INLVIKEKAAFIPTEAF

SEQ ID NO: 2944077 - protein, 23 aa, Entamoeba invadens
INLYQIRSTRHFRLNKTVFRVTR

SEQ ID NO: 2944078 - protein, 20 aa, Entamoeba invadens
INMISYFKSLFAIATESAIL

SEQ ID NO: 2944079 - protein, 25 aa, Entamoeba invadens
INMKDLVTEFSWFFAQVLQAANDQG

SEQ ID NO: 2944080 - protein, 19 aa, Entamoeba invadens
INMKNCKEIGASAFENCLR

SEQ ID NO: 2944081 - protein, 18 aa, Entamoeba invadens
INMMPEYSFGNTMGDPFL

SEQ ID NO: 2944082 - protein, 25 aa, Entamoeba invadens
INMPLGAPLPFNFVNSLPKPNRNTL

SEQ ID NO: 2944083 - protein, 22 aa, Entamoeba invadens
INNISIDFGRRVEEECQKQYEL

SEQ ID NO: 2944084 - protein, 23 aa, Entamoeba invadens
INNKECRKELIAMGIETRDLYLH

SEQ ID NO: 2944085 - protein, 24 aa, Entamoeba invadens
INNKYICLKKYMIGFDPLTELCRL

SEQ ID NO: 2944086 - protein, 22 aa, Entamoeba invadens
INNRFFPKVIHLINSRQPNTTN

SEQ ID NO: 2944087 - protein, 26 aa, Entamoeba invadens
INNWAKEFAKWAPRMNCIVYTGDGES

SEQ ID NO: 2944088 - protein, 23 aa, Entamoeba invadens
INNYAFKFCWNIKTLSFPNLLSK

SEQ ID NO: 2944089 - protein, 23 aa, Entamoeba invadens
INPFKLTQFYSFNKIIKIFPKLQ

SEQ ID NO: 2944090 - protein, 28 aa, Entamoeba invadens
INPTLPTHEQWAALISHLSKPSPVIRSA

SEQ ID NO: 2944091 - protein, 18 aa, Entamoeba invadens
INPYRLSELYPFNRIHKV

SEQ ID NO: 2944092 - protein, 18 aa, Entamoeba invadens
INPYRLSELYPFNRIIND

SEQ ID NO: 2944093 - protein, 17 aa, Entamoeba invadens
INQKMHLQFARPGGQPE

SEQ ID NO: 2944094 - protein, 19 aa, Entamoeba invadens
INQRTVLATLRLTTFKNCL

SEQ ID NO: 2944095 - protein, 24 aa, Entamoeba invadens
INQSEHIQCYPMMYGGNRGGFGGG

SEQ ID NO: 2944096 - protein, 17 aa, Entamoeba invadens
INREIKYTVTYESLVCY

SEQ ID NO: 2944097 - protein, 17 aa, Entamoeba invadens
INRKCTSALDVIQKNIN

SEQ ID NO: 2944098 - protein, 19 aa, Entamoeba invadens
INRMGSLNLSTAICQCFLP

SEQ ID NO: 2944099 - protein, 18 aa, Entamoeba invadens
INSAIDFYFTNFISQNEI

SEQ ID NO: 2944100 - protein, 17 aa, Entamoeba invadens
INSALIYKRDVNINPMY

SEQ ID NO: 2944101 - protein, 19 aa, Entamoeba invadens
INSDIIYNIHVLKRYYNYL

SEQ ID NO: 2944102 - protein, 25 aa, Entamoeba invadens
INSDLSAVGLRFAGEQGPMLQSVVD

SEQ ID NO: 2944103 - protein, 20 aa, Entamoeba invadens
INSKCIKCSFWHSPDDKGHF

SEQ ID NO: 2944104 - protein, 26 aa, Entamoeba invadens
INSKIVRYMVRSCGSEEVFNVYCECS

SEQ ID NO: 2944105 - protein, 20 aa, Entamoeba invadens
INSLILKFAEEWQNIGKTQA

SEQ ID NO: 2944106 - protein, 18 aa, Entamoeba invadens
INSRFVKIQGDLYEYFDL

SEQ ID NO: 2944107 - protein, 22 aa, Entamoeba invadens
INSRGVKGIRTFHLTVDTENDL

SEQ ID NO: 2944108 - protein, 24 aa, Entamoeba invadens
INSRNLKGPRVFFIVTENSIDHES

SEQ ID NO: 2944109 - protein, 25 aa, Entamoeba invadens
INSRNLKGPRVFFIVTENSIDHESF

SEQ ID NO: 2944110 - protein, 18 aa, Entamoeba invadens
INSSRYFIKEGFLTKQCR

SEQ ID NO: 2944111 - protein, 24 aa, Entamoeba invadens
INSTELRPTVLAQYVDHYFDRPEK

SEQ ID NO: 2944112 - protein, 17 aa, Entamoeba invadens
INSTFAILKSALEKHIS

SEQ ID NO: 2944113 - protein, 21 aa, Entamoeba invadens
INSTYSFKRWFWISRNITEII

SEQ ID NO: 2944114 - protein, 23 aa, Entamoeba invadens
INSTYSFTRWFWISRNITEIINN

SEQ ID NO: 2944115 - protein, 17 aa, Entamoeba invadens
INSYSFFGCHNLESVVI

SEQ ID NO: 2944116 - protein, 18 aa, Entamoeba invadens
INTDFLLLLVKKLVERNK

SEQ ID NO: 2944117 - protein, 18 aa, Entamoeba invadens
INTFKVPIEKYIKDQFSE

SEQ ID NO: 2944118 - protein, 24 aa, Entamoeba invadens
INTKCFDALQIIRINPQYKVARRG

SEQ ID NO: 2944119 - protein, 17 aa, Entamoeba invadens
INTLHFLGDVLEKVRNC

SEQ ID NO: 2944120 - protein, 17 aa, Entamoeba invadens
INTLIGWTVDNIDMKEK

SEQ ID NO: 2944121 - protein, 32 aa, Entamoeba invadens
INTNLPLVFPVEVPRCDSVCEYIYVNGYDKTN

SEQ ID NO: 2944122 - protein, 26 aa, Entamoeba invadens
INVCCVCGDVGHLLEKCPVKLEEFKR

SEQ ID NO: 2944123 - protein, 17 aa, Entamoeba invadens
INVPLNIIDYVKLENKS

SEQ ID NO: 2944124 - protein, 18 aa, Entamoeba invadens
INVQFSWTDTVKKEQTSC

SEQ ID NO: 2944125 - protein, 19 aa, Entamoeba invadens
INVRERAKIICEMLNDKEF

SEQ ID NO: 2944126 - protein, 22 aa, Entamoeba invadens
INVSELFDLVARKLPKTEKGLI

SEQ ID NO: 2944127 - protein, 30 aa, Entamoeba invadens
INVVELYIRQCKNFRIGLMSKTKIVDIVES

SEQ ID NO: 2944128 - protein, 25 aa, Entamoeba invadens
INVYKWRKIYELIEQVIGAKYPQPK

SEQ ID NO: 2944129 - protein, 24 aa, Entamoeba invadens
INWKLEKLIQFTFNICHLCQFKNK

SEQ ID NO: 2944130 - protein, 25 aa, Entamoeba invadens
INWLMTVKITNEWLVGKEDDEDLDM

SEQ ID NO: 2944131 - protein, 17 aa, Entamoeba invadens
INYDFLMDIIKLLEQLL

SEQ ID NO: 2944132 - protein, 23 aa, Entamoeba invadens
INYFHCLLSPPSLCENMDRAVTC

SEQ ID NO: 2944133 - protein, 25 aa, Entamoeba invadens
INYFNHKIARDFPTEDLKEKGTKKS

SEQ ID NO: 2944134 - protein, 18 aa, Entamoeba invadens
INYKVAIENIVFKYAKIM

SEQ ID NO: 2944135 - protein, 25 aa, Entamoeba invadens
INYYCLPYNFLICDYKTIKPEKLIN

SEQ ID NO: 2944136 - protein, 17 aa, Entamoeba invadens
IPAIALGTWLAEKDLVG

SEQ ID NO: 2944137 - protein, 19 aa, Entamoeba invadens
IPAKELVDILIVINTDVTA

SEQ ID NO: 2944138 - protein, 22 aa, Entamoeba invadens
IPAPQGNRGGNTYDFSSQKKVD

SEQ ID NO: 2944139 - protein, 17 aa, Entamoeba invadens
IPAVQSILGEFGVRVKP

SEQ ID NO: 2944140 - protein, 19 aa, Entamoeba invadens
IPCGLLVLRGDEIILIGAL

SEQ ID NO: 2944141 - protein, 17 aa, Entamoeba invadens
IPCQLQHMMNVKKVTKS

SEQ ID NO: 2944142 - protein, 22 aa, Entamoeba invadens
IPCRCFDHCISLSSVVLPPNCS

SEQ ID NO: 2944143 - protein, 20 aa, Entamoeba invadens
IPDDCKLFEYDVFKQKDQII

SEQ ID NO: 2944144 - protein, 17 aa, Entamoeba invadens
IPDEARLILGKVGNDEE

SEQ ID NO: 2944145 - protein, 18 aa, Entamoeba invadens
IPDEIFKSLEFLEEVILP

SEQ ID NO: 2944146 - protein, 24 aa, Entamoeba invadens
IPDEPIFPIEFFISCDPKEIARQM

SEQ ID NO: 2944147 - protein, 24 aa, Entamoeba invadens
IPDEYRRLFTYIVAFLKDLVSKGE

SEQ ID NO: 2944148 - protein, 21 aa, Entamoeba invadens
IPDFRSKGGMWTRYDPKVYAN

SEQ ID NO: 2944149 - protein, 18 aa, Entamoeba invadens
IPDGFGLLQNLKILILND

SEQ ID NO: 2944150 - protein, 23 aa, Entamoeba invadens
IPDKLRESSLLKRALDYSIKSGV

SEQ ID NO: 2944151 - protein, 24 aa, Entamoeba invadens
IPDLKIRVESIIDNFAIECNTRKF

SEQ ID NO: 2944152 - protein, 25 aa, Entamoeba invadens
IPDNFDKLRCCKICGLIKSEGQFES

SEQ ID NO: 2944153 - protein, 24 aa, Entamoeba invadens
IPDRMPNDLLLQVLIGMYKCGVLC

SEQ ID NO: 2944154 - protein, 17 aa, Entamoeba invadens
IPDSIKIISINFKDVTI

SEQ ID NO: 2944155 - protein, 18 aa, Entamoeba invadens
IPDSKIKVTNCVSLCLFT

SEQ ID NO: 2944156 - protein, 21 aa, Entamoeba invadens
IPDSLVSLSLENVVMSNDIDL

SEQ ID NO: 2944157 - protein, 26 aa, Entamoeba invadens
IPDSRFCIEFIYRLVSLDSNDKYVQL

SEQ ID NO: 2944158 - protein, 20 aa, Entamoeba invadens
IPDVPLVINYDMPWTAEDYI

SEQ ID NO: 2944159 - protein, 24 aa, Entamoeba invadens
IPDYKLDKFLFFGALTTGMLNLNL

SEQ ID NO: 2944160 - protein, 29 aa, Entamoeba invadens
IPECKLSLKEVFVPSLVIPNANFFRNYLL

SEQ ID NO: 2944161 - protein, 17 aa, Entamoeba invadens
IPEEAKELIPMEESLQK

SEQ ID NO: 2944162 - protein, 18 aa, Entamoeba invadens
IPEFVFKINNNYNVQTEV

SEQ ID NO: 2944163 - protein, 20 aa, Entamoeba invadens
IPEGATLIGERAFPNTVKIN

SEQ ID NO: 2944164 - protein, 17 aa, Entamoeba invadens
IPEGCPQGNLTDPAQLI

SEQ ID NO: 2944165 - protein, 21 aa, Entamoeba invadens
IPEGFGFGWCDVFVVKRQKTF

SEQ ID NO: 2944166 - protein, 25 aa, Entamoeba invadens
IPEKDARMAVLLANCRLPRDDENEA

SEQ ID NO: 2944167 - protein, 25 aa, Entamoeba invadens
IPEKYKRIGDIIVDFLNQIVSAKDP

SEQ ID NO: 2944168 - protein, 23 aa, Entamoeba invadens
IPENEVLKFLNVLELGSDIDPST

SEQ ID NO: 2944169 - protein, 17 aa, Entamoeba invadens
IPENLKIDVKSVEQKHP

SEQ ID NO: 2944170 - protein, 32 aa, Entamoeba invadens
IPENVCTRLGQSCFQGLKFAEVLIPYSVESIL

SEQ ID NO: 2944171 - protein, 17 aa, Entamoeba invadens
IPENWPSALKSRIIKER

SEQ ID NO: 2944172 - protein, 19 aa, Entamoeba invadens
IPERVKVFELKNCLGVEVV

SEQ ID NO: 2944173 - protein, 23 aa, Entamoeba invadens
IPESLRLKARTDFLCVCDCLLSY

SEQ ID NO: 2944174 - protein, 21 aa, Entamoeba invadens
IPESVKQMYTDGCTWATHFSR

SEQ ID NO: 2944175 - protein, 21 aa, Entamoeba invadens
IPETVKVIILRMCTGNADVLQ

SEQ ID NO: 2944176 - protein, 24 aa, Entamoeba invadens
IPEVARLALIATIERTVLFDSELQ

SEQ ID NO: 2944177 - protein, 18 aa, Entamoeba invadens
IPFDFPMDIHCYTASLDF

SEQ ID NO: 2944178 - protein, 21 aa, Entamoeba invadens
IPFIHCLYSSILTLTPDEATK

SEQ ID NO: 2944179 - protein, 18 aa, Entamoeba invadens
IPFIKKVFLYFSENNIGF

SEQ ID NO: 2944180 - protein, 22 aa, Entamoeba invadens
IPFLKKSLITPFLIFQNGERGI

SEQ ID NO: 2944181 - protein, 28 aa, Entamoeba invadens
IPFMPHIVLEVVKTIFAKRGITGEKILI

SEQ ID NO: 2944182 - protein, 18 aa, Entamoeba invadens
IPFNLKILRKSVFASCCS

SEQ ID NO: 2944183 - protein, 20 aa, Entamoeba invadens
IPFRELRFNGTIKRNTATMQ

SEQ ID NO: 2944184 - protein, 23 aa, Entamoeba invadens
IPFRGGFDACVLAEKGIDAINMF

SEQ ID NO: 2944185 - protein, 18 aa, Entamoeba invadens
IPFSLSFIRSVAKQLLLF

SEQ ID NO: 2944186 - protein, 17 aa, Entamoeba invadens
IPFSYLTLFTVIKCTPD

SEQ ID NO: 2944187 - protein, 18 aa, Entamoeba invadens
IPGLLDFFGGNEYNVKGI

SEQ ID NO: 2944188 - protein, 19 aa, Entamoeba invadens
IPGQLYQFRGFDVANMSFI

SEQ ID NO: 2944189 - protein, 22 aa, Entamoeba invadens
IPGRTLCLGDLIDLKTFKDTAV

SEQ ID NO: 2944190 - protein, 22 aa, Entamoeba invadens
IPHAAVCVLQLYTIDDSHDAIV

SEQ ID NO: 2944191 - protein, 19 aa, Entamoeba invadens
IPHCTFLNCYNLKEIVFPE

SEQ ID NO: 2944192 - protein, 17 aa, Entamoeba invadens
IPHEEMDAYLNIEVKKI

SEQ ID NO: 2944193 - protein, 27 aa, Entamoeba invadens
IPHFAAPDHFLFAAVDGHSGFQASYSF

SEQ ID NO: 2944194 - protein, 19 aa, Entamoeba invadens
IPHNLSYLGGGAFLSCCSL

SEQ ID NO: 2944195 - protein, 17 aa, Entamoeba invadens
IPHPYFFNNNIKKIILP

SEQ ID NO: 2944196 - protein, 18 aa, Entamoeba invadens
IPHQMIKLYLQTLNTKTD

SEQ ID NO: 2944197 - protein, 26 aa, Entamoeba invadens
IPHTLDLPSYTFPRIKTEALPSTQYT

SEQ ID NO: 2944198 - protein, 20 aa, Entamoeba invadens
IPIANQWKMVQEFDKKQRKD

SEQ ID NO: 2944199 - protein, 34 aa, Entamoeba invadens
IPIDPCCLNSCVQWCFIKNFLVIFQFFPTLVNIS

SEQ ID NO: 2944200 - protein, 20 aa, Entamoeba invadens
IPIEFEILMAKCWDVEPKNR

SEQ ID NO: 2944201 - protein, 26 aa, Entamoeba invadens
IPIESNSSMITLKFIEPVQSGTTGDV

SEQ ID NO: 2944202 - protein, 19 aa, Entamoeba invadens
IPIFLPFLTSLREFFQNYM

SEQ ID NO: 2944203 - protein, 34 aa, Entamoeba invadens
IPIHKPEHISGRRPLSHEVLPCKDILKTLKNLPE

SEQ ID NO: 2944204 - protein, 17 aa, Entamoeba invadens
IPILGKIALDLMKKFSL

SEQ ID NO: 2944205 - protein, 19 aa, Entamoeba invadens
IPILQPLHVYVCQGHLSDI

SEQ ID NO: 2944206 - protein, 17 aa, Entamoeba invadens
IPILSLWMHDVVNINEM

SEQ ID NO: 2944207 - protein, 27 aa, Entamoeba invadens
IPILYIKEPLKWEGCSWGFLCDNIQNW

SEQ ID NO: 2944208 - protein, 21 aa, Entamoeba invadens
IPINKNIVWRVPLKDNDKSAG

SEQ ID NO: 2944209 - protein, 18 aa, Entamoeba invadens
IPIPEKFQTVTLEVCRHT

SEQ ID NO: 2944210 - protein, 27 aa, Entamoeba invadens
IPISFKETKNVFLFNMNNFVFKNTFEN

SEQ ID NO: 2944211 - protein, 17 aa, Entamoeba invadens
IPISIIDGIAFGRMRKK

SEQ ID NO: 2944212 - protein, 24 aa, Entamoeba invadens
IPITAVKYRPQWYNFSSTEQEEAV

SEQ ID NO: 2944213 - protein, 19 aa, Entamoeba invadens
IPITISFGITDEGIPLMDP

SEQ ID NO: 2944214 - protein, 28 aa, Entamoeba invadens
IPKCAFFVFCDECVFGFYSESQTFYLSP

SEQ ID NO: 2944215 - protein, 18 aa, Entamoeba invadens
IPKCERVRSVALKCFCEC

SEQ ID NO: 2944216 - protein, 17 aa, Entamoeba invadens
IPKCFQLKGLKCAEKMK

SEQ ID NO: 2944217 - protein, 25 aa, Entamoeba invadens
IPKCPRCGGKMTFNLREDDLFVDGP

SEQ ID NO: 2944218 - protein, 21 aa, Entamoeba invadens
IPKDSLLYIGHVKQRSIPLES

SEQ ID NO: 2944219 - protein, 17 aa, Entamoeba invadens
IPKEAFDYGKAHKLGSN

SEQ ID NO: 2944220 - protein, 21 aa, Entamoeba invadens
IPKEAKIGVVLCRNNKVREKI

SEQ ID NO: 2944221 - protein, 21 aa, Entamoeba invadens
IPKEEGAPFVKLRKVEKKEES

SEQ ID NO: 2944222 - protein, 33 aa, Entamoeba invadens
IPKEELKVDPSGHKMILTEDKFDSDNIRTVMSE

SEQ ID NO: 2944223 - protein, 19 aa, Entamoeba invadens
IPKEKKEGFVYVKGDENHF

SEQ ID NO: 2944224 - protein, 21 aa, Entamoeba invadens
IPKEMGEVFSGLPDNIAKQLL

SEQ ID NO: 2944225 - protein, 19 aa, Entamoeba invadens
IPKEPKIVLSGAFEGSENI

SEQ ID NO: 2944226 - protein, 24 aa, Entamoeba invadens
IPKGLDSAILVSRSRSVGESRSVI

SEQ ID NO: 2944227 - protein, 30 aa, Entamoeba invadens
IPKGQCTRRVGIVGCDWDDLSAQELFALLS

SEQ ID NO: 2944228 - protein, 24 aa, Entamoeba invadens
IPKHGYLIEWARQGVLMLNATLTV

SEQ ID NO: 2944229 - protein, 21 aa, Entamoeba invadens
IPKICKIRFSNHDVIDVQSLA

SEQ ID NO: 2944230 - protein, 20 aa, Entamoeba invadens
IPKIFKRVASPINDFITDKP

SEQ ID NO: 2944231 - protein, 20 aa, Entamoeba invadens
IPKIVFKCPLVKLYLDSNNL

SEQ ID NO: 2944232 - protein, 17 aa, Entamoeba invadens
IPKIYFLAQTFKELVDV

SEQ ID NO: 2944233 - protein, 21 aa, Entamoeba invadens
IPKNCFKNCTSLTFVYIPQKV

SEQ ID NO: 2944234 - protein, 24 aa, Entamoeba invadens
IPKNELRFAYFKNEDFAVSVGGNK

SEQ ID NO: 2944235 - protein, 21 aa, Entamoeba invadens
IPKNSFCVILPKNIKNITKIT

SEQ ID NO: 2944236 - protein, 27 aa, Entamoeba invadens
IPKNVKSFGAFCFYNSVPKENVLFENK

SEQ ID NO: 2944237 - protein, 17 aa, Entamoeba invadens
IPKQDMEALQFLFGVTD

SEQ ID NO: 2944238 - protein, 26 aa, Entamoeba invadens
IPKQMPGPTKDFWVVFGDELMMSLVC

SEQ ID NO: 2944239 - protein, 18 aa, Entamoeba invadens
IPKRMFKDCVSLFEIDIP

SEQ ID NO: 2944240 - protein, 27 aa, Entamoeba invadens
IPKSLKLIGSKAFSYTGLPSFEVLENF

SEQ ID NO: 2944241 - protein, 25 aa, Entamoeba invadens
IPKSVCSLGDMTFKSCYKLKEINIP

SEQ ID NO: 2944242 - protein, 18 aa, Entamoeba invadens
IPKSVTFLGDCCFTSCTS

SEQ ID NO: 2944243 - protein, 25 aa, Entamoeba invadens
IPKTVNYIGDWAFFCCSSLEYIDIP

SEQ ID NO: 2944244 - protein, 21 aa, Entamoeba invadens
IPKVVCFLNPTIFKLDNSCII

SEQ ID NO: 2944245 - protein, 19 aa, Entamoeba invadens
IPLADGLAHLSEFQTKMPR

SEQ ID NO: 2944246 - protein, 18 aa, Entamoeba invadens
IPLDPVIARSCDVGSPYF

SEQ ID NO: 2944247 - protein, 21 aa, Entamoeba invadens
IPLFSNFTGVFGYPLQSITTK

SEQ ID NO: 2944248 - protein, 21 aa, Entamoeba invadens
IPLIAEPIFEFMSRKSQSNVI

SEQ ID NO: 2944249 - protein, 18 aa, Entamoeba invadens
IPLIKTLINFEQFCEEAN

SEQ ID NO: 2944250 - protein, 22 aa, Entamoeba invadens
IPLIRKEWNAEFTQEQALSLIK

SEQ ID NO: 2944251 - protein, 17 aa, Entamoeba invadens
IPLISPVHRTVSMYEDE

SEQ ID NO: 2944252 - protein, 17 aa, Entamoeba invadens
IPLKKVFLIPQTHDGAI

SEQ ID NO: 2944253 - protein, 18 aa, Entamoeba invadens
IPLKLDWKDTPLPNKQCL

SEQ ID NO: 2944254 - protein, 19 aa, Entamoeba invadens
IPLKTFKVGVKTFFMQHEE

SEQ ID NO: 2944255 - protein, 19 aa, Entamoeba invadens
IPLLLKYNTNNAWWNGYCE

SEQ ID NO: 2944256 - protein, 26 aa, Entamoeba invadens
IPLLRFTPKVLVCVGDPMQLDPVLQI

SEQ ID NO: 2944257 - protein, 18 aa, Entamoeba invadens
IPLMFHFNPISWKPKIKI

SEQ ID NO: 2944258 - protein, 25 aa, Entamoeba invadens
IPLMYNNFLHPFITLFDAGSVFFNQ

SEQ ID NO: 2944259 - protein, 21 aa, Entamoeba invadens
IPLNKDCIGKNFIFKVSEKLV

SEQ ID NO: 2944260 - protein, 21 aa, Entamoeba invadens
IPLNRKTIRYFPNIETLCLWN

SEQ ID NO: 2944261 - protein, 23 aa, Entamoeba invadens
IPLPIKALIDYLKIHAANVEGIF

SEQ ID NO: 2944262 - protein, 17 aa, Entamoeba invadens
IPLPYCVVNCLSMQVAV

SEQ ID NO: 2944263 - protein, 17 aa, Entamoeba invadens
IPLRYYRFTQIQGHHGL

SEQ ID NO: 2944264 - protein, 26 aa, Entamoeba invadens
IPLSEMNLPFQWAVRKNIFYVNNISI

SEQ ID NO: 2944265 - protein, 19 aa, Entamoeba invadens
IPLSPMSGLIGWVPHSDTF

SEQ ID NO: 2944266 - protein, 23 aa, Entamoeba invadens
IPLSTMSGLIGWVPHSDTFHQLI

SEQ ID NO: 2944267 - protein, 23 aa, Entamoeba invadens
IPLSVTLIGDWCFNKCSSLSDVI

SEQ ID NO: 2944268 - protein, 29 aa, Entamoeba invadens
IPLSVVSIGDYCFFECYSLINITIPSNVS

SEQ ID NO: 2944269 - protein, 29 aa, Entamoeba invadens
IPLSVVSIGDYCFFECYSLINITITSNVK

SEQ ID NO: 2944270 - protein, 26 aa, Entamoeba invadens
IPLTCKTIRFFLNIETLHLWNKNDET

SEQ ID NO: 2944271 - protein, 17 aa, Entamoeba invadens
IPLTITCEVAVFICQLN

SEQ ID NO: 2944272 - protein, 31 aa, Entamoeba invadens
IPLVITFTYLGNWPDRLEAINSMKTSLSLEI

SEQ ID NO: 2944273 - protein, 18 aa, Entamoeba invadens
IPLVLFFKQRIRNLVNFL

SEQ ID NO: 2944274 - protein, 19 aa, Entamoeba invadens
IPLVQRFIEKGTFDTTQCL

SEQ ID NO: 2944275 - protein, 25 aa, Entamoeba invadens
IPLVVLQLRKGIYPPRSLILENNLE

SEQ ID NO: 2944276 - protein, 23 aa, Entamoeba invadens
IPMADLTKWVKMRTNSTDVDFVL

SEQ ID NO: 2944277 - protein, 22 aa, Entamoeba invadens
IPMDLLDRLLIIPTKPYDSTQL

SEQ ID NO: 2944278 - protein, 31 aa, Entamoeba invadens
IPMLFVIGCALPLRRHLFNKIVFKVVNPASK

SEQ ID NO: 2944279 - protein, 23 aa, Entamoeba invadens
IPMLLVYPRPFLDTGNANFVAGL

SEQ ID NO: 2944280 - protein, 19 aa, Entamoeba invadens
IPMMREWNDIVVVVLGGLI

SEQ ID NO: 2944281 - protein, 27 aa, Entamoeba invadens
IPMPCPPGCCDGCPCLFFQNCDECSCD

SEQ ID NO: 2944282 - protein, 18 aa, Entamoeba invadens
IPMRDFGDFLAVHVDPNV

SEQ ID NO: 2944283 - protein, 27 aa, Entamoeba invadens
IPMSIKRLEKLSGLLLSSNQFSTFPES

SEQ ID NO: 2944284 - protein, 26 aa, Entamoeba invadens
IPNAFDFDVFMLISALEMLKSGNNVS

SEQ ID NO: 2944285 - protein, 21 aa, Entamoeba invadens
IPNEKYKTLALGKTKEVDAKL

SEQ ID NO: 2944286 - protein, 17 aa, Entamoeba invadens
IPNETEIVLYMTNPSTG

SEQ ID NO: 2944287 - protein, 18 aa, Entamoeba invadens
IPNKCFKNCYSLKEINLS

SEQ ID NO: 2944288 - protein, 17 aa, Entamoeba invadens
IPNKEISSFGESKREID

SEQ ID NO: 2944289 - protein, 23 aa, Entamoeba invadens
IPNKLLCIGARAFYNCSNLKKLN

SEQ ID NO: 2944290 - protein, 21 aa, Entamoeba invadens
IPNKMKIIGEYSLAKCKGIIE

SEQ ID NO: 2944291 - protein, 20 aa, Entamoeba invadens
IPNKVCLVTEFALYSSLQDL

SEQ ID NO: 2944292 - protein, 22 aa, Entamoeba invadens
IPNKVCLVTEFAQFGSLQDLMK

SEQ ID NO: 2944293 - protein, 21 aa, Entamoeba invadens
IPNKVCLVTEFSQFGSLQDLM

SEQ ID NO: 2944294 - protein, 22 aa, Entamoeba invadens
IPNKVYQFRGFDIANMSFIRGE

SEQ ID NO: 2944295 - protein, 19 aa, Entamoeba invadens
IPNLFAYYYYYTISYSKAF

SEQ ID NO: 2944296 - protein, 27 aa, Entamoeba invadens
IPNNITAIGNFCFVCATKLERVVLPLS

SEQ ID NO: 2944297 - protein, 18 aa, Entamoeba invadens
IPNNMQLAVCDVPPKGLN

SEQ ID NO: 2944298 - protein, 22 aa, Entamoeba invadens
IPNPYIIWVYCFVLFPKQISEE

SEQ ID NO: 2944299 - protein, 23 aa, Entamoeba invadens
IPNPYIIWVYCFVLFPKQISEEP

SEQ ID NO: 2944300 - protein, 21 aa, Entamoeba invadens
IPNQLCYTGIISYNLAELYWA

SEQ ID NO: 2944301 - protein, 18 aa, Entamoeba invadens
IPNSEFYVECDMVIQAIS

SEQ ID NO: 2944302 - protein, 20 aa, Entamoeba invadens
IPNSGFLCDLVWSDPNDLDI

SEQ ID NO: 2944303 - protein, 19 aa, Entamoeba invadens
IPNSLKIVISKLRSVNKPE

SEQ ID NO: 2944304 - protein, 23 aa, Entamoeba invadens
IPNSMCELCYNLKIVEISDKLIE

SEQ ID NO: 2944305 - protein, 24 aa, Entamoeba invadens
IPNSMCELCYNLKIVEISDKLIEI

SEQ ID NO: 2944306 - protein, 19 aa, Entamoeba invadens
IPNSVTLIDNFAFKNCKKL

SEQ ID NO: 2944307 - protein, 19 aa, Entamoeba invadens
IPNTPVFKMKAIKINHFSV

SEQ ID NO: 2944308 - protein, 17 aa, Entamoeba invadens
IPNVACKCCRRKFHKQC

SEQ ID NO: 2944309 - protein, 48 aa, Entamoeba invadens
IPPEDVTLCAGCSCVFGKRKRKNFCKKCKSYVCQKCWNNSQKCCDMCE

SEQ ID NO: 2944310 - protein, 20 aa, Entamoeba invadens
IPPHEARKLVAQTFAGVAEI

SEQ ID NO: 2944311 - protein, 24 aa, Entamoeba invadens
IPPKEEILIEVELTLVQKKYYRAL

SEQ ID NO: 2944312 - protein, 23 aa, Entamoeba invadens
IPPKTPPVYLFFKDFQLQPMKFV

SEQ ID NO: 2944313 - protein, 24 aa, Entamoeba invadens
IPPKVAEKLFLEYFVNEVSEDVGI

SEQ ID NO: 2944314 - protein, 19 aa, Entamoeba invadens
IPPLYRYSLIADIMSHCVE

SEQ ID NO: 2944315 - protein, 26 aa, Entamoeba invadens
IPPQYAHKMWMTFLHLIGSPLMSNNS

SEQ ID NO: 2944316 - protein, 17 aa, Entamoeba invadens
IPPSVSIINDKNRNTYN

SEQ ID NO: 2944317 - protein, 27 aa, Entamoeba invadens
IPPTVSVLCYKCFEHCSSLSSINIPNG

SEQ ID NO: 2944318 - protein, 18 aa, Entamoeba invadens
IPQCIGSLRDNCFSECKT

SEQ ID NO: 2944319 - protein, 19 aa, Entamoeba invadens
IPQCQSGLVSLLTDQYLDS

SEQ ID NO: 2944320 - protein, 25 aa, Entamoeba invadens
IPQELSKFGHFCFGKCPLRQKPKLA

SEQ ID NO: 2944321 - protein, 25 aa, Entamoeba invadens
IPQEVMPSFSVDYLLLVFVLSTISP

SEQ ID NO: 2944322 - protein, 19 aa, Entamoeba invadens
IPQHQFCYWDKSGTVSLCD

SEQ ID NO: 2944323 - protein, 27 aa, Entamoeba invadens
IPQIEMKDTFGIFSIYRNVAMRYFNEL

SEQ ID NO: 2944324 - protein, 18 aa, Entamoeba invadens
IPQIICYINNYYFSDGIL

SEQ ID NO: 2944325 - protein, 20 aa, Entamoeba invadens
IPQLFQRISKFSFSAPSRKV

SEQ ID NO: 2944326 - protein, 25 aa, Entamoeba invadens
IPQLKGKKFFFSRIFQLKPLNREVK

SEQ ID NO: 2944327 - protein, 18 aa, Entamoeba invadens
IPQLRKLDICDSEDVNFN

SEQ ID NO: 2944328 - protein, 26 aa, Entamoeba invadens
IPQMRDVCKLIRMILEVAGVDENTDL

SEQ ID NO: 2944329 - protein, 21 aa, Entamoeba invadens
IPQMTCHKVLPPSYQSDLIRQ

SEQ ID NO: 2944330 - protein, 17 aa, Entamoeba invadens
IPQMTQRFFISVQKASF

SEQ ID NO: 2944331 - protein, 22 aa, Entamoeba invadens
IPQNLKKIGIRAFSDCDIEELV

SEQ ID NO: 2944332 - protein, 23 aa, Entamoeba invadens
IPQNLKKIGIRAFSDCDIEELVI

SEQ ID NO: 2944333 - protein, 24 aa, Entamoeba invadens
IPQSVTFIDDFAFYRCRKLRSVKF

SEQ ID NO: 2944334 - protein, 25 aa, Entamoeba invadens
IPQTGEVLMRFMWEGDAPSTQPQRI

SEQ ID NO: 2944335 - protein, 19 aa, Entamoeba invadens
IPQTIEWTGNRIYYIQGDL

SEQ ID NO: 2944336 - protein, 21 aa, Entamoeba invadens
IPQTLSLLGEHCFSYCINLNS

SEQ ID NO: 2944337 - protein, 28 aa, Entamoeba invadens
IPQTTRINFCDELGPIIGTECAELIDRL

SEQ ID NO: 2944338 - protein, 26 aa, Entamoeba invadens
IPQVACGGLSLAEMIAAKQGNLKAVE

SEQ ID NO: 2944339 - protein, 19 aa, Entamoeba invadens
IPQYPAFNPLVIFPLSVIL

SEQ ID NO: 2944340 - protein, 17 aa, Entamoeba invadens
IPRAMKSIFAELKKKEK

SEQ ID NO: 2944341 - protein, 17 aa, Entamoeba invadens
IPRDINIGCHWLTVDGV

SEQ ID NO: 2944342 - protein, 17 aa, Entamoeba invadens
IPRSEYEVMEMVEGKVK

SEQ ID NO: 2944343 - protein, 17 aa, Entamoeba invadens
IPRSILLIGNKSDVLQE

SEQ ID NO: 2944344 - protein, 20 aa, Entamoeba invadens
IPRVVSLDFGNEVVELGSFV

SEQ ID NO: 2944345 - protein, 22 aa, Entamoeba invadens
IPRYELLIRDMLKDAGKDYSGL

SEQ ID NO: 2944346 - protein, 21 aa, Entamoeba invadens
IPRYELLIRDMLKDIGKDYAA

SEQ ID NO: 2944347 - protein, 23 aa, Entamoeba invadens
IPRYELLIRDMLKDVGKDFPDVE

SEQ ID NO: 2944348 - protein, 18 aa, Entamoeba invadens
IPSALQVLLTANFELPTI

SEQ ID NO: 2944349 - protein, 17 aa, Entamoeba invadens
IPSASALILKALKEPPK

SEQ ID NO: 2944350 - protein, 25 aa, Entamoeba invadens
IPSCIKSIGDYCFNECINLTSITIP

SEQ ID NO: 2944351 - protein, 22 aa, Entamoeba invadens
IPSEALRHCGFDVVDNHGNTPL

SEQ ID NO: 2944352 - protein, 22 aa, Entamoeba invadens
IPSEDICLFFSSEFFEIGSVKI

SEQ ID NO: 2944353 - protein, 19 aa, Entamoeba invadens
IPSELTSNIFPFIQSDSGL

SEQ ID NO: 2944354 - protein, 23 aa, Entamoeba invadens
IPSHPFALLAKEGVIIPSLTEII

SEQ ID NO: 2944355 - protein, 21 aa, Entamoeba invadens
IPSIDEKWCDGLFEDKAKCKK

SEQ ID NO: 2944356 - protein, 18 aa, Entamoeba invadens
IPSIPFKVVDAMEDTVIK

SEQ ID NO: 2944357 - protein, 22 aa, Entamoeba invadens
IPSKPFFAVIVWYPCDYSYIKT

SEQ ID NO: 2944358 - protein, 17 aa, Entamoeba invadens
IPSLPSFSQSVQVPPPI

SEQ ID NO: 2944359 - protein, 21 aa, Entamoeba invadens
IPSLVSTIGYMCFKDCSSLIS

SEQ ID NO: 2944360 - protein, 25 aa, Entamoeba invadens
IPSMRTKLGERIFLFHNESFDDPDP

SEQ ID NO: 2944361 - protein, 27 aa, Entamoeba invadens
IPSPLPMIFRLFLRKDYTFEVFSLVCE

SEQ ID NO: 2944362 - protein, 20 aa, Entamoeba invadens
IPSRESIKFPYLSYTALETI

SEQ ID NO: 2944363 - protein, 25 aa, Entamoeba invadens
IPSSFCPRCGAYLILSIQGDITCEV

SEQ ID NO: 2944364 - protein, 24 aa, Entamoeba invadens
IPSSVKSIGDWMLLFKQYYNTIEC

SEQ ID NO: 2944365 - protein, 19 aa, Entamoeba invadens
IPSSVSFIAYRCFGECYSL

SEQ ID NO: 2944366 - protein, 18 aa, Entamoeba invadens
IPSSVSFIDRRCFDGCHS

SEQ ID NO: 2944367 - protein, 18 aa, Entamoeba invadens
IPSSVSFIDRSCFSECHS

SEQ ID NO: 2944368 - protein, 19 aa, Entamoeba invadens
IPSSVSLIARRYFSECHSL

SEQ ID NO: 2944369 - protein, 22 aa, Entamoeba invadens
IPSSVTLFGPRCFQACRNLESI

SEQ ID NO: 2944370 - protein, 21 aa, Entamoeba invadens
IPSTSSKMFKFFANYDTYVQY

SEQ ID NO: 2944371 - protein, 18 aa, Entamoeba invadens
IPSTVTLLGESAFENCNT

SEQ ID NO: 2944372 - protein, 17 aa, Entamoeba invadens
IPSVAIVDPEFTITLPK

SEQ ID NO: 2944373 - protein, 17 aa, Entamoeba invadens
IPSVCPLLVHPNITLRQ

SEQ ID NO: 2944374 - protein, 18 aa, Entamoeba invadens
IPTAIAFESNVSHINTLS

SEQ ID NO: 2944375 - protein, 22 aa, Entamoeba invadens
IPTDGIYMYNFIKESIGNTNVV

SEQ ID NO: 2944376 - protein, 25 aa, Entamoeba invadens
IPTDYAGLIQSCWKQEGSERPTFDQ

SEQ ID NO: 2944377 - protein, 17 aa, Entamoeba invadens
IPTELLVLYKIPDTYIK

SEQ ID NO: 2944378 - protein, 19 aa, Entamoeba invadens
IPTFSAFVKYARKNCKPVL

SEQ ID NO: 2944379 - protein, 20 aa, Entamoeba invadens
IPTGDSLLMQVISPDKEFDK

SEQ ID NO: 2944380 - protein, 20 aa, Entamoeba invadens
IPTGNEMRGLQSLISGLVDV

SEQ ID NO: 2944381 - protein, 26 aa, Entamoeba invadens
IPTIKFSYTNLRSMQIISYESFITQV

SEQ ID NO: 2944382 - protein, 27 aa, Entamoeba invadens
IPTIPSGLCWGCIRLTSVDFSFQLQSI

SEQ ID NO: 2944383 - protein, 24 aa, Entamoeba invadens
IPTKPGKYGMKVWTMVDNISGLVC

SEQ ID NO: 2944384 - protein, 17 aa, Entamoeba invadens
IPTLLQKQFDEWKNVRK

SEQ ID NO: 2944385 - protein, 23 aa, Entamoeba invadens
IPTLTFSGPTTFVPLIEHATQIV

SEQ ID NO: 2944386 - protein, 25 aa, Entamoeba invadens
IPTNSWKRLEVLKITGCGISELENI

SEQ ID NO: 2944387 - protein, 26 aa, Entamoeba invadens
IPTNVVLPVYFEKVYQCEKGEQDIFL

SEQ ID NO: 2944388 - protein, 17 aa, Entamoeba invadens
IPTSVTFISWNFTYCDN

SEQ ID NO: 2944389 - protein, 19 aa, Entamoeba invadens
IPTTISIIGNNAFNGCEKI

SEQ ID NO: 2944390 - protein, 19 aa, Entamoeba invadens
IPTTLSLLGDSTFEACTSL

SEQ ID NO: 2944391 - protein, 20 aa, Entamoeba invadens
IPTVKWWGMQDEWNLMVMEL

SEQ ID NO: 2944392 - protein, 18 aa, Entamoeba invadens
IPTVLRKPTLTKYPTTVY

SEQ ID NO: 2944393 - protein, 19 aa, Entamoeba invadens
IPVALKRKDIIGIAQTGSG

SEQ ID NO: 2944394 - protein, 19 aa, Entamoeba invadens
IPVANYLSGKLFLKETPTE

SEQ ID NO: 2944395 - protein, 19 aa, Entamoeba invadens
IPVDCRFPYEFRAGKIKNA

SEQ ID NO: 2944396 - protein, 18 aa, Entamoeba invadens
IPVFTNFNAQLPLAELSD

SEQ ID NO: 2944397 - protein, 17 aa, Entamoeba invadens
IPVFYRDNGAYVVTTTN

SEQ ID NO: 2944398 - protein, 17 aa, Entamoeba invadens
IPVIMALLGVWYNNFYK

SEQ ID NO: 2944399 - protein, 22 aa, Entamoeba invadens
IPVKRIDYAVIVNVCAPLMQKF

SEQ ID NO: 2944400 - protein, 25 aa, Entamoeba invadens
IPVTKLQPCFGIFYTISKFKKFVPD

SEQ ID NO: 2944401 - protein, 17 aa, Entamoeba invadens
IPVTSKRLFPYMETQHI

SEQ ID NO: 2944402 - protein, 19 aa, Entamoeba invadens
IPVVDEIIKTVSMKFKIPE

SEQ ID NO: 2944403 - protein, 17 aa, Entamoeba invadens
IPVVGMYAFSRTQLEIF

SEQ ID NO: 2944404 - protein, 17 aa, Entamoeba invadens
IPWCHPTDVKQGLRRQA

SEQ ID NO: 2944405 - protein, 21 aa, Entamoeba invadens
IPWMLDTAIRRRFEKRIYIGL

SEQ ID NO: 2944406 - protein, 22 aa, Entamoeba invadens
IPYCDKGSFVTSCLSKDGKMLF

SEQ ID NO: 2944407 - protein, 17 aa, Entamoeba invadens
IPYDIFSMLLPHQRVAI

SEQ ID NO: 2944408 - protein, 27 aa, Entamoeba invadens
IPYEDRLKEAVLFSYRFPAKAEDVRSM

SEQ ID NO: 2944409 - protein, 24 aa, Entamoeba invadens
IPYEKRYEIFAAFGDHKKMIARLE

SEQ ID NO: 2944410 - protein, 19 aa, Entamoeba invadens
IPYKTPSKHLPIIETDSRK

SEQ ID NO: 2944411 - protein, 22 aa, Entamoeba invadens
IPYLHKYDELFTRLNSMKIPKG

SEQ ID NO: 2944412 - protein, 17 aa, Entamoeba invadens
IPYSYDYFTGVLPPFAL

SEQ ID NO: 2944413 - protein, 25 aa, Entamoeba invadens
IPYTLPLEAIVAIEERAEIPYKTPS

SEQ ID NO: 2944414 - protein, 30 aa, Entamoeba invadens
IQAAPAFPECFPHLFGKQKIRCLIPCAIDQ

SEQ ID NO: 2944415 - protein, 17 aa, Entamoeba invadens
IQAKLVAVVDERRKAQA

SEQ ID NO: 2944416 - protein, 18 aa, Entamoeba invadens
IQALFPFYNVLLGASELN

SEQ ID NO: 2944417 - protein, 26 aa, Entamoeba invadens
IQALFRVLSPFEWHGVLIPILPVDES

SEQ ID NO: 2944418 - protein, 22 aa, Entamoeba invadens
IQANPGMLYDIIKTHQNDQQQQ

SEQ ID NO: 2944419 - protein, 24 aa, Entamoeba invadens
IQAPEVLQNIGLLNKVLIFFKNCL

SEQ ID NO: 2944420 - protein, 18 aa, Entamoeba invadens
IQAYELMILLSILNKTFN

SEQ ID NO: 2944421 - protein, 23 aa, Entamoeba invadens
IQCDDCGIYFCNGKIEGLLLSHI

SEQ ID NO: 2944422 - protein, 24 aa, Entamoeba invadens
IQCGDLYFNKWLALISTLGSMSEV

SEQ ID NO: 2944423 - protein, 27 aa, Entamoeba invadens
IQCNPKYVKAFLRRAVILSHNKSFVEA

SEQ ID NO: 2944424 - protein, 29 aa, Entamoeba invadens
IQDASACYRKGSFPLISIFEPHQKEPMDL

SEQ ID NO: 2944425 - protein, 23 aa, Entamoeba invadens
IQDKEVLKTVAYLLEVDAGQLEH

SEQ ID NO: 2944426 - protein, 25 aa, Entamoeba invadens
IQDLKCKYLDLYLMHWPVAVKENSS

SEQ ID NO: 2944427 - protein, 31 aa, Entamoeba invadens
IQDTIHIWYQFRNWFRLFKRTKKLKLLKKKL

SEQ ID NO: 2944428 - protein, 19 aa, Entamoeba invadens
IQDYWRMYVLDLKNITDDS

SEQ ID NO: 2944429 - protein, 32 aa, Entamoeba invadens
IQEECDICDLMFCTKCLSSFVISQNTKCVTSS

SEQ ID NO: 2944430 - protein, 18 aa, Entamoeba invadens
IQEGGGYCPPSVPLQEQK

SEQ ID NO: 2944431 - protein, 23 aa, Entamoeba invadens
IQEIKKTLVYPGRIAIVTEGVFR

SEQ ID NO: 2944432 - protein, 17 aa, Entamoeba invadens
IQEIKRFLGKDWEDLKS

SEQ ID NO: 2944433 - protein, 20 aa, Entamoeba invadens
IQEILKCRYDYVVDAIDSVS

SEQ ID NO: 2944434 - protein, 24 aa, Entamoeba invadens
IQELPKFCFSKCFSLRHLKISENI

SEQ ID NO: 2944435 - protein, 23 aa, Entamoeba invadens
IQELSRLGGMQILLKLLDELCVS

SEQ ID NO: 2944436 - protein, 18 aa, Entamoeba invadens
IQEPIPIDFDAIIQSNIS

SEQ ID NO: 2944437 - protein, 18 aa, Entamoeba invadens
IQESKRYIGRKVSQEELL

SEQ ID NO: 2944438 - protein, 18 aa, Entamoeba invadens
IQETFSFLSTFQHTKNGL

SEQ ID NO: 2944439 - protein, 18 aa, Entamoeba invadens
IQEVELFSDMTVFGTEAF

SEQ ID NO: 2944440 - protein, 18 aa, Entamoeba invadens
IQEVFFKKATTITFIECG

SEQ ID NO: 2944441 - protein, 17 aa, Entamoeba invadens
IQFAPILFGSKINLEKY

SEQ ID NO: 2944442 - protein, 24 aa, Entamoeba invadens
IQFEAVKGLSIYRHTLELLTDSIN

SEQ ID NO: 2944443 - protein, 17 aa, Entamoeba invadens
IQFIMKLIYKLLKAQKC

SEQ ID NO: 2944444 - protein, 17 aa, Entamoeba invadens
IQFKGSAYFALLCAPLY

SEQ ID NO: 2944445 - protein, 18 aa, Entamoeba invadens
IQFNELVGVYSKILLSFV

SEQ ID NO: 2944446 - protein, 23 aa, Entamoeba invadens
IQFRRKVCLDAIRGLQYLHFNDV

SEQ ID NO: 2944447 - protein, 19 aa, Entamoeba invadens
IQFVCTILQNKNCYNTNVV

SEQ ID NO: 2944448 - protein, 19 aa, Entamoeba invadens
IQFVGWRSLNQLCINYSTY

SEQ ID NO: 2944449 - protein, 23 aa, Entamoeba invadens
IQGFPGQVIDTWLGLDKKGEIHI

SEQ ID NO: 2944450 - protein, 17 aa, Entamoeba invadens
IQGHRKLLAAAMEEKYY

SEQ ID NO: 2944451 - protein, 19 aa, Entamoeba invadens
IQGIEISRAYIFVQQAQCL

SEQ ID NO: 2944452 - protein, 22 aa, Entamoeba invadens
IQGLCFDGCKSLEEIEIPETVE

SEQ ID NO: 2944453 - protein, 22 aa, Entamoeba invadens
IQGLCFDGCKSLREIKIPENVN

SEQ ID NO: 2944454 - protein, 20 aa, Entamoeba invadens
IQGYIPLIFFDSMTDDMKMY

SEQ ID NO: 2944455 - protein, 18 aa, Entamoeba invadens
IQHCLFLLVESLKLITYR

SEQ ID NO: 2944456 - protein, 25 aa, Entamoeba invadens
IQHFKERRNTLTFQQLNSGTPEENT

SEQ ID NO: 2944457 - protein, 17 aa, Entamoeba invadens
IQHLLEFGSQPIRDEII

SEQ ID NO: 2944458 - protein, 30 aa, Entamoeba invadens
IQHRKHIKALFKKEAEDFLKSCPVKKLTLN

SEQ ID NO: 2944459 - protein, 25 aa, Entamoeba invadens
IQHTTCKLAKLRKECEVEKQKIGLM

SEQ ID NO: 2944460 - protein, 17 aa, Entamoeba invadens
IQICGVFPKSPDVLDTV

SEQ ID NO: 2944461 - protein, 30 aa, Entamoeba invadens
IQIDPSFLVRALEVYNIYKSVYSTIETEKK

SEQ ID NO: 2944462 - protein, 19 aa, Entamoeba invadens
IQIGCGVVSSVVSDTLNVE

SEQ ID NO: 2944463 - protein, 19 aa, Entamoeba invadens
IQIMGCGKLKMKPNDQRFL

SEQ ID NO: 2944464 - protein, 18 aa, Entamoeba invadens
IQIPNGVTSIGMYCFCDC

SEQ ID NO: 2944465 - protein, 18 aa, Entamoeba invadens
IQISHTFSVMTLNSLVQK

SEQ ID NO: 2944466 - protein, 22 aa, Entamoeba invadens
IQITINLLQHFLLNSCTTDDVK

SEQ ID NO: 2944467 - protein, 17 aa, Entamoeba invadens
IQIWDYRTKIMLHSYPT

SEQ ID NO: 2944468 - protein, 19 aa, Entamoeba invadens
IQIYWKLSKKEIASIEYTY

SEQ ID NO: 2944469 - protein, 18 aa, Entamoeba invadens
IQKDGWSGFGSVREIDLS

SEQ ID NO: 2944470 - protein, 20 aa, Entamoeba invadens
IQKFGFNLFYKCFSLKEIAI

SEQ ID NO: 2944471 - protein, 24 aa, Entamoeba invadens
IQKKIKAEAILKHCQVINTADVMN

SEQ ID NO: 2944472 - protein, 20 aa, Entamoeba invadens
IQKMQSIPMNKNWKGKIVSK

SEQ ID NO: 2944473 - protein, 24 aa, Entamoeba invadens
IQKQICDFIAYKIIKYIDAGLEYC

SEQ ID NO: 2944474 - protein, 20 aa, Entamoeba invadens
IQKRGFYWKSVECHTEGQLT

SEQ ID NO: 2944475 - protein, 25 aa, Entamoeba invadens
IQKTSEGYPMIAQMAVSKSQQQQDV

SEQ ID NO: 2944476 - protein, 20 aa, Entamoeba invadens
IQKWIFWQLKSWDKTTESLN

SEQ ID NO: 2944477 - protein, 20 aa, Entamoeba invadens
IQKYFTLQSEARFKGMKYLE

SEQ ID NO: 2944478 - protein, 22 aa, Entamoeba invadens
IQKYGFPIVKLHNWEYKPKSNE

SEQ ID NO: 2944479 - protein, 20 aa, Entamoeba invadens
IQLAFSLPITLIRYVQPNPN

SEQ ID NO: 2944480 - protein, 20 aa, Entamoeba invadens
IQLCFFKAIIQLVRGFEKYV

SEQ ID NO: 2944481 - protein, 17 aa, Entamoeba invadens
IQLEIAVGCAISAFEKT

SEQ ID NO: 2944482 - protein, 22 aa, Entamoeba invadens
IQLERIKTVFLRGKLIFNKNEI

SEQ ID NO: 2944483 - protein, 22 aa, Entamoeba invadens
IQLFGASSIQFIKSGALNRTTV

SEQ ID NO: 2944484 - protein, 17 aa, Entamoeba invadens
IQLGTVIFVQKCFSNNK

SEQ ID NO: 2944485 - protein, 19 aa, Entamoeba invadens
IQLKGKCDYFLVQHVDGLS

SEQ ID NO: 2944486 - protein, 17 aa, Entamoeba invadens
IQLKTCVASVNFKLQNV

SEQ ID NO: 2944487 - protein, 23 aa, Entamoeba invadens
IQLKTLWPTEDFVRVSATGYAGG

SEQ ID NO: 2944488 - protein, 17 aa, Entamoeba invadens
IQLLEEIFSGYPMYLHR

SEQ ID NO: 2944489 - protein, 17 aa, Entamoeba invadens
IQLLWDMMESVDGNIDD

SEQ ID NO: 2944490 - protein, 18 aa, Entamoeba invadens
IQLPLSLNRIGFKCFNEC

SEQ ID NO: 2944491 - protein, 17 aa, Entamoeba invadens
IQLPYKLKVRMLFDTSR

SEQ ID NO: 2944492 - protein, 25 aa, Entamoeba invadens
IQLSHPHLHPPLSSFKKELPATLLF

SEQ ID NO: 2944493 - protein, 25 aa, Entamoeba invadens
IQLSQFRILTGFLERNFDDYKKFED

SEQ ID NO: 2944494 - protein, 25 aa, Entamoeba invadens
IQMFLSKQLKAMCFFLTTDGDLYAT

SEQ ID NO: 2944495 - protein, 27 aa, Entamoeba invadens
IQMPPSLLSRFDLIYLILDRPDLERDK

SEQ ID NO: 2944496 - protein, 22 aa, Entamoeba invadens
IQNAFNRFGFEQIKLDDIKIFC

SEQ ID NO: 2944497 - protein, 23 aa, Entamoeba invadens
IQNDIDPALEMIRLEEHLEKPKD

SEQ ID NO: 2944498 - protein, 23 aa, Entamoeba invadens
IQNFPKRHNHVFEDWQINQMYHR

SEQ ID NO: 2944499 - protein, 24 aa, Entamoeba invadens
IQNFVFDACLEFGYFFDSKLSKNS

SEQ ID NO: 2944500 - protein, 17 aa, Entamoeba invadens
IQNGIGGSGDFARNAYV

SEQ ID NO: 2944501 - protein, 23 aa, Entamoeba invadens
IQNLPDLLFINLTRLQSLESATN

SEQ ID NO: 2944502 - protein, 18 aa, Entamoeba invadens
IQNNGGVILSVLGTKRVN

SEQ ID NO: 2944503 - protein, 24 aa, Entamoeba invadens
IQNRLPIGDIVKLIDFEEDARKTF

SEQ ID NO: 2944504 - protein, 18 aa, Entamoeba invadens
IQNVRPFPDVLPQQTQPT

SEQ ID NO: 2944505 - protein, 17 aa, Entamoeba invadens
IQNYRFNVIKYLNKSLF

SEQ ID NO: 2944506 - protein, 18 aa, Entamoeba invadens
IQPEDFSNVLGLFRLIDL

SEQ ID NO: 2944507 - protein, 18 aa, Entamoeba invadens
IQPFCFFKCEKLKEIAIP

SEQ ID NO: 2944508 - protein, 23 aa, Entamoeba invadens
IQPHSQLLYAYCNVFIRTNYNEK

SEQ ID NO: 2944509 - protein, 25 aa, Entamoeba invadens
IQPIPRYPAAFPFGYDKNPRYPPAR

SEQ ID NO: 2944510 - protein, 23 aa, Entamoeba invadens
IQPNKSFPFAWTNPTLKHLIQMH

SEQ ID NO: 2944511 - protein, 19 aa, Entamoeba invadens
IQPTHTWGQIKTIYKELDV

SEQ ID NO: 2944512 - protein, 19 aa, Entamoeba invadens
IQPVAPFSFFNINGVTESM

SEQ ID NO: 2944513 - protein, 19 aa, Entamoeba invadens
IQPYLLRRVKQNVEKSIPP

SEQ ID NO: 2944514 - protein, 19 aa, Entamoeba invadens
IQQGTALLFCMSQYATENW

SEQ ID NO: 2944515 - protein, 23 aa, Entamoeba invadens
IQQHCLREIALLKQINHKNIVQL

SEQ ID NO: 2944516 - protein, 17 aa, Entamoeba invadens
IQQLPMSHLSYYPVVVS

SEQ ID NO: 2944517 - protein, 24 aa, Entamoeba invadens
IQQMFTLSSLCFVDNNIVEFPEVI

SEQ ID NO: 2944518 - protein, 21 aa, Entamoeba invadens
IQQYGRIGVYITHIMNTKPIS

SEQ ID NO: 2944519 - protein, 19 aa, Entamoeba invadens
IQRDIPIPLVSAGADKGNL

SEQ ID NO: 2944520 - protein, 25 aa, Entamoeba invadens
IQREHLRLQVCSSFSKDESVLYTAG

SEQ ID NO: 2944521 - protein, 23 aa, Entamoeba invadens
IQREVLPLLYLFIANSNAPAVLH

SEQ ID NO: 2944522 - protein, 23 aa, Entamoeba invadens
IQRILDSRVKKVVSVKVSSNPVT

SEQ ID NO: 2944523 - protein, 25 aa, Entamoeba invadens
IQRIMRYPMLIKEVLKFTPQSHPDY

SEQ ID NO: 2944524 - protein, 23 aa, Entamoeba invadens
IQRKFLKDQLRMEATLNLTGLIQ

SEQ ID NO: 2944525 - protein, 17 aa, Entamoeba invadens
IQRLIELGASKKLATEA

SEQ ID NO: 2944526 - protein, 24 aa, Entamoeba invadens
IQRLPRYKLFLIDLVKCTPACHPD

SEQ ID NO: 2944527 - protein, 27 aa, Entamoeba invadens
IQRPPRYKLLLEAVLESLPTWWKKERK

SEQ ID NO: 2944528 - protein, 23 aa, Entamoeba invadens
IQRPPRYKLLMDAVVSALPEWWQ

SEQ ID NO: 2944529 - protein, 20 aa, Entamoeba invadens
IQRRIESMEGFETFTQEKKD

SEQ ID NO: 2944530 - protein, 23 aa, Entamoeba invadens
IQRVRELEVQYGIPSSSHLKIEV

SEQ ID NO: 2944531 - protein, 21 aa, Entamoeba invadens
IQRYLPLNFKKVTWTFKDDNI

SEQ ID NO: 2944532 - protein, 18 aa, Entamoeba invadens
IQSAFLAAALKVFIEVVD

SEQ ID NO: 2944533 - protein, 19 aa, Entamoeba invadens
IQSDSGLQFIAESKASGAS

SEQ ID NO: 2944534 - protein, 21 aa, Entamoeba invadens
IQSGCFANCVLLQKLDLKNLM

SEQ ID NO: 2944535 - protein, 17 aa, Entamoeba invadens
IQSGTLLMKRDDKFSPV

SEQ ID NO: 2944536 - protein, 19 aa, Entamoeba invadens
IQSIGGFLILRLICPAIVQ

SEQ ID NO: 2944537 - protein, 19 aa, Entamoeba invadens
IQSIPSIKIAQTLQPQCQQ

SEQ ID NO: 2944538 - protein, 22 aa, Entamoeba invadens
IQSKYKATVLFKTKPFFGDDGF

SEQ ID NO: 2944539 - protein, 29 aa, Entamoeba invadens
IQSLKALYKRAVLLNSQFNTLLVTLSNTS

SEQ ID NO: 2944540 - protein, 18 aa, Entamoeba invadens
IQSPLLVDRMGELKALLN

SEQ ID NO: 2944541 - protein, 22 aa, Entamoeba invadens
IQSQCFIECVSLQSILIPSGVD

SEQ ID NO: 2944542 - protein, 34 aa, Entamoeba invadens
IQSRFYRAPEICIGYPYTSAIDMWSFGCMVAEMF

SEQ ID NO: 2944543 - protein, 23 aa, Entamoeba invadens
IQSVIRRNRWSNSYNTVIHNVLE

SEQ ID NO: 2944544 - protein, 17 aa, Entamoeba invadens
IQSVLQMVKALLVDSKA

SEQ ID NO: 2944545 - protein, 26 aa, Entamoeba invadens
IQTCPSRIFTMLCFFLEALTRPDKPA

SEQ ID NO: 2944546 - protein, 25 aa, Entamoeba invadens
IQTHLKFGIKNNGSIRRVIVPLFSI

SEQ ID NO: 2944547 - protein, 18 aa, Entamoeba invadens
IQTKAFCCCILLNTVNIP

SEQ ID NO: 2944548 - protein, 23 aa, Entamoeba invadens
IQTKKLRGINYIRIEKLFEDPLL

SEQ ID NO: 2944549 - protein, 18 aa, Entamoeba invadens
IQTTVEMKYHVDIVNQAQ

SEQ ID NO: 2944550 - protein, 17 aa, Entamoeba invadens
IQTVCFHDELTPEESDK

SEQ ID NO: 2944551 - protein, 23 aa, Entamoeba invadens
IQVCKKYALLLDRFRTNPIRITR

SEQ ID NO: 2944552 - protein, 23 aa, Entamoeba invadens
IQVFSYGCAILYVSKFFSKIDEL

SEQ ID NO: 2944553 - protein, 18 aa, Entamoeba invadens
IQVIRAFITLSVNKTLFP

SEQ ID NO: 2944554 - protein, 17 aa, Entamoeba invadens
IQVKGPFTLRSGTGYNL

SEQ ID NO: 2944555 - protein, 20 aa, Entamoeba invadens
IQVKMLLRLHEIFFEKLTEK

SEQ ID NO: 2944556 - protein, 19 aa, Entamoeba invadens
IQVLESIEAYFWKGEETPT

SEQ ID NO: 2944557 - protein, 24 aa, Entamoeba invadens
IQVSKDIRKAFALNDDEDVIQTYT

SEQ ID NO: 2944558 - protein, 22 aa, Entamoeba invadens
IQYAEKLIKFFASVKKTGDSFW

SEQ ID NO: 2944559 - protein, 26 aa, Entamoeba invadens
IQYFMREVLEGLSYLHSQNLVYNGLV

SEQ ID NO: 2944560 - protein, 18 aa, Entamoeba invadens
IQYLCGFTGENVSIVITK

SEQ ID NO: 2944561 - protein, 20 aa, Entamoeba invadens
IRADVIVPWCEIDQKKKTNF

SEQ ID NO: 2944562 - protein, 23 aa, Entamoeba invadens
IRAKRAFDPADWVEKKCTMLNDY

SEQ ID NO: 2944563 - protein, 18 aa, Entamoeba invadens
IRALFKKEAEDFLKSCPA

SEQ ID NO: 2944564 - protein, 21 aa, Entamoeba invadens
IRALLRRLTHLKIIPESEEKG

SEQ ID NO: 2944565 - protein, 18 aa, Entamoeba invadens
IRALPVDIWLHVIPQIIA

SEQ ID NO: 2944566 - protein, 19 aa, Entamoeba invadens
IRALYDMIDIAALNADKTY

SEQ ID NO: 2944567 - protein, 19 aa, Entamoeba invadens
IRALYDMIDIAALNAYKTY

SEQ ID NO: 2944568 - protein, 25 aa, Entamoeba invadens
IRANCPSHVPSCFAESFDDPTKKGG

SEQ ID NO: 2944569 - protein, 19 aa, Entamoeba invadens
IRARMVKAVEECFRLNCNE

SEQ ID NO: 2944570 - protein, 21 aa, Entamoeba invadens
IRASKELFIDILLPDEPLLFF

SEQ ID NO: 2944571 - protein, 22 aa, Entamoeba invadens
IRCDQCKKPIAHWEMVQCSVGT

SEQ ID NO: 2944572 - protein, 19 aa, Entamoeba invadens
IRCGCDIISTIIDNDMVPP

SEQ ID NO: 2944573 - protein, 25 aa, Entamoeba invadens
IRDASLLWRKDEIVEIIDEHLDTLS

SEQ ID NO: 2944574 - protein, 18 aa, Entamoeba invadens
IRDIEVIQPIPWLQSEDL

SEQ ID NO: 2944575 - protein, 18 aa, Entamoeba invadens
IRDIVKFLRTFKRLNQLV

SEQ ID NO: 2944576 - protein, 24 aa, Entamoeba invadens
IRDLEKIGWVYKVSVRHIEVYNNN

SEQ ID NO: 2944577 - protein, 18 aa, Entamoeba invadens
IRDLMKYLQTIGAESNSI

SEQ ID NO: 2944578 - protein, 18 aa, Entamoeba invadens
IRDLPIFFTYQINSTKFS

SEQ ID NO: 2944579 - protein, 22 aa, Entamoeba invadens
IRDPAFLAFLGFFFDLLTEAKC

SEQ ID NO: 2944580 - protein, 35 aa, Entamoeba invadens
IRDVIKSQQVRWVLSRSFVVWVPLTVVGKYVETSD

SEQ ID NO: 2944581 - protein, 17 aa, Entamoeba invadens
IRDVMKLATEVGDIAGY

SEQ ID NO: 2944582 - protein, 22 aa, Entamoeba invadens
IRDVTARLGVVTIKDKAEALEE

SEQ ID NO: 2944583 - protein, 19 aa, Entamoeba invadens
IREDAGVTDLVWRENGNFL

SEQ ID NO: 2944584 - protein, 20 aa, Entamoeba invadens
IREFARCIKMWKTAKTSKFN

SEQ ID NO: 2944585 - protein, 19 aa, Entamoeba invadens
IREIEIPNSVTFLGDSVFD

SEQ ID NO: 2944586 - protein, 17 aa, Entamoeba invadens
IREIIRFGLKPYTKSDY

SEQ ID NO: 2944587 - protein, 19 aa, Entamoeba invadens
IREILKRDFDVAILKLKKL

SEQ ID NO: 2944588 - protein, 26 aa, Entamoeba invadens
IREIMEVKDSFVLRVLYRLKCQLSLR

SEQ ID NO: 2944589 - protein, 23 aa, Entamoeba invadens
IREKSGSISPSFTSVYNDIVGKE

SEQ ID NO: 2944590 - protein, 22 aa, Entamoeba invadens
IRELCFDGCKSLEEIEIPETVE

SEQ ID NO: 2944591 - protein, 26 aa, Entamoeba invadens
IRELCVECVCRRKCILKHFCETLERK

SEQ ID NO: 2944592 - protein, 22 aa, Entamoeba invadens
IRELKIPYTVWFSKSKRTLFEI

SEQ ID NO: 2944593 - protein, 26 aa, Entamoeba invadens
IRELPEPLITFNMYSMFIDTARTFEA

SEQ ID NO: 2944594 - protein, 19 aa, Entamoeba invadens
IRELTSLMISRFGFKKNCL

SEQ ID NO: 2944595 - protein, 22 aa, Entamoeba invadens
IREMYFKIVSAIYNLHKQNIGH

SEQ ID NO: 2944596 - protein, 27 aa, Entamoeba invadens
IRENSRPCPKCGTFIEKNGGCQWMSCY

SEQ ID NO: 2944597 - protein, 27 aa, Entamoeba invadens
IRETALRLKMSVSYALMIAHAAAHLKP

SEQ ID NO: 2944598 - protein, 25 aa, Entamoeba invadens
IRETISVPLIYFMTGGQFQIKSGQE

SEQ ID NO: 2944599 - protein, 26 aa, Entamoeba invadens
IRETLRALQYIHEFGFIHRDIKTANI

SEQ ID NO: 2944600 - protein, 29 aa, Entamoeba invadens
IRETSSTIKFCFSSRNIQCIVKKNNVFSG

SEQ ID NO: 2944601 - protein, 17 aa, Entamoeba invadens
IREVCRFVDEKKKKILV

SEQ ID NO: 2944602 - protein, 25 aa, Entamoeba invadens
IRFAGVKGVVSVDCLDKSENIYFRP

SEQ ID NO: 2944603 - protein, 17 aa, Entamoeba invadens
IRFFTPFIMEYVPQTIE

SEQ ID NO: 2944604 - protein, 17 aa, Entamoeba invadens
IRFKAMAIDCKPFCELC

SEQ ID NO: 2944605 - protein, 22 aa, Entamoeba invadens
IRFKCSGPLFIVENLNETPKNW

SEQ ID NO: 2944606 - protein, 17 aa, Entamoeba invadens
IRFPKTYPVIYKTLRVD

SEQ ID NO: 2944607 - protein, 21 aa, Entamoeba invadens
IRFVDVHSCVMRRIISVATEG

SEQ ID NO: 2944608 - protein, 17 aa, Entamoeba invadens
IRFVPPDYRLCQRNRFS

SEQ ID NO: 2944609 - protein, 20 aa, Entamoeba invadens
IRFWDVRSKECVDINRNFHT

SEQ ID NO: 2944610 - protein, 20 aa, Entamoeba invadens
IRGAFKVDRQIALKQMKNLM

SEQ ID NO: 2944611 - protein, 17 aa, Entamoeba invadens
IRGEIETICKLKLGGFG

SEQ ID NO: 2944612 - protein, 23 aa, Entamoeba invadens
IRGFKEFVIRQSMHKELLNLSFN

SEQ ID NO: 2944613 - protein, 18 aa, Entamoeba invadens
IRGKTGWIVLDTRTTISS

SEQ ID NO: 2944614 - protein, 25 aa, Entamoeba invadens
IRGKVFKGKALAVCGNLPNPKDYEK

SEQ ID NO: 2944615 - protein, 18 aa, Entamoeba invadens
IRGKVWMRLLQVSDDETE

SEQ ID NO: 2944616 - protein, 20 aa, Entamoeba invadens
IRGTGVGVGLVMFGTQEKAD

SEQ ID NO: 2944617 - protein, 18 aa, Entamoeba invadens
IRGTTLNCLKCKDDYFNI

SEQ ID NO: 2944618 - protein, 24 aa, Entamoeba invadens
IRHDLAFRRILFILSLVNGGVSYV

SEQ ID NO: 2944619 - protein, 19 aa, Entamoeba invadens
IRHNEVVEVLKIWENEEKG

SEQ ID NO: 2944620 - protein, 25 aa, Entamoeba invadens
IRHRHIPLRPSYRLVGVIDPFAVLQ

SEQ ID NO: 2944621 - protein, 29 aa, Entamoeba invadens
IRIEGYYNRRNFQVMFPIVIGSDISNPQL

SEQ ID NO: 2944622 - protein, 18 aa, Entamoeba invadens
IRIKFMIDAAKGILYLHE

SEQ ID NO: 2944623 - protein, 17 aa, Entamoeba invadens
IRIKFMMDASKGIQYLH

SEQ ID NO: 2944624 - protein, 17 aa, Entamoeba invadens
IRILMKFLESQNAINRT

SEQ ID NO: 2944625 - protein, 26 aa, Entamoeba invadens
IRIMEQCCLGVQWLHNAFGIIHRDIK

SEQ ID NO: 2944626 - protein, 19 aa, Entamoeba invadens
IRINESWPSYPERDLDDDG

SEQ ID NO: 2944627 - protein, 30 aa, Entamoeba invadens
IRIPTSVTCIGKFAFKNCISLTSFNSANVL

SEQ ID NO: 2944628 - protein, 19 aa, Entamoeba invadens
IRIQKKFGSYGLLYKSSRL

SEQ ID NO: 2944629 - protein, 20 aa, Entamoeba invadens
IRISPKYKPLFTHIQTQIVF

SEQ ID NO: 2944630 - protein, 19 aa, Entamoeba invadens
IRITNRINMFFSSNEVGDE

SEQ ID NO: 2944631 - protein, 27 aa, Entamoeba invadens
IRITRFGGKLSIPDSIKSISINFRDAT

SEQ ID NO: 2944632 - protein, 17 aa, Entamoeba invadens
IRKACDMVRSGELTSKN

SEQ ID NO: 2944633 - protein, 17 aa, Entamoeba invadens
IRKDLYKNIVFSSGTSM

SEQ ID NO: 2944634 - protein, 21 aa, Entamoeba invadens
IRKERVDALYKLKEQKIADYV

SEQ ID NO: 2944635 - protein, 17 aa, Entamoeba invadens
IRKEVAEIVKLYPQKFT

SEQ ID NO: 2944636 - protein, 17 aa, Entamoeba invadens
IRKFAKWLHSQHFLHKL

SEQ ID NO: 2944637 - protein, 22 aa, Entamoeba invadens
IRKLDSLCFCWCRNLRNVDISY

SEQ ID NO: 2944638 - protein, 17 aa, Entamoeba invadens
IRKNLPYSSKSDLYSLG

SEQ ID NO: 2944639 - protein, 26 aa, Entamoeba invadens
IRKPFLFLHCHILREYLSKTIRIEGF

SEQ ID NO: 2944640 - protein, 17 aa, Entamoeba invadens
IRKPHIIHSRSRVVDRL

SEQ ID NO: 2944641 - protein, 19 aa, Entamoeba invadens
IRKQFPYQDLVYRPFLRLR

SEQ ID NO: 2944642 - protein, 20 aa, Entamoeba invadens
IRKQIRFIKNRFIAQRNVLM

SEQ ID NO: 2944643 - protein, 19 aa, Entamoeba invadens
IRKTLKLLKLRQINNAVFI

SEQ ID NO: 2944644 - protein, 19 aa, Entamoeba invadens
IRKTLKLLRLRQINNAVFI

SEQ ID NO: 2944645 - protein, 21 aa, Entamoeba invadens
IRKVEKIEVIPLPELDDKQLQ

SEQ ID NO: 2944646 - protein, 25 aa, Entamoeba invadens
IRKVELTNMKFIFTTFKTIIAEYST

SEQ ID NO: 2944647 - protein, 17 aa, Entamoeba invadens
IRKVIERYAQIDFGVSY

SEQ ID NO: 2944648 - protein, 18 aa, Entamoeba invadens
IRKVLALRNKYMYIGDKE

SEQ ID NO: 2944649 - protein, 17 aa, Entamoeba invadens
IRKVTELLIDWKTLNSV

SEQ ID NO: 2944650 - protein, 17 aa, Entamoeba invadens
IRKVWKERKVMINSSPR

SEQ ID NO: 2944651 - protein, 17 aa, Entamoeba invadens
IRKYKSFNVWKYCTEAF

SEQ ID NO: 2944652 - protein, 24 aa, Entamoeba invadens
IRKYVKSFRKSDMDRDGHIDEPSV

SEQ ID NO: 2944653 - protein, 23 aa, Entamoeba invadens
IRLDPPHLLWVIPHLTSISVLQR

SEQ ID NO: 2944654 - protein, 17 aa, Entamoeba invadens
IRLEFERANTFFIKPFL

SEQ ID NO: 2944655 - protein, 18 aa, Entamoeba invadens
IRLFSLFVRDILVQKMSK

SEQ ID NO: 2944656 - protein, 20 aa, Entamoeba invadens
IRLFVGLVVEGEIARYGATK

SEQ ID NO: 2944657 - protein, 17 aa, Entamoeba invadens
IRLIDFGSSCFENSTLY

SEQ ID NO: 2944658 - protein, 17 aa, Entamoeba invadens
IRLKNTRFLDSLIPLFK

SEQ ID NO: 2944659 - protein, 17 aa, Entamoeba invadens
IRLKTRNFTSGKLGLLT

SEQ ID NO: 2944660 - protein, 17 aa, Entamoeba invadens
IRLLHILKRSDRISLIR

SEQ ID NO: 2944661 - protein, 20 aa, Entamoeba invadens
IRLMARNAPGVFLSLKSDDV

SEQ ID NO: 2944662 - protein, 21 aa, Entamoeba invadens
IRLNPSTVLFFNGLTNPTYGT

SEQ ID NO: 2944663 - protein, 29 aa, Entamoeba invadens
IRLPNSITSLGDFCFSFCVSLTQINLPLG

SEQ ID NO: 2944664 - protein, 17 aa, Entamoeba invadens
IRLSADCNFIMVITNTK

SEQ ID NO: 2944665 - protein, 19 aa, Entamoeba invadens
IRLSILRTLFHCLSVENAS

SEQ ID NO: 2944666 - protein, 17 aa, Entamoeba invadens
IRLWEIIGKTFSSIWAL

SEQ ID NO: 2944667 - protein, 21 aa, Entamoeba invadens
IRMEAFKEIERESKIKPYSIE

SEQ ID NO: 2944668 - protein, 20 aa, Entamoeba invadens
IRMFKQRMGEDVNRHVNAVQ

SEQ ID NO: 2944669 - protein, 24 aa, Entamoeba invadens
IRMIKDRLTIINTYLTVFRPNTQV

SEQ ID NO: 2944670 - protein, 26 aa, Entamoeba invadens
IRMSNCDKLLSSMFVNWIFLTSVKLP

SEQ ID NO: 2944671 - protein, 27 aa, Entamoeba invadens
IRMSNCDKLLSSMFVNWIFLTSVKLPS

SEQ ID NO: 2944672 - protein, 17 aa, Entamoeba invadens
IRMSTPVTFNYSERRNN

SEQ ID NO: 2944673 - protein, 18 aa, Entamoeba invadens
IRMVACEMINKANSGHPG

SEQ ID NO: 2944674 - protein, 23 aa, Entamoeba invadens
IRNCYPTKIEFVGNGIDMSQMKL

SEQ ID NO: 2944675 - protein, 18 aa, Entamoeba invadens
IRNCYPTQIEFVGNGIDM

SEQ ID NO: 2944676 - protein, 23 aa, Entamoeba invadens
IRNGESTIRHFLVINNVNNHSEE

SEQ ID NO: 2944677 - protein, 20 aa, Entamoeba invadens
IRNKFKFYYDRFSEYLPEYY

SEQ ID NO: 2944678 - protein, 18 aa, Entamoeba invadens
IRNKLIFKNINIMADQII

SEQ ID NO: 2944679 - protein, 17 aa, Entamoeba invadens
IRNKQRCSVLIKEVTKK

SEQ ID NO: 2944680 - protein, 20 aa, Entamoeba invadens
IRNPWGCCEWKGKWRDDDPA

SEQ ID NO: 2944681 - protein, 21 aa, Entamoeba invadens
IRNPWGKCEWTGKWSDEDSSW

SEQ ID NO: 2944682 - protein, 24 aa, Entamoeba invadens
IRNQRWLLRKVLNIDLREKMEKEI

SEQ ID NO: 2944683 - protein, 18 aa, Entamoeba invadens
IRNTLSWLYLDKSDLESE

SEQ ID NO: 2944684 - protein, 18 aa, Entamoeba invadens
IRPAYLISEVVQKSEAQN

SEQ ID NO: 2944685 - protein, 23 aa, Entamoeba invadens
IRPCELGPFGFEWDNKNEEDRKG

SEQ ID NO: 2944686 - protein, 21 aa, Entamoeba invadens
IRPDKQIVMFSATFPQSVEQS

SEQ ID NO: 2944687 - protein, 28 aa, Entamoeba invadens
IRPEEISVCLRRVEMNSVHLGVGQMVTK

SEQ ID NO: 2944688 - protein, 21 aa, Entamoeba invadens
IRPFLVEGLSFKTDSPVPHKA

SEQ ID NO: 2944689 - protein, 18 aa, Entamoeba invadens
IRPLSYPSTDIFLLCFSV

SEQ ID NO: 2944690 - protein, 18 aa, Entamoeba invadens
IRPLWRHYYQNTQAIIFV

SEQ ID NO: 2944691 - protein, 24 aa, Entamoeba invadens
IRPLWRHYYSGSNAIIFVLDSNDR

SEQ ID NO: 2944692 - protein, 19 aa, Entamoeba invadens
IRPMNFIKKYSFAIHAACD

SEQ ID NO: 2944693 - protein, 18 aa, Entamoeba invadens
IRPQPIINQHGSTTTIAT

SEQ ID NO: 2944694 - protein, 22 aa, Entamoeba invadens
IRPSYERCLNVFFKSKILTNTY

SEQ ID NO: 2944695 - protein, 17 aa, Entamoeba invadens
IRPTHSFTIKVVHKELP

SEQ ID NO: 2944696 - protein, 17 aa, Entamoeba invadens
IRQACFKITENIKDAQR

SEQ ID NO: 2944697 - protein, 17 aa, Entamoeba invadens
IRQALRRLGLKTVGTLA

SEQ ID NO: 2944698 - protein, 22 aa, Entamoeba invadens
IRQCSNRHPVFFVPGILASTLH

SEQ ID NO: 2944699 - protein, 28 aa, Entamoeba invadens
IRQELDLRTGAAFTRFQTTLLKRQVPVL

SEQ ID NO: 2944700 - protein, 23 aa, Entamoeba invadens
IRQFKLFECFPVLFNCFNNARQL

SEQ ID NO: 2944701 - protein, 27 aa, Entamoeba invadens
IRQTATCLIYKCLNCGDDCCCVKGNEG

SEQ ID NO: 2944702 - protein, 19 aa, Entamoeba invadens
IRQVLKGLQYLYVHGLFHG

SEQ ID NO: 2944703 - protein, 19 aa, Entamoeba invadens
IRRAMFLKEEQKIFDGFDP

SEQ ID NO: 2944704 - protein, 19 aa, Entamoeba invadens
IRRDGRFLFVQQALKILRQ

SEQ ID NO: 2944705 - protein, 24 aa, Entamoeba invadens
IRRESSIRRSVLRFGENLIDPVRQ

SEQ ID NO: 2944706 - protein, 34 aa, Entamoeba invadens
IRRFEHLFTEACCYACSYYSYKYAEVIEADAFEL

SEQ ID NO: 2944707 - protein, 19 aa, Entamoeba invadens
IRRVCPCAFLETSAKENTQ

SEQ ID NO: 2944708 - protein, 18 aa, Entamoeba invadens
IRRVNSYVQVYGMLAQFC

SEQ ID NO: 2944709 - protein, 21 aa, Entamoeba invadens
IRRYCHGVFEPTYRATIGVDF

SEQ ID NO: 2944710 - protein, 27 aa, Entamoeba invadens
IRSFLVCLKMIICLVGTDSLQPERIGN

SEQ ID NO: 2944711 - protein, 26 aa, Entamoeba invadens
IRSFMFKNCRSLTGVKLPNSIKSLGD

SEQ ID NO: 2944712 - protein, 24 aa, Entamoeba invadens
IRSNGYRVFIMFAQILVICAESPF

SEQ ID NO: 2944713 - protein, 18 aa, Entamoeba invadens
IRSRCVMVRVPAPNKAEM

SEQ ID NO: 2944714 - protein, 19 aa, Entamoeba invadens
IRSTRAFEAEVIKRIRQEK

SEQ ID NO: 2944715 - protein, 18 aa, Entamoeba invadens
IRSVEWNQLVLPSTVKEL

SEQ ID NO: 2944716 - protein, 17 aa, Entamoeba invadens
IRTAVCLETQNYPDSPH

SEQ ID NO: 2944717 - protein, 17 aa, Entamoeba invadens
IRTGQEFNSPENDDVRR

SEQ ID NO: 2944718 - protein, 18 aa, Entamoeba invadens
IRTKMNFVSIAERVDDMS

SEQ ID NO: 2944719 - protein, 27 aa, Entamoeba invadens
IRTLFKKDFLALDWRQKIRVFDCTFRG

SEQ ID NO: 2944720 - protein, 18 aa, Entamoeba invadens
IRTLGPLKRHQTLRFVDI

SEQ ID NO: 2944721 - protein, 22 aa, Entamoeba invadens
IRTNVLYPRCYDVSRDIRKVAC

SEQ ID NO: 2944722 - protein, 20 aa, Entamoeba invadens
IRTQKRLKSIQSPRRNEFCR

SEQ ID NO: 2944723 - protein, 22 aa, Entamoeba invadens
IRTSKNYTECVTIWKDFHYNTI

SEQ ID NO: 2944724 - protein, 18 aa, Entamoeba invadens
IRTVPSLVTLKRGDACEF

SEQ ID NO: 2944725 - protein, 17 aa, Entamoeba invadens
IRVAKQIPPNYRNQVSF

SEQ ID NO: 2944726 - protein, 17 aa, Entamoeba invadens
IRVAMGCGKNGERSNPL

SEQ ID NO: 2944727 - protein, 20 aa, Entamoeba invadens
IRVASTPMGWYTFKETKTWN

SEQ ID NO: 2944728 - protein, 20 aa, Entamoeba invadens
IRVDMRIVTEFVCRKYPDAV

SEQ ID NO: 2944729 - protein, 18 aa, Entamoeba invadens
IRVEPPIVVIKKGTAVEF

SEQ ID NO: 2944730 - protein, 19 aa, Entamoeba invadens
IRVEVLKAMDMFSVDNTPG

SEQ ID NO: 2944731 - protein, 24 aa, Entamoeba invadens
IRVGRTGKCYADFESSEVMTRVRC

SEQ ID NO: 2944732 - protein, 20 aa, Entamoeba invadens
IRVGSSLLFNCVELLHVTYV

SEQ ID NO: 2944733 - protein, 24 aa, Entamoeba invadens
IRVIDFGSACFENSTLYTYIQSRH

SEQ ID NO: 2944734 - protein, 27 aa, Entamoeba invadens
IRVIGEKCFRYAPIADIVIPPTVIKIK

SEQ ID NO: 2944735 - protein, 22 aa, Entamoeba invadens
IRVIQGKASIGFITLNQPIPLD

SEQ ID NO: 2944736 - protein, 26 aa, Entamoeba invadens
IRWFKKTEVESGIFIFENDDRLYSVG

SEQ ID NO: 2944737 - protein, 18 aa, Entamoeba invadens
IRYAERVGYPLVFCSSYT

SEQ ID NO: 2944738 - protein, 20 aa, Entamoeba invadens
IRYFIPMLEIYPELQGEAKL

SEQ ID NO: 2944739 - protein, 21 aa, Entamoeba invadens
IRYILRACAVASKYEETITEI

SEQ ID NO: 2944740 - protein, 27 aa, Entamoeba invadens
IRYMPYVHCFPDIFFVMKENFKNYFAD

SEQ ID NO: 2944741 - protein, 28 aa, Entamoeba invadens
ISAFVCVFERRMVLVTSNKVIEMKMKLE

SEQ ID NO: 2944742 - protein, 21 aa, Entamoeba invadens
ISAGLLHGWNYQALIKEVTEY

SEQ ID NO: 2944743 - protein, 18 aa, Entamoeba invadens
ISAGLTFSFAVEQIAINK

SEQ ID NO: 2944744 - protein, 17 aa, Entamoeba invadens
ISAHLAIQTRNATHVDY

SEQ ID NO: 2944745 - protein, 21 aa, Entamoeba invadens
ISALANHYFKLHVYTQIPNLM

SEQ ID NO: 2944746 - protein, 21 aa, Entamoeba invadens
ISALANHYFKLHVYTQITNLM

SEQ ID NO: 2944747 - protein, 21 aa, Entamoeba invadens
ISALANYYFKIHVYTKIPNLK

SEQ ID NO: 2944748 - protein, 24 aa, Entamoeba invadens
ISALKPFCEKTIFTGSPVKAKELT

SEQ ID NO: 2944749 - protein, 26 aa, Entamoeba invadens
ISARGTISWMPLCLSDFNEKAQIHVF

SEQ ID NO: 2944750 - protein, 17 aa, Entamoeba invadens
ISASIKKFPGMVVGKDL

SEQ ID NO: 2944751 - protein, 21 aa, Entamoeba invadens
ISASKRRSFEYGKESKTVTGK

SEQ ID NO: 2944752 - protein, 17 aa, Entamoeba invadens
ISATVFLETYKEALENM

SEQ ID NO: 2944753 - protein, 21 aa, Entamoeba invadens
ISAVRVFEWSKTVELLMRQKD

SEQ ID NO: 2944754 - protein, 18 aa, Entamoeba invadens
ISAYCFPQKTVVRRRCDN

SEQ ID NO: 2944755 - protein, 38 aa, Entamoeba invadens
ISCENQWWYGRKGNSFGYFPGEYCQVIGGINKEVKSEG

SEQ ID NO: 2944756 - protein, 25 aa, Entamoeba invadens
ISCFKECYCLSEIHCSNTLKMLPTS

SEQ ID NO: 2944757 - protein, 22 aa, Entamoeba invadens
ISCKTQEGLKMPIRKPTATSTS

SEQ ID NO: 2944758 - protein, 23 aa, Entamoeba invadens
ISCKYGNECVEDFLSDLDNNSVV

SEQ ID NO: 2944759 - protein, 22 aa, Entamoeba invadens
ISCKYGNECVEDFLSDLVNNSV

SEQ ID NO: 2944760 - protein, 29 aa, Entamoeba invadens
ISCNRLLEFVQRLGFTFIQRGTRSTKYTV

SEQ ID NO: 2944761 - protein, 21 aa, Entamoeba invadens
ISCYHRLNVLCLINKRARAGC

SEQ ID NO: 2944762 - protein, 18 aa, Entamoeba invadens
ISDCLIHVFVASKEDKNN

SEQ ID NO: 2944763 - protein, 21 aa, Entamoeba invadens
ISDDFDVLKLLGYSQLKLNKK

SEQ ID NO: 2944764 - protein, 17 aa, Entamoeba invadens
ISDEFKATIEAVKKHSE

SEQ ID NO: 2944765 - protein, 18 aa, Entamoeba invadens
ISDFCFKECISLSSIRIA

SEQ ID NO: 2944766 - protein, 18 aa, Entamoeba invadens
ISDKVMFNEICQYYKNRN

SEQ ID NO: 2944767 - protein, 23 aa, Entamoeba invadens
ISDSFYSHHRHFFVVTDTGKPVF

SEQ ID NO: 2944768 - protein, 21 aa, Entamoeba invadens
ISDVFSVVFFDEFPVKCQDVL

SEQ ID NO: 2944769 - protein, 17 aa, Entamoeba invadens
ISDWGIKTNEVFFTVLV

SEQ ID NO: 2944770 - protein, 20 aa, Entamoeba invadens
ISDWIVTIILLMFSAENRVK

SEQ ID NO: 2944771 - protein, 23 aa, Entamoeba invadens
ISDYRQLLEIGFEEQKFVEQIGF

SEQ ID NO: 2944772 - protein, 21 aa, Entamoeba invadens
ISEAHARIRGVPEIEERDALA

SEQ ID NO: 2944773 - protein, 34 aa, Entamoeba invadens
ISEALCIGCGLCVKKCPFEAIKIINLPKNLETCT

SEQ ID NO: 2944774 - protein, 19 aa, Entamoeba invadens
ISEARIRVDHFCDADLRSL

SEQ ID NO: 2944775 - protein, 23 aa, Entamoeba invadens
ISECGVGVVVTKEQIAAGVKRLI

SEQ ID NO: 2944776 - protein, 26 aa, Entamoeba invadens
ISECLAVAMDECWKINEIVQKIREQR

SEQ ID NO: 2944777 - protein, 18 aa, Entamoeba invadens
ISEELKTKCEWHAEAAAK

SEQ ID NO: 2944778 - protein, 23 aa, Entamoeba invadens
ISEFKELFTTIAEAYGEGTPSAV

SEQ ID NO: 2944779 - protein, 19 aa, Entamoeba invadens
ISEFLFPPLPTVFAFCARQ

SEQ ID NO: 2944780 - protein, 37 aa, Entamoeba invadens
ISEFPNSSFLHLEWLCNFKGLYGYVLITHTNAYLWTD

SEQ ID NO: 2944781 - protein, 18 aa, Entamoeba invadens
ISEFPRLVEILKNNENIQ

SEQ ID NO: 2944782 - protein, 18 aa, Entamoeba invadens
ISEGVSFKTARRRRNTNV

SEQ ID NO: 2944783 - protein, 25 aa, Entamoeba invadens
ISEIDSVGIIKLWCETNGVDFVHRF

SEQ ID NO: 2944784 - protein, 19 aa, Entamoeba invadens
ISEIGRLVNEIVYKRFEKA

SEQ ID NO: 2944785 - protein, 18 aa, Entamoeba invadens
ISEKKTNVLYLFGTGFCW

SEQ ID NO: 2944786 - protein, 30 aa, Entamoeba invadens
ISEKNLKMIFEISMLFPHKTVQQIIMRLKW

SEQ ID NO: 2944787 - protein, 20 aa, Entamoeba invadens
ISELFASIAENLCTLPIPAD

SEQ ID NO: 2944788 - protein, 26 aa, Entamoeba invadens
ISELPPLEIFDTLTLNNISISNNNKL

SEQ ID NO: 2944789 - protein, 18 aa, Entamoeba invadens
ISELPTFFDEKQKLVNIK

SEQ ID NO: 2944790 - protein, 27 aa, Entamoeba invadens
ISELSMIGLDFVKRGVKRVSIMNQGYV

SEQ ID NO: 2944791 - protein, 18 aa, Entamoeba invadens
ISEPFVWGQMEVRKLQYS

SEQ ID NO: 2944792 - protein, 18 aa, Entamoeba invadens
ISEPIWPVELYDQLINIT

SEQ ID NO: 2944793 - protein, 18 aa, Entamoeba invadens
ISERIKIEMENGISEKTA

SEQ ID NO: 2944794 - protein, 28 aa, Entamoeba invadens
ISESLSELGKWLVGNCEKILNYKNEFKL

SEQ ID NO: 2944795 - protein, 23 aa, Entamoeba invadens
ISESVLVKICLDISKALKYLHVE

SEQ ID NO: 2944796 - protein, 17 aa, Entamoeba invadens
ISETFVALVKDIKQNRA

SEQ ID NO: 2944797 - protein, 17 aa, Entamoeba invadens
ISEVAVKMDDTFITQIT

SEQ ID NO: 2944798 - protein, 25 aa, Entamoeba invadens
ISEVKTRLSRFCQVHSKYFQYYFFS

SEQ ID NO: 2944799 - protein, 25 aa, Entamoeba invadens
ISEYNFGYLIYCEFTSLSIKMEYAE

SEQ ID NO: 2944800 - protein, 18 aa, Entamoeba invadens
ISFCCYSHLTNKLNQNYE

SEQ ID NO: 2944801 - protein, 20 aa, Entamoeba invadens
ISFFERIIWYSISYSHVIQT

SEQ ID NO: 2944802 - protein, 24 aa, Entamoeba invadens
ISFNVVAMLLHYGVPPETLLLPVP

SEQ ID NO: 2944803 - protein, 17 aa, Entamoeba invadens
ISFQVFLNFQHSQSSKN

SEQ ID NO: 2944804 - protein, 19 aa, Entamoeba invadens
ISFRLGDPNLVVFNDIVDK

SEQ ID NO: 2944805 - protein, 23 aa, Entamoeba invadens
ISFTELPSLVFLSHSANRTIDLS

SEQ ID NO: 2944806 - protein, 25 aa, Entamoeba invadens
ISFTMCEFNCNIAFCDRRRIIEKTQ

SEQ ID NO: 2944807 - protein, 19 aa, Entamoeba invadens
ISFTPVFHLILRLLNPTTN

SEQ ID NO: 2944808 - protein, 20 aa, Entamoeba invadens
ISFYLILPIQRIPRYELLIR

SEQ ID NO: 2944809 - protein, 23 aa, Entamoeba invadens
ISGESCGFIAEDRVRFPWYVAGG

SEQ ID NO: 2944810 - protein, 19 aa, Entamoeba invadens
ISGMCCLLIAVLTYSEMAK

SEQ ID NO: 2944811 - protein, 17 aa, Entamoeba invadens
ISGRFLIHTTKGELKEG

SEQ ID NO: 2944812 - protein, 26 aa, Entamoeba invadens
ISGTKFLLYCWSRPDLRGYLNSQGVE

SEQ ID NO: 2944813 - protein, 24 aa, Entamoeba invadens
ISGWLELLSSLLVCVKMAVGLIRS

SEQ ID NO: 2944814 - protein, 24 aa, Entamoeba invadens
ISHDISLLIPEIWSRMRRNEQEPK

SEQ ID NO: 2944815 - protein, 18 aa, Entamoeba invadens
ISHFPQFIPYNLEKSRKY

SEQ ID NO: 2944816 - protein, 21 aa, Entamoeba invadens
ISHIYDCLGDRAVYVLDCPYS

SEQ ID NO: 2944817 - protein, 21 aa, Entamoeba invadens
ISHPFIVKLYYAFQTADKLYM

SEQ ID NO: 2944818 - protein, 20 aa, Entamoeba invadens
ISIACKQNFIAAGFKDGNIA

SEQ ID NO: 2944819 - protein, 27 aa, Entamoeba invadens
ISIAPGEMWRILQANILSYLSKHCSNV

SEQ ID NO: 2944820 - protein, 25 aa, Entamoeba invadens
ISICIKFFQFCITNFQLMFPDQIDE

SEQ ID NO: 2944821 - protein, 24 aa, Entamoeba invadens
ISIEFKYRKSFYTLSDVVLGQVYF

SEQ ID NO: 2944822 - protein, 22 aa, Entamoeba invadens
ISIEIPSTVTLLGDSSFQDCGA

SEQ ID NO: 2944823 - protein, 17 aa, Entamoeba invadens
ISIGDCRTFLYSPRTHH

SEQ ID NO: 2944824 - protein, 22 aa, Entamoeba invadens
ISIGNICSFFAETLPTTEFEPK

SEQ ID NO: 2944825 - protein, 17 aa, Entamoeba invadens
ISIGPTCKDVHTPQETI

SEQ ID NO: 2944826 - protein, 18 aa, Entamoeba invadens
ISIGRGEGVREWFRCGLR

SEQ ID NO: 2944827 - protein, 20 aa, Entamoeba invadens
ISIIDGIAFGRMRKKVDCRI

SEQ ID NO: 2944828 - protein, 18 aa, Entamoeba invadens
ISIIFGVNIFTGVNVVDM

SEQ ID NO: 2944829 - protein, 24 aa, Entamoeba invadens
ISIKTRNPIIFSFHPSALKCSIAA

SEQ ID NO: 2944830 - protein, 23 aa, Entamoeba invadens
ISIKTRNPIVFSFHPSALKCSIA

SEQ ID NO: 2944831 - protein, 33 aa, Entamoeba invadens
ISIPSINSLCFCKGEMFFLSGFQLFSKKLNKKI

SEQ ID NO: 2944832 - protein, 17 aa, Entamoeba invadens
ISIQFYLLKDIKNISFS

SEQ ID NO: 2944833 - protein, 25 aa, Entamoeba invadens
ISIYCPLPVVSRFLFVSKKCKLSVE

SEQ ID NO: 2944834 - protein, 26 aa, Entamoeba invadens
ISKDCVTAFTMLRKNPNYSLETLSTE

SEQ ID NO: 2944835 - protein, 17 aa, Entamoeba invadens
ISKFCFENEKCITSLKF

SEQ ID NO: 2944836 - protein, 17 aa, Entamoeba invadens
ISKFPEWAKSAMNPLKY

SEQ ID NO: 2944837 - protein, 23 aa, Entamoeba invadens
ISKGLEWIDDILLTRTAETQKFF

SEQ ID NO: 2944838 - protein, 49 aa, Entamoeba invadens
ISKHFVREGLNISHFAFRWLTCCLSREFSIKVILRLWDSFLAFENGLGF

SEQ ID NO: 2944839 - protein, 19 aa, Entamoeba invadens
ISKHVGCCQAGIYADGKLI

SEQ ID NO: 2944840 - protein, 25 aa, Entamoeba invadens
ISKIGDGCFRQCISLNKINLPSNLL

SEQ ID NO: 2944841 - protein, 21 aa, Entamoeba invadens
ISKIMAANGIPFAKSEAIWKI

SEQ ID NO: 2944842 - protein, 23 aa, Entamoeba invadens
ISKIWYFIGKVIFKEKKCPFEPL

SEQ ID NO: 2944843 - protein, 17 aa, Entamoeba invadens
ISKKCGNALNFVFRSPN

SEQ ID NO: 2944844 - protein, 18 aa, Entamoeba invadens
ISKKCKTLLDAISINPIE

SEQ ID NO: 2944845 - protein, 24 aa, Entamoeba invadens
ISKKGARLNKVFVERMGENVNSKT

SEQ ID NO: 2944846 - protein, 29 aa, Entamoeba invadens
ISKKGKLYIEYKWVRGISGMYHAITHGGP

SEQ ID NO: 2944847 - protein, 23 aa, Entamoeba invadens
ISKKRKAEVLFDSKEKSLTRPLF

SEQ ID NO: 2944848 - protein, 19 aa, Entamoeba invadens
ISKKTFPLLTINFVHKYTK

SEQ ID NO: 2944849 - protein, 24 aa, Entamoeba invadens
ISKLGEIPDFFDVFQVIFNVISDL

SEQ ID NO: 2944850 - protein, 32 aa, Entamoeba invadens
ISKLNVELHLEWKRLACEVVNIPTGSFFSKTR

SEQ ID NO: 2944851 - protein, 22 aa, Entamoeba invadens
ISKNKPKLVCFGHSHNCFGVMK

SEQ ID NO: 2944852 - protein, 23 aa, Entamoeba invadens
ISKPLPMGVCGLYNLGNTCYMNS

SEQ ID NO: 2944853 - protein, 25 aa, Entamoeba invadens
ISKQELECFGLIFGVGDKKVIGTAP

SEQ ID NO: 2944854 - protein, 32 aa, Entamoeba invadens
ISKRIGIIERLIKIAGFCFSYRNFDTLLCILL

SEQ ID NO: 2944855 - protein, 20 aa, Entamoeba invadens
ISKRLKTKIFDSQKTNNINK

SEQ ID NO: 2944856 - protein, 27 aa, Entamoeba invadens
ISKSGRGRMNIMLSGGMTIINFGLSQA

SEQ ID NO: 2944857 - protein, 31 aa, Entamoeba invadens
ISKTKLPPLFCRYKLLPFYLDLFRSNMPEAS

SEQ ID NO: 2944858 - protein, 17 aa, Entamoeba invadens
ISLDLSDIISLGDYGLQ

SEQ ID NO: 2944859 - protein, 17 aa, Entamoeba invadens
ISLDLSTVISLGDYGLQ

SEQ ID NO: 2944860 - protein, 19 aa, Entamoeba invadens
ISLHLFKVLLNNEGELGIP

SEQ ID NO: 2944861 - protein, 19 aa, Entamoeba invadens
ISLHLTIKGNRSLSNSQIQ

SEQ ID NO: 2944862 - protein, 19 aa, Entamoeba invadens
ISLIKKVAFYSGAFLQKTC

SEQ ID NO: 2944863 - protein, 24 aa, Entamoeba invadens
ISLKIIEGLVKYTLLFDLTGVTNN

SEQ ID NO: 2944864 - protein, 17 aa, Entamoeba invadens
ISLKVFDSFIPNFFSLK

SEQ ID NO: 2944865 - protein, 24 aa, Entamoeba invadens
ISLLDMFFEYGMSTKYLKYRPQNV

SEQ ID NO: 2944866 - protein, 17 aa, Entamoeba invadens
ISLLKWINDDFVPTMDR

SEQ ID NO: 2944867 - protein, 17 aa, Entamoeba invadens
ISLNLKNRGVMFVSKNN

SEQ ID NO: 2944868 - protein, 18 aa, Entamoeba invadens
ISLPVYLERVKKLALGCS

SEQ ID NO: 2944869 - protein, 24 aa, Entamoeba invadens
ISLQCKRGGQPMYRNLTIADESIL

SEQ ID NO: 2944870 - protein, 17 aa, Entamoeba invadens
ISLQRKSIIPFIRPKKA

SEQ ID NO: 2944871 - protein, 25 aa, Entamoeba invadens
ISLRFPNKRATVFEQFMTIEKMWND

SEQ ID NO: 2944872 - protein, 22 aa, Entamoeba invadens
ISLSEKGGCDAGWGIIAEQDTL

SEQ ID NO: 2944873 - protein, 17 aa, Entamoeba invadens
ISLSKAYGLKLNIQQAE

SEQ ID NO: 2944874 - protein, 22 aa, Entamoeba invadens
ISMAVFYVQAFRVENLREKFKV

SEQ ID NO: 2944875 - protein, 23 aa, Entamoeba invadens
ISMEEIVRGFPIVLKQIERLEEK

SEQ ID NO: 2944876 - protein, 24 aa, Entamoeba invadens
ISMKSEMSKARMMEISNAEHSEIL

SEQ ID NO: 2944877 - protein, 19 aa, Entamoeba invadens
ISMNKCKYINFLGEAPLLE

SEQ ID NO: 2944878 - protein, 19 aa, Entamoeba invadens
ISMTCNLLLQLLKQETELE

SEQ ID NO: 2944879 - protein, 20 aa, Entamoeba invadens
ISMYSIRFGTMLYTLEHPNM

SEQ ID NO: 2944880 - protein, 17 aa, Entamoeba invadens
ISNATCENGIFDSTKRK

SEQ ID NO: 2944881 - protein, 25 aa, Entamoeba invadens
ISNCLTCYDITPSGLSIRFKERCEA

SEQ ID NO: 2944882 - protein, 26 aa, Entamoeba invadens
ISNEKFRALFSYSIRLMITLVKSISS

SEQ ID NO: 2944883 - protein, 18 aa, Entamoeba invadens
ISNFPRIELTTDELIEST

SEQ ID NO: 2944884 - protein, 17 aa, Entamoeba invadens
ISNFVLFPKQTITVKSV

SEQ ID NO: 2944885 - protein, 25 aa, Entamoeba invadens
ISNIRIPSMRFFEAIVNVKMDVKNR

SEQ ID NO: 2944886 - protein, 17 aa, Entamoeba invadens
ISNLLLKLYESMEDLIV

SEQ ID NO: 2944887 - protein, 18 aa, Entamoeba invadens
ISNLLLKLYESMEDLIVN

SEQ ID NO: 2944888 - protein, 22 aa, Entamoeba invadens
ISNSIRYGRYETVVVERQIEDD

SEQ ID NO: 2944889 - protein, 20 aa, Entamoeba invadens
ISNSKCSKCTFWHTPNDNGT

SEQ ID NO: 2944890 - protein, 20 aa, Entamoeba invadens
ISNSSWRYNTIKSAITNNDW

SEQ ID NO: 2944891 - protein, 18 aa, Entamoeba invadens
ISNTKCFDVFSLNNQSNL

SEQ ID NO: 2944892 - protein, 20 aa, Entamoeba invadens
ISPEAYRVISEMWTHKPENR

SEQ ID NO: 2944893 - protein, 17 aa, Entamoeba invadens
ISPELVKRSMIGATSEK

SEQ ID NO: 2944894 - protein, 17 aa, Entamoeba invadens
ISPHNGVIITITRLGNG

SEQ ID NO: 2944895 - protein, 19 aa, Entamoeba invadens
ISPICSFGDPSLSPKRKYS

SEQ ID NO: 2944896 - protein, 19 aa, Entamoeba invadens
ISPKSFKTAIGEFAPQFSG

SEQ ID NO: 2944897 - protein, 18 aa, Entamoeba invadens
ISPLDACRGDQCRAQVTA

SEQ ID NO: 2944898 - protein, 24 aa, Entamoeba invadens
ISPNGRFCYMADYSGNIEVYTVGG

SEQ ID NO: 2944899 - protein, 18 aa, Entamoeba invadens
ISPPEGTNTMWSKESWMM

SEQ ID NO: 2944900 - protein, 25 aa, Entamoeba invadens
ISPPPYPFDLCFYTVSPELSISNTK

SEQ ID NO: 2944901 - protein, 20 aa, Entamoeba invadens
ISPSEVEWGPLYQMKLASFR

SEQ ID NO: 2944902 - protein, 20 aa, Entamoeba invadens
ISPSKRATMSPMYPIPPPQD

SEQ ID NO: 2944903 - protein, 27 aa, Entamoeba invadens
ISPSYLEYSAWLAVIPLGMKCNEIFGI

SEQ ID NO: 2944904 - protein, 18 aa, Entamoeba invadens
ISQDGHEFFISRECAQHS

SEQ ID NO: 2944905 - protein, 18 aa, Entamoeba invadens
ISQECSFKGIPAIEKTLY

SEQ ID NO: 2944906 - protein, 17 aa, Entamoeba invadens
ISQIKKTNGRIAQFKSL

SEQ ID NO: 2944907 - protein, 25 aa, Entamoeba invadens
ISQKRFSFLCSIFGKYYKKKENYKD

SEQ ID NO: 2944908 - protein, 27 aa, Entamoeba invadens
ISQLKFNMFCFSYFNTHYIFRADIAHV

SEQ ID NO: 2944909 - protein, 22 aa, Entamoeba invadens
ISQMCIRPGTPAAQMKPVNSKV

SEQ ID NO: 2944910 - protein, 21 aa, Entamoeba invadens
ISQNRLVKFAKRRRTYEGFTQ

SEQ ID NO: 2944911 - protein, 19 aa, Entamoeba invadens
ISQNYRISDLLAENQNLKK

SEQ ID NO: 2944912 - protein, 17 aa, Entamoeba invadens
ISQTLRFEGCMWGFINE

SEQ ID NO: 2944913 - protein, 17 aa, Entamoeba invadens
ISQVGIGRKVHFLNKKE

SEQ ID NO: 2944914 - protein, 22 aa, Entamoeba invadens
ISREPILIALFYNYGLSLLNNM

SEQ ID NO: 2944915 - protein, 23 aa, Entamoeba invadens
ISREPILIALFYNYGLSLLNNMT

SEQ ID NO: 2944916 - protein, 24 aa, Entamoeba invadens
ISREPILVALFYNYGLSLLNNMTR

SEQ ID NO: 2944917 - protein, 25 aa, Entamoeba invadens
ISRIKVILDKKCFECNKFFDDFFVP

SEQ ID NO: 2944918 - protein, 24 aa, Entamoeba invadens
ISRKCVAVGEYFRKVTRIDDTYVF

SEQ ID NO: 2944919 - protein, 17 aa, Entamoeba invadens
ISRLLAATHRQQRVGDS

SEQ ID NO: 2944920 - protein, 24 aa, Entamoeba invadens
ISRNCVAVGEYFRKVTRIDDTYVF

SEQ ID NO: 2944921 - protein, 17 aa, Entamoeba invadens
ISRNDCYDLYYDRFNIE

SEQ ID NO: 2944922 - protein, 25 aa, Entamoeba invadens
ISRNFWVSGCRRGCKQMCFDSNGGA

SEQ ID NO: 2944923 - protein, 21 aa, Entamoeba invadens
ISRNRYEWYVSQFAAQKYGII

SEQ ID NO: 2944924 - protein, 26 aa, Entamoeba invadens
ISRNVPRLLWRVKYIQGDVSGAVREV

SEQ ID NO: 2944925 - protein, 17 aa, Entamoeba invadens
ISRRCDSEMKKWKDTVT

SEQ ID NO: 2944926 - protein, 26 aa, Entamoeba invadens
ISRRDCSRTGLRFSSRGGDINGNVSN

SEQ ID NO: 2944927 - protein, 24 aa, Entamoeba invadens
ISRSVLQLANKLYVAFDEKLEVYE

SEQ ID NO: 2944928 - protein, 26 aa, Entamoeba invadens
ISRVLKYKFCQDIAKAMEFLQSSQIV

SEQ ID NO: 2944929 - protein, 34 aa, Entamoeba invadens
ISSADFKAAQFSNGKWRSEWTVTLNGSKASIEGR

SEQ ID NO: 2944930 - protein, 17 aa, Entamoeba invadens
ISSAFSYDGEVFVSSCG

SEQ ID NO: 2944931 - protein, 18 aa, Entamoeba invadens
ISSALQWSEKGMGVGYIK

SEQ ID NO: 2944932 - protein, 29 aa, Entamoeba invadens
ISSASVLRLAFGLDFCYFEVCANQSNSAI

SEQ ID NO: 2944933 - protein, 26 aa, Entamoeba invadens
ISSAVERYDLFSGKVLDEAKRVIDQF

SEQ ID NO: 2944934 - protein, 23 aa, Entamoeba invadens
ISSDPNMTFSISFRTPAINDKGI

SEQ ID NO: 2944935 - protein, 17 aa, Entamoeba invadens
ISSELKLRNENENLERM

SEQ ID NO: 2944936 - protein, 18 aa, Entamoeba invadens
ISSEVIKPVTIYIKSGYY

SEQ ID NO: 2944937 - protein, 24 aa, Entamoeba invadens
ISSFDSLCFLSRLFFGCVDESFIG

SEQ ID NO: 2944938 - protein, 20 aa, Entamoeba invadens
ISSFIYLYPIFDNYKYYVRF

SEQ ID NO: 2944939 - protein, 18 aa, Entamoeba invadens
ISSFMLTKRNTFFNREQF

SEQ ID NO: 2944940 - protein, 33 aa, Entamoeba invadens
ISSFPIGINLMCKDIVKTKGFKKLKSLVEVMAY

SEQ ID NO: 2944941 - protein, 18 aa, Entamoeba invadens
ISSGCFYGCCNLGNIEIS

SEQ ID NO: 2944942 - protein, 22 aa, Entamoeba invadens
ISSGDFLFGAVVTKQVDKEDVY

SEQ ID NO: 2944943 - protein, 18 aa, Entamoeba invadens
ISSHGFGCRVIQRLIEKS

SEQ ID NO: 2944944 - protein, 17 aa, Entamoeba invadens
ISSIKMCLKRIKETSNS

SEQ ID NO: 2944945 - protein, 17 aa, Entamoeba invadens
ISSKIVFLNQIDNPSFI

SEQ ID NO: 2944946 - protein, 21 aa, Entamoeba invadens
ISSLKLFPFIETLHLYTRKDA

SEQ ID NO: 2944947 - protein, 20 aa, Entamoeba invadens
ISSLMFEYSYNFTDGKGVFD

SEQ ID NO: 2944948 - protein, 23 aa, Entamoeba invadens
ISSNRYEWYVSQFAMQRQGIVPV

SEQ ID NO: 2944949 - protein, 18 aa, Entamoeba invadens
ISSPKRFIFLRGNHESRA

SEQ ID NO: 2944950 - protein, 24 aa, Entamoeba invadens
ISSQKYAAWRGGAIIANTEAIAKV

SEQ ID NO: 2944951 - protein, 17 aa, Entamoeba invadens
ISSRFTKALFRDADQVT

SEQ ID NO: 2944952 - protein, 24 aa, Entamoeba invadens
ISSSFEILAGLVLTDEEFFEIKDQ

SEQ ID NO: 2944953 - protein, 27 aa, Entamoeba invadens
ISSSNCLRARALFWGLRERCKTVRRKT

SEQ ID NO: 2944954 - protein, 18 aa, Entamoeba invadens
ISSSVIIIGNYCFSGCKY

SEQ ID NO: 2944955 - protein, 24 aa, Entamoeba invadens
ISSTFCGTNFKFLSGVTKICSTFF

SEQ ID NO: 2944956 - protein, 17 aa, Entamoeba invadens
ISSVTTRVPYLSKRTYI

SEQ ID NO: 2944957 - protein, 25 aa, Entamoeba invadens
ISSYTLRDKLTWLIGKNGESLSVPK

SEQ ID NO: 2944958 - protein, 19 aa, Entamoeba invadens
ISTALLLPKFIEFKKNGDA

SEQ ID NO: 2944959 - protein, 36 aa, Entamoeba invadens
ISTAQSGKCLQFFPHPRPVTSVAFHPSEHIMATACG

SEQ ID NO: 2944960 - protein, 19 aa, Entamoeba invadens
ISTCFALAICRPVDQSDKE

SEQ ID NO: 2944961 - protein, 17 aa, Entamoeba invadens
ISTCGGFDHIESVEKDQ

SEQ ID NO: 2944962 - protein, 17 aa, Entamoeba invadens
ISTEMGIYLALISLDAK

SEQ ID NO: 2944963 - protein, 23 aa, Entamoeba invadens
ISTIIDAPMKWDCTNPQEFYFRR

SEQ ID NO: 2944964 - protein, 27 aa, Entamoeba invadens
ISTKMCCGYLLGAAMEFKAEEAYIDMD

SEQ ID NO: 2944965 - protein, 29 aa, Entamoeba invadens
ISTKRIVDVKMRFNFIEFKNSNPTSTMSW

SEQ ID NO: 2944966 - protein, 26 aa, Entamoeba invadens
ISTLCGTVSIGVCGSLLQALYSEELT

SEQ ID NO: 2944967 - protein, 24 aa, Entamoeba invadens
ISTLKPFVFDECRSSIEKNINEKE

SEQ ID NO: 2944968 - protein, 24 aa, Entamoeba invadens
ISTLKRWTPFESFERIYDSKSDKS

SEQ ID NO: 2944969 - protein, 17 aa, Entamoeba invadens
ISTQCFFACKMMITLEV

SEQ ID NO: 2944970 - protein, 29 aa, Entamoeba invadens
ISTQCFVNLFSVRGCDLISLNVNCCPTLN

SEQ ID NO: 2944971 - protein, 25 aa, Entamoeba invadens
ISTQCPCTFKNISVSLVDIYNKKIT

SEQ ID NO: 2944972 - protein, 28 aa, Entamoeba invadens
ISTVSFDEMMKWITLMDAIKNDAEHYQE

SEQ ID NO: 2944973 - protein, 17 aa, Entamoeba invadens
ISTYKAIYTYNSYEKRI

SEQ ID NO: 2944974 - protein, 20 aa, Entamoeba invadens
ISVAESYKAFTDKFSKSDVG

SEQ ID NO: 2944975 - protein, 25 aa, Entamoeba invadens
ISVARKDNWENIAFVQSFDSKNYFF

SEQ ID NO: 2944976 - protein, 27 aa, Entamoeba invadens
ISVDGCLRCYDLRKGLLTTDNINKPLT

SEQ ID NO: 2944977 - protein, 34 aa, Entamoeba invadens
ISVERCMWLYPVSFCKAMYFNPMVPDFLGERYRE

SEQ ID NO: 2944978 - protein, 18 aa, Entamoeba invadens
ISVEYVIKAFADSMEKDT

SEQ ID NO: 2944979 - protein, 25 aa, Entamoeba invadens
ISVFFGTDCVVCWVNKEVILRTKNV

SEQ ID NO: 2944980 - protein, 18 aa, Entamoeba invadens
ISVFSAFWMDKEGIISFN

SEQ ID NO: 2944981 - protein, 21 aa, Entamoeba invadens
ISVIWPCVHYLLTNYQNEDVI

SEQ ID NO: 2944982 - protein, 20 aa, Entamoeba invadens
ISVKMKIGVRDVFEKLLEIM

SEQ ID NO: 2944983 - protein, 24 aa, Entamoeba invadens
ISVKVLHPALVRKGVCDVLTILDA

SEQ ID NO: 2944984 - protein, 20 aa, Entamoeba invadens
ISVLCNGGIVPVKNAGRRCA

SEQ ID NO: 2944985 - protein, 24 aa, Entamoeba invadens
ISVLNNLRKSLGLNTFAFRPHCGE

SEQ ID NO: 2944986 - protein, 23 aa, Entamoeba invadens
ISVLPKETKLVIGVFQTEEQIGT

SEQ ID NO: 2944987 - protein, 18 aa, Entamoeba invadens
ISVLRTYRRLGVATKLLR

SEQ ID NO: 2944988 - protein, 25 aa, Entamoeba invadens
ISVLYKKGFLIKGIFRESQVASIRQ

SEQ ID NO: 2944989 - protein, 17 aa, Entamoeba invadens
ISVNHLGELCYIKENET

SEQ ID NO: 2944990 - protein, 17 aa, Entamoeba invadens
ISVRQSLWRAMLHIEDM

SEQ ID NO: 2944991 - protein, 21 aa, Entamoeba invadens
ISVRSIGKMCFKDCTDLKYIE

SEQ ID NO: 2944992 - protein, 24 aa, Entamoeba invadens
ISVVCKNFILGCLKMNCEKRLTAE

SEQ ID NO: 2944993 - protein, 18 aa, Entamoeba invadens
ISWYSRAGKYEVVNSLYN

SEQ ID NO: 2944994 - protein, 17 aa, Entamoeba invadens
ISYALLKYELRNINAPE

SEQ ID NO: 2944995 - protein, 17 aa, Entamoeba invadens
ISYFTDEYTRWMEEREK

SEQ ID NO: 2944996 - protein, 26 aa, Entamoeba invadens
ISYGACQFPTLGFVIDRYYQIKSFTK

SEQ ID NO: 2944997 - protein, 17 aa, Entamoeba invadens
ISYHYWDLGRYDLASHE

SEQ ID NO: 2944998 - protein, 26 aa, Entamoeba invadens
ISYIFPRFGDVGVEMAFKLEEMAVNI

SEQ ID NO: 2944999 - protein, 28 aa, Entamoeba invadens
ISYIIVGSLIKYVCVFPDDFVVDENGMC

SEQ ID NO: 2945000 - protein, 18 aa, Entamoeba invadens
ISYILKASFLNSSLRTFV

SEQ ID NO: 2945001 - protein, 20 aa, Entamoeba invadens
ISYLECPDLIALPKKCDIKK

SEQ ID NO: 2945002 - protein, 17 aa, Entamoeba invadens
ISYLEKLTRAIGVETPA

SEQ ID NO: 2945003 - protein, 36 aa, Entamoeba invadens
ISYMRVPFNSVFAMKGKLKEGASFKWYKKDQIIDKM

SEQ ID NO: 2945004 - protein, 26 aa, Entamoeba invadens
ISYSEMRIAYELSDKLKMNVFIGSNV

SEQ ID NO: 2945005 - protein, 25 aa, Entamoeba invadens
ISYSPLEEWKEATARLFDGKERNKE

SEQ ID NO: 2945006 - protein, 18 aa, Entamoeba invadens
ISYYPRTFYRFGKISEFS

SEQ ID NO: 2945007 - protein, 17 aa, Entamoeba invadens
ITAAMVTDLSYFINELK

SEQ ID NO: 2945008 - protein, 17 aa, Entamoeba invadens
ITAEILFTLSKYYKQIK

SEQ ID NO: 2945009 - protein, 19 aa, Entamoeba invadens
ITAGVDVLQFWNVFVKPKF

SEQ ID NO: 2945010 - protein, 24 aa, Entamoeba invadens
ITAICDGCGWGSASCLAAQSALHG

SEQ ID NO: 2945011 - protein, 17 aa, Entamoeba invadens
ITAIPMILLAPFGYSKN

SEQ ID NO: 2945012 - protein, 26 aa, Entamoeba invadens
ITAIYKSGLFFRFHNSNLRAFCHCSQ

SEQ ID NO: 2945013 - protein, 22 aa, Entamoeba invadens
ITAKVCNNSGCLQLNSVTVANP

SEQ ID NO: 2945014 - protein, 18 aa, Entamoeba invadens
ITAVEFRKCLERFGATSL

SEQ ID NO: 2945015 - protein, 18 aa, Entamoeba invadens
ITAWEIFYQQEPYKEFKS

SEQ ID NO: 2945016 - protein, 17 aa, Entamoeba invadens
ITCDEVIKELKIQGQPA

SEQ ID NO: 2945017 - protein, 18 aa, Entamoeba invadens
ITCGCGKYRFYREKLGEI

SEQ ID NO: 2945018 - protein, 25 aa, Entamoeba invadens
ITCKCGCIFCWTCGKDVTNDDTHFS

SEQ ID NO: 2945019 - protein, 17 aa, Entamoeba invadens
ITCKSQCEVFEYAEKFK

SEQ ID NO: 2945020 - protein, 19 aa, Entamoeba invadens
ITCLQIAQHYGIQFVIIKT

SEQ ID NO: 2945021 - protein, 17 aa, Entamoeba invadens
ITCPAYFNVSQRQATKD

SEQ ID NO: 2945022 - protein, 21 aa, Entamoeba invadens
ITCSECIKLVMKNVSTASERA

SEQ ID NO: 2945023 - protein, 25 aa, Entamoeba invadens
ITCSKVPSAFLFRLYNTTEEKIVDV

SEQ ID NO: 2945024 - protein, 30 aa, Entamoeba invadens
ITCSPDFSRKCKVCAIGFYPDETSGKCVAC

SEQ ID NO: 2945025 - protein, 18 aa, Entamoeba invadens
ITDAEFLSGTSYRLVNTG

SEQ ID NO: 2945026 - protein, 17 aa, Entamoeba invadens
ITDDTLLEIKPLSKKVG

SEQ ID NO: 2945027 - protein, 28 aa, Entamoeba invadens
ITDELFSHFDFFKSVEWQNTELYVSPLC

SEQ ID NO: 2945028 - protein, 20 aa, Entamoeba invadens
ITDFEMCFYFNISKASMKDG

SEQ ID NO: 2945029 - protein, 18 aa, Entamoeba invadens
ITDKAIQVFLQRTPNLNF

SEQ ID NO: 2945030 - protein, 24 aa, Entamoeba invadens
ITDKEATCSILFVFGKLICANPVA

SEQ ID NO: 2945031 - protein, 19 aa, Entamoeba invadens
ITDLRTGITKSFFNVDELK

SEQ ID NO: 2945032 - protein, 29 aa, Entamoeba invadens
ITDMRVVWVCWIFKMKDFRIERNNYFDVM

SEQ ID NO: 2945033 - protein, 21 aa, Entamoeba invadens
ITDPKRALATVAIKTLNALVC

SEQ ID NO: 2945034 - protein, 19 aa, Entamoeba invadens
ITDRASFDKVSSWFTEVRD

SEQ ID NO: 2945035 - protein, 22 aa, Entamoeba invadens
ITEAINALRMFLRQLPNNANFD

SEQ ID NO: 2945036 - protein, 18 aa, Entamoeba invadens
ITEANCKCRAELERSVGV

SEQ ID NO: 2945037 - protein, 17 aa, Entamoeba invadens
ITECTLLPKQIREDYEK

SEQ ID NO: 2945038 - protein, 17 aa, Entamoeba invadens
ITECVVDSITCENGIYE

SEQ ID NO: 2945039 - protein, 23 aa, Entamoeba invadens
ITEHTRARIIAMKDTDEVFLNPG

SEQ ID NO: 2945040 - protein, 17 aa, Entamoeba invadens
ITEKATRKFFAFSNPQS

SEQ ID NO: 2945041 - protein, 23 aa, Entamoeba invadens
ITEKHSSGWWFATNDKGQSGFVP

SEQ ID NO: 2945042 - protein, 20 aa, Entamoeba invadens
ITELGKYCFGRCTSLSKVRL

SEQ ID NO: 2945043 - protein, 22 aa, Entamoeba invadens
ITELNKCLDLEVAREDKFNKMK

SEQ ID NO: 2945044 - protein, 17 aa, Entamoeba invadens
ITELRRSLMSEIMKNSD

SEQ ID NO: 2945045 - protein, 25 aa, Entamoeba invadens
ITENFLKSLIFRFSDSLNKVTTVMP

SEQ ID NO: 2945046 - protein, 19 aa, Entamoeba invadens
ITEPFLLVLCSDQISVIQK

SEQ ID NO: 2945047 - protein, 24 aa, Entamoeba invadens
ITERISSDFSALVPPLQQNSSSSF

SEQ ID NO: 2945048 - protein, 19 aa, Entamoeba invadens
ITEVPSFCFDGCTNLLSIT

SEQ ID NO: 2945049 - protein, 22 aa, Entamoeba invadens
ITFDSFCLFVRLLEYLPPSTLS

SEQ ID NO: 2945050 - protein, 23 aa, Entamoeba invadens
ITFFKALCLMCHHVAQNSEKNLM

SEQ ID NO: 2945051 - protein, 20 aa, Entamoeba invadens
ITFLEIMKWEDAFPKEKFKM

SEQ ID NO: 2945052 - protein, 24 aa, Entamoeba invadens
ITFLRHLYDKCNYVGPHLVVVPLS

SEQ ID NO: 2945053 - protein, 17 aa, Entamoeba invadens
ITFLSIEIFFARRDPIL

SEQ ID NO: 2945054 - protein, 18 aa, Entamoeba invadens
ITFSCLTKIERMYLIQQL

SEQ ID NO: 2945055 - protein, 17 aa, Entamoeba invadens
ITFSSAYVPDKEYEDAK

SEQ ID NO: 2945056 - protein, 22 aa, Entamoeba invadens
ITFYKINVWFAVDYTFTQTHKT

SEQ ID NO: 2945057 - protein, 19 aa, Entamoeba invadens
ITGASGFVGRFVLRSVCEK

SEQ ID NO: 2945058 - protein, 27 aa, Entamoeba invadens
ITGDMKEGCSFGWYKADQIFERMAVKY

SEQ ID NO: 2945059 - protein, 25 aa, Entamoeba invadens
ITGEASLFLIKYFADGKHQFMENTF

SEQ ID NO: 2945060 - protein, 19 aa, Entamoeba invadens
ITGKFEFLSLSLPILVNLL

SEQ ID NO: 2945061 - protein, 25 aa, Entamoeba invadens
  misc_feature (20)..(21): Xaa can be any naturally occurring amino acid
ITGTSWPTCPLITFRNSPRXXQELK

SEQ ID NO: 2945062 - protein, 27 aa, Entamoeba invadens
ITGVLLRKKICALWIKLPPNVHDQITT

SEQ ID NO: 2945063 - protein, 25 aa, Entamoeba invadens
ITHDVLCPKCKGKGTKSGKELKKCQ

SEQ ID NO: 2945064 - protein, 29 aa, Entamoeba invadens
ITHIKGLEILKAVYLEPMMKVASKNDHEF

SEQ ID NO: 2945065 - protein, 17 aa, Entamoeba invadens
ITHISLPSAVSFLNGST

SEQ ID NO: 2945066 - protein, 17 aa, Entamoeba invadens
ITHRELSDLLSEYHPDI

SEQ ID NO: 2945067 - protein, 19 aa, Entamoeba invadens
ITHTLPILLDIIFGLYDVK

SEQ ID NO: 2945068 - protein, 21 aa, Entamoeba invadens
ITHYKFGVLYCQKDQTNEDDM

SEQ ID NO: 2945069 - protein, 30 aa, Entamoeba invadens
ITIASFDAAPCFPPDYSLRDVYLIETTEKL

SEQ ID NO: 2945070 - protein, 20 aa, Entamoeba invadens
ITIEGLFLMYLDLVGMEQIY

SEQ ID NO: 2945071 - protein, 18 aa, Entamoeba invadens
ITIEKILLVRECTLSLKD

SEQ ID NO: 2945072 - protein, 18 aa, Entamoeba invadens
ITIGVSVSRVGKEAFSDC

SEQ ID NO: 2945073 - protein, 26 aa, Entamoeba invadens
ITIHKRCCQNAFVANLYISAAFSNPR

SEQ ID NO: 2945074 - protein, 17 aa, Entamoeba invadens
ITIKMPFDEFIKFAVKI

SEQ ID NO: 2945075 - protein, 21 aa, Entamoeba invadens
ITIKNNFIWGTRFGIAYWGTS

SEQ ID NO: 2945076 - protein, 23 aa, Entamoeba invadens
ITILSKYSGIFLKKCCIDNYGFG

SEQ ID NO: 2945077 - protein, 17 aa, Entamoeba invadens
ITIPFSVTYIGDECFSE

SEQ ID NO: 2945078 - protein, 17 aa, Entamoeba invadens
ITIPLSVTLIGDWCFNK

SEQ ID NO: 2945079 - protein, 31 aa, Entamoeba invadens
ITIQEGVKFFGNYCFFKCLSLEEINFPQSVQ

SEQ ID NO: 2945080 - protein, 23 aa, Entamoeba invadens
ITIREMQRYILILEKIITKKNTT

SEQ ID NO: 2945081 - protein, 21 aa, Entamoeba invadens
ITIVLARRLHQFLTYYTKQPH

SEQ ID NO: 2945082 - protein, 18 aa, Entamoeba invadens
ITIYLMLTYKKWQLYDRK

SEQ ID NO: 2945083 - protein, 22 aa, Entamoeba invadens
ITKDVFFRVDIKYIEIPQNVEV

SEQ ID NO: 2945084 - protein, 19 aa, Entamoeba invadens
ITKEMARKMMGEEEVVEGD

SEQ ID NO: 2945085 - protein, 25 aa, Entamoeba invadens
ITKESSFKSIERWLSELKDNADPKI

SEQ ID NO: 2945086 - protein, 24 aa, Entamoeba invadens
ITKEYGVVVPLVLMNSFSTQVDTE

SEQ ID NO: 2945087 - protein, 23 aa, Entamoeba invadens
ITKEYPLRTGVLGGVTGAMYSNK

SEQ ID NO: 2945088 - protein, 24 aa, Entamoeba invadens
ITKHQKLMLIFMCVIRRVYLRFDT

SEQ ID NO: 2945089 - protein, 23 aa, Entamoeba invadens
ITKIDIIRYFGILLYMGAHHDIK

SEQ ID NO: 2945090 - protein, 24 aa, Entamoeba invadens
ITKIDIIRYFGILLYMGAHHDIKN

SEQ ID NO: 2945091 - protein, 25 aa, Entamoeba invadens
ITKIGNSMFKYCRNLSSITMKNVIE

SEQ ID NO: 2945092 - protein, 23 aa, Entamoeba invadens
ITKLESYGFCGMGSLEKLILPNA

SEQ ID NO: 2945093 - protein, 28 aa, Entamoeba invadens
ITKLQKMLIGFSICFDVLLNSLKGDGVL

SEQ ID NO: 2945094 - protein, 23 aa, Entamoeba invadens
ITKMELDAFLSVSISQANYQDTK

SEQ ID NO: 2945095 - protein, 25 aa, Entamoeba invadens
ITKPAIRRLARRGGVKRINGLVYEE

SEQ ID NO: 2945096 - protein, 17 aa, Entamoeba invadens
ITKSGKPMYCGKLKQRA

SEQ ID NO: 2945097 - protein, 17 aa, Entamoeba invadens
ITKSIWVQKKLNWNAKD

SEQ ID NO: 2945098 - protein, 18 aa, Entamoeba invadens
ITKSRWTVPNIVYRSIEF

SEQ ID NO: 2945099 - protein, 17 aa, Entamoeba invadens
ITKTVSMLQCDKMDQST

SEQ ID NO: 2945100 - protein, 17 aa, Entamoeba invadens
ITKVLGIVTDPFLEKDV

SEQ ID NO: 2945101 - protein, 18 aa, Entamoeba invadens
ITLCCCFCNVDIGINPLI

SEQ ID NO: 2945102 - protein, 18 aa, Entamoeba invadens
ITLCSRFWYKGINKNIII

SEQ ID NO: 2945103 - protein, 19 aa, Entamoeba invadens
ITLFPEYKDLFTGAELEKH

SEQ ID NO: 2945104 - protein, 18 aa, Entamoeba invadens
ITLIKTCFPQHSLSSIDI

SEQ ID NO: 2945105 - protein, 19 aa, Entamoeba invadens
ITLKDCVYFIKRFGTCNDI

SEQ ID NO: 2945106 - protein, 25 aa, Entamoeba invadens
ITLLCLKANYPKRVFLLRGNHESRQ

SEQ ID NO: 2945107 - protein, 40 aa, Entamoeba invadens
ITLLEVLTWVEPFPKEIYKFGWSIADLISIGKRPSTILKL

SEQ ID NO: 2945108 - protein, 25 aa, Entamoeba invadens
ITLNCGHTFCYTCDLQHAMRNGNKY

SEQ ID NO: 2945109 - protein, 18 aa, Entamoeba invadens
ITLPITINYVPPRCFNNC

SEQ ID NO: 2945110 - protein, 23 aa, Entamoeba invadens
ITLPLERNTFFFIPKILTPKQED

SEQ ID NO: 2945111 - protein, 22 aa, Entamoeba invadens
ITLPSVSVMDSFVRDVFERIAI

SEQ ID NO: 2945112 - protein, 20 aa, Entamoeba invadens
ITLQEFLKFFLPPQDKNTVP

SEQ ID NO: 2945113 - protein, 24 aa, Entamoeba invadens
ITLVRRNRGKFVFEKNNETFRNIL

SEQ ID NO: 2945114 - protein, 25 aa, Entamoeba invadens
ITMDRYEADWAMVERGWMTHVRGMV

SEQ ID NO: 2945115 - protein, 22 aa, Entamoeba invadens
ITMFECFGWCEAYPLDTFKYPW

SEQ ID NO: 2945116 - protein, 21 aa, Entamoeba invadens
ITMFECITWSYAYSKDKFKFP

SEQ ID NO: 2945117 - protein, 20 aa, Entamoeba invadens
ITMFECLNWVHAYPKQKFKF

SEQ ID NO: 2945118 - protein, 36 aa, Entamoeba invadens
ITMFETISWREAYIKNEFKFPWKIAEFVNDGKSLSK

SEQ ID NO: 2945119 - protein, 17 aa, Entamoeba invadens
ITMLCNVIAVCKKIANH

SEQ ID NO: 2945120 - protein, 19 aa, Entamoeba invadens
ITMLECFLWDNAFPKNVYV

SEQ ID NO: 2945121 - protein, 19 aa, Entamoeba invadens
ITMLECFLWSEAFPKSSYI

SEQ ID NO: 2945122 - protein, 19 aa, Entamoeba invadens
ITMLECFLWSEAFPKSTYI

SEQ ID NO: 2945123 - protein, 24 aa, Entamoeba invadens
ITMPSSFKAVEEWVNTMKQKGDAT

SEQ ID NO: 2945124 - protein, 26 aa, Entamoeba invadens
ITMPYACKLLFQEMQSMNVVPRLSFR

SEQ ID NO: 2945125 - protein, 17 aa, Entamoeba invadens
ITMRKWSYANGFNIKQT

SEQ ID NO: 2945126 - protein, 17 aa, Entamoeba invadens
ITMRLHSGMSPQAKEKQ

SEQ ID NO: 2945127 - protein, 17 aa, Entamoeba invadens
ITMWELFYEGYPFGERP

SEQ ID NO: 2945128 - protein, 18 aa, Entamoeba invadens
ITMWEVFYESAPFFEYQE

SEQ ID NO: 2945129 - protein, 19 aa, Entamoeba invadens
ITMYEIFIWGEAFPREMFR

SEQ ID NO: 2945130 - protein, 26 aa, Entamoeba invadens
ITMYEVMGWGEAYSVDIFRFPWTIAE

SEQ ID NO: 2945131 - protein, 24 aa, Entamoeba invadens
ITNCADKLFKDCSFVVKGTVHCSD

SEQ ID NO: 2945132 - protein, 21 aa, Entamoeba invadens
ITNCLGNICDLMVTNKQPMFY

SEQ ID NO: 2945133 - protein, 18 aa, Entamoeba invadens
ITNFFPDRVDTQVRDFLC

SEQ ID NO: 2945134 - protein, 17 aa, Entamoeba invadens
ITNFILINKSCFSVIQT

SEQ ID NO: 2945135 - protein, 24 aa, Entamoeba invadens
ITNKDRPMHMFSVFVPVEKKGVLY

SEQ ID NO: 2945136 - protein, 25 aa, Entamoeba invadens
ITNLKLFVRRCSKLFMNVKLPHELQ

SEQ ID NO: 2945137 - protein, 17 aa, Entamoeba invadens
ITNNFLLFSNKKIAKEQ

SEQ ID NO: 2945138 - protein, 19 aa, Entamoeba invadens
ITNPFPIALIHSSLSPHQD

SEQ ID NO: 2945139 - protein, 26 aa, Entamoeba invadens
ITNRDSFDYLQEWIDDVSMYCPQGVK

SEQ ID NO: 2945140 - protein, 28 aa, Entamoeba invadens
ITNSYRPIFNVPLSDVFFQAYLEKNQSI

SEQ ID NO: 2945141 - protein, 23 aa, Entamoeba invadens
ITNTLYLFRWVTLLFSQEFTIEN

SEQ ID NO: 2945142 - protein, 30 aa, Entamoeba invadens
ITPDNFFFFRLPRFTPFDGKLLEPYKNKFR

SEQ ID NO: 2945143 - protein, 17 aa, Entamoeba invadens
ITPEFLLTHMIKKHPSE

SEQ ID NO: 2945144 - protein, 24 aa, Entamoeba invadens
ITPFFEVIDEAFLMKKSGTCVKAI

SEQ ID NO: 2945145 - protein, 18 aa, Entamoeba invadens
ITPFLPLNFLKLNENNSK

SEQ ID NO: 2945146 - protein, 18 aa, Entamoeba invadens
ITPICVKGELAFMTEGLK

SEQ ID NO: 2945147 - protein, 17 aa, Entamoeba invadens
ITPIIPIINENKESPLI

SEQ ID NO: 2945148 - protein, 26 aa, Entamoeba invadens
ITPKIYRFRHFVIKLTIDPSFGIQYT

SEQ ID NO: 2945149 - protein, 25 aa, Entamoeba invadens
ITPKNLFCSEIGFLSANLYATTVFG

SEQ ID NO: 2945150 - protein, 17 aa, Entamoeba invadens
ITPLHAFSSGEYDPIYP

SEQ ID NO: 2945151 - protein, 23 aa, Entamoeba invadens
ITPLINCLPVFKLNFSENEIVEI

SEQ ID NO: 2945152 - protein, 25 aa, Entamoeba invadens
ITPNKRPGFMEIYKRLEEVRAKSVA

SEQ ID NO: 2945153 - protein, 25 aa, Entamoeba invadens
ITPRKRGRLELMYGKEMQEESYTEK

SEQ ID NO: 2945154 - protein, 25 aa, Entamoeba invadens
ITPRRMCTLYWDYAIRRKWDSFYTV

SEQ ID NO: 2945155 - protein, 26 aa, Entamoeba invadens
ITPTVMFCDSIGFLSANFYAKNLFDE

SEQ ID NO: 2945156 - protein, 27 aa, Entamoeba invadens
ITPTYCLSCPPGFYISNNICKTNSELV

SEQ ID NO: 2945157 - protein, 18 aa, Entamoeba invadens
ITQDLARSFIETPRRHAP

SEQ ID NO: 2945158 - protein, 17 aa, Entamoeba invadens
ITQEIYDSNVLVARVVS

SEQ ID NO: 2945159 - protein, 24 aa, Entamoeba invadens
ITQFCKELAKAQPICKDRRTADDM

SEQ ID NO: 2945160 - protein, 25 aa, Entamoeba invadens
ITQFFRFEHFVLVELYLQLGPPLKV

SEQ ID NO: 2945161 - protein, 18 aa, Entamoeba invadens
ITQIFPKSLLLAILSQAH

SEQ ID NO: 2945162 - protein, 23 aa, Entamoeba invadens
ITQKCWGHVLVPLLNAIEIRSVE

SEQ ID NO: 2945163 - protein, 17 aa, Entamoeba invadens
ITQKLSEAFYRPTTPSS

SEQ ID NO: 2945164 - protein, 30 aa, Entamoeba invadens
ITQNFLLKCPDLFRLASHFVNLPNFQFSSG

SEQ ID NO: 2945165 - protein, 23 aa, Entamoeba invadens
ITQRNGFKNVKICETKKNTIPGG

SEQ ID NO: 2945166 - protein, 28 aa, Entamoeba invadens
ITQSCYLQFPTVCKFESSRYVHVSLDQN

SEQ ID NO: 2945167 - protein, 22 aa, Entamoeba invadens
ITRRRNCLAPTMSEETQLVDQN

SEQ ID NO: 2945168 - protein, 20 aa, Entamoeba invadens
ITRSLPLYLSIYVFGESNNE

SEQ ID NO: 2945169 - protein, 24 aa, Entamoeba invadens
ITRSMLNSRIEIWKKDAELDDALF

SEQ ID NO: 2945170 - protein, 23 aa, Entamoeba invadens
ITSCPQCVYALPPSIRGTWWFPL

SEQ ID NO: 2945171 - protein, 21 aa, Entamoeba invadens
ITSDCFRACSLLNDIQFPSSL

SEQ ID NO: 2945172 - protein, 18 aa, Entamoeba invadens
ITSDFCFFERYVKGNPQA

SEQ ID NO: 2945173 - protein, 27 aa, Entamoeba invadens
ITSEDPTLLKHCMIVLKKMVEKYNSVF

SEQ ID NO: 2945174 - protein, 29 aa, Entamoeba invadens
ITSELLCAFPKEWRLDDINGEIFSVFAQN

SEQ ID NO: 2945175 - protein, 32 aa, Entamoeba invadens
ITSELLCAFPKEWRLDDINGEIFSVFAQNIRT

SEQ ID NO: 2945176 - protein, 20 aa, Entamoeba invadens
ITSEMTWYFESTKSMTNVYQ

SEQ ID NO: 2945177 - protein, 20 aa, Entamoeba invadens
ITSEMTWYFESTKSVTNVYQ

SEQ ID NO: 2945178 - protein, 26 aa, Entamoeba invadens
ITSGCFKGCLSLDVVVPNTIITVQKN

SEQ ID NO: 2945179 - protein, 23 aa, Entamoeba invadens
ITSIGIFLWKFWSVYDKAVEEGI

SEQ ID NO: 2945180 - protein, 26 aa, Entamoeba invadens
ITSIKEVKRILGVAFKDDSIVNIKSN

SEQ ID NO: 2945181 - protein, 19 aa, Entamoeba invadens
ITSKFAFDVIQILPSNLLF

SEQ ID NO: 2945182 - protein, 19 aa, Entamoeba invadens
ITSLCSFSSNFLPKSVKQL

SEQ ID NO: 2945183 - protein, 19 aa, Entamoeba invadens
ITSLCYILLHGLCEDNTKC

SEQ ID NO: 2945184 - protein, 27 aa, Entamoeba invadens
ITSLFETEWFPPRVRYIHIFKKEIPTF

SEQ ID NO: 2945185 - protein, 25 aa, Entamoeba invadens
ITSLKALLLRGCDNLNSLPSFPNLK

SEQ ID NO: 2945186 - protein, 17 aa, Entamoeba invadens
ITSLKFSKKCVSIMTSA

SEQ ID NO: 2945187 - protein, 27 aa, Entamoeba invadens
ITSLPAYFFKNCVSLTLDNINGFNQVN

SEQ ID NO: 2945188 - protein, 19 aa, Entamoeba invadens
ITSLPLIEKEVDCCEASLK

SEQ ID NO: 2945189 - protein, 24 aa, Entamoeba invadens
ITSLTLKLTIRWLVSGRANGITGY

SEQ ID NO: 2945190 - protein, 28 aa, Entamoeba invadens
ITSLWRKKLPVKYPTSFVILDEQNALVV

SEQ ID NO: 2945191 - protein, 19 aa, Entamoeba invadens
ITSPFPYILGLLASFRADA

SEQ ID NO: 2945192 - protein, 26 aa, Entamoeba invadens
ITSPKFRISSSISYIGHFVPDNEYDP

SEQ ID NO: 2945193 - protein, 23 aa, Entamoeba invadens
ITSQEMMNTLVLTNYVVQYSQVF

SEQ ID NO: 2945194 - protein, 19 aa, Entamoeba invadens
ITSRLSFEKVEEWYNTVQK

SEQ ID NO: 2945195 - protein, 23 aa, Entamoeba invadens
ITSSFLKRDPVMFQELEIPNEKI

SEQ ID NO: 2945196 - protein, 23 aa, Entamoeba invadens
ITSTDLLDLFAFLLSLLSNEAIA

SEQ ID NO: 2945197 - protein, 19 aa, Entamoeba invadens
ITSTMAISILKGAAAAAKK

SEQ ID NO: 2945198 - protein, 24 aa, Entamoeba invadens
ITSYKRSGVVGVNIGKIKRMFVSI

SEQ ID NO: 2945199 - protein, 18 aa, Entamoeba invadens
ITTALELLPFYPKLYESI

SEQ ID NO: 2945200 - protein, 22 aa, Entamoeba invadens
ITTATCGLFFMISGTTYLKTEH

SEQ ID NO: 2945201 - protein, 17 aa, Entamoeba invadens
ITTEFGVITVDEQTIAC

SEQ ID NO: 2945202 - protein, 23 aa, Entamoeba invadens
ITTEPYIKWDYDFRIQKIGNHYR

SEQ ID NO: 2945203 - protein, 26 aa, Entamoeba invadens
ITTFSLKCHTCKKLIKNSYNYIPPKP

SEQ ID NO: 2945204 - protein, 24 aa, Entamoeba invadens
ITTHKFKIVVFTGSIAPGIPSNIF

SEQ ID NO: 2945205 - protein, 25 aa, Entamoeba invadens
ITTILRLVGLLSGRTIQQITTRANW

SEQ ID NO: 2945206 - protein, 17 aa, Entamoeba invadens
ITTIMALANDSFPNAKR

SEQ ID NO: 2945207 - protein, 17 aa, Entamoeba invadens
ITTKFGFKVVTQKLCML

SEQ ID NO: 2945208 - protein, 23 aa, Entamoeba invadens
ITTPEFGRLQPFEDVTCELFEET

SEQ ID NO: 2945209 - protein, 19 aa, Entamoeba invadens
ITTPMCFAEMKKLMKGSQA

SEQ ID NO: 2945210 - protein, 21 aa, Entamoeba invadens
ITTQLKLGRFVQPYNPSIEDT

SEQ ID NO: 2945211 - protein, 18 aa, Entamoeba invadens
ITTSFNWLSEMLSKMING

SEQ ID NO: 2945212 - protein, 20 aa, Entamoeba invadens
ITTSIIIFCQLIRAVKYLHS

SEQ ID NO: 2945213 - protein, 26 aa, Entamoeba invadens
ITTSLLFEFIWPPAYGDRIDTKELVD

SEQ ID NO: 2945214 - protein, 24 aa, Entamoeba invadens
ITTTLLKKACRSIGVKRWPYRKIL

SEQ ID NO: 2945215 - protein, 19 aa, Entamoeba invadens
ITTVMAFSVVDGKILMSVY

SEQ ID NO: 2945216 - protein, 20 aa, Entamoeba invadens
ITVAPKDNWEKINFVKENGE

SEQ ID NO: 2945217 - protein, 30 aa, Entamoeba invadens
ITVDCVSFIFDVLSRWLLSYGKNLFSVHLI

SEQ ID NO: 2945218 - protein, 20 aa, Entamoeba invadens
ITVDPIAKSRAKTISRNRMT

SEQ ID NO: 2945219 - protein, 19 aa, Entamoeba invadens
ITVHDILKGIDIERDSTEK

SEQ ID NO: 2945220 - protein, 28 aa, Entamoeba invadens
ITVIPKYCFSNSVLREFVVPQSVREIGK

SEQ ID NO: 2945221 - protein, 27 aa, Entamoeba invadens
ITVKDGVEFTLKCNYDTFIEASNVGAF

SEQ ID NO: 2945222 - protein, 19 aa, Entamoeba invadens
ITVKSRFLFIKSESLKFFN

SEQ ID NO: 2945223 - protein, 19 aa, Entamoeba invadens
ITVNFEFEAKCLGNIHHLE

SEQ ID NO: 2945224 - protein, 23 aa, Entamoeba invadens
ITVPGVKVVINFGMEKVMQFDPL

SEQ ID NO: 2945225 - protein, 24 aa, Entamoeba invadens
ITVPINCTLFLKKKEGYDEKGMEV

SEQ ID NO: 2945226 - protein, 21 aa, Entamoeba invadens
ITVRDFLSRGLSFVINETIEG

SEQ ID NO: 2945227 - protein, 21 aa, Entamoeba invadens
ITVRNNFIWGSMFGIAYWGWS

SEQ ID NO: 2945228 - protein, 21 aa, Entamoeba invadens
ITWFDCACAVIFPETFDNTIL

SEQ ID NO: 2945229 - protein, 27 aa, Entamoeba invadens
ITYADAFPKLFEVLNIIRVVKSPLLKE

SEQ ID NO: 2945230 - protein, 25 aa, Entamoeba invadens
ITYKLCGSSITVKWTVTNPSSDKPL

SEQ ID NO: 2945231 - protein, 17 aa, Entamoeba invadens
ITYSFTVNEEADKKERL

SEQ ID NO: 2945232 - protein, 18 aa, Entamoeba invadens
ITYTWKEMVESIKSMIKD

SEQ ID NO: 2945233 - protein, 20 aa, Entamoeba invadens
ITYVEFRFAPIQCIIQGLTY

SEQ ID NO: 2945234 - protein, 21 aa, Entamoeba invadens
IVACLVKFKCEVNVVNQEQKT

SEQ ID NO: 2945235 - protein, 17 aa, Entamoeba invadens
IVAEECLEIDFSKQIMT

SEQ ID NO: 2945236 - protein, 25 aa, Entamoeba invadens
IVAFFKACVIVPFRAILTEYVANGT

SEQ ID NO: 2945237 - protein, 23 aa, Entamoeba invadens
IVAIGRECFRNCSALKKVEIPFK

SEQ ID NO: 2945238 - protein, 26 aa, Entamoeba invadens
IVAIKAIQLVKEWSEFSEMFPYNDLL

SEQ ID NO: 2945239 - protein, 21 aa, Entamoeba invadens
IVAKLSGKKALRYSLTANTPF

SEQ ID NO: 2945240 - protein, 31 aa, Entamoeba invadens
IVAPGRLKIMNFVRMWMKNAWKDFEGKEDLI

SEQ ID NO: 2945241 - protein, 19 aa, Entamoeba invadens
IVAPLMLFPPYNFYMCFTL

SEQ ID NO: 2945242 - protein, 20 aa, Entamoeba invadens
IVAPTVTVPLFFDNKESPCF

SEQ ID NO: 2945243 - protein, 26 aa, Entamoeba invadens
IVASFKRSGVVGVNIGKIKRMFVSIK

SEQ ID NO: 2945244 - protein, 21 aa, Entamoeba invadens
IVASWSRKGGDKGSVLTGTVI

SEQ ID NO: 2945245 - protein, 25 aa, Entamoeba invadens
IVAYPTHNFHFFIAAAIVMVQHENI

SEQ ID NO: 2945246 - protein, 23 aa, Entamoeba invadens
IVCDSCFDEGYFTDDFGQATLSA

SEQ ID NO: 2945247 - protein, 27 aa, Entamoeba invadens
IVCLCGQKFCFKCLGEFHAPATCQQVQ

SEQ ID NO: 2945248 - protein, 23 aa, Entamoeba invadens
IVCSCARVTLRLIKETIRMNDLK

SEQ ID NO: 2945249 - protein, 25 aa, Entamoeba invadens
IVCWYSRKDKVIGFIINGINLGPAF

SEQ ID NO: 2945250 - protein, 25 aa, Entamoeba invadens
IVDAFNIIFKKGFDKKVALEFYDKV

SEQ ID NO: 2945251 - protein, 19 aa, Entamoeba invadens
IVDCECVKDSIVQTQVGGR

SEQ ID NO: 2945252 - protein, 18 aa, Entamoeba invadens
IVDEECLLHFEVSIEGSP

SEQ ID NO: 2945253 - protein, 17 aa, Entamoeba invadens
IVDFMKLEYVNFFCNEN

SEQ ID NO: 2945254 - protein, 24 aa, Entamoeba invadens
IVDGDGIRNFRFVNNLYGVVNRLK

SEQ ID NO: 2945255 - protein, 20 aa, Entamoeba invadens
IVDGLECLSSLVQLTSLDLS

SEQ ID NO: 2945256 - protein, 18 aa, Entamoeba invadens
IVDIKLLLITDVEKAANE

SEQ ID NO: 2945257 - protein, 25 aa, Entamoeba invadens
IVDIPFSGLVSFKYPCDDDLIPESV

SEQ ID NO: 2945258 - protein, 23 aa, Entamoeba invadens
IVDIPYTLIWDIRVIVQSIRETS

SEQ ID NO: 2945259 - protein, 27 aa, Entamoeba invadens
IVDIREFRCELPFQLFKSGFKLIPKQI

SEQ ID NO: 2945260 - protein, 21 aa, Entamoeba invadens
IVDLFEFFAVNSFKEMEFVVL

SEQ ID NO: 2945261 - protein, 17 aa, Entamoeba invadens
IVDLLFIKATNIFIETK

SEQ ID NO: 2945262 - protein, 19 aa, Entamoeba invadens
IVDLTLKYLPLLGQHFRDD

SEQ ID NO: 2945263 - protein, 19 aa, Entamoeba invadens
IVDLVKDYNMSTGINGKYQ

SEQ ID NO: 2945264 - protein, 17 aa, Entamoeba invadens
IVDSCLSGSAATLFAYG

SEQ ID NO: 2945265 - protein, 22 aa, Entamoeba invadens
IVDTGVKVIRVFGKGRESENEP

SEQ ID NO: 2945266 - protein, 17 aa, Entamoeba invadens
IVDYKFYLQMNALGYTF

SEQ ID NO: 2945267 - protein, 23 aa, Entamoeba invadens
IVEALRSTSPVGIRTSQIRKQRS

SEQ ID NO: 2945268 - protein, 19 aa, Entamoeba invadens
IVECIKAEEVPKCDCEVAV

SEQ ID NO: 2945269 - protein, 21 aa, Entamoeba invadens
IVEDIIYEWGYTVRYEGENRE

SEQ ID NO: 2945270 - protein, 28 aa, Entamoeba invadens
IVEDLKRVFQLIFDRVPESFTHHLDHSK

SEQ ID NO: 2945271 - protein, 17 aa, Entamoeba invadens
IVEEMWRAIMIKYDQIY

SEQ ID NO: 2945272 - protein, 22 aa, Entamoeba invadens
IVEFTANPLVHFFQTVSKKNSL

SEQ ID NO: 2945273 - protein, 17 aa, Entamoeba invadens
IVEGQGITEPNDEDDNI

SEQ ID NO: 2945274 - protein, 25 aa, Entamoeba invadens
IVEILKRGGKCLIPVFSLGRAQEFE

SEQ ID NO: 2945275 - protein, 23 aa, Entamoeba invadens
IVEISEEPFLRVVDNDIINGALM

SEQ ID NO: 2945276 - protein, 24 aa, Entamoeba invadens
IVEIYKFWRDMILTGQVNELLETI

SEQ ID NO: 2945277 - protein, 17 aa, Entamoeba invadens
IVEKAGHELVLLENYKK

SEQ ID NO: 2945278 - protein, 19 aa, Entamoeba invadens
IVEKEPKVDDALDEMRSQI

SEQ ID NO: 2945279 - protein, 18 aa, Entamoeba invadens
IVEKLLGFLKQIDEAPED

SEQ ID NO: 2945280 - protein, 19 aa, Entamoeba invadens
IVELESLRCLFSKKEKFEL

SEQ ID NO: 2945281 - protein, 21 aa, Entamoeba invadens
IVELYQKYCRVYNISPKEEKY

SEQ ID NO: 2945282 - protein, 25 aa, Entamoeba invadens
IVEMSDGFVGHSIVESGFYNFQKTH

SEQ ID NO: 2945283 - protein, 18 aa, Entamoeba invadens
IVENGGVILNLFNTKRVN

SEQ ID NO: 2945284 - protein, 19 aa, Entamoeba invadens
IVEPFPYFCLKNVYEETGK

SEQ ID NO: 2945285 - protein, 19 aa, Entamoeba invadens
IVEPITLSLIYDFDFKSSR

SEQ ID NO: 2945286 - protein, 24 aa, Entamoeba invadens
IVEQLKLTINEKVDLEKTIENQKE

SEQ ID NO: 2945287 - protein, 23 aa, Entamoeba invadens
IVEQLKLTTNEKVELEKTIENQN

SEQ ID NO: 2945288 - protein, 21 aa, Entamoeba invadens
IVEQMPVLKSFPVEKPQVVIH

SEQ ID NO: 2945289 - protein, 17 aa, Entamoeba invadens
IVESEIIPDSIARNVSS

SEQ ID NO: 2945290 - protein, 19 aa, Entamoeba invadens
IVESIGCINYTYGLGNYNR

SEQ ID NO: 2945291 - protein, 18 aa, Entamoeba invadens
IVESVAFRHCEALKSIIF

SEQ ID NO: 2945292 - protein, 18 aa, Entamoeba invadens
IVETPEFMPISFNAEEVN

SEQ ID NO: 2945293 - protein, 26 aa, Entamoeba invadens
IVEVFKRKCVYKFIHIPIQSGSTQVL

SEQ ID NO: 2945294 - protein, 25 aa, Entamoeba invadens
IVEYIKKNGAEHFLKKVPEDIRVEM

SEQ ID NO: 2945295 - protein, 25 aa, Entamoeba invadens
IVFDFGMKRIDAITLGRGTSNPDPS

SEQ ID NO: 2945296 - protein, 17 aa, Entamoeba invadens
IVFDPVYHESLLLIAAK

SEQ ID NO: 2945297 - protein, 29 aa, Entamoeba invadens
IVFGGKLSQFVIRFVLDRIRLGRENLLYL

SEQ ID NO: 2945298 - protein, 18 aa, Entamoeba invadens
IVFVSPMFHPNIYTNGSI

SEQ ID NO: 2945299 - protein, 22 aa, Entamoeba invadens
IVGCLRSLRVGRIIQLHDEVQG

SEQ ID NO: 2945300 - protein, 24 aa, Entamoeba invadens
IVGDYSAVLPFCYDGMPNRYRDPA

SEQ ID NO: 2945301 - protein, 23 aa, Entamoeba invadens
IVGGFLYPSCVRINHKNQLLILD

SEQ ID NO: 2945302 - protein, 18 aa, Entamoeba invadens
IVGMCLVLASGRSNTVFN

SEQ ID NO: 2945303 - protein, 19 aa, Entamoeba invadens
IVGPFKLLFKRETAAMNSV

SEQ ID NO: 2945304 - protein, 17 aa, Entamoeba invadens
IVGRGGFSVVYKALHKA

SEQ ID NO: 2945305 - protein, 17 aa, Entamoeba invadens
IVGTLEFLRGCDLDSFL

SEQ ID NO: 2945306 - protein, 25 aa, Entamoeba invadens
IVGVACFDFDCFVVFKHPDAISQIE

SEQ ID NO: 2945307 - protein, 26 aa, Entamoeba invadens
IVGVFPEVFEKLVFANVLMPETEIIE

SEQ ID NO: 2945308 - protein, 24 aa, Entamoeba invadens
IVGVKFFISTCVTMFKLINFSDKT

SEQ ID NO: 2945309 - protein, 18 aa, Entamoeba invadens
IVHEKIPRFDFYSRVMNL

SEQ ID NO: 2945310 - protein, 20 aa, Entamoeba invadens
IVHFLRWTNEFEDMDYFEAK

SEQ ID NO: 2945311 - protein, 23 aa, Entamoeba invadens
IVHKDLKKYVVVEGLNDYIVADT

SEQ ID NO: 2945312 - protein, 19 aa, Entamoeba invadens
IVHLNAWRRNIPLIVDIID

SEQ ID NO: 2945313 - protein, 24 aa, Entamoeba invadens
IVHQRVCIMDCVIPLDKKYIEVRM

SEQ ID NO: 2945314 - protein, 17 aa, Entamoeba invadens
IVHRDIKPSNFLIKDNK

SEQ ID NO: 2945315 - protein, 24 aa, Entamoeba invadens
IVHWFKTEFFHWVEDYCLECGSKD

SEQ ID NO: 2945316 - protein, 19 aa, Entamoeba invadens
IVICNRWVERGVTLFWKYF

SEQ ID NO: 2945317 - protein, 18 aa, Entamoeba invadens
IVIFSCKALDTLLFESAK

SEQ ID NO: 2945318 - protein, 24 aa, Entamoeba invadens
IVIGLKGLKLFVYQLNTSVINETI

SEQ ID NO: 2945319 - protein, 17 aa, Entamoeba invadens
IVILSGGMKGFVLKHKE

SEQ ID NO: 2945320 - protein, 17 aa, Entamoeba invadens
IVIMLSLVFSTPKLVFL

SEQ ID NO: 2945321 - protein, 23 aa, Entamoeba invadens
IVIPEQITDIGIYAFYKCGNLKE

SEQ ID NO: 2945322 - protein, 34 aa, Entamoeba invadens
IVIPKSVSFIGRFCFFNCGFVHFSEINLKVNTLS

SEQ ID NO: 2945323 - protein, 18 aa, Entamoeba invadens
IVIPNEFLNSSILDHLML

SEQ ID NO: 2945324 - protein, 25 aa, Entamoeba invadens
IVIPRGVKKIGSFAFWRCQQLKEII

SEQ ID NO: 2945325 - protein, 26 aa, Entamoeba invadens
IVIPRGVKKIGSFAFWRCQQLKEIIL

SEQ ID NO: 2945326 - protein, 18 aa, Entamoeba invadens
IVISGLPDGPFYSAPFVL

SEQ ID NO: 2945327 - protein, 18 aa, Entamoeba invadens
IVISKNCKSKNNLMYFIA

SEQ ID NO: 2945328 - protein, 24 aa, Entamoeba invadens
IVIYKTAYSYSLRSFYEMFQSIRK

SEQ ID NO: 2945329 - protein, 17 aa, Entamoeba invadens
IVKCCTRNIIPKLIEKV

SEQ ID NO: 2945330 - protein, 17 aa, Entamoeba invadens
IVKCLFNAGQIRMAYIA

SEQ ID NO: 2945331 - protein, 17 aa, Entamoeba invadens
IVKDPKCLNVIYRGHTS

SEQ ID NO: 2945332 - protein, 22 aa, Entamoeba invadens
IVKFIECLNGSYFKYIVMEYVE

SEQ ID NO: 2945333 - protein, 17 aa, Entamoeba invadens
IVKHFKIDWNEDARELL

SEQ ID NO: 2945334 - protein, 25 aa, Entamoeba invadens
IVKKVFEDYSYPEILERIGNNTIEP

SEQ ID NO: 2945335 - protein, 17 aa, Entamoeba invadens
IVKLHNWEYKPKSNEKT

SEQ ID NO: 2945336 - protein, 29 aa, Entamoeba invadens
IVKLPRFLVEIGDYCFFNCVALEEVELPE

SEQ ID NO: 2945337 - protein, 23 aa, Entamoeba invadens
IVKNGEKWIGLTFSPAGTTQMII

SEQ ID NO: 2945338 - protein, 24 aa, Entamoeba invadens
IVKQFSTDVFDEFFQYKQCQKLEV

SEQ ID NO: 2945339 - protein, 21 aa, Entamoeba invadens
IVKTILCEKCEKVFRKKCEEI

SEQ ID NO: 2945340 - protein, 23 aa, Entamoeba invadens
IVKTPPCIFGMRLESLNRLPRPI

SEQ ID NO: 2945341 - protein, 22 aa, Entamoeba invadens
IVKTSMKAFVIRKKLVSGKTVE

SEQ ID NO: 2945342 - protein, 24 aa, Entamoeba invadens
IVKYIKHQCFSRHGDDLVVNKQIF

SEQ ID NO: 2945343 - protein, 18 aa, Entamoeba invadens
IVKYKLPKTYLKNQYCVA

SEQ ID NO: 2945344 - protein, 25 aa, Entamoeba invadens
IVKYPKFLIPKYFACVMKKVYQSLI

SEQ ID NO: 2945345 - protein, 18 aa, Entamoeba invadens
IVKYSLALVKDAFGNYVV

SEQ ID NO: 2945346 - protein, 25 aa, Entamoeba invadens
IVLALECIHSMGIIHRDIKPDNILI

SEQ ID NO: 2945347 - protein, 32 aa, Entamoeba invadens
IVLDCGHSFCDSCFAIWCKKFSYCPSCKKPID

SEQ ID NO: 2945348 - protein, 17 aa, Entamoeba invadens
IVLDCSNTVKGFYEKCG

SEQ ID NO: 2945349 - protein, 19 aa, Entamoeba invadens
IVLFRSAHMIEECLQLALR

SEQ ID NO: 2945350 - protein, 23 aa, Entamoeba invadens
IVLKGEILFEKTIMVNIHKIFKF

SEQ ID NO: 2945351 - protein, 17 aa, Entamoeba invadens
IVLKGTEMALPFNEVMH

SEQ ID NO: 2945352 - protein, 17 aa, Entamoeba invadens
IVLKWKDTMFNIFGNAG

SEQ ID NO: 2945353 - protein, 34 aa, Entamoeba invadens
IVLKYMFDNCWPKAIELLTSMGRLIDVVRMLLYT

SEQ ID NO: 2945354 - protein, 17 aa, Entamoeba invadens
IVLLAVGSNDFWDVGVL

SEQ ID NO: 2945355 - protein, 17 aa, Entamoeba invadens
IVLLGSGSVGKSAIATR

SEQ ID NO: 2945356 - protein, 20 aa, Entamoeba invadens
IVLLIGLWVVAYIEEKNKTR

SEQ ID NO: 2945357 - protein, 17 aa, Entamoeba invadens
IVLPLPKLIAAKEVKKE

SEQ ID NO: 2945358 - protein, 17 aa, Entamoeba invadens
IVLPNSIKKIGLGCFRF

SEQ ID NO: 2945359 - protein, 17 aa, Entamoeba invadens
IVLPRFLSAVNPFKEFT

SEQ ID NO: 2945360 - protein, 25 aa, Entamoeba invadens
IVLQFKRLKTLIVVETHKEEYLRKQ

SEQ ID NO: 2945361 - protein, 24 aa, Entamoeba invadens
IVLRDLRGEGVIAFVEEVSIGLID

SEQ ID NO: 2945362 - protein, 28 aa, Entamoeba invadens
IVLRFLENFRLWIGLRRFNVLFDESILS

SEQ ID NO: 2945363 - protein, 26 aa, Entamoeba invadens
IVLRFNTDFRMAVNFIQINKKCQDVV

SEQ ID NO: 2945364 - protein, 18 aa, Entamoeba invadens
IVLRFSFNSKVVKLPCGA

SEQ ID NO: 2945365 - protein, 22 aa, Entamoeba invadens
IVLRRKVGMILRIINLSFLFDQ

SEQ ID NO: 2945366 - protein, 17 aa, Entamoeba invadens
IVLSRYPLFQSRYNIPI

SEQ ID NO: 2945367 - protein, 17 aa, Entamoeba invadens
IVLVGGMTRMPLIQQTV

SEQ ID NO: 2945368 - protein, 20 aa, Entamoeba invadens
IVLYCGNPVLEIYPYEAKEA

SEQ ID NO: 2945369 - protein, 31 aa, Entamoeba invadens
IVLYKFLFTRRSHLNWARFDKWENDMIKKQS

SEQ ID NO: 2945370 - protein, 27 aa, Entamoeba invadens
IVMACRVQLPLAYAWALSIHKSQGLTL

SEQ ID NO: 2945371 - protein, 17 aa, Entamoeba invadens
IVMECAIQYFSANPVAL

SEQ ID NO: 2945372 - protein, 18 aa, Entamoeba invadens
IVMEICGAGSVSDIMHIL

SEQ ID NO: 2945373 - protein, 18 aa, Entamoeba invadens
IVMGCFKVNVGEDKVTEV

SEQ ID NO: 2945374 - protein, 24 aa, Entamoeba invadens
IVMKDIPLELVHDIAQLKIPKGVL

SEQ ID NO: 2945375 - protein, 19 aa, Entamoeba invadens
IVMPECLTEFNLNVFCKCK

SEQ ID NO: 2945376 - protein, 20 aa, Entamoeba invadens
IVMPELDSFFMLKKMILEMI

SEQ ID NO: 2945377 - protein, 18 aa, Entamoeba invadens
IVNCTTDGAATCAGLDGG

SEQ ID NO: 2945378 - protein, 23 aa, Entamoeba invadens
IVNDLMKREWGMIIFDEVQSAPT

SEQ ID NO: 2945379 - protein, 19 aa, Entamoeba invadens
IVNDNLKFVKPEWIYLCVN

SEQ ID NO: 2945380 - protein, 18 aa, Entamoeba invadens
IVNEAFPVCLPRVQDILD

SEQ ID NO: 2945381 - protein, 23 aa, Entamoeba invadens
IVNEKGNVFGMFYGNCKDRVLIP

SEQ ID NO: 2945382 - protein, 24 aa, Entamoeba invadens
IVNFKTSAIVFLKINDIVFAIRDG

SEQ ID NO: 2945383 - protein, 27 aa, Entamoeba invadens
IVNGVLRCLLLYNYSFLFAFETTPNVL

SEQ ID NO: 2945384 - protein, 24 aa, Entamoeba invadens
IVNNLKFEPEIGVVTEQLNGLQRV

SEQ ID NO: 2945385 - protein, 27 aa, Entamoeba invadens
IVNNRVGNFPIVLKLPVKCQSNYICLH

SEQ ID NO: 2945386 - protein, 17 aa, Entamoeba invadens
IVNPALMALYAEGKETG

SEQ ID NO: 2945387 - protein, 18 aa, Entamoeba invadens
IVNSLRFDKFAGERIKKE

SEQ ID NO: 2945388 - protein, 25 aa, Entamoeba invadens
IVNVKYFICAGNMPQSILKEVMGKG

SEQ ID NO: 2945389 - protein, 24 aa, Entamoeba invadens
IVNYKTEVSFMFSEQMKKIGIQCE

SEQ ID NO: 2945390 - protein, 18 aa, Entamoeba invadens
IVPHIALNKTATFTVEII

SEQ ID NO: 2945391 - protein, 22 aa, Entamoeba invadens
IVPPMRFSSLLPTKPVPPPQSQ

SEQ ID NO: 2945392 - protein, 20 aa, Entamoeba invadens
IVPRLSIGSFQSYKRMVQEV

SEQ ID NO: 2945393 - protein, 19 aa, Entamoeba invadens
IVPRLSLGSFEHYKEMIKI

SEQ ID NO: 2945394 - protein, 26 aa, Entamoeba invadens
IVPRTPVPMIRMFNPRINTTDLLKER

SEQ ID NO: 2945395 - protein, 24 aa, Entamoeba invadens
IVPTKMFYQIIVWFNVDYVTVDNN

SEQ ID NO: 2945396 - protein, 17 aa, Entamoeba invadens
IVQCRKHYNGCPHCNAI

SEQ ID NO: 2945397 - protein, 17 aa, Entamoeba invadens
IVQDLRLSDFLLTANPG

SEQ ID NO: 2945398 - protein, 17 aa, Entamoeba invadens
IVQETLCLSRKLVKPTL

SEQ ID NO: 2945399 - protein, 25 aa, Entamoeba invadens
IVQIKAAEVFTHFSSFQNFAPLLPL

SEQ ID NO: 2945400 - protein, 29 aa, Entamoeba invadens
IVQKMKIQIGMLYDLHSIFYKKISQRMKA

SEQ ID NO: 2945401 - protein, 27 aa, Entamoeba invadens
IVRDIKEILCYFALDFNEEMQKAASSS

SEQ ID NO: 2945402 - protein, 29 aa, Entamoeba invadens
IVREVDPEFKRTVLINTKFDNRVKELTDK

SEQ ID NO: 2945403 - protein, 29 aa, Entamoeba invadens
IVRGETLDAFAFRYIEIYTSPYTKQEQTK

SEQ ID NO: 2945404 - protein, 17 aa, Entamoeba invadens
IVRKSNMTFSRMFIGNI

SEQ ID NO: 2945405 - protein, 26 aa, Entamoeba invadens
IVRQCLNCMYGAYDLMRDICTQYVHS

SEQ ID NO: 2945406 - protein, 17 aa, Entamoeba invadens
IVRRICVDYQQSGVSVQ

SEQ ID NO: 2945407 - protein, 25 aa, Entamoeba invadens
IVRRSGSKLKFVLMVYKSAENDIFT

SEQ ID NO: 2945408 - protein, 22 aa, Entamoeba invadens
IVRSRLTKFPKFLRKLPNLYDI

SEQ ID NO: 2945409 - protein, 23 aa, Entamoeba invadens
IVRVCLECLNLVFHSLSEQEAFE

SEQ ID NO: 2945410 - protein, 19 aa, Entamoeba invadens
IVRWVKLLIKSWRNYDQSG

SEQ ID NO: 2945411 - protein, 25 aa, Entamoeba invadens
IVSCRELRVPLLKLVSFEDFAKHNI

SEQ ID NO: 2945412 - protein, 25 aa, Entamoeba invadens
IVSEAACALSYVVIKMEDKFAPFFE

SEQ ID NO: 2945413 - protein, 24 aa, Entamoeba invadens
IVSELLWMVCYRFIHTQDNKEWGF

SEQ ID NO: 2945414 - protein, 23 aa, Entamoeba invadens
IVSEWFYLRTVRVEVDTRFEYSF

SEQ ID NO: 2945415 - protein, 31 aa, Entamoeba invadens
IVSFAITIYECFKWGEAYPINEFKFPWKIAE

SEQ ID NO: 2945416 - protein, 17 aa, Entamoeba invadens
IVSFQYSRCSDYFSLGC

SEQ ID NO: 2945417 - protein, 20 aa, Entamoeba invadens
IVSGLFCAAISMIQFDVAIN

SEQ ID NO: 2945418 - protein, 27 aa, Entamoeba invadens
IVSIDIVEAFPLISAAWDLTTKESVLK

SEQ ID NO: 2945419 - protein, 18 aa, Entamoeba invadens
IVSKAFSVISLWQYQDQK

SEQ ID NO: 2945420 - protein, 27 aa, Entamoeba invadens
IVSKSIKFARPADCLPKVADLVGQIRH

SEQ ID NO: 2945421 - protein, 23 aa, Entamoeba invadens
IVSKTDCLFLFEAIQKKEKVCSR

SEQ ID NO: 2945422 - protein, 23 aa, Entamoeba invadens
IVSKYFICISNFKNMVLICKKFE

SEQ ID NO: 2945423 - protein, 24 aa, Entamoeba invadens
IVSKYFVCLNDFKNLILVCKKFEE

SEQ ID NO: 2945424 - protein, 24 aa, Entamoeba invadens
IVSKYFVCLNDFKNLILVCKKFNE

SEQ ID NO: 2945425 - protein, 17 aa, Entamoeba invadens
IVSLKIDWIIERYQLPQ

SEQ ID NO: 2945426 - protein, 17 aa, Entamoeba invadens
IVSMYFKTVEDFINIEF

SEQ ID NO: 2945427 - protein, 20 aa, Entamoeba invadens
IVSNELYGFVVADIVPIKSC

SEQ ID NO: 2945428 - protein, 18 aa, Entamoeba invadens
IVSPFRPGMIENYQQFGE

SEQ ID NO: 2945429 - protein, 36 aa, Entamoeba invadens
IVSPSVCVSLYLWSYFPQIGEYILVLDVGESQSSCY

SEQ ID NO: 2945430 - protein, 18 aa, Entamoeba invadens
IVSRTCDLLCSILNLTES

SEQ ID NO: 2945431 - protein, 19 aa, Entamoeba invadens
IVSSALHFLNYHHNFTEMD

SEQ ID NO: 2945432 - protein, 18 aa, Entamoeba invadens
IVSSCFTTFLVKDTQTNC

SEQ ID NO: 2945433 - protein, 18 aa, Entamoeba invadens
IVSVWSFGVILYRMITGV

SEQ ID NO: 2945434 - protein, 17 aa, Entamoeba invadens
IVSYQLLNALLVFQSAV

SEQ ID NO: 2945435 - protein, 19 aa, Entamoeba invadens
IVTEFVCRKYPDAVRAVRP

SEQ ID NO: 2945436 - protein, 23 aa, Entamoeba invadens
IVTEKLNGFFLIPDRGSWNYSLA

SEQ ID NO: 2945437 - protein, 17 aa, Entamoeba invadens
IVTFSFRAPSVGVDLVD

SEQ ID NO: 2945438 - protein, 19 aa, Entamoeba invadens
IVTICKTLIFSAKTKGIRV

SEQ ID NO: 2945439 - protein, 28 aa, Entamoeba invadens
IVTIPPKFACEFSLFLNPLCTSTIDSTF

SEQ ID NO: 2945440 - protein, 25 aa, Entamoeba invadens
IVTKWKPEVAYNFPNVPCLLVGTKL

SEQ ID NO: 2945441 - protein, 20 aa, Entamoeba invadens
IVTLFPEYKDVFSGAELEKR

SEQ ID NO: 2945442 - protein, 24 aa, Entamoeba invadens
IVTLFRLTTAIARQIADILPITFD

SEQ ID NO: 2945443 - protein, 18 aa, Entamoeba invadens
IVTLKRGFACEFEIFIKP

SEQ ID NO: 2945444 - protein, 22 aa, Entamoeba invadens
IVTLTCLRHLDLNANQFTSFPV

SEQ ID NO: 2945445 - protein, 23 aa, Entamoeba invadens
IVTMRLALRCLIIGEVESHYQRD

SEQ ID NO: 2945446 - protein, 28 aa, Entamoeba invadens
IVTPRFAVSCSLELMSQLSALASKKDIF

SEQ ID NO: 2945447 - protein, 18 aa, Entamoeba invadens
IVTREHKTDFNVIEYGKN

SEQ ID NO: 2945448 - protein, 25 aa, Entamoeba invadens
IVTTLKARCSVIAAANPKGGKYNPS

SEQ ID NO: 2945449 - protein, 19 aa, Entamoeba invadens
IVTVILRPVDDIMMEMTRQ

SEQ ID NO: 2945450 - protein, 17 aa, Entamoeba invadens
IVVDLRGWSLGYVNDLF

SEQ ID NO: 2945451 - protein, 19 aa, Entamoeba invadens
IVVGLKIDLRDSVREIHKL

SEQ ID NO: 2945452 - protein, 26 aa, Entamoeba invadens
IVVKLSLKVDFVFFVPSHILRKLGAN

SEQ ID NO: 2945453 - protein, 21 aa, Entamoeba invadens
IVVKNCPLLALNDRSYQKGKV

SEQ ID NO: 2945454 - protein, 17 aa, Entamoeba invadens
IVVKRLLEWMRTIDDES

SEQ ID NO: 2945455 - protein, 18 aa, Entamoeba invadens
IVVLLSRIQNMLNLTQQT

SEQ ID NO: 2945456 - protein, 20 aa, Entamoeba invadens
IVVNSLKESQEWSRQEKQNK

SEQ ID NO: 2945457 - protein, 18 aa, Entamoeba invadens
IVVSLCVDGIWSVDFLAQ

SEQ ID NO: 2945458 - protein, 26 aa, Entamoeba invadens
IVVTWGLKLPHLFNYAGDMLGLTQFD

SEQ ID NO: 2945459 - protein, 17 aa, Entamoeba invadens
IVVWYNVDYNTFVINKN

SEQ ID NO: 2945460 - protein, 18 aa, Entamoeba invadens
IVVYKILKILQRIHQKEL

SEQ ID NO: 2945461 - protein, 21 aa, Entamoeba invadens
IVYDCIKSFNLIRPTDHITIG

SEQ ID NO: 2945462 - protein, 18 aa, Entamoeba invadens
IVYEVPRVRIRYMIIFKL

SEQ ID NO: 2945463 - protein, 17 aa, Entamoeba invadens
IVYGCIYGIGPYSLADE

SEQ ID NO: 2945464 - protein, 33 aa, Entamoeba invadens
IVYRGNRFCLPLCIMFPFDYPLTPPLFFTDPTA

SEQ ID NO: 2945465 - protein, 27 aa, Entamoeba invadens
IVYSVGILCFHHFYKLNKIVFSSNLSS

SEQ ID NO: 2945466 - protein, 17 aa, Entamoeba invadens
IWALGCTVLELITGNPP

SEQ ID NO: 2945467 - protein, 18 aa, Entamoeba invadens
IWECFTGVIPSSANREEM

SEQ ID NO: 2945468 - protein, 20 aa, Entamoeba invadens
IWEGGIFKLTMTFTDEYPIK

SEQ ID NO: 2945469 - protein, 19 aa, Entamoeba invadens
IWEGLKLKGYPKEVYSRGN

SEQ ID NO: 2945470 - protein, 24 aa, Entamoeba invadens
IWEHYFMLFCFERGFEEAMNVVEF

SEQ ID NO: 2945471 - protein, 18 aa, Entamoeba invadens
IWEIIKDRVSRLIIDAQI

SEQ ID NO: 2945472 - protein, 23 aa, Entamoeba invadens
IWFNDGLIFKHVIWYEVFYHNTF

SEQ ID NO: 2945473 - protein, 23 aa, Entamoeba invadens
IWFQIPIRLKKTRKRENEKTRKR

SEQ ID NO: 2945474 - protein, 22 aa, Entamoeba invadens
IWKRVRKCLKTTFMSVDNLVHC

SEQ ID NO: 2945475 - protein, 22 aa, Entamoeba invadens
IWPEEFLQPLVKVMESEDKNKV

SEQ ID NO: 2945476 - protein, 18 aa, Entamoeba invadens
IWQNRYNILIQFPDSLDL

SEQ ID NO: 2945477 - protein, 19 aa, Entamoeba invadens
IWRETVLDGLGGFAEQRKA

SEQ ID NO: 2945478 - protein, 18 aa, Entamoeba invadens
IWRNCYLTAAYELEHPMQ

SEQ ID NO: 2945479 - protein, 20 aa, Entamoeba invadens
IWSEHCRPACGVCREGFVCT

SEQ ID NO: 2945480 - protein, 19 aa, Entamoeba invadens
IWTEEVCGYITRIENCVPN

SEQ ID NO: 2945481 - protein, 19 aa, Entamoeba invadens
IWVMSKFVSMSRRIDVCGA

SEQ ID NO: 2945482 - protein, 18 aa, Entamoeba invadens
IWYNLCKYYHVLNRTVNN

SEQ ID NO: 2945483 - protein, 22 aa, Entamoeba invadens
IWYNRYSGFEYKQSRGDRGNMT

SEQ ID NO: 2945484 - protein, 18 aa, Entamoeba invadens
IYADASLSLVVFELDKAV

SEQ ID NO: 2945485 - protein, 23 aa, Entamoeba invadens
IYAEIGFGHPVFRGESEYDQAIK

SEQ ID NO: 2945486 - protein, 19 aa, Entamoeba invadens
IYAKIYIKLLEFEEENKGW

SEQ ID NO: 2945487 - protein, 18 aa, Entamoeba invadens
IYALGITMWELFYEQYPF

SEQ ID NO: 2945488 - protein, 17 aa, Entamoeba invadens
IYALGVIFWEMLYEMKP

SEQ ID NO: 2945489 - protein, 17 aa, Entamoeba invadens
IYCEGRLLFDEADIEEF

SEQ ID NO: 2945490 - protein, 18 aa, Entamoeba invadens
IYCSEFITVFDISNLNLE

SEQ ID NO: 2945491 - protein, 25 aa, Entamoeba invadens
IYCTKSDLILLVLRKMTNMEFEAKI

SEQ ID NO: 2945492 - protein, 17 aa, Entamoeba invadens
IYCVVSVGQQAPVQTRS

SEQ ID NO: 2945493 - protein, 22 aa, Entamoeba invadens
IYDCGNEVFTWKGKKCSRKEWE

SEQ ID NO: 2945494 - protein, 20 aa, Entamoeba invadens
IYDGNALVAGIVSDKIDSLE

SEQ ID NO: 2945495 - protein, 18 aa, Entamoeba invadens
IYDHALLVLPEFFKSFLE

SEQ ID NO: 2945496 - protein, 18 aa, Entamoeba invadens
IYDKFGLDLAEDVKTQIV

SEQ ID NO: 2945497 - protein, 32 aa, Entamoeba invadens
IYDKNKRTIACFGGFGKEVGKFCEPSSVCLWG

SEQ ID NO: 2945498 - protein, 18 aa, Entamoeba invadens
IYDPNPLVSVLFEEFNLN

SEQ ID NO: 2945499 - protein, 18 aa, Entamoeba invadens
IYDSNVLVARVVSGKTKS

SEQ ID NO: 2945500 - protein, 19 aa, Entamoeba invadens
IYDYNILKEDYIRFTEIID

SEQ ID NO: 2945501 - protein, 17 aa, Entamoeba invadens
IYECLREVGQKISQDEF

SEQ ID NO: 2945502 - protein, 17 aa, Entamoeba invadens
IYEIPKLVTDVWKKENI

SEQ ID NO: 2945503 - protein, 18 aa, Entamoeba invadens
IYEKFIIITEKFMSFSKK

SEQ ID NO: 2945504 - protein, 25 aa, Entamoeba invadens
IYEMFVKRTLISGGMTESEAMLKIE

SEQ ID NO: 2945505 - protein, 19 aa, Entamoeba invadens
IYEQIPFICEGCYTPMRSK

SEQ ID NO: 2945506 - protein, 17 aa, Entamoeba invadens
IYEVFKRIYSVCDEYIT

SEQ ID NO: 2945507 - protein, 17 aa, Entamoeba invadens
IYFETANGFEIEYLVED

SEQ ID NO: 2945508 - protein, 26 aa, Entamoeba invadens
IYFGGCVIKKVLFPPSVKALQFNNEN

SEQ ID NO: 2945509 - protein, 30 aa, Entamoeba invadens
IYFHNLKYDSCFLAEYGINKCIKKDGKTMK

SEQ ID NO: 2945510 - protein, 34 aa, Entamoeba invadens
IYFHNLKYDSCFLAEYGINKCIKKDGKTMKMNLI

SEQ ID NO: 2945511 - protein, 18 aa, Entamoeba invadens
IYFKNKIPHFVRKISEQS

SEQ ID NO: 2945512 - protein, 17 aa, Entamoeba invadens
IYGDAIAEFKRLGCYFV

SEQ ID NO: 2945513 - protein, 34 aa, Entamoeba invadens
IYGFHKLECRNGLCFSHDFFVKSQPLLLERIKRK

SEQ ID NO: 2945514 - protein, 17 aa, Entamoeba invadens
IYGGGIVFYDEVTKNEA

SEQ ID NO: 2945515 - protein, 24 aa, Entamoeba invadens
IYGKGAGCGVSLYIAYKQKVSKKK

SEQ ID NO: 2945516 - protein, 25 aa, Entamoeba invadens
IYGMLELKKALLLTVVGAPTRRMKD

SEQ ID NO: 2945517 - protein, 23 aa, Entamoeba invadens
IYGRSCFMKCVSLKKVPIIRHIA

SEQ ID NO: 2945518 - protein, 21 aa, Entamoeba invadens
IYGRWKSMGLVNNFAEVLRNV

SEQ ID NO: 2945519 - protein, 17 aa, Entamoeba invadens
IYHDLWMQIKTTDFLGN

SEQ ID NO: 2945520 - protein, 21 aa, Entamoeba invadens
IYHEMIRLLGTIAARHPTLAQ

SEQ ID NO: 2945521 - protein, 18 aa, Entamoeba invadens
IYHPRYYNTGVLPKAIDL

SEQ ID NO: 2945522 - protein, 18 aa, Entamoeba invadens
IYHRMGITEFEDLPPDVV

SEQ ID NO: 2945523 - protein, 17 aa, Entamoeba invadens
IYHRMTVTNLDELGYDT

SEQ ID NO: 2945524 - protein, 19 aa, Entamoeba invadens
IYISKTVVCEDCLKTVSIF

SEQ ID NO: 2945525 - protein, 17 aa, Entamoeba invadens
IYITDTHNFFFFSSNTN

SEQ ID NO: 2945526 - protein, 24 aa, Entamoeba invadens
IYKDFKAQLSYLIALKRKETNDPL

SEQ ID NO: 2945527 - protein, 21 aa, Entamoeba invadens
IYKDYEITDDTLLEIKPLSKK

SEQ ID NO: 2945528 - protein, 24 aa, Entamoeba invadens
IYKECSCNTIAGLFKLFLRELPTP

SEQ ID NO: 2945529 - protein, 24 aa, Entamoeba invadens
IYKEEIPIFIKFYDKFDCDTYNDE

SEQ ID NO: 2945530 - protein, 19 aa, Entamoeba invadens
IYKFIPRTVGPYEKPTAMI

SEQ ID NO: 2945531 - protein, 19 aa, Entamoeba invadens
IYKKLAVSFRSARSRLKSE

SEQ ID NO: 2945532 - protein, 21 aa, Entamoeba invadens
IYKKNELERFVGHVEIEKTTL

SEQ ID NO: 2945533 - protein, 25 aa, Entamoeba invadens
IYKMPSDIFLFAIIIHKHLLGKNHT

SEQ ID NO: 2945534 - protein, 26 aa, Entamoeba invadens
IYKNCDCFVFIYSILSIDSFNELESF

SEQ ID NO: 2945535 - protein, 17 aa, Entamoeba invadens
IYKNKVCIVSNDKIFDW

SEQ ID NO: 2945536 - protein, 24 aa, Entamoeba invadens
IYKPCGHSFCLSCVKDTVKAQIEN

SEQ ID NO: 2945537 - protein, 28 aa, Entamoeba invadens
IYKPRAFFKGIIFPLCTEKNVTGKEALI

SEQ ID NO: 2945538 - protein, 19 aa, Entamoeba invadens
IYKRLDVEETWKIAEILSL

SEQ ID NO: 2945539 - protein, 21 aa, Entamoeba invadens
IYKTEHFMPSVLEREKIIDVQ

SEQ ID NO: 2945540 - protein, 18 aa, Entamoeba invadens
IYKTLRVDGELSVKGSIE

SEQ ID NO: 2945541 - protein, 20 aa, Entamoeba invadens
IYKYKCWKEISLENIGINKE

SEQ ID NO: 2945542 - protein, 20 aa, Entamoeba invadens
IYKYNCWKEIPYENIGINKE

SEQ ID NO: 2945543 - protein, 19 aa, Entamoeba invadens
IYLCPYRIIATGPDCGIIE

SEQ ID NO: 2945544 - protein, 17 aa, Entamoeba invadens
IYLDNAFLIVGDVLGGA

SEQ ID NO: 2945545 - protein, 17 aa, Entamoeba invadens
IYLIGCNALHILNITSS

SEQ ID NO: 2945546 - protein, 17 aa, Entamoeba invadens
IYLKTTAGFKRYYKESE

SEQ ID NO: 2945547 - protein, 18 aa, Entamoeba invadens
IYLNLLIMCVETIQVEKW

SEQ ID NO: 2945548 - protein, 25 aa, Entamoeba invadens
IYLSKIVGCPMCKALSNIFVEQFQR

SEQ ID NO: 2945549 - protein, 17 aa, Entamoeba invadens
IYLSYSLEEIDFVKKVF

SEQ ID NO: 2945550 - protein, 18 aa, Entamoeba invadens
IYMHKTCATELQMGCRPI

SEQ ID NO: 2945551 - protein, 17 aa, Entamoeba invadens
IYMKWKGREYLREAPTL

SEQ ID NO: 2945552 - protein, 17 aa, Entamoeba invadens
IYMYPWTIADDVASGKR

SEQ ID NO: 2945553 - protein, 28 aa, Entamoeba invadens
IYNCAICMTCGCFLCYKDGKRRDDNVHS

SEQ ID NO: 2945554 - protein, 32 aa, Entamoeba invadens
IYNCLECVKCEERIEAGWSLKIERKKLNESGE

SEQ ID NO: 2945555 - protein, 22 aa, Entamoeba invadens
IYNEFLKRYFFLGTNINKKTSD

SEQ ID NO: 2945556 - protein, 33 aa, Entamoeba invadens
IYNEKCDLFSIGVMLYEMITGIMLNVKKDPSVP

SEQ ID NO: 2945557 - protein, 20 aa, Entamoeba invadens
IYNEVVCDLLGEKSDDLDEE

SEQ ID NO: 2945558 - protein, 18 aa, Entamoeba invadens
IYNFCISLATLADLARDD

SEQ ID NO: 2945559 - protein, 25 aa, Entamoeba invadens
IYNFFKNEFKFVGDVVFVKSETIWN

SEQ ID NO: 2945560 - protein, 19 aa, Entamoeba invadens
IYNFLLRVALKQKRYTDAV

SEQ ID NO: 2945561 - protein, 23 aa, Entamoeba invadens
IYNHLKALLVQSLKKCFDTENLP

SEQ ID NO: 2945562 - protein, 26 aa, Entamoeba invadens
IYNKEDLFEFGRCIEKIMSEVSEVTK

SEQ ID NO: 2945563 - protein, 18 aa, Entamoeba invadens
IYNNCMIITLIPNENKCL

SEQ ID NO: 2945564 - protein, 18 aa, Entamoeba invadens
IYNSECEILFGTVKLTKL

SEQ ID NO: 2945565 - protein, 19 aa, Entamoeba invadens
IYNSTRWAILVSGLHILVS

SEQ ID NO: 2945566 - protein, 20 aa, Entamoeba invadens
IYNSVYWKERCFGLTSDTIL

SEQ ID NO: 2945567 - protein, 18 aa, Entamoeba invadens
IYNYLIQICSSFDERVVF

SEQ ID NO: 2945568 - protein, 18 aa, Entamoeba invadens
IYPEPLSLCGNSNFDTTN

SEQ ID NO: 2945569 - protein, 17 aa, Entamoeba invadens
IYPQFMFHLRRSHFLRV

SEQ ID NO: 2945570 - protein, 25 aa, Entamoeba invadens
IYPVSEFKGDVIIVQMTQKKKNLPS

SEQ ID NO: 2945571 - protein, 20 aa, Entamoeba invadens
IYQCKSVVHLLNLNTLNITS

SEQ ID NO: 2945572 - protein, 24 aa, Entamoeba invadens
IYQICTILLEYLCRDYRIINAFFD

SEQ ID NO: 2945573 - protein, 20 aa, Entamoeba invadens
IYQPFCPIQSTLNLSSSFFS

SEQ ID NO: 2945574 - protein, 25 aa, Entamoeba invadens
IYQTFCKEYKYLLEVTLSVTDENKE

SEQ ID NO: 2945575 - protein, 18 aa, Entamoeba invadens
IYRATNFQFLKRVFERAI

SEQ ID NO: 2945576 - protein, 31 aa, Entamoeba invadens
IYRICTCAPHLDKRYGKGFVIDKETELPAIG

SEQ ID NO: 2945577 - protein, 27 aa, Entamoeba invadens
IYRNSMPLDMFKFISSHIKTYDMGQPD

SEQ ID NO: 2945578 - protein, 18 aa, Entamoeba invadens
IYSAGVILMEMCMSCVTR

SEQ ID NO: 2945579 - protein, 21 aa, Entamoeba invadens
IYSCGILLHVMLYGYMPVVHE

SEQ ID NO: 2945580 - protein, 25 aa, Entamoeba invadens
IYSFAITMFEVFGWCEAYPKEMFKF

SEQ ID NO: 2945581 - protein, 18 aa, Entamoeba invadens
IYSFALIIIEFLEGKATF

SEQ ID NO: 2945582 - protein, 24 aa, Entamoeba invadens
IYSFGITLWEIFYRAQPFREYLAS

SEQ ID NO: 2945583 - protein, 25 aa, Entamoeba invadens
IYSFGITLYEVFGWCEAYQHTKFKF

SEQ ID NO: 2945584 - protein, 24 aa, Entamoeba invadens
IYSFMMFLCKLLFQKIPPSLQEMS

SEQ ID NO: 2945585 - protein, 30 aa, Entamoeba invadens
IYSGRRWDWRGNVIKYNYISNVIGWDNSSC

SEQ ID NO: 2945586 - protein, 20 aa, Entamoeba invadens
IYSIEVISFLLLLKVKYPER

SEQ ID NO: 2945587 - protein, 18 aa, Entamoeba invadens
IYSLGITMWELFYEGYPF

SEQ ID NO: 2945588 - protein, 17 aa, Entamoeba invadens
IYSMGMCLLEVFQQHEI

SEQ ID NO: 2945589 - protein, 18 aa, Entamoeba invadens
IYSQLPIYNVLDRFSDGM

SEQ ID NO: 2945590 - protein, 18 aa, Entamoeba invadens
IYTISIAPGEMWRILQAN

SEQ ID NO: 2945591 - protein, 23 aa, Entamoeba invadens
IYTISLTFVGIVDFLKINETGEP

SEQ ID NO: 2945592 - protein, 26 aa, Entamoeba invadens
IYTNYAAFCAIGIPVHHVAFTNTGVW

SEQ ID NO: 2945593 - protein, 18 aa, Entamoeba invadens
IYTTGFWSSKEHLFVDHT

SEQ ID NO: 2945594 - protein, 19 aa, Entamoeba invadens
IYVAGCLKFVSQVSDPYLR

SEQ ID NO: 2945595 - protein, 24 aa, Entamoeba invadens
IYVKGINSKGAFIFKSNKAPLKLP

SEQ ID NO: 2945596 - protein, 18 aa, Entamoeba invadens
IYVRCGRVDDAYSLCCKI

SEQ ID NO: 2945597 - protein, 32 aa, Entamoeba invadens
IYVSRLKQFLEFYLAKALQIFPGDSILKKCEE

SEQ ID NO: 2945598 - protein, 19 aa, Entamoeba invadens
IYVVVKLTNFHIIINSKTL

SEQ ID NO: 2945599 - protein, 24 aa, Entamoeba invadens
IYYARSCIRRSKIVNEIFDTENSF

SEQ ID NO: 2945600 - protein, 18 aa, Entamoeba invadens
IYYCRHAKQIELKNVTCD

SEQ ID NO: 2945601 - protein, 24 aa, Entamoeba invadens
IYYIKSSGVYFLYQMNCYKIVMLG

SEQ ID NO: 2945602 - protein, 19 aa, Entamoeba invadens
KAADLSLAYFEEFKDNDYS

SEQ ID NO: 2945603 - protein, 26 aa, Entamoeba invadens
KAADSCLWEFDLLRYHINPDVRKWVL

SEQ ID NO: 2945604 - protein, 17 aa, Entamoeba invadens
KAAELTLYDVMEVGLRA

SEQ ID NO: 2945605 - protein, 21 aa, Entamoeba invadens
KAAESQDGWKQIYRTDDVMVL

SEQ ID NO: 2945606 - protein, 28 aa, Entamoeba invadens
KAAFKVYLDYFGFRACFDPSEVDHAKCY

SEQ ID NO: 2945607 - protein, 21 aa, Entamoeba invadens
KAAKNQLVVQCFSHKEVHLIF

SEQ ID NO: 2945608 - protein, 26 aa, Entamoeba invadens
KAAKQCIPHHIYASSMAFEKLCVADV

SEQ ID NO: 2945609 - protein, 24 aa, Entamoeba invadens
KAALKKKIETAGLVAKNAAIQELA

SEQ ID NO: 2945610 - protein, 24 aa, Entamoeba invadens
KAALKKKIETSGLVAKNAAIQELA

SEQ ID NO: 2945611 - protein, 19 aa, Entamoeba invadens
KAAQCVVLRLDKIIKECTI

SEQ ID NO: 2945612 - protein, 17 aa, Entamoeba invadens
KAAQFIGQCYKLKDVET

SEQ ID NO: 2945613 - protein, 21 aa, Entamoeba invadens
KAARIKRQLIFKGVLKGDETS

SEQ ID NO: 2945614 - protein, 18 aa, Entamoeba invadens
KAAYKKHTICVPLLSGVK

SEQ ID NO: 2945615 - protein, 17 aa, Entamoeba invadens
KACFKFCSALSAVTMSR

SEQ ID NO: 2945616 - protein, 27 aa, Entamoeba invadens
KACYMLAKMGLLRSFWCYFKNKNENTG

SEQ ID NO: 2945617 - protein, 18 aa, Entamoeba invadens
KADADIILSVGEDSRAVL

SEQ ID NO: 2945618 - protein, 27 aa, Entamoeba invadens
KADAKTFWSSRLLKTSQDFAVFKNLIN

SEQ ID NO: 2945619 - protein, 22 aa, Entamoeba invadens
KADEFCHLIKWKAKKGRLDNIR

SEQ ID NO: 2945620 - protein, 21 aa, Entamoeba invadens
KADGKRLTIYNAPQKEEGLAV

SEQ ID NO: 2945621 - protein, 18 aa, Entamoeba invadens
KADIWSIGIMMMEMTEGD

SEQ ID NO: 2945622 - protein, 22 aa, Entamoeba invadens
KADKPKPRQRFSLDTSSKKNLR

SEQ ID NO: 2945623 - protein, 26 aa, Entamoeba invadens
KADLGARCLCYSTIGIYQLLAHNVPL

SEQ ID NO: 2945624 - protein, 18 aa, Entamoeba invadens
KADLRLIASPDFETKNEK

SEQ ID NO: 2945625 - protein, 25 aa, Entamoeba invadens
KADRNWSLNATKFIMLKYRHWQLAH

SEQ ID NO: 2945626 - protein, 20 aa, Entamoeba invadens
KADTELAEALEAIRKAKQTG

SEQ ID NO: 2945627 - protein, 27 aa, Entamoeba invadens
KADVDFRIFLDIFFEGVRSPCYLIYTT

SEQ ID NO: 2945628 - protein, 18 aa, Entamoeba invadens
KAEEAAKEEAERQKSLFS

SEQ ID NO: 2945629 - protein, 25 aa, Entamoeba invadens
KAEEIFKPDIMYTIVSKMYSEISTS

SEQ ID NO: 2945630 - protein, 26 aa, Entamoeba invadens
KAEEIWKFVATFSELEQENHAEGKDL

SEQ ID NO: 2945631 - protein, 24 aa, Entamoeba invadens
KAEFDRLELENISFTRSDLSNEIK

SEQ ID NO: 2945632 - protein, 18 aa, Entamoeba invadens
KAEFPTEMANLFIEQKNE

SEQ ID NO: 2945633 - protein, 23 aa, Entamoeba invadens
KAEGAGQGTIWFMQREVTEKKKF

SEQ ID NO: 2945634 - protein, 30 aa, Entamoeba invadens
KAEGRFHKCFYKRSDSSFATMKFDMFIPTQ

SEQ ID NO: 2945635 - protein, 23 aa, Entamoeba invadens
KAEGSGQGAIWFMQREVTEKKKF

SEQ ID NO: 2945636 - protein, 18 aa, Entamoeba invadens
KAEKCVKCKNGYYPYTNG

SEQ ID NO: 2945637 - protein, 21 aa, Entamoeba invadens
KAEKMYSRYDISLILNDKKDV

SEQ ID NO: 2945638 - protein, 22 aa, Entamoeba invadens
KAEKRSIIVISEKVSEKKIASL

SEQ ID NO: 2945639 - protein, 26 aa, Entamoeba invadens
KAELTRKGLTDWFKANGVIVGQMLTS

SEQ ID NO: 2945640 - protein, 25 aa, Entamoeba invadens
KAEMLCCVCGALIEVNPSCMCANCI

SEQ ID NO: 2945641 - protein, 21 aa, Entamoeba invadens
KAEMRHAFLDFIQRALQWDPE

SEQ ID NO: 2945642 - protein, 20 aa, Entamoeba invadens
KAEPEVVCMLLGNKSDAGAD

SEQ ID NO: 2945643 - protein, 24 aa, Entamoeba invadens
KAEQEKKAAQRKEWAKKEAAEQKA

SEQ ID NO: 2945644 - protein, 29 aa, Entamoeba invadens
KAEQSIDTSFRYNKKYNLIEIDMLKQCNK

SEQ ID NO: 2945645 - protein, 25 aa, Entamoeba invadens
KAESELDELREFVRDVQTMKEQMKN

SEQ ID NO: 2945646 - protein, 19 aa, Entamoeba invadens
KAEVKYLKKVLVEKDKSLT

SEQ ID NO: 2945647 - protein, 19 aa, Entamoeba invadens
KAEYIPIVELMFQQIDSDF

SEQ ID NO: 2945648 - protein, 21 aa, Entamoeba invadens
KAEYRLTSTVILYLETNTEAT

SEQ ID NO: 2945649 - protein, 22 aa, Entamoeba invadens
KAFAKSGIEIVDFSNSKIELKD

SEQ ID NO: 2945650 - protein, 20 aa, Entamoeba invadens
KAFAPIAVKGIREIVEKAGH

SEQ ID NO: 2945651 - protein, 18 aa, Entamoeba invadens
KAFAQRKLIEQKRNEHIA

SEQ ID NO: 2945652 - protein, 19 aa, Entamoeba invadens
KAFAQRKLIEQKRNEQIAI

SEQ ID NO: 2945653 - protein, 21 aa, Entamoeba invadens
KAFCDLLALNGLKFEDVENYK

SEQ ID NO: 2945654 - protein, 24 aa, Entamoeba invadens
KAFCVKNGGSFVLPGFSQEYVVEG

SEQ ID NO: 2945655 - protein, 21 aa, Entamoeba invadens
KAFDFPFKVDAFAIGMKEFEL

SEQ ID NO: 2945656 - protein, 17 aa, Entamoeba invadens
KAFFYSNTLLYAYSDAL

SEQ ID NO: 2945657 - protein, 26 aa, Entamoeba invadens
KAFKFNPRCDELWTLFTTYLSSMPED

SEQ ID NO: 2945658 - protein, 19 aa, Entamoeba invadens
KAFKPLKNFMESITTLQKR

SEQ ID NO: 2945659 - protein, 18 aa, Entamoeba invadens
KAFLIQKGFIEFASQRLA

SEQ ID NO: 2945660 - protein, 17 aa, Entamoeba invadens
KAFNVNITPHFLISLFS

SEQ ID NO: 2945661 - protein, 17 aa, Entamoeba invadens
KAFPYNFYYKIYIKLSY

SEQ ID NO: 2945662 - protein, 20 aa, Entamoeba invadens
KAFRQLPPVYVMIYCGVNGT

SEQ ID NO: 2945663 - protein, 17 aa, Entamoeba invadens
KAFSKIETLQCYDYMLD

SEQ ID NO: 2945664 - protein, 17 aa, Entamoeba invadens
KAFTCYLFNLTDTKKDG

SEQ ID NO: 2945665 - protein, 20 aa, Entamoeba invadens
KAFTTFQFYVFRTIDFTKMI

SEQ ID NO: 2945666 - protein, 26 aa, Entamoeba invadens
KAGEGYLQCLQRLLGTNAGYEMFVEN

SEQ ID NO: 2945667 - protein, 24 aa, Entamoeba invadens
KAGFKPGFARQLVDAIARDNSSHS

SEQ ID NO: 2945668 - protein, 28 aa, Entamoeba invadens
KAGINFSEFKKSGILPEDFGEAIMGSGL

SEQ ID NO: 2945669 - protein, 22 aa, Entamoeba invadens
KAGKAVKSVMSMWGTWKDMTQL

SEQ ID NO: 2945670 - protein, 19 aa, Entamoeba invadens
KAGPGNCVTLANPPTYNRM

SEQ ID NO: 2945671 - protein, 17 aa, Entamoeba invadens
KAGVCVYDKCGNGMIDN

SEQ ID NO: 2945672 - protein, 27 aa, Entamoeba invadens
KAGVKFMFDCVMGLKTGFRGNGCILAD

SEQ ID NO: 2945673 - protein, 17 aa, Entamoeba invadens
KAGVQMRYECSTLPTAG

SEQ ID NO: 2945674 - protein, 20 aa, Entamoeba invadens
KAGYQVRCVFFDYDKKISFH

SEQ ID NO: 2945675 - protein, 20 aa, Entamoeba invadens
KAHFEFSRIVFFQKGSKMMP

SEQ ID NO: 2945676 - protein, 20 aa, Entamoeba invadens
KAIDLYGPNNWELVSQFIER

SEQ ID NO: 2945677 - protein, 29 aa, Entamoeba invadens
KAIECGKKICAIGGMVFSLPLFKPKFPIV

SEQ ID NO: 2945678 - protein, 25 aa, Entamoeba invadens
KAIEEYKKLLSMNADKLEYYINIAQ

SEQ ID NO: 2945679 - protein, 25 aa, Entamoeba invadens
KAIEKRSTLYFKIISMYKVPLNIDE

SEQ ID NO: 2945680 - protein, 30 aa, Entamoeba invadens
KAIEKYGEVFLRLNKVALLDSEWMNGSLSI

SEQ ID NO: 2945681 - protein, 17 aa, Entamoeba invadens
KAIELPKLLEVIPESCF

SEQ ID NO: 2945682 - protein, 17 aa, Entamoeba invadens
KAIEVVYYLSDLDVSNP

SEQ ID NO: 2945683 - protein, 19 aa, Entamoeba invadens
KAIGICLEILGSCYENLAP

SEQ ID NO: 2945684 - protein, 23 aa, Entamoeba invadens
KAIGNNSFFFWLFPIQRKVDNKK

SEQ ID NO: 2945685 - protein, 17 aa, Entamoeba invadens
KAIKCVNKYIDFAKNIG

SEQ ID NO: 2945686 - protein, 17 aa, Entamoeba invadens
KAILDAFNHCTSIQSGK

SEQ ID NO: 2945687 - protein, 19 aa, Entamoeba invadens
KAILGEATLTGFANILNKA

SEQ ID NO: 2945688 - protein, 19 aa, Entamoeba invadens
KAILPKYIIQFRVNDAKIR

SEQ ID NO: 2945689 - protein, 28 aa, Entamoeba invadens
KAILVLKGNPLSGFNVFEEQVPTAPQGN

SEQ ID NO: 2945690 - protein, 25 aa, Entamoeba invadens
KAILVLPECYIDFVNEDEMERNNVE

SEQ ID NO: 2945691 - protein, 31 aa, Entamoeba invadens
KAINAEFYKSRGLCKVTNLTGVQMDFYTKGM

SEQ ID NO: 2945692 - protein, 29 aa, Entamoeba invadens
KAIPQVVFNLCWWIYTFGNRTEGIFRVSG

SEQ ID NO: 2945693 - protein, 18 aa, Entamoeba invadens
KAISCGLVSTSNTDFHVN

SEQ ID NO: 2945694 - protein, 17 aa, Entamoeba invadens
KAKERYMMADLFGLLPH

SEQ ID NO: 2945695 - protein, 17 aa, Entamoeba invadens
KAKEVFESIKMSNLKVT

SEQ ID NO: 2945696 - protein, 23 aa, Entamoeba invadens
KAKFGNEVFEVYFVPVGKTCELI

SEQ ID NO: 2945697 - protein, 19 aa, Entamoeba invadens
KAKFLEYDRTLLVSDPRRC

SEQ ID NO: 2945698 - protein, 24 aa, Entamoeba invadens
KAKGFGYYFMMSRIIPKCFQLKGL

SEQ ID NO: 2945699 - protein, 17 aa, Entamoeba invadens
KAKGVGELVTFMKRPLD

SEQ ID NO: 2945700 - protein, 21 aa, Entamoeba invadens
KAKITPFAMLTAMQNKSTIKG

SEQ ID NO: 2945701 - protein, 18 aa, Entamoeba invadens
KAKIVQQMSWARDEKKLE

SEQ ID NO: 2945702 - protein, 23 aa, Entamoeba invadens
KAKKMGLTKCVGVFFTHGHFDHV

SEQ ID NO: 2945703 - protein, 22 aa, Entamoeba invadens
KAKKQAKQYARKVEKAERKLAK

SEQ ID NO: 2945704 - protein, 17 aa, Entamoeba invadens
KAKKVAKKFERCQEVFF

SEQ ID NO: 2945705 - protein, 24 aa, Entamoeba invadens
KAKMKVPLATVLQCKYNDILYTTD

SEQ ID NO: 2945706 - protein, 25 aa, Entamoeba invadens
KAKNKANICFIFFDDQNNVFGAFSK

SEQ ID NO: 2945707 - protein, 20 aa, Entamoeba invadens
KAKNMKKWSVEDASKIENYE

SEQ ID NO: 2945708 - protein, 17 aa, Entamoeba invadens
KAKQSLCKAEIEDSTKL

SEQ ID NO: 2945709 - protein, 21 aa, Entamoeba invadens
KAKSLEFYFDFLVKTDDIRQL

SEQ ID NO: 2945710 - protein, 27 aa, Entamoeba invadens
KAKTRIDREVAFLKILKSRFIIQLYQV

SEQ ID NO: 2945711 - protein, 20 aa, Entamoeba invadens
KAKYCDRGTSNFYRTFILTM

SEQ ID NO: 2945712 - protein, 24 aa, Entamoeba invadens
KAKYLLRPHIHSVVNIVDKKLVLE

SEQ ID NO: 2945713 - protein, 23 aa, Entamoeba invadens
KALADSWNALFIESSAKDNINIK

SEQ ID NO: 2945714 - protein, 26 aa, Entamoeba invadens
KALCLESIVMKRCLNITGEGIKQLKT

SEQ ID NO: 2945715 - protein, 26 aa, Entamoeba invadens
KALDRIWHKECFVCVECGKDFSGDRK

SEQ ID NO: 2945716 - protein, 18 aa, Entamoeba invadens
KALEKVGLVEVLNVIEFS

SEQ ID NO: 2945717 - protein, 21 aa, Entamoeba invadens
KALELCNKITLDFNGETKKIR

SEQ ID NO: 2945718 - protein, 19 aa, Entamoeba invadens
KALGCTDMAEAVVFEDAVL

SEQ ID NO: 2945719 - protein, 17 aa, Entamoeba invadens
KALIRVCYDEREKKDGW

SEQ ID NO: 2945720 - protein, 17 aa, Entamoeba invadens
KALIRVCYDSKEKKDGW

SEQ ID NO: 2945721 - protein, 24 aa, Entamoeba invadens
KALKRIKFETEENIDAVIVLENFK

SEQ ID NO: 2945722 - protein, 19 aa, Entamoeba invadens
KALKTISPKWIKSGENEVD

SEQ ID NO: 2945723 - protein, 17 aa, Entamoeba invadens
KALLAKHSEEFGVHIAQ

SEQ ID NO: 2945724 - protein, 18 aa, Entamoeba invadens
KALLDSMNHCGSFESTTD

SEQ ID NO: 2945725 - protein, 23 aa, Entamoeba invadens
KALLEGKCPVMFRDGDLLVSKTD

SEQ ID NO: 2945726 - protein, 19 aa, Entamoeba invadens
KALLRRYGRYLAATNPKAL

SEQ ID NO: 2945727 - protein, 24 aa, Entamoeba invadens
KALNIKEATDFCILSTTQIALLFD

SEQ ID NO: 2945728 - protein, 24 aa, Entamoeba invadens
KALPECLRSLCYVEDSNIHFDKIG

SEQ ID NO: 2945729 - protein, 23 aa, Entamoeba invadens
KALPKKRKLPAPKKPVQKRKKLV

SEQ ID NO: 2945730 - protein, 18 aa, Entamoeba invadens
KALPNVLMAIFFDNEEVG

SEQ ID NO: 2945731 - protein, 23 aa, Entamoeba invadens
KALPQNVLHYYNFVIFAPEDPDK

SEQ ID NO: 2945732 - protein, 17 aa, Entamoeba invadens
KALQEWYDGGPVQMSPM

SEQ ID NO: 2945733 - protein, 18 aa, Entamoeba invadens
KALQFWTKLNHFTLIYDS

SEQ ID NO: 2945734 - protein, 21 aa, Entamoeba invadens
KALQHWSYFYTAKRVLIEALM

SEQ ID NO: 2945735 - protein, 23 aa, Entamoeba invadens
KALQYSYVKMFFLPRDDVASDLF

SEQ ID NO: 2945736 - protein, 26 aa, Entamoeba invadens
KALRKEIKVSEDLLPTVNVKDLVKAY

SEQ ID NO: 2945737 - protein, 18 aa, Entamoeba invadens
KALSEFQSTLSLQVIIDN

SEQ ID NO: 2945738 - protein, 18 aa, Entamoeba invadens
KALVEFGVVDKFRVLNDR

SEQ ID NO: 2945739 - protein, 23 aa, Entamoeba invadens
KALVILCRMVFSLIAQISVKNKV

SEQ ID NO: 2945740 - protein, 21 aa, Entamoeba invadens
KALVSRFLLLKNIQKDHEKRK

SEQ ID NO: 2945741 - protein, 17 aa, Entamoeba invadens
KAMKVIEHIKGVGTQEH

SEQ ID NO: 2945742 - protein, 17 aa, Entamoeba invadens
KAMPRNVFQLINANIET

SEQ ID NO: 2945743 - protein, 20 aa, Entamoeba invadens
KANAKLTDFGSFRNINMLMT

SEQ ID NO: 2945744 - protein, 23 aa, Entamoeba invadens
KANGDSAPTCTFITSNNGNRQLL

SEQ ID NO: 2945745 - protein, 18 aa, Entamoeba invadens
KANGLKVLCRGHQCVDGF

SEQ ID NO: 2945746 - protein, 26 aa, Entamoeba invadens
KANIFKKYYMRICHVTVNMIIDEMFE

SEQ ID NO: 2945747 - protein, 21 aa, Entamoeba invadens
KANIFQNYYMRICHVTVSMII

SEQ ID NO: 2945748 - protein, 17 aa, Entamoeba invadens
KANSEVVDFIATSFSVK

SEQ ID NO: 2945749 - protein, 21 aa, Entamoeba invadens
KANTCKALYDYDAQDENELSI

SEQ ID NO: 2945750 - protein, 20 aa, Entamoeba invadens
KAPCAITPKMECDAMEDQSH

SEQ ID NO: 2945751 - protein, 24 aa, Entamoeba invadens
KAPCMSEKGCSKHFPKEFCNETIL

SEQ ID NO: 2945752 - protein, 20 aa, Entamoeba invadens
KAPCMSKGFLSIFQRNFAMK

SEQ ID NO: 2945753 - protein, 19 aa, Entamoeba invadens
KAPIGIDLIKFKGACDILF

SEQ ID NO: 2945754 - protein, 19 aa, Entamoeba invadens
KAPLRVLLTQLWKDFGDYA

SEQ ID NO: 2945755 - protein, 30 aa, Entamoeba invadens
KAPQLPKAYGFHVCVTKWLSLVQLLMGEIP

SEQ ID NO: 2945756 - protein, 18 aa, Entamoeba invadens
KAPTKSWVSLYMRPTVIP

SEQ ID NO: 2945757 - protein, 19 aa, Entamoeba invadens
KAPVFEFPDPGDFETCAVQ

SEQ ID NO: 2945758 - protein, 35 aa, Entamoeba invadens
KAPWPLSNRDFVFVWKWFIKDGCYYLILESVNSTQ

SEQ ID NO: 2945759 - protein, 20 aa, Entamoeba invadens
KAPYEIMFYMPIHGLSRENP

SEQ ID NO: 2945760 - protein, 20 aa, Entamoeba invadens
KAQAGGFNFKNLDALGEAFS

SEQ ID NO: 2945761 - protein, 21 aa, Entamoeba invadens
KAQALCPCSGIVDFDFEKVRG

SEQ ID NO: 2945762 - protein, 19 aa, Entamoeba invadens
KAQFKMMYMLMKLKKSQNE

SEQ ID NO: 2945763 - protein, 29 aa, Entamoeba invadens
KAQFSELKWSPKGNLVICKAQTSVDSSGQ

SEQ ID NO: 2945764 - protein, 23 aa, Entamoeba invadens
KAQIVGKEKLIFLFVSKTGEIFG

SEQ ID NO: 2945765 - protein, 20 aa, Entamoeba invadens
KAQIVGNEKLIFLFVSKTGE

SEQ ID NO: 2945766 - protein, 17 aa, Entamoeba invadens
KAQKFVLEIGGKFKNSA

SEQ ID NO: 2945767 - protein, 21 aa, Entamoeba invadens
KAQLFVKFGKYIVESLYVYAM

SEQ ID NO: 2945768 - protein, 30 aa, Entamoeba invadens
KAQLSKWAGECLILPNFLILPVQRFPRYVM

SEQ ID NO: 2945769 - protein, 24 aa, Entamoeba invadens
KAQPGESLIRGFPLNFSLSEVASI

SEQ ID NO: 2945770 - protein, 21 aa, Entamoeba invadens
KAQTCRGMVGSPYWMAPEVLL

SEQ ID NO: 2945771 - protein, 25 aa, Entamoeba invadens
KAQVIDLFGILAMVEGFKVDSDESS

SEQ ID NO: 2945772 - protein, 27 aa, Entamoeba invadens
KARADFCYAATVALNYTLAVGIKECWA

SEQ ID NO: 2945773 - protein, 22 aa, Entamoeba invadens
KARCPQLRYEYNLYKILMENGE

SEQ ID NO: 2945774 - protein, 26 aa, Entamoeba invadens
KARKAEWKKRQCVLKEEAEINHFRGF

SEQ ID NO: 2945775 - protein, 19 aa, Entamoeba invadens
KARKLFVRATEKCKTETIY

SEQ ID NO: 2945776 - protein, 17 aa, Entamoeba invadens
KARKRRTRKTTQKSKLD

SEQ ID NO: 2945777 - protein, 21 aa, Entamoeba invadens
KARPLDQNWCRPLSQSQSCGG

SEQ ID NO: 2945778 - protein, 24 aa, Entamoeba invadens
KARPLEVLVNYCLEKAVEESLTDV

SEQ ID NO: 2945779 - protein, 18 aa, Entamoeba invadens
KASECIADICEIAVENKS

SEQ ID NO: 2945780 - protein, 19 aa, Entamoeba invadens
KASEGKLQKIRFDLDEANN

SEQ ID NO: 2945781 - protein, 20 aa, Entamoeba invadens
KASFFKGEFNTLQLKQVREL

SEQ ID NO: 2945782 - protein, 19 aa, Entamoeba invadens
KASGISINMATAKREELID

SEQ ID NO: 2945783 - protein, 18 aa, Entamoeba invadens
KASIPINPKESFKIFIAP

SEQ ID NO: 2945784 - protein, 28 aa, Entamoeba invadens
KASISVWDLRKMRCRAMLTDEGSINTMS

SEQ ID NO: 2945785 - protein, 18 aa, Entamoeba invadens
KASLIVSFFTNMITSKLS

SEQ ID NO: 2945786 - protein, 23 aa, Entamoeba invadens
KASLPGIKLSNTFHWNYGFDSTF

SEQ ID NO: 2945787 - protein, 24 aa, Entamoeba invadens
KASNWLSRDRFVLSNGHGSSLLYL

SEQ ID NO: 2945788 - protein, 19 aa, Entamoeba invadens
KASTCARIDCFSDINTNKF

SEQ ID NO: 2945789 - protein, 18 aa, Entamoeba invadens
KATEEFGDRIGFTMKEVV

SEQ ID NO: 2945790 - protein, 24 aa, Entamoeba invadens
KATGIPFVKWWGMQDDWNLMVMEL

SEQ ID NO: 2945791 - protein, 24 aa, Entamoeba invadens
KATIPLSYAINCLKQIDSVRTAQD

SEQ ID NO: 2945792 - protein, 25 aa, Entamoeba invadens
KATKGEVFPDLDVLPLFLTKKKVLS

SEQ ID NO: 2945793 - protein, 24 aa, Entamoeba invadens
KATRQYEDFFGFKFFNPPQTQFFF

SEQ ID NO: 2945794 - protein, 25 aa, Entamoeba invadens
KAVDALKYLLLMKLMQKKPGEIDVV

SEQ ID NO: 2945795 - protein, 21 aa, Entamoeba invadens
KAVDDACGWPADPNSHLLATL

SEQ ID NO: 2945796 - protein, 25 aa, Entamoeba invadens
KAVEEIKGHCPVVDIENGFIVQLKK

SEQ ID NO: 2945797 - protein, 19 aa, Entamoeba invadens
KAVFALPLKNCVNLKSVSI

SEQ ID NO: 2945798 - protein, 26 aa, Entamoeba invadens
KAVLKKEFYQIVVWFNVDFQTVDKNK

SEQ ID NO: 2945799 - protein, 17 aa, Entamoeba invadens
KAVNELLYGNSFEMSQS

SEQ ID NO: 2945800 - protein, 17 aa, Entamoeba invadens
KAVRALGRCAIKLENVA

SEQ ID NO: 2945801 - protein, 25 aa, Entamoeba invadens
KAVSKKKLCLIVWFEVDFETIDRIQ

SEQ ID NO: 2945802 - protein, 19 aa, Entamoeba invadens
KAYCVFYCNQDVRILKQGH

SEQ ID NO: 2945803 - protein, 19 aa, Entamoeba invadens
KAYFKAVVSVDDWMLICFK

SEQ ID NO: 2945804 - protein, 18 aa, Entamoeba invadens
KAYIVGFDGVKVYYYNSA

SEQ ID NO: 2945805 - protein, 19 aa, Entamoeba invadens
KAYLKRKIIELEGLAEKRK

SEQ ID NO: 2945806 - protein, 19 aa, Entamoeba invadens
KAYLRQFVHTIPYIMTEQF

SEQ ID NO: 2945807 - protein, 25 aa, Entamoeba invadens
KAYSGTFPTLVMKFIEKNIVPSARM

SEQ ID NO: 2945808 - protein, 26 aa, Entamoeba invadens
KAYTKIVFELCPFCHIPKEYCEFGPN

SEQ ID NO: 2945809 - protein, 18 aa, Entamoeba invadens
KAYYVFYCNQDVRILKQD

SEQ ID NO: 2945810 - protein, 20 aa, Entamoeba invadens
KCADTKKVYCIGRSANKSEL

SEQ ID NO: 2945811 - protein, 21 aa, Entamoeba invadens
KCAECGKADPEWVSLTLGVLI

SEQ ID NO: 2945812 - protein, 26 aa, Entamoeba invadens
KCAECTQSFDIGRSAAFGKYIPELKH

SEQ ID NO: 2945813 - protein, 27 aa, Entamoeba invadens
KCAEFRSKGRLPMCMYNDSLTHTSLFR

SEQ ID NO: 2945814 - protein, 19 aa, Entamoeba invadens
KCAFCNCKKMTRLKLSDRI

SEQ ID NO: 2945815 - protein, 21 aa, Entamoeba invadens
KCAQSSFDYKNCTQTICGVDG

SEQ ID NO: 2945816 - protein, 20 aa, Entamoeba invadens
KCCLCQKRTFFMTPFPKVKT

SEQ ID NO: 2945817 - protein, 18 aa, Entamoeba invadens
KCCMAMPMEKCVKKKTTS

SEQ ID NO: 2945818 - protein, 18 aa, Entamoeba invadens
KCCYTCNFFCGGEMCVCT

SEQ ID NO: 2945819 - protein, 18 aa, Entamoeba invadens
KCDKCKENFFLSEDKCVD

SEQ ID NO: 2945820 - protein, 25 aa, Entamoeba invadens
KCDLKKEREVSCIAGEELAVKIRRV

SEQ ID NO: 2945821 - protein, 18 aa, Entamoeba invadens
KCDLSLKHVLIVGLGGVG

SEQ ID NO: 2945822 - protein, 18 aa, Entamoeba invadens
KCDRSRVDMVYKGKKYLN

SEQ ID NO: 2945823 - protein, 18 aa, Entamoeba invadens
KCDSEGKMIEDFRNAILK

SEQ ID NO: 2945824 - protein, 25 aa, Entamoeba invadens
KCDVKSDLKGTVGVNGLAMVRCTSW

SEQ ID NO: 2945825 - protein, 21 aa, Entamoeba invadens
KCDYINIFGTFDCQKVLSFCQ

SEQ ID NO: 2945826 - protein, 20 aa, Entamoeba invadens
KCDYPCFRCEGIVSNDCIDC

SEQ ID NO: 2945827 - protein, 18 aa, Entamoeba invadens
KCEAHLKGGAKKVIISAP

SEQ ID NO: 2945828 - protein, 22 aa, Entamoeba invadens
KCEDCGKYFCNGRILNHSFSQI

SEQ ID NO: 2945829 - protein, 20 aa, Entamoeba invadens
KCEDLLKMKVFDEAEGSTMK

SEQ ID NO: 2945830 - protein, 17 aa, Entamoeba invadens
KCEGGCDKSIGMLFYQL

SEQ ID NO: 2945831 - protein, 24 aa, Entamoeba invadens
KCEIIKIEYCRDFDFIFGDSKIQK

SEQ ID NO: 2945832 - protein, 21 aa, Entamoeba invadens
KCEIPFYQVVFWFIVDFGITQ

SEQ ID NO: 2945833 - protein, 17 aa, Entamoeba invadens
KCEKFKLPVGIQELDID

SEQ ID NO: 2945834 - protein, 23 aa, Entamoeba invadens
KCEKFVILIGLLLFKVENYNTDF

SEQ ID NO: 2945835 - protein, 26 aa, Entamoeba invadens
KCEKSQINMLWLLRFLVSSEVFKNSL

SEQ ID NO: 2945836 - protein, 19 aa, Entamoeba invadens
KCFDGCSMQSVQILNCKYR

SEQ ID NO: 2945837 - protein, 22 aa, Entamoeba invadens
KCFDNRLCISLALKMINDKGFD

SEQ ID NO: 2945838 - protein, 20 aa, Entamoeba invadens
KCFECNKFFDDFFVPNLIGV

SEQ ID NO: 2945839 - protein, 19 aa, Entamoeba invadens
KCFEGCGIVNFTVNMNRDV

SEQ ID NO: 2945840 - protein, 21 aa, Entamoeba invadens
KCFEILCPMSTSFYTEYVSAE

SEQ ID NO: 2945841 - protein, 24 aa, Entamoeba invadens
KCFEKCTFKSFVVPTQITSLGERC

SEQ ID NO: 2945842 - protein, 24 aa, Entamoeba invadens
KCFENCKSLSALTLSDYITQVEEG

SEQ ID NO: 2945843 - protein, 20 aa, Entamoeba invadens
KCFGNCAVLFAVTLPSALSH

SEQ ID NO: 2945844 - protein, 19 aa, Entamoeba invadens
KCFIDCAGLSEVQIGNKVK

SEQ ID NO: 2945845 - protein, 17 aa, Entamoeba invadens
KCFIGCTTLDISLLNTV

SEQ ID NO: 2945846 - protein, 22 aa, Entamoeba invadens
KCFKINGAFNGCYSLKEIAIPE

SEQ ID NO: 2945847 - protein, 20 aa, Entamoeba invadens
KCFKNCFKLKEVILPPFINM

SEQ ID NO: 2945848 - protein, 17 aa, Entamoeba invadens
KCFKNCTKLSKVVLSKN

SEQ ID NO: 2945849 - protein, 17 aa, Entamoeba invadens
KCFKNCYSLKEINLSHV

SEQ ID NO: 2945850 - protein, 26 aa, Entamoeba invadens
KCFLNCPRLRFVYLSKKVRKVGKSAF

SEQ ID NO: 2945851 - protein, 24 aa, Entamoeba invadens
KCFSACSTLNFVVFPRHLSEIGDE

SEQ ID NO: 2945852 - protein, 18 aa, Entamoeba invadens
KCFSCCDTLSAVTLPSLI

SEQ ID NO: 2945853 - protein, 26 aa, Entamoeba invadens
KCFSKCRNLSCIEISTSVIKFGYKCF

SEQ ID NO: 2945854 - protein, 27 aa, Entamoeba invadens
KCGEMLVKRSRFRSVILDSFVDGVCTK

SEQ ID NO: 2945855 - protein, 28 aa, Entamoeba invadens
KCGHLFCSECLEVLLNTQGVHYCPICRS

SEQ ID NO: 2945856 - protein, 20 aa, Entamoeba invadens
KCGIIKFTIPDTVVSLDLNL

SEQ ID NO: 2945857 - protein, 17 aa, Entamoeba invadens
KCGKTTICNTFFETTSS

SEQ ID NO: 2945858 - protein, 18 aa, Entamoeba invadens
KCGLKFDGVHFHVGSNSH

SEQ ID NO: 2945859 - protein, 21 aa, Entamoeba invadens
KCGRCVNGMDFLNLREDFIPT

SEQ ID NO: 2945860 - protein, 23 aa, Entamoeba invadens
KCGSCVCSNCSPDTLVIKGKKER

SEQ ID NO: 2945861 - protein, 26 aa, Entamoeba invadens
KCGSDGRLTKCYGIGKVKPFSDFTLR

SEQ ID NO: 2945862 - protein, 19 aa, Entamoeba invadens
KCGYCDWSCGGMCNGSTGV

SEQ ID NO: 2945863 - protein, 25 aa, Entamoeba invadens
KCHFKKCKWLTSFDIPSSVTHIGDD

SEQ ID NO: 2945864 - protein, 19 aa, Entamoeba invadens
KCIAEELGIHYVVEPAFGE

SEQ ID NO: 2945865 - protein, 20 aa, Entamoeba invadens
KCIAEELGIHYVVEPAFGEF

SEQ ID NO: 2945866 - protein, 22 aa, Entamoeba invadens
KCICDHKAFIFVLENNGAFDPM

SEQ ID NO: 2945867 - protein, 21 aa, Entamoeba invadens
KCIEKVASHKECCVEHICAIC

SEQ ID NO: 2945868 - protein, 26 aa, Entamoeba invadens
KCIEYPIEKCVSCLSTGKCIKCETYY

SEQ ID NO: 2945869 - protein, 24 aa, Entamoeba invadens
KCIGACFDGAYVLIRNGGLSGKFL

SEQ ID NO: 2945870 - protein, 19 aa, Entamoeba invadens
KCIGACFDGSYVLIRNGGL

SEQ ID NO: 2945871 - protein, 26 aa, Entamoeba invadens
KCIGCLQCVRVCPKGVLTSTHMKSTV

SEQ ID NO: 2945872 - protein, 17 aa, Entamoeba invadens
KCIKKEEGIGFECISQC

SEQ ID NO: 2945873 - protein, 24 aa, Entamoeba invadens
KCIKSECFYGCSVLKELDMSPEVD

SEQ ID NO: 2945874 - protein, 23 aa, Entamoeba invadens
KCIKSNAFESCLSLKEIVLPKSL

SEQ ID NO: 2945875 - protein, 20 aa, Entamoeba invadens
KCINCGKKSEFVDSSLGFFC

SEQ ID NO: 2945876 - protein, 24 aa, Entamoeba invadens
KCIPDYCFSCCQKLETIKHLENII

SEQ ID NO: 2945877 - protein, 26 aa, Entamoeba invadens
KCIPIIKEIHSGAVALQYTLALIKKM

SEQ ID NO: 2945878 - protein, 18 aa, Entamoeba invadens
KCIPVCGKDEYKYIENDQ

SEQ ID NO: 2945879 - protein, 20 aa, Entamoeba invadens
KCIRVMKRLQINPLVIEKTR

SEQ ID NO: 2945880 - protein, 25 aa, Entamoeba invadens
KCKDIIEHWGVIWDNFERILSTRKD

SEQ ID NO: 2945881 - protein, 20 aa, Entamoeba invadens
KCKEKSFVISPRVIFSSDEW

SEQ ID NO: 2945882 - protein, 28 aa, Entamoeba invadens
KCKIEAKPRRPTCVQPGKKKMTKAGFEK

SEQ ID NO: 2945883 - protein, 21 aa, Entamoeba invadens
KCKLSTYSATRWNYMANSSSA

SEQ ID NO: 2945884 - protein, 19 aa, Entamoeba invadens
KCKQQMCVECFANSVKENM

SEQ ID NO: 2945885 - protein, 20 aa, Entamoeba invadens
KCKSSVDRKGILVFSTDDLR

SEQ ID NO: 2945886 - protein, 20 aa, Entamoeba invadens
KCKVLKFTVKNAMTGGDYVV

SEQ ID NO: 2945887 - protein, 32 aa, Entamoeba invadens
KCKVPIEGRFAWKDDVGGFVCADCVAKANASA

SEQ ID NO: 2945888 - protein, 19 aa, Entamoeba invadens
KCKYEEMMYYFDSKPNNTE

SEQ ID NO: 2945889 - protein, 21 aa, Entamoeba invadens
KCLECKDPQYLASNGLCSNCE

SEQ ID NO: 2945890 - protein, 23 aa, Entamoeba invadens
KCLEIKPRFLLKNETNEVIVLNG

SEQ ID NO: 2945891 - protein, 29 aa, Entamoeba invadens
KCLFGYETLCSLKILPSVIIINNKKFNQN

SEQ ID NO: 2945892 - protein, 21 aa, Entamoeba invadens
KCLLEWCRGVTLELLYDSKVD

SEQ ID NO: 2945893 - protein, 19 aa, Entamoeba invadens
KCLNTCFDFSLLTTIQEAA

SEQ ID NO: 2945894 - protein, 17 aa, Entamoeba invadens
KCLPQELTIFADTRNAY

SEQ ID NO: 2945895 - protein, 24 aa, Entamoeba invadens
KCLVACKRVPGKVTKEEGIEVIDM

SEQ ID NO: 2945896 - protein, 18 aa, Entamoeba invadens
KCLVEIFNRGMIDLPDNV

SEQ ID NO: 2945897 - protein, 18 aa, Entamoeba invadens
KCNDFKKEKARNIGEILA

SEQ ID NO: 2945898 - protein, 17 aa, Entamoeba invadens
KCNEGLFILNGKCVNLP

SEQ ID NO: 2945899 - protein, 23 aa, Entamoeba invadens
KCNEPCIPLLPVVLKDLEKIHDN

SEQ ID NO: 2945900 - protein, 17 aa, Entamoeba invadens
KCNFIIRGGKSCSQFLS

SEQ ID NO: 2945901 - protein, 23 aa, Entamoeba invadens
KCNFPVEISCDLSRMIFYRKELQ

SEQ ID NO: 2945902 - protein, 25 aa, Entamoeba invadens
KCNVLSCYGTFVFGNRGYISVMNSI

SEQ ID NO: 2945903 - protein, 17 aa, Entamoeba invadens
KCPDFSIYTFGRIEMEK

SEQ ID NO: 2945904 - protein, 20 aa, Entamoeba invadens
KCPKCSATIEKNRGCNHMTC

SEQ ID NO: 2945905 - protein, 26 aa, Entamoeba invadens
KCPLCKCPVLKAYGCNHINCTCGCEF

SEQ ID NO: 2945906 - protein, 21 aa, Entamoeba invadens
KCPNVKLSLERPMKKLLVGSE

SEQ ID NO: 2945907 - protein, 24 aa, Entamoeba invadens
KCPSFESRSLFSIIRNSVLKMREY

SEQ ID NO: 2945908 - protein, 26 aa, Entamoeba invadens
KCPTCPAKVHKTCYCGRSEKDLCCGE

SEQ ID NO: 2945909 - protein, 19 aa, Entamoeba invadens
KCPVFCMRWTPDGRRLITG

SEQ ID NO: 2945910 - protein, 19 aa, Entamoeba invadens
KCQDMVCDFVKEFGAEINI

SEQ ID NO: 2945911 - protein, 20 aa, Entamoeba invadens
KCQIASFCEMIRKFSTEMFE

SEQ ID NO: 2945912 - protein, 18 aa, Entamoeba invadens
KCRMVHLEHLLSSIEKKM

SEQ ID NO: 2945913 - protein, 18 aa, Entamoeba invadens
KCRYDYVVDAIDSVSPKV

SEQ ID NO: 2945914 - protein, 22 aa, Entamoeba invadens
KCSCAVVGKRIRMSDDLKRLQA

SEQ ID NO: 2945915 - protein, 18 aa, Entamoeba invadens
KCSCKIDDKIVLFSKGLK

SEQ ID NO: 2945916 - protein, 21 aa, Entamoeba invadens
KCSKIGAIIDLLGVYASNVPE

SEQ ID NO: 2945917 - protein, 21 aa, Entamoeba invadens
KCSNLKSIVFEDGRNVDINKE

SEQ ID NO: 2945918 - protein, 20 aa, Entamoeba invadens
KCSNMGVLNCDGNCIVFESS

SEQ ID NO: 2945919 - protein, 18 aa, Entamoeba invadens
KCSPLMPLVSSGAKPILP

SEQ ID NO: 2945920 - protein, 29 aa, Entamoeba invadens
KCSTIPERVYWKWFLRLSEIPRPSYHCLP

SEQ ID NO: 2945921 - protein, 19 aa, Entamoeba invadens
KCTDLFFHLHINPYKSSKI

SEQ ID NO: 2945922 - protein, 18 aa, Entamoeba invadens
KCTDSHYITKGMCEVCDH

SEQ ID NO: 2945923 - protein, 21 aa, Entamoeba invadens
KCTFKSTSFVNTFTRIENCSL

SEQ ID NO: 2945924 - protein, 20 aa, Entamoeba invadens
KCTFVVMTTMFYKILPEAQF

SEQ ID NO: 2945925 - protein, 18 aa, Entamoeba invadens
KCTKCHADELVLYNKTKT

SEQ ID NO: 2945926 - protein, 26 aa, Entamoeba invadens
KCTKFECLECQTGFYLNDNKLCSLCS

SEQ ID NO: 2945927 - protein, 17 aa, Entamoeba invadens
KCTKLTRVVLPDNLIPI

SEQ ID NO: 2945928 - protein, 21 aa, Entamoeba invadens
KCTKSSIILDTKFCDLLSTSF

SEQ ID NO: 2945929 - protein, 21 aa, Entamoeba invadens
KCTKTNFLIELDVEKMYLCKD

SEQ ID NO: 2945930 - protein, 19 aa, Entamoeba invadens
KCTQSPKFVKVISSKQRKN

SEQ ID NO: 2945931 - protein, 19 aa, Entamoeba invadens
KCVCGKYICNGPVSNCGDC

SEQ ID NO: 2945932 - protein, 18 aa, Entamoeba invadens
KCVCPYCRGDFTDFQTVK

SEQ ID NO: 2945933 - protein, 19 aa, Entamoeba invadens
KCVEDLKFIDWKCIVGKLT

SEQ ID NO: 2945934 - protein, 25 aa, Entamoeba invadens
KCVEDLKFIDWRGIVGNLTVKQRKV

SEQ ID NO: 2945935 - protein, 23 aa, Entamoeba invadens
KCVEMIWEKLGLIKTYLKSKSGD

SEQ ID NO: 2945936 - protein, 21 aa, Entamoeba invadens
KCVFCKALHFECERRNKHHPN

SEQ ID NO: 2945937 - protein, 18 aa, Entamoeba invadens
KCVFKDCVGLLYVEMRGV

SEQ ID NO: 2945938 - protein, 21 aa, Entamoeba invadens
KCVGCQLCTTKCTFDVLEKGK

SEQ ID NO: 2945939 - protein, 19 aa, Entamoeba invadens
KCVKLKGKIEFNKITEIGE

SEQ ID NO: 2945940 - protein, 30 aa, Entamoeba invadens
KCVKNENNVFVWTYKDYKAFDHTEELNHQF

SEQ ID NO: 2945941 - protein, 17 aa, Entamoeba invadens
KCVQCIVSSIENVTNVA

SEQ ID NO: 2945942 - protein, 19 aa, Entamoeba invadens
KCVRCGLAYHHSGITQEER

SEQ ID NO: 2945943 - protein, 20 aa, Entamoeba invadens
KCVRKMRHATMWRNAIKELN

SEQ ID NO: 2945944 - protein, 21 aa, Entamoeba invadens
KCYMICYNGALIMKGSEIIYE

SEQ ID NO: 2945945 - protein, 20 aa, Entamoeba invadens
KCYSLEFVVLPSLLLEIGNY

SEQ ID NO: 2945946 - protein, 25 aa, Entamoeba invadens
KDADIKKHPWFEGIDWDKLLAKQLP

SEQ ID NO: 2945947 - protein, 18 aa, Entamoeba invadens
KDAFTEKMFFDFSKNLKM

SEQ ID NO: 2945948 - protein, 20 aa, Entamoeba invadens
KDAGANVVLCQWGFDDEANH

SEQ ID NO: 2945949 - protein, 24 aa, Entamoeba invadens
KDAIETYPGFSIFKKELTQLFVQD

SEQ ID NO: 2945950 - protein, 20 aa, Entamoeba invadens
KDAIPVFLWMANNYFTVQGS

SEQ ID NO: 2945951 - protein, 24 aa, Entamoeba invadens
KDAKETLTCLTLEWVDELTERNEG

SEQ ID NO: 2945952 - protein, 24 aa, Entamoeba invadens
KDALKRPNVSVIFQTENAVFGVNH

SEQ ID NO: 2945953 - protein, 22 aa, Entamoeba invadens
KDAMEYGLNRFTRDAKFTQKPK

SEQ ID NO: 2945954 - protein, 19 aa, Entamoeba invadens
KDAQIKIAEFQRTCNEFQE

SEQ ID NO: 2945955 - protein, 17 aa, Entamoeba invadens
KDAQRKIAELTKRIEDG

SEQ ID NO: 2945956 - protein, 21 aa, Entamoeba invadens
KDAQRKLAELVKRIEDGLNDS

SEQ ID NO: 2945957 - protein, 17 aa, Entamoeba invadens
KDARVQARILQTLEEYK

SEQ ID NO: 2945958 - protein, 18 aa, Entamoeba invadens
KDATFCLFNGIEHTSGIV

SEQ ID NO: 2945959 - protein, 19 aa, Entamoeba invadens
KDAVGWSFLVECNKGRYHT

SEQ ID NO: 2945960 - protein, 19 aa, Entamoeba invadens
KDAVKCIPIIKEIHSGAVA

SEQ ID NO: 2945961 - protein, 17 aa, Entamoeba invadens
KDCELFNGILPFNITNL

SEQ ID NO: 2945962 - protein, 25 aa, Entamoeba invadens
KDDFIKMKGVILLRSIIIKAVPIQV

SEQ ID NO: 2945963 - protein, 29 aa, Entamoeba invadens
KDDICKLPELYKDLNLFVTSPSEWLEKSV

SEQ ID NO: 2945964 - protein, 19 aa, Entamoeba invadens
KDDIELISSHGFGCRVIQR

SEQ ID NO: 2945965 - protein, 25 aa, Entamoeba invadens
KDDKKEKKKVFGIFKKKDKHADEDF

SEQ ID NO: 2945966 - protein, 22 aa, Entamoeba invadens
KDDPTRPSVVFMLAALINKLNL

SEQ ID NO: 2945967 - protein, 20 aa, Entamoeba invadens
KDDQACFALISLRCTLEGIP

SEQ ID NO: 2945968 - protein, 20 aa, Entamoeba invadens
KDDQACFVLISLRCTLEGVP

SEQ ID NO: 2945969 - protein, 20 aa, Entamoeba invadens
KDDSKVYVLKLMFGETDKDV

SEQ ID NO: 2945970 - protein, 26 aa, Entamoeba invadens
KDDVKIARALIRCFTTLNLQSHLLVE

SEQ ID NO: 2945971 - protein, 19 aa, Entamoeba invadens
KDDVLKQIFSYTGKDDLIR

SEQ ID NO: 2945972 - protein, 34 aa, Entamoeba invadens
KDDVPKFPGFELFKMDIFRLVSIKLKEEAPLTQE

SEQ ID NO: 2945973 - protein, 23 aa, Entamoeba invadens
KDECLSCKDGYFTSKHKMKIQFS

SEQ ID NO: 2945974 - protein, 24 aa, Entamoeba invadens
KDEDGYFYWVYKNYVVFKTLNKQK

SEQ ID NO: 2945975 - protein, 23 aa, Entamoeba invadens
KDEFYMDVILTFQDAIYFNHPES

SEQ ID NO: 2945976 - protein, 24 aa, Entamoeba invadens
KDEKESRTGCTFRIHLIGHSLGGL

SEQ ID NO: 2945977 - protein, 24 aa, Entamoeba invadens
KDEKKSSVIPTDFTKTEKNVVNST

SEQ ID NO: 2945978 - protein, 22 aa, Entamoeba invadens
KDEKLCKCFNEFMTQLNRMDKI

SEQ ID NO: 2945979 - protein, 26 aa, Entamoeba invadens
KDELDCIGCTCTIVYVWEEDGEMYVQ

SEQ ID NO: 2945980 - protein, 19 aa, Entamoeba invadens
KDEMEAFLLYIYTGNPSFP

SEQ ID NO: 2945981 - protein, 31 aa, Entamoeba invadens
KDENLTKLFAFLKRIIPTITLSPTNFSQTTT

SEQ ID NO: 2945982 - protein, 26 aa, Entamoeba invadens
KDENYGLCHVCVVASIIKGKNTRELN

SEQ ID NO: 2945983 - protein, 19 aa, Entamoeba invadens
KDESSGWWTGELHAKTGLF

SEQ ID NO: 2945984 - protein, 18 aa, Entamoeba invadens
KDEVHVMGTEVSTLKDDL

SEQ ID NO: 2945985 - protein, 21 aa, Entamoeba invadens
KDEYPTAMGFVDFENEEDAQK

SEQ ID NO: 2945986 - protein, 24 aa, Entamoeba invadens
KDFDALSALWKYIFEEKLRIDSSE

SEQ ID NO: 2945987 - protein, 24 aa, Entamoeba invadens
KDFEKMCCKSLLVGGDDRNFQIGI

SEQ ID NO: 2945988 - protein, 19 aa, Entamoeba invadens
KDFGGYLLIYKKREFCVEN

SEQ ID NO: 2945989 - protein, 27 aa, Entamoeba invadens
KDFKMLTLEGWYEMLWHSDISVYQKEV

SEQ ID NO: 2945990 - protein, 24 aa, Entamoeba invadens
KDFKRIFKSLSFPDLLSCRLVCKK

SEQ ID NO: 2945991 - protein, 17 aa, Entamoeba invadens
KDFKVVIEKALAMDGFQ

SEQ ID NO: 2945992 - protein, 19 aa, Entamoeba invadens
KDFKVVIEKALAMEGFQDD

SEQ ID NO: 2945993 - protein, 20 aa, Entamoeba invadens
KDFKYAWNIADFTSSGKRLH

SEQ ID NO: 2945994 - protein, 17 aa, Entamoeba invadens
KDFLLSYHIRRIVNVSK

SEQ ID NO: 2945995 - protein, 25 aa, Entamoeba invadens
KDFLPRGSGIVTRRPLIVQCVRSDV

SEQ ID NO: 2945996 - protein, 25 aa, Entamoeba invadens
KDFLPRGSGIVTRRPLIVQCVRTDV

SEQ ID NO: 2945997 - protein, 21 aa, Entamoeba invadens
KDFSEHIPIALCGNKCDLESE

SEQ ID NO: 2945998 - protein, 21 aa, Entamoeba invadens
KDFSEHIPIALCGNKCDLESN

SEQ ID NO: 2945999 - protein, 21 aa, Entamoeba invadens
KDFSHMPPLRMKVKQQLPTLT

SEQ ID NO: 2946000 - protein, 18 aa, Entamoeba invadens
KDFTCIHPYFNIPNLQVF

SEQ ID NO: 2946001 - protein, 19 aa, Entamoeba invadens
KDGECKFMIGNDRTSLLKI

SEQ ID NO: 2946002 - protein, 20 aa, Entamoeba invadens
KDGHLLWLLLEKIPKEEQTV

SEQ ID NO: 2946003 - protein, 21 aa, Entamoeba invadens
KDGIIKLANFGSVAFVDEKHP

SEQ ID NO: 2946004 - protein, 23 aa, Entamoeba invadens
KDGKDFALKKCVITSKNEKSLIN

SEQ ID NO: 2946005 - protein, 20 aa, Entamoeba invadens
KDGKDFIPLIDIMLSSLIEL

SEQ ID NO: 2946006 - protein, 25 aa, Entamoeba invadens
KDGLITKIVLCYPVSYSSSKKEKRC

SEQ ID NO: 2946007 - protein, 34 aa, Entamoeba invadens
KDGNPFKFFQRGFFKNCTEDMYFQSNVETYCFVP

SEQ ID NO: 2946008 - protein, 20 aa, Entamoeba invadens
KDGRSGQRFNSISLNKTGEK

SEQ ID NO: 2946009 - protein, 23 aa, Entamoeba invadens
KDGWERSCDVCLLNEMDSKGLEL

SEQ ID NO: 2946010 - protein, 25 aa, Entamoeba invadens
KDHFYTKIIVHFAVKSETIAKIKKA

SEQ ID NO: 2946011 - protein, 25 aa, Entamoeba invadens
KDHIPEIVVNYFIRLFIDRFDRVVF

SEQ ID NO: 2946012 - protein, 20 aa, Entamoeba invadens
KDHPNVFAWYVDDETPLCGL

SEQ ID NO: 2946013 - protein, 18 aa, Entamoeba invadens
KDIAEITLRAETPEKNVQ

SEQ ID NO: 2946014 - protein, 18 aa, Entamoeba invadens
KDIAEITVRAETIEKNIQ

SEQ ID NO: 2946015 - protein, 17 aa, Entamoeba invadens
KDIARWNKRTQTMDDND

SEQ ID NO: 2946016 - protein, 18 aa, Entamoeba invadens
KDIETLFGTKEFEFRINE

SEQ ID NO: 2946017 - protein, 20 aa, Entamoeba invadens
KDIFIGGDIDKYGRCVICTS

SEQ ID NO: 2946018 - protein, 19 aa, Entamoeba invadens
KDIFLRELISNCSDALDKI

SEQ ID NO: 2946019 - protein, 26 aa, Entamoeba invadens
KDIFTEFRVSGTLKKARQNLHNKFFE

SEQ ID NO: 2946020 - protein, 21 aa, Entamoeba invadens
KDIIIGIFSLCCNRFRDKVTP

SEQ ID NO: 2946021 - protein, 25 aa, Entamoeba invadens
KDIKEAYRKLSLTSFLITPIQRLPR

SEQ ID NO: 2946022 - protein, 26 aa, Entamoeba invadens
KDIKKRLKTLRRLRIMNHRLRHLKHK

SEQ ID NO: 2946023 - protein, 49 aa, Entamoeba invadens
KDIKLAFSSDVLKIVFILRNCPVPEIVKVLKYYFPKCGNFDDDEVDLLR

SEQ ID NO: 2946024 - protein, 28 aa, Entamoeba invadens
KDIKTLPLHKLRESIGMVGQEPVLFSES

SEQ ID NO: 2946025 - protein, 18 aa, Entamoeba invadens
KDILKEKLLFAIQNATGF

SEQ ID NO: 2946026 - protein, 18 aa, Entamoeba invadens
KDILKYKTEIDAYKLQLK

SEQ ID NO: 2946027 - protein, 19 aa, Entamoeba invadens
KDILNLLIEVLDIVHDAQQ

SEQ ID NO: 2946028 - protein, 17 aa, Entamoeba invadens
KDIPQYVHRAGRTARAG

SEQ ID NO: 2946029 - protein, 20 aa, Entamoeba invadens
KDIQAKWKVDAKMNKRMWGR

SEQ ID NO: 2946030 - protein, 18 aa, Entamoeba invadens
KDIRKCREQIRRMKKKEL

SEQ ID NO: 2946031 - protein, 26 aa, Entamoeba invadens
KDISIEEFNAFLAVTIIQGQFKDNKI

SEQ ID NO: 2946032 - protein, 21 aa, Entamoeba invadens
KDITFNSCFIEKVETIPMSVK

SEQ ID NO: 2946033 - protein, 17 aa, Entamoeba invadens
KDIYHCILSGGKLPSFF

SEQ ID NO: 2946034 - protein, 21 aa, Entamoeba invadens
KDKAGKLAVEYALENKLDLST

SEQ ID NO: 2946035 - protein, 21 aa, Entamoeba invadens
KDKAYETFQYFFPEMSNDNFQ

SEQ ID NO: 2946036 - protein, 24 aa, Entamoeba invadens
KDKCPSCRGLRVVQEEKILEIVVQ

SEQ ID NO: 2946037 - protein, 29 aa, Entamoeba invadens
KDKEAILEANMKYAVLLSASRAAEERNLK

SEQ ID NO: 2946038 - protein, 21 aa, Entamoeba invadens
KDKEVCKASREVKKDCDKTKN

SEQ ID NO: 2946039 - protein, 23 aa, Entamoeba invadens
KDKFKFPWSIAEFVIKGSRLPKP

SEQ ID NO: 2946040 - protein, 24 aa, Entamoeba invadens
KDKIKNFFCNSVVGKQNLCVVVED

SEQ ID NO: 2946041 - protein, 23 aa, Entamoeba invadens
KDKKFRLKIFMGDYAYDDRDGCV

SEQ ID NO: 2946042 - protein, 21 aa, Entamoeba invadens
KDKKGVLLFSKFREFLEKFPT

SEQ ID NO: 2946043 - protein, 19 aa, Entamoeba invadens
KDKKKFCENNVLIQKENND

SEQ ID NO: 2946044 - protein, 21 aa, Entamoeba invadens
KDKKRLLKMCQKIYFECKDVD

SEQ ID NO: 2946045 - protein, 25 aa, Entamoeba invadens
KDKLGDMLPRLLLLLQDEDTNIQKL

SEQ ID NO: 2946046 - protein, 28 aa, Entamoeba invadens
KDKLLPKHIYRFVGILIYMGAHHDTKNP

SEQ ID NO: 2946047 - protein, 32 aa, Entamoeba invadens
KDKLSLVEIGPRLCLRLIKILMGCFQGATAYV

SEQ ID NO: 2946048 - protein, 19 aa, Entamoeba invadens
KDKMAIPVHFDVFYSKMKL

SEQ ID NO: 2946049 - protein, 25 aa, Entamoeba invadens
KDKMFRTMFFYKLIQQVVSVYTGKA

SEQ ID NO: 2946050 - protein, 22 aa, Entamoeba invadens
KDKPWKNQFFYYFYKTKPDLDV

SEQ ID NO: 2946051 - protein, 20 aa, Entamoeba invadens
KDKRIFPFFIENLQTTDHGE

SEQ ID NO: 2946052 - protein, 23 aa, Entamoeba invadens
KDKRKVDNYTVAIIIANFFFCVN

SEQ ID NO: 2946053 - protein, 27 aa, Entamoeba invadens
KDKSNGLKCAICWDVSDDVVTTQCGHI

SEQ ID NO: 2946054 - protein, 17 aa, Entamoeba invadens
KDKVCSPVCLNVVNKLT

SEQ ID NO: 2946055 - protein, 18 aa, Entamoeba invadens
KDKYYKRETDCISCDELC

SEQ ID NO: 2946056 - protein, 21 aa, Entamoeba invadens
KDLAGARKRFGRFRRRSADNE

SEQ ID NO: 2946057 - protein, 24 aa, Entamoeba invadens
KDLDFRFQLQAKKYLSSDLRLVLK

SEQ ID NO: 2946058 - protein, 24 aa, Entamoeba invadens
KDLDPMCYKKFCFLVRLGDGQYSR

SEQ ID NO: 2946059 - protein, 17 aa, Entamoeba invadens
KDLEMFATHNCKMTPIE

SEQ ID NO: 2946060 - protein, 31 aa, Entamoeba invadens
KDLEMNKEYSLGFALSRFVCDSITGTEGQSN

SEQ ID NO: 2946061 - protein, 24 aa, Entamoeba invadens
KDLIRHLVCPVAKRFNSLGQIQGH

SEQ ID NO: 2946062 - protein, 18 aa, Entamoeba invadens
KDLISDFTFKTWTFYITR

SEQ ID NO: 2946063 - protein, 23 aa, Entamoeba invadens
KDLKDAYDLCMRFKAKDKKATDK

SEQ ID NO: 2946064 - protein, 22 aa, Entamoeba invadens
KDLKEAYEFCLRFKAKNRTATD

SEQ ID NO: 2946065 - protein, 18 aa, Entamoeba invadens
KDLKGEIDEMTYGSKLKN

SEQ ID NO: 2946066 - protein, 21 aa, Entamoeba invadens
KDLKKDIALLRNSFDQKKKER

SEQ ID NO: 2946067 - protein, 23 aa, Entamoeba invadens
KDLKREVVIPVIKIDSGVDDPNR

SEQ ID NO: 2946068 - protein, 24 aa, Entamoeba invadens
KDLLGRTKFSSVYKAFLNSQQVAL

SEQ ID NO: 2946069 - protein, 23 aa, Entamoeba invadens
KDLLNKIPVFFLEVNDMTKVSDL

SEQ ID NO: 2946070 - protein, 28 aa, Entamoeba invadens
KDLLTNHCLFCLYTHTALFGEEKFPKGM

SEQ ID NO: 2946071 - protein, 21 aa, Entamoeba invadens
KDLNAFYGLVDFYVKILTAKK

SEQ ID NO: 2946072 - protein, 20 aa, Entamoeba invadens
KDLNEAFNMYREMYYEGGVH

SEQ ID NO: 2946073 - protein, 17 aa, Entamoeba invadens
KDLNIDNVISFVKITGD

SEQ ID NO: 2946074 - protein, 25 aa, Entamoeba invadens
KDLNRAALTFNWLVDYAEQNGFIVH

SEQ ID NO: 2946075 - protein, 28 aa, Entamoeba invadens
KDLNRSALSFNWLVKYVEQYGYILTRRP

SEQ ID NO: 2946076 - protein, 19 aa, Entamoeba invadens
KDLNSSIQFFDSENNKIAE

SEQ ID NO: 2946077 - protein, 19 aa, Entamoeba invadens
KDLPEKYTKGVLLFPPKPL

SEQ ID NO: 2946078 - protein, 17 aa, Entamoeba invadens
KDLPIAGVVLVNPAVSV

SEQ ID NO: 2946079 - protein, 26 aa, Entamoeba invadens
KDLPKEFKGTFDTVLKTFKAELTQMQ

SEQ ID NO: 2946080 - protein, 23 aa, Entamoeba invadens
KDLPRTEIGGVYLKKGEPLFAAI

SEQ ID NO: 2946081 - protein, 28 aa, Entamoeba invadens
KDLPYDFFKNSFCDIPVTANIYFDKNIV

SEQ ID NO: 2946082 - protein, 22 aa, Entamoeba invadens
KDLQFGISTCQLINCIKLNILQ

SEQ ID NO: 2946083 - protein, 34 aa, Entamoeba invadens
KDLQRLCWKGVPWHFRPKVWRILTNETPLSLSKQ

SEQ ID NO: 2946084 - protein, 19 aa, Entamoeba invadens
KDLRRILRKMLSYDEKERI

SEQ ID NO: 2946085 - protein, 25 aa, Entamoeba invadens
KDLSELISLAFVCFKKKNETMKNAE

SEQ ID NO: 2946086 - protein, 17 aa, Entamoeba invadens
KDLSKIFSVRNVIEEAD

SEQ ID NO: 2946087 - protein, 25 aa, Entamoeba invadens
KDLTIPNCYSGIVGNVESPRPGLST

SEQ ID NO: 2946088 - protein, 25 aa, Entamoeba invadens
KDLVPKSIIHFLVFKTRDSVQKELI

SEQ ID NO: 2946089 - protein, 17 aa, Entamoeba invadens
KDLYGNIFLSGGNQSKN

SEQ ID NO: 2946090 - protein, 20 aa, Entamoeba invadens
KDLYKNIVFSSGTSMYSGIN

SEQ ID NO: 2946091 - protein, 24 aa, Entamoeba invadens
KDLYPRKWGLGPFAQQKKKLVAEG

SEQ ID NO: 2946092 - protein, 24 aa, Entamoeba invadens
KDLYRRTFAPNMMRPMRAADTNGT

SEQ ID NO: 2946093 - protein, 17 aa, Entamoeba invadens
KDMFKMHFAEELLAGIA

SEQ ID NO: 2946094 - protein, 17 aa, Entamoeba invadens
KDMFKMHFTEELLAGTA

SEQ ID NO: 2946095 - protein, 17 aa, Entamoeba invadens
KDMIGIKQIPIWEENSH

SEQ ID NO: 2946096 - protein, 20 aa, Entamoeba invadens
KDMIIRGGHNVWPIEICEVL

SEQ ID NO: 2946097 - protein, 30 aa, Entamoeba invadens
KDMMSLGEILRVFCGITLYKNKKIELDEEF

SEQ ID NO: 2946098 - protein, 21 aa, Entamoeba invadens
KDMRVDNEFIKALLMLHFGTD

SEQ ID NO: 2946099 - protein, 23 aa, Entamoeba invadens
KDMYDMVVSYGFLNGNNCKCEMQ

SEQ ID NO: 2946100 - protein, 18 aa, Entamoeba invadens
KDNCPQCHLPAFNTKGRG

SEQ ID NO: 2946101 - protein, 23 aa, Entamoeba invadens
KDNDRYIRWSSKDSGHSFEIVDP

SEQ ID NO: 2946102 - protein, 18 aa, Entamoeba invadens
KDNDSLVKFLSNIINENI

SEQ ID NO: 2946103 - protein, 32 aa, Entamoeba invadens
KDNKPFGGITFRPFPLRGFVEIVFCAVDSTVQ

SEQ ID NO: 2946104 - protein, 33 aa, Entamoeba invadens
KDNKWNLAIESCIKRSTLASFIVRSENDKRKLR

SEQ ID NO: 2946105 - protein, 18 aa, Entamoeba invadens
KDNPNKRRLVQRLIPSTF

SEQ ID NO: 2946106 - protein, 18 aa, Entamoeba invadens
KDNRVCIDNEKIKHVIED

SEQ ID NO: 2946107 - protein, 25 aa, Entamoeba invadens
KDNVLKMMISAIIVALKMANPKYEA

SEQ ID NO: 2946108 - protein, 26 aa, Entamoeba invadens
KDNYFGGKVPPIFVVHSLKHVPKEIA

SEQ ID NO: 2946109 - protein, 17 aa, Entamoeba invadens
KDPFFLYILLRCNSIPT

SEQ ID NO: 2946110 - protein, 18 aa, Entamoeba invadens
KDPHKREYISFLHSSFLQ

SEQ ID NO: 2946111 - protein, 19 aa, Entamoeba invadens
KDPLRMTFADVQIYFNSGD

SEQ ID NO: 2946112 - protein, 21 aa, Entamoeba invadens
KDPPERTACYIRDIAYARNSG

SEQ ID NO: 2946113 - protein, 22 aa, Entamoeba invadens
KDPSRLTVNFLYGTLNKDEKDV

SEQ ID NO: 2946114 - protein, 24 aa, Entamoeba invadens
KDPTRLMAYLAKIKLDEMGLDIER

SEQ ID NO: 2946115 - protein, 27 aa, Entamoeba invadens
KDPYLDKQFKFAWDIVDFVVSGKRLKR

SEQ ID NO: 2946116 - protein, 18 aa, Entamoeba invadens
KDQAIFFLNAFWAECGSE

SEQ ID NO: 2946117 - protein, 24 aa, Entamoeba invadens
KDQKKPDLLGMESLQVEPLSNPLK

SEQ ID NO: 2946118 - protein, 26 aa, Entamoeba invadens
KDQQKRRCGFSTKRLQRNWRNSASSE

SEQ ID NO: 2946119 - protein, 20 aa, Entamoeba invadens
KDQRHVVAIQGLTTVAREEF

SEQ ID NO: 2946120 - protein, 18 aa, Entamoeba invadens
KDQWSPALTLSRVLLSIS

SEQ ID NO: 2946121 - protein, 17 aa, Entamoeba invadens
KDRCKNQVFKKHDLLRK

SEQ ID NO: 2946122 - protein, 18 aa, Entamoeba invadens
KDRDSCPVCLKKFGYFLP

SEQ ID NO: 2946123 - protein, 21 aa, Entamoeba invadens
KDRDTWSQFLINNENPLYSCI

SEQ ID NO: 2946124 - protein, 23 aa, Entamoeba invadens
KDREEFYRKAGYKGLQKDMERER

SEQ ID NO: 2946125 - protein, 26 aa, Entamoeba invadens
KDRFKFPWKIAEFVISGKRLERNEDM

SEQ ID NO: 2946126 - protein, 20 aa, Entamoeba invadens
KDRKRRLSLVDLFTKRQSRD

SEQ ID NO: 2946127 - protein, 21 aa, Entamoeba invadens
KDRMKNFAFFIGRKCDNVVFD

SEQ ID NO: 2946128 - protein, 23 aa, Entamoeba invadens
KDRSGFVLCTGFSGKGNEASAKF

SEQ ID NO: 2946129 - protein, 32 aa, Entamoeba invadens
KDRTICSVVWYLVMVETFLPHIIKSVLPDILS

SEQ ID NO: 2946130 - protein, 19 aa, Entamoeba invadens
KDRTNVMVYMYDRHRIGFD

SEQ ID NO: 2946131 - protein, 21 aa, Entamoeba invadens
KDRVECFIDDFSLYNPESLTK

SEQ ID NO: 2946132 - protein, 28 aa, Entamoeba invadens
KDSELMSDMHLIDYSLLVGVHQLSDTEM

SEQ ID NO: 2946133 - protein, 29 aa, Entamoeba invadens
KDSELMSDMHLIDYSLLVGVHQLSDTEME

SEQ ID NO: 2946134 - protein, 23 aa, Entamoeba invadens
KDSEPIYRFVFVTHKEQEDKDGV

SEQ ID NO: 2946135 - protein, 23 aa, Entamoeba invadens
KDSFARLNMWFDELVRYGPNKGI

SEQ ID NO: 2946136 - protein, 18 aa, Entamoeba invadens
KDSFSIKFEEVYKNIHEK

SEQ ID NO: 2946137 - protein, 19 aa, Entamoeba invadens
KDSGIVIHIMQSLRVILSV

SEQ ID NO: 2946138 - protein, 23 aa, Entamoeba invadens
KDSIEILNQVGLYDKLRDADDKK

SEQ ID NO: 2946139 - protein, 22 aa, Entamoeba invadens
KDSKCSSCTFWYSPSDDGTHCS

SEQ ID NO: 2946140 - protein, 24 aa, Entamoeba invadens
KDSKGRRGFVYADYFTSFSHTEIV

SEQ ID NO: 2946141 - protein, 25 aa, Entamoeba invadens
KDSLRRFKALLLLHSVLQMEQNTLS

SEQ ID NO: 2946142 - protein, 17 aa, Entamoeba invadens
KDSMIFRVVGTNGEVHR

SEQ ID NO: 2946143 - protein, 27 aa, Entamoeba invadens
KDSNEIQSRLAICLQRTQRIIDGVTAL

SEQ ID NO: 2946144 - protein, 21 aa, Entamoeba invadens
KDSPFTCKILQDPSTACLLNS

SEQ ID NO: 2946145 - protein, 19 aa, Entamoeba invadens
KDSPWDIDVLFGTYDYNKE

SEQ ID NO: 2946146 - protein, 17 aa, Entamoeba invadens
KDSPWDIDVLFGTYNYN

SEQ ID NO: 2946147 - protein, 21 aa, Entamoeba invadens
KDSSARVCIFSVLTQTLPEFA

SEQ ID NO: 2946148 - protein, 21 aa, Entamoeba invadens
KDSSDIVLIDFGLAETITDVY

SEQ ID NO: 2946149 - protein, 28 aa, Entamoeba invadens
KDSTCLPCTVTNCFKCTEFECLGCQTVF

SEQ ID NO: 2946150 - protein, 20 aa, Entamoeba invadens
KDSVSYCFIDLQVFEVENTA

SEQ ID NO: 2946151 - protein, 17 aa, Entamoeba invadens
KDSVTFVRRFCSPARKY

SEQ ID NO: 2946152 - protein, 18 aa, Entamoeba invadens
KDSVVRLALELMQQTLTE

SEQ ID NO: 2946153 - protein, 17 aa, Entamoeba invadens
KDSWYSYYIRAVDKDLK

SEQ ID NO: 2946154 - protein, 17 aa, Entamoeba invadens
KDTAAGISTIFTIKNDF

SEQ ID NO: 2946155 - protein, 25 aa, Entamoeba invadens
KDTDPRHLLEFYRRYIPKQTGTSKL

SEQ ID NO: 2946156 - protein, 20 aa, Entamoeba invadens
KDTFKALCNFIVVPDSTYLS

SEQ ID NO: 2946157 - protein, 23 aa, Entamoeba invadens
KDTIKLFSLKKCTGVKMMNNIEM

SEQ ID NO: 2946158 - protein, 17 aa, Entamoeba invadens
KDTIKLSELILYIRDHN

SEQ ID NO: 2946159 - protein, 17 aa, Entamoeba invadens
KDTIMEFVQQIQKSNND

SEQ ID NO: 2946160 - protein, 22 aa, Entamoeba invadens
KDTLEPKLDFAYDETIKGSPLS

SEQ ID NO: 2946161 - protein, 29 aa, Entamoeba invadens
KDTLIPFVKRYVVWFTVSLTDSYSLFTDL

SEQ ID NO: 2946162 - protein, 18 aa, Entamoeba invadens
KDTMKKLNECLKITQFKE

SEQ ID NO: 2946163 - protein, 17 aa, Entamoeba invadens
KDTRFYRKWEICEKTNP

SEQ ID NO: 2946164 - protein, 25 aa, Entamoeba invadens
KDTRTCCIELLGLIHLSFSKQRNEL

SEQ ID NO: 2946165 - protein, 28 aa, Entamoeba invadens
KDTTTIGDFSFVNLNFDKPASTTAPTTT

SEQ ID NO: 2946166 - protein, 19 aa, Entamoeba invadens
KDTVFSMDWQYDGNVMILT

SEQ ID NO: 2946167 - protein, 20 aa, Entamoeba invadens
KDTVLFFIMNCFEIRMKKSN

SEQ ID NO: 2946168 - protein, 20 aa, Entamoeba invadens
KDTYIRAGDGFVIVYSITST

SEQ ID NO: 2946169 - protein, 17 aa, Entamoeba invadens
KDVAVEISNRAEIKEQQ

SEQ ID NO: 2946170 - protein, 21 aa, Entamoeba invadens
KDVDGLISIAVRNRSVAETKY

SEQ ID NO: 2946171 - protein, 26 aa, Entamoeba invadens
KDVDMKLRFKMCLDATKGVSYLHKNG

SEQ ID NO: 2946172 - protein, 20 aa, Entamoeba invadens
KDVEVGRAIVPLNYLLQKTQ

SEQ ID NO: 2946173 - protein, 17 aa, Entamoeba invadens
KDVFGCDMPLSACSLTS

SEQ ID NO: 2946174 - protein, 21 aa, Entamoeba invadens
KDVGCCKQLILGENLLLNGAF

SEQ ID NO: 2946175 - protein, 20 aa, Entamoeba invadens
KDVGCCQKLILKNSDTDVLY

SEQ ID NO: 2946176 - protein, 26 aa, Entamoeba invadens
KDVIFRHFAKIWSYKFINVTNGVTPR

SEQ ID NO: 2946177 - protein, 25 aa, Entamoeba invadens
KDVILKDELRGMRRVLKRLGYVSED

SEQ ID NO: 2946178 - protein, 25 aa, Entamoeba invadens
KDVITFVLCYVFYPNIVIPKALEGK

SEQ ID NO: 2946179 - protein, 23 aa, Entamoeba invadens
KDVITNLGLYRKKIVELRREMTS

SEQ ID NO: 2946180 - protein, 22 aa, Entamoeba invadens
KDVKCDHKFDELIRCTADYLRS

SEQ ID NO: 2946181 - protein, 24 aa, Entamoeba invadens
KDVKELKGLIPTYSKHYLVDGKNA

SEQ ID NO: 2946182 - protein, 19 aa, Entamoeba invadens
KDVKKKKVAEKMGEDLAPA

SEQ ID NO: 2946183 - protein, 26 aa, Entamoeba invadens
KDVKVFLLRDFFSLILKTASSEPIPV

SEQ ID NO: 2946184 - protein, 24 aa, Entamoeba invadens
KDVLRRFKALILLHTLSQLEESTI

SEQ ID NO: 2946185 - protein, 28 aa, Entamoeba invadens
KDVLTRIFPILMMFRRELTYPAMTMTSP

SEQ ID NO: 2946186 - protein, 19 aa, Entamoeba invadens
KDVLYNIKIVFVGDPCTLD

SEQ ID NO: 2946187 - protein, 18 aa, Entamoeba invadens
KDVMRNWFEFHRYASDEE

SEQ ID NO: 2946188 - protein, 28 aa, Entamoeba invadens
KDVREEFKELIPQIVMLFKNVIRSNGQE

SEQ ID NO: 2946189 - protein, 20 aa, Entamoeba invadens
KDVRNVCIIDCGHSNTTCSI

SEQ ID NO: 2946190 - protein, 32 aa, Entamoeba invadens
KDVRTVKRCFLCYRPCCKNHSINLEADAENTN

SEQ ID NO: 2946191 - protein, 26 aa, Entamoeba invadens
KDVSCSRIATEIKKKFPDVSLSKETV

SEQ ID NO: 2946192 - protein, 26 aa, Entamoeba invadens
KDVSRGCLKRGVAVVTVGYPACSTIA

SEQ ID NO: 2946193 - protein, 32 aa, Entamoeba invadens
KDVSVDDIINAWAILIKVKDSMQVGSYDRAKS

SEQ ID NO: 2946194 - protein, 19 aa, Entamoeba invadens
KDVVTRFATYFDDETLTRF

SEQ ID NO: 2946195 - protein, 20 aa, Entamoeba invadens
KDVYSLLTVDQFMLIYKNRI

SEQ ID NO: 2946196 - protein, 23 aa, Entamoeba invadens
KDWVKEPFIKPFDVVVDVELPNC

SEQ ID NO: 2946197 - protein, 18 aa, Entamoeba invadens
KDYESIIEWERWIRRMSD

SEQ ID NO: 2946198 - protein, 18 aa, Entamoeba invadens
KDYETIRFDDLYFEQWER

SEQ ID NO: 2946199 - protein, 19 aa, Entamoeba invadens
KDYFAFDITREIAQSWLAN

SEQ ID NO: 2946200 - protein, 19 aa, Entamoeba invadens
KDYFEVMKTVWGTEGNDKQ

SEQ ID NO: 2946201 - protein, 23 aa, Entamoeba invadens
KDYKEQKKGAAIVDEKSACLNET

SEQ ID NO: 2946202 - protein, 29 aa, Entamoeba invadens
KDYKKRPPALEMLKCEFMKPNGNRKRITD

SEQ ID NO: 2946203 - protein, 23 aa, Entamoeba invadens
KDYQMFHSLCFTEKVKKLRMFNI

SEQ ID NO: 2946204 - protein, 23 aa, Entamoeba invadens
KDYYYEKCVPRNMLILADGGYSS

SEQ ID NO: 2946205 - protein, 19 aa, Entamoeba invadens
KEAAQACEEMMDGTEIEGK

SEQ ID NO: 2946206 - protein, 19 aa, Entamoeba invadens
KEACDKNKIAVEPESIALK

SEQ ID NO: 2946207 - protein, 18 aa, Entamoeba invadens
KEACNIFYGTIIKSLSHY

SEQ ID NO: 2946208 - protein, 18 aa, Entamoeba invadens
KEAECYMPPWMMQRLKIG

SEQ ID NO: 2946209 - protein, 26 aa, Entamoeba invadens
KEAEFYWPKLLILLEILKMFEKTGDK

SEQ ID NO: 2946210 - protein, 21 aa, Entamoeba invadens
KEAEIRCAIATPSAETEEAAW

SEQ ID NO: 2946211 - protein, 21 aa, Entamoeba invadens
KEAELKIAHIQKIHKKQNEKG

SEQ ID NO: 2946212 - protein, 22 aa, Entamoeba invadens
KEAEVKKKIAFSQELSASRLKL

SEQ ID NO: 2946213 - protein, 18 aa, Entamoeba invadens
KEAFHFIEDILFMNGIVV

SEQ ID NO: 2946214 - protein, 17 aa, Entamoeba invadens
KEAFLHRSEELEAMKSG

SEQ ID NO: 2946215 - protein, 18 aa, Entamoeba invadens
KEAFMNMCNRLRKFVKPE

SEQ ID NO: 2946216 - protein, 18 aa, Entamoeba invadens
KEAFRNCKSLKYVVIENM

SEQ ID NO: 2946217 - protein, 25 aa, Entamoeba invadens
KEAFSLKGTFFTYFYDKFQALDNGI

SEQ ID NO: 2946218 - protein, 18 aa, Entamoeba invadens
KEAHKAILDTFFNKSKED

SEQ ID NO: 2946219 - protein, 18 aa, Entamoeba invadens
KEAHLKKLKVMQMDEKVE

SEQ ID NO: 2946220 - protein, 20 aa, Entamoeba invadens
KEAIEKLRVFKIPLPPPTEC

SEQ ID NO: 2946221 - protein, 19 aa, Entamoeba invadens
KEALIKVVVEYGRSDMMNE

SEQ ID NO: 2946222 - protein, 17 aa, Entamoeba invadens
KEALLVFKIMEVDKNAK

SEQ ID NO: 2946223 - protein, 24 aa, Entamoeba invadens
KEAQALLKRTLLFVNNIKQSFQYL

SEQ ID NO: 2946224 - protein, 22 aa, Entamoeba invadens
KEAREGADLLIEKKFIKEFPQD

SEQ ID NO: 2946225 - protein, 18 aa, Entamoeba invadens
KEARKESIIRKKQNILKN

SEQ ID NO: 2946226 - protein, 18 aa, Entamoeba invadens
KEARMNCITPKNLFCSEI

SEQ ID NO: 2946227 - protein, 19 aa, Entamoeba invadens
KEASYHFISPVSVQIQEIN

SEQ ID NO: 2946228 - protein, 23 aa, Entamoeba invadens
KEATFALAMKCMYESPKNLLKSE

SEQ ID NO: 2946229 - protein, 25 aa, Entamoeba invadens
KEATKLAFKEFFPIGKCVSQNCENT

SEQ ID NO: 2946230 - protein, 20 aa, Entamoeba invadens
KEATPFVEITREFFKRLFDD

SEQ ID NO: 2946231 - protein, 25 aa, Entamoeba invadens
KEAVSCYIASCGDLCKIRVEAVEAM

SEQ ID NO: 2946232 - protein, 19 aa, Entamoeba invadens
KEAYKRISSAEKEKMEAKI

SEQ ID NO: 2946233 - protein, 21 aa, Entamoeba invadens
KEAYLACNLNRQQIQRFQHLV

SEQ ID NO: 2946234 - protein, 24 aa, Entamoeba invadens
KEAYLKGLINYGCVDNMKSNLLLQ

SEQ ID NO: 2946235 - protein, 24 aa, Entamoeba invadens
KECGAKMELVRHVSFVDCPGHDSL

SEQ ID NO: 2946236 - protein, 19 aa, Entamoeba invadens
KECGFDYYYDKAFLDKVEQ

SEQ ID NO: 2946237 - protein, 25 aa, Entamoeba invadens
KECILSGLLSVDGKKVFHLDRNDYY

SEQ ID NO: 2946238 - protein, 21 aa, Entamoeba invadens
KECIPCVSPVGLADESGAVQR

SEQ ID NO: 2946239 - protein, 22 aa, Entamoeba invadens
KECRQILELYASVYEDLLAVPV

SEQ ID NO: 2946240 - protein, 18 aa, Entamoeba invadens
KECSKLIRKTVERPEFVA

SEQ ID NO: 2946241 - protein, 17 aa, Entamoeba invadens
KECVNWVNGQLPDEEPI

SEQ ID NO: 2946242 - protein, 24 aa, Entamoeba invadens
KECVSPHSFDLVFLTKEDPKGFIV

SEQ ID NO: 2946243 - protein, 17 aa, Entamoeba invadens
KECYSRNPTKFDGVDDM

SEQ ID NO: 2946244 - protein, 17 aa, Entamoeba invadens
KEDASLLRVGFKGDFDI

SEQ ID NO: 2946245 - protein, 19 aa, Entamoeba invadens
KEDENRFNTVFFVGKKLTP

SEQ ID NO: 2946246 - protein, 23 aa, Entamoeba invadens
KEDFKYPWKIAEFVMSGKRLENS

SEQ ID NO: 2946247 - protein, 17 aa, Entamoeba invadens
KEDFTVFNGIYPFGLTN

SEQ ID NO: 2946248 - protein, 25 aa, Entamoeba invadens
KEDFYKRLIVYEVDYTTSTYKEGKR

SEQ ID NO: 2946249 - protein, 23 aa, Entamoeba invadens
KEDIFKVFEIFKMIDERRETNID

SEQ ID NO: 2946250 - protein, 20 aa, Entamoeba invadens
KEDLNSFVAVVDWNMLSNGM

SEQ ID NO: 2946251 - protein, 26 aa, Entamoeba invadens
KEDLQMCISEKFLAIVSNVSYELVEV

SEQ ID NO: 2946252 - protein, 20 aa, Entamoeba invadens
KEDLRLALEEGIRVSSYEHS

SEQ ID NO: 2946253 - protein, 17 aa, Entamoeba invadens
KEDLSKLTTEYKLLEAD

SEQ ID NO: 2946254 - protein, 18 aa, Entamoeba invadens
KEDMNGCDMVLGYGGMYN

SEQ ID NO: 2946255 - protein, 20 aa, Entamoeba invadens
KEDNSGISIEECEHHEEQAQ

SEQ ID NO: 2946256 - protein, 17 aa, Entamoeba invadens
KEDQSGFGILRLVVEIV

SEQ ID NO: 2946257 - protein, 18 aa, Entamoeba invadens
KEDSCLYTDVYGSAELSS

SEQ ID NO: 2946258 - protein, 51 aa, Entamoeba invadens
KEDVIKRGFSSLDINEMFYHRYSKYYYIDWKTKQLFYHIGPIENTPRVLKE

SEQ ID NO: 2946259 - protein, 21 aa, Entamoeba invadens
KEDYTNFILPDFLSDEIQSNV

SEQ ID NO: 2946260 - protein, 19 aa, Entamoeba invadens
KEEAETFVSICNDYAQEDS

SEQ ID NO: 2946261 - protein, 25 aa, Entamoeba invadens
KEEARRISLVYEMMVDKTLDQMNTF

SEQ ID NO: 2946262 - protein, 22 aa, Entamoeba invadens
KEECKMEDGVIFGMENLKCMLN

SEQ ID NO: 2946263 - protein, 21 aa, Entamoeba invadens
KEEDKRGFWGLAPNKVVGLRY

SEQ ID NO: 2946264 - protein, 24 aa, Entamoeba invadens
KEEDLQRLFGLAGEIEKVVIDHET

SEQ ID NO: 2946265 - protein, 20 aa, Entamoeba invadens
KEEELGFMTKITCSKVPSAF

SEQ ID NO: 2946266 - protein, 24 aa, Entamoeba invadens
KEEEYPAVILVVFRKYLYLCRKLQ

SEQ ID NO: 2946267 - protein, 27 aa, Entamoeba invadens
KEEFKKFSFTGCIGITGVFLNKVAKDF

SEQ ID NO: 2946268 - protein, 24 aa, Entamoeba invadens
KEEGKPVKRMSFLGRRQQTNGPKK

SEQ ID NO: 2946269 - protein, 25 aa, Entamoeba invadens
KEEIAYFCEPVRRFEDLMIKEITGV

SEQ ID NO: 2946270 - protein, 19 aa, Entamoeba invadens
KEEIITIILGNLFLTTCQY

SEQ ID NO: 2946271 - protein, 18 aa, Entamoeba invadens
KEEIKFTVFEIEQLEKMK

SEQ ID NO: 2946272 - protein, 22 aa, Entamoeba invadens
KEEIKPKNDWILNRKKEFEERR

SEQ ID NO: 2946273 - protein, 26 aa, Entamoeba invadens
KEEIRKFKKSIPWNQPEKVDFVKQFK

SEQ ID NO: 2946274 - protein, 34 aa, Entamoeba invadens
KEEITRLEIPMAMFHFGGTFTHIIGEKPVEMTIE

SEQ ID NO: 2946275 - protein, 18 aa, Entamoeba invadens
KEEIWRNSLVNLFEREVI

SEQ ID NO: 2946276 - protein, 18 aa, Entamoeba invadens
KEEIYGLVLVEDRKLHSV

SEQ ID NO: 2946277 - protein, 21 aa, Entamoeba invadens
KEEKDFFLGKLLDVVRYAELR

SEQ ID NO: 2946278 - protein, 21 aa, Entamoeba invadens
KEEKDTLFAYMEFNAKNDLAL

SEQ ID NO: 2946279 - protein, 24 aa, Entamoeba invadens
KEEKGEELFHKWGVNGPKECALVV

SEQ ID NO: 2946280 - protein, 20 aa, Entamoeba invadens
KEEKGEFLSGLDLVELGEIH

SEQ ID NO: 2946281 - protein, 24 aa, Entamoeba invadens
KEEKRSCADMVLFKEFPFYLLNIE

SEQ ID NO: 2946282 - protein, 27 aa, Entamoeba invadens
KEEKYQERMCCLLIAIIFEITDIEKVK

SEQ ID NO: 2946283 - protein, 21 aa, Entamoeba invadens
KEELIEYFKKFTFNSVELEFI

SEQ ID NO: 2946284 - protein, 25 aa, Entamoeba invadens
KEELRIKRSRMIKKIFDIEDNNKHR

SEQ ID NO: 2946285 - protein, 24 aa, Entamoeba invadens
KEEMFRLEIHLEYGEVSLENNDRS

SEQ ID NO: 2946286 - protein, 21 aa, Entamoeba invadens
KEEMICSGVLSIDRMQDCIGP

SEQ ID NO: 2946287 - protein, 20 aa, Entamoeba invadens
KEENCGFSSVVIAKQLGWID

SEQ ID NO: 2946288 - protein, 23 aa, Entamoeba invadens
KEENKRPVVLRIFAEKKKTPKTL

SEQ ID NO: 2946289 - protein, 21 aa, Entamoeba invadens
KEEPDDLIVQGFVFRSVKRLV

SEQ ID NO: 2946290 - protein, 22 aa, Entamoeba invadens
KEEPKEELKEEVKPAEEVKEDK

SEQ ID NO: 2946291 - protein, 19 aa, Entamoeba invadens
KEERGEGVVVLKRIPTNKM

SEQ ID NO: 2946292 - protein, 18 aa, Entamoeba invadens
KEERSRHTSIYVGELPIK

SEQ ID NO: 2946293 - protein, 41 aa, Entamoeba invadens
KEERYLLESRMAYLDIFPKCRGYQLPSLFNYQPTMDRAYET

SEQ ID NO: 2946294 - protein, 19 aa, Entamoeba invadens
KEERYSFYLGNDRENNLFS

SEQ ID NO: 2946295 - protein, 19 aa, Entamoeba invadens
KEESKACKTEKCTTNTNLQ

SEQ ID NO: 2946296 - protein, 22 aa, Entamoeba invadens
KEESRRASALQDFVKSDSEELM

SEQ ID NO: 2946297 - protein, 18 aa, Entamoeba invadens
KEEVLRLNSIMKDMNMNE

SEQ ID NO: 2946298 - protein, 28 aa, Entamoeba invadens
KEEWLYDCISEMKLLSPETYLVDGEFKE

SEQ ID NO: 2946299 - protein, 24 aa, Entamoeba invadens
KEEYFKTLLPLLGSLVEDKEVNVR

SEQ ID NO: 2946300 - protein, 20 aa, Entamoeba invadens
KEEYNTYAFLVMKKDKIVIE

SEQ ID NO: 2946301 - protein, 22 aa, Entamoeba invadens
KEEYNYFMAVCFPENQLTVIDY

SEQ ID NO: 2946302 - protein, 20 aa, Entamoeba invadens
KEEYRKVRVYALVYKTEQTE

SEQ ID NO: 2946303 - protein, 23 aa, Entamoeba invadens
KEEYRLTEILIRKYVTGGSQLST

SEQ ID NO: 2946304 - protein, 21 aa, Entamoeba invadens
KEEYVEGVAVGMLHEMYYIKY

SEQ ID NO: 2946305 - protein, 20 aa, Entamoeba invadens
KEFEEVKPLIVPLTKELPPD

SEQ ID NO: 2946306 - protein, 22 aa, Entamoeba invadens
KEFEGMCLNFAIGDINEESVSQ

SEQ ID NO: 2946307 - protein, 26 aa, Entamoeba invadens
KEFEHIIKLKLEFESVRNKQKMVLYL

SEQ ID NO: 2946308 - protein, 21 aa, Entamoeba invadens
KEFELRMTLNDVILLGKKIKY

SEQ ID NO: 2946309 - protein, 19 aa, Entamoeba invadens
KEFERCYDERAVNKIAFPK

SEQ ID NO: 2946310 - protein, 24 aa, Entamoeba invadens
KEFEYAKKFIKMIGAQFVENASGR

SEQ ID NO: 2946311 - protein, 23 aa, Entamoeba invadens
KEFGEYHFDVLISRDKEVGTFKK

SEQ ID NO: 2946312 - protein, 26 aa, Entamoeba invadens
KEFGLDNWAAVASNLPFRDHFDCKMR

SEQ ID NO: 2946313 - protein, 21 aa, Entamoeba invadens
KEFIKHIVLLILDEIHLKFHV

SEQ ID NO: 2946314 - protein, 18 aa, Entamoeba invadens
KEFMKIVNKRFVKNLSTY

SEQ ID NO: 2946315 - protein, 22 aa, Entamoeba invadens
KEFMLRVITYTSYFINTASYEW

SEQ ID NO: 2946316 - protein, 17 aa, Entamoeba invadens
KEFPAYRKIELNGKRVL

SEQ ID NO: 2946317 - protein, 17 aa, Entamoeba invadens
KEFPAYRKLELNGKKIL

SEQ ID NO: 2946318 - protein, 17 aa, Entamoeba invadens
KEFRDLFDPKAVFASEW

SEQ ID NO: 2946319 - protein, 22 aa, Entamoeba invadens
KEFRMYHPFQVVVVSDMFRLFN

SEQ ID NO: 2946320 - protein, 17 aa, Entamoeba invadens
KEFSGFVKDFETVPTKE

SEQ ID NO: 2946321 - protein, 23 aa, Entamoeba invadens
KEFSHFNAVMSFLSYLLKAPVVP

SEQ ID NO: 2946322 - protein, 24 aa, Entamoeba invadens
KEFSHFNAVMSFLSYLLKAPVVPK

SEQ ID NO: 2946323 - protein, 25 aa, Entamoeba invadens
KEFSNKNRVVFVFGSNAAGHFGNTE

SEQ ID NO: 2946324 - protein, 21 aa, Entamoeba invadens
KEFSVPFALVDKMDRMQDSML

SEQ ID NO: 2946325 - protein, 22 aa, Entamoeba invadens
KEFTDPELTTFVPVLIPEFLPL

SEQ ID NO: 2946326 - protein, 26 aa, Entamoeba invadens
KEFTRKTSVASFVLFKGDIVMRDILG

SEQ ID NO: 2946327 - protein, 17 aa, Entamoeba invadens
KEFVNFIPLSGVEQNIS

SEQ ID NO: 2946328 - protein, 26 aa, Entamoeba invadens
KEGAYFARALTDIGIDTTYILPGGLQ

SEQ ID NO: 2946329 - protein, 27 aa, Entamoeba invadens
KEGCIDWLCNKGFIPKLITTLMGTQSL

SEQ ID NO: 2946330 - protein, 23 aa, Entamoeba invadens
KEGCVFCRNSVCIICEPNRVFDV

SEQ ID NO: 2946331 - protein, 23 aa, Entamoeba invadens
KEGEKPLQRECEMVNEQPERNKE

SEQ ID NO: 2946332 - protein, 19 aa, Entamoeba invadens
KEGIKISSELNLYDKEDKY

SEQ ID NO: 2946333 - protein, 20 aa, Entamoeba invadens
KEGIPAMEMQVDALKMKLEA

SEQ ID NO: 2946334 - protein, 23 aa, Entamoeba invadens
KEGKGKLGFIGTIQQFLEIGKTW

SEQ ID NO: 2946335 - protein, 20 aa, Entamoeba invadens
KEGKIVGYCLTKIEDDESHP

SEQ ID NO: 2946336 - protein, 21 aa, Entamoeba invadens
KEGKRTAVVWTALQDGVLNAE

SEQ ID NO: 2946337 - protein, 21 aa, Entamoeba invadens
KEGLMWGAARLEPVVHTIKML

SEQ ID NO: 2946338 - protein, 26 aa, Entamoeba invadens
KEGLQMADKFGCVFYEISAKNNTNID

SEQ ID NO: 2946339 - protein, 21 aa, Entamoeba invadens
KEGQCYLPFLQGLTGFKQYKL

SEQ ID NO: 2946340 - protein, 19 aa, Entamoeba invadens
KEGRHTNTYFIKKETKPEF

SEQ ID NO: 2946341 - protein, 22 aa, Entamoeba invadens
KEGRKALFVQNMFSLAKEKSGF

SEQ ID NO: 2946342 - protein, 29 aa, Entamoeba invadens
KEGRLDEKKFRTMMMVRYNKCLVNPGEPV

SEQ ID NO: 2946343 - protein, 26 aa, Entamoeba invadens
KEGSLPFYMIIIWLLKSINLQLIKKY

SEQ ID NO: 2946344 - protein, 21 aa, Entamoeba invadens
KEGVSREFAFLGFSTESEAQN

SEQ ID NO: 2946345 - protein, 20 aa, Entamoeba invadens
KEGYPIFAETCIQYLEMTSD

SEQ ID NO: 2946346 - protein, 19 aa, Entamoeba invadens
KEGYSILIEAAREYDQQNC

SEQ ID NO: 2946347 - protein, 18 aa, Entamoeba invadens
KEHCKKKPMEYLSVEAMN

SEQ ID NO: 2946348 - protein, 17 aa, Entamoeba invadens
KEHEKCDEVIFKLKAEV

SEQ ID NO: 2946349 - protein, 17 aa, Entamoeba invadens
KEHFHVSGFWKLKDTSI

SEQ ID NO: 2946350 - protein, 18 aa, Entamoeba invadens
KEHISAYLSKWDIQVKDI

SEQ ID NO: 2946351 - protein, 20 aa, Entamoeba invadens
KEHKLCLMKSAKTLADGIAV

SEQ ID NO: 2946352 - protein, 18 aa, Entamoeba invadens
KEHLKNIKIESSHNLVFS

SEQ ID NO: 2946353 - protein, 21 aa, Entamoeba invadens
KEHNWRIEGNKIVFEASAAEK

SEQ ID NO: 2946354 - protein, 22 aa, Entamoeba invadens
KEHVPIVLCGNKSDLESARIVP

SEQ ID NO: 2946355 - protein, 27 aa, Entamoeba invadens
KEIAANCFRKYTGVDMIKIPKSVLKIN

SEQ ID NO: 2946356 - protein, 26 aa, Entamoeba invadens
KEICRKMPNKAFSVLEGRVFIETDEH

SEQ ID NO: 2946357 - protein, 24 aa, Entamoeba invadens
KEIDHVKVFLGDYVDRGKYSVETM

SEQ ID NO: 2946358 - protein, 25 aa, Entamoeba invadens
KEIDHVKVFLGDYVDRGKYSVETMI

SEQ ID NO: 2946359 - protein, 19 aa, Entamoeba invadens
KEIEACTKFASRLQDRLLG

SEQ ID NO: 2946360 - protein, 25 aa, Entamoeba invadens
KEIEALKKKLAEEIAKREAAEKALA

SEQ ID NO: 2946361 - protein, 28 aa, Entamoeba invadens
KEIEFPSRLTSICNYVFEYCRKLSSITF

SEQ ID NO: 2946362 - protein, 28 aa, Entamoeba invadens
KEIELKKRMSLSFIPEDLLVSFEIPVKV

SEQ ID NO: 2946363 - protein, 20 aa, Entamoeba invadens
KEIEPGILMTGSLDGKIRVL

SEQ ID NO: 2946364 - protein, 18 aa, Entamoeba invadens
KEIETFDFCGFKVPKKYE

SEQ ID NO: 2946365 - protein, 19 aa, Entamoeba invadens
KEIEVHKLLTKNEYVVPLI

SEQ ID NO: 2946366 - protein, 19 aa, Entamoeba invadens
KEIEVLIDKCIQRKEDRAH

SEQ ID NO: 2946367 - protein, 17 aa, Entamoeba invadens
KEIFAKVPFNTTDPLVT

SEQ ID NO: 2946368 - protein, 20 aa, Entamoeba invadens
KEIFESVLMAVTYEAGDADT

SEQ ID NO: 2946369 - protein, 21 aa, Entamoeba invadens
KEIGAHCFERCIALKSIDLPQ

SEQ ID NO: 2946370 - protein, 17 aa, Entamoeba invadens
KEIGNIFTSKCANYIIR

SEQ ID NO: 2946371 - protein, 23 aa, Entamoeba invadens
KEIGRVSFLESFIYRNNTLQIRE

SEQ ID NO: 2946372 - protein, 19 aa, Entamoeba invadens
KEIHLPKLVEVIPDSCFSN

SEQ ID NO: 2946373 - protein, 21 aa, Entamoeba invadens
KEIIARYRALYNFDENFDTET

SEQ ID NO: 2946374 - protein, 22 aa, Entamoeba invadens
KEIIQFSSLCDVPFYPPTEDMK

SEQ ID NO: 2946375 - protein, 22 aa, Entamoeba invadens
KEIKAVLFMECSSLTGFNITTL

SEQ ID NO: 2946376 - protein, 20 aa, Entamoeba invadens
KEIKEFYLVVNGESFIVPLT

SEQ ID NO: 2946377 - protein, 23 aa, Entamoeba invadens
KEIKERKSGMIKRRNEEIKKSLI

SEQ ID NO: 2946378 - protein, 18 aa, Entamoeba invadens
KEIKERRNGLPIMMEEAN

SEQ ID NO: 2946379 - protein, 20 aa, Entamoeba invadens
KEIKKFAFSECVSLEEISLP

SEQ ID NO: 2946380 - protein, 22 aa, Entamoeba invadens
KEIKKKRSIFGFTSSSTLSLST

SEQ ID NO: 2946381 - protein, 17 aa, Entamoeba invadens
KEIKVTYPVDALDKIIA

SEQ ID NO: 2946382 - protein, 20 aa, Entamoeba invadens
KEILIRIFTTLAYDISEGVK

SEQ ID NO: 2946383 - protein, 19 aa, Entamoeba invadens
KEILKVKEKGFFYFDVDCV

SEQ ID NO: 2946384 - protein, 20 aa, Entamoeba invadens
KEIMDIWNKATVKLVRRTSV

SEQ ID NO: 2946385 - protein, 21 aa, Entamoeba invadens
KEIMVKQAVPYPFKRNDTIIE

SEQ ID NO: 2946386 - protein, 20 aa, Entamoeba invadens
KEIMWGDCGVGNFFISTENL

SEQ ID NO: 2946387 - protein, 19 aa, Entamoeba invadens
KEINCVFNGKVYQMPIQSP

SEQ ID NO: 2946388 - protein, 20 aa, Entamoeba invadens
KEINFCKKIGLPIIGVVENM

SEQ ID NO: 2946389 - protein, 23 aa, Entamoeba invadens
KEINPGLLNRLFKKSGNEGSSRR

SEQ ID NO: 2946390 - protein, 26 aa, Entamoeba invadens
KEIPEVLVNLLIRVIMEYLILDNTLQ

SEQ ID NO: 2946391 - protein, 31 aa, Entamoeba invadens
KEIPHKVYCRYTPGDIFPFFTDFYQQVDDLK

SEQ ID NO: 2946392 - protein, 23 aa, Entamoeba invadens
KEIPKYKNILMLYAHADRGQDLK

SEQ ID NO: 2946393 - protein, 17 aa, Entamoeba invadens
KEIPSFYNLQKWVSERN

SEQ ID NO: 2946394 - protein, 21 aa, Entamoeba invadens
KEIPVFKATTFKNEPTQEENI

SEQ ID NO: 2946395 - protein, 18 aa, Entamoeba invadens
KEIPVSVDDIDWLVKNTT

SEQ ID NO: 2946396 - protein, 19 aa, Entamoeba invadens
KEISEAISVNAGTTVAVAI

SEQ ID NO: 2946397 - protein, 17 aa, Entamoeba invadens
KEISGVYAVENAKMCNA

SEQ ID NO: 2946398 - protein, 23 aa, Entamoeba invadens
KEISKCLLSKCSPHDLLKKLSLF

SEQ ID NO: 2946399 - protein, 25 aa, Entamoeba invadens
KEISLPLNHIVDWTKFYKVNSVDQF

SEQ ID NO: 2946400 - protein, 21 aa, Entamoeba invadens
KEISWDKDLEEFILKWKNVHV

SEQ ID NO: 2946401 - protein, 17 aa, Entamoeba invadens
KEITTIMALANDSFPNA

SEQ ID NO: 2946402 - protein, 25 aa, Entamoeba invadens
KEIVKSCFVVISFLPQYFVEQPFLQ

SEQ ID NO: 2946403 - protein, 21 aa, Entamoeba invadens
KEIVPRYLSLNGESQVLNTLC

SEQ ID NO: 2946404 - protein, 25 aa, Entamoeba invadens
KEIVQWPVQHPELFAEYGQPPSRGV

SEQ ID NO: 2946405 - protein, 26 aa, Entamoeba invadens
KEIWNICFVCAHILQIKEKCVDILQK

SEQ ID NO: 2946406 - protein, 17 aa, Entamoeba invadens
KEIYDCAAVVDLVIQFA

SEQ ID NO: 2946407 - protein, 22 aa, Entamoeba invadens
KEIYDRIFSMLVVKVNKALQKH

SEQ ID NO: 2946408 - protein, 28 aa, Entamoeba invadens
KEKAEIKKSVSICKFPNDWNIKIDEQMK

SEQ ID NO: 2946409 - protein, 17 aa, Entamoeba invadens
KEKAGKWEVPLPKVKPI

SEQ ID NO: 2946410 - protein, 20 aa, Entamoeba invadens
KEKAVLNLPPILVRQNKDLT

SEQ ID NO: 2946411 - protein, 32 aa, Entamoeba invadens
KEKCASLSKNVFCCLEKYFSEDFVVDQDQVDR

SEQ ID NO: 2946412 - protein, 20 aa, Entamoeba invadens
KEKCEMCCHLLGEIDICETI

SEQ ID NO: 2946413 - protein, 19 aa, Entamoeba invadens
KEKCLTCNLTNYKTQSGKC

SEQ ID NO: 2946414 - protein, 28 aa, Entamoeba invadens
KEKDARAEELWSLVSLFASLEQENGKEG

SEQ ID NO: 2946415 - protein, 20 aa, Entamoeba invadens
KEKEGKVIITQATYDELKQS

SEQ ID NO: 2946416 - protein, 20 aa, Entamoeba invadens
KEKEICLLCGESYQLIEGQC

SEQ ID NO: 2946417 - protein, 26 aa, Entamoeba invadens
KEKEIVCSPSMKLLWDNYKFTTDNPI

SEQ ID NO: 2946418 - protein, 20 aa, Entamoeba invadens
KEKEKMADEIVTFKQINDEK

SEQ ID NO: 2946419 - protein, 17 aa, Entamoeba invadens
KEKENVLNELNTTKEQK

SEQ ID NO: 2946420 - protein, 21 aa, Entamoeba invadens
KEKEVVNGFHLETSYSSICVR

SEQ ID NO: 2946421 - protein, 19 aa, Entamoeba invadens
KEKEYLKEFVNTYKAKDVV

SEQ ID NO: 2946422 - protein, 20 aa, Entamoeba invadens
KEKFAEIAVEAIEKIGDSDI

SEQ ID NO: 2946423 - protein, 19 aa, Entamoeba invadens
KEKFDNLVHKRCPQSHSMM

SEQ ID NO: 2946424 - protein, 29 aa, Entamoeba invadens
KEKFPLLLEYCRLCCKWGNGWNGQQQYLK

SEQ ID NO: 2946425 - protein, 20 aa, Entamoeba invadens
KEKFTTIPRLAFMPTGPLQK

SEQ ID NO: 2946426 - protein, 19 aa, Entamoeba invadens
KEKGCMLSLGLYDTKGSAL

SEQ ID NO: 2946427 - protein, 21 aa, Entamoeba invadens
KEKGDVILFIVGNKLDLGKRE

SEQ ID NO: 2946428 - protein, 24 aa, Entamoeba invadens
KEKGFFYFDVDCVSGQNVAPNNVI

SEQ ID NO: 2946429 - protein, 32 aa, Entamoeba invadens
KEKIAVPFLLKCCNDCANALLYLSSHNILHRN

SEQ ID NO: 2946430 - protein, 36 aa, Entamoeba invadens
KEKICQIAFETYNFPLFCLISQPVLSLLSTGKSTGF

SEQ ID NO: 2946431 - protein, 23 aa, Entamoeba invadens
KEKITYFKAICQMCHTISQNAEK

SEQ ID NO: 2946432 - protein, 22 aa, Entamoeba invadens
KEKKEKRRRNTITNIIKDSDKK

SEQ ID NO: 2946433 - protein, 21 aa, Entamoeba invadens
KEKKLKKKKGISIVQKLMRSI

SEQ ID NO: 2946434 - protein, 24 aa, Entamoeba invadens
KEKKRICAGIIDLAQFADLAGKTE

SEQ ID NO: 2946435 - protein, 21 aa, Entamoeba invadens
KEKKRKVIIWSKRGDLRREYP

SEQ ID NO: 2946436 - protein, 21 aa, Entamoeba invadens
KEKKTWWGGKVEDVEKLEKQD

SEQ ID NO: 2946437 - protein, 25 aa, Entamoeba invadens
KEKLKEDGIEISVSYLSKTIKKMGI

SEQ ID NO: 2946438 - protein, 18 aa, Entamoeba invadens
KEKMDLITCKSGYGMTEL

SEQ ID NO: 2946439 - protein, 29 aa, Entamoeba invadens
KEKMPEHFEVFRLLCVMISEIVNQCPTNK

SEQ ID NO: 2946440 - protein, 22 aa, Entamoeba invadens
KEKNGKVILCTDGTANNGLGNL

SEQ ID NO: 2946441 - protein, 19 aa, Entamoeba invadens
KEKNHILVMRKDKQISSIS

SEQ ID NO: 2946442 - protein, 19 aa, Entamoeba invadens
KEKPRVVLELNTTAEALMW

SEQ ID NO: 2946443 - protein, 18 aa, Entamoeba invadens
KEKQRTESELITLKEQKE

SEQ ID NO: 2946444 - protein, 23 aa, Entamoeba invadens
KEKRTQFHMLVRELHGYDSRCDE

SEQ ID NO: 2946445 - protein, 21 aa, Entamoeba invadens
KEKRYHPARYPNWEYTNTSTI

SEQ ID NO: 2946446 - protein, 26 aa, Entamoeba invadens
KEKSLTRPLFCSAIKGKKSVVLLMRM

SEQ ID NO: 2946447 - protein, 25 aa, Entamoeba invadens
KEKSMVFTCHGAFWVMSDGKVYIQQ

SEQ ID NO: 2946448 - protein, 21 aa, Entamoeba invadens
KEKTCGVLFNVNYERKYKEFI

SEQ ID NO: 2946449 - protein, 21 aa, Entamoeba invadens
KEKTKDFGIEFDVPNYSIIRR

SEQ ID NO: 2946450 - protein, 23 aa, Entamoeba invadens
KEKTVIKFVRYALGRLRLDEDFR

SEQ ID NO: 2946451 - protein, 20 aa, Entamoeba invadens
KEKTYFCTVDGQTIVVDLKR

SEQ ID NO: 2946452 - protein, 20 aa, Entamoeba invadens
KEKVKQCYLCKETGHTFKDC

SEQ ID NO: 2946453 - protein, 25 aa, Entamoeba invadens
KEKVNYVGKCAFFFCSNLEEIYVKN

SEQ ID NO: 2946454 - protein, 33 aa, Entamoeba invadens
KEKYIKMVRCRKGAACKLCERPFDVYRWHMADS

SEQ ID NO: 2946455 - protein, 21 aa, Entamoeba invadens
KEKYKMLCKKNLIVFELSVKE

SEQ ID NO: 2946456 - protein, 23 aa, Entamoeba invadens
KEKYLRLPKIVLIDTIGGNPIEL

SEQ ID NO: 2946457 - protein, 27 aa, Entamoeba invadens
KEKYTDEALCWFFDALFHMNSLYDLGE

SEQ ID NO: 2946458 - protein, 18 aa, Entamoeba invadens
KELAGVMFQAKWDETNKT

SEQ ID NO: 2946459 - protein, 23 aa, Entamoeba invadens
KELAKQARLRKIEEDKKRAEEER

SEQ ID NO: 2946460 - protein, 17 aa, Entamoeba invadens
KELCQFKDTICETHDLL

SEQ ID NO: 2946461 - protein, 24 aa, Entamoeba invadens
KELDEIKTPYVFEKENCILKVDMP

SEQ ID NO: 2946462 - protein, 25 aa, Entamoeba invadens
KELDGKKVIKVVCSNGYTACLTDTG

SEQ ID NO: 2946463 - protein, 21 aa, Entamoeba invadens
KELDIEHSLVFDIFMAHKTLL

SEQ ID NO: 2946464 - protein, 25 aa, Entamoeba invadens
KELDLSDIKKFRLIIEQMPTRCYIK

SEQ ID NO: 2946465 - protein, 20 aa, Entamoeba invadens
KELDVCVTIANSTYKFDNFR

SEQ ID NO: 2946466 - protein, 21 aa, Entamoeba invadens
KELEGRISAVYVDDEKAELLF

SEQ ID NO: 2946467 - protein, 28 aa, Entamoeba invadens
KELERRVYRWMLPVLEQPLTFVYPKSTP

SEQ ID NO: 2946468 - protein, 18 aa, Entamoeba invadens
KELESFKDFELPQEEEDE

SEQ ID NO: 2946469 - protein, 17 aa, Entamoeba invadens
KELETNSFRKARLQTTL

SEQ ID NO: 2946470 - protein, 24 aa, Entamoeba invadens
KELFDVLHSFSLIEPELGYIQGMS

SEQ ID NO: 2946471 - protein, 27 aa, Entamoeba invadens
KELFLGKRPDGVLILMDAFNSINFKAI

SEQ ID NO: 2946472 - protein, 19 aa, Entamoeba invadens
KELFTEGLLLPNGNALPVL

SEQ ID NO: 2946473 - protein, 20 aa, Entamoeba invadens
KELFTTFVCDTVLECDIQPS

SEQ ID NO: 2946474 - protein, 19 aa, Entamoeba invadens
KELGEWQHGILMTWTSGNN

SEQ ID NO: 2946475 - protein, 19 aa, Entamoeba invadens
KELIGMSIFVQGTKKELGD

SEQ ID NO: 2946476 - protein, 18 aa, Entamoeba invadens
KELIMEWSAGHVWTYTSK

SEQ ID NO: 2946477 - protein, 17 aa, Entamoeba invadens
KELKEELKVEDKQKEEV

SEQ ID NO: 2946478 - protein, 22 aa, Entamoeba invadens
KELKEKMFVEEKFRCELMTAIE

SEQ ID NO: 2946479 - protein, 17 aa, Entamoeba invadens
KELKKLGKMTSEKAKKF

SEQ ID NO: 2946480 - protein, 17 aa, Entamoeba invadens
KELKLKREKAILIMDGF

SEQ ID NO: 2946481 - protein, 29 aa, Entamoeba invadens
KELKNPNGMIELFSNVVFVANLPENTTEQ

SEQ ID NO: 2946482 - protein, 22 aa, Entamoeba invadens
KELKSCIPLAPIHNPASYSVIE

SEQ ID NO: 2946483 - protein, 23 aa, Entamoeba invadens
KELKVPVLFEIPFRELRFNGTIK

SEQ ID NO: 2946484 - protein, 26 aa, Entamoeba invadens
KELKVVELNARVMAYSDAIEVLSVLV

SEQ ID NO: 2946485 - protein, 20 aa, Entamoeba invadens
KELLAHPFIGWATTSYFYKK

SEQ ID NO: 2946486 - protein, 23 aa, Entamoeba invadens
KELLENGRNCFIEILKSYRKIIR

SEQ ID NO: 2946487 - protein, 22 aa, Entamoeba invadens
KELLPKFVVILTKCFDRFKEDE

SEQ ID NO: 2946488 - protein, 22 aa, Entamoeba invadens
KELLYELRFYLMTQSALRNDLI

SEQ ID NO: 2946489 - protein, 19 aa, Entamoeba invadens
KELMIKKEEDGVILKQLTK

SEQ ID NO: 2946490 - protein, 22 aa, Entamoeba invadens
KELMSRCVFLRNSAFPVSNDSY

SEQ ID NO: 2946491 - protein, 19 aa, Entamoeba invadens
KELNYLFGEYGDLTRIIMG

SEQ ID NO: 2946492 - protein, 26 aa, Entamoeba invadens
KELPGGRTSDSGWGCMIRSMQMALAQ

SEQ ID NO: 2946493 - protein, 22 aa, Entamoeba invadens
KELPIYDGYLFHAIDKERTHFR

SEQ ID NO: 2946494 - protein, 21 aa, Entamoeba invadens
KELPLVFDFEHECQGISTGRN

SEQ ID NO: 2946495 - protein, 26 aa, Entamoeba invadens
KELPMSYKLWHTFLLSSERDARGTPL

SEQ ID NO: 2946496 - protein, 23 aa, Entamoeba invadens
KELQTRLYTEKEITQKLDDENES

SEQ ID NO: 2946497 - protein, 17 aa, Entamoeba invadens
KELRKVVKFGGEVVKSE

SEQ ID NO: 2946498 - protein, 22 aa, Entamoeba invadens
KELRLLKVPIVVVGIPKTIDND

SEQ ID NO: 2946499 - protein, 19 aa, Entamoeba invadens
KELRRMKVQDLVLREKNIL

SEQ ID NO: 2946500 - protein, 25 aa, Entamoeba invadens
KELSDLSTLFPCVVDSSLTKNGLSE

SEQ ID NO: 2946501 - protein, 18 aa, Entamoeba invadens
KELSEIEDWLFISGETTA

SEQ ID NO: 2946502 - protein, 24 aa, Entamoeba invadens
KELSEIRKMFIGQFGTTLVAECIE

SEQ ID NO: 2946503 - protein, 21 aa, Entamoeba invadens
KELSYKIIAVLIFLVLDKDFS

SEQ ID NO: 2946504 - protein, 20 aa, Entamoeba invadens
KELTEENAKEELRLKEKEEE

SEQ ID NO: 2946505 - protein, 22 aa, Entamoeba invadens
KELTRLTKLFILRRTSKVNQKY

SEQ ID NO: 2946506 - protein, 18 aa, Entamoeba invadens
KELVAMRNILYASAKSVV

SEQ ID NO: 2946507 - protein, 19 aa, Entamoeba invadens
KELVEIIKLEFIKLSNIEL

SEQ ID NO: 2946508 - protein, 24 aa, Entamoeba invadens
KELVLPCGLTKLGFGAFENATTLT

SEQ ID NO: 2946509 - protein, 20 aa, Entamoeba invadens
KELYMEYFVEAIENEDLVIS

SEQ ID NO: 2946510 - protein, 21 aa, Entamoeba invadens
KELYPGLPIDTIFPKDVPINC

SEQ ID NO: 2946511 - protein, 21 aa, Entamoeba invadens
KEMAEQLLGMEYLKSSAMSEL

SEQ ID NO: 2946512 - protein, 20 aa, Entamoeba invadens
KEMAVACYQFYTKGFTKVGI

SEQ ID NO: 2946513 - protein, 19 aa, Entamoeba invadens
KEMAYVFSGFVVSDDNKEG

SEQ ID NO: 2946514 - protein, 19 aa, Entamoeba invadens
KEMAYVFSGFVVSDDSKEG

SEQ ID NO: 2946515 - protein, 27 aa, Entamoeba invadens
KEMCELFRIDLFGSIVYSILIEKSRKL

SEQ ID NO: 2946516 - protein, 22 aa, Entamoeba invadens
KEMDKLPLEFGWCSETTGNVCA

SEQ ID NO: 2946517 - protein, 19 aa, Entamoeba invadens
KEMIIRGGHNVWPKEICEV

SEQ ID NO: 2946518 - protein, 24 aa, Entamoeba invadens
KEMILVSVLNYLGYSFLFQKPKKF

SEQ ID NO: 2946519 - protein, 21 aa, Entamoeba invadens
KEMIQNAAVAFMFPDVPTDVV

SEQ ID NO: 2946520 - protein, 21 aa, Entamoeba invadens
KEMKKEKPIAMKKEKGSAQAA

SEQ ID NO: 2946521 - protein, 17 aa, Entamoeba invadens
KEMKKFQKMFVRIVDRK

SEQ ID NO: 2946522 - protein, 19 aa, Entamoeba invadens
KEMKVCGALGALASGLKKT

SEQ ID NO: 2946523 - protein, 27 aa, Entamoeba invadens
KEMKVHKLVPFSICDAFQLPIKYDILL

SEQ ID NO: 2946524 - protein, 19 aa, Entamoeba invadens
KEMLLAVICKVGYYYISKD

SEQ ID NO: 2946525 - protein, 20 aa, Entamoeba invadens
KEMRKFKLAPLLIKEVTRQV

SEQ ID NO: 2946526 - protein, 20 aa, Entamoeba invadens
KEMRYIHRWLVTKFPDKTVF

SEQ ID NO: 2946527 - protein, 23 aa, Entamoeba invadens
KEMSMPVPCFNVINGGAHAGNAL

SEQ ID NO: 2946528 - protein, 18 aa, Entamoeba invadens
KEMTHIEPALLRQRSVRF

SEQ ID NO: 2946529 - protein, 19 aa, Entamoeba invadens
KEMVDVVAEKDCKCFTCSK

SEQ ID NO: 2946530 - protein, 25 aa, Entamoeba invadens
KEMYRKSPECDFIKKFEGKIVGSKV

SEQ ID NO: 2946531 - protein, 17 aa, Entamoeba invadens
KENACSQNQVGILARNI

SEQ ID NO: 2946532 - protein, 23 aa, Entamoeba invadens
KENCLDCSDTFFVSNSKCVSSGG

SEQ ID NO: 2946533 - protein, 22 aa, Entamoeba invadens
KENDKRCVLMNYPFIANFMIQT

SEQ ID NO: 2946534 - protein, 25 aa, Entamoeba invadens
KENDMKRLSEELGKEKEKRESAERE

SEQ ID NO: 2946535 - protein, 26 aa, Entamoeba invadens
KENDPRLGYVSAMAVAPSGEYCIVGT

SEQ ID NO: 2946536 - protein, 26 aa, Entamoeba invadens
KENEEFKMRVSFRVQHEPVLGLRIIN

SEQ ID NO: 2946537 - protein, 20 aa, Entamoeba invadens
KENEKFCKVNYDYEAQEANE

SEQ ID NO: 2946538 - protein, 20 aa, Entamoeba invadens
KENFPHLKILDLQDNKIEVL

SEQ ID NO: 2946539 - protein, 33 aa, Entamoeba invadens
KENGFVFSCIGAFWIMQDWKLYIQQNVGGSFNA

SEQ ID NO: 2946540 - protein, 20 aa, Entamoeba invadens
KENGTELLLSFVASPPNVAR

SEQ ID NO: 2946541 - protein, 20 aa, Entamoeba invadens
KENIDILRSLLRTEQQISCL

SEQ ID NO: 2946542 - protein, 25 aa, Entamoeba invadens
KENIKRIVQFLGVVFPRALEVKWRF

SEQ ID NO: 2946543 - protein, 18 aa, Entamoeba invadens
KENIVYKRLEIIKQVQQV

SEQ ID NO: 2946544 - protein, 20 aa, Entamoeba invadens
KENKARLVIDATFSSPYFFH

SEQ ID NO: 2946545 - protein, 17 aa, Entamoeba invadens
KENKRFVSSSGMESSEI

SEQ ID NO: 2946546 - protein, 28 aa, Entamoeba invadens
KENLGSCLKPRLPQPPTVKVITQHVPKI

SEQ ID NO: 2946547 - protein, 23 aa, Entamoeba invadens
KENLRLFFELIKGRNIILSSGAF

SEQ ID NO: 2946548 - protein, 20 aa, Entamoeba invadens
KENMDSFRLDASDLKVLLDD

SEQ ID NO: 2946549 - protein, 19 aa, Entamoeba invadens
KENMEYAEAIAFSQQYNAK

SEQ ID NO: 2946550 - protein, 20 aa, Entamoeba invadens
KENMKNLAYDKDLLSSEKKK

SEQ ID NO: 2946551 - protein, 18 aa, Entamoeba invadens
KENMKYCFEQAKNELKIP

SEQ ID NO: 2946552 - protein, 17 aa, Entamoeba invadens
KENPFNFSLLLFHTAGK

SEQ ID NO: 2946553 - protein, 24 aa, Entamoeba invadens
KENPQFLDMGVFAFDEQMEPQKTA

SEQ ID NO: 2946554 - protein, 19 aa, Entamoeba invadens
KENQSICSLNDQITEIKQL

SEQ ID NO: 2946555 - protein, 21 aa, Entamoeba invadens
KENRLNIGIFGYQETGKTSLI

SEQ ID NO: 2946556 - protein, 34 aa, Entamoeba invadens
KENSKPIFLLVVDLIDLLSAFIPLPPEMIQVKTF

SEQ ID NO: 2946557 - protein, 19 aa, Entamoeba invadens
KENYCVCLNDDIADATNAD

SEQ ID NO: 2946558 - protein, 19 aa, Entamoeba invadens
KENYFTDAFSKYQDQINAL

SEQ ID NO: 2946559 - protein, 18 aa, Entamoeba invadens
KEPCEVLYSSIFEFIIKA

SEQ ID NO: 2946560 - protein, 28 aa, Entamoeba invadens
KEPEIFLVKVFIKWFCKKSRLNDYNTKC

SEQ ID NO: 2946561 - protein, 28 aa, Entamoeba invadens
KEPEIFLVKVFIKWFCKKSRLNDYNTRC

SEQ ID NO: 2946562 - protein, 22 aa, Entamoeba invadens
KEPFAKLKVEMVRWFDKNKLRM

SEQ ID NO: 2946563 - protein, 18 aa, Entamoeba invadens
KEPHLVSTLQKIVFLSSF

SEQ ID NO: 2946564 - protein, 22 aa, Entamoeba invadens
KEPIIGDFILVNGMKCHPFHYQ

SEQ ID NO: 2946565 - protein, 21 aa, Entamoeba invadens
KEPKEVIPVEVDWDEEGDVPL

SEQ ID NO: 2946566 - protein, 22 aa, Entamoeba invadens
KEPKVELLFVGFPRELERSTIC

SEQ ID NO: 2946567 - protein, 20 aa, Entamoeba invadens
KEPLSITIFEACEKYFKGNS

SEQ ID NO: 2946568 - protein, 17 aa, Entamoeba invadens
KEPNTLNLIDFGMLGGG

SEQ ID NO: 2946569 - protein, 19 aa, Entamoeba invadens
KEPQLRFAPKDFGDKERLD

SEQ ID NO: 2946570 - protein, 27 aa, Entamoeba invadens
KEPYPKIRFKFAWDIVDFVVSGKRLKE

SEQ ID NO: 2946571 - protein, 18 aa, Entamoeba invadens
KEQCELLATDLKKEDVTV

SEQ ID NO: 2946572 - protein, 28 aa, Entamoeba invadens
KEQCGLQKLRVLWIQSCEDVKFYGKTTT

SEQ ID NO: 2946573 - protein, 25 aa, Entamoeba invadens
KEQDLKSDVFAFGASFTTEKEHTPT

SEQ ID NO: 2946574 - protein, 23 aa, Entamoeba invadens
KEQEGRTSPTYQLMFKPVDNDPF

SEQ ID NO: 2946575 - protein, 25 aa, Entamoeba invadens
KEQENEWSILSSFFIVNPKLQEVDF

SEQ ID NO: 2946576 - protein, 18 aa, Entamoeba invadens
KEQFEIITNTFLIDPNMV

SEQ ID NO: 2946577 - protein, 19 aa, Entamoeba invadens
KEQFKFLVDSLDYLLADIY

SEQ ID NO: 2946578 - protein, 24 aa, Entamoeba invadens
KEQFKRYGTVESIEFKDKEEKDTL

SEQ ID NO: 2946579 - protein, 23 aa, Entamoeba invadens
KEQFLKFRDEVLVDSTLNKIFSW

SEQ ID NO: 2946580 - protein, 25 aa, Entamoeba invadens
KEQIHKWSGRSVGDLIFTYKNNLKS

SEQ ID NO: 2946581 - protein, 17 aa, Entamoeba invadens
KEQIRINEDLAYTSSII

SEQ ID NO: 2946582 - protein, 21 aa, Entamoeba invadens
KEQKNWGRFCGGLDNTSGTTG

SEQ ID NO: 2946583 - protein, 27 aa, Entamoeba invadens
KEQKVCFSFTQSCGRKMFQSLTTTFFR

SEQ ID NO: 2946584 - protein, 23 aa, Entamoeba invadens
KEQLKQLFMTVGKVLKISIPTNK

SEQ ID NO: 2946585 - protein, 17 aa, Entamoeba invadens
KEQNTRLDAAKKDMKKQ

SEQ ID NO: 2946586 - protein, 19 aa, Entamoeba invadens
KEQPPNIIVAGSKEDLPPP

SEQ ID NO: 2946587 - protein, 17 aa, Entamoeba invadens
KEQQRLFTELSLNKFRK

SEQ ID NO: 2946588 - protein, 21 aa, Entamoeba invadens
KEQRNALYASIFLFILKAFPK

SEQ ID NO: 2946589 - protein, 26 aa, Entamoeba invadens
KEQSYVVGVDACFYIRANCPSHVPSC

SEQ ID NO: 2946590 - protein, 22 aa, Entamoeba invadens
KEQTPPMSFGFDELALSAPQTQ

SEQ ID NO: 2946591 - protein, 17 aa, Entamoeba invadens
KERDFVKSTTFGRAKYA

SEQ ID NO: 2946592 - protein, 23 aa, Entamoeba invadens
KERECMCRPYELGVIDVYPKFIR

SEQ ID NO: 2946593 - protein, 19 aa, Entamoeba invadens
KEREDLYGQFGFQSASSKP

SEQ ID NO: 2946594 - protein, 19 aa, Entamoeba invadens
KERETVERQITGLFESLAK

SEQ ID NO: 2946595 - protein, 18 aa, Entamoeba invadens
KERGEGVVKFLIDGHQLG

SEQ ID NO: 2946596 - protein, 35 aa, Entamoeba invadens
KERGGLELFGKLLGCLFIKKYIDLSVIIDKALQTK

SEQ ID NO: 2946597 - protein, 25 aa, Entamoeba invadens
KERHGRIAMRLANAFMEDGNIENAA

SEQ ID NO: 2946598 - protein, 30 aa, Entamoeba invadens
KERLECFLEKDVQLLFPLYYFIQIAHDKRY

SEQ ID NO: 2946599 - protein, 27 aa, Entamoeba invadens
KERLVGFSQKCVRMCYNKDEGKVWLNN

SEQ ID NO: 2946600 - protein, 20 aa, Entamoeba invadens
KERLWNIFGSTFSYICEILF

SEQ ID NO: 2946601 - protein, 21 aa, Entamoeba invadens
KERMDFLLVQLRISLECDDYL

SEQ ID NO: 2946602 - protein, 17 aa, Entamoeba invadens
KERMGSWLSKLLGKKDM

SEQ ID NO: 2946603 - protein, 23 aa, Entamoeba invadens
KERMRPVRYCKYGLTKFDYFISQ

SEQ ID NO: 2946604 - protein, 26 aa, Entamoeba invadens
KERNAVKCDVPFGWITFETNFSASAL

SEQ ID NO: 2946605 - protein, 23 aa, Entamoeba invadens
KERNCSYLFGYQAIDEFLASNNC

SEQ ID NO: 2946606 - protein, 25 aa, Entamoeba invadens
KERNDFLFQRCEILSEEVDALEIIK

SEQ ID NO: 2946607 - protein, 20 aa, Entamoeba invadens
KERNKHTAIPKCLTKRRYGD

SEQ ID NO: 2946608 - protein, 21 aa, Entamoeba invadens
KERPSSIKVAQHFLTNMFSVV

SEQ ID NO: 2946609 - protein, 20 aa, Entamoeba invadens
KERRKDELILSITRDEEVVK

SEQ ID NO: 2946610 - protein, 27 aa, Entamoeba invadens
KERTMLRLRHAFPSVLEREEVISQSIT

SEQ ID NO: 2946611 - protein, 18 aa, Entamoeba invadens
KERVCDRCAADSVDVENS

SEQ ID NO: 2946612 - protein, 17 aa, Entamoeba invadens
KERVCIYCKLEETKKTS

SEQ ID NO: 2946613 - protein, 18 aa, Entamoeba invadens
KERYNLFSGCTKAKSSTI

SEQ ID NO: 2946614 - protein, 27 aa, Entamoeba invadens
KESALLYEFLTDFARKMFQKVVTIHLD

SEQ ID NO: 2946615 - protein, 28 aa, Entamoeba invadens
KESASGKDLFGLAKERENVLIVRDPSTQ

SEQ ID NO: 2946616 - protein, 22 aa, Entamoeba invadens
KESASYMFLVFDKLKEEEENGG

SEQ ID NO: 2946617 - protein, 21 aa, Entamoeba invadens
KESCLDCSDTFFVSNSKCVSS

SEQ ID NO: 2946618 - protein, 19 aa, Entamoeba invadens
KESDCIVVGSERGYFSCVV

SEQ ID NO: 2946619 - protein, 25 aa, Entamoeba invadens
KESEFKFTECLTRIFNKGFLIYYYR

SEQ ID NO: 2946620 - protein, 25 aa, Entamoeba invadens
KESEFKYHTFDSFTIPSHIQSIEKY

SEQ ID NO: 2946621 - protein, 24 aa, Entamoeba invadens
KESFELFQKRIVAFEITCINIEAR

SEQ ID NO: 2946622 - protein, 27 aa, Entamoeba invadens
KESFESGDFQWAITLLNHVVFKNPQNT

SEQ ID NO: 2946623 - protein, 17 aa, Entamoeba invadens
KESFILQKVDFIDKADF

SEQ ID NO: 2946624 - protein, 20 aa, Entamoeba invadens
KESFIRKILVETLAKYPDQV

SEQ ID NO: 2946625 - protein, 23 aa, Entamoeba invadens
KESGCKTPAFMVRSAVSSNFISK

SEQ ID NO: 2946626 - protein, 23 aa, Entamoeba invadens
KESGDFSVPIPRIIRQMTTQEKN

SEQ ID NO: 2946627 - protein, 21 aa, Entamoeba invadens
KESGEGWFFNVWQPSDILSGK

SEQ ID NO: 2946628 - protein, 20 aa, Entamoeba invadens
KESGKTIGVLKCMRSGCPSC

SEQ ID NO: 2946629 - protein, 17 aa, Entamoeba invadens
KESGWVCSMQITAVLQT

SEQ ID NO: 2946630 - protein, 18 aa, Entamoeba invadens
KESHVLVKMKERLDYIIT

SEQ ID NO: 2946631 - protein, 17 aa, Entamoeba invadens
KESIYIVNITKGINNRD

SEQ ID NO: 2946632 - protein, 17 aa, Entamoeba invadens
KESKNPIILFIDKIHTV

SEQ ID NO: 2946633 - protein, 23 aa, Entamoeba invadens
KESKRPSSLRLQYKCPTYKEILD

SEQ ID NO: 2946634 - protein, 20 aa, Entamoeba invadens
KESLKLKKFFDIKSLQKVTA

SEQ ID NO: 2946635 - protein, 17 aa, Entamoeba invadens
KESLKMQTSLGVIPSDN

SEQ ID NO: 2946636 - protein, 22 aa, Entamoeba invadens
KESNNIYVFKCEEYKVISFTTP

SEQ ID NO: 2946637 - protein, 23 aa, Entamoeba invadens
KESNPLLERVWNNILLKSKEQQI

SEQ ID NO: 2946638 - protein, 23 aa, Entamoeba invadens
KESRFRINRKGKMIREFDDKISA

SEQ ID NO: 2946639 - protein, 22 aa, Entamoeba invadens
KESRQGALRIVHFLVSELGDTR

SEQ ID NO: 2946640 - protein, 18 aa, Entamoeba invadens
KESSCLSVTRQDHNTSVT

SEQ ID NO: 2946641 - protein, 26 aa, Entamoeba invadens
KESTKYIVKVLCEYLTVQGIVFEQVV

SEQ ID NO: 2946642 - protein, 20 aa, Entamoeba invadens
KESTNVLKYVLAIVECAMKG

SEQ ID NO: 2946643 - protein, 27 aa, Entamoeba invadens
KESTVPLRLFLKIAGVIVSFSKVAYTV

SEQ ID NO: 2946644 - protein, 21 aa, Entamoeba invadens
KESVDGVVFLVGNKIDVTGEL

SEQ ID NO: 2946645 - protein, 20 aa, Entamoeba invadens
KESYPKYTFVVIDTPKPTSL

SEQ ID NO: 2946646 - protein, 22 aa, Entamoeba invadens
KETDAEMGWAIDNEAQIEQEAK

SEQ ID NO: 2946647 - protein, 18 aa, Entamoeba invadens
KETDEWRDAKSQAKVVSK

SEQ ID NO: 2946648 - protein, 23 aa, Entamoeba invadens
KETDKNLGCLLSFGTTTSPGIWL

SEQ ID NO: 2946649 - protein, 21 aa, Entamoeba invadens
KETEGKCQFIIGGMAPSDDPY

SEQ ID NO: 2946650 - protein, 25 aa, Entamoeba invadens
KETESKGIFSYFFGKTDEYEQAPKY

SEQ ID NO: 2946651 - protein, 20 aa, Entamoeba invadens
KETFLKCVVDRKSVFTAEQR

SEQ ID NO: 2946652 - protein, 17 aa, Entamoeba invadens
KETIFPLQTIQTPINSS

SEQ ID NO: 2946653 - protein, 25 aa, Entamoeba invadens
KETKKSGSITSFFTAKAKKDVKKEA

SEQ ID NO: 2946654 - protein, 19 aa, Entamoeba invadens
KETKVEVPLKEMSKDEPKK

SEQ ID NO: 2946655 - protein, 17 aa, Entamoeba invadens
KETKWEVDVGGKAAATR

SEQ ID NO: 2946656 - protein, 18 aa, Entamoeba invadens
KETLECIIVQQFNKFVPF

SEQ ID NO: 2946657 - protein, 19 aa, Entamoeba invadens
KETLEDWMIVCVDQSGCYR

SEQ ID NO: 2946658 - protein, 17 aa, Entamoeba invadens
KETLGILDISKTVIGGL

SEQ ID NO: 2946659 - protein, 27 aa, Entamoeba invadens
KETLHFLEDLLFEFGIVVLNTRDESDG

SEQ ID NO: 2946660 - protein, 19 aa, Entamoeba invadens
KETMRLITGNGLYLSKEDI

SEQ ID NO: 2946661 - protein, 17 aa, Entamoeba invadens
KETMVKKLYEAMEQIKQ

SEQ ID NO: 2946662 - protein, 21 aa, Entamoeba invadens
KETPVKLMGERIVIQDSEIEK

SEQ ID NO: 2946663 - protein, 20 aa, Entamoeba invadens
KETQKLCEFISNTTTKYLGD

SEQ ID NO: 2946664 - protein, 21 aa, Entamoeba invadens
KETQQCSGFGFVTFENKEDVE

SEQ ID NO: 2946665 - protein, 20 aa, Entamoeba invadens
KETQRLGAKVTDSEAKLADA

SEQ ID NO: 2946666 - protein, 21 aa, Entamoeba invadens
KETQRSTYLVLLYKMLLRRNG

SEQ ID NO: 2946667 - protein, 20 aa, Entamoeba invadens
KETQTHWKRIYTRSPEKMED

SEQ ID NO: 2946668 - protein, 23 aa, Entamoeba invadens
KETRALPVSAFEIVWTIIEKYSK

SEQ ID NO: 2946669 - protein, 19 aa, Entamoeba invadens
KETRDLICIGNTSKHNMKV

SEQ ID NO: 2946670 - protein, 23 aa, Entamoeba invadens
KETRKALMKQLIVVFLVTRVVIV

SEQ ID NO: 2946671 - protein, 21 aa, Entamoeba invadens
KETRLSVPNTLTYSLKGLDIT

SEQ ID NO: 2946672 - protein, 20 aa, Entamoeba invadens
KETSRKAIEKCGEDFKQKEK

SEQ ID NO: 2946673 - protein, 20 aa, Entamoeba invadens
KETTWGDALIQTRVDTLLFV

SEQ ID NO: 2946674 - protein, 18 aa, Entamoeba invadens
KETVAANMDSDWREDTLS

SEQ ID NO: 2946675 - protein, 22 aa, Entamoeba invadens
KETVGRLVVRDGRLCDYEYYGG

SEQ ID NO: 2946676 - protein, 30 aa, Entamoeba invadens
KETYKTFLCIAEHICALLLPSFSKTITLSC

SEQ ID NO: 2946677 - protein, 23 aa, Entamoeba invadens
KEVADITTSIWVQKKIYWNAKDT

SEQ ID NO: 2946678 - protein, 20 aa, Entamoeba invadens
KEVAEAYSVLSDHEKRRTYD

SEQ ID NO: 2946679 - protein, 21 aa, Entamoeba invadens
KEVAPVPPFITTDFYVHSPEF

SEQ ID NO: 2946680 - protein, 26 aa, Entamoeba invadens
KEVARCFLRNGKGVTRCLISKDDFER

SEQ ID NO: 2946681 - protein, 24 aa, Entamoeba invadens
KEVARYENMAAITHYKFGVLYCQK

SEQ ID NO: 2946682 - protein, 23 aa, Entamoeba invadens
KEVARYLVDLAIARKSPDNVTVL

SEQ ID NO: 2946683 - protein, 24 aa, Entamoeba invadens
KEVCDKGAMIFWFAYMPLQGTRKE

SEQ ID NO: 2946684 - protein, 17 aa, Entamoeba invadens
KEVCYYYGCPTCKISVE

SEQ ID NO: 2946685 - protein, 30 aa, Entamoeba invadens
KEVDELYHRLSVSKLADFSCETLVSTLKRF

SEQ ID NO: 2946686 - protein, 25 aa, Entamoeba invadens
KEVDGFRIAVDFARREEARDKTPGR

SEQ ID NO: 2946687 - protein, 21 aa, Entamoeba invadens
KEVDKIRYLWLMNSKDIKPSF

SEQ ID NO: 2946688 - protein, 22 aa, Entamoeba invadens
KEVEAVCLLKYLIDLFNSFQLA

SEQ ID NO: 2946689 - protein, 17 aa, Entamoeba invadens
KEVEEIYHRMGVTEIED

SEQ ID NO: 2946690 - protein, 18 aa, Entamoeba invadens
KEVEFTLVVLFSSYTYEV

SEQ ID NO: 2946691 - protein, 20 aa, Entamoeba invadens
KEVEVGLNLLQPIEQKFIDV

SEQ ID NO: 2946692 - protein, 18 aa, Entamoeba invadens
KEVFIEKANHVFVDSQFD

SEQ ID NO: 2946693 - protein, 20 aa, Entamoeba invadens
KEVFIEKANHVFVDSYFDIQ

SEQ ID NO: 2946694 - protein, 20 aa, Entamoeba invadens
KEVFKYILKDEELYDQMNER

SEQ ID NO: 2946695 - protein, 19 aa, Entamoeba invadens
KEVGECLVQIVNHEKPRLP

SEQ ID NO: 2946696 - protein, 31 aa, Entamoeba invadens
KEVIELPIKHPELFESLGIAQPKGVLLYGPP

SEQ ID NO: 2946697 - protein, 18 aa, Entamoeba invadens
KEVILPPFINMLGTETFD

SEQ ID NO: 2946698 - protein, 26 aa, Entamoeba invadens
KEVIVKKWECGATWVKVVNGEDRVHF

SEQ ID NO: 2946699 - protein, 18 aa, Entamoeba invadens
KEVKGGKECVLFPEEKKS

SEQ ID NO: 2946700 - protein, 20 aa, Entamoeba invadens
KEVKLLLPLEIFRSQKQKEN

SEQ ID NO: 2946701 - protein, 17 aa, Entamoeba invadens
KEVKLPENITMILNSCF

SEQ ID NO: 2946702 - protein, 23 aa, Entamoeba invadens
KEVKREFLCCGPMYVVTNRVSLQ

SEQ ID NO: 2946703 - protein, 25 aa, Entamoeba invadens
KEVKSEGIVLFDYVGKNPHELTAEV

SEQ ID NO: 2946704 - protein, 18 aa, Entamoeba invadens
KEVKSTLVNANFHGGADQ

SEQ ID NO: 2946705 - protein, 22 aa, Entamoeba invadens
KEVKSWNTSTLWGDLKAETQAA

SEQ ID NO: 2946706 - protein, 20 aa, Entamoeba invadens
KEVLDKCTEYCIMVDNLCQF

SEQ ID NO: 2946707 - protein, 20 aa, Entamoeba invadens
KEVLGKWVGLEKYRVIYSSN

SEQ ID NO: 2946708 - protein, 17 aa, Entamoeba invadens
KEVLKTRVFELKQANEE

SEQ ID NO: 2946709 - protein, 26 aa, Entamoeba invadens
KEVLSPSCLTSSCTPRLSKNNKNNEI

SEQ ID NO: 2946710 - protein, 18 aa, Entamoeba invadens
KEVLSVIKNAKFVYNTNA

SEQ ID NO: 2946711 - protein, 18 aa, Entamoeba invadens
KEVMKYLGEKKHKRPSRN

SEQ ID NO: 2946712 - protein, 21 aa, Entamoeba invadens
KEVNAKAWKECSALTQVGLKE

SEQ ID NO: 2946713 - protein, 27 aa, Entamoeba invadens
KEVPYFGVFRVHGKLGETVAIPLNERE

SEQ ID NO: 2946714 - protein, 21 aa, Entamoeba invadens
KEVQKVPTLVLFPVSTVSQMR

SEQ ID NO: 2946715 - protein, 17 aa, Entamoeba invadens
KEVRALVATLSQKQPQQ

SEQ ID NO: 2946716 - protein, 21 aa, Entamoeba invadens
KEVRLDKEFILQKGTLLNMEC

SEQ ID NO: 2946717 - protein, 23 aa, Entamoeba invadens
KEVSDSNCVLCLIEYYLKDLQCL

SEQ ID NO: 2946718 - protein, 26 aa, Entamoeba invadens
KEVSMLYKFRCDYIVHFYGAVFFPNK

SEQ ID NO: 2946719 - protein, 20 aa, Entamoeba invadens
KEVSTMLLAVTSMKDNLQTQ

SEQ ID NO: 2946720 - protein, 17 aa, Entamoeba invadens
KEVTEVQILVGGKDQKI

SEQ ID NO: 2946721 - protein, 26 aa, Entamoeba invadens
KEVTLRILGHQKFEVIFPSKVESLNF

SEQ ID NO: 2946722 - protein, 20 aa, Entamoeba invadens
KEVTSLTAVSVFQLYNNIDL

SEQ ID NO: 2946723 - protein, 25 aa, Entamoeba invadens
KEVVKIPFEIDDCFKSAEERELFEM

SEQ ID NO: 2946724 - protein, 18 aa, Entamoeba invadens
KEVVLRWRRGKKEGNKGK

SEQ ID NO: 2946725 - protein, 17 aa, Entamoeba invadens
KEVVNGKSTELKQYSSF

SEQ ID NO: 2946726 - protein, 17 aa, Entamoeba invadens
KEVVSIGACLLAKDILQ

SEQ ID NO: 2946727 - protein, 25 aa, Entamoeba invadens
KEVVVRVDGCIRLKQYKFLNRFADL

SEQ ID NO: 2946728 - protein, 19 aa, Entamoeba invadens
KEVWKCVINDQIRYNNDIR

SEQ ID NO: 2946729 - protein, 17 aa, Entamoeba invadens
KEVYDCAHGIKGITTSL

SEQ ID NO: 2946730 - protein, 19 aa, Entamoeba invadens
KEVYEEIEIVLKELNRLSA

SEQ ID NO: 2946731 - protein, 17 aa, Entamoeba invadens
KEVYPAESMNRDGKIFH

SEQ ID NO: 2946732 - protein, 21 aa, Entamoeba invadens
KEWCKNRLVSFAVPTHIFVLE

SEQ ID NO: 2946733 - protein, 19 aa, Entamoeba invadens
KEWFGSSQVKKVRVDNTIK

SEQ ID NO: 2946734 - protein, 28 aa, Entamoeba invadens
KEYAETVDWWGFGILIFEMIHGHAPFVS

SEQ ID NO: 2946735 - protein, 26 aa, Entamoeba invadens
KEYDIYFDITLQIVIYFLQIAGIDIN

SEQ ID NO: 2946736 - protein, 21 aa, Entamoeba invadens
KEYEEYYPLFVQYATQSPQHR

SEQ ID NO: 2946737 - protein, 25 aa, Entamoeba invadens
KEYFMKFGGIFSCKVVPEKKYGFVC

SEQ ID NO: 2946738 - protein, 19 aa, Entamoeba invadens
KEYGCVCYNTPVGEIQVGV

SEQ ID NO: 2946739 - protein, 29 aa, Entamoeba invadens
KEYHLKLCLCPLCKHGMEVFGAKRPVSWI

SEQ ID NO: 2946740 - protein, 22 aa, Entamoeba invadens
KEYKLVSGVLKRVVCDKECYYW

SEQ ID NO: 2946741 - protein, 19 aa, Entamoeba invadens
KEYLADLEFEKDLSKLVAF

SEQ ID NO: 2946742 - protein, 25 aa, Entamoeba invadens
KEYLKLRAKRFVLFSSVLKNPQFEI

SEQ ID NO: 2946743 - protein, 20 aa, Entamoeba invadens
KEYLMKNGACTSQYLMGVVE

SEQ ID NO: 2946744 - protein, 22 aa, Entamoeba invadens
KEYPDLFFAKQVVNNACATQAI

SEQ ID NO: 2946745 - protein, 31 aa, Entamoeba invadens
KEYRTLVNYFPIRGEHFCSGTIEKSSASTDT

SEQ ID NO: 2946746 - protein, 26 aa, Entamoeba invadens
KEYSPMAFAIIRRFFGVSDREMMRSI

SEQ ID NO: 2946747 - protein, 28 aa, Entamoeba invadens
KEYTDKPLFFFIGLSLKQDTHFLSTIQK

SEQ ID NO: 2946748 - protein, 17 aa, Entamoeba invadens
KEYTEGIAHINSTTKPR

SEQ ID NO: 2946749 - protein, 25 aa, Entamoeba invadens
KEYVEFCNGMGWTLDIKSHNGFLGG

SEQ ID NO: 2946750 - protein, 21 aa, Entamoeba invadens
KEYVFRKACVLNKIEKMERPK

SEQ ID NO: 2946751 - protein, 21 aa, Entamoeba invadens
KFAAAIVKFLMWVEKKFGEKL

SEQ ID NO: 2946752 - protein, 21 aa, Entamoeba invadens
KFAASIFKFLIKVEKKFGKKL

SEQ ID NO: 2946753 - protein, 18 aa, Entamoeba invadens
KFACKAVISKTLLGALGL

SEQ ID NO: 2946754 - protein, 19 aa, Entamoeba invadens
KFAEFRFTLTEPFDVVLEK

SEQ ID NO: 2946755 - protein, 17 aa, Entamoeba invadens
KFAEKRSPSSYVKILLR

SEQ ID NO: 2946756 - protein, 18 aa, Entamoeba invadens
KFAFPLISDKVMFNEICQ

SEQ ID NO: 2946757 - protein, 22 aa, Entamoeba invadens
KFAKEYFCKITRLNLSTTNERF

SEQ ID NO: 2946758 - protein, 18 aa, Entamoeba invadens
KFAKRNVTMAMAFTSIVP

SEQ ID NO: 2946759 - protein, 22 aa, Entamoeba invadens
KFAPFNACCHHGKIKPHDMKPP

SEQ ID NO: 2946760 - protein, 20 aa, Entamoeba invadens
KFAPTSGCYLRVIDSSGKDV

SEQ ID NO: 2946761 - protein, 20 aa, Entamoeba invadens
KFAQSFGAVGYFECSAKTKF

SEQ ID NO: 2946762 - protein, 21 aa, Entamoeba invadens
KFAQSIGAVGYFECSAKTKFN

SEQ ID NO: 2946763 - protein, 19 aa, Entamoeba invadens
KFAQSIGAVGYFECSAKTN

SEQ ID NO: 2946764 - protein, 19 aa, Entamoeba invadens
KFCDCSDLECKKCVNTDNF

SEQ ID NO: 2946765 - protein, 22 aa, Entamoeba invadens
KFCEGKADGFIKFDKQKYGWYA

SEQ ID NO: 2946766 - protein, 22 aa, Entamoeba invadens
KFDANLFKRPSLKGDALSASTL

SEQ ID NO: 2946767 - protein, 20 aa, Entamoeba invadens
KFDARCFYHNTQLSSITLST

SEQ ID NO: 2946768 - protein, 24 aa, Entamoeba invadens
KFDDDRLIPVFGFGDKTTGGNAVF

SEQ ID NO: 2946769 - protein, 24 aa, Entamoeba invadens
KFDDDRLIPVYGFGDKTTGDRAVF

SEQ ID NO: 2946770 - protein, 26 aa, Entamoeba invadens
KFDDEMSFRHVYNWLSEARRFCNKEN

SEQ ID NO: 2946771 - protein, 19 aa, Entamoeba invadens
KFDGRFENVISIFDEFEPI

SEQ ID NO: 2946772 - protein, 28 aa, Entamoeba invadens
KFDKETRRKLLLCGMARAGKDQVKEMRV

SEQ ID NO: 2946773 - protein, 27 aa, Entamoeba invadens
KFDLCTWEFFHIDFGYLFNSRPNFDAN

SEQ ID NO: 2946774 - protein, 28 aa, Entamoeba invadens
KFDLSLKFDLFHQCCVGVQWLHNRLNLI

SEQ ID NO: 2946775 - protein, 19 aa, Entamoeba invadens
KFDNEFLCLESLSVTNAVA

SEQ ID NO: 2946776 - protein, 25 aa, Entamoeba invadens
KFDNFRDIECIPHCMFMKCYNLKEM

SEQ ID NO: 2946777 - protein, 24 aa, Entamoeba invadens
KFDNNCFRCFKLYTVYINLFGYDE

SEQ ID NO: 2946778 - protein, 19 aa, Entamoeba invadens
KFDTFSFKQCNNTIFEFIN

SEQ ID NO: 2946779 - protein, 20 aa, Entamoeba invadens
KFDTLCEIYDTMTITQSVIF

SEQ ID NO: 2946780 - protein, 21 aa, Entamoeba invadens
KFDVSFYKRFDVVINALDNLQ

SEQ ID NO: 2946781 - protein, 24 aa, Entamoeba invadens
KFEDGLKKTVEWYLKNKKNWERTD

SEQ ID NO: 2946782 - protein, 21 aa, Entamoeba invadens
KFEELCFIGNAKLEEIILDSR

SEQ ID NO: 2946783 - protein, 17 aa, Entamoeba invadens
KFEFGIAEDMMAIKCNV

SEQ ID NO: 2946784 - protein, 22 aa, Entamoeba invadens
KFEFKRVQYERVEWEYYDDVKQ

SEQ ID NO: 2946785 - protein, 23 aa, Entamoeba invadens
KFEFPAFGVNLLIDPQIKEGYKF

SEQ ID NO: 2946786 - protein, 26 aa, Entamoeba invadens
KFEKRKTGGLVLEFIDSIECVNGDFF

SEQ ID NO: 2946787 - protein, 19 aa, Entamoeba invadens
KFEKVCIDAFITIRQHGPL

SEQ ID NO: 2946788 - protein, 39 aa, Entamoeba invadens
KFELRILPEVVMLKPFYACEFSIYLTPKCTCQINNKICI

SEQ ID NO: 2946789 - protein, 24 aa, Entamoeba invadens
KFELYRLNSKFEIQRTKNVGDELY

SEQ ID NO: 2946790 - protein, 19 aa, Entamoeba invadens
KFEMEDCMFLQPQQLNFNL

SEQ ID NO: 2946791 - protein, 19 aa, Entamoeba invadens
KFESCCFESNRSIQHVTLL

SEQ ID NO: 2946792 - protein, 20 aa, Entamoeba invadens
KFETDVPWWAKREADVTKEL

SEQ ID NO: 2946793 - protein, 17 aa, Entamoeba invadens
KFETKNNLFDFGSAFGE

SEQ ID NO: 2946794 - protein, 19 aa, Entamoeba invadens
KFETPKFYQFFSSIDDSIE

SEQ ID NO: 2946795 - protein, 20 aa, Entamoeba invadens
KFEVFCEGKFCIKHHTVKTY

SEQ ID NO: 2946796 - protein, 24 aa, Entamoeba invadens
KFFAHPDISSLNFVRMFRSILPVS

SEQ ID NO: 2946797 - protein, 27 aa, Entamoeba invadens
KFFCKKGEARLVEWKKKLPKDVTAIIC

SEQ ID NO: 2946798 - protein, 19 aa, Entamoeba invadens
KFFDGMAFGPLYPNFKENL

SEQ ID NO: 2946799 - protein, 19 aa, Entamoeba invadens
KFFHKTEYIKLFIDTERHI

SEQ ID NO: 2946800 - protein, 17 aa, Entamoeba invadens
KFFKAPVLEDLVGAYDF

SEQ ID NO: 2946801 - protein, 24 aa, Entamoeba invadens
KFFKKCSLESISLSLKNGLTQKTA

SEQ ID NO: 2946802 - protein, 18 aa, Entamoeba invadens
KFFNINVWFNVNYHTTQK

SEQ ID NO: 2946803 - protein, 19 aa, Entamoeba invadens
KFFQADVRFVKKVIENLIE

SEQ ID NO: 2946804 - protein, 17 aa, Entamoeba invadens
KFFRVVIWFQVSYKTTQ

SEQ ID NO: 2946805 - protein, 22 aa, Entamoeba invadens
KFGAMCYCQIGTESQWAVDREC

SEQ ID NO: 2946806 - protein, 34 aa, Entamoeba invadens
KFGATELSIAPALESKETVKACITEEKHKRTQCK

SEQ ID NO: 2946807 - protein, 17 aa, Entamoeba invadens
KFGDLLANYQLVALMKG

SEQ ID NO: 2946808 - protein, 26 aa, Entamoeba invadens
KFGDSCFYLCNCKLFKDYILPERCFT

SEQ ID NO: 2946809 - protein, 21 aa, Entamoeba invadens
KFGGDALIGYELELVKIVIEM

SEQ ID NO: 2946810 - protein, 18 aa, Entamoeba invadens
KFGIPVVTTKGMFSVDNE

SEQ ID NO: 2946811 - protein, 24 aa, Entamoeba invadens
KFGLRQMLLRNFPGVKKFIGLEML

SEQ ID NO: 2946812 - protein, 17 aa, Entamoeba invadens
KFGNTLLLACFKDPVIT

SEQ ID NO: 2946813 - protein, 17 aa, Entamoeba invadens
KFGPICSLIRRGLNNDV

SEQ ID NO: 2946814 - protein, 20 aa, Entamoeba invadens
KFGPSAKNYQEWRFVLCESE

SEQ ID NO: 2946815 - protein, 23 aa, Entamoeba invadens
KFGRNIETWFYLKGGDDGNSIVS

SEQ ID NO: 2946816 - protein, 19 aa, Entamoeba invadens
KFGTDLLQSGWRVAPYYPI

SEQ ID NO: 2946817 - protein, 24 aa, Entamoeba invadens
KFGTNCFFCCDLLRDNSMIPKEAF

SEQ ID NO: 2946818 - protein, 17 aa, Entamoeba invadens
KFGVLYRKAGQTTENEM

SEQ ID NO: 2946819 - protein, 25 aa, Entamoeba invadens
KFHAKWNPTCQCVFQTLADIQINET

SEQ ID NO: 2946820 - protein, 32 aa, Entamoeba invadens
KFHDLDCLVMALEIIFKKHVHFLESMMVDVKS

SEQ ID NO: 2946821 - protein, 20 aa, Entamoeba invadens
KFHPFFKYLYPTIVTGLQNL

SEQ ID NO: 2946822 - protein, 21 aa, Entamoeba invadens
KFHPIEFARQITLMQNDLFRK

SEQ ID NO: 2946823 - protein, 35 aa, Entamoeba invadens
KFHVKILPHKFCWRVKNDLYICVKDITVFTHLNGK

SEQ ID NO: 2946824 - protein, 21 aa, Entamoeba invadens
KFIDWKCIVGKLTVKQRGIIA

SEQ ID NO: 2946825 - protein, 18 aa, Entamoeba invadens
KFIECIQDTTQLLLYTFI

SEQ ID NO: 2946826 - protein, 26 aa, Entamoeba invadens
KFIEECWKGVFAMLYIGGIDENMNVL

SEQ ID NO: 2946827 - protein, 21 aa, Entamoeba invadens
KFIESIVWFNVDFETVDINKN

SEQ ID NO: 2946828 - protein, 17 aa, Entamoeba invadens
KFIEVYFEKCLQDPSCL

SEQ ID NO: 2946829 - protein, 20 aa, Entamoeba invadens
KFIGSCVFNGNYYILSEHAI

SEQ ID NO: 2946830 - protein, 20 aa, Entamoeba invadens
KFIMKLSINEFMSYFFNMMN

SEQ ID NO: 2946831 - protein, 17 aa, Entamoeba invadens
KFIPLPFPNKFQKIRSK

SEQ ID NO: 2946832 - protein, 21 aa, Entamoeba invadens
KFIQCKGALSVDENGKCSEST

SEQ ID NO: 2946833 - protein, 23 aa, Entamoeba invadens
KFIRGLVNFSGFVFRKQGNDCVC

SEQ ID NO: 2946834 - protein, 27 aa, Entamoeba invadens
KFIRVDWDYGYKEGREFGRGKDGEQKQ

SEQ ID NO: 2946835 - protein, 18 aa, Entamoeba invadens
KFKAKRVEFSAGNIEISS

SEQ ID NO: 2946836 - protein, 53 aa, Entamoeba invadens
KFKDLGFDFSRLPFFIFEWHYLWFIHALPFDFALKLFDVILLDGFYALFNIGD

SEQ ID NO: 2946837 - protein, 21 aa, Entamoeba invadens
KFKEIPLMFHFNPIQWNPKMV

SEQ ID NO: 2946838 - protein, 19 aa, Entamoeba invadens
KFKGQFLTQFSPCWGEKVE

SEQ ID NO: 2946839 - protein, 17 aa, Entamoeba invadens
KFKIPKLSLGFEKIKSS

SEQ ID NO: 2946840 - protein, 25 aa, Entamoeba invadens
KFKKLWDTYSFYLAKDVETIKRQIT

SEQ ID NO: 2946841 - protein, 22 aa, Entamoeba invadens
KFKLCVYKGPKEVLVYSTAAGV

SEQ ID NO: 2946842 - protein, 20 aa, Entamoeba invadens
KFKLLHWFDMDHIIYNDGSL

SEQ ID NO: 2946843 - protein, 18 aa, Entamoeba invadens
KFKNFKFYFKVIYDDKNP

SEQ ID NO: 2946844 - protein, 22 aa, Entamoeba invadens
KFKNRNVMKLIYLDLLGYNTQF

SEQ ID NO: 2946845 - protein, 22 aa, Entamoeba invadens
KFKSIPCKESKTFVTDQDNQDF

SEQ ID NO: 2946846 - protein, 24 aa, Entamoeba invadens
KFKVEKLMRIVLMIIHNILQVDWY

SEQ ID NO: 2946847 - protein, 21 aa, Entamoeba invadens
KFKYPWNIVEFVVAGKRLEIG

SEQ ID NO: 2946848 - protein, 20 aa, Entamoeba invadens
KFLCDRFHVELIFVSDGLTP

SEQ ID NO: 2946849 - protein, 22 aa, Entamoeba invadens
KFLCSGPLFIVEKVMEPPKKWM

SEQ ID NO: 2946850 - protein, 18 aa, Entamoeba invadens
KFLECLQTSQSYIKTIGN

SEQ ID NO: 2946851 - protein, 28 aa, Entamoeba invadens
KFLEESKKFFGEVAFDYITFLQKKIGDF

SEQ ID NO: 2946852 - protein, 22 aa, Entamoeba invadens
KFLEGVAYLIAFYDMTAEMIEF

SEQ ID NO: 2946853 - protein, 22 aa, Entamoeba invadens
KFLGEGCFCYCFSLHSINMPST

SEQ ID NO: 2946854 - protein, 24 aa, Entamoeba invadens
KFLKAMPVDSLRVFDVNLRQKYYT

SEQ ID NO: 2946855 - protein, 19 aa, Entamoeba invadens
KFLKTYPCVLKLLREKSNE

SEQ ID NO: 2946856 - protein, 24 aa, Entamoeba invadens
KFLLFRCVLENNLIQIRTIVDSLK

SEQ ID NO: 2946857 - protein, 17 aa, Entamoeba invadens
KFLPEICVIMTREMELF

SEQ ID NO: 2946858 - protein, 18 aa, Entamoeba invadens
KFLREMKEKIFPYEVTSW

SEQ ID NO: 2946859 - protein, 23 aa, Entamoeba invadens
KFLRGSSFSELGEYNLVVKSANI

SEQ ID NO: 2946860 - protein, 18 aa, Entamoeba invadens
KFLSSCFLDCGFLKQIEI

SEQ ID NO: 2946861 - protein, 25 aa, Entamoeba invadens
KFMFKNCRKLEDVVMRKGIHKICDL

SEQ ID NO: 2946862 - protein, 22 aa, Entamoeba invadens
KFMFKNCWRLKNIDIQKNIVKI

SEQ ID NO: 2946863 - protein, 18 aa, Entamoeba invadens
KFMGAGYVQWATCVTELF

SEQ ID NO: 2946864 - protein, 23 aa, Entamoeba invadens
KFMSFGQAFYRGSECCFLVCDVT

SEQ ID NO: 2946865 - protein, 22 aa, Entamoeba invadens
KFNEIPLMFHFNPIQWKPKMKK

SEQ ID NO: 2946866 - protein, 25 aa, Entamoeba invadens
KFNEKLCIGDTLYGTTETLCYQQYD

SEQ ID NO: 2946867 - protein, 19 aa, Entamoeba invadens
KFNFNDFRIKGIRYEIPYW

SEQ ID NO: 2946868 - protein, 22 aa, Entamoeba invadens
KFNILDCVRALKGFETNRDEVD

SEQ ID NO: 2946869 - protein, 24 aa, Entamoeba invadens
KFNLKFKKVCLGSSSFTKRLNELL

SEQ ID NO: 2946870 - protein, 28 aa, Entamoeba invadens
KFNLLQFRLSFEFTKDFRIKSISQFCRN

SEQ ID NO: 2946871 - protein, 23 aa, Entamoeba invadens
KFNLPNERFSLFVDNDVIITLTH

SEQ ID NO: 2946872 - protein, 19 aa, Entamoeba invadens
KFNNSFFIRLNKLYLGLLN

SEQ ID NO: 2946873 - protein, 25 aa, Entamoeba invadens
KFNPMCLTSQFNHVFIVVQPDTNTE

SEQ ID NO: 2946874 - protein, 23 aa, Entamoeba invadens
KFNVFQKIRFDLVMNSLKEMTSL

SEQ ID NO: 2946875 - protein, 24 aa, Entamoeba invadens
KFNWDINECIPWIIENLATFPRPE

SEQ ID NO: 2946876 - protein, 22 aa, Entamoeba invadens
KFPEDKIAVSFEVVTDKCHQFI

SEQ ID NO: 2946877 - protein, 20 aa, Entamoeba invadens
KFPEDYIPTVFDNYVVTLTA

SEQ ID NO: 2946878 - protein, 25 aa, Entamoeba invadens
KFPERIPFRLTRMIVNAMDVSGIEG

SEQ ID NO: 2946879 - protein, 30 aa, Entamoeba invadens
KFPERRDARCKDCRRNFVSLGDKVKIVGGN

SEQ ID NO: 2946880 - protein, 17 aa, Entamoeba invadens
KFPLVVLTRDCLNIFDL

SEQ ID NO: 2946881 - protein, 23 aa, Entamoeba invadens
KFPNDFFSILKLTLIDSKSVLLS

SEQ ID NO: 2946882 - protein, 29 aa, Entamoeba invadens
KFPNELAEYDFLYEKYKQLGIKFPEMSPV

SEQ ID NO: 2946883 - protein, 22 aa, Entamoeba invadens
KFPPSPCPVYILSLPFYKEQLE

SEQ ID NO: 2946884 - protein, 18 aa, Entamoeba invadens
KFPQSYDVPNFVNAMHYK

SEQ ID NO: 2946885 - protein, 28 aa, Entamoeba invadens
KFPRSLRSLKLVSVCYKKAINLIDIGLL

SEQ ID NO: 2946886 - protein, 24 aa, Entamoeba invadens
KFPRTHPRFRTLRADAKQEDILAA

SEQ ID NO: 2946887 - protein, 20 aa, Entamoeba invadens
KFPSHLTKLEMCSCSSLKTL

SEQ ID NO: 2946888 - protein, 28 aa, Entamoeba invadens
KFPTQFLALISHCLIVPILPLGENNRLC

SEQ ID NO: 2946889 - protein, 24 aa, Entamoeba invadens
KFQEAEYWKRESLNWISVDQRPVD

SEQ ID NO: 2946890 - protein, 25 aa, Entamoeba invadens
KFQEPRSSRGLSFREMKGKKVTISE

SEQ ID NO: 2946891 - protein, 18 aa, Entamoeba invadens
KFQGNMGKFHFNPISLNY

SEQ ID NO: 2946892 - protein, 18 aa, Entamoeba invadens
KFQIDEFQMKIKELSGKK

SEQ ID NO: 2946893 - protein, 18 aa, Entamoeba invadens
KFQLIRNITPPIIPKISG

SEQ ID NO: 2946894 - protein, 18 aa, Entamoeba invadens
KFQQFGICQVVEEKNMGK

SEQ ID NO: 2946895 - protein, 17 aa, Entamoeba invadens
KFQVFKSGVLKGGAVVS

SEQ ID NO: 2946896 - protein, 18 aa, Entamoeba invadens
KFRCELMTAIEINVFDSC

SEQ ID NO: 2946897 - protein, 21 aa, Entamoeba invadens
KFRDMCLSETNWIECMSDGVQ

SEQ ID NO: 2946898 - protein, 18 aa, Entamoeba invadens
KFRHHLKKANAFEQLLRI

SEQ ID NO: 2946899 - protein, 18 aa, Entamoeba invadens
KFRIFGASTLFVYDADAK

SEQ ID NO: 2946900 - protein, 22 aa, Entamoeba invadens
KFRKLFPAIETFYVYSEQDKIY

SEQ ID NO: 2946901 - protein, 18 aa, Entamoeba invadens
KFRLKESFEYEWENNVRL

SEQ ID NO: 2946902 - protein, 20 aa, Entamoeba invadens
KFRSEFIVHFYGAVFVPNKV

SEQ ID NO: 2946903 - protein, 22 aa, Entamoeba invadens
KFRSEFVVHFYGAVFARNKVCM

SEQ ID NO: 2946904 - protein, 19 aa, Entamoeba invadens
KFRSELIKKLPAAYTPYID

SEQ ID NO: 2946905 - protein, 19 aa, Entamoeba invadens
KFRSEYIVHFYGAVFVPNN

SEQ ID NO: 2946906 - protein, 20 aa, Entamoeba invadens
KFRSLPRSVTKLTIKQTNER

SEQ ID NO: 2946907 - protein, 23 aa, Entamoeba invadens
KFSDELFDTISLLSLTRNQYDRC

SEQ ID NO: 2946908 - protein, 26 aa, Entamoeba invadens
KFSDKHGDVCPLNWVPGKDTMKPTPD

SEQ ID NO: 2946909 - protein, 29 aa, Entamoeba invadens
KFSDKYDSVFRFVLNNTLIVDTLKTARKI

SEQ ID NO: 2946910 - protein, 19 aa, Entamoeba invadens
KFSETCCSILKQSLVISSS

SEQ ID NO: 2946911 - protein, 26 aa, Entamoeba invadens
KFSFFLVDFCDLRSAQTSLFLTGTLI

SEQ ID NO: 2946912 - protein, 34 aa, Entamoeba invadens
KFSLCSPEFYILFHISAWIGMCCDNINVVASATD

SEQ ID NO: 2946913 - protein, 18 aa, Entamoeba invadens
KFSMFIIEVSQYVENHTK

SEQ ID NO: 2946914 - protein, 19 aa, Entamoeba invadens
KFSPPFTFVNMTPLTLELT

SEQ ID NO: 2946915 - protein, 19 aa, Entamoeba invadens
KFSQELYNTINAVFDVFET

SEQ ID NO: 2946916 - protein, 18 aa, Entamoeba invadens
KFTECSVIGLTDVKISLI

SEQ ID NO: 2946917 - protein, 22 aa, Entamoeba invadens
KFTEKPKPLAKVIPKTTYTKSI

SEQ ID NO: 2946918 - protein, 24 aa, Entamoeba invadens
KFTELKRYTLLLTNLPHKRLRDVA

SEQ ID NO: 2946919 - protein, 19 aa, Entamoeba invadens
KFTEYELRGIPLRIELGPR

SEQ ID NO: 2946920 - protein, 18 aa, Entamoeba invadens
KFTGASIFIRSQEVIGWD

SEQ ID NO: 2946921 - protein, 24 aa, Entamoeba invadens
KFTKKCKMNALLEIELWDVDEVAF

SEQ ID NO: 2946922 - protein, 21 aa, Entamoeba invadens
KFTNLCFTNTFGTQSIYTEEN

SEQ ID NO: 2946923 - protein, 28 aa, Entamoeba invadens
KFTNTLPPQWRFWESMTQDFCATSKEAF

SEQ ID NO: 2946924 - protein, 17 aa, Entamoeba invadens
KFTSKIGKISTKFTSGI

SEQ ID NO: 2946925 - protein, 19 aa, Entamoeba invadens
KFTVSNGYFCLHPYASGVF

SEQ ID NO: 2946926 - protein, 26 aa, Entamoeba invadens
KFTYPIAGKLWMKYFDDFVSKYGETK

SEQ ID NO: 2946927 - protein, 19 aa, Entamoeba invadens
KFVALLFFVDFITSRVKVL

SEQ ID NO: 2946928 - protein, 26 aa, Entamoeba invadens
KFVATFFAHKGCKIAVASSSFVQGEG

SEQ ID NO: 2946929 - protein, 19 aa, Entamoeba invadens
KFVECVRIGNNASRSVVLR

SEQ ID NO: 2946930 - protein, 26 aa, Entamoeba invadens
KFVENKRVFHLLKIKTILMNMCALEC

SEQ ID NO: 2946931 - protein, 23 aa, Entamoeba invadens
KFVGNCRELSAVFLGNNRGVTNL

SEQ ID NO: 2946932 - protein, 28 aa, Entamoeba invadens
KFVKEYFLRIEEMFYPYFSCLVGNSNTS

SEQ ID NO: 2946933 - protein, 31 aa, Entamoeba invadens
KFVKLQMRAANCLKDIDFYFEKYLAICEAVT

SEQ ID NO: 2946934 - protein, 18 aa, Entamoeba invadens
KFVLDIIHSGVSFEIDDH

SEQ ID NO: 2946935 - protein, 22 aa, Entamoeba invadens
KFVPDMSDLYFAFFTALASNYS

SEQ ID NO: 2946936 - protein, 18 aa, Entamoeba invadens
KFYEAFGKNLKLGIHEDT

SEQ ID NO: 2946937 - protein, 25 aa, Entamoeba invadens
KFYFWKRDLEMGIKHTCNCFCHALG

SEQ ID NO: 2946938 - protein, 21 aa, Entamoeba invadens
KFYIELRQSFKQDDDTPVTTR

SEQ ID NO: 2946939 - protein, 20 aa, Entamoeba invadens
KFYKKRRGFIASSKERNWMC

SEQ ID NO: 2946940 - protein, 23 aa, Entamoeba invadens
KFYKRSQMKISYKKEDFLRGNET

SEQ ID NO: 2946941 - protein, 26 aa, Entamoeba invadens
KFYNCLKAKTCVLFKMDLKGKQKLYE

SEQ ID NO: 2946942 - protein, 20 aa, Entamoeba invadens
KFYNFCFGENFEAKSEENDK

SEQ ID NO: 2946943 - protein, 28 aa, Entamoeba invadens
KGADFHTWKKRWFVMKDHYIYYFTKNSP

SEQ ID NO: 2946944 - protein, 29 aa, Entamoeba invadens
KGADLPFLSGLLLIHFKNFFKLSDAKEII

SEQ ID NO: 2946945 - protein, 21 aa, Entamoeba invadens
KGADTLVLWLDCDREGENISF

SEQ ID NO: 2946946 - protein, 18 aa, Entamoeba invadens
KGAGFEISKMKAFDNEKP

SEQ ID NO: 2946947 - protein, 21 aa, Entamoeba invadens
KGAGVGPTLCLAYKIQKHSKG

SEQ ID NO: 2946948 - protein, 22 aa, Entamoeba invadens
KGAKGVFYYAYYDLVYIDDKGI

SEQ ID NO: 2946949 - protein, 19 aa, Entamoeba invadens
KGAMDRCGIKIGRKLARKA

SEQ ID NO: 2946950 - protein, 25 aa, Entamoeba invadens
KGAPRKYKAMLWKKLLNLDTIDEKT

SEQ ID NO: 2946951 - protein, 17 aa, Entamoeba invadens
KGASKETVGRLVVRDGR

SEQ ID NO: 2946952 - protein, 26 aa, Entamoeba invadens
KGATVCPKCWPLLVSASNLLNFVLVT

SEQ ID NO: 2946953 - protein, 19 aa, Entamoeba invadens
KGCAAPVMRIENELDVPLH

SEQ ID NO: 2946954 - protein, 23 aa, Entamoeba invadens
KGCGCCYAAAIANHGQILYANMT

SEQ ID NO: 2946955 - protein, 22 aa, Entamoeba invadens
KGCNIKTTFLLPNTLTRFSITD

SEQ ID NO: 2946956 - protein, 22 aa, Entamoeba invadens
KGCSMRAHLTCLGRLFTREQDI

SEQ ID NO: 2946957 - protein, 19 aa, Entamoeba invadens
KGCTKDVYKNRRMSWRSKN

SEQ ID NO: 2946958 - protein, 31 aa, Entamoeba invadens
KGDAYKLKLCFCPFCQVGIKALGLDKPENHK

SEQ ID NO: 2946959 - protein, 19 aa, Entamoeba invadens
KGDCSRAREVMSLLNDIDI

SEQ ID NO: 2946960 - protein, 23 aa, Entamoeba invadens
KGDDLRIGYKNGVIKDVNLSSGN

SEQ ID NO: 2946961 - protein, 21 aa, Entamoeba invadens
KGDDTHFCFLVIRNAVGKTRW

SEQ ID NO: 2946962 - protein, 19 aa, Entamoeba invadens
KGDEEFVSFDFVNTNPVID

SEQ ID NO: 2946963 - protein, 19 aa, Entamoeba invadens
KGDETKTFLVVQKGSEDCL

SEQ ID NO: 2946964 - protein, 20 aa, Entamoeba invadens
KGDETPKVIFSFDDVKFPDF

SEQ ID NO: 2946965 - protein, 24 aa, Entamoeba invadens
KGDFACKVPSIAVRNIVGHTGDIT

SEQ ID NO: 2946966 - protein, 20 aa, Entamoeba invadens
KGDFHIFRLLVTCSQNDVLI

SEQ ID NO: 2946967 - protein, 27 aa, Entamoeba invadens
KGDFQFKLVGVLIHLGSLDSGHYYSYI

SEQ ID NO: 2946968 - protein, 18 aa, Entamoeba invadens
KGDIMSFSDVYNLITKLI

SEQ ID NO: 2946969 - protein, 20 aa, Entamoeba invadens
KGDIVMRDILGFTVLNRTRK

SEQ ID NO: 2946970 - protein, 17 aa, Entamoeba invadens
KGDKTGASQHLKLKKLH

SEQ ID NO: 2946971 - protein, 17 aa, Entamoeba invadens
KGDPFWGSLLSFSYNKA

SEQ ID NO: 2946972 - protein, 24 aa, Entamoeba invadens
KGDQEIFCVFVLLVQGKRVYSMPL

SEQ ID NO: 2946973 - protein, 20 aa, Entamoeba invadens
KGDRIAIGTTYGFAVYSMDN

SEQ ID NO: 2946974 - protein, 17 aa, Entamoeba invadens
KGDTHWRDESLSLRDEL

SEQ ID NO: 2946975 - protein, 19 aa, Entamoeba invadens
KGDVEKAILVLKGNPLSGF

SEQ ID NO: 2946976 - protein, 21 aa, Entamoeba invadens
KGEACEFEIFITPLCSCYIND

SEQ ID NO: 2946977 - protein, 18 aa, Entamoeba invadens
KGEACEFEIFNKLLCSFI

SEQ ID NO: 2946978 - protein, 25 aa, Entamoeba invadens
KGECFDLKLRPDKVFESLKSGLYES

SEQ ID NO: 2946979 - protein, 24 aa, Entamoeba invadens
KGEETDLMFFRPCEGTDLKDVSKY

SEQ ID NO: 2946980 - protein, 29 aa, Entamoeba invadens
KGEKREMCYKIAFEVFAAVAHKNDPMKFD

SEQ ID NO: 2946981 - protein, 17 aa, Entamoeba invadens
KGEKVILETGAYFEPND

SEQ ID NO: 2946982 - protein, 27 aa, Entamoeba invadens
KGELCLKYFRVESVSGKTPYLHIQNFL

SEQ ID NO: 2946983 - protein, 27 aa, Entamoeba invadens
KGELLRGFCDGRLFDRLHIKASSKPFL

SEQ ID NO: 2946984 - protein, 20 aa, Entamoeba invadens
KGEMPEIPKIYFLAQTFKEL

SEQ ID NO: 2946985 - protein, 21 aa, Entamoeba invadens
KGEMVMCKVATFGNFDDVVEA

SEQ ID NO: 2946986 - protein, 33 aa, Entamoeba invadens
KGEPKCVGCSFFIKCFLCNKMLNYNMVTQSTSS

SEQ ID NO: 2946987 - protein, 18 aa, Entamoeba invadens
KGEPLFAAIFRVLRAYCA

SEQ ID NO: 2946988 - protein, 17 aa, Entamoeba invadens
KGEQTGLVPTSNLMTIK

SEQ ID NO: 2946989 - protein, 20 aa, Entamoeba invadens
KGETYTILFSKLNDVDETNS

SEQ ID NO: 2946990 - protein, 19 aa, Entamoeba invadens
KGEVCEFEIFIKLLCLCKI

SEQ ID NO: 2946991 - protein, 22 aa, Entamoeba invadens
KGEYPCGVLYGKMEEELREKEF

SEQ ID NO: 2946992 - protein, 23 aa, Entamoeba invadens
KGFACEFTLIIAPFCTSKIDTTI

SEQ ID NO: 2946993 - protein, 20 aa, Entamoeba invadens
KGFATSWGALGSVFKKCDKK

SEQ ID NO: 2946994 - protein, 18 aa, Entamoeba invadens
KGFCLTPSDMNGVITYTS

SEQ ID NO: 2946995 - protein, 20 aa, Entamoeba invadens
KGFEHKLVFVMPTNMKEFEA

SEQ ID NO: 2946996 - protein, 26 aa, Entamoeba invadens
KGFKKLKSLVEVMAYFFENFQTIAPF

SEQ ID NO: 2946997 - protein, 19 aa, Entamoeba invadens
KGFLTSNEFFRVMTNLDEV

SEQ ID NO: 2946998 - protein, 26 aa, Entamoeba invadens
KGFNEKVCGRKNLLIVAVSGKSIFGS

SEQ ID NO: 2946999 - protein, 20 aa, Entamoeba invadens
KGFNGFLILRSMYITTKKKH

SEQ ID NO: 2947000 - protein, 18 aa, Entamoeba invadens
KGFPIKKSSLINTSERVT

SEQ ID NO: 2947001 - protein, 25 aa, Entamoeba invadens
KGFRMAEKKAKETINAMKISFEKKD

SEQ ID NO: 2947002 - protein, 17 aa, Entamoeba invadens
KGFSEVILSLATGDNEI

SEQ ID NO: 2947003 - protein, 24 aa, Entamoeba invadens
KGFSPRLFNKWNYDEVHVPDMSLV

SEQ ID NO: 2947004 - protein, 18 aa, Entamoeba invadens
KGFYTMDDIRGMPEKSNS

SEQ ID NO: 2947005 - protein, 19 aa, Entamoeba invadens
KGGCICPGGIGFDINCGVR

SEQ ID NO: 2947006 - protein, 18 aa, Entamoeba invadens
KGGEMFKTTFSKIHTLSV

SEQ ID NO: 2947007 - protein, 23 aa, Entamoeba invadens
KGGIFNIWFNTWFIHDNHLEFSK

SEQ ID NO: 2947008 - protein, 18 aa, Entamoeba invadens
KGGKIGMNVLEGINSVQW

SEQ ID NO: 2947009 - protein, 20 aa, Entamoeba invadens
KGGKVYRTILVVDQSNYIIE

SEQ ID NO: 2947010 - protein, 22 aa, Entamoeba invadens
KGGLEKSMFERLLLNKVPYALL

SEQ ID NO: 2947011 - protein, 19 aa, Entamoeba invadens
KGGLLYLLNHFVSGIDLEQ

SEQ ID NO: 2947012 - protein, 22 aa, Entamoeba invadens
KGGLSKDFLWTFVLNNENEFDE

SEQ ID NO: 2947013 - protein, 18 aa, Entamoeba invadens
KGGMKKVGISKEDREAME

SEQ ID NO: 2947014 - protein, 18 aa, Entamoeba invadens
KGGPMERIQSGQSFDDDD

SEQ ID NO: 2947015 - protein, 25 aa, Entamoeba invadens
KGGVLSYKYSSKFVRILSSKIFQDK

SEQ ID NO: 2947016 - protein, 20 aa, Entamoeba invadens
KGICKSRGFYKLKSSENSKE

SEQ ID NO: 2947017 - protein, 25 aa, Entamoeba invadens
KGIDPELNFEFNLRPSVTRQNVVLY

SEQ ID NO: 2947018 - protein, 25 aa, Entamoeba invadens
KGIITEIFPSILFKIPDFINTSVHE

SEQ ID NO: 2947019 - protein, 19 aa, Entamoeba invadens
KGILSGLFYLHSEHHIVHR

SEQ ID NO: 2947020 - protein, 22 aa, Entamoeba invadens
KGINSGMPFYIYNLIEELDEEG

SEQ ID NO: 2947021 - protein, 23 aa, Entamoeba invadens
KGIPIDFLFGRRDHPPLPEVATL

SEQ ID NO: 2947022 - protein, 26 aa, Entamoeba invadens
KGIPRSICVTFNFNCLLVLREGGEVV

SEQ ID NO: 2947023 - protein, 19 aa, Entamoeba invadens
KGIQRYVKYIFKNQKHPIY

SEQ ID NO: 2947024 - protein, 25 aa, Entamoeba invadens
KGISEEAKRVFGLKKTSAFNRIIDV

SEQ ID NO: 2947025 - protein, 17 aa, Entamoeba invadens
KGIVRVVFPPGIDYEKT

SEQ ID NO: 2947026 - protein, 19 aa, Entamoeba invadens
KGIYDAFVKAASSDVKKIA

SEQ ID NO: 2947027 - protein, 21 aa, Entamoeba invadens
KGKAACWMKTLFDKKNIEVEE

SEQ ID NO: 2947028 - protein, 23 aa, Entamoeba invadens
KGKAGCWMKSLFDIKNLEVEEYV

SEQ ID NO: 2947029 - protein, 19 aa, Entamoeba invadens
KGKASFGIYMFLEKNNIKC

SEQ ID NO: 2947030 - protein, 28 aa, Entamoeba invadens
KGKCIKRVKREFVLGILMYVGIPPDISV

SEQ ID NO: 2947031 - protein, 24 aa, Entamoeba invadens
KGKCQKCQDTSCAKCTYDNQIEIC

SEQ ID NO: 2947032 - protein, 22 aa, Entamoeba invadens
KGKDGRFKVLIDLLGKSDDGEM

SEQ ID NO: 2947033 - protein, 25 aa, Entamoeba invadens
KGKDIKLPLLPPLRPKTPKPTEEQA

SEQ ID NO: 2947034 - protein, 25 aa, Entamoeba invadens
KGKEIPFELLSTFPPVDSTSTSQAT

SEQ ID NO: 2947035 - protein, 21 aa, Entamoeba invadens
KGKEVIDVFNKYAIYKRLVGK

SEQ ID NO: 2947036 - protein, 18 aa, Entamoeba invadens
KGKIEYLEMLYKLCQQKV

SEQ ID NO: 2947037 - protein, 17 aa, Entamoeba invadens
KGKIGGIDLQFHPILPW

SEQ ID NO: 2947038 - protein, 19 aa, Entamoeba invadens
KGKIIEMMSIFNSKLNPQF

SEQ ID NO: 2947039 - protein, 20 aa, Entamoeba invadens
KGKIKCSFGIGTSFTCDTGN

SEQ ID NO: 2947040 - protein, 26 aa, Entamoeba invadens
KGKIKSFGSYCFGMCKSLVIIKLPES

SEQ ID NO: 2947041 - protein, 20 aa, Entamoeba invadens
KGKLCGDGEYSLPIYNGQPF

SEQ ID NO: 2947042 - protein, 19 aa, Entamoeba invadens
KGKLKEMDTPLNLIKEKDT

SEQ ID NO: 2947043 - protein, 18 aa, Entamoeba invadens
KGKLKRDVEESLDNLLSQ

SEQ ID NO: 2947044 - protein, 17 aa, Entamoeba invadens
KGKNFNTYHFLKNKVYE

SEQ ID NO: 2947045 - protein, 25 aa, Entamoeba invadens
KGKPKSCALIKLDSDEAVDRAVNSL

SEQ ID NO: 2947046 - protein, 22 aa, Entamoeba invadens
KGKSKKCSLISISEKLEQKVIE

SEQ ID NO: 2947047 - protein, 20 aa, Entamoeba invadens
KGKVHGGVLLYSPAVSIPIN

SEQ ID NO: 2947048 - protein, 19 aa, Entamoeba invadens
KGKVHPIVPIFKKGAFLKN

SEQ ID NO: 2947049 - protein, 20 aa, Entamoeba invadens
KGKVKFRVTFTVDVNALLTV

SEQ ID NO: 2947050 - protein, 19 aa, Entamoeba invadens
KGKVPRAKEGVILGHEGVG

SEQ ID NO: 2947051 - protein, 17 aa, Entamoeba invadens
KGKWDFDAATGNDWMDK

SEQ ID NO: 2947052 - protein, 26 aa, Entamoeba invadens
KGKYEKDIAEIIVRAETLEKKSKWLN

SEQ ID NO: 2947053 - protein, 22 aa, Entamoeba invadens
KGKYEKDIAEIIVRAKTFEKKV

SEQ ID NO: 2947054 - protein, 22 aa, Entamoeba invadens
KGKYEKDIAEITVRAETLEKKV

SEQ ID NO: 2947055 - protein, 21 aa, Entamoeba invadens
KGKYMSCCMMYRGDVSNREVN

SEQ ID NO: 2947056 - protein, 24 aa, Entamoeba invadens
KGKYYDNFCEWTFNIFLVLNNNKE

SEQ ID NO: 2947057 - protein, 18 aa, Entamoeba invadens
KGLCYFDCSQGWFGNYRT

SEQ ID NO: 2947058 - protein, 29 aa, Entamoeba invadens
KGLDTDPDFNWKYLFLLYDSYTQMSNFFN

SEQ ID NO: 2947059 - protein, 17 aa, Entamoeba invadens
KGLEMLISRRQKGKLFQ

SEQ ID NO: 2947060 - protein, 24 aa, Entamoeba invadens
KGLESLEIIPFIRFIDLSSTEVKD

SEQ ID NO: 2947061 - protein, 20 aa, Entamoeba invadens
KGLFCDLLWSDPFVPEPGQK

SEQ ID NO: 2947062 - protein, 22 aa, Entamoeba invadens
KGLFHRHRRLYGSDREIARTEA

SEQ ID NO: 2947063 - protein, 20 aa, Entamoeba invadens
KGLFRKGLALNGLKKYEEAL

SEQ ID NO: 2947064 - protein, 24 aa, Entamoeba invadens
KGLKENVRVLPLVDYQNFQMNISV

SEQ ID NO: 2947065 - protein, 22 aa, Entamoeba invadens
KGLKNLRLPTTLKILDLNFCNN

SEQ ID NO: 2947066 - protein, 24 aa, Entamoeba invadens
KGLLREFDDSFALNQSQKVSEIVR

SEQ ID NO: 2947067 - protein, 19 aa, Entamoeba invadens
KGLLVDRDRIYVVNNPIDW

SEQ ID NO: 2947068 - protein, 17 aa, Entamoeba invadens
KGLPYDIVILNDFGTIE

SEQ ID NO: 2947069 - protein, 25 aa, Entamoeba invadens
KGLSKGKSRVFGWMVCGGEILESEK

SEQ ID NO: 2947070 - protein, 25 aa, Entamoeba invadens
KGLSRSACVIVAYLMMAYQINIKTA

SEQ ID NO: 2947071 - protein, 17 aa, Entamoeba invadens
KGLVKKFEHDWKYHKYL

SEQ ID NO: 2947072 - protein, 19 aa, Entamoeba invadens
KGLYSRPLVLESVFHTEFF

SEQ ID NO: 2947073 - protein, 23 aa, Entamoeba invadens
KGLYYRQSIIYGRYQTPLNNSIV

SEQ ID NO: 2947074 - protein, 19 aa, Entamoeba invadens
KGMEKHIEKYHGYKSTIAH

SEQ ID NO: 2947075 - protein, 29 aa, Entamoeba invadens
KGMNCAFGRWPVKSCNFILKLIKSAVDNA

SEQ ID NO: 2947076 - protein, 17 aa, Entamoeba invadens
KGMRCLWMTNFDMILTT

SEQ ID NO: 2947077 - protein, 18 aa, Entamoeba invadens
KGMRLFFDEKFCEETPEG

SEQ ID NO: 2947078 - protein, 27 aa, Entamoeba invadens
KGMSFKGGVIEIRYASFSKKDVERIEQ

SEQ ID NO: 2947079 - protein, 30 aa, Entamoeba invadens
KGNKKIEEFRVFCCRNLGIASVYNNDVVLK

SEQ ID NO: 2947080 - protein, 23 aa, Entamoeba invadens
KGNLPYKKYIGWQAVDVSDIPND

SEQ ID NO: 2947081 - protein, 20 aa, Entamoeba invadens
KGNNVPTWFVLSTAVDFVSL

SEQ ID NO: 2947082 - protein, 17 aa, Entamoeba invadens
KGNPLSIHFILKDEPVV

SEQ ID NO: 2947083 - protein, 20 aa, Entamoeba invadens
KGNSHLILAYVLRPSNKSLL

SEQ ID NO: 2947084 - protein, 17 aa, Entamoeba invadens
KGNSWTRPKEMGVLQSI

SEQ ID NO: 2947085 - protein, 21 aa, Entamoeba invadens
KGNTLRLIDHFIYHNHICIVT

SEQ ID NO: 2947086 - protein, 24 aa, Entamoeba invadens
KGNTLRMVDHFVFHNHICIVTELL

SEQ ID NO: 2947087 - protein, 17 aa, Entamoeba invadens
KGNVIPFKPQEPPQQQS

SEQ ID NO: 2947088 - protein, 19 aa, Entamoeba invadens
KGNVVLIRVRLMIDKTGQI

SEQ ID NO: 2947089 - protein, 19 aa, Entamoeba invadens
KGNYFVCGDSGNLYQSPDV

SEQ ID NO: 2947090 - protein, 20 aa, Entamoeba invadens
KGNYLRSKFDIELIKKTGYV

SEQ ID NO: 2947091 - protein, 23 aa, Entamoeba invadens
KGPFSEPEIQYFMREVLEGLSYL

SEQ ID NO: 2947092 - protein, 24 aa, Entamoeba invadens
KGQELRLKQQFFFTSASLQDIVRR

SEQ ID NO: 2947093 - protein, 20 aa, Entamoeba invadens
KGQFNAMLRRKAFMHQYTEE

SEQ ID NO: 2947094 - protein, 30 aa, Entamoeba invadens
KGQLKHFIPLIWAKGGLFLDKILYLRNDKM

SEQ ID NO: 2947095 - protein, 21 aa, Entamoeba invadens
KGQMINRLLCQSVLQQKDRVF

SEQ ID NO: 2947096 - protein, 22 aa, Entamoeba invadens
KGRIEIPLSRMYLKEEIRRLSR

SEQ ID NO: 2947097 - protein, 20 aa, Entamoeba invadens
KGRNGLKIDQLFKGKDTSAV

SEQ ID NO: 2947098 - protein, 25 aa, Entamoeba invadens
KGRPFRPLAERGCSTTRYTGKTITD

SEQ ID NO: 2947099 - protein, 20 aa, Entamoeba invadens
KGRPQILNFFRGFESTKHRI

SEQ ID NO: 2947100 - protein, 19 aa, Entamoeba invadens
KGRSCVPCATFDSHCVTCV

SEQ ID NO: 2947101 - protein, 24 aa, Entamoeba invadens
KGRTVLHLACLLDDPFVVDELMKN

SEQ ID NO: 2947102 - protein, 20 aa, Entamoeba invadens
KGRWKKGEVFFVNHDEHTVE

SEQ ID NO: 2947103 - protein, 19 aa, Entamoeba invadens
KGRYKEVFETQSFEEFLLK

SEQ ID NO: 2947104 - protein, 19 aa, Entamoeba invadens
KGSEPVRVADWSFPVVCSS

SEQ ID NO: 2947105 - protein, 20 aa, Entamoeba invadens
KGSGCQGSIEDMEKLDVVNP

SEQ ID NO: 2947106 - protein, 20 aa, Entamoeba invadens
KGSGENGVKVVMDSQNGKEE

SEQ ID NO: 2947107 - protein, 25 aa, Entamoeba invadens
KGSGIKIASVFGGAPSRMQMGKPEK

SEQ ID NO: 2947108 - protein, 29 aa, Entamoeba invadens
KGSPFYKVCVCCKSAVQAFLPRFPPEKLF

SEQ ID NO: 2947109 - protein, 26 aa, Entamoeba invadens
KGSQEAKLRFAFQVYDVDSDGFISNG

SEQ ID NO: 2947110 - protein, 20 aa, Entamoeba invadens
KGSQEPLLFDIPTQSGKVRL

SEQ ID NO: 2947111 - protein, 20 aa, Entamoeba invadens
KGSRLSEGKCVVCQAGTFQS

SEQ ID NO: 2947112 - protein, 24 aa, Entamoeba invadens
KGSTPVKFCKRGVGPAFRTSDEDN

SEQ ID NO: 2947113 - protein, 20 aa, Entamoeba invadens
KGTDAMDVLYGRVYPLKLGY

SEQ ID NO: 2947114 - protein, 24 aa, Entamoeba invadens
KGTDPSDGFALFSATVKYLQKLRT

SEQ ID NO: 2947115 - protein, 21 aa, Entamoeba invadens
KGTEMALPFNEVMHMEKVNSA

SEQ ID NO: 2947116 - protein, 21 aa, Entamoeba invadens
KGTESLLRNSIHGVSSTAAAL

SEQ ID NO: 2947117 - protein, 24 aa, Entamoeba invadens
KGTGCTVCGVCSKEPLAANTMDAM

SEQ ID NO: 2947118 - protein, 18 aa, Entamoeba invadens
KGTIKLKFFDVAAENIED

SEQ ID NO: 2947119 - protein, 27 aa, Entamoeba invadens
KGTKIPFSNTFPVFPIRNDVIVELYEN

SEQ ID NO: 2947120 - protein, 17 aa, Entamoeba invadens
KGTKKLFTRGIPQNLKK

SEQ ID NO: 2947121 - protein, 20 aa, Entamoeba invadens
KGTLFEEFEKLITKFNNNNR

SEQ ID NO: 2947122 - protein, 17 aa, Entamoeba invadens
KGTNTCTNCFFYYDEES

SEQ ID NO: 2947123 - protein, 26 aa, Entamoeba invadens
KGTQLGWKVFKFLNKQEIAVSDMAYG

SEQ ID NO: 2947124 - protein, 23 aa, Entamoeba invadens
KGTYKLELCKDANTIIRTTEFII

SEQ ID NO: 2947125 - protein, 18 aa, Entamoeba invadens
KGVCKLFSYYNEKKKLLL

SEQ ID NO: 2947126 - protein, 26 aa, Entamoeba invadens
KGVDLWKIIFFIAVKYIEINGKPKDF

SEQ ID NO: 2947127 - protein, 17 aa, Entamoeba invadens
KGVEFENSLYLSLLSSG

SEQ ID NO: 2947128 - protein, 24 aa, Entamoeba invadens
KGVERGFWRLCKKDTVVMKRRYLL

SEQ ID NO: 2947129 - protein, 17 aa, Entamoeba invadens
KGVFLLLDAIWTIVKET

SEQ ID NO: 2947130 - protein, 17 aa, Entamoeba invadens
KGVIDQTLFKQHKKSKL

SEQ ID NO: 2947131 - protein, 23 aa, Entamoeba invadens
KGVKHIVERSIKHYKECHEGVVV

SEQ ID NO: 2947132 - protein, 24 aa, Entamoeba invadens
KGVKIGWLYCLRGYDCGYVPQNFT

SEQ ID NO: 2947133 - protein, 17 aa, Entamoeba invadens
KGVKSLVVKSCDDLEKI

SEQ ID NO: 2947134 - protein, 17 aa, Entamoeba invadens
KGVLKCGVQIIKAENIT

SEQ ID NO: 2947135 - protein, 28 aa, Entamoeba invadens
KGVLKKEFFRIIVWFDVDFETVDRNKSR

SEQ ID NO: 2947136 - protein, 29 aa, Entamoeba invadens
KGVLKKEFYRIIVWFNVDFETVENNKSQN

SEQ ID NO: 2947137 - protein, 28 aa, Entamoeba invadens
KGVLKRELYRIIVWFDVDFETVDKNNSR

SEQ ID NO: 2947138 - protein, 21 aa, Entamoeba invadens
KGVQALNSFGLVHGNLNPQTI

SEQ ID NO: 2947139 - protein, 17 aa, Entamoeba invadens
KGVVLDFTETCTNKAGD

SEQ ID NO: 2947140 - protein, 22 aa, Entamoeba invadens
KGVWKNVCGVIKESSSDERKEY

SEQ ID NO: 2947141 - protein, 25 aa, Entamoeba invadens
KGVYKTRGFYKLKPEERMFGFEEFS

SEQ ID NO: 2947142 - protein, 17 aa, Entamoeba invadens
KGVYRYHTTPGMFYNLL

SEQ ID NO: 2947143 - protein, 26 aa, Entamoeba invadens
KGVYWKTVSCGFIFVTYYDIRASRSA

SEQ ID NO: 2947144 - protein, 17 aa, Entamoeba invadens
KGWGNRSVTSSQSDVVT

SEQ ID NO: 2947145 - protein, 19 aa, Entamoeba invadens
KGWWCSTHRFHLVGESCDT

SEQ ID NO: 2947146 - protein, 22 aa, Entamoeba invadens
KGYAKRVVIEIVTRIVKTKRTE

SEQ ID NO: 2947147 - protein, 36 aa, Entamoeba invadens
KGYDFQNPRPWWMRRMRGHMFEPFPGHPPVFSPYGP

SEQ ID NO: 2947148 - protein, 18 aa, Entamoeba invadens
KGYFKHMIEHLTATNPER

SEQ ID NO: 2947149 - protein, 18 aa, Entamoeba invadens
KGYFLDEFIKVITANEEK

SEQ ID NO: 2947150 - protein, 24 aa, Entamoeba invadens
KGYGEHQCKFIFALKKLSLTDLAH

SEQ ID NO: 2947151 - protein, 20 aa, Entamoeba invadens
KGYGLYRLDVLSGKSTVVFG

SEQ ID NO: 2947152 - protein, 17 aa, Entamoeba invadens
KGYKGFDLYIPTGSVSK

SEQ ID NO: 2947153 - protein, 28 aa, Entamoeba invadens
KGYLYICLKCTKGGVPFKRPITSADECV

SEQ ID NO: 2947154 - protein, 20 aa, Entamoeba invadens
KGYNFFGFHVRFRDLARGGL

SEQ ID NO: 2947155 - protein, 25 aa, Entamoeba invadens
KGYNVKSVEVFLHKKDVVLNTGIVK

SEQ ID NO: 2947156 - protein, 20 aa, Entamoeba invadens
KGYTTEGIFRLAPSDRDIDE

SEQ ID NO: 2947157 - protein, 20 aa, Entamoeba invadens
KGYVERLKKELQLLAPEGTN

SEQ ID NO: 2947158 - protein, 18 aa, Entamoeba invadens
KGYYRLIRLNIFLENFHQ

SEQ ID NO: 2947159 - protein, 20 aa, Entamoeba invadens
KHAALLCYIASGNVPKIMDM

SEQ ID NO: 2947160 - protein, 20 aa, Entamoeba invadens
KHAFYIGAINSMAFFNVGKG

SEQ ID NO: 2947161 - protein, 23 aa, Entamoeba invadens
KHARIIWLRNFFIGTLINSIINY

SEQ ID NO: 2947162 - protein, 26 aa, Entamoeba invadens
KHAYSPVKPFMCFDKTPFAINPLITS

SEQ ID NO: 2947163 - protein, 19 aa, Entamoeba invadens
KHCFGNCLQLSKVELNNNI

SEQ ID NO: 2947164 - protein, 21 aa, Entamoeba invadens
KHCKITIGRPHRLSRMTKQFI

SEQ ID NO: 2947165 - protein, 24 aa, Entamoeba invadens
KHDFKKVSWSRCARTDKGVSAANN

SEQ ID NO: 2947166 - protein, 26 aa, Entamoeba invadens
KHDKFPCGRCGETLTKNDFVPYKRDD

SEQ ID NO: 2947167 - protein, 25 aa, Entamoeba invadens
KHDLHLVEIVKFLKNVFGDVGNKFL

SEQ ID NO: 2947168 - protein, 32 aa, Entamoeba invadens
KHDNFRRAFVCSKRGFLRCFIPNEVTKIKDYS

SEQ ID NO: 2947169 - protein, 25 aa, Entamoeba invadens
KHDYLMKMAEDFLEMVKFAKENKFW

SEQ ID NO: 2947170 - protein, 18 aa, Entamoeba invadens
KHDYMPLALHVLLLMGKY

SEQ ID NO: 2947171 - protein, 23 aa, Entamoeba invadens
KHECLECGKKFRTASEVRRHQST

SEQ ID NO: 2947172 - protein, 26 aa, Entamoeba invadens
KHELEFGFKCIFILVKGSVEKSNKTT

SEQ ID NO: 2947173 - protein, 26 aa, Entamoeba invadens
KHENCWRELRGLLNVMQPQDCARLCE

SEQ ID NO: 2947174 - protein, 19 aa, Entamoeba invadens
KHENFEVVSFVLTNSKGNY

SEQ ID NO: 2947175 - protein, 18 aa, Entamoeba invadens
KHFEGCITFIEQNPKPVL

SEQ ID NO: 2947176 - protein, 17 aa, Entamoeba invadens
KHFHNFCTILNERKKMK

SEQ ID NO: 2947177 - protein, 17 aa, Entamoeba invadens
KHFLVTELIPFFDKPFV

SEQ ID NO: 2947178 - protein, 17 aa, Entamoeba invadens
KHFNICHFVKYSKTDRE

SEQ ID NO: 2947179 - protein, 19 aa, Entamoeba invadens
KHFTLEPCDIIGYDKSFSI

SEQ ID NO: 2947180 - protein, 17 aa, Entamoeba invadens
KHGFLISHNLKRERGAK

SEQ ID NO: 2947181 - protein, 26 aa, Entamoeba invadens
KHGHEIWQTAFKCFNKIPSQRPRFKD

SEQ ID NO: 2947182 - protein, 21 aa, Entamoeba invadens
KHGKTFWARRSLNIYNGAIVL

SEQ ID NO: 2947183 - protein, 18 aa, Entamoeba invadens
KHGLYCQDCISNLDEIVR

SEQ ID NO: 2947184 - protein, 32 aa, Entamoeba invadens
KHGRGGQSSVRFARLRLEKRHNYVRRVGELAV

SEQ ID NO: 2947185 - protein, 18 aa, Entamoeba invadens
KHHCPDAPYILAATKVDL

SEQ ID NO: 2947186 - protein, 24 aa, Entamoeba invadens
KHHLQICVALKTLLTTRIQVETNL

SEQ ID NO: 2947187 - protein, 18 aa, Entamoeba invadens
KHIGRIGFVIMRLLLSMQ

SEQ ID NO: 2947188 - protein, 30 aa, Entamoeba invadens
KHILLIQKRIRGFCVRKLPEVCGLKERKNL

SEQ ID NO: 2947189 - protein, 18 aa, Entamoeba invadens
KHILRIAACMELVHDATL

SEQ ID NO: 2947190 - protein, 17 aa, Entamoeba invadens
KHINHFNDFCVSNDVGA

SEQ ID NO: 2947191 - protein, 23 aa, Entamoeba invadens
KHISEFVVWMYNHLLVGYSNEFP

SEQ ID NO: 2947192 - protein, 17 aa, Entamoeba invadens
KHIWFDNECSFQNLELM

SEQ ID NO: 2947193 - protein, 24 aa, Entamoeba invadens
KHKIKLRVSCVFYMGTDILFGKEY

SEQ ID NO: 2947194 - protein, 24 aa, Entamoeba invadens
KHKKVKTRREILCKDKNTRKFKYL

SEQ ID NO: 2947195 - protein, 17 aa, Entamoeba invadens
KHKLQYFITAIIIEEQR

SEQ ID NO: 2947196 - protein, 21 aa, Entamoeba invadens
KHKLRGMSARSLEKIGITSAE

SEQ ID NO: 2947197 - protein, 26 aa, Entamoeba invadens
KHKNVYCFAETLILDKIGVFSPLRCD

SEQ ID NO: 2947198 - protein, 19 aa, Entamoeba invadens
KHKSELVEAYRMVSDGVRI

SEQ ID NO: 2947199 - protein, 26 aa, Entamoeba invadens
KHKVNGVLCDFAFVVNDVLVGMSVDS

SEQ ID NO: 2947200 - protein, 25 aa, Entamoeba invadens
KHLCSFKGKMWAKVFIKSKPGRYGI

SEQ ID NO: 2947201 - protein, 25 aa, Entamoeba invadens
KHLDFFKITFKNGFDEVFLEEVGLY

SEQ ID NO: 2947202 - protein, 19 aa, Entamoeba invadens
KHLELMNSLIETFKDYFEV

SEQ ID NO: 2947203 - protein, 25 aa, Entamoeba invadens
KHLHRWMKETYGINVADQYKNNSSL

SEQ ID NO: 2947204 - protein, 23 aa, Entamoeba invadens
KHLKIISSKAINFKGNFNSLEEV

SEQ ID NO: 2947205 - protein, 17 aa, Entamoeba invadens
KHLKLCYEKIREIGKEV

SEQ ID NO: 2947206 - protein, 18 aa, Entamoeba invadens
KHLKMCVDNYRILGDDKS

SEQ ID NO: 2947207 - protein, 19 aa, Entamoeba invadens
KHLKSCKYFCSQNGLEAVA

SEQ ID NO: 2947208 - protein, 17 aa, Entamoeba invadens
KHLLFLKTMIGHPMGAS

SEQ ID NO: 2947209 - protein, 21 aa, Entamoeba invadens
KHLLSEKIVHSFSVCDPKFFT

SEQ ID NO: 2947210 - protein, 19 aa, Entamoeba invadens
KHLNECATLKGTIETLGND

SEQ ID NO: 2947211 - protein, 17 aa, Entamoeba invadens
KHLPSIETLNLWNEKDE

SEQ ID NO: 2947212 - protein, 22 aa, Entamoeba invadens
KHLQCKQCPTIIPQQKVTEQHL

SEQ ID NO: 2947213 - protein, 19 aa, Entamoeba invadens
KHMIVMEFIIYRSLDQIIK

SEQ ID NO: 2947214 - protein, 18 aa, Entamoeba invadens
KHMTVLRTLYDVVDMDVD

SEQ ID NO: 2947215 - protein, 17 aa, Entamoeba invadens
KHNCVDLTYGSRLKSKI

SEQ ID NO: 2947216 - protein, 22 aa, Entamoeba invadens
KHNERQGKCEIFQVQQGKEDEA

SEQ ID NO: 2947217 - protein, 20 aa, Entamoeba invadens
KHNIIEVVKECIMKYIDNEN

SEQ ID NO: 2947218 - protein, 22 aa, Entamoeba invadens
KHNLVCAKIIDLGRTQIKPNTV

SEQ ID NO: 2947219 - protein, 21 aa, Entamoeba invadens
KHNRGSAMFMQVNPIEEVDES

SEQ ID NO: 2947220 - protein, 19 aa, Entamoeba invadens
KHNTNFWIYHGFHGSEVEA

SEQ ID NO: 2947221 - protein, 25 aa, Entamoeba invadens
KHPDLAIPLWYSFGTVVILLEEVVS

SEQ ID NO: 2947222 - protein, 22 aa, Entamoeba invadens
KHPDPFACKVLYQSKTITSKPP

SEQ ID NO: 2947223 - protein, 25 aa, Entamoeba invadens
KHPEGPKLLRFVIMNCSSKYRKTLV

SEQ ID NO: 2947224 - protein, 21 aa, Entamoeba invadens
KHPFNKYFMRGMLVTLATDSP

SEQ ID NO: 2947225 - protein, 18 aa, Entamoeba invadens
KHPLFNIRNIFQKIRKLR

SEQ ID NO: 2947226 - protein, 20 aa, Entamoeba invadens
KHPVDGFSVGLVNDSDIYVW

SEQ ID NO: 2947227 - protein, 18 aa, Entamoeba invadens
KHQLKMAERFEITQIFDT

SEQ ID NO: 2947228 - protein, 19 aa, Entamoeba invadens
KHRFCPRCVNGEALKIMEK

SEQ ID NO: 2947229 - protein, 25 aa, Entamoeba invadens
KHRNFYCAAGANFPSIVGKENLMED

SEQ ID NO: 2947230 - protein, 24 aa, Entamoeba invadens
KHRSKGRFPALTWFNKTNGSALVR

SEQ ID NO: 2947231 - protein, 19 aa, Entamoeba invadens
KHRSYKLSDTRKWSSTNAL

SEQ ID NO: 2947232 - protein, 17 aa, Entamoeba invadens
KHSEHPTEFLVEMNHGV

SEQ ID NO: 2947233 - protein, 26 aa, Entamoeba invadens
KHSFITLRELFKWADRHASSYEELAR

SEQ ID NO: 2947234 - protein, 19 aa, Entamoeba invadens
KHSGEFSWMKSYVYNTKIK

SEQ ID NO: 2947235 - protein, 22 aa, Entamoeba invadens
KHSICKLSDGNTCIVCNDGYII

SEQ ID NO: 2947236 - protein, 19 aa, Entamoeba invadens
KHSIWYGFDNTFIVPSTVV

SEQ ID NO: 2947237 - protein, 21 aa, Entamoeba invadens
KHSLKGFKLLQAAVVNGFVGL

SEQ ID NO: 2947238 - protein, 20 aa, Entamoeba invadens
KHSSIPLLVMEASGIHDTTH

SEQ ID NO: 2947239 - protein, 18 aa, Entamoeba invadens
KHTEFISDFCFSPTNDIV

SEQ ID NO: 2947240 - protein, 22 aa, Entamoeba invadens
KHTKARVIALHDFVTIHLADLI

SEQ ID NO: 2947241 - protein, 24 aa, Entamoeba invadens
KHVANNCFERCLSLTALTFGEELL

SEQ ID NO: 2947242 - protein, 20 aa, Entamoeba invadens
KHVCQFKAKGVKYYYHNIHI

SEQ ID NO: 2947243 - protein, 24 aa, Entamoeba invadens
KHVIWYEVFYHNTFPQKEHGNVCK

SEQ ID NO: 2947244 - protein, 19 aa, Entamoeba invadens
KHVKRTFDCVLPFCKLLNI

SEQ ID NO: 2947245 - protein, 21 aa, Entamoeba invadens
KHVLDIVILTDKWCVRIAINY

SEQ ID NO: 2947246 - protein, 24 aa, Entamoeba invadens
KHVQARPLPPVPAPTPFPSTSGEV

SEQ ID NO: 2947247 - protein, 19 aa, Entamoeba invadens
KHWIDKIAFIRNIQSYVVY

SEQ ID NO: 2947248 - protein, 24 aa, Entamoeba invadens
KHWMGKGTPILALADLNKEMQENV

SEQ ID NO: 2947249 - protein, 19 aa, Entamoeba invadens
KHYKECHEGVVVQRIQSYL

SEQ ID NO: 2947250 - protein, 19 aa, Entamoeba invadens
KHYSSNVPFILVGTKSDMR

SEQ ID NO: 2947251 - protein, 19 aa, Entamoeba invadens
KIADFYYDYLNDVIYIEEA

SEQ ID NO: 2947252 - protein, 26 aa, Entamoeba invadens
KIADLQFFKCFSLSTIEVPTSVTRIG

SEQ ID NO: 2947253 - protein, 17 aa, Entamoeba invadens
KIADYGFSRIFGTESEF

SEQ ID NO: 2947254 - protein, 18 aa, Entamoeba invadens
KIAEEWKVSFFETSAKSR

SEQ ID NO: 2947255 - protein, 21 aa, Entamoeba invadens
KIAEVVKMRVYHCQTKEDKFD

SEQ ID NO: 2947256 - protein, 34 aa, Entamoeba invadens
KIAFDRNCFLLLRVMWMFVKFSFTKPDNVDDFFD

SEQ ID NO: 2947257 - protein, 18 aa, Entamoeba invadens
KIAILMIRTNPNYRPQLH

SEQ ID NO: 2947258 - protein, 30 aa, Entamoeba invadens
KIAKLQGFWYTVLFHSRFFDFYATSPKDVK

SEQ ID NO: 2947259 - protein, 18 aa, Entamoeba invadens
KIALFVEKCLLREVMREE

SEQ ID NO: 2947260 - protein, 19 aa, Entamoeba invadens
KIALIKSFGKTLVDSLLPL

SEQ ID NO: 2947261 - protein, 19 aa, Entamoeba invadens
KIAQRSSASLGNFSKNLKG

SEQ ID NO: 2947262 - protein, 23 aa, Entamoeba invadens
KIARRRVVGQLNKCIKIFEQKRK

SEQ ID NO: 2947263 - protein, 26 aa, Entamoeba invadens
KIASISKRIGLPWYATVAAMEKYQKL

SEQ ID NO: 2947264 - protein, 18 aa, Entamoeba invadens
KIAVPTKRNVSCQKKEIK

SEQ ID NO: 2947265 - protein, 19 aa, Entamoeba invadens
KICAMKHSVTIDIISNCDV

SEQ ID NO: 2947266 - protein, 18 aa, Entamoeba invadens
KICDCCFEECTSLVDIKM

SEQ ID NO: 2947267 - protein, 33 aa, Entamoeba invadens
KICEKCNKKVCGVCAMTKIALVAGGSLRTVCDA

SEQ ID NO: 2947268 - protein, 24 aa, Entamoeba invadens
KICEMKTSGGFYIVMEEGFASIRF

SEQ ID NO: 2947269 - protein, 20 aa, Entamoeba invadens
KICGAKYVMPNCTSFMQKLF

SEQ ID NO: 2947270 - protein, 21 aa, Entamoeba invadens
KICNVKVGVFLSEKNNEGRGD

SEQ ID NO: 2947271 - protein, 19 aa, Entamoeba invadens
KICYKELDKSKVFDSIICL

SEQ ID NO: 2947272 - protein, 19 aa, Entamoeba invadens
KIDASGIGIKSELPIDLNQ

SEQ ID NO: 2947273 - protein, 30 aa, Entamoeba invadens
KIDASICSENSMGFLPNIMSIVSASVPLIN

SEQ ID NO: 2947274 - protein, 21 aa, Entamoeba invadens
KIDDCYCLQKYGKKCEEFDSL

SEQ ID NO: 2947275 - protein, 30 aa, Entamoeba invadens
KIDDITAFVLQWLRKNEVILDECKFTVILR

SEQ ID NO: 2947276 - protein, 23 aa, Entamoeba invadens
KIDEFKILLTMDGDVVDKNGICV

SEQ ID NO: 2947277 - protein, 20 aa, Entamoeba invadens
KIDFRFALVEYKDHNPGDEF

SEQ ID NO: 2947278 - protein, 18 aa, Entamoeba invadens
KIDFYRINVWFNVDYTFT

SEQ ID NO: 2947279 - protein, 23 aa, Entamoeba invadens
KIDFYRIVVWFSVDYTTVDVNKN

SEQ ID NO: 2947280 - protein, 17 aa, Entamoeba invadens
KIDGFYVQVCYDNEDTV

SEQ ID NO: 2947281 - protein, 19 aa, Entamoeba invadens
KIDGVRCALCHDHYTATMC

SEQ ID NO: 2947282 - protein, 19 aa, Entamoeba invadens
KIDIIKVLNYCGKPLNFDV

SEQ ID NO: 2947283 - protein, 23 aa, Entamoeba invadens
KIDKECFWLCPYIENVNLPASLT

SEQ ID NO: 2947284 - protein, 21 aa, Entamoeba invadens
KIDKGAFGKIFVARRKDDSKV

SEQ ID NO: 2947285 - protein, 24 aa, Entamoeba invadens
KIDLANSVIAVFSFLPPFLDIIGY

SEQ ID NO: 2947286 - protein, 31 aa, Entamoeba invadens
KIDLKNSLKVIGDFCFRGCEKLLSLDIPKGV

SEQ ID NO: 2947287 - protein, 20 aa, Entamoeba invadens
KIDLSCVDIVINICNDCSPN

SEQ ID NO: 2947288 - protein, 19 aa, Entamoeba invadens
KIDNFRYIKKLSLTKQKTW

SEQ ID NO: 2947289 - protein, 27 aa, Entamoeba invadens
KIDPKFLKLGIPFFMWEIGQCVLLTPK

SEQ ID NO: 2947290 - protein, 20 aa, Entamoeba invadens
KIDRKVMLEQGIQIFNKEYI

SEQ ID NO: 2947291 - protein, 26 aa, Entamoeba invadens
KIDRTDPIWREPIFSIILNSGVVAET

SEQ ID NO: 2947292 - protein, 21 aa, Entamoeba invadens
KIDSTMFVETFRVYFERMKEQ

SEQ ID NO: 2947293 - protein, 19 aa, Entamoeba invadens
KIDYEFFSMTTLEEVDFRG

SEQ ID NO: 2947294 - protein, 21 aa, Entamoeba invadens
KIDYGLCSVKQNYGIYESFAK

SEQ ID NO: 2947295 - protein, 24 aa, Entamoeba invadens
KIEAKFNYTELMYKFETEKKKEKI

SEQ ID NO: 2947296 - protein, 29 aa, Entamoeba invadens
KIEANNSLLKSARLLGVKLNLTASEFTSP

SEQ ID NO: 2947297 - protein, 24 aa, Entamoeba invadens
KIECPKSAFLRMLKAAFYEAPDNH

SEQ ID NO: 2947298 - protein, 24 aa, Entamoeba invadens
KIECPKSAFLRMLKAAFYEAPDSH

SEQ ID NO: 2947299 - protein, 21 aa, Entamoeba invadens
KIEDFLVYFAVDLNLFEKTLE

SEQ ID NO: 2947300 - protein, 24 aa, Entamoeba invadens
KIEECKAKHCPRDILKKKEKEMNE

SEQ ID NO: 2947301 - protein, 24 aa, Entamoeba invadens
KIEFFMWKEFVGRFTPNMFPGFLE

SEQ ID NO: 2947302 - protein, 18 aa, Entamoeba invadens
KIEIFDFNSSITGTEQKE

SEQ ID NO: 2947303 - protein, 24 aa, Entamoeba invadens
KIEIGRPNYWGEIESDSEELGGFG

SEQ ID NO: 2947304 - protein, 22 aa, Entamoeba invadens
KIEKCFDETFSPLISKLPKLEV

SEQ ID NO: 2947305 - protein, 17 aa, Entamoeba invadens
KIEKIGWENYKKAECAI

SEQ ID NO: 2947306 - protein, 17 aa, Entamoeba invadens
KIEKMKKDILVLEDEEK

SEQ ID NO: 2947307 - protein, 19 aa, Entamoeba invadens
KIEKVILVGGCALIPKVKQ

SEQ ID NO: 2947308 - protein, 20 aa, Entamoeba invadens
KIELEHLNFQILQYQQILQK

SEQ ID NO: 2947309 - protein, 26 aa, Entamoeba invadens
KIELKSCKHPQLLAEAALYKYLAEGN

SEQ ID NO: 2947310 - protein, 48 aa, Entamoeba invadens
KIEMTEHYAKLFLRFIRRLLCSKANYIFKENIEFGFNLLRSIISLCDN

SEQ ID NO: 2947311 - protein, 18 aa, Entamoeba invadens
KIEPKVIRKLPATIIITS

SEQ ID NO: 2947312 - protein, 17 aa, Entamoeba invadens
KIEPYAIALSHFQNVRF

SEQ ID NO: 2947313 - protein, 25 aa, Entamoeba invadens
KIEQLADGTFEFAIEPQEEVDNKEV

SEQ ID NO: 2947314 - protein, 25 aa, Entamoeba invadens
KIESQWKSGGSVILYRDRPLSQILT

SEQ ID NO: 2947315 - protein, 18 aa, Entamoeba invadens
KIESSSFVQFLEALFFYE

SEQ ID NO: 2947316 - protein, 28 aa, Entamoeba invadens
KIESTCFMNCRALSAIKLPSNLVELESF

SEQ ID NO: 2947317 - protein, 36 aa, Entamoeba invadens
KIESTCFMNCRALSTIKLPSKFVELESFVFQFCDSI

SEQ ID NO: 2947318 - protein, 20 aa, Entamoeba invadens
KIETLQCVDYMLGDANKVIN

SEQ ID NO: 2947319 - protein, 19 aa, Entamoeba invadens
KIETLQCVDYMLGDDNKVI

SEQ ID NO: 2947320 - protein, 19 aa, Entamoeba invadens
KIETLQCYDYMLDNDNKLI

SEQ ID NO: 2947321 - protein, 18 aa, Entamoeba invadens
KIETLYVYTIKDYTFGND

SEQ ID NO: 2947322 - protein, 18 aa, Entamoeba invadens
KIEVAECNNKNGENFKDK

SEQ ID NO: 2947323 - protein, 19 aa, Entamoeba invadens
KIEYSRPVYTPIFKNKGGA

SEQ ID NO: 2947324 - protein, 23 aa, Entamoeba invadens
KIFECGFSLVFFVSDEEAKNLGN

SEQ ID NO: 2947325 - protein, 17 aa, Entamoeba invadens
KIFESELIEARFVVEPI

SEQ ID NO: 2947326 - protein, 19 aa, Entamoeba invadens
KIFFPDFFLPHKNISQSHI

SEQ ID NO: 2947327 - protein, 19 aa, Entamoeba invadens
KIFHFNTGFIFFSKDEHNM

SEQ ID NO: 2947328 - protein, 18 aa, Entamoeba invadens
KIFIDGRGPFVFITVGPK

SEQ ID NO: 2947329 - protein, 18 aa, Entamoeba invadens
KIFKSGAFEKDVYNPLTK

SEQ ID NO: 2947330 - protein, 22 aa, Entamoeba invadens
KIFKTGKWRKSMLDALNHSSHV

SEQ ID NO: 2947331 - protein, 24 aa, Entamoeba invadens
KIFLKRFKMKTSFYDRYGETHRLD

SEQ ID NO: 2947332 - protein, 18 aa, Entamoeba invadens
KIFSRLSVINLFTPEEFS

SEQ ID NO: 2947333 - protein, 23 aa, Entamoeba invadens
KIFTFCRRIFVNLGQKTDQYCRC

SEQ ID NO: 2947334 - protein, 17 aa, Entamoeba invadens
KIGAIGFCECSALTQDG

SEQ ID NO: 2947335 - protein, 21 aa, Entamoeba invadens
KIGDCRYAAYLVEQGKPNKLL

SEQ ID NO: 2947336 - protein, 19 aa, Entamoeba invadens
KIGDFCFACATQLENVILP

SEQ ID NO: 2947337 - protein, 19 aa, Entamoeba invadens
KIGDFVLGRRVGFGSTAVV

SEQ ID NO: 2947338 - protein, 18 aa, Entamoeba invadens
KIGDLILVQLMEIKFLEI

SEQ ID NO: 2947339 - protein, 21 aa, Entamoeba invadens
KIGDVYFDLPATFLCQVVSFC

SEQ ID NO: 2947340 - protein, 25 aa, Entamoeba invadens
KIGEKPATIFFFFFEKLMNEKKVQS

SEQ ID NO: 2947341 - protein, 24 aa, Entamoeba invadens
KIGENCFECCYSLSSIKLPKALLC

SEQ ID NO: 2947342 - protein, 17 aa, Entamoeba invadens
KIGFDLKTTDKVAGDSI

SEQ ID NO: 2947343 - protein, 18 aa, Entamoeba invadens
KIGGEVVQFGSKVKEKAK

SEQ ID NO: 2947344 - protein, 18 aa, Entamoeba invadens
KIGGGGMVQWATQLVDLF

SEQ ID NO: 2947345 - protein, 21 aa, Entamoeba invadens
KIGGIDLQFHPILPWIYSVGA

SEQ ID NO: 2947346 - protein, 19 aa, Entamoeba invadens
KIGHVPVIKVCDTVDEALS

SEQ ID NO: 2947347 - protein, 24 aa, Entamoeba invadens
KIGKEAGGFICRAFAQENSSGGFI

SEQ ID NO: 2947348 - protein, 20 aa, Entamoeba invadens
KIGKELGWSVYKFKTRQERS

SEQ ID NO: 2947349 - protein, 18 aa, Entamoeba invadens
KIGKILITKNEIEELKMN

SEQ ID NO: 2947350 - protein, 20 aa, Entamoeba invadens
KIGLLGDMGVGKTCIVQRFC

SEQ ID NO: 2947351 - protein, 24 aa, Entamoeba invadens
KIGNFKIGLIHGHQIIPWGDKEAL

SEQ ID NO: 2947352 - protein, 23 aa, Entamoeba invadens
KIGQEVKLGRRINMIMQTVFFKL

SEQ ID NO: 2947353 - protein, 21 aa, Entamoeba invadens
KIGSLSFDMLFTIKSTGEFYV

SEQ ID NO: 2947354 - protein, 24 aa, Entamoeba invadens
KIGTKRWSQFFVENRTKNFCEGFH

SEQ ID NO: 2947355 - protein, 17 aa, Entamoeba invadens
KIHAANVEGIFRICGNQ

SEQ ID NO: 2947356 - protein, 18 aa, Entamoeba invadens
KIHTRDSASLCTFFNEVE

SEQ ID NO: 2947357 - protein, 19 aa, Entamoeba invadens
KIICLNIELELKKEKDNAE

SEQ ID NO: 2947358 - protein, 23 aa, Entamoeba invadens
KIIDCSLAYVKLVTKDGIVRYHK

SEQ ID NO: 2947359 - protein, 28 aa, Entamoeba invadens
KIIELRREISFFILMKLFAILFEEKIEF

SEQ ID NO: 2947360 - protein, 20 aa, Entamoeba invadens
KIIETPGLWFSQKFLSANLT

SEQ ID NO: 2947361 - protein, 20 aa, Entamoeba invadens
KIIFDRVAYNITFQISFEPF

SEQ ID NO: 2947362 - protein, 19 aa, Entamoeba invadens
KIIIAHIIDLCSLTNFLGV

SEQ ID NO: 2947363 - protein, 18 aa, Entamoeba invadens
KIIKCKRKKLLNEGEITL

SEQ ID NO: 2947364 - protein, 23 aa, Entamoeba invadens
KIIKDEVFYNFVYDSQCFMNCSK

SEQ ID NO: 2947365 - protein, 18 aa, Entamoeba invadens
KIIKNCHQIVRMKISDSI

SEQ ID NO: 2947366 - protein, 22 aa, Entamoeba invadens
KIIKRGPLPVGEGEVVVTTVPV

SEQ ID NO: 2947367 - protein, 25 aa, Entamoeba invadens
KIIKSEEVINVFIDFGGRTEEVRLK

SEQ ID NO: 2947368 - protein, 18 aa, Entamoeba invadens
KIIKYEIWDAAGQERYRS

SEQ ID NO: 2947369 - protein, 20 aa, Entamoeba invadens
KIILGLKKLVKNVCMYSLND

SEQ ID NO: 2947370 - protein, 27 aa, Entamoeba invadens
KIINEKEDELIIAMKRIEESEKEKKEK

SEQ ID NO: 2947371 - protein, 18 aa, Entamoeba invadens
KIIPWFEANLEEFLTEMR

SEQ ID NO: 2947372 - protein, 19 aa, Entamoeba invadens
KIIQLINLRLDTVKANLKA

SEQ ID NO: 2947373 - protein, 20 aa, Entamoeba invadens
KIISEFLVVRYWRTEENEST

SEQ ID NO: 2947374 - protein, 19 aa, Entamoeba invadens
KIISELWKADFEMKNTKLL

SEQ ID NO: 2947375 - protein, 19 aa, Entamoeba invadens
KIISIDFSKLAMPKVIERV

SEQ ID NO: 2947376 - protein, 23 aa, Entamoeba invadens
KIITRGCGYLQNISDFEEGRDGI

SEQ ID NO: 2947377 - protein, 24 aa, Entamoeba invadens
KIIWLCLKNGIAARDKWVSEDPRR

SEQ ID NO: 2947378 - protein, 18 aa, Entamoeba invadens
KIIYIYTIFFNVLNFLKI

SEQ ID NO: 2947379 - protein, 20 aa, Entamoeba invadens
KIKAENFDWAFSVGVKCSTK

SEQ ID NO: 2947380 - protein, 26 aa, Entamoeba invadens
KIKAENFDWAFSVGVKCSTKFFDVGC

SEQ ID NO: 2947381 - protein, 20 aa, Entamoeba invadens
KIKALKFHLVLCNKLTEMNV

SEQ ID NO: 2947382 - protein, 23 aa, Entamoeba invadens
KIKEFCFEGCLALKEISLPTSLK

SEQ ID NO: 2947383 - protein, 21 aa, Entamoeba invadens
KIKELLMPAFTPLLNESLFKP

SEQ ID NO: 2947384 - protein, 21 aa, Entamoeba invadens
KIKESVFAWRNDIEQMKKKIE

SEQ ID NO: 2947385 - protein, 26 aa, Entamoeba invadens
KIKEVSVTDGHCNYFLLKKKKKDAKN

SEQ ID NO: 2947386 - protein, 22 aa, Entamoeba invadens
KIKIECGWVLTNVLYKLTDLSK

SEQ ID NO: 2947387 - protein, 18 aa, Entamoeba invadens
KIKKAAVRECKRQEEEAQ

SEQ ID NO: 2947388 - protein, 24 aa, Entamoeba invadens
KIKLKGAECTLQFANERTLHAVTL

SEQ ID NO: 2947389 - protein, 24 aa, Entamoeba invadens
KIKMFREMIHRLKVAHPDIEELKL

SEQ ID NO: 2947390 - protein, 18 aa, Entamoeba invadens
KIKNGSVFEQCLVLSNIA

SEQ ID NO: 2947391 - protein, 18 aa, Entamoeba invadens
KIKNIFGDFTTLFSVNEN

SEQ ID NO: 2947392 - protein, 24 aa, Entamoeba invadens
KIKNPKSGISIAIKSLRSENRLIL

SEQ ID NO: 2947393 - protein, 24 aa, Entamoeba invadens
KIKNRFRQSFDFKTDDLTLLDTDD

SEQ ID NO: 2947394 - protein, 18 aa, Entamoeba invadens
KIKSVFIDPFNFFRLRVD

SEQ ID NO: 2947395 - protein, 22 aa, Entamoeba invadens
KIKVVGEVRLSVTLSKILSLFS

SEQ ID NO: 2947396 - protein, 19 aa, Entamoeba invadens
KILALKINQWYANQTKIQS

SEQ ID NO: 2947397 - protein, 22 aa, Entamoeba invadens
KILAQLYMPFFSRKIEVPEELK

SEQ ID NO: 2947398 - protein, 20 aa, Entamoeba invadens
KILCQQGIGWVIGNVSSIMS

SEQ ID NO: 2947399 - protein, 18 aa, Entamoeba invadens
KILCSKIVDAARAREAAR

SEQ ID NO: 2947400 - protein, 27 aa, Entamoeba invadens
KILDAPEAFGYELYTKCPNAKEKLQAI

SEQ ID NO: 2947401 - protein, 25 aa, Entamoeba invadens
KILEEVKAAEALRQQCTVQGLQDTT

SEQ ID NO: 2947402 - protein, 17 aa, Entamoeba invadens
KILEKVIEFMTYHHNHS

SEQ ID NO: 2947403 - protein, 17 aa, Entamoeba invadens
KILFFEANTSAVFLYQI

SEQ ID NO: 2947404 - protein, 19 aa, Entamoeba invadens
KILGMLASVEIRLAKILVE

SEQ ID NO: 2947405 - protein, 17 aa, Entamoeba invadens
KILHKQNLLFLVEDDNR

SEQ ID NO: 2947406 - protein, 20 aa, Entamoeba invadens
KILICTDTHLGALEKSESRR

SEQ ID NO: 2947407 - protein, 22 aa, Entamoeba invadens
KILKKHIIPPFSIVPTKYRGFI

SEQ ID NO: 2947408 - protein, 20 aa, Entamoeba invadens
KILKRREYRLRKLVEKAKIA

SEQ ID NO: 2947409 - protein, 19 aa, Entamoeba invadens
KILMGCFQGATAYVNESFV

SEQ ID NO: 2947410 - protein, 20 aa, Entamoeba invadens
KILMYSLYFTMDMKFGNRIG

SEQ ID NO: 2947411 - protein, 17 aa, Entamoeba invadens
KILNPISNTKCFDVFSL

SEQ ID NO: 2947412 - protein, 31 aa, Entamoeba invadens
KILNSFNVFMSFEMADYLLSFLEHLNKNEWI

SEQ ID NO: 2947413 - protein, 22 aa, Entamoeba invadens
KILNTMPQWIIDALMKQNADLS

SEQ ID NO: 2947414 - protein, 19 aa, Entamoeba invadens
KILPEAQFDIAIVDTNPDV

SEQ ID NO: 2947415 - protein, 24 aa, Entamoeba invadens
KILPKQISTRWGVLLNKKVSEYKR

SEQ ID NO: 2947416 - protein, 20 aa, Entamoeba invadens
KILSCDILQILDFANLSKLV

SEQ ID NO: 2947417 - protein, 20 aa, Entamoeba invadens
KILSEKTVSISPPLSKRLQT

SEQ ID NO: 2947418 - protein, 17 aa, Entamoeba invadens
KILSWKEDENFMLKMQL

SEQ ID NO: 2947419 - protein, 18 aa, Entamoeba invadens
KILTDFYVVTSYKLNGMK

SEQ ID NO: 2947420 - protein, 25 aa, Entamoeba invadens
KILTRLSGDLNRAHLVGANYHQPTT

SEQ ID NO: 2947421 - protein, 28 aa, Entamoeba invadens
KILVVYCYSCTVFLPPHIEMLVLNSAMI

SEQ ID NO: 2947422 - protein, 23 aa, Entamoeba invadens
KILYDEFLKLYVILYKSTIDVDG

SEQ ID NO: 2947423 - protein, 17 aa, Entamoeba invadens
KILYYAVQDGLSVPKGL

SEQ ID NO: 2947424 - protein, 19 aa, Entamoeba invadens
KIMCLSIALLFAGSCDKEI

SEQ ID NO: 2947425 - protein, 27 aa, Entamoeba invadens
KIMDFLGGLFTGIAVGKRLPLQCAGAI

SEQ ID NO: 2947426 - protein, 19 aa, Entamoeba invadens
KIMGLRYGKKYTDLNELRY

SEQ ID NO: 2947427 - protein, 20 aa, Entamoeba invadens
KIMKAEFHILCSYSKETQIK

SEQ ID NO: 2947428 - protein, 23 aa, Entamoeba invadens
KIMKAEFHILCSYSKETQIKLEI

SEQ ID NO: 2947429 - protein, 17 aa, Entamoeba invadens
KIMKKILTVQEVEEEHN

SEQ ID NO: 2947430 - protein, 20 aa, Entamoeba invadens
KIMMSGVVLSIEMSALKRKM

SEQ ID NO: 2947431 - protein, 19 aa, Entamoeba invadens
KIMMWLRKLLYPRSYLSGL

SEQ ID NO: 2947432 - protein, 18 aa, Entamoeba invadens
KIMVMKRIRERSRQKRIN

SEQ ID NO: 2947433 - protein, 24 aa, Entamoeba invadens
KINALCFSEKCGVLLTGGEDSVIR

SEQ ID NO: 2947434 - protein, 17 aa, Entamoeba invadens
KINEHFQTLLPPSKGKR

SEQ ID NO: 2947435 - protein, 20 aa, Entamoeba invadens
KINELILPLHYYFKNLFDKM

SEQ ID NO: 2947436 - protein, 20 aa, Entamoeba invadens
KINFNIEVIGCFARVTATHF

SEQ ID NO: 2947437 - protein, 17 aa, Entamoeba invadens
KINGRYGNDLSMKTIAQ

SEQ ID NO: 2947438 - protein, 18 aa, Entamoeba invadens
KINILFNIFYLRLIIVKC

SEQ ID NO: 2947439 - protein, 25 aa, Entamoeba invadens
KINKLEFVRLAVLLKEYTLALKQRS

SEQ ID NO: 2947440 - protein, 25 aa, Entamoeba invadens
KINKSCAKLACSMHINPVLISSVDI

SEQ ID NO: 2947441 - protein, 20 aa, Entamoeba invadens
KINLFFMDTFMVPFYLHDSL

SEQ ID NO: 2947442 - protein, 24 aa, Entamoeba invadens
KINNCDIQNAFLCEQESSGTLFRF

SEQ ID NO: 2947443 - protein, 18 aa, Entamoeba invadens
KINNCTKAIEVMHKEGVN

SEQ ID NO: 2947444 - protein, 25 aa, Entamoeba invadens
KINPMFQKAMRTFICSDYFGQARSL

SEQ ID NO: 2947445 - protein, 20 aa, Entamoeba invadens
KINPNMFDFFNPVFQTPKVH

SEQ ID NO: 2947446 - protein, 20 aa, Entamoeba invadens
KINPPHSATEPKRTSSTKPR

SEQ ID NO: 2947447 - protein, 25 aa, Entamoeba invadens
KINQFKRVVEFLVVKGFATKEENNI

SEQ ID NO: 2947448 - protein, 25 aa, Entamoeba invadens
KINTFKTFFFNTLVVSYEFYLQMKA

SEQ ID NO: 2947449 - protein, 17 aa, Entamoeba invadens
KINTFNLGKTEKEQLKE

SEQ ID NO: 2947450 - protein, 24 aa, Entamoeba invadens
KINVKAACWMKEMLDKKRLEVKEF

SEQ ID NO: 2947451 - protein, 24 aa, Entamoeba invadens
KINVKAACWMKEMLDKKSLEVNEF

SEQ ID NO: 2947452 - protein, 19 aa, Entamoeba invadens
KINVKDTIYRGGKLVDEKT

SEQ ID NO: 2947453 - protein, 19 aa, Entamoeba invadens
KIPAEVVFHSDIIYQQFNK

SEQ ID NO: 2947454 - protein, 19 aa, Entamoeba invadens
KIPCALCGNKRDLNTQLVS

SEQ ID NO: 2947455 - protein, 24 aa, Entamoeba invadens
KIPDFCFFHCKTLTSVKLPNSTFL

SEQ ID NO: 2947456 - protein, 18 aa, Entamoeba invadens
KIPEDVFTAVKFPKLKIL

SEQ ID NO: 2947457 - protein, 19 aa, Entamoeba invadens
KIPERWFTSKKVLLLQNGE

SEQ ID NO: 2947458 - protein, 19 aa, Entamoeba invadens
KIPESLFSMGRLVGLFLNC

SEQ ID NO: 2947459 - protein, 20 aa, Entamoeba invadens
KIPFGVSSLGNLCFGECGTL

SEQ ID NO: 2947460 - protein, 21 aa, Entamoeba invadens
KIPHLLRLHICCNPIYDVNSL

SEQ ID NO: 2947461 - protein, 32 aa, Entamoeba invadens
KIPKIVKSLGYGCLSCLASLKGYTVRPHVQRL

SEQ ID NO: 2947462 - protein, 19 aa, Entamoeba invadens
KIPKMFSMACILRRKAKIQ

SEQ ID NO: 2947463 - protein, 18 aa, Entamoeba invadens
KIPKSVLKINNFSFSDSI

SEQ ID NO: 2947464 - protein, 31 aa, Entamoeba invadens
KIPLIDLIHFLPLIMKSYLESSVVKNRSVLE

SEQ ID NO: 2947465 - protein, 23 aa, Entamoeba invadens
KIPLITSICFVKNCTANYVYHGA

SEQ ID NO: 2947466 - protein, 22 aa, Entamoeba invadens
KIPNEYLDFGVFYHQVKSRKEM

SEQ ID NO: 2947467 - protein, 24 aa, Entamoeba invadens
KIPNKVCMACFSLSKVVFPDVCTK

SEQ ID NO: 2947468 - protein, 23 aa, Entamoeba invadens
KIPNTHLKFWALNMVLTEKYKFP

SEQ ID NO: 2947469 - protein, 26 aa, Entamoeba invadens
KIPVECKHLRFVVEMDDFSSYVPTTL

SEQ ID NO: 2947470 - protein, 21 aa, Entamoeba invadens
KIPWCPVCLKKSQSSLSETLV

SEQ ID NO: 2947471 - protein, 24 aa, Entamoeba invadens
KIPYFNFVRYLVIYAPFQTLPNGF

SEQ ID NO: 2947472 - protein, 20 aa, Entamoeba invadens
KIPYSCFFTISQLISMDAYT

SEQ ID NO: 2947473 - protein, 20 aa, Entamoeba invadens
KIPYSCFVNCFSMKTIELPT

SEQ ID NO: 2947474 - protein, 20 aa, Entamoeba invadens
KIQESAFLLAIQLVGLDINA

SEQ ID NO: 2947475 - protein, 40 aa, Entamoeba invadens
KIQFIDFRTAEVFGFGHLKGALNIPYAENWKEEVQKTTEK

SEQ ID NO: 2947476 - protein, 18 aa, Entamoeba invadens
KIQFSVLEGCDYYEIRTV

SEQ ID NO: 2947477 - protein, 23 aa, Entamoeba invadens
KIQGEAVVAFIIVKKDQTFDDIE

SEQ ID NO: 2947478 - protein, 20 aa, Entamoeba invadens
KIQGHHRLLAAAMVVEKYYK

SEQ ID NO: 2947479 - protein, 19 aa, Entamoeba invadens
KIQIDEVQKIIARPGSLSR

SEQ ID NO: 2947480 - protein, 19 aa, Entamoeba invadens
KIQLPFPLTEKHHILIQVR

SEQ ID NO: 2947481 - protein, 24 aa, Entamoeba invadens
KIQSTEELVLFIPVMQNVFIKVLI

SEQ ID NO: 2947482 - protein, 27 aa, Entamoeba invadens
KIRIANKMGDLMSFVCLDDDKVKETNA

SEQ ID NO: 2947483 - protein, 23 aa, Entamoeba invadens
KIRKGKFGVVYKGTYRGNVVAIK

SEQ ID NO: 2947484 - protein, 25 aa, Entamoeba invadens
KIRLIDFGSSCFVETPLYTYIQSRH

SEQ ID NO: 2947485 - protein, 20 aa, Entamoeba invadens
KIRRMMIDISLEYPTKEKMF

SEQ ID NO: 2947486 - protein, 29 aa, Entamoeba invadens
KIRTKFVCWTGKELWAFKDVVNGETVVYS

SEQ ID NO: 2947487 - protein, 22 aa, Entamoeba invadens
KIRVLGCACFYECINLNKLLIP

SEQ ID NO: 2947488 - protein, 28 aa, Entamoeba invadens
KIRVVSLLKNSWFFYELIVKSLTMDVEA

SEQ ID NO: 2947489 - protein, 19 aa, Entamoeba invadens
KIRYKYGNIVFKGDVTTTV

SEQ ID NO: 2947490 - protein, 20 aa, Entamoeba invadens
KIRYPKRITLLRGNHETRQI

SEQ ID NO: 2947491 - protein, 18 aa, Entamoeba invadens
KISAEFCKNFVFLDITCK

SEQ ID NO: 2947492 - protein, 26 aa, Entamoeba invadens
KISALRKLFSGKWVPEEKIVLFKAIC

SEQ ID NO: 2947493 - protein, 25 aa, Entamoeba invadens
KISDLNALMDACCNLVDIGDFTIYQ

SEQ ID NO: 2947494 - protein, 27 aa, Entamoeba invadens
KISEIPNIVPIPSVPNVPTISLVETKK

SEQ ID NO: 2947495 - protein, 17 aa, Entamoeba invadens
KISGTMIKVELWDTAGL

SEQ ID NO: 2947496 - protein, 24 aa, Entamoeba invadens
KISKDEFLEVFSPDVQKWRTTFDM

SEQ ID NO: 2947497 - protein, 22 aa, Entamoeba invadens
KISKDELVNAIQLFESFPEQTI

SEQ ID NO: 2947498 - protein, 18 aa, Entamoeba invadens
KISKSACTACKLTKIVLW

SEQ ID NO: 2947499 - protein, 26 aa, Entamoeba invadens
KISLTLDTLFMKSFKVYIEYLTHNTV

SEQ ID NO: 2947500 - protein, 21 aa, Entamoeba invadens
KISMINFLIFYYKYDTHEVVN

SEQ ID NO: 2947501 - protein, 21 aa, Entamoeba invadens
KISNDCIMENVHLLIDFYTII

SEQ ID NO: 2947502 - protein, 20 aa, Entamoeba invadens
KISPGDGVKVTWVESKTDKL

SEQ ID NO: 2947503 - protein, 19 aa, Entamoeba invadens
KISPRITQDLARSFIETPR

SEQ ID NO: 2947504 - protein, 18 aa, Entamoeba invadens
KISRENRNGILFIDPPDE

SEQ ID NO: 2947505 - protein, 17 aa, Entamoeba invadens
KISSMINKYESLEQKKI

SEQ ID NO: 2947506 - protein, 30 aa, Entamoeba invadens
KISTFGDIYFWFDVCAPNITYFVSEKSAIM

SEQ ID NO: 2947507 - protein, 18 aa, Entamoeba invadens
KISVLKKEIEGLKQSQPA

SEQ ID NO: 2947508 - protein, 17 aa, Entamoeba invadens
KITCNLHYVDATYLNYE

SEQ ID NO: 2947509 - protein, 19 aa, Entamoeba invadens
KITDLLVSLFIDKPSNEDR

SEQ ID NO: 2947510 - protein, 23 aa, Entamoeba invadens
KITFEYINAFYIQGSSKLMPQND

SEQ ID NO: 2947511 - protein, 25 aa, Entamoeba invadens
KITGALRSPFTLTVESPSYTGSRMV

SEQ ID NO: 2947512 - protein, 18 aa, Entamoeba invadens
KITGKIAFDDSIAAAQGD

SEQ ID NO: 2947513 - protein, 22 aa, Entamoeba invadens
KITGRQFLQLGLKDREDLRLTP

SEQ ID NO: 2947514 - protein, 17 aa, Entamoeba invadens
KITHSSFVFWFQSVFAK

SEQ ID NO: 2947515 - protein, 24 aa, Entamoeba invadens
KITIWNCTHPTFLSLIETQIEARR

SEQ ID NO: 2947516 - protein, 24 aa, Entamoeba invadens
KITIWNCTHPTFLSSIETQIEARR

SEQ ID NO: 2947517 - protein, 25 aa, Entamoeba invadens
KITIWNCTHPTFLSSIETQIEARRM

SEQ ID NO: 2947518 - protein, 26 aa, Entamoeba invadens
KITNYLFDWRDGMIVKSIGGEDEPLK

SEQ ID NO: 2947519 - protein, 25 aa, Entamoeba invadens
KITQYNAIHPFPFYQRIVFPCEQME

SEQ ID NO: 2947520 - protein, 28 aa, Entamoeba invadens
KITRCVRAEFGAYFLRNVERMTLKLPIN

SEQ ID NO: 2947521 - protein, 25 aa, Entamoeba invadens
KITRYELLFFFALSFFHIEWNDYYD

SEQ ID NO: 2947522 - protein, 18 aa, Entamoeba invadens
KITSLIIIKPPKPVDTNQ

SEQ ID NO: 2947523 - protein, 24 aa, Entamoeba invadens
KITTEGKAGCSLVSKYSDAFYFYV

SEQ ID NO: 2947524 - protein, 25 aa, Entamoeba invadens
KITTLCPFGVFLQLRTISFKNNLIE

SEQ ID NO: 2947525 - protein, 19 aa, Entamoeba invadens
KITTPPLFKIFKYMDDSER

SEQ ID NO: 2947526 - protein, 18 aa, Entamoeba invadens
KIVCPEYIHFLRGNHESL

SEQ ID NO: 2947527 - protein, 22 aa, Entamoeba invadens
KIVCPPSVMPSKFKYQTYTCNA

SEQ ID NO: 2947528 - protein, 25 aa, Entamoeba invadens
KIVCTTCGISYCFNCRVEYHDGYTC

SEQ ID NO: 2947529 - protein, 22 aa, Entamoeba invadens
KIVDLDMFLSIFNTAFNINGSS

SEQ ID NO: 2947530 - protein, 18 aa, Entamoeba invadens
KIVEKFKIGTEVDRSFVE

SEQ ID NO: 2947531 - protein, 18 aa, Entamoeba invadens
KIVEVFEAYFSKIDEETI

SEQ ID NO: 2947532 - protein, 27 aa, Entamoeba invadens
KIVFPKEVLKGFLLYIQQFNPFMKVVL

SEQ ID NO: 2947533 - protein, 31 aa, Entamoeba invadens
KIVFYLWTPDGCKIKEKMLFSATKATIKQAF

SEQ ID NO: 2947534 - protein, 25 aa, Entamoeba invadens
KIVGEIKKGLLLYFGINEADDEKDI

SEQ ID NO: 2947535 - protein, 26 aa, Entamoeba invadens
KIVGYFKRLELKRENVKENEDGWYKE

SEQ ID NO: 2947536 - protein, 19 aa, Entamoeba invadens
KIVKKRRGRKRKADTKTDV

SEQ ID NO: 2947537 - protein, 21 aa, Entamoeba invadens
KIVKSKLSQFVNFPKNNETAI

SEQ ID NO: 2947538 - protein, 18 aa, Entamoeba invadens
KIVLCYAPHVKFLIQHFE

SEQ ID NO: 2947539 - protein, 20 aa, Entamoeba invadens
KIVLFLFKVLFRCDSVYSSS

SEQ ID NO: 2947540 - protein, 18 aa, Entamoeba invadens
KIVLYSSMEDIARFKIAV

SEQ ID NO: 2947541 - protein, 19 aa, Entamoeba invadens
KIVNIRACPVEGNKLIALM

SEQ ID NO: 2947542 - protein, 18 aa, Entamoeba invadens
KIVNPALMALYAEGQETG

SEQ ID NO: 2947543 - protein, 20 aa, Entamoeba invadens
KIVNSCCFCDSVTVDNVIFA

SEQ ID NO: 2947544 - protein, 30 aa, Entamoeba invadens
KIVPDGILCFFPSYVYMNLCISHWDEMDVI

SEQ ID NO: 2947545 - protein, 32 aa, Entamoeba invadens
KIVQEAVIWPMLRPDIFTGLRAPPKGILLFGP

SEQ ID NO: 2947546 - protein, 29 aa, Entamoeba invadens
KIVQSFSVCDPCFFTSFRDACLSKRDSIF

SEQ ID NO: 2947547 - protein, 19 aa, Entamoeba invadens
KIVVKELFKMVSSDETLEY

SEQ ID NO: 2947548 - protein, 19 aa, Entamoeba invadens
KIVVWYPVDYEFFLLHKNT

SEQ ID NO: 2947549 - protein, 17 aa, Entamoeba invadens
KIWRFSDSATMTVSFEK

SEQ ID NO: 2947550 - protein, 23 aa, Entamoeba invadens
KIYCTKESLDFVRNCFNTNYSKI

SEQ ID NO: 2947551 - protein, 18 aa, Entamoeba invadens
KIYEDQNKLIIAAQNVLQ

SEQ ID NO: 2947552 - protein, 18 aa, Entamoeba invadens
KIYFKVMFMNVKNYDKFS

SEQ ID NO: 2947553 - protein, 19 aa, Entamoeba invadens
KIYKYFGMEYSEEFEENIK

SEQ ID NO: 2947554 - protein, 23 aa, Entamoeba invadens
KIYNLKAKELFKESPSEAVKFMI

SEQ ID NO: 2947555 - protein, 22 aa, Entamoeba invadens
KIYNLRIVAIMPGVLVENMTPK

SEQ ID NO: 2947556 - protein, 18 aa, Entamoeba invadens
KIYTESILNYKSTIKEYT

SEQ ID NO: 2947557 - protein, 20 aa, Entamoeba invadens
KKADFDTIIHLLRKSTLSQT

SEQ ID NO: 2947558 - protein, 21 aa, Entamoeba invadens
KKAEIVFRFSPSPTHQPPKES

SEQ ID NO: 2947559 - protein, 21 aa, Entamoeba invadens
KKAFYRMSLKYHPDKHPDDAE

SEQ ID NO: 2947560 - protein, 17 aa, Entamoeba invadens
KKAGENWKAMGEEDKKP

SEQ ID NO: 2947561 - protein, 27 aa, Entamoeba invadens
KKAGLENFKKFGLLHFLVFYYDQDWKK

SEQ ID NO: 2947562 - protein, 21 aa, Entamoeba invadens
KKAGLQFPVARIHAALKKGRY

SEQ ID NO: 2947563 - protein, 22 aa, Entamoeba invadens
KKAGTNITFVWNGGDQHLGGLD

SEQ ID NO: 2947564 - protein, 26 aa, Entamoeba invadens
KKAIKLCIEISFAGLSRNSLNRAKTL

SEQ ID NO: 2947565 - protein, 17 aa, Entamoeba invadens
KKAKAPCVRVKKSDIDF

SEQ ID NO: 2947566 - protein, 17 aa, Entamoeba invadens
KKAKKKRYHIIEYITVF

SEQ ID NO: 2947567 - protein, 23 aa, Entamoeba invadens
KKAKRVIKVIRGYHGISAEEIAK

SEQ ID NO: 2947568 - protein, 28 aa, Entamoeba invadens
KKALRMLSGAIVFKMCKKIYDTTHNKFS

SEQ ID NO: 2947569 - protein, 19 aa, Entamoeba invadens
KKANIPNKKMLVLLPVPMK

SEQ ID NO: 2947570 - protein, 18 aa, Entamoeba invadens
KKAPFSFENNFVVMFTNF

SEQ ID NO: 2947571 - protein, 20 aa, Entamoeba invadens
KKARRPRLPRKLQKVETLNF

SEQ ID NO: 2947572 - protein, 17 aa, Entamoeba invadens
KKARVWMSDSDIQFIMK

SEQ ID NO: 2947573 - protein, 19 aa, Entamoeba invadens
KKAVIEWPHKYVIANTKST

SEQ ID NO: 2947574 - protein, 24 aa, Entamoeba invadens
KKAVLKTVFDFVVMKKKRRAVNKA

SEQ ID NO: 2947575 - protein, 26 aa, Entamoeba invadens
KKCARCGKLLTVRDFLRDSMYCKECK

SEQ ID NO: 2947576 - protein, 21 aa, Entamoeba invadens
KKCDYINIFGTFDCQKVLSFC

SEQ ID NO: 2947577 - protein, 25 aa, Entamoeba invadens
KKCEAFLFNDRVIWFTVSKAYKVGK

SEQ ID NO: 2947578 - protein, 19 aa, Entamoeba invadens
KKCECSRLDISPPGTSEEL

SEQ ID NO: 2947579 - protein, 23 aa, Entamoeba invadens
KKCEKCKPGFWIENFECVTCETC

SEQ ID NO: 2947580 - protein, 26 aa, Entamoeba invadens
KKCEMCNMTSWIPLRETVHITETQKI

SEQ ID NO: 2947581 - protein, 20 aa, Entamoeba invadens
KKCGNALNFVFRSPNYSAPQ

SEQ ID NO: 2947582 - protein, 23 aa, Entamoeba invadens
KKCIPCKTCSYCQNMQEVVMDNT

SEQ ID NO: 2947583 - protein, 18 aa, Entamoeba invadens
KKCIPRKIYQEIIHTVTL

SEQ ID NO: 2947584 - protein, 21 aa, Entamoeba invadens
KKCKEAVGMLHIIPYRISDNK

SEQ ID NO: 2947585 - protein, 23 aa, Entamoeba invadens
KKCMLFGGICGSIGGITEINLET

SEQ ID NO: 2947586 - protein, 21 aa, Entamoeba invadens
KKCNPSLDFSNIISKRALTSP

SEQ ID NO: 2947587 - protein, 19 aa, Entamoeba invadens
KKCNSRGEFITKFEKILTV

SEQ ID NO: 2947588 - protein, 22 aa, Entamoeba invadens
KKCRKERMLFPKIHERPRMSST

SEQ ID NO: 2947589 - protein, 28 aa, Entamoeba invadens
KKCRYLFFWRYVIRMCNVERPIPKERFI

SEQ ID NO: 2947590 - protein, 23 aa, Entamoeba invadens
KKCSNLFVPFILQVRKFIAQAEV

SEQ ID NO: 2947591 - protein, 23 aa, Entamoeba invadens
KKCTEEPARIIARNAGMDGGVVV

SEQ ID NO: 2947592 - protein, 19 aa, Entamoeba invadens
KKCVFAAGEFNVFNAFKKE

SEQ ID NO: 2947593 - protein, 30 aa, Entamoeba invadens
KKCVGGIDLPTWRVSKNGVEEWYQLKNFCD

SEQ ID NO: 2947594 - protein, 25 aa, Entamoeba invadens
KKCVKGNCPEMYFKEGAEKMCKRCT

SEQ ID NO: 2947595 - protein, 20 aa, Entamoeba invadens
KKCVPKSCRALLNSETSPLK

SEQ ID NO: 2947596 - protein, 21 aa, Entamoeba invadens
KKCYIKHFSVMNGEMMYNQVS

SEQ ID NO: 2947597 - protein, 30 aa, Entamoeba invadens
KKDAIFSTRWFPPKIRKMRIKYLPIINMTK

SEQ ID NO: 2947598 - protein, 24 aa, Entamoeba invadens
KKDATGILDIFGFDIATSQKEEKR

SEQ ID NO: 2947599 - protein, 18 aa, Entamoeba invadens
KKDCEIVNGIDTNRMPFA

SEQ ID NO: 2947600 - protein, 21 aa, Entamoeba invadens
KKDDLIFAFMLDKIANILESI

SEQ ID NO: 2947601 - protein, 18 aa, Entamoeba invadens
KKDFDGIVVWFEVIYATY

SEQ ID NO: 2947602 - protein, 24 aa, Entamoeba invadens
KKDFFFEDCESLNLVFLNDKTLDL

SEQ ID NO: 2947603 - protein, 24 aa, Entamoeba invadens
KKDFLEKLETVFGLQEEGYYDEAK

SEQ ID NO: 2947604 - protein, 25 aa, Entamoeba invadens
KKDFREFGEIFGLRELVDAYIKQRL

SEQ ID NO: 2947605 - protein, 21 aa, Entamoeba invadens
KKDGCVIYEKMVEKLNQLPWR

SEQ ID NO: 2947606 - protein, 18 aa, Entamoeba invadens
KKDGIAKFTMTVDEFPRP

SEQ ID NO: 2947607 - protein, 34 aa, Entamoeba invadens
KKDGITFVAIFIRVCMKFDFYECPLLLSEYFGES

SEQ ID NO: 2947608 - protein, 17 aa, Entamoeba invadens
KKDGKFVIKAFGSNLPD

SEQ ID NO: 2947609 - protein, 22 aa, Entamoeba invadens
KKDGNMMYCGGWDDYLSVGQIG

SEQ ID NO: 2947610 - protein, 26 aa, Entamoeba invadens
KKDIVYIWFRAIKDIGDFCFCECNFK

SEQ ID NO: 2947611 - protein, 19 aa, Entamoeba invadens
KKDKDTFVKLSKDADSASV

SEQ ID NO: 2947612 - protein, 20 aa, Entamoeba invadens
KKDLADWSKQLEIAENQDRE

SEQ ID NO: 2947613 - protein, 19 aa, Entamoeba invadens
KKDLFKALQCFEKCGEKGR

SEQ ID NO: 2947614 - protein, 21 aa, Entamoeba invadens
KKDLFKGLLDVVSSYEKRKTL

SEQ ID NO: 2947615 - protein, 25 aa, Entamoeba invadens
KKDLKDLKALCGHFEVITDVANLFM

SEQ ID NO: 2947616 - protein, 27 aa, Entamoeba invadens
KKDLLSSDPYVIVSIGPDSQRTKTVMK

SEQ ID NO: 2947617 - protein, 24 aa, Entamoeba invadens
KKDMKEILTTMGLVRTNPKTVKQF

SEQ ID NO: 2947618 - protein, 17 aa, Entamoeba invadens
KKDPAVIQAEKQQKEAE

SEQ ID NO: 2947619 - protein, 26 aa, Entamoeba invadens
KKDPKFCPLWRLAAVKCDGVKFTGKL

SEQ ID NO: 2947620 - protein, 19 aa, Entamoeba invadens
KKDSWGALGAHKYIGVTFG

SEQ ID NO: 2947621 - protein, 19 aa, Entamoeba invadens
KKDTFKIGVLIENTTDEVN

SEQ ID NO: 2947622 - protein, 35 aa, Entamoeba invadens
KKDTFLVLVFYCRDFSVVCPKELVEVNNKFEMFES

SEQ ID NO: 2947623 - protein, 20 aa, Entamoeba invadens
KKDVCIPEEIVGRYLPKLNG

SEQ ID NO: 2947624 - protein, 17 aa, Entamoeba invadens
KKDVKECIKDQANALNW

SEQ ID NO: 2947625 - protein, 20 aa, Entamoeba invadens
KKDVKFVIVIFFYINVTRND

SEQ ID NO: 2947626 - protein, 22 aa, Entamoeba invadens
KKDWRKVGFTPAAAKHTPPNKG

SEQ ID NO: 2947627 - protein, 23 aa, Entamoeba invadens
KKDYATAICEYSKAISCNPFNHI

SEQ ID NO: 2947628 - protein, 19 aa, Entamoeba invadens
KKEAEDFLKSCPVKKLTLN

SEQ ID NO: 2947629 - protein, 25 aa, Entamoeba invadens
KKEDAEKIIGWAIGKEISTSNEKVK

SEQ ID NO: 2947630 - protein, 23 aa, Entamoeba invadens
KKEDENRFNAVFFVGKKLTPSNE

SEQ ID NO: 2947631 - protein, 20 aa, Entamoeba invadens
KKEDRWGWPTLFTSKEYRVA

SEQ ID NO: 2947632 - protein, 23 aa, Entamoeba invadens
KKEEKCYIGLDLINGKVRDNLEA

SEQ ID NO: 2947633 - protein, 20 aa, Entamoeba invadens
KKEEVFRTDVDFKKQNAHFA

SEQ ID NO: 2947634 - protein, 28 aa, Entamoeba invadens
KKEFLRKSIDICASRVFEIGDHVHSFTF

SEQ ID NO: 2947635 - protein, 21 aa, Entamoeba invadens
KKEGDLVIVPLNIKKDELPQE

SEQ ID NO: 2947636 - protein, 17 aa, Entamoeba invadens
KKEGEAPKSSRHFKASP

SEQ ID NO: 2947637 - protein, 17 aa, Entamoeba invadens
KKEGFVYVKGDENHFMF

SEQ ID NO: 2947638 - protein, 25 aa, Entamoeba invadens
KKEHEKLCGWNELLQRMRNNLGHIF

SEQ ID NO: 2947639 - protein, 21 aa, Entamoeba invadens
KKEHFKSVAFDKVKEVRIGEN

SEQ ID NO: 2947640 - protein, 20 aa, Entamoeba invadens
KKEIEACTKFASRLQDRLLG

SEQ ID NO: 2947641 - protein, 20 aa, Entamoeba invadens
KKEIKVVLWDVGRQAQNYDL

SEQ ID NO: 2947642 - protein, 19 aa, Entamoeba invadens
KKEILLRISENEDFTYCRM

SEQ ID NO: 2947643 - protein, 27 aa, Entamoeba invadens
KKEINKERSLCVGSKRFDNPKKETIQE

SEQ ID NO: 2947644 - protein, 20 aa, Entamoeba invadens
KKEIPMVEVVEIPKERKEDI

SEQ ID NO: 2947645 - protein, 21 aa, Entamoeba invadens
KKEIPTFAANLSKFVQLKTIT

SEQ ID NO: 2947646 - protein, 23 aa, Entamoeba invadens
KKEIRCVSSTFLDRDCDLQLIWK

SEQ ID NO: 2947647 - protein, 19 aa, Entamoeba invadens
KKEISPPWVPPVKDEIETT

SEQ ID NO: 2947648 - protein, 23 aa, Entamoeba invadens
KKEKARIRKGCNLLVGTPGRLLD

SEQ ID NO: 2947649 - protein, 24 aa, Entamoeba invadens
KKEKIEYAPLWLPSDIEKCQICGK

SEQ ID NO: 2947650 - protein, 25 aa, Entamoeba invadens
KKEKRKQIGCFICQQQGHTSQDCPY

SEQ ID NO: 2947651 - protein, 23 aa, Entamoeba invadens
KKELCYLTLLPFIIPKRHQDNMV

SEQ ID NO: 2947652 - protein, 18 aa, Entamoeba invadens
KKELERLNTKIGGVDTEI

SEQ ID NO: 2947653 - protein, 23 aa, Entamoeba invadens
KKELLLKKGMLFDIVGVKSQRTC

SEQ ID NO: 2947654 - protein, 18 aa, Entamoeba invadens
KKELMLVDIRNYKKGMAK

SEQ ID NO: 2947655 - protein, 22 aa, Entamoeba invadens
KKELSLGVLKWVTDITLKLVVN

SEQ ID NO: 2947656 - protein, 33 aa, Entamoeba invadens
KKEMMRRESLEYSRVKTTVCKSVVAKLQAYYDN

SEQ ID NO: 2947657 - protein, 18 aa, Entamoeba invadens
KKEMPINAVYSFDGMVFD

SEQ ID NO: 2947658 - protein, 18 aa, Entamoeba invadens
KKEMTLREAEVLALSTLK

SEQ ID NO: 2947659 - protein, 19 aa, Entamoeba invadens
KKENHSWSIFSNKNKKEIE

SEQ ID NO: 2947660 - protein, 19 aa, Entamoeba invadens
KKENLNVSSKDEWKEKHKK

SEQ ID NO: 2947661 - protein, 27 aa, Entamoeba invadens
KKEQIAQFFLPFLLDFIDNFDRLSSVW

SEQ ID NO: 2947662 - protein, 27 aa, Entamoeba invadens
KKEQPIHKYSCLFDVEQPALPQPQNDL

SEQ ID NO: 2947663 - protein, 25 aa, Entamoeba invadens
KKEQTSCYLFCFETANVLYNVGVAH

SEQ ID NO: 2947664 - protein, 18 aa, Entamoeba invadens
KKEQVKCEYDYTAQDQGE

SEQ ID NO: 2947665 - protein, 21 aa, Entamoeba invadens
KKERESRIVEVAKLNTTIQEL

SEQ ID NO: 2947666 - protein, 20 aa, Entamoeba invadens
KKERKVWKIADEKLEDLSND

SEQ ID NO: 2947667 - protein, 26 aa, Entamoeba invadens
KKERLRMLVTLGDYLAAIALAENNLE

SEQ ID NO: 2947668 - protein, 19 aa, Entamoeba invadens
KKERSVERWVEVARPLVHG

SEQ ID NO: 2947669 - protein, 33 aa, Entamoeba invadens
KKETPNWVTGEGKVSGLEILKGLTTQQLVISNE

SEQ ID NO: 2947670 - protein, 23 aa, Entamoeba invadens
KKETRPVVKLSFKDESTKERATE

SEQ ID NO: 2947671 - protein, 24 aa, Entamoeba invadens
KKEVEGRKSLGLNYNFISRNHFSI

SEQ ID NO: 2947672 - protein, 30 aa, Entamoeba invadens
KKEVISWLHSCRRGKSTKKMMVCGTSSEEV

SEQ ID NO: 2947673 - protein, 18 aa, Entamoeba invadens
KKEVITSIVVPKSQILNA

SEQ ID NO: 2947674 - protein, 20 aa, Entamoeba invadens
KKEVRDALISTFETLHAQVI

SEQ ID NO: 2947675 - protein, 23 aa, Entamoeba invadens
KKEVVDIILSIVMGFVVDEESAD

SEQ ID NO: 2947676 - protein, 20 aa, Entamoeba invadens
KKEVYYGFMHEEELQEWGAT

SEQ ID NO: 2947677 - protein, 18 aa, Entamoeba invadens
KKEYRKKEEEVVRIEEEK

SEQ ID NO: 2947678 - protein, 21 aa, Entamoeba invadens
KKFAADLDKAVFLLVTKALLE

SEQ ID NO: 2947679 - protein, 18 aa, Entamoeba invadens
KKFARLSFSEEFQEKMHD

SEQ ID NO: 2947680 - protein, 29 aa, Entamoeba invadens
KKFCIKEKKEAFCVGVLNSSCLFTAGNED

SEQ ID NO: 2947681 - protein, 31 aa, Entamoeba invadens
KKFDCKFVVMFDRDFEIFRTFKNVFFFGEKI

SEQ ID NO: 2947682 - protein, 20 aa, Entamoeba invadens
KKFDIVITIIQTVGSILRSE

SEQ ID NO: 2947683 - protein, 17 aa, Entamoeba invadens
KKFDVFNDIWAYGVTIW

SEQ ID NO: 2947684 - protein, 24 aa, Entamoeba invadens
KKFEYKDSIFFKFVVDVKKDSKTK

SEQ ID NO: 2947685 - protein, 20 aa, Entamoeba invadens
KKFFSLKGDMLQFIVEHWYL

SEQ ID NO: 2947686 - protein, 20 aa, Entamoeba invadens
KKFGKIILVGGGARIPGVKE

SEQ ID NO: 2947687 - protein, 25 aa, Entamoeba invadens
KKFGKKVSVRNCLAWTDFMNCCTSI

SEQ ID NO: 2947688 - protein, 23 aa, Entamoeba invadens
KKFGSHCFDVCFALTSFTIPDSV

SEQ ID NO: 2947689 - protein, 27 aa, Entamoeba invadens
KKFGSPEMWKMCCDLFDMLSLSAVIDG

SEQ ID NO: 2947690 - protein, 17 aa, Entamoeba invadens
KKFIGKPAPFTPFTAFL

SEQ ID NO: 2947691 - protein, 17 aa, Entamoeba invadens
KKFKCFLVSAKDATNVE

SEQ ID NO: 2947692 - protein, 23 aa, Entamoeba invadens
KKFKDKFPNLGLEYAIGGQISFD

SEQ ID NO: 2947693 - protein, 23 aa, Entamoeba invadens
KKFKKPAKLSVSFKSYKSSKRSE

SEQ ID NO: 2947694 - protein, 20 aa, Entamoeba invadens
KKFLEEEIGMTVKVFPYTPN

SEQ ID NO: 2947695 - protein, 17 aa, Entamoeba invadens
KKFLISKTMTYHGESLD

SEQ ID NO: 2947696 - protein, 17 aa, Entamoeba invadens
KKFLRKWIVHNTTQLVY

SEQ ID NO: 2947697 - protein, 22 aa, Entamoeba invadens
KKFMPTFPFPYMNGRLHLGHTF

SEQ ID NO: 2947698 - protein, 19 aa, Entamoeba invadens
KKFNCTNVHHLVEENLSLV

SEQ ID NO: 2947699 - protein, 26 aa, Entamoeba invadens
KKFNLKFKKVCLGSSSFTKRLNELLQ

SEQ ID NO: 2947700 - protein, 30 aa, Entamoeba invadens
KKFPILKNSWKLVLSLLCTDPTVSVGNSED

SEQ ID NO: 2947701 - protein, 24 aa, Entamoeba invadens
KKFPMCKGEGIGYASYITLSLLRF

SEQ ID NO: 2947702 - protein, 29 aa, Entamoeba invadens
KKFQDQAVWMLNALWLKEKDAHAEEIWNF

SEQ ID NO: 2947703 - protein, 19 aa, Entamoeba invadens
KKFSFFFSLLLESEVTTVV

SEQ ID NO: 2947704 - protein, 19 aa, Entamoeba invadens
KKFSGNMGKFHFNPFSLNS

SEQ ID NO: 2947705 - protein, 21 aa, Entamoeba invadens
KKFTFPFPTKALYDYTAETDD

SEQ ID NO: 2947706 - protein, 20 aa, Entamoeba invadens
KKFVEFYNYLPVLEIPDVER

SEQ ID NO: 2947707 - protein, 21 aa, Entamoeba invadens
KKFVIRQSRGFDFEDRDIPEE

SEQ ID NO: 2947708 - protein, 24 aa, Entamoeba invadens
KKFYKVIIWYSVNYLTYFQNTDRN

SEQ ID NO: 2947709 - protein, 23 aa, Entamoeba invadens
KKFYRIIVWFNVDFETVDRNKNR

SEQ ID NO: 2947710 - protein, 24 aa, Entamoeba invadens
KKFYRLNAGIFREEFLYENVLQVV

SEQ ID NO: 2947711 - protein, 19 aa, Entamoeba invadens
KKFYVKRFNSLYDEGKAEE

SEQ ID NO: 2947712 - protein, 21 aa, Entamoeba invadens
KKGDKVRARLDVVNYHVNGIT

SEQ ID NO: 2947713 - protein, 18 aa, Entamoeba invadens
KKGEHPDHVIVIKYVPYV

SEQ ID NO: 2947714 - protein, 24 aa, Entamoeba invadens
KKGELKGDYITVVVKDFKTLNQML

SEQ ID NO: 2947715 - protein, 23 aa, Entamoeba invadens
KKGEMKSGIVGVIVKNTEIANRI

SEQ ID NO: 2947716 - protein, 21 aa, Entamoeba invadens
KKGEMVFDIQCLQSHIVTTVK

SEQ ID NO: 2947717 - protein, 21 aa, Entamoeba invadens
KKGESGSACYSNRTADTPDNV

SEQ ID NO: 2947718 - protein, 23 aa, Entamoeba invadens
KKGESKVRLNAMECTGMAVVPIE

SEQ ID NO: 2947719 - protein, 20 aa, Entamoeba invadens
KKGFPAFAIPKALYIEHTPF

SEQ ID NO: 2947720 - protein, 19 aa, Entamoeba invadens
KKGFPRLLEFFKKDKRSAS

SEQ ID NO: 2947721 - protein, 20 aa, Entamoeba invadens
KKGGFSKYKYPSMTKTFDQF

SEQ ID NO: 2947722 - protein, 28 aa, Entamoeba invadens
KKGGLRYSKECDVWAIGIILYIILSGTH

SEQ ID NO: 2947723 - protein, 28 aa, Entamoeba invadens
KKGKTFGERVTRCDGFVIVVEAADETKF

SEQ ID NO: 2947724 - protein, 20 aa, Entamoeba invadens
KKGKVLIQLDISFFGSIDNV

SEQ ID NO: 2947725 - protein, 27 aa, Entamoeba invadens
KKGLLKMGRLHVHMAKALPQHIGKQMS

SEQ ID NO: 2947726 - protein, 22 aa, Entamoeba invadens
KKGMNAKFYQEFYGFDTTVLTG

SEQ ID NO: 2947727 - protein, 25 aa, Entamoeba invadens
KKGMTKVDVCFRVFKNGKILYDQKQ

SEQ ID NO: 2947728 - protein, 23 aa, Entamoeba invadens
KKGNFYLALVFLHYAMVFTPQYG

SEQ ID NO: 2947729 - protein, 19 aa, Entamoeba invadens
KKGNITNCIVYYDAIKCTT

SEQ ID NO: 2947730 - protein, 21 aa, Entamoeba invadens
KKGNPRGKCTSKIPGMPYGKL

SEQ ID NO: 2947731 - protein, 26 aa, Entamoeba invadens
KKGPVFELYRSTGLAKMPSVCGYIET

SEQ ID NO: 2947732 - protein, 21 aa, Entamoeba invadens
KKGQRSLAFRLSHQKITGRQF

SEQ ID NO: 2947733 - protein, 20 aa, Entamoeba invadens
KKGRGTYRINSECSSEDFDF

SEQ ID NO: 2947734 - protein, 22 aa, Entamoeba invadens
KKGSSFSPYFASFYQIEKRRGS

SEQ ID NO: 2947735 - protein, 22 aa, Entamoeba invadens
KKGWNESLFDFGDENKEIAKED

SEQ ID NO: 2947736 - protein, 19 aa, Entamoeba invadens
KKHFLEIFENLNSKFDDVA

SEQ ID NO: 2947737 - protein, 22 aa, Entamoeba invadens
KKHFNICPFVKYTKEDRKKYGN

SEQ ID NO: 2947738 - protein, 18 aa, Entamoeba invadens
KKHFTLILDDCWHQTDLR

SEQ ID NO: 2947739 - protein, 25 aa, Entamoeba invadens
KKHKEIYCVILRYELNGDFYSVPLI

SEQ ID NO: 2947740 - protein, 23 aa, Entamoeba invadens
KKHKEMVWMSGVSKLIDEDSKNY

SEQ ID NO: 2947741 - protein, 20 aa, Entamoeba invadens
KKHLPSVIIVGNKCDLKKER

SEQ ID NO: 2947742 - protein, 21 aa, Entamoeba invadens
KKHNATFSRVFVQSSKILQFL

SEQ ID NO: 2947743 - protein, 24 aa, Entamoeba invadens
KKHPEILNVLKLFIDNITDINKKN

SEQ ID NO: 2947744 - protein, 28 aa, Entamoeba invadens
KKHPFCEFCNIPFIDLDSLYKHLNTQHE

SEQ ID NO: 2947745 - protein, 22 aa, Entamoeba invadens
KKHSIEVPSYIPPSFNTPQNSK

SEQ ID NO: 2947746 - protein, 18 aa, Entamoeba invadens
KKHTILFTRFHYNPIEET

SEQ ID NO: 2947747 - protein, 32 aa, Entamoeba invadens
KKIAERGVLSQICEICYKLDLNSDYYKGFGGG

SEQ ID NO: 2947748 - protein, 17 aa, Entamoeba invadens
KKIAISRASVLGLSKAT

SEQ ID NO: 2947749 - protein, 19 aa, Entamoeba invadens
KKIAPPLGTLMSASKAFEI

SEQ ID NO: 2947750 - protein, 24 aa, Entamoeba invadens
KKIDFFKIVVWFTVSYNTSLNTLN

SEQ ID NO: 2947751 - protein, 24 aa, Entamoeba invadens
KKIDFTRPRILAMSQDTMPDSPGR

SEQ ID NO: 2947752 - protein, 18 aa, Entamoeba invadens
KKIEADYIHKVKEAEVKK

SEQ ID NO: 2947753 - protein, 19 aa, Entamoeba invadens
KKIEAFVIIPYITQLIEIM

SEQ ID NO: 2947754 - protein, 22 aa, Entamoeba invadens
KKIEIDCAKSIFEKKRTKHEFC

SEQ ID NO: 2947755 - protein, 20 aa, Entamoeba invadens
KKIFCPSRATLYYSCDEEEK

SEQ ID NO: 2947756 - protein, 20 aa, Entamoeba invadens
KKIFDYVCVTFGKSGVTFES

SEQ ID NO: 2947757 - protein, 25 aa, Entamoeba invadens
KKIFFKAKEVFRILFTLVSSLQEDD

SEQ ID NO: 2947758 - protein, 20 aa, Entamoeba invadens
KKIFKNWGNDDVDNFIKTVA

SEQ ID NO: 2947759 - protein, 23 aa, Entamoeba invadens
KKIFPKNVFVNFDMNFGSNSFGS

SEQ ID NO: 2947760 - protein, 23 aa, Entamoeba invadens
KKIFPKNVYVNFDMNFGSNAFGS

SEQ ID NO: 2947761 - protein, 23 aa, Entamoeba invadens
KKIFPKNVYVNFDMNFGSNSFGS

SEQ ID NO: 2947762 - protein, 17 aa, Entamoeba invadens
KKIFPTKNFEFIEINAS

SEQ ID NO: 2947763 - protein, 20 aa, Entamoeba invadens
KKIGCPYIECSALTGTKIED

SEQ ID NO: 2947764 - protein, 19 aa, Entamoeba invadens
KKIGGFIVVNPTSFSFKGT

SEQ ID NO: 2947765 - protein, 17 aa, Entamoeba invadens
KKIGPIVFDSNSQDWNI

SEQ ID NO: 2947766 - protein, 20 aa, Entamoeba invadens
KKIGTTFKMFTPFFKVYFLY

SEQ ID NO: 2947767 - protein, 20 aa, Entamoeba invadens
KKIIVPFILLKGVNDLETVY

SEQ ID NO: 2947768 - protein, 19 aa, Entamoeba invadens
KKIKGEKKVDCINSVCGVG

SEQ ID NO: 2947769 - protein, 24 aa, Entamoeba invadens
KKIKMFREMIHRLKVAHPDIEELK

SEQ ID NO: 2947770 - protein, 28 aa, Entamoeba invadens
KKIKMGGLRPTWEIAYYSWEEAVLNAIS

SEQ ID NO: 2947771 - protein, 22 aa, Entamoeba invadens
KKIKPEVLQIFEAYDVEIPDFL

SEQ ID NO: 2947772 - protein, 18 aa, Entamoeba invadens
KKIKPVVLLNEPKAITLP

SEQ ID NO: 2947773 - protein, 23 aa, Entamoeba invadens
KKIKVICPHITFSSGDLQNNCSY

SEQ ID NO: 2947774 - protein, 22 aa, Entamoeba invadens
KKILFSKGFRVFGGDSRRSSDY

SEQ ID NO: 2947775 - protein, 21 aa, Entamoeba invadens
KKIPARILCEMVLFCENGAVE

SEQ ID NO: 2947776 - protein, 26 aa, Entamoeba invadens
KKIPGYFKYFYDYKVSYQQFLSFQTE

SEQ ID NO: 2947777 - protein, 17 aa, Entamoeba invadens
KKIPLVMEDILKKIQFM

SEQ ID NO: 2947778 - protein, 18 aa, Entamoeba invadens
KKIPTLIPKVLMGVTGSV

SEQ ID NO: 2947779 - protein, 19 aa, Entamoeba invadens
KKIREFFEKSLLFNNSLYY

SEQ ID NO: 2947780 - protein, 18 aa, Entamoeba invadens
KKISDDMYDLNGSKNKSV

SEQ ID NO: 2947781 - protein, 22 aa, Entamoeba invadens
KKISDSIVFVALFHKFEILTVF

SEQ ID NO: 2947782 - protein, 21 aa, Entamoeba invadens
KKISEGFGMQVAIYDPYLKME

SEQ ID NO: 2947783 - protein, 17 aa, Entamoeba invadens
KKISPTDYRLHVVNEVY

SEQ ID NO: 2947784 - protein, 19 aa, Entamoeba invadens
KKISSINVIQRAIRNYQIM

SEQ ID NO: 2947785 - protein, 20 aa, Entamoeba invadens
KKITGKHCVVPLIYTNTNLP

SEQ ID NO: 2947786 - protein, 18 aa, Entamoeba invadens
KKITLAFGNSSNIRLTQE

SEQ ID NO: 2947787 - protein, 24 aa, Entamoeba invadens
KKIVLPALCFKILQITPKSKNVFV

SEQ ID NO: 2947788 - protein, 23 aa, Entamoeba invadens
KKIYEVPTRFKVSTRHLPDFERF

SEQ ID NO: 2947789 - protein, 19 aa, Entamoeba invadens
KKIYITIMSCYNFEECVHK

SEQ ID NO: 2947790 - protein, 29 aa, Entamoeba invadens
KKKAAAAALRIVRKCPSYCEIYIQKTKAL

SEQ ID NO: 2947791 - protein, 26 aa, Entamoeba invadens
KKKAEKCVLCDTSFLYSLKSQTNEIH

SEQ ID NO: 2947792 - protein, 19 aa, Entamoeba invadens
KKKAEKEAREKAEAERLEQ

SEQ ID NO: 2947793 - protein, 19 aa, Entamoeba invadens
KKKAFEFFMNVAIESLELG

SEQ ID NO: 2947794 - protein, 18 aa, Entamoeba invadens
KKKALLISGLFVNDKPSK

SEQ ID NO: 2947795 - protein, 24 aa, Entamoeba invadens
KKKCSEEAQNVMIDFMNKYTQQDS

SEQ ID NO: 2947796 - protein, 19 aa, Entamoeba invadens
KKKDCFEEGVKCLQEAFSS

SEQ ID NO: 2947797 - protein, 19 aa, Entamoeba invadens
KKKDIGRCYGNKDATNKAQ

SEQ ID NO: 2947798 - protein, 22 aa, Entamoeba invadens
KKKEGFLPNVLYIVESTVPLVN

SEQ ID NO: 2947799 - protein, 22 aa, Entamoeba invadens
KKKEKAVPFIDDREEIDEIDNE

SEQ ID NO: 2947800 - protein, 20 aa, Entamoeba invadens
KKKFEEIIRFVPPDYRLCQR

SEQ ID NO: 2947801 - protein, 24 aa, Entamoeba invadens
KKKFFRIIVWFNVDFETVDRNKSR

SEQ ID NO: 2947802 - protein, 19 aa, Entamoeba invadens
KKKFGGKKYIGFIDIDLCE

SEQ ID NO: 2947803 - protein, 17 aa, Entamoeba invadens
KKKFGIFLESIEMSNEV

SEQ ID NO: 2947804 - protein, 31 aa, Entamoeba invadens
KKKFPSGRGYIRYLYNKRIEMIDGKVKNYKF

SEQ ID NO: 2947805 - protein, 24 aa, Entamoeba invadens
KKKFPTYDLPLLKPLEDMGVTDAD

SEQ ID NO: 2947806 - protein, 24 aa, Entamoeba invadens
KKKGEECLKLLLIAHPDLASCPFH

SEQ ID NO: 2947807 - protein, 21 aa, Entamoeba invadens
KKKGNRVIICTGRSIYETRHI

SEQ ID NO: 2947808 - protein, 20 aa, Entamoeba invadens
KKKGVALKFCSEGEIKESDE

SEQ ID NO: 2947809 - protein, 21 aa, Entamoeba invadens
KKKGVAVAMGNAFEEVKKKAD

SEQ ID NO: 2947810 - protein, 18 aa, Entamoeba invadens
KKKHGFFSFLKRKAKDKS

SEQ ID NO: 2947811 - protein, 19 aa, Entamoeba invadens
KKKIEMLVAKYAKRVLTEE

SEQ ID NO: 2947812 - protein, 19 aa, Entamoeba invadens
KKKIETAGLVAKNAAIQEL

SEQ ID NO: 2947813 - protein, 19 aa, Entamoeba invadens
KKKIVLVCQCSGKYRSCSY

SEQ ID NO: 2947814 - protein, 21 aa, Entamoeba invadens
KKKKDCVRIAELSSMLCDVAF

SEQ ID NO: 2947815 - protein, 25 aa, Entamoeba invadens
KKKKEKLCWMKCTKIVCENEVEEIV

SEQ ID NO: 2947816 - protein, 24 aa, Entamoeba invadens
KKKKSVCHVVLMSDIVFFLLKKKQ

SEQ ID NO: 2947817 - protein, 23 aa, Entamoeba invadens
KKKLKEVNAMLSVKIATSTIDYQ

SEQ ID NO: 2947818 - protein, 24 aa, Entamoeba invadens
KKKLPKDVTAIICFALPEGKKEKN

SEQ ID NO: 2947819 - protein, 18 aa, Entamoeba invadens
KKKLSGKQQCVWGKMSFV

SEQ ID NO: 2947820 - protein, 25 aa, Entamoeba invadens
KKKMFKEAIECYNRAITLDKGNITY

SEQ ID NO: 2947821 - protein, 25 aa, Entamoeba invadens
KKKMGFFKEIWRRITPGHSPALSPK

SEQ ID NO: 2947822 - protein, 19 aa, Entamoeba invadens
KKKNDGMKRKEEWHPYLLF

SEQ ID NO: 2947823 - protein, 21 aa, Entamoeba invadens
KKKNVLSEWMVVCPGTRNEMA

SEQ ID NO: 2947824 - protein, 19 aa, Entamoeba invadens
KKKPDDFRKACQYNLVNDG

SEQ ID NO: 2947825 - protein, 20 aa, Entamoeba invadens
KKKPDSFVNMDIPLNNYVMD

SEQ ID NO: 2947826 - protein, 19 aa, Entamoeba invadens
KKKPFARLVECSWMSLNSG

SEQ ID NO: 2947827 - protein, 20 aa, Entamoeba invadens
KKKPGCSGRVRLDHTKKELD

SEQ ID NO: 2947828 - protein, 19 aa, Entamoeba invadens
KKKPLMLVWENLDPLGKNI

SEQ ID NO: 2947829 - protein, 17 aa, Entamoeba invadens
KKKQLKEQALQIIDEAL

SEQ ID NO: 2947830 - protein, 26 aa, Entamoeba invadens
KKKSGDISFRISIEVDNSARIKVYGE

SEQ ID NO: 2947831 - protein, 21 aa, Entamoeba invadens
KKKSGGFGDFVIRKINNKIPE

SEQ ID NO: 2947832 - protein, 25 aa, Entamoeba invadens
KKKSRKSVTITICFNTVATVGLTGE

SEQ ID NO: 2947833 - protein, 22 aa, Entamoeba invadens
KKKVAMKVNITFDVEVKKKDDN

SEQ ID NO: 2947834 - protein, 23 aa, Entamoeba invadens
KKKVEKHVICFQILEASPINLCS

SEQ ID NO: 2947835 - protein, 21 aa, Entamoeba invadens
KKKYAYLDVDAVDKLHRDNTK

SEQ ID NO: 2947836 - protein, 18 aa, Entamoeba invadens
KKKYLSFLSEDYRASIIM

SEQ ID NO: 2947837 - protein, 20 aa, Entamoeba invadens
KKKYNVIFNSKFDGLNRETF

SEQ ID NO: 2947838 - protein, 25 aa, Entamoeba invadens
KKLAFEFPSKYFSDAVTNDINNTEN

SEQ ID NO: 2947839 - protein, 20 aa, Entamoeba invadens
KKLCDNSMKQIVDQYSEQLS

SEQ ID NO: 2947840 - protein, 25 aa, Entamoeba invadens
KKLCIRYRFVKGMVETFYICHTCNV

SEQ ID NO: 2947841 - protein, 20 aa, Entamoeba invadens
KKLDEELRLLNLKEDGNGKE

SEQ ID NO: 2947842 - protein, 19 aa, Entamoeba invadens
KKLDFGRVINDYCEKQFKT

SEQ ID NO: 2947843 - protein, 23 aa, Entamoeba invadens
KKLDQIKETFLYRPNTLQRETQT

SEQ ID NO: 2947844 - protein, 20 aa, Entamoeba invadens
KKLDQQVCLGEMSSVDSFKK

SEQ ID NO: 2947845 - protein, 17 aa, Entamoeba invadens
KKLEDDFQVELSKIEKI

SEQ ID NO: 2947846 - protein, 20 aa, Entamoeba invadens
KKLELAHAMVELSEENIELN

SEQ ID NO: 2947847 - protein, 20 aa, Entamoeba invadens
KKLESLIACKEKIQKTEIEF

SEQ ID NO: 2947848 - protein, 22 aa, Entamoeba invadens
KKLETFELLDAIQLNQIVVELK

SEQ ID NO: 2947849 - protein, 26 aa, Entamoeba invadens
KKLFFKTVAVSYAFYLQMKAFGYTFY

SEQ ID NO: 2947850 - protein, 20 aa, Entamoeba invadens
KKLFFKTVAVSYEFYLQMKA

SEQ ID NO: 2947851 - protein, 17 aa, Entamoeba invadens
KKLFPTLTLRDFTQLID

SEQ ID NO: 2947852 - protein, 17 aa, Entamoeba invadens
KKLGLGEKFVFDNNTWF

SEQ ID NO: 2947853 - protein, 24 aa, Entamoeba invadens
KKLIEIGEFAFARCESLENFDFNE

SEQ ID NO: 2947854 - protein, 19 aa, Entamoeba invadens
KKLIKVCYPKMVMLTPSYW

SEQ ID NO: 2947855 - protein, 22 aa, Entamoeba invadens
KKLILKKCSGVKMATNVEIGEF

SEQ ID NO: 2947856 - protein, 19 aa, Entamoeba invadens
KKLILLMTFTTFKRTIPSP

SEQ ID NO: 2947857 - protein, 20 aa, Entamoeba invadens
KKLIWKGRCFILEEESLHQH

SEQ ID NO: 2947858 - protein, 23 aa, Entamoeba invadens
KKLKHLKPTSVVFLKKENLDDPS

SEQ ID NO: 2947859 - protein, 21 aa, Entamoeba invadens
KKLKIRLCGSESNWDLFKLWT

SEQ ID NO: 2947860 - protein, 19 aa, Entamoeba invadens
KKLKKKKKEKAVPFIDDRE

SEQ ID NO: 2947861 - protein, 27 aa, Entamoeba invadens
KKLKKSKGAGCYLCGNTGHNGRDCPDA

SEQ ID NO: 2947862 - protein, 22 aa, Entamoeba invadens
KKLKPSRRNLLKKLQNEKREAA

SEQ ID NO: 2947863 - protein, 23 aa, Entamoeba invadens
KKLKSRVYKGVPLPSRADYWKLV

SEQ ID NO: 2947864 - protein, 21 aa, Entamoeba invadens
KKLKTLSFKALPKILEVNETG

SEQ ID NO: 2947865 - protein, 21 aa, Entamoeba invadens
KKLKYRMSVSYDNVHKMTRRS

SEQ ID NO: 2947866 - protein, 19 aa, Entamoeba invadens
KKLLLAMIHTMPNKAQNII

SEQ ID NO: 2947867 - protein, 30 aa, Entamoeba invadens
KKLLREFLIEKCVNFADAAREAANRRGAGN

SEQ ID NO: 2947868 - protein, 28 aa, Entamoeba invadens
KKLMCKECACPKCKECGKSIEGKIIRVD

SEQ ID NO: 2947869 - protein, 20 aa, Entamoeba invadens
KKLNHASVFEIDRYASVVHT

SEQ ID NO: 2947870 - protein, 17 aa, Entamoeba invadens
KKLNIVYTNNCDIFVNK

SEQ ID NO: 2947871 - protein, 20 aa, Entamoeba invadens
KKLPAALEFYDRKIKFVEEQ

SEQ ID NO: 2947872 - protein, 19 aa, Entamoeba invadens
KKLPENSMMMCEGKIICRN

SEQ ID NO: 2947873 - protein, 18 aa, Entamoeba invadens
KKLPKIGVTTLLKKLTNP

SEQ ID NO: 2947874 - protein, 26 aa, Entamoeba invadens
KKLPMKVRVSESFIACNALSEESAPS

SEQ ID NO: 2947875 - protein, 19 aa, Entamoeba invadens
KKLPQDILEKCNTSGVPIV

SEQ ID NO: 2947876 - protein, 19 aa, Entamoeba invadens
KKLPTEKVSELPAWTKPKP

SEQ ID NO: 2947877 - protein, 21 aa, Entamoeba invadens
KKLQYEYDQLINLVSGHEDET

SEQ ID NO: 2947878 - protein, 21 aa, Entamoeba invadens
KKLRDGIQFECHFAPVEVKSN

SEQ ID NO: 2947879 - protein, 23 aa, Entamoeba invadens
KKLRPRRGRKAKKEVIEEVSDEE

SEQ ID NO: 2947880 - protein, 22 aa, Entamoeba invadens
KKLRRLTLPQFAPWRQTTQERI

SEQ ID NO: 2947881 - protein, 19 aa, Entamoeba invadens
KKLSGMRADYFFVSKECEN

SEQ ID NO: 2947882 - protein, 20 aa, Entamoeba invadens
KKLSKIVFPPTVNFVGENCL

SEQ ID NO: 2947883 - protein, 26 aa, Entamoeba invadens
KKLSSIRLLLIPSYNIKISNFELKKR

SEQ ID NO: 2947884 - protein, 25 aa, Entamoeba invadens
KKLSSIRLLLIPSYNIKISNFELKR

SEQ ID NO: 2947885 - protein, 25 aa, Entamoeba invadens
KKLSSIRLLYIPSYNIKISNFELKK

SEQ ID NO: 2947886 - protein, 17 aa, Entamoeba invadens
KKLSTTVTRMANLKPIF

SEQ ID NO: 2947887 - protein, 19 aa, Entamoeba invadens
KKLTELNEQLDLERITAQQ

SEQ ID NO: 2947888 - protein, 18 aa, Entamoeba invadens
KKLTELNEQLDLERTTAQ

SEQ ID NO: 2947889 - protein, 18 aa, Entamoeba invadens
KKLTELNEQLDLERTTDQ

SEQ ID NO: 2947890 - protein, 23 aa, Entamoeba invadens
KKLTELNEQLGLEKKTVQQAKAQ

SEQ ID NO: 2947891 - protein, 17 aa, Entamoeba invadens
KKLTIRNAVKIRLEDEG

SEQ ID NO: 2947892 - protein, 24 aa, Entamoeba invadens
KKLTSIWYLREAVLALAANLNVSG

SEQ ID NO: 2947893 - protein, 25 aa, Entamoeba invadens
KKLTVKKCIANIFLIPEKCFGGIDV

SEQ ID NO: 2947894 - protein, 20 aa, Entamoeba invadens
KKLVELMGIPAIEANCEAEG

SEQ ID NO: 2947895 - protein, 18 aa, Entamoeba invadens
KKLVSLLTTCHYKDNVVA

SEQ ID NO: 2947896 - protein, 19 aa, Entamoeba invadens
KKLVSRIGECDEFVVVMSG

SEQ ID NO: 2947897 - protein, 20 aa, Entamoeba invadens
KKLWHYTRAVFREKYSPLLL

SEQ ID NO: 2947898 - protein, 22 aa, Entamoeba invadens
KKLYFNAACEMLGKVYPISKEC

SEQ ID NO: 2947899 - protein, 19 aa, Entamoeba invadens
KKLYSVVVHFNVKFDDIQK

SEQ ID NO: 2947900 - protein, 29 aa, Entamoeba invadens
KKMDEFRKEVAMLAKFVSPYLIRFYGACF

SEQ ID NO: 2947901 - protein, 19 aa, Entamoeba invadens
KKMDLWCANKVLVIHLKRF

SEQ ID NO: 2947902 - protein, 20 aa, Entamoeba invadens
KKMERAACKIRECVKSKLLT

SEQ ID NO: 2947903 - protein, 19 aa, Entamoeba invadens
KKMFEAFNVVSAHVATFKY

SEQ ID NO: 2947904 - protein, 20 aa, Entamoeba invadens
KKMGEIDISLAFSITPNDET

SEQ ID NO: 2947905 - protein, 21 aa, Entamoeba invadens
KKMILEMIPTYFGNECIDGTT

SEQ ID NO: 2947906 - protein, 21 aa, Entamoeba invadens
KKMKDGLFFAFDFGGGTLDTT

SEQ ID NO: 2947907 - protein, 17 aa, Entamoeba invadens
KKMKEDHPVVVIEENSD

SEQ ID NO: 2947908 - protein, 18 aa, Entamoeba invadens
KKMKLCGIEDTIEEFEKE

SEQ ID NO: 2947909 - protein, 22 aa, Entamoeba invadens
KKMKLPRFTINMVLKPITNTVL

SEQ ID NO: 2947910 - protein, 23 aa, Entamoeba invadens
KKMKVICPHITFSSRDLQNGFSY

SEQ ID NO: 2947911 - protein, 19 aa, Entamoeba invadens
KKMMLVRWIESMVGVGIDP

SEQ ID NO: 2947912 - protein, 23 aa, Entamoeba invadens
KKMNKICAVGGKTTMTLVEISEI

SEQ ID NO: 2947913 - protein, 18 aa, Entamoeba invadens
KKMQAVDGISKFEQIVLE

SEQ ID NO: 2947914 - protein, 19 aa, Entamoeba invadens
KKMSRLVSVSKLIAPTNSI

SEQ ID NO: 2947915 - protein, 27 aa, Entamoeba invadens
KKMTEPEFLGLFTPFGPISRHNFHVSD

SEQ ID NO: 2947916 - protein, 27 aa, Entamoeba invadens
KKMTKVMRATENWKRRVSGKEEILFGD

SEQ ID NO: 2947917 - protein, 18 aa, Entamoeba invadens
KKMVGIIHEGVWKPGMDA

SEQ ID NO: 2947918 - protein, 28 aa, Entamoeba invadens
KKNARISIPPQFRRKSSHKLMRQDTPLI

SEQ ID NO: 2947919 - protein, 18 aa, Entamoeba invadens
KKNAVVLSGYEIESIGKF

SEQ ID NO: 2947920 - protein, 20 aa, Entamoeba invadens
KKNCPEKDPAVPQVLKHKKT

SEQ ID NO: 2947921 - protein, 27 aa, Entamoeba invadens
KKNECKTCVLCGGIFSMGNRKRHCAMC

SEQ ID NO: 2947922 - protein, 29 aa, Entamoeba invadens
KKNEKGGCLCNNFIPLFVIFDQLYHGLLF

SEQ ID NO: 2947923 - protein, 21 aa, Entamoeba invadens
KKNEVIRKCHFLTKEEVAQMP

SEQ ID NO: 2947924 - protein, 20 aa, Entamoeba invadens
KKNFDFMKKIYLYVRPNTRF

SEQ ID NO: 2947925 - protein, 20 aa, Entamoeba invadens
KKNFDSYALYISRVLRSVFP

SEQ ID NO: 2947926 - protein, 25 aa, Entamoeba invadens
KKNGTKRLPLVFVVTNITPGVDGKE

SEQ ID NO: 2947927 - protein, 17 aa, Entamoeba invadens
KKNIKFYTIDAIKIGQE

SEQ ID NO: 2947928 - protein, 19 aa, Entamoeba invadens
KKNILLRFFDVGLQTYVYI

SEQ ID NO: 2947929 - protein, 30 aa, Entamoeba invadens
KKNKNVRCSLDILNCRKVVLLNTKYNNITI

SEQ ID NO: 2947930 - protein, 25 aa, Entamoeba invadens
KKNKRIQMKLNFIMDRSCKVKQDLR

SEQ ID NO: 2947931 - protein, 17 aa, Entamoeba invadens
KKNLVVCKRVVFEQNDV

SEQ ID NO: 2947932 - protein, 18 aa, Entamoeba invadens
KKNMELTEMYDSLMDENK

SEQ ID NO: 2947933 - protein, 20 aa, Entamoeba invadens
KKNMERRLPSELYVPRTSHS

SEQ ID NO: 2947934 - protein, 24 aa, Entamoeba invadens
KKNNEKINDWGFVMVENENGWKAE

SEQ ID NO: 2947935 - protein, 19 aa, Entamoeba invadens
KKNQHSISVNISARKEEDV

SEQ ID NO: 2947936 - protein, 22 aa, Entamoeba invadens
KKNSFRKAQMFMEFSQKEKILN

SEQ ID NO: 2947937 - protein, 18 aa, Entamoeba invadens
KKNTRLAMIHKLTNLVKE

SEQ ID NO: 2947938 - protein, 21 aa, Entamoeba invadens
KKNVATCFVCGSYDHKSMDCP

SEQ ID NO: 2947939 - protein, 31 aa, Entamoeba invadens
KKPAEFWRAHVLDLPKLCGLAKNYYSVKARC

SEQ ID NO: 2947940 - protein, 29 aa, Entamoeba invadens
KKPDEKPQRPAGCDGKGGCGCGHTCGGCK

SEQ ID NO: 2947941 - protein, 28 aa, Entamoeba invadens
KKPFAPSFHKSHPFCLEEIYGDEENSDS

SEQ ID NO: 2947942 - protein, 19 aa, Entamoeba invadens
KKPFSCYHNSFLNLAIGYL

SEQ ID NO: 2947943 - protein, 20 aa, Entamoeba invadens
KKPFTPIWTKSGLKALKEYK

SEQ ID NO: 2947944 - protein, 17 aa, Entamoeba invadens
KKPIAFSPLQNCVEDYD

SEQ ID NO: 2947945 - protein, 19 aa, Entamoeba invadens
KKPIPPFILYNNRTLEEIL

SEQ ID NO: 2947946 - protein, 20 aa, Entamoeba invadens
KKPIWPIELFEDLIAITQDH

SEQ ID NO: 2947947 - protein, 20 aa, Entamoeba invadens
KKPLCTKMVYSQCEKYTIDL

SEQ ID NO: 2947948 - protein, 20 aa, Entamoeba invadens
KKPLESAGFAQYVDGDNDDD

SEQ ID NO: 2947949 - protein, 18 aa, Entamoeba invadens
KKPLESYHNSFLNLAIGY

SEQ ID NO: 2947950 - protein, 18 aa, Entamoeba invadens
KKPLHCVYCKLRRHVNSS

SEQ ID NO: 2947951 - protein, 18 aa, Entamoeba invadens
KKPLIVILANKSDLEETV

SEQ ID NO: 2947952 - protein, 19 aa, Entamoeba invadens
KKPMEVMLIMYDKMLIVCE

SEQ ID NO: 2947953 - protein, 18 aa, Entamoeba invadens
KKPMEYLSVEAMNDDTIA

SEQ ID NO: 2947954 - protein, 20 aa, Entamoeba invadens
KKPMGRGRAETCFEMGDNSG

SEQ ID NO: 2947955 - protein, 23 aa, Entamoeba invadens
  misc_feature (17)..(18): Xaa can be any naturally occurring amino acid
KKPMGRGRAETCLRWGXXSTTDY

SEQ ID NO: 2947956 - protein, 19 aa, Entamoeba invadens
KKPNCKGKIRLDHTRRILD

SEQ ID NO: 2947957 - protein, 21 aa, Entamoeba invadens
KKPQGVVGFIVKIELDDSGDM

SEQ ID NO: 2947958 - protein, 20 aa, Entamoeba invadens
KKPQICTSINKSILELKRSS

SEQ ID NO: 2947959 - protein, 20 aa, Entamoeba invadens
KKPTSLIFIREFRVPVNAFV

SEQ ID NO: 2947960 - protein, 24 aa, Entamoeba invadens
KKPTTKSNNDWGFDYDSGASGSSA

SEQ ID NO: 2947961 - protein, 21 aa, Entamoeba invadens
KKQAEEWGNIPFFETSAQNNI

SEQ ID NO: 2947962 - protein, 24 aa, Entamoeba invadens
KKQAELDVANYYRQFVLDTKNDTL

SEQ ID NO: 2947963 - protein, 19 aa, Entamoeba invadens
KKQAKQYARKVEEAERKLA

SEQ ID NO: 2947964 - protein, 24 aa, Entamoeba invadens
KKQEERWMIPKCVNTLVVSTAGFV

SEQ ID NO: 2947965 - protein, 23 aa, Entamoeba invadens
KKQEVLKNFVEWVKNSIEFIDSF

SEQ ID NO: 2947966 - protein, 23 aa, Entamoeba invadens
KKQFLSVGICDKVLNLVTRMPTQ

SEQ ID NO: 2947967 - protein, 21 aa, Entamoeba invadens
KKQFPCLFNLVKKMNARVQPL

SEQ ID NO: 2947968 - protein, 24 aa, Entamoeba invadens
KKQIFPACYTLLSKRDEQWVFERN

SEQ ID NO: 2947969 - protein, 19 aa, Entamoeba invadens
KKQKIRFVITQKLSEAFYR

SEQ ID NO: 2947970 - protein, 17 aa, Entamoeba invadens
KKQKIVLVIPHREKDYP

SEQ ID NO: 2947971 - protein, 38 aa, Entamoeba invadens
KKQKKRLECELDQLEECCVFRSNVIMEMCEQTINALST

SEQ ID NO: 2947972 - protein, 23 aa, Entamoeba invadens
KKQKYTIQWMVEFKDVTLIELKS

SEQ ID NO: 2947973 - protein, 26 aa, Entamoeba invadens
KKQLAKCGMGLQMKREIEMQSHLNHP

SEQ ID NO: 2947974 - protein, 17 aa, Entamoeba invadens
KKQMLYFRLFDDAWLFA

SEQ ID NO: 2947975 - protein, 25 aa, Entamoeba invadens
KKQNEWNHKCVMCTANMGKFSSDRS

SEQ ID NO: 2947976 - protein, 22 aa, Entamoeba invadens
KKQRNDFLFLFVNELQRSLMAC

SEQ ID NO: 2947977 - protein, 21 aa, Entamoeba invadens
KKQSVSWLIGKVVKRREGEWK

SEQ ID NO: 2947978 - protein, 37 aa, Entamoeba invadens
KKQTKEVFCTTQIIVVLKLRYTNPMSIDVTSMGTTTP

SEQ ID NO: 2947979 - protein, 19 aa, Entamoeba invadens
KKQWVVKAKSIWENIQRNK

SEQ ID NO: 2947980 - protein, 17 aa, Entamoeba invadens
KKRCNTILSGTESEFSP

SEQ ID NO: 2947981 - protein, 20 aa, Entamoeba invadens
KKREAVWRKGNLVDTIDSII

SEQ ID NO: 2947982 - protein, 24 aa, Entamoeba invadens
KKREFLTRFKAEFDSIKNEKEERT

SEQ ID NO: 2947983 - protein, 19 aa, Entamoeba invadens
KKRFKSYIKAIPKAQITPI

SEQ ID NO: 2947984 - protein, 21 aa, Entamoeba invadens
KKRFWRETYGGAKLFMMSELY

SEQ ID NO: 2947985 - protein, 17 aa, Entamoeba invadens
KKRFYGTHKVSPPTIDI

SEQ ID NO: 2947986 - protein, 17 aa, Entamoeba invadens
KKRGLHTLIRLKKQKAK

SEQ ID NO: 2947987 - protein, 19 aa, Entamoeba invadens
KKRIEEFNNNVAIYDDMLR

SEQ ID NO: 2947988 - protein, 30 aa, Entamoeba invadens
KKRILKILFLETISSFLMNKVMIRKFCDFE

SEQ ID NO: 2947989 - protein, 18 aa, Entamoeba invadens
KKRIRIIEHIVDIAYESY

SEQ ID NO: 2947990 - protein, 20 aa, Entamoeba invadens
KKRIVLKDSYSMISNKLSDF

SEQ ID NO: 2947991 - protein, 19 aa, Entamoeba invadens
KKRKEVFDMLRLNSYLQYK

SEQ ID NO: 2947992 - protein, 30 aa, Entamoeba invadens
KKRKSKKTECPFRINLNFKAKLGKWKITKM

SEQ ID NO: 2947993 - protein, 23 aa, Entamoeba invadens
KKRLEPFYLMNVVLYIDSFNTLQ

SEQ ID NO: 2947994 - protein, 17 aa, Entamoeba invadens
KKRLPLEKIDLTGAKFG

SEQ ID NO: 2947995 - protein, 19 aa, Entamoeba invadens
KKRNAMIMRGFSVESLAEH

SEQ ID NO: 2947996 - protein, 20 aa, Entamoeba invadens
KKRQFEFVDLIFGFHQNFMR

SEQ ID NO: 2947997 - protein, 18 aa, Entamoeba invadens
KKRRSLRFYEALGKNVNG

SEQ ID NO: 2947998 - protein, 21 aa, Entamoeba invadens
KKRSRVSVCFGATNVSKPVMY

SEQ ID NO: 2947999 - protein, 22 aa, Entamoeba invadens
KKRSTVALQVFHIGVLKRGEDV

SEQ ID NO: 2948000 - protein, 20 aa, Entamoeba invadens
KKRVFNCFVVGGVDNSLSLW

SEQ ID NO: 2948001 - protein, 19 aa, Entamoeba invadens
KKRVLAVKFVKVIVLDEAD

SEQ ID NO: 2948002 - protein, 19 aa, Entamoeba invadens
KKRVWGLRMKDCCVENTDG

SEQ ID NO: 2948003 - protein, 18 aa, Entamoeba invadens
KKRYHIIEYITVFHKRSI

SEQ ID NO: 2948004 - protein, 18 aa, Entamoeba invadens
KKSDILEFYEECADDKNY

SEQ ID NO: 2948005 - protein, 18 aa, Entamoeba invadens
KKSDKCAQFNVSIVFTPV

SEQ ID NO: 2948006 - protein, 19 aa, Entamoeba invadens
KKSDNIMDFFSSVPSSTTP

SEQ ID NO: 2948007 - protein, 21 aa, Entamoeba invadens
KKSDYLWTLFFNDLSLFDARR

SEQ ID NO: 2948008 - protein, 25 aa, Entamoeba invadens
KKSECKTNVGSIHFESVVRGKYTVK

SEQ ID NO: 2948009 - protein, 23 aa, Entamoeba invadens
KKSEETWMPYYLYHLKNINPNIV

SEQ ID NO: 2948010 - protein, 20 aa, Entamoeba invadens
KKSELLKSTFEELVKSYITT

SEQ ID NO: 2948011 - protein, 23 aa, Entamoeba invadens
KKSEVMRLTLLIGEPPSAVSKNS

SEQ ID NO: 2948012 - protein, 24 aa, Entamoeba invadens
KKSFHKKKGWKRLAEREPKVKENP

SEQ ID NO: 2948013 - protein, 17 aa, Entamoeba invadens
KKSFKLAENVLLAHKLK

SEQ ID NO: 2948014 - protein, 26 aa, Entamoeba invadens
KKSFLNIVTVMWDWPKESIQRLNSVL

SEQ ID NO: 2948015 - protein, 28 aa, Entamoeba invadens
KKSFQCVSLDLIGYFSRLEKLETLNTLV

SEQ ID NO: 2948016 - protein, 19 aa, Entamoeba invadens
KKSGLDILLDPNFDELDYE

SEQ ID NO: 2948017 - protein, 19 aa, Entamoeba invadens
KKSGNPFGVDSDDEDTKPT

SEQ ID NO: 2948018 - protein, 18 aa, Entamoeba invadens
KKSGVFFTTLIKQKVNGV

SEQ ID NO: 2948019 - protein, 20 aa, Entamoeba invadens
KKSGVGVAMGNAFDSVKEKA

SEQ ID NO: 2948020 - protein, 24 aa, Entamoeba invadens
KKSHLLYFIFSRDTIFGMWMGFPV

SEQ ID NO: 2948021 - protein, 21 aa, Entamoeba invadens
KKSIGSFEWVDGIVVKCMKRG

SEQ ID NO: 2948022 - protein, 33 aa, Entamoeba invadens
KKSIIKRTGCDLSKCRLNVVLTCPAYFNDLQRD

SEQ ID NO: 2948023 - protein, 18 aa, Entamoeba invadens
KKSILKKYFGKVLPNLSE

SEQ ID NO: 2948024 - protein, 21 aa, Entamoeba invadens
KKSKFDALFVIRRLEATLWYK

SEQ ID NO: 2948025 - protein, 17 aa, Entamoeba invadens
KKSKLAYHEQFVLMLTF

SEQ ID NO: 2948026 - protein, 23 aa, Entamoeba invadens
KKSKSMKSFSVFSGSNPIILSCF

SEQ ID NO: 2948027 - protein, 32 aa, Entamoeba invadens
KKSKWIVPNCIYRCVEYLKKHGKNCEGLFRKN

SEQ ID NO: 2948028 - protein, 26 aa, Entamoeba invadens
KKSLMCGHYFLTPLVVKFSPPFTFVN

SEQ ID NO: 2948029 - protein, 20 aa, Entamoeba invadens
KKSLTVEYVIPIGSFCVLDS

SEQ ID NO: 2948030 - protein, 23 aa, Entamoeba invadens
KKSMEVPLNFTRLVVSRAEKVII

SEQ ID NO: 2948031 - protein, 21 aa, Entamoeba invadens
KKSQASGFCYINDIVCAILEL

SEQ ID NO: 2948032 - protein, 21 aa, Entamoeba invadens
KKSQVKWTFLINKSTPLTVKE

SEQ ID NO: 2948033 - protein, 20 aa, Entamoeba invadens
KKSRLNDYNTRCGLNHDINS

SEQ ID NO: 2948034 - protein, 27 aa, Entamoeba invadens
KKSRWRVPNVVYRCIEFMQKKNADQLE

SEQ ID NO: 2948035 - protein, 28 aa, Entamoeba invadens
KKSRYDLQYIFKQCDYYTLMADSAMYVG

SEQ ID NO: 2948036 - protein, 32 aa, Entamoeba invadens
KKSSESYNILKLCVSRILDCISVNTNLVPNEY

SEQ ID NO: 2948037 - protein, 23 aa, Entamoeba invadens
KKSSFKVSFNFESTLYPKNKYLY

SEQ ID NO: 2948038 - protein, 24 aa, Entamoeba invadens
KKSSVIKVKVLVSGFNDDDDKPVN

SEQ ID NO: 2948039 - protein, 33 aa, Entamoeba invadens
KKSTLALIFQLILRYRLFNIKFKMTDFSHWIYS

SEQ ID NO: 2948040 - protein, 22 aa, Entamoeba invadens
KKSVAAALRIVRKCPDLGEQYI

SEQ ID NO: 2948041 - protein, 19 aa, Entamoeba invadens
KKSVIEWQYPYVIANAKSS

SEQ ID NO: 2948042 - protein, 19 aa, Entamoeba invadens
KKSVLSIPFAEGGGCNIIV

SEQ ID NO: 2948043 - protein, 17 aa, Entamoeba invadens
KKSWKHHTLSLSVEPSD

SEQ ID NO: 2948044 - protein, 24 aa, Entamoeba invadens
KKTDPSNVVSLDYLLKFEKAEQAV

SEQ ID NO: 2948045 - protein, 18 aa, Entamoeba invadens
KKTEKAVMFGLNALINLC

SEQ ID NO: 2948046 - protein, 25 aa, Entamoeba invadens
KKTEKCRKCGMYFPSNELKTHKFLC

SEQ ID NO: 2948047 - protein, 17 aa, Entamoeba invadens
KKTFFTLQFMKVTKIVF

SEQ ID NO: 2948048 - protein, 18 aa, Entamoeba invadens
KKTFGLSYVTSGFGMTEL

SEQ ID NO: 2948049 - protein, 29 aa, Entamoeba invadens
KKTFKAYPMVRWFWMVEYSGGYFGFQTIF

SEQ ID NO: 2948050 - protein, 38 aa, Entamoeba invadens
KKTGDSFWRFCLFLRKLCENIRVGRIFQEKLITGVGYI

SEQ ID NO: 2948051 - protein, 20 aa, Entamoeba invadens
KKTHFTEEFILKEEKERQRS

SEQ ID NO: 2948052 - protein, 20 aa, Entamoeba invadens
KKTHYLPLFPSKPHPKQQKA

SEQ ID NO: 2948053 - protein, 21 aa, Entamoeba invadens
KKTICYHIALPTFLGKFDAKK

SEQ ID NO: 2948054 - protein, 21 aa, Entamoeba invadens
KKTKIGLLICDEGHRIKNLMT

SEQ ID NO: 2948055 - protein, 20 aa, Entamoeba invadens
KKTKIGVRGGFPHGFNPADI

SEQ ID NO: 2948056 - protein, 23 aa, Entamoeba invadens
KKTKRIDRILCVFFNGTFIFTQE

SEQ ID NO: 2948057 - protein, 23 aa, Entamoeba invadens
KKTLEYIKFVLKSVSLQPSYLLC

SEQ ID NO: 2948058 - protein, 21 aa, Entamoeba invadens
KKTLPFTYGYILEHIVMNMYG

SEQ ID NO: 2948059 - protein, 24 aa, Entamoeba invadens
KKTLRMSYTVTFVFNPNPYLLHTT

SEQ ID NO: 2948060 - protein, 19 aa, Entamoeba invadens
KKTLSRWTDKRMFKVIYNS

SEQ ID NO: 2948061 - protein, 17 aa, Entamoeba invadens
KKTMAWCDQHWYNYGGR

SEQ ID NO: 2948062 - protein, 19 aa, Entamoeba invadens
KKTMIGLLISHNFNMGINL

SEQ ID NO: 2948063 - protein, 25 aa, Entamoeba invadens
KKTMSRSQMGLPLPNKNFLQNFNVT

SEQ ID NO: 2948064 - protein, 25 aa, Entamoeba invadens
KKTNKLRYFYLFNDLMIYGIGNQRI

SEQ ID NO: 2948065 - protein, 21 aa, Entamoeba invadens
KKTNVLYLFGTGFCWGVVEDN

SEQ ID NO: 2948066 - protein, 28 aa, Entamoeba invadens
KKTSVSWKECKTIKCGEKVEKLVVKSCE

SEQ ID NO: 2948067 - protein, 22 aa, Entamoeba invadens
KKVAKKFERCQEVFFETKELNL

SEQ ID NO: 2948068 - protein, 17 aa, Entamoeba invadens
KKVDVWSAGVIAYQLIT

SEQ ID NO: 2948069 - protein, 24 aa, Entamoeba invadens
KKVEQPKSSWFGWGSKPLPQPEEE

SEQ ID NO: 2948070 - protein, 21 aa, Entamoeba invadens
KKVEVVLGVPFIYLTKVQQIL

SEQ ID NO: 2948071 - protein, 29 aa, Entamoeba invadens
KKVEVWCRKGGVELVDFSFCHKPYVSHSF

SEQ ID NO: 2948072 - protein, 24 aa, Entamoeba invadens
KKVIERLMKCWILYNQDGGYQQGM

SEQ ID NO: 2948073 - protein, 25 aa, Entamoeba invadens
KKVITEFLGKIGWKESAINFMEKYD

SEQ ID NO: 2948074 - protein, 23 aa, Entamoeba invadens
KKVKACGIHGGMRQDERTKALET

SEQ ID NO: 2948075 - protein, 17 aa, Entamoeba invadens
KKVKELTEENAKEELRL

SEQ ID NO: 2948076 - protein, 25 aa, Entamoeba invadens
KKVKEWCIIPLYKLVMHDDHEIRKS

SEQ ID NO: 2948077 - protein, 22 aa, Entamoeba invadens
KKVKFSFKNEVMMFEQAFQNFV

SEQ ID NO: 2948078 - protein, 23 aa, Entamoeba invadens
KKVKIVLQHKMDWLRQSKATLQD

SEQ ID NO: 2948079 - protein, 18 aa, Entamoeba invadens
KKVKLRELFEKATIPAKS

SEQ ID NO: 2948080 - protein, 28 aa, Entamoeba invadens
KKVKRAHLTERLIRIQSISKQNTTYDKQ

SEQ ID NO: 2948081 - protein, 24 aa, Entamoeba invadens
KKVKRVKCSDVLKNVKMCVEEVKS

SEQ ID NO: 2948082 - protein, 18 aa, Entamoeba invadens
KKVLEMVNAVLPPLQESV

SEQ ID NO: 2948083 - protein, 17 aa, Entamoeba invadens
KKVLEQFLKLDTKKVLP

SEQ ID NO: 2948084 - protein, 19 aa, Entamoeba invadens
KKVLEYDAPGILALATQMK

SEQ ID NO: 2948085 - protein, 18 aa, Entamoeba invadens
KKVLLPMCLSDFNENAFV

SEQ ID NO: 2948086 - protein, 19 aa, Entamoeba invadens
KKVLVCAPSNIAVDQLAAK

SEQ ID NO: 2948087 - protein, 21 aa, Entamoeba invadens
KKVNFRFCFNCKEAWHEGLTC

SEQ ID NO: 2948088 - protein, 20 aa, Entamoeba invadens
KKVNLFNFGKFVVRFYNIGD

SEQ ID NO: 2948089 - protein, 22 aa, Entamoeba invadens
KKVNMFLRWMIRKDSEVDFGIW

SEQ ID NO: 2948090 - protein, 27 aa, Entamoeba invadens
KKVNPNVCLFIKFDVFIPYSKCTSRAI

SEQ ID NO: 2948091 - protein, 21 aa, Entamoeba invadens
KKVNVYPSFLVVANKIDTNNR

SEQ ID NO: 2948092 - protein, 19 aa, Entamoeba invadens
KKVPCAGVILVSPKMDPAS

SEQ ID NO: 2948093 - protein, 17 aa, Entamoeba invadens
KKVPVDVQITFRSTKEA

SEQ ID NO: 2948094 - protein, 24 aa, Entamoeba invadens
KKVRARDSMFEMFQKFTMKEKKEE

SEQ ID NO: 2948095 - protein, 27 aa, Entamoeba invadens
KKVREKRGICLVNRLISMLSAFQAATT

SEQ ID NO: 2948096 - protein, 17 aa, Entamoeba invadens
KKVRGVCFSTKDTMKKL

SEQ ID NO: 2948097 - protein, 26 aa, Entamoeba invadens
KKVRKLREGSFGIVFKGTYRGNVVAI

SEQ ID NO: 2948098 - protein, 17 aa, Entamoeba invadens
KKVSAIFGCVTVMEGCI

SEQ ID NO: 2948099 - protein, 25 aa, Entamoeba invadens
KKVSGIERENWFVALGITKYDLIRT

SEQ ID NO: 2948100 - protein, 25 aa, Entamoeba invadens
KKVTAACPFNEFTYLSGSSDRTLHL

SEQ ID NO: 2948101 - protein, 18 aa, Entamoeba invadens
KKVTLVGGRYGLGSKEFT

SEQ ID NO: 2948102 - protein, 25 aa, Entamoeba invadens
KKVTRYCFSGAQFLQSVTFSNTLEK

SEQ ID NO: 2948103 - protein, 19 aa, Entamoeba invadens
KKVVFPSFFYKLNKRDIGT

SEQ ID NO: 2948104 - protein, 28 aa, Entamoeba invadens
KKVVKGNCVAQLLRMLTINAVRGDVLSM

SEQ ID NO: 2948105 - protein, 25 aa, Entamoeba invadens
KKVVSWQLLCRAVMYSLSVLNAPRL

SEQ ID NO: 2948106 - protein, 25 aa, Entamoeba invadens
KKVWESIPNFPFVCVEEMSIKNLRK

SEQ ID NO: 2948107 - protein, 19 aa, Entamoeba invadens
KKVYFWHEGLGFTFVHNGI

SEQ ID NO: 2948108 - protein, 21 aa, Entamoeba invadens
KKVYRKTVTIGYMPIMLQSKH

SEQ ID NO: 2948109 - protein, 19 aa, Entamoeba invadens
KKWDGEVLIIQFSETLESK

SEQ ID NO: 2948110 - protein, 17 aa, Entamoeba invadens
KKWKMYNNFPFPNVEEI

SEQ ID NO: 2948111 - protein, 27 aa, Entamoeba invadens
KKWPDYQLRPNFLIALVEAPSLFINHL

SEQ ID NO: 2948112 - protein, 28 aa, Entamoeba invadens
KKWPDYQLRPNFLITLVEAPSMFVGHED

SEQ ID NO: 2948113 - protein, 23 aa, Entamoeba invadens
KKYADGPFAIFLDVIEKNTQKPV

SEQ ID NO: 2948114 - protein, 21 aa, Entamoeba invadens
KKYDMSNFILAPQVVPEQPTI

SEQ ID NO: 2948115 - protein, 25 aa, Entamoeba invadens
KKYEEKRVIVLAGNKIDLGEGRVVT

SEQ ID NO: 2948116 - protein, 23 aa, Entamoeba invadens
KKYEIRLLGDLIIKIAKNSDVKT

SEQ ID NO: 2948117 - protein, 36 aa, Entamoeba invadens
KKYENVALCFKLIIKQCIFLCQMLRTSLKQCSLVNV

SEQ ID NO: 2948118 - protein, 18 aa, Entamoeba invadens
KKYHFLRMMSENFTEKLM

SEQ ID NO: 2948119 - protein, 32 aa, Entamoeba invadens
KKYHPDCFGCVKCSRKLGADFVTFDNLAYCKA

SEQ ID NO: 2948120 - protein, 19 aa, Entamoeba invadens
KKYIKVCDLDKLYDRIDLG

SEQ ID NO: 2948121 - protein, 24 aa, Entamoeba invadens
KKYITDWYASYRWGASVEPISDPT

SEQ ID NO: 2948122 - protein, 24 aa, Entamoeba invadens
KKYKAPWSRCLLFGSRGIKAKERY

SEQ ID NO: 2948123 - protein, 23 aa, Entamoeba invadens
KKYKCDRSRVDVMYKGKKYLNTF

SEQ ID NO: 2948124 - protein, 21 aa, Entamoeba invadens
KKYKCDRSRVDVVYKGKKYLN

SEQ ID NO: 2948125 - protein, 17 aa, Entamoeba invadens
KKYKFLLDRFRINPIRI

SEQ ID NO: 2948126 - protein, 22 aa, Entamoeba invadens
KKYKFSLHYAAVFEYGNILQHN

SEQ ID NO: 2948127 - protein, 19 aa, Entamoeba invadens
KKYKLIKKYLRFDDGAYLR

SEQ ID NO: 2948128 - protein, 20 aa, Entamoeba invadens
KKYKNYRVGAVQQKDIDTQQ

SEQ ID NO: 2948129 - protein, 25 aa, Entamoeba invadens
KKYKQKLEVCWRRSNGVVQMNGKYQ

SEQ ID NO: 2948130 - protein, 21 aa, Entamoeba invadens
KKYKRSCIFSQTGYTNGPWIS

SEQ ID NO: 2948131 - protein, 17 aa, Entamoeba invadens
KKYKVLDFDGVCSPGTK

SEQ ID NO: 2948132 - protein, 19 aa, Entamoeba invadens
KKYLCEKLGAVLWVLVEEE

SEQ ID NO: 2948133 - protein, 18 aa, Entamoeba invadens
KKYLCVHGGISDKLPTVE

SEQ ID NO: 2948134 - protein, 25 aa, Entamoeba invadens
KKYLEATNMVRICAQYFTKRISRNE

SEQ ID NO: 2948135 - protein, 20 aa, Entamoeba invadens
KKYLGDRGVNCTVLENGLNE

SEQ ID NO: 2948136 - protein, 21 aa, Entamoeba invadens
KKYLYCGNVVKEFITTEQTYC

SEQ ID NO: 2948137 - protein, 17 aa, Entamoeba invadens
KKYNENFGNGFIVNVED

SEQ ID NO: 2948138 - protein, 17 aa, Entamoeba invadens
KKYNVKFIRPLIDIPVV

SEQ ID NO: 2948139 - protein, 25 aa, Entamoeba invadens
KKYPSYKQFKGFNGFIAVVGDVLGL

SEQ ID NO: 2948140 - protein, 21 aa, Entamoeba invadens
KKYRIPTTVVFLSDLLNEFGV

SEQ ID NO: 2948141 - protein, 24 aa, Entamoeba invadens
KKYRNVIEKCWKQKIQKSGTINEI

SEQ ID NO: 2948142 - protein, 19 aa, Entamoeba invadens
KKYRQSFTLTTLAIGNVET

SEQ ID NO: 2948143 - protein, 18 aa, Entamoeba invadens
KKYSENFGNGFVVSVKNG

SEQ ID NO: 2948144 - protein, 17 aa, Entamoeba invadens
KKYSFIILNKKRTNQKI

SEQ ID NO: 2948145 - protein, 17 aa, Entamoeba invadens
KKYSFIILNKKRTSQKM

SEQ ID NO: 2948146 - protein, 32 aa, Entamoeba invadens
KKYSIHLLLKLGDAMILRFAIPSRKMTKEDLF

SEQ ID NO: 2948147 - protein, 19 aa, Entamoeba invadens
KKYTAIIYLMLRGGLKYDL

SEQ ID NO: 2948148 - protein, 25 aa, Entamoeba invadens
KKYTKLCQYLDAFTFAYGSITTAHA

SEQ ID NO: 2948149 - protein, 20 aa, Entamoeba invadens
KKYTLNFLVDFSMKDPLNVQ

SEQ ID NO: 2948150 - protein, 17 aa, Entamoeba invadens
KKYVGDFDIVFAAVKSK

SEQ ID NO: 2948151 - protein, 19 aa, Entamoeba invadens
KKYWKGNVTLFPVVFSSPV

SEQ ID NO: 2948152 - protein, 22 aa, Entamoeba invadens
KKYYADNAIRVLLAPQDVSLHE

SEQ ID NO: 2948153 - protein, 19 aa, Entamoeba invadens
KKYYAMKILRKDVVKERKQ

SEQ ID NO: 2948154 - protein, 24 aa, Entamoeba invadens
KKYYCDVCKVTLNGENEWKTHLIS

SEQ ID NO: 2948155 - protein, 22 aa, Entamoeba invadens
KKYYRIIVWFNVDFTIVDKNKK

SEQ ID NO: 2948156 - protein, 20 aa, Entamoeba invadens
KKYYSTLEMGYKNKELFSLD

SEQ ID NO: 2948157 - protein, 20 aa, Entamoeba invadens
KKYYYLVMELCDFTLAEYTE

SEQ ID NO: 2948158 - protein, 25 aa, Entamoeba invadens
KLAAYFKQVYIWQGGNDINCIVFGF

SEQ ID NO: 2948159 - protein, 19 aa, Entamoeba invadens
KLADAGATGAFIAKLKAKY

SEQ ID NO: 2948160 - protein, 20 aa, Entamoeba invadens
KLADNTEVFAKWRRGEKKEN

SEQ ID NO: 2948161 - protein, 18 aa, Entamoeba invadens
KLAEAGLNAVCCYYQEVE

SEQ ID NO: 2948162 - protein, 22 aa, Entamoeba invadens
KLAIPCRPIFTLKGSHDTHWFV

SEQ ID NO: 2948163 - protein, 19 aa, Entamoeba invadens
KLAIPEFVNDLSVSLFTDE

SEQ ID NO: 2948164 - protein, 26 aa, Entamoeba invadens
KLAKATVGMLCLKLSKQLVPFEGKNK

SEQ ID NO: 2948165 - protein, 20 aa, Entamoeba invadens
KLAKCGVIDRALKMLSLSSV

SEQ ID NO: 2948166 - protein, 30 aa, Entamoeba invadens
KLAKNDIVFLKGWIPVKINKFYNPMTDLTG

SEQ ID NO: 2948167 - protein, 19 aa, Entamoeba invadens
KLALANRVEKIYTQRIILF

SEQ ID NO: 2948168 - protein, 18 aa, Entamoeba invadens
KLAMWPKYNVYVADERYN

SEQ ID NO: 2948169 - protein, 25 aa, Entamoeba invadens
KLANLPKSLPFVLKIDSFKKGVFEF

SEQ ID NO: 2948170 - protein, 25 aa, Entamoeba invadens
KLANLPKSLPFVLKIDSFKKGVFTV

SEQ ID NO: 2948171 - protein, 19 aa, Entamoeba invadens
KLAPKYPATFEPFIYTIVD

SEQ ID NO: 2948172 - protein, 18 aa, Entamoeba invadens
KLARCSKCRGYMNKYNTL

SEQ ID NO: 2948173 - protein, 26 aa, Entamoeba invadens
KLASAWADLVNKYWGGHSYISPKSFK

SEQ ID NO: 2948174 - protein, 17 aa, Entamoeba invadens
KLASGKPIFIPQETCNK

SEQ ID NO: 2948175 - protein, 19 aa, Entamoeba invadens
KLASKWGVPFFEVSAKNNV

SEQ ID NO: 2948176 - protein, 28 aa, Entamoeba invadens
KLASSFPSLLIMKCFKSLETKEQREKGA

SEQ ID NO: 2948177 - protein, 23 aa, Entamoeba invadens
KLASTCFYGCISLTSISCNTNVV

SEQ ID NO: 2948178 - protein, 20 aa, Entamoeba invadens
KLATFGIIVGVACFDFDCFV

SEQ ID NO: 2948179 - protein, 24 aa, Entamoeba invadens
KLAVPLLLFHNGGNFNIDIDNQSV

SEQ ID NO: 2948180 - protein, 21 aa, Entamoeba invadens
KLCATCGKPITAGMVNALGKT

SEQ ID NO: 2948181 - protein, 24 aa, Entamoeba invadens
KLCATLCAAFDKLGVRQIKDDETL

SEQ ID NO: 2948182 - protein, 23 aa, Entamoeba invadens
KLCCYPSYDFVHCLVDSFEDITH

SEQ ID NO: 2948183 - protein, 17 aa, Entamoeba invadens
KLCDQAVDYEECFEDAV

SEQ ID NO: 2948184 - protein, 19 aa, Entamoeba invadens
KLCEMCADLSFKNIASCVY

SEQ ID NO: 2948185 - protein, 20 aa, Entamoeba invadens
KLCFGYCTMLSFIEIPTSVK

SEQ ID NO: 2948186 - protein, 19 aa, Entamoeba invadens
KLCHVALDFDEEIQRLPHH

SEQ ID NO: 2948187 - protein, 27 aa, Entamoeba invadens
KLCNLLKNIICLDEVVQSLVFGITSNL

SEQ ID NO: 2948188 - protein, 18 aa, Entamoeba invadens
KLCTKCYAPYIIDNDKFM

SEQ ID NO: 2948189 - protein, 19 aa, Entamoeba invadens
KLDAIGFSSCNERLTMQRA

SEQ ID NO: 2948190 - protein, 28 aa, Entamoeba invadens
KLDAYCREFYPKGAGVVMPKDANSYYVI

SEQ ID NO: 2948191 - protein, 25 aa, Entamoeba invadens
KLDEMKTFLDQMASKFSDLLIQNVD

SEQ ID NO: 2948192 - protein, 18 aa, Entamoeba invadens
KLDEVIVLLNIIKSSFPF

SEQ ID NO: 2948193 - protein, 20 aa, Entamoeba invadens
KLDGSLFQGKYLKVNKSTEK

SEQ ID NO: 2948194 - protein, 19 aa, Entamoeba invadens
KLDISMCNSLKTLILNNTP

SEQ ID NO: 2948195 - protein, 19 aa, Entamoeba invadens
KLDKKFHCALSDARNTALT

SEQ ID NO: 2948196 - protein, 19 aa, Entamoeba invadens
KLDLAQKCTHELSQIGYSH

SEQ ID NO: 2948197 - protein, 31 aa, Entamoeba invadens
KLDLQPNELPGFKTPFLSGVTATEPIQQPTQ

SEQ ID NO: 2948198 - protein, 21 aa, Entamoeba invadens
KLDNCNLLQHFAELDTNFSIQ

SEQ ID NO: 2948199 - protein, 21 aa, Entamoeba invadens
KLDNFYMPFFLQRADDPVPNV

SEQ ID NO: 2948200 - protein, 25 aa, Entamoeba invadens
KLDPFTFKLLLPRLVLSQNEQTELL

SEQ ID NO: 2948201 - protein, 20 aa, Entamoeba invadens
KLDPSLLITHRFEGLEKVED

SEQ ID NO: 2948202 - protein, 18 aa, Entamoeba invadens
KLDQIRFDLAKQSKEENV

SEQ ID NO: 2948203 - protein, 25 aa, Entamoeba invadens
KLDTKLKFVEFLNEALVGNSVLMTV

SEQ ID NO: 2948204 - protein, 17 aa, Entamoeba invadens
KLEAIKTVWDVKRIREM

SEQ ID NO: 2948205 - protein, 18 aa, Entamoeba invadens
KLEDEYDQLINLVYKHED

SEQ ID NO: 2948206 - protein, 19 aa, Entamoeba invadens
KLEEARKFAKEMMSKDKIK

SEQ ID NO: 2948207 - protein, 21 aa, Entamoeba invadens
KLEEEKQQLAIKIDEIEHNKN

SEQ ID NO: 2948208 - protein, 32 aa, Entamoeba invadens
KLEELHAISEFPSVSVVFPFNSSTGQLLTVLP

SEQ ID NO: 2948209 - protein, 23 aa, Entamoeba invadens
KLEEREGAVPFGIENLIENIKNK

SEQ ID NO: 2948210 - protein, 36 aa, Entamoeba invadens
KLEHLKFDVGLLLRLVLCLTSALSYDGDRRLRVSEK

SEQ ID NO: 2948211 - protein, 25 aa, Entamoeba invadens
KLEIGETFPKFEVLRSDGNNTTYQC

SEQ ID NO: 2948212 - protein, 20 aa, Entamoeba invadens
KLEIRLGIVNMAFFTVTPKR

SEQ ID NO: 2948213 - protein, 27 aa, Entamoeba invadens
KLEKALPSWERRGIKIDDELSYEDCVR

SEQ ID NO: 2948214 - protein, 24 aa, Entamoeba invadens
KLEKCLMFKGKIYIVMDYCTNGSL

SEQ ID NO: 2948215 - protein, 20 aa, Entamoeba invadens
KLEKCYWTKLICSPKNAIRD

SEQ ID NO: 2948216 - protein, 24 aa, Entamoeba invadens
KLEKSHLFPHIFFDEHRLSRRMSH

SEQ ID NO: 2948217 - protein, 18 aa, Entamoeba invadens
KLEKYIYWLEEDGYDETK

SEQ ID NO: 2948218 - protein, 18 aa, Entamoeba invadens
KLELMKEEDEEGGGVKKR

SEQ ID NO: 2948219 - protein, 20 aa, Entamoeba invadens
KLELSTLVYLLDFYETKITD

SEQ ID NO: 2948220 - protein, 23 aa, Entamoeba invadens
KLEMMKEAINTVGMNEVDVKQGI

SEQ ID NO: 2948221 - protein, 19 aa, Entamoeba invadens
KLENIVKINSFEETIKTLL

SEQ ID NO: 2948222 - protein, 25 aa, Entamoeba invadens
KLENLRKTADVIALKKYHKKDLTIA

SEQ ID NO: 2948223 - protein, 25 aa, Entamoeba invadens
KLENTILYFRAWEMIDNKNTGFFDP

SEQ ID NO: 2948224 - protein, 18 aa, Entamoeba invadens
KLEQEIKEKEMLNKLKTN

SEQ ID NO: 2948225 - protein, 22 aa, Entamoeba invadens
KLEQYNKIFSWFNLVDQDRSGT

SEQ ID NO: 2948226 - protein, 17 aa, Entamoeba invadens
KLERFVDVFDCHDVAKL

SEQ ID NO: 2948227 - protein, 22 aa, Entamoeba invadens
KLESDFKYDYLISPLMKPADFD

SEQ ID NO: 2948228 - protein, 21 aa, Entamoeba invadens
KLESISIIMSDTLEAKKAAIR

SEQ ID NO: 2948229 - protein, 19 aa, Entamoeba invadens
KLETICLSASTSLQQATNT

SEQ ID NO: 2948230 - protein, 17 aa, Entamoeba invadens
KLETLYLPYEVDYNLSF

SEQ ID NO: 2948231 - protein, 27 aa, Entamoeba invadens
KLEVQEIKASIAMYEWGMSVRSSVQRL

SEQ ID NO: 2948232 - protein, 17 aa, Entamoeba invadens
KLEVSISAVDMIYCNNS

SEQ ID NO: 2948233 - protein, 25 aa, Entamoeba invadens
KLEYKNYDFFCVGIRPPTNLVSKIE

SEQ ID NO: 2948234 - protein, 19 aa, Entamoeba invadens
KLEYYRKSYVYAEANYEYI

SEQ ID NO: 2948235 - protein, 29 aa, Entamoeba invadens
KLFDGKRGYVGACLHVQKLLGLSQFNSEE

SEQ ID NO: 2948236 - protein, 17 aa, Entamoeba invadens
KLFDGLRLDNCHSVPLP

SEQ ID NO: 2948237 - protein, 18 aa, Entamoeba invadens
KLFDICVLRQIEAMNCKY

SEQ ID NO: 2948238 - protein, 23 aa, Entamoeba invadens
KLFDKRVAPFSIFRPNTIQELIN

SEQ ID NO: 2948239 - protein, 17 aa, Entamoeba invadens
KLFEPYNPVSLSFEEKH

SEQ ID NO: 2948240 - protein, 25 aa, Entamoeba invadens
KLFGEPLAQVVLCLDHIRYELAVNV

SEQ ID NO: 2948241 - protein, 19 aa, Entamoeba invadens
KLFGFEYLSEFSGIANSPF

SEQ ID NO: 2948242 - protein, 20 aa, Entamoeba invadens
KLFHIDFGFIFGNTVPLKAN

SEQ ID NO: 2948243 - protein, 19 aa, Entamoeba invadens
KLFKESKDRLREFQIILKK

SEQ ID NO: 2948244 - protein, 17 aa, Entamoeba invadens
KLFKRVKDGQIICKCGK

SEQ ID NO: 2948245 - protein, 27 aa, Entamoeba invadens
KLFKSPNYRKALLDAFNHCNLIESGKS

SEQ ID NO: 2948246 - protein, 28 aa, Entamoeba invadens
KLFKTCLPGVRPALIKGLADMMCLIEKN

SEQ ID NO: 2948247 - protein, 30 aa, Entamoeba invadens
KLFKTCLPGVRPALIKGLAKMMCLIKKNIR

SEQ ID NO: 2948248 - protein, 23 aa, Entamoeba invadens
KLFLECSCTPFFLHLDNIDFSTF

SEQ ID NO: 2948249 - protein, 17 aa, Entamoeba invadens
KLFPAMEKQFLYSDKDE

SEQ ID NO: 2948250 - protein, 20 aa, Entamoeba invadens
KLFPGNRPTNSFVLDKMTPF

SEQ ID NO: 2948251 - protein, 23 aa, Entamoeba invadens
KLFPYPYEFVAIITPPLNPLEFN

SEQ ID NO: 2948252 - protein, 30 aa, Entamoeba invadens
KLFQVGTPFPFHDWCVIENQSGTKTCRCCS

SEQ ID NO: 2948253 - protein, 17 aa, Entamoeba invadens
KLFRIARVLVHKNYRKQ

SEQ ID NO: 2948254 - protein, 17 aa, Entamoeba invadens
KLFSYIITFLIRELSTT

SEQ ID NO: 2948255 - protein, 18 aa, Entamoeba invadens
KLGAKKYIECSALTQFNL

SEQ ID NO: 2948256 - protein, 29 aa, Entamoeba invadens
KLGDDLRQDCLILRAFQLFDDIWKNEGKD

SEQ ID NO: 2948257 - protein, 19 aa, Entamoeba invadens
KLGEGFLKLFTKELTEEML

SEQ ID NO: 2948258 - protein, 23 aa, Entamoeba invadens
KLGEGVCGKCYLAFHETTGVKVA

SEQ ID NO: 2948259 - protein, 24 aa, Entamoeba invadens
KLGGKKKPPMWSREYSVMTSNGPC

SEQ ID NO: 2948260 - protein, 22 aa, Entamoeba invadens
KLGKKEWIIYASLRDVEHTVKC

SEQ ID NO: 2948261 - protein, 18 aa, Entamoeba invadens
KLGLEKIGECLANLYVVR

SEQ ID NO: 2948262 - protein, 17 aa, Entamoeba invadens
KLGLSTLNMLACHHLEP

SEQ ID NO: 2948263 - protein, 20 aa, Entamoeba invadens
KLGNNLDCNVFHFGQFDMTL

SEQ ID NO: 2948264 - protein, 20 aa, Entamoeba invadens
KLGNSCFCKCSSLKNINIPS

SEQ ID NO: 2948265 - protein, 18 aa, Entamoeba invadens
KLGNSVYIFQNDYMISVL

SEQ ID NO: 2948266 - protein, 19 aa, Entamoeba invadens
KLGPDILRILAKTFVDEEE

SEQ ID NO: 2948267 - protein, 17 aa, Entamoeba invadens
KLGSSLVALKIVSKDKS

SEQ ID NO: 2948268 - protein, 18 aa, Entamoeba invadens
KLGTWTDFRVKPSKVSKC

SEQ ID NO: 2948269 - protein, 18 aa, Entamoeba invadens
KLGYPHKGFPEGFVERVL

SEQ ID NO: 2948270 - protein, 19 aa, Entamoeba invadens
KLHDFLFDGCESSSGDVSP

SEQ ID NO: 2948271 - protein, 19 aa, Entamoeba invadens
KLHFIDFEFGNISVPTPLI

SEQ ID NO: 2948272 - protein, 18 aa, Entamoeba invadens
KLHFLPTYLFMPSPLSDL

SEQ ID NO: 2948273 - protein, 22 aa, Entamoeba invadens
KLHHISLIFVFDGMTQVIKKAE

SEQ ID NO: 2948274 - protein, 18 aa, Entamoeba invadens
KLHLDYLDLYLIHLPISI

SEQ ID NO: 2948275 - protein, 27 aa, Entamoeba invadens
KLHLFIPRMPCFSVTLDFLKSLPKTFS

SEQ ID NO: 2948276 - protein, 20 aa, Entamoeba invadens
KLHLKICDFGAAKILDVQQP

SEQ ID NO: 2948277 - protein, 18 aa, Entamoeba invadens
KLHLWVRRLFGLPFLPKE

SEQ ID NO: 2948278 - protein, 18 aa, Entamoeba invadens
KLHMMIIHAIVRMTYPVD

SEQ ID NO: 2948279 - protein, 23 aa, Entamoeba invadens
KLHREAWNAMSLKYKGRPFTDVE

SEQ ID NO: 2948280 - protein, 17 aa, Entamoeba invadens
KLHTLYCDASVFPTTTS

SEQ ID NO: 2948281 - protein, 23 aa, Entamoeba invadens
KLHTNFGDFFLCHGGLSPSMKYV

SEQ ID NO: 2948282 - protein, 19 aa, Entamoeba invadens
KLIALYIQICGVFPKSPDV

SEQ ID NO: 2948283 - protein, 25 aa, Entamoeba invadens
KLIDCACFILSKIVSSFTISQDYAK

SEQ ID NO: 2948284 - protein, 17 aa, Entamoeba invadens
KLIDLLTVLARREIDGC

SEQ ID NO: 2948285 - protein, 19 aa, Entamoeba invadens
KLIENFYVDFPIDKRNSTK

SEQ ID NO: 2948286 - protein, 17 aa, Entamoeba invadens
KLIETAWEQHQHIKNQS

SEQ ID NO: 2948287 - protein, 17 aa, Entamoeba invadens
KLIGSEVKTLFFAENGA

SEQ ID NO: 2948288 - protein, 23 aa, Entamoeba invadens
KLIIEKQLFKNCENLVEVVGMEK

SEQ ID NO: 2948289 - protein, 26 aa, Entamoeba invadens
KLIKHAFALVYLRDVVIARFADETIV

SEQ ID NO: 2948290 - protein, 18 aa, Entamoeba invadens
KLIKLTLKDYNFARHCIG

SEQ ID NO: 2948291 - protein, 17 aa, Entamoeba invadens
KLIKMVKLLKSNFEKGN

SEQ ID NO: 2948292 - protein, 24 aa, Entamoeba invadens
KLIKPCVIESTFLDDVLKEVTLIQ

SEQ ID NO: 2948293 - protein, 26 aa, Entamoeba invadens
KLILEPTAAFYFYGIRNHGFNIENDV

SEQ ID NO: 2948294 - protein, 24 aa, Entamoeba invadens
KLILKKLFDSSAFIYSMKPNVVES

SEQ ID NO: 2948295 - protein, 29 aa, Entamoeba invadens
KLIPKFKPIRKHCECIPTDIPCKESAIKR

SEQ ID NO: 2948296 - protein, 25 aa, Entamoeba invadens
KLIPVLFTHKNFMAFVKKTSTTAVS

SEQ ID NO: 2948297 - protein, 20 aa, Entamoeba invadens
KLIRFCLNGTPLDEDVVCTL

SEQ ID NO: 2948298 - protein, 20 aa, Entamoeba invadens
KLISSCFRRATSGVEVQFVQ

SEQ ID NO: 2948299 - protein, 20 aa, Entamoeba invadens
KLIVISGCVVDVLIFDEINK

SEQ ID NO: 2948300 - protein, 18 aa, Entamoeba invadens
KLIYKCLDAWSQTFNDAV

SEQ ID NO: 2948301 - protein, 23 aa, Entamoeba invadens
KLKAFREDFIYAFATYFDVAFPQ

SEQ ID NO: 2948302 - protein, 19 aa, Entamoeba invadens
KLKAIVFDEEIKLLLIRKM

SEQ ID NO: 2948303 - protein, 26 aa, Entamoeba invadens
KLKCQGESELCEWDVFKGYVKETTKE

SEQ ID NO: 2948304 - protein, 17 aa, Entamoeba invadens
KLKDIRLPLNITSIEES

SEQ ID NO: 2948305 - protein, 24 aa, Entamoeba invadens
KLKEDEKQSILAMVENDFEEKKKM

SEQ ID NO: 2948306 - protein, 20 aa, Entamoeba invadens
KLKEISFPLTLQKISRNCFN

SEQ ID NO: 2948307 - protein, 23 aa, Entamoeba invadens
KLKEREVVMWVLLPANKHSYNYP

SEQ ID NO: 2948308 - protein, 19 aa, Entamoeba invadens
KLKERFDEIFGTTKYSKLI

SEQ ID NO: 2948309 - protein, 21 aa, Entamoeba invadens
KLKEVLRGIGVEYTDDKDKMK

SEQ ID NO: 2948310 - protein, 26 aa, Entamoeba invadens
KLKEVYRPTLVNAFRVTTQCITMALN

SEQ ID NO: 2948311 - protein, 20 aa, Entamoeba invadens
KLKFVCLCTCGSEGFEKATE

SEQ ID NO: 2948312 - protein, 18 aa, Entamoeba invadens
KLKGGVCKESFEDEVPVV

SEQ ID NO: 2948313 - protein, 20 aa, Entamoeba invadens
KLKIEGYMLFIIAVNNNEFV

SEQ ID NO: 2948314 - protein, 18 aa, Entamoeba invadens
KLKIFGMQELVIQGNVYV

SEQ ID NO: 2948315 - protein, 19 aa, Entamoeba invadens
KLKKIFELQQVFPDCPEEV

SEQ ID NO: 2948316 - protein, 22 aa, Entamoeba invadens
KLKKMECQFIPDSVTRVKVVSA

SEQ ID NO: 2948317 - protein, 23 aa, Entamoeba invadens
KLKLELGESMAIIIQPQSVDDLN

SEQ ID NO: 2948318 - protein, 17 aa, Entamoeba invadens
KLKLLEVEKEKIVNELD

SEQ ID NO: 2948319 - protein, 21 aa, Entamoeba invadens
KLKLQPKVVFLKLEGSCVDGF

SEQ ID NO: 2948320 - protein, 18 aa, Entamoeba invadens
KLKNLFLDEFVQQITGSY

SEQ ID NO: 2948321 - protein, 21 aa, Entamoeba invadens
KLKNRELFILNKLKHTNVVEL

SEQ ID NO: 2948322 - protein, 24 aa, Entamoeba invadens
KLKNSQYLCALAYFVQKKKVSVEY

SEQ ID NO: 2948323 - protein, 26 aa, Entamoeba invadens
KLKNTGGLRRKSFSQQFKEKVQPMQN

SEQ ID NO: 2948324 - protein, 18 aa, Entamoeba invadens
KLKREMEDLITSKCSPSN

SEQ ID NO: 2948325 - protein, 18 aa, Entamoeba invadens
KLKRFIMDLSPANVVTFV

SEQ ID NO: 2948326 - protein, 23 aa, Entamoeba invadens
KLKSLELPICVSYIGEFAFEMCT

SEQ ID NO: 2948327 - protein, 25 aa, Entamoeba invadens
KLKSPELLEIFLTRLQEIYDERMQS

SEQ ID NO: 2948328 - protein, 24 aa, Entamoeba invadens
KLKTLKLYWCDKLQNLSLANGLEQ

SEQ ID NO: 2948329 - protein, 25 aa, Entamoeba invadens
KLKVARYSYCDFVFGEIHVAENLER

SEQ ID NO: 2948330 - protein, 20 aa, Entamoeba invadens
KLKVPKRTKPGSTLIHKKDN

SEQ ID NO: 2948331 - protein, 21 aa, Entamoeba invadens
KLKYQRWGYEALFSGHTGRKL

SEQ ID NO: 2948332 - protein, 19 aa, Entamoeba invadens
KLLAKRLLSHEVQDLKTEE

SEQ ID NO: 2948333 - protein, 20 aa, Entamoeba invadens
KLLCEETFVLANQVWLSRMD

SEQ ID NO: 2948334 - protein, 18 aa, Entamoeba invadens
KLLCLCKIDEHFVVIYLN

SEQ ID NO: 2948335 - protein, 19 aa, Entamoeba invadens
KLLDGGKLLKTFVEMDKKA

SEQ ID NO: 2948336 - protein, 19 aa, Entamoeba invadens
KLLDKANCTLGNPTPTSVL

SEQ ID NO: 2948337 - protein, 28 aa, Entamoeba invadens
KLLEFRRVYRCAKCKREFEVEAQVETSY

SEQ ID NO: 2948338 - protein, 19 aa, Entamoeba invadens
KLLEIVRRQHDVLVKMKSD

SEQ ID NO: 2948339 - protein, 24 aa, Entamoeba invadens
KLLELGSSAFSRCLHLRSLSLPEK

SEQ ID NO: 2948340 - protein, 18 aa, Entamoeba invadens
KLLERCGKEHQPIDLFDS

SEQ ID NO: 2948341 - protein, 18 aa, Entamoeba invadens
KLLETIGTMLNRKKTRAV

SEQ ID NO: 2948342 - protein, 25 aa, Entamoeba invadens
KLLFEKSVAVSLVLPVMSNPYLHEL

SEQ ID NO: 2948343 - protein, 19 aa, Entamoeba invadens
KLLFPRTTSEIFAFRGIDI

SEQ ID NO: 2948344 - protein, 20 aa, Entamoeba invadens
KLLGCTDMKKAIVFEDAVLG

SEQ ID NO: 2948345 - protein, 19 aa, Entamoeba invadens
KLLGEKKIAEKVYLETVPA

SEQ ID NO: 2948346 - protein, 28 aa, Entamoeba invadens
KLLHHLGIKCSNLIFNNRHFKAIHYIPS

SEQ ID NO: 2948347 - protein, 20 aa, Entamoeba invadens
KLLIDSCEAYSKSQLHFAQC

SEQ ID NO: 2948348 - protein, 18 aa, Entamoeba invadens
KLLKEGGLVKQCRKALKE

SEQ ID NO: 2948349 - protein, 23 aa, Entamoeba invadens
KLLKFKSTIIWFYKHFLPDTIEF

SEQ ID NO: 2948350 - protein, 17 aa, Entamoeba invadens
KLLKQSRVKSLLHEISR

SEQ ID NO: 2948351 - protein, 20 aa, Entamoeba invadens
KLLLEERYIFLASSIEQLNP

SEQ ID NO: 2948352 - protein, 20 aa, Entamoeba invadens
KLLLHSCFYNEVMFQRWYSQ

SEQ ID NO: 2948353 - protein, 18 aa, Entamoeba invadens
KLLLKNCFFEKYRLLQYI

SEQ ID NO: 2948354 - protein, 25 aa, Entamoeba invadens
KLLLLKKKRYAAIMVNENGETKREL

SEQ ID NO: 2948355 - protein, 17 aa, Entamoeba invadens
KLLLNDLLKHTPHNHID

SEQ ID NO: 2948356 - protein, 19 aa, Entamoeba invadens
KLLLQAVERCLAEGDESLV

SEQ ID NO: 2948357 - protein, 20 aa, Entamoeba invadens
KLLMAYEEAIGFVIGNMSYD

SEQ ID NO: 2948358 - protein, 25 aa, Entamoeba invadens
KLLMPESQDLIALIQNFVKGFVQLV

SEQ ID NO: 2948359 - protein, 25 aa, Entamoeba invadens
KLLNCYYSLFTRPSPQLLTALYNAM

SEQ ID NO: 2948360 - protein, 18 aa, Entamoeba invadens
KLLNSPAVYPNWKAGNAL

SEQ ID NO: 2948361 - protein, 24 aa, Entamoeba invadens
KLLQKKNCGILLLGEHGSGKSTIA

SEQ ID NO: 2948362 - protein, 20 aa, Entamoeba invadens
KLLRERASTYALSIADENGV

SEQ ID NO: 2948363 - protein, 20 aa, Entamoeba invadens
KLLRLRQINNAVFIRANAST

SEQ ID NO: 2948364 - protein, 20 aa, Entamoeba invadens
KLLRSENWLEKVLIKTKAKV

SEQ ID NO: 2948365 - protein, 20 aa, Entamoeba invadens
KLLSICLTQSSVVYGLCECQ

SEQ ID NO: 2948366 - protein, 20 aa, Entamoeba invadens
KLLSIPRYCFSYCSNLKTIT

SEQ ID NO: 2948367 - protein, 20 aa, Entamoeba invadens
KLLSVLRPVSVSSQISSPVT

SEQ ID NO: 2948368 - protein, 24 aa, Entamoeba invadens
KLLTELRTPITYTRLHTINYCLPS

SEQ ID NO: 2948369 - protein, 26 aa, Entamoeba invadens
KLLTLPSCGDGGIILKSDGAILSQEG

SEQ ID NO: 2948370 - protein, 24 aa, Entamoeba invadens
KLLTNDMLLRYGVSDKIFCHLNGT

SEQ ID NO: 2948371 - protein, 19 aa, Entamoeba invadens
KLLTNMLIAPAFIAATKAK

SEQ ID NO: 2948372 - protein, 17 aa, Entamoeba invadens
KLLVCYRDDAVGSLADT

SEQ ID NO: 2948373 - protein, 17 aa, Entamoeba invadens
KLLYETFYTISDVLLSK

SEQ ID NO: 2948374 - protein, 23 aa, Entamoeba invadens
KLLYPRSYLSGLFVDNHDVDRIM

SEQ ID NO: 2948375 - protein, 17 aa, Entamoeba invadens
KLMEVVSFETFKSESHL

SEQ ID NO: 2948376 - protein, 19 aa, Entamoeba invadens
KLMFKGVSISFKIDELQSV

SEQ ID NO: 2948377 - protein, 23 aa, Entamoeba invadens
KLMLEQMNQLILESKVQDARQAR

SEQ ID NO: 2948378 - protein, 19 aa, Entamoeba invadens
KLMNELYSLKAKNEKQETE

SEQ ID NO: 2948379 - protein, 21 aa, Entamoeba invadens
KLMTLCIEKCRNCTFSNVVLN

SEQ ID NO: 2948380 - protein, 20 aa, Entamoeba invadens
KLMYIECSFLSQDRNVNAEI

SEQ ID NO: 2948381 - protein, 23 aa, Entamoeba invadens
KLNCIVHGINLVFSDLIKNIPEL

SEQ ID NO: 2948382 - protein, 31 aa, Entamoeba invadens
KLNCLNGECFRGCVSLESLLLPSAMMNISTN

SEQ ID NO: 2948383 - protein, 20 aa, Entamoeba invadens
KLNDLGCEFAGLSVCGISEF

SEQ ID NO: 2948384 - protein, 18 aa, Entamoeba invadens
KLNEDAFDKEAKRFDETR

SEQ ID NO: 2948385 - protein, 25 aa, Entamoeba invadens
KLNEVCSFTLKAEDAFGDEGDKTRN

SEQ ID NO: 2948386 - protein, 22 aa, Entamoeba invadens
KLNEVPLYIDSFHKLRTLNVSY

SEQ ID NO: 2948387 - protein, 29 aa, Entamoeba invadens
KLNEWILRLPDFCFQKCYSLSTLSIPPSV

SEQ ID NO: 2948388 - protein, 19 aa, Entamoeba invadens
KLNGCTDGVFLIRPSKTDP

SEQ ID NO: 2948389 - protein, 19 aa, Entamoeba invadens
KLNKFKYVVENIINDSENT

SEQ ID NO: 2948390 - protein, 19 aa, Entamoeba invadens
KLNKLGSSCFRECGNLTHV

SEQ ID NO: 2948391 - protein, 26 aa, Entamoeba invadens
KLNQIKELICELMIMGGVDAVLQYCK

SEQ ID NO: 2948392 - protein, 22 aa, Entamoeba invadens
KLNRLHREPFLKLTKRYKELRE

SEQ ID NO: 2948393 - protein, 19 aa, Entamoeba invadens
KLNSSFLFSQERKSLDPEQ

SEQ ID NO: 2948394 - protein, 23 aa, Entamoeba invadens
KLNSSWFAKLGMWHKALTKLEDE

SEQ ID NO: 2948395 - protein, 25 aa, Entamoeba invadens
KLPDHLKIIGVHAFSACGLTYIDIP

SEQ ID NO: 2948396 - protein, 32 aa, Entamoeba invadens
KLPDKLPAMDFFIAKGFASKLSDTFNILIQPL

SEQ ID NO: 2948397 - protein, 19 aa, Entamoeba invadens
KLPEDRPKEEAQQDDKKTD

SEQ ID NO: 2948398 - protein, 21 aa, Entamoeba invadens
KLPENITMILNSCFDACSELE

SEQ ID NO: 2948399 - protein, 21 aa, Entamoeba invadens
KLPFPSFIDQWFTLHDSPFGN

SEQ ID NO: 2948400 - protein, 18 aa, Entamoeba invadens
KLPFQHLVREIAQQSKTD

SEQ ID NO: 2948401 - protein, 44 aa, Entamoeba invadens
KLPHEETITLSLRMLRFCFRAENKTELGFDISLQVLKRVKERDT

SEQ ID NO: 2948402 - protein, 24 aa, Entamoeba invadens
KLPHSVEHLACFNFDRNSIPWNNN

SEQ ID NO: 2948403 - protein, 18 aa, Entamoeba invadens
KLPKLSVEYCEGVVIENI

SEQ ID NO: 2948404 - protein, 17 aa, Entamoeba invadens
KLPLNYKNFKTIILDVN

SEQ ID NO: 2948405 - protein, 18 aa, Entamoeba invadens
KLPLSPSMKNVGNIFTVS

SEQ ID NO: 2948406 - protein, 22 aa, Entamoeba invadens
KLPNDLKFIGKNIFGLITSLTT

SEQ ID NO: 2948407 - protein, 26 aa, Entamoeba invadens
KLPNSIKSLGDMAFKNCCAIKELVVP

SEQ ID NO: 2948408 - protein, 24 aa, Entamoeba invadens
KLPPSCVKLKLQKCKKLQELELPT

SEQ ID NO: 2948409 - protein, 21 aa, Entamoeba invadens
KLPPSHLGLSHLFEIGFYLKS

SEQ ID NO: 2948410 - protein, 25 aa, Entamoeba invadens
KLPPYTFYMCFLLNKILMPKSLTNI

SEQ ID NO: 2948411 - protein, 19 aa, Entamoeba invadens
KLPQVKALYPYTAANDEEL

SEQ ID NO: 2948412 - protein, 21 aa, Entamoeba invadens
KLPSNFFIFSNLRALNFTHNQ

SEQ ID NO: 2948413 - protein, 22 aa, Entamoeba invadens
KLPSSPRLLPAYLTKQTTQPIK

SEQ ID NO: 2948414 - protein, 22 aa, Entamoeba invadens
KLPTKKRYTFTISQDDQKTIGF

SEQ ID NO: 2948415 - protein, 25 aa, Entamoeba invadens
KLQCIPREFSRLSNLQTLELDNNEF

SEQ ID NO: 2948416 - protein, 24 aa, Entamoeba invadens
KLQEQRLNVFFSESSTRRYVPRSI

SEQ ID NO: 2948417 - protein, 18 aa, Entamoeba invadens
KLQFINKIPEDMTINEIR

SEQ ID NO: 2948418 - protein, 25 aa, Entamoeba invadens
KLQISSAQILHWARKLNNLQTKVFV

SEQ ID NO: 2948419 - protein, 17 aa, Entamoeba invadens
KLQKLRANDNMIKTLPN

SEQ ID NO: 2948420 - protein, 37 aa, Entamoeba invadens
KLQLDYLDLYLIHWPVSIKVGATFPMKKDDFIEVPIE

SEQ ID NO: 2948421 - protein, 19 aa, Entamoeba invadens
KLQNLYLMKCVKLRMGCLV

SEQ ID NO: 2948422 - protein, 20 aa, Entamoeba invadens
KLQNMRVGIQFIDKPEFSVE

SEQ ID NO: 2948423 - protein, 19 aa, Entamoeba invadens
KLQTADMVIIPSIDEKWCD

SEQ ID NO: 2948424 - protein, 25 aa, Entamoeba invadens
KLQYEYDQFINLVFGHEDETNNLNG

SEQ ID NO: 2948425 - protein, 17 aa, Entamoeba invadens
KLRARNHIRDTVLKKHE

SEQ ID NO: 2948426 - protein, 23 aa, Entamoeba invadens
KLRDVLRTYALYNFEVQYGQGLN

SEQ ID NO: 2948427 - protein, 23 aa, Entamoeba invadens
KLREVDTVWKFLGNWDLTWNEPY

SEQ ID NO: 2948428 - protein, 20 aa, Entamoeba invadens
KLRIKFCMDTSQGISYLHEN

SEQ ID NO: 2948429 - protein, 32 aa, Entamoeba invadens
KLRIRDFPKRVEFPSCLKELVIEDLSRKPPEL

SEQ ID NO: 2948430 - protein, 19 aa, Entamoeba invadens
KLRKLREKKQSQKAEKIEL

SEQ ID NO: 2948431 - protein, 20 aa, Entamoeba invadens
KLRKSMGVIPGLERRMSEQQ

SEQ ID NO: 2948432 - protein, 18 aa, Entamoeba invadens
KLRKYKKGVVLDFTETCT

SEQ ID NO: 2948433 - protein, 23 aa, Entamoeba invadens
KLRLESCCSEGALAAANEVTLVK

SEQ ID NO: 2948434 - protein, 25 aa, Entamoeba invadens
KLRLVDGKYQWEVLKNCEGRQIIGG

SEQ ID NO: 2948435 - protein, 21 aa, Entamoeba invadens
KLRMASATAFSLSPEAAANLN

SEQ ID NO: 2948436 - protein, 21 aa, Entamoeba invadens
KLRREVLEAKSALAENKKKTR

SEQ ID NO: 2948437 - protein, 18 aa, Entamoeba invadens
KLRVEAVAIEILDQFHDQ

SEQ ID NO: 2948438 - protein, 20 aa, Entamoeba invadens
KLRVKICLDAARGIAYLHDN

SEQ ID NO: 2948439 - protein, 18 aa, Entamoeba invadens
KLRVVAFGPSLKQFGKRV

SEQ ID NO: 2948440 - protein, 19 aa, Entamoeba invadens
KLSAVRIAGELAVKKHEAQ

SEQ ID NO: 2948441 - protein, 26 aa, Entamoeba invadens
KLSDICLRSAAAPTYFHPYQNYVDGG

SEQ ID NO: 2948442 - protein, 20 aa, Entamoeba invadens
KLSEELGMRGDIFVKSVEYG

SEQ ID NO: 2948443 - protein, 17 aa, Entamoeba invadens
KLSEIKLPMLLKQLNDS

SEQ ID NO: 2948444 - protein, 23 aa, Entamoeba invadens
KLSERYSDKYGRLNARLLQTYLK

SEQ ID NO: 2948445 - protein, 25 aa, Entamoeba invadens
KLSESEFIQFFCLFEYYIDDDGQFD

SEQ ID NO: 2948446 - protein, 24 aa, Entamoeba invadens
KLSFKKLYSVVVHFNVKFDDIQKL

SEQ ID NO: 2948447 - protein, 20 aa, Entamoeba invadens
KLSFSVGDVVVYQFTNTQST

SEQ ID NO: 2948448 - protein, 18 aa, Entamoeba invadens
KLSGAQSPLGNWWDDKTN

SEQ ID NO: 2948449 - protein, 25 aa, Entamoeba invadens
KLSGHPDCVQSLITIDRNTVFSGSF

SEQ ID NO: 2948450 - protein, 18 aa, Entamoeba invadens
KLSGKRHLYVMLQTEKGR

SEQ ID NO: 2948451 - protein, 20 aa, Entamoeba invadens
KLSHYLAAFGCQLLGTTRVN

SEQ ID NO: 2948452 - protein, 25 aa, Entamoeba invadens
KLSILHCFTSNFVLQEGVDLLSISY

SEQ ID NO: 2948453 - protein, 25 aa, Entamoeba invadens
KLSIPDFVKDLSISWYTNERHSVWL

SEQ ID NO: 2948454 - protein, 23 aa, Entamoeba invadens
KLSKHAYCFVPIITMKTSQGSDP

SEQ ID NO: 2948455 - protein, 27 aa, Entamoeba invadens
KLSKKGLRPGVFAAISGMYLSNTKWGM

SEQ ID NO: 2948456 - protein, 27 aa, Entamoeba invadens
KLSKLFPNVCVYISYLSDIILDPLYKT

SEQ ID NO: 2948457 - protein, 29 aa, Entamoeba invadens
KLSKSAFEFCRFKTFKIPAGIKEVEEDAI

SEQ ID NO: 2948458 - protein, 26 aa, Entamoeba invadens
KLSLSIPMKRIHTVSIDGINFNSEKI

SEQ ID NO: 2948459 - protein, 19 aa, Entamoeba invadens
KLSQFAQEHLWKYISTADA

SEQ ID NO: 2948460 - protein, 26 aa, Entamoeba invadens
KLSQLIFECSLSFSINDFYELIFDQI

SEQ ID NO: 2948461 - protein, 19 aa, Entamoeba invadens
KLSSFGCVPQTFVVVFKED

SEQ ID NO: 2948462 - protein, 28 aa, Entamoeba invadens
KLSSKQCILGYRMCKAAFDDLMKRMENI

SEQ ID NO: 2948463 - protein, 19 aa, Entamoeba invadens
KLSSVFMAFSPTDLKMLSP

SEQ ID NO: 2948464 - protein, 23 aa, Entamoeba invadens
KLSSVRLLLIPSYNIEKSDFELK

SEQ ID NO: 2948465 - protein, 23 aa, Entamoeba invadens
KLSSVRLLLLPSYNIKSNTFEMR

SEQ ID NO: 2948466 - protein, 19 aa, Entamoeba invadens
KLSTCPVTIIFDDELSCVK

SEQ ID NO: 2948467 - protein, 29 aa, Entamoeba invadens
KLSTELFKQFFPKVRFLDIDDDVIVSQFT

SEQ ID NO: 2948468 - protein, 21 aa, Entamoeba invadens
KLSVGKGCFKNCGKLKKFVGK

SEQ ID NO: 2948469 - protein, 19 aa, Entamoeba invadens
KLSYCCIEQLKGNELTNLD

SEQ ID NO: 2948470 - protein, 19 aa, Entamoeba invadens
KLSYCCIEQLKGNELTYLN

SEQ ID NO: 2948471 - protein, 21 aa, Entamoeba invadens
KLTCDGCIICTQAGSTGYSRS

SEQ ID NO: 2948472 - protein, 17 aa, Entamoeba invadens
KLTCRKFYQQIATCQST

SEQ ID NO: 2948473 - protein, 17 aa, Entamoeba invadens
KLTDFTIIGGRCTEFPN

SEQ ID NO: 2948474 - protein, 17 aa, Entamoeba invadens
KLTELNEQLDLERITAQ

SEQ ID NO: 2948475 - protein, 19 aa, Entamoeba invadens
KLTKLHLGNVITFQDNLQY

SEQ ID NO: 2948476 - protein, 27 aa, Entamoeba invadens
KLTKMFSEYFVRLVAMYNSLGIVIEEN

SEQ ID NO: 2948477 - protein, 18 aa, Entamoeba invadens
KLTLKKYIETCFPFESNS

SEQ ID NO: 2948478 - protein, 34 aa, Entamoeba invadens
KLTNGMYIRARWDKGLCVIDSEFLLFNKTNENIF

SEQ ID NO: 2948479 - protein, 27 aa, Entamoeba invadens
KLTPKTTIVGFRYLFAYYRQPDVKMCE

SEQ ID NO: 2948480 - protein, 20 aa, Entamoeba invadens
KLTSCYIKGRVDTLGELCFN

SEQ ID NO: 2948481 - protein, 19 aa, Entamoeba invadens
KLTSLIVIRGCLNEVKSLP

SEQ ID NO: 2948482 - protein, 19 aa, Entamoeba invadens
KLTSLKCRMIPQNTANKMT

SEQ ID NO: 2948483 - protein, 19 aa, Entamoeba invadens
KLTTGTIERLFRDAEKYEI

SEQ ID NO: 2948484 - protein, 30 aa, Entamoeba invadens
KLTTTKGWDKLRWDDFLALKEEMQDDFPMT

SEQ ID NO: 2948485 - protein, 21 aa, Entamoeba invadens
KLTVLKSVCINFECVDVSLAV

SEQ ID NO: 2948486 - protein, 23 aa, Entamoeba invadens
KLVCEMKAQFSVDEKVVIYALYA

SEQ ID NO: 2948487 - protein, 24 aa, Entamoeba invadens
KLVCGGVQLFKCKKLEQLDTFRIC

SEQ ID NO: 2948488 - protein, 24 aa, Entamoeba invadens
KLVCKAKRFGNKCFYDCEDLEEVF

SEQ ID NO: 2948489 - protein, 17 aa, Entamoeba invadens
KLVCPNCDIPLDNYVEA

SEQ ID NO: 2948490 - protein, 20 aa, Entamoeba invadens
KLVDESFLFWDKQLKFVKRI

SEQ ID NO: 2948491 - protein, 26 aa, Entamoeba invadens
KLVESFTDWKFVDAVPYFATQTNCKR

SEQ ID NO: 2948492 - protein, 17 aa, Entamoeba invadens
KLVEVIYQFSSFFSSQF

SEQ ID NO: 2948493 - protein, 17 aa, Entamoeba invadens
KLVFSRIAFEIKDGLVI

SEQ ID NO: 2948494 - protein, 19 aa, Entamoeba invadens
KLVGMEITNTLNLQDRLTD

SEQ ID NO: 2948495 - protein, 22 aa, Entamoeba invadens
KLVGYRFIRFTNEMDARNFIEG

SEQ ID NO: 2948496 - protein, 21 aa, Entamoeba invadens
KLVKETCNWKTLYWTINDEGI

SEQ ID NO: 2948497 - protein, 18 aa, Entamoeba invadens
KLVKFCVSSKEIIEEMKQ

SEQ ID NO: 2948498 - protein, 21 aa, Entamoeba invadens
KLVKFPLSPRQAAAVCEGYTN

SEQ ID NO: 2948499 - protein, 22 aa, Entamoeba invadens
KLVKVCDLDKSLRVILENVMTN

SEQ ID NO: 2948500 - protein, 20 aa, Entamoeba invadens
KLVLGARATRPFSQRQDKHT

SEQ ID NO: 2948501 - protein, 20 aa, Entamoeba invadens
KLVNLHRLFYGSAGVAKERL

SEQ ID NO: 2948502 - protein, 20 aa, Entamoeba invadens
KLVQCLKAVFQYPSTPHEIL

SEQ ID NO: 2948503 - protein, 17 aa, Entamoeba invadens
KLVQDFRQKKICGPNSL

SEQ ID NO: 2948504 - protein, 18 aa, Entamoeba invadens
KLVSNGVRYDHIKICSGK

SEQ ID NO: 2948505 - protein, 24 aa, Entamoeba invadens
KLVVKRLVSAIAYLHSLNIVHRDL

SEQ ID NO: 2948506 - protein, 17 aa, Entamoeba invadens
KLVYIAVDGVCPFAKIV

SEQ ID NO: 2948507 - protein, 27 aa, Entamoeba invadens
KLWDELPRSWKILVADQVALKVISSFC

SEQ ID NO: 2948508 - protein, 17 aa, Entamoeba invadens
KLWDLKSGEPIQTYAVH

SEQ ID NO: 2948509 - protein, 21 aa, Entamoeba invadens
KLWINMSECIEIFDTNKDELT

SEQ ID NO: 2948510 - protein, 23 aa, Entamoeba invadens
KLWKTNAEIVWAKSVFECTRDLF

SEQ ID NO: 2948511 - protein, 27 aa, Entamoeba invadens
KLYCQSLCLLSKMFLDHKTLYYDVEPF

SEQ ID NO: 2948512 - protein, 29 aa, Entamoeba invadens
KLYDAKMGCCIDLLAPLFTFVGYQLDLPM

SEQ ID NO: 2948513 - protein, 17 aa, Entamoeba invadens
KLYDEWETLYTKYASEY

SEQ ID NO: 2948514 - protein, 27 aa, Entamoeba invadens
KLYEMYELRVSLIEQWATFKLTSPYMP

SEQ ID NO: 2948515 - protein, 21 aa, Entamoeba invadens
KLYEVVCCCIAIIPSSACIER

SEQ ID NO: 2948516 - protein, 20 aa, Entamoeba invadens
KLYIEFGGKLLNDSHAVRVL

SEQ ID NO: 2948517 - protein, 17 aa, Entamoeba invadens
KLYKGLFLFVKDELKEE

SEQ ID NO: 2948518 - protein, 18 aa, Entamoeba invadens
KLYKNICQIKPDLRWAWD

SEQ ID NO: 2948519 - protein, 21 aa, Entamoeba invadens
KLYLFECTKLTFLQNSSTMES

SEQ ID NO: 2948520 - protein, 27 aa, Entamoeba invadens
KLYPEECDKYFPVLCEVVKSATKRRYV

SEQ ID NO: 2948521 - protein, 17 aa, Entamoeba invadens
KLYRNINTIVAPPLNGD

SEQ ID NO: 2948522 - protein, 19 aa, Entamoeba invadens
KLYVVPDYFSASVKKVIEK

SEQ ID NO: 2948523 - protein, 18 aa, Entamoeba invadens
KMAARFEIANIFDKQGKI

SEQ ID NO: 2948524 - protein, 24 aa, Entamoeba invadens
KMADGRCAACQVTNCVMCDGNKGN

SEQ ID NO: 2948525 - protein, 17 aa, Entamoeba invadens
KMAEFPMAPSLARVIIS

SEQ ID NO: 2948526 - protein, 24 aa, Entamoeba invadens
KMAEVYRGVFLYEGKLYVVDEFGS

SEQ ID NO: 2948527 - protein, 25 aa, Entamoeba invadens
KMAIYKYGTWMGGLVGSLSVAYCGI

SEQ ID NO: 2948528 - protein, 17 aa, Entamoeba invadens
KMALKVSLKSFISCQRT

SEQ ID NO: 2948529 - protein, 18 aa, Entamoeba invadens
KMCFKNCRNLKIVETQNK

SEQ ID NO: 2948530 - protein, 18 aa, Entamoeba invadens
KMCRDQVGCRFLQQQLEE

SEQ ID NO: 2948531 - protein, 24 aa, Entamoeba invadens
KMDASRNALLEWVNSKIAPNKINN

SEQ ID NO: 2948532 - protein, 18 aa, Entamoeba invadens
KMDEEVMNNFAIENNDIV

SEQ ID NO: 2948533 - protein, 29 aa, Entamoeba invadens
KMDEFKKEVAMLAKFVSPYVIRFYGASFI

SEQ ID NO: 2948534 - protein, 24 aa, Entamoeba invadens
KMDIKVSFDIPKFKYLCDGSTNLN

SEQ ID NO: 2948535 - protein, 25 aa, Entamoeba invadens
KMDITSPNPCMWDLVAYRIKYFPHP

SEQ ID NO: 2948536 - protein, 19 aa, Entamoeba invadens
KMDLEEDIFEAIDVDNIEA

SEQ ID NO: 2948537 - protein, 18 aa, Entamoeba invadens
KMDLELHLNYLKSGKPID

SEQ ID NO: 2948538 - protein, 24 aa, Entamoeba invadens
KMDPKTAFYSGFMLSELSYKCKAF

SEQ ID NO: 2948539 - protein, 24 aa, Entamoeba invadens
KMDSELLPVFATNFLKESLKAIQR

SEQ ID NO: 2948540 - protein, 21 aa, Entamoeba invadens
KMDTLRLFIKVSKGCKDAVMR

SEQ ID NO: 2948541 - protein, 25 aa, Entamoeba invadens
KMDVGMVPNKVYIYFDKAEKIKAAD

SEQ ID NO: 2948542 - protein, 21 aa, Entamoeba invadens
KMDVVNCLKENIGVSYEVNLK

SEQ ID NO: 2948543 - protein, 18 aa, Entamoeba invadens
KMENWKTRTIAFKKQTND

SEQ ID NO: 2948544 - protein, 31 aa, Entamoeba invadens
KMERPEYRNFLSVIYKWVDEMLKDIQHNEPL

SEQ ID NO: 2948545 - protein, 21 aa, Entamoeba invadens
KMFAKTSFKENISFLTLIYNE

SEQ ID NO: 2948546 - protein, 17 aa, Entamoeba invadens
KMFDDFELFYSHDVNIT

SEQ ID NO: 2948547 - protein, 25 aa, Entamoeba invadens
KMFHTKCSEDLFSDLHVKKTPTQVR

SEQ ID NO: 2948548 - protein, 20 aa, Entamoeba invadens
KMFIEVSAFVLSNLKKQLIH

SEQ ID NO: 2948549 - protein, 30 aa, Entamoeba invadens
KMFKTSALCNLRIAELCSDMLGILLTRHGS

SEQ ID NO: 2948550 - protein, 23 aa, Entamoeba invadens
KMFLRDFDVLSAYAVFSLMCDEQ

SEQ ID NO: 2948551 - protein, 19 aa, Entamoeba invadens
KMFYGCIALSSIKNTNHIT

SEQ ID NO: 2948552 - protein, 20 aa, Entamoeba invadens
KMFYQIVVWFNVDYTTITKN

SEQ ID NO: 2948553 - protein, 22 aa, Entamoeba invadens
KMFYQRPPFRTEIENKTVISEF

SEQ ID NO: 2948554 - protein, 19 aa, Entamoeba invadens
KMGAMWWFVLVERNVWRCA

SEQ ID NO: 2948555 - protein, 24 aa, Entamoeba invadens
KMGDVMFEKFGFNRVYVAVQAVLV

SEQ ID NO: 2948556 - protein, 26 aa, Entamoeba invadens
KMGEITPETFLVGVFRVIDKNCDGTL

SEQ ID NO: 2948557 - protein, 23 aa, Entamoeba invadens
KMGFPQKFKYLAFDMSDDTEQDL

SEQ ID NO: 2948558 - protein, 18 aa, Entamoeba invadens
KMGKGLWEKYHLTFEEEY

SEQ ID NO: 2948559 - protein, 18 aa, Entamoeba invadens
KMGMGLVYDVCHNIAKVE

SEQ ID NO: 2948560 - protein, 18 aa, Entamoeba invadens
KMGVFDSYTIFKAAKEFL

SEQ ID NO: 2948561 - protein, 19 aa, Entamoeba invadens
KMHIPVIVCCETYKMTDGI

SEQ ID NO: 2948562 - protein, 25 aa, Entamoeba invadens
KMHITQNFFCYVPIFVKGNISIRIS

SEQ ID NO: 2948563 - protein, 28 aa, Entamoeba invadens
KMHLQFARPGGQPEGVMQFQQQMPRAVP

SEQ ID NO: 2948564 - protein, 19 aa, Entamoeba invadens
KMHRHFDAMSGKKAENEID

SEQ ID NO: 2948565 - protein, 25 aa, Entamoeba invadens
KMHTETWILMVLWYGGDPSKFTDYE

SEQ ID NO: 2948566 - protein, 21 aa, Entamoeba invadens
KMHTYGLPKFVLWEKYYFANR

SEQ ID NO: 2948567 - protein, 24 aa, Entamoeba invadens
KMIDLKITVIFLFDEFFDLSESLK

SEQ ID NO: 2948568 - protein, 18 aa, Entamoeba invadens
KMIEEVNGGVLIKKGEGY

SEQ ID NO: 2948569 - protein, 19 aa, Entamoeba invadens
KMIEIKSVFTLINNSYFPE

SEQ ID NO: 2948570 - protein, 25 aa, Entamoeba invadens
KMIIPPKGKFVIGIRKTMTPATKKF

SEQ ID NO: 2948571 - protein, 19 aa, Entamoeba invadens
KMIKCKLLQKTIFPITLKR

SEQ ID NO: 2948572 - protein, 18 aa, Entamoeba invadens
KMINRLFICAICDQKYFR

SEQ ID NO: 2948573 - protein, 27 aa, Entamoeba invadens
KMISKLSLYKCGMSEYDPEKVVNAIQI

SEQ ID NO: 2948574 - protein, 25 aa, Entamoeba invadens
KMKDLPVVILRPSIIYGQGDVTGIA

SEQ ID NO: 2948575 - protein, 22 aa, Entamoeba invadens
KMKDTFNPLSLYSFPLQSKNTS

SEQ ID NO: 2948576 - protein, 22 aa, Entamoeba invadens
KMKEERLSSGSGFTSENSENEG

SEQ ID NO: 2948577 - protein, 18 aa, Entamoeba invadens
KMKEFKPAFPDLTKGVFS

SEQ ID NO: 2948578 - protein, 25 aa, Entamoeba invadens
KMKEIKRTPTQLSFKKTLKLMSSFF

SEQ ID NO: 2948579 - protein, 22 aa, Entamoeba invadens
KMKEIPLMFHFNPVQVDHKTQR

SEQ ID NO: 2948580 - protein, 23 aa, Entamoeba invadens
KMKETKIAFLFYLFKVSVDEFLE

SEQ ID NO: 2948581 - protein, 18 aa, Entamoeba invadens
KMKFEVAKIDGKILRKKN

SEQ ID NO: 2948582 - protein, 29 aa, Entamoeba invadens
KMKGFFKKEFLRVSLEMVFAKYDEILEQD

SEQ ID NO: 2948583 - protein, 19 aa, Entamoeba invadens
KMKGSKLGVFGEYRGGMGS

SEQ ID NO: 2948584 - protein, 25 aa, Entamoeba invadens
KMKILFTVYPITTWAYMRPSAQFSY

SEQ ID NO: 2948585 - protein, 25 aa, Entamoeba invadens
KMKKMFKLLLEYSVFAKNENVKIAL

SEQ ID NO: 2948586 - protein, 21 aa, Entamoeba invadens
KMKLTEMSSMVAVNDAMSGVT

SEQ ID NO: 2948587 - protein, 18 aa, Entamoeba invadens
KMKNSYPYPQHVSCSDSF

SEQ ID NO: 2948588 - protein, 23 aa, Entamoeba invadens
KMKSEIEKGGKIELLGTKNTGVK

SEQ ID NO: 2948589 - protein, 24 aa, Entamoeba invadens
KMKVICPQITFSLRDLQNGCSYKE

SEQ ID NO: 2948590 - protein, 20 aa, Entamoeba invadens
KMLCELNVRDNLKMQGIPEE

SEQ ID NO: 2948591 - protein, 23 aa, Entamoeba invadens
KMLELIECREGIVMSEDNEIVSI

SEQ ID NO: 2948592 - protein, 25 aa, Entamoeba invadens
KMLERKRTWELLKIVKEEGVDTLKS

SEQ ID NO: 2948593 - protein, 18 aa, Entamoeba invadens
KMLHILRILLPLENSFVV

SEQ ID NO: 2948594 - protein, 17 aa, Entamoeba invadens
KMLILGAKFLELKNYDA

SEQ ID NO: 2948595 - protein, 22 aa, Entamoeba invadens
KMLKCDIALTVLRERIRKALQL

SEQ ID NO: 2948596 - protein, 31 aa, Entamoeba invadens
KMLKHGRAGVPVEVMGLMLGEYVDQYTVRVV

SEQ ID NO: 2948597 - protein, 21 aa, Entamoeba invadens
KMLKLKSQKYFYVFGKEMNNL

SEQ ID NO: 2948598 - protein, 23 aa, Entamoeba invadens
KMLLDEYWGYVGMVQASTRDKIA

SEQ ID NO: 2948599 - protein, 21 aa, Entamoeba invadens
KMLLDIICGILLGKSYVPFGA

SEQ ID NO: 2948600 - protein, 17 aa, Entamoeba invadens
KMLLDYIYLNSLLDESK

SEQ ID NO: 2948601 - protein, 18 aa, Entamoeba invadens
KMLQPSFCRVTDFREAIC

SEQ ID NO: 2948602 - protein, 18 aa, Entamoeba invadens
KMLSCGVAANSPMYPQLV

SEQ ID NO: 2948603 - protein, 26 aa, Entamoeba invadens
KMLSDLRIVFVVSFHSALMWWNTHFA

SEQ ID NO: 2948604 - protein, 17 aa, Entamoeba invadens
KMLSLILTELNKYVFDQ

SEQ ID NO: 2948605 - protein, 26 aa, Entamoeba invadens
KMLWEMIECCALRGVFYPTNSYYLES

SEQ ID NO: 2948606 - protein, 19 aa, Entamoeba invadens
KMMEFKVECLPDFIKNISQ

SEQ ID NO: 2948607 - protein, 22 aa, Entamoeba invadens
KMMKEREEYLREWKKRKRITKE

SEQ ID NO: 2948608 - protein, 25 aa, Entamoeba invadens
KMMLDVCQPIKGLIAAIADKMSLHH

SEQ ID NO: 2948609 - protein, 25 aa, Entamoeba invadens
KMMPQTTRFLSPRSGPKDVYLPSTI

SEQ ID NO: 2948610 - protein, 26 aa, Entamoeba invadens
KMMRIVQTWGVLFPKQLFDYTNMYMK

SEQ ID NO: 2948611 - protein, 19 aa, Entamoeba invadens
KMMTLCAPVRVVGDEHGHV

SEQ ID NO: 2948612 - protein, 19 aa, Entamoeba invadens
KMNFFRVNIWYEVSYELVQ

SEQ ID NO: 2948613 - protein, 17 aa, Entamoeba invadens
KMNNQMCIFSYTPDSDL

SEQ ID NO: 2948614 - protein, 25 aa, Entamoeba invadens
KMNRCVVLGNAFRPFPIKETVSNFF

SEQ ID NO: 2948615 - protein, 26 aa, Entamoeba invadens
KMPFPCAIEGWFEFRNSPLGEETYTG

SEQ ID NO: 2948616 - protein, 22 aa, Entamoeba invadens
KMPGEVKSIVQYQDKLFLSMNC

SEQ ID NO: 2948617 - protein, 21 aa, Entamoeba invadens
KMPKLVVVNCPLYFENENDTS

SEQ ID NO: 2948618 - protein, 19 aa, Entamoeba invadens
KMPLTKWKLKNCGDNLLFM

SEQ ID NO: 2948619 - protein, 18 aa, Entamoeba invadens
KMPNLKNVKLIGGTQVEK

SEQ ID NO: 2948620 - protein, 23 aa, Entamoeba invadens
KMPTEINEGIFLTFDFGGGTLDT

SEQ ID NO: 2948621 - protein, 18 aa, Entamoeba invadens
KMQHGFILNNGYFMPAIG

SEQ ID NO: 2948622 - protein, 22 aa, Entamoeba invadens
KMQKYKTKFDVFDQKHGKEKMN

SEQ ID NO: 2948623 - protein, 18 aa, Entamoeba invadens
KMQMIFSSIKTFALKLND

SEQ ID NO: 2948624 - protein, 22 aa, Entamoeba invadens
KMQSVLIMFLLKYCDMTVGRPH

SEQ ID NO: 2948625 - protein, 18 aa, Entamoeba invadens
KMQTRVGIMLQVEAIKTA

SEQ ID NO: 2948626 - protein, 18 aa, Entamoeba invadens
KMQVKIADYGFCRSINGN

SEQ ID NO: 2948627 - protein, 18 aa, Entamoeba invadens
KMRARLISYTDIFQIKTN

SEQ ID NO: 2948628 - protein, 21 aa, Entamoeba invadens
KMRCKHCLTCNSTNYKTNGGD

SEQ ID NO: 2948629 - protein, 25 aa, Entamoeba invadens
KMRGGQLRKGQSLLFNQEKRKSNET

SEQ ID NO: 2948630 - protein, 18 aa, Entamoeba invadens
KMRMKSSELELKTRADKL

SEQ ID NO: 2948631 - protein, 26 aa, Entamoeba invadens
KMSKGVHVSLRFGVSSATRYERTTQY

SEQ ID NO: 2948632 - protein, 20 aa, Entamoeba invadens
KMSMVTEFAKYGSLKDLIQK

SEQ ID NO: 2948633 - protein, 18 aa, Entamoeba invadens
KMTDLLDENCRECFDDFV

SEQ ID NO: 2948634 - protein, 24 aa, Entamoeba invadens
KMTEIKPRVTLHFKSLKERLYEPG

SEQ ID NO: 2948635 - protein, 25 aa, Entamoeba invadens
KMTEVYRKNVDIVLVVFDTNDIYSF

SEQ ID NO: 2948636 - protein, 20 aa, Entamoeba invadens
KMTFTCPMWHPNIYANGDVC

SEQ ID NO: 2948637 - protein, 18 aa, Entamoeba invadens
KMTKEDLFDAGLLKENQV

SEQ ID NO: 2948638 - protein, 18 aa, Entamoeba invadens
KMTLEKMCSFTLPTDLMC

SEQ ID NO: 2948639 - protein, 18 aa, Entamoeba invadens
KMTLRFPEEIHFVNCLDN

SEQ ID NO: 2948640 - protein, 29 aa, Entamoeba invadens
KMTNCDCVTFALSCGMNSLKFFKIENSNK

SEQ ID NO: 2948641 - protein, 27 aa, Entamoeba invadens
KMTPERVCSYEAMMAGKMRLQDKEIEL

SEQ ID NO: 2948642 - protein, 24 aa, Entamoeba invadens
KMTRPEFEALPGWKKQKQKYELKL

SEQ ID NO: 2948643 - protein, 19 aa, Entamoeba invadens
KMTSSLVSRCMKDLHKNSL

SEQ ID NO: 2948644 - protein, 34 aa, Entamoeba invadens
KMTVEKSLKCVARFADLNLGIAISENDNMRLNSV

SEQ ID NO: 2948645 - protein, 17 aa, Entamoeba invadens
KMVCPTLSIPLLLLQIR

SEQ ID NO: 2948646 - protein, 24 aa, Entamoeba invadens
KMVDVFRAAWWFSALTKDEALSVL

SEQ ID NO: 2948647 - protein, 20 aa, Entamoeba invadens
KMVECYHVILDVASWINEKK

SEQ ID NO: 2948648 - protein, 19 aa, Entamoeba invadens
KMVELHGSSFAKPFCVVML

SEQ ID NO: 2948649 - protein, 27 aa, Entamoeba invadens
KMVFPLQRIKLLLCNQHKDCFKIKAGI

SEQ ID NO: 2948650 - protein, 26 aa, Entamoeba invadens
KMVIPKFCFEKCYLLTTVVFAETVET

SEQ ID NO: 2948651 - protein, 23 aa, Entamoeba invadens
KMVIWEKYFLRNKVVVPKKDENS

SEQ ID NO: 2948652 - protein, 18 aa, Entamoeba invadens
KMYAECYLMCDQRKVNEK

SEQ ID NO: 2948653 - protein, 17 aa, Entamoeba invadens
KMYFKVMIIKVKNLDTL

SEQ ID NO: 2948654 - protein, 23 aa, Entamoeba invadens
KMYIPELIFGHLLTSSNYRDDDK

SEQ ID NO: 2948655 - protein, 17 aa, Entamoeba invadens
KMYKIVFDSSDMDLCAK

SEQ ID NO: 2948656 - protein, 25 aa, Entamoeba invadens
KMYKLCGICGKKLLINSEEETQHME

SEQ ID NO: 2948657 - protein, 17 aa, Entamoeba invadens
KMYLLKELEWVYVDNMA

SEQ ID NO: 2948658 - protein, 24 aa, Entamoeba invadens
KMYQDCATQCRRLISRMQPTTETQ

SEQ ID NO: 2948659 - protein, 20 aa, Entamoeba invadens
KMYQINGEWTYHTNGGRVKN

SEQ ID NO: 2948660 - protein, 24 aa, Entamoeba invadens
KMYRPKNYLPLFLNPLLAVVPTTP

SEQ ID NO: 2948661 - protein, 26 aa, Entamoeba invadens
KMYVCGRNSVVYTKKWLEDFGKKTST

SEQ ID NO: 2948662 - protein, 20 aa, Entamoeba invadens
KMYYGEGIPQIYNEVFDSFN

SEQ ID NO: 2948663 - protein, 20 aa, Entamoeba invadens
KNACAELLFVAQENGTFDVQ

SEQ ID NO: 2948664 - protein, 24 aa, Entamoeba invadens
KNADLRLVDFAVFYELSASFEFFK

SEQ ID NO: 2948665 - protein, 23 aa, Entamoeba invadens
KNAEIKLRQFAVESVFKAQFASL

SEQ ID NO: 2948666 - protein, 23 aa, Entamoeba invadens
KNAEIKLRQFAVESVFKTQFACL

SEQ ID NO: 2948667 - protein, 29 aa, Entamoeba invadens
KNAEYLPDFVRMFFTKFFKIMREGEVETV

SEQ ID NO: 2948668 - protein, 17 aa, Entamoeba invadens
KNAFKNCELLSEVNNMD

SEQ ID NO: 2948669 - protein, 23 aa, Entamoeba invadens
KNAFRKAQITLEYKKRENSINEK

SEQ ID NO: 2948670 - protein, 20 aa, Entamoeba invadens
KNAFVGCYSFDISQYTKQKK

SEQ ID NO: 2948671 - protein, 21 aa, Entamoeba invadens
KNAKCAGKFFLTSEEVVKQIG

SEQ ID NO: 2948672 - protein, 23 aa, Entamoeba invadens
KNAKHLTPGFIFAGIIPVYDTYS

SEQ ID NO: 2948673 - protein, 21 aa, Entamoeba invadens
KNAKNRFLLRIKQKETDSSLK

SEQ ID NO: 2948674 - protein, 25 aa, Entamoeba invadens
KNALLRLQKRLLFHRSKTIVYNKAG

SEQ ID NO: 2948675 - protein, 26 aa, Entamoeba invadens
KNAMFDEAWFPYAHFHPFYASFHSMN

SEQ ID NO: 2948676 - protein, 17 aa, Entamoeba invadens
KNARRQRLLKSFYLPLL

SEQ ID NO: 2948677 - protein, 23 aa, Entamoeba invadens
KNARRRKKQLLKMERKENKNKGN

SEQ ID NO: 2948678 - protein, 21 aa, Entamoeba invadens
KNASDKKIFALNSEKDELEDK

SEQ ID NO: 2948679 - protein, 20 aa, Entamoeba invadens
KNCEEPGCLATYTKTRFNSC

SEQ ID NO: 2948680 - protein, 21 aa, Entamoeba invadens
KNCEISCSIFEILLKQPLNHG

SEQ ID NO: 2948681 - protein, 23 aa, Entamoeba invadens
KNCFPPQTKWCVLNMHNKSTVMQ

SEQ ID NO: 2948682 - protein, 22 aa, Entamoeba invadens
KNCKKCATLFGRYCNECNDHFK

SEQ ID NO: 2948683 - protein, 23 aa, Entamoeba invadens
KNCMANCDPKMFIPLIPIIVSRL

SEQ ID NO: 2948684 - protein, 24 aa, Entamoeba invadens
KNCMANCDPKMFIPLIPIIVSRLG

SEQ ID NO: 2948685 - protein, 19 aa, Entamoeba invadens
KNCNCFSDALCKKLLQKGI

SEQ ID NO: 2948686 - protein, 22 aa, Entamoeba invadens
KNCQYCIGKMAFYKCSNITSLS

SEQ ID NO: 2948687 - protein, 17 aa, Entamoeba invadens
KNCTFRHSGLKAIYFSG

SEQ ID NO: 2948688 - protein, 17 aa, Entamoeba invadens
KNCTGTFSYFRQYNEYQ

SEQ ID NO: 2948689 - protein, 21 aa, Entamoeba invadens
KNCVTALEMLHINPPKLCVGM

SEQ ID NO: 2948690 - protein, 19 aa, Entamoeba invadens
KNDCTLLVDGIDVDFIYTP

SEQ ID NO: 2948691 - protein, 26 aa, Entamoeba invadens
KNDDCPRNIYLIIVIIDKIFKIESEE

SEQ ID NO: 2948692 - protein, 18 aa, Entamoeba invadens
KNDIELINGNNLIGIDNT

SEQ ID NO: 2948693 - protein, 21 aa, Entamoeba invadens
KNDIIERLRLVLSKSRTVKDE

SEQ ID NO: 2948694 - protein, 24 aa, Entamoeba invadens
KNDINVFIKNHWALLSNLPLFKTN

SEQ ID NO: 2948695 - protein, 24 aa, Entamoeba invadens
KNDIRLKSLQIMKIQSEYDVNEKQ

SEQ ID NO: 2948696 - protein, 24 aa, Entamoeba invadens
KNDMCISFAKGPFIKQRNLFLFKL

SEQ ID NO: 2948697 - protein, 19 aa, Entamoeba invadens
KNDQCAKGYIDINIGTKVY

SEQ ID NO: 2948698 - protein, 20 aa, Entamoeba invadens
KNDSCGYLFLGDYVDRGDFG

SEQ ID NO: 2948699 - protein, 23 aa, Entamoeba invadens
KNDTHKVFLIDGFPRNEENKSSW

SEQ ID NO: 2948700 - protein, 18 aa, Entamoeba invadens
KNDWKKDMLKTFPEKLMK

SEQ ID NO: 2948701 - protein, 23 aa, Entamoeba invadens
KNEAKWAELEWKNYLKHTNSIIT

SEQ ID NO: 2948702 - protein, 27 aa, Entamoeba invadens
KNEARDTRDICIKKKGISGNKCSPTCY

SEQ ID NO: 2948703 - protein, 17 aa, Entamoeba invadens
KNECSIKMNVLNKKFGD

SEQ ID NO: 2948704 - protein, 25 aa, Entamoeba invadens
KNEDAPDIAMCWDNGKGTKDGCVKT

SEQ ID NO: 2948705 - protein, 24 aa, Entamoeba invadens
KNEEFKLDCGLYVWINGNNLFQFG

SEQ ID NO: 2948706 - protein, 22 aa, Entamoeba invadens
KNEFFQCFCKEFGHIENFEPKK

SEQ ID NO: 2948707 - protein, 35 aa, Entamoeba invadens
KNEFPDVQKTFMFNHWCFFCQTFVESGEQKIKKVD

SEQ ID NO: 2948708 - protein, 20 aa, Entamoeba invadens
KNEFPEAYVPTVFDNYTTNV

SEQ ID NO: 2948709 - protein, 20 aa, Entamoeba invadens
KNEGILGFHLENVSVQNEKN

SEQ ID NO: 2948710 - protein, 27 aa, Entamoeba invadens
KNEILRINPNLAEFVNFYYTTNHDETI

SEQ ID NO: 2948711 - protein, 21 aa, Entamoeba invadens
KNEKEKECGIVVERDNTKAET

SEQ ID NO: 2948712 - protein, 24 aa, Entamoeba invadens
KNEKEMCRMCKNATMYDEVPQEMI

SEQ ID NO: 2948713 - protein, 25 aa, Entamoeba invadens
KNEKNLRKVIGFCGFPNVGKSSTIN

SEQ ID NO: 2948714 - protein, 22 aa, Entamoeba invadens
KNELILFYMFYVMVGEEAQFKA

SEQ ID NO: 2948715 - protein, 18 aa, Entamoeba invadens
KNELLAEFINSWQNAKQR

SEQ ID NO: 2948716 - protein, 21 aa, Entamoeba invadens
KNELLLHFELIGRIELHPSIS

SEQ ID NO: 2948717 - protein, 20 aa, Entamoeba invadens
KNELTPMGLFGSQNKDPLAN

SEQ ID NO: 2948718 - protein, 20 aa, Entamoeba invadens
KNELWDIFLDVSLHLEMYEK

SEQ ID NO: 2948719 - protein, 19 aa, Entamoeba invadens
KNELWKSVDSQIMDKLSLQ

SEQ ID NO: 2948720 - protein, 20 aa, Entamoeba invadens
KNEMDLKTLISIFYTLLIDS

SEQ ID NO: 2948721 - protein, 24 aa, Entamoeba invadens
KNEMTWKDIVHFSYQIASGMAEIH

SEQ ID NO: 2948722 - protein, 24 aa, Entamoeba invadens
KNESPKVVEDMFGVQISKSTEENK

SEQ ID NO: 2948723 - protein, 21 aa, Entamoeba invadens
KNESVFFLKWHVLQPDYAINL

SEQ ID NO: 2948724 - protein, 20 aa, Entamoeba invadens
KNESVYFFKWHILQPDYATN

SEQ ID NO: 2948725 - protein, 18 aa, Entamoeba invadens
KNFAMILGPLVIHPGSSV

SEQ ID NO: 2948726 - protein, 22 aa, Entamoeba invadens
KNFDSYALYISRVLKSVFPDIG

SEQ ID NO: 2948727 - protein, 21 aa, Entamoeba invadens
KNFEEIICNIFGPLLEATLNP

SEQ ID NO: 2948728 - protein, 24 aa, Entamoeba invadens
KNFEIPLSRSLRPMRIDDVSHQKL

SEQ ID NO: 2948729 - protein, 20 aa, Entamoeba invadens
KNFFKRVIYYPVDCSKHNNK

SEQ ID NO: 2948730 - protein, 25 aa, Entamoeba invadens
KNFFNKMFCHWNHYVRMFFCELLLY

SEQ ID NO: 2948731 - protein, 17 aa, Entamoeba invadens
KNFIFKVSEKLVYKFSI

SEQ ID NO: 2948732 - protein, 17 aa, Entamoeba invadens
KNFKPPKLFFAIDKSEL

SEQ ID NO: 2948733 - protein, 17 aa, Entamoeba invadens
KNFLRTTLHPMKTSFNS

SEQ ID NO: 2948734 - protein, 17 aa, Entamoeba invadens
KNFPYAGSFIQRQGELF

SEQ ID NO: 2948735 - protein, 23 aa, Entamoeba invadens
KNFTFKISKKLVYKSKKASAENL

SEQ ID NO: 2948736 - protein, 28 aa, Entamoeba invadens
KNFTQIFTIPRRCCVRRKQSVYLQNPEE

SEQ ID NO: 2948737 - protein, 19 aa, Entamoeba invadens
KNGASLFLRDSMGCTALHY

SEQ ID NO: 2948738 - protein, 23 aa, Entamoeba invadens
KNGDLMVNAVYNFMTNRASNYGK

SEQ ID NO: 2948739 - protein, 17 aa, Entamoeba invadens
KNGGFKWVQEKHSSLTK

SEQ ID NO: 2948740 - protein, 18 aa, Entamoeba invadens
KNGGIEWVEKKFGIMKED

SEQ ID NO: 2948741 - protein, 19 aa, Entamoeba invadens
KNGIEFSAIVPITSHEWEV

SEQ ID NO: 2948742 - protein, 20 aa, Entamoeba invadens
KNGIQLGLHFARNHKNISRF

SEQ ID NO: 2948743 - protein, 20 aa, Entamoeba invadens
KNGLENFCYSMKNTLNEQIA

SEQ ID NO: 2948744 - protein, 24 aa, Entamoeba invadens
KNGLSYKDSLLFVQSKRQCVMPNS

SEQ ID NO: 2948745 - protein, 30 aa, Entamoeba invadens
KNGRNYLDKRSKAILKKWFNEHYAYPYPSD

SEQ ID NO: 2948746 - protein, 21 aa, Entamoeba invadens
KNGRTRAGINFLASDAAKGIS

SEQ ID NO: 2948747 - protein, 18 aa, Entamoeba invadens
KNGSEWDGVKLTLSVQKR

SEQ ID NO: 2948748 - protein, 25 aa, Entamoeba invadens
KNGSFRQCCHYGKVLLPKLLDIPKE

SEQ ID NO: 2948749 - protein, 17 aa, Entamoeba invadens
KNGVFAITKRICSLSGN

SEQ ID NO: 2948750 - protein, 27 aa, Entamoeba invadens
KNGYDFDDIFKFLSFLDETLKINQQYG

SEQ ID NO: 2948751 - protein, 26 aa, Entamoeba invadens
KNGYFLRDDLIEFAGLFVQFKTKNEQ

SEQ ID NO: 2948752 - protein, 21 aa, Entamoeba invadens
KNHDYCDCCLKNFGIILYCDG

SEQ ID NO: 2948753 - protein, 18 aa, Entamoeba invadens
KNHIEEFLKDLSDLTQLK

SEQ ID NO: 2948754 - protein, 24 aa, Entamoeba invadens
KNHINCPKQFFAKEDVKCGIFLRE

SEQ ID NO: 2948755 - protein, 28 aa, Entamoeba invadens
KNHLKYRKSVLWPFLDFFLVNNNTPLSC

SEQ ID NO: 2948756 - protein, 20 aa, Entamoeba invadens
KNHPWFEGINWNTLLSESRE

SEQ ID NO: 2948757 - protein, 27 aa, Entamoeba invadens
KNHQRKGAWTGGKFGDLSGVGENIDRR

SEQ ID NO: 2948758 - protein, 27 aa, Entamoeba invadens
KNHVQELLQMFRFVCCMDYEAKCRDEV

SEQ ID NO: 2948759 - protein, 24 aa, Entamoeba invadens
KNHVSRVCVYGVILVNNMGFPCLL

SEQ ID NO: 2948760 - protein, 28 aa, Entamoeba invadens
KNIARFRCKGRIPLVTYYSSKTGAALFR

SEQ ID NO: 2948761 - protein, 20 aa, Entamoeba invadens
KNIDKVVVWYSISYKESLKY

SEQ ID NO: 2948762 - protein, 25 aa, Entamoeba invadens
KNIEFWRQLWRTCEQSDLVLQIVDG

SEQ ID NO: 2948763 - protein, 17 aa, Entamoeba invadens
KNIEGFIQEAGRAGRDG

SEQ ID NO: 2948764 - protein, 19 aa, Entamoeba invadens
KNIELKYLRNAHITIDAEI

SEQ ID NO: 2948765 - protein, 19 aa, Entamoeba invadens
KNIESKVLIEWIGNEVPSR

SEQ ID NO: 2948766 - protein, 20 aa, Entamoeba invadens
KNIFESFDMVLKKILDGEGL

SEQ ID NO: 2948767 - protein, 30 aa, Entamoeba invadens
KNIFLTNMLFDFALEYGYFFNSKLARNTGG

SEQ ID NO: 2948768 - protein, 22 aa, Entamoeba invadens
KNIFNRLSRILAHFLYAHHEVE

SEQ ID NO: 2948769 - protein, 23 aa, Entamoeba invadens
KNIGSCTLCGGVVVPLVPEEELK

SEQ ID NO: 2948770 - protein, 18 aa, Entamoeba invadens
KNIHGGLTPGGRVRMEKL

SEQ ID NO: 2948771 - protein, 20 aa, Entamoeba invadens
KNIINSISFQNMKRKELLQY

SEQ ID NO: 2948772 - protein, 21 aa, Entamoeba invadens
KNIKIGLCNVFLMHTSASLSI

SEQ ID NO: 2948773 - protein, 26 aa, Entamoeba invadens
KNIKLNELQLIFGRKSTIIGQYMDML

SEQ ID NO: 2948774 - protein, 28 aa, Entamoeba invadens
KNIKTGVPRVWVDGCFDMFHWGHANVVR

SEQ ID NO: 2948775 - protein, 17 aa, Entamoeba invadens
KNILLLYKRENLVSRGQ

SEQ ID NO: 2948776 - protein, 21 aa, Entamoeba invadens
KNILLRLTKPVDVPNIINIKV

SEQ ID NO: 2948777 - protein, 30 aa, Entamoeba invadens
KNIMLLCVSEAGWVFGCFTTTAVSNNQKTH

SEQ ID NO: 2948778 - protein, 23 aa, Entamoeba invadens
KNIPEKLSLIFIVKKYLTNIVRS

SEQ ID NO: 2948779 - protein, 19 aa, Entamoeba invadens
KNIQIFKFQIDEFQMKIKE

SEQ ID NO: 2948780 - protein, 18 aa, Entamoeba invadens
KNISRFALEVMDKCLSLY

SEQ ID NO: 2948781 - protein, 20 aa, Entamoeba invadens
KNISVCLANNFFTFLPVDNM

SEQ ID NO: 2948782 - protein, 19 aa, Entamoeba invadens
KNITAIFACSTFAEYKHEE

SEQ ID NO: 2948783 - protein, 22 aa, Entamoeba invadens
KNITCTDCSNCILNIDCESCET

SEQ ID NO: 2948784 - protein, 22 aa, Entamoeba invadens
KNITCTNCSNCILNIDCESCET

SEQ ID NO: 2948785 - protein, 25 aa, Entamoeba invadens
KNITFRFKFQFTDTVLLFQKGAFDY

SEQ ID NO: 2948786 - protein, 24 aa, Entamoeba invadens
KNITSCYFRGAHGIMIVYDMTKQK

SEQ ID NO: 2948787 - protein, 26 aa, Entamoeba invadens
KNKAISVIFELDFPNPVLLIKLKQLS

SEQ ID NO: 2948788 - protein, 21 aa, Entamoeba invadens
KNKCPYCNKEMLFMVQVYAPL

SEQ ID NO: 2948789 - protein, 30 aa, Entamoeba invadens
KNKCVLTKEFFCIIVWFAVDFKTVNTNKSR

SEQ ID NO: 2948790 - protein, 25 aa, Entamoeba invadens
KNKDCPVCSINLRIDEYLPKEMATM

SEQ ID NO: 2948791 - protein, 25 aa, Entamoeba invadens
KNKDEFRKAMVLFQIVLEGNEMLEI

SEQ ID NO: 2948792 - protein, 24 aa, Entamoeba invadens
KNKDLRELFQLMTYPGPARFSPGD

SEQ ID NO: 2948793 - protein, 17 aa, Entamoeba invadens
KNKECIVATSSMALSPY

SEQ ID NO: 2948794 - protein, 26 aa, Entamoeba invadens
KNKEDLCGFNIWPYAYMDKSIKYRGF

SEQ ID NO: 2948795 - protein, 23 aa, Entamoeba invadens
KNKELPEEFKVSGDLVTGKNVFF

SEQ ID NO: 2948796 - protein, 29 aa, Entamoeba invadens
KNKEPNCIVQNSFGCWRCQDTYYLDIPTK

SEQ ID NO: 2948797 - protein, 23 aa, Entamoeba invadens
KNKEYFVNFSRFQIVTIEHLKKY

SEQ ID NO: 2948798 - protein, 20 aa, Entamoeba invadens
KNKFVASFVEIEYLGNIDEE

SEQ ID NO: 2948799 - protein, 24 aa, Entamoeba invadens
KNKFYRIIVWFSVNFVIVDRNKNR

SEQ ID NO: 2948800 - protein, 26 aa, Entamoeba invadens
KNKGFSIRTIRKFLFHLLHALQTLSQ

SEQ ID NO: 2948801 - protein, 23 aa, Entamoeba invadens
KNKGLCIEMDKFLLSSMQSVLFQ

SEQ ID NO: 2948802 - protein, 18 aa, Entamoeba invadens
KNKKACFLNILLSLFCGD

SEQ ID NO: 2948803 - protein, 26 aa, Entamoeba invadens
KNKKGKRVNYCFVEFVHHSDAERAAR

SEQ ID NO: 2948804 - protein, 23 aa, Entamoeba invadens
KNKKIHFILGGAFGNRETMINKL

SEQ ID NO: 2948805 - protein, 32 aa, Entamoeba invadens
KNKKLEFIPCKECPYKKSIGSVYIFEKDNARY

SEQ ID NO: 2948806 - protein, 22 aa, Entamoeba invadens
KNKLYDVPILFVGNKSDIEQQR

SEQ ID NO: 2948807 - protein, 26 aa, Entamoeba invadens
KNKMTYKEALKFVTNKRMCVLPNKGF

SEQ ID NO: 2948808 - protein, 23 aa, Entamoeba invadens
KNKNFRNFKLFKVSSKNGTGMDE

SEQ ID NO: 2948809 - protein, 22 aa, Entamoeba invadens
KNKPEMLEAMEIDSSIPDMKDD

SEQ ID NO: 2948810 - protein, 18 aa, Entamoeba invadens
KNKQDILLNTLKKITNYI

SEQ ID NO: 2948811 - protein, 21 aa, Entamoeba invadens
KNKRVMCKAITYSSDDIYHNI

SEQ ID NO: 2948812 - protein, 17 aa, Entamoeba invadens
KNKSCRFIIDEEVFTEG

SEQ ID NO: 2948813 - protein, 18 aa, Entamoeba invadens
KNKSEWNGVPVYFKLDKK

SEQ ID NO: 2948814 - protein, 30 aa, Entamoeba invadens
KNKSFLCQAEFSFLANMIMKNYRLKAEGNS

SEQ ID NO: 2948815 - protein, 20 aa, Entamoeba invadens
KNKVCIVSNDKIFDWGNTIN

SEQ ID NO: 2948816 - protein, 26 aa, Entamoeba invadens
KNKVEILDWKRLVVVLENAPIRSVKV

SEQ ID NO: 2948817 - protein, 22 aa, Entamoeba invadens
KNKVFRAFAGVQCSPKTTNGLS

SEQ ID NO: 2948818 - protein, 23 aa, Entamoeba invadens
KNLAVCLAPCIIRTATNSFETVQ

SEQ ID NO: 2948819 - protein, 19 aa, Entamoeba invadens
KNLAVCWTPTLFSVASDDI

SEQ ID NO: 2948820 - protein, 26 aa, Entamoeba invadens
KNLDEFTVDFIIDFERIFDNDITTWE

SEQ ID NO: 2948821 - protein, 17 aa, Entamoeba invadens
KNLDYDGCEKLIEKILV

SEQ ID NO: 2948822 - protein, 26 aa, Entamoeba invadens
KNLESHYLCAAAFNALVQKMEKTAFV

SEQ ID NO: 2948823 - protein, 29 aa, Entamoeba invadens
KNLETKETLCFTMSLNTLVTAFKPQVALR

SEQ ID NO: 2948824 - protein, 28 aa, Entamoeba invadens
KNLFAFINECYKFFGKEIKGAEDVLDIL

SEQ ID NO: 2948825 - protein, 20 aa, Entamoeba invadens
KNLFCTWPQTALPKENAFKQ

SEQ ID NO: 2948826 - protein, 27 aa, Entamoeba invadens
KNLIKEMLKREGLTFMEKVLLDTSLEV

SEQ ID NO: 2948827 - protein, 22 aa, Entamoeba invadens
KNLKDLEKIECEKEQNETKEEN

SEQ ID NO: 2948828 - protein, 20 aa, Entamoeba invadens
KNLKEGLLLSILSNHLHTSY

SEQ ID NO: 2948829 - protein, 19 aa, Entamoeba invadens
KNLKFFLDVVSQRKLTLTS

SEQ ID NO: 2948830 - protein, 17 aa, Entamoeba invadens
KNLKISDSSLYFLKENL

SEQ ID NO: 2948831 - protein, 25 aa, Entamoeba invadens
KNLKMSVELPVCKILIISMCQNCDL

SEQ ID NO: 2948832 - protein, 21 aa, Entamoeba invadens
KNLKRSTIIENFAFGKSHPRL

SEQ ID NO: 2948833 - protein, 17 aa, Entamoeba invadens
KNLKRVDLNGVTKISNA

SEQ ID NO: 2948834 - protein, 17 aa, Entamoeba invadens
KNLKVALLEKARDVSTG

SEQ ID NO: 2948835 - protein, 23 aa, Entamoeba invadens
KNLKVDIGAFFNCNKMKRLEVNE

SEQ ID NO: 2948836 - protein, 22 aa, Entamoeba invadens
KNLKVLAFYMNFFYNLTINNQS

SEQ ID NO: 2948837 - protein, 24 aa, Entamoeba invadens
KNLLKKCMIGLVQKHIITVYMLLA

SEQ ID NO: 2948838 - protein, 19 aa, Entamoeba invadens
KNLLMKNTHYWKTQFDLND

SEQ ID NO: 2948839 - protein, 23 aa, Entamoeba invadens
KNLLMKNTHYWKTQFDLNDTFTE

SEQ ID NO: 2948840 - protein, 23 aa, Entamoeba invadens
KNLLRKQKFVYLILDEAHSAKNE

SEQ ID NO: 2948841 - protein, 33 aa, Entamoeba invadens
KNLNFKNNCFEVAYFVFCCNLNLSLQQDVSTRN

SEQ ID NO: 2948842 - protein, 20 aa, Entamoeba invadens
KNLNVIVGMMTKLGMPFSIN

SEQ ID NO: 2948843 - protein, 23 aa, Entamoeba invadens
KNLPKCVLQYDFSHIKNADAKTK

SEQ ID NO: 2948844 - protein, 23 aa, Entamoeba invadens
KNLPKRPEFGPSLQKVTLQTNIF

SEQ ID NO: 2948845 - protein, 24 aa, Entamoeba invadens
KNLPRHVLIPAFLIDNGVEPRYCR

SEQ ID NO: 2948846 - protein, 20 aa, Entamoeba invadens
KNLRYPLSFEDYVKKYNDRA

SEQ ID NO: 2948847 - protein, 17 aa, Entamoeba invadens
KNLSLAFFGKIKKYMEL

SEQ ID NO: 2948848 - protein, 20 aa, Entamoeba invadens
KNLSVCWTPTMFSVSTEELS

SEQ ID NO: 2948849 - protein, 24 aa, Entamoeba invadens
KNLSYEAKCVVMGLLEKEPEERLT

SEQ ID NO: 2948850 - protein, 17 aa, Entamoeba invadens
KNLTFSNSFNLYVDLQA

SEQ ID NO: 2948851 - protein, 23 aa, Entamoeba invadens
KNLVEERCVWRSQFEQNTGVDKR

SEQ ID NO: 2948852 - protein, 27 aa, Entamoeba invadens
KNLVSRGFEEVKIREALKETKGDVEKA

SEQ ID NO: 2948853 - protein, 20 aa, Entamoeba invadens
KNLVVFLVLFIFQDFFPDLY

SEQ ID NO: 2948854 - protein, 18 aa, Entamoeba invadens
KNLWDYEALFTQINCGNG

SEQ ID NO: 2948855 - protein, 24 aa, Entamoeba invadens
KNMEMGKMILKHCVRSIEMFVESN

SEQ ID NO: 2948856 - protein, 18 aa, Entamoeba invadens
KNMIKMIFLNEVLTESTP

SEQ ID NO: 2948857 - protein, 17 aa, Entamoeba invadens
KNMIKVVNFLKDATHVV

SEQ ID NO: 2948858 - protein, 18 aa, Entamoeba invadens
KNMIRFSVNGLFNKEINV

SEQ ID NO: 2948859 - protein, 19 aa, Entamoeba invadens
KNMKFLWTLSNDKASFFFH

SEQ ID NO: 2948860 - protein, 20 aa, Entamoeba invadens
KNMKNPIFVLTDFDEEIHQM

SEQ ID NO: 2948861 - protein, 23 aa, Entamoeba invadens
KNMKRRRRRVLKQIVEKAKISLS

SEQ ID NO: 2948862 - protein, 24 aa, Entamoeba invadens
KNMKVPRVQGIIMEALKLSTAIKN

SEQ ID NO: 2948863 - protein, 19 aa, Entamoeba invadens
KNMLNARIAEIQAQLDEER

SEQ ID NO: 2948864 - protein, 20 aa, Entamoeba invadens
KNMNIFGWYNSKKVPESGFI

SEQ ID NO: 2948865 - protein, 23 aa, Entamoeba invadens
KNMRCLRNVFKTFNITKIQSGCF

SEQ ID NO: 2948866 - protein, 23 aa, Entamoeba invadens
KNNEKRPTLAQLLKQLNEIKLNY

SEQ ID NO: 2948867 - protein, 17 aa, Entamoeba invadens
KNNFIWGTYNGVSYFGG

SEQ ID NO: 2948868 - protein, 17 aa, Entamoeba invadens
KNNFKYNRVLHCDVSDV

SEQ ID NO: 2948869 - protein, 24 aa, Entamoeba invadens
KNNGNWQWPKGCYVGYWNGTKISP

SEQ ID NO: 2948870 - protein, 34 aa, Entamoeba invadens
KNNILMFNVCLLLSRISLDFGIHPGVPYPFQDQF

SEQ ID NO: 2948871 - protein, 26 aa, Entamoeba invadens
KNNKGVLCKTGFVLNEQFECISSEIC

SEQ ID NO: 2948872 - protein, 35 aa, Entamoeba invadens
KNNKIVVMLVNFFKDLYHGFEFSFTISDCNFKSED

SEQ ID NO: 2948873 - protein, 22 aa, Entamoeba invadens
KNNLPNGMVFFFDFGGGTLDTA

SEQ ID NO: 2948874 - protein, 26 aa, Entamoeba invadens
KNNLRSPTIWHLYGIVAREQKDYVES

SEQ ID NO: 2948875 - protein, 23 aa, Entamoeba invadens
KNNQGVFLFKGWGEVLDKGKAFK

SEQ ID NO: 2948876 - protein, 30 aa, Entamoeba invadens
KNNYACQFTFKHVYLDLGMNPTLVVVERKK

SEQ ID NO: 2948877 - protein, 27 aa, Entamoeba invadens
KNNYVFAICDGCGWGELGKDASNIGLN

SEQ ID NO: 2948878 - protein, 20 aa, Entamoeba invadens
KNPISLFGVIAARLLCLQKL

SEQ ID NO: 2948879 - protein, 18 aa, Entamoeba invadens
KNPKFLPKRSREKVGRLK

SEQ ID NO: 2948880 - protein, 19 aa, Entamoeba invadens
KNPLLQILRGFLLDKSKWT

SEQ ID NO: 2948881 - protein, 19 aa, Entamoeba invadens
KNPNFKINPLRVVVRNVPR

SEQ ID NO: 2948882 - protein, 25 aa, Entamoeba invadens
KNPRNCKMCRECIRDQRQEFVKLGR

SEQ ID NO: 2948883 - protein, 22 aa, Entamoeba invadens
KNPTVAIALKMVMAAGRDSKIF

SEQ ID NO: 2948884 - protein, 23 aa, Entamoeba invadens
KNPYCIGCATAMGAVKVQTCCKC

SEQ ID NO: 2948885 - protein, 17 aa, Entamoeba invadens
KNQCIVPGYTILSTSHV

SEQ ID NO: 2948886 - protein, 21 aa, Entamoeba invadens
KNQFPCLFNLVKKMNAKIPLV

SEQ ID NO: 2948887 - protein, 19 aa, Entamoeba invadens
KNQIARFNDAFQRANASQQ

SEQ ID NO: 2948888 - protein, 24 aa, Entamoeba invadens
KNQISLKKSRIVLFDKSPVDYIKP

SEQ ID NO: 2948889 - protein, 19 aa, Entamoeba invadens
KNQKWSIIDSIAIDKDINI

SEQ ID NO: 2948890 - protein, 18 aa, Entamoeba invadens
KNQLQLMNEKIKSREDLV

SEQ ID NO: 2948891 - protein, 21 aa, Entamoeba invadens
KNQLRRYCEYVTQVVKDEDDI

SEQ ID NO: 2948892 - protein, 20 aa, Entamoeba invadens
KNQLRRYCEYVTQVVKDEYN

SEQ ID NO: 2948893 - protein, 19 aa, Entamoeba invadens
KNQNLKLLLHFEDFGTKIP

SEQ ID NO: 2948894 - protein, 24 aa, Entamoeba invadens
KNQNLRLVLINGKYYLQAETEDQL

SEQ ID NO: 2948895 - protein, 28 aa, Entamoeba invadens
KNQPEWFPKVQLLRLMKKDVQFTYSMLL

SEQ ID NO: 2948896 - protein, 23 aa, Entamoeba invadens
KNQRSSFEPFLWTVSDHENEKVK

SEQ ID NO: 2948897 - protein, 20 aa, Entamoeba invadens
KNQYFCAINNVLIRPKKWIE

SEQ ID NO: 2948898 - protein, 23 aa, Entamoeba invadens
KNRAELYHIIFALKHMAKTFPVP

SEQ ID NO: 2948899 - protein, 22 aa, Entamoeba invadens
KNRCFKQLTSLECVKVMNATCF

SEQ ID NO: 2948900 - protein, 17 aa, Entamoeba invadens
KNRFSLNQENSFGNSNF

SEQ ID NO: 2948901 - protein, 20 aa, Entamoeba invadens
KNRIAAIQLLEEIFSGYPMY

SEQ ID NO: 2948902 - protein, 18 aa, Entamoeba invadens
KNRIKGHTREKFPPTNSQ

SEQ ID NO: 2948903 - protein, 25 aa, Entamoeba invadens
KNRKEFAKDMVLVFENAMNYNEKKT

SEQ ID NO: 2948904 - protein, 21 aa, Entamoeba invadens
KNRKLDIVSFSLIEPNKSLAT

SEQ ID NO: 2948905 - protein, 25 aa, Entamoeba invadens
KNRRRIGHNFFWFLKAEIHDARVTA

SEQ ID NO: 2948906 - protein, 20 aa, Entamoeba invadens
KNRTCADCGDTAVKYVDMTF

SEQ ID NO: 2948907 - protein, 24 aa, Entamoeba invadens
KNRYDHALGLYVYLRDELMGDMNN

SEQ ID NO: 2948908 - protein, 19 aa, Entamoeba invadens
KNSAFECYLKVKKEQKLVE

SEQ ID NO: 2948909 - protein, 18 aa, Entamoeba invadens
KNSDIVICLSYEIEHEEV

SEQ ID NO: 2948910 - protein, 24 aa, Entamoeba invadens
KNSECYQLGFLIFLLVQHNREVVV

SEQ ID NO: 2948911 - protein, 23 aa, Entamoeba invadens
KNSEFDVLSAIFAFWYKDVAQQI

SEQ ID NO: 2948912 - protein, 22 aa, Entamoeba invadens
KNSENLFFTQFCESLKNTSDEK

SEQ ID NO: 2948913 - protein, 19 aa, Entamoeba invadens
KNSFLFSFESNGRMNKPRM

SEQ ID NO: 2948914 - protein, 24 aa, Entamoeba invadens
KNSFPRTYLPTVFDNYLTTVKFKK

SEQ ID NO: 2948915 - protein, 19 aa, Entamoeba invadens
KNSGFSIKKGDKVRARLDV

SEQ ID NO: 2948916 - protein, 25 aa, Entamoeba invadens
KNSGILLMRAGLFGSDSVATAGIYP

SEQ ID NO: 2948917 - protein, 18 aa, Entamoeba invadens
KNSHFFPDITKLSEFTDS

SEQ ID NO: 2948918 - protein, 29 aa, Entamoeba invadens
KNSISKIFLRFCPFFAIYQHFLINHDNAF

SEQ ID NO: 2948919 - protein, 26 aa, Entamoeba invadens
KNSMIQMAVLYANAFMHYGTTNIMFL

SEQ ID NO: 2948920 - protein, 19 aa, Entamoeba invadens
KNSNFDWIISQAVNIGKCQ

SEQ ID NO: 2948921 - protein, 24 aa, Entamoeba invadens
KNSNYCVQCGLRLVYNSSNKLVSF

SEQ ID NO: 2948922 - protein, 24 aa, Entamoeba invadens
KNSSDIWKYLSLWDGDMQVDGTCP

SEQ ID NO: 2948923 - protein, 25 aa, Entamoeba invadens
KNSSRTSIQIAYICSRAEIFPNMVL

SEQ ID NO: 2948924 - protein, 27 aa, Entamoeba invadens
KNSSWLRWIACRLVMLEKREHDLVFLK

SEQ ID NO: 2948925 - protein, 20 aa, Entamoeba invadens
KNSTLRLVFDGVDNAPQKPT

SEQ ID NO: 2948926 - protein, 24 aa, Entamoeba invadens
KNSTSATHLYVWDSVISPHGNTFF

SEQ ID NO: 2948927 - protein, 21 aa, Entamoeba invadens
KNSYVTLILCDYFEAYCDILS

SEQ ID NO: 2948928 - protein, 18 aa, Entamoeba invadens
KNTCKLARIRDFKEEKMN

SEQ ID NO: 2948929 - protein, 19 aa, Entamoeba invadens
KNTEGEIVQLKSELNTQKE

SEQ ID NO: 2948930 - protein, 18 aa, Entamoeba invadens
KNTFLCVKRMPRIARPMQ

SEQ ID NO: 2948931 - protein, 19 aa, Entamoeba invadens
KNTFNMCYSLSFIKVPNGL

SEQ ID NO: 2948932 - protein, 18 aa, Entamoeba invadens
KNTLAHLSIHSSLINGVD

SEQ ID NO: 2948933 - protein, 35 aa, Entamoeba invadens
KNTLKKVIVCDGVDRLLSILTIFPFNKHKQIMYFF

SEQ ID NO: 2948934 - protein, 20 aa, Entamoeba invadens
KNTLRWTGRYLGRGTEPCVL

SEQ ID NO: 2948935 - protein, 31 aa, Entamoeba invadens
KNTMLFFSFYQRFVIEELFYVCQSRLQKFEE

SEQ ID NO: 2948936 - protein, 26 aa, Entamoeba invadens
KNTPLKKLMEAFCNKQGLNMSSVRFL

SEQ ID NO: 2948937 - protein, 20 aa, Entamoeba invadens
KNTPNYLLFQINRFFISTDL

SEQ ID NO: 2948938 - protein, 19 aa, Entamoeba invadens
KNTRFLDSLIPLFKLPSLK

SEQ ID NO: 2948939 - protein, 23 aa, Entamoeba invadens
KNTRLIQSYAFEKCKNLVLVKNL

SEQ ID NO: 2948940 - protein, 21 aa, Entamoeba invadens
KNTRMAIKLFRSHDLDRDGYL

SEQ ID NO: 2948941 - protein, 28 aa, Entamoeba invadens
KNVARIKGFPSILAVDVFKEYTKMKNIN

SEQ ID NO: 2948942 - protein, 23 aa, Entamoeba invadens
KNVECVHWDIGIITPYRKQVLDV

SEQ ID NO: 2948943 - protein, 27 aa, Entamoeba invadens
KNVFELFEFIGNLSLRQHEQHDQNTNS

SEQ ID NO: 2948944 - protein, 19 aa, Entamoeba invadens
KNVFKEFVGAITFTGLSVD

SEQ ID NO: 2948945 - protein, 23 aa, Entamoeba invadens
KNVGKFRVVYEIEGCEYCEYNQD

SEQ ID NO: 2948946 - protein, 23 aa, Entamoeba invadens
KNVGVCLTNLFKPEIFRGDNKLK

SEQ ID NO: 2948947 - protein, 25 aa, Entamoeba invadens
KNVGVQIIQLFKFLPGKDMFEQHYQ

SEQ ID NO: 2948948 - protein, 30 aa, Entamoeba invadens
KNVGYLFVFPSRVWDYFKEKMRMEIKVKGR

SEQ ID NO: 2948949 - protein, 23 aa, Entamoeba invadens
KNVHSLPGFVFEKNRLCIQSYEP

SEQ ID NO: 2948950 - protein, 19 aa, Entamoeba invadens
KNVIISVFINLTFSQACLK

SEQ ID NO: 2948951 - protein, 20 aa, Entamoeba invadens
KNVILSFERGGMVSRFVDGK

SEQ ID NO: 2948952 - protein, 24 aa, Entamoeba invadens
KNVKIMLMDGELCITWDKDIITDL

SEQ ID NO: 2948953 - protein, 18 aa, Entamoeba invadens
KNVKKLGTRCLTKYKKQS

SEQ ID NO: 2948954 - protein, 19 aa, Entamoeba invadens
KNVKKLGTRCLTKYKKQSI

SEQ ID NO: 2948955 - protein, 18 aa, Entamoeba invadens
KNVKLPEQHCESIRAREP

SEQ ID NO: 2948956 - protein, 22 aa, Entamoeba invadens
KNVKVCGEFKALSAAQIIISPN

SEQ ID NO: 2948957 - protein, 26 aa, Entamoeba invadens
KNVLDIPITICLRKDDGTQHQLVLNP

SEQ ID NO: 2948958 - protein, 20 aa, Entamoeba invadens
KNVLIEKLFECCSLSSEYKK

SEQ ID NO: 2948959 - protein, 26 aa, Entamoeba invadens
KNVLIEKLFECCSLSSEYKKSDILEF

SEQ ID NO: 2948960 - protein, 22 aa, Entamoeba invadens
KNVNKYVGFFYRVTFYGNAFEA

SEQ ID NO: 2948961 - protein, 23 aa, Entamoeba invadens
KNVNTYVGFFYRVTFYGNAFEAL

SEQ ID NO: 2948962 - protein, 21 aa, Entamoeba invadens
KNVNVANKWKMECELELTTLS

SEQ ID NO: 2948963 - protein, 17 aa, Entamoeba invadens
KNVPFRSVVTVGNHSFD

SEQ ID NO: 2948964 - protein, 29 aa, Entamoeba invadens
KNVPVSTCVRLGPFIPRLMTYLKQVEFYE

SEQ ID NO: 2948965 - protein, 19 aa, Entamoeba invadens
KNVREVYEVIASHFSETRY

SEQ ID NO: 2948966 - protein, 17 aa, Entamoeba invadens
KNVRSVGRFCFYNSVGE

SEQ ID NO: 2948967 - protein, 18 aa, Entamoeba invadens
KNVSLDFSKSVTLKSICL

SEQ ID NO: 2948968 - protein, 21 aa, Entamoeba invadens
KNVTCTNCSNCILNIDCESCE

SEQ ID NO: 2948969 - protein, 19 aa, Entamoeba invadens
KNVTECLQHVTFDIENAQN

SEQ ID NO: 2948970 - protein, 27 aa, Entamoeba invadens
KNVTIWNCTHINYLNTICDCISEVNLK

SEQ ID NO: 2948971 - protein, 23 aa, Entamoeba invadens
KNVVDVLGFLYFVVIEKMDNWFY

SEQ ID NO: 2948972 - protein, 21 aa, Entamoeba invadens
KNVWICPPAEYFDKIINEGCA

SEQ ID NO: 2948973 - protein, 20 aa, Entamoeba invadens
KNVYVFSWTIADDVASGKRP

SEQ ID NO: 2948974 - protein, 28 aa, Entamoeba invadens
KNYAIYCAQSLAAEQCVPKLEYGEQIAR

SEQ ID NO: 2948975 - protein, 18 aa, Entamoeba invadens
KNYEFLREFICTLSSICN

SEQ ID NO: 2948976 - protein, 17 aa, Entamoeba invadens
KNYEIVKQFVLANFEMI

SEQ ID NO: 2948977 - protein, 34 aa, Entamoeba invadens
KNYGEIIRNSIDWKAMKLPVKFGVQERGNNIVVV

SEQ ID NO: 2948978 - protein, 20 aa, Entamoeba invadens
KNYIYCVGVEKELFEKMIKT

SEQ ID NO: 2948979 - protein, 21 aa, Entamoeba invadens
KNYKETFVVPGNHEYYDGSFV

SEQ ID NO: 2948980 - protein, 28 aa, Entamoeba invadens
KNYKNCCLYCLKALFPNESNTYTSVFNT

SEQ ID NO: 2948981 - protein, 17 aa, Entamoeba invadens
KNYKVTCSHIIYTSSDR

SEQ ID NO: 2948982 - protein, 27 aa, Entamoeba invadens
KNYLPPAPLVFGLGIVFAVEKTEKEET

SEQ ID NO: 2948983 - protein, 27 aa, Entamoeba invadens
KNYSEPVDWWGFGVLIFEMIHGHAPYV

SEQ ID NO: 2948984 - protein, 31 aa, Entamoeba invadens
KNYSFYKIVIWFRVFYELTFKKSKVDIEFKQ

SEQ ID NO: 2948985 - protein, 19 aa, Entamoeba invadens
KNYTCNRKSLMVLPNTLHA

SEQ ID NO: 2948986 - protein, 18 aa, Entamoeba invadens
KNYTEVQASFGMIISLIK

SEQ ID NO: 2948987 - protein, 24 aa, Entamoeba invadens
KPAIECVKKIVLYFESLSRFQKSP

SEQ ID NO: 2948988 - protein, 18 aa, Entamoeba invadens
KPANICPFSARLKFETHV

SEQ ID NO: 2948989 - protein, 18 aa, Entamoeba invadens
KPAPLRTKCVNNYKLETQ

SEQ ID NO: 2948990 - protein, 18 aa, Entamoeba invadens
KPAPRRGTGAAKMVAPPA

SEQ ID NO: 2948991 - protein, 17 aa, Entamoeba invadens
KPAQWLVGKSVIRGRDW

SEQ ID NO: 2948992 - protein, 25 aa, Entamoeba invadens
KPATLKDDFPLLLLGNKVNCTDGSK

SEQ ID NO: 2948993 - protein, 24 aa, Entamoeba invadens
KPATLQFLQCFAILVENIKQTNFL

SEQ ID NO: 2948994 - protein, 20 aa, Entamoeba invadens
KPAVFLAPLMNWRNKNTQFG

SEQ ID NO: 2948995 - protein, 19 aa, Entamoeba invadens
KPCDPEADIIYTVDNDGKF

SEQ ID NO: 2948996 - protein, 21 aa, Entamoeba invadens
KPCFDNFIRFISGYSDDKNSL

SEQ ID NO: 2948997 - protein, 18 aa, Entamoeba invadens
KPCSEFDPYCSKCALDFT

SEQ ID NO: 2948998 - protein, 19 aa, Entamoeba invadens
KPDNILVVALDFDQKVNAK

SEQ ID NO: 2948999 - protein, 39 aa, Entamoeba invadens
KPEARIHGVLIEKMCSFKYECIIGCKKDPLFGPVIVFGM

SEQ ID NO: 2949000 - protein, 21 aa, Entamoeba invadens
KPEDFLGDFIDCFESRTPSLA

SEQ ID NO: 2949001 - protein, 18 aa, Entamoeba invadens
KPEETAMEIIKPDYDNVS

SEQ ID NO: 2949002 - protein, 19 aa, Entamoeba invadens
KPEFINRLDDIVVFTPLRQ

SEQ ID NO: 2949003 - protein, 22 aa, Entamoeba invadens
KPEFPVTLPPPIIIPPQKRNLF

SEQ ID NO: 2949004 - protein, 19 aa, Entamoeba invadens
KPEMLSPRIEPIKISDNIS

SEQ ID NO: 2949005 - protein, 23 aa, Entamoeba invadens
KPENRPRCCTFSMKGRFNKSFDR

SEQ ID NO: 2949006 - protein, 21 aa, Entamoeba invadens
KPENSYECFQFLNLLNSLHFK

SEQ ID NO: 2949007 - protein, 17 aa, Entamoeba invadens
KPEPRYVLVETNSDNDL

SEQ ID NO: 2949008 - protein, 23 aa, Entamoeba invadens
KPESKRYYQMFEEIKKEMQENKI

SEQ ID NO: 2949009 - protein, 21 aa, Entamoeba invadens
KPESQGVIFIECDLPKEKQKE

SEQ ID NO: 2949010 - protein, 17 aa, Entamoeba invadens
KPEYIKMVQDWTNSVSA

SEQ ID NO: 2949011 - protein, 17 aa, Entamoeba invadens
KPFCGLTVEPIDIINNY

SEQ ID NO: 2949012 - protein, 19 aa, Entamoeba invadens
KPFDEFPEYTAIQLNDTHP

SEQ ID NO: 2949013 - protein, 24 aa, Entamoeba invadens
KPFKCPFPGCTLSFKRKSDAKKHL

SEQ ID NO: 2949014 - protein, 18 aa, Entamoeba invadens
KPFSCYHNSFLNLAIGYL

SEQ ID NO: 2949015 - protein, 18 aa, Entamoeba invadens
KPGEIDVVLGTKNAVGYS

SEQ ID NO: 2949016 - protein, 19 aa, Entamoeba invadens
KPGLYGIKFWMSVDSETGM

SEQ ID NO: 2949017 - protein, 17 aa, Entamoeba invadens
KPGMLYLLPTTTDTYQL

SEQ ID NO: 2949018 - protein, 30 aa, Entamoeba invadens
KPGQPKFFPVSKEPFPDVFFKDISDDSENL

SEQ ID NO: 2949019 - protein, 17 aa, Entamoeba invadens
KPGRYGIKFWVCSIFIK

SEQ ID NO: 2949020 - protein, 17 aa, Entamoeba invadens
KPGRYGIKFWVCSIFTK

SEQ ID NO: 2949021 - protein, 25 aa, Entamoeba invadens
KPGSKVCTGIGFAIYGTEEDAHKTK

SEQ ID NO: 2949022 - protein, 18 aa, Entamoeba invadens
KPGYACEFEISIKPLCTC

SEQ ID NO: 2949023 - protein, 20 aa, Entamoeba invadens
KPHCLFICFAHDHIFGTYSN

SEQ ID NO: 2949024 - protein, 18 aa, Entamoeba invadens
KPHISFEGFDGFFKILMD

SEQ ID NO: 2949025 - protein, 26 aa, Entamoeba invadens
KPHKLRLCKSASMGGVGNSLFVKLHD

SEQ ID NO: 2949026 - protein, 17 aa, Entamoeba invadens
KPHWRREDILKFYEGLT

SEQ ID NO: 2949027 - protein, 17 aa, Entamoeba invadens
KPIDDWLCQCKNTPMGI

SEQ ID NO: 2949028 - protein, 21 aa, Entamoeba invadens
KPIDKGGINSLIWKIDELNSP

SEQ ID NO: 2949029 - protein, 17 aa, Entamoeba invadens
KPIFLFEKDIRQILNEL

SEQ ID NO: 2949030 - protein, 18 aa, Entamoeba invadens
KPIIKMRALYDYEATDDT

SEQ ID NO: 2949031 - protein, 18 aa, Entamoeba invadens
KPIILRLGEVFVEAHDLT

SEQ ID NO: 2949032 - protein, 17 aa, Entamoeba invadens
KPIKFLFPRLVDRNKFI

SEQ ID NO: 2949033 - protein, 17 aa, Entamoeba invadens
KPILKKMMKKGVINNVI

SEQ ID NO: 2949034 - protein, 17 aa, Entamoeba invadens
KPIPPPVVEKASESVNE

SEQ ID NO: 2949035 - protein, 27 aa, Entamoeba invadens
KPITPFSLLCCALLFDGVRKNYLRVNC

SEQ ID NO: 2949036 - protein, 20 aa, Entamoeba invadens
KPIVIGFCGDSSVGKTALYT

SEQ ID NO: 2949037 - protein, 20 aa, Entamoeba invadens
KPKDFAFLVAEWYQLCLTYN

SEQ ID NO: 2949038 - protein, 17 aa, Entamoeba invadens
KPKDFGFKLENVPLEAF

SEQ ID NO: 2949039 - protein, 25 aa, Entamoeba invadens
KPKELCKGMVNLAKYADLDGKKITV

SEQ ID NO: 2949040 - protein, 21 aa, Entamoeba invadens
KPKFTFSMFLFLERDTKAEKQ

SEQ ID NO: 2949041 - protein, 27 aa, Entamoeba invadens
KPKIVRPRGASLFGNFDPTQKPLRKSV

SEQ ID NO: 2949042 - protein, 24 aa, Entamoeba invadens
KPKKEGYTGKEWLKMYKQGKDFMF

SEQ ID NO: 2949043 - protein, 24 aa, Entamoeba invadens
KPKKMSKSWAEFNEEFKQLEKAKQ

SEQ ID NO: 2949044 - protein, 25 aa, Entamoeba invadens
KPKLFYKVMFTFPITFKQTKKSLQP

SEQ ID NO: 2949045 - protein, 19 aa, Entamoeba invadens
KPKLRVLGVVDHFEGKLFF

SEQ ID NO: 2949046 - protein, 20 aa, Entamoeba invadens
KPKNELKWDLDIQNDNLSVV

SEQ ID NO: 2949047 - protein, 24 aa, Entamoeba invadens
KPKNFKFVFQMCGKYEEKILPVDY

SEQ ID NO: 2949048 - protein, 21 aa, Entamoeba invadens
KPKRKDYLEAMERLRTETKTR

SEQ ID NO: 2949049 - protein, 17 aa, Entamoeba invadens
KPKRKKPMKMVSHTMKP

SEQ ID NO: 2949050 - protein, 25 aa, Entamoeba invadens
KPKYSKYSLHWKSVLPDNYFNSENF

SEQ ID NO: 2949051 - protein, 23 aa, Entamoeba invadens
KPLDNLFDFGFEPTPRNTDGTAT

SEQ ID NO: 2949052 - protein, 18 aa, Entamoeba invadens
KPLDQFKEELLKIFKPEN

SEQ ID NO: 2949053 - protein, 24 aa, Entamoeba invadens
KPLELPCTIQTPFTAEDVQQLILN

SEQ ID NO: 2949054 - protein, 20 aa, Entamoeba invadens
KPLERRLYELARKHCGSQPK

SEQ ID NO: 2949055 - protein, 18 aa, Entamoeba invadens
KPLFAKILSLHAEKNELQ

SEQ ID NO: 2949056 - protein, 24 aa, Entamoeba invadens
KPLFPIFICDAGLIIISKYPIVYN

SEQ ID NO: 2949057 - protein, 26 aa, Entamoeba invadens
KPLFRKRRLLLLAEYLKDFTLSPEEK

SEQ ID NO: 2949058 - protein, 17 aa, Entamoeba invadens
KPLKLIDIKSIKQVKNT

SEQ ID NO: 2949059 - protein, 18 aa, Entamoeba invadens
KPLLDVCAQIAEHAEQYA

SEQ ID NO: 2949060 - protein, 29 aa, Entamoeba invadens
KPLMEQAIEKVCCNLVRLFDITTAIVKDT

SEQ ID NO: 2949061 - protein, 22 aa, Entamoeba invadens
KPLNGIGIVFEGMYIESNPLQI

SEQ ID NO: 2949062 - protein, 17 aa, Entamoeba invadens
KPLPAMFDELLVGHNGG

SEQ ID NO: 2949063 - protein, 19 aa, Entamoeba invadens
KPLQIERVVIPSVSELRNE

SEQ ID NO: 2949064 - protein, 22 aa, Entamoeba invadens
KPLRIPLQDVYKISGIGTVPVG

SEQ ID NO: 2949065 - protein, 24 aa, Entamoeba invadens
KPLSDKKAFLFSLFSNGRIEGMEK

SEQ ID NO: 2949066 - protein, 24 aa, Entamoeba invadens
KPLSFRKKALFNFGAVQLAMHAFA

SEQ ID NO: 2949067 - protein, 18 aa, Entamoeba invadens
KPLYRKRLLVKIDGYDDD

SEQ ID NO: 2949068 - protein, 23 aa, Entamoeba invadens
KPMNCPGHCLMFASRKRSYRELP

SEQ ID NO: 2949069 - protein, 19 aa, Entamoeba invadens
KPMVGVHVIVKFAGKKEEK

SEQ ID NO: 2949070 - protein, 19 aa, Entamoeba invadens
KPNDSWDVWALGVVIVEMM

SEQ ID NO: 2949071 - protein, 29 aa, Entamoeba invadens
KPNGEPCALDKVPFDVCVTDPEDEEIEAK

SEQ ID NO: 2949072 - protein, 27 aa, Entamoeba invadens
KPNISLSLMEFIGYFESLKGIMPPVVG

SEQ ID NO: 2949073 - protein, 30 aa, Entamoeba invadens
KPNYWVVRPVLRKHQKCFGLFDDITPVIKI

SEQ ID NO: 2949074 - protein, 29 aa, Entamoeba invadens
KPPEIRLSTAKVFRYRPFSLILTMSSTWR

SEQ ID NO: 2949075 - protein, 18 aa, Entamoeba invadens
KPPIKMLDIMNAKYGDKL

SEQ ID NO: 2949076 - protein, 18 aa, Entamoeba invadens
KPPLSPRPSTLGSPRPTT

SEQ ID NO: 2949077 - protein, 18 aa, Entamoeba invadens
KPPVFTFKTNLFGKPPSK

SEQ ID NO: 2949078 - protein, 26 aa, Entamoeba invadens
KPQPKPEVLDGFRLDIRVGEIVEAGP

SEQ ID NO: 2949079 - protein, 25 aa, Entamoeba invadens
KPQRYSIKFWMCCDCESGMVINLQM

SEQ ID NO: 2949080 - protein, 17 aa, Entamoeba invadens
KPQSSQGSVCFDPIRLM

SEQ ID NO: 2949081 - protein, 20 aa, Entamoeba invadens
KPQVCAPKILGDKSLVDLRL

SEQ ID NO: 2949082 - protein, 21 aa, Entamoeba invadens
KPRCFKGNSLSSVTLCDYIET

SEQ ID NO: 2949083 - protein, 21 aa, Entamoeba invadens
KPRDVVSFLPFILQARKLTRQ

SEQ ID NO: 2949084 - protein, 25 aa, Entamoeba invadens
KPREFFKVRVLYDFDYFESLKYPSD

SEQ ID NO: 2949085 - protein, 21 aa, Entamoeba invadens
KPRKIRSKKILSLEEQLALVE

SEQ ID NO: 2949086 - protein, 17 aa, Entamoeba invadens
KPRKMLHQFLGPLNPND

SEQ ID NO: 2949087 - protein, 18 aa, Entamoeba invadens
KPRLIGAKCVGFHQLCLA

SEQ ID NO: 2949088 - protein, 28 aa, Entamoeba invadens
KPRLLEQLSGTLIRAGKDIGLVVFCVYN

SEQ ID NO: 2949089 - protein, 25 aa, Entamoeba invadens
KPRVYKKRAKKYPVAKPKKAKNSYI

SEQ ID NO: 2949090 - protein, 22 aa, Entamoeba invadens
KPRYLMGVGYPVEMILCVLFGV

SEQ ID NO: 2949091 - protein, 24 aa, Entamoeba invadens
KPSAIEIYPPFVPFLDMGFNISFR

SEQ ID NO: 2949092 - protein, 19 aa, Entamoeba invadens
KPSCIVVDIGGMMSWAIPV

SEQ ID NO: 2949093 - protein, 20 aa, Entamoeba invadens
KPSCSQMCVEIGGTKNLIYI

SEQ ID NO: 2949094 - protein, 22 aa, Entamoeba invadens
KPSELHSGISVCELNHQFDICS

SEQ ID NO: 2949095 - protein, 18 aa, Entamoeba invadens
KPSGKRHRKVFFPKDKPD

SEQ ID NO: 2949096 - protein, 24 aa, Entamoeba invadens
KPSIPCIKYFLGQINKIYSEVDEI

SEQ ID NO: 2949097 - protein, 20 aa, Entamoeba invadens
KPSNVTIYFKGTDKYSSTES

SEQ ID NO: 2949098 - protein, 19 aa, Entamoeba invadens
KPSQFPVGGCCYCKESGNA

SEQ ID NO: 2949099 - protein, 24 aa, Entamoeba invadens
KPSRLFEIMLVYGLKNIKENCFDG

SEQ ID NO: 2949100 - protein, 18 aa, Entamoeba invadens
KPTEEILDKAFTVAQENG

SEQ ID NO: 2949101 - protein, 18 aa, Entamoeba invadens
KPTEEVLDKAFTVAQENG

SEQ ID NO: 2949102 - protein, 18 aa, Entamoeba invadens
KPTFKPSQSGKCELCNET

SEQ ID NO: 2949103 - protein, 19 aa, Entamoeba invadens
KPTIEFRTKLILDNSKMDP

SEQ ID NO: 2949104 - protein, 22 aa, Entamoeba invadens
KPTLRLACLEKETKQKSTRQNS

SEQ ID NO: 2949105 - protein, 26 aa, Entamoeba invadens
KPTLRMVYRPPLKTLTPRRLITRTQP

SEQ ID NO: 2949106 - protein, 18 aa, Entamoeba invadens
KPTMSFDTSSLCMPTSTD

SEQ ID NO: 2949107 - protein, 17 aa, Entamoeba invadens
KPTNGSSGFSFGDTTNK

SEQ ID NO: 2949108 - protein, 20 aa, Entamoeba invadens
KPTNVSLPFALHSQNSEGAT

SEQ ID NO: 2949109 - protein, 24 aa, Entamoeba invadens
KPTQHVFVALSLGGAGDKGSFEVL

SEQ ID NO: 2949110 - protein, 19 aa, Entamoeba invadens
KPTSFKVVKNYILMTSPSE

SEQ ID NO: 2949111 - protein, 17 aa, Entamoeba invadens
KPTTGVKSWTTGEESQI

SEQ ID NO: 2949112 - protein, 19 aa, Entamoeba invadens
KPTYYLFLLDKEFEHQDDV

SEQ ID NO: 2949113 - protein, 23 aa, Entamoeba invadens
KPVHGRTRLVTFERLKFSSEIHL

SEQ ID NO: 2949114 - protein, 26 aa, Entamoeba invadens
KPVLAFFKKVLERIGDVTRGTPYKRL

SEQ ID NO: 2949115 - protein, 25 aa, Entamoeba invadens
KPVNFCRSIYPISVWESFSKYCVAT

SEQ ID NO: 2949116 - protein, 25 aa, Entamoeba invadens
KPVPYDFNGIKGFTHAGVYKCALNK

SEQ ID NO: 2949117 - protein, 25 aa, Entamoeba invadens
KPVQYRPRRSTVFADSKVDELNPKK

SEQ ID NO: 2949118 - protein, 25 aa, Entamoeba invadens
KPVRRVCFVDCKDLKISSSDTTHVE

SEQ ID NO: 2949119 - protein, 19 aa, Entamoeba invadens
KPVSSGRKWQPPAKAAEPA

SEQ ID NO: 2949120 - protein, 21 aa, Entamoeba invadens
KPWHCPHGRQTVRHLFDIRKA

SEQ ID NO: 2949121 - protein, 31 aa, Entamoeba invadens
KPYAYIAAAEVEFCFFRRKTAALNIFKEALK

SEQ ID NO: 2949122 - protein, 24 aa, Entamoeba invadens
KPYEKVGIILFVLGMMRRIKDTSV

SEQ ID NO: 2949123 - protein, 20 aa, Entamoeba invadens
KPYEYCLTAVCKYENAKASA

SEQ ID NO: 2949124 - protein, 27 aa, Entamoeba invadens
KPYLKQCGFTDCYSLPISGFSGLNLMK

SEQ ID NO: 2949125 - protein, 27 aa, Entamoeba invadens
KPYTCPSCGMKFLRKHDCNVHLRIHTG

SEQ ID NO: 2949126 - protein, 17 aa, Entamoeba invadens
KPYYHWFCTEARESWIG

SEQ ID NO: 2949127 - protein, 19 aa, Entamoeba invadens
KQAHAEIIILLQKHDTEVK

SEQ ID NO: 2949128 - protein, 18 aa, Entamoeba invadens
KQAIELLHTVLTQVNTVL

SEQ ID NO: 2949129 - protein, 33 aa, Entamoeba invadens
KQAKEYPVVVPVEFLVFLARVWTIRISSRKKDE

SEQ ID NO: 2949130 - protein, 25 aa, Entamoeba invadens
KQAKIPLVCSWENKTDWSIEIHREY

SEQ ID NO: 2949131 - protein, 19 aa, Entamoeba invadens
KQAKLAEEVLFSFNEQSAM

SEQ ID NO: 2949132 - protein, 19 aa, Entamoeba invadens
KQAKSEHWQIQRGKEDLSK

SEQ ID NO: 2949133 - protein, 20 aa, Entamoeba invadens
KQALIKLGEEIITIVDKSNE

SEQ ID NO: 2949134 - protein, 21 aa, Entamoeba invadens
KQARHSAEMACFAADKNRLTP

SEQ ID NO: 2949135 - protein, 20 aa, Entamoeba invadens
KQCKAVFDMEIKRGVSESTA

SEQ ID NO: 2949136 - protein, 17 aa, Entamoeba invadens
KQCRVCTTGYYPSNANL

SEQ ID NO: 2949137 - protein, 27 aa, Entamoeba invadens
KQDDFMWKGDCQVVKRDTKLRVIFSDK

SEQ ID NO: 2949138 - protein, 24 aa, Entamoeba invadens
KQDGDFPLLLTQSFECKNVELLNI

SEQ ID NO: 2949139 - protein, 31 aa, Entamoeba invadens
KQDILFTQMKFVFNREAEAFGDFTISCGDIK

SEQ ID NO: 2949140 - protein, 19 aa, Entamoeba invadens
KQDMEALQFLFGVTDKRKK

SEQ ID NO: 2949141 - protein, 26 aa, Entamoeba invadens
KQDPKLQFQWWFPLVESVTAVEFHQN

SEQ ID NO: 2949142 - protein, 29 aa, Entamoeba invadens
KQDPRLQFQWWFPLVESISAVEFHQNQDW

SEQ ID NO: 2949143 - protein, 21 aa, Entamoeba invadens
KQDRPCFKCGWPGHISKDCPY

SEQ ID NO: 2949144 - protein, 30 aa, Entamoeba invadens
KQDSIMIGHFLKYYLNQMVEPVIPYEKATQ

SEQ ID NO: 2949145 - protein, 27 aa, Entamoeba invadens
KQDYIFQIWCEAVYYLVHSHQQSIIDS

SEQ ID NO: 2949146 - protein, 20 aa, Entamoeba invadens
KQEAINFSCIFDDLKKYPYH

SEQ ID NO: 2949147 - protein, 19 aa, Entamoeba invadens
KQEEVCNIVSLVIEKQHKL

SEQ ID NO: 2949148 - protein, 28 aa, Entamoeba invadens
KQEHVLHLRIKRILNNFLENRKNPIKLY

SEQ ID NO: 2949149 - protein, 24 aa, Entamoeba invadens
KQEIVLCKTLVLKTKDVFRRNVQD

SEQ ID NO: 2949150 - protein, 34 aa, Entamoeba invadens
KQEKHKRVMFALGTVLYCVANKGGVKTPYWEWED

SEQ ID NO: 2949151 - protein, 22 aa, Entamoeba invadens
KQEKLYGYRIVDFKPNCLPVLV

SEQ ID NO: 2949152 - protein, 29 aa, Entamoeba invadens
KQENIKFAPIVRPTLPLHMEILDNETEPS

SEQ ID NO: 2949153 - protein, 37 aa, Entamoeba invadens
KQEVFMKFTLHKNAICAISLLKARSGIDSMLDNCMEL

SEQ ID NO: 2949154 - protein, 20 aa, Entamoeba invadens
KQFDVSATWRVVKFTPVDIC

SEQ ID NO: 2949155 - protein, 17 aa, Entamoeba invadens
KQFDWCIDNSIEYVNRQ

SEQ ID NO: 2949156 - protein, 19 aa, Entamoeba invadens
KQFEAPKLLNIRRNTISVS

SEQ ID NO: 2949157 - protein, 25 aa, Entamoeba invadens
KQFEYIIKFIFSFIAKDKQHEQLMA

SEQ ID NO: 2949158 - protein, 23 aa, Entamoeba invadens
KQFFRELIDGLVLQEDAKKLYKI

SEQ ID NO: 2949159 - protein, 23 aa, Entamoeba invadens
KQFGDGCFEKCYSLTSVEFPASI

SEQ ID NO: 2949160 - protein, 19 aa, Entamoeba invadens
KQFGKRVFAGCGILTHAVF

SEQ ID NO: 2949161 - protein, 22 aa, Entamoeba invadens
KQFITKFARKFTQLELLKGGLD

SEQ ID NO: 2949162 - protein, 23 aa, Entamoeba invadens
KQFLKDVAIEISNRAEIKEQQQK

SEQ ID NO: 2949163 - protein, 30 aa, Entamoeba invadens
KQFLNIIGIRCLFGYGTLCSVEIPPSVSII

SEQ ID NO: 2949164 - protein, 25 aa, Entamoeba invadens
KQFLSCLPLIITIVLQSQKYFEALL

SEQ ID NO: 2949165 - protein, 17 aa, Entamoeba invadens
KQFTHFLYFMMRTIFTK

SEQ ID NO: 2949166 - protein, 24 aa, Entamoeba invadens
KQFWCSAHRLALCGEGLEKEPEIF

SEQ ID NO: 2949167 - protein, 20 aa, Entamoeba invadens
KQGELEMEKKVLLEKNEKLF

SEQ ID NO: 2949168 - protein, 31 aa, Entamoeba invadens
KQGGSWKSWKRRWFVIKDKKMWYFSGKNDTE

SEQ ID NO: 2949169 - protein, 21 aa, Entamoeba invadens
KQGHSKFRDMCLEYLNIDVDK

SEQ ID NO: 2949170 - protein, 22 aa, Entamoeba invadens
KQGHSKFRDMCLEYLNIDVDKV

SEQ ID NO: 2949171 - protein, 22 aa, Entamoeba invadens
KQGHSKFRDVCLEYLNIDVDKV

SEQ ID NO: 2949172 - protein, 18 aa, Entamoeba invadens
KQGKDFMFNKTINSKDRI

SEQ ID NO: 2949173 - protein, 19 aa, Entamoeba invadens
KQHETELFQQMLLQQAPEI

SEQ ID NO: 2949174 - protein, 17 aa, Entamoeba invadens
KQICEKYKKQAKSGTEE

SEQ ID NO: 2949175 - protein, 17 aa, Entamoeba invadens
KQICEKYNKQAKSGTEE

SEQ ID NO: 2949176 - protein, 21 aa, Entamoeba invadens
KQICGPKYTALVLELNASDER

SEQ ID NO: 2949177 - protein, 23 aa, Entamoeba invadens
KQIGESCFKDCLSLSSIIIPEKI

SEQ ID NO: 2949178 - protein, 18 aa, Entamoeba invadens
KQIKAKFKAEERVRPNMI

SEQ ID NO: 2949179 - protein, 24 aa, Entamoeba invadens
KQIKCKNGNNVCFECGTPNPSWAS

SEQ ID NO: 2949180 - protein, 21 aa, Entamoeba invadens
KQIKEKCLLTGKRTKPVSKSH

SEQ ID NO: 2949181 - protein, 20 aa, Entamoeba invadens
KQIMWKYLHMEGNPYRDRIY

SEQ ID NO: 2949182 - protein, 19 aa, Entamoeba invadens
KQINELRAQLRVVERETRN

SEQ ID NO: 2949183 - protein, 23 aa, Entamoeba invadens
KQIPELIEHFSLDEKILENYLIG

SEQ ID NO: 2949184 - protein, 22 aa, Entamoeba invadens
KQITESVLRLKAQAKVQKEENQ

SEQ ID NO: 2949185 - protein, 24 aa, Entamoeba invadens
KQKALEIYTIIASSVVKRKLYLLV

SEQ ID NO: 2949186 - protein, 20 aa, Entamoeba invadens
KQKCQFCGNSVNTKNFQMHQ

SEQ ID NO: 2949187 - protein, 30 aa, Entamoeba invadens
KQKDSIQCIKCKLVMHKMCDPYNTAEMYVC

SEQ ID NO: 2949188 - protein, 17 aa, Entamoeba invadens
KQKEVFDGISSDLTKME

SEQ ID NO: 2949189 - protein, 29 aa, Entamoeba invadens
KQKEYYNGLMILTGLYLNVIRHYIRTEYI

SEQ ID NO: 2949190 - protein, 18 aa, Entamoeba invadens
KQKGIFFLCDPILGDDGR

SEQ ID NO: 2949191 - protein, 17 aa, Entamoeba invadens
KQKTLFVNFSLTKKEGS

SEQ ID NO: 2949192 - protein, 30 aa, Entamoeba invadens
KQKVFVCTVCNIYIHKKCIDKFRKDPTSCR

SEQ ID NO: 2949193 - protein, 17 aa, Entamoeba invadens
KQKVLKCSAGYYNTFDM

SEQ ID NO: 2949194 - protein, 24 aa, Entamoeba invadens
KQKVWEVNIKLSFIGEINTFARSV

SEQ ID NO: 2949195 - protein, 19 aa, Entamoeba invadens
KQKYFIKQFVYILRQLPDF

SEQ ID NO: 2949196 - protein, 19 aa, Entamoeba invadens
KQLDGRELLLGYNDVIQPE

SEQ ID NO: 2949197 - protein, 18 aa, Entamoeba invadens
KQLEAAFIEQENERKRLE

SEQ ID NO: 2949198 - protein, 21 aa, Entamoeba invadens
KQLECPGVVPPFGVESICTNN

SEQ ID NO: 2949199 - protein, 18 aa, Entamoeba invadens
KQLEKCVKLSSRYDETEM

SEQ ID NO: 2949200 - protein, 17 aa, Entamoeba invadens
KQLETSFLNTNLFEKTH

SEQ ID NO: 2949201 - protein, 24 aa, Entamoeba invadens
KQLFRDLFQIVFGFVYDQIVMGDT

SEQ ID NO: 2949202 - protein, 19 aa, Entamoeba invadens
KQLGLVLSFVLQFDNKKLG

SEQ ID NO: 2949203 - protein, 18 aa, Entamoeba invadens
KQLGRKSLMYNVETKEIV

SEQ ID NO: 2949204 - protein, 18 aa, Entamoeba invadens
KQLGTLIRSLGCAPTEEE

SEQ ID NO: 2949205 - protein, 18 aa, Entamoeba invadens
KQLKAILNVDDFQIDNMA

SEQ ID NO: 2949206 - protein, 20 aa, Entamoeba invadens
KQLKENYGFLKTNNFVCEVH

SEQ ID NO: 2949207 - protein, 24 aa, Entamoeba invadens
KQLKKKEDIVLPSLVGDKSVQSFD

SEQ ID NO: 2949208 - protein, 23 aa, Entamoeba invadens
KQLKLSIGCGGMKVIYLTQKGDK

SEQ ID NO: 2949209 - protein, 20 aa, Entamoeba invadens
KQLKTILGVYGIKYLLVCQE

SEQ ID NO: 2949210 - protein, 17 aa, Entamoeba invadens
KQLKTLRRLRIINHRLR

SEQ ID NO: 2949211 - protein, 23 aa, Entamoeba invadens
KQLLEKVSELNTQLGKLENDNKQ

SEQ ID NO: 2949212 - protein, 25 aa, Entamoeba invadens
KQLLKRECSVGLLKRFSEMLQGDSA

SEQ ID NO: 2949213 - protein, 17 aa, Entamoeba invadens
KQLLLLVLSASKASVNC

SEQ ID NO: 2949214 - protein, 18 aa, Entamoeba invadens
KQLMYLTSTISWIMLLYN

SEQ ID NO: 2949215 - protein, 21 aa, Entamoeba invadens
KQLPVKLISEFVRTRTPVQVR

SEQ ID NO: 2949216 - protein, 25 aa, Entamoeba invadens
KQLQLCLCPLCLNGIPPCADTKTQL

SEQ ID NO: 2949217 - protein, 23 aa, Entamoeba invadens
KQLQSFSVWLVYVLPQNMQFHMN

SEQ ID NO: 2949218 - protein, 20 aa, Entamoeba invadens
KQLRLDPGIYDKLQAEKVTV

SEQ ID NO: 2949219 - protein, 27 aa, Entamoeba invadens
KQLSFDEFDAFIGMLLFNGVAHDNKKS

SEQ ID NO: 2949220 - protein, 24 aa, Entamoeba invadens
KQLTESSMNKWGAISQSISTITTS

SEQ ID NO: 2949221 - protein, 19 aa, Entamoeba invadens
KQLTQRRVRTYKCINTINA

SEQ ID NO: 2949222 - protein, 21 aa, Entamoeba invadens
KQLVKELYAFERKNDMLTKRK

SEQ ID NO: 2949223 - protein, 18 aa, Entamoeba invadens
KQLWDHTFCYELRTNPSE

SEQ ID NO: 2949224 - protein, 23 aa, Entamoeba invadens
KQMIKRKNFHITRNLIVAYSSLT

SEQ ID NO: 2949225 - protein, 19 aa, Entamoeba invadens
KQMKCPFAGCDKMVTKDDF

SEQ ID NO: 2949226 - protein, 23 aa, Entamoeba invadens
KQMLITVPFFRILTLENYGDPIF

SEQ ID NO: 2949227 - protein, 27 aa, Entamoeba invadens
KQNKPLRLIIMSATLRVSEFLDNTNLF

SEQ ID NO: 2949228 - protein, 25 aa, Entamoeba invadens
KQNMLKHILSLCGRITQNATSKMTS

SEQ ID NO: 2949229 - protein, 24 aa, Entamoeba invadens
KQNSLCLTAVFSLLVEKNTKLKLL

SEQ ID NO: 2949230 - protein, 20 aa, Entamoeba invadens
KQNTCPYKTISVGPDVTSAC

SEQ ID NO: 2949231 - protein, 23 aa, Entamoeba invadens
KQNTCPYKTISVGPDVTSACVHE

SEQ ID NO: 2949232 - protein, 22 aa, Entamoeba invadens
KQNWKQLNLIRVYKKFQENFRT

SEQ ID NO: 2949233 - protein, 31 aa, Entamoeba invadens
KQPANPPVTPAFEFLEGSSLSHTSGSPTPKT

SEQ ID NO: 2949234 - protein, 22 aa, Entamoeba invadens
KQPKCGRCSNPIVGEYYKINGV

SEQ ID NO: 2949235 - protein, 21 aa, Entamoeba invadens
KQPPYRRFFSSQQCTINKVEG

SEQ ID NO: 2949236 - protein, 18 aa, Entamoeba invadens
KQPSGAFEQMLIVPEPTK

SEQ ID NO: 2949237 - protein, 21 aa, Entamoeba invadens
KQPVNALCWANGSLYSGSSDK

SEQ ID NO: 2949238 - protein, 17 aa, Entamoeba invadens
KQQCQAIANVFEQYDIA

SEQ ID NO: 2949239 - protein, 17 aa, Entamoeba invadens
KQQGCIHYVTIMLLKII

SEQ ID NO: 2949240 - protein, 25 aa, Entamoeba invadens
KQQILDCFNGFCARTKKRGDQAIGP

SEQ ID NO: 2949241 - protein, 24 aa, Entamoeba invadens
KQQLLKRAGKPIVENKGKPKFVKT

SEQ ID NO: 2949242 - protein, 24 aa, Entamoeba invadens
KQQSHGIVLKKECFSSSFQQGLSA

SEQ ID NO: 2949243 - protein, 30 aa, Entamoeba invadens
KQQVMKWGQSCIILPNFLILPVQRLPRYIL

SEQ ID NO: 2949244 - protein, 19 aa, Entamoeba invadens
KQREFVRVQAMLYYTNMAG

SEQ ID NO: 2949245 - protein, 22 aa, Entamoeba invadens
KQRELFCGSAALFPILTSKDDF

SEQ ID NO: 2949246 - protein, 24 aa, Entamoeba invadens
KQRFPEASERCIGNLFGCAGGAIN

SEQ ID NO: 2949247 - protein, 17 aa, Entamoeba invadens
KQRKLNREKIELRLLKD

SEQ ID NO: 2949248 - protein, 22 aa, Entamoeba invadens
KQRLIKSPPFCLSQQKQKRMTL

SEQ ID NO: 2949249 - protein, 18 aa, Entamoeba invadens
KQRREFNLKKILENVKVS

SEQ ID NO: 2949250 - protein, 22 aa, Entamoeba invadens
KQRSEEGMRNIKRETAILSAKY

SEQ ID NO: 2949251 - protein, 23 aa, Entamoeba invadens
KQRSSWECGVFVLFFIRIFVQFH

SEQ ID NO: 2949252 - protein, 18 aa, Entamoeba invadens
KQRSYEFIGASNALCGLM

SEQ ID NO: 2949253 - protein, 20 aa, Entamoeba invadens
KQRYMKCFMSFMEDPFWRVR

SEQ ID NO: 2949254 - protein, 25 aa, Entamoeba invadens
KQSDGGWFSSWWKSESDELNMMKKV

SEQ ID NO: 2949255 - protein, 25 aa, Entamoeba invadens
KQSFWMKRVAYLAAQTCLHQDDDVL

SEQ ID NO: 2949256 - protein, 19 aa, Entamoeba invadens
KQSGIPFYIVYTPQYAPVQ

SEQ ID NO: 2949257 - protein, 27 aa, Entamoeba invadens
KQSHPTHRFILVHGAGSFGHVPAAEYS

SEQ ID NO: 2949258 - protein, 22 aa, Entamoeba invadens
KQSIHLTSLRGIVNISNEQFIT

SEQ ID NO: 2949259 - protein, 21 aa, Entamoeba invadens
KQSIWSLGLCNTLYTKNSQPE

SEQ ID NO: 2949260 - protein, 20 aa, Entamoeba invadens
KQSLIELTVLHFLNKFYDNS

SEQ ID NO: 2949261 - protein, 19 aa, Entamoeba invadens
KQSLIELTVLHFLNNFYDN

SEQ ID NO: 2949262 - protein, 30 aa, Entamoeba invadens
KQSLLFLVFCSDIAISFFIDSQIVFDKYIE

SEQ ID NO: 2949263 - protein, 24 aa, Entamoeba invadens
KQSRKSVVITVCFNTVSVAGLTGE

SEQ ID NO: 2949264 - protein, 20 aa, Entamoeba invadens
KQSRNNICFLVKQNISPYLD

SEQ ID NO: 2949265 - protein, 28 aa, Entamoeba invadens
KQSSVGLCCAKVKTLHFVGDEIEVMRIT

SEQ ID NO: 2949266 - protein, 17 aa, Entamoeba invadens
KQSTFLQKQQRVAKLTG

SEQ ID NO: 2949267 - protein, 19 aa, Entamoeba invadens
KQTALYLATFLKRRVEAFL

SEQ ID NO: 2949268 - protein, 19 aa, Entamoeba invadens
KQTDFGFELGYGLNSDDGS

SEQ ID NO: 2949269 - protein, 17 aa, Entamoeba invadens
KQTELPTTIAYRKIDQY

SEQ ID NO: 2949270 - protein, 18 aa, Entamoeba invadens
KQTIKMLLPENVVIDNVV

SEQ ID NO: 2949271 - protein, 27 aa, Entamoeba invadens
KQTILNVCLKLSKLALHDKKFEKARQY

SEQ ID NO: 2949272 - protein, 17 aa, Entamoeba invadens
KQTKKRVLYLFVTSDGY

SEQ ID NO: 2949273 - protein, 19 aa, Entamoeba invadens
KQTKRTKCTERLVKINSLT

SEQ ID NO: 2949274 - protein, 21 aa, Entamoeba invadens
KQTLFFLKYPLKMEMGDRIGG

SEQ ID NO: 2949275 - protein, 18 aa, Entamoeba invadens
KQTPFFIQCFNFKHIQPE

SEQ ID NO: 2949276 - protein, 25 aa, Entamoeba invadens
KQTQDIFVALSLGGAGDKGSFEVIK

SEQ ID NO: 2949277 - protein, 22 aa, Entamoeba invadens
KQTRFGYEKDDEFIDDEDFDKV

SEQ ID NO: 2949278 - protein, 19 aa, Entamoeba invadens
KQTSFPFHMEQLLFEYFNF

SEQ ID NO: 2949279 - protein, 27 aa, Entamoeba invadens
KQTTKSLPLCLSRGEIFLKTQNKDGDF

SEQ ID NO: 2949280 - protein, 19 aa, Entamoeba invadens
KQVELNLVMEFEIRSSSEI

SEQ ID NO: 2949281 - protein, 26 aa, Entamoeba invadens
KQVFLHRIPHTLVFQLKRFSFNTLTF

SEQ ID NO: 2949282 - protein, 25 aa, Entamoeba invadens
KQVIKPYVICKTCKTTNDSGDTKQE

SEQ ID NO: 2949283 - protein, 22 aa, Entamoeba invadens
KQVLCQSIRVSTIIQQKHRKTY

SEQ ID NO: 2949284 - protein, 24 aa, Entamoeba invadens
KQVQEDEVVLALRGILDERRKDIA

SEQ ID NO: 2949285 - protein, 35 aa, Entamoeba invadens
KQVSELYHRLSVSNLNEFPCETIANTLKRFTRELP

SEQ ID NO: 2949286 - protein, 17 aa, Entamoeba invadens
KQYLKGVVEKYKAQRQE

SEQ ID NO: 2949287 - protein, 23 aa, Entamoeba invadens
KQYLVCKLGEFFQFKGECKKELC

SEQ ID NO: 2949288 - protein, 17 aa, Entamoeba invadens
KQYQVFLSVVGRLSEYA

SEQ ID NO: 2949289 - protein, 18 aa, Entamoeba invadens
KQYYLRRIILTNDNGTKT

SEQ ID NO: 2949290 - protein, 23 aa, Entamoeba invadens
KRAEMWKFFSSLIKKSREVDLLR

SEQ ID NO: 2949291 - protein, 21 aa, Entamoeba invadens
KRAFACCEMLREIKICGKTVV

SEQ ID NO: 2949292 - protein, 21 aa, Entamoeba invadens
KRAGSGIMKKLTAIREDAEKC

SEQ ID NO: 2949293 - protein, 21 aa, Entamoeba invadens
KRAKKAKLLRPFSKGTTPHSH

SEQ ID NO: 2949294 - protein, 22 aa, Entamoeba invadens
KRAKPFPDIFVEAGKALGCTDM

SEQ ID NO: 2949295 - protein, 18 aa, Entamoeba invadens
KRAKPKLKDKTQLTKEKK

SEQ ID NO: 2949296 - protein, 20 aa, Entamoeba invadens
KRALEPFVYVLADHQDERVK

SEQ ID NO: 2949297 - protein, 19 aa, Entamoeba invadens
KRALQWDPEMRMRPDQALQ

SEQ ID NO: 2949298 - protein, 18 aa, Entamoeba invadens
KRALSVTKFKEEKVIKKL

SEQ ID NO: 2949299 - protein, 20 aa, Entamoeba invadens
KRALYSVLVLNKFGILTGIS

SEQ ID NO: 2949300 - protein, 21 aa, Entamoeba invadens
KRAQEDIGVCLSIISKNIKEL

SEQ ID NO: 2949301 - protein, 17 aa, Entamoeba invadens
KRAQPPTPRKVTPINTT

SEQ ID NO: 2949302 - protein, 23 aa, Entamoeba invadens
KRATKFVKILSHLAIPNYPDKLL

SEQ ID NO: 2949303 - protein, 20 aa, Entamoeba invadens
KRAYKKLAMKYHPDKNPGNK

SEQ ID NO: 2949304 - protein, 21 aa, Entamoeba invadens
KRAYYAFKIEGDEKVFGENSR

SEQ ID NO: 2949305 - protein, 21 aa, Entamoeba invadens
KRCECQGVRMELIGVIESDSQ

SEQ ID NO: 2949306 - protein, 24 aa, Entamoeba invadens
KRCEMCCKCAALSGCLSSIRDDQH

SEQ ID NO: 2949307 - protein, 19 aa, Entamoeba invadens
KRCFDFCIELQQLLYEGGS

SEQ ID NO: 2949308 - protein, 18 aa, Entamoeba invadens
KRCFECINRQVIKHFNKL

SEQ ID NO: 2949309 - protein, 19 aa, Entamoeba invadens
KRCFSRRQKSVFYKQKDAE

SEQ ID NO: 2949310 - protein, 19 aa, Entamoeba invadens
KRCFWECGSLSSVIIPPSV

SEQ ID NO: 2949311 - protein, 24 aa, Entamoeba invadens
KRCGKECVFEWQLLPQFIYATNLD

SEQ ID NO: 2949312 - protein, 30 aa, Entamoeba invadens
KRCLEPLEVYEFWEGYGMSITPKVVIMVVE

SEQ ID NO: 2949313 - protein, 18 aa, Entamoeba invadens
KRCVECRAVVKGSGVLCE

SEQ ID NO: 2949314 - protein, 24 aa, Entamoeba invadens
KRDACGRTPLHIAVIMNDALSVEI

SEQ ID NO: 2949315 - protein, 26 aa, Entamoeba invadens
KRDDFKRVLNTYAVRGFPSDVIDDAF

SEQ ID NO: 2949316 - protein, 23 aa, Entamoeba invadens
KRDDVKARIDVVIEKEYVEKDTA

SEQ ID NO: 2949317 - protein, 24 aa, Entamoeba invadens
KRDEFRPRSVLIGKVPPLSGKIDL

SEQ ID NO: 2949318 - protein, 23 aa, Entamoeba invadens
KRDEIIRAISYLVRLNRLVRVKS

SEQ ID NO: 2949319 - protein, 28 aa, Entamoeba invadens
KRDFGGEIYELWDAIFAYPKHKLQYFIT

SEQ ID NO: 2949320 - protein, 26 aa, Entamoeba invadens
KRDFKKKPFPPARIRKLMKIATDKKH

SEQ ID NO: 2949321 - protein, 24 aa, Entamoeba invadens
KRDGESLEALTILEELLKSKEITL

SEQ ID NO: 2949322 - protein, 20 aa, Entamoeba invadens
KRDICRKGQMINRLLCQSVL

SEQ ID NO: 2949323 - protein, 21 aa, Entamoeba invadens
KRDINMRASHSIRTPRKINGE

SEQ ID NO: 2949324 - protein, 19 aa, Entamoeba invadens
KRDISLIAMDECSPDILNE

SEQ ID NO: 2949325 - protein, 24 aa, Entamoeba invadens
KRDKEIFTALSMECFVEIIERFGV

SEQ ID NO: 2949326 - protein, 22 aa, Entamoeba invadens
KRDKKFEAAMMQVRLANHLESF

SEQ ID NO: 2949327 - protein, 22 aa, Entamoeba invadens
KRDPENCALILVIKGTTIEVEA

SEQ ID NO: 2949328 - protein, 27 aa, Entamoeba invadens
KRDPNRMGIIDCSLRGVDVKQTWSSLI

SEQ ID NO: 2949329 - protein, 19 aa, Entamoeba invadens
KRDQSVLVRYFADGYQFGW

SEQ ID NO: 2949330 - protein, 18 aa, Entamoeba invadens
KRDSLLFSSMDPSDENVE

SEQ ID NO: 2949331 - protein, 24 aa, Entamoeba invadens
KRDWECIDSLRLGLLNDHLTALLK

SEQ ID NO: 2949332 - protein, 18 aa, Entamoeba invadens
KREAMIHCDIGYFVGDVS

SEQ ID NO: 2949333 - protein, 24 aa, Entamoeba invadens
KREELRLSSLQVLLKGILSAEVNG

SEQ ID NO: 2949334 - protein, 24 aa, Entamoeba invadens
KREEVIKRIIRWMQDEFRTPEEIV

SEQ ID NO: 2949335 - protein, 26 aa, Entamoeba invadens
KREFRREECLELWDRIFAYPEREMYY

SEQ ID NO: 2949336 - protein, 25 aa, Entamoeba invadens
KREGPQIRGIHPFVINHAAGWTDIT

SEQ ID NO: 2949337 - protein, 20 aa, Entamoeba invadens
KREKHLKHFGKLQLVLFLKG

SEQ ID NO: 2949338 - protein, 17 aa, Entamoeba invadens
KREKRFCEEITKNEDCV

SEQ ID NO: 2949339 - protein, 27 aa, Entamoeba invadens
KRELLWKKRCIRFRKVANKKMDEEARK

SEQ ID NO: 2949340 - protein, 25 aa, Entamoeba invadens
KRELYKIKFTQFIWAIIEQVNKEVE

SEQ ID NO: 2949341 - protein, 21 aa, Entamoeba invadens
KREMDVMINFIDFVVTEAHDI

SEQ ID NO: 2949342 - protein, 21 aa, Entamoeba invadens
KRENCSYDRLSGCDECIEDHH

SEQ ID NO: 2949343 - protein, 21 aa, Entamoeba invadens
KRENLKIQSDEFVKMTQQLSP

SEQ ID NO: 2949344 - protein, 17 aa, Entamoeba invadens
KRESIYFKRHNPRTSDG

SEQ ID NO: 2949345 - protein, 19 aa, Entamoeba invadens
KRETEDLALLLGKMYEEYC

SEQ ID NO: 2949346 - protein, 24 aa, Entamoeba invadens
KRETETLLDNSMRAFQAMLKEMSV

SEQ ID NO: 2949347 - protein, 22 aa, Entamoeba invadens
KRETVGLIVPGIVKNVQRVRDN

SEQ ID NO: 2949348 - protein, 21 aa, Entamoeba invadens
KRETVVLSFKREVHQTQVPQT

SEQ ID NO: 2949349 - protein, 17 aa, Entamoeba invadens
KREVMKISIRDFGQTPL

SEQ ID NO: 2949350 - protein, 19 aa, Entamoeba invadens
KREVQFFGFPTGVLAKQKI

SEQ ID NO: 2949351 - protein, 24 aa, Entamoeba invadens
KRFCLTCFRTTLFTPKETPLIDKL

SEQ ID NO: 2949352 - protein, 21 aa, Entamoeba invadens
KRFECLVCQSLAPPPEEMTKK

SEQ ID NO: 2949353 - protein, 19 aa, Entamoeba invadens
KRFEHPWEIADFVGKGNHL

SEQ ID NO: 2949354 - protein, 20 aa, Entamoeba invadens
KRFEKASSFVQIPQNDPEIE

SEQ ID NO: 2949355 - protein, 17 aa, Entamoeba invadens
KRFGFHRREEVVKCVKR

SEQ ID NO: 2949356 - protein, 19 aa, Entamoeba invadens
KRFGNKIPDCVTKLGEECF

SEQ ID NO: 2949357 - protein, 20 aa, Entamoeba invadens
KRFGRFRRRSADNEKRTKAK

SEQ ID NO: 2949358 - protein, 18 aa, Entamoeba invadens
KRFHHVFEDWQKNNYYLK

SEQ ID NO: 2949359 - protein, 20 aa, Entamoeba invadens
KRFITKESKYYVIMDSLKES

SEQ ID NO: 2949360 - protein, 17 aa, Entamoeba invadens
KRFKGHWVKSVGEEEGM

SEQ ID NO: 2949361 - protein, 21 aa, Entamoeba invadens
KRFLTKIPCRGILGTYACFYH

SEQ ID NO: 2949362 - protein, 22 aa, Entamoeba invadens
KRFNPAIPDKMGWDDFLKSYLA

SEQ ID NO: 2949363 - protein, 20 aa, Entamoeba invadens
KRFQYALNIADFVTEGKRLE

SEQ ID NO: 2949364 - protein, 22 aa, Entamoeba invadens
KRFRYPKALFQSSFLGMEASGI

SEQ ID NO: 2949365 - protein, 21 aa, Entamoeba invadens
KRFSQLLSVQRMFVFNLAQSI

SEQ ID NO: 2949366 - protein, 43 aa, Entamoeba invadens
KRGALEMPRLKVLFMKKCFLHGDCLEMDLTRCDSLLQIYFGGC

SEQ ID NO: 2949367 - protein, 22 aa, Entamoeba invadens
KRGDLRREYPILTPDSQILSEA

SEQ ID NO: 2949368 - protein, 24 aa, Entamoeba invadens
KRGEHKIKAVLMLYKSAEIDVYSA

SEQ ID NO: 2949369 - protein, 25 aa, Entamoeba invadens
KRGETPITFKERIDREILRLHEQSD

SEQ ID NO: 2949370 - protein, 19 aa, Entamoeba invadens
KRGEWIDDFRIFMFSYQQG

SEQ ID NO: 2949371 - protein, 37 aa, Entamoeba invadens
KRGFDLIKTVWVKKQYVGQSVIIPINIDILSENYNVP

SEQ ID NO: 2949372 - protein, 32 aa, Entamoeba invadens
KRGFRVLEGKPCVQSSVLLEEFCKMNNMKCIN

SEQ ID NO: 2949373 - protein, 17 aa, Entamoeba invadens
KRGFSLDKDNYWVNTSE

SEQ ID NO: 2949374 - protein, 21 aa, Entamoeba invadens
KRGGLNLEEILAIIMYADSTQ

SEQ ID NO: 2949375 - protein, 20 aa, Entamoeba invadens
KRGIFWCCNSLVKFESFGDV

SEQ ID NO: 2949376 - protein, 25 aa, Entamoeba invadens
KRGKTFWNKRVINVYNGCLYLYEST

SEQ ID NO: 2949377 - protein, 21 aa, Entamoeba invadens
KRGLAELSVDISVLRMAKILK

SEQ ID NO: 2949378 - protein, 19 aa, Entamoeba invadens
KRGLGVTMHIGEKVDDDEA

SEQ ID NO: 2949379 - protein, 31 aa, Entamoeba invadens
KRGLWEGVCVFLVSFLRRMKSSIFNVHNPWI

SEQ ID NO: 2949380 - protein, 28 aa, Entamoeba invadens
KRGMNAWSRREMIIFNGLFVLYNETSNI

SEQ ID NO: 2949381 - protein, 19 aa, Entamoeba invadens
KRGRLISNYMFFLVSSQES

SEQ ID NO: 2949382 - protein, 25 aa, Entamoeba invadens
KRGSFITMMAALMMGACGLTNNQID

SEQ ID NO: 2949383 - protein, 20 aa, Entamoeba invadens
KRGTLCWSPTRNLLAVGTTA

SEQ ID NO: 2949384 - protein, 25 aa, Entamoeba invadens
KRGVKEYIKGIVWVYLYYTGHPISW

SEQ ID NO: 2949385 - protein, 18 aa, Entamoeba invadens
KRGVRPTLPITFVEKYGK

SEQ ID NO: 2949386 - protein, 19 aa, Entamoeba invadens
KRHFFLFNDRLVVTKYADF

SEQ ID NO: 2949387 - protein, 19 aa, Entamoeba invadens
KRIAERSQKIIIDTEEKIQ

SEQ ID NO: 2949388 - protein, 25 aa, Entamoeba invadens
KRIEHVKPIRGIREDKEEKVENKIA

SEQ ID NO: 2949389 - protein, 18 aa, Entamoeba invadens
KRIENMFLVLLQQNKTKI

SEQ ID NO: 2949390 - protein, 20 aa, Entamoeba invadens
KRIESDGFVKSVYRMNYCKT

SEQ ID NO: 2949391 - protein, 18 aa, Entamoeba invadens
KRIESRQAYLPKREFQKL

SEQ ID NO: 2949392 - protein, 21 aa, Entamoeba invadens
KRIFVCKVCGLTIDRNQTISH

SEQ ID NO: 2949393 - protein, 19 aa, Entamoeba invadens
KRIGDAYIKAKDEAVQKKK

SEQ ID NO: 2949394 - protein, 21 aa, Entamoeba invadens
KRIGFSRLLFFMFSEYFNELF

SEQ ID NO: 2949395 - protein, 19 aa, Entamoeba invadens
KRIGTPVYMAPEVLQQEKY

SEQ ID NO: 2949396 - protein, 22 aa, Entamoeba invadens
KRIIPKNLLWVIHGIYKVVLIK

SEQ ID NO: 2949397 - protein, 25 aa, Entamoeba invadens
KRIKAKMHCFGHIHNCYRYVEKYGR

SEQ ID NO: 2949398 - protein, 19 aa, Entamoeba invadens
KRIKAVILPNHITSLGNNC

SEQ ID NO: 2949399 - protein, 17 aa, Entamoeba invadens
KRIKFDFPCVPITNATP

SEQ ID NO: 2949400 - protein, 23 aa, Entamoeba invadens
KRIKKYAFESCLSLKDIVLPKSL

SEQ ID NO: 2949401 - protein, 20 aa, Entamoeba invadens
KRILERFNFDLLNNVTEETA

SEQ ID NO: 2949402 - protein, 24 aa, Entamoeba invadens
KRILFKLNKPLSMVQAHSTPLTTL

SEQ ID NO: 2949403 - protein, 28 aa, Entamoeba invadens
KRIMMTMADCLSSLFAKSVREDIMDQCQ

SEQ ID NO: 2949404 - protein, 17 aa, Entamoeba invadens
KRISRTYTLYAIDYPFA

SEQ ID NO: 2949405 - protein, 20 aa, Entamoeba invadens
KRISSPLMISSSIEKIIEID

SEQ ID NO: 2949406 - protein, 21 aa, Entamoeba invadens
KRITELGVPVFGGRVYGSLAV

SEQ ID NO: 2949407 - protein, 26 aa, Entamoeba invadens
KRITIPEIRQSTFFKSFKAETYEIPP

SEQ ID NO: 2949408 - protein, 20 aa, Entamoeba invadens
KRITRDPRFVLDDNEKPPSM

SEQ ID NO: 2949409 - protein, 26 aa, Entamoeba invadens
KRIVFKCAIAGCRKRIKVEYQGSAMV

SEQ ID NO: 2949410 - protein, 21 aa, Entamoeba invadens
KRIVYRTTLPSLGYKILVSAK

SEQ ID NO: 2949411 - protein, 17 aa, Entamoeba invadens
KRIYIGLPEAPARSKMI

SEQ ID NO: 2949412 - protein, 20 aa, Entamoeba invadens
KRKADGIVVALKQMEVNQDN

SEQ ID NO: 2949413 - protein, 26 aa, Entamoeba invadens
KRKAEGAGQGAIWFMQREVTEKKKFM

SEQ ID NO: 2949414 - protein, 21 aa, Entamoeba invadens
KRKAPPPLPQRGSKPSGGKVG

SEQ ID NO: 2949415 - protein, 20 aa, Entamoeba invadens
KRKCEDDGKEILNFRNTTLD

SEQ ID NO: 2949416 - protein, 19 aa, Entamoeba invadens
KRKDHANTIMIYIGSDNEE

SEQ ID NO: 2949417 - protein, 17 aa, Entamoeba invadens
KRKEALVSDVSKKIEEV

SEQ ID NO: 2949418 - protein, 29 aa, Entamoeba invadens
KRKEFKDNLKAVILFPEYYKNPFTIVPDL

SEQ ID NO: 2949419 - protein, 21 aa, Entamoeba invadens
KRKELLQYMSKIRKLFNEGDQ

SEQ ID NO: 2949420 - protein, 17 aa, Entamoeba invadens
KRKFEDYQHLFPQLHPL

SEQ ID NO: 2949421 - protein, 26 aa, Entamoeba invadens
KRKFYCKKCLNFVCLKCFDSTNGCCK

SEQ ID NO: 2949422 - protein, 20 aa, Entamoeba invadens
KRKIARIICGKKVNRNKLTK

SEQ ID NO: 2949423 - protein, 24 aa, Entamoeba invadens
KRKIEPNCLCGQKYDRTEQKRTEN

SEQ ID NO: 2949424 - protein, 19 aa, Entamoeba invadens
KRKKRRLIVLFGAKAEFCH

SEQ ID NO: 2949425 - protein, 23 aa, Entamoeba invadens
KRKLCQPYVIAAAIRDCALAADG

SEQ ID NO: 2949426 - protein, 17 aa, Entamoeba invadens
KRKLDVLSLNMTTQTKA

SEQ ID NO: 2949427 - protein, 25 aa, Entamoeba invadens
KRKLRLRSRSIHPLIDTVDEVSYTT

SEQ ID NO: 2949428 - protein, 17 aa, Entamoeba invadens
KRKMGYGGSGFKFDKKE

SEQ ID NO: 2949429 - protein, 17 aa, Entamoeba invadens
KRKNVNVANKWKMECEL

SEQ ID NO: 2949430 - protein, 21 aa, Entamoeba invadens
KRKQEEPLMLIGRYINSLDPY

SEQ ID NO: 2949431 - protein, 26 aa, Entamoeba invadens
KRKQLEGILLRFSELVATELRNETGR

SEQ ID NO: 2949432 - protein, 30 aa, Entamoeba invadens
KRKRSLGFLSPRSRKGISILKKRSSSSTQV

SEQ ID NO: 2949433 - protein, 23 aa, Entamoeba invadens
KRKSEFIESLQFGVKNYFYEGNY

SEQ ID NO: 2949434 - protein, 29 aa, Entamoeba invadens
KRKSGLRIRDCFDKTDADCVAKVVVEINK

SEQ ID NO: 2949435 - protein, 27 aa, Entamoeba invadens
KRKSLKRRLSATLGIGRRDKAKEKDEK

SEQ ID NO: 2949436 - protein, 18 aa, Entamoeba invadens
KRKVVLVCQCSGKYRSCS

SEQ ID NO: 2949437 - protein, 19 aa, Entamoeba invadens
KRKYIEAIGGYRGVLEQTE

SEQ ID NO: 2949438 - protein, 19 aa, Entamoeba invadens
KRLAAGKPRQSAIFHFGRN

SEQ ID NO: 2949439 - protein, 21 aa, Entamoeba invadens
KRLAEREARNPVFYFLQKNHP

SEQ ID NO: 2949440 - protein, 25 aa, Entamoeba invadens
KRLDLVCFKKSFGVEETYKVCEDFC

SEQ ID NO: 2949441 - protein, 21 aa, Entamoeba invadens
KRLEDIERVLRKEVESDMKDF

SEQ ID NO: 2949442 - protein, 30 aa, Entamoeba invadens
KRLEETVRVLPLIDYRTLRINTRVLHSEST

SEQ ID NO: 2949443 - protein, 19 aa, Entamoeba invadens
KRLEKVLIETKAKVLGVSP

SEQ ID NO: 2949444 - protein, 20 aa, Entamoeba invadens
KRLEMIYLMNVSLYFEKFGD

SEQ ID NO: 2949445 - protein, 21 aa, Entamoeba invadens
KRLENEYKVFSGITESSHIIP

SEQ ID NO: 2949446 - protein, 18 aa, Entamoeba invadens
KRLFEILKENGYDVETSF

SEQ ID NO: 2949447 - protein, 20 aa, Entamoeba invadens
KRLFIFSFDCNIEYGQKRIG

SEQ ID NO: 2949448 - protein, 21 aa, Entamoeba invadens
KRLFSLSFKKRIFSLEVVIIG

SEQ ID NO: 2949449 - protein, 19 aa, Entamoeba invadens
KRLGFATCLEHEFFEDDKT

SEQ ID NO: 2949450 - protein, 17 aa, Entamoeba invadens
KRLIEALLQDDSPNKEW

SEQ ID NO: 2949451 - protein, 19 aa, Entamoeba invadens
KRLIGRRFSDPAIQEDMKH

SEQ ID NO: 2949452 - protein, 19 aa, Entamoeba invadens
KRLIGRRFSDPTIQEDMKH

SEQ ID NO: 2949453 - protein, 32 aa, Entamoeba invadens
KRLINLLHYCILRGASTASMYWNIFIQNASTW

SEQ ID NO: 2949454 - protein, 19 aa, Entamoeba invadens
KRLKYRNGRFLPFLMAGNP

SEQ ID NO: 2949455 - protein, 20 aa, Entamoeba invadens
KRLLSACSMVETAESVEIQL

SEQ ID NO: 2949456 - protein, 24 aa, Entamoeba invadens
KRLLTQPMKIDWTFYCHKCDGMAS

SEQ ID NO: 2949457 - protein, 17 aa, Entamoeba invadens
KRLMRFCPKNVIFDRKT

SEQ ID NO: 2949458 - protein, 22 aa, Entamoeba invadens
KRLNKVRARLALLRSSYLIDNK

SEQ ID NO: 2949459 - protein, 25 aa, Entamoeba invadens
KRLNMFKKICELYKKSTTNNLPSLL

SEQ ID NO: 2949460 - protein, 25 aa, Entamoeba invadens
KRLNMKCPLKFDIGAIYDKLLTGTG

SEQ ID NO: 2949461 - protein, 21 aa, Entamoeba invadens
KRLPYLPMIVDFKVFVVTFVK

SEQ ID NO: 2949462 - protein, 28 aa, Entamoeba invadens
KRLQLPKLSVFWDKHRAFLSSANSKLQE

SEQ ID NO: 2949463 - protein, 28 aa, Entamoeba invadens
KRLQSFEIPKSVILLGLCILEGCTSLTS

SEQ ID NO: 2949464 - protein, 19 aa, Entamoeba invadens
KRLSAQVQRHCDDLFVTPP

SEQ ID NO: 2949465 - protein, 23 aa, Entamoeba invadens
KRLSEKQCSLLFNGKEKDGIKEK

SEQ ID NO: 2949466 - protein, 18 aa, Entamoeba invadens
KRLSLLPTSVGSWTIDPA

SEQ ID NO: 2949467 - protein, 21 aa, Entamoeba invadens
KRLSNDDSIVCWFNKDTKEIG

SEQ ID NO: 2949468 - protein, 21 aa, Entamoeba invadens
KRLSQKYPLYVQMITKESIDM

SEQ ID NO: 2949469 - protein, 18 aa, Entamoeba invadens
KRLTKYNTLHFVLVLDHK

SEQ ID NO: 2949470 - protein, 19 aa, Entamoeba invadens
KRLTKYNTLHFVLVLDHKN

SEQ ID NO: 2949471 - protein, 20 aa, Entamoeba invadens
KRMAMRRSVRGQRPRADPTS

SEQ ID NO: 2949472 - protein, 17 aa, Entamoeba invadens
KRMEPYQTLPLLKQETL

SEQ ID NO: 2949473 - protein, 21 aa, Entamoeba invadens
KRMIELSKLLIYFNGSDSTNA

SEQ ID NO: 2949474 - protein, 23 aa, Entamoeba invadens
KRMKELKRDLLILNTVENKVREK

SEQ ID NO: 2949475 - protein, 17 aa, Entamoeba invadens
KRMKILAPRLKMLAQST

SEQ ID NO: 2949476 - protein, 21 aa, Entamoeba invadens
KRMLMTGGLMMELFKNALKKL

SEQ ID NO: 2949477 - protein, 17 aa, Entamoeba invadens
KRMLYLFVDQIRKSDGT

SEQ ID NO: 2949478 - protein, 20 aa, Entamoeba invadens
KRNACYRRMSTEVAMEDEVR

SEQ ID NO: 2949479 - protein, 17 aa, Entamoeba invadens
KRNASAIPKGLDSAILV

SEQ ID NO: 2949480 - protein, 22 aa, Entamoeba invadens
KRNCVGVALTIGKRNYMEDVAI

SEQ ID NO: 2949481 - protein, 20 aa, Entamoeba invadens
KRNEINTGIAKYFETQKTTG

SEQ ID NO: 2949482 - protein, 25 aa, Entamoeba invadens
KRNELRGRSGWGCTQIRSSKEERIL

SEQ ID NO: 2949483 - protein, 20 aa, Entamoeba invadens
KRNGKDVYNIFKFEENDVFE

SEQ ID NO: 2949484 - protein, 20 aa, Entamoeba invadens
KRNIPVFLPPGGHAIYLEID

SEQ ID NO: 2949485 - protein, 19 aa, Entamoeba invadens
KRNIRKFVIGIGGSATNDG

SEQ ID NO: 2949486 - protein, 19 aa, Entamoeba invadens
KRNQIILSHQLIAFSSLAN

SEQ ID NO: 2949487 - protein, 30 aa, Entamoeba invadens
KRNRKVFKVARRKISLFSCFDSLERLIIRN

SEQ ID NO: 2949488 - protein, 25 aa, Entamoeba invadens
KRNVERSGWLRMISKVITISNHIRY

SEQ ID NO: 2949489 - protein, 21 aa, Entamoeba invadens
KRNVKVLYPRIEFNSKDAVFN

SEQ ID NO: 2949490 - protein, 25 aa, Entamoeba invadens
  misc_feature (25)..(25): Xaa can be any naturally occurring amino acid
KRNVQMGVIPPHYPAVIPKQRLIKX

SEQ ID NO: 2949491 - protein, 25 aa, Entamoeba invadens
KRNVTFPKFSIESSFNMVSQLKTLG

SEQ ID NO: 2949492 - protein, 23 aa, Entamoeba invadens
KRNYVKMRGMPNLQQMRGATQMR

SEQ ID NO: 2949493 - protein, 21 aa, Entamoeba invadens
KRPDTFTVPFVKHPKKSKDDE

SEQ ID NO: 2949494 - protein, 27 aa, Entamoeba invadens
KRPIFTIKIANTFLRKKVSTMLFGIEN

SEQ ID NO: 2949495 - protein, 21 aa, Entamoeba invadens
KRPNLSAAMSSAMCRINSYSK

SEQ ID NO: 2949496 - protein, 17 aa, Entamoeba invadens
KRPNYITRTIFVKYSKK

SEQ ID NO: 2949497 - protein, 19 aa, Entamoeba invadens
KRPPTKMICLNAQADALTP

SEQ ID NO: 2949498 - protein, 21 aa, Entamoeba invadens
KRPSDEMVSAFSHLFEDYDKT

SEQ ID NO: 2949499 - protein, 20 aa, Entamoeba invadens
KRPSKSLCKRNFFTALETTQ

SEQ ID NO: 2949500 - protein, 24 aa, Entamoeba invadens
KRPTADQLLQFAFFDPHVVPASLP

SEQ ID NO: 2949501 - protein, 25 aa, Entamoeba invadens
KRPTVDEVLRRLAVLDEDMKKISQL

SEQ ID NO: 2949502 - protein, 17 aa, Entamoeba invadens
KRPVKLVSQDSEPYVFT

SEQ ID NO: 2949503 - protein, 39 aa, Entamoeba invadens
KRPYWKELVEGIITILMKGRCFNSYALNAALRKTLKSTS

SEQ ID NO: 2949504 - protein, 24 aa, Entamoeba invadens
KRQADKAIGVFLFKVIDSNNSGKI

SEQ ID NO: 2949505 - protein, 18 aa, Entamoeba invadens
KRQFPLYRRVPYYDFRWG

SEQ ID NO: 2949506 - protein, 21 aa, Entamoeba invadens
KRQGTKFVIHEPAVFKLPGAE

SEQ ID NO: 2949507 - protein, 20 aa, Entamoeba invadens
KRQKSIRLIGKISGSALTYN

SEQ ID NO: 2949508 - protein, 20 aa, Entamoeba invadens
KRQLIKYGSFNTLQFGPIIL

SEQ ID NO: 2949509 - protein, 18 aa, Entamoeba invadens
KRQLPIVMSECPSRNTRK

SEQ ID NO: 2949510 - protein, 19 aa, Entamoeba invadens
KRQNEFGIGGSYKANENTN

SEQ ID NO: 2949511 - protein, 19 aa, Entamoeba invadens
KRQSDISCFFNKMNNVKKV

SEQ ID NO: 2949512 - protein, 26 aa, Entamoeba invadens
KRQVTQFGDGYWRIAAREVRHNPTDC

SEQ ID NO: 2949513 - protein, 20 aa, Entamoeba invadens
KRQVTRCVVTVPAHFEMTQV

SEQ ID NO: 2949514 - protein, 19 aa, Entamoeba invadens
KRQWDELNQKLLQEANAAP

SEQ ID NO: 2949515 - protein, 17 aa, Entamoeba invadens
KRRAALLKRKEHERMQR

SEQ ID NO: 2949516 - protein, 23 aa, Entamoeba invadens
KRRCNTEVMFIHFPDFLLDPVTA

SEQ ID NO: 2949517 - protein, 18 aa, Entamoeba invadens
KRREVMRLLQDFISELGF

SEQ ID NO: 2949518 - protein, 28 aa, Entamoeba invadens
KRRGDNWAMKKANGFCKTFKGEKREMCY

SEQ ID NO: 2949519 - protein, 18 aa, Entamoeba invadens
KRRHSMSAFSPTSSMFSV

SEQ ID NO: 2949520 - protein, 25 aa, Entamoeba invadens
KRRIFGELIKVVGIEQNVLIIRTNK

SEQ ID NO: 2949521 - protein, 18 aa, Entamoeba invadens
KRRISLRDFFPFKREEFP

SEQ ID NO: 2949522 - protein, 19 aa, Entamoeba invadens
KRRISLRDFFPFKREEFPK

SEQ ID NO: 2949523 - protein, 20 aa, Entamoeba invadens
KRRLDAWLATDFADNHLRQT

SEQ ID NO: 2949524 - protein, 26 aa, Entamoeba invadens
KRRLEFTSCFLCGKTGHLSNMCPENP

SEQ ID NO: 2949525 - protein, 18 aa, Entamoeba invadens
KRRLNILKRVSEDTKIAF

SEQ ID NO: 2949526 - protein, 21 aa, Entamoeba invadens
KRRLSDYNQHCQIEHRIKATY

SEQ ID NO: 2949527 - protein, 17 aa, Entamoeba invadens
KRRMGKLINEFFELTYL

SEQ ID NO: 2949528 - protein, 31 aa, Entamoeba invadens
KRRMKEPVYYCEVRAPSEVVGKVFQVLDKRR

SEQ ID NO: 2949529 - protein, 19 aa, Entamoeba invadens
KRRMRRKVMEITHISELQD

SEQ ID NO: 2949530 - protein, 22 aa, Entamoeba invadens
KRRPKKMLEFFAVEKITDKSGD

SEQ ID NO: 2949531 - protein, 21 aa, Entamoeba invadens
KRRPRRLSANVNRKPRELKTT

SEQ ID NO: 2949532 - protein, 22 aa, Entamoeba invadens
KRRRLVYDSSMMDFSKESFYNA

SEQ ID NO: 2949533 - protein, 21 aa, Entamoeba invadens
KRRRVICPLKTYSFSHKNDKF

SEQ ID NO: 2949534 - protein, 27 aa, Entamoeba invadens
KRRSKKTECPFRINLNYRANSNTWNIT

SEQ ID NO: 2949535 - protein, 17 aa, Entamoeba invadens
KRRSMSSAKGMKLELDS

SEQ ID NO: 2949536 - protein, 17 aa, Entamoeba invadens
KRRTAFLGIGVKPKPSL

SEQ ID NO: 2949537 - protein, 21 aa, Entamoeba invadens
KRRYFVIKNNFIFYFPSSQPD

SEQ ID NO: 2949538 - protein, 23 aa, Entamoeba invadens
KRSALIRIPANRVVETHNYLLDI

SEQ ID NO: 2949539 - protein, 18 aa, Entamoeba invadens
KRSCSICKSNYYPIQGRC

SEQ ID NO: 2949540 - protein, 24 aa, Entamoeba invadens
KRSDGLKMTFVFSKNDFLVNGNIE

SEQ ID NO: 2949541 - protein, 27 aa, Entamoeba invadens
KRSEELCVLGNLFGIECFDDGLVSIGG

SEQ ID NO: 2949542 - protein, 17 aa, Entamoeba invadens
KRSEGAVLYKSYIFGPS

SEQ ID NO: 2949543 - protein, 19 aa, Entamoeba invadens
KRSERRGAALSALGKLTRN

SEQ ID NO: 2949544 - protein, 25 aa, Entamoeba invadens
KRSEWFRKQFHPIELRERRLLKQKS

SEQ ID NO: 2949545 - protein, 20 aa, Entamoeba invadens
KRSFDHLFKILVIGESGVGK

SEQ ID NO: 2949546 - protein, 19 aa, Entamoeba invadens
KRSGAINVLQSRFIQSYVP

SEQ ID NO: 2949547 - protein, 23 aa, Entamoeba invadens
KRSGFAGRCFGGKPVILLYDEND

SEQ ID NO: 2949548 - protein, 22 aa, Entamoeba invadens
KRSGKPRLSRSIKASDEKKEIE

SEQ ID NO: 2949549 - protein, 22 aa, Entamoeba invadens
KRSIGDERYVIWSGAVQTLLRA

SEQ ID NO: 2949550 - protein, 24 aa, Entamoeba invadens
KRSKFYCMAGANFPVIFGKEKLEE

SEQ ID NO: 2949551 - protein, 22 aa, Entamoeba invadens
KRSKKTIKFRVPKSMELNGVKA

SEQ ID NO: 2949552 - protein, 20 aa, Entamoeba invadens
KRSMLRICAHNRLYAKQNYL

SEQ ID NO: 2949553 - protein, 18 aa, Entamoeba invadens
KRSNEFLDYLTAAETKFR

SEQ ID NO: 2949554 - protein, 23 aa, Entamoeba invadens
KRSPAVCARARRNLIKNCERAKM

SEQ ID NO: 2949555 - protein, 17 aa, Entamoeba invadens
KRSPIVIHLSVDRTGKI

SEQ ID NO: 2949556 - protein, 33 aa, Entamoeba invadens
KRSTFLFKGGVPYGGVDWFDWNVVIGNIEGIVE

SEQ ID NO: 2949557 - protein, 19 aa, Entamoeba invadens
KRSTMRSRLSYSSSNSQPV

SEQ ID NO: 2949558 - protein, 22 aa, Entamoeba invadens
KRSVECWMHPDLFHLDKSTGAP

SEQ ID NO: 2949559 - protein, 23 aa, Entamoeba invadens
KRSVECWMHPDLFHLDKSTGAPP

SEQ ID NO: 2949560 - protein, 21 aa, Entamoeba invadens
KRTDMAVVLVGEFINLIKVSG

SEQ ID NO: 2949561 - protein, 18 aa, Entamoeba invadens
KRTECALPVGTPFVKEGF

SEQ ID NO: 2949562 - protein, 20 aa, Entamoeba invadens
KRTESPLVFHTHLGATAARK

SEQ ID NO: 2949563 - protein, 19 aa, Entamoeba invadens
KRTFGGVVYNMINFEQYKD

SEQ ID NO: 2949564 - protein, 19 aa, Entamoeba invadens
KRTFGGVVYNMINFEQYTD

SEQ ID NO: 2949565 - protein, 27 aa, Entamoeba invadens
KRTHKSISGLLFKGSMLELLEEYGKVL

SEQ ID NO: 2949566 - protein, 22 aa, Entamoeba invadens
KRTIKDIPLFYTKTLFMDSSSD

SEQ ID NO: 2949567 - protein, 21 aa, Entamoeba invadens
KRTKAKSVVDAKLKDAEREKA

SEQ ID NO: 2949568 - protein, 17 aa, Entamoeba invadens
KRTKLQILDGFQKKNRK

SEQ ID NO: 2949569 - protein, 21 aa, Entamoeba invadens
KRTLEEAKRDIEIRMEAFKEI

SEQ ID NO: 2949570 - protein, 21 aa, Entamoeba invadens
KRTNFKMAPHFEIANIFDEKG

SEQ ID NO: 2949571 - protein, 21 aa, Entamoeba invadens
KRTNFKMAPHFEIANIFDEQG

SEQ ID NO: 2949572 - protein, 22 aa, Entamoeba invadens
KRTPKAIMSMDQFDGVIDSIGH

SEQ ID NO: 2949573 - protein, 23 aa, Entamoeba invadens
KRTRNWHSQQCCVLISLLNQYFD

SEQ ID NO: 2949574 - protein, 36 aa, Entamoeba invadens
KRTRTILNFFSSFLLQRAGIEYDLDFPIFSHEKDLA

SEQ ID NO: 2949575 - protein, 20 aa, Entamoeba invadens
KRTSFKQTVFKIFGGEKKKT

SEQ ID NO: 2949576 - protein, 20 aa, Entamoeba invadens
KRTSGQFVMNSMTSVLLRLL

SEQ ID NO: 2949577 - protein, 20 aa, Entamoeba invadens
KRTTTTFQFLYIKEIKFNNY

SEQ ID NO: 2949578 - protein, 18 aa, Entamoeba invadens
KRVCKYFSSIVIDKKQTT

SEQ ID NO: 2949579 - protein, 28 aa, Entamoeba invadens
KRVELFSAQFFECVKKLPTKQGNYAYLL

SEQ ID NO: 2949580 - protein, 17 aa, Entamoeba invadens
KRVEPLIEEVRIAPWTS

SEQ ID NO: 2949581 - protein, 19 aa, Entamoeba invadens
KRVFSRFVSKFTEKLVEKK

SEQ ID NO: 2949582 - protein, 18 aa, Entamoeba invadens
KRVFVDNRFEGMTIVGHI

SEQ ID NO: 2949583 - protein, 24 aa, Entamoeba invadens
KRVGKWRSVEEYGPIRKYQDIGFE

SEQ ID NO: 2949584 - protein, 21 aa, Entamoeba invadens
KRVGMMKGSRTFGVGVNESKT

SEQ ID NO: 2949585 - protein, 17 aa, Entamoeba invadens
KRVHDIRGGANVNSRLI

SEQ ID NO: 2949586 - protein, 32 aa, Entamoeba invadens
KRVIESDCVVFGCGHTFHVICIKNEFIKNKTQ

SEQ ID NO: 2949587 - protein, 22 aa, Entamoeba invadens
KRVKEIPGEYFALGTDKTVIMK

SEQ ID NO: 2949588 - protein, 18 aa, Entamoeba invadens
KRVKIVEWYDYMVPKCYI

SEQ ID NO: 2949589 - protein, 18 aa, Entamoeba invadens
KRVKRGILNFDKEPKKGE

SEQ ID NO: 2949590 - protein, 20 aa, Entamoeba invadens
KRVKRWTKGGLILKNSYGTK

SEQ ID NO: 2949591 - protein, 19 aa, Entamoeba invadens
KRVPKMCFMDCHQLENVVG

SEQ ID NO: 2949592 - protein, 20 aa, Entamoeba invadens
KRVQEVYGLVNTLKEQLQEK

SEQ ID NO: 2949593 - protein, 17 aa, Entamoeba invadens
KRVTFDPKVLVLFYKCF

SEQ ID NO: 2949594 - protein, 18 aa, Entamoeba invadens
KRVVKCPLMSNKIFNIIT

SEQ ID NO: 2949595 - protein, 21 aa, Entamoeba invadens
KRVVLSPLTLVLPFLSNFSVF

SEQ ID NO: 2949596 - protein, 25 aa, Entamoeba invadens
KRVYNELDSRFVILKKRHKNCDRML

SEQ ID NO: 2949597 - protein, 21 aa, Entamoeba invadens
KRVYSPRRRVSIMKVDQDEKH

SEQ ID NO: 2949598 - protein, 25 aa, Entamoeba invadens
KRWIPRSDKPSTCFMLNRTNNTIGR

SEQ ID NO: 2949599 - protein, 20 aa, Entamoeba invadens
KRYAEKVGYPLVLCSSYSGQ

SEQ ID NO: 2949600 - protein, 20 aa, Entamoeba invadens
KRYAGVFWCNAEKYDHLDTK

SEQ ID NO: 2949601 - protein, 19 aa, Entamoeba invadens
KRYDKLFFLTCSNYSDIKL

SEQ ID NO: 2949602 - protein, 21 aa, Entamoeba invadens
KRYFKQCEFKLWRKKPDVQIV

SEQ ID NO: 2949603 - protein, 27 aa, Entamoeba invadens
KRYFVKELPWVLAIQIKRFGWDERKIN

SEQ ID NO: 2949604 - protein, 18 aa, Entamoeba invadens
KRYILNEFIDIYDPIIVD

SEQ ID NO: 2949605 - protein, 20 aa, Entamoeba invadens
KRYINARFLPDKAIDLVDEA

SEQ ID NO: 2949606 - protein, 23 aa, Entamoeba invadens
KRYKNYLSKRMRILSSTENVIID

SEQ ID NO: 2949607 - protein, 25 aa, Entamoeba invadens
KRYKSIEGIGIKVIVLEGTRTLLID

SEQ ID NO: 2949608 - protein, 19 aa, Entamoeba invadens
KRYLIPRYTPNLVRNKSPH

SEQ ID NO: 2949609 - protein, 18 aa, Entamoeba invadens
KRYQDINLRLGINTEDGY

SEQ ID NO: 2949610 - protein, 21 aa, Entamoeba invadens
KRYQPMFLHCRSLREIFIETP

SEQ ID NO: 2949611 - protein, 20 aa, Entamoeba invadens
KRYRIYLGLDTSESTTELSP

SEQ ID NO: 2949612 - protein, 19 aa, Entamoeba invadens
KRYRYHLLCECGGSLFVDE

SEQ ID NO: 2949613 - protein, 19 aa, Entamoeba invadens
KRYTWFKQKYEEFEKKFEG

SEQ ID NO: 2949614 - protein, 18 aa, Entamoeba invadens
KRYVDLRVSLGGNPSDIC

SEQ ID NO: 2949615 - protein, 20 aa, Entamoeba invadens
KRYYYLRAMSGYLSGVKTSG

SEQ ID NO: 2949616 - protein, 26 aa, Entamoeba invadens
KSACIDIVSFLPIVFTKAAEVVSGGV

SEQ ID NO: 2949617 - protein, 17 aa, Entamoeba invadens
KSACLNETFLNEYVANY

SEQ ID NO: 2949618 - protein, 29 aa, Entamoeba invadens
KSADFFGHLNGVVSMCFDEDYNLVSAGKD

SEQ ID NO: 2949619 - protein, 25 aa, Entamoeba invadens
KSAEACSGLQGFFYYNSVGGGTGSG

SEQ ID NO: 2949620 - protein, 26 aa, Entamoeba invadens
KSAEFDRRLMPIISYLDDELGKYLHD

SEQ ID NO: 2949621 - protein, 19 aa, Entamoeba invadens
KSAFELFKDLELVNDAGSQ

SEQ ID NO: 2949622 - protein, 19 aa, Entamoeba invadens
KSAHIPRLEKCSRLIHSEE

SEQ ID NO: 2949623 - protein, 21 aa, Entamoeba invadens
KSAKNGIGLVRLMGRDAGFIA

SEQ ID NO: 2949624 - protein, 20 aa, Entamoeba invadens
KSAKRVRMIVREDIEEREEF

SEQ ID NO: 2949625 - protein, 20 aa, Entamoeba invadens
KSALKAPLVLADYLKMPAIF

SEQ ID NO: 2949626 - protein, 19 aa, Entamoeba invadens
KSALMSAFLDDLRKVKTSI

SEQ ID NO: 2949627 - protein, 18 aa, Entamoeba invadens
KSAMRLFSICDFFMTTFV

SEQ ID NO: 2949628 - protein, 19 aa, Entamoeba invadens
KSAMRRKLVDWLSEVSSLL

SEQ ID NO: 2949629 - protein, 20 aa, Entamoeba invadens
KSAPNRAVFNMMIRSDHEAS

SEQ ID NO: 2949630 - protein, 18 aa, Entamoeba invadens
KSAQQIMTRIKWVNSGKQ

SEQ ID NO: 2949631 - protein, 21 aa, Entamoeba invadens
KSASKYDLLIQIASETLTPQT

SEQ ID NO: 2949632 - protein, 19 aa, Entamoeba invadens
KSASLLHTRFEDVEKSVFL

SEQ ID NO: 2949633 - protein, 20 aa, Entamoeba invadens
KSASVSPALFDFSGEFHTGE

SEQ ID NO: 2949634 - protein, 20 aa, Entamoeba invadens
KSATFVLQKVCFERNASKFQ

SEQ ID NO: 2949635 - protein, 26 aa, Entamoeba invadens
KSAVIKNEVKGMIPIIQSGEYDISKI

SEQ ID NO: 2949636 - protein, 18 aa, Entamoeba invadens
KSAVKIPYIDSHYKGITA

SEQ ID NO: 2949637 - protein, 25 aa, Entamoeba invadens
KSAVSFLKVNPWFTLTQDIERFYDL

SEQ ID NO: 2949638 - protein, 17 aa, Entamoeba invadens
KSAVTIIDQKAKGLFSA

SEQ ID NO: 2949639 - protein, 19 aa, Entamoeba invadens
KSAVYKVSRLIEGLDDLDL

SEQ ID NO: 2949640 - protein, 20 aa, Entamoeba invadens
KSAYFKPLINRITPLGENVE

SEQ ID NO: 2949641 - protein, 20 aa, Entamoeba invadens
KSAYGKRFVDAVNNFLREHN

SEQ ID NO: 2949642 - protein, 18 aa, Entamoeba invadens
KSAYRVIGMLGRGSFGQV

SEQ ID NO: 2949643 - protein, 19 aa, Entamoeba invadens
KSCFKNCTQLDTIDVNLTT

SEQ ID NO: 2949644 - protein, 21 aa, Entamoeba invadens
KSCFSGCIWIKSVVLNRKCQS

SEQ ID NO: 2949645 - protein, 19 aa, Entamoeba invadens
KSCFVYCLQLSRVISSNKI

SEQ ID NO: 2949646 - protein, 21 aa, Entamoeba invadens
KSDCIWLLTKKTFIKITLLND

SEQ ID NO: 2949647 - protein, 20 aa, Entamoeba invadens
KSDDNVFVWDIWMEGPTQTP

SEQ ID NO: 2949648 - protein, 20 aa, Entamoeba invadens
KSDDSIFMVLDLCNGSVDDL

SEQ ID NO: 2949649 - protein, 24 aa, Entamoeba invadens
KSDEELEQAPIVFPKNKKKKRTLI

SEQ ID NO: 2949650 - protein, 19 aa, Entamoeba invadens
KSDGKRFLKKVTHQLELDF

SEQ ID NO: 2949651 - protein, 19 aa, Entamoeba invadens
KSDICLTIKCVATAMAVYK

SEQ ID NO: 2949652 - protein, 19 aa, Entamoeba invadens
KSDIEVRMLEIMKSVEACN

SEQ ID NO: 2949653 - protein, 21 aa, Entamoeba invadens
KSDLYSLGVILFQMATTYFPF

SEQ ID NO: 2949654 - protein, 21 aa, Entamoeba invadens
KSDMFWKFKINAAVEHIKKEV

SEQ ID NO: 2949655 - protein, 18 aa, Entamoeba invadens
KSDQIISVIVKKLNEKDE

SEQ ID NO: 2949656 - protein, 21 aa, Entamoeba invadens
KSDRSLYTLLFHLIDDDNSGT

SEQ ID NO: 2949657 - protein, 17 aa, Entamoeba invadens
KSDSKYTTLGWSQVCDF

SEQ ID NO: 2949658 - protein, 29 aa, Entamoeba invadens
KSDTLCEFGKWVFCGCFSITNVECPDEMR

SEQ ID NO: 2949659 - protein, 22 aa, Entamoeba invadens
KSDVIYPWSKFDGTLDVELYNS

SEQ ID NO: 2949660 - protein, 19 aa, Entamoeba invadens
KSDVWKMFHEFEERCGNVQ

SEQ ID NO: 2949661 - protein, 17 aa, Entamoeba invadens
KSDYHVFNLKRKAVLLD

SEQ ID NO: 2949662 - protein, 17 aa, Entamoeba invadens
KSDYKLMSEDDLFSKMT

SEQ ID NO: 2949663 - protein, 20 aa, Entamoeba invadens
KSEAIWKIVTEVIDCTKELG

SEQ ID NO: 2949664 - protein, 19 aa, Entamoeba invadens
KSEEKWGKLPLETREEEKQ

SEQ ID NO: 2949665 - protein, 19 aa, Entamoeba invadens
KSEESVSVFEIQRECQTKI

SEQ ID NO: 2949666 - protein, 20 aa, Entamoeba invadens
KSEFFPRDIERAMYQKCVVP

SEQ ID NO: 2949667 - protein, 22 aa, Entamoeba invadens
KSEFRVLDSLQMFFQSGGSSLT

SEQ ID NO: 2949668 - protein, 38 aa, Entamoeba invadens
KSEGGNDWNLLFKKRHCFCGYYIFVEFSVRGSLESLEN

SEQ ID NO: 2949669 - protein, 19 aa, Entamoeba invadens
KSEISRYGIELEENEDISI

SEQ ID NO: 2949670 - protein, 22 aa, Entamoeba invadens
KSEKGIEFWKKHFFNAKTGGLE

SEQ ID NO: 2949671 - protein, 18 aa, Entamoeba invadens
KSEKPQKLVVCQNPTKSA

SEQ ID NO: 2949672 - protein, 18 aa, Entamoeba invadens
KSELFGRVFQVFLRNQKW

SEQ ID NO: 2949673 - protein, 18 aa, Entamoeba invadens
KSELVKVVFSKQDEVLQV

SEQ ID NO: 2949674 - protein, 26 aa, Entamoeba invadens
KSELYYYVVMECSAYGSLYNFMSMNK

SEQ ID NO: 2949675 - protein, 27 aa, Entamoeba invadens
KSEMFSDECIFKLLSYVSEHKNQEMDH

SEQ ID NO: 2949676 - protein, 19 aa, Entamoeba invadens
KSENVFSVGNAFIIKKTGD

SEQ ID NO: 2949677 - protein, 26 aa, Entamoeba invadens
KSERPFELFNSLGICRVVEDNKLGIE

SEQ ID NO: 2949678 - protein, 22 aa, Entamoeba invadens
KSERPKRVFVAKTPQEKCFVVN

SEQ ID NO: 2949679 - protein, 28 aa, Entamoeba invadens
KSESIRYNFAINYAFGFWDNQLFKDESG

SEQ ID NO: 2949680 - protein, 22 aa, Entamoeba invadens
KSESVKCFFVVVLTEFHGETCQ

SEQ ID NO: 2949681 - protein, 18 aa, Entamoeba invadens
KSFAHSFSSSSLEKLGEW

SEQ ID NO: 2949682 - protein, 23 aa, Entamoeba invadens
KSFCKKIKAVGYCECSALNNTNV

SEQ ID NO: 2949683 - protein, 23 aa, Entamoeba invadens
KSFDQRLYRSLSYKKFDPCCLNQ

SEQ ID NO: 2949684 - protein, 17 aa, Entamoeba invadens
KSFDTIRIFQSNPPQEV

SEQ ID NO: 2949685 - protein, 24 aa, Entamoeba invadens
KSFEEVYYRILLVADDRIKVGDVI

SEQ ID NO: 2949686 - protein, 18 aa, Entamoeba invadens
KSFFKKKFFQVVVWFTVD

SEQ ID NO: 2949687 - protein, 20 aa, Entamoeba invadens
KSFGHRFATRTGFGQVCPYG

SEQ ID NO: 2949688 - protein, 19 aa, Entamoeba invadens
KSFGNKNWVFSIPAKSMQV

SEQ ID NO: 2949689 - protein, 19 aa, Entamoeba invadens
KSFIVLMVGLQGRFEHDLG

SEQ ID NO: 2949690 - protein, 19 aa, Entamoeba invadens
KSFIVMMFSAFWLSQDGKA

SEQ ID NO: 2949691 - protein, 17 aa, Entamoeba invadens
KSFKAKHKISATGTPMM

SEQ ID NO: 2949692 - protein, 18 aa, Entamoeba invadens
KSFKGWVISVKYDKTDDK

SEQ ID NO: 2949693 - protein, 25 aa, Entamoeba invadens
KSFLAFIERLFRLLKLIADNSKENL

SEQ ID NO: 2949694 - protein, 17 aa, Entamoeba invadens
KSFLKKKFFRIIVWFNV

SEQ ID NO: 2949695 - protein, 20 aa, Entamoeba invadens
KSFNCVELPTSLTKLKIKNL

SEQ ID NO: 2949696 - protein, 17 aa, Entamoeba invadens
KSFQWAKEVQYWTKKEA

SEQ ID NO: 2949697 - protein, 17 aa, Entamoeba invadens
KSFRYELKCHCKSIAST

SEQ ID NO: 2949698 - protein, 19 aa, Entamoeba invadens
KSFSFKIVLLGSGSVGKSA

SEQ ID NO: 2949699 - protein, 18 aa, Entamoeba invadens
KSFSSFVASISFNHAYIY

SEQ ID NO: 2949700 - protein, 17 aa, Entamoeba invadens
KSFSSFVASLSFDQAYI

SEQ ID NO: 2949701 - protein, 27 aa, Entamoeba invadens
KSFSTVCLLLSLWNVVDCPFRAMDEFD

SEQ ID NO: 2949702 - protein, 28 aa, Entamoeba invadens
KSFSTVCLLLSLWNVVDCPFRAMDEFDV

SEQ ID NO: 2949703 - protein, 20 aa, Entamoeba invadens
KSFTKFSWFTKKFPITRNFN

SEQ ID NO: 2949704 - protein, 24 aa, Entamoeba invadens
KSFVFSVFSAFWILQDQTIHFHKH

SEQ ID NO: 2949705 - protein, 20 aa, Entamoeba invadens
KSGACGDGYYGEAGKCQKCS

SEQ ID NO: 2949706 - protein, 30 aa, Entamoeba invadens
KSGALGHFCPVCFELLIKRYQCAICGMNVH

SEQ ID NO: 2949707 - protein, 27 aa, Entamoeba invadens
KSGDINFNLCFKDYYLAANSSKNPLTG

SEQ ID NO: 2949708 - protein, 23 aa, Entamoeba invadens
KSGEWKLGGLQLVSTLTDPQDYK

SEQ ID NO: 2949709 - protein, 20 aa, Entamoeba invadens
KSGFFQRTEYLLSHGEDISR

SEQ ID NO: 2949710 - protein, 17 aa, Entamoeba invadens
KSGGLKMKKLTASEKLQ

SEQ ID NO: 2949711 - protein, 18 aa, Entamoeba invadens
KSGGRPILPVTFIEENEH

SEQ ID NO: 2949712 - protein, 24 aa, Entamoeba invadens
KSGHFLHIDFAHFLGNKLKVAGVI

SEQ ID NO: 2949713 - protein, 19 aa, Entamoeba invadens
KSGICCSIFVRENDDFFVP

SEQ ID NO: 2949714 - protein, 20 aa, Entamoeba invadens
KSGIQWAELFKVHKLVLTRY

SEQ ID NO: 2949715 - protein, 24 aa, Entamoeba invadens
KSGIVECFVVMFDRFSKTVQNETK

SEQ ID NO: 2949716 - protein, 23 aa, Entamoeba invadens
KSGKKIMVHSCVITQQKFFKDLS

SEQ ID NO: 2949717 - protein, 25 aa, Entamoeba invadens
KSGKLKKMVIEWEMNVKPFDKKNEK

SEQ ID NO: 2949718 - protein, 29 aa, Entamoeba invadens
KSGKWNILKCLNCKSNFLAMKNDDSKTIL

SEQ ID NO: 2949719 - protein, 26 aa, Entamoeba invadens
KSGKYAKFTICFSSVISDELLDYFAT

SEQ ID NO: 2949720 - protein, 20 aa, Entamoeba invadens
KSGLCTKCAQGSGLISNGKC

SEQ ID NO: 2949721 - protein, 21 aa, Entamoeba invadens
KSGQFRLHITALKYLAEYCPN

SEQ ID NO: 2949722 - protein, 20 aa, Entamoeba invadens
KSGSIFIPRGISVQSLDHTK

SEQ ID NO: 2949723 - protein, 25 aa, Entamoeba invadens
KSGSPKLGLDRSFRLETLLMLELFS

SEQ ID NO: 2949724 - protein, 19 aa, Entamoeba invadens
KSGTCVKAIDFIQQLIEKK

SEQ ID NO: 2949725 - protein, 29 aa, Entamoeba invadens
KSGTEEFKFGKIKIFFKVADNQRLQNGIT

SEQ ID NO: 2949726 - protein, 19 aa, Entamoeba invadens
KSGVLKGGAVVSVAYLPQQ

SEQ ID NO: 2949727 - protein, 19 aa, Entamoeba invadens
KSGVPPLPMFVKRRTTTCL

SEQ ID NO: 2949728 - protein, 34 aa, Entamoeba invadens
KSGWLMKEGGGWKSWKKRFFVLDGATLTYYKDDT

SEQ ID NO: 2949729 - protein, 25 aa, Entamoeba invadens
KSGYFSPFVICICGDGRVLKPLVST

SEQ ID NO: 2949730 - protein, 26 aa, Entamoeba invadens
KSGYWLKGDTSFIFSLVRNGELNPKI

SEQ ID NO: 2949731 - protein, 21 aa, Entamoeba invadens
KSHCFKRLSLNEIDIPERVSS

SEQ ID NO: 2949732 - protein, 20 aa, Entamoeba invadens
KSHGETCIYLLNAIGDLTTI

SEQ ID NO: 2949733 - protein, 19 aa, Entamoeba invadens
KSHGLYCSVCNRSFTDSAS

SEQ ID NO: 2949734 - protein, 21 aa, Entamoeba invadens
KSHRRFTIFSFKKSSKSLKKS

SEQ ID NO: 2949735 - protein, 21 aa, Entamoeba invadens
KSHVLKFFVKKFINPSELVSL

SEQ ID NO: 2949736 - protein, 17 aa, Entamoeba invadens
KSIAFSEQFMKSLPLLW

SEQ ID NO: 2949737 - protein, 28 aa, Entamoeba invadens
KSIAGGVAYRPTDKVTIGANGKYSKTNG

SEQ ID NO: 2949738 - protein, 20 aa, Entamoeba invadens
KSICMNDFLAFNYEDDQTPV

SEQ ID NO: 2949739 - protein, 35 aa, Entamoeba invadens
KSIDLTECYKVHFVCRVGVVYLTHFDSFHTNYTEG

SEQ ID NO: 2949740 - protein, 19 aa, Entamoeba invadens
KSIDVPIFVVHATNDEIIP

SEQ ID NO: 2949741 - protein, 19 aa, Entamoeba invadens
KSIEDYTECIGFQTNEDIY

SEQ ID NO: 2949742 - protein, 26 aa, Entamoeba invadens
KSIELKGSTISIVFHDHFTPLRIYQT

SEQ ID NO: 2949743 - protein, 17 aa, Entamoeba invadens
KSIEWKTPTFKKFTKLV

SEQ ID NO: 2949744 - protein, 24 aa, Entamoeba invadens
KSIFEILNTPPLYDALDTSQKFEL

SEQ ID NO: 2949745 - protein, 24 aa, Entamoeba invadens
KSIGRKCFIKCLSLSSFTIPPNIK

SEQ ID NO: 2949746 - protein, 22 aa, Entamoeba invadens
KSIHKLSKMKVAVLGMHHRTLV

SEQ ID NO: 2949747 - protein, 23 aa, Entamoeba invadens
KSIIEFLNVWVLALGDNFSVVPP

SEQ ID NO: 2949748 - protein, 25 aa, Entamoeba invadens
KSIILLEYVKQCGKTHQLGQPIPLT

SEQ ID NO: 2949749 - protein, 20 aa, Entamoeba invadens
KSIKRFKATIGEKLAKIDKK

SEQ ID NO: 2949750 - protein, 27 aa, Entamoeba invadens
KSILEEIQKQLALLPTIMERISNFEST

SEQ ID NO: 2949751 - protein, 19 aa, Entamoeba invadens
KSILSAYEFDGRSCVDLKD

SEQ ID NO: 2949752 - protein, 19 aa, Entamoeba invadens
KSINEGFVKNIQNLEQTNT

SEQ ID NO: 2949753 - protein, 26 aa, Entamoeba invadens
KSINVSLCALRDVIAAISSKASHIPY

SEQ ID NO: 2949754 - protein, 19 aa, Entamoeba invadens
KSIPFLTAIAHMPNSEVYA

SEQ ID NO: 2949755 - protein, 32 aa, Entamoeba invadens
KSIPSNAPNTFEWVYKYFFELLKKSSEFKDNT

SEQ ID NO: 2949756 - protein, 20 aa, Entamoeba invadens
KSIQDGWMKGTYDVVCATVA

SEQ ID NO: 2949757 - protein, 24 aa, Entamoeba invadens
KSIQGLDAVIGWTINSLSQVDIPI

SEQ ID NO: 2949758 - protein, 19 aa, Entamoeba invadens
KSIQKRAGIQTEKKQKSSK

SEQ ID NO: 2949759 - protein, 19 aa, Entamoeba invadens
KSIRTSAHLSFNLQFDYNK

SEQ ID NO: 2949760 - protein, 33 aa, Entamoeba invadens
KSISCKMLVIGLGLLHLCCGDASTLVMDTVRAL

SEQ ID NO: 2949761 - protein, 19 aa, Entamoeba invadens
KSISIEGEWVIGGKNKLVG

SEQ ID NO: 2949762 - protein, 18 aa, Entamoeba invadens
KSIVVGMCVAGFKNANGQ

SEQ ID NO: 2949763 - protein, 18 aa, Entamoeba invadens
KSKDEFYQSFDYKELLEV

SEQ ID NO: 2949764 - protein, 21 aa, Entamoeba invadens
KSKEFATILFGWLDQNKDGYL

SEQ ID NO: 2949765 - protein, 22 aa, Entamoeba invadens
KSKEFVEWKETWKEVLQLDVPF

SEQ ID NO: 2949766 - protein, 27 aa, Entamoeba invadens
KSKEKRGEIQYSLLPKITAPTIPKTTK

SEQ ID NO: 2949767 - protein, 23 aa, Entamoeba invadens
KSKEPSKRVILLGDYFVGKTTLF

SEQ ID NO: 2949768 - protein, 20 aa, Entamoeba invadens
KSKFKNALKIILMAFGEIVE

SEQ ID NO: 2949769 - protein, 18 aa, Entamoeba invadens
KSKFSYFRQGMLEVAMLS

SEQ ID NO: 2949770 - protein, 19 aa, Entamoeba invadens
KSKGTAFVCFKTAEIRDKV

SEQ ID NO: 2949771 - protein, 19 aa, Entamoeba invadens
KSKHLYDDLTKVFDEKSVL

SEQ ID NO: 2949772 - protein, 18 aa, Entamoeba invadens
KSKKCLGFCAMPMSEMVN

SEQ ID NO: 2949773 - protein, 25 aa, Entamoeba invadens
KSKKCNSCGFHYFYNAAAASTVFIR

SEQ ID NO: 2949774 - protein, 18 aa, Entamoeba invadens
KSKLCLRQLTYIKNEKNT

SEQ ID NO: 2949775 - protein, 19 aa, Entamoeba invadens
KSKLVELVQKFDHSLQEIS

SEQ ID NO: 2949776 - protein, 24 aa, Entamoeba invadens
KSKMDLLVSFSFIKTIELIASCLN

SEQ ID NO: 2949777 - protein, 17 aa, Entamoeba invadens
KSKNVLEKFGIKNNIYY

SEQ ID NO: 2949778 - protein, 29 aa, Entamoeba invadens
KSKPGRYGIKVWMCADCETGMTLNLQMYC

SEQ ID NO: 2949779 - protein, 17 aa, Entamoeba invadens
KSKPQRYGIKFCFLFLL

SEQ ID NO: 2949780 - protein, 27 aa, Entamoeba invadens
KSKPQRYGIKFWMCCDCESGMVINLQM

SEQ ID NO: 2949781 - protein, 30 aa, Entamoeba invadens
KSKPQRYGIKFWMCRVCESGMVINLQMYCG

SEQ ID NO: 2949782 - protein, 29 aa, Entamoeba invadens
KSKQFKLLVKECLRELTIDMNSIEVKEIA

SEQ ID NO: 2949783 - protein, 23 aa, Entamoeba invadens
KSKRPLTPYLRFAQAKREEIKAG

SEQ ID NO: 2949784 - protein, 29 aa, Entamoeba invadens
KSKTGKRYKKCFALIISDAVIFLTNKSIC

SEQ ID NO: 2949785 - protein, 19 aa, Entamoeba invadens
KSKVAHPLLVKKVKGLIEP

SEQ ID NO: 2949786 - protein, 19 aa, Entamoeba invadens
KSKVCVIEMGGGKFDISLC

SEQ ID NO: 2949787 - protein, 20 aa, Entamoeba invadens
KSKVEGLVMDLEVEKESHNI

SEQ ID NO: 2949788 - protein, 24 aa, Entamoeba invadens
KSKVLKVNLDWSLQNVYSLIAHES

SEQ ID NO: 2949789 - protein, 18 aa, Entamoeba invadens
KSKVRMKMLYSSTKAIFR

SEQ ID NO: 2949790 - protein, 25 aa, Entamoeba invadens
KSKVTRIYLPFCFTSYSYELKNEPV

SEQ ID NO: 2949791 - protein, 25 aa, Entamoeba invadens
KSKWWGVNVLLPLLKVFGLDDEVRE

SEQ ID NO: 2949792 - protein, 19 aa, Entamoeba invadens
KSLAEKCFERALLETPPYI

SEQ ID NO: 2949793 - protein, 28 aa, Entamoeba invadens
KSLAMPDAHSGYGFSIGGVAAMRTDKGG

SEQ ID NO: 2949794 - protein, 17 aa, Entamoeba invadens
KSLCCFQLESVKVPSRV

SEQ ID NO: 2949795 - protein, 20 aa, Entamoeba invadens
KSLCFYGKRIGDYVTSREVV

SEQ ID NO: 2949796 - protein, 19 aa, Entamoeba invadens
KSLCSCKSLSIVEMSENIY

SEQ ID NO: 2949797 - protein, 17 aa, Entamoeba invadens
KSLELGVFVSRVVVSSD

SEQ ID NO: 2949798 - protein, 17 aa, Entamoeba invadens
KSLEMVDAIREFLLQCG

SEQ ID NO: 2949799 - protein, 24 aa, Entamoeba invadens
KSLESFSLLGVNSIRAFPEYDYFQ

SEQ ID NO: 2949800 - protein, 20 aa, Entamoeba invadens
KSLFFKSREIFSHLFEIVAS

SEQ ID NO: 2949801 - protein, 27 aa, Entamoeba invadens
KSLFFKSREIFSHLFEIVASLQEDNCL

SEQ ID NO: 2949802 - protein, 20 aa, Entamoeba invadens
KSLFISIALAIKLVLISKTS

SEQ ID NO: 2949803 - protein, 20 aa, Entamoeba invadens
KSLFYKRFYNVIFSKICFTQ

SEQ ID NO: 2949804 - protein, 22 aa, Entamoeba invadens
KSLGDGCFEECINLSAITIPSR

SEQ ID NO: 2949805 - protein, 22 aa, Entamoeba invadens
KSLGIYCFWECNNLVGVIIPSS

SEQ ID NO: 2949806 - protein, 20 aa, Entamoeba invadens
KSLISLKFSNYVISFGKSAF

SEQ ID NO: 2949807 - protein, 18 aa, Entamoeba invadens
KSLKCIYIPEGVFYISDD

SEQ ID NO: 2949808 - protein, 23 aa, Entamoeba invadens
KSLKIPKPEDFIFVDYEGGLLSR

SEQ ID NO: 2949809 - protein, 18 aa, Entamoeba invadens
KSLKKLNHLTGMDLKADN

SEQ ID NO: 2949810 - protein, 22 aa, Entamoeba invadens
KSLKKLQLVNCIALTLISSLQS

SEQ ID NO: 2949811 - protein, 24 aa, Entamoeba invadens
KSLKKVGERCFAFCYSLESVCCES

SEQ ID NO: 2949812 - protein, 25 aa, Entamoeba invadens
KSLKKVGERCFAFCYSLESVCCESQ

SEQ ID NO: 2949813 - protein, 25 aa, Entamoeba invadens
KSLKKVVLYFSYKFLVHLLDFDYST

SEQ ID NO: 2949814 - protein, 23 aa, Entamoeba invadens
KSLKQKWAKITIFMKNWTELLPH

SEQ ID NO: 2949815 - protein, 17 aa, Entamoeba invadens
KSLKTGYMVEKTPEGTK

SEQ ID NO: 2949816 - protein, 26 aa, Entamoeba invadens
KSLKVKLCDFGLCIKATESMDSLVGT

SEQ ID NO: 2949817 - protein, 25 aa, Entamoeba invadens
KSLLKFPFVIPVNYKMKFLHQEAKQ

SEQ ID NO: 2949818 - protein, 18 aa, Entamoeba invadens
KSLLKSERPFELFNSLGI

SEQ ID NO: 2949819 - protein, 20 aa, Entamoeba invadens
KSLMCLAFLPVEDVSGVFEN

SEQ ID NO: 2949820 - protein, 18 aa, Entamoeba invadens
KSLMTWSEKQRMSVIFDS

SEQ ID NO: 2949821 - protein, 18 aa, Entamoeba invadens
KSLNKWDKKLLFFNIREF

SEQ ID NO: 2949822 - protein, 18 aa, Entamoeba invadens
KSLNKWDKKLLFSTLESL

SEQ ID NO: 2949823 - protein, 19 aa, Entamoeba invadens
KSLPDLFARTVKVSKSDLS

SEQ ID NO: 2949824 - protein, 17 aa, Entamoeba invadens
KSLPTRLRVLIKTLGDE

SEQ ID NO: 2949825 - protein, 33 aa, Entamoeba invadens
KSLQQLTMRLNWLPLKSKIGWEEYCRQNQKTPQ

SEQ ID NO: 2949826 - protein, 19 aa, Entamoeba invadens
KSLQYTGNRAFEKCCSLTK

SEQ ID NO: 2949827 - protein, 22 aa, Entamoeba invadens
KSLRLRNVDVGKGWDVLFEAYN

SEQ ID NO: 2949828 - protein, 17 aa, Entamoeba invadens
KSLSDIKLRMMLGNNSS

SEQ ID NO: 2949829 - protein, 23 aa, Entamoeba invadens
KSLSELGKKCFFHCEKLKEINLE

SEQ ID NO: 2949830 - protein, 19 aa, Entamoeba invadens
KSLSFKAQQILSLTSTGRH

SEQ ID NO: 2949831 - protein, 23 aa, Entamoeba invadens
KSLSKILIGKSVERLDKSCFENC

SEQ ID NO: 2949832 - protein, 25 aa, Entamoeba invadens
KSLSLHFPQIVFRLFVHNFNTLLNN

SEQ ID NO: 2949833 - protein, 19 aa, Entamoeba invadens
KSLSVPIINCEDVVSKNST

SEQ ID NO: 2949834 - protein, 18 aa, Entamoeba invadens
KSLVNEFLLKDLKKKGVD

SEQ ID NO: 2949835 - protein, 25 aa, Entamoeba invadens
KSLYLHAYQSYIWNTVVSKRVEKYG

SEQ ID NO: 2949836 - protein, 19 aa, Entamoeba invadens
KSLYLVLSCVENGKYFVNQ

SEQ ID NO: 2949837 - protein, 21 aa, Entamoeba invadens
KSMFCEMKYFMMLLKGISTKR

SEQ ID NO: 2949838 - protein, 17 aa, Entamoeba invadens
KSMFPDVDPQVIEQTLR

SEQ ID NO: 2949839 - protein, 18 aa, Entamoeba invadens
KSMLFFPPIAPLPQESSK

SEQ ID NO: 2949840 - protein, 22 aa, Entamoeba invadens
KSMLTIKMEKFVSVTIGDVKYT

SEQ ID NO: 2949841 - protein, 26 aa, Entamoeba invadens
KSMTDLFFREARGCVIVFDLTDYSTF

SEQ ID NO: 2949842 - protein, 20 aa, Entamoeba invadens
KSNCFDLDFLGRVKEIGDFC

SEQ ID NO: 2949843 - protein, 21 aa, Entamoeba invadens
KSNCVQCLQKALKEANLSSDN

SEQ ID NO: 2949844 - protein, 21 aa, Entamoeba invadens
KSNFKDTVFNMGFKINSIDNK

SEQ ID NO: 2949845 - protein, 20 aa, Entamoeba invadens
KSNFKFPIVKIADYGFSRGL

SEQ ID NO: 2949846 - protein, 23 aa, Entamoeba invadens
KSNIKLSELILYIRDNNGFKPYS

SEQ ID NO: 2949847 - protein, 21 aa, Entamoeba invadens
KSNIPCYGAILLDETLEYILL

SEQ ID NO: 2949848 - protein, 20 aa, Entamoeba invadens
KSNKKRLSLRSDPGDVAQVL

SEQ ID NO: 2949849 - protein, 21 aa, Entamoeba invadens
KSNKRLVQFTVSLIDLSLPFE

SEQ ID NO: 2949850 - protein, 20 aa, Entamoeba invadens
KSNLALSCIQMCFLTNEIVT

SEQ ID NO: 2949851 - protein, 24 aa, Entamoeba invadens
KSNLKYKLYQMLFKLLREKNESLS

SEQ ID NO: 2949852 - protein, 20 aa, Entamoeba invadens
KSNLLSLCNSFFISETGIKE

SEQ ID NO: 2949853 - protein, 33 aa, Entamoeba invadens
KSNMTMFRKSRVFKLAGSNGFDYCDSTTTPTEE

SEQ ID NO: 2949854 - protein, 19 aa, Entamoeba invadens
KSNPIPVIFMKNTQQKDSF

SEQ ID NO: 2949855 - protein, 32 aa, Entamoeba invadens
KSNRFSEDLGRIFIKMQPYLKVYNMYVANNAY

SEQ ID NO: 2949856 - protein, 18 aa, Entamoeba invadens
KSNTDLIAYVLQDNNVEK

SEQ ID NO: 2949857 - protein, 19 aa, Entamoeba invadens
KSNTICLLDLIEATVEEDQ

SEQ ID NO: 2949858 - protein, 17 aa, Entamoeba invadens
KSNVHFFSLQKGTIVVN

SEQ ID NO: 2949859 - protein, 25 aa, Entamoeba invadens
KSNVIDGLLFVFGRRGKQIRQSKLV

SEQ ID NO: 2949860 - protein, 20 aa, Entamoeba invadens
KSNVSIFFEFWSHLLYICNY

SEQ ID NO: 2949861 - protein, 35 aa, Entamoeba invadens
KSNVVCDVCKHVNLRFDPYVFISLQLPNKMSTVSF

SEQ ID NO: 2949862 - protein, 18 aa, Entamoeba invadens
KSNWKVCKESIKNEANEI

SEQ ID NO: 2949863 - protein, 17 aa, Entamoeba invadens
KSPAIALKTCNNFDIPS

SEQ ID NO: 2949864 - protein, 23 aa, Entamoeba invadens
KSPDMFVPWIPNNMQLAVCDVPP

SEQ ID NO: 2949865 - protein, 19 aa, Entamoeba invadens
KSPEMEALGMIKSEFLGVF

SEQ ID NO: 2949866 - protein, 23 aa, Entamoeba invadens
KSPEVKGPSYLKGEIKDYEMTQN

SEQ ID NO: 2949867 - protein, 31 aa, Entamoeba invadens
KSPFPLTDVHFLPKWFSLDSLICAGDGLSVC

SEQ ID NO: 2949868 - protein, 20 aa, Entamoeba invadens
KSPGVPFVEVLFDFMNNVTQ

SEQ ID NO: 2949869 - protein, 22 aa, Entamoeba invadens
KSPHYRLMNTFAHSSERYGQRY

SEQ ID NO: 2949870 - protein, 25 aa, Entamoeba invadens
KSPIACLAAFVKRAWAKDVKLEPEN

SEQ ID NO: 2949871 - protein, 17 aa, Entamoeba invadens
KSPKFIKKVSVIFQTHT

SEQ ID NO: 2949872 - protein, 27 aa, Entamoeba invadens
KSPKPMAPVSFDVFMSEMVFKQKKMGL

SEQ ID NO: 2949873 - protein, 19 aa, Entamoeba invadens
KSPLFAIFGSGCTRTKFNS

SEQ ID NO: 2949874 - protein, 17 aa, Entamoeba invadens
KSPLFIIVVTDAVSDKF

SEQ ID NO: 2949875 - protein, 26 aa, Entamoeba invadens
KSPLFIKLKSMYGVMEHSLMKKTTEV

SEQ ID NO: 2949876 - protein, 27 aa, Entamoeba invadens
KSPLPKIVSPLPLFEMETEPQQQKLRN

SEQ ID NO: 2949877 - protein, 23 aa, Entamoeba invadens
KSPLTYFLPLIFDIPQNYPTNLP

SEQ ID NO: 2949878 - protein, 23 aa, Entamoeba invadens
KSPTTCPVERSFNKFGQLERANM

SEQ ID NO: 2949879 - protein, 22 aa, Entamoeba invadens
KSPTTCPVERSFNKIGQYDRAN

SEQ ID NO: 2949880 - protein, 20 aa, Entamoeba invadens
KSQASGFCYINDIVCGIMEL

SEQ ID NO: 2949881 - protein, 17 aa, Entamoeba invadens
KSQDCLEKKGTYKQDKK

SEQ ID NO: 2949882 - protein, 25 aa, Entamoeba invadens
KSQDPICILVFLPGMAEIEEMRAQI

SEQ ID NO: 2949883 - protein, 21 aa, Entamoeba invadens
KSQEEIFSFLLQSNRKGFKDP

SEQ ID NO: 2949884 - protein, 26 aa, Entamoeba invadens
KSQGKKVLKLQCGMGHHNTVGFSKIK

SEQ ID NO: 2949885 - protein, 18 aa, Entamoeba invadens
KSQGYGFVTFIRKEDAET

SEQ ID NO: 2949886 - protein, 26 aa, Entamoeba invadens
KSQIKALEALNKMVWDDKTDDEKTAA

SEQ ID NO: 2949887 - protein, 20 aa, Entamoeba invadens
KSQIKRSEQARREKFFEENK

SEQ ID NO: 2949888 - protein, 18 aa, Entamoeba invadens
KSQLRFSQDPSIDSSQND

SEQ ID NO: 2949889 - protein, 19 aa, Entamoeba invadens
KSQNRCYEEVFYLQCDSRW

SEQ ID NO: 2949890 - protein, 25 aa, Entamoeba invadens
KSQNRLRELFYWAYKQEFLPNTRNQ

SEQ ID NO: 2949891 - protein, 23 aa, Entamoeba invadens
KSQPNAWEVLKIISKISKNLNMI

SEQ ID NO: 2949892 - protein, 21 aa, Entamoeba invadens
KSQRNLKRFNSFMNLNISPRV

SEQ ID NO: 2949893 - protein, 24 aa, Entamoeba invadens
KSQTTDFVFHFGRKSNVKKPEPKN

SEQ ID NO: 2949894 - protein, 18 aa, Entamoeba invadens
KSRANVVVMAATNRPNSI

SEQ ID NO: 2949895 - protein, 23 aa, Entamoeba invadens
KSREVLGYCGMPKTEIHDDNYNL

SEQ ID NO: 2949896 - protein, 20 aa, Entamoeba invadens
KSRFVRFQIIANFGKICQFL

SEQ ID NO: 2949897 - protein, 19 aa, Entamoeba invadens
KSRGVIHRMINNMKGGDRE

SEQ ID NO: 2949898 - protein, 30 aa, Entamoeba invadens
KSRHRCEFVNCVLRYKHREYFFVKCNAEFA

SEQ ID NO: 2949899 - protein, 21 aa, Entamoeba invadens
KSRKTWKKNLLDALNRSDRVE

SEQ ID NO: 2949900 - protein, 18 aa, Entamoeba invadens
KSRLNKRVNKMVAVAKEC

SEQ ID NO: 2949901 - protein, 20 aa, Entamoeba invadens
KSRLTCLMCDYKYKIVDGTC

SEQ ID NO: 2949902 - protein, 19 aa, Entamoeba invadens
KSRLVTILYNMVYTRIPNV

SEQ ID NO: 2949903 - protein, 20 aa, Entamoeba invadens
KSRNIVCLVYQLLQYYEGLI

SEQ ID NO: 2949904 - protein, 24 aa, Entamoeba invadens
KSRPHPLKRRREEIGESSGTTDTS

SEQ ID NO: 2949905 - protein, 23 aa, Entamoeba invadens
KSRPHPLKRRREESGESSGTTDT

SEQ ID NO: 2949906 - protein, 18 aa, Entamoeba invadens
KSRPWRKRYEGIDREELN

SEQ ID NO: 2949907 - protein, 18 aa, Entamoeba invadens
KSRYFKTLVERLTPVFKT

SEQ ID NO: 2949908 - protein, 19 aa, Entamoeba invadens
KSSDYNQHCQIEHRIKATY

SEQ ID NO: 2949909 - protein, 25 aa, Entamoeba invadens
KSSFFYWKKLYMVYKDTTLYFFDTP

SEQ ID NO: 2949910 - protein, 25 aa, Entamoeba invadens
KSSFIEALVGFQFNVVESTIGTRRP

SEQ ID NO: 2949911 - protein, 18 aa, Entamoeba invadens
KSSGGLFGRDLRKIDPKF

SEQ ID NO: 2949912 - protein, 17 aa, Entamoeba invadens
KSSIHAMNILGAMVKSQ

SEQ ID NO: 2949913 - protein, 17 aa, Entamoeba invadens
KSSIHLREKEIDVNMTY

SEQ ID NO: 2949914 - protein, 29 aa, Entamoeba invadens
KSSIKKFKICAVMPCRMATVISALLDPEN

SEQ ID NO: 2949915 - protein, 18 aa, Entamoeba invadens
KSSIKLKALIRVVKNCKT

SEQ ID NO: 2949916 - protein, 20 aa, Entamoeba invadens
KSSILFHRLLLVNKFGDDVI

SEQ ID NO: 2949917 - protein, 21 aa, Entamoeba invadens
KSSKVVLDFFAFWSNPINTVE

SEQ ID NO: 2949918 - protein, 19 aa, Entamoeba invadens
KSSLETMYLDSLSMSVESI

SEQ ID NO: 2949919 - protein, 25 aa, Entamoeba invadens
KSSNYRLKMKAQRKRMVRIRCEIDI

SEQ ID NO: 2949920 - protein, 27 aa, Entamoeba invadens
KSSQCKVIVFFSCIPSVNYHYALFSEL

SEQ ID NO: 2949921 - protein, 26 aa, Entamoeba invadens
KSSSFSCDFWSLGIILFSMAFGDSPF

SEQ ID NO: 2949922 - protein, 17 aa, Entamoeba invadens
KSSTIVCTSLISHHNED

SEQ ID NO: 2949923 - protein, 23 aa, Entamoeba invadens
KSSTLPGKVWVHKKLLGSEGDKT

SEQ ID NO: 2949924 - protein, 27 aa, Entamoeba invadens
KSSTMYRVKWPGTIDVFVSDEVYNFFT

SEQ ID NO: 2949925 - protein, 20 aa, Entamoeba invadens
KSSVNGLMFLAQIEVLQHPD

SEQ ID NO: 2949926 - protein, 17 aa, Entamoeba invadens
KSSVVPKQMHRVSVRKL

SEQ ID NO: 2949927 - protein, 18 aa, Entamoeba invadens
KSTDCIVNVFSRTKFVKR

SEQ ID NO: 2949928 - protein, 25 aa, Entamoeba invadens
KSTETRSLKVLKQIIEPFLDQNGVS

SEQ ID NO: 2949929 - protein, 25 aa, Entamoeba invadens
KSTFLGHLFAGLQIIDQRTIDQYKR

SEQ ID NO: 2949930 - protein, 24 aa, Entamoeba invadens
KSTFQLGLVLFHFPVVTIQHDEIL

SEQ ID NO: 2949931 - protein, 17 aa, Entamoeba invadens
KSTIGVIEFDLTLLKYY

SEQ ID NO: 2949932 - protein, 18 aa, Entamoeba invadens
KSTIKYPFHKLIQKYLAM

SEQ ID NO: 2949933 - protein, 23 aa, Entamoeba invadens
KSTIVCRLELNVGWEMVSVDVNR

SEQ ID NO: 2949934 - protein, 25 aa, Entamoeba invadens
KSTKEKWKVKAFLLSDWKMKEFKDN

SEQ ID NO: 2949935 - protein, 18 aa, Entamoeba invadens
KSTLKSRFEKFYDSVPPT

SEQ ID NO: 2949936 - protein, 18 aa, Entamoeba invadens
KSTLPMMFSYSTTKTNAI

SEQ ID NO: 2949937 - protein, 18 aa, Entamoeba invadens
KSTMRRKITVFSRNEGNL

SEQ ID NO: 2949938 - protein, 21 aa, Entamoeba invadens
KSTMRYYEWVLSILSEIIRRL

SEQ ID NO: 2949939 - protein, 18 aa, Entamoeba invadens
KSTPLSERKSGTEQKEES

SEQ ID NO: 2949940 - protein, 17 aa, Entamoeba invadens
KSTQIAFTLTQKYNETM

SEQ ID NO: 2949941 - protein, 19 aa, Entamoeba invadens
KSTVYKYIERMATEKTDEM

SEQ ID NO: 2949942 - protein, 25 aa, Entamoeba invadens
KSTYKKFKVCVPYIGTILDNIATVK

SEQ ID NO: 2949943 - protein, 25 aa, Entamoeba invadens
KSVELFELWEGLWFMLQETCVEPGV

SEQ ID NO: 2949944 - protein, 31 aa, Entamoeba invadens
KSVELPTGISKLRIDSCPIFTLSSLANLKGL

SEQ ID NO: 2949945 - protein, 22 aa, Entamoeba invadens
KSVFPKITRLVLFSLGDENEIA

SEQ ID NO: 2949946 - protein, 19 aa, Entamoeba invadens
KSVGCAVHKFLSNAFKNLQ

SEQ ID NO: 2949947 - protein, 26 aa, Entamoeba invadens
KSVGKKLKFSSCNKLSKLTLSAIPEY

SEQ ID NO: 2949948 - protein, 20 aa, Entamoeba invadens
KSVGSAMFMNCKRLEEVTLY

SEQ ID NO: 2949949 - protein, 27 aa, Entamoeba invadens
KSVKKVGDFCFYKSLGVKNIKFEDKRS

SEQ ID NO: 2949950 - protein, 21 aa, Entamoeba invadens
KSVKTLICNQSDKLITLHFEE

SEQ ID NO: 2949951 - protein, 22 aa, Entamoeba invadens
KSVKTVGPRAFYNCVSLETINC

SEQ ID NO: 2949952 - protein, 17 aa, Entamoeba invadens
KSVKVMQRKVCDYVMNG

SEQ ID NO: 2949953 - protein, 27 aa, Entamoeba invadens
KSVLKKTFFQIIVWFDVDFETVDKNKS

SEQ ID NO: 2949954 - protein, 18 aa, Entamoeba invadens
KSVLLCDNYCEWIDQKTE

SEQ ID NO: 2949955 - protein, 19 aa, Entamoeba invadens
KSVMGHLFPTVSIIDKTFQ

SEQ ID NO: 2949956 - protein, 18 aa, Entamoeba invadens
KSVPNDFCRVVGAPLPLP

SEQ ID NO: 2949957 - protein, 23 aa, Entamoeba invadens
KSVQMKPVFANIVFSDYENSLDT

SEQ ID NO: 2949958 - protein, 19 aa, Entamoeba invadens
KSVQWKVDYKLLDVQQGDS

SEQ ID NO: 2949959 - protein, 20 aa, Entamoeba invadens
KSVSSIGQFAFCSCENLETI

SEQ ID NO: 2949960 - protein, 25 aa, Entamoeba invadens
KSVSVFGESCFEKCVSLQRIVIPPK

SEQ ID NO: 2949961 - protein, 17 aa, Entamoeba invadens
KSVSVIILLLSVGDCRV

SEQ ID NO: 2949962 - protein, 22 aa, Entamoeba invadens
KSVTFSFLFDFVEHMEMFQKGE

SEQ ID NO: 2949963 - protein, 31 aa, Entamoeba invadens
KSVTMPSHLKRIGYYCFEYCYSLQSIEVPDC

SEQ ID NO: 2949964 - protein, 25 aa, Entamoeba invadens
KSVYLLGELLHLAGVLFPTKNVSLQ

SEQ ID NO: 2949965 - protein, 22 aa, Entamoeba invadens
KSVYWKPQLSSVFKTITLANCW

SEQ ID NO: 2949966 - protein, 17 aa, Entamoeba invadens
KSYEIPEYLVVKDEVEI

SEQ ID NO: 2949967 - protein, 22 aa, Entamoeba invadens
KSYLGGCCFNCCESLVEVGLPD

SEQ ID NO: 2949968 - protein, 23 aa, Entamoeba invadens
KSYLNERIVSFSIPTFIFTLPEF

SEQ ID NO: 2949969 - protein, 19 aa, Entamoeba invadens
KSYPLALNYLKKALNLAKG

SEQ ID NO: 2949970 - protein, 26 aa, Entamoeba invadens
KSYTANELIGFIPLHNVTLCVLATSF

SEQ ID NO: 2949971 - protein, 22 aa, Entamoeba invadens
KSYVLRKVLNGIYFEFVNLLIE

SEQ ID NO: 2949972 - protein, 18 aa, Entamoeba invadens
KTAACLAITDIAKEDTAS

SEQ ID NO: 2949973 - protein, 18 aa, Entamoeba invadens
KTAACLAITDIAKEDTAT

SEQ ID NO: 2949974 - protein, 20 aa, Entamoeba invadens
KTAAFALPIIHHLSEDPYTG

SEQ ID NO: 2949975 - protein, 18 aa, Entamoeba invadens
KTAAFLFPIISDILQNPP

SEQ ID NO: 2949976 - protein, 18 aa, Entamoeba invadens
KTACSPRLLQLVEKTIGL

SEQ ID NO: 2949977 - protein, 19 aa, Entamoeba invadens
KTACSPRLLQLVEKTIGLG

SEQ ID NO: 2949978 - protein, 25 aa, Entamoeba invadens
KTADVSMKFWFEKTSEEYSYQSGVF

SEQ ID NO: 2949979 - protein, 32 aa, Entamoeba invadens
KTAEKIFKERFYRIALHSGFYQKLSLLEDQNK

SEQ ID NO: 2949980 - protein, 25 aa, Entamoeba invadens
KTAEVKRIYCFVFNEFLVFTKCLKL

SEQ ID NO: 2949981 - protein, 20 aa, Entamoeba invadens
KTAGVGLIICGGNVSDLALH

SEQ ID NO: 2949982 - protein, 20 aa, Entamoeba invadens
KTAIRAIVGFENIEVNFVGN

SEQ ID NO: 2949983 - protein, 19 aa, Entamoeba invadens
KTAIVRRFSNNFFENIYEP

SEQ ID NO: 2949984 - protein, 18 aa, Entamoeba invadens
KTAKRYGCDVTMSEMVMA

SEQ ID NO: 2949985 - protein, 17 aa, Entamoeba invadens
KTAKWGVTQLVSQKALD

SEQ ID NO: 2949986 - protein, 17 aa, Entamoeba invadens
KTALCAAFANYARVNPT

SEQ ID NO: 2949987 - protein, 19 aa, Entamoeba invadens
KTALITTFCCEKFTNNYKA

SEQ ID NO: 2949988 - protein, 27 aa, Entamoeba invadens
KTALLKTFRRAFFGYDCFFTELEQNSI

SEQ ID NO: 2949989 - protein, 21 aa, Entamoeba invadens
KTALRYESFVLKGIDETGIYD

SEQ ID NO: 2949990 - protein, 21 aa, Entamoeba invadens
KTALYCLLALSSAEEVETAEK

SEQ ID NO: 2949991 - protein, 28 aa, Entamoeba invadens
KTAMVIKSRVIVALKYFCDDALDECNQS

SEQ ID NO: 2949992 - protein, 18 aa, Entamoeba invadens
KTANGFMNDLRLVWTNGM

SEQ ID NO: 2949993 - protein, 17 aa, Entamoeba invadens
KTARASVYTAGYQTETS

SEQ ID NO: 2949994 - protein, 27 aa, Entamoeba invadens
KTATAGLKRSASFSGYVQAIKPTLQVS

SEQ ID NO: 2949995 - protein, 26 aa, Entamoeba invadens
KTATGFRLDPNFLVELDKSFPTFKRV

SEQ ID NO: 2949996 - protein, 23 aa, Entamoeba invadens
KTAYEYRCTLGMGVTGYAAAVFK

SEQ ID NO: 2949997 - protein, 24 aa, Entamoeba invadens
KTAYKELLLKIIIQTPVLVQKQIT

SEQ ID NO: 2949998 - protein, 21 aa, Entamoeba invadens
KTCDLEKYFKNMFALQKVFEN

SEQ ID NO: 2949999 - protein, 25 aa, Entamoeba invadens
KTCEALAAFEMVKVLLMDRESTSKC

SEQ ID NO: 2950000 - protein, 20 aa, Entamoeba invadens
KTCFASCASQAWSVATIIDA

SEQ ID NO: 2950001 - protein, 23 aa, Entamoeba invadens
KTCFTLEMVYDFFDISFEDLPAI

SEQ ID NO: 2950002 - protein, 17 aa, Entamoeba invadens
KTCIPRMTCYDCKHLKE

SEQ ID NO: 2950003 - protein, 17 aa, Entamoeba invadens
KTCKLCIDGNYYDKTTK

SEQ ID NO: 2950004 - protein, 20 aa, Entamoeba invadens
KTCSCKSSALAQDTSSIKSG

SEQ ID NO: 2950005 - protein, 31 aa, Entamoeba invadens
KTDAAGWLGWIMKILELMDADLIKCIGACFD

SEQ ID NO: 2950006 - protein, 30 aa, Entamoeba invadens
KTDAAGWLGWIMKMLELMDVDLIKCIGACF

SEQ ID NO: 2950007 - protein, 31 aa, Entamoeba invadens
KTDAAGWLSWIMKILELMDADFIKCIGACFD

SEQ ID NO: 2950008 - protein, 17 aa, Entamoeba invadens
KTDESIFDFEITPNNGN

SEQ ID NO: 2950009 - protein, 19 aa, Entamoeba invadens
KTDEYYRYKMPDLVEKIEG

SEQ ID NO: 2950010 - protein, 24 aa, Entamoeba invadens
KTDFFKIVVFYTVPYTPFKEDCAQ

SEQ ID NO: 2950011 - protein, 25 aa, Entamoeba invadens
KTDGKWSDYNWISSVVGLELVDALG

SEQ ID NO: 2950012 - protein, 18 aa, Entamoeba invadens
KTDLLPHIGVDNFESKAY

SEQ ID NO: 2950013 - protein, 23 aa, Entamoeba invadens
KTDLPSLMLLAVKFVPQFYQLVD

SEQ ID NO: 2950014 - protein, 17 aa, Entamoeba invadens
KTDNSLFKEKNEVLEKQ

SEQ ID NO: 2950015 - protein, 20 aa, Entamoeba invadens
KTDRCYNFIPAKAKSFQCLN

SEQ ID NO: 2950016 - protein, 23 aa, Entamoeba invadens
KTDTLTFSVVWEVDANGEIINCE

SEQ ID NO: 2950017 - protein, 29 aa, Entamoeba invadens
KTDVKYRMRYSWIIFSLLIKGIIGYYNDY

SEQ ID NO: 2950018 - protein, 40 aa, Entamoeba invadens
KTDWQSKFLIPRTFLGKILRLLKILNKFPLFKNDDQLRVA

SEQ ID NO: 2950019 - protein, 18 aa, Entamoeba invadens
KTEAFAVQSIRERQASWI

SEQ ID NO: 2950020 - protein, 19 aa, Entamoeba invadens
KTEAFLFVKSLTYLLTLFS

SEQ ID NO: 2950021 - protein, 24 aa, Entamoeba invadens
KTEAGCEIMRLGGIVAILRYELVI

SEQ ID NO: 2950022 - protein, 24 aa, Entamoeba invadens
KTEALLPMKGILNVMVYMDTMNRV

SEQ ID NO: 2950023 - protein, 25 aa, Entamoeba invadens
KTECLKTPFPGLINYFLYTAKNMHF

SEQ ID NO: 2950024 - protein, 18 aa, Entamoeba invadens
KTEEEWVIDKVILIDCGD

SEQ ID NO: 2950025 - protein, 20 aa, Entamoeba invadens
KTEEGYRICVVTKPNNKPFP

SEQ ID NO: 2950026 - protein, 17 aa, Entamoeba invadens
KTEFLMMLLENYRALTN

SEQ ID NO: 2950027 - protein, 20 aa, Entamoeba invadens
KTEGAIVCGAHVFFKTTKRC

SEQ ID NO: 2950028 - protein, 19 aa, Entamoeba invadens
KTEGIFRLSAKQEEVDCYK

SEQ ID NO: 2950029 - protein, 20 aa, Entamoeba invadens
KTEHKAGVYNISWSEDSKTF

SEQ ID NO: 2950030 - protein, 26 aa, Entamoeba invadens
KTEHSISRFTLYDAVPTFKPKLDNTE

SEQ ID NO: 2950031 - protein, 18 aa, Entamoeba invadens
KTEIDFGGFSFDNAEAPK

SEQ ID NO: 2950032 - protein, 25 aa, Entamoeba invadens
KTEILMQMKTCFAPLLQSFDLSDEI

SEQ ID NO: 2950033 - protein, 18 aa, Entamoeba invadens
KTEIRWTVVNFLIVADDL

SEQ ID NO: 2950034 - protein, 23 aa, Entamoeba invadens
KTEKEVNEVSAFFYVQPILKNSS

SEQ ID NO: 2950035 - protein, 23 aa, Entamoeba invadens
KTEKKDYYLGLNIEKDKASIILS

SEQ ID NO: 2950036 - protein, 17 aa, Entamoeba invadens
KTEKLLGQRDVYVEKRY

SEQ ID NO: 2950037 - protein, 29 aa, Entamoeba invadens
KTELEEFVRSGVEWAVLCEKYPRGLINVC

SEQ ID NO: 2950038 - protein, 21 aa, Entamoeba invadens
KTELFGFGGFAGGLDTKNRSM

SEQ ID NO: 2950039 - protein, 22 aa, Entamoeba invadens
KTENKLGISIVNSIANFIITNK

SEQ ID NO: 2950040 - protein, 18 aa, Entamoeba invadens
KTENPWKSYEEVIPNDIS

SEQ ID NO: 2950041 - protein, 18 aa, Entamoeba invadens
KTEPYFACIYAMTEEGIV

SEQ ID NO: 2950042 - protein, 29 aa, Entamoeba invadens
KTERFKPIVLKDVMCRGSVGESVKEPSRE

SEQ ID NO: 2950043 - protein, 26 aa, Entamoeba invadens
KTESLCAGIPHFLTGYMRNWGRDTFI

SEQ ID NO: 2950044 - protein, 23 aa, Entamoeba invadens
KTEVIRNVRDGVILTVAKESLNK

SEQ ID NO: 2950045 - protein, 23 aa, Entamoeba invadens
KTEVKCLKMLVENGIVNAIMDLL

SEQ ID NO: 2950046 - protein, 22 aa, Entamoeba invadens
KTEYGNGQFLMKFITDGSIESN

SEQ ID NO: 2950047 - protein, 18 aa, Entamoeba invadens
KTFALFKEPCEVLYSSIF

SEQ ID NO: 2950048 - protein, 17 aa, Entamoeba invadens
KTFCGLSVYGGTLVVGE

SEQ ID NO: 2950049 - protein, 36 aa, Entamoeba invadens
KTFCTDTRIALGIVKRSDFGFDETINFIKEYPGSPN

SEQ ID NO: 2950050 - protein, 20 aa, Entamoeba invadens
KTFCTVFAQYVKLRAKGKNI

SEQ ID NO: 2950051 - protein, 21 aa, Entamoeba invadens
KTFEAPTTFFLPHNVTDIYST

SEQ ID NO: 2950052 - protein, 20 aa, Entamoeba invadens
KTFFATLPFLDKGKLCGDGE

SEQ ID NO: 2950053 - protein, 22 aa, Entamoeba invadens
KTFFKDHNFFGLCENQIHFFPQ

SEQ ID NO: 2950054 - protein, 21 aa, Entamoeba invadens
KTFGKKFDRDAYGFKGNPFVF

SEQ ID NO: 2950055 - protein, 24 aa, Entamoeba invadens
KTFGSYCFYKCISLSSVTIPSSVT

SEQ ID NO: 2950056 - protein, 24 aa, Entamoeba invadens
KTFIKKNMVVVFTFGGPAGLVNET

SEQ ID NO: 2950057 - protein, 23 aa, Entamoeba invadens
KTFKLCCSRVDVFNLCVDNIRTL

SEQ ID NO: 2950058 - protein, 28 aa, Entamoeba invadens
KTFKRECAFKEWLLQKVFNGERAALLTD

SEQ ID NO: 2950059 - protein, 24 aa, Entamoeba invadens
KTFLEEVSPFYTLYTLLKEKVSEW

SEQ ID NO: 2950060 - protein, 26 aa, Entamoeba invadens
KTFLICPENLLTLRVLKCSREVRYNK

SEQ ID NO: 2950061 - protein, 27 aa, Entamoeba invadens
KTFLPEQISALVLKYLYSIVQDNLVTK

SEQ ID NO: 2950062 - protein, 25 aa, Entamoeba invadens
KTFNLKAACYMKSILDANNIIYEQG

SEQ ID NO: 2950063 - protein, 27 aa, Entamoeba invadens
KTFPCVKLNPTKALTIFHKQFYDERFK

SEQ ID NO: 2950064 - protein, 18 aa, Entamoeba invadens
KTFPEVVVSMMLSGFNEL

SEQ ID NO: 2950065 - protein, 18 aa, Entamoeba invadens
KTFPMCTIAAQPRLPEHC

SEQ ID NO: 2950066 - protein, 21 aa, Entamoeba invadens
KTFRDFLCFVEDDMSSILSQS

SEQ ID NO: 2950067 - protein, 17 aa, Entamoeba invadens
KTFRLASNPLFPVTSLD

SEQ ID NO: 2950068 - protein, 22 aa, Entamoeba invadens
KTFRTTCLFELYDRELGDLKKR

SEQ ID NO: 2950069 - protein, 23 aa, Entamoeba invadens
KTFRTTCLFELYDRELGDLKKRI

SEQ ID NO: 2950070 - protein, 17 aa, Entamoeba invadens
KTFSCVRTTIDHDYEHC

SEQ ID NO: 2950071 - protein, 18 aa, Entamoeba invadens
KTFSLGGCVVCSEGYYQT

SEQ ID NO: 2950072 - protein, 17 aa, Entamoeba invadens
KTFTFKFLMNGINFILN

SEQ ID NO: 2950073 - protein, 24 aa, Entamoeba invadens
KTGCPFRINLNFRTKTNTWNITKM

SEQ ID NO: 2950074 - protein, 22 aa, Entamoeba invadens
KTGDLHVTFLVYRHLQIFNTLT

SEQ ID NO: 2950075 - protein, 23 aa, Entamoeba invadens
KTGERPDPCFLRKVRRSGNRYDH

SEQ ID NO: 2950076 - protein, 22 aa, Entamoeba invadens
KTGETYCKVIVHLNNIGDGSLD

SEQ ID NO: 2950077 - protein, 25 aa, Entamoeba invadens
KTGFQYGVLLAENWDIVVTKQHNFP

SEQ ID NO: 2950078 - protein, 18 aa, Entamoeba invadens
KTGHYSHLIAGYLMTNGV

SEQ ID NO: 2950079 - protein, 19 aa, Entamoeba invadens
KTGISAGVGSVFEKKYLTI

SEQ ID NO: 2950080 - protein, 26 aa, Entamoeba invadens
KTGKEVYCGCCVIKSEGKQEVYPFSI

SEQ ID NO: 2950081 - protein, 24 aa, Entamoeba invadens
KTGKTALACQFCDQPAPTEYNATT

SEQ ID NO: 2950082 - protein, 28 aa, Entamoeba invadens
KTGLKIEFFRIIVWFNVDFETVNRNKNR

SEQ ID NO: 2950083 - protein, 24 aa, Entamoeba invadens
KTGNDGRCALCFGYHNKKPIYICS

SEQ ID NO: 2950084 - protein, 24 aa, Entamoeba invadens
KTGNWKFNVGRHFIFKLPTKKSKD

SEQ ID NO: 2950085 - protein, 25 aa, Entamoeba invadens
KTGQIPLEVCIRSPDAELATSLHAS

SEQ ID NO: 2950086 - protein, 19 aa, Entamoeba invadens
KTGRGDVYIDVKWKDVMRN

SEQ ID NO: 2950087 - protein, 25 aa, Entamoeba invadens
KTGSWCKSHYINLRSLLRCEEVRNQ

SEQ ID NO: 2950088 - protein, 21 aa, Entamoeba invadens
KTGSYYSIFNLRTENLKGTFV

SEQ ID NO: 2950089 - protein, 25 aa, Entamoeba invadens
KTGTFCGTAAYLAPEILLGEKYDSA

SEQ ID NO: 2950090 - protein, 25 aa, Entamoeba invadens
KTGTHARYGFIEFIDHTTAEFAKEN

SEQ ID NO: 2950091 - protein, 21 aa, Entamoeba invadens
KTGVLSVDVIRIFMTNFEHRL

SEQ ID NO: 2950092 - protein, 21 aa, Entamoeba invadens
KTHAIELSRKLFLSDKDFEIT

SEQ ID NO: 2950093 - protein, 23 aa, Entamoeba invadens
KTHANWKGARWVPTEKTTLITIS

SEQ ID NO: 2950094 - protein, 19 aa, Entamoeba invadens
KTHEIPVAVEFVVSRAMRN

SEQ ID NO: 2950095 - protein, 29 aa, Entamoeba invadens
KTHFPKTIYLRFKWFFLVSDILSPTDTVT

SEQ ID NO: 2950096 - protein, 18 aa, Entamoeba invadens
KTHFTLVDGHKWYMGCGF

SEQ ID NO: 2950097 - protein, 32 aa, Entamoeba invadens
KTHGEGEGCWWGCVIKGAHVIDIKRMESTKYL

SEQ ID NO: 2950098 - protein, 25 aa, Entamoeba invadens
KTHKKVCIDRAIQVISNSSWRYNTI

SEQ ID NO: 2950099 - protein, 24 aa, Entamoeba invadens
KTHKKVCNDRAIQVISNSSWRYNT

SEQ ID NO: 2950100 - protein, 18 aa, Entamoeba invadens
KTHRGITEICQFAFLNCV

SEQ ID NO: 2950101 - protein, 17 aa, Entamoeba invadens
KTICELNNTFCCCESLK

SEQ ID NO: 2950102 - protein, 19 aa, Entamoeba invadens
KTICFIGSLTRLVHVLDFY

SEQ ID NO: 2950103 - protein, 19 aa, Entamoeba invadens
KTICGEWWLKVLDDGNVVF

SEQ ID NO: 2950104 - protein, 17 aa, Entamoeba invadens
KTIDDIRSFVFVNKKCE

SEQ ID NO: 2950105 - protein, 28 aa, Entamoeba invadens
KTIEKFAFKNCYSLENITFPKTLVKMED

SEQ ID NO: 2950106 - protein, 27 aa, Entamoeba invadens
KTIEKFAFKNCYSLESLTFPKILEKVE

SEQ ID NO: 2950107 - protein, 19 aa, Entamoeba invadens
KTIELCSGINGATVVPILK

SEQ ID NO: 2950108 - protein, 24 aa, Entamoeba invadens
KTIELPTSLSVIIGAAFSECGLIE

SEQ ID NO: 2950109 - protein, 18 aa, Entamoeba invadens
KTIFELNETIKLLEKNNL

SEQ ID NO: 2950110 - protein, 24 aa, Entamoeba invadens
KTIFKGKLSLFARLTSTGIKQPSK

SEQ ID NO: 2950111 - protein, 18 aa, Entamoeba invadens
KTIFKVQIVIDFDAIITR

SEQ ID NO: 2950112 - protein, 19 aa, Entamoeba invadens
KTIGFFLNIETLHLWHKND

SEQ ID NO: 2950113 - protein, 22 aa, Entamoeba invadens
KTIGKNCFRHCVGFSEIAFPCT

SEQ ID NO: 2950114 - protein, 21 aa, Entamoeba invadens
KTIGKSCFEYCSSISDIKIPC

SEQ ID NO: 2950115 - protein, 19 aa, Entamoeba invadens
KTIHLILALCLNIGTESPD

SEQ ID NO: 2950116 - protein, 20 aa, Entamoeba invadens
KTIIKKIGLFNAMYVTSNPL

SEQ ID NO: 2950117 - protein, 26 aa, Entamoeba invadens
KTIIKRGTEFFSFLISRDDNISPKIS

SEQ ID NO: 2950118 - protein, 22 aa, Entamoeba invadens
KTIKKVVEFCLTKKQPNDTKSS

SEQ ID NO: 2950119 - protein, 25 aa, Entamoeba invadens
KTIKRLCSFEILPSFIQEIIISKIS

SEQ ID NO: 2950120 - protein, 17 aa, Entamoeba invadens
KTIKRMAEEEIKKKTGH

SEQ ID NO: 2950121 - protein, 19 aa, Entamoeba invadens
KTIKVDYCERMLSDIEAKY

SEQ ID NO: 2950122 - protein, 20 aa, Entamoeba invadens
KTILKQCGENVTFIPPFYCD

SEQ ID NO: 2950123 - protein, 24 aa, Entamoeba invadens
KTILSEVHFIRGFQIYDYEVRDIV

SEQ ID NO: 2950124 - protein, 25 aa, Entamoeba invadens
KTIMKYCAKHSVFAGKKHVIIGNFF

SEQ ID NO: 2950125 - protein, 17 aa, Entamoeba invadens
KTIPKIQFLKRGVFWCC

SEQ ID NO: 2950126 - protein, 24 aa, Entamoeba invadens
KTIPLCVISTIGAALDFNEEISAR

SEQ ID NO: 2950127 - protein, 27 aa, Entamoeba invadens
KTIQLERITSIFLNNTWIMDKEQIFDV

SEQ ID NO: 2950128 - protein, 25 aa, Entamoeba invadens
KTIQRICHFCATTSRIRAMAFDHKG

SEQ ID NO: 2950129 - protein, 19 aa, Entamoeba invadens
KTIQRISRHNCTKRKTTLL

SEQ ID NO: 2950130 - protein, 20 aa, Entamoeba invadens
KTIRLARESGIWVEVTTLII

SEQ ID NO: 2950131 - protein, 19 aa, Entamoeba invadens
KTISALRTELADERNKQEE

SEQ ID NO: 2950132 - protein, 24 aa, Entamoeba invadens
KTISEIKSLLPIVFNKSTQIGNSI

SEQ ID NO: 2950133 - protein, 17 aa, Entamoeba invadens
KTISIVELFFKTKFNDI

SEQ ID NO: 2950134 - protein, 20 aa, Entamoeba invadens
KTITTKLEFSYAVRPEQVFD

SEQ ID NO: 2950135 - protein, 17 aa, Entamoeba invadens
KTIWEVIQANSFCLTNG

SEQ ID NO: 2950136 - protein, 19 aa, Entamoeba invadens
KTIYDDTSFVFVLQKQFVK

SEQ ID NO: 2950137 - protein, 24 aa, Entamoeba invadens
KTKAFSEFEFEYSLMSTNDDERNP

SEQ ID NO: 2950138 - protein, 19 aa, Entamoeba invadens
KTKDFNFIGCGCLSSLNIP

SEQ ID NO: 2950139 - protein, 18 aa, Entamoeba invadens
KTKEAYGFGDLSSKTNFS

SEQ ID NO: 2950140 - protein, 29 aa, Entamoeba invadens
KTKEMCSFPEHLCVVPIQKQLHWSALNNP

SEQ ID NO: 2950141 - protein, 24 aa, Entamoeba invadens
KTKGMVEGVFRLCAKASDVEQILN

SEQ ID NO: 2950142 - protein, 20 aa, Entamoeba invadens
KTKHAMRWGVPVLTHQWLFD

SEQ ID NO: 2950143 - protein, 19 aa, Entamoeba invadens
KTKIKAVKYLECSAKTGEN

SEQ ID NO: 2950144 - protein, 27 aa, Entamoeba invadens
KTKIKCAWINTSCRVITKKAFNVNITP

SEQ ID NO: 2950145 - protein, 22 aa, Entamoeba invadens
KTKKDLKMCLVRKYNKEERFST

SEQ ID NO: 2950146 - protein, 26 aa, Entamoeba invadens
KTKKTIAWYPIFFFKTMKSPNITFKN

SEQ ID NO: 2950147 - protein, 27 aa, Entamoeba invadens
KTKMLCWTGKELWAFKEQNAGKTAVGI

SEQ ID NO: 2950148 - protein, 24 aa, Entamoeba invadens
KTKSGRTGLHYAVLGGHLDVVKLL

SEQ ID NO: 2950149 - protein, 19 aa, Entamoeba invadens
KTKSMVIGFFKYIKNTESD

SEQ ID NO: 2950150 - protein, 20 aa, Entamoeba invadens
KTKSPVCHIMSLWCLTQCVC

SEQ ID NO: 2950151 - protein, 20 aa, Entamoeba invadens
KTKTFYSQFEILRQRSVEQK

SEQ ID NO: 2950152 - protein, 20 aa, Entamoeba invadens
KTKTLFPCMETQYLYTLEDQ

SEQ ID NO: 2950153 - protein, 20 aa, Entamoeba invadens
KTKWFPPKVRTLRIQSQQIE

SEQ ID NO: 2950154 - protein, 19 aa, Entamoeba invadens
KTKWVPEVVDNCGVEKPNI

SEQ ID NO: 2950155 - protein, 25 aa, Entamoeba invadens
KTKYKFKGEIVLYYIDSWDIKKGIY

SEQ ID NO: 2950156 - protein, 17 aa, Entamoeba invadens
KTLAERSLMLFDNFEDI

SEQ ID NO: 2950157 - protein, 19 aa, Entamoeba invadens
KTLAKWIIRKIENLGLNTY

SEQ ID NO: 2950158 - protein, 20 aa, Entamoeba invadens
KTLCQRGRVYQIKKLTPKRN

SEQ ID NO: 2950159 - protein, 30 aa, Entamoeba invadens
KTLDIVIPFVMRVERNISRYLLLKEEDMWD

SEQ ID NO: 2950160 - protein, 17 aa, Entamoeba invadens
KTLDSWTKLIGNLPLLE

SEQ ID NO: 2950161 - protein, 22 aa, Entamoeba invadens
KTLDVRSCKRVDFSNLVIKNEL

SEQ ID NO: 2950162 - protein, 23 aa, Entamoeba invadens
KTLDYPLVLSRVVKGSIVHTRVS

SEQ ID NO: 2950163 - protein, 23 aa, Entamoeba invadens
KTLETISLLGYLYHVQDVHGPHL

SEQ ID NO: 2950164 - protein, 21 aa, Entamoeba invadens
KTLEYCKLASYNLREVDVSLV

SEQ ID NO: 2950165 - protein, 20 aa, Entamoeba invadens
KTLGKWCFAGCTSLSSFVVE

SEQ ID NO: 2950166 - protein, 20 aa, Entamoeba invadens
KTLGSFCYATKPIASLTLPD

SEQ ID NO: 2950167 - protein, 18 aa, Entamoeba invadens
KTLIFSAKTKGIRVSALR

SEQ ID NO: 2950168 - protein, 24 aa, Entamoeba invadens
KTLIGFHLYHCLTSITLQTEMESL

SEQ ID NO: 2950169 - protein, 25 aa, Entamoeba invadens
KTLIGSGCFENCTSLSLLKLPNNNM

SEQ ID NO: 2950170 - protein, 24 aa, Entamoeba invadens
KTLKCPSIMAGEVMEHLCDNLIPT

SEQ ID NO: 2950171 - protein, 19 aa, Entamoeba invadens
KTLKECKTPVVSLFQENQW

SEQ ID NO: 2950172 - protein, 20 aa, Entamoeba invadens
KTLKEIGKYCFYYCESLRDI

SEQ ID NO: 2950173 - protein, 17 aa, Entamoeba invadens
KTLKFKRALLQTHSSFP

SEQ ID NO: 2950174 - protein, 21 aa, Entamoeba invadens
KTLKFTEVMFKGGKTIRHVKK

SEQ ID NO: 2950175 - protein, 21 aa, Entamoeba invadens
KTLKIDTIFKEQLPKVPKCFL

SEQ ID NO: 2950176 - protein, 25 aa, Entamoeba invadens
KTLKIGFASGFNFRLLNTLPSLERV

SEQ ID NO: 2950177 - protein, 25 aa, Entamoeba invadens
KTLKRAEVWRRFFNYIAKNDSYYVW

SEQ ID NO: 2950178 - protein, 26 aa, Entamoeba invadens
KTLKTIGKFVFKNCVSLESITFPKLL

SEQ ID NO: 2950179 - protein, 29 aa, Entamoeba invadens
KTLLETESFKLGPFLDESLKMKEESFDMI

SEQ ID NO: 2950180 - protein, 20 aa, Entamoeba invadens
KTLMKFLVVDDVTSKIMWFV

SEQ ID NO: 2950181 - protein, 28 aa, Entamoeba invadens
KTLNALVCSIKVGFQRHIAVVMPSVIVQ

SEQ ID NO: 2950182 - protein, 25 aa, Entamoeba invadens
KTLNFPPEMCWTLLTIFLKKLPVPL

SEQ ID NO: 2950183 - protein, 21 aa, Entamoeba invadens
KTLNGILIKFDDRGCGTVCVV

SEQ ID NO: 2950184 - protein, 22 aa, Entamoeba invadens
KTLNSLKFFYFVIKIKIRVIGL

SEQ ID NO: 2950185 - protein, 24 aa, Entamoeba invadens
KTLPETCKKWLLSATINDDVETIK

SEQ ID NO: 2950186 - protein, 17 aa, Entamoeba invadens
KTLRFNKNYVNLASAED

SEQ ID NO: 2950187 - protein, 17 aa, Entamoeba invadens
KTLRVALINAIGNRKAE

SEQ ID NO: 2950188 - protein, 22 aa, Entamoeba invadens
KTLRVIECDIVRTFPEGAEYLF

SEQ ID NO: 2950189 - protein, 17 aa, Entamoeba invadens
KTLRVLIKICDSHIPQT

SEQ ID NO: 2950190 - protein, 19 aa, Entamoeba invadens
KTLSFLIPMFEMIKTAKES

SEQ ID NO: 2950191 - protein, 25 aa, Entamoeba invadens
KTLSGHNGWVWDVCFSNNSEYIISA

SEQ ID NO: 2950192 - protein, 17 aa, Entamoeba invadens
KTLSLQFNNNWITVAGN

SEQ ID NO: 2950193 - protein, 18 aa, Entamoeba invadens
KTLSWYFWSIKIGKYRDH

SEQ ID NO: 2950194 - protein, 21 aa, Entamoeba invadens
KTLTDFAKFVGKIYKIDENAI

SEQ ID NO: 2950195 - protein, 17 aa, Entamoeba invadens
KTLWGVRANYLLEELGI

SEQ ID NO: 2950196 - protein, 20 aa, Entamoeba invadens
KTLYLPSYRFKVPKSVTSQI

SEQ ID NO: 2950197 - protein, 20 aa, Entamoeba invadens
KTLYVRGAYTKGIFRENTFA

SEQ ID NO: 2950198 - protein, 17 aa, Entamoeba invadens
KTMEFYFGILISENDKN

SEQ ID NO: 2950199 - protein, 23 aa, Entamoeba invadens
KTMENVLFLWALRNPACGYIQGL

SEQ ID NO: 2950200 - protein, 26 aa, Entamoeba invadens
KTMFIVCSKSSVFGCFNGAQLPIETN

SEQ ID NO: 2950201 - protein, 27 aa, Entamoeba invadens
KTMIVVFADDCAFGYYSESGSTSMFYN

SEQ ID NO: 2950202 - protein, 23 aa, Entamoeba invadens
KTMKIGELFISITHPDIVSRVLN

SEQ ID NO: 2950203 - protein, 25 aa, Entamoeba invadens
KTMKKRRRPSTCQSLPQFVKINDHI

SEQ ID NO: 2950204 - protein, 24 aa, Entamoeba invadens
KTMKVKLRMPGGVWEDEVSYLKID

SEQ ID NO: 2950205 - protein, 20 aa, Entamoeba invadens
KTMNRRSCQFVSKKRENEEK

SEQ ID NO: 2950206 - protein, 18 aa, Entamoeba invadens
KTMQPINWMKGMVQAALY

SEQ ID NO: 2950207 - protein, 19 aa, Entamoeba invadens
KTMRDYKTASEELMRTKTE

SEQ ID NO: 2950208 - protein, 30 aa, Entamoeba invadens
KTMYYCPFCSRCFLYACNKNHRNTCEKYTD

SEQ ID NO: 2950209 - protein, 22 aa, Entamoeba invadens
KTNCIKYVHPLLKRSGDLATNK

SEQ ID NO: 2950210 - protein, 20 aa, Entamoeba invadens
KTNECNDCDEILSQRLIFQI

SEQ ID NO: 2950211 - protein, 26 aa, Entamoeba invadens
KTNGKRLFSKFLYIFIQMCKTTQIGN

SEQ ID NO: 2950212 - protein, 28 aa, Entamoeba invadens
KTNGSALVRCAQPLPGIVAPLTGKNTTG

SEQ ID NO: 2950213 - protein, 24 aa, Entamoeba invadens
KTNHYRKALLDAFNHCQMIESGKN

SEQ ID NO: 2950214 - protein, 19 aa, Entamoeba invadens
KTNIYGTGISTVLSKFSKF

SEQ ID NO: 2950215 - protein, 20 aa, Entamoeba invadens
KTNKMCKVIIPSWLHVEQLE

SEQ ID NO: 2950216 - protein, 19 aa, Entamoeba invadens
KTNKSALCKILTGQPPPQN

SEQ ID NO: 2950217 - protein, 17 aa, Entamoeba invadens
KTNKSRYFYLFNDLLLY

SEQ ID NO: 2950218 - protein, 25 aa, Entamoeba invadens
KTNNDFNNMFGMDFMFGNNFANNQQ

SEQ ID NO: 2950219 - protein, 25 aa, Entamoeba invadens
KTNPKLWWKYIYNVKLDEIKEKNKP

SEQ ID NO: 2950220 - protein, 19 aa, Entamoeba invadens
KTNRKKVECLLNQLRTATQ

SEQ ID NO: 2950221 - protein, 27 aa, Entamoeba invadens
KTPCERRWNSIVLPLDMDAGNRLSIAN

SEQ ID NO: 2950222 - protein, 22 aa, Entamoeba invadens
KTPCRIPAVFLAPVRNDIVQFV

SEQ ID NO: 2950223 - protein, 22 aa, Entamoeba invadens
KTPCRIPAVFLAPVRNDMFQFV

SEQ ID NO: 2950224 - protein, 23 aa, Entamoeba invadens
KTPEEIRKTFGIVNDFTPEEEEQ

SEQ ID NO: 2950225 - protein, 23 aa, Entamoeba invadens
KTPELNFRCSFDEIKTMWKTMKV

SEQ ID NO: 2950226 - protein, 17 aa, Entamoeba invadens
KTPENQKKCDIPKTEKS

SEQ ID NO: 2950227 - protein, 18 aa, Entamoeba invadens
KTPKGVEVLLDILKDVGS

SEQ ID NO: 2950228 - protein, 20 aa, Entamoeba invadens
KTPKRRAAPLAKSPRTQLIK

SEQ ID NO: 2950229 - protein, 18 aa, Entamoeba invadens
KTPLNKRLPVLRKSRENR

SEQ ID NO: 2950230 - protein, 19 aa, Entamoeba invadens
KTPNIDWAKEKARWDQAVS

SEQ ID NO: 2950231 - protein, 28 aa, Entamoeba invadens
KTPQDVFCFFLKAGHLCPFAPSMFPCYP

SEQ ID NO: 2950232 - protein, 26 aa, Entamoeba invadens
KTPQMLEFGWEWMIQKIISENLVTPS

SEQ ID NO: 2950233 - protein, 24 aa, Entamoeba invadens
KTPRLMCELEIDLLRGFQNTSSYV

SEQ ID NO: 2950234 - protein, 27 aa, Entamoeba invadens
KTPSVVEVYLKLGLDISDIEKKRFLKE

SEQ ID NO: 2950235 - protein, 23 aa, Entamoeba invadens
KTPTKKRVCLIVDGSVVSTLMTG

SEQ ID NO: 2950236 - protein, 19 aa, Entamoeba invadens
KTPVDFAVLCQNLIELPPE

SEQ ID NO: 2950237 - protein, 17 aa, Entamoeba invadens
KTQEKRENLSFKNSLGH

SEQ ID NO: 2950238 - protein, 23 aa, Entamoeba invadens
KTQEYLAVILLSFIDQNKLLEVL

SEQ ID NO: 2950239 - protein, 25 aa, Entamoeba invadens
KTQFKYPWEVADFVSAGKRMKIKRS

SEQ ID NO: 2950240 - protein, 20 aa, Entamoeba invadens
KTQFNHVFLVVGFDLDQSNI

SEQ ID NO: 2950241 - protein, 26 aa, Entamoeba invadens
KTQGIIPLFVFDGATLPAKMKTEEAR

SEQ ID NO: 2950242 - protein, 26 aa, Entamoeba invadens
KTQIKMPQRSVLRVNRLVQKGQKQLS

SEQ ID NO: 2950243 - protein, 17 aa, Entamoeba invadens
KTQITGFFFFSKNENGV

SEQ ID NO: 2950244 - protein, 25 aa, Entamoeba invadens
KTQLRNVVVLNLMFYSLRMKLVDVI

SEQ ID NO: 2950245 - protein, 24 aa, Entamoeba invadens
KTQNVWPRRVKDLIINKKQILINT

SEQ ID NO: 2950246 - protein, 24 aa, Entamoeba invadens
KTQPIFRKDHRGLSVMTGNCTGDN

SEQ ID NO: 2950247 - protein, 21 aa, Entamoeba invadens
KTQRWPDLINFLTVDPTLPKL

SEQ ID NO: 2950248 - protein, 23 aa, Entamoeba invadens
KTQSSEFYSFFSVPSNMNITNLL

SEQ ID NO: 2950249 - protein, 22 aa, Entamoeba invadens
KTQTGMTALHWATYNYQVDLLS

SEQ ID NO: 2950250 - protein, 26 aa, Entamoeba invadens
KTQTPEDLFDFGFEATPRMQETPEPV

SEQ ID NO: 2950251 - protein, 28 aa, Entamoeba invadens
KTQVMKFKKWLESWKNVIPDRQAVLLAG

SEQ ID NO: 2950252 - protein, 26 aa, Entamoeba invadens
KTRCLQTKDIFAFPALANNTTATPEA

SEQ ID NO: 2950253 - protein, 20 aa, Entamoeba invadens
KTREAKESKQTFVPVDPTNQ

SEQ ID NO: 2950254 - protein, 20 aa, Entamoeba invadens
KTRFNSCYLSFSKLLKREKS

SEQ ID NO: 2950255 - protein, 21 aa, Entamoeba invadens
KTRGVLSLDLLTYLDTKKATE

SEQ ID NO: 2950256 - protein, 30 aa, Entamoeba invadens
KTRHFERECCLKMSVIYLIIKNSTFGNDLL

SEQ ID NO: 2950257 - protein, 27 aa, Entamoeba invadens
KTRHTNCLFFIAIQIWRGIPAQIKSIL

SEQ ID NO: 2950258 - protein, 19 aa, Entamoeba invadens
KTRKVCKNNSILMKRVNSI

SEQ ID NO: 2950259 - protein, 26 aa, Entamoeba invadens
KTRLHTYFPGLTLFISYLEGLIDEFE

SEQ ID NO: 2950260 - protein, 22 aa, Entamoeba invadens
KTRLSEWGFGKEHFEEIAQKFK

SEQ ID NO: 2950261 - protein, 19 aa, Entamoeba invadens
KTRNGNIGVCFKDEKKEKE

SEQ ID NO: 2950262 - protein, 25 aa, Entamoeba invadens
KTRNIEIGETFPLVQEIESKDGNSE

SEQ ID NO: 2950263 - protein, 23 aa, Entamoeba invadens
KTRPKSLLPEGIYPYTTDPQKGP

SEQ ID NO: 2950264 - protein, 18 aa, Entamoeba invadens
KTRWELVNLLQKEVARGI

SEQ ID NO: 2950265 - protein, 26 aa, Entamoeba invadens
KTSAEYFIRVAFKLEKQRMFNSSYLI

SEQ ID NO: 2950266 - protein, 19 aa, Entamoeba invadens
KTSEFQCLYSFKENRNYQS

SEQ ID NO: 2950267 - protein, 20 aa, Entamoeba invadens
KTSEGIKCLETAITQTCKEP

SEQ ID NO: 2950268 - protein, 24 aa, Entamoeba invadens
KTSEKRLSSKINMVRKEKERIGAF

SEQ ID NO: 2950269 - protein, 18 aa, Entamoeba invadens
KTSELFLPPEAINNIEIS

SEQ ID NO: 2950270 - protein, 26 aa, Entamoeba invadens
KTSESILFRSSEPFLKNIEQRGQSDY

SEQ ID NO: 2950271 - protein, 19 aa, Entamoeba invadens
KTSESKFRLIFSSEQSQLN

SEQ ID NO: 2950272 - protein, 17 aa, Entamoeba invadens
KTSFIFSLVRNGILNPI

SEQ ID NO: 2950273 - protein, 18 aa, Entamoeba invadens
KTSIAIRLVHNIFTKIYD

SEQ ID NO: 2950274 - protein, 27 aa, Entamoeba invadens
KTSIILRYSLGVFKNYYLPTVLETTCF

SEQ ID NO: 2950275 - protein, 19 aa, Entamoeba invadens
KTSILRQLCQGTFVEGYRG

SEQ ID NO: 2950276 - protein, 20 aa, Entamoeba invadens
KTSKERIVFLLIFKSEKQVD

SEQ ID NO: 2950277 - protein, 22 aa, Entamoeba invadens
KTSLEQCVYWIATVSSVIEHIR

SEQ ID NO: 2950278 - protein, 19 aa, Entamoeba invadens
KTSLIKRVLFREFEKEPEP

SEQ ID NO: 2950279 - protein, 27 aa, Entamoeba invadens
KTSLIYRMVSNEFKETLPPTVPDVTPY

SEQ ID NO: 2950280 - protein, 27 aa, Entamoeba invadens
KTSLKLSCLHLAILFDAFDFFEDLKDQ

SEQ ID NO: 2950281 - protein, 21 aa, Entamoeba invadens
KTSLPKFSIIGANFFVKLPKN

SEQ ID NO: 2950282 - protein, 25 aa, Entamoeba invadens
KTSMSRLVSEFSRYKLIDDEKLGIF

SEQ ID NO: 2950283 - protein, 21 aa, Entamoeba invadens
KTSPKEAVGVLVLKNNEPAVV

SEQ ID NO: 2950284 - protein, 25 aa, Entamoeba invadens
KTSPRGASYLGVRNIWHAMLMPLNN

SEQ ID NO: 2950285 - protein, 24 aa, Entamoeba invadens
KTSPRRLATFILKDHSSVKPKQNV

SEQ ID NO: 2950286 - protein, 23 aa, Entamoeba invadens
KTSRNRLDWVYCFQNDTFVKCGK

SEQ ID NO: 2950287 - protein, 18 aa, Entamoeba invadens
KTSSAEIVVSGYKLKTNS

SEQ ID NO: 2950288 - protein, 20 aa, Entamoeba invadens
KTSVATSFSEYVDVLGRVYA

SEQ ID NO: 2950289 - protein, 26 aa, Entamoeba invadens
KTSVIKREFFEVVLHYEISFQVFLNF

SEQ ID NO: 2950290 - protein, 27 aa, Entamoeba invadens
KTSVSWKECKTIKCGEKVEKLVVKSCE

SEQ ID NO: 2950291 - protein, 27 aa, Entamoeba invadens
KTTADAWCDWVKSVAGLFGLKLNLCVN

SEQ ID NO: 2950292 - protein, 17 aa, Entamoeba invadens
KTTALRIFVETQKVPQE

SEQ ID NO: 2950293 - protein, 18 aa, Entamoeba invadens
KTTALVFHSGKLVITGGK

SEQ ID NO: 2950294 - protein, 17 aa, Entamoeba invadens
KTTCLLCGESYRLFEGE

SEQ ID NO: 2950295 - protein, 22 aa, Entamoeba invadens
KTTDVRTAFFQAFEEIQKQLTE

SEQ ID NO: 2950296 - protein, 19 aa, Entamoeba invadens
KTTEGFGEALLRIDSTVEI

SEQ ID NO: 2950297 - protein, 19 aa, Entamoeba invadens
KTTEPRETISLINDKITFS

SEQ ID NO: 2950298 - protein, 25 aa, Entamoeba invadens
KTTEWKKGVGMEEFYCIPCSLNYIK

SEQ ID NO: 2950299 - protein, 19 aa, Entamoeba invadens
KTTGLSVEVIRTFLKNMKD

SEQ ID NO: 2950300 - protein, 18 aa, Entamoeba invadens
KTTGVYLLIPPKISARDL

SEQ ID NO: 2950301 - protein, 24 aa, Entamoeba invadens
KTTILYRLQCGKVIPSMPTIGFNM

SEQ ID NO: 2950302 - protein, 20 aa, Entamoeba invadens
KTTKICVMVLKALQELNPTQ

SEQ ID NO: 2950303 - protein, 22 aa, Entamoeba invadens
KTTKIGDGHFIFEPEEPKKVPQ

SEQ ID NO: 2950304 - protein, 20 aa, Entamoeba invadens
KTTKLCIIILKSLKEMHPDV

SEQ ID NO: 2950305 - protein, 23 aa, Entamoeba invadens
KTTKRCFVCSLVHDYKENTGECW

SEQ ID NO: 2950306 - protein, 19 aa, Entamoeba invadens
KTTKVPLVVPKNVTPPVSQ

SEQ ID NO: 2950307 - protein, 22 aa, Entamoeba invadens
KTTKYVLLKYFYWKFTEPSVMS

SEQ ID NO: 2950308 - protein, 23 aa, Entamoeba invadens
KTTLFKKKLFVGSEDEIKKQILF

SEQ ID NO: 2950309 - protein, 18 aa, Entamoeba invadens
KTTLFLLFALNGSSSIRN

SEQ ID NO: 2950310 - protein, 30 aa, Entamoeba invadens
KTTLPEHFEVFKLLCKMFGEIINQSNKNKM

SEQ ID NO: 2950311 - protein, 25 aa, Entamoeba invadens
KTTNYKQFLGIGVCDVGEIMTGTET

SEQ ID NO: 2950312 - protein, 24 aa, Entamoeba invadens
KTTPKRFSEFEAFHNLIKYVTNDP

SEQ ID NO: 2950313 - protein, 18 aa, Entamoeba invadens
KTTPPKHPDFIPLIKTLI

SEQ ID NO: 2950314 - protein, 25 aa, Entamoeba invadens
KTTPRLSMGIMIHKGVFEFPFATMT

SEQ ID NO: 2950315 - protein, 22 aa, Entamoeba invadens
KTTRLCVLILKSLKDLKPSVEY

SEQ ID NO: 2950316 - protein, 19 aa, Entamoeba invadens
KTTRRKLKSGMSRKEGQNE

SEQ ID NO: 2950317 - protein, 24 aa, Entamoeba invadens
KTTSARGGFFGSFFSSKDKERKEK

SEQ ID NO: 2950318 - protein, 25 aa, Entamoeba invadens
KTTTLYIKMMISGILSKGILISGDN

SEQ ID NO: 2950319 - protein, 24 aa, Entamoeba invadens
KTTTRRNFSYRVVMVKDNVEMDMR

SEQ ID NO: 2950320 - protein, 20 aa, Entamoeba invadens
KTTWRNLPVLDKLRKENQIE

SEQ ID NO: 2950321 - protein, 23 aa, Entamoeba invadens
KTVAICGENLWVGTLAGLNVFNT

SEQ ID NO: 2950322 - protein, 18 aa, Entamoeba invadens
KTVEAVAPTTEFVYITVN

SEQ ID NO: 2950323 - protein, 19 aa, Entamoeba invadens
KTVEILLAKYIEFFYLTNT

SEQ ID NO: 2950324 - protein, 24 aa, Entamoeba invadens
KTVEVCSRLIRLMKTDNLTILESA

SEQ ID NO: 2950325 - protein, 23 aa, Entamoeba invadens
KTVFEFYPIGTIFHELSKKEENS

SEQ ID NO: 2950326 - protein, 34 aa, Entamoeba invadens
KTVFRIWDSIFAFPSRRFHLFIASTILIMNAKSA

SEQ ID NO: 2950327 - protein, 29 aa, Entamoeba invadens
KTVGTRAGECLVRKVLDKFPTKVIDSAVL

SEQ ID NO: 2950328 - protein, 24 aa, Entamoeba invadens
KTVICGSDNGLAWLYKDNLGNKVN

SEQ ID NO: 2950329 - protein, 19 aa, Entamoeba invadens
KTVIPDLVLQCFDVLSKVK

SEQ ID NO: 2950330 - protein, 21 aa, Entamoeba invadens
KTVKIVKAFLGCYLIINGTIL

SEQ ID NO: 2950331 - protein, 17 aa, Entamoeba invadens
KTVKLQLWDTAGQERFA

SEQ ID NO: 2950332 - protein, 29 aa, Entamoeba invadens
KTVLKIEFFRIIVWFNVDFETVDRNKSRN

SEQ ID NO: 2950333 - protein, 24 aa, Entamoeba invadens
KTVLKSEGYMLFYKRSNETVLKSD

SEQ ID NO: 2950334 - protein, 28 aa, Entamoeba invadens
KTVLNRKFFRIIVWFNVNFETVDRNKNR

SEQ ID NO: 2950335 - protein, 19 aa, Entamoeba invadens
KTVMKRAYPTENMNLPVGW

SEQ ID NO: 2950336 - protein, 26 aa, Entamoeba invadens
KTVNLGEYTKLFALHRACMTVNDSEK

SEQ ID NO: 2950337 - protein, 27 aa, Entamoeba invadens
KTVPEIASDCLYTFVHLSVQFEYLNYF

SEQ ID NO: 2950338 - protein, 31 aa, Entamoeba invadens
KTVPPLRVAAFVKRLLLLMLNCDASIALDLR

SEQ ID NO: 2950339 - protein, 19 aa, Entamoeba invadens
KTVPWKYSKSHFQMEYQSN

SEQ ID NO: 2950340 - protein, 32 aa, Entamoeba invadens
KTVRTKGEYLFKTNLDFTYNLLRGIISYCNVN

SEQ ID NO: 2950341 - protein, 18 aa, Entamoeba invadens
KTVTCNYVSIPITTCHLH

SEQ ID NO: 2950342 - protein, 37 aa, Entamoeba invadens
KTVVVCPQSLIGNWENEFMKWLGTERIPVKTGSSDAL

SEQ ID NO: 2950343 - protein, 19 aa, Entamoeba invadens
KTWSNLRITNNLNKNTFSG

SEQ ID NO: 2950344 - protein, 19 aa, Entamoeba invadens
KTYCPEKFPPMSKISKIRK

SEQ ID NO: 2950345 - protein, 29 aa, Entamoeba invadens
KTYDAKKNDCWAIGIILYQVFTGKLPFTP

SEQ ID NO: 2950346 - protein, 24 aa, Entamoeba invadens
KTYDRNTLVAAYKLLNMSYQILLE

SEQ ID NO: 2950347 - protein, 25 aa, Entamoeba invadens
KTYIKSSGVLLMLLKELECGNNQKR

SEQ ID NO: 2950348 - protein, 24 aa, Entamoeba invadens
KTYILRDDVKLIFFVFDKQGKKIN

SEQ ID NO: 2950349 - protein, 25 aa, Entamoeba invadens
KTYILRDDVKLIFFVFDKRGKKINK

SEQ ID NO: 2950350 - protein, 19 aa, Entamoeba invadens
KTYLKLKRLIEALLQDDSP

SEQ ID NO: 2950351 - protein, 22 aa, Entamoeba invadens
KTYLTTCFNVDMKFLMEKYQIH

SEQ ID NO: 2950352 - protein, 34 aa, Entamoeba invadens
KTYMLEYFMLWFSRCFPLEVELKILDLILMEGWE

SEQ ID NO: 2950353 - protein, 17 aa, Entamoeba invadens
KTYMPKMLSLILTELNK

SEQ ID NO: 2950354 - protein, 23 aa, Entamoeba invadens
KTYRIRYLKHPYLSRKNDDLVVS

SEQ ID NO: 2950355 - protein, 27 aa, Entamoeba invadens
KTYTADELIGFIALHTFTVCVLVKEVK

SEQ ID NO: 2950356 - protein, 19 aa, Entamoeba invadens
KVAALPVPIPVLRGNASYV

SEQ ID NO: 2950357 - protein, 22 aa, Entamoeba invadens
KVADEWKILFYETSAKNKTNIT

SEQ ID NO: 2950358 - protein, 19 aa, Entamoeba invadens
KVADEWKTLFYETSAKNNT

SEQ ID NO: 2950359 - protein, 18 aa, Entamoeba invadens
KVADFAVAMEDAICLSAV

SEQ ID NO: 2950360 - protein, 21 aa, Entamoeba invadens
KVADKWKTLFYETSAKNNTNI

SEQ ID NO: 2950361 - protein, 23 aa, Entamoeba invadens
KVAEKEGKKKAAVRMTGDENAEF

SEQ ID NO: 2950362 - protein, 20 aa, Entamoeba invadens
KVAEVRAWMATHLKSASILI

SEQ ID NO: 2950363 - protein, 18 aa, Entamoeba invadens
KVAFSLGTLQFYLGNYPT

SEQ ID NO: 2950364 - protein, 28 aa, Entamoeba invadens
KVAGHRGYYLKGWGFKLNQALINYATQF

SEQ ID NO: 2950365 - protein, 22 aa, Entamoeba invadens
KVAIENIVFKYAKIMTELNESR

SEQ ID NO: 2950366 - protein, 25 aa, Entamoeba invadens
KVAKIKNGVWSQCYFDTYNTEKLVN

SEQ ID NO: 2950367 - protein, 19 aa, Entamoeba invadens
KVAKVGADYKAEFCTSTAS

SEQ ID NO: 2950368 - protein, 21 aa, Entamoeba invadens
KVANPLNFCLKKIGKEKQLER

SEQ ID NO: 2950369 - protein, 23 aa, Entamoeba invadens
KVAQIMQLVFCILKKDTNRELIT

SEQ ID NO: 2950370 - protein, 24 aa, Entamoeba invadens
KVASLRIIKIAIRDGSLKVNGLLE

SEQ ID NO: 2950371 - protein, 18 aa, Entamoeba invadens
KVASTCAVDGRKVEIDMN

SEQ ID NO: 2950372 - protein, 23 aa, Entamoeba invadens
KVATIPLKIIISLKKDMVNQKVD

SEQ ID NO: 2950373 - protein, 20 aa, Entamoeba invadens
KVAVYNYNWRCMCIECDEYR

SEQ ID NO: 2950374 - protein, 21 aa, Entamoeba invadens
KVAYLTCQKALYVYTDDNSKN

SEQ ID NO: 2950375 - protein, 18 aa, Entamoeba invadens
KVCASKLHAESCVGNVLG

SEQ ID NO: 2950376 - protein, 21 aa, Entamoeba invadens
KVCEMLIAVAHRCDHAQVISI

SEQ ID NO: 2950377 - protein, 18 aa, Entamoeba invadens
KVCKKYLEIPSMFHYNPV

SEQ ID NO: 2950378 - protein, 18 aa, Entamoeba invadens
KVCLCGSQGVGKTCLVNR

SEQ ID NO: 2950379 - protein, 18 aa, Entamoeba invadens
KVCSEFLDNMFLHVKADF

SEQ ID NO: 2950380 - protein, 19 aa, Entamoeba invadens
KVDAKMNKRMWGRILVGAE

SEQ ID NO: 2950381 - protein, 21 aa, Entamoeba invadens
KVDCLQFLIHLYLSKFPTQFL

SEQ ID NO: 2950382 - protein, 24 aa, Entamoeba invadens
KVDDFCFYNSIPIENIIFEEKESI

SEQ ID NO: 2950383 - protein, 26 aa, Entamoeba invadens
KVDFKKVNLEVMRAWVTSKVVEILGV

SEQ ID NO: 2950384 - protein, 24 aa, Entamoeba invadens
KVDHPVFEGELLIPKKSQTKQTKL

SEQ ID NO: 2950385 - protein, 28 aa, Entamoeba invadens
KVDIKIELCNSVFSCLYPTPQNVDENNK

SEQ ID NO: 2950386 - protein, 17 aa, Entamoeba invadens
KVDLCAKPVPYDFNGIK

SEQ ID NO: 2950387 - protein, 19 aa, Entamoeba invadens
KVDLCGKGSFSGEVTFEEK

SEQ ID NO: 2950388 - protein, 20 aa, Entamoeba invadens
KVDLCGKGSFSGEVTFEEKK

SEQ ID NO: 2950389 - protein, 26 aa, Entamoeba invadens
KVDNKEGLCFKHEFFQRDHPELLQKI

SEQ ID NO: 2950390 - protein, 23 aa, Entamoeba invadens
KVDSLDLACFISRKITSDEGIPR

SEQ ID NO: 2950391 - protein, 24 aa, Entamoeba invadens
KVDTENFDIFGFLPNVFSQVQSTF

SEQ ID NO: 2950392 - protein, 19 aa, Entamoeba invadens
KVDVKIPMEIQGEKEKTTQ

SEQ ID NO: 2950393 - protein, 18 aa, Entamoeba invadens
KVDVLYRVDLKCIASPNG

SEQ ID NO: 2950394 - protein, 17 aa, Entamoeba invadens
KVDYCQYGSGFFFINGE

SEQ ID NO: 2950395 - protein, 17 aa, Entamoeba invadens
KVEADIIIPVEELEETV

SEQ ID NO: 2950396 - protein, 20 aa, Entamoeba invadens
KVEEIQLFFCYSQNRTTSYI

SEQ ID NO: 2950397 - protein, 23 aa, Entamoeba invadens
KVEEIYIGNGITFVGESCFQGCI

SEQ ID NO: 2950398 - protein, 17 aa, Entamoeba invadens
KVEFCIGKIKAIEEKMW

SEQ ID NO: 2950399 - protein, 17 aa, Entamoeba invadens
KVEFNLESWKRLYCNSE

SEQ ID NO: 2950400 - protein, 18 aa, Entamoeba invadens
KVEIGEVERSVWERRPIQ

SEQ ID NO: 2950401 - protein, 18 aa, Entamoeba invadens
KVEIKNPLFIVSMPRSGS

SEQ ID NO: 2950402 - protein, 22 aa, Entamoeba invadens
KVEIKNPLFIVSMPRSGSTFAH

SEQ ID NO: 2950403 - protein, 20 aa, Entamoeba invadens
KVEILKCAVEAKSKLAKIEE

SEQ ID NO: 2950404 - protein, 25 aa, Entamoeba invadens
KVEKAITPKLRFGKSPKKTKEDTPL

SEQ ID NO: 2950405 - protein, 20 aa, Entamoeba invadens
KVEKEMITYADAFPKLFEVL

SEQ ID NO: 2950406 - protein, 18 aa, Entamoeba invadens
KVEKKAEIVFRFSPSPTH

SEQ ID NO: 2950407 - protein, 21 aa, Entamoeba invadens
KVEKSTRLESIPNNEEVEKIK

SEQ ID NO: 2950408 - protein, 23 aa, Entamoeba invadens
KVELKRPLFITSLPRSGSTFLHN

SEQ ID NO: 2950409 - protein, 24 aa, Entamoeba invadens
KVERSRFKPSFSMGPEDYGVQQLD

SEQ ID NO: 2950410 - protein, 20 aa, Entamoeba invadens
KVESFFDLFYSPALPEDFNP

SEQ ID NO: 2950411 - protein, 23 aa, Entamoeba invadens
KVESKFKKFSFKADDYIFRDANM

SEQ ID NO: 2950412 - protein, 19 aa, Entamoeba invadens
KVETMGMVFKMINLPKSVV

SEQ ID NO: 2950413 - protein, 25 aa, Entamoeba invadens
KVEVLKGGKILKVSKDTWKNVGKLE

SEQ ID NO: 2950414 - protein, 19 aa, Entamoeba invadens
KVEVPVVGVKTAFDVDGWI

SEQ ID NO: 2950415 - protein, 17 aa, Entamoeba invadens
KVFAQKFFDSFLHQNSD

SEQ ID NO: 2950416 - protein, 23 aa, Entamoeba invadens
KVFCEVIKIVFLYNSDNIVFVDA

SEQ ID NO: 2950417 - protein, 17 aa, Entamoeba invadens
KVFCVHGGISPSLNSLE

SEQ ID NO: 2950418 - protein, 17 aa, Entamoeba invadens
KVFDSFIPNFFSLKSCQ

SEQ ID NO: 2950419 - protein, 35 aa, Entamoeba invadens
KVFEDSVCGLMKCWSTLRLTVEHQFGGQDSEQKKD

SEQ ID NO: 2950420 - protein, 17 aa, Entamoeba invadens
KVFEKFCKTKNCILLTT

SEQ ID NO: 2950421 - protein, 24 aa, Entamoeba invadens
KVFFKAKEVFRILFTLVSSLQEDD

SEQ ID NO: 2950422 - protein, 19 aa, Entamoeba invadens
KVFKMVFNRIHMIPEYMKT

SEQ ID NO: 2950423 - protein, 24 aa, Entamoeba invadens
KVFKNQCFRGCVLLELTVPKTVKH

SEQ ID NO: 2950424 - protein, 23 aa, Entamoeba invadens
KVFPRKSNTTFQEYFTSKDFQNW

SEQ ID NO: 2950425 - protein, 29 aa, Entamoeba invadens
KVFRSNRYVCDRKAFIFSLFSNGRSERPL

SEQ ID NO: 2950426 - protein, 18 aa, Entamoeba invadens
KVFSDVIGYPVLIPIMLK

SEQ ID NO: 2950427 - protein, 17 aa, Entamoeba invadens
KVFSNFATKCNFTSFKR

SEQ ID NO: 2950428 - protein, 17 aa, Entamoeba invadens
KVGAHLIAEILKGQCGL

SEQ ID NO: 2950429 - protein, 22 aa, Entamoeba invadens
KVGCILCGAGIAKHHILNAMKR

SEQ ID NO: 2950430 - protein, 20 aa, Entamoeba invadens
KVGDAKGRFATYKGSGKVFV

SEQ ID NO: 2950431 - protein, 23 aa, Entamoeba invadens
KVGELKGNVYLGFKDLETAKNVM

SEQ ID NO: 2950432 - protein, 20 aa, Entamoeba invadens
KVGFLRLFLYLFKESSNLDY

SEQ ID NO: 2950433 - protein, 26 aa, Entamoeba invadens
KVGGVLSMEAFNHFLCRSTEQNREDK

SEQ ID NO: 2950434 - protein, 24 aa, Entamoeba invadens
KVGKLGGLFRPDSFVCGKNGAGNN

SEQ ID NO: 2950435 - protein, 23 aa, Entamoeba invadens
KVGKTSLCLSEFDMLKGDTSLLL

SEQ ID NO: 2950436 - protein, 18 aa, Entamoeba invadens
KVGLAVTSLHVFQFCTNE

SEQ ID NO: 2950437 - protein, 18 aa, Entamoeba invadens
KVGLLDHDVVVWMGDLNF

SEQ ID NO: 2950438 - protein, 23 aa, Entamoeba invadens
KVGNKGRVKVCFDKKSEVVEVYE

SEQ ID NO: 2950439 - protein, 23 aa, Entamoeba invadens
KVGPDIIRNPAFLISRTKEDYVS

SEQ ID NO: 2950440 - protein, 18 aa, Entamoeba invadens
KVGSLCFYDSVFESVLLP

SEQ ID NO: 2950441 - protein, 26 aa, Entamoeba invadens
KVGSLYTEVYCQLLVRSWQINADSLI

SEQ ID NO: 2950442 - protein, 23 aa, Entamoeba invadens
KVGTDLKREFPIFDAVPESEKPV

SEQ ID NO: 2950443 - protein, 18 aa, Entamoeba invadens
KVGVVCAGDETTVLIDKT

SEQ ID NO: 2950444 - protein, 19 aa, Entamoeba invadens
KVGYGDRLLSQFLVEMDGL

SEQ ID NO: 2950445 - protein, 33 aa, Entamoeba invadens
KVHNIPKCAFFVFCDECVFGFYSESQTLYLSPL

SEQ ID NO: 2950446 - protein, 25 aa, Entamoeba invadens
KVHVVCRVGVVYLTHFDSFHTNYTE

SEQ ID NO: 2950447 - protein, 24 aa, Entamoeba invadens
KVIDLLQKFDCWEGLYYFLSQIVN

SEQ ID NO: 2950448 - protein, 17 aa, Entamoeba invadens
KVIEAVFLDDVYILSPS

SEQ ID NO: 2950449 - protein, 25 aa, Entamoeba invadens
KVIELMCIYASINPGFFPESRQIAV

SEQ ID NO: 2950450 - protein, 25 aa, Entamoeba invadens
KVIENFKECIFYSGRSMDTDTGCLV

SEQ ID NO: 2950451 - protein, 25 aa, Entamoeba invadens
KVIFYEMNEVLTLLNDCVVSLCQNV

SEQ ID NO: 2950452 - protein, 17 aa, Entamoeba invadens
KVIGRVKMELFRTVCPK

SEQ ID NO: 2950453 - protein, 23 aa, Entamoeba invadens
KVIIKRLAALSVKTQRNQCQNKQ

SEQ ID NO: 2950454 - protein, 21 aa, Entamoeba invadens
KVIKARNSFIKELPPSLKEFK

SEQ ID NO: 2950455 - protein, 28 aa, Entamoeba invadens
KVIKKHCFDCCGKLSQIEFCHSITAFEE

SEQ ID NO: 2950456 - protein, 26 aa, Entamoeba invadens
KVINVRAACWMKAMLDAKNLEINEFC

SEQ ID NO: 2950457 - protein, 18 aa, Entamoeba invadens
KVIPEKLNHVIACLIDAI

SEQ ID NO: 2950458 - protein, 22 aa, Entamoeba invadens
KVIPMLLYFSYVFDEEELSVEC

SEQ ID NO: 2950459 - protein, 17 aa, Entamoeba invadens
KVIPSLEDPFWTALASL

SEQ ID NO: 2950460 - protein, 17 aa, Entamoeba invadens
KVIQWTIFHGFDVLLEM

SEQ ID NO: 2950461 - protein, 17 aa, Entamoeba invadens
KVIRICFDATFQCTFDW

SEQ ID NO: 2950462 - protein, 23 aa, Entamoeba invadens
KVIRKKVFYEIIVWFEVDYVTVF

SEQ ID NO: 2950463 - protein, 24 aa, Entamoeba invadens
KVISEPPVEILVSGPILHLKKLGS

SEQ ID NO: 2950464 - protein, 19 aa, Entamoeba invadens
KVISQRKFIEQKLNEHIAI

SEQ ID NO: 2950465 - protein, 19 aa, Entamoeba invadens
KVISSFCGMDDLLNNDILD

SEQ ID NO: 2950466 - protein, 17 aa, Entamoeba invadens
KVITRKSVLPDFATPHH

SEQ ID NO: 2950467 - protein, 24 aa, Entamoeba invadens
KVKCILDRDVLYLASLFASAKKKK

SEQ ID NO: 2950468 - protein, 24 aa, Entamoeba invadens
KVKCSICGQLGHTHQNCTCTKQQQ

SEQ ID NO: 2950469 - protein, 19 aa, Entamoeba invadens
KVKELILEVVVKFLQSIDM

SEQ ID NO: 2950470 - protein, 17 aa, Entamoeba invadens
KVKELTREHGFDNIGSV

SEQ ID NO: 2950471 - protein, 21 aa, Entamoeba invadens
KVKEVTVLACTWNVNQCVYPR

SEQ ID NO: 2950472 - protein, 18 aa, Entamoeba invadens
KVKFILNKIELIQSGVET

SEQ ID NO: 2950473 - protein, 19 aa, Entamoeba invadens
KVKFPERIIMLRGNHESRQ

SEQ ID NO: 2950474 - protein, 19 aa, Entamoeba invadens
KVKGWEVIQQSDLNSETID

SEQ ID NO: 2950475 - protein, 30 aa, Entamoeba invadens
KVKHLKGGVFWCCNSLIKFDNFRDIECIPH

SEQ ID NO: 2950476 - protein, 25 aa, Entamoeba invadens
KVKHLKSCVFWCCNSLSCLTILETL

SEQ ID NO: 2950477 - protein, 26 aa, Entamoeba invadens
KVKHLKSGVFWCCNSFVMFDNFGDIE

SEQ ID NO: 2950478 - protein, 18 aa, Entamoeba invadens
KVKIERRLAFKIAGRQKI

SEQ ID NO: 2950479 - protein, 21 aa, Entamoeba invadens
KVKIMPALECKLIEETMKKYN

SEQ ID NO: 2950480 - protein, 22 aa, Entamoeba invadens
KVKKEAKCGSYVEKGNAMETES

SEQ ID NO: 2950481 - protein, 18 aa, Entamoeba invadens
KVKKRSKSFVDFEAERKR

SEQ ID NO: 2950482 - protein, 21 aa, Entamoeba invadens
KVKKSFCGDAQYFQSDLNTID

SEQ ID NO: 2950483 - protein, 20 aa, Entamoeba invadens
KVKLAGVQLLDFYTKACNEN

SEQ ID NO: 2950484 - protein, 25 aa, Entamoeba invadens
KVKLIDFGSACFENYTLYSYIQSRH

SEQ ID NO: 2950485 - protein, 26 aa, Entamoeba invadens
KVKLIDFGSACFENYTLYSYIQSRHY

SEQ ID NO: 2950486 - protein, 24 aa, Entamoeba invadens
KVKLIGCKLSRDFGVIKMVEGILR

SEQ ID NO: 2950487 - protein, 19 aa, Entamoeba invadens
KVKMLLLVVPTFQFAKGNT

SEQ ID NO: 2950488 - protein, 21 aa, Entamoeba invadens
KVKMSRELLQTLIADDLKVIE

SEQ ID NO: 2950489 - protein, 24 aa, Entamoeba invadens
KVKRFPQQYFYVYFLFETNETSGN

SEQ ID NO: 2950490 - protein, 20 aa, Entamoeba invadens
KVKRPSIVNITHFKPYQHFD

SEQ ID NO: 2950491 - protein, 20 aa, Entamoeba invadens
KVKRRVCNYTSLSTKAVVTH

SEQ ID NO: 2950492 - protein, 21 aa, Entamoeba invadens
KVKTTRLVIMILQALKQLKPD

SEQ ID NO: 2950493 - protein, 17 aa, Entamoeba invadens
KVKVYLRTGENGNVNIK

SEQ ID NO: 2950494 - protein, 23 aa, Entamoeba invadens
KVKYGESDFVLMFWNPNQPLEQW

SEQ ID NO: 2950495 - protein, 18 aa, Entamoeba invadens
KVKYLGRRAFYYCKSLKE

SEQ ID NO: 2950496 - protein, 21 aa, Entamoeba invadens
KVLAVKLSRSIGVAKTIAFLQ

SEQ ID NO: 2950497 - protein, 22 aa, Entamoeba invadens
KVLDCPMVKAPFGVECLSTKSI

SEQ ID NO: 2950498 - protein, 24 aa, Entamoeba invadens
KVLEKCGMCAEDIDSLTKVLSTDR

SEQ ID NO: 2950499 - protein, 19 aa, Entamoeba invadens
KVLEMFPNFTNILQIDDHT

SEQ ID NO: 2950500 - protein, 23 aa, Entamoeba invadens
KVLERNCFKRCYSLDSIDLNNVE

SEQ ID NO: 2950501 - protein, 24 aa, Entamoeba invadens
KVLFTKRKVQVEGLTNGMGKAAFK

SEQ ID NO: 2950502 - protein, 26 aa, Entamoeba invadens
KVLKCVCPSCHRLYCHDDERLNSLKS

SEQ ID NO: 2950503 - protein, 17 aa, Entamoeba invadens
KVLLLKKDFDVELLCKF

SEQ ID NO: 2950504 - protein, 23 aa, Entamoeba invadens
KVLLSELYIEMCASNSTHLVYLS

SEQ ID NO: 2950505 - protein, 24 aa, Entamoeba invadens
KVLLYQFIICPILDDPTLIGYKQP

SEQ ID NO: 2950506 - protein, 19 aa, Entamoeba invadens
KVLNLELIENAKLNETLPK

SEQ ID NO: 2950507 - protein, 17 aa, Entamoeba invadens
KVLPFLHTILVQKSPLE

SEQ ID NO: 2950508 - protein, 22 aa, Entamoeba invadens
KVLPSFWCVFIQSGKTNVCELH

SEQ ID NO: 2950509 - protein, 26 aa, Entamoeba invadens
KVLQSLKGECKFTFKTLQELNVKKAE

SEQ ID NO: 2950510 - protein, 17 aa, Entamoeba invadens
KVLRILLKKSVATEIRV

SEQ ID NO: 2950511 - protein, 20 aa, Entamoeba invadens
KVLRREIGCEVIFTCVEMTS

SEQ ID NO: 2950512 - protein, 20 aa, Entamoeba invadens
KVLSDFCFENCISLFSVKMF

SEQ ID NO: 2950513 - protein, 30 aa, Entamoeba invadens
KVLSRLDFDLSCGRYECTLIQKIFYEQCTV

SEQ ID NO: 2950514 - protein, 19 aa, Entamoeba invadens
KVLSYKGFALFTSTDDEFY

SEQ ID NO: 2950515 - protein, 21 aa, Entamoeba invadens
KVLSYPFKNFDAVFSTTSSSQ

SEQ ID NO: 2950516 - protein, 19 aa, Entamoeba invadens
KVLWTCLIKNVIRELKVSQ

SEQ ID NO: 2950517 - protein, 29 aa, Entamoeba invadens
KVMEFSRLKYLKLKWTTYFLNYNLECLEQ

SEQ ID NO: 2950518 - protein, 19 aa, Entamoeba invadens
KVMHSLDMIRSLSLQTPAE

SEQ ID NO: 2950519 - protein, 18 aa, Entamoeba invadens
KVMKEGCVIIGAENLIEK

SEQ ID NO: 2950520 - protein, 34 aa, Entamoeba invadens
KVMKKEVICVEPAIVKKSHMSRSLLESKDLSTIS

SEQ ID NO: 2950521 - protein, 20 aa, Entamoeba invadens
KVMQCKYVSWSNSMKENIQQ

SEQ ID NO: 2950522 - protein, 22 aa, Entamoeba invadens
KVMYPTRISLMRGNHESRQVTQ

SEQ ID NO: 2950523 - protein, 22 aa, Entamoeba invadens
KVNCTTTLFFARLGNVRKDELK

SEQ ID NO: 2950524 - protein, 26 aa, Entamoeba invadens
KVNEICLKNSFALREKWIAAKPERAN

SEQ ID NO: 2950525 - protein, 24 aa, Entamoeba invadens
KVNEIPFECLFQFTSNKVVVPSTV

SEQ ID NO: 2950526 - protein, 17 aa, Entamoeba invadens
KVNERFEGEMAKIMVKP

SEQ ID NO: 2950527 - protein, 26 aa, Entamoeba invadens
KVNERMKFGLIYTWNSWHANEKGRMV

SEQ ID NO: 2950528 - protein, 19 aa, Entamoeba invadens
KVNFFRVVIWYEVDYKTSV

SEQ ID NO: 2950529 - protein, 20 aa, Entamoeba invadens
KVNGNVIDWFLWSTGEKNKD

SEQ ID NO: 2950530 - protein, 24 aa, Entamoeba invadens
KVNLFVIYMMRGFAHGFYRKPTFH

SEQ ID NO: 2950531 - protein, 26 aa, Entamoeba invadens
KVNMVCPTCHKVLLVKNYEKHQETHT

SEQ ID NO: 2950532 - protein, 22 aa, Entamoeba invadens
KVNPRSIYLGYNFLFNFFPHLN

SEQ ID NO: 2950533 - protein, 23 aa, Entamoeba invadens
KVNPRSIYLGYNFLFNFFPHLNT

SEQ ID NO: 2950534 - protein, 27 aa, Entamoeba invadens
KVNPRSIYLGYNFLFNFFPRLNTLTGN

SEQ ID NO: 2950535 - protein, 18 aa, Entamoeba invadens
KVNPWFTLTQDIERFYDL

SEQ ID NO: 2950536 - protein, 18 aa, Entamoeba invadens
KVNRCVNQTISFIAETQQ

SEQ ID NO: 2950537 - protein, 17 aa, Entamoeba invadens
KVNTLGLSSRFKEDQQF

SEQ ID NO: 2950538 - protein, 17 aa, Entamoeba invadens
KVNVCGGLLKILQIGKC

SEQ ID NO: 2950539 - protein, 18 aa, Entamoeba invadens
KVNVNIIIRVYKGDTERY

SEQ ID NO: 2950540 - protein, 22 aa, Entamoeba invadens
KVNYERVVGLFCFLYDEIDISM

SEQ ID NO: 2950541 - protein, 19 aa, Entamoeba invadens
KVPCKYASRRLRDYQTSQQ

SEQ ID NO: 2950542 - protein, 20 aa, Entamoeba invadens
KVPEGWFQGFLIPILTGTTF

SEQ ID NO: 2950543 - protein, 19 aa, Entamoeba invadens
KVPIEKYIKDQFSEITKNK

SEQ ID NO: 2950544 - protein, 26 aa, Entamoeba invadens
KVPIRQALKSEKEWFTNHPIYGKIAD

SEQ ID NO: 2950545 - protein, 19 aa, Entamoeba invadens
KVPLFAGSFQCYFDVKNDQ

SEQ ID NO: 2950546 - protein, 25 aa, Entamoeba invadens
KVPQETYLKIAFCREDPFIQKGDVL

SEQ ID NO: 2950547 - protein, 18 aa, Entamoeba invadens
KVPRIICGTKADLPCVVD

SEQ ID NO: 2950548 - protein, 18 aa, Entamoeba invadens
KVPSLYSPPSYVGEYIIK

SEQ ID NO: 2950549 - protein, 30 aa, Entamoeba invadens
KVPTMLLYLYLPRPVNYFGQYKTILEQSTL

SEQ ID NO: 2950550 - protein, 25 aa, Entamoeba invadens
KVPVKKGMCDAVVFCLSLMGIDFPH

SEQ ID NO: 2950551 - protein, 25 aa, Entamoeba invadens
KVPVTVKGVLPWKDYILHQIQNKPN

SEQ ID NO: 2950552 - protein, 18 aa, Entamoeba invadens
KVQEKKLFNPLTGSFETL

SEQ ID NO: 2950553 - protein, 17 aa, Entamoeba invadens
KVQFSVLEGCDYYEIRS

SEQ ID NO: 2950554 - protein, 17 aa, Entamoeba invadens
KVQFSVMNGCDYYEIRT

SEQ ID NO: 2950555 - protein, 20 aa, Entamoeba invadens
KVQIVIDFDAIITRLKYDAI

SEQ ID NO: 2950556 - protein, 25 aa, Entamoeba invadens
KVQLGMKRAVLFFEKNRKTVVRYLG

SEQ ID NO: 2950557 - protein, 23 aa, Entamoeba invadens
KVQMGVSCLKLAGQDVSESIEKI

SEQ ID NO: 2950558 - protein, 25 aa, Entamoeba invadens
KVQQEDEVVLALRSILTARRVDTNG

SEQ ID NO: 2950559 - protein, 25 aa, Entamoeba invadens
KVQSKRISLDFIMNEYFLDLLCTLP

SEQ ID NO: 2950560 - protein, 25 aa, Entamoeba invadens
KVQSMFWRYLRMFLYLKYNIKTIVS

SEQ ID NO: 2950561 - protein, 22 aa, Entamoeba invadens
KVRDKLALDIVMDLISNKMNSI

SEQ ID NO: 2950562 - protein, 21 aa, Entamoeba invadens
KVREELACWKAVNTQLLSLLE

SEQ ID NO: 2950563 - protein, 22 aa, Entamoeba invadens
KVREFIQGAIYGGRCMTRDNKK

SEQ ID NO: 2950564 - protein, 26 aa, Entamoeba invadens
KVREKRGICLVNRLISMLSAFQAATN

SEQ ID NO: 2950565 - protein, 26 aa, Entamoeba invadens
KVREKRGICLVNRLISMLSAFQAATT

SEQ ID NO: 2950566 - protein, 20 aa, Entamoeba invadens
KVREQAICIIGRLTKYNPAF

SEQ ID NO: 2950567 - protein, 17 aa, Entamoeba invadens
KVREVMPSLSFSTKNIV

SEQ ID NO: 2950568 - protein, 19 aa, Entamoeba invadens
KVRKLREGSFGIVFKGTYR

SEQ ID NO: 2950569 - protein, 18 aa, Entamoeba invadens
KVRSGKLWSKCIDDAIVK

SEQ ID NO: 2950570 - protein, 21 aa, Entamoeba invadens
KVRVAVCRSMEKCVKLTGERL

SEQ ID NO: 2950571 - protein, 17 aa, Entamoeba invadens
KVRVCVISDTHLRHKKV

SEQ ID NO: 2950572 - protein, 17 aa, Entamoeba invadens
KVRVSYQNLLKCFVLNE

SEQ ID NO: 2950573 - protein, 31 aa, Entamoeba invadens
KVSEYACGLGVSFGNLFGFEAMTVAYSGLCE

SEQ ID NO: 2950574 - protein, 18 aa, Entamoeba invadens
KVSFILKALEEFTLFMAD

SEQ ID NO: 2950575 - protein, 25 aa, Entamoeba invadens
KVSFKRSGVVGVNLGRVKRMFVSLK

SEQ ID NO: 2950576 - protein, 18 aa, Entamoeba invadens
KVSGYQFEGELVRVCSES

SEQ ID NO: 2950577 - protein, 19 aa, Entamoeba invadens
KVSISLKHMCCVVCFATHK

SEQ ID NO: 2950578 - protein, 23 aa, Entamoeba invadens
KVSKCTEGIHYVELMIYITQLDG

SEQ ID NO: 2950579 - protein, 20 aa, Entamoeba invadens
KVSKTQSYPGLNCFKQGVKK

SEQ ID NO: 2950580 - protein, 27 aa, Entamoeba invadens
KVSMNYENHKYFGIVRMYGDVQLSQTK

SEQ ID NO: 2950581 - protein, 22 aa, Entamoeba invadens
KVSSLGFLLPHFINGVKTIVGV

SEQ ID NO: 2950582 - protein, 25 aa, Entamoeba invadens
KVSYFPRDLYDFAFEVIDTDDSGYL

SEQ ID NO: 2950583 - protein, 26 aa, Entamoeba invadens
KVSYKKVLSGLLWKPNGIVKGPLDVG

SEQ ID NO: 2950584 - protein, 23 aa, Entamoeba invadens
KVTCLSFNGYLFVGTEKSAVEFY

SEQ ID NO: 2950585 - protein, 25 aa, Entamoeba invadens
KVTIPELLKKLCLNVLQITNGKSTQ

SEQ ID NO: 2950586 - protein, 22 aa, Entamoeba invadens
KVTIPFELFWLFVDECNTSNSP

SEQ ID NO: 2950587 - protein, 26 aa, Entamoeba invadens
KVTIWNCTHFTYLNTICECISEVNLK

SEQ ID NO: 2950588 - protein, 20 aa, Entamoeba invadens
KVTKIGFKCFNKCKKLKKVV

SEQ ID NO: 2950589 - protein, 17 aa, Entamoeba invadens
KVTLIFENENILLLGNF

SEQ ID NO: 2950590 - protein, 24 aa, Entamoeba invadens
KVTPTELFFKHFMALIRKIVTENA

SEQ ID NO: 2950591 - protein, 23 aa, Entamoeba invadens
KVTREYFPKFSRNFTKEENEVKT

SEQ ID NO: 2950592 - protein, 20 aa, Entamoeba invadens
KVTRTLLLFDETFRGMKAYA

SEQ ID NO: 2950593 - protein, 18 aa, Entamoeba invadens
KVVAKGIVKRSELVKTPS

SEQ ID NO: 2950594 - protein, 18 aa, Entamoeba invadens
KVVCFDWNVYFSTEVAII

SEQ ID NO: 2950595 - protein, 26 aa, Entamoeba invadens
KVVCGKAACWMKTLLDKNSLEISEFR

SEQ ID NO: 2950596 - protein, 23 aa, Entamoeba invadens
KVVCTRSNFKRIMLFKENEITGG

SEQ ID NO: 2950597 - protein, 18 aa, Entamoeba invadens
KVVDEVSTIIALLNVPSV

SEQ ID NO: 2950598 - protein, 19 aa, Entamoeba invadens
KVVDFCVKSGLSVVELLSI

SEQ ID NO: 2950599 - protein, 24 aa, Entamoeba invadens
KVVDFRAGSVVKTYAAHEGTKMSC

SEQ ID NO: 2950600 - protein, 23 aa, Entamoeba invadens
KVVEGIVCPICYQTTKDVQTTKC

SEQ ID NO: 2950601 - protein, 25 aa, Entamoeba invadens
KVVELERELLLFSGVVTLQADDETL

SEQ ID NO: 2950602 - protein, 25 aa, Entamoeba invadens
KVVESKGRPSQSISTSSSFSSTLKN

SEQ ID NO: 2950603 - protein, 20 aa, Entamoeba invadens
KVVEVKYCYSVFKNGNIKRN

SEQ ID NO: 2950604 - protein, 19 aa, Entamoeba invadens
KVVEVLAIIIQTYVDSDAM

SEQ ID NO: 2950605 - protein, 19 aa, Entamoeba invadens
KVVFLKKRVKNYDYIIIAN

SEQ ID NO: 2950606 - protein, 25 aa, Entamoeba invadens
KVVGCSCAPLLPIIFVVFQVNNFLQ

SEQ ID NO: 2950607 - protein, 17 aa, Entamoeba invadens
KVVKGILFGVSSFTAPQ

SEQ ID NO: 2950608 - protein, 25 aa, Entamoeba invadens
KVVKKHCFNCCYNLSQIEFCHSITA

SEQ ID NO: 2950609 - protein, 20 aa, Entamoeba invadens
KVVKKKVEIVPQKKDDEDWG

SEQ ID NO: 2950610 - protein, 21 aa, Entamoeba invadens
KVVKKRCDSFALILSQEGVKL

SEQ ID NO: 2950611 - protein, 27 aa, Entamoeba invadens
KVVKPRGQNGFGFDGCFVPNGYDKTYA

SEQ ID NO: 2950612 - protein, 17 aa, Entamoeba invadens
KVVKRICENKAIEMEKC

SEQ ID NO: 2950613 - protein, 23 aa, Entamoeba invadens
KVVLCNRPLMCLISSSKTSGCVI

SEQ ID NO: 2950614 - protein, 17 aa, Entamoeba invadens
KVVLELKVQPNFILMNL

SEQ ID NO: 2950615 - protein, 21 aa, Entamoeba invadens
KVVLENCAFVVCNDGSSRQHI

SEQ ID NO: 2950616 - protein, 24 aa, Entamoeba invadens
KVVLHKKIYAKRVIDEEIVSYLFI

SEQ ID NO: 2950617 - protein, 28 aa, Entamoeba invadens
KVVLKKEFFKIIVWFNVDFETVDRNKSR

SEQ ID NO: 2950618 - protein, 28 aa, Entamoeba invadens
KVVLKKEFFRIIVWFSVNFKTVDRNKFR

SEQ ID NO: 2950619 - protein, 28 aa, Entamoeba invadens
KVVLKKEFFRTIVWFNVDFETVDRNKNR

SEQ ID NO: 2950620 - protein, 23 aa, Entamoeba invadens
KVVLKLLTLFPFENLDVSERTFL

SEQ ID NO: 2950621 - protein, 18 aa, Entamoeba invadens
KVVLKNCQKVDVVINNSA

SEQ ID NO: 2950622 - protein, 18 aa, Entamoeba invadens
KVVNHFEGIINFNNKVWI

SEQ ID NO: 2950623 - protein, 22 aa, Entamoeba invadens
KVVPISGLFYAIGHAPNVQFLN

SEQ ID NO: 2950624 - protein, 33 aa, Entamoeba invadens
KVVPVIIPPVRPHLRPQVKPVVPERRVEVPQQV

SEQ ID NO: 2950625 - protein, 25 aa, Entamoeba invadens
KVVQKLYELFSYHQVEFYKAIHRAF

SEQ ID NO: 2950626 - protein, 17 aa, Entamoeba invadens
KVVRGVDVLFAKKEGNW

SEQ ID NO: 2950627 - protein, 24 aa, Entamoeba invadens
KVVRRICSCFDMSPDFEQKVMVGE

SEQ ID NO: 2950628 - protein, 17 aa, Entamoeba invadens
KVVRRMYNLSVVHRQKD

SEQ ID NO: 2950629 - protein, 18 aa, Entamoeba invadens
KVVSSVIVLTEECRRIEE

SEQ ID NO: 2950630 - protein, 19 aa, Entamoeba invadens
KVVTSYIHFIVMYLDDLTK

SEQ ID NO: 2950631 - protein, 20 aa, Entamoeba invadens
KVVYNDVDYFFAFLNDTYSV

SEQ ID NO: 2950632 - protein, 23 aa, Entamoeba invadens
KVYALKGNWFFKIVSNGNKDDFA

SEQ ID NO: 2950633 - protein, 23 aa, Entamoeba invadens
KVYCSVKFEFDEPIINVGGVMNV

SEQ ID NO: 2950634 - protein, 24 aa, Entamoeba invadens
KVYCTKESLDFVRNCFNTNYSKIQ

SEQ ID NO: 2950635 - protein, 25 aa, Entamoeba invadens
KVYDKRTFYRLAEVYKAEGTKCTNV

SEQ ID NO: 2950636 - protein, 23 aa, Entamoeba invadens
KVYEVCSVPASLAFLHGNFVTQR

SEQ ID NO: 2950637 - protein, 20 aa, Entamoeba invadens
KVYIFGGAKLNFSEATVKLE

SEQ ID NO: 2950638 - protein, 22 aa, Entamoeba invadens
KVYIHKIYVAYKERKGGVVSVM

SEQ ID NO: 2950639 - protein, 26 aa, Entamoeba invadens
KVYINKVKVCFKRFEDYAKMYVGKES

SEQ ID NO: 2950640 - protein, 33 aa, Entamoeba invadens
KVYISKQLLCFINARPADMIILVGGGDKSPIKT

SEQ ID NO: 2950641 - protein, 22 aa, Entamoeba invadens
KVYKEQAIWMLNAMWPSTKSAK

SEQ ID NO: 2950642 - protein, 21 aa, Entamoeba invadens
KVYKFELEKYITFAQKGISVW

SEQ ID NO: 2950643 - protein, 17 aa, Entamoeba invadens
KVYKMMWTKNTPKKQKT

SEQ ID NO: 2950644 - protein, 25 aa, Entamoeba invadens
KVYLDAVFFPRVRKDIFPFYQEGWR

SEQ ID NO: 2950645 - protein, 32 aa, Entamoeba invadens
KVYNIPKCAFFVFCDECVFGFYSESQTLYLSP

SEQ ID NO: 2950646 - protein, 24 aa, Entamoeba invadens
KVYPELLNILPYTLRHEAHRFIGD

SEQ ID NO: 2950647 - protein, 23 aa, Entamoeba invadens
KVYRIPVLYAPQFDRVNRKEEMM

SEQ ID NO: 2950648 - protein, 19 aa, Entamoeba invadens
KVYSEYCSNFRHTTELLPL

SEQ ID NO: 2950649 - protein, 19 aa, Entamoeba invadens
KVYTCSNLEDQNCLKRVGE

SEQ ID NO: 2950650 - protein, 19 aa, Entamoeba invadens
KWAFRNCKSLKEITLPESL

SEQ ID NO: 2950651 - protein, 23 aa, Entamoeba invadens
KWANVQLSGAFIIKDVEKDLDNG

SEQ ID NO: 2950652 - protein, 17 aa, Entamoeba invadens
KWCDGLFEDKAKCKKAR

SEQ ID NO: 2950653 - protein, 22 aa, Entamoeba invadens
KWCKEMRSSIALNLKRLFLMIK

SEQ ID NO: 2950654 - protein, 17 aa, Entamoeba invadens
KWCKEVIHHCPTAKYMV

SEQ ID NO: 2950655 - protein, 17 aa, Entamoeba invadens
KWCKIENTIVCVYTNVE

SEQ ID NO: 2950656 - protein, 23 aa, Entamoeba invadens
KWEAIPTMELMPCVKEALHYDVI

SEQ ID NO: 2950657 - protein, 25 aa, Entamoeba invadens
KWECPKQVILTLLFRLADTNNSGKL

SEQ ID NO: 2950658 - protein, 21 aa, Entamoeba invadens
KWESPLLFINVFHSFQTLFNT

SEQ ID NO: 2950659 - protein, 27 aa, Entamoeba invadens
KWFEVPNECYGRIIPRTTLTIDHIPHS

SEQ ID NO: 2950660 - protein, 17 aa, Entamoeba invadens
KWFNEHYAYPYPSDEEK

SEQ ID NO: 2950661 - protein, 29 aa, Entamoeba invadens
KWGDVYLNKHFKFPWQIAEFVSDGNRVEQ

SEQ ID NO: 2950662 - protein, 18 aa, Entamoeba invadens
KWHFSCGCSLCEEDKKRY

SEQ ID NO: 2950663 - protein, 26 aa, Entamoeba invadens
KWHPEVVHFAPKVPIILVGTKLDTRN

SEQ ID NO: 2950664 - protein, 17 aa, Entamoeba invadens
KWISGFKGTRVVDEGEA

SEQ ID NO: 2950665 - protein, 23 aa, Entamoeba invadens
KWKIKADSPGVDWTVSLYSDKEK

SEQ ID NO: 2950666 - protein, 21 aa, Entamoeba invadens
KWKLKNCGDNLLFMSENVAPV

SEQ ID NO: 2950667 - protein, 26 aa, Entamoeba invadens
KWKVYKSRIPVVGALLLNEAMTHVIR

SEQ ID NO: 2950668 - protein, 17 aa, Entamoeba invadens
KWMCKKEDVSYVTKEKN

SEQ ID NO: 2950669 - protein, 19 aa, Entamoeba invadens
KWMEYEWENKIPIDTELTD

SEQ ID NO: 2950670 - protein, 19 aa, Entamoeba invadens
KWNEFLFNEFLPLNQLPQS

SEQ ID NO: 2950671 - protein, 18 aa, Entamoeba invadens
KWNHAVENCVKRATLASF

SEQ ID NO: 2950672 - protein, 20 aa, Entamoeba invadens
KWNNDGVIFLTTFENGTVEL

SEQ ID NO: 2950673 - protein, 21 aa, Entamoeba invadens
KWPENSLIAIGGFLFLRFINP

SEQ ID NO: 2950674 - protein, 24 aa, Entamoeba invadens
KWSELKELFIRDVDESIIYTNDVI

SEQ ID NO: 2950675 - protein, 22 aa, Entamoeba invadens
KWSELKEVLKKEVDEEICYTDD

SEQ ID NO: 2950676 - protein, 23 aa, Entamoeba invadens
KWSETKFKNVVNFAESVIKSSGV

SEQ ID NO: 2950677 - protein, 22 aa, Entamoeba invadens
KWSIPQTTDFVFSLKNLFNKPP

SEQ ID NO: 2950678 - protein, 19 aa, Entamoeba invadens
KWTASEVQQLLTLSKGNMY

SEQ ID NO: 2950679 - protein, 25 aa, Entamoeba invadens
KWTEISRLLPGRSPNSIKNRFFSYL

SEQ ID NO: 2950680 - protein, 20 aa, Entamoeba invadens
KWTGKFPGMLAGEYCRHQKY

SEQ ID NO: 2950681 - protein, 28 aa, Entamoeba invadens
KWTLHFSARLPFSFKYYIAYLNKVIAIV

SEQ ID NO: 2950682 - protein, 30 aa, Entamoeba invadens
KWVPEEKIVLFKAICLLCSDISSRSDVNLM

SEQ ID NO: 2950683 - protein, 17 aa, Entamoeba invadens
KWWADGKSHAELDIIPM

SEQ ID NO: 2950684 - protein, 24 aa, Entamoeba invadens
KWWDDIWLNEGFASYVGTLFGVST

SEQ ID NO: 2950685 - protein, 39 aa, Entamoeba invadens
KWYCLPRLIFISLRWKLEMWDCIKEVIIYCTKHIGEDVS

SEQ ID NO: 2950686 - protein, 26 aa, Entamoeba invadens
KYAALVFVGPVWCWDLCAPLKNACKE

SEQ ID NO: 2950687 - protein, 18 aa, Entamoeba invadens
KYAEWKTWLRPEITTEVS

SEQ ID NO: 2950688 - protein, 20 aa, Entamoeba invadens
KYAIKVLIVSGTVNMEDVKG

SEQ ID NO: 2950689 - protein, 25 aa, Entamoeba invadens
KYAIYKRLVGKPVSLLRERDDILKI

SEQ ID NO: 2950690 - protein, 21 aa, Entamoeba invadens
KYAKDLNRFFSYTKKRPNFKV

SEQ ID NO: 2950691 - protein, 25 aa, Entamoeba invadens
KYAPFVCLEPWFGRCDTEYFDKNFD

SEQ ID NO: 2950692 - protein, 25 aa, Entamoeba invadens
KYAQIKSLNYTSGKRGVFSIIKFSS

SEQ ID NO: 2950693 - protein, 26 aa, Entamoeba invadens
KYASYLRFLMERRLYKEKLESTDLLP

SEQ ID NO: 2950694 - protein, 20 aa, Entamoeba invadens
KYCFSMAVKCSREIKVKSCV

SEQ ID NO: 2950695 - protein, 19 aa, Entamoeba invadens
KYCGKRGAVCKNLSSSRAT

SEQ ID NO: 2950696 - protein, 19 aa, Entamoeba invadens
KYCHGVFDQLYRATIGVDF

SEQ ID NO: 2950697 - protein, 34 aa, Entamoeba invadens
KYCKEQRTKIVLTFLCLKELRSKDFYELDDNLKS

SEQ ID NO: 2950698 - protein, 19 aa, Entamoeba invadens
KYCLYNCYNLIAVSLPETL

SEQ ID NO: 2950699 - protein, 25 aa, Entamoeba invadens
KYCSNCIRVFTAWFTTRDDVFTNSS

SEQ ID NO: 2950700 - protein, 23 aa, Entamoeba invadens
KYCTEAFDYLGLAAIIDQKIFCI

SEQ ID NO: 2950701 - protein, 23 aa, Entamoeba invadens
KYDCSFIGGIICEDEGIYYNRVI

SEQ ID NO: 2950702 - protein, 19 aa, Entamoeba invadens
KYDEAFFKSMYQSKVDQYT

SEQ ID NO: 2950703 - protein, 17 aa, Entamoeba invadens
KYDFHFIGGCPVPKQHL

SEQ ID NO: 2950704 - protein, 19 aa, Entamoeba invadens
KYDLFPKCLGKYTNTVLLT

SEQ ID NO: 2950705 - protein, 23 aa, Entamoeba invadens
KYDVICLPGGLPGANYLAKDTLL

SEQ ID NO: 2950706 - protein, 22 aa, Entamoeba invadens
KYDYCLPLSLSQIADCKYSLIS

SEQ ID NO: 2950707 - protein, 26 aa, Entamoeba invadens
KYDYKCDLWSLGGLLYFLRTHVYPLS

SEQ ID NO: 2950708 - protein, 22 aa, Entamoeba invadens
KYEAPWTVYSVSWSNRLDKPRR

SEQ ID NO: 2950709 - protein, 18 aa, Entamoeba invadens
KYEEALGVFKKLETIEKS

SEQ ID NO: 2950710 - protein, 19 aa, Entamoeba invadens
KYEEWRVEQKKPKACVGMY

SEQ ID NO: 2950711 - protein, 22 aa, Entamoeba invadens
KYEKARVLGTRALQISMNAPVF

SEQ ID NO: 2950712 - protein, 18 aa, Entamoeba invadens
KYEKDIAEIIRFICSANT

SEQ ID NO: 2950713 - protein, 20 aa, Entamoeba invadens
KYEKDIAEITVKVETFEKNV

SEQ ID NO: 2950714 - protein, 20 aa, Entamoeba invadens
KYEKDIAEITVRAETLEKNV

SEQ ID NO: 2950715 - protein, 17 aa, Entamoeba invadens
KYEKIYELFSIHKNMAN

SEQ ID NO: 2950716 - protein, 24 aa, Entamoeba invadens
KYELPKTIKVCKIHIKGNISKNKE

SEQ ID NO: 2950717 - protein, 21 aa, Entamoeba invadens
KYEMQCIPCEVPLKKNKMCTF

SEQ ID NO: 2950718 - protein, 24 aa, Entamoeba invadens
KYEMSFPLAQFRRAVDVLFTQCIK

SEQ ID NO: 2950719 - protein, 19 aa, Entamoeba invadens
KYENLKDDFSFVFKDPKEM

SEQ ID NO: 2950720 - protein, 21 aa, Entamoeba invadens
KYEQSGGCIALFPQKVVIEMS

SEQ ID NO: 2950721 - protein, 21 aa, Entamoeba invadens
KYEQTCWRAFVKYIEDTQKII

SEQ ID NO: 2950722 - protein, 27 aa, Entamoeba invadens
KYERDAFELFQKRIVAFEITCINIEAR

SEQ ID NO: 2950723 - protein, 27 aa, Entamoeba invadens
KYEREAFELFQKRIVAFEITCINIEAR

SEQ ID NO: 2950724 - protein, 18 aa, Entamoeba invadens
KYERLLCQLIQKYLLYIA

SEQ ID NO: 2950725 - protein, 18 aa, Entamoeba invadens
KYERMLRNKKEFNDSQIH

SEQ ID NO: 2950726 - protein, 25 aa, Entamoeba invadens
KYERYPRYGYYISNFNFNIRNDTTK

SEQ ID NO: 2950727 - protein, 20 aa, Entamoeba invadens
KYFANICFSTYPVMNNQKFG

SEQ ID NO: 2950728 - protein, 23 aa, Entamoeba invadens
KYFAYRPVFEGGNLIDSSEHTLK

SEQ ID NO: 2950729 - protein, 19 aa, Entamoeba invadens
KYFCVHGNVTPGLTTIAAI

SEQ ID NO: 2950730 - protein, 17 aa, Entamoeba invadens
KYFESFFVIVSDPTSSH

SEQ ID NO: 2950731 - protein, 25 aa, Entamoeba invadens
KYFEVSAKSGFGLEELFTDLANNIA

SEQ ID NO: 2950732 - protein, 21 aa, Entamoeba invadens
KYFFDTVVVSYTFYLQMKAFG

SEQ ID NO: 2950733 - protein, 27 aa, Entamoeba invadens
KYFGIGYKAKYLWKTFYEVHCSPQTFK

SEQ ID NO: 2950734 - protein, 18 aa, Entamoeba invadens
KYFKRGYNTVKVIMKYAQ

SEQ ID NO: 2950735 - protein, 19 aa, Entamoeba invadens
KYFNFCYNGNYTFTDKNIG

SEQ ID NO: 2950736 - protein, 18 aa, Entamoeba invadens
KYFNMSRCVNDQNINFVV

SEQ ID NO: 2950737 - protein, 19 aa, Entamoeba invadens
KYFPHLQTIFLYTPDDEIF

SEQ ID NO: 2950738 - protein, 24 aa, Entamoeba invadens
KYFPICSTLKSIGRYCYSHMTSAE

SEQ ID NO: 2950739 - protein, 25 aa, Entamoeba invadens
KYFPKMKILHLWKKEDENFGNGFII

SEQ ID NO: 2950740 - protein, 23 aa, Entamoeba invadens
KYFPNVETFYLWNEGDEKFWKKL

SEQ ID NO: 2950741 - protein, 20 aa, Entamoeba invadens
KYFPRIETLYLYDQTDPFWF

SEQ ID NO: 2950742 - protein, 18 aa, Entamoeba invadens
KYFPSIETLNIWSESDET

SEQ ID NO: 2950743 - protein, 17 aa, Entamoeba invadens
KYFSYDTTHNFVFPTSI

SEQ ID NO: 2950744 - protein, 19 aa, Entamoeba invadens
KYFSYDTTHNFVFPTSITK

SEQ ID NO: 2950745 - protein, 20 aa, Entamoeba invadens
KYFTDKSVSVGKGYEVMDKC

SEQ ID NO: 2950746 - protein, 21 aa, Entamoeba invadens
KYFTKIRVVFNPAKVVYASGV

SEQ ID NO: 2950747 - protein, 24 aa, Entamoeba invadens
KYFVAFKSIVDWANDLLDYGTTYG

SEQ ID NO: 2950748 - protein, 23 aa, Entamoeba invadens
KYFYLVMEYCDFGNLESYLVQKE

SEQ ID NO: 2950749 - protein, 21 aa, Entamoeba invadens
KYGDPGFEFQEFVLNHIEPSK

SEQ ID NO: 2950750 - protein, 18 aa, Entamoeba invadens
KYGIFRMSMRHTEGGVMF

SEQ ID NO: 2950751 - protein, 34 aa, Entamoeba invadens
KYGKKMVPCYVCGEVGHAQKFCPVAAQQKAVKIA

SEQ ID NO: 2950752 - protein, 28 aa, Entamoeba invadens
KYGNSEMWKMCCELFDFLALSAVIDNHI

SEQ ID NO: 2950753 - protein, 26 aa, Entamoeba invadens
KYGSCPHGGYGLGVERLVMWMLGEDH

SEQ ID NO: 2950754 - protein, 27 aa, Entamoeba invadens
KYGSDGAVFKTNFPSADVIIFGPGLMG

SEQ ID NO: 2950755 - protein, 19 aa, Entamoeba invadens
KYGVEVLVLLYALKIQHPD

SEQ ID NO: 2950756 - protein, 17 aa, Entamoeba invadens
KYHAYCGDYVKSNTERV

SEQ ID NO: 2950757 - protein, 19 aa, Entamoeba invadens
KYHCGQTFLEKAYKVQYTE

SEQ ID NO: 2950758 - protein, 18 aa, Entamoeba invadens
KYHILVFYCKDFSTVCPK

SEQ ID NO: 2950759 - protein, 18 aa, Entamoeba invadens
KYHVNAFNKYMIVTYDDI

SEQ ID NO: 2950760 - protein, 27 aa, Entamoeba invadens
KYICDTVLYTIDYRVMGNIPKFELVLT

SEQ ID NO: 2950761 - protein, 30 aa, Entamoeba invadens
KYICNGPVTNCSKCQILIHTSNCNHYAYYI

SEQ ID NO: 2950762 - protein, 19 aa, Entamoeba invadens
KYIEFCINNGVKYYLEDDT

SEQ ID NO: 2950763 - protein, 21 aa, Entamoeba invadens
KYIERKFMRKSCNVNVINELT

SEQ ID NO: 2950764 - protein, 17 aa, Entamoeba invadens
KYIFKSSLNEIYFEKLE

SEQ ID NO: 2950765 - protein, 25 aa, Entamoeba invadens
KYIGIDLGFLRYLVEFIKHETVSSN

SEQ ID NO: 2950766 - protein, 27 aa, Entamoeba invadens
KYIHMNLEFSDVFWRKVDERIKKGKKS

SEQ ID NO: 2950767 - protein, 23 aa, Entamoeba invadens
KYIKDYRFFSFDFVTQTVCQSQS

SEQ ID NO: 2950768 - protein, 18 aa, Entamoeba invadens
KYIKILKIDGEVLLDKTA

SEQ ID NO: 2950769 - protein, 23 aa, Entamoeba invadens
KYIKLPSIIVLNSLRGYSIQTNY

SEQ ID NO: 2950770 - protein, 17 aa, Entamoeba invadens
KYIKVCDLDKLYDRIDL

SEQ ID NO: 2950771 - protein, 21 aa, Entamoeba invadens
KYILSPSVFNLCYLKSIEFVG

SEQ ID NO: 2950772 - protein, 20 aa, Entamoeba invadens
KYINCVFELSGVYVNCQIPL

SEQ ID NO: 2950773 - protein, 17 aa, Entamoeba invadens
KYIPCIYVVNKIDQMNK

SEQ ID NO: 2950774 - protein, 18 aa, Entamoeba invadens
KYIPCIYVVNKIDQMNKE

SEQ ID NO: 2950775 - protein, 23 aa, Entamoeba invadens
KYIPLCQKALILFEKGIVSYNSP

SEQ ID NO: 2950776 - protein, 19 aa, Entamoeba invadens
KYIPNSCFFKCGNLIEIEI

SEQ ID NO: 2950777 - protein, 19 aa, Entamoeba invadens
KYIRAWPGGMGSYKFSGNY

SEQ ID NO: 2950778 - protein, 19 aa, Entamoeba invadens
KYITFAQKGISVWTNGISE

SEQ ID NO: 2950779 - protein, 18 aa, Entamoeba invadens
KYKEFTVLNNFWTKQHVF

SEQ ID NO: 2950780 - protein, 22 aa, Entamoeba invadens
KYKGNMLKFHFNPIPLTPEILP

SEQ ID NO: 2950781 - protein, 17 aa, Entamoeba invadens
KYKKAADIFSFGITMYE

SEQ ID NO: 2950782 - protein, 23 aa, Entamoeba invadens
KYKKAADIYSFFITMLEIFIWEE

SEQ ID NO: 2950783 - protein, 20 aa, Entamoeba invadens
KYKKSCVALSLVLDNKLSPI

SEQ ID NO: 2950784 - protein, 32 aa, Entamoeba invadens
KYKLFKRTFTVFGRGRIDKVPFKKANYPRRVE

SEQ ID NO: 2950785 - protein, 17 aa, Entamoeba invadens
KYKLIKKYLRFDDGAYL

SEQ ID NO: 2950786 - protein, 23 aa, Entamoeba invadens
KYKNGLNYFTFFFTQFVAKTDTA

SEQ ID NO: 2950787 - protein, 19 aa, Entamoeba invadens
KYKPLLFDTFGDYLVYACD

SEQ ID NO: 2950788 - protein, 17 aa, Entamoeba invadens
KYKPLSIDVPRFKEDTP

SEQ ID NO: 2950789 - protein, 19 aa, Entamoeba invadens
KYKQLGIKFPEMSPVKGVN

SEQ ID NO: 2950790 - protein, 17 aa, Entamoeba invadens
KYKTLRLNIAMTVTTAL

SEQ ID NO: 2950791 - protein, 18 aa, Entamoeba invadens
KYKTYEWLFWDVSGAAKF

SEQ ID NO: 2950792 - protein, 20 aa, Entamoeba invadens
KYLAEGNEGPGLTKVFYTGV

SEQ ID NO: 2950793 - protein, 18 aa, Entamoeba invadens
KYLCLLASSLSSERLFSE

SEQ ID NO: 2950794 - protein, 17 aa, Entamoeba invadens
KYLDLIGYVVRVTEIPR

SEQ ID NO: 2950795 - protein, 26 aa, Entamoeba invadens
KYLEKGELVAGCIKKVIFERQSLSDQ

SEQ ID NO: 2950796 - protein, 19 aa, Entamoeba invadens
KYLFCGTPAKTGVEIIGLN

SEQ ID NO: 2950797 - protein, 17 aa, Entamoeba invadens
KYLGFKKYTYERLDGSV

SEQ ID NO: 2950798 - protein, 17 aa, Entamoeba invadens
KYLHMILSGVGYLHANF

SEQ ID NO: 2950799 - protein, 18 aa, Entamoeba invadens
  misc_feature (18)..(18): Xaa can be any naturally occurring amino acid
KYLISGLYDIRVCEYKYX

SEQ ID NO: 2950800 - protein, 22 aa, Entamoeba invadens
KYLKIYKCPSISFEGIQNLEME

SEQ ID NO: 2950801 - protein, 17 aa, Entamoeba invadens
KYLKYADSLYRCKQLKR

SEQ ID NO: 2950802 - protein, 21 aa, Entamoeba invadens
KYLLDTYKKFVLDIIHSGVSF

SEQ ID NO: 2950803 - protein, 20 aa, Entamoeba invadens
KYLMKLLISLFQKFDNEKTI

SEQ ID NO: 2950804 - protein, 25 aa, Entamoeba invadens
KYLMYFCVSMLLSVKEEIMSTGFCG

SEQ ID NO: 2950805 - protein, 20 aa, Entamoeba invadens
KYLNEILYCYQNLVDYESMT

SEQ ID NO: 2950806 - protein, 25 aa, Entamoeba invadens
KYLPPNCYIFFLAINKKYCDASIEQ

SEQ ID NO: 2950807 - protein, 24 aa, Entamoeba invadens
KYLQTVYFPSTIVDFNLENISNST

SEQ ID NO: 2950808 - protein, 19 aa, Entamoeba invadens
KYLQTYRLGTNVLLVDCPG

SEQ ID NO: 2950809 - protein, 23 aa, Entamoeba invadens
KYLRAKMCFPEDAVPFTLREPVA

SEQ ID NO: 2950810 - protein, 22 aa, Entamoeba invadens
KYLRLLEKKGFFKTTSEEERAE

SEQ ID NO: 2950811 - protein, 17 aa, Entamoeba invadens
KYLRLYKTNPYYFMSGT

SEQ ID NO: 2950812 - protein, 26 aa, Entamoeba invadens
KYLRPHLDTLKAFHAMLPFGETSKLL

SEQ ID NO: 2950813 - protein, 30 aa, Entamoeba invadens
KYLSSDLRLVLKIKPAIFPMEYPSSEESFM

SEQ ID NO: 2950814 - protein, 24 aa, Entamoeba invadens
KYLTEKYKALRIINEDKRKLLENL

SEQ ID NO: 2950815 - protein, 22 aa, Entamoeba invadens
KYLYKQLCSQREKAFYEEIVSL

SEQ ID NO: 2950816 - protein, 18 aa, Entamoeba invadens
KYMAHLYGAMFITNKVCV

SEQ ID NO: 2950817 - protein, 18 aa, Entamoeba invadens
KYMRNNLGLLFSKVVTVL

SEQ ID NO: 2950818 - protein, 19 aa, Entamoeba invadens
KYNCLFPLLYKNSSIVIIV

SEQ ID NO: 2950819 - protein, 18 aa, Entamoeba invadens
KYNFKFIGTIPIEPKVCM

SEQ ID NO: 2950820 - protein, 30 aa, Entamoeba invadens
KYNKLKAWRHSLPYKRVVISPFYSSINYIM

SEQ ID NO: 2950821 - protein, 17 aa, Entamoeba invadens
KYNLEMFLYRDSLMKGD

SEQ ID NO: 2950822 - protein, 26 aa, Entamoeba invadens
KYNLKPCLQVGFPGLIELGKINDLML

SEQ ID NO: 2950823 - protein, 28 aa, Entamoeba invadens
KYNLLLRKMKFDYLDEISKVKTKRFRNE

SEQ ID NO: 2950824 - protein, 25 aa, Entamoeba invadens
KYNLRQMCLPDFVGIKKCAFVSMKV

SEQ ID NO: 2950825 - protein, 18 aa, Entamoeba invadens
KYNMRMIGPNCLGIINPR

SEQ ID NO: 2950826 - protein, 20 aa, Entamoeba invadens
KYNPAFVMPSYRITIINLLT

SEQ ID NO: 2950827 - protein, 18 aa, Entamoeba invadens
KYNPILHKVIYHEIVDLD

SEQ ID NO: 2950828 - protein, 20 aa, Entamoeba invadens
KYNPPYLEQDVFAFDEQMDG

SEQ ID NO: 2950829 - protein, 20 aa, Entamoeba invadens
KYNTEIILLWGNPKNMDFSI

SEQ ID NO: 2950830 - protein, 19 aa, Entamoeba invadens
KYNTFGISYSCRINSTFER

SEQ ID NO: 2950831 - protein, 24 aa, Entamoeba invadens
KYPEKIPFRLTRMMVNAMEVSGIE

SEQ ID NO: 2950832 - protein, 19 aa, Entamoeba invadens
KYPEWLKEEEILLKVGDEG

SEQ ID NO: 2950833 - protein, 25 aa, Entamoeba invadens
KYPHCPCTQSNCVVQFSGDVFNLQN

SEQ ID NO: 2950834 - protein, 25 aa, Entamoeba invadens
KYPHLPFFFHCRSAWEDFKTICEEI

SEQ ID NO: 2950835 - protein, 19 aa, Entamoeba invadens
KYPMSSAGMVFKRFGKEIV

SEQ ID NO: 2950836 - protein, 20 aa, Entamoeba invadens
KYPNLQILKVLFREVREVKK

SEQ ID NO: 2950837 - protein, 17 aa, Entamoeba invadens
KYPNYLFDIVYKGDTTP

SEQ ID NO: 2950838 - protein, 25 aa, Entamoeba invadens
KYPQFTALKVAWDFVELPSQIMENW

SEQ ID NO: 2950839 - protein, 17 aa, Entamoeba invadens
KYPRILFRRSDRTRQSE

SEQ ID NO: 2950840 - protein, 25 aa, Entamoeba invadens
KYPSLLEFWSSVPLEEYLSDFTILK

SEQ ID NO: 2950841 - protein, 20 aa, Entamoeba invadens
KYPTDFEFKENLLVDLAVES

SEQ ID NO: 2950842 - protein, 19 aa, Entamoeba invadens
KYPTNTWVPVMHTVLDLLY

SEQ ID NO: 2950843 - protein, 21 aa, Entamoeba invadens
KYPVDGVVVLKAFGKSSKESV

SEQ ID NO: 2950844 - protein, 28 aa, Entamoeba invadens
KYQALSRGCAQLAFYLKALAANSSVVLR

SEQ ID NO: 2950845 - protein, 25 aa, Entamoeba invadens
KYQCLCWCSSLSHLTIPTGVTSLGE

SEQ ID NO: 2950846 - protein, 24 aa, Entamoeba invadens
KYQDKRWFDQNAFESIMAGKKVEP

SEQ ID NO: 2950847 - protein, 20 aa, Entamoeba invadens
KYQIFCFKDKNYLFYDSKNK

SEQ ID NO: 2950848 - protein, 26 aa, Entamoeba invadens
KYQPPNVECLWVFEGDVVTVYDITDD

SEQ ID NO: 2950849 - protein, 18 aa, Entamoeba invadens
KYQQRVVLFVLDEENYDQ

SEQ ID NO: 2950850 - protein, 20 aa, Entamoeba invadens
KYQSIFGLDVLPEFQHRGLA

SEQ ID NO: 2950851 - protein, 25 aa, Entamoeba invadens
KYRAKGRFPVLSWVGPKNQCLVRSS

SEQ ID NO: 2950852 - protein, 30 aa, Entamoeba invadens
KYREEISQLKSKRLTNFFWSKDNGEKAEAE

SEQ ID NO: 2950853 - protein, 27 aa, Entamoeba invadens
KYREVHPEMTWQAFCKDKSLIRPQRVV

SEQ ID NO: 2950854 - protein, 21 aa, Entamoeba invadens
KYRHWQLAHRRVISFVDFLKT

SEQ ID NO: 2950855 - protein, 21 aa, Entamoeba invadens
KYRLKEMFSDFKLVNSCWLVT

SEQ ID NO: 2950856 - protein, 26 aa, Entamoeba invadens
KYRNQSGIVYCLSRKNTKDVCDQLVA

SEQ ID NO: 2950857 - protein, 26 aa, Entamoeba invadens
KYRRMPGAKKWKDWSEMNYGKLVGKI

SEQ ID NO: 2950858 - protein, 19 aa, Entamoeba invadens
KYRSCSYSPKGGSSNSSCD

SEQ ID NO: 2950859 - protein, 20 aa, Entamoeba invadens
KYRSLFNYTKEDLIENTQVK

SEQ ID NO: 2950860 - protein, 17 aa, Entamoeba invadens
KYSHVGSLAVVRAAMAT

SEQ ID NO: 2950861 - protein, 30 aa, Entamoeba invadens
KYSIHLLLKLSDAMILRFAIPSRKMTKEDL

SEQ ID NO: 2950862 - protein, 19 aa, Entamoeba invadens
KYSIHLLVKLGDAMILSDD

SEQ ID NO: 2950863 - protein, 23 aa, Entamoeba invadens
KYSIKLTHWPVIFEEAKKFIEWE

SEQ ID NO: 2950864 - protein, 18 aa, Entamoeba invadens
KYSKGCFEETPLCMYSKK

SEQ ID NO: 2950865 - protein, 17 aa, Entamoeba invadens
KYSKRYSSVEFLRRRAI

SEQ ID NO: 2950866 - protein, 24 aa, Entamoeba invadens
KYSLDGYDEFEWVKFHPQGHVVIA

SEQ ID NO: 2950867 - protein, 17 aa, Entamoeba invadens
KYSLISQSMCVECLDSF

SEQ ID NO: 2950868 - protein, 20 aa, Entamoeba invadens
KYSMSCLCFMKVVDFSIKKT

SEQ ID NO: 2950869 - protein, 21 aa, Entamoeba invadens
KYSPFQICRDKSCGTADAEKE

SEQ ID NO: 2950870 - protein, 18 aa, Entamoeba invadens
KYSQLFYFDSFMLNQKAI

SEQ ID NO: 2950871 - protein, 23 aa, Entamoeba invadens
KYSRPSKYLLYQILKVTFYDYPL

SEQ ID NO: 2950872 - protein, 24 aa, Entamoeba invadens
KYSTTLQCFSHFSFFVSSKQFVVT

SEQ ID NO: 2950873 - protein, 28 aa, Entamoeba invadens
KYSYGMIVWEIILRLITGEHVIPYYSDE

SEQ ID NO: 2950874 - protein, 17 aa, Entamoeba invadens
KYTCGVYEEEFRKEKSL

SEQ ID NO: 2950875 - protein, 18 aa, Entamoeba invadens
KYTCKYCGNHYDDVDTFQ

SEQ ID NO: 2950876 - protein, 20 aa, Entamoeba invadens
KYTFKGDVVLYCIDMNSIDC

SEQ ID NO: 2950877 - protein, 18 aa, Entamoeba invadens
KYTFKGDVVLYYIDMNSI

SEQ ID NO: 2950878 - protein, 17 aa, Entamoeba invadens
KYTGFTYYTTILDSASN

SEQ ID NO: 2950879 - protein, 25 aa, Entamoeba invadens
KYTHLCDIWSLGVTVFVSMCGYYPF

SEQ ID NO: 2950880 - protein, 25 aa, Entamoeba invadens
KYTIKFKLAVIIAKWEIDNDLDELY

SEQ ID NO: 2950881 - protein, 25 aa, Entamoeba invadens
KYTKRLCLQKCRIKVFGDKVNLKTL

SEQ ID NO: 2950882 - protein, 17 aa, Entamoeba invadens
KYTPYCQYTVFDCLEII

SEQ ID NO: 2950883 - protein, 17 aa, Entamoeba invadens
KYTPYCQYTVFDCLEVL

SEQ ID NO: 2950884 - protein, 19 aa, Entamoeba invadens
KYTREEFDDVCARLRKCIP

SEQ ID NO: 2950885 - protein, 23 aa, Entamoeba invadens
KYTTLMYMSFLFSGMIYNNNNCF

SEQ ID NO: 2950886 - protein, 17 aa, Entamoeba invadens
KYTTLPIHDIISKRVIL

SEQ ID NO: 2950887 - protein, 21 aa, Entamoeba invadens
KYTTSLGNFFLCHGGISPNLV

SEQ ID NO: 2950888 - protein, 18 aa, Entamoeba invadens
KYTWKSKIKKSYEFIKPE

SEQ ID NO: 2950889 - protein, 25 aa, Entamoeba invadens
KYVDKPDECDFVFSIQRHGKVVNKM

SEQ ID NO: 2950890 - protein, 20 aa, Entamoeba invadens
KYVECYLINDMLWLVTELMD

SEQ ID NO: 2950891 - protein, 24 aa, Entamoeba invadens
KYVGELPLLNSLKMKFCPFCDIKN

SEQ ID NO: 2950892 - protein, 17 aa, Entamoeba invadens
KYVKALFTLASKLSPCV

SEQ ID NO: 2950893 - protein, 19 aa, Entamoeba invadens
KYVKDCDLLICIGTSLVVE

SEQ ID NO: 2950894 - protein, 23 aa, Entamoeba invadens
KYVKDDKDFFVFSLKSPSGSEAT

SEQ ID NO: 2950895 - protein, 19 aa, Entamoeba invadens
KYVLDRIRMNPIQITPKTK

SEQ ID NO: 2950896 - protein, 18 aa, Entamoeba invadens
KYVNYAFIRFSRFLGNCI

SEQ ID NO: 2950897 - protein, 24 aa, Entamoeba invadens
KYVPENVCLLCLKNNANIAMFPCG

SEQ ID NO: 2950898 - protein, 28 aa, Entamoeba invadens
KYVRGWDDPRMPTIMGFKRKGYSANAIN

SEQ ID NO: 2950899 - protein, 17 aa, Entamoeba invadens
KYVRYFEVKAGYGDFSV

SEQ ID NO: 2950900 - protein, 18 aa, Entamoeba invadens
KYVRYFEVKAGYGDFSVG

SEQ ID NO: 2950901 - protein, 26 aa, Entamoeba invadens
KYVTLPCKPIKLGENCFELCSRLDVV

SEQ ID NO: 2950902 - protein, 17 aa, Entamoeba invadens
KYVTRPRVCCVSESKKL

SEQ ID NO: 2950903 - protein, 17 aa, Entamoeba invadens
KYVTRPRVCCVSESKRL

SEQ ID NO: 2950904 - protein, 18 aa, Entamoeba invadens
KYVTRPRVCCVSESKRLL

SEQ ID NO: 2950905 - protein, 24 aa, Entamoeba invadens
KYVTSIGNYCFKDCTSLSSINIPI

SEQ ID NO: 2950906 - protein, 24 aa, Entamoeba invadens
KYYESKREAWALAEDYAFPGAVQY

SEQ ID NO: 2950907 - protein, 20 aa, Entamoeba invadens
KYYGECPFFPKHPPENITQV

SEQ ID NO: 2950908 - protein, 31 aa, Entamoeba invadens
KYYHLAKQYGYRARSAFKLIQMNKRYDFLGS

SEQ ID NO: 2950909 - protein, 19 aa, Entamoeba invadens
KYYIKELSEYLVFDKRISD

SEQ ID NO: 2950910 - protein, 22 aa, Entamoeba invadens
KYYISLKELKLSGVDLKTLDGE

SEQ ID NO: 2950911 - protein, 19 aa, Entamoeba invadens
KYYKNSYLLDNQCKNYDNN

SEQ ID NO: 2950912 - protein, 20 aa, Entamoeba invadens
KYYNIEGVIIDGFTDEQIYY

SEQ ID NO: 2950913 - protein, 19 aa, Entamoeba invadens
KYYPFVAGYIALYSNDMAE

SEQ ID NO: 2950914 - protein, 27 aa, Entamoeba invadens
KYYYQGCKGWGWFFPHNYAPFITDMAK

SEQ ID NO: 2950915 - protein, 20 aa, Entamoeba invadens
LAACHKVGILHLDMKPSNIF

SEQ ID NO: 2950916 - protein, 21 aa, Entamoeba invadens
LAADGWQMWNTIRKVIGYNTN

SEQ ID NO: 2950917 - protein, 36 aa, Entamoeba invadens
LAAELKAYCYMECSALKRTGLKDIFDQAVRFTLKQR

SEQ ID NO: 2950918 - protein, 19 aa, Entamoeba invadens
LAAKLKFGENEIVAKPRSE

SEQ ID NO: 2950919 - protein, 17 aa, Entamoeba invadens
LAAKSCRMSIISDEYTL

SEQ ID NO: 2950920 - protein, 19 aa, Entamoeba invadens
LAARLASFYERAGMVECIG

SEQ ID NO: 2950921 - protein, 24 aa, Entamoeba invadens
LAATLGIDISFQFDDMYRRSRRLI

SEQ ID NO: 2950922 - protein, 27 aa, Entamoeba invadens
LACALIKKYIREISEPIWPVELYDQLI

SEQ ID NO: 2950923 - protein, 21 aa, Entamoeba invadens
LACILLRQVLMYSQLDPSQVA

SEQ ID NO: 2950924 - protein, 17 aa, Entamoeba invadens
LADAGAIGTSIAKLKAK

SEQ ID NO: 2950925 - protein, 24 aa, Entamoeba invadens
LADDELWEKRGLVVPRRTSVALSI

SEQ ID NO: 2950926 - protein, 19 aa, Entamoeba invadens
LADDWKILFYETSAKNKIN

SEQ ID NO: 2950927 - protein, 18 aa, Entamoeba invadens
LADEWGSLFFEVSGKHNI

SEQ ID NO: 2950928 - protein, 17 aa, Entamoeba invadens
LADGIIFAQLLNYLQSG

SEQ ID NO: 2950929 - protein, 21 aa, Entamoeba invadens
LADIKCLKHVLMAIENYKNCW

SEQ ID NO: 2950930 - protein, 23 aa, Entamoeba invadens
LADIYDGLVKMISTLAQYSKALP

SEQ ID NO: 2950931 - protein, 22 aa, Entamoeba invadens
LADLKEKLCYVAQNYEEEKKKD

SEQ ID NO: 2950932 - protein, 20 aa, Entamoeba invadens
LADLKLSVMGHEFPQSTKNV

SEQ ID NO: 2950933 - protein, 17 aa, Entamoeba invadens
LADLVAFMATCKRFYLI

SEQ ID NO: 2950934 - protein, 23 aa, Entamoeba invadens
LADPDTVQMLFAIITEQVQAGNI

SEQ ID NO: 2950935 - protein, 22 aa, Entamoeba invadens
LADPQLLMKMRFYMLEMDIPRL

SEQ ID NO: 2950936 - protein, 31 aa, Entamoeba invadens
LADRCELYKCKDCKKLIAFSAMTGTVKSSVV

SEQ ID NO: 2950937 - protein, 17 aa, Entamoeba invadens
LADSVFLNAFSYAVQSI

SEQ ID NO: 2950938 - protein, 17 aa, Entamoeba invadens
LADTDILKAKRNVPEDL

SEQ ID NO: 2950939 - protein, 24 aa, Entamoeba invadens
LADTIIMLYVKWRHSATAYSKLYD

SEQ ID NO: 2950940 - protein, 25 aa, Entamoeba invadens
LAEELSLTCLVKFWEVKGHIIKMLI

SEQ ID NO: 2950941 - protein, 17 aa, Entamoeba invadens
LAEEVLFSFNEQSAMLV

SEQ ID NO: 2950942 - protein, 17 aa, Entamoeba invadens
LAEEWRVSFYETSAKNK

SEQ ID NO: 2950943 - protein, 34 aa, Entamoeba invadens
LAEGMLMKMGEMFGGEILYNFVMHHIGETWTSQY

SEQ ID NO: 2950944 - protein, 25 aa, Entamoeba invadens
LAEHLKRTGGIFVTRFPPEPNGYLH

SEQ ID NO: 2950945 - protein, 18 aa, Entamoeba invadens
LAEIFKCGVNELPLHIIL

SEQ ID NO: 2950946 - protein, 34 aa, Entamoeba invadens
LAEKAWKNKAMKWKKKRQIGSTVMTLILLKERAN

SEQ ID NO: 2950947 - protein, 19 aa, Entamoeba invadens
LAELSLFMLDGMKSVELPT

SEQ ID NO: 2950948 - protein, 23 aa, Entamoeba invadens
LAERKSFRLSKGHDVTLELQNLP

SEQ ID NO: 2950949 - protein, 21 aa, Entamoeba invadens
LAERRRIWARKKVGKLELQEE

SEQ ID NO: 2950950 - protein, 18 aa, Entamoeba invadens
LAESEVMLKSLLKRLEDV

SEQ ID NO: 2950951 - protein, 17 aa, Entamoeba invadens
LAESSFQFLKLVIEKTQ

SEQ ID NO: 2950952 - protein, 21 aa, Entamoeba invadens
LAETLGAYVLKEKREHSPQFL

SEQ ID NO: 2950953 - protein, 24 aa, Entamoeba invadens
LAEVVRLAPPLSIILVKQGTYDES

SEQ ID NO: 2950954 - protein, 20 aa, Entamoeba invadens
LAFCSSCKNVIAPFTHFFVC

SEQ ID NO: 2950955 - protein, 24 aa, Entamoeba invadens
LAFDLKTGRKYAIKIVDKQLFSNV

SEQ ID NO: 2950956 - protein, 19 aa, Entamoeba invadens
LAFEQRKLIETAWEQHQHI

SEQ ID NO: 2950957 - protein, 18 aa, Entamoeba invadens
LAFESCGLTKIEIPSTVK

SEQ ID NO: 2950958 - protein, 19 aa, Entamoeba invadens
LAFFTKFFEENKCVGAESC

SEQ ID NO: 2950959 - protein, 19 aa, Entamoeba invadens
LAFKHCGYVGVPVGKNVRT

SEQ ID NO: 2950960 - protein, 17 aa, Entamoeba invadens
LAFSECLTTVGVKEGDV

SEQ ID NO: 2950961 - protein, 17 aa, Entamoeba invadens
LAFSNDLLFVFSNVVNK

SEQ ID NO: 2950962 - protein, 19 aa, Entamoeba invadens
LAGEAELMRIGWLENEEQT

SEQ ID NO: 2950963 - protein, 17 aa, Entamoeba invadens
LAGEQGMVKGLKDKLNK

SEQ ID NO: 2950964 - protein, 21 aa, Entamoeba invadens
LAGGAKIFSVFETQFRPNIDS

SEQ ID NO: 2950965 - protein, 19 aa, Entamoeba invadens
LAGYNLRLTQRRDKIAQKA

SEQ ID NO: 2950966 - protein, 18 aa, Entamoeba invadens
LAHRRVISFVDFLKTSSD

SEQ ID NO: 2950967 - protein, 18 aa, Entamoeba invadens
LAIECYNEAFELTPSNFE

SEQ ID NO: 2950968 - protein, 25 aa, Entamoeba invadens
LAIGWDILSRMYFKITNIIAKINVV

SEQ ID NO: 2950969 - protein, 17 aa, Entamoeba invadens
LAIIKSQHFDNGKNIFL

SEQ ID NO: 2950970 - protein, 19 aa, Entamoeba invadens
LAIIQRKSRHVKIAEDLDE

SEQ ID NO: 2950971 - protein, 17 aa, Entamoeba invadens
LAIKIVLPKEVLKIDNT

SEQ ID NO: 2950972 - protein, 20 aa, Entamoeba invadens
LAIPPVFKLLGKAAEEHCNE

SEQ ID NO: 2950973 - protein, 18 aa, Entamoeba invadens
LAIRCDQALVKKQTTQLL

SEQ ID NO: 2950974 - protein, 22 aa, Entamoeba invadens
LAIVKEILAIVGEVHETLCDQI

SEQ ID NO: 2950975 - protein, 25 aa, Entamoeba invadens
LAKARPKYRSPICCVLGHVDTGKTK

SEQ ID NO: 2950976 - protein, 28 aa, Entamoeba invadens
LAKDVCWHVRYVCAVNIGKCCDAFPGDA

SEQ ID NO: 2950977 - protein, 25 aa, Entamoeba invadens
LAKEIKASCYMECSALTRSGLNQVF

SEQ ID NO: 2950978 - protein, 21 aa, Entamoeba invadens
LAKFLNYDRDGLFLKMQTQLY

SEQ ID NO: 2950979 - protein, 17 aa, Entamoeba invadens
LAKGFDGNNHFVLCNEY

SEQ ID NO: 2950980 - protein, 19 aa, Entamoeba invadens
LAKGSLPWQGLKVQKGEDR

SEQ ID NO: 2950981 - protein, 18 aa, Entamoeba invadens
LAKIAVEVCDGVFIHSLV

SEQ ID NO: 2950982 - protein, 19 aa, Entamoeba invadens
LAKKFPEIRRKIKTDPGVP

SEQ ID NO: 2950983 - protein, 18 aa, Entamoeba invadens
LAKKLKIVDLVQADRYYV

SEQ ID NO: 2950984 - protein, 18 aa, Entamoeba invadens
LAKKYPLYMQMLTKETVN

SEQ ID NO: 2950985 - protein, 23 aa, Entamoeba invadens
LAKLTKRIEDGLNDSDMLKAQKA

SEQ ID NO: 2950986 - protein, 23 aa, Entamoeba invadens
LAKMLDWYSLLYSNYNMLITEDT

SEQ ID NO: 2950987 - protein, 56 aa, Entamoeba invadens
LAKNCMLCNLPFSLVTRRHHCRKCGKCVCANCSKGKITVSKKCGMERVCDRCLEKY

SEQ ID NO: 2950988 - protein, 17 aa, Entamoeba invadens
LAKNPFFEKTFSLQFGK

SEQ ID NO: 2950989 - protein, 27 aa, Entamoeba invadens
LAKPYNLPTMFMIPYSMNEIQQLVQAP

SEQ ID NO: 2950990 - protein, 20 aa, Entamoeba invadens
LAKQARLRKIEEDKKKTEEE

SEQ ID NO: 2950991 - protein, 19 aa, Entamoeba invadens
LAKSLKMEIGENYKDELTN

SEQ ID NO: 2950992 - protein, 28 aa, Entamoeba invadens
LAKSTLAWKGLRVTVRITVINRVATYEV

SEQ ID NO: 2950993 - protein, 21 aa, Entamoeba invadens
LAKVPCFIMKSSGFVEKESFP

SEQ ID NO: 2950994 - protein, 17 aa, Entamoeba invadens
LAKVVAIPKSLQKYREA

SEQ ID NO: 2950995 - protein, 25 aa, Entamoeba invadens
LALFLNRFQLAMSIDTTLSRSLRDQ

SEQ ID NO: 2950996 - protein, 18 aa, Entamoeba invadens
LALFPGADSREFWQRAED

SEQ ID NO: 2950997 - protein, 29 aa, Entamoeba invadens
LALHYAAAVGLPLEVLRAISSAYPQAVNK

SEQ ID NO: 2950998 - protein, 28 aa, Entamoeba invadens
LALHYCDRAGIVVLRVPSTFDLKRICRV

SEQ ID NO: 2950999 - protein, 17 aa, Entamoeba invadens
LALIRATPFTSVRILVE

SEQ ID NO: 2951000 - protein, 17 aa, Entamoeba invadens
LALKIVQTSCNITQSVS

SEQ ID NO: 2951001 - protein, 21 aa, Entamoeba invadens
LALKLLCNVVYGYTGAGFTGR

SEQ ID NO: 2951002 - protein, 22 aa, Entamoeba invadens
LALKNPHFYDGFFSVTKNNVEV

SEQ ID NO: 2951003 - protein, 22 aa, Entamoeba invadens
LALKVLPLIPTFLIDKRTDVRS

SEQ ID NO: 2951004 - protein, 21 aa, Entamoeba invadens
LALLEVKKFLLFRCVLENNLI

SEQ ID NO: 2951005 - protein, 25 aa, Entamoeba invadens
LALMKKIYAIFGFKTDIALSTRNEK

SEQ ID NO: 2951006 - protein, 25 aa, Entamoeba invadens
LALNRLQVLFWYGSPFNFDMIENVV

SEQ ID NO: 2951007 - protein, 18 aa, Entamoeba invadens
LALNWIMGGSTKYTRNDG

SEQ ID NO: 2951008 - protein, 19 aa, Entamoeba invadens
LALPSLRKVTAYIPSENEM

SEQ ID NO: 2951009 - protein, 17 aa, Entamoeba invadens
LALTTAEYFAYTCDMHV

SEQ ID NO: 2951010 - protein, 28 aa, Entamoeba invadens
LALVEGYDSMGFEFSRPLLRAETERQLK

SEQ ID NO: 2951011 - protein, 25 aa, Entamoeba invadens
LAMAYYTLFVKPVFEIHQKSSKNKD

SEQ ID NO: 2951012 - protein, 20 aa, Entamoeba invadens
LAMEAFVFDCVIKKLRTTIT

SEQ ID NO: 2951013 - protein, 22 aa, Entamoeba invadens
LAMGDGFLLYLAKWENGKINTT

SEQ ID NO: 2951014 - protein, 24 aa, Entamoeba invadens
LAMKTLDRLAGVPLRDQLDELPAA

SEQ ID NO: 2951015 - protein, 18 aa, Entamoeba invadens
LAMLDQIKKFGFGVPSLY

SEQ ID NO: 2951016 - protein, 23 aa, Entamoeba invadens
LANALKHKISFNVLALQKDSINK

SEQ ID NO: 2951017 - protein, 24 aa, Entamoeba invadens
LANFPTEGLLQFFIGTGNYYGTEH

SEQ ID NO: 2951018 - protein, 17 aa, Entamoeba invadens
LANKFIVGQGIDNLNGV

SEQ ID NO: 2951019 - protein, 18 aa, Entamoeba invadens
LANMTGVLFTPVPGTFEN

SEQ ID NO: 2951020 - protein, 27 aa, Entamoeba invadens
LAPAVLFFPYMQAVRFLADYLNGDTYY

SEQ ID NO: 2951021 - protein, 23 aa, Entamoeba invadens
LAPKLCKVAFDVMNAEFLLSTTF

SEQ ID NO: 2951022 - protein, 19 aa, Entamoeba invadens
LAPLIPMIIERLINTFQME

SEQ ID NO: 2951023 - protein, 19 aa, Entamoeba invadens
LAPLRSIEKLNVCGNRITT

SEQ ID NO: 2951024 - protein, 20 aa, Entamoeba invadens
LAQICFRDTYKAILSPTQME

SEQ ID NO: 2951025 - protein, 17 aa, Entamoeba invadens
LAQKVWVASKPKIEPSG

SEQ ID NO: 2951026 - protein, 22 aa, Entamoeba invadens
LAQRGSGIIPLHGNWYNDARDL

SEQ ID NO: 2951027 - protein, 26 aa, Entamoeba invadens
LARAPKRWILRNEIQLVRCDKSGSNN

SEQ ID NO: 2951028 - protein, 22 aa, Entamoeba invadens
LARASFKGGCTVDMKSCTLAYT

SEQ ID NO: 2951029 - protein, 21 aa, Entamoeba invadens
LARAVLKYNTKSYFKRKSIMK

SEQ ID NO: 2951030 - protein, 17 aa, Entamoeba invadens
LARFKENKIQLLVATDV

SEQ ID NO: 2951031 - protein, 17 aa, Entamoeba invadens
LARHEIFEISKEDGEIV

SEQ ID NO: 2951032 - protein, 23 aa, Entamoeba invadens
LARKEARCMIEYKVHHPDTLMSE

SEQ ID NO: 2951033 - protein, 18 aa, Entamoeba invadens
LARKRMLMTGGLMMELFK

SEQ ID NO: 2951034 - protein, 23 aa, Entamoeba invadens
LARNKPFFMKSFGKKDMKKEEER

SEQ ID NO: 2951035 - protein, 19 aa, Entamoeba invadens
LARRMCGIQPYWNDTVSYY

SEQ ID NO: 2951036 - protein, 17 aa, Entamoeba invadens
LASDAFHLITSVHGKRL

SEQ ID NO: 2951037 - protein, 19 aa, Entamoeba invadens
LASEKVAQFEADFGGTNIL

SEQ ID NO: 2951038 - protein, 18 aa, Entamoeba invadens
LASESGLNVFNLVFSLLS

SEQ ID NO: 2951039 - protein, 24 aa, Entamoeba invadens
LASFKDSITLFANFINKGGRPFMP

SEQ ID NO: 2951040 - protein, 20 aa, Entamoeba invadens
LASISEFVPIDFEQTETVLL

SEQ ID NO: 2951041 - protein, 19 aa, Entamoeba invadens
LASKILLDDYWCDIIKIGN

SEQ ID NO: 2951042 - protein, 18 aa, Entamoeba invadens
LASLCCSDSPNIRSYLIK

SEQ ID NO: 2951043 - protein, 19 aa, Entamoeba invadens
LASLIKCNILPVKRMLHPK

SEQ ID NO: 2951044 - protein, 18 aa, Entamoeba invadens
LASLLQSKMRAFLKRLVL

SEQ ID NO: 2951045 - protein, 18 aa, Entamoeba invadens
LASLPLPPLPFLKELDLS

SEQ ID NO: 2951046 - protein, 25 aa, Entamoeba invadens
LASPLLKRIFLIASRPDRQNDREEA

SEQ ID NO: 2951047 - protein, 17 aa, Entamoeba invadens
LASQLGVCLDNHVKYHM

SEQ ID NO: 2951048 - protein, 18 aa, Entamoeba invadens
LASTISFVSTFAETTHGA

SEQ ID NO: 2951049 - protein, 28 aa, Entamoeba invadens
LASVEFGCFKECFSLRELVFPESTVHFG

SEQ ID NO: 2951050 - protein, 22 aa, Entamoeba invadens
LASVEIRLAKILVEPFNQLLAS

SEQ ID NO: 2951051 - protein, 26 aa, Entamoeba invadens
LATDFKHRRLLIVSIDIHNSVSSVES

SEQ ID NO: 2951052 - protein, 17 aa, Entamoeba invadens
LATETLIVLPLGSHNFF

SEQ ID NO: 2951053 - protein, 18 aa, Entamoeba invadens
LATFEYPFSANKATIDYA

SEQ ID NO: 2951054 - protein, 25 aa, Entamoeba invadens
LATGAKHPVCLYVSGSNTQVIAFSL

SEQ ID NO: 2951055 - protein, 24 aa, Entamoeba invadens
LATHIKRTICIKCQNKIFESTSSV

SEQ ID NO: 2951056 - protein, 17 aa, Entamoeba invadens
LATLRLTTFKNCLSFHQ

SEQ ID NO: 2951057 - protein, 19 aa, Entamoeba invadens
LATRSVLKATWNGLGNGET

SEQ ID NO: 2951058 - protein, 17 aa, Entamoeba invadens
LATSFPCAEVFNCMIRK

SEQ ID NO: 2951059 - protein, 17 aa, Entamoeba invadens
LAVACGAQESFGYLTEL

SEQ ID NO: 2951060 - protein, 17 aa, Entamoeba invadens
LAVCIGLSVLVPDDCVD

SEQ ID NO: 2951061 - protein, 29 aa, Entamoeba invadens
LAVESLEIPRFVLGPNLKELEIRKSLFLI

SEQ ID NO: 2951062 - protein, 20 aa, Entamoeba invadens
LAVHLYRPFSAKHFLEQLPA

SEQ ID NO: 2951063 - protein, 24 aa, Entamoeba invadens
LAVKFPATHPGDFLLLRNVCENVL

SEQ ID NO: 2951064 - protein, 19 aa, Entamoeba invadens
LAVTILRIVYALPESSTFM

SEQ ID NO: 2951065 - protein, 17 aa, Entamoeba invadens
LAVTSWNTFPSFLRKHL

SEQ ID NO: 2951066 - protein, 17 aa, Entamoeba invadens
LAWKPETPNLFTTQFPS

SEQ ID NO: 2951067 - protein, 17 aa, Entamoeba invadens
LAYAYEFANTKMGIDKL

SEQ ID NO: 2951068 - protein, 23 aa, Entamoeba invadens
LAYCTRKKIDQCYYITEKLPEST

SEQ ID NO: 2951069 - protein, 17 aa, Entamoeba invadens
LAYKRPRAMSKDTDYPL

SEQ ID NO: 2951070 - protein, 17 aa, Entamoeba invadens
LAYNHPEVVAKWMPEIT

SEQ ID NO: 2951071 - protein, 17 aa, Entamoeba invadens
LAYRAPEMINLYDYKPI

SEQ ID NO: 2951072 - protein, 21 aa, Entamoeba invadens
LAYTCQALVKGISSKEFEKKK

SEQ ID NO: 2951073 - protein, 18 aa, Entamoeba invadens
LAYYRTGFAEGMKLKIIK

SEQ ID NO: 2951074 - protein, 19 aa, Entamoeba invadens
LCAARNPLVIFIQAENGDL

SEQ ID NO: 2951075 - protein, 18 aa, Entamoeba invadens
LCAEVNWEKKLIVTGSED

SEQ ID NO: 2951076 - protein, 25 aa, Entamoeba invadens
LCAGLPKEFASFLSYCKSLKYDEAP

SEQ ID NO: 2951077 - protein, 27 aa, Entamoeba invadens
LCAGLPLEFKTFLMYSRGLRFEEEPRY

SEQ ID NO: 2951078 - protein, 17 aa, Entamoeba invadens
LCALPGVGTKIASLILA

SEQ ID NO: 2951079 - protein, 19 aa, Entamoeba invadens
LCANFDVKALYVVNPECKI

SEQ ID NO: 2951080 - protein, 18 aa, Entamoeba invadens
LCASECQNHLIIKLPPLL

SEQ ID NO: 2951081 - protein, 17 aa, Entamoeba invadens
LCDCQVSLMVFKDEKLV

SEQ ID NO: 2951082 - protein, 18 aa, Entamoeba invadens
LCDLPFRRISGGSNIFGK

SEQ ID NO: 2951083 - protein, 27 aa, Entamoeba invadens
LCDNCFRKYIEVQTIFVPKSVKSVGRF

SEQ ID NO: 2951084 - protein, 17 aa, Entamoeba invadens
LCDQFKPLSKVAAALQV

SEQ ID NO: 2951085 - protein, 17 aa, Entamoeba invadens
LCDRIKESPKFDVTWNL

SEQ ID NO: 2951086 - protein, 19 aa, Entamoeba invadens
LCDTFCALVSHGKEDDGFY

SEQ ID NO: 2951087 - protein, 19 aa, Entamoeba invadens
LCEDKFCCVECKREKIGKE

SEQ ID NO: 2951088 - protein, 29 aa, Entamoeba invadens
LCEGIKYIPCCAFLRCYRLNEIKVPQSVT

SEQ ID NO: 2951089 - protein, 24 aa, Entamoeba invadens
LCEPVSLVCLAIFYDIVTRSEVDQ

SEQ ID NO: 2951090 - protein, 24 aa, Entamoeba invadens
LCESTHIDMGRFCFYETKIKVDSS

SEQ ID NO: 2951091 - protein, 25 aa, Entamoeba invadens
LCETHMIFFISRFVSGGDVFEKLKE

SEQ ID NO: 2951092 - protein, 27 aa, Entamoeba invadens
LCETKGKEIGVCWFECGTNNISLSQYL

SEQ ID NO: 2951093 - protein, 17 aa, Entamoeba invadens
LCFESCTKLKNFVISSS

SEQ ID NO: 2951094 - protein, 18 aa, Entamoeba invadens
LCFFGCVSLEQLGVDTKT

SEQ ID NO: 2951095 - protein, 26 aa, Entamoeba invadens
LCFKDCSSLSILKCPESLALPQNAFL

SEQ ID NO: 2951096 - protein, 27 aa, Entamoeba invadens
LCFKGCSSLTSLHCSSSFQAPQHILKY

SEQ ID NO: 2951097 - protein, 24 aa, Entamoeba invadens
LCFMMPSFRDILAKLISQLNVGIA

SEQ ID NO: 2951098 - protein, 19 aa, Entamoeba invadens
LCFSNCCFLKELVLNEKCV

SEQ ID NO: 2951099 - protein, 22 aa, Entamoeba invadens
LCGEESFGTGCCGIREKDGIWA

SEQ ID NO: 2951100 - protein, 27 aa, Entamoeba invadens
LCGELFKSLQLAAVIGKTAFCVHAGIF

SEQ ID NO: 2951101 - protein, 18 aa, Entamoeba invadens
LCGGDGTITWVLDEFLRH

SEQ ID NO: 2951102 - protein, 20 aa, Entamoeba invadens
LCGIPSSGLGNLFMLMDLHT

SEQ ID NO: 2951103 - protein, 24 aa, Entamoeba invadens
LCGLPESLVELVLRSCNKLNNVEF

SEQ ID NO: 2951104 - protein, 26 aa, Entamoeba invadens
LCGPSIPKMFGVSGSGVFNGTHGGIA

SEQ ID NO: 2951105 - protein, 19 aa, Entamoeba invadens
LCGSEIFSGTIARLRDDMV

SEQ ID NO: 2951106 - protein, 25 aa, Entamoeba invadens
LCGSESALCLACFLEKMTIPPVDHF

SEQ ID NO: 2951107 - protein, 30 aa, Entamoeba invadens
LCGTFKKIPIFVVCSCGKEQSLAHPKTIVM

SEQ ID NO: 2951108 - protein, 25 aa, Entamoeba invadens
LCGTHIIYMISRFVKNGEIFDKLQD

SEQ ID NO: 2951109 - protein, 20 aa, Entamoeba invadens
LCGTTCSYNDIIIDPHMKDI

SEQ ID NO: 2951110 - protein, 17 aa, Entamoeba invadens
LCIIPSPHLKISNCDKL

SEQ ID NO: 2951111 - protein, 19 aa, Entamoeba invadens
LCIKNEFKQHPTAFARYVT

SEQ ID NO: 2951112 - protein, 25 aa, Entamoeba invadens
LCINCFKNGITKLMLTEIPYFRTIL

SEQ ID NO: 2951113 - protein, 25 aa, Entamoeba invadens
LCISKCKCFSSLKFLNNRTSFEKLF

SEQ ID NO: 2951114 - protein, 18 aa, Entamoeba invadens
LCISKYAKPILCSPTLAT

SEQ ID NO: 2951115 - protein, 20 aa, Entamoeba invadens
LCITAAPYIDFLKLGFGTSV

SEQ ID NO: 2951116 - protein, 26 aa, Entamoeba invadens
LCKASLICKMKFSPFDSFKDCGLLVH

SEQ ID NO: 2951117 - protein, 26 aa, Entamoeba invadens
LCKFCTKDNCIFCEGGVIVSDGKCLQ

SEQ ID NO: 2951118 - protein, 18 aa, Entamoeba invadens
LCKHPNLVEYKDFFTWDR

SEQ ID NO: 2951119 - protein, 17 aa, Entamoeba invadens
LCKHPNLVEYKDFFTWN

SEQ ID NO: 2951120 - protein, 18 aa, Entamoeba invadens
LCKHSSTFRRCVNTAQYL

SEQ ID NO: 2951121 - protein, 18 aa, Entamoeba invadens
LCKKAFWEECYKTELKNF

SEQ ID NO: 2951122 - protein, 18 aa, Entamoeba invadens
LCKKGIMIAKNRMKESDS

SEQ ID NO: 2951123 - protein, 19 aa, Entamoeba invadens
LCKKHFKKALESMTCSVIG

SEQ ID NO: 2951124 - protein, 17 aa, Entamoeba invadens
LCKLVKAKCEEDGKHIV

SEQ ID NO: 2951125 - protein, 17 aa, Entamoeba invadens
LCKNLKTSVIVSDSSKV

SEQ ID NO: 2951126 - protein, 18 aa, Entamoeba invadens
LCKPYPYPIECVLQKYRL

SEQ ID NO: 2951127 - protein, 26 aa, Entamoeba invadens
LCKQNMYLKDGMCFGIDVSCLNISSG

SEQ ID NO: 2951128 - protein, 19 aa, Entamoeba invadens
LCKRLERVEFPFSQMSDLT

SEQ ID NO: 2951129 - protein, 21 aa, Entamoeba invadens
LCKSVHIRIRIDRENTDKSNK

SEQ ID NO: 2951130 - protein, 18 aa, Entamoeba invadens
LCKYGGECVEDFLSDLDN

SEQ ID NO: 2951131 - protein, 17 aa, Entamoeba invadens
LCLALQYITDVNGFFGF

SEQ ID NO: 2951132 - protein, 23 aa, Entamoeba invadens
LCLAMRPRMFMPIDDTGKVITTS

SEQ ID NO: 2951133 - protein, 22 aa, Entamoeba invadens
LCLDHIRYELAVNVAVTTIGTV

SEQ ID NO: 2951134 - protein, 21 aa, Entamoeba invadens
LCLGIKPGAKIVLRNVKVRRG

SEQ ID NO: 2951135 - protein, 22 aa, Entamoeba invadens
LCMNLRPTQTFVVVPVVDDDNV

SEQ ID NO: 2951136 - protein, 21 aa, Entamoeba invadens
LCMYFPRQMLTFFKMDPQNAA

SEQ ID NO: 2951137 - protein, 24 aa, Entamoeba invadens
LCNERPEVLQPLLNPIQADNPQLA

SEQ ID NO: 2951138 - protein, 20 aa, Entamoeba invadens
LCNGYSIKLLLFDLKTTKSR

SEQ ID NO: 2951139 - protein, 17 aa, Entamoeba invadens
LCNKNIEGCKLEFIIGL

SEQ ID NO: 2951140 - protein, 17 aa, Entamoeba invadens
LCNSEKEVALKMCSAKT

SEQ ID NO: 2951141 - protein, 21 aa, Entamoeba invadens
LCNSPEIFSPMMVYILSAIDR

SEQ ID NO: 2951142 - protein, 20 aa, Entamoeba invadens
LCNTGKIILFDMEESVTQDM

SEQ ID NO: 2951143 - protein, 22 aa, Entamoeba invadens
LCPFTNCRAEILSWELRGICDP

SEQ ID NO: 2951144 - protein, 18 aa, Entamoeba invadens
LCPLADMETFLSADFLKI

SEQ ID NO: 2951145 - protein, 18 aa, Entamoeba invadens
LCPLKNSPFNAIRSDTDF

SEQ ID NO: 2951146 - protein, 24 aa, Entamoeba invadens
LCPPINPSTLFTLFDFNRPDDSFV

SEQ ID NO: 2951147 - protein, 29 aa, Entamoeba invadens
LCQEKGCVVELILNFIMKMVVRLQIEKES

SEQ ID NO: 2951148 - protein, 18 aa, Entamoeba invadens
LCQKCYDTIEWKKKFHKY

SEQ ID NO: 2951149 - protein, 20 aa, Entamoeba invadens
LCRNEFKEPHLVSTLQKIVF

SEQ ID NO: 2951150 - protein, 17 aa, Entamoeba invadens
LCSALLLVWDYFEDDYS

SEQ ID NO: 2951151 - protein, 28 aa, Entamoeba invadens
LCSGCEWQRVEAAIFIFRCLVRVTESDA

SEQ ID NO: 2951152 - protein, 26 aa, Entamoeba invadens
LCSGDANGIFRIWDLRTKKTTKAYQF

SEQ ID NO: 2951153 - protein, 18 aa, Entamoeba invadens
LCSHSWTLLSNISLNQTV

SEQ ID NO: 2951154 - protein, 23 aa, Entamoeba invadens
LCSKFLMTFSRSVARKFFKDTFS

SEQ ID NO: 2951155 - protein, 22 aa, Entamoeba invadens
LCSLQDTTLCLQNLLTLQVTQI

SEQ ID NO: 2951156 - protein, 17 aa, Entamoeba invadens
LCSQLACYATYTAKHVP

SEQ ID NO: 2951157 - protein, 18 aa, Entamoeba invadens
LCTCKVSEAIFLVTTTKK

SEQ ID NO: 2951158 - protein, 27 aa, Entamoeba invadens
LCTIPLKGKGTAVCWNEKGDEFYSASS

SEQ ID NO: 2951159 - protein, 20 aa, Entamoeba invadens
LCTKCTKITFDKLQIKDSIY

SEQ ID NO: 2951160 - protein, 19 aa, Entamoeba invadens
LCTKIVIMLSLVFSTPKLV

SEQ ID NO: 2951161 - protein, 22 aa, Entamoeba invadens
LCTLLRKLVKTELCSTHNFNLL

SEQ ID NO: 2951162 - protein, 17 aa, Entamoeba invadens
LCTLPIPADEHVEVVNV

SEQ ID NO: 2951163 - protein, 20 aa, Entamoeba invadens
LCTTRHGLIPNLLDGCKNSR

SEQ ID NO: 2951164 - protein, 17 aa, Entamoeba invadens
LCTYDPYDLPSEFRGLA

SEQ ID NO: 2951165 - protein, 19 aa, Entamoeba invadens
LCVCNIKKFGHVFNVKLNV

SEQ ID NO: 2951166 - protein, 22 aa, Entamoeba invadens
LCVEPGKFIFKTTMSDLLKLVI

SEQ ID NO: 2951167 - protein, 25 aa, Entamoeba invadens
LCVGICECCVACFECCGSLKSCDCK

SEQ ID NO: 2951168 - protein, 23 aa, Entamoeba invadens
LCVGNGSKSRLKVQISTKTDTNK

SEQ ID NO: 2951169 - protein, 23 aa, Entamoeba invadens
LCVGRKCQICKLNYLMYSANRCV

SEQ ID NO: 2951170 - protein, 18 aa, Entamoeba invadens
LCVHPNVVAFHEYISSPE

SEQ ID NO: 2951171 - protein, 19 aa, Entamoeba invadens
LCVKRMPRIARPMQKKRAS

SEQ ID NO: 2951172 - protein, 22 aa, Entamoeba invadens
LCVTGLDCSKNLTVPTNLQNLK

SEQ ID NO: 2951173 - protein, 19 aa, Entamoeba invadens
LCYESCIGSDFASWAGQAQ

SEQ ID NO: 2951174 - protein, 19 aa, Entamoeba invadens
LCYLLKFLREVAQCSQKNK

SEQ ID NO: 2951175 - protein, 19 aa, Entamoeba invadens
LCYMECSALKNTGLDDIFQ

SEQ ID NO: 2951176 - protein, 17 aa, Entamoeba invadens
LCYQKGLILQLVLVFEP

SEQ ID NO: 2951177 - protein, 36 aa, Entamoeba invadens
LDAAEFYWKRHEDVLKEIRRTVEILVFHLNSLQTTP

SEQ ID NO: 2951178 - protein, 18 aa, Entamoeba invadens
LDAAKIAGINCLRLMNEH

SEQ ID NO: 2951179 - protein, 19 aa, Entamoeba invadens
LDAASAFSLTHKYMSNTEY

SEQ ID NO: 2951180 - protein, 17 aa, Entamoeba invadens
LDAECFTMTSNVTLEKT

SEQ ID NO: 2951181 - protein, 32 aa, Entamoeba invadens
LDAEGRVFYQLPLVIESMLIYLYNKGCTTHGL

SEQ ID NO: 2951182 - protein, 26 aa, Entamoeba invadens
LDAEIKRKESELVERLNELETNKKLQ

SEQ ID NO: 2951183 - protein, 23 aa, Entamoeba invadens
LDAEIRKNLELSRKSSGAESTRY

SEQ ID NO: 2951184 - protein, 17 aa, Entamoeba invadens
LDAFDLFVQNGLFNEET

SEQ ID NO: 2951185 - protein, 20 aa, Entamoeba invadens
LDAFNLWLCSIPLAVNLVDE

SEQ ID NO: 2951186 - protein, 21 aa, Entamoeba invadens
LDAFSKLRVIKQVDELKSWKF

SEQ ID NO: 2951187 - protein, 17 aa, Entamoeba invadens
LDAIKGIVYLYTNGILH

SEQ ID NO: 2951188 - protein, 18 aa, Entamoeba invadens
LDAIKILKINPSYPVNTN

SEQ ID NO: 2951189 - protein, 23 aa, Entamoeba invadens
LDAKYQFFGCKKFAVLADVLCGL

SEQ ID NO: 2951190 - protein, 25 aa, Entamoeba invadens
LDALGLSFIRLCSMSRLNQLREHFD

SEQ ID NO: 2951191 - protein, 39 aa, Entamoeba invadens
LDAPKSLPTDFVFGCAVPLCTSTGYFSLENVKEKTCGVL

SEQ ID NO: 2951192 - protein, 20 aa, Entamoeba invadens
LDARKQRELDDLKRQEAERK

SEQ ID NO: 2951193 - protein, 24 aa, Entamoeba invadens
LDASHQSKGFGFLEFATEADKNRM

SEQ ID NO: 2951194 - protein, 21 aa, Entamoeba invadens
LDCSKCSLLTHLTVYTTAQQF

SEQ ID NO: 2951195 - protein, 17 aa, Entamoeba invadens
LDCTASFRKMMEIGVNN

SEQ ID NO: 2951196 - protein, 21 aa, Entamoeba invadens
LDCVKNVKIKYPNMDDENIPE

SEQ ID NO: 2951197 - protein, 18 aa, Entamoeba invadens
LDCVNCTNVTVSNFMIYN

SEQ ID NO: 2951198 - protein, 18 aa, Entamoeba invadens
LDCYKTLTKFGVKVSGRV

SEQ ID NO: 2951199 - protein, 24 aa, Entamoeba invadens
LDDCLAGLVLLCCLNDGDDLTEQI

SEQ ID NO: 2951200 - protein, 19 aa, Entamoeba invadens
LDDCLGRTLWDGEKYLGDY

SEQ ID NO: 2951201 - protein, 26 aa, Entamoeba invadens
LDDEVLTMYLVFCISKDEKLQEVDAT

SEQ ID NO: 2951202 - protein, 25 aa, Entamoeba invadens
LDDEVPLCQTCLVMQLKMKEVICES

SEQ ID NO: 2951203 - protein, 20 aa, Entamoeba invadens
LDDFCFCWCNSLSSVTIPSS

SEQ ID NO: 2951204 - protein, 21 aa, Entamoeba invadens
LDDFCFCWCNSLSSVTIPSSV

SEQ ID NO: 2951205 - protein, 25 aa, Entamoeba invadens
LDDFDFSTIDAWLLLSVPGKFHGDM

SEQ ID NO: 2951206 - protein, 27 aa, Entamoeba invadens
LDDFYRYEVIPGFIKRLNELLSTAKTM

SEQ ID NO: 2951207 - protein, 20 aa, Entamoeba invadens
LDDGCFWNCNTLIYINIPQK

SEQ ID NO: 2951208 - protein, 18 aa, Entamoeba invadens
LDDINGEIFSVFAQNIRT

SEQ ID NO: 2951209 - protein, 22 aa, Entamoeba invadens
LDDKLKACIMTKIQVQSQTDEL

SEQ ID NO: 2951210 - protein, 18 aa, Entamoeba invadens
LDDKWLIDNVDIYITEVP

SEQ ID NO: 2951211 - protein, 19 aa, Entamoeba invadens
LDDLCYRLNKFIVTLFPEY

SEQ ID NO: 2951212 - protein, 24 aa, Entamoeba invadens
LDDLDSFVILLKKWWADGKSHAEL

SEQ ID NO: 2951213 - protein, 23 aa, Entamoeba invadens
LDDLPAYILMEISYPQSTSCSNP

SEQ ID NO: 2951214 - protein, 22 aa, Entamoeba invadens
LDDLQLLLIRDVQKVKTRPLKE

SEQ ID NO: 2951215 - protein, 20 aa, Entamoeba invadens
LDDNTFRFYFIPVVRGSFTE

SEQ ID NO: 2951216 - protein, 17 aa, Entamoeba invadens
LDDPETFCITARLYFKL

SEQ ID NO: 2951217 - protein, 21 aa, Entamoeba invadens
LDDSCFCGCSKLVTIKIPSTV

SEQ ID NO: 2951218 - protein, 26 aa, Entamoeba invadens
LDDVHFIDLFCHLHKKIATETDSGTT

SEQ ID NO: 2951219 - protein, 28 aa, Entamoeba invadens
LDDVLKEVISFRCAMARVKSEFKESGEG

SEQ ID NO: 2951220 - protein, 20 aa, Entamoeba invadens
LDDYWCDIIKIGNMVVDRKR

SEQ ID NO: 2951221 - protein, 17 aa, Entamoeba invadens
LDEAIDTMMAWADSQNV

SEQ ID NO: 2951222 - protein, 18 aa, Entamoeba invadens
LDEALLLEPTNFYLWQFA

SEQ ID NO: 2951223 - protein, 18 aa, Entamoeba invadens
LDEDIFVWVKQVSPTLWL

SEQ ID NO: 2951224 - protein, 27 aa, Entamoeba invadens
LDEENRRLKLRIGELVNNKENYESTEV

SEQ ID NO: 2951225 - protein, 24 aa, Entamoeba invadens
LDEFDMHAALCQRLHDPAQIIEIA

SEQ ID NO: 2951226 - protein, 22 aa, Entamoeba invadens
LDEFSKRHFVVTSKFLYQLKQI

SEQ ID NO: 2951227 - protein, 18 aa, Entamoeba invadens
LDEGCYFGVDKLKAIVLP

SEQ ID NO: 2951228 - protein, 24 aa, Entamoeba invadens
LDEGPRIEEMFTLLPTSDDKTSIL

SEQ ID NO: 2951229 - protein, 19 aa, Entamoeba invadens
LDEIIKRKINITTSLNTIV

SEQ ID NO: 2951230 - protein, 24 aa, Entamoeba invadens
LDEKKGKFIVIKKHDLEIMAKLLV

SEQ ID NO: 2951231 - protein, 25 aa, Entamoeba invadens
LDELKHYLCFIFWTSSQSWHLSFVM

SEQ ID NO: 2951232 - protein, 22 aa, Entamoeba invadens
LDELKNLLLDPSFLPTTKEQQA

SEQ ID NO: 2951233 - protein, 18 aa, Entamoeba invadens
LDESRFIGEVVVTNKKGL

SEQ ID NO: 2951234 - protein, 23 aa, Entamoeba invadens
LDETCALIPLPILPKQNPCYALC

SEQ ID NO: 2951235 - protein, 18 aa, Entamoeba invadens
LDETRCLQCIQYIKSAQI

SEQ ID NO: 2951236 - protein, 24 aa, Entamoeba invadens
LDEVLRPNGVFFFRDYGMGDMKQE

SEQ ID NO: 2951237 - protein, 19 aa, Entamoeba invadens
LDEYMCYFMQLDQVKLDDT

SEQ ID NO: 2951238 - protein, 20 aa, Entamoeba invadens
LDFALPMIKNMFPYTFTVTR

SEQ ID NO: 2951239 - protein, 17 aa, Entamoeba invadens
LDFDGVCSPGTKLMPGM

SEQ ID NO: 2951240 - protein, 17 aa, Entamoeba invadens
LDFFKTNIIKFNNFSTK

SEQ ID NO: 2951241 - protein, 20 aa, Entamoeba invadens
LDFGMWKSLVEAVGDHFVQT

SEQ ID NO: 2951242 - protein, 24 aa, Entamoeba invadens
LDFINHLKRIVGFEKLKRIQQNQK

SEQ ID NO: 2951243 - protein, 19 aa, Entamoeba invadens
LDFKTLRYFPNIETLHLWN

SEQ ID NO: 2951244 - protein, 19 aa, Entamoeba invadens
LDFLNLPVSVSRGVLGNLT

SEQ ID NO: 2951245 - protein, 25 aa, Entamoeba invadens
LDFLPRRIGDDLLKIVGGKPYMFDD

SEQ ID NO: 2951246 - protein, 19 aa, Entamoeba invadens
LDFNMRMNNIFAFILTHTK

SEQ ID NO: 2951247 - protein, 20 aa, Entamoeba invadens
LDFSKFPLLKRVILNMKILF

SEQ ID NO: 2951248 - protein, 20 aa, Entamoeba invadens
LDFSPFIVTQIRFKVGDVIY

SEQ ID NO: 2951249 - protein, 24 aa, Entamoeba invadens
LDFTPDFFCFLKYGTSKQLNMATM

SEQ ID NO: 2951250 - protein, 18 aa, Entamoeba invadens
LDGALYITSQRFIHVSVK

SEQ ID NO: 2951251 - protein, 17 aa, Entamoeba invadens
LDGDGLINFEEFSKVIL

SEQ ID NO: 2951252 - protein, 17 aa, Entamoeba invadens
LDGIRNFLNLQILSCRS

SEQ ID NO: 2951253 - protein, 17 aa, Entamoeba invadens
LDGISLLFESGVQVGMR

SEQ ID NO: 2951254 - protein, 19 aa, Entamoeba invadens
LDGKRIRPSIFEKESDNIK

SEQ ID NO: 2951255 - protein, 19 aa, Entamoeba invadens
LDGNCFERCISLKTVSLPT

SEQ ID NO: 2951256 - protein, 17 aa, Entamoeba invadens
LDGPMPWEDEEWENQTH

SEQ ID NO: 2951257 - protein, 17 aa, Entamoeba invadens
LDGTDCFVKKQYECVCV

SEQ ID NO: 2951258 - protein, 18 aa, Entamoeba invadens
LDGTYLFRVSKKTLDYPL

SEQ ID NO: 2951259 - protein, 20 aa, Entamoeba invadens
LDGYYRKALFVKYVADALNP

SEQ ID NO: 2951260 - protein, 27 aa, Entamoeba invadens
LDHFPEAFCHLKMLVNLNVSCNKIPSF

SEQ ID NO: 2951261 - protein, 20 aa, Entamoeba invadens
LDHHPPRFNHLLKVVGDILL

SEQ ID NO: 2951262 - protein, 22 aa, Entamoeba invadens
LDHHPPRFNNLLKIVSDIVSFL

SEQ ID NO: 2951263 - protein, 20 aa, Entamoeba invadens
LDHIKKWLTKCDIKTYETPQ

SEQ ID NO: 2951264 - protein, 23 aa, Entamoeba invadens
LDHSRVFFRGISIFDVANFLNIC

SEQ ID NO: 2951265 - protein, 20 aa, Entamoeba invadens
LDIFKFPSKIAEFVMSGKRF

SEQ ID NO: 2951266 - protein, 25 aa, Entamoeba invadens
LDIFSLAITMWVLFFEDIPFSTYAQ

SEQ ID NO: 2951267 - protein, 22 aa, Entamoeba invadens
LDIKCFKFCYSLKEIELPKSIT

SEQ ID NO: 2951268 - protein, 23 aa, Entamoeba invadens
LDIKKGFCSTIRIFEDCSYIIVD

SEQ ID NO: 2951269 - protein, 17 aa, Entamoeba invadens
LDILAKISPLFPSLSLE

SEQ ID NO: 2951270 - protein, 17 aa, Entamoeba invadens
LDIPEEFCDTIMGTLMK

SEQ ID NO: 2951271 - protein, 17 aa, Entamoeba invadens
LDIPKSVTFLGDCCFTS

SEQ ID NO: 2951272 - protein, 20 aa, Entamoeba invadens
LDISEPIGFKNVISAQSASS

SEQ ID NO: 2951273 - protein, 17 aa, Entamoeba invadens
LDKAMELISYFQNNESL

SEQ ID NO: 2951274 - protein, 20 aa, Entamoeba invadens
LDKCDFNFALKNVFEKNKKE

SEQ ID NO: 2951275 - protein, 18 aa, Entamoeba invadens
LDKCPIKSFTFCKNSAMT

SEQ ID NO: 2951276 - protein, 19 aa, Entamoeba invadens
LDKDFCLPNSLVIIQNKLF

SEQ ID NO: 2951277 - protein, 29 aa, Entamoeba invadens
LDKDGKLPCVFFIFSRKLVMDYAKRLAKS

SEQ ID NO: 2951278 - protein, 27 aa, Entamoeba invadens
LDKDPKVTYILSEKVKYVYRAVEDVYI

SEQ ID NO: 2951279 - protein, 29 aa, Entamoeba invadens
LDKEELQWCKAYLIGLLILCETRNSLCGF

SEQ ID NO: 2951280 - protein, 20 aa, Entamoeba invadens
LDKEGLFRLSSTLERVNYMK

SEQ ID NO: 2951281 - protein, 28 aa, Entamoeba invadens
LDKEGLQQFGVFCLAKLFSYDSSKIGQY

SEQ ID NO: 2951282 - protein, 26 aa, Entamoeba invadens
LDKEGLQQFGVFCLAKVFSYDATPTS

SEQ ID NO: 2951283 - protein, 21 aa, Entamoeba invadens
LDKFKKYFRKIVNVAKNFPFV

SEQ ID NO: 2951284 - protein, 17 aa, Entamoeba invadens
LDKFSVKVEKSTRLESI

SEQ ID NO: 2951285 - protein, 24 aa, Entamoeba invadens
LDKFYKLFSVVIFGGIHSPQKAIE

SEQ ID NO: 2951286 - protein, 18 aa, Entamoeba invadens
LDKIDSFSTCTDVLNDCI

SEQ ID NO: 2951287 - protein, 21 aa, Entamoeba invadens
LDKIRACGLLAQKELASTIIV

SEQ ID NO: 2951288 - protein, 22 aa, Entamoeba invadens
LDKITKLSIVFSLRVADKKLYS

SEQ ID NO: 2951289 - protein, 18 aa, Entamoeba invadens
LDKLCFSKCISLRSVSFK

SEQ ID NO: 2951290 - protein, 20 aa, Entamoeba invadens
LDKLLSLGVFEQFQASVDFK

SEQ ID NO: 2951291 - protein, 17 aa, Entamoeba invadens
LDKLYDRIDLGIFEANS

SEQ ID NO: 2951292 - protein, 17 aa, Entamoeba invadens
LDKLYNRIDLGIFEANS

SEQ ID NO: 2951293 - protein, 22 aa, Entamoeba invadens
LDKQLFVYLLRTCPKITQDMVM

SEQ ID NO: 2951294 - protein, 23 aa, Entamoeba invadens
LDKRNACIAPWCEDPACEKTIKE

SEQ ID NO: 2951295 - protein, 20 aa, Entamoeba invadens
LDKSLRVILENVMTNKKTGH

SEQ ID NO: 2951296 - protein, 24 aa, Entamoeba invadens
LDKSMLRKSLLNTRYVIPLPPTSV

SEQ ID NO: 2951297 - protein, 19 aa, Entamoeba invadens
LDKTCLDALVSLSRIYWNL

SEQ ID NO: 2951298 - protein, 18 aa, Entamoeba invadens
LDKTSLKISQEFDEEQIP

SEQ ID NO: 2951299 - protein, 23 aa, Entamoeba invadens
LDKVKAVEIEWKMCEDRLTSEAV

SEQ ID NO: 2951300 - protein, 18 aa, Entamoeba invadens
LDKVMWRKKMKEVKPISQ

SEQ ID NO: 2951301 - protein, 19 aa, Entamoeba invadens
LDKVRGVCKTNYFETSALE

SEQ ID NO: 2951302 - protein, 20 aa, Entamoeba invadens
LDKYPAPNFVPRFITPGHYI

SEQ ID NO: 2951303 - protein, 19 aa, Entamoeba invadens
LDLFARYRYLKEITSLVLD

SEQ ID NO: 2951304 - protein, 19 aa, Entamoeba invadens
LDLFQCFYHAGVSFPSSLK

SEQ ID NO: 2951305 - protein, 21 aa, Entamoeba invadens
LDLFRGLCCDGLDTGISMGNG

SEQ ID NO: 2951306 - protein, 26 aa, Entamoeba invadens
LDLFRKAAAVQIVMLGGEFVAQKKRR

SEQ ID NO: 2951307 - protein, 19 aa, Entamoeba invadens
LDLFSIKNTLLLNVVVEYL

SEQ ID NO: 2951308 - protein, 20 aa, Entamoeba invadens
LDLGIVYDVCHNIAKLEKHV

SEQ ID NO: 2951309 - protein, 17 aa, Entamoeba invadens
LDLGKRIHCELMEKLTD

SEQ ID NO: 2951310 - protein, 17 aa, Entamoeba invadens
LDLHTSTLAGLTYSQQS

SEQ ID NO: 2951311 - protein, 18 aa, Entamoeba invadens
LDLIKYYKYHGIPLPSAK

SEQ ID NO: 2951312 - protein, 26 aa, Entamoeba invadens
LDLKYRDCVFKKPLIEKCDEALGKFG

SEQ ID NO: 2951313 - protein, 18 aa, Entamoeba invadens
LDLNFGKFTALTLVRFRG

SEQ ID NO: 2951314 - protein, 17 aa, Entamoeba invadens
LDLPRDIDFHFFAHKGG

SEQ ID NO: 2951315 - protein, 19 aa, Entamoeba invadens
LDLRKATTLEEIRVTRFGG

SEQ ID NO: 2951316 - protein, 21 aa, Entamoeba invadens
LDLRKGSPQEGVFDLRINGPK

SEQ ID NO: 2951317 - protein, 30 aa, Entamoeba invadens
LDLRSYLIMPVQRLPRYQLLLQDLLKHTEK

SEQ ID NO: 2951318 - protein, 35 aa, Entamoeba invadens
LDLRSYLIMPVQRLPRYRLLLTDLIKHTDDAFPDK

SEQ ID NO: 2951319 - protein, 17 aa, Entamoeba invadens
LDLSDIISLGDYGLQRM

SEQ ID NO: 2951320 - protein, 18 aa, Entamoeba invadens
LDLSKFPALYDLDISVAK

SEQ ID NO: 2951321 - protein, 24 aa, Entamoeba invadens
LDLSKRGGMDGGWFMITDHTPTIV

SEQ ID NO: 2951322 - protein, 17 aa, Entamoeba invadens
LDLSNCYLVSAQNVNNL

SEQ ID NO: 2951323 - protein, 17 aa, Entamoeba invadens
LDLSNVVEIEDNNNLDG

SEQ ID NO: 2951324 - protein, 24 aa, Entamoeba invadens
LDLTESLIFYCGDLVMTDNTQIIG

SEQ ID NO: 2951325 - protein, 17 aa, Entamoeba invadens
LDLTNLYSVESLVLISS

SEQ ID NO: 2951326 - protein, 21 aa, Entamoeba invadens
LDLTPSLPLHILFENVNNNNV

SEQ ID NO: 2951327 - protein, 25 aa, Entamoeba invadens
LDLVSNMKALCSIFYFETSAFENIK

SEQ ID NO: 2951328 - protein, 18 aa, Entamoeba invadens
LDLYGEFPSLKSCFSLRE

SEQ ID NO: 2951329 - protein, 31 aa, Entamoeba invadens
LDLYLIHLPISIKLGATFPLKKDDFIEVPIE

SEQ ID NO: 2951330 - protein, 22 aa, Entamoeba invadens
LDMDERLLGAKWVCPIEDSMFV

SEQ ID NO: 2951331 - protein, 33 aa, Entamoeba invadens
LDMEYRSGLIEGVYILRYLQRENLLLAINEEFD

SEQ ID NO: 2951332 - protein, 18 aa, Entamoeba invadens
LDMFFKKWGTMSVNNQNG

SEQ ID NO: 2951333 - protein, 19 aa, Entamoeba invadens
LDMGFKKELTSILDYLPKK

SEQ ID NO: 2951334 - protein, 21 aa, Entamoeba invadens
LDMGFNISFRVDDMEYLFRNS

SEQ ID NO: 2951335 - protein, 24 aa, Entamoeba invadens
LDMGISMGICIVGIMYRMLTDDLR

SEQ ID NO: 2951336 - protein, 24 aa, Entamoeba invadens
LDMKRILNKRVQVLSGGELQMFAI

SEQ ID NO: 2951337 - protein, 22 aa, Entamoeba invadens
LDMKTLTAIGDFKVDPEALHGE

SEQ ID NO: 2951338 - protein, 19 aa, Entamoeba invadens
LDMLCKWSNKQTLHVLFKS

SEQ ID NO: 2951339 - protein, 17 aa, Entamoeba invadens
LDMRYNRPNNRKMMSGW

SEQ ID NO: 2951340 - protein, 17 aa, Entamoeba invadens
LDMTDKFDVDWKYDLDE

SEQ ID NO: 2951341 - protein, 19 aa, Entamoeba invadens
LDNANLLISHFQTFNKIEN

SEQ ID NO: 2951342 - protein, 27 aa, Entamoeba invadens
LDNCAFCECKAITGIVIPNGVSYISNK

SEQ ID NO: 2951343 - protein, 18 aa, Entamoeba invadens
LDNCKFESVHIRFKHQAV

SEQ ID NO: 2951344 - protein, 23 aa, Entamoeba invadens
LDNDCFYMCFKLKQITLPDTIRF

SEQ ID NO: 2951345 - protein, 27 aa, Entamoeba invadens
LDNEHFKIACFLFPPERDKYLNLRDQE

SEQ ID NO: 2951346 - protein, 21 aa, Entamoeba invadens
LDNFTKVRWDIGADKVDDSED

SEQ ID NO: 2951347 - protein, 26 aa, Entamoeba invadens
LDNGFDRLLCHCIANYYNLVSYSTGT

SEQ ID NO: 2951348 - protein, 19 aa, Entamoeba invadens
LDNIKRLVLIGDEGVGKSA

SEQ ID NO: 2951349 - protein, 18 aa, Entamoeba invadens
LDNINFVKFTSFIKLLMN

SEQ ID NO: 2951350 - protein, 19 aa, Entamoeba invadens
LDNLKRLTINYSNGLNLYI

SEQ ID NO: 2951351 - protein, 21 aa, Entamoeba invadens
LDNMKKLIIDQGIDQNSGDNV

SEQ ID NO: 2951352 - protein, 19 aa, Entamoeba invadens
LDNSFVFGMMCENKSDCEV

SEQ ID NO: 2951353 - protein, 20 aa, Entamoeba invadens
LDNYHIVSCLIRHCGQELIP

SEQ ID NO: 2951354 - protein, 25 aa, Entamoeba invadens
LDPALLRPGRLDRKIEFPLPDRRQK

SEQ ID NO: 2951355 - protein, 19 aa, Entamoeba invadens
LDPALLRSGRFDRKIEFPT

SEQ ID NO: 2951356 - protein, 19 aa, Entamoeba invadens
LDPEFRHTWDEHLIKRENI

SEQ ID NO: 2951357 - protein, 23 aa, Entamoeba invadens
LDPHKPLICVSHEPPFGILDYGL

SEQ ID NO: 2951358 - protein, 19 aa, Entamoeba invadens
LDPKVRIAAVQSILTILKK

SEQ ID NO: 2951359 - protein, 24 aa, Entamoeba invadens
LDPNPFASPSIFAFSREVAGLSED

SEQ ID NO: 2951360 - protein, 19 aa, Entamoeba invadens
LDPNYKPVFTVASDDKITE

SEQ ID NO: 2951361 - protein, 23 aa, Entamoeba invadens
LDPPFKFLNPAFEGIFLSINEAV

SEQ ID NO: 2951362 - protein, 21 aa, Entamoeba invadens
LDPSTLFTMRYVYLLIKNTQV

SEQ ID NO: 2951363 - protein, 26 aa, Entamoeba invadens
LDQFLCLRPARHFSGIPTPLKNSEID

SEQ ID NO: 2951364 - protein, 36 aa, Entamoeba invadens
LDQIECAQGHIIDCVSGIEMVHPVFFDSNNAPMAPR

SEQ ID NO: 2951365 - protein, 21 aa, Entamoeba invadens
LDQIKKFGFGVPSLYLNDMVI

SEQ ID NO: 2951366 - protein, 19 aa, Entamoeba invadens
LDQLGCKNVPEEPQIDDAI

SEQ ID NO: 2951367 - protein, 24 aa, Entamoeba invadens
LDQLKGLVPEEGFEQLLTEKPEIV

SEQ ID NO: 2951368 - protein, 25 aa, Entamoeba invadens
LDQLKPFFAAFIDKFYDVFPECSDR

SEQ ID NO: 2951369 - protein, 26 aa, Entamoeba invadens
LDQLLVCLPITYFLNVNKWDLNTMNK

SEQ ID NO: 2951370 - protein, 17 aa, Entamoeba invadens
LDQLPFYGVPKELKVLV

SEQ ID NO: 2951371 - protein, 20 aa, Entamoeba invadens
LDQTVDVMAFIVTKKDQSAD

SEQ ID NO: 2951372 - protein, 22 aa, Entamoeba invadens
LDRALLRTCNKFGQFRKDEPAS

SEQ ID NO: 2951373 - protein, 21 aa, Entamoeba invadens
LDRAQFRTAIQYLVPVVEKTL

SEQ ID NO: 2951374 - protein, 36 aa, Entamoeba invadens
LDRFFDALFTREFFKENRNVLKWMSLHHPQLSGVLM

SEQ ID NO: 2951375 - protein, 22 aa, Entamoeba invadens
LDRVKEVVQWYVGDVVTSVSVN

SEQ ID NO: 2951376 - protein, 24 aa, Entamoeba invadens
LDRVLWFYNTCVIKRVLQSAEDIK

SEQ ID NO: 2951377 - protein, 18 aa, Entamoeba invadens
LDRWDDFGKIVVEMTDNT

SEQ ID NO: 2951378 - protein, 19 aa, Entamoeba invadens
LDRWISVIEPSVFVLGNTP

SEQ ID NO: 2951379 - protein, 18 aa, Entamoeba invadens
LDRYLGIIKEEIDKYEDE

SEQ ID NO: 2951380 - protein, 22 aa, Entamoeba invadens
LDSASFASLFLQFKIIEKCFSL

SEQ ID NO: 2951381 - protein, 17 aa, Entamoeba invadens
LDSCCVVEYIKESQATK

SEQ ID NO: 2951382 - protein, 26 aa, Entamoeba invadens
LDSDVYIRILILYLPLLIKFDDETID

SEQ ID NO: 2951383 - protein, 19 aa, Entamoeba invadens
LDSFAYKRVITLPEHAISF

SEQ ID NO: 2951384 - protein, 19 aa, Entamoeba invadens
LDSFFMLKKMILEMIPTYF

SEQ ID NO: 2951385 - protein, 18 aa, Entamoeba invadens
LDSFRLLNITQIQFMGKD

SEQ ID NO: 2951386 - protein, 22 aa, Entamoeba invadens
LDSGKLAEGFFWAKKAISRASK

SEQ ID NO: 2951387 - protein, 27 aa, Entamoeba invadens
LDSIRNRPTLIFPFTPTHTFFMRAHPT

SEQ ID NO: 2951388 - protein, 27 aa, Entamoeba invadens
LDSKGLFPAPTRWNSKLGEQGGIRLYD

SEQ ID NO: 2951389 - protein, 18 aa, Entamoeba invadens
LDSKYSTPTQIVLPTGHS

SEQ ID NO: 2951390 - protein, 26 aa, Entamoeba invadens
LDSLICAGDGLSVCYVDEADRNLTVI

SEQ ID NO: 2951391 - protein, 19 aa, Entamoeba invadens
LDSLINMSSSHAFVGISHK

SEQ ID NO: 2951392 - protein, 22 aa, Entamoeba invadens
LDSLKRISVLNGKVLESPAACY

SEQ ID NO: 2951393 - protein, 25 aa, Entamoeba invadens
LDSNFEGVEGWLKHITKILKGAIQI

SEQ ID NO: 2951394 - protein, 23 aa, Entamoeba invadens
LDSNFSKAFLRIFVFSLPPDNRL

SEQ ID NO: 2951395 - protein, 21 aa, Entamoeba invadens
LDSNLSMLIKCVESLKERVID

SEQ ID NO: 2951396 - protein, 24 aa, Entamoeba invadens
LDSYFGSVCELDLIYYFHKVYQVI

SEQ ID NO: 2951397 - protein, 26 aa, Entamoeba invadens
LDSYGKRILVPLGFYNMMLRTKQPNY

SEQ ID NO: 2951398 - protein, 29 aa, Entamoeba invadens
LDTETEMFLWLGNNGELRCEEHVRYSQDH

SEQ ID NO: 2951399 - protein, 21 aa, Entamoeba invadens
LDTFRIFPFGNPRVVMLANNP

SEQ ID NO: 2951400 - protein, 25 aa, Entamoeba invadens
LDTIPKFCFFNCCSLTSLKLSSSLR

SEQ ID NO: 2951401 - protein, 22 aa, Entamoeba invadens
LDTKIKLKEEIENQMKEKENEL

SEQ ID NO: 2951402 - protein, 19 aa, Entamoeba invadens
LDTKQSFFVFSNRIPSPTQ

SEQ ID NO: 2951403 - protein, 17 aa, Entamoeba invadens
LDTLILIIEYDIVFGYI

SEQ ID NO: 2951404 - protein, 19 aa, Entamoeba invadens
LDTLKPILFTDVEIKDVLA

SEQ ID NO: 2951405 - protein, 17 aa, Entamoeba invadens
LDTLVYMGPTYYQRLKH

SEQ ID NO: 2951406 - protein, 20 aa, Entamoeba invadens
LDTLYVCLREGHCFCDECVF

SEQ ID NO: 2951407 - protein, 18 aa, Entamoeba invadens
LDTMTEYLLSYSLGDLLL

SEQ ID NO: 2951408 - protein, 26 aa, Entamoeba invadens
LDTRSGRMRLSLGKNIQLSPPRQDLS

SEQ ID NO: 2951409 - protein, 19 aa, Entamoeba invadens
LDTSDMFCMSLVFTGNNVG

SEQ ID NO: 2951410 - protein, 26 aa, Entamoeba invadens
LDTTKTAECKIIYVTRLSVVDDNLVL

SEQ ID NO: 2951411 - protein, 25 aa, Entamoeba invadens
LDTTKTAECKIVYVTRLLVINDDLV

SEQ ID NO: 2951412 - protein, 26 aa, Entamoeba invadens
LDTTKTAECKIVYVTRLLVINDDLVL

SEQ ID NO: 2951413 - protein, 19 aa, Entamoeba invadens
LDVCKKANIIHCDVKPENV

SEQ ID NO: 2951414 - protein, 23 aa, Entamoeba invadens
LDVCTAALSVFRHHKDVVMTFVE

SEQ ID NO: 2951415 - protein, 24 aa, Entamoeba invadens
LDVFGEAMLVMFAEIHRRYVMTEE

SEQ ID NO: 2951416 - protein, 18 aa, Entamoeba invadens
LDVFKYITIQNFQPEKAK

SEQ ID NO: 2951417 - protein, 18 aa, Entamoeba invadens
LDVFVKWAEQHGINMVIS

SEQ ID NO: 2951418 - protein, 19 aa, Entamoeba invadens
LDVGWYVVFGCTYQPNIRR

SEQ ID NO: 2951419 - protein, 24 aa, Entamoeba invadens
LDVIDIRSTVAFNVLVDHIKIDAV

SEQ ID NO: 2951420 - protein, 17 aa, Entamoeba invadens
LDVKKCTTHLVGNLLKK

SEQ ID NO: 2951421 - protein, 17 aa, Entamoeba invadens
LDVKSFVETSVKLIEQI

SEQ ID NO: 2951422 - protein, 20 aa, Entamoeba invadens
LDVLFKCYLVPLSYSKYSPI

SEQ ID NO: 2951423 - protein, 23 aa, Entamoeba invadens
LDVLPVYLGFCVNSNKFDCFAEA

SEQ ID NO: 2951424 - protein, 25 aa, Entamoeba invadens
LDVNILQFIALVPMNNTRLVVLSLV

SEQ ID NO: 2951425 - protein, 18 aa, Entamoeba invadens
LDVPFSYMKHVYTATESE

SEQ ID NO: 2951426 - protein, 25 aa, Entamoeba invadens
LDVSICTGGTWPLKPSENIDLPEVM

SEQ ID NO: 2951427 - protein, 22 aa, Entamoeba invadens
LDVSLRRIRQAFAPEGSYDSII

SEQ ID NO: 2951428 - protein, 19 aa, Entamoeba invadens
LDVTCGLYEDFSFSTEDNV

SEQ ID NO: 2951429 - protein, 23 aa, Entamoeba invadens
LDVVRCDWRLRGTMDQKMFSLIC

SEQ ID NO: 2951430 - protein, 19 aa, Entamoeba invadens
LDVYQKLTFSNVIAPPKAS

SEQ ID NO: 2951431 - protein, 29 aa, Entamoeba invadens
LDVYVHRWGKLSSEVVAFMMFKGLDRKSV

SEQ ID NO: 2951432 - protein, 28 aa, Entamoeba invadens
LDWKRNPAWCDRVLFRVSQLYQISLRDY

SEQ ID NO: 2951433 - protein, 19 aa, Entamoeba invadens
LDWNCTKPDLLLTCSLDST

SEQ ID NO: 2951434 - protein, 17 aa, Entamoeba invadens
LDYCTKTIRSVEQQLYH

SEQ ID NO: 2951435 - protein, 17 aa, Entamoeba invadens
LDYDGCEKLIEKILVKE

SEQ ID NO: 2951436 - protein, 17 aa, Entamoeba invadens
LDYFFRNNCVGVLMEIN

SEQ ID NO: 2951437 - protein, 17 aa, Entamoeba invadens
LDYFPSLETMFIDSPKT

SEQ ID NO: 2951438 - protein, 25 aa, Entamoeba invadens
LDYIQYILCIMWFKTVTPQDRVFLV

SEQ ID NO: 2951439 - protein, 21 aa, Entamoeba invadens
LDYISRIVFDPVYHESLLLIA

SEQ ID NO: 2951440 - protein, 25 aa, Entamoeba invadens
LDYKNHLFKIYAFIPTNLQLKQQKY

SEQ ID NO: 2951441 - protein, 25 aa, Entamoeba invadens
LEAIEYCGLGDWFGVSEYMGTRSAK

SEQ ID NO: 2951442 - protein, 24 aa, Entamoeba invadens
LEAIPKQKIEIMPPRVVEKMPIGI

SEQ ID NO: 2951443 - protein, 17 aa, Entamoeba invadens
LEAKFVQALNRQSVLAQ

SEQ ID NO: 2951444 - protein, 17 aa, Entamoeba invadens
LEAKKMRESFLVRSSSS

SEQ ID NO: 2951445 - protein, 20 aa, Entamoeba invadens
LEAKPIIVTYDFTAKPFTHK

SEQ ID NO: 2951446 - protein, 25 aa, Entamoeba invadens
LEAKSVQMGIAFIKFSGKDLNALLK

SEQ ID NO: 2951447 - protein, 22 aa, Entamoeba invadens
LEALCDLLGVLGEEMQKLMVMQ

SEQ ID NO: 2951448 - protein, 20 aa, Entamoeba invadens
LEALKGVIAHYFTIQPLKFR

SEQ ID NO: 2951449 - protein, 24 aa, Entamoeba invadens
LEALLRFLKESKIPVAGIGLGPIF

SEQ ID NO: 2951450 - protein, 21 aa, Entamoeba invadens
LEALNKVVFVRSIDEKTMKAA

SEQ ID NO: 2951451 - protein, 18 aa, Entamoeba invadens
LEANAWGVFGYPLESSVK

SEQ ID NO: 2951452 - protein, 24 aa, Entamoeba invadens
LEAPIPRINILQRIVICLNANITR

SEQ ID NO: 2951453 - protein, 22 aa, Entamoeba invadens
LEAPKKLKSWEFDDTPISRGSA

SEQ ID NO: 2951454 - protein, 18 aa, Entamoeba invadens
LEAQKKMALDDKAEAEKT

SEQ ID NO: 2951455 - protein, 17 aa, Entamoeba invadens
LEAQKKMALDNKTDDEK

SEQ ID NO: 2951456 - protein, 17 aa, Entamoeba invadens
LEARKIFYNSLSILMCP

SEQ ID NO: 2951457 - protein, 18 aa, Entamoeba invadens
LEASDPFLGADASIKKKF

SEQ ID NO: 2951458 - protein, 24 aa, Entamoeba invadens
LEASEKRLSCEEMRMNAMRREVLM

SEQ ID NO: 2951459 - protein, 19 aa, Entamoeba invadens
LEASKCFIDTFALKDVLML

SEQ ID NO: 2951460 - protein, 23 aa, Entamoeba invadens
LEASYSAIARKVMDKSALVSSEE

SEQ ID NO: 2951461 - protein, 23 aa, Entamoeba invadens
LEATCVFELSPPMSPPFSDDEMS

SEQ ID NO: 2951462 - protein, 23 aa, Entamoeba invadens
LEAVLSAILCFRISADGKGMIMN

SEQ ID NO: 2951463 - protein, 20 aa, Entamoeba invadens
LEAVRKRPGMYIGDTSDGTG

SEQ ID NO: 2951464 - protein, 21 aa, Entamoeba invadens
LEAYKRIVPKFMKGKKMFDAV

SEQ ID NO: 2951465 - protein, 18 aa, Entamoeba invadens
LECENCLSTKVYLNTTVK

SEQ ID NO: 2951466 - protein, 26 aa, Entamoeba invadens
LECHCKYTIKIYDEFVACFDTLPLVA

SEQ ID NO: 2951467 - protein, 17 aa, Entamoeba invadens
LECIGGHAFENCINLNS

SEQ ID NO: 2951468 - protein, 19 aa, Entamoeba invadens
LECLCDAYCVLKNLMHLIE

SEQ ID NO: 2951469 - protein, 20 aa, Entamoeba invadens
LECLCEMVGDIFEPYVIDIF

SEQ ID NO: 2951470 - protein, 17 aa, Entamoeba invadens
LECLKLNSFNMSYVIYT

SEQ ID NO: 2951471 - protein, 25 aa, Entamoeba invadens
LECLKTVIYPIEWVSTYNMNLQRFF

SEQ ID NO: 2951472 - protein, 21 aa, Entamoeba invadens
LECNKSWCGGLKYMYQHQSPI

SEQ ID NO: 2951473 - protein, 21 aa, Entamoeba invadens
LECSPNFYYKFIKLFKKSNKN

SEQ ID NO: 2951474 - protein, 17 aa, Entamoeba invadens
LECSRDELKAVLLKDKE

SEQ ID NO: 2951475 - protein, 25 aa, Entamoeba invadens
LECVCKKCQIAIISVYINPYRLSEL

SEQ ID NO: 2951476 - protein, 27 aa, Entamoeba invadens
LECVVARAVIGWKNWKEKGSSIAPLLL

SEQ ID NO: 2951477 - protein, 30 aa, Entamoeba invadens
LEDCIKWADTIQCFVVGPGLGRDQYILDIA

SEQ ID NO: 2951478 - protein, 24 aa, Entamoeba invadens
LEDEFRWIASNVKSWGNKLKFINR

SEQ ID NO: 2951479 - protein, 17 aa, Entamoeba invadens
LEDFETLKLIGKGTYGK

SEQ ID NO: 2951480 - protein, 27 aa, Entamoeba invadens
LEDKKAWVIDLNFMFTGEKKYEFEDVE

SEQ ID NO: 2951481 - protein, 30 aa, Entamoeba invadens
LEDKNRKLAVLFKKIEDGLNDSDMLKAQKA

SEQ ID NO: 2951482 - protein, 23 aa, Entamoeba invadens
LEDLKPVGFVAQNPLSFKVQQIT

SEQ ID NO: 2951483 - protein, 42 aa, Entamoeba invadens
LEDLLGKKFCFPGLILHDIILRFIPEQAEFFLTKGSKSDFDT

SEQ ID NO: 2951484 - protein, 18 aa, Entamoeba invadens
LEDLTMLELLRLTYTQTQ

SEQ ID NO: 2951485 - protein, 17 aa, Entamoeba invadens
LEDVIGQQMAIGKTSPF

SEQ ID NO: 2951486 - protein, 19 aa, Entamoeba invadens
LEDYFGYPVIQCMNVTDVD

SEQ ID NO: 2951487 - protein, 18 aa, Entamoeba invadens
LEEAIRWFSRSVKASTLS

SEQ ID NO: 2951488 - protein, 18 aa, Entamoeba invadens
LEEFKDSFFPPDPSVVYF

SEQ ID NO: 2951489 - protein, 18 aa, Entamoeba invadens
LEEGGSIIEMFKAKSKVL

SEQ ID NO: 2951490 - protein, 22 aa, Entamoeba invadens
LEEGYVWVVMEFMDSGCLTEIL

SEQ ID NO: 2951491 - protein, 19 aa, Entamoeba invadens
LEEICNFTKQFSLDPNVKK

SEQ ID NO: 2951492 - protein, 19 aa, Entamoeba invadens
LEEIIPFLDVLKDLPENGR

SEQ ID NO: 2951493 - protein, 24 aa, Entamoeba invadens
LEEIKAGCFENCAFLRNVKIPSSV

SEQ ID NO: 2951494 - protein, 17 aa, Entamoeba invadens
LEEIKSINEGFVKNIQN

SEQ ID NO: 2951495 - protein, 18 aa, Entamoeba invadens
LEEILRFEHIASLSEYVV

SEQ ID NO: 2951496 - protein, 20 aa, Entamoeba invadens
LEEISAFFMSKVQVVLNTNT

SEQ ID NO: 2951497 - protein, 24 aa, Entamoeba invadens
LEEKAMKYLAQFGFGEDLVNKIIA

SEQ ID NO: 2951498 - protein, 20 aa, Entamoeba invadens
LEEKAMKYLAQFGYGEELVN

SEQ ID NO: 2951499 - protein, 22 aa, Entamoeba invadens
LEEKAMKYLAQFGYGEELVNKI

SEQ ID NO: 2951500 - protein, 25 aa, Entamoeba invadens
LEEKFPGFLARTVLFCGVSAGSILS

SEQ ID NO: 2951501 - protein, 18 aa, Entamoeba invadens
LEEKIKYSYILSFESLAV

SEQ ID NO: 2951502 - protein, 23 aa, Entamoeba invadens
LEEKMLLRQLFLSKEHKDVAEIN

SEQ ID NO: 2951503 - protein, 26 aa, Entamoeba invadens
LEEKRQKLIMAEDVEKRCEVLLDIQC

SEQ ID NO: 2951504 - protein, 17 aa, Entamoeba invadens
LEEKRVLLFAPLSTTTG

SEQ ID NO: 2951505 - protein, 18 aa, Entamoeba invadens
LEELKKKRFDEFMNGLTE

SEQ ID NO: 2951506 - protein, 25 aa, Entamoeba invadens
LEELKKMDAAVVLFPCQRVLLVIYS

SEQ ID NO: 2951507 - protein, 21 aa, Entamoeba invadens
LEELKNLVLYLQQTIIKTQSE

SEQ ID NO: 2951508 - protein, 17 aa, Entamoeba invadens
LEELVNLFDIIVSNATF

SEQ ID NO: 2951509 - protein, 36 aa, Entamoeba invadens
LEELVSYLKMVCKMVNLDWEVGRKKFDLSSFENGKK

SEQ ID NO: 2951510 - protein, 22 aa, Entamoeba invadens
LEEMGGSVIWDGVEEVSETTSI

SEQ ID NO: 2951511 - protein, 23 aa, Entamoeba invadens
LEEMIDRWLCFIQQTTQKEWEVT

SEQ ID NO: 2951512 - protein, 24 aa, Entamoeba invadens
LEEMIDRWLCFIQQTTQKEWEVTF

SEQ ID NO: 2951513 - protein, 23 aa, Entamoeba invadens
LEENFKTLLCFVEQQNAVMKKMG

SEQ ID NO: 2951514 - protein, 19 aa, Entamoeba invadens
LEENPSWVVLFGKSMLNSV

SEQ ID NO: 2951515 - protein, 30 aa, Entamoeba invadens
LEENPWVKEMTRISIFGTQQEKEEAYEKYS

SEQ ID NO: 2951516 - protein, 24 aa, Entamoeba invadens
LEEQLPIFFNYLITPMGPPLVSNE

SEQ ID NO: 2951517 - protein, 22 aa, Entamoeba invadens
LEEQWCYRKARKIMDGADSDIL

SEQ ID NO: 2951518 - protein, 24 aa, Entamoeba invadens
LEESDIFPSFGLLVVLYQSLEKEC

SEQ ID NO: 2951519 - protein, 18 aa, Entamoeba invadens
LEETCIQQIPGFDRSINA

SEQ ID NO: 2951520 - protein, 19 aa, Entamoeba invadens
LEETCRVIINDIVVVLSKI

SEQ ID NO: 2951521 - protein, 25 aa, Entamoeba invadens
LEETMKKLKGYRHVNKKARDQYKGF

SEQ ID NO: 2951522 - protein, 20 aa, Entamoeba invadens
LEEVFTSKGIVTFKKRLVVD

SEQ ID NO: 2951523 - protein, 18 aa, Entamoeba invadens
LEEVSRWLNTFGKVEEMK

SEQ ID NO: 2951524 - protein, 21 aa, Entamoeba invadens
LEEVTRQKVSFESQNKELQTR

SEQ ID NO: 2951525 - protein, 22 aa, Entamoeba invadens
LEEWAHPSLKHLVVGNSSHSCF

SEQ ID NO: 2951526 - protein, 17 aa, Entamoeba invadens
LEEWNRPPEGVVLGKKK

SEQ ID NO: 2951527 - protein, 17 aa, Entamoeba invadens
LEEWYKILWDVNTTQFF

SEQ ID NO: 2951528 - protein, 17 aa, Entamoeba invadens
LEEYISLQLVHNKLKSV

SEQ ID NO: 2951529 - protein, 25 aa, Entamoeba invadens
LEEYRKMIEEFKKVEADIIIPVEEL

SEQ ID NO: 2951530 - protein, 26 aa, Entamoeba invadens
LEFCSDEVFNLFGLLEKVTTALFEIT

SEQ ID NO: 2951531 - protein, 24 aa, Entamoeba invadens
LEFEEWTLYEGIIWMIHSTVSSLE

SEQ ID NO: 2951532 - protein, 17 aa, Entamoeba invadens
LEFFYPVSYDKFLEEKK

SEQ ID NO: 2951533 - protein, 20 aa, Entamoeba invadens
LEFIECLTPTITVDKDTIKL

SEQ ID NO: 2951534 - protein, 17 aa, Entamoeba invadens
LEFIKIVATDKMISEEA

SEQ ID NO: 2951535 - protein, 31 aa, Entamoeba invadens
LEFLNELCEAWKLLVELPWTDKQFYTDNELQ

SEQ ID NO: 2951536 - protein, 17 aa, Entamoeba invadens
LEFPHLIIVYYQEISTS

SEQ ID NO: 2951537 - protein, 19 aa, Entamoeba invadens
LEFPNSVVKFGNYVCKNCE

SEQ ID NO: 2951538 - protein, 18 aa, Entamoeba invadens
LEFVSCNTLSSLTIPPSV

SEQ ID NO: 2951539 - protein, 17 aa, Entamoeba invadens
LEGADCLLKAQTGSGKT

SEQ ID NO: 2951540 - protein, 19 aa, Entamoeba invadens
LEGDLSIIPCTEFNNEGEY

SEQ ID NO: 2951541 - protein, 19 aa, Entamoeba invadens
LEGDMKSQDILKVGLECTE

SEQ ID NO: 2951542 - protein, 19 aa, Entamoeba invadens
LEGDYATQLFITVDSKTVL

SEQ ID NO: 2951543 - protein, 30 aa, Entamoeba invadens
LEGIKMKCAMCRNLAAFLLKKIRRDRLSAK

SEQ ID NO: 2951544 - protein, 21 aa, Entamoeba invadens
LEGKGRVLVGVNVVGATDFDY

SEQ ID NO: 2951545 - protein, 20 aa, Entamoeba invadens
LEGKGTQLLLKTKEIASATQ

SEQ ID NO: 2951546 - protein, 23 aa, Entamoeba invadens
LEGKLEFTEFLYGNFRREIPLPA

SEQ ID NO: 2951547 - protein, 23 aa, Entamoeba invadens
LEGKPKMFLPEGIERLMYQVYFS

SEQ ID NO: 2951548 - protein, 19 aa, Entamoeba invadens
LEGMFSTNFSTYFKTEKVV

SEQ ID NO: 2951549 - protein, 18 aa, Entamoeba invadens
LEGMRKRHGVKREHLFDG

SEQ ID NO: 2951550 - protein, 26 aa, Entamoeba invadens
LEGQLIQRPWFFQALEELEYFETSIP

SEQ ID NO: 2951551 - protein, 25 aa, Entamoeba invadens
LEGRGVCLRFPRFIKKRDDKKCSDG

SEQ ID NO: 2951552 - protein, 21 aa, Entamoeba invadens
LEGRIAAVIERLMAQIEEMTN

SEQ ID NO: 2951553 - protein, 22 aa, Entamoeba invadens
LEGRRATCYPSFQPKLHNQSAV

SEQ ID NO: 2951554 - protein, 20 aa, Entamoeba invadens
LEGSSLYRRTLVMVFATAAY

SEQ ID NO: 2951555 - protein, 28 aa, Entamoeba invadens
LEGSVEGFIAFNIGFLLPRDEEINYEKL

SEQ ID NO: 2951556 - protein, 20 aa, Entamoeba invadens
LEGTCVTGVLVHQKGELMSC

SEQ ID NO: 2951557 - protein, 29 aa, Entamoeba invadens
LEGVYNFGNGFAIFSFRFEDVGYDDSTSD

SEQ ID NO: 2951558 - protein, 22 aa, Entamoeba invadens
LEGWDFRGAYHVDDKKPKWFEV

SEQ ID NO: 2951559 - protein, 30 aa, Entamoeba invadens
LEGYYEGGKWSFLFECPRDYPNNPPKVSCI

SEQ ID NO: 2951560 - protein, 20 aa, Entamoeba invadens
LEHCKECSVAIKVNENVQLD

SEQ ID NO: 2951561 - protein, 21 aa, Entamoeba invadens
LEHCKEGLAIHKGQMKAEAAG

SEQ ID NO: 2951562 - protein, 20 aa, Entamoeba invadens
LEHKEYFMQVSMKKLKTFKD

SEQ ID NO: 2951563 - protein, 17 aa, Entamoeba invadens
LEHLVELMKSFSKLISL

SEQ ID NO: 2951564 - protein, 20 aa, Entamoeba invadens
LEHNFFYSFLMAKVMCENFN

SEQ ID NO: 2951565 - protein, 18 aa, Entamoeba invadens
LEHPKLKSVYQVDEALQR

SEQ ID NO: 2951566 - protein, 30 aa, Entamoeba invadens
LEHPVWKLVCLPGLIGAIGEKDVYVFNNNF

SEQ ID NO: 2951567 - protein, 18 aa, Entamoeba invadens
LEHRSLRTVIFSADSPTT

SEQ ID NO: 2951568 - protein, 18 aa, Entamoeba invadens
LEHVKKNQGVVFKKDDDK

SEQ ID NO: 2951569 - protein, 17 aa, Entamoeba invadens
LEIAALRCEEGFKEISE

SEQ ID NO: 2951570 - protein, 17 aa, Entamoeba invadens
LEIAVGCAISAFEKTSA

SEQ ID NO: 2951571 - protein, 19 aa, Entamoeba invadens
LEIESCKKIEGIIKTPLTQ

SEQ ID NO: 2951572 - protein, 19 aa, Entamoeba invadens
LEIFLPFEHSNTILPNNIY

SEQ ID NO: 2951573 - protein, 23 aa, Entamoeba invadens
LEIGCFKGCYSLSKIVINGPIKV

SEQ ID NO: 2951574 - protein, 17 aa, Entamoeba invadens
LEIGEDFLYYSYNLQNI

SEQ ID NO: 2951575 - protein, 18 aa, Entamoeba invadens
LEIGKFCFQSCSSLEYVE

SEQ ID NO: 2951576 - protein, 18 aa, Entamoeba invadens
LEIGKTWLSLISEKTGHH

SEQ ID NO: 2951577 - protein, 18 aa, Entamoeba invadens
LEIICKRAFFNCQKLENF

SEQ ID NO: 2951578 - protein, 20 aa, Entamoeba invadens
LEIIDIFFVLVCPKVGSCTC

SEQ ID NO: 2951579 - protein, 24 aa, Entamoeba invadens
LEIIKKGRGTYRINSECSSEDFDY

SEQ ID NO: 2951580 - protein, 37 aa, Entamoeba invadens
LEIIKLTLICLSSLSIHKRCLDTLIQNGCQFDVFNAI

SEQ ID NO: 2951581 - protein, 20 aa, Entamoeba invadens
LEIITLWYRPLEILLGKEVY

SEQ ID NO: 2951582 - protein, 18 aa, Entamoeba invadens
LEIKCLMRKQLVEMALTQ

SEQ ID NO: 2951583 - protein, 17 aa, Entamoeba invadens
LEIKIPLSVKSMADDCF

SEQ ID NO: 2951584 - protein, 17 aa, Entamoeba invadens
LEIKKCFSIKNDGKSVV

SEQ ID NO: 2951585 - protein, 17 aa, Entamoeba invadens
LEIKPQTVLKCFLGVLY

SEQ ID NO: 2951586 - protein, 25 aa, Entamoeba invadens
LEIKTMVECNALFKQRSEEGMRNIK

SEQ ID NO: 2951587 - protein, 27 aa, Entamoeba invadens
LEILDLCCNCILDIECLTALYNLKELN

SEQ ID NO: 2951588 - protein, 20 aa, Entamoeba invadens
LEILEEVKFFGSILKMKHSK

SEQ ID NO: 2951589 - protein, 18 aa, Entamoeba invadens
LEILKEFASQQWDRTLCY

SEQ ID NO: 2951590 - protein, 27 aa, Entamoeba invadens
LEINMCSRRLYTLFKTFIEMHAESLIR

SEQ ID NO: 2951591 - protein, 17 aa, Entamoeba invadens
LEIQQIYFFQSITWFSV

SEQ ID NO: 2951592 - protein, 17 aa, Entamoeba invadens
LEIRDFNMAYLLFTSIV

SEQ ID NO: 2951593 - protein, 18 aa, Entamoeba invadens
LEIRFAKLAKTFSDYQNL

SEQ ID NO: 2951594 - protein, 18 aa, Entamoeba invadens
LEISRPSVVFGDLHGQYF

SEQ ID NO: 2951595 - protein, 19 aa, Entamoeba invadens
LEITFGIPNDVPWTDNHAT

SEQ ID NO: 2951596 - protein, 26 aa, Entamoeba invadens
LEIVQKYKIGAVLSFGPTPIDYLPSV

SEQ ID NO: 2951597 - protein, 25 aa, Entamoeba invadens
LEIYKDRVFNNWATKVFAEVKNVSC

SEQ ID NO: 2951598 - protein, 17 aa, Entamoeba invadens
LEIYVAEFANYQNALKH

SEQ ID NO: 2951599 - protein, 26 aa, Entamoeba invadens
LEKALKYLFDKGLDKEGLFRLSSTLE

SEQ ID NO: 2951600 - protein, 17 aa, Entamoeba invadens
LEKAVVSSITLYLTSKS

SEQ ID NO: 2951601 - protein, 17 aa, Entamoeba invadens
LEKCLSVIQSNGVYAQF

SEQ ID NO: 2951602 - protein, 21 aa, Entamoeba invadens
LEKDLSVKEIIYLRNYAKTET

SEQ ID NO: 2951603 - protein, 21 aa, Entamoeba invadens
LEKERLRTERRKKERAERDAA

SEQ ID NO: 2951604 - protein, 20 aa, Entamoeba invadens
LEKEYPPGIYTFPFSFKVPL

SEQ ID NO: 2951605 - protein, 27 aa, Entamoeba invadens
LEKFFHAYATWDWARNPVMLGVSDDRP

SEQ ID NO: 2951606 - protein, 21 aa, Entamoeba invadens
LEKFFNVLFCGDRSGVLSFLQ

SEQ ID NO: 2951607 - protein, 17 aa, Entamoeba invadens
LEKFTICSRKFNIEEVN

SEQ ID NO: 2951608 - protein, 25 aa, Entamoeba invadens
LEKGFQYEVCCNVKLTANAKKFFAF

SEQ ID NO: 2951609 - protein, 23 aa, Entamoeba invadens
LEKHKGKTVVLVFYPHDWTYICP

SEQ ID NO: 2951610 - protein, 18 aa, Entamoeba invadens
LEKIDCMYYQLLVNQNVI

SEQ ID NO: 2951611 - protein, 25 aa, Entamoeba invadens
LEKIKKLRITPVIATSLKINISKCT

SEQ ID NO: 2951612 - protein, 22 aa, Entamoeba invadens
LEKISKALLKFSTHDGLEELTV

SEQ ID NO: 2951613 - protein, 23 aa, Entamoeba invadens
LEKKLYERSEFHFDPSQMQKRFD

SEQ ID NO: 2951614 - protein, 21 aa, Entamoeba invadens
LEKKSGMLLDCYDVSYLWVGK

SEQ ID NO: 2951615 - protein, 17 aa, Entamoeba invadens
LEKKSKFVVESDEEDTR

SEQ ID NO: 2951616 - protein, 20 aa, Entamoeba invadens
LEKLAKGWYPEKEIICAVCK

SEQ ID NO: 2951617 - protein, 25 aa, Entamoeba invadens
LEKLHCYEMDVLNCFIRVVQTVELP

SEQ ID NO: 2951618 - protein, 23 aa, Entamoeba invadens
LEKLKCGIATKLFEVGVVNEDIF

SEQ ID NO: 2951619 - protein, 24 aa, Entamoeba invadens
LEKLRKCITACYFYNAAKIKGQSY

SEQ ID NO: 2951620 - protein, 25 aa, Entamoeba invadens
LEKLTLCYDLLPTVFKKPLSSPEFA

SEQ ID NO: 2951621 - protein, 23 aa, Entamoeba invadens
LEKLWKYTYEQLKTDPKEHNLIF

SEQ ID NO: 2951622 - protein, 19 aa, Entamoeba invadens
LEKMCDLIQPIIRAQTAPA

SEQ ID NO: 2951623 - protein, 22 aa, Entamoeba invadens
LEKMFYQIVVWFGVNYGTVDKN

SEQ ID NO: 2951624 - protein, 23 aa, Entamoeba invadens
LEKMPLTSFGKVYAPELRKLAIE

SEQ ID NO: 2951625 - protein, 22 aa, Entamoeba invadens
LEKMTIPPVDHFIRQSNLSTAY

SEQ ID NO: 2951626 - protein, 18 aa, Entamoeba invadens
LEKNRKVFVQNLLIDITR

SEQ ID NO: 2951627 - protein, 19 aa, Entamoeba invadens
LEKPIEVFRNVYVTVDDLL

SEQ ID NO: 2951628 - protein, 20 aa, Entamoeba invadens
LEKRGKLVVLSRGVSEEVFS

SEQ ID NO: 2951629 - protein, 17 aa, Entamoeba invadens
LEKRGVILFSQTETNYF

SEQ ID NO: 2951630 - protein, 19 aa, Entamoeba invadens
LEKRKERISSENIDYEAVE

SEQ ID NO: 2951631 - protein, 17 aa, Entamoeba invadens
LEKRRIDINNGVSEKTS

SEQ ID NO: 2951632 - protein, 21 aa, Entamoeba invadens
LEKTLKDKQLRMWTLEEQNKR

SEQ ID NO: 2951633 - protein, 17 aa, Entamoeba invadens
LEKVCPTSLIFSDIQRD

SEQ ID NO: 2951634 - protein, 23 aa, Entamoeba invadens
LEKVFPSAFQFIATKTKDLDFRF

SEQ ID NO: 2951635 - protein, 26 aa, Entamoeba invadens
LEKVPLRNGLPYPLVDCLEYFNTHSA

SEQ ID NO: 2951636 - protein, 17 aa, Entamoeba invadens
LELCFFSKSLLSREPNV

SEQ ID NO: 2951637 - protein, 26 aa, Entamoeba invadens
LELCKEILKFRPLKKYVTVIPSSLET

SEQ ID NO: 2951638 - protein, 20 aa, Entamoeba invadens
LELEGYEFSDCVKLTEIVGL

SEQ ID NO: 2951639 - protein, 24 aa, Entamoeba invadens
LELEIRTVVYLSDRLDEVKELSEI

SEQ ID NO: 2951640 - protein, 18 aa, Entamoeba invadens
LELENSLRIIGLDKEKVV

SEQ ID NO: 2951641 - protein, 17 aa, Entamoeba invadens
LELFGCQNLDDFSLEKI

SEQ ID NO: 2951642 - protein, 26 aa, Entamoeba invadens
LELFKEWKSGMPLAMVFVSSFNSVIR

SEQ ID NO: 2951643 - protein, 27 aa, Entamoeba invadens
LELFKEWKSGMPLPMVFVSSFNSVIRL

SEQ ID NO: 2951644 - protein, 23 aa, Entamoeba invadens
LELFPCDILKLSNLRFLNLSANE

SEQ ID NO: 2951645 - protein, 21 aa, Entamoeba invadens
LELGDAFTWFSKAQEYFFNWF

SEQ ID NO: 2951646 - protein, 21 aa, Entamoeba invadens
LELIEKLQIYKKCEFKKKYED

SEQ ID NO: 2951647 - protein, 21 aa, Entamoeba invadens
LELIKEGRAAVVMLAGGQGTR

SEQ ID NO: 2951648 - protein, 29 aa, Entamoeba invadens
LELIPRDEIPFGIPGCSYATAPFTHVNPS

SEQ ID NO: 2951649 - protein, 25 aa, Entamoeba invadens
LELIRKLKAACKMDESLGSFYQDVS

SEQ ID NO: 2951650 - protein, 17 aa, Entamoeba invadens
LELIVIFSCKALDTLLF

SEQ ID NO: 2951651 - protein, 23 aa, Entamoeba invadens
LELKEFIYMFYFIQLDGDFEKKK

SEQ ID NO: 2951652 - protein, 17 aa, Entamoeba invadens
LELKKPIYRAALSLVGM

SEQ ID NO: 2951653 - protein, 23 aa, Entamoeba invadens
LELKVRELIAVWGSFYPNEMNEY

SEQ ID NO: 2951654 - protein, 19 aa, Entamoeba invadens
LELLELYSAGILNGLYITT

SEQ ID NO: 2951655 - protein, 40 aa, Entamoeba invadens
LELLQLCSACLVPKVTFRMMYNSIRFVWNTPILILEKIIL

SEQ ID NO: 2951656 - protein, 20 aa, Entamoeba invadens
LELNASCLSVFSNIKKKLFI

SEQ ID NO: 2951657 - protein, 17 aa, Entamoeba invadens
LELNTMFEQLVKQNEEN

SEQ ID NO: 2951658 - protein, 19 aa, Entamoeba invadens
LELRFCNWTTVKPGSKIEE

SEQ ID NO: 2951659 - protein, 18 aa, Entamoeba invadens
LELRMCSLVTDSGIKTLI

SEQ ID NO: 2951660 - protein, 21 aa, Entamoeba invadens
LELRNSFISSCRIVVENHFAR

SEQ ID NO: 2951661 - protein, 26 aa, Entamoeba invadens
LELSMKRNRFCIIDELITTEERYVSL

SEQ ID NO: 2951662 - protein, 19 aa, Entamoeba invadens
LELTFPTLLKGAISYLEKL

SEQ ID NO: 2951663 - protein, 18 aa, Entamoeba invadens
LELTHLFVSCSRGPSMLK

SEQ ID NO: 2951664 - protein, 19 aa, Entamoeba invadens
LELWDTCGQTDYLRVSQRL

SEQ ID NO: 2951665 - protein, 17 aa, Entamoeba invadens
LELWSTRFDLSPFPNPN

SEQ ID NO: 2951666 - protein, 31 aa, Entamoeba invadens
LELYKEYLKNDCINYILTIVMKLSPEQQLFF

SEQ ID NO: 2951667 - protein, 18 aa, Entamoeba invadens
LELYKKLYYGESFKFNLL

SEQ ID NO: 2951668 - protein, 26 aa, Entamoeba invadens
LEMAIKSNDSFPCFYNVQKYFSNRNK

SEQ ID NO: 2951669 - protein, 19 aa, Entamoeba invadens
LEMAPLLVFIRDFVGNNQR

SEQ ID NO: 2951670 - protein, 17 aa, Entamoeba invadens
LEMCSCSSLKTLQISNL

SEQ ID NO: 2951671 - protein, 21 aa, Entamoeba invadens
LEMGKSLSLEQLMKVFELNEN

SEQ ID NO: 2951672 - protein, 17 aa, Entamoeba invadens
LEMGVGQAIIFVNRKEE

SEQ ID NO: 2951673 - protein, 17 aa, Entamoeba invadens
LEMIKKTVIGDENIDGV

SEQ ID NO: 2951674 - protein, 17 aa, Entamoeba invadens
LEMKNKFLSKIDGYAKY

SEQ ID NO: 2951675 - protein, 25 aa, Entamoeba invadens
LEMKPPVICKILAIVNNWINVYPPL

SEQ ID NO: 2951676 - protein, 18 aa, Entamoeba invadens
LEMKVGGMSVIMEKDGKE

SEQ ID NO: 2951677 - protein, 19 aa, Entamoeba invadens
LEMNERVNAIMTDFGSARN

SEQ ID NO: 2951678 - protein, 20 aa, Entamoeba invadens
LEMNGCKAISKICNLPKLKI

SEQ ID NO: 2951679 - protein, 21 aa, Entamoeba invadens
LEMQACKRYIIRLQSAVLGPN

SEQ ID NO: 2951680 - protein, 22 aa, Entamoeba invadens
LEMQACKRYIIRLQSAVLGPNP

SEQ ID NO: 2951681 - protein, 23 aa, Entamoeba invadens
LEMRKANESYKQQIDVMSVDLEN

SEQ ID NO: 2951682 - protein, 25 aa, Entamoeba invadens
LEMTIYRLGGVIGLMSKGIPTLVED

SEQ ID NO: 2951683 - protein, 20 aa, Entamoeba invadens
LENAEKFLADFDHFSQQEDS

SEQ ID NO: 2951684 - protein, 25 aa, Entamoeba invadens
LENAELRLSGFTHILTRLDNTIFID

SEQ ID NO: 2951685 - protein, 26 aa, Entamoeba invadens
LENAKRLNVAITRARNNLILVMHHNI

SEQ ID NO: 2951686 - protein, 17 aa, Entamoeba invadens
LENEFPKLITELSNTEP

SEQ ID NO: 2951687 - protein, 21 aa, Entamoeba invadens
LENFPTTGILQIFIYPDNCYG

SEQ ID NO: 2951688 - protein, 28 aa, Entamoeba invadens
LENFRTEFLRYCPLYENIYQTLSESDIQ

SEQ ID NO: 2951689 - protein, 23 aa, Entamoeba invadens
LENGVPFLPIGMYYSSITEDEME

SEQ ID NO: 2951690 - protein, 17 aa, Entamoeba invadens
LENIALDAFSRMERVYD

SEQ ID NO: 2951691 - protein, 20 aa, Entamoeba invadens
LENIGERPLDVFVGNNNRIE

SEQ ID NO: 2951692 - protein, 18 aa, Entamoeba invadens
LENIKGKKSVTCEEIEKC

SEQ ID NO: 2951693 - protein, 18 aa, Entamoeba invadens
LENIPQMTQRFFISVQKA

SEQ ID NO: 2951694 - protein, 24 aa, Entamoeba invadens
LENIRYIYSGAFINCSLLQKVKLN

SEQ ID NO: 2951695 - protein, 18 aa, Entamoeba invadens
LENLKTDFALLIKEVMTL

SEQ ID NO: 2951696 - protein, 18 aa, Entamoeba invadens
LENLYCLNNLVQNIFIYG

SEQ ID NO: 2951697 - protein, 18 aa, Entamoeba invadens
LENMFLFGNSFGNYLPSQ

SEQ ID NO: 2951698 - protein, 19 aa, Entamoeba invadens
LENNCLKLNAAITSKEKAL

SEQ ID NO: 2951699 - protein, 28 aa, Entamoeba invadens
LENQIGTALFKFAGVLNIYKLFVSNSDT

SEQ ID NO: 2951700 - protein, 25 aa, Entamoeba invadens
LENRCVPTASAQQWCDLRNYTYVES

SEQ ID NO: 2951701 - protein, 22 aa, Entamoeba invadens
LENRVKALELVIDRVESGNIPH

SEQ ID NO: 2951702 - protein, 17 aa, Entamoeba invadens
LENRYGAAIPAESSFFG

SEQ ID NO: 2951703 - protein, 19 aa, Entamoeba invadens
LENSCYLELSFVNENDKEV

SEQ ID NO: 2951704 - protein, 18 aa, Entamoeba invadens
LENSICLQRANISNVDKT

SEQ ID NO: 2951705 - protein, 25 aa, Entamoeba invadens
LENSMSYIRFIKCVEKFGMESIETS

SEQ ID NO: 2951706 - protein, 17 aa, Entamoeba invadens
LENSVVFELSRKTDVRV

SEQ ID NO: 2951707 - protein, 25 aa, Entamoeba invadens
LENVGAFCFKDCYSLKSASFRNKNL

SEQ ID NO: 2951708 - protein, 19 aa, Entamoeba invadens
LENVIQWIDSEEVLKKSQT

SEQ ID NO: 2951709 - protein, 27 aa, Entamoeba invadens
LENVSSRKFICCGPLIALDNMNDPPVK

SEQ ID NO: 2951710 - protein, 20 aa, Entamoeba invadens
LENYKNFFIDFSHTVYISPN

SEQ ID NO: 2951711 - protein, 23 aa, Entamoeba invadens
LEPCKLKKLRLERNTEICVDADF

SEQ ID NO: 2951712 - protein, 20 aa, Entamoeba invadens
LEPFKYLIQLSSFFSDKFFY

SEQ ID NO: 2951713 - protein, 21 aa, Entamoeba invadens
LEPFMFHVCTKLLKIEIPTTI

SEQ ID NO: 2951714 - protein, 25 aa, Entamoeba invadens
LEPFRPEEVTAFLVQRLLGKLEEIP

SEQ ID NO: 2951715 - protein, 17 aa, Entamoeba invadens
LEPIFLMNVVLYITQSD

SEQ ID NO: 2951716 - protein, 18 aa, Entamoeba invadens
LEPILKFHREILQSDKSH

SEQ ID NO: 2951717 - protein, 22 aa, Entamoeba invadens
LEPKREVEIFSMFGSGEEELRN

SEQ ID NO: 2951718 - protein, 20 aa, Entamoeba invadens
LEPLLPQIVEALLCLMIDEH

SEQ ID NO: 2951719 - protein, 24 aa, Entamoeba invadens
LEPPGGLMPPGMLPPPGLAPPGGM

SEQ ID NO: 2951720 - protein, 18 aa, Entamoeba invadens
LEPQISISDGFSSLPNHK

SEQ ID NO: 2951721 - protein, 17 aa, Entamoeba invadens
LEPTNFYLWQFAGEVAL

SEQ ID NO: 2951722 - protein, 22 aa, Entamoeba invadens
LEPVSPVLHFDFGMPDNETKND

SEQ ID NO: 2951723 - protein, 19 aa, Entamoeba invadens
LEPVTVCRMGEDFTVSIVM

SEQ ID NO: 2951724 - protein, 26 aa, Entamoeba invadens
LEQALKFIVADGIKLVNIDAQNIFEG

SEQ ID NO: 2951725 - protein, 18 aa, Entamoeba invadens
LEQCKPEFSFTVESKQRT

SEQ ID NO: 2951726 - protein, 20 aa, Entamoeba invadens
LEQDLALKYKAGVTVEDKVV

SEQ ID NO: 2951727 - protein, 19 aa, Entamoeba invadens
LEQFRRAAAFGESDMLNGV

SEQ ID NO: 2951728 - protein, 24 aa, Entamoeba invadens
LEQHLNEGRYEYYMENGNQKMLEE

SEQ ID NO: 2951729 - protein, 23 aa, Entamoeba invadens
LEQKVMFVLCTLEECGVLTFQKV

SEQ ID NO: 2951730 - protein, 18 aa, Entamoeba invadens
LEQLDFPKSLTFIKKNAF

SEQ ID NO: 2951731 - protein, 18 aa, Entamoeba invadens
LEQLELASIGGYIKSYKQ

SEQ ID NO: 2951732 - protein, 18 aa, Entamoeba invadens
LEQLFMTVGKVLKVSIPT

SEQ ID NO: 2951733 - protein, 18 aa, Entamoeba invadens
LEQLKAKNWRKSILDALN

SEQ ID NO: 2951734 - protein, 17 aa, Entamoeba invadens
LEQLKLSVVEFGECVLK

SEQ ID NO: 2951735 - protein, 19 aa, Entamoeba invadens
LEQLTLLSMLDFSFNKIND

SEQ ID NO: 2951736 - protein, 23 aa, Entamoeba invadens
LEQMKTQMSQLVGDKQKLEEKMT

SEQ ID NO: 2951737 - protein, 26 aa, Entamoeba invadens
LEQPTTCPLCHFGLVQVKNKTTTETF

SEQ ID NO: 2951738 - protein, 24 aa, Entamoeba invadens
LEQYSGNCRFVFICNEVNLITPAI

SEQ ID NO: 2951739 - protein, 20 aa, Entamoeba invadens
LEQYVKFRVDEVELKKLSTE

SEQ ID NO: 2951740 - protein, 19 aa, Entamoeba invadens
LERIKFRYSNLRQRELDLS

SEQ ID NO: 2951741 - protein, 19 aa, Entamoeba invadens
LERIKLKEVIEIVKNPQRI

SEQ ID NO: 2951742 - protein, 41 aa, Entamoeba invadens
LERLSIIVCDMVKRIVLPHSLKYLMVYGCKEIIAFDNMKNG

SEQ ID NO: 2951743 - protein, 21 aa, Entamoeba invadens
LERNNPFIFAFLAKDEALNKH

SEQ ID NO: 2951744 - protein, 27 aa, Entamoeba invadens
LERTGICSYNALAALSRLFFREVDESF

SEQ ID NO: 2951745 - protein, 17 aa, Entamoeba invadens
LERVPCKLTKPVPRSKI

SEQ ID NO: 2951746 - protein, 29 aa, Entamoeba invadens
LERVRSEGLQKLFTCLCAEINETFPQDLA

SEQ ID NO: 2951747 - protein, 25 aa, Entamoeba invadens
LERVSEIFYNGVLVFDRNQIQHMGR

SEQ ID NO: 2951748 - protein, 20 aa, Entamoeba invadens
LERVSRCLNHNLNPEESIGV

SEQ ID NO: 2951749 - protein, 21 aa, Entamoeba invadens
LERYKIKSVVSIIEVEPKIPG

SEQ ID NO: 2951750 - protein, 18 aa, Entamoeba invadens
LESCLQYRKSTLDLTKLT

SEQ ID NO: 2951751 - protein, 18 aa, Entamoeba invadens
LESDIVVFAFPVYWYDLP

SEQ ID NO: 2951752 - protein, 24 aa, Entamoeba invadens
LESEKTKSLEVVKKIETLQVENAK

SEQ ID NO: 2951753 - protein, 27 aa, Entamoeba invadens
LESETIYSLLLARGMALRSTFLSSLIQ

SEQ ID NO: 2951754 - protein, 18 aa, Entamoeba invadens
LESFAYSILYLAKGSLPW

SEQ ID NO: 2951755 - protein, 20 aa, Entamoeba invadens
LESFKLIGCVNEIDFSTNKV

SEQ ID NO: 2951756 - protein, 21 aa, Entamoeba invadens
LESIKSNAFKCCGLTEIVIPQ

SEQ ID NO: 2951757 - protein, 18 aa, Entamoeba invadens
LESISLPLSVSRINDNCF

SEQ ID NO: 2951758 - protein, 24 aa, Entamoeba invadens
LESKDGVCFKHEFFQKDHPDYLQK

SEQ ID NO: 2951759 - protein, 24 aa, Entamoeba invadens
LESKKPRGSTYFRQSQPRSTYFDR

SEQ ID NO: 2951760 - protein, 20 aa, Entamoeba invadens
LESKNNCLLLQKGASTQYDA

SEQ ID NO: 2951761 - protein, 20 aa, Entamoeba invadens
LESLFTFLGLNPLVFLMIRP

SEQ ID NO: 2951762 - protein, 25 aa, Entamoeba invadens
LESLGYKEGTHFVVIVKKQALKTGA

SEQ ID NO: 2951763 - protein, 24 aa, Entamoeba invadens
LESLKERLEKEIMEKKHIQDDYND

SEQ ID NO: 2951764 - protein, 23 aa, Entamoeba invadens
LESLNFWLCSMFNKTEIQGFYGI

SEQ ID NO: 2951765 - protein, 27 aa, Entamoeba invadens
LESLPTWWKKERKELKMSTAKLREVIF

SEQ ID NO: 2951766 - protein, 24 aa, Entamoeba invadens
LESPDLKADFILLAQPAVTHILMT

SEQ ID NO: 2951767 - protein, 24 aa, Entamoeba invadens
LESQFCGFCAVNIYDIKQDLEYYF

SEQ ID NO: 2951768 - protein, 19 aa, Entamoeba invadens
LESQLAPIVVFATNRGLVE

SEQ ID NO: 2951769 - protein, 17 aa, Entamoeba invadens
LESSGRFTMTHETQQKL

SEQ ID NO: 2951770 - protein, 27 aa, Entamoeba invadens
LESSLPFLHFFDGFRTSHEIQKIHQLS

SEQ ID NO: 2951771 - protein, 22 aa, Entamoeba invadens
LESVDFGNGVVMTYDPDTLEQH

SEQ ID NO: 2951772 - protein, 45 aa, Entamoeba invadens
LESVIIRKDIETIGRLCFVNCQLLKKFVCKNIKKCFVSSFENTQV

SEQ ID NO: 2951773 - protein, 26 aa, Entamoeba invadens
LESWTEKKIGGIIFDSAVDDWGKRSS

SEQ ID NO: 2951774 - protein, 22 aa, Entamoeba invadens
LETAPNVSFRCVETMYYNHHLG

SEQ ID NO: 2951775 - protein, 25 aa, Entamoeba invadens
LETCLKTIELHYGKEYDLLESDNKS

SEQ ID NO: 2951776 - protein, 25 aa, Entamoeba invadens
LETDLTLTKRVVAIGSKPGKNTVWV

SEQ ID NO: 2951777 - protein, 18 aa, Entamoeba invadens
LETFKTLKNILAIKDVDE

SEQ ID NO: 2951778 - protein, 26 aa, Entamoeba invadens
LETHIPFDFIVNGDFLRKTLGEHLTE

SEQ ID NO: 2951779 - protein, 20 aa, Entamoeba invadens
LETLGSYSLADCTSLKSITL

SEQ ID NO: 2951780 - protein, 17 aa, Entamoeba invadens
LETLILWPENNFLAFKH

SEQ ID NO: 2951781 - protein, 17 aa, Entamoeba invadens
LETLILWPKDNFLAFKH

SEQ ID NO: 2951782 - protein, 21 aa, Entamoeba invadens
LETLKIFKWKNFPQISRKIKN

SEQ ID NO: 2951783 - protein, 22 aa, Entamoeba invadens
LETLLKCLPDYLEEKLLIESAL

SEQ ID NO: 2951784 - protein, 21 aa, Entamoeba invadens
LETLTGFKWIGNVAKKVVDTE

SEQ ID NO: 2951785 - protein, 17 aa, Entamoeba invadens
LETMAVWINRPRSRIDK

SEQ ID NO: 2951786 - protein, 31 aa, Entamoeba invadens
LETMYHPKCPLPSCGFDWCHQNPDLLCTWYL

SEQ ID NO: 2951787 - protein, 24 aa, Entamoeba invadens
LETNPKCWDIPKVAAVPPITDKCE

SEQ ID NO: 2951788 - protein, 22 aa, Entamoeba invadens
LETPNVYVVRAFFDDFTELTNL

SEQ ID NO: 2951789 - protein, 17 aa, Entamoeba invadens
LETQYGIPSSSHLKIER

SEQ ID NO: 2951790 - protein, 20 aa, Entamoeba invadens
LETRCIVMLPSRSGCVTCKD

SEQ ID NO: 2951791 - protein, 19 aa, Entamoeba invadens
LETRYEEYYGLSSSTLQYW

SEQ ID NO: 2951792 - protein, 20 aa, Entamoeba invadens
LETSFPLSLISNVFSTDVYY

SEQ ID NO: 2951793 - protein, 19 aa, Entamoeba invadens
LETSFRNTQRFLKMYQDCA

SEQ ID NO: 2951794 - protein, 29 aa, Entamoeba invadens
LETTLRFNFWDKITFKFEVDEIGKIKLVV

SEQ ID NO: 2951795 - protein, 23 aa, Entamoeba invadens
LETVPAFRYELLGTEKFVEKSTK

SEQ ID NO: 2951796 - protein, 27 aa, Entamoeba invadens
LETVYKVTKKDSGPCFDSEEIEKIGED

SEQ ID NO: 2951797 - protein, 18 aa, Entamoeba invadens
LETWTVPMFQGLLPRHME

SEQ ID NO: 2951798 - protein, 24 aa, Entamoeba invadens
LEVAKNAKVRRFIHVSTDEVYGQV

SEQ ID NO: 2951799 - protein, 22 aa, Entamoeba invadens
LEVFQKSTLIGFFLKQLGSPYS

SEQ ID NO: 2951800 - protein, 24 aa, Entamoeba invadens
LEVICTILKWFIHKEDTDYSTDLK

SEQ ID NO: 2951801 - protein, 18 aa, Entamoeba invadens
LEVIFNFQRTEQVVLSSS

SEQ ID NO: 2951802 - protein, 31 aa, Entamoeba invadens
LEVKSGFQIIGRQCCYYWEYLQSVVLPFGIK

SEQ ID NO: 2951803 - protein, 18 aa, Entamoeba invadens
LEVLCRRKPVGVDITDTV

SEQ ID NO: 2951804 - protein, 20 aa, Entamoeba invadens
LEVLFKVLSFDATIQQNGPI

SEQ ID NO: 2951805 - protein, 20 aa, Entamoeba invadens
LEVLLKYGANIGQIYNGKPL

SEQ ID NO: 2951806 - protein, 20 aa, Entamoeba invadens
LEVLRWKKLDEKMALLQNAY

SEQ ID NO: 2951807 - protein, 25 aa, Entamoeba invadens
LEVPEKCKFVKGTVRNDYTTEKIDY

SEQ ID NO: 2951808 - protein, 26 aa, Entamoeba invadens
LEVPEVRKAVCNKLEFLGVELDSEKN

SEQ ID NO: 2951809 - protein, 20 aa, Entamoeba invadens
LEVPNTIGLARICFPATPSH

SEQ ID NO: 2951810 - protein, 27 aa, Entamoeba invadens
LEVQERACFFLAILRQFETLREQHIDI

SEQ ID NO: 2951811 - protein, 17 aa, Entamoeba invadens
LEVQKKMALDDKAEAEK

SEQ ID NO: 2951812 - protein, 19 aa, Entamoeba invadens
LEVSLPFDRQFSEDKSVTI

SEQ ID NO: 2951813 - protein, 25 aa, Entamoeba invadens
LEVVTLKSGFACEFSVYYVKPLCSC

SEQ ID NO: 2951814 - protein, 18 aa, Entamoeba invadens
LEVVYFPLSITKLKVTKC

SEQ ID NO: 2951815 - protein, 20 aa, Entamoeba invadens
LEVYIWYDAELKRLNLEKER

SEQ ID NO: 2951816 - protein, 29 aa, Entamoeba invadens
LEVYNCRMCSINLKTKRLVFDNGVDKRID

SEQ ID NO: 2951817 - protein, 24 aa, Entamoeba invadens
LEVYYRKLLFGLGVAFATQMIQNP

SEQ ID NO: 2951818 - protein, 18 aa, Entamoeba invadens
LEYCLKQLTRMEGLPEEL

SEQ ID NO: 2951819 - protein, 19 aa, Entamoeba invadens
LEYERKEGDKMIGVAFVQR

SEQ ID NO: 2951820 - protein, 25 aa, Entamoeba invadens
LEYFGCITKGCYFHLCQSLWRKVNT

SEQ ID NO: 2951821 - protein, 23 aa, Entamoeba invadens
LEYGFPITIKDGAWIGANAIIMP

SEQ ID NO: 2951822 - protein, 17 aa, Entamoeba invadens
LEYHAWLMVFLKHDSSV

SEQ ID NO: 2951823 - protein, 18 aa, Entamoeba invadens
LEYIHRWQICHRDVKLEN

SEQ ID NO: 2951824 - protein, 20 aa, Entamoeba invadens
LEYLSALLMLGEENITTDTL

SEQ ID NO: 2951825 - protein, 20 aa, Entamoeba invadens
LEYLTFMLKLFVSAPLTQDF

SEQ ID NO: 2951826 - protein, 19 aa, Entamoeba invadens
LEYPSCTQIALKYLSENER

SEQ ID NO: 2951827 - protein, 18 aa, Entamoeba invadens
LEYRDFTEQIGFKEPLCG

SEQ ID NO: 2951828 - protein, 21 aa, Entamoeba invadens
LEYVKCLTEYVKVLKLTNSTC

SEQ ID NO: 2951829 - protein, 18 aa, Entamoeba invadens
LEYVKKGKSEELRKRPVK

SEQ ID NO: 2951830 - protein, 18 aa, Entamoeba invadens
LFAEETRENIIFITIEEA

SEQ ID NO: 2951831 - protein, 20 aa, Entamoeba invadens
LFAEQRFDFLDSSVLLYMKT

SEQ ID NO: 2951832 - protein, 20 aa, Entamoeba invadens
LFAFPGDIVTLGIFPPSLWK

SEQ ID NO: 2951833 - protein, 27 aa, Entamoeba invadens
LFAGKKLECKQCYEREFEEEEGKKVTD

SEQ ID NO: 2951834 - protein, 17 aa, Entamoeba invadens
LFAIPVVEQLNGTQKSL

SEQ ID NO: 2951835 - protein, 17 aa, Entamoeba invadens
LFAKMLKMCKADWYYPN

SEQ ID NO: 2951836 - protein, 23 aa, Entamoeba invadens
LFALYYKQWENIVLRQKDELLQK

SEQ ID NO: 2951837 - protein, 21 aa, Entamoeba invadens
LFAMPQFKNGITIKLDKKLFT

SEQ ID NO: 2951838 - protein, 26 aa, Entamoeba invadens
LFANVLRCLINLGDFNSAFGVYSGIQ

SEQ ID NO: 2951839 - protein, 20 aa, Entamoeba invadens
LFAPEIVEKLLGFLKQIDEA

SEQ ID NO: 2951840 - protein, 20 aa, Entamoeba invadens
LFASAAFDYSIKVWDIRSVT

SEQ ID NO: 2951841 - protein, 22 aa, Entamoeba invadens
LFATNCIESGLFDEILRFLDFV

SEQ ID NO: 2951842 - protein, 20 aa, Entamoeba invadens
LFCDVCQKHTTLSISVVDIE

SEQ ID NO: 2951843 - protein, 20 aa, Entamoeba invadens
LFCGCSSLSYIQLPSKITKL

SEQ ID NO: 2951844 - protein, 18 aa, Entamoeba invadens
LFCKEHRDELSAKYGGKE

SEQ ID NO: 2951845 - protein, 19 aa, Entamoeba invadens
LFDCEYDRFLACSRDYEDF

SEQ ID NO: 2951846 - protein, 22 aa, Entamoeba invadens
LFDEILRFLDFVPDNLQGKNLQ

SEQ ID NO: 2951847 - protein, 25 aa, Entamoeba invadens
LFDFVYKKIELFGSVQTEGTKLGVT

SEQ ID NO: 2951848 - protein, 20 aa, Entamoeba invadens
LFDIITKCWCQKPEARPSIE

SEQ ID NO: 2951849 - protein, 23 aa, Entamoeba invadens
LFDKASENVALWEASQSALKTVN

SEQ ID NO: 2951850 - protein, 17 aa, Entamoeba invadens
LFDPLFVHLIKKRFSVE

SEQ ID NO: 2951851 - protein, 18 aa, Entamoeba invadens
LFDPTVPEGMDWDTFVKD

SEQ ID NO: 2951852 - protein, 21 aa, Entamoeba invadens
LFDRINHDIFYEFNGGDGVLD

SEQ ID NO: 2951853 - protein, 21 aa, Entamoeba invadens
LFDSFLRFVLAERKNSKSLLF

SEQ ID NO: 2951854 - protein, 20 aa, Entamoeba invadens
LFEAEDRSVWVTKKIQKKSV

SEQ ID NO: 2951855 - protein, 19 aa, Entamoeba invadens
LFEALKYLHSLGVIHRDIK

SEQ ID NO: 2951856 - protein, 25 aa, Entamoeba invadens
LFECAKLKNLFTLCLKSISEHQKEI

SEQ ID NO: 2951857 - protein, 18 aa, Entamoeba invadens
LFEDKWTVVGEIFFNSKD

SEQ ID NO: 2951858 - protein, 21 aa, Entamoeba invadens
LFEDSSLCAFHAKRITVNNRD

SEQ ID NO: 2951859 - protein, 18 aa, Entamoeba invadens
LFEELAYIIQLTFTSDFV

SEQ ID NO: 2951860 - protein, 18 aa, Entamoeba invadens
LFEEMKYILIEDENEVFT

SEQ ID NO: 2951861 - protein, 17 aa, Entamoeba invadens
LFEGFSFVAEEKEKEDV

SEQ ID NO: 2951862 - protein, 23 aa, Entamoeba invadens
LFEISAPCAFTLDSLPITHTIPQ

SEQ ID NO: 2951863 - protein, 22 aa, Entamoeba invadens
LFEKEIDGVKYCLVKWGGGLSY

SEQ ID NO: 2951864 - protein, 17 aa, Entamoeba invadens
LFEKFDYTVKKILGKFG

SEQ ID NO: 2951865 - protein, 17 aa, Entamoeba invadens
LFEKRKCIIQRINSTTF

SEQ ID NO: 2951866 - protein, 18 aa, Entamoeba invadens
LFEKWVIAPFEEFCVAKF

SEQ ID NO: 2951867 - protein, 18 aa, Entamoeba invadens
LFEKYICKGVYNNLSAFK

SEQ ID NO: 2951868 - protein, 18 aa, Entamoeba invadens
LFELACIRSLSSEAINLL

SEQ ID NO: 2951869 - protein, 17 aa, Entamoeba invadens
LFESGVQVGMRIIREQM

SEQ ID NO: 2951870 - protein, 23 aa, Entamoeba invadens
LFESLKVLSIHSLYFPLFLEKFE

SEQ ID NO: 2951871 - protein, 26 aa, Entamoeba invadens
LFEVGFEEFKGWKAWKQKAEEQKAGL

SEQ ID NO: 2951872 - protein, 18 aa, Entamoeba invadens
LFEVLKKSILLVYNEIEP

SEQ ID NO: 2951873 - protein, 18 aa, Entamoeba invadens
LFEVNKYYTFGFFTCVSP

SEQ ID NO: 2951874 - protein, 18 aa, Entamoeba invadens
LFEYDCPVAVNYALLDVG

SEQ ID NO: 2951875 - protein, 17 aa, Entamoeba invadens
LFFGCEKLSVLQLPSTF

SEQ ID NO: 2951876 - protein, 17 aa, Entamoeba invadens
LFFGDKRSYTFVLDINN

SEQ ID NO: 2951877 - protein, 17 aa, Entamoeba invadens
LFFIDALAISSGLTSLP

SEQ ID NO: 2951878 - protein, 24 aa, Entamoeba invadens
LFFKQRIRNLVNFLLYRDWKDIIK

SEQ ID NO: 2951879 - protein, 19 aa, Entamoeba invadens
LFFKVNVWYEVSYKKYVES

SEQ ID NO: 2951880 - protein, 20 aa, Entamoeba invadens
LFFNTWRKSREITEKVEDKN

SEQ ID NO: 2951881 - protein, 18 aa, Entamoeba invadens
LFFQNCDECSCDGDDGDG

SEQ ID NO: 2951882 - protein, 18 aa, Entamoeba invadens
LFFRDFEYNWILPTNLTQ

SEQ ID NO: 2951883 - protein, 20 aa, Entamoeba invadens
LFFTCLSTIFDIFENKVTKV

SEQ ID NO: 2951884 - protein, 19 aa, Entamoeba invadens
LFGEEEFMIVLPVMEAVGN

SEQ ID NO: 2951885 - protein, 18 aa, Entamoeba invadens
LFGEVPVEFVTHAIEVAI

SEQ ID NO: 2951886 - protein, 19 aa, Entamoeba invadens
LFGGDEWSTLFSPINSLQM

SEQ ID NO: 2951887 - protein, 17 aa, Entamoeba invadens
LFGKEALPFLNDIFPGL

SEQ ID NO: 2951888 - protein, 22 aa, Entamoeba invadens
LFGLKGLCAYISHANMLDKTNT

SEQ ID NO: 2951889 - protein, 17 aa, Entamoeba invadens
LFGLLQFSVFFKKTVET

SEQ ID NO: 2951890 - protein, 18 aa, Entamoeba invadens
LFGNERLLGLNVFSEQFN

SEQ ID NO: 2951891 - protein, 17 aa, Entamoeba invadens
LFGPIKELDRFAEKTKN

SEQ ID NO: 2951892 - protein, 19 aa, Entamoeba invadens
LFGTSIFKERVHELNPNET

SEQ ID NO: 2951893 - protein, 18 aa, Entamoeba invadens
LFHCKPTYLAVVPRVLQR

SEQ ID NO: 2951894 - protein, 21 aa, Entamoeba invadens
LFHGLMIFKDKFGTFPKSHDT

SEQ ID NO: 2951895 - protein, 18 aa, Entamoeba invadens
LFHSMYYNYFNGFDKPLF

SEQ ID NO: 2951896 - protein, 26 aa, Entamoeba invadens
LFHTREIASRLGIWNSRGKEKFDVLI

SEQ ID NO: 2951897 - protein, 17 aa, Entamoeba invadens
LFHWNFAYESCYENLFS

SEQ ID NO: 2951898 - protein, 18 aa, Entamoeba invadens
LFHYHFSYQINFQDALDF

SEQ ID NO: 2951899 - protein, 19 aa, Entamoeba invadens
LFIAEGNCLNASFVPTTLE

SEQ ID NO: 2951900 - protein, 32 aa, Entamoeba invadens
LFIAVAELFKFPQYVQFWGYVKKYIMVFKLRD

SEQ ID NO: 2951901 - protein, 26 aa, Entamoeba invadens
LFIESDQLFGLLLEWCDKEEESTMVM

SEQ ID NO: 2951902 - protein, 23 aa, Entamoeba invadens
LFIKNVDKFVEWEGDALRLSVTK

SEQ ID NO: 2951903 - protein, 18 aa, Entamoeba invadens
LFINFKTSLCLSQTPHLR

SEQ ID NO: 2951904 - protein, 26 aa, Entamoeba invadens
LFIRCKKVELLRCDNLNFKMLSNELC

SEQ ID NO: 2951905 - protein, 26 aa, Entamoeba invadens
LFIREMAERISFCGGKMGEVWINSSK

SEQ ID NO: 2951906 - protein, 17 aa, Entamoeba invadens
LFISIRDLCVIKKDNTI

SEQ ID NO: 2951907 - protein, 18 aa, Entamoeba invadens
LFIVPEKCQVVFTLAEEK

SEQ ID NO: 2951908 - protein, 22 aa, Entamoeba invadens
LFIYLFRLMLATGIPELQSEKD

SEQ ID NO: 2951909 - protein, 19 aa, Entamoeba invadens
LFKDLKAFVTKFLEYAFTA

SEQ ID NO: 2951910 - protein, 21 aa, Entamoeba invadens
LFKENQKCWSITGEFNQIVLK

SEQ ID NO: 2951911 - protein, 19 aa, Entamoeba invadens
LFKKIKFPITPLYQVISLV

SEQ ID NO: 2951912 - protein, 20 aa, Entamoeba invadens
LFKLFLRELPTPAIPTQFYD

SEQ ID NO: 2951913 - protein, 35 aa, Entamoeba invadens
LFKLFLRELPTPIIPTNCYDFFVSEEVVSDISNNP

SEQ ID NO: 2951914 - protein, 22 aa, Entamoeba invadens
LFKQFVINMALFFQIPNTASLE

SEQ ID NO: 2951915 - protein, 18 aa, Entamoeba invadens
LFKRKYFTDKSVSVGKGY

SEQ ID NO: 2951916 - protein, 24 aa, Entamoeba invadens
LFKSEVFTKPVFSFGKREEEIVEK

SEQ ID NO: 2951917 - protein, 25 aa, Entamoeba invadens
LFKSGPLDKFKGSLFQSLPIGNFPR

SEQ ID NO: 2951918 - protein, 18 aa, Entamoeba invadens
LFKSRGTDLISINLSSSP

SEQ ID NO: 2951919 - protein, 18 aa, Entamoeba invadens
LFKTDCSQTRKFCGLFFA

SEQ ID NO: 2951920 - protein, 17 aa, Entamoeba invadens
LFKTVGHKTGKRLSMIG

SEQ ID NO: 2951921 - protein, 23 aa, Entamoeba invadens
LFKVTYRNGFTYHLPHCSLTTDA

SEQ ID NO: 2951922 - protein, 32 aa, Entamoeba invadens
LFKYFPSLITLRFPIDKIRLFEKEEINQIKFI

SEQ ID NO: 2951923 - protein, 23 aa, Entamoeba invadens
LFLCNCSALSWNFIDLLDNRKYL

SEQ ID NO: 2951924 - protein, 20 aa, Entamoeba invadens
LFLEDVEKWKTANLLEHLNY

SEQ ID NO: 2951925 - protein, 20 aa, Entamoeba invadens
LFLEKCFDITFSVKSARLKS

SEQ ID NO: 2951926 - protein, 17 aa, Entamoeba invadens
LFLEKIKGILSLDSNET

SEQ ID NO: 2951927 - protein, 17 aa, Entamoeba invadens
LFLFNSMDFARLENLLQ

SEQ ID NO: 2951928 - protein, 19 aa, Entamoeba invadens
LFLFPPYVLCQLLPPVKYI

SEQ ID NO: 2951929 - protein, 27 aa, Entamoeba invadens
LFLGSAMAASNIEWLEEENIHYIINVT

SEQ ID NO: 2951930 - protein, 18 aa, Entamoeba invadens
LFLGVCMIHPRVTHELVL

SEQ ID NO: 2951931 - protein, 17 aa, Entamoeba invadens
LFLKAIHVHSQIKNIGA

SEQ ID NO: 2951932 - protein, 24 aa, Entamoeba invadens
LFLKYLEPRFKPFVDGIYLVDYSR

SEQ ID NO: 2951933 - protein, 21 aa, Entamoeba invadens
LFLKYLFKVNERFEGEMAKIM

SEQ ID NO: 2951934 - protein, 17 aa, Entamoeba invadens
LFLLRISKVSQFKTTNN

SEQ ID NO: 2951935 - protein, 17 aa, Entamoeba invadens
LFLNYLKTKKYSEALNL

SEQ ID NO: 2951936 - protein, 21 aa, Entamoeba invadens
LFLQKLENFVELFSHKISDFF

SEQ ID NO: 2951937 - protein, 18 aa, Entamoeba invadens
LFLREIYGNDVLNISEER

SEQ ID NO: 2951938 - protein, 18 aa, Entamoeba invadens
LFLRSIDSLVHMSSIVHT

SEQ ID NO: 2951939 - protein, 18 aa, Entamoeba invadens
LFLVLSHLHIFRYAFEIL

SEQ ID NO: 2951940 - protein, 23 aa, Entamoeba invadens
LFMKDGTCDICYEEGRLVGERCG

SEQ ID NO: 2951941 - protein, 18 aa, Entamoeba invadens
LFMMSELYHSHYPNMEVK

SEQ ID NO: 2951942 - protein, 17 aa, Entamoeba invadens
LFMSRIIKRLKAQVYLR

SEQ ID NO: 2951943 - protein, 18 aa, Entamoeba invadens
LFNANLRGSVAVLESCNG

SEQ ID NO: 2951944 - protein, 28 aa, Entamoeba invadens
LFNEFFLKYKKIRHWLGDADIFKYKFIF

SEQ ID NO: 2951945 - protein, 20 aa, Entamoeba invadens
LFNFFPRLNTLTGNLNTMVR

SEQ ID NO: 2951946 - protein, 21 aa, Entamoeba invadens
LFNICKLCKNLLTKIRPENFE

SEQ ID NO: 2951947 - protein, 17 aa, Entamoeba invadens
LFNISGDCSSLVVIFAL

SEQ ID NO: 2951948 - protein, 23 aa, Entamoeba invadens
LFNRPRDGLTLVIKENNVRGCFH

SEQ ID NO: 2951949 - protein, 24 aa, Entamoeba invadens
LFNSELKSGIDLVLDLTNFEEIIR

SEQ ID NO: 2951950 - protein, 20 aa, Entamoeba invadens
LFNSEVVKIFQFCDNVIQKA

SEQ ID NO: 2951951 - protein, 18 aa, Entamoeba invadens
LFNSLALAIKIVMPKQIV

SEQ ID NO: 2951952 - protein, 18 aa, Entamoeba invadens
LFNTLPLCVLLRRKMGNF

SEQ ID NO: 2951953 - protein, 24 aa, Entamoeba invadens
LFNVRCVYDASTICNVYLYADFDS

SEQ ID NO: 2951954 - protein, 17 aa, Entamoeba invadens
LFNYLNKNNCIFKNENN

SEQ ID NO: 2951955 - protein, 19 aa, Entamoeba invadens
LFNYYSAKAQKEFVKKFIF

SEQ ID NO: 2951956 - protein, 26 aa, Entamoeba invadens
LFPDYKKKSAASVRGFPMYNALMNFE

SEQ ID NO: 2951957 - protein, 19 aa, Entamoeba invadens
LFPHLEFIGFIKCTLPVSR

SEQ ID NO: 2951958 - protein, 24 aa, Entamoeba invadens
LFPLLEVILSWTYPSFAKKVGYKY

SEQ ID NO: 2951959 - protein, 18 aa, Entamoeba invadens
LFPLLYKNSSIVIIVYDP

SEQ ID NO: 2951960 - protein, 18 aa, Entamoeba invadens
LFPSHVINSLSLLLNSFN

SEQ ID NO: 2951961 - protein, 19 aa, Entamoeba invadens
LFPTSFVEGSSFYKTVMEN

SEQ ID NO: 2951962 - protein, 26 aa, Entamoeba invadens
LFPYSWDITNLISRGERPTIELGDGE

SEQ ID NO: 2951963 - protein, 17 aa, Entamoeba invadens
LFQDFYNTFDFTKMDKD

SEQ ID NO: 2951964 - protein, 23 aa, Entamoeba invadens
LFQERIQKCFVIRNDYIYSDAML

SEQ ID NO: 2951965 - protein, 31 aa, Entamoeba invadens
LFQGKLMLVWKWTTEVLMNIPCYERKDDRGD

SEQ ID NO: 2951966 - protein, 21 aa, Entamoeba invadens
LFQPSCAISGISIDDANEIVS

SEQ ID NO: 2951967 - protein, 17 aa, Entamoeba invadens
LFQRVKGQFNAMLRRKA

SEQ ID NO: 2951968 - protein, 24 aa, Entamoeba invadens
LFQTNCGKIRFEVWDTAGQEKFGG

SEQ ID NO: 2951969 - protein, 25 aa, Entamoeba invadens
LFQVIKERMTSLVIGKIKTFVVFPV

SEQ ID NO: 2951970 - protein, 25 aa, Entamoeba invadens
LFRKYPQKYLPVIAKLCDNLNTLDD

SEQ ID NO: 2951971 - protein, 17 aa, Entamoeba invadens
LFRLDIRSIGINRQDSP

SEQ ID NO: 2951972 - protein, 25 aa, Entamoeba invadens
LFRRLLECLQYFSIEDVEFLETLLF

SEQ ID NO: 2951973 - protein, 19 aa, Entamoeba invadens
LFRRVKYYYIHAHTLMGEK

SEQ ID NO: 2951974 - protein, 19 aa, Entamoeba invadens
LFSDIPFFMVESTRNTVKR

SEQ ID NO: 2951975 - protein, 21 aa, Entamoeba invadens
LFSDMALGVCTCSNTTEFCRQ

SEQ ID NO: 2951976 - protein, 23 aa, Entamoeba invadens
LFSEAMKTIFIDSVLKCAECTRS

SEQ ID NO: 2951977 - protein, 21 aa, Entamoeba invadens
LFSEFINFMFEIVRGNDSKSI

SEQ ID NO: 2951978 - protein, 18 aa, Entamoeba invadens
LFSEKWLLEEGAKFHNLV

SEQ ID NO: 2951979 - protein, 33 aa, Entamoeba invadens
LFSFSDCDWSVFQICKWLNLLVEHKRYVTDTFC

SEQ ID NO: 2951980 - protein, 24 aa, Entamoeba invadens
LFSLEASFKFSERKALLNTLKLCG

SEQ ID NO: 2951981 - protein, 17 aa, Entamoeba invadens
LFSNANLYDTYMYYYTH

SEQ ID NO: 2951982 - protein, 19 aa, Entamoeba invadens
LFSNISMVVGYYVQEGYIK

SEQ ID NO: 2951983 - protein, 18 aa, Entamoeba invadens
LFSPTSTLNVSLCSKLFC

SEQ ID NO: 2951984 - protein, 17 aa, Entamoeba invadens
LFSREFTIENTIKLWDG

SEQ ID NO: 2951985 - protein, 19 aa, Entamoeba invadens
LFSTLKCGVSFHQSKNEIY

SEQ ID NO: 2951986 - protein, 18 aa, Entamoeba invadens
LFSYLVIDEVHCVSQWGH

SEQ ID NO: 2951987 - protein, 18 aa, Entamoeba invadens
LFTELSLNKFRKEQLTEE

SEQ ID NO: 2951988 - protein, 24 aa, Entamoeba invadens
LFTESRFVGVAAFTQLEKLKLARL

SEQ ID NO: 2951989 - protein, 17 aa, Entamoeba invadens
LFTKMTQLFAGDYMEDD

SEQ ID NO: 2951990 - protein, 24 aa, Entamoeba invadens
LFTKTGIFVPIFSSYVSLFCGSYR

SEQ ID NO: 2951991 - protein, 23 aa, Entamoeba invadens
LFTLERRKTVFLGTQPVSPSTSP

SEQ ID NO: 2951992 - protein, 19 aa, Entamoeba invadens
LFTLFPRKYHTNLHRLYLV

SEQ ID NO: 2951993 - protein, 18 aa, Entamoeba invadens
LFTLKFPRKLFVLTNSII

SEQ ID NO: 2951994 - protein, 20 aa, Entamoeba invadens
LFTPEEFSFYFSTRKNNFKT

SEQ ID NO: 2951995 - protein, 23 aa, Entamoeba invadens
LFTPPPNCGLVFAKGNLCPNGRN

SEQ ID NO: 2951996 - protein, 18 aa, Entamoeba invadens
LFTQRGQTEIDYAKHLLH

SEQ ID NO: 2951997 - protein, 17 aa, Entamoeba invadens
LFTRFACEKCEKEESVL

SEQ ID NO: 2951998 - protein, 18 aa, Entamoeba invadens
LFTTCSFDSTACVWDLRT

SEQ ID NO: 2951999 - protein, 33 aa, Entamoeba invadens
LFTVLADGAGWGMPSFRAATKACDSVLDYISKN

SEQ ID NO: 2952000 - protein, 24 aa, Entamoeba invadens
LFVDNRYLIWAGFTTDKHKTKILV

SEQ ID NO: 2952001 - protein, 20 aa, Entamoeba invadens
LFVFVRCLIENPAFDSQTKE

SEQ ID NO: 2952002 - protein, 21 aa, Entamoeba invadens
LFVGAEILFQPSIIGEEGLGI

SEQ ID NO: 2952003 - protein, 18 aa, Entamoeba invadens
LFVLILNYFVIHFTTNKM

SEQ ID NO: 2952004 - protein, 21 aa, Entamoeba invadens
LFVMSGGDLLFSITGEISSSG

SEQ ID NO: 2952005 - protein, 19 aa, Entamoeba invadens
LFVNGRFAKQFQLLFQKTL

SEQ ID NO: 2952006 - protein, 19 aa, Entamoeba invadens
LFVQLNRFDSFGVDVMKIN

SEQ ID NO: 2952007 - protein, 19 aa, Entamoeba invadens
LFVRTCLLLEQLIDTDGVV

SEQ ID NO: 2952008 - protein, 18 aa, Entamoeba invadens
LFVSDGLNHRICQFDLRG

SEQ ID NO: 2952009 - protein, 17 aa, Entamoeba invadens
LFVSFPNFVGTPKYDPM

SEQ ID NO: 2952010 - protein, 18 aa, Entamoeba invadens
LFVSKKCKLSVELAPMNP

SEQ ID NO: 2952011 - protein, 19 aa, Entamoeba invadens
LFVSMSYRNSKDGVLNQYE

SEQ ID NO: 2952012 - protein, 24 aa, Entamoeba invadens
LFVTMEYFESGSLYDVYKKYPLTT

SEQ ID NO: 2952013 - protein, 26 aa, Entamoeba invadens
LFWNEEKRYFVQVIWQDNKKQKVIVD

SEQ ID NO: 2952014 - protein, 17 aa, Entamoeba invadens
LFYAIGHAPNVQFLNGQ

SEQ ID NO: 2952015 - protein, 23 aa, Entamoeba invadens
LFYCAMQRVCRFELITDSVIKEF

SEQ ID NO: 2952016 - protein, 22 aa, Entamoeba invadens
LFYETFLLPNIQTFKIKSSQIN

SEQ ID NO: 2952017 - protein, 24 aa, Entamoeba invadens
LFYGEISLCPAIYSPVFEIKNGLA

SEQ ID NO: 2952018 - protein, 24 aa, Entamoeba invadens
LFYLHCENKWFGECKILYTHKSPV

SEQ ID NO: 2952019 - protein, 19 aa, Entamoeba invadens
LFYPCMQCADIFEMNVDIC

SEQ ID NO: 2952020 - protein, 26 aa, Entamoeba invadens
LFYQTAPWAWKEETLFETIIYTISLT

SEQ ID NO: 2952021 - protein, 22 aa, Entamoeba invadens
LFYTQKFKIMKSFMKVDRMVIG

SEQ ID NO: 2952022 - protein, 18 aa, Entamoeba invadens
LGAACFYGCCNISNISIP

SEQ ID NO: 2952023 - protein, 25 aa, Entamoeba invadens
LGALKDGKSVFVFDVKIPTSFFSHV

SEQ ID NO: 2952024 - protein, 17 aa, Entamoeba invadens
LGALSRLQTLMVSNLNL

SEQ ID NO: 2952025 - protein, 26 aa, Entamoeba invadens
LGANFKRKFPTVIMSIVVDEYDPNVT

SEQ ID NO: 2952026 - protein, 26 aa, Entamoeba invadens
LGAPAAAICRVHFPFYDHKIDSSRWG

SEQ ID NO: 2952027 - protein, 24 aa, Entamoeba invadens
LGAYKPSLIMSKFFPALQGSQGKM

SEQ ID NO: 2952028 - protein, 18 aa, Entamoeba invadens
LGCRCFIECTSIQCVTLS

SEQ ID NO: 2952029 - protein, 21 aa, Entamoeba invadens
LGCTNCKPGYFPKNLGCSQCS

SEQ ID NO: 2952030 - protein, 21 aa, Entamoeba invadens
LGDAMILRFAIPSRKMTKEDL

SEQ ID NO: 2952031 - protein, 21 aa, Entamoeba invadens
LGDDCKSYVFTLNISFGQNNI

SEQ ID NO: 2952032 - protein, 19 aa, Entamoeba invadens
LGDFCFTNTPITRIEIPQA

SEQ ID NO: 2952033 - protein, 23 aa, Entamoeba invadens
LGDFPCIGGIVFDISGSNFDSLK

SEQ ID NO: 2952034 - protein, 18 aa, Entamoeba invadens
LGDGLTCEFLSLRQVIKN

SEQ ID NO: 2952035 - protein, 24 aa, Entamoeba invadens
LGDGTCFDCSSIVTQKCEELKMSE

SEQ ID NO: 2952036 - protein, 27 aa, Entamoeba invadens
LGDILFLTSRWGALVLLDEGDALIEKR

SEQ ID NO: 2952037 - protein, 22 aa, Entamoeba invadens
LGDLKKVILYGGVFEEVISENV

SEQ ID NO: 2952038 - protein, 36 aa, Entamoeba invadens
LGDVPFNSVFAIKGKLKEGASFRWYKNEQIIDRMAM

SEQ ID NO: 2952039 - protein, 17 aa, Entamoeba invadens
LGDYCFYCDKTLSEIKI

SEQ ID NO: 2952040 - protein, 21 aa, Entamoeba invadens
LGDYEKLHFGDELSDSENGED

SEQ ID NO: 2952041 - protein, 23 aa, Entamoeba invadens
LGECALTKQLFDWCRSKEEEETT

SEQ ID NO: 2952042 - protein, 17 aa, Entamoeba invadens
LGECVFLGCSNLSVIEL

SEQ ID NO: 2952043 - protein, 26 aa, Entamoeba invadens
LGEDSFGIVFKGIFRGNIVAIKKMKN

SEQ ID NO: 2952044 - protein, 18 aa, Entamoeba invadens
LGEELVRVAVLWHESWHE

SEQ ID NO: 2952045 - protein, 18 aa, Entamoeba invadens
LGEFIVLYLSFIRAGSGL

SEQ ID NO: 2952046 - protein, 19 aa, Entamoeba invadens
LGEGSTCVVHLCFDISTGI

SEQ ID NO: 2952047 - protein, 22 aa, Entamoeba invadens
LGEGVKDYLGRIENIMLHVLKY

SEQ ID NO: 2952048 - protein, 26 aa, Entamoeba invadens
LGEKLEEIGAFCFCNCVSLQTIEIPK

SEQ ID NO: 2952049 - protein, 28 aa, Entamoeba invadens
LGEKSVKLFFDTCINLSVFGVKMSEIVF

SEQ ID NO: 2952050 - protein, 28 aa, Entamoeba invadens
LGEKYDSAVDWWSFGILTYEMMVGIPPF

SEQ ID NO: 2952051 - protein, 20 aa, Entamoeba invadens
LGELLKETWFNGNQTRSIKM

SEQ ID NO: 2952052 - protein, 28 aa, Entamoeba invadens
LGELPQAFARMSALYGGTYMLRAKIQEI

SEQ ID NO: 2952053 - protein, 27 aa, Entamoeba invadens
LGEMERDCMISHGMSALLRERLFLASD

SEQ ID NO: 2952054 - protein, 22 aa, Entamoeba invadens
LGEPRKKRCTTPNRMVSFQTVK

SEQ ID NO: 2952055 - protein, 20 aa, Entamoeba invadens
LGERYFRVDPQYSKYIELDD

SEQ ID NO: 2952056 - protein, 28 aa, Entamoeba invadens
LGESFRGEWKTIWKLVSKDHYKSVSSIS

SEQ ID NO: 2952057 - protein, 26 aa, Entamoeba invadens
LGEVEMYNTLCLMQYVVKRSVKLQKQ

SEQ ID NO: 2952058 - protein, 20 aa, Entamoeba invadens
LGFEHPKGMFVIPLKNPISI

SEQ ID NO: 2952059 - protein, 24 aa, Entamoeba invadens
LGFFEKGRFKGFLEYLQNYDENKP

SEQ ID NO: 2952060 - protein, 17 aa, Entamoeba invadens
LGFGTSVFTGGLREKLA

SEQ ID NO: 2952061 - protein, 24 aa, Entamoeba invadens
LGFKGLEGTLSFTFVGYNDERYQA

SEQ ID NO: 2952062 - protein, 23 aa, Entamoeba invadens
LGFRTGKKTLLVMAGNKCDLEEQ

SEQ ID NO: 2952063 - protein, 17 aa, Entamoeba invadens
LGGGIEVLVARKGKVLQ

SEQ ID NO: 2952064 - protein, 29 aa, Entamoeba invadens
LGGGLGMPGLGMGGGLGIGGMPAMGGMPG

SEQ ID NO: 2952065 - protein, 19 aa, Entamoeba invadens
LGGIIPIAVTWEVLASLGQ

SEQ ID NO: 2952066 - protein, 26 aa, Entamoeba invadens
LGGQGMLLCIGCIDLNSENNQAAFVR

SEQ ID NO: 2952067 - protein, 23 aa, Entamoeba invadens
LGGRRLVLYPAILNEDGKEDGKH

SEQ ID NO: 2952068 - protein, 19 aa, Entamoeba invadens
LGGSCFIHCISLSKILIPE

SEQ ID NO: 2952069 - protein, 17 aa, Entamoeba invadens
LGGVVQAQFVNWEKDGR

SEQ ID NO: 2952070 - protein, 18 aa, Entamoeba invadens
LGHHVSSYLILPIQRIPR

SEQ ID NO: 2952071 - protein, 23 aa, Entamoeba invadens
LGHKKGKCILVSGHDLFDLKNIL

SEQ ID NO: 2952072 - protein, 17 aa, Entamoeba invadens
LGHRKLLFEKKSQYNGK

SEQ ID NO: 2952073 - protein, 18 aa, Entamoeba invadens
LGHTLIYSSCLPRLEQYR

SEQ ID NO: 2952074 - protein, 29 aa, Entamoeba invadens
LGHYECPVCGFCYCELPVECKVCKANLIF

SEQ ID NO: 2952075 - protein, 18 aa, Entamoeba invadens
LGICAGAYFACDRFEFNK

SEQ ID NO: 2952076 - protein, 22 aa, Entamoeba invadens
LGIKQKRVEQLFQEKERKIREF

SEQ ID NO: 2952077 - protein, 24 aa, Entamoeba invadens
LGIKRELYCLQVHTGDFVGAFETR

SEQ ID NO: 2952078 - protein, 26 aa, Entamoeba invadens
LGIMCMEMSDGMPPYMDFPPMRALFL

SEQ ID NO: 2952079 - protein, 17 aa, Entamoeba invadens
LGIREIIRFGLKPYTKS

SEQ ID NO: 2952080 - protein, 19 aa, Entamoeba invadens
LGIRKGRPLTVNDFNKVKE

SEQ ID NO: 2952081 - protein, 19 aa, Entamoeba invadens
LGIRPCIKEAGRGAVGTIF

SEQ ID NO: 2952082 - protein, 17 aa, Entamoeba invadens
LGISNLYTVNPFFTLQF

SEQ ID NO: 2952083 - protein, 23 aa, Entamoeba invadens
LGISRSGSVLREMCSCTQACAEQ

SEQ ID NO: 2952084 - protein, 18 aa, Entamoeba invadens
LGKEFLKFFRVENFQVPN

SEQ ID NO: 2952085 - protein, 18 aa, Entamoeba invadens
LGKFAVKLPLDYRLSKLV

SEQ ID NO: 2952086 - protein, 26 aa, Entamoeba invadens
LGKGMYKIRIWRKPNVRLFGPLMDGM

SEQ ID NO: 2952087 - protein, 17 aa, Entamoeba invadens
LGKKDMRILMVGLDAAG

SEQ ID NO: 2952088 - protein, 23 aa, Entamoeba invadens
LGKKFKMALILARDPRFKRLTCT

SEQ ID NO: 2952089 - protein, 28 aa, Entamoeba invadens
LGKLMLDRIKLLYDRAFHINEESTQFVK

SEQ ID NO: 2952090 - protein, 27 aa, Entamoeba invadens
LGKLVPNCRFTDFWNGYGCGQVPDKVI

SEQ ID NO: 2952091 - protein, 24 aa, Entamoeba invadens
LGKNCFSCCPKLSSITYQQDTEVN

SEQ ID NO: 2952092 - protein, 17 aa, Entamoeba invadens
LGKRCFEHCVGLNAITL

SEQ ID NO: 2952093 - protein, 22 aa, Entamoeba invadens
LGKSALFDDMFFKLQKRLEKEI

SEQ ID NO: 2952094 - protein, 17 aa, Entamoeba invadens
LGKSCFSGCKALHSVLL

SEQ ID NO: 2952095 - protein, 17 aa, Entamoeba invadens
LGKSFCMLSSYRAEQSR

SEQ ID NO: 2952096 - protein, 18 aa, Entamoeba invadens
LGKTKIFGTPKVMRVAEL

SEQ ID NO: 2952097 - protein, 24 aa, Entamoeba invadens
LGKVDVGNCAKLWNSLPNTVTKEF

SEQ ID NO: 2952098 - protein, 17 aa, Entamoeba invadens
LGKVIIWEVNEDGTDAK

SEQ ID NO: 2952099 - protein, 29 aa, Entamoeba invadens
LGKVKPTGIKPWELRVMKLQDTSAYRVFD

SEQ ID NO: 2952100 - protein, 20 aa, Entamoeba invadens
LGKVPVCGIGVVGSGKGVIN

SEQ ID NO: 2952101 - protein, 17 aa, Entamoeba invadens
LGKWKVYNPKIGMDSLQ

SEQ ID NO: 2952102 - protein, 23 aa, Entamoeba invadens
LGKYFIEVFKACGLKEDAAEFIW

SEQ ID NO: 2952103 - protein, 23 aa, Entamoeba invadens
LGKYGGSPFVYCQYGYGDVAQGF

SEQ ID NO: 2952104 - protein, 25 aa, Entamoeba invadens
LGLANRFVSGPSFASYIVGNKTDLE

SEQ ID NO: 2952105 - protein, 17 aa, Entamoeba invadens
LGLFGKGSADAFVSSEI

SEQ ID NO: 2952106 - protein, 24 aa, Entamoeba invadens
LGLFRPKGIATFDFLESEIIKEVV

SEQ ID NO: 2952107 - protein, 22 aa, Entamoeba invadens
LGLFYKEIKSIKGLYKSDTNEL

SEQ ID NO: 2952108 - protein, 17 aa, Entamoeba invadens
LGLHSGDFIPRLFVLDS

SEQ ID NO: 2952109 - protein, 27 aa, Entamoeba invadens
LGLKVSRCGSFFNNYVLRFKGVPGTIL

SEQ ID NO: 2952110 - protein, 17 aa, Entamoeba invadens
LGLLVKRILSFDPTLDA

SEQ ID NO: 2952111 - protein, 18 aa, Entamoeba invadens
LGLPDVLESIAIYCTDRT

SEQ ID NO: 2952112 - protein, 20 aa, Entamoeba invadens
LGLRFQMYGVIPKVSSKEII

SEQ ID NO: 2952113 - protein, 19 aa, Entamoeba invadens
LGLSHLFEIGFYLKSARDF

SEQ ID NO: 2952114 - protein, 19 aa, Entamoeba invadens
LGLSLDSFVNFMMGTSQNN

SEQ ID NO: 2952115 - protein, 25 aa, Entamoeba invadens
LGLVVCATCEGKIYIVNTMTNLICG

SEQ ID NO: 2952116 - protein, 18 aa, Entamoeba invadens
LGMIVCKAKNFTVFLTLK

SEQ ID NO: 2952117 - protein, 17 aa, Entamoeba invadens
LGMMSVFVLRHVFNEDE

SEQ ID NO: 2952118 - protein, 25 aa, Entamoeba invadens
LGMPFSINGVQFFDYMLFRREPITL

SEQ ID NO: 2952119 - protein, 17 aa, Entamoeba invadens
LGMTMYHLFSCKKPYEE

SEQ ID NO: 2952120 - protein, 24 aa, Entamoeba invadens
LGNCCFKDDFNLFSIDLPNAVSYL

SEQ ID NO: 2952121 - protein, 18 aa, Entamoeba invadens
LGNFIVVLLRVYSRKIAM

SEQ ID NO: 2952122 - protein, 25 aa, Entamoeba invadens
LGNFVGELVGFVWGLLANFEERCSR

SEQ ID NO: 2952123 - protein, 18 aa, Entamoeba invadens
LGNKCVSVIVKISREVPM

SEQ ID NO: 2952124 - protein, 21 aa, Entamoeba invadens
LGNLHLLSLVVHNTGNLFIDN

SEQ ID NO: 2952125 - protein, 24 aa, Entamoeba invadens
LGNMFPDFLHYVFPIVKEKFLGGI

SEQ ID NO: 2952126 - protein, 18 aa, Entamoeba invadens
LGNSCFYGCISITSLTIP

SEQ ID NO: 2952127 - protein, 25 aa, Entamoeba invadens
LGNSCWELFCLEHGILPDGTPAKEG

SEQ ID NO: 2952128 - protein, 17 aa, Entamoeba invadens
LGNWFKESNNIYVFKCE

SEQ ID NO: 2952129 - protein, 18 aa, Entamoeba invadens
LGPERYMAPEILFNPSMI

SEQ ID NO: 2952130 - protein, 18 aa, Entamoeba invadens
LGPRFVLKLRTIQKGTMN

SEQ ID NO: 2952131 - protein, 25 aa, Entamoeba invadens
LGPSLKLSDCIVCYNQNKTLPIFIK

SEQ ID NO: 2952132 - protein, 17 aa, Entamoeba invadens
LGPSVVKICTGFCETSV

SEQ ID NO: 2952133 - protein, 26 aa, Entamoeba invadens
LGQACFRGCNSLVLLILPQKLVELQN

SEQ ID NO: 2952134 - protein, 20 aa, Entamoeba invadens
LGQFQTRGIILLKLNSIARG

SEQ ID NO: 2952135 - protein, 23 aa, Entamoeba invadens
LGQNRLCLQMSKLGSEAKDNASW

SEQ ID NO: 2952136 - protein, 19 aa, Entamoeba invadens
LGQSHGKYGLFPLAKGVTL

SEQ ID NO: 2952137 - protein, 20 aa, Entamoeba invadens
LGQSSFRSSIAVIKNEIKAG

SEQ ID NO: 2952138 - protein, 20 aa, Entamoeba invadens
LGQYCFSHCYSLTSIDIPKD

SEQ ID NO: 2952139 - protein, 40 aa, Entamoeba invadens
LGRACPEHLIRIPILGSFACGKTSLRWCYMQNDGYEDMGA

SEQ ID NO: 2952140 - protein, 22 aa, Entamoeba invadens
LGRESVFPILKYTMNITNKDKT

SEQ ID NO: 2952141 - protein, 28 aa, Entamoeba invadens
LGRKFIPDRLKIIIQLFVTAEFKVCKKE

SEQ ID NO: 2952142 - protein, 36 aa, Entamoeba invadens
LGRLPKQMRFAIRSDKAMKAFLCFDQNSDELFAFGV

SEQ ID NO: 2952143 - protein, 28 aa, Entamoeba invadens
LGRMMLKAKTMWTVVCVFYIAIHCVIDI

SEQ ID NO: 2952144 - protein, 22 aa, Entamoeba invadens
LGSASLELLPYNAMTALIHTFG

SEQ ID NO: 2952145 - protein, 27 aa, Entamoeba invadens
LGSETWEWLFWMGFRDIFIWKKGSEYE

SEQ ID NO: 2952146 - protein, 25 aa, Entamoeba invadens
LGSFPIFRLKYSWEGISSEDKENES

SEQ ID NO: 2952147 - protein, 27 aa, Entamoeba invadens
LGSIEIGEFIITNFAAIFPNFGGNFTE

SEQ ID NO: 2952148 - protein, 21 aa, Entamoeba invadens
LGSRNVIFPKYAFLMSPQPIC

SEQ ID NO: 2952149 - protein, 25 aa, Entamoeba invadens
LGSTCLAFLKVCPTRYDLIHKHYTK

SEQ ID NO: 2952150 - protein, 25 aa, Entamoeba invadens
LGSVTCWHLYALILKLEKNYEESCK

SEQ ID NO: 2952151 - protein, 27 aa, Entamoeba invadens
LGSWEFKLKVGGLIEAFYRVFQDGAIT

SEQ ID NO: 2952152 - protein, 17 aa, Entamoeba invadens
LGTDGQRTFYLLNGYLI

SEQ ID NO: 2952153 - protein, 22 aa, Entamoeba invadens
LGTECFKECTSLTIFVPKTVTS

SEQ ID NO: 2952154 - protein, 31 aa, Entamoeba invadens
LGTEVYELFGGKEFKAPVDLCVKHIKSWTLA

SEQ ID NO: 2952155 - protein, 48 aa, Entamoeba invadens
LGTGGKLVNAWKVLLDKYWGGYSVLSPREFKSAIGEFAPQFSGYQQQD

SEQ ID NO: 2952156 - protein, 22 aa, Entamoeba invadens
LGTKIWNDFNIVWTKKVGDIGT

SEQ ID NO: 2952157 - protein, 32 aa, Entamoeba invadens
LGTKYPLKRIKLFADKHHCFITFYTRTTAMEA

SEQ ID NO: 2952158 - protein, 19 aa, Entamoeba invadens
LGTQCFKNYPVIKSVNVPE

SEQ ID NO: 2952159 - protein, 27 aa, Entamoeba invadens
LGTYFKKCMLRNLRLHYTDDQLIEIFK

SEQ ID NO: 2952160 - protein, 18 aa, Entamoeba invadens
LGTYHFVKINGKYNDAET

SEQ ID NO: 2952161 - protein, 21 aa, Entamoeba invadens
LGVCTCSNTTEFCRQAHGSCY

SEQ ID NO: 2952162 - protein, 19 aa, Entamoeba invadens
LGVFGEYRGGMGSWTLLVD

SEQ ID NO: 2952163 - protein, 24 aa, Entamoeba invadens
LGVIGLKALCMILMRMLSSKCKSE

SEQ ID NO: 2952164 - protein, 23 aa, Entamoeba invadens
LGVLSEKYMEWVIANVFQVTLTR

SEQ ID NO: 2952165 - protein, 22 aa, Entamoeba invadens
LGVMFDAFFDMCYDRLKHLELM

SEQ ID NO: 2952166 - protein, 17 aa, Entamoeba invadens
LGVQQSVGWEHFDIFKP

SEQ ID NO: 2952167 - protein, 26 aa, Entamoeba invadens
LGVRDFKGKHYIGGRFIPLQMQKDLG

SEQ ID NO: 2952168 - protein, 26 aa, Entamoeba invadens
LGVSLLRPVETVYRYLERTNCLAVLD

SEQ ID NO: 2952169 - protein, 25 aa, Entamoeba invadens
LGVTCFECAHGAPPYIDLPPMKAML

SEQ ID NO: 2952170 - protein, 19 aa, Entamoeba invadens
LGVTELGQYCFYKCKGLRS

SEQ ID NO: 2952171 - protein, 25 aa, Entamoeba invadens
LGVTMFECFSWKEAYPKEDFKYPWK

SEQ ID NO: 2952172 - protein, 23 aa, Entamoeba invadens
LGVWKYLRKHKIVSLEKVMLTLD

SEQ ID NO: 2952173 - protein, 26 aa, Entamoeba invadens
LGVYKSQRGYTHFWKMTGSRYVDVKN

SEQ ID NO: 2952174 - protein, 22 aa, Entamoeba invadens
LGWSMKLDKAFSYIQNSCESRV

SEQ ID NO: 2952175 - protein, 25 aa, Entamoeba invadens
LGYCAICQLPSGARLHLIYSSPIGN

SEQ ID NO: 2952176 - protein, 25 aa, Entamoeba invadens
LGYLAKKKKYSFIVFNNKRTNFKMA

SEQ ID NO: 2952177 - protein, 32 aa, Entamoeba invadens
LGYPNRIIYNEFLKRYFFLGTNINKKTSDAMP

SEQ ID NO: 2952178 - protein, 20 aa, Entamoeba invadens
LGYQCVIGGSLIHYKRSDKQ

SEQ ID NO: 2952179 - protein, 21 aa, Entamoeba invadens
LGYSLFMVGKSFAIHTTTAFE

SEQ ID NO: 2952180 - protein, 20 aa, Entamoeba invadens
LGYSNYRGGLDVKTGTTGKY

SEQ ID NO: 2952181 - protein, 20 aa, Entamoeba invadens
LHCETCASKVNISLWSLSKK

SEQ ID NO: 2952182 - protein, 23 aa, Entamoeba invadens
LHDLPLSALMEFLTVCVDPKILG

SEQ ID NO: 2952183 - protein, 23 aa, Entamoeba invadens
LHDLTTIFKLRKGEVLKKSPGTY

SEQ ID NO: 2952184 - protein, 25 aa, Entamoeba invadens
LHDRALALTAMSAFKDKEFKTTYHC

SEQ ID NO: 2952185 - protein, 17 aa, Entamoeba invadens
LHEFDFNDTFILQKSEF

SEQ ID NO: 2952186 - protein, 25 aa, Entamoeba invadens
LHEGLTLLGKYCFNACMQLEGIVLP

SEQ ID NO: 2952187 - protein, 17 aa, Entamoeba invadens
LHEKVRFVVKNSFPVNS

SEQ ID NO: 2952188 - protein, 19 aa, Entamoeba invadens
LHEKYDILFTLFKALERRY

SEQ ID NO: 2952189 - protein, 28 aa, Entamoeba invadens
LHELSKKIPCYWGRILNISDLNYNNLAD

SEQ ID NO: 2952190 - protein, 17 aa, Entamoeba invadens
LHFEECENITFDFCNVC

SEQ ID NO: 2952191 - protein, 17 aa, Entamoeba invadens
LHFYTDKGTLCYSQCKF

SEQ ID NO: 2952192 - protein, 26 aa, Entamoeba invadens
LHGDYTYKELFEFLNIEIISPDNNEN

SEQ ID NO: 2952193 - protein, 18 aa, Entamoeba invadens
LHGLQIEGAILMMKEQIE

SEQ ID NO: 2952194 - protein, 19 aa, Entamoeba invadens
LHGPFLIVMPLGMVEHWHR

SEQ ID NO: 2952195 - protein, 21 aa, Entamoeba invadens
LHGRRNVMCLVVTDNDDVFGS

SEQ ID NO: 2952196 - protein, 25 aa, Entamoeba invadens
LHHAAAHCPFNFVSKIIDSNPGAFM

SEQ ID NO: 2952197 - protein, 23 aa, Entamoeba invadens
LHHAEAFGIQVYGTKRFLKMKNS

SEQ ID NO: 2952198 - protein, 21 aa, Entamoeba invadens
LHHCAICGNATVADILLENGI

SEQ ID NO: 2952199 - protein, 17 aa, Entamoeba invadens
LHHGEAFIALDIANGKQ

SEQ ID NO: 2952200 - protein, 17 aa, Entamoeba invadens
LHHKMELVNHIIKAKIH

SEQ ID NO: 2952201 - protein, 25 aa, Entamoeba invadens
LHHPNIITLWAMFYKNTHLNLVIEE

SEQ ID NO: 2952202 - protein, 30 aa, Entamoeba invadens
LHHSGIKVEGFWPVVMAKALSKANVEDLIM

SEQ ID NO: 2952203 - protein, 19 aa, Entamoeba invadens
LHIAAKFGLLQSAQWLLDH

SEQ ID NO: 2952204 - protein, 17 aa, Entamoeba invadens
LHIFKTQIDTFLVILTK

SEQ ID NO: 2952205 - protein, 17 aa, Entamoeba invadens
LHIFLRKFPGNMMYGQF

SEQ ID NO: 2952206 - protein, 20 aa, Entamoeba invadens
LHIFMTDIFWDGHAVDPLIV

SEQ ID NO: 2952207 - protein, 18 aa, Entamoeba invadens
LHIGHICKSFGIRDTPTN

SEQ ID NO: 2952208 - protein, 25 aa, Entamoeba invadens
LHIHFPMKEFLTFFETMNYEQNTTL

SEQ ID NO: 2952209 - protein, 26 aa, Entamoeba invadens
LHIKTCSRSKFVLPEKCFSGVTIKNS

SEQ ID NO: 2952210 - protein, 22 aa, Entamoeba invadens
LHINPLKVLRYIPFLLHYIPNL

SEQ ID NO: 2952211 - protein, 28 aa, Entamoeba invadens
LHINPPRVLRYIPFLRKYIPNLETYEGN

SEQ ID NO: 2952212 - protein, 23 aa, Entamoeba invadens
LHIPSSVCVSNFEKCHLTKLEIT

SEQ ID NO: 2952213 - protein, 19 aa, Entamoeba invadens
LHIRNCLPDDIVVQRVEER

SEQ ID NO: 2952214 - protein, 19 aa, Entamoeba invadens
LHITDCERLSEIVDLNNEL

SEQ ID NO: 2952215 - protein, 21 aa, Entamoeba invadens
LHKFEVFLSGLYCLLTDEPTS

SEQ ID NO: 2952216 - protein, 24 aa, Entamoeba invadens
LHKGEACEFEIFITPLCSCQINDK

SEQ ID NO: 2952217 - protein, 27 aa, Entamoeba invadens
LHKNFYPSREDFVADVRLTFQNAMTFN

SEQ ID NO: 2952218 - protein, 31 aa, Entamoeba invadens
LHKVVPEYFWKCVLRISPLLRNQDKHEFYFH

SEQ ID NO: 2952219 - protein, 18 aa, Entamoeba invadens
LHLCCERDTFNVAKVLLR

SEQ ID NO: 2952220 - protein, 20 aa, Entamoeba invadens
LHLDNCYYINFDLPSTLTGL

SEQ ID NO: 2952221 - protein, 21 aa, Entamoeba invadens
LHLDNCYYINFDLPSTLTGLT

SEQ ID NO: 2952222 - protein, 25 aa, Entamoeba invadens
LHLERCVKDLKEIFAKVPFNTTDPL

SEQ ID NO: 2952223 - protein, 17 aa, Entamoeba invadens
LHLGNVITFQDNLQYIT

SEQ ID NO: 2952224 - protein, 19 aa, Entamoeba invadens
LHLIIKAVRLVQLELIETP

SEQ ID NO: 2952225 - protein, 26 aa, Entamoeba invadens
LHLKLKCSIVPTAFCKEDVPKVLFAT

SEQ ID NO: 2952226 - protein, 18 aa, Entamoeba invadens
LHLLDCYNDYVLENDEDD

SEQ ID NO: 2952227 - protein, 21 aa, Entamoeba invadens
LHLLIDLLREFGYSFESRFVE

SEQ ID NO: 2952228 - protein, 25 aa, Entamoeba invadens
LHLLMDCLIEYGYIFESNPMKGKAE

SEQ ID NO: 2952229 - protein, 25 aa, Entamoeba invadens
LHLNRMNLQKGLPFNRGITNLVAIG

SEQ ID NO: 2952230 - protein, 18 aa, Entamoeba invadens
LHLRNCRGKIGFENESQK

SEQ ID NO: 2952231 - protein, 17 aa, Entamoeba invadens
LHLRNCSGLKRKDTLSK

SEQ ID NO: 2952232 - protein, 29 aa, Entamoeba invadens
LHLTEYLALGTVMVWSCFTAADDKFKVTT

SEQ ID NO: 2952233 - protein, 26 aa, Entamoeba invadens
LHLTRCRKCIFHLPSTLTKLSLYDVC

SEQ ID NO: 2952234 - protein, 17 aa, Entamoeba invadens
LHLVLGEKRLTHLQNAI

SEQ ID NO: 2952235 - protein, 19 aa, Entamoeba invadens
LHLVLLLQCPLNISVGNYY

SEQ ID NO: 2952236 - protein, 25 aa, Entamoeba invadens
LHNFLYRVALVFDKRNIRMDGCSFC

SEQ ID NO: 2952237 - protein, 20 aa, Entamoeba invadens
LHNKLCLRFEQDHIVKRFAK

SEQ ID NO: 2952238 - protein, 23 aa, Entamoeba invadens
LHNKRSLAFVLQFFECVEPPYCE

SEQ ID NO: 2952239 - protein, 19 aa, Entamoeba invadens
LHNLALIIINVFNKGAKTS

SEQ ID NO: 2952240 - protein, 19 aa, Entamoeba invadens
LHPKCFIIPLGTGNSLSRC

SEQ ID NO: 2952241 - protein, 21 aa, Entamoeba invadens
LHPKGPLGLSTHMIVFMKKFK

SEQ ID NO: 2952242 - protein, 17 aa, Entamoeba invadens
LHPWDVKFCESLEKDML

SEQ ID NO: 2952243 - protein, 17 aa, Entamoeba invadens
LHPWGTEMRYVYMALEW

SEQ ID NO: 2952244 - protein, 17 aa, Entamoeba invadens
LHQIVHILLPLANAYIT

SEQ ID NO: 2952245 - protein, 20 aa, Entamoeba invadens
LHQLDPPKLLSIYDPSSSIR

SEQ ID NO: 2952246 - protein, 17 aa, Entamoeba invadens
LHQLFKTTYQVNGLPND

SEQ ID NO: 2952247 - protein, 21 aa, Entamoeba invadens
LHQLFPVILTLVVTKQIGTGA

SEQ ID NO: 2952248 - protein, 22 aa, Entamoeba invadens
LHRELGVSLCGQISGFKEFVGL

SEQ ID NO: 2952249 - protein, 19 aa, Entamoeba invadens
LHRKIMNIVPIWTKTIEKY

SEQ ID NO: 2952250 - protein, 19 aa, Entamoeba invadens
LHRQQHEFLFGFGGGCDFE

SEQ ID NO: 2952251 - protein, 24 aa, Entamoeba invadens
LHRSEELPLVYPVDVPSNGEVLEF

SEQ ID NO: 2952252 - protein, 23 aa, Entamoeba invadens
LHRTICLNCISQIIPSLSVETIT

SEQ ID NO: 2952253 - protein, 32 aa, Entamoeba invadens
LHRVFADHFMYCILIVRVARIVDSGLWPKLFS

SEQ ID NO: 2952254 - protein, 19 aa, Entamoeba invadens
LHRVLRVSMKPERHFAFIA

SEQ ID NO: 2952255 - protein, 22 aa, Entamoeba invadens
LHRVSLFLLFVWIKINPPFQNE

SEQ ID NO: 2952256 - protein, 17 aa, Entamoeba invadens
LHSAVLFLLDLKQVNLT

SEQ ID NO: 2952257 - protein, 17 aa, Entamoeba invadens
LHSEILMFLSEFLEKTP

SEQ ID NO: 2952258 - protein, 24 aa, Entamoeba invadens
LHSELGKFFCVHGGISPNLNSLQD

SEQ ID NO: 2952259 - protein, 22 aa, Entamoeba invadens
LHSLQIPNFVTWLPDFCFENAT

SEQ ID NO: 2952260 - protein, 21 aa, Entamoeba invadens
LHSSISVRMNDMWRNNEKSLE

SEQ ID NO: 2952261 - protein, 19 aa, Entamoeba invadens
LHSTFCNFGNLVSPPKINT

SEQ ID NO: 2952262 - protein, 18 aa, Entamoeba invadens
LHSVDFVHYIRPFLVEGL

SEQ ID NO: 2952263 - protein, 17 aa, Entamoeba invadens
LHTAKLCDFGMATYTGG

SEQ ID NO: 2952264 - protein, 22 aa, Entamoeba invadens
LHTEAQFKLAQLVQQLEAAQGE

SEQ ID NO: 2952265 - protein, 19 aa, Entamoeba invadens
LHTESGLLYDEYVMMQIPS

SEQ ID NO: 2952266 - protein, 27 aa, Entamoeba invadens
LHTGLNFRKAMTLMFHGFFDDSSFSVT

SEQ ID NO: 2952267 - protein, 17 aa, Entamoeba invadens
LHTKVPKFDVFEGKSTF

SEQ ID NO: 2952268 - protein, 22 aa, Entamoeba invadens
LHTLKRIRIFVSDNEQLKYFVP

SEQ ID NO: 2952269 - protein, 25 aa, Entamoeba invadens
LHTSSLRYVKTGDFFSKLRDSNGKK

SEQ ID NO: 2952270 - protein, 17 aa, Entamoeba invadens
LHTWKGDDFLNHTNDPI

SEQ ID NO: 2952271 - protein, 23 aa, Entamoeba invadens
LHVETVFLIWVFLREVKRVPDLR

SEQ ID NO: 2952272 - protein, 23 aa, Entamoeba invadens
LHVPKCVLYHPTLPCVLADISKD

SEQ ID NO: 2952273 - protein, 22 aa, Entamoeba invadens
LHVPPELSSVNWKVSKVGQAYL

SEQ ID NO: 2952274 - protein, 25 aa, Entamoeba invadens
LHVSYPCPRIFRNPDFKGFPKKLEL

SEQ ID NO: 2952275 - protein, 25 aa, Entamoeba invadens
LHWGCPVDVWSHGCMIFELVTGDYL

SEQ ID NO: 2952276 - protein, 17 aa, Entamoeba invadens
LHWLEYFPTCGVEDLKL

SEQ ID NO: 2952277 - protein, 18 aa, Entamoeba invadens
LIAALPDSNRHVLWYFCD

SEQ ID NO: 2952278 - protein, 19 aa, Entamoeba invadens
LIACFLKLGYTAKLHRTTK

SEQ ID NO: 2952279 - protein, 18 aa, Entamoeba invadens
LIAECWQHDQSKRPKFNV

SEQ ID NO: 2952280 - protein, 29 aa, Entamoeba invadens
LIAFGACLACGVLMNFTRTLLIKNGLITN

SEQ ID NO: 2952281 - protein, 18 aa, Entamoeba invadens
LIAKLKTQQIIGGQLKNF

SEQ ID NO: 2952282 - protein, 19 aa, Entamoeba invadens
LIAKPRGNKPLNIFQRRTN

SEQ ID NO: 2952283 - protein, 24 aa, Entamoeba invadens
LIAKVKMFKGLKVDDGYITRKFTG

SEQ ID NO: 2952284 - protein, 17 aa, Entamoeba invadens
LIALYASGNEKITNSED

SEQ ID NO: 2952285 - protein, 24 aa, Entamoeba invadens
LIAPNKWQCCLCDTINTEKSIYYD

SEQ ID NO: 2952286 - protein, 27 aa, Entamoeba invadens
LIAQNREYFIAYEIRVTLNDQIDRFNK

SEQ ID NO: 2952287 - protein, 17 aa, Entamoeba invadens
LIARLVKYAQIHKMTLK

SEQ ID NO: 2952288 - protein, 17 aa, Entamoeba invadens
LIATPFYYRYNPFIQKF

SEQ ID NO: 2952289 - protein, 19 aa, Entamoeba invadens
LIAVFVIGQSWQFREFPIK

SEQ ID NO: 2952290 - protein, 25 aa, Entamoeba invadens
LIAVTTCSVERSFSLIKRASRPNRK

SEQ ID NO: 2952291 - protein, 26 aa, Entamoeba invadens
LIAVTTCSVERSFSLIKRASRPNRKN

SEQ ID NO: 2952292 - protein, 17 aa, Entamoeba invadens
LIAYKPKVVYDEYNDED

SEQ ID NO: 2952293 - protein, 17 aa, Entamoeba invadens
LICDGHGGDLCSKAAVK

SEQ ID NO: 2952294 - protein, 20 aa, Entamoeba invadens
LICKKCEVNAVFVKNNINTI

SEQ ID NO: 2952295 - protein, 24 aa, Entamoeba invadens
LICKKFSCVLDRFRYNPIPVTTTK

SEQ ID NO: 2952296 - protein, 24 aa, Entamoeba invadens
LICPKKKCGINSFPLKIVSQKVEK

SEQ ID NO: 2952297 - protein, 17 aa, Entamoeba invadens
LICYPTLKKVMSTIPSN

SEQ ID NO: 2952298 - protein, 19 aa, Entamoeba invadens
LIDCGEGILTTMIKQNIDV

SEQ ID NO: 2952299 - protein, 17 aa, Entamoeba invadens
LIDCNELAFLVQQIDGT

SEQ ID NO: 2952300 - protein, 17 aa, Entamoeba invadens
LIDCPGVVHPSDDTETD

SEQ ID NO: 2952301 - protein, 25 aa, Entamoeba invadens
LIDDERSVVLLLEVIFNFQRTEQVV

SEQ ID NO: 2952302 - protein, 20 aa, Entamoeba invadens
LIDDLYMFFIHPCGTSSTIE

SEQ ID NO: 2952303 - protein, 22 aa, Entamoeba invadens
LIDFGSSCFENSTLYTYIQSRH

SEQ ID NO: 2952304 - protein, 26 aa, Entamoeba invadens
LIDFKSLYPSIIMEFAVCFTNNTIGD

SEQ ID NO: 2952305 - protein, 24 aa, Entamoeba invadens
LIDGASYPSEFLLLSCDEEICMCV

SEQ ID NO: 2952306 - protein, 19 aa, Entamoeba invadens
LIDGMIDCVFAYYSDSPLL

SEQ ID NO: 2952307 - protein, 18 aa, Entamoeba invadens
LIDKERCRLDKEIKTNTF

SEQ ID NO: 2952308 - protein, 25 aa, Entamoeba invadens
LIDKKPRIDLSFALVSRNVEVCVEL

SEQ ID NO: 2952309 - protein, 19 aa, Entamoeba invadens
LIDLAWLNGFFCNSTFTSG

SEQ ID NO: 2952310 - protein, 20 aa, Entamoeba invadens
LIDLGSCCFDNCTLYTYIQS

SEQ ID NO: 2952311 - protein, 32 aa, Entamoeba invadens
LIDLKLLTPEFKAVLKAAGMKRKDLCNPETVQ

SEQ ID NO: 2952312 - protein, 27 aa, Entamoeba invadens
LIDLSKKKKVIWCGDLNVALRWIDVAK

SEQ ID NO: 2952313 - protein, 25 aa, Entamoeba invadens
LIDNFPFDAVFAITGDMKEGCSFGW

SEQ ID NO: 2952314 - protein, 21 aa, Entamoeba invadens
LIDQMRMWFLPSFDNQKNGIK

SEQ ID NO: 2952315 - protein, 21 aa, Entamoeba invadens
LIDRLSLLPSENIPEKSVIVL

SEQ ID NO: 2952316 - protein, 17 aa, Entamoeba invadens
LIDVVPIKIPQQADSNA

SEQ ID NO: 2952317 - protein, 18 aa, Entamoeba invadens
LIECVFKNSFRLVEYSDK

SEQ ID NO: 2952318 - protein, 22 aa, Entamoeba invadens
LIEEFRMGLTPPVTSLVVIDDK

SEQ ID NO: 2952319 - protein, 23 aa, Entamoeba invadens
LIEEGKCVIVPMLYDIDTGVASV

SEQ ID NO: 2952320 - protein, 20 aa, Entamoeba invadens
LIEELRKVGYVFESRLTEGK

SEQ ID NO: 2952321 - protein, 32 aa, Entamoeba invadens
LIEGYCITFPFKNKRLVSADVISELFFSLFDC

SEQ ID NO: 2952322 - protein, 17 aa, Entamoeba invadens
LIEKAAFLPIAGKLIEN

SEQ ID NO: 2952323 - protein, 18 aa, Entamoeba invadens
LIEKRTSGQFVMNSMTSV

SEQ ID NO: 2952324 - protein, 21 aa, Entamoeba invadens
LIEKSELGSMFSIKTPCLPKR

SEQ ID NO: 2952325 - protein, 18 aa, Entamoeba invadens
LIEMYIGCYLKIMDLLKV

SEQ ID NO: 2952326 - protein, 17 aa, Entamoeba invadens
LIENLVMLNNNLKARQQ

SEQ ID NO: 2952327 - protein, 21 aa, Entamoeba invadens
LIEPFNVFFNGEFPYCALDIS

SEQ ID NO: 2952328 - protein, 18 aa, Entamoeba invadens
LIEPFTFGNCISLTKIEL

SEQ ID NO: 2952329 - protein, 17 aa, Entamoeba invadens
LIERYFGRLVCTIQSTS

SEQ ID NO: 2952330 - protein, 24 aa, Entamoeba invadens
LIETAFALTFFRDVVVARFADEPV

SEQ ID NO: 2952331 - protein, 17 aa, Entamoeba invadens
LIETFKDYFEVMKTVWG

SEQ ID NO: 2952332 - protein, 18 aa, Entamoeba invadens
LIEYMYRSQWFERGGLCA

SEQ ID NO: 2952333 - protein, 17 aa, Entamoeba invadens
LIFDFSGIGIFGTSKNA

SEQ ID NO: 2952334 - protein, 24 aa, Entamoeba invadens
LIFDSMFFIPINRRMNAVLKELWM

SEQ ID NO: 2952335 - protein, 19 aa, Entamoeba invadens
LIFFENLETLILWPENNFL

SEQ ID NO: 2952336 - protein, 21 aa, Entamoeba invadens
LIFFENLETLILWPKDNFLAF

SEQ ID NO: 2952337 - protein, 20 aa, Entamoeba invadens
LIFFENLETLILWPQNNFLA

SEQ ID NO: 2952338 - protein, 18 aa, Entamoeba invadens
LIFGCINYTTAIDIWSVG

SEQ ID NO: 2952339 - protein, 20 aa, Entamoeba invadens
LIFGELNFKSGNKELKPPVD

SEQ ID NO: 2952340 - protein, 17 aa, Entamoeba invadens
LIFGNRNLFEFFINANV

SEQ ID NO: 2952341 - protein, 18 aa, Entamoeba invadens
LIFKGCSKLTKIENITQV

SEQ ID NO: 2952342 - protein, 17 aa, Entamoeba invadens
LIFKQCDYYTLMADSAM

SEQ ID NO: 2952343 - protein, 23 aa, Entamoeba invadens
LIFLNDHKYMMVVDTNWVNQQDV

SEQ ID NO: 2952344 - protein, 19 aa, Entamoeba invadens
LIFMFYVKWDVSDKYWELL

SEQ ID NO: 2952345 - protein, 20 aa, Entamoeba invadens
LIFYNILQWLDKLNVTVPIP

SEQ ID NO: 2952346 - protein, 17 aa, Entamoeba invadens
LIGCGVSTCQNTFCRSS

SEQ ID NO: 2952347 - protein, 21 aa, Entamoeba invadens
LIGCSRLILFDPDWNPAKDKQ

SEQ ID NO: 2952348 - protein, 22 aa, Entamoeba invadens
LIGDYCFFQCIGLSDYTWRLLK

SEQ ID NO: 2952349 - protein, 23 aa, Entamoeba invadens
LIGEEKYQCTLTFGYNGDNKRIA

SEQ ID NO: 2952350 - protein, 17 aa, Entamoeba invadens
LIGESPLGFPTNLMPIL

SEQ ID NO: 2952351 - protein, 19 aa, Entamoeba invadens
LIGGAKLFDVFENVYRPVI

SEQ ID NO: 2952352 - protein, 18 aa, Entamoeba invadens
LIGGLVENPTQLFPSVQK

SEQ ID NO: 2952353 - protein, 23 aa, Entamoeba invadens
LIGMAASFGYQIDINKLYKKGKT

SEQ ID NO: 2952354 - protein, 24 aa, Entamoeba invadens
LIGSKWCSIASCLNNRTARATRNR

SEQ ID NO: 2952355 - protein, 18 aa, Entamoeba invadens
LIGTCLVELNAQRRMHMK

SEQ ID NO: 2952356 - protein, 19 aa, Entamoeba invadens
LIGTETCKINREIKYTVTY

SEQ ID NO: 2952357 - protein, 17 aa, Entamoeba invadens
LIGTETCKINRENKYTV

SEQ ID NO: 2952358 - protein, 20 aa, Entamoeba invadens
LIGVFPYEYIPTIFDNYIKT

SEQ ID NO: 2952359 - protein, 19 aa, Entamoeba invadens
LIGYWCFSECSSLSSITIP

SEQ ID NO: 2952360 - protein, 18 aa, Entamoeba invadens
LIHCDIKPSNFVMKGNDE

SEQ ID NO: 2952361 - protein, 18 aa, Entamoeba invadens
LIHFCKAPIGIDLIKFKG

SEQ ID NO: 2952362 - protein, 18 aa, Entamoeba invadens
LIHFELHTPFVLSYYKYW

SEQ ID NO: 2952363 - protein, 18 aa, Entamoeba invadens
LIHGRTFKPDCTLSEKGF

SEQ ID NO: 2952364 - protein, 20 aa, Entamoeba invadens
LIHKACGWMLREIGKKNEKT

SEQ ID NO: 2952365 - protein, 17 aa, Entamoeba invadens
LIHLDVYPFLGAQLSVA

SEQ ID NO: 2952366 - protein, 17 aa, Entamoeba invadens
LIHPWLYGPTVYVNPYF

SEQ ID NO: 2952367 - protein, 17 aa, Entamoeba invadens
LIHRDLKPANLLLQSTD

SEQ ID NO: 2952368 - protein, 24 aa, Entamoeba invadens
LIHSNLSLCFLKLDRLDETKEQSE

SEQ ID NO: 2952369 - protein, 26 aa, Entamoeba invadens
LIHVCEYGTVCLRSASIIETNAKQLP

SEQ ID NO: 2952370 - protein, 19 aa, Entamoeba invadens
LIHVKGKKKPFARLVECSW

SEQ ID NO: 2952371 - protein, 17 aa, Entamoeba invadens
LIIDQGIDQNSGDNVQN

SEQ ID NO: 2952372 - protein, 17 aa, Entamoeba invadens
LIIECFREELLDLYDLE

SEQ ID NO: 2952373 - protein, 17 aa, Entamoeba invadens
LIIEIVINILGLNDTIY

SEQ ID NO: 2952374 - protein, 18 aa, Entamoeba invadens
LIIGEFPVYLVVGCESGE

SEQ ID NO: 2952375 - protein, 17 aa, Entamoeba invadens
LIIKKCQFDSIQLTTRL

SEQ ID NO: 2952376 - protein, 20 aa, Entamoeba invadens
LIILDCRPYTNAYANRVNGG

SEQ ID NO: 2952377 - protein, 30 aa, Entamoeba invadens
LIILECTRLGLKTVWLGGTFTTSVFTAIQY

SEQ ID NO: 2952378 - protein, 17 aa, Entamoeba invadens
LIILNFFGQETLFEAPE

SEQ ID NO: 2952379 - protein, 24 aa, Entamoeba invadens
LIIPHTLGGFLTRKESAACDKRLY

SEQ ID NO: 2952380 - protein, 18 aa, Entamoeba invadens
LIISSPFFRATETARYIA

SEQ ID NO: 2952381 - protein, 24 aa, Entamoeba invadens
LIITQSGCSFGFYNDEPITKDENG

SEQ ID NO: 2952382 - protein, 26 aa, Entamoeba invadens
LIKCSKFDIVCGMMYIKVDQNFECWI

SEQ ID NO: 2952383 - protein, 25 aa, Entamoeba invadens
LIKDKCLRCRDGFVFEGNNCVDITK

SEQ ID NO: 2952384 - protein, 23 aa, Entamoeba invadens
LIKDRLVIRKPHIIHSRSRVVDR

SEQ ID NO: 2952385 - protein, 23 aa, Entamoeba invadens
LIKGISVIGIRFVLNESCIPSID

SEQ ID NO: 2952386 - protein, 17 aa, Entamoeba invadens
LIKGLKQSLKFIENDNA

SEQ ID NO: 2952387 - protein, 18 aa, Entamoeba invadens
LIKHPFLKPDSILDKSLV

SEQ ID NO: 2952388 - protein, 20 aa, Entamoeba invadens
LIKKEHCDYVVGIGGGSAVD

SEQ ID NO: 2952389 - protein, 22 aa, Entamoeba invadens
LIKKELNIFTGIETLNLPSDIL

SEQ ID NO: 2952390 - protein, 24 aa, Entamoeba invadens
LIKKISKCDGFILTIEDYDGNLFG

SEQ ID NO: 2952391 - protein, 19 aa, Entamoeba invadens
LIKLCKLKNIKVPHVVDSI

SEQ ID NO: 2952392 - protein, 20 aa, Entamoeba invadens
LIKLCKLKNIKVPHVVDSIP

SEQ ID NO: 2952393 - protein, 24 aa, Entamoeba invadens
LIKLDDMRGAEEFFLDNKTEQEED

SEQ ID NO: 2952394 - protein, 17 aa, Entamoeba invadens
LIKMILIGDSGVGKSCL

SEQ ID NO: 2952395 - protein, 26 aa, Entamoeba invadens
LIKQTFPRLFLFDDMFNYVKEEDGVD

SEQ ID NO: 2952396 - protein, 25 aa, Entamoeba invadens
LIKRCWSADPLLRPDINELVKSLSD

SEQ ID NO: 2952397 - protein, 17 aa, Entamoeba invadens
LIKRLLNHLPEQRPTFN

SEQ ID NO: 2952398 - protein, 19 aa, Entamoeba invadens
LIKRRDEVFKERKRLENGE

SEQ ID NO: 2952399 - protein, 18 aa, Entamoeba invadens
LIKSCATALELLDTKPSK

SEQ ID NO: 2952400 - protein, 17 aa, Entamoeba invadens
LIKSVGDSLLILSSKDV

SEQ ID NO: 2952401 - protein, 18 aa, Entamoeba invadens
LIKTFPMLYISVFGGISN

SEQ ID NO: 2952402 - protein, 19 aa, Entamoeba invadens
LIKTSGCWMFEHKVYIGME

SEQ ID NO: 2952403 - protein, 21 aa, Entamoeba invadens
LIKYDCSFGKFYCKNERSKLY

SEQ ID NO: 2952404 - protein, 22 aa, Entamoeba invadens
LILADLVFKTDFVEFTNTSFVF

SEQ ID NO: 2952405 - protein, 24 aa, Entamoeba invadens
LILARSWLKYSYVHSFYLSENGGV

SEQ ID NO: 2952406 - protein, 22 aa, Entamoeba invadens
LILEKFYRFAMDYVSAPQLHMT

SEQ ID NO: 2952407 - protein, 23 aa, Entamoeba invadens
LILEQRNLLSLTLLVSPQILKRE

SEQ ID NO: 2952408 - protein, 17 aa, Entamoeba invadens
LILFDMMGIIAYSKEKN

SEQ ID NO: 2952409 - protein, 25 aa, Entamoeba invadens
LILIKKIPPVWARAVVEAAEAADSR

SEQ ID NO: 2952410 - protein, 17 aa, Entamoeba invadens
LILIPLLRFTPKVLVCV

SEQ ID NO: 2952411 - protein, 22 aa, Entamoeba invadens
LILKEEVTKCVIKQSDTLLKEI

SEQ ID NO: 2952412 - protein, 23 aa, Entamoeba invadens
LILKEKPQFVVITGDLTDSPNVQ

SEQ ID NO: 2952413 - protein, 19 aa, Entamoeba invadens
LILKSCSNLLLANLDKICA

SEQ ID NO: 2952414 - protein, 21 aa, Entamoeba invadens
LILLFKQARLSVMRYNTETNR

SEQ ID NO: 2952415 - protein, 23 aa, Entamoeba invadens
LILLKTCAKIEMINILNQQEKVH

SEQ ID NO: 2952416 - protein, 17 aa, Entamoeba invadens
LILPIKELCQIAHDHGA

SEQ ID NO: 2952417 - protein, 24 aa, Entamoeba invadens
LILRAADGVGLFDARDRKLNRHEF

SEQ ID NO: 2952418 - protein, 30 aa, Entamoeba invadens
LILSKYHYKAFCFLKSLFSKNVEYRTTEPL

SEQ ID NO: 2952419 - protein, 19 aa, Entamoeba invadens
LILSSAHVKGMFGVPDSYI

SEQ ID NO: 2952420 - protein, 18 aa, Entamoeba invadens
LILTCTNALELIKRVNFS

SEQ ID NO: 2952421 - protein, 18 aa, Entamoeba invadens
LILTYGEKQCVVSLQTFP

SEQ ID NO: 2952422 - protein, 18 aa, Entamoeba invadens
LILYYLLHVFPLEYIPSV

SEQ ID NO: 2952423 - protein, 17 aa, Entamoeba invadens
LIMARRMTLEGAKVLGV

SEQ ID NO: 2952424 - protein, 22 aa, Entamoeba invadens
LIMELYKEFLLKNGYVTDAGNL

SEQ ID NO: 2952425 - protein, 21 aa, Entamoeba invadens
LIMKRCWEFDAKKRVGIDKLV

SEQ ID NO: 2952426 - protein, 18 aa, Entamoeba invadens
LIMNCFNKRFFGGNNEVM

SEQ ID NO: 2952427 - protein, 27 aa, Entamoeba invadens
LIMPVQRLPRYTLLLTDLVKRTPETYD

SEQ ID NO: 2952428 - protein, 23 aa, Entamoeba invadens
LINDHCFRECYNLSSVKIPSSVS

SEQ ID NO: 2952429 - protein, 19 aa, Entamoeba invadens
LINEKFFFFLLETLNRVRD

SEQ ID NO: 2952430 - protein, 23 aa, Entamoeba invadens
LINELKIDFIFHGVVNSFDISNG

SEQ ID NO: 2952431 - protein, 17 aa, Entamoeba invadens
LINFIEALSNLKIEGYI

SEQ ID NO: 2952432 - protein, 20 aa, Entamoeba invadens
LINKKCCDSIQSMYTASYNL

SEQ ID NO: 2952433 - protein, 21 aa, Entamoeba invadens
LINNLEIYNTILLNTKLEVKS

SEQ ID NO: 2952434 - protein, 25 aa, Entamoeba invadens
LINRLEYLNRLWAAGIYAETIQKLN

SEQ ID NO: 2952435 - protein, 22 aa, Entamoeba invadens
LINVAIEYGWFFFSIITKSLVL

SEQ ID NO: 2952436 - protein, 19 aa, Entamoeba invadens
LIPEEFREVLYSVSTALLI

SEQ ID NO: 2952437 - protein, 25 aa, Entamoeba invadens
LIPEPTAAFYFYGIQKHAFNIENDI

SEQ ID NO: 2952438 - protein, 24 aa, Entamoeba invadens
LIPEPTAAFYFYSIRNHAFNIEND

SEQ ID NO: 2952439 - protein, 23 aa, Entamoeba invadens
LIPGKLYQFRGFDIANMSFIKGD

SEQ ID NO: 2952440 - protein, 19 aa, Entamoeba invadens
LIPLLSESLVSSPLPKEKE

SEQ ID NO: 2952441 - protein, 24 aa, Entamoeba invadens
LIPMFLGGITDFYFRDDTKMEDMV

SEQ ID NO: 2952442 - protein, 18 aa, Entamoeba invadens
LIPPECLKVASIYIPVVA

SEQ ID NO: 2952443 - protein, 19 aa, Entamoeba invadens
LIPRESVIYMQDLLQQPQS

SEQ ID NO: 2952444 - protein, 17 aa, Entamoeba invadens
LIPSGKIKNIFGDFTTL

SEQ ID NO: 2952445 - protein, 19 aa, Entamoeba invadens
LIQALKFELHHLSTLADFL

SEQ ID NO: 2952446 - protein, 20 aa, Entamoeba invadens
LIQDETIVSFGLAQSSIPNA

SEQ ID NO: 2952447 - protein, 19 aa, Entamoeba invadens
LIQECWDETTVLPILSLVG

SEQ ID NO: 2952448 - protein, 24 aa, Entamoeba invadens
LIQFYRAVLLYRNIKTENVRSWVC

SEQ ID NO: 2952449 - protein, 19 aa, Entamoeba invadens
LIQKDCDNFQYAFRKMGEN

SEQ ID NO: 2952450 - protein, 18 aa, Entamoeba invadens
LIQKDFKGNNSVGMAQIY

SEQ ID NO: 2952451 - protein, 25 aa, Entamoeba invadens
LIQPIQRLPRYVLLLKELIKATPEL

SEQ ID NO: 2952452 - protein, 26 aa, Entamoeba invadens
LIQPVQRFPRYVLLLDSLIKATPNFT

SEQ ID NO: 2952453 - protein, 18 aa, Entamoeba invadens
LIQRGRLLLNERFGETNF

SEQ ID NO: 2952454 - protein, 18 aa, Entamoeba invadens
LIQTRVDTLLFVYLENIG

SEQ ID NO: 2952455 - protein, 18 aa, Entamoeba invadens
LIQYAMNVPELFGVVIPL

SEQ ID NO: 2952456 - protein, 17 aa, Entamoeba invadens
LIRFCPQGTPLDKDVVC

SEQ ID NO: 2952457 - protein, 18 aa, Entamoeba invadens
LIRHCGQELIPFWDALRD

SEQ ID NO: 2952458 - protein, 24 aa, Entamoeba invadens
LIRKMPLEFNKMLSIYSKNTNLFD

SEQ ID NO: 2952459 - protein, 17 aa, Entamoeba invadens
LIRKRKAVLPFTRKHDF

SEQ ID NO: 2952460 - protein, 21 aa, Entamoeba invadens
LIRLCVCGNKTFPADECYNLT

SEQ ID NO: 2952461 - protein, 17 aa, Entamoeba invadens
LIRQCYRPFNKMHPAHV

SEQ ID NO: 2952462 - protein, 25 aa, Entamoeba invadens
LIRVMRYTEEISDWIVTIILLMFSA

SEQ ID NO: 2952463 - protein, 20 aa, Entamoeba invadens
LIRVVFQNRCRIIESNDDCF

SEQ ID NO: 2952464 - protein, 24 aa, Entamoeba invadens
LISACIRVIIKVTRFTKVNAEVLI

SEQ ID NO: 2952465 - protein, 24 aa, Entamoeba invadens
LISALAMGCVAAFSKSEHGREILV

SEQ ID NO: 2952466 - protein, 18 aa, Entamoeba invadens
LISDYFKVHGRFMELLMW

SEQ ID NO: 2952467 - protein, 19 aa, Entamoeba invadens
LISEIFPQALRVMDAHNIR

SEQ ID NO: 2952468 - protein, 21 aa, Entamoeba invadens
LISFLKLHVFQILKSTFTCNP

SEQ ID NO: 2952469 - protein, 25 aa, Entamoeba invadens
LISGCLNGRLSLWEYDGSEWRGSPE

SEQ ID NO: 2952470 - protein, 26 aa, Entamoeba invadens
LISKELPSFIFFRWDHTHEDKEFKSI

SEQ ID NO: 2952471 - protein, 33 aa, Entamoeba invadens
LISLLCCIKEIPFLCRCSKEAVLDIFHNIQNTC

SEQ ID NO: 2952472 - protein, 25 aa, Entamoeba invadens
LISLLDRLGFCFDYYETGIYLDIAD

SEQ ID NO: 2952473 - protein, 17 aa, Entamoeba invadens
LISPYSLLIKRDQQTLA

SEQ ID NO: 2952474 - protein, 17 aa, Entamoeba invadens
LISQCFIYGESSDVFII

SEQ ID NO: 2952475 - protein, 19 aa, Entamoeba invadens
LISQNGICLKCEEGKLLEN

SEQ ID NO: 2952476 - protein, 17 aa, Entamoeba invadens
LISQPVLSLLSTGKSTG

SEQ ID NO: 2952477 - protein, 22 aa, Entamoeba invadens
LISSELHVYVLLIGMVADYGKG

SEQ ID NO: 2952478 - protein, 19 aa, Entamoeba invadens
LISSPSLKKVILYVTLYEA

SEQ ID NO: 2952479 - protein, 19 aa, Entamoeba invadens
LITAFEVGEATFLDWYPDC

SEQ ID NO: 2952480 - protein, 24 aa, Entamoeba invadens
LITCFKGGLRSYVLRKGEEKLRRL

SEQ ID NO: 2952481 - protein, 25 aa, Entamoeba invadens
LITCVKKLIEVDGVLSIHDDTHIIF

SEQ ID NO: 2952482 - protein, 23 aa, Entamoeba invadens
LITEGFFKTFTFLFEKITDKAQS

SEQ ID NO: 2952483 - protein, 22 aa, Entamoeba invadens
LITFNDRILWVADHFKNKAISV

SEQ ID NO: 2952484 - protein, 18 aa, Entamoeba invadens
LITKYGLDLSKLEEAKKI

SEQ ID NO: 2952485 - protein, 22 aa, Entamoeba invadens
LITLKACGQIKVIKTLNEQQNV

SEQ ID NO: 2952486 - protein, 23 aa, Entamoeba invadens
LITLKACGQIKVIKTLNEQQNVN

SEQ ID NO: 2952487 - protein, 27 aa, Entamoeba invadens
LITNKLIIRYAIDYNVPLYVPPVFDDT

SEQ ID NO: 2952488 - protein, 19 aa, Entamoeba invadens
LITPFQWQHVFIPVLPVSL

SEQ ID NO: 2952489 - protein, 17 aa, Entamoeba invadens
LITQIAFETLVENYLNS

SEQ ID NO: 2952490 - protein, 18 aa, Entamoeba invadens
LITRFDFSSLTTIKEAAL

SEQ ID NO: 2952491 - protein, 24 aa, Entamoeba invadens
LITRGKYKLADFGSAIEADNYLHR

SEQ ID NO: 2952492 - protein, 17 aa, Entamoeba invadens
LITRYSIYYNVPLYVPP

SEQ ID NO: 2952493 - protein, 19 aa, Entamoeba invadens
LITSLSCGIPSTVGCVTPD

SEQ ID NO: 2952494 - protein, 19 aa, Entamoeba invadens
LITSVLRFAMNNDFQDLNE

SEQ ID NO: 2952495 - protein, 26 aa, Entamoeba invadens
LIVAKYFLYRCDFINVICVCKKFKET

SEQ ID NO: 2952496 - protein, 17 aa, Entamoeba invadens
LIVEFQASVPVTLKDFK

SEQ ID NO: 2952497 - protein, 19 aa, Entamoeba invadens
LIVEMAKKFIGKPAPFTPF

SEQ ID NO: 2952498 - protein, 18 aa, Entamoeba invadens
LIVFPKERIDTTMTPMET

SEQ ID NO: 2952499 - protein, 25 aa, Entamoeba invadens
LIVHGCKRVWFGFNLSEETVKEFTI

SEQ ID NO: 2952500 - protein, 17 aa, Entamoeba invadens
LIVKILEKYGCGSCGPR

SEQ ID NO: 2952501 - protein, 24 aa, Entamoeba invadens
LIVLERRVMRIFTKRKNVEDVVEC

SEQ ID NO: 2952502 - protein, 18 aa, Entamoeba invadens
LIVLKYVLCDSSRSLNNL

SEQ ID NO: 2952503 - protein, 26 aa, Entamoeba invadens
LIVNKMKAYCTGFIPIKEMFYTLSLA

SEQ ID NO: 2952504 - protein, 19 aa, Entamoeba invadens
LIVQIAVSCPKAFGPLGTD

SEQ ID NO: 2952505 - protein, 26 aa, Entamoeba invadens
LIVQSCPRYAQTLNLGFSYLPFLNAF

SEQ ID NO: 2952506 - protein, 18 aa, Entamoeba invadens
LIVQYSMALGTELKQLLL

SEQ ID NO: 2952507 - protein, 18 aa, Entamoeba invadens
LIVRGIKTFGLGMWSDMG

SEQ ID NO: 2952508 - protein, 17 aa, Entamoeba invadens
LIVSIGVCDHRLVQNSH

SEQ ID NO: 2952509 - protein, 26 aa, Entamoeba invadens
LIVTHFPFGPTAYFGLYNVVSRHDAK

SEQ ID NO: 2952510 - protein, 18 aa, Entamoeba invadens
LIYGNAVGIVQEFIDYSP

SEQ ID NO: 2952511 - protein, 17 aa, Entamoeba invadens
LIYKDVLRYGGTEFQFE

SEQ ID NO: 2952512 - protein, 25 aa, Entamoeba invadens
LIYLMKIFGEFFYKKDYLMSFYKIM

SEQ ID NO: 2952513 - protein, 28 aa, Entamoeba invadens
LIYRLLVGRCPFQLLQMDTFSALQAQVA

SEQ ID NO: 2952514 - protein, 28 aa, Entamoeba invadens
LIYRLLVGRCPFQLLQMDTFSALQAQVV

SEQ ID NO: 2952515 - protein, 17 aa, Entamoeba invadens
LIYYKTFLIDNILICVN

SEQ ID NO: 2952516 - protein, 17 aa, Entamoeba invadens
LKADFDFQEQLIALSSA

SEQ ID NO: 2952517 - protein, 17 aa, Entamoeba invadens
LKAEKVLEMKMDFNDTP

SEQ ID NO: 2952518 - protein, 21 aa, Entamoeba invadens
LKAENNFVFTWAQSELNEGKG

SEQ ID NO: 2952519 - protein, 25 aa, Entamoeba invadens
LKAEVGPNIVLRSGNTMFPGFKERL

SEQ ID NO: 2952520 - protein, 20 aa, Entamoeba invadens
LKAFKGILLDVKQSFTRAVE

SEQ ID NO: 2952521 - protein, 18 aa, Entamoeba invadens
LKAFPKIETLQCVDFMLG

SEQ ID NO: 2952522 - protein, 17 aa, Entamoeba invadens
LKAFPKIETLQCVDYML

SEQ ID NO: 2952523 - protein, 29 aa, Entamoeba invadens
LKAGTDIIGCIEIICFILTEHPRLFPNDV

SEQ ID NO: 2952524 - protein, 33 aa, Entamoeba invadens
LKAHLYRFVSSLEVFYTLCLVEYLVVNVNHFEA

SEQ ID NO: 2952525 - protein, 26 aa, Entamoeba invadens
LKAILKISRSHFAQFKNVFVNTLNEY

SEQ ID NO: 2952526 - protein, 19 aa, Entamoeba invadens
LKAIQSAREKARKDMEERR

SEQ ID NO: 2952527 - protein, 23 aa, Entamoeba invadens
LKAKCVKFTVAHAQFIAEKMELN

SEQ ID NO: 2952528 - protein, 27 aa, Entamoeba invadens
LKAKHHVAYRMLKKCNTIEEMKVTIPQ

SEQ ID NO: 2952529 - protein, 18 aa, Entamoeba invadens
LKAKITFERLEEFSDIQI

SEQ ID NO: 2952530 - protein, 20 aa, Entamoeba invadens
LKAKNWRKSILDALNHSDYF

SEQ ID NO: 2952531 - protein, 18 aa, Entamoeba invadens
LKAKVLLDLYFKSAPPNE

SEQ ID NO: 2952532 - protein, 18 aa, Entamoeba invadens
LKALEEFTLFMADKEMKN

SEQ ID NO: 2952533 - protein, 19 aa, Entamoeba invadens
LKALFEIIEKKFLWDKVRV

SEQ ID NO: 2952534 - protein, 17 aa, Entamoeba invadens
LKALGWAPTVGFEEGLK

SEQ ID NO: 2952535 - protein, 18 aa, Entamoeba invadens
LKALKYLHSAGIVHRDIK

SEQ ID NO: 2952536 - protein, 32 aa, Entamoeba invadens
LKALLFKLLGKEGLALRIYFQLDYETNARRDC

SEQ ID NO: 2952537 - protein, 18 aa, Entamoeba invadens
LKALREVTDLPIFFHSHN

SEQ ID NO: 2952538 - protein, 18 aa, Entamoeba invadens
LKALSALINIAAVKESRE

SEQ ID NO: 2952539 - protein, 18 aa, Entamoeba invadens
LKASFLNSSLRTFVQGSF

SEQ ID NO: 2952540 - protein, 18 aa, Entamoeba invadens
LKAYIAIGDGKGHVGLGV

SEQ ID NO: 2952541 - protein, 24 aa, Entamoeba invadens
LKCAECTRSFDIGRSAAFGKYIPE

SEQ ID NO: 2952542 - protein, 20 aa, Entamoeba invadens
LKCDITYDIFADVLSQTFSI

SEQ ID NO: 2952543 - protein, 17 aa, Entamoeba invadens
LKCERIIETISFYDKQL

SEQ ID NO: 2952544 - protein, 21 aa, Entamoeba invadens
LKCLDFKQKHLHRWMKETYGI

SEQ ID NO: 2952545 - protein, 19 aa, Entamoeba invadens
LKCLKQIRKRSCVFTHMNN

SEQ ID NO: 2952546 - protein, 20 aa, Entamoeba invadens
LKCNREFLSMLVQARKNDTL

SEQ ID NO: 2952547 - protein, 26 aa, Entamoeba invadens
LKCNVLKEIFCHVCLRNDTVVPEIEK

SEQ ID NO: 2952548 - protein, 19 aa, Entamoeba invadens
LKCPAEFKLEISKKAVAFE

SEQ ID NO: 2952549 - protein, 24 aa, Entamoeba invadens
LKCPESLVSLLLCEGMEDKDSIRM

SEQ ID NO: 2952550 - protein, 19 aa, Entamoeba invadens
LKCPHCKKPIKLNYKKTLE

SEQ ID NO: 2952551 - protein, 26 aa, Entamoeba invadens
LKCPQARMSWKFFESYSLYLSAQLPD

SEQ ID NO: 2952552 - protein, 30 aa, Entamoeba invadens
LKCSALRALIKVDLATAVAYVVKKAEQINT

SEQ ID NO: 2952553 - protein, 25 aa, Entamoeba invadens
LKCSLEKLKHLKFLNLKSLTKSAVF

SEQ ID NO: 2952554 - protein, 20 aa, Entamoeba invadens
LKCYFHNEMPNFYTEKNGKP

SEQ ID NO: 2952555 - protein, 21 aa, Entamoeba invadens
LKDADALDRCRIGDLDIQKLR

SEQ ID NO: 2952556 - protein, 17 aa, Entamoeba invadens
LKDAMGMNALHYACQSN

SEQ ID NO: 2952557 - protein, 19 aa, Entamoeba invadens
LKDCDLVTIVNEWLKKRYT

SEQ ID NO: 2952558 - protein, 23 aa, Entamoeba invadens
LKDCGDVNAIGRIHNFLEKAGWI

SEQ ID NO: 2952559 - protein, 18 aa, Entamoeba invadens
LKDDFALITLMKPVCTTV

SEQ ID NO: 2952560 - protein, 19 aa, Entamoeba invadens
LKDDFSFVFKDPKEMANFK

SEQ ID NO: 2952561 - protein, 29 aa, Entamoeba invadens
LKDEILRINPNLAEFVNFYYTTNHDETIE

SEQ ID NO: 2952562 - protein, 26 aa, Entamoeba invadens
LKDEKLLFMAFEWMKQSVALSAGNLD

SEQ ID NO: 2952563 - protein, 19 aa, Entamoeba invadens
LKDEMIKKIQNVNTTLNDQ

SEQ ID NO: 2952564 - protein, 23 aa, Entamoeba invadens
LKDFEMTRVIAITMKQDVFHDVI

SEQ ID NO: 2952565 - protein, 17 aa, Entamoeba invadens
LKDGKLKKICRKNNKER

SEQ ID NO: 2952566 - protein, 29 aa, Entamoeba invadens
LKDIAIPCGVSLIGSYAFSKCCKLEKIEI

SEQ ID NO: 2952567 - protein, 24 aa, Entamoeba invadens
LKDIPQHFIFNFGVLDVHLQQLNT

SEQ ID NO: 2952568 - protein, 26 aa, Entamoeba invadens
LKDISSLFWFFKYFSPETFDNNFSEI

SEQ ID NO: 2952569 - protein, 18 aa, Entamoeba invadens
LKDLIYRNWMSISVCAVS

SEQ ID NO: 2952570 - protein, 22 aa, Entamoeba invadens
LKDLQCLKCYEILTNWIKCGLL

SEQ ID NO: 2952571 - protein, 22 aa, Entamoeba invadens
LKDLTLKLNKAIPEGTSQKDVD

SEQ ID NO: 2952572 - protein, 17 aa, Entamoeba invadens
LKDLVTVVSNAEKQTFV

SEQ ID NO: 2952573 - protein, 18 aa, Entamoeba invadens
LKDMISHYIETLVDCAEN

SEQ ID NO: 2952574 - protein, 25 aa, Entamoeba invadens
LKDNFKFLTKFVVYFIDEVEELSLA

SEQ ID NO: 2952575 - protein, 27 aa, Entamoeba invadens
LKDNFTFTISDVFPAVMKRNKLADKNK

SEQ ID NO: 2952576 - protein, 20 aa, Entamoeba invadens
LKDNLDFGTVSFVSGKSVPK

SEQ ID NO: 2952577 - protein, 20 aa, Entamoeba invadens
LKDNRMVRTSFCLDTIEIAE

SEQ ID NO: 2952578 - protein, 19 aa, Entamoeba invadens
LKDNRYHLWTGNVIAKTPT

SEQ ID NO: 2952579 - protein, 28 aa, Entamoeba invadens
LKDNTCLPCTLIGCFKCTKFECLECQTG

SEQ ID NO: 2952580 - protein, 17 aa, Entamoeba invadens
LKDPCVFICNDVVNQDV

SEQ ID NO: 2952581 - protein, 19 aa, Entamoeba invadens
LKDQIILDLYNYVYPRGEF

SEQ ID NO: 2952582 - protein, 23 aa, Entamoeba invadens
LKDRYTRCLELYVAPRKTVTIKD

SEQ ID NO: 2952583 - protein, 24 aa, Entamoeba invadens
LKDSKCLPCTLTGCSKCLETECLT

SEQ ID NO: 2952584 - protein, 22 aa, Entamoeba invadens
LKDTDIDNEWGITIMQKNHEEM

SEQ ID NO: 2952585 - protein, 18 aa, Entamoeba invadens
LKDTLKFRILDLKEGSEN

SEQ ID NO: 2952586 - protein, 18 aa, Entamoeba invadens
LKDTLPNISGSIMHAILV

SEQ ID NO: 2952587 - protein, 22 aa, Entamoeba invadens
LKDTNEIYCTIHLPQPKNLQAA

SEQ ID NO: 2952588 - protein, 19 aa, Entamoeba invadens
LKDVPSIFLTCENLKQLRT

SEQ ID NO: 2952589 - protein, 21 aa, Entamoeba invadens
LKDYLKKRCIEHKNDDIARGV

SEQ ID NO: 2952590 - protein, 21 aa, Entamoeba invadens
LKEAFELQRMESIANNLRHLH

SEQ ID NO: 2952591 - protein, 22 aa, Entamoeba invadens
LKEAFFQEFYRAMMETFQHVQT

SEQ ID NO: 2952592 - protein, 18 aa, Entamoeba invadens
LKEAFNEFHFFSTIANER

SEQ ID NO: 2952593 - protein, 18 aa, Entamoeba invadens
LKEAITVSLRNGANGISI

SEQ ID NO: 2952594 - protein, 18 aa, Entamoeba invadens
LKEALKYINANTVEDIMK

SEQ ID NO: 2952595 - protein, 19 aa, Entamoeba invadens
LKEAVLHVRIIERIIFVFN

SEQ ID NO: 2952596 - protein, 17 aa, Entamoeba invadens
LKEAVYMALFKVTDTNG

SEQ ID NO: 2952597 - protein, 23 aa, Entamoeba invadens
LKECAFSNYPKGIIFALEATIGF

SEQ ID NO: 2952598 - protein, 19 aa, Entamoeba invadens
LKEEKVCFEEPETVNESTC

SEQ ID NO: 2952599 - protein, 28 aa, Entamoeba invadens
LKEERAYTLKICRAIQKSGCNVLLVQKS

SEQ ID NO: 2952600 - protein, 20 aa, Entamoeba invadens
LKEFKEMMEDSLSLHDVENI

SEQ ID NO: 2952601 - protein, 19 aa, Entamoeba invadens
LKEFLEHLAHFMEENSETI

SEQ ID NO: 2952602 - protein, 26 aa, Entamoeba invadens
LKEFNFPPHLTRIGTKCFVECPNLKE

SEQ ID NO: 2952603 - protein, 19 aa, Entamoeba invadens
LKEFSIIRITNAVLHVPTD

SEQ ID NO: 2952604 - protein, 18 aa, Entamoeba invadens
LKEGAVCFQCGKKATCYG

SEQ ID NO: 2952605 - protein, 24 aa, Entamoeba invadens
LKEGEVIYYWCIFQNKGKEAKNGI

SEQ ID NO: 2952606 - protein, 22 aa, Entamoeba invadens
LKEGKIVCLGKRSAQLTPMDSQ

SEQ ID NO: 2952607 - protein, 26 aa, Entamoeba invadens
LKEGMNVRYAAPICGPYECVTKYKYH

SEQ ID NO: 2952608 - protein, 20 aa, Entamoeba invadens
LKEHPEAIQELALLCPPDEV

SEQ ID NO: 2952609 - protein, 17 aa, Entamoeba invadens
LKEIEIPSGVVWMEATF

SEQ ID NO: 2952610 - protein, 27 aa, Entamoeba invadens
LKEIHLPKLVEVIPESFFFQIKDVYID

SEQ ID NO: 2952611 - protein, 31 aa, Entamoeba invadens
LKEIKLPKLLKFIPDSCFNRCTSLSSVSFGK

SEQ ID NO: 2952612 - protein, 31 aa, Entamoeba invadens
LKEIKLPKLLKFIPDSCFNRCTSLSSVSFGT

SEQ ID NO: 2952613 - protein, 22 aa, Entamoeba invadens
LKEIPGGLVPKSALPLFKKWDA

SEQ ID NO: 2952614 - protein, 18 aa, Entamoeba invadens
LKEISSMALTKMKETAEA

SEQ ID NO: 2952615 - protein, 31 aa, Entamoeba invadens
LKEKDARAEELWKFVGLFSSLEQENGKEGCG

SEQ ID NO: 2952616 - protein, 30 aa, Entamoeba invadens
LKEKGREKFDRYLIRPNLNKFAFKIDKKDS

SEQ ID NO: 2952617 - protein, 20 aa, Entamoeba invadens
LKEKKDVVVVAMNEETISTG

SEQ ID NO: 2952618 - protein, 17 aa, Entamoeba invadens
LKEKLCHVAQNYEEEKK

SEQ ID NO: 2952619 - protein, 21 aa, Entamoeba invadens
LKEKLHKMDEAVLKNDKDAYE

SEQ ID NO: 2952620 - protein, 25 aa, Entamoeba invadens
LKEKLKSNCLLGEWQITKDAMFLLH

SEQ ID NO: 2952621 - protein, 36 aa, Entamoeba invadens
LKEKTKDILLLFKYDRWGCFKEQILGPSFEDKEKHE

SEQ ID NO: 2952622 - protein, 18 aa, Entamoeba invadens
LKEKVIMLIVSSFSKKIN

SEQ ID NO: 2952623 - protein, 22 aa, Entamoeba invadens
LKELFICQLLDFIPHTVEYLYV

SEQ ID NO: 2952624 - protein, 21 aa, Entamoeba invadens
LKELILPTTLKVIGKHIFSLN

SEQ ID NO: 2952625 - protein, 17 aa, Entamoeba invadens
LKELKELSKIFVVSDRM

SEQ ID NO: 2952626 - protein, 36 aa, Entamoeba invadens
LKELKISVKTGRHWCLCLPSSLVVLTIKGGTFWLTN

SEQ ID NO: 2952627 - protein, 22 aa, Entamoeba invadens
LKELNVAFNFIKTIPVGFSQMK

SEQ ID NO: 2952628 - protein, 23 aa, Entamoeba invadens
LKELQFKQGSSIDVKRKEEDLTN

SEQ ID NO: 2952629 - protein, 19 aa, Entamoeba invadens
LKELTKFVVALGKPKESAE

SEQ ID NO: 2952630 - protein, 25 aa, Entamoeba invadens
LKELVFPLHLKFVGKKCFQKCEKLE

SEQ ID NO: 2952631 - protein, 25 aa, Entamoeba invadens
LKELVFRKTVVFEMGGCFERGVSLT

SEQ ID NO: 2952632 - protein, 27 aa, Entamoeba invadens
LKELVFRKTVVFGMGGCFERCVSLTHL

SEQ ID NO: 2952633 - protein, 20 aa, Entamoeba invadens
LKELYFINCNSIVLPSISFE

SEQ ID NO: 2952634 - protein, 19 aa, Entamoeba invadens
LKEMKHFLLYVEKVSKEEM

SEQ ID NO: 2952635 - protein, 18 aa, Entamoeba invadens
LKEMKKFQKMFVRIVDRK

SEQ ID NO: 2952636 - protein, 20 aa, Entamoeba invadens
LKEMYNRVLSESLKTIQNEQ

SEQ ID NO: 2952637 - protein, 19 aa, Entamoeba invadens
LKENECRILLVANKRDLQW

SEQ ID NO: 2952638 - protein, 29 aa, Entamoeba invadens
LKENKEGTGFMCYGRWRRVGNNRIEIREL

SEQ ID NO: 2952639 - protein, 18 aa, Entamoeba invadens
LKERCYIKQIILDRKMIS

SEQ ID NO: 2952640 - protein, 20 aa, Entamoeba invadens
LKERESWTPDLVKLVESCLM

SEQ ID NO: 2952641 - protein, 21 aa, Entamoeba invadens
LKERLYYDIFNFITKQTMTAA

SEQ ID NO: 2952642 - protein, 24 aa, Entamoeba invadens
LKERQKVNVLFSFLKTHTNSKIIV

SEQ ID NO: 2952643 - protein, 20 aa, Entamoeba invadens
LKESAPCFLVQIPKLYLKDG

SEQ ID NO: 2952644 - protein, 26 aa, Entamoeba invadens
LKESFWLHGLWPQFILNRNMFCCWSP

SEQ ID NO: 2952645 - protein, 20 aa, Entamoeba invadens
LKESMFPYYEMMIPLSHNIK

SEQ ID NO: 2952646 - protein, 19 aa, Entamoeba invadens
LKESNRAILTLAIATSLNI

SEQ ID NO: 2952647 - protein, 18 aa, Entamoeba invadens
LKESQEWSRQEKQNKKMR

SEQ ID NO: 2952648 - protein, 22 aa, Entamoeba invadens
LKETCQRNGATFVEKSSPLLSI

SEQ ID NO: 2952649 - protein, 18 aa, Entamoeba invadens
LKETFRIVFPDRPLLECE

SEQ ID NO: 2952650 - protein, 26 aa, Entamoeba invadens
LKETILPPLEELRPFPSNKNTVLRTG

SEQ ID NO: 2952651 - protein, 21 aa, Entamoeba invadens
LKETKRACARLVVDNNEENLI

SEQ ID NO: 2952652 - protein, 18 aa, Entamoeba invadens
LKEVAELYFEFYGTLMPL

SEQ ID NO: 2952653 - protein, 18 aa, Entamoeba invadens
LKEVCSVIDACYLQSVCF

SEQ ID NO: 2952654 - protein, 25 aa, Entamoeba invadens
LKEVEKRLGTVVGVDDVLDKTDFSE

SEQ ID NO: 2952655 - protein, 20 aa, Entamoeba invadens
LKEVFSLAIQNYIGVSLNGP

SEQ ID NO: 2952656 - protein, 25 aa, Entamoeba invadens
LKEVKRYTEDIPRKFIALKKTKPDG

SEQ ID NO: 2952657 - protein, 19 aa, Entamoeba invadens
LKEVPVIYLRPDDDGKSLE

SEQ ID NO: 2952658 - protein, 17 aa, Entamoeba invadens
LKEVWKRMFNLLDPTLV

SEQ ID NO: 2952659 - protein, 21 aa, Entamoeba invadens
LKFAGNYSKLEICEVSTDSKI

SEQ ID NO: 2952660 - protein, 18 aa, Entamoeba invadens
LKFDHPYIKNVLVGSQVL

SEQ ID NO: 2952661 - protein, 17 aa, Entamoeba invadens
LKFDKNNVKAFYRIGVV

SEQ ID NO: 2952662 - protein, 20 aa, Entamoeba invadens
LKFEPDCFIHDFIDIILTII

SEQ ID NO: 2952663 - protein, 28 aa, Entamoeba invadens
LKFFGMKFTPKEGGCSIERVLEVDPKGS

SEQ ID NO: 2952664 - protein, 24 aa, Entamoeba invadens
LKFGRNIETWFYLKGGNDGNTIVS

SEQ ID NO: 2952665 - protein, 18 aa, Entamoeba invadens
LKFHAFVGKGSRSTVKTL

SEQ ID NO: 2952666 - protein, 20 aa, Entamoeba invadens
LKFLCHVSERGILQPLVNAV

SEQ ID NO: 2952667 - protein, 20 aa, Entamoeba invadens
LKFLKGIIKGSLKFGESTTR

SEQ ID NO: 2952668 - protein, 17 aa, Entamoeba invadens
LKFNEMIFGGDVEYDKP

SEQ ID NO: 2952669 - protein, 17 aa, Entamoeba invadens
LKFPRKLFVLTNSIITK

SEQ ID NO: 2952670 - protein, 17 aa, Entamoeba invadens
LKFSNYVISFGKSAFEM

SEQ ID NO: 2952671 - protein, 22 aa, Entamoeba invadens
LKFTDLPVFIQEKIKLYNTLIT

SEQ ID NO: 2952672 - protein, 19 aa, Entamoeba invadens
LKFTKNIWTSSSYTDIFRD

SEQ ID NO: 2952673 - protein, 20 aa, Entamoeba invadens
LKFTTWTFKNSIIPRPITLT

SEQ ID NO: 2952674 - protein, 19 aa, Entamoeba invadens
LKFVEKFLAKTQLKDLDDK

SEQ ID NO: 2952675 - protein, 28 aa, Entamoeba invadens
LKFVKCAPMWFQFMTNLKIEVALIPNGI

SEQ ID NO: 2952676 - protein, 24 aa, Entamoeba invadens
LKFVKPEWIYLCVNSGQVQPIENY

SEQ ID NO: 2952677 - protein, 20 aa, Entamoeba invadens
LKGAPNLETLIIKKHYITDS

SEQ ID NO: 2952678 - protein, 23 aa, Entamoeba invadens
LKGCAPILNAMMIRGSTLMKDIS

SEQ ID NO: 2952679 - protein, 19 aa, Entamoeba invadens
LKGDLINKVRWIDSTKETT

SEQ ID NO: 2952680 - protein, 20 aa, Entamoeba invadens
LKGFDLRSNRVVFNNSTFGG

SEQ ID NO: 2952681 - protein, 17 aa, Entamoeba invadens
LKGFYGISIINVASDTS

SEQ ID NO: 2952682 - protein, 21 aa, Entamoeba invadens
LKGFYPELLYDETLKLANIKN

SEQ ID NO: 2952683 - protein, 18 aa, Entamoeba invadens
LKGHTRAVVSADFSPIEQ

SEQ ID NO: 2952684 - protein, 19 aa, Entamoeba invadens
LKGIFDCGYPDYAYPNLFV

SEQ ID NO: 2952685 - protein, 19 aa, Entamoeba invadens
LKGIILNCSGGIDSSVTAA

SEQ ID NO: 2952686 - protein, 25 aa, Entamoeba invadens
LKGILSWLIHNVWITKKLNTVNLLT

SEQ ID NO: 2952687 - protein, 18 aa, Entamoeba invadens
LKGISELEKRCDKLEKSQ

SEQ ID NO: 2952688 - protein, 17 aa, Entamoeba invadens
LKGISFKDLPPFQKSVL

SEQ ID NO: 2952689 - protein, 31 aa, Entamoeba invadens
LKGKDQGGLMLAPRLKVKPHFKEQKNKEETK

SEQ ID NO: 2952690 - protein, 17 aa, Entamoeba invadens
LKGLEILEEVYLTPLTK

SEQ ID NO: 2952691 - protein, 21 aa, Entamoeba invadens
LKGLQYLYVHGLFHGKITKNC

SEQ ID NO: 2952692 - protein, 19 aa, Entamoeba invadens
LKGMNVMKGLEFVNVDALR

SEQ ID NO: 2952693 - protein, 24 aa, Entamoeba invadens
LKGNEILFRRVLVAYSKIAKTHAE

SEQ ID NO: 2952694 - protein, 17 aa, Entamoeba invadens
LKGQKFKNVEVVNFEDV

SEQ ID NO: 2952695 - protein, 28 aa, Entamoeba invadens
LKGRRDFRRCNVCSIDPPGCKDIDDALH

SEQ ID NO: 2952696 - protein, 17 aa, Entamoeba invadens
LKGSLYGRKADENERGK

SEQ ID NO: 2952697 - protein, 19 aa, Entamoeba invadens
LKGTCIVEMLISFLSSAQD

SEQ ID NO: 2952698 - protein, 36 aa, Entamoeba invadens
LKGTGHGAAVDWWSLGILIYEMIVGIPPFYDDDVSI

SEQ ID NO: 2952699 - protein, 20 aa, Entamoeba invadens
LKGTVPLYAICNCGNTCTDL

SEQ ID NO: 2952700 - protein, 25 aa, Entamoeba invadens
LKGVAEWLLKCQTYEGGFSGNPGGE

SEQ ID NO: 2952701 - protein, 19 aa, Entamoeba invadens
LKGVGWQFKVRVKYVEIYN

SEQ ID NO: 2952702 - protein, 20 aa, Entamoeba invadens
LKGVVEAWGTVVKKVLSSLS

SEQ ID NO: 2952703 - protein, 20 aa, Entamoeba invadens
LKGVVLPILTSVSRKGRLRY

SEQ ID NO: 2952704 - protein, 41 aa, Entamoeba invadens
LKGYMIKEVYGVRVPIIYRQGCYELLNKHFCQMGYSPEEAR

SEQ ID NO: 2952705 - protein, 28 aa, Entamoeba invadens
LKHACTIFKPFVSRPWTILKKDYLTRPI

SEQ ID NO: 2952706 - protein, 30 aa, Entamoeba invadens
LKHEEFLCFCGKYVDFPFEVKKRSKIIGLD

SEQ ID NO: 2952707 - protein, 24 aa, Entamoeba invadens
LKHFDKQRIGKLCEQAGLFKRALQ

SEQ ID NO: 2952708 - protein, 31 aa, Entamoeba invadens
LKHFNILNYLALKCFLLSGFKSKRNANKYEK

SEQ ID NO: 2952709 - protein, 18 aa, Entamoeba invadens
LKHHCELYRCSSSKRIST

SEQ ID NO: 2952710 - protein, 20 aa, Entamoeba invadens
LKHLVPFYIRCGLHPVENVA

SEQ ID NO: 2952711 - protein, 17 aa, Entamoeba invadens
LKHQFEVHFDRISNSLG

SEQ ID NO: 2952712 - protein, 18 aa, Entamoeba invadens
LKHQLSLQIRVESVKANF

SEQ ID NO: 2952713 - protein, 21 aa, Entamoeba invadens
LKHTTECLQEIMTLHPKLKTK

SEQ ID NO: 2952714 - protein, 24 aa, Entamoeba invadens
LKIASDYKTIKWVRYITKAGTIQY

SEQ ID NO: 2952715 - protein, 26 aa, Entamoeba invadens
LKIASELKLYIDIFYVVKLLESAEIE

SEQ ID NO: 2952716 - protein, 17 aa, Entamoeba invadens
LKICEKMTNFIIGSSSK

SEQ ID NO: 2952717 - protein, 18 aa, Entamoeba invadens
LKICRQIELRKSKFMKEI

SEQ ID NO: 2952718 - protein, 23 aa, Entamoeba invadens
LKIDEVFGPFFVKHRIVQDYSFS

SEQ ID NO: 2952719 - protein, 20 aa, Entamoeba invadens
LKIDGLMPAKYQELMKKCWE

SEQ ID NO: 2952720 - protein, 19 aa, Entamoeba invadens
LKIDLLINVVQTEITEAAN

SEQ ID NO: 2952721 - protein, 18 aa, Entamoeba invadens
LKIDTIFKEQLPKVPKYF

SEQ ID NO: 2952722 - protein, 18 aa, Entamoeba invadens
LKIEEFIKTCLLCIESSP

SEQ ID NO: 2952723 - protein, 26 aa, Entamoeba invadens
LKIEKYNIPFLFPVPYREDRNYSVTF

SEQ ID NO: 2952724 - protein, 27 aa, Entamoeba invadens
LKIFKTGKWRKSLLDALNHSSHVESGK

SEQ ID NO: 2952725 - protein, 17 aa, Entamoeba invadens
LKIFLDTTHVFNLVDTD

SEQ ID NO: 2952726 - protein, 19 aa, Entamoeba invadens
LKIGTDIIQREHLRLQVCS

SEQ ID NO: 2952727 - protein, 19 aa, Entamoeba invadens
LKIGTSCFGECERLSKVVL

SEQ ID NO: 2952728 - protein, 20 aa, Entamoeba invadens
LKIIGVHAFSACGLTNIDIP

SEQ ID NO: 2952729 - protein, 23 aa, Entamoeba invadens
LKIKDEVYIGGELEHGINVDEST

SEQ ID NO: 2952730 - protein, 20 aa, Entamoeba invadens
LKIKFIIDAAKGLSYLHTNG

SEQ ID NO: 2952731 - protein, 22 aa, Entamoeba invadens
LKIKFYTPEEFFLKEAPVSYEN

SEQ ID NO: 2952732 - protein, 23 aa, Entamoeba invadens
LKIKGDFGKTIKRQKYLSKEMPV

SEQ ID NO: 2952733 - protein, 17 aa, Entamoeba invadens
LKIKLSDFIVTNPDASI

SEQ ID NO: 2952734 - protein, 20 aa, Entamoeba invadens
LKIKQLRFGNDILDIQKFVR

SEQ ID NO: 2952735 - protein, 20 aa, Entamoeba invadens
LKIKRCEKLTSVTFIDQNIT

SEQ ID NO: 2952736 - protein, 25 aa, Entamoeba invadens
LKILDLILMEGWEILFTVFSAILHF

SEQ ID NO: 2952737 - protein, 18 aa, Entamoeba invadens
LKILGSVILGEKCFNNCS

SEQ ID NO: 2952738 - protein, 29 aa, Entamoeba invadens
LKILKFDDCKGLTCLPDMSQMTGLGNVTA

SEQ ID NO: 2952739 - protein, 27 aa, Entamoeba invadens
LKILLCQISRALIWRVSNLMLSNSSAQ

SEQ ID NO: 2952740 - protein, 17 aa, Entamoeba invadens
LKILLDVEKTVFDQIVT

SEQ ID NO: 2952741 - protein, 19 aa, Entamoeba invadens
LKIMARPIIHLNAIDVSGT

SEQ ID NO: 2952742 - protein, 18 aa, Entamoeba invadens
LKINEIILRNIIATRDEW

SEQ ID NO: 2952743 - protein, 24 aa, Entamoeba invadens
LKINMELCKGCGMCARDCIAQCLK

SEQ ID NO: 2952744 - protein, 17 aa, Entamoeba invadens
LKINSPEGVILLRGNHE

SEQ ID NO: 2952745 - protein, 18 aa, Entamoeba invadens
LKIPLLIDPEETVEASLD

SEQ ID NO: 2952746 - protein, 20 aa, Entamoeba invadens
LKIPSGVERLEIYAHEYKSF

SEQ ID NO: 2952747 - protein, 22 aa, Entamoeba invadens
LKIQCGVVRPFQPVKSGFKMTN

SEQ ID NO: 2952748 - protein, 21 aa, Entamoeba invadens
LKIQIRRSYYELFSLIKTMEF

SEQ ID NO: 2952749 - protein, 25 aa, Entamoeba invadens
LKIRERAICIIGRLTKYNPAFVMPS

SEQ ID NO: 2952750 - protein, 22 aa, Entamoeba invadens
LKIRRILFAMLERIEEISDDIE

SEQ ID NO: 2952751 - protein, 26 aa, Entamoeba invadens
LKISCPSVKMIVPYVARLRLEKYVYN

SEQ ID NO: 2952752 - protein, 19 aa, Entamoeba invadens
LKISDSSLYFLKENLYKYP

SEQ ID NO: 2952753 - protein, 27 aa, Entamoeba invadens
LKISLIQIFRAHLWQKIHESLVMDLFQ

SEQ ID NO: 2952754 - protein, 18 aa, Entamoeba invadens
LKISQDVIDEKVYLPQLY

SEQ ID NO: 2952755 - protein, 18 aa, Entamoeba invadens
LKISQEFDEEQIPSQITQ

SEQ ID NO: 2952756 - protein, 25 aa, Entamoeba invadens
LKISSPKFGPILPVTDFLPTQTILE

SEQ ID NO: 2952757 - protein, 17 aa, Entamoeba invadens
LKISTIFKSCGFKTPLR

SEQ ID NO: 2952758 - protein, 22 aa, Entamoeba invadens
LKITPISGGFLFMYDVSAIVDT

SEQ ID NO: 2952759 - protein, 20 aa, Entamoeba invadens
LKITRPKLYRTEVVEPDSFY

SEQ ID NO: 2952760 - protein, 17 aa, Entamoeba invadens
LKIVAILSHAKKLRNST

SEQ ID NO: 2952761 - protein, 24 aa, Entamoeba invadens
LKIVFYRIVVWFNVDYTTVDTNSN

SEQ ID NO: 2952762 - protein, 18 aa, Entamoeba invadens
LKIVRKRINGEVCNSENP

SEQ ID NO: 2952763 - protein, 26 aa, Entamoeba invadens
LKIVSLCAWKLPKYVLRDVYESNSVT

SEQ ID NO: 2952764 - protein, 17 aa, Entamoeba invadens
LKKAAPEFHLQTRDFKV

SEQ ID NO: 2952765 - protein, 17 aa, Entamoeba invadens
LKKAGIEQAVLNYLFDE

SEQ ID NO: 2952766 - protein, 19 aa, Entamoeba invadens
LKKAHVFEQIIRIEKLQKG

SEQ ID NO: 2952767 - protein, 23 aa, Entamoeba invadens
LKKAKKAGFKWRVQTEKPLFPIF

SEQ ID NO: 2952768 - protein, 18 aa, Entamoeba invadens
LKKAKRFHIIQEMYTTEK

SEQ ID NO: 2952769 - protein, 20 aa, Entamoeba invadens
LKKALSYKRLVLGVFSHVHK

SEQ ID NO: 2952770 - protein, 23 aa, Entamoeba invadens
LKKAMPLIFEAGTLLKANAKDVF

SEQ ID NO: 2952771 - protein, 17 aa, Entamoeba invadens
LKKARICMSLLLRGKKK

SEQ ID NO: 2952772 - protein, 20 aa, Entamoeba invadens
LKKAYKKLAMKYHPDKNPGN

SEQ ID NO: 2952773 - protein, 21 aa, Entamoeba invadens
LKKCPLCVGFKQPVTQEEIEN

SEQ ID NO: 2952774 - protein, 20 aa, Entamoeba invadens
LKKDDLWVVLPQEYPYKLSS

SEQ ID NO: 2952775 - protein, 30 aa, Entamoeba invadens
LKKDFKANPFVTLYALRVLDTFDEHTVLYY

SEQ ID NO: 2952776 - protein, 18 aa, Entamoeba invadens
LKKDFVFEVFEDAAKGRI

SEQ ID NO: 2952777 - protein, 20 aa, Entamoeba invadens
LKKDGKCIIFNQIGRFLNCE

SEQ ID NO: 2952778 - protein, 22 aa, Entamoeba invadens
LKKDMLIFFKRQTQLMALENDY

SEQ ID NO: 2952779 - protein, 25 aa, Entamoeba invadens
LKKEFYRIIVWFNVDFETVDINKSR

SEQ ID NO: 2952780 - protein, 25 aa, Entamoeba invadens
LKKEFYRIIVWFNVDFETVDRNKNR

SEQ ID NO: 2952781 - protein, 25 aa, Entamoeba invadens
LKKEFYRIIVWFNVVFETVNRNKNR

SEQ ID NO: 2952782 - protein, 25 aa, Entamoeba invadens
LKKEFYRIIVWFSVDFETFDRNKSR

SEQ ID NO: 2952783 - protein, 23 aa, Entamoeba invadens
LKKEGDGWKWFCGGRVVKVEGDV

SEQ ID NO: 2952784 - protein, 17 aa, Entamoeba invadens
LKKEKLFDGKRGYVGAC

SEQ ID NO: 2952785 - protein, 17 aa, Entamoeba invadens
LKKELKEELKVEDKQKE

SEQ ID NO: 2952786 - protein, 19 aa, Entamoeba invadens
LKKELQLLAPEGTNVNIIA

SEQ ID NO: 2952787 - protein, 21 aa, Entamoeba invadens
LKKEVPPPWVPPVKSKTEISQ

SEQ ID NO: 2952788 - protein, 22 aa, Entamoeba invadens
LKKEVQNVCQILLQFLRTDDER

SEQ ID NO: 2952789 - protein, 19 aa, Entamoeba invadens
LKKEYGWRQVECRMMRGRC

SEQ ID NO: 2952790 - protein, 25 aa, Entamoeba invadens
LKKFECIDCSHILINPKLIRSNFIN

SEQ ID NO: 2952791 - protein, 17 aa, Entamoeba invadens
LKKFLFEPFPLESYFEN

SEQ ID NO: 2952792 - protein, 20 aa, Entamoeba invadens
LKKFLLQMPNRIFGYEETMT

SEQ ID NO: 2952793 - protein, 20 aa, Entamoeba invadens
LKKFSRMRVGEVEKTKEEVE

SEQ ID NO: 2952794 - protein, 20 aa, Entamoeba invadens
LKKGEISNMHISIKAKTQLS

SEQ ID NO: 2952795 - protein, 18 aa, Entamoeba invadens
LKKGFPVHRLSKPREISR

SEQ ID NO: 2952796 - protein, 18 aa, Entamoeba invadens
LKKGFPVHRLSKPRQISR

SEQ ID NO: 2952797 - protein, 22 aa, Entamoeba invadens
LKKGKNKNAFFVMSNKEERNDA

SEQ ID NO: 2952798 - protein, 24 aa, Entamoeba invadens
LKKGKYMSICDFFQGDVGYEEINE

SEQ ID NO: 2952799 - protein, 20 aa, Entamoeba invadens
LKKIEAAMIEEKRELEKEKH

SEQ ID NO: 2952800 - protein, 24 aa, Entamoeba invadens
LKKIEFPTCLAYLGEYAFGQCKAL

SEQ ID NO: 2952801 - protein, 26 aa, Entamoeba invadens
LKKIHFKTIEFCDKYAFSKHLEAIFV

SEQ ID NO: 2952802 - protein, 17 aa, Entamoeba invadens
LKKIQTITFSFGIFTCL

SEQ ID NO: 2952803 - protein, 20 aa, Entamoeba invadens
LKKKIEERYSPLINNDTDKT

SEQ ID NO: 2952804 - protein, 19 aa, Entamoeba invadens
LKKKLAEEIAKREAAEKAL

SEQ ID NO: 2952805 - protein, 19 aa, Entamoeba invadens
LKKKLAEEIKKREAAEKAL

SEQ ID NO: 2952806 - protein, 20 aa, Entamoeba invadens
LKKKLPPLFNEFDITRLSVC

SEQ ID NO: 2952807 - protein, 21 aa, Entamoeba invadens
LKKKLPPLFNEFDITRLSVCT

SEQ ID NO: 2952808 - protein, 25 aa, Entamoeba invadens
LKKKPKFLCSISFGQLEHFLSDADF

SEQ ID NO: 2952809 - protein, 21 aa, Entamoeba invadens
LKKKRFDEFMNGLTEISFKLK

SEQ ID NO: 2952810 - protein, 27 aa, Entamoeba invadens
LKKKRMLLKRCWNDFTWNGDFHSEIGE

SEQ ID NO: 2952811 - protein, 17 aa, Entamoeba invadens
LKKKSAFRLKVTQEMVK

SEQ ID NO: 2952812 - protein, 20 aa, Entamoeba invadens
LKKLCERAPQIEVKKKKARD

SEQ ID NO: 2952813 - protein, 19 aa, Entamoeba invadens
LKKLCLVKINGGLGTTMGC

SEQ ID NO: 2952814 - protein, 17 aa, Entamoeba invadens
LKKLEDARVKKGLPETI

SEQ ID NO: 2952815 - protein, 21 aa, Entamoeba invadens
LKKLEIINCVSDVMLEGITLE

SEQ ID NO: 2952816 - protein, 22 aa, Entamoeba invadens
LKKLFKAEIIFENYDVVVTDGD

SEQ ID NO: 2952817 - protein, 23 aa, Entamoeba invadens
LKKLKTEVLEFIHNTYGLEKDEI

SEQ ID NO: 2952818 - protein, 18 aa, Entamoeba invadens
LKKLLGVLDDAMYSEAPK

SEQ ID NO: 2952819 - protein, 26 aa, Entamoeba invadens
LKKLRLERLKDILLIQRDFIENQEQV

SEQ ID NO: 2952820 - protein, 22 aa, Entamoeba invadens
LKKLRMRKAQIEKFRNEAERVY

SEQ ID NO: 2952821 - protein, 20 aa, Entamoeba invadens
LKKLVKNVCMYSLNDKYVPT

SEQ ID NO: 2952822 - protein, 26 aa, Entamoeba invadens
LKKLYETRHAFSLSISSEVSDELSTS

SEQ ID NO: 2952823 - protein, 20 aa, Entamoeba invadens
LKKMISNDCELIMSRIIPDT

SEQ ID NO: 2952824 - protein, 28 aa, Entamoeba invadens
LKKMRRRFWFEKFHWFISSENFVIISGK

SEQ ID NO: 2952825 - protein, 21 aa, Entamoeba invadens
LKKNKMCTFTITLTPFCSTQL

SEQ ID NO: 2952826 - protein, 19 aa, Entamoeba invadens
LKKNLIYKRMLSVLDANQN

SEQ ID NO: 2952827 - protein, 22 aa, Entamoeba invadens
LKKNVIEILKKCAYDDDQEVRD

SEQ ID NO: 2952828 - protein, 23 aa, Entamoeba invadens
LKKPNFWKLRRKDCPWTKQKKCN

SEQ ID NO: 2952829 - protein, 18 aa, Entamoeba invadens
LKKQCERKALKESTEHFN

SEQ ID NO: 2952830 - protein, 20 aa, Entamoeba invadens
LKKQKGLCRKVGIRNGSFES

SEQ ID NO: 2952831 - protein, 23 aa, Entamoeba invadens
LKKQYRMDFGIHEFINTSFYKKE

SEQ ID NO: 2952832 - protein, 17 aa, Entamoeba invadens
LKKRDSLLFSSMDPSDE

SEQ ID NO: 2952833 - protein, 24 aa, Entamoeba invadens
LKKRFDFPMDMFKEVSLSTQSSSI

SEQ ID NO: 2952834 - protein, 20 aa, Entamoeba invadens
LKKRIENFLQPKSPSLSTSS

SEQ ID NO: 2952835 - protein, 23 aa, Entamoeba invadens
LKKRSTEIYNWLKNSLFSYFKAP

SEQ ID NO: 2952836 - protein, 19 aa, Entamoeba invadens
LKKSDGFVLVYSLDNYFTF

SEQ ID NO: 2952837 - protein, 18 aa, Entamoeba invadens
LKKSPVFCYESSAIWFVK

SEQ ID NO: 2952838 - protein, 18 aa, Entamoeba invadens
LKKSRLFADIPYSKINVT

SEQ ID NO: 2952839 - protein, 22 aa, Entamoeba invadens
LKKSSVTRQFIRVVVVESADTH

SEQ ID NO: 2952840 - protein, 17 aa, Entamoeba invadens
LKKSVLAIFANKQDDSR

SEQ ID NO: 2952841 - protein, 20 aa, Entamoeba invadens
LKKSVLKVKVYLRTGENGNV

SEQ ID NO: 2952842 - protein, 17 aa, Entamoeba invadens
LKKSVPITVTYKEMKFE

SEQ ID NO: 2952843 - protein, 17 aa, Entamoeba invadens
LKKSYPSFTPFDELKTI

SEQ ID NO: 2952844 - protein, 26 aa, Entamoeba invadens
LKKTFYKIIVWYCVDFKTVCRNKSRN

SEQ ID NO: 2952845 - protein, 17 aa, Entamoeba invadens
LKKVAALLFKTVSQNKT

SEQ ID NO: 2952846 - protein, 20 aa, Entamoeba invadens
LKKVEFLGSTLIPSDITEIG

SEQ ID NO: 2952847 - protein, 21 aa, Entamoeba invadens
LKKVKCTPLQLFFTTFQTHHG

SEQ ID NO: 2952848 - protein, 22 aa, Entamoeba invadens
LKKYDVGCFGEWLHGDKKVIDQ

SEQ ID NO: 2952849 - protein, 23 aa, Entamoeba invadens
LKKYHKKDLTIALKQSEEKIVGY

SEQ ID NO: 2952850 - protein, 24 aa, Entamoeba invadens
LKKYKRVVCIESVWDKANAVKCHK

SEQ ID NO: 2952851 - protein, 20 aa, Entamoeba invadens
LKLAEIFKCGVNELPLHIYL

SEQ ID NO: 2952852 - protein, 17 aa, Entamoeba invadens
LKLAIGKFICEAPFVVK

SEQ ID NO: 2952853 - protein, 19 aa, Entamoeba invadens
LKLAVMYLICAEFIPEKKD

SEQ ID NO: 2952854 - protein, 20 aa, Entamoeba invadens
LKLAYSYLVGILNKRPERIL

SEQ ID NO: 2952855 - protein, 25 aa, Entamoeba invadens
LKLCQRKAKINGLFRTLQLFNVTTT

SEQ ID NO: 2952856 - protein, 19 aa, Entamoeba invadens
LKLDILQSLFQAYYEYPAL

SEQ ID NO: 2952857 - protein, 19 aa, Entamoeba invadens
LKLDKIVCACISNDRKNIL

SEQ ID NO: 2952858 - protein, 20 aa, Entamoeba invadens
LKLEKLHIICISNLEEWAHP

SEQ ID NO: 2952859 - protein, 22 aa, Entamoeba invadens
LKLEVLKRKTLNVENDFKATKT

SEQ ID NO: 2952860 - protein, 20 aa, Entamoeba invadens
LKLFCKNVEKVYSISMNVVH

SEQ ID NO: 2952861 - protein, 17 aa, Entamoeba invadens
LKLFEYVLGIPDENFRV

SEQ ID NO: 2952862 - protein, 17 aa, Entamoeba invadens
LKLFKVVGQNGIIGVEE

SEQ ID NO: 2952863 - protein, 20 aa, Entamoeba invadens
LKLFREEIVREITSQIQKFK

SEQ ID NO: 2952864 - protein, 17 aa, Entamoeba invadens
LKLFSYVGLTKQTNYEA

SEQ ID NO: 2952865 - protein, 26 aa, Entamoeba invadens
LKLFYFPEKFVFLKGGRPIHPVVITD

SEQ ID NO: 2952866 - protein, 29 aa, Entamoeba invadens
LKLGISCARKNMFRTLGIVFLNTLNGNTV

SEQ ID NO: 2952867 - protein, 20 aa, Entamoeba invadens
LKLGKCYPCNSFDANCVECN

SEQ ID NO: 2952868 - protein, 23 aa, Entamoeba invadens
LKLGKCYPCNSFDPNCVECNNST

SEQ ID NO: 2952869 - protein, 18 aa, Entamoeba invadens
LKLHHIVPPNGLVIYCGS

SEQ ID NO: 2952870 - protein, 21 aa, Entamoeba invadens
LKLHSKNAMKFWKKNFSVKGK

SEQ ID NO: 2952871 - protein, 17 aa, Entamoeba invadens
LKLICYPTLKKVMSTIP

SEQ ID NO: 2952872 - protein, 24 aa, Entamoeba invadens
LKLIDLGSACFENYTLYTYIQSRH

SEQ ID NO: 2952873 - protein, 20 aa, Entamoeba invadens
LKLIKSLYLMYKYDDKNPQI

SEQ ID NO: 2952874 - protein, 25 aa, Entamoeba invadens
LKLKEYPDSFCVKFIILMMYVYIIH

SEQ ID NO: 2952875 - protein, 20 aa, Entamoeba invadens
LKLKIPDVAPNEFLSQVKFS

SEQ ID NO: 2952876 - protein, 21 aa, Entamoeba invadens
LKLKKGDFVGIISSNRYEWYV

SEQ ID NO: 2952877 - protein, 19 aa, Entamoeba invadens
LKLKKQRIGMSEELGDILR

SEQ ID NO: 2952878 - protein, 20 aa, Entamoeba invadens
LKLKMLGIGLEETFFVERPP

SEQ ID NO: 2952879 - protein, 21 aa, Entamoeba invadens
LKLKNFAVAIDRMYIAKRRNF

SEQ ID NO: 2952880 - protein, 17 aa, Entamoeba invadens
LKLKSEKEQLVGVLDKL

SEQ ID NO: 2952881 - protein, 21 aa, Entamoeba invadens
LKLLCKEGVVHFLFEEYINHK

SEQ ID NO: 2952882 - protein, 24 aa, Entamoeba invadens
LKLLKKGCFYDCSSLTEVTLPSTL

SEQ ID NO: 2952883 - protein, 23 aa, Entamoeba invadens
LKLLKKKLAVEIAKREAAEKAFA

SEQ ID NO: 2952884 - protein, 21 aa, Entamoeba invadens
LKLLKLRQINNAVFIRANAST

SEQ ID NO: 2952885 - protein, 18 aa, Entamoeba invadens
LKLLNTVECVGEKGEIKK

SEQ ID NO: 2952886 - protein, 21 aa, Entamoeba invadens
LKLLPKYVFLNGVYIDYSTNQ

SEQ ID NO: 2952887 - protein, 20 aa, Entamoeba invadens
LKLNHCTRLVLKDFYSPLLL

SEQ ID NO: 2952888 - protein, 19 aa, Entamoeba invadens
LKLNKCILPLSTVPAQTPL

SEQ ID NO: 2952889 - protein, 24 aa, Entamoeba invadens
LKLPTEFVDRWVLQVSNYKFGKNE

SEQ ID NO: 2952890 - protein, 17 aa, Entamoeba invadens
LKLPVKCQSNYICLHHW

SEQ ID NO: 2952891 - protein, 18 aa, Entamoeba invadens
LKLQNEMTTHEEVVNQLE

SEQ ID NO: 2952892 - protein, 23 aa, Entamoeba invadens
LKLQRKPPYFMPAPNNKFEIGKI

SEQ ID NO: 2952893 - protein, 17 aa, Entamoeba invadens
LKLQSIVSYNHLGNNDG

SEQ ID NO: 2952894 - protein, 22 aa, Entamoeba invadens
LKLRPNEAFEFTLEFTPLCTCK

SEQ ID NO: 2952895 - protein, 21 aa, Entamoeba invadens
LKLRSEIQWYFRKYYHDNKFT

SEQ ID NO: 2952896 - protein, 17 aa, Entamoeba invadens
LKLSEITFCANIVKAAK

SEQ ID NO: 2952897 - protein, 20 aa, Entamoeba invadens
LKLSFSLFYNDEFVFVGKTK

SEQ ID NO: 2952898 - protein, 20 aa, Entamoeba invadens
LKLSKCVNPKITITNEIHSL

SEQ ID NO: 2952899 - protein, 18 aa, Entamoeba invadens
LKLSQLCDKVDTFSVQGT

SEQ ID NO: 2952900 - protein, 20 aa, Entamoeba invadens
LKLSVCIDKSIAWMNQDRNK

SEQ ID NO: 2952901 - protein, 21 aa, Entamoeba invadens
LKLSVLGFILPYVIDSMKHLD

SEQ ID NO: 2952902 - protein, 17 aa, Entamoeba invadens
LKLTAFQVINKIIEKEG

SEQ ID NO: 2952903 - protein, 17 aa, Entamoeba invadens
LKLTALEIPEKCTELRI

SEQ ID NO: 2952904 - protein, 26 aa, Entamoeba invadens
LKLTPRFRNTPSLLWFLEHFSPDTIA

SEQ ID NO: 2952905 - protein, 19 aa, Entamoeba invadens
LKLTTNEKVELEKTINQQL

SEQ ID NO: 2952906 - protein, 19 aa, Entamoeba invadens
LKLTYPEKFHLLRGNHESR

SEQ ID NO: 2952907 - protein, 17 aa, Entamoeba invadens
LKLYIKYAKTINPKMTK

SEQ ID NO: 2952908 - protein, 30 aa, Entamoeba invadens
LKLYLDQWGVLYKRIAVLKNRKMDMDRHYE

SEQ ID NO: 2952909 - protein, 21 aa, Entamoeba invadens
LKLYPTLVIRGTRLYEMWRKG

SEQ ID NO: 2952910 - protein, 24 aa, Entamoeba invadens
LKMACLPKIPYFVEMHSMEIINLM

SEQ ID NO: 2952911 - protein, 17 aa, Entamoeba invadens
LKMAQSLFMEDPSVLSD

SEQ ID NO: 2952912 - protein, 19 aa, Entamoeba invadens
LKMCNKYYFEVQLRHINNP

SEQ ID NO: 2952913 - protein, 23 aa, Entamoeba invadens
LKMEKRMLELLKYWLEKSPDCCA

SEQ ID NO: 2952914 - protein, 20 aa, Entamoeba invadens
LKMFECSNIKIYLNTTLKNL

SEQ ID NO: 2952915 - protein, 17 aa, Entamoeba invadens
LKMFFEKLAEEFFSCQK

SEQ ID NO: 2952916 - protein, 18 aa, Entamoeba invadens
LKMFIAILQRCRTEECTT

SEQ ID NO: 2952917 - protein, 19 aa, Entamoeba invadens
LKMGFPASLDLRADNKVTP

SEQ ID NO: 2952918 - protein, 24 aa, Entamoeba invadens
LKMIDKRKGVVIYKIDEAHSDNII

SEQ ID NO: 2952919 - protein, 20 aa, Entamoeba invadens
LKMIQKYGVVDCFHGVNSQY

SEQ ID NO: 2952920 - protein, 22 aa, Entamoeba invadens
LKMKFCPFCDIKNVIRTLYTMT

SEQ ID NO: 2952921 - protein, 24 aa, Entamoeba invadens
LKMKRVDQSAALQFIQLFTKLCNH

SEQ ID NO: 2952922 - protein, 20 aa, Entamoeba invadens
LKMKYPVVILHAVRLLGKIS

SEQ ID NO: 2952923 - protein, 22 aa, Entamoeba invadens
LKMLKMSNCAAVYQNLPSTLIE

SEQ ID NO: 2952924 - protein, 18 aa, Entamoeba invadens
LKMLLGLYTPSPILPLGA

SEQ ID NO: 2952925 - protein, 25 aa, Entamoeba invadens
LKMMTEYRASVELETVLTGQQKQKQ

SEQ ID NO: 2952926 - protein, 17 aa, Entamoeba invadens
LKMNGGRLLTNRVSVCR

SEQ ID NO: 2952927 - protein, 20 aa, Entamoeba invadens
LKMNVFIGSNVVARPNNFVK

SEQ ID NO: 2952928 - protein, 20 aa, Entamoeba invadens
LKMRNCTNFDIELMSKTKEV

SEQ ID NO: 2952929 - protein, 19 aa, Entamoeba invadens
LKMSFPSLHDAVFQWVVGD

SEQ ID NO: 2952930 - protein, 17 aa, Entamoeba invadens
LKMSKYFHMFVGNNYWG

SEQ ID NO: 2952931 - protein, 18 aa, Entamoeba invadens
LKMSTAKLREVIFKLNSY

SEQ ID NO: 2952932 - protein, 21 aa, Entamoeba invadens
LKMTWFTNILIIKENVIQIDI

SEQ ID NO: 2952933 - protein, 25 aa, Entamoeba invadens
LKMVECYPLPGILLLASVSVLYIST

SEQ ID NO: 2952934 - protein, 21 aa, Entamoeba invadens
LKMVFDMANIEVKGFLTSNEF

SEQ ID NO: 2952935 - protein, 17 aa, Entamoeba invadens
LKNACKEVLKTVKPTQH

SEQ ID NO: 2952936 - protein, 26 aa, Entamoeba invadens
LKNAMKNEFFFEMLLKEMGKSQKEIE

SEQ ID NO: 2952937 - protein, 22 aa, Entamoeba invadens
LKNAVKLIFLNKMDLFEEKLTK

SEQ ID NO: 2952938 - protein, 19 aa, Entamoeba invadens
LKNDFPHRVYPLSYSFTLP

SEQ ID NO: 2952939 - protein, 23 aa, Entamoeba invadens
LKNECSYCAKLSKIRNIENITEV

SEQ ID NO: 2952940 - protein, 24 aa, Entamoeba invadens
LKNEFNIPPTRFFPNEVGKHTKSL

SEQ ID NO: 2952941 - protein, 17 aa, Entamoeba invadens
LKNEIKIKDEQFAMIEN

SEQ ID NO: 2952942 - protein, 21 aa, Entamoeba invadens
LKNELRAVGKASTLLKHAVAY

SEQ ID NO: 2952943 - protein, 27 aa, Entamoeba invadens
LKNETRLRIAVMFLRKLYSDALNSKAR

SEQ ID NO: 2952944 - protein, 18 aa, Entamoeba invadens
LKNEVGKIFLNFSPYFAV

SEQ ID NO: 2952945 - protein, 20 aa, Entamoeba invadens
LKNFCKKDEPALAIKVTSVE

SEQ ID NO: 2952946 - protein, 22 aa, Entamoeba invadens
LKNFGGGLLLISHHQHMIEAAT

SEQ ID NO: 2952947 - protein, 22 aa, Entamoeba invadens
LKNFIDRTVMLYNWADWTAKKC

SEQ ID NO: 2952948 - protein, 26 aa, Entamoeba invadens
LKNFKEFKEQFTLIIDDLMSNSYIQN

SEQ ID NO: 2952949 - protein, 22 aa, Entamoeba invadens
LKNFYSCIYNYFNISNNRIQKL

SEQ ID NO: 2952950 - protein, 24 aa, Entamoeba invadens
LKNGESFPVFYACLTSKTKETYSK

SEQ ID NO: 2952951 - protein, 20 aa, Entamoeba invadens
LKNIEGLECLSYVRTDEEVL

SEQ ID NO: 2952952 - protein, 20 aa, Entamoeba invadens
LKNIFELLSRVCMNEDECVW

SEQ ID NO: 2952953 - protein, 17 aa, Entamoeba invadens
LKNIKVPHVVDSIPDRC

SEQ ID NO: 2952954 - protein, 17 aa, Entamoeba invadens
LKNIKVPHVVDSIPGRC

SEQ ID NO: 2952955 - protein, 18 aa, Entamoeba invadens
LKNIPKTVFIPELHSEQT

SEQ ID NO: 2952956 - protein, 27 aa, Entamoeba invadens
LKNKIFEMFSKKEAMTFQEINTELDQP

SEQ ID NO: 2952957 - protein, 24 aa, Entamoeba invadens
LKNKPCYFRQGMLEIAMLNTVNLH

SEQ ID NO: 2952958 - protein, 17 aa, Entamoeba invadens
LKNKRTVVVEQNDQFIS

SEQ ID NO: 2952959 - protein, 19 aa, Entamoeba invadens
LKNLESFVVVCYDSVSKFF

SEQ ID NO: 2952960 - protein, 20 aa, Entamoeba invadens
LKNLHICGMNFPPEQIGAIF

SEQ ID NO: 2952961 - protein, 19 aa, Entamoeba invadens
LKNLITLFHWNFAYESCYE

SEQ ID NO: 2952962 - protein, 18 aa, Entamoeba invadens
LKNLLGLFNGMRLFSKFL

SEQ ID NO: 2952963 - protein, 21 aa, Entamoeba invadens
LKNNGLFLRKLDVMDFLVKPL

SEQ ID NO: 2952964 - protein, 17 aa, Entamoeba invadens
LKNPASLEKLWKIKEET

SEQ ID NO: 2952965 - protein, 19 aa, Entamoeba invadens
LKNPLKVGNHIVFGGTPAA

SEQ ID NO: 2952966 - protein, 19 aa, Entamoeba invadens
LKNPQRLNVSITRAKYGLV

SEQ ID NO: 2952967 - protein, 18 aa, Entamoeba invadens
LKNQLILAAKSRKLGGVL

SEQ ID NO: 2952968 - protein, 22 aa, Entamoeba invadens
LKNRHLKKLKEWTGAHKFKIVM

SEQ ID NO: 2952969 - protein, 24 aa, Entamoeba invadens
LKNRLDFFESLCSFNNNYKNLRDT

SEQ ID NO: 2952970 - protein, 21 aa, Entamoeba invadens
LKNRLSQFVKKHCLTSNCYII

SEQ ID NO: 2952971 - protein, 17 aa, Entamoeba invadens
LKNRMAIPKQKVTSSEA

SEQ ID NO: 2952972 - protein, 18 aa, Entamoeba invadens
LKNSTFEKCWKLKEIKIP

SEQ ID NO: 2952973 - protein, 17 aa, Entamoeba invadens
LKNSVIAVFANKQDDVA

SEQ ID NO: 2952974 - protein, 17 aa, Entamoeba invadens
LKNTFLTFSNNVEKVCQ

SEQ ID NO: 2952975 - protein, 19 aa, Entamoeba invadens
LKNTLFVLICDNIIVEGNK

SEQ ID NO: 2952976 - protein, 18 aa, Entamoeba invadens
LKNTLGMDIYSFTELEKH

SEQ ID NO: 2952977 - protein, 18 aa, Entamoeba invadens
LKNVGGVLEMSKCKVESF

SEQ ID NO: 2952978 - protein, 19 aa, Entamoeba invadens
LKNVIQSVIHIKRVTLVPQ

SEQ ID NO: 2952979 - protein, 28 aa, Entamoeba invadens
LKNVKLWFKSVVIPVYVRESGMETPQFE

SEQ ID NO: 2952980 - protein, 25 aa, Entamoeba invadens
LKNVLKGHIALIQFEEMIDHIVEKL

SEQ ID NO: 2952981 - protein, 18 aa, Entamoeba invadens
LKNVPKCESLVIQDSKMK

SEQ ID NO: 2952982 - protein, 29 aa, Entamoeba invadens
LKNVREYFEVGCVVIPSLSYLPSGPLQKF

SEQ ID NO: 2952983 - protein, 18 aa, Entamoeba invadens
LKNVYLFFHFIFNFLCNF

SEQ ID NO: 2952984 - protein, 18 aa, Entamoeba invadens
LKPDMYVGEILKERRRDF

SEQ ID NO: 2952985 - protein, 18 aa, Entamoeba invadens
LKPDVVFFSLIKDIIPFV

SEQ ID NO: 2952986 - protein, 23 aa, Entamoeba invadens
LKPEDIGFIIAPTFHVKSINLNE

SEQ ID NO: 2952987 - protein, 21 aa, Entamoeba invadens
LKPENILLCPFQPNEIPQVKI

SEQ ID NO: 2952988 - protein, 21 aa, Entamoeba invadens
LKPGYACEFEIFIKPLCSCVT

SEQ ID NO: 2952989 - protein, 22 aa, Entamoeba invadens
LKPKKLWTGKQLYGLALRPNPN

SEQ ID NO: 2952990 - protein, 21 aa, Entamoeba invadens
LKPKMFKLKLPIKGSLIQSGC

SEQ ID NO: 2952991 - protein, 23 aa, Entamoeba invadens
LKPKRTSKVFSFIGSVRKRRATA

SEQ ID NO: 2952992 - protein, 25 aa, Entamoeba invadens
LKPNFTFKEIIKYFELDTIKNRVWS

SEQ ID NO: 2952993 - protein, 28 aa, Entamoeba invadens
LKPQDLKGSFKLSVRRERSKTAVIKLRE

SEQ ID NO: 2952994 - protein, 33 aa, Entamoeba invadens
LKPQIVVLCCKKFTFKKGIKFECMLVDVQEEDN

SEQ ID NO: 2952995 - protein, 26 aa, Entamoeba invadens
LKPSRRISNGLPFIIHVNAINNTRTN

SEQ ID NO: 2952996 - protein, 18 aa, Entamoeba invadens
LKPTFNLSSYNSIKELFI

SEQ ID NO: 2952997 - protein, 22 aa, Entamoeba invadens
LKQCLKSYISQEHPFSKHLKDC

SEQ ID NO: 2952998 - protein, 20 aa, Entamoeba invadens
LKQDFCSIRVSEVIEEMEEK

SEQ ID NO: 2952999 - protein, 17 aa, Entamoeba invadens
LKQEFKTILKYETIDET

SEQ ID NO: 2953000 - protein, 23 aa, Entamoeba invadens
LKQEFPNKIVIASIMCMDNKEDW

SEQ ID NO: 2953001 - protein, 17 aa, Entamoeba invadens
LKQEWKFNKIVVDETKA

SEQ ID NO: 2953002 - protein, 17 aa, Entamoeba invadens
LKQFCLILKERQKVNVL

SEQ ID NO: 2953003 - protein, 23 aa, Entamoeba invadens
LKQGHSKFRDMCLEYLNIDVDKV

SEQ ID NO: 2953004 - protein, 23 aa, Entamoeba invadens
LKQGHSKFRDVCLEYLNIDVDKV

SEQ ID NO: 2953005 - protein, 17 aa, Entamoeba invadens
LKQICMSEMKFATDHIV

SEQ ID NO: 2953006 - protein, 19 aa, Entamoeba invadens
LKQINCKSVVLPQKCRAFE

SEQ ID NO: 2953007 - protein, 17 aa, Entamoeba invadens
LKQKFYSIKGISYDQIT

SEQ ID NO: 2953008 - protein, 21 aa, Entamoeba invadens
LKQKSVMFLALLSDYIEHPVG

SEQ ID NO: 2953009 - protein, 18 aa, Entamoeba invadens
LKQLKKLNIVYTNNCDIF

SEQ ID NO: 2953010 - protein, 26 aa, Entamoeba invadens
LKQLPLRYFIIPALMSQQPRLMKLSK

SEQ ID NO: 2953011 - protein, 26 aa, Entamoeba invadens
LKQLRCNSILEGIRITRLGYPNRIIY

SEQ ID NO: 2953012 - protein, 22 aa, Entamoeba invadens
LKQLRLFGRFKSVDLSKAKVLE

SEQ ID NO: 2953013 - protein, 20 aa, Entamoeba invadens
LKQLVCAMGNKSVLEMTKKT

SEQ ID NO: 2953014 - protein, 17 aa, Entamoeba invadens
LKQNGFMSQTLCLGTTE

SEQ ID NO: 2953015 - protein, 19 aa, Entamoeba invadens
LKQPMFLADEIQREYLKKR

SEQ ID NO: 2953016 - protein, 23 aa, Entamoeba invadens
LKQRAEKKMMGIECKMTEDEIVN

SEQ ID NO: 2953017 - protein, 21 aa, Entamoeba invadens
LKQRKCRIGGVSIYHVESFEI

SEQ ID NO: 2953018 - protein, 23 aa, Entamoeba invadens
LKQRRARINKCINVINAEVIGLE

SEQ ID NO: 2953019 - protein, 19 aa, Entamoeba invadens
LKQRTEVLLEKEGVNIARD

SEQ ID NO: 2953020 - protein, 18 aa, Entamoeba invadens
LKQSILYEKMHIGEKIDI

SEQ ID NO: 2953021 - protein, 22 aa, Entamoeba invadens
LKQSKNVICPQVNYSSQDTHNK

SEQ ID NO: 2953022 - protein, 19 aa, Entamoeba invadens
LKQTKCLLIGAGTLGCNVS

SEQ ID NO: 2953023 - protein, 17 aa, Entamoeba invadens
LKRCLKLSEKMLPLPDK

SEQ ID NO: 2953024 - protein, 20 aa, Entamoeba invadens
LKRCSVSMMMGCKSVRMEQR

SEQ ID NO: 2953025 - protein, 21 aa, Entamoeba invadens
LKRDGDFNCALIEFETIKQAK

SEQ ID NO: 2953026 - protein, 25 aa, Entamoeba invadens
LKREFYRIIVWFNVNFETVDRNKSR

SEQ ID NO: 2953027 - protein, 21 aa, Entamoeba invadens
LKREKAILIMDGFKTHSTVRV

SEQ ID NO: 2953028 - protein, 19 aa, Entamoeba invadens
LKREKDFLTKDSLKKKSPR

SEQ ID NO: 2953029 - protein, 19 aa, Entamoeba invadens
LKRESEGILSPRSPVISPR

SEQ ID NO: 2953030 - protein, 20 aa, Entamoeba invadens
LKRFRTLKHPNIVSYIEHIT

SEQ ID NO: 2953031 - protein, 20 aa, Entamoeba invadens
LKRGFACEFEIFIKPLCSCK

SEQ ID NO: 2953032 - protein, 21 aa, Entamoeba invadens
LKRGIGMLMFEAIKGIKQELI

SEQ ID NO: 2953033 - protein, 19 aa, Entamoeba invadens
LKRIGAYTFKNCISLTSIV

SEQ ID NO: 2953034 - protein, 21 aa, Entamoeba invadens
LKRIKLCLKRSKELKIPKIIS

SEQ ID NO: 2953035 - protein, 20 aa, Entamoeba invadens
LKRIKMSCVDEVIVKNDEVA

SEQ ID NO: 2953036 - protein, 25 aa, Entamoeba invadens
LKRKFDMLPSCQIYKDYEITDDTLL

SEQ ID NO: 2953037 - protein, 22 aa, Entamoeba invadens
LKRKKPYLSHTAYFFRKSVLNA

SEQ ID NO: 2953038 - protein, 21 aa, Entamoeba invadens
LKRKTELLFAKSAKIREQQEK

SEQ ID NO: 2953039 - protein, 19 aa, Entamoeba invadens
LKRLEVGGIGHCMTTRTIG

SEQ ID NO: 2953040 - protein, 27 aa, Entamoeba invadens
LKRLMKFPPVFSLRPIIEMAISISDKK

SEQ ID NO: 2953041 - protein, 22 aa, Entamoeba invadens
LKRNWKPVPGYIKKEIGGNYST

SEQ ID NO: 2953042 - protein, 17 aa, Entamoeba invadens
LKRSFSQNVQTNLKPKT

SEQ ID NO: 2953043 - protein, 25 aa, Entamoeba invadens
LKRSNRCLKCSNGYLLSEGHCQNTS

SEQ ID NO: 2953044 - protein, 30 aa, Entamoeba invadens
LKRTKLKRCKVVALCGCNDLPLNYPVDSKL

SEQ ID NO: 2953045 - protein, 24 aa, Entamoeba invadens
LKRTLRLTNLIGVQILNLNIDIYY

SEQ ID NO: 2953046 - protein, 19 aa, Entamoeba invadens
LKRVFDFSKNYVIYRNLYS

SEQ ID NO: 2953047 - protein, 24 aa, Entamoeba invadens
LKRVKASAFLSCEFLEEVTVNAKI

SEQ ID NO: 2953048 - protein, 19 aa, Entamoeba invadens
LKSAANVLLSKGFGVKEIS

SEQ ID NO: 2953049 - protein, 28 aa, Entamoeba invadens
LKSACIPESGLECYMLLNYCFNLTTVNI

SEQ ID NO: 2953050 - protein, 20 aa, Entamoeba invadens
LKSAGLAFQAACKVRGKTSN

SEQ ID NO: 2953051 - protein, 21 aa, Entamoeba invadens
LKSAISFKENIIFVVETRQEK

SEQ ID NO: 2953052 - protein, 17 aa, Entamoeba invadens
LKSCSVKLRECFHEGNG

SEQ ID NO: 2953053 - protein, 35 aa, Entamoeba invadens
LKSDESKDAFTLCGSRGDYLFAFGGQKCDIAVYKK

SEQ ID NO: 2953054 - protein, 20 aa, Entamoeba invadens
LKSDGKLAFHAMWKDKYLTE

SEQ ID NO: 2953055 - protein, 18 aa, Entamoeba invadens
LKSDIVFLNDYGMRTMTL

SEQ ID NO: 2953056 - protein, 26 aa, Entamoeba invadens
LKSEFGDGTLFARFINSFRANAITAN

SEQ ID NO: 2953057 - protein, 17 aa, Entamoeba invadens
LKSEITWMCTVEGGDYL

SEQ ID NO: 2953058 - protein, 24 aa, Entamoeba invadens
LKSELKTLANYVASSWKEILEVLY

SEQ ID NO: 2953059 - protein, 23 aa, Entamoeba invadens
LKSFAVVAFDDWIYKDGEIVFLR

SEQ ID NO: 2953060 - protein, 18 aa, Entamoeba invadens
LKSFFAVILVERYLTLQT

SEQ ID NO: 2953061 - protein, 19 aa, Entamoeba invadens
LKSFYRVRVFYPITYQDYL

SEQ ID NO: 2953062 - protein, 18 aa, Entamoeba invadens
LKSGGSFVAKIFVEGEHP

SEQ ID NO: 2953063 - protein, 17 aa, Entamoeba invadens
LKSGIPFIENVETKEHV

SEQ ID NO: 2953064 - protein, 19 aa, Entamoeba invadens
LKSIAFCGISTGIYGFPAK

SEQ ID NO: 2953065 - protein, 17 aa, Entamoeba invadens
LKSIFLLNVNCEKLIAP

SEQ ID NO: 2953066 - protein, 20 aa, Entamoeba invadens
LKSILLPTCVSIIKECSFWG

SEQ ID NO: 2953067 - protein, 21 aa, Entamoeba invadens
LKSKALNYLSVFVKKQIDVMH

SEQ ID NO: 2953068 - protein, 19 aa, Entamoeba invadens
LKSKFLMLLSHASTEQLKR

SEQ ID NO: 2953069 - protein, 20 aa, Entamoeba invadens
LKSKLLLRKVIEQRMYQDRI

SEQ ID NO: 2953070 - protein, 18 aa, Entamoeba invadens
LKSKPVLKVLNFLVELAV

SEQ ID NO: 2953071 - protein, 22 aa, Entamoeba invadens
LKSLEAFSFKNCQYLKEIKLPK

SEQ ID NO: 2953072 - protein, 19 aa, Entamoeba invadens
LKSLFELSLLFPTKTIQQI

SEQ ID NO: 2953073 - protein, 20 aa, Entamoeba invadens
LKSLKSFEANGCKQCEFILP

SEQ ID NO: 2953074 - protein, 33 aa, Entamoeba invadens
LKSLLFSHKVYWLLRGATLLQMEAIESLAEVVL

SEQ ID NO: 2953075 - protein, 21 aa, Entamoeba invadens
LKSLLKNRMRPFHETDTAYLL

SEQ ID NO: 2953076 - protein, 24 aa, Entamoeba invadens
LKSLPPSCSCRFTGNVIEDVEFPD

SEQ ID NO: 2953077 - protein, 26 aa, Entamoeba invadens
LKSLVLRISSDFSFDYIIPQHLPHKF

SEQ ID NO: 2953078 - protein, 21 aa, Entamoeba invadens
LKSNMKILQFMKIHTFDNKCE

SEQ ID NO: 2953079 - protein, 22 aa, Entamoeba invadens
LKSPEDHSTLLLKENDKRCVLM

SEQ ID NO: 2953080 - protein, 28 aa, Entamoeba invadens
LKSPELQRRIIINLAPPVCTHFFENTIF

SEQ ID NO: 2953081 - protein, 17 aa, Entamoeba invadens
LKSPIEKILLFFPNIET

SEQ ID NO: 2953082 - protein, 23 aa, Entamoeba invadens
LKSQKRLTLFHAELVMQYLKCLI

SEQ ID NO: 2953083 - protein, 23 aa, Entamoeba invadens
LKSQKSSEHLIPFDDKVRPTSST

SEQ ID NO: 2953084 - protein, 22 aa, Entamoeba invadens
LKSRGDIGQLFYWLIVGENEKT

SEQ ID NO: 2953085 - protein, 21 aa, Entamoeba invadens
LKSRKIIPTKYLDLSKTGCAA

SEQ ID NO: 2953086 - protein, 18 aa, Entamoeba invadens
LKSTALILKTGKIVCTGT

SEQ ID NO: 2953087 - protein, 18 aa, Entamoeba invadens
LKSTEAFFNTAFSLQNEF

SEQ ID NO: 2953088 - protein, 17 aa, Entamoeba invadens
LKSTFEELVKSYITTKD

SEQ ID NO: 2953089 - protein, 21 aa, Entamoeba invadens
LKSTNILDVFVFFKQIDITKN

SEQ ID NO: 2953090 - protein, 19 aa, Entamoeba invadens
LKSTVLLSEETVPLEKEVH

SEQ ID NO: 2953091 - protein, 19 aa, Entamoeba invadens
LKSVITAYLRIRGNFAGDL

SEQ ID NO: 2953092 - protein, 19 aa, Entamoeba invadens
LKSVITGYFRIRGNFPDDL

SEQ ID NO: 2953093 - protein, 24 aa, Entamoeba invadens
LKSVKVMQRKVCDYVIHGEMVKAH

SEQ ID NO: 2953094 - protein, 25 aa, Entamoeba invadens
LKSVLKTNFFCLSKTATGFRLDPNF

SEQ ID NO: 2953095 - protein, 19 aa, Entamoeba invadens
LKSVTSWFEATFVKNWDRG

SEQ ID NO: 2953096 - protein, 26 aa, Entamoeba invadens
LKSYKKDIAEIIVRAETLEKNIQMAE

SEQ ID NO: 2953097 - protein, 19 aa, Entamoeba invadens
LKSYLNLHLVPFSIPTFIF

SEQ ID NO: 2953098 - protein, 20 aa, Entamoeba invadens
LKTADTLFNFILINKKCQLT

SEQ ID NO: 2953099 - protein, 22 aa, Entamoeba invadens
LKTALRYESFVLKGIDETGIYD

SEQ ID NO: 2953100 - protein, 19 aa, Entamoeba invadens
LKTATGLSDPFVLFDSEVS

SEQ ID NO: 2953101 - protein, 29 aa, Entamoeba invadens
LKTAVLQKKVKFIGDFAFSGCINLEEVVV

SEQ ID NO: 2953102 - protein, 25 aa, Entamoeba invadens
LKTDPKTAFYSGFMLSELSYKCKAF

SEQ ID NO: 2953103 - protein, 21 aa, Entamoeba invadens
LKTEPYFACIYAMTEEGIVAL

SEQ ID NO: 2953104 - protein, 17 aa, Entamoeba invadens
LKTFKFLSKNKNIKTRL

SEQ ID NO: 2953105 - protein, 27 aa, Entamoeba invadens
LKTFQACRVHFDFLKMELPTSLRRFLV

SEQ ID NO: 2953106 - protein, 19 aa, Entamoeba invadens
LKTGEVYVHQNIKENYKIK

SEQ ID NO: 2953107 - protein, 17 aa, Entamoeba invadens
LKTGFDVLYYLKTSNQF

SEQ ID NO: 2953108 - protein, 23 aa, Entamoeba invadens
LKTICPQSEFQFQFDLPLQASGV

SEQ ID NO: 2953109 - protein, 17 aa, Entamoeba invadens
LKTIEFPPGTSFGEGSL

SEQ ID NO: 2953110 - protein, 28 aa, Entamoeba invadens
LKTIEKFAFKNCYSLENLTFPKTLVIME

SEQ ID NO: 2953111 - protein, 20 aa, Entamoeba invadens
LKTIFSLPMKLAEAGLNAVC

SEQ ID NO: 2953112 - protein, 21 aa, Entamoeba invadens
LKTILKKVVSSVIVLTEECRR

SEQ ID NO: 2953113 - protein, 24 aa, Entamoeba invadens
LKTINEAFKYGFLTEEDLSELQDD

SEQ ID NO: 2953114 - protein, 24 aa, Entamoeba invadens
LKTIPKIQFLKRGIFWCCNSLVKF

SEQ ID NO: 2953115 - protein, 24 aa, Entamoeba invadens
LKTIPKIQFLKRGVFWCCNSLVKF

SEQ ID NO: 2953116 - protein, 27 aa, Entamoeba invadens
LKTIRLICTIPPTWGLEETKNAIRDTG

SEQ ID NO: 2953117 - protein, 23 aa, Entamoeba invadens
LKTKCEWHAEAAAKIFIDTINCH

SEQ ID NO: 2953118 - protein, 18 aa, Entamoeba invadens
LKTKKCLNKELVRDKDGR

SEQ ID NO: 2953119 - protein, 18 aa, Entamoeba invadens
LKTKNCEIHKRFLGINQK

SEQ ID NO: 2953120 - protein, 18 aa, Entamoeba invadens
LKTKSVLGDLEIVNQQLA

SEQ ID NO: 2953121 - protein, 36 aa, Entamoeba invadens
LKTKWFPPKVRKIRLFTNEVLISFYVKFKSYFNRIK

SEQ ID NO: 2953122 - protein, 25 aa, Entamoeba invadens
LKTKWFPPKVRKIRLSSNEVLAVGK

SEQ ID NO: 2953123 - protein, 19 aa, Entamoeba invadens
LKTKWFPSKVRKLKINSKE

SEQ ID NO: 2953124 - protein, 20 aa, Entamoeba invadens
LKTLCIHNGIVQDFDGLNLE

SEQ ID NO: 2953125 - protein, 21 aa, Entamoeba invadens
LKTLDFRVAINYWSQYTAKYF

SEQ ID NO: 2953126 - protein, 17 aa, Entamoeba invadens
LKTLIQLCPSDCCLIEL

SEQ ID NO: 2953127 - protein, 18 aa, Entamoeba invadens
LKTLISIFYTLLIDSEHP

SEQ ID NO: 2953128 - protein, 17 aa, Entamoeba invadens
LKTLLKEIPVSIDTIVF

SEQ ID NO: 2953129 - protein, 25 aa, Entamoeba invadens
LKTLPTTRRIVCSYADEVIASLSAY

SEQ ID NO: 2953130 - protein, 20 aa, Entamoeba invadens
LKTLTPRGSSEFKTHRLNIT

SEQ ID NO: 2953131 - protein, 17 aa, Entamoeba invadens
LKTLTVHFKSEKIKNEV

SEQ ID NO: 2953132 - protein, 25 aa, Entamoeba invadens
LKTNDLHAILSILQFHFDEQLAFHL

SEQ ID NO: 2953133 - protein, 22 aa, Entamoeba invadens
LKTPINAVGKRACKIVKNCEVR

SEQ ID NO: 2953134 - protein, 17 aa, Entamoeba invadens
LKTPTAIFVRVINEAIC

SEQ ID NO: 2953135 - protein, 18 aa, Entamoeba invadens
LKTQFVIEAFEKMLRNAK

SEQ ID NO: 2953136 - protein, 23 aa, Entamoeba invadens
LKTQKSRRFSFREKKYVEDIMPE

SEQ ID NO: 2953137 - protein, 20 aa, Entamoeba invadens
LKTQLVKRNDEFKELLENLE

SEQ ID NO: 2953138 - protein, 23 aa, Entamoeba invadens
LKTQRFDKDLAHDYKNKKRNLAY

SEQ ID NO: 2953139 - protein, 24 aa, Entamoeba invadens
LKTQTMFLLIKMKMMKNRKEKMKK

SEQ ID NO: 2953140 - protein, 18 aa, Entamoeba invadens
LKTRPFFAGTNFDKFQNK

SEQ ID NO: 2953141 - protein, 18 aa, Entamoeba invadens
LKTSFFQWSPDNTAAAPC

SEQ ID NO: 2953142 - protein, 28 aa, Entamoeba invadens
LKTSLRFLQKRFVCVASSKVEYIGNTEG

SEQ ID NO: 2953143 - protein, 25 aa, Entamoeba invadens
LKTSNGKLWYTIGILNENEELYDQA

SEQ ID NO: 2953144 - protein, 19 aa, Entamoeba invadens
LKTSYDFRNLLSLTSLKLI

SEQ ID NO: 2953145 - protein, 19 aa, Entamoeba invadens
LKTTAGLSLEFNPVVNTTN

SEQ ID NO: 2953146 - protein, 24 aa, Entamoeba invadens
LKTTDNWRRLFAITDELFSHFDFF

SEQ ID NO: 2953147 - protein, 17 aa, Entamoeba invadens
LKTTPLRAREQFICAKS

SEQ ID NO: 2953148 - protein, 17 aa, Entamoeba invadens
LKTVVLILTCTNALELI

SEQ ID NO: 2953149 - protein, 21 aa, Entamoeba invadens
LKTVYFPSSLVDFDMEYISNC

SEQ ID NO: 2953150 - protein, 17 aa, Entamoeba invadens
LKTYLFMSPIREADTFL

SEQ ID NO: 2953151 - protein, 17 aa, Entamoeba invadens
LKVADFGLARSLDKESL

SEQ ID NO: 2953152 - protein, 22 aa, Entamoeba invadens
LKVDFLRVIFSYQYFFEMNIPI

SEQ ID NO: 2953153 - protein, 18 aa, Entamoeba invadens
LKVDILVNHVNFDDLQTV

SEQ ID NO: 2953154 - protein, 22 aa, Entamoeba invadens
LKVDLPYFDVCVSNTPYSISSP

SEQ ID NO: 2953155 - protein, 19 aa, Entamoeba invadens
LKVDYCDNCEFLFEANKLE

SEQ ID NO: 2953156 - protein, 19 aa, Entamoeba invadens
LKVDYCDNCEFWFEANKLE

SEQ ID NO: 2953157 - protein, 17 aa, Entamoeba invadens
LKVECGYCEYNSVSNSV

SEQ ID NO: 2953158 - protein, 22 aa, Entamoeba invadens
LKVEFGDSFLAMYKGLNKVPFV

SEQ ID NO: 2953159 - protein, 23 aa, Entamoeba invadens
LKVEGAVLEKVVEWLNFHNEHPL

SEQ ID NO: 2953160 - protein, 19 aa, Entamoeba invadens
LKVEKKMDFDMLVSMPFQH

SEQ ID NO: 2953161 - protein, 17 aa, Entamoeba invadens
LKVFNCGKSTLFEKGAF

SEQ ID NO: 2953162 - protein, 19 aa, Entamoeba invadens
LKVGERYHIIGIYQSSRYD

SEQ ID NO: 2953163 - protein, 19 aa, Entamoeba invadens
LKVGFELTGERCEFNGIPA

SEQ ID NO: 2953164 - protein, 20 aa, Entamoeba invadens
LKVGSLIGKVFCSLRQYEDK

SEQ ID NO: 2953165 - protein, 20 aa, Entamoeba invadens
LKVIHPFTFTQENPYTKIEK

SEQ ID NO: 2953166 - protein, 25 aa, Entamoeba invadens
LKVIKVISSRNVWISQFLPNLEKVN

SEQ ID NO: 2953167 - protein, 19 aa, Entamoeba invadens
LKVIPKREEKILVKVLPKY

SEQ ID NO: 2953168 - protein, 20 aa, Entamoeba invadens
LKVKDAWFDVLSVLNKDVTS

SEQ ID NO: 2953169 - protein, 17 aa, Entamoeba invadens
LKVLDDYTAIAISQDSQ

SEQ ID NO: 2953170 - protein, 27 aa, Entamoeba invadens
LKVLESPLWKDELQVLVGNAKGELLFY

SEQ ID NO: 2953171 - protein, 24 aa, Entamoeba invadens
LKVLQKRLDIFFIENWEFSDEKKT

SEQ ID NO: 2953172 - protein, 17 aa, Entamoeba invadens
LKVLVEAVVIILRDEDF

SEQ ID NO: 2953173 - protein, 19 aa, Entamoeba invadens
LKVLVPGAGLGRLAYEIAK

SEQ ID NO: 2953174 - protein, 20 aa, Entamoeba invadens
LKVMKSIDCTGIIRYMPYVH

SEQ ID NO: 2953175 - protein, 19 aa, Entamoeba invadens
LKVNPWFSKSNDIETFCAF

SEQ ID NO: 2953176 - protein, 19 aa, Entamoeba invadens
LKVNPWFTTKEDIEEFCTI

SEQ ID NO: 2953177 - protein, 17 aa, Entamoeba invadens
LKVNPWLTSTLDVEKFY

SEQ ID NO: 2953178 - protein, 25 aa, Entamoeba invadens
LKVNRKFEISLGMAQQALYYNHDSL

SEQ ID NO: 2953179 - protein, 20 aa, Entamoeba invadens
LKVPNYQRNWFIGIRLENTN

SEQ ID NO: 2953180 - protein, 17 aa, Entamoeba invadens
LKVQVSAPASVPQEEEK

SEQ ID NO: 2953181 - protein, 20 aa, Entamoeba invadens
LKVRAVGYDLSYKRSLQYSP

SEQ ID NO: 2953182 - protein, 20 aa, Entamoeba invadens
LKVRSLRILFMQLTELRRLE

SEQ ID NO: 2953183 - protein, 25 aa, Entamoeba invadens
LKVRTFPGHCFVDFKDDISMNKALK

SEQ ID NO: 2953184 - protein, 19 aa, Entamoeba invadens
LKVSDKIRPIFEEVNLSLF

SEQ ID NO: 2953185 - protein, 19 aa, Entamoeba invadens
LKVSEGIARNLLKKLSKRD

SEQ ID NO: 2953186 - protein, 26 aa, Entamoeba invadens
LKVSPSSICRYMKSLEAQEMIEETQH

SEQ ID NO: 2953187 - protein, 18 aa, Entamoeba invadens
LKVVLVDFAPTQKLARAN

SEQ ID NO: 2953188 - protein, 18 aa, Entamoeba invadens
LKVVRLLYQRAVEGKPLY

SEQ ID NO: 2953189 - protein, 26 aa, Entamoeba invadens
LKVWRKRPGNEMVVQCIKNAYQYNEE

SEQ ID NO: 2953190 - protein, 23 aa, Entamoeba invadens
LKVYECLYDYPKYASSIVSHKFI

SEQ ID NO: 2953191 - protein, 22 aa, Entamoeba invadens
LKVYEECFRKEGLKKKDEILKT

SEQ ID NO: 2953192 - protein, 21 aa, Entamoeba invadens
LKVYEWSLGVEEIRSYETGGD

SEQ ID NO: 2953193 - protein, 18 aa, Entamoeba invadens
LKYADSLYRCKQLKRAAL

SEQ ID NO: 2953194 - protein, 19 aa, Entamoeba invadens
LKYDEEYTWVFPPTKASGF

SEQ ID NO: 2953195 - protein, 21 aa, Entamoeba invadens
LKYFKSRGYLTELLTLLAENE

SEQ ID NO: 2953196 - protein, 19 aa, Entamoeba invadens
LKYFVPFISAYRGLLLNLL

SEQ ID NO: 2953197 - protein, 20 aa, Entamoeba invadens
LKYFVPFLSIYRGFIINLIL

SEQ ID NO: 2953198 - protein, 22 aa, Entamoeba invadens
LKYFYWKFTEPSVMSLHEMYKT

SEQ ID NO: 2953199 - protein, 22 aa, Entamoeba invadens
LKYIRIVVPCLAQFRPRQLYEI

SEQ ID NO: 2953200 - protein, 28 aa, Entamoeba invadens
LKYLIDLFNSFQLAYNFEFILSSKRFVD

SEQ ID NO: 2953201 - protein, 17 aa, Entamoeba invadens
LKYLYCRPTVSAQRDPK

SEQ ID NO: 2953202 - protein, 18 aa, Entamoeba invadens
LKYMIYKLPDDYRGVTTG

SEQ ID NO: 2953203 - protein, 31 aa, Entamoeba invadens
LKYNAFKSDVWSCGVMAYRIAVGKGPFDKDG

SEQ ID NO: 2953204 - protein, 19 aa, Entamoeba invadens
LKYQAEMVGRKICSIVPYT

SEQ ID NO: 2953205 - protein, 20 aa, Entamoeba invadens
LKYQTVRELLNFMCNTYNLK

SEQ ID NO: 2953206 - protein, 20 aa, Entamoeba invadens
LKYSPKEIVSLCYSIGDAQI

SEQ ID NO: 2953207 - protein, 27 aa, Entamoeba invadens
LKYTPKGVFCLMTFYGPACPNNSGLIA

SEQ ID NO: 2953208 - protein, 21 aa, Entamoeba invadens
LKYVEACGGIEKALAVGQKAY

SEQ ID NO: 2953209 - protein, 22 aa, Entamoeba invadens
LKYVFEALPLKTELEGESQFED

SEQ ID NO: 2953210 - protein, 19 aa, Entamoeba invadens
LKYVKPICEFGGIEPNPTH

SEQ ID NO: 2953211 - protein, 25 aa, Entamoeba invadens
LKYYYIRISAIAKKESRSIEVTQPL

SEQ ID NO: 2953212 - protein, 30 aa, Entamoeba invadens
LKYYYQGCQCWDWYFPYLYAPFIADVATYL

SEQ ID NO: 2953213 - protein, 17 aa, Entamoeba invadens
LLACDVWEHAYYIDTRN

SEQ ID NO: 2953214 - protein, 23 aa, Entamoeba invadens
LLAGTAMGRRSFFQFGTELEHNS

SEQ ID NO: 2953215 - protein, 23 aa, Entamoeba invadens
LLALKDIIPFFIDHVEQMQVFEL

SEQ ID NO: 2953216 - protein, 25 aa, Entamoeba invadens
LLALPHYYLTLFKSFENLFSLGHSF

SEQ ID NO: 2953217 - protein, 18 aa, Entamoeba invadens
LLALRLALCCSMHQNEND

SEQ ID NO: 2953218 - protein, 17 aa, Entamoeba invadens
LLALVLNYLCKAAMSRL

SEQ ID NO: 2953219 - protein, 17 aa, Entamoeba invadens
LLANVVFSMRSERKGMV

SEQ ID NO: 2953220 - protein, 28 aa, Entamoeba invadens
LLANVWPYIRFSIDYNIAQTELKFLKTY

SEQ ID NO: 2953221 - protein, 17 aa, Entamoeba invadens
LLAQIGWTEDDYFDGIR

SEQ ID NO: 2953222 - protein, 26 aa, Entamoeba invadens
LLAQNCPKCAAALSISRLSEAEGQRL

SEQ ID NO: 2953223 - protein, 18 aa, Entamoeba invadens
LLASSLTSLRCVWCGITL

SEQ ID NO: 2953224 - protein, 25 aa, Entamoeba invadens
LLATGVTPEGGWYDCNKQWAPQDNI

SEQ ID NO: 2953225 - protein, 19 aa, Entamoeba invadens
LLAYHYYYALSFLPQYRDV

SEQ ID NO: 2953226 - protein, 26 aa, Entamoeba invadens
LLCDKFGHICLLYFIRHVDDKALLKK

SEQ ID NO: 2953227 - protein, 21 aa, Entamoeba invadens
LLCDSDFIGALTMDDDLQQEL

SEQ ID NO: 2953228 - protein, 18 aa, Entamoeba invadens
LLCFDGCISLKEVRIPQT

SEQ ID NO: 2953229 - protein, 18 aa, Entamoeba invadens
LLCFENCTLLRIKIPTTI

SEQ ID NO: 2953230 - protein, 18 aa, Entamoeba invadens
LLCINPRAFYNCSNLKEL

SEQ ID NO: 2953231 - protein, 26 aa, Entamoeba invadens
LLCISGCGCLYSFMKKVIGAEYTRMN

SEQ ID NO: 2953232 - protein, 19 aa, Entamoeba invadens
LLCISSILPSATYQDMALF

SEQ ID NO: 2953233 - protein, 30 aa, Entamoeba invadens
LLCNYLEKNCCVIASGFLRDEETTEKYRLR

SEQ ID NO: 2953234 - protein, 21 aa, Entamoeba invadens
LLCRGIKLAPAASHIAQLEGI

SEQ ID NO: 2953235 - protein, 38 aa, Entamoeba invadens
LLCVEGLAICLRSFLKLSPFPEYTCKPSGVQIHVGKDV

SEQ ID NO: 2953236 - protein, 17 aa, Entamoeba invadens
LLDAIQLNQIVVELKKQ

SEQ ID NO: 2953237 - protein, 17 aa, Entamoeba invadens
LLDALLVLKSFPPQFEM

SEQ ID NO: 2953238 - protein, 27 aa, Entamoeba invadens
LLDCSKRFSFEFFSIHHRLNFIVLSLC

SEQ ID NO: 2953239 - protein, 22 aa, Entamoeba invadens
LLDCYDVSYLWVGKNISEIDKK

SEQ ID NO: 2953240 - protein, 19 aa, Entamoeba invadens
LLDDNCIEHLLNLVDNLAN

SEQ ID NO: 2953241 - protein, 17 aa, Entamoeba invadens
LLDEANCTLGNPTPTKV

SEQ ID NO: 2953242 - protein, 18 aa, Entamoeba invadens
LLDEEMLVEFQFFGLEKT

SEQ ID NO: 2953243 - protein, 26 aa, Entamoeba invadens
LLDFLKRKFGKIFEEDPFCFVSESVR

SEQ ID NO: 2953244 - protein, 28 aa, Entamoeba invadens
LLDFRFPDEKVRLFALKCIDAMKDHELV

SEQ ID NO: 2953245 - protein, 28 aa, Entamoeba invadens
LLDFRYPDPQIRAFALRCIDTMTDDQLV

SEQ ID NO: 2953246 - protein, 24 aa, Entamoeba invadens
LLDKAADVSFAYPTIQPLITWTEK

SEQ ID NO: 2953247 - protein, 23 aa, Entamoeba invadens
LLDKKCIPPPFSECKLHRLSLRQ

SEQ ID NO: 2953248 - protein, 22 aa, Entamoeba invadens
LLDKKFFVLAYFWEENVISLFV

SEQ ID NO: 2953249 - protein, 23 aa, Entamoeba invadens
LLDLGSFERKASYLIDIDNTDTT

SEQ ID NO: 2953250 - protein, 25 aa, Entamoeba invadens
LLDLLRQYFGFTFQEVVKKKPENAW

SEQ ID NO: 2953251 - protein, 20 aa, Entamoeba invadens
LLDLRKATTLEEIRITRFGG

SEQ ID NO: 2953252 - protein, 17 aa, Entamoeba invadens
LLDNWLILLNDVLRNSM

SEQ ID NO: 2953253 - protein, 26 aa, Entamoeba invadens
LLDPTFKKAYLDNADIFFEGKQVASV

SEQ ID NO: 2953254 - protein, 26 aa, Entamoeba invadens
LLDQALLRPGRFDRILYVGLPDNSTR

SEQ ID NO: 2953255 - protein, 24 aa, Entamoeba invadens
LLDREIAFNLSLIYAKAGNEDLVI

SEQ ID NO: 2953256 - protein, 26 aa, Entamoeba invadens
LLDSFSYFCMCVRDKIANFVREIFCV

SEQ ID NO: 2953257 - protein, 19 aa, Entamoeba invadens
LLDSICGILLGKAYIPFGA

SEQ ID NO: 2953258 - protein, 28 aa, Entamoeba invadens
LLDTFFYLVVFRGEAVVDWMKQKLEEKE

SEQ ID NO: 2953259 - protein, 24 aa, Entamoeba invadens
LLDTPFCVFPILDVLEVYQDTKQD

SEQ ID NO: 2953260 - protein, 26 aa, Entamoeba invadens
LLDVVFFKTLYCCFSPELPDKMTKIM

SEQ ID NO: 2953261 - protein, 21 aa, Entamoeba invadens
LLEAYRILYLLATRAKTLRFN

SEQ ID NO: 2953262 - protein, 18 aa, Entamoeba invadens
LLECEDINLVIAKGACLY

SEQ ID NO: 2953263 - protein, 18 aa, Entamoeba invadens
LLEDRFVELLAEEDKTQF

SEQ ID NO: 2953264 - protein, 24 aa, Entamoeba invadens
LLEEFRFAVCSNLRSIECGTNLKK

SEQ ID NO: 2953265 - protein, 18 aa, Entamoeba invadens
LLEEYPFFINYKNKGGET

SEQ ID NO: 2953266 - protein, 24 aa, Entamoeba invadens
LLEEYRIQLILNHILFAGIDGQFS

SEQ ID NO: 2953267 - protein, 18 aa, Entamoeba invadens
LLEFKVPDLRKIYKMECI

SEQ ID NO: 2953268 - protein, 24 aa, Entamoeba invadens
LLEHRHLLELNKCLNNLYSAESEK

SEQ ID NO: 2953269 - protein, 25 aa, Entamoeba invadens
LLEIKSCAFEGCKSLEEITIPQSVY

SEQ ID NO: 2953270 - protein, 21 aa, Entamoeba invadens
LLEILPLLYSSILQFFVYAES

SEQ ID NO: 2953271 - protein, 21 aa, Entamoeba invadens
LLEIPDKCFFECSILNTIDIP

SEQ ID NO: 2953272 - protein, 31 aa, Entamoeba invadens
LLEIYDVVRYLVYWGKAKVIEAVFLDDVYIL

SEQ ID NO: 2953273 - protein, 17 aa, Entamoeba invadens
LLEKAGFNIVFKNTKDS

SEQ ID NO: 2953274 - protein, 28 aa, Entamoeba invadens
LLEKYLKSKGFRVGKYHAGMSASDRESV

SEQ ID NO: 2953275 - protein, 22 aa, Entamoeba invadens
LLELRNSFISSCRIVVENHFAR

SEQ ID NO: 2953276 - protein, 17 aa, Entamoeba invadens
LLELSRNFLVFCRKQAQ

SEQ ID NO: 2953277 - protein, 19 aa, Entamoeba invadens
LLENLKTDFALLIKEVMTL

SEQ ID NO: 2953278 - protein, 32 aa, Entamoeba invadens
LLENRCLVDPYFGRLKTVYAFAREKYNKDTVI

SEQ ID NO: 2953279 - protein, 19 aa, Entamoeba invadens
LLEQAVLFSPRRRYLDRQQ

SEQ ID NO: 2953280 - protein, 17 aa, Entamoeba invadens
LLERHDMITISKANTLE

SEQ ID NO: 2953281 - protein, 26 aa, Entamoeba invadens
LLERYKKYSFCLGFVIVEAEEETAIL

SEQ ID NO: 2953282 - protein, 19 aa, Entamoeba invadens
LLESFLFPGKFLYDNILLP

SEQ ID NO: 2953283 - protein, 20 aa, Entamoeba invadens
LLESIEYSVLLPMMDDHEQL

SEQ ID NO: 2953284 - protein, 19 aa, Entamoeba invadens
LLESLELPTTIPILEEQPD

SEQ ID NO: 2953285 - protein, 27 aa, Entamoeba invadens
LLETRKDFPISRPEVVDDVVLNKQRTL

SEQ ID NO: 2953286 - protein, 23 aa, Entamoeba invadens
LLEVRRWILVDSILRASNRHTEL

SEQ ID NO: 2953287 - protein, 18 aa, Entamoeba invadens
LLEWSKCTKSSIILDTKF

SEQ ID NO: 2953288 - protein, 21 aa, Entamoeba invadens
LLFAIPEVVDYLVSHYDTFLK

SEQ ID NO: 2953289 - protein, 20 aa, Entamoeba invadens
LLFDICSEVGFYLESKPSRK

SEQ ID NO: 2953290 - protein, 19 aa, Entamoeba invadens
LLFEEGFLVMYKKFNREGV

SEQ ID NO: 2953291 - protein, 18 aa, Entamoeba invadens
LLFELFTPLFQYKDLAVT

SEQ ID NO: 2953292 - protein, 21 aa, Entamoeba invadens
LLFEYVERLELFESYIDILLN

SEQ ID NO: 2953293 - protein, 23 aa, Entamoeba invadens
LLFEYVERLELFKSYIDILLNEV

SEQ ID NO: 2953294 - protein, 17 aa, Entamoeba invadens
LLFFFDYYTENHVEKGL

SEQ ID NO: 2953295 - protein, 19 aa, Entamoeba invadens
LLFGKTFLEETCLTFVNTL

SEQ ID NO: 2953296 - protein, 18 aa, Entamoeba invadens
LLFIPRIVTKSERNFIQT

SEQ ID NO: 2953297 - protein, 18 aa, Entamoeba invadens
LLFKDNCFEECPIEEGIT

SEQ ID NO: 2953298 - protein, 27 aa, Entamoeba invadens
LLFLCQRASHVFGVFVAEELVMKNDYY

SEQ ID NO: 2953299 - protein, 17 aa, Entamoeba invadens
LLFQRLVNYIKMTQRSR

SEQ ID NO: 2953300 - protein, 17 aa, Entamoeba invadens
LLFRDEDMLIFGNRNLF

SEQ ID NO: 2953301 - protein, 18 aa, Entamoeba invadens
LLFSILVRKSIEVQDFTS

SEQ ID NO: 2953302 - protein, 17 aa, Entamoeba invadens
LLFSNGVDGSVCSMLLK

SEQ ID NO: 2953303 - protein, 25 aa, Entamoeba invadens
LLFTKLEPLFCGVVDKVTMNISLAD

SEQ ID NO: 2953304 - protein, 26 aa, Entamoeba invadens
LLFVCNGKDMYGCLTTTHLKNASYIV

SEQ ID NO: 2953305 - protein, 19 aa, Entamoeba invadens
LLGCLTTFKPKTFKNCIEL

SEQ ID NO: 2953306 - protein, 18 aa, Entamoeba invadens
LLGECYLHGCGLKKDLFK

SEQ ID NO: 2953307 - protein, 29 aa, Entamoeba invadens
LLGGLTRILKFLLPFVVDKLPIVFGKFIK

SEQ ID NO: 2953308 - protein, 22 aa, Entamoeba invadens
LLGISKMRFSLQVSPQQLASVI

SEQ ID NO: 2953309 - protein, 26 aa, Entamoeba invadens
LLGLFYRFSGTLAKYAKKLEGFAATP

SEQ ID NO: 2953310 - protein, 24 aa, Entamoeba invadens
LLGLLNAFCSFTFEKPAKKSKVTF

SEQ ID NO: 2953311 - protein, 25 aa, Entamoeba invadens
LLGMRDCAFEEVMKARMDIKGILLE

SEQ ID NO: 2953312 - protein, 19 aa, Entamoeba invadens
LLGNLNFTNPMATTSTPSQ

SEQ ID NO: 2953313 - protein, 18 aa, Entamoeba invadens
LLGPLGFVGGIFAGVAGV

SEQ ID NO: 2953314 - protein, 25 aa, Entamoeba invadens
LLGVASRLKSLLVFPESNSYLEELI

SEQ ID NO: 2953315 - protein, 17 aa, Entamoeba invadens
LLHFEDFGTKIPELDTI

SEQ ID NO: 2953316 - protein, 19 aa, Entamoeba invadens
LLHFPGPVVFTSNCIMKPK

SEQ ID NO: 2953317 - protein, 20 aa, Entamoeba invadens
LLHGKCLSTFPPLEKLNLTF

SEQ ID NO: 2953318 - protein, 19 aa, Entamoeba invadens
LLHGKRYVFRTGEIACLLK

SEQ ID NO: 2953319 - protein, 17 aa, Entamoeba invadens
LLHILKRSDRISLIRLV

SEQ ID NO: 2953320 - protein, 27 aa, Entamoeba invadens
LLHQCGTPLKVGNILMKRDVPLDLLET

SEQ ID NO: 2953321 - protein, 20 aa, Entamoeba invadens
LLHRGKAAALTVDFVEKKKI

SEQ ID NO: 2953322 - protein, 17 aa, Entamoeba invadens
LLHSINIQLFKGNTEEF

SEQ ID NO: 2953323 - protein, 24 aa, Entamoeba invadens
LLHSYYIICIEKNYILPEQFLDYH

SEQ ID NO: 2953324 - protein, 17 aa, Entamoeba invadens
LLIDFVRELGYFVETKT

SEQ ID NO: 2953325 - protein, 25 aa, Entamoeba invadens
LLIDLLEIRGGFDFESKYTEGKVGT

SEQ ID NO: 2953326 - protein, 23 aa, Entamoeba invadens
LLIDLLVVRCGYEFESKYTEGKI

SEQ ID NO: 2953327 - protein, 24 aa, Entamoeba invadens
LLIDMLREFGYFFQTRMTVGKSGT

SEQ ID NO: 2953328 - protein, 19 aa, Entamoeba invadens
LLIDTLFLLGVDFNTYTTD

SEQ ID NO: 2953329 - protein, 19 aa, Entamoeba invadens
LLIECPDQQNAVCLSILRP

SEQ ID NO: 2953330 - protein, 25 aa, Entamoeba invadens
LLIEKGCPHSLTLVNVMMTTYIGKE

SEQ ID NO: 2953331 - protein, 17 aa, Entamoeba invadens
LLIEYCEGKGCKNMWSF

SEQ ID NO: 2953332 - protein, 19 aa, Entamoeba invadens
LLIGSVFPRVEKVFINGCV

SEQ ID NO: 2953333 - protein, 18 aa, Entamoeba invadens
LLIHEWAGFATFVPHKEG

SEQ ID NO: 2953334 - protein, 17 aa, Entamoeba invadens
LLIHSNINFLPVSCFKN

SEQ ID NO: 2953335 - protein, 25 aa, Entamoeba invadens
LLILDEWRGSIVVFDLKTNKCEGVW

SEQ ID NO: 2953336 - protein, 24 aa, Entamoeba invadens
LLIMPVQRIPRYVLLIKDLLKNTD

SEQ ID NO: 2953337 - protein, 18 aa, Entamoeba invadens
LLINEGVVVHFGDSMLRI

SEQ ID NO: 2953338 - protein, 26 aa, Entamoeba invadens
LLIPPNILPLFPAIVVNKMCKLYRNI

SEQ ID NO: 2953339 - protein, 24 aa, Entamoeba invadens
LLIRSRSAALFSGNFCNVTSLSDE

SEQ ID NO: 2953340 - protein, 18 aa, Entamoeba invadens
LLIRYGGDIGKMYQKKPL

SEQ ID NO: 2953341 - protein, 37 aa, Entamoeba invadens
LLISKLKLLITDVFACPLRYVVCLPTGSDCRLESVVK

SEQ ID NO: 2953342 - protein, 18 aa, Entamoeba invadens
LLIYLSLCHLQILRITAP

SEQ ID NO: 2953343 - protein, 17 aa, Entamoeba invadens
LLKAMVINVKHQEVSTV

SEQ ID NO: 2953344 - protein, 22 aa, Entamoeba invadens
LLKDKLKCLLDDLLSTYIQLCV

SEQ ID NO: 2953345 - protein, 34 aa, Entamoeba invadens
LLKEELIKDMCLMVNMVVKYRGTMFRAIVELELK

SEQ ID NO: 2953346 - protein, 23 aa, Entamoeba invadens
LLKEKLKFLDIMNRVPMHDGGIV

SEQ ID NO: 2953347 - protein, 22 aa, Entamoeba invadens
LLKENRVFIPFFKFNSQNKSIL

SEQ ID NO: 2953348 - protein, 26 aa, Entamoeba invadens
LLKERKEAVTILLRYFNIPHISLIQP

SEQ ID NO: 2953349 - protein, 25 aa, Entamoeba invadens
LLKIKARLIEGMSLIVFASVQCVSA

SEQ ID NO: 2953350 - protein, 25 aa, Entamoeba invadens
LLKKEELRKILTALRPQDFEPNRPP

SEQ ID NO: 2953351 - protein, 18 aa, Entamoeba invadens
LLKLCHPNSNYLKKEIEL

SEQ ID NO: 2953352 - protein, 27 aa, Entamoeba invadens
LLKLTRSGCYYRLLGGVRGDGAVIQPV

SEQ ID NO: 2953353 - protein, 19 aa, Entamoeba invadens
LLKMAYERLFYCMDNNNVY

SEQ ID NO: 2953354 - protein, 17 aa, Entamoeba invadens
LLKNCSNVKMTKNVGIG

SEQ ID NO: 2953355 - protein, 18 aa, Entamoeba invadens
LLKNLSMSLITTSAHESA

SEQ ID NO: 2953356 - protein, 19 aa, Entamoeba invadens
LLKNYNFKTVKLCKTKNST

SEQ ID NO: 2953357 - protein, 19 aa, Entamoeba invadens
LLKPFIPELISSLQRLVNH

SEQ ID NO: 2953358 - protein, 25 aa, Entamoeba invadens
LLKQTCLRRKNFKLIVTSATLEAEK

SEQ ID NO: 2953359 - protein, 21 aa, Entamoeba invadens
LLKQYKVNSSILFGKADQQDR

SEQ ID NO: 2953360 - protein, 20 aa, Entamoeba invadens
LLKRLCVISPEYVQKQNPET

SEQ ID NO: 2953361 - protein, 27 aa, Entamoeba invadens
LLKSFLEKYPKIMFFKTSLQNPDEMKK

SEQ ID NO: 2953362 - protein, 32 aa, Entamoeba invadens
LLKSGKVLLIRRGCDLFESLFVVLNYKKNVPL

SEQ ID NO: 2953363 - protein, 22 aa, Entamoeba invadens
LLKSNCYSYVYGSAMSPIEAKQ

SEQ ID NO: 2953364 - protein, 23 aa, Entamoeba invadens
LLKSTAYGSGLIKYTHHPHVVLT

SEQ ID NO: 2953365 - protein, 23 aa, Entamoeba invadens
LLKSVEPVPSFVGFDKKFYISSL

SEQ ID NO: 2953366 - protein, 17 aa, Entamoeba invadens
LLKTRYGKDLTQDDIQL

SEQ ID NO: 2953367 - protein, 43 aa, Entamoeba invadens
LLKYELRNINAPERIKYVPEEPVLRKEIKVIGTNHLPLNKVQQ

SEQ ID NO: 2953368 - protein, 18 aa, Entamoeba invadens
LLLAALRKSEGLFREMKR

SEQ ID NO: 2953369 - protein, 19 aa, Entamoeba invadens
LLLCSCDYADQGIYTTETF

SEQ ID NO: 2953370 - protein, 19 aa, Entamoeba invadens
LLLEFGYIVFFEKINREGI

SEQ ID NO: 2953371 - protein, 17 aa, Entamoeba invadens
LLLELGFELITKTLSGK

SEQ ID NO: 2953372 - protein, 21 aa, Entamoeba invadens
LLLEMLYRHGKMWCHTLQCCD

SEQ ID NO: 2953373 - protein, 18 aa, Entamoeba invadens
LLLILCLIICSMNNKKMC

SEQ ID NO: 2953374 - protein, 23 aa, Entamoeba invadens
LLLKELQALTALPTATRTTATNI

SEQ ID NO: 2953375 - protein, 23 aa, Entamoeba invadens
LLLKRFGVKCVHISFVAGGEIMV

SEQ ID NO: 2953376 - protein, 18 aa, Entamoeba invadens
LLLKYGASVGQTYKGKPL

SEQ ID NO: 2953377 - protein, 27 aa, Entamoeba invadens
LLLLEVVILCALAFKCEEECFLDVNIL

SEQ ID NO: 2953378 - protein, 21 aa, Entamoeba invadens
LLLMRRLEWISAEESNLEKVR

SEQ ID NO: 2953379 - protein, 17 aa, Entamoeba invadens
LLLNEFDVLLTFVTCNW

SEQ ID NO: 2953380 - protein, 18 aa, Entamoeba invadens
LLLNRSVWLNQWLVFPRF

SEQ ID NO: 2953381 - protein, 17 aa, Entamoeba invadens
LLLPKCLNTCFDFSLLT

SEQ ID NO: 2953382 - protein, 18 aa, Entamoeba invadens
LLLQFCCLLSEFVDQIYD

SEQ ID NO: 2953383 - protein, 17 aa, Entamoeba invadens
LLLQFQDKRFQPIHDLT

SEQ ID NO: 2953384 - protein, 25 aa, Entamoeba invadens
LLLQRSLYLLQCLYNKPFVNVDEVK

SEQ ID NO: 2953385 - protein, 20 aa, Entamoeba invadens
LLLSVAFGYPVDKLNYGNKE

SEQ ID NO: 2953386 - protein, 26 aa, Entamoeba invadens
LLLTNCTDLSLLGKLRSFPNIKKIAI

SEQ ID NO: 2953387 - protein, 19 aa, Entamoeba invadens
LLMDAVCAVLLIESSQNGA

SEQ ID NO: 2953388 - protein, 23 aa, Entamoeba invadens
LLMDLLGVFGFFFETKRVHGKKT

SEQ ID NO: 2953389 - protein, 18 aa, Entamoeba invadens
LLMEVIRMAMPCPEHQIK

SEQ ID NO: 2953390 - protein, 18 aa, Entamoeba invadens
LLMEYRMDKTESFPQSFH

SEQ ID NO: 2953391 - protein, 26 aa, Entamoeba invadens
LLMHIRRALLLFSRYPYTFLANSTMT

SEQ ID NO: 2953392 - protein, 27 aa, Entamoeba invadens
LLMKLPFNHLFDFLGVCMEPISVENVC

SEQ ID NO: 2953393 - protein, 17 aa, Entamoeba invadens
LLMKYRGCRGIALQETY

SEQ ID NO: 2953394 - protein, 17 aa, Entamoeba invadens
LLMNVPEIVPFRFTLNI

SEQ ID NO: 2953395 - protein, 18 aa, Entamoeba invadens
LLMRFTRNEFDAEKKSTI

SEQ ID NO: 2953396 - protein, 24 aa, Entamoeba invadens
LLMSLKSPFFYQANTYKKIKEVDI

SEQ ID NO: 2953397 - protein, 18 aa, Entamoeba invadens
LLNALKLVHKRLEDIKMV

SEQ ID NO: 2953398 - protein, 18 aa, Entamoeba invadens
LLNCLIFVMTPEFKVDCP

SEQ ID NO: 2953399 - protein, 25 aa, Entamoeba invadens
LLNEKREKCPLLFKNIIKNFESRMS

SEQ ID NO: 2953400 - protein, 21 aa, Entamoeba invadens
LLNGFACEFEILITPKCSSTI

SEQ ID NO: 2953401 - protein, 17 aa, Entamoeba invadens
LLNIFGFVPSEKGSDKF

SEQ ID NO: 2953402 - protein, 23 aa, Entamoeba invadens
LLNIIKSSFPFLINNEDTVRVLS

SEQ ID NO: 2953403 - protein, 21 aa, Entamoeba invadens
LLNIKFKIVLKSPLKKAKVTQ

SEQ ID NO: 2953404 - protein, 21 aa, Entamoeba invadens
LLNIPLRVGVVVEDTETSPFL

SEQ ID NO: 2953405 - protein, 25 aa, Entamoeba invadens
LLNKGDCVKMKKKAIKREKKRKTAV

SEQ ID NO: 2953406 - protein, 18 aa, Entamoeba invadens
LLNLCEFIEREGIKVPIN

SEQ ID NO: 2953407 - protein, 19 aa, Entamoeba invadens
LLNLHLRYFTPTEIKRIHG

SEQ ID NO: 2953408 - protein, 18 aa, Entamoeba invadens
LLNLISMNPIPVSQVVDI

SEQ ID NO: 2953409 - protein, 32 aa, Entamoeba invadens
LLNNEGELGIPEMIGLNLLLQCLDMYEKEIFE

SEQ ID NO: 2953410 - protein, 18 aa, Entamoeba invadens
LLNNEPIFVYGLLDQGYW

SEQ ID NO: 2953411 - protein, 22 aa, Entamoeba invadens
LLNNPRIVLSQETFRNVTGVMR

SEQ ID NO: 2953412 - protein, 18 aa, Entamoeba invadens
LLNRCIEVVLSTPDYDVR

SEQ ID NO: 2953413 - protein, 18 aa, Entamoeba invadens
LLNRRPHFDANRFAVPNC

SEQ ID NO: 2953414 - protein, 21 aa, Entamoeba invadens
LLNSIGFSFEFRRPERYALKT

SEQ ID NO: 2953415 - protein, 25 aa, Entamoeba invadens
LLNSLKEPVPFLLLMTRHDIYPFTT

SEQ ID NO: 2953416 - protein, 18 aa, Entamoeba invadens
LLNVAYYFQSFDDIKNLV

SEQ ID NO: 2953417 - protein, 21 aa, Entamoeba invadens
LLNVEQFYNYKMINPRDITDN

SEQ ID NO: 2953418 - protein, 17 aa, Entamoeba invadens
LLPEHKDMYKAAVEADP

SEQ ID NO: 2953419 - protein, 17 aa, Entamoeba invadens
LLPEWITPQNELHHVYI

SEQ ID NO: 2953420 - protein, 26 aa, Entamoeba invadens
LLPHQRVAIKWLWEHHNDTKIHGCIL

SEQ ID NO: 2953421 - protein, 18 aa, Entamoeba invadens
LLPKCLQTSFNFTSLTTI

SEQ ID NO: 2953422 - protein, 25 aa, Entamoeba invadens
LLPKEGYVVPDFQMRDFMLCLISDC

SEQ ID NO: 2953423 - protein, 25 aa, Entamoeba invadens
LLPKSDVFMAFYFHYTKFIYFTVKE

SEQ ID NO: 2953424 - protein, 18 aa, Entamoeba invadens
LLPLKPSQPVGVLIKNTQ

SEQ ID NO: 2953425 - protein, 18 aa, Entamoeba invadens
LLPNLLVEVCESAFENCC

SEQ ID NO: 2953426 - protein, 17 aa, Entamoeba invadens
LLPNPILRDTTMDVFCS

SEQ ID NO: 2953427 - protein, 23 aa, Entamoeba invadens
LLPSGELKKGFKKVLQQSTEEID

SEQ ID NO: 2953428 - protein, 17 aa, Entamoeba invadens
LLPSLFVLALPRSGSTF

SEQ ID NO: 2953429 - protein, 33 aa, Entamoeba invadens
LLPSTMKITCEIAGPKIKLPINMDAVDFLQINM

SEQ ID NO: 2953430 - protein, 17 aa, Entamoeba invadens
LLPTIMERISNFESTLL

SEQ ID NO: 2953431 - protein, 17 aa, Entamoeba invadens
LLPTLIVYRNTNHVKQF

SEQ ID NO: 2953432 - protein, 22 aa, Entamoeba invadens
LLPYAMSALCRLVDSPTKAIHP

SEQ ID NO: 2953433 - protein, 24 aa, Entamoeba invadens
LLPYFRRSLEEFNFTVDDCPVFDG

SEQ ID NO: 2953434 - protein, 24 aa, Entamoeba invadens
LLPYQKMFFMYKFTVYSVSFGQWE

SEQ ID NO: 2953435 - protein, 20 aa, Entamoeba invadens
LLQHFAELDTNFSIQISKIN

SEQ ID NO: 2953436 - protein, 17 aa, Entamoeba invadens
LLQIAPHQVKIGFTTGF

SEQ ID NO: 2953437 - protein, 18 aa, Entamoeba invadens
LLQIPKFVKSISLNKEFV

SEQ ID NO: 2953438 - protein, 19 aa, Entamoeba invadens
LLQIPKFVKSISLNKEFVP

SEQ ID NO: 2953439 - protein, 18 aa, Entamoeba invadens
LLQKAGINFSEFKKSGIL

SEQ ID NO: 2953440 - protein, 24 aa, Entamoeba invadens
LLQKEKPMLFKNFNLLFKTSYIRF

SEQ ID NO: 2953441 - protein, 26 aa, Entamoeba invadens
LLQKGIPTWINRMAWYGNKYQEYFGT

SEQ ID NO: 2953442 - protein, 20 aa, Entamoeba invadens
LLQKSMRAITSMLSSDTIPF

SEQ ID NO: 2953443 - protein, 24 aa, Entamoeba invadens
LLQLRPSFEFTKDFRIKSRSQFCR

SEQ ID NO: 2953444 - protein, 17 aa, Entamoeba invadens
LLQNLVMISLSNTIEPS

SEQ ID NO: 2953445 - protein, 30 aa, Entamoeba invadens
LLQQPEMCYCVPPRLVVWRMEKVNREMFEV

SEQ ID NO: 2953446 - protein, 23 aa, Entamoeba invadens
LLQREKWSLVKIIDQKSYKVDEN

SEQ ID NO: 2953447 - protein, 19 aa, Entamoeba invadens
LLQRLKSGVYGDIYENLQD

SEQ ID NO: 2953448 - protein, 25 aa, Entamoeba invadens
LLQSGWRVAPYYPIIEGSVVEKQKK

SEQ ID NO: 2953449 - protein, 23 aa, Entamoeba invadens
LLQVSRLLIEFNMKQFITQILGL

SEQ ID NO: 2953450 - protein, 19 aa, Entamoeba invadens
LLRAVKCPVGQNVNDWVAV

SEQ ID NO: 2953451 - protein, 23 aa, Entamoeba invadens
LLREMSLTFSPQVVQFITENYRF

SEQ ID NO: 2953452 - protein, 24 aa, Entamoeba invadens
LLRGIIPILERWLGNLLARQFEGR

SEQ ID NO: 2953453 - protein, 18 aa, Entamoeba invadens
LLRILPKHIKNIVIGLST

SEQ ID NO: 2953454 - protein, 17 aa, Entamoeba invadens
LLRKCNHTASKVLTDPK

SEQ ID NO: 2953455 - protein, 25 aa, Entamoeba invadens
LLRKIGVPCGDTLPDVIIAAGSIGC

SEQ ID NO: 2953456 - protein, 20 aa, Entamoeba invadens
LLRKNIKIIPHIFESITSCE

SEQ ID NO: 2953457 - protein, 24 aa, Entamoeba invadens
LLRPPEVFLSILLTKPHLYKQVAY

SEQ ID NO: 2953458 - protein, 18 aa, Entamoeba invadens
LLRPRVRPVRLAESALGA

SEQ ID NO: 2953459 - protein, 21 aa, Entamoeba invadens
LLRQFASLMVDGDRQISVGFI

SEQ ID NO: 2953460 - protein, 24 aa, Entamoeba invadens
LLRQRSVRFIQLFSKNVTELLEGR

SEQ ID NO: 2953461 - protein, 18 aa, Entamoeba invadens
LLRRGASSPALLQRLQRD

SEQ ID NO: 2953462 - protein, 25 aa, Entamoeba invadens
LLRSICLECFTLKASQQTLLGVAIE

SEQ ID NO: 2953463 - protein, 18 aa, Entamoeba invadens
LLRSLPLSCYIDKVISKS

SEQ ID NO: 2953464 - protein, 18 aa, Entamoeba invadens
LLRVKVRSVYSYLDSLIP

SEQ ID NO: 2953465 - protein, 19 aa, Entamoeba invadens
LLSDLPFGENMTVLCVMNG

SEQ ID NO: 2953466 - protein, 21 aa, Entamoeba invadens
LLSDNEFISSLILSPRKGQKV

SEQ ID NO: 2953467 - protein, 17 aa, Entamoeba invadens
LLSEEDLSLALMKNVGS

SEQ ID NO: 2953468 - protein, 20 aa, Entamoeba invadens
LLSEPSCSVGEVVRAVGKDK

SEQ ID NO: 2953469 - protein, 18 aa, Entamoeba invadens
LLSFCEVPFVASIVKMLS

SEQ ID NO: 2953470 - protein, 26 aa, Entamoeba invadens
LLSGFLEKQYHQFSGLLNYVHKDENR

SEQ ID NO: 2953471 - protein, 18 aa, Entamoeba invadens
LLSGTLKSVVAMIKAKLN

SEQ ID NO: 2953472 - protein, 21 aa, Entamoeba invadens
LLSHFLGSLDFEYYQQYTRNV

SEQ ID NO: 2953473 - protein, 18 aa, Entamoeba invadens
LLSHSFYFLIFETNILFI

SEQ ID NO: 2953474 - protein, 19 aa, Entamoeba invadens
LLSHVFKAPSFEFEQKKTT

SEQ ID NO: 2953475 - protein, 18 aa, Entamoeba invadens
LLSKLSFPKKFLLEKDTQ

SEQ ID NO: 2953476 - protein, 17 aa, Entamoeba invadens
LLSKPRILEALLKVCRD

SEQ ID NO: 2953477 - protein, 32 aa, Entamoeba invadens
LLSKRCEMCGQRMCKKCCLKGFVLNFNNNQRT

SEQ ID NO: 2953478 - protein, 29 aa, Entamoeba invadens
LLSLEMLKNAFSTFRINLVLDLKANKERM

SEQ ID NO: 2953479 - protein, 18 aa, Entamoeba invadens
LLSLLLLYGANVHAENKN

SEQ ID NO: 2953480 - protein, 22 aa, Entamoeba invadens
LLSLSFKTPFTFGTNSETGSGS

SEQ ID NO: 2953481 - protein, 25 aa, Entamoeba invadens
LLSLVRYQFMKSFVLISFQYIDHFM

SEQ ID NO: 2953482 - protein, 19 aa, Entamoeba invadens
LLSMRAFKKKLQRLENRKE

SEQ ID NO: 2953483 - protein, 18 aa, Entamoeba invadens
LLSNGINAVRWVGGVELE

SEQ ID NO: 2953484 - protein, 17 aa, Entamoeba invadens
LLSNTVDLVRVFKEQRK

SEQ ID NO: 2953485 - protein, 17 aa, Entamoeba invadens
LLSNVKLFEISFIQKQT

SEQ ID NO: 2953486 - protein, 17 aa, Entamoeba invadens
LLSQFLVEMDGLKETKI

SEQ ID NO: 2953487 - protein, 20 aa, Entamoeba invadens
  misc_feature (20)..(20): Xaa can be any naturally occurring amino acid
LLSRCHGYRISLRHHSPRDX

SEQ ID NO: 2953488 - protein, 17 aa, Entamoeba invadens
LLSRIGVTRAVGGTHFT

SEQ ID NO: 2953489 - protein, 26 aa, Entamoeba invadens
LLSRKKIFKQWGCEDVDTYLYTLARV

SEQ ID NO: 2953490 - protein, 17 aa, Entamoeba invadens
LLSRYGYINNRFVLTLE

SEQ ID NO: 2953491 - protein, 18 aa, Entamoeba invadens
LLSSESIFTMQAVDENDS

SEQ ID NO: 2953492 - protein, 17 aa, Entamoeba invadens
LLSSGLFELMEFTLQKQ

SEQ ID NO: 2953493 - protein, 27 aa, Entamoeba invadens
LLSSKAGGCGLNLIGGANLVMFDPDWN

SEQ ID NO: 2953494 - protein, 18 aa, Entamoeba invadens
LLSSVFRKEMASLMERHV

SEQ ID NO: 2953495 - protein, 18 aa, Entamoeba invadens
LLSTCQSSILSSLLSDES

SEQ ID NO: 2953496 - protein, 33 aa, Entamoeba invadens
LLSTSTKKKSGWRFPIPLYRSIEYIKKKEGLKE

SEQ ID NO: 2953497 - protein, 18 aa, Entamoeba invadens
LLSVLCILLSSLNYRVLV

SEQ ID NO: 2953498 - protein, 17 aa, Entamoeba invadens
LLSYYNEKKKLVLIMTT

SEQ ID NO: 2953499 - protein, 19 aa, Entamoeba invadens
LLTCDGRDPLFSFTTSFFK

SEQ ID NO: 2953500 - protein, 19 aa, Entamoeba invadens
LLTEEEMMTFFGCSEVIPK

SEQ ID NO: 2953501 - protein, 24 aa, Entamoeba invadens
LLTEFRMKHCCSKDVVLPTNLQLL

SEQ ID NO: 2953502 - protein, 19 aa, Entamoeba invadens
LLTELTVRKILKKCATFNR

SEQ ID NO: 2953503 - protein, 33 aa, Entamoeba invadens
LLTENQRRLWLKYFDENGIRVLFYSALKENKEI

SEQ ID NO: 2953504 - protein, 28 aa, Entamoeba invadens
LLTFERVAICGFKNTYIFSTEASFQPNN

SEQ ID NO: 2953505 - protein, 18 aa, Entamoeba invadens
LLTFLQMSDIQFKQDVVV

SEQ ID NO: 2953506 - protein, 22 aa, Entamoeba invadens
LLTGKCRLFDIGLPPSLVLHFE

SEQ ID NO: 2953507 - protein, 17 aa, Entamoeba invadens
LLTGYGFAVKPAQNQIL

SEQ ID NO: 2953508 - protein, 24 aa, Entamoeba invadens
LLTHPRGSLLFEKFIPYFTKDQIN

SEQ ID NO: 2953509 - protein, 26 aa, Entamoeba invadens
LLTIEVVKEFTGFFYITVTFENYRTE

SEQ ID NO: 2953510 - protein, 22 aa, Entamoeba invadens
LLTKTRRNGLVYYFSLLLGTSY

SEQ ID NO: 2953511 - protein, 23 aa, Entamoeba invadens
LLTKYYAMSKLRLDIYEKDVSLD

SEQ ID NO: 2953512 - protein, 17 aa, Entamoeba invadens
LLTLLSQNMLAEFHTQI

SEQ ID NO: 2953513 - protein, 24 aa, Entamoeba invadens
LLTLPSMVFFFGMNVNQSITVVPC

SEQ ID NO: 2953514 - protein, 19 aa, Entamoeba invadens
LLTLVPFILSQSFDKLPPL

SEQ ID NO: 2953515 - protein, 19 aa, Entamoeba invadens
LLTNTRLSLLVFEDNNNKV

SEQ ID NO: 2953516 - protein, 19 aa, Entamoeba invadens
LLTPEYVVEFFLRGIESVQ

SEQ ID NO: 2953517 - protein, 18 aa, Entamoeba invadens
LLTPFVWQQILIPVLPMF

SEQ ID NO: 2953518 - protein, 17 aa, Entamoeba invadens
LLTQLWKDFGDYAQAMC

SEQ ID NO: 2953519 - protein, 22 aa, Entamoeba invadens
LLTQNCVLFTCLDKEAQKYHPK

SEQ ID NO: 2953520 - protein, 23 aa, Entamoeba invadens
LLTRKPSAPIRKKSSRVLSVQSD

SEQ ID NO: 2953521 - protein, 17 aa, Entamoeba invadens
LLTRTGLGVVLRLETQN

SEQ ID NO: 2953522 - protein, 17 aa, Entamoeba invadens
LLTSEVESLLNVREMNA

SEQ ID NO: 2953523 - protein, 17 aa, Entamoeba invadens
LLTSQILFRGMTTSDQL

SEQ ID NO: 2953524 - protein, 17 aa, Entamoeba invadens
LLTSQSVSPSFEKSQSH

SEQ ID NO: 2953525 - protein, 18 aa, Entamoeba invadens
LLTSVFLEIASAAEKMDL

SEQ ID NO: 2953526 - protein, 25 aa, Entamoeba invadens
LLTTELSMPCGMKRVKVVKSDKNSL

SEQ ID NO: 2953527 - protein, 18 aa, Entamoeba invadens
LLTYCRESLEYSSDVMCF

SEQ ID NO: 2953528 - protein, 29 aa, Entamoeba invadens
LLVAGYMEVVRVFDLRKMQTLALITEAHS

SEQ ID NO: 2953529 - protein, 17 aa, Entamoeba invadens
LLVCCSMFKDTSIKPSL

SEQ ID NO: 2953530 - protein, 24 aa, Entamoeba invadens
LLVESAWCVGEYCYYLTSEDTLST

SEQ ID NO: 2953531 - protein, 23 aa, Entamoeba invadens
LLVHCVGEMNALISLRKKHNTNF

SEQ ID NO: 2953532 - protein, 19 aa, Entamoeba invadens
LLVKELMFDLVILRITVML

SEQ ID NO: 2953533 - protein, 42 aa, Entamoeba invadens
LLVKHEVINIFAIKWIKMMFAREFLLNDVVIIWDSLFAFGKK

SEQ ID NO: 2953534 - protein, 18 aa, Entamoeba invadens
LLVKKYVESVGIEETGAK

SEQ ID NO: 2953535 - protein, 24 aa, Entamoeba invadens
LLVKLPFCHLFDFFAVSLDPNQVD

SEQ ID NO: 2953536 - protein, 25 aa, Entamoeba invadens
LLVKLSDAMILRFAIPSRKMTKKDL

SEQ ID NO: 2953537 - protein, 17 aa, Entamoeba invadens
LLVKPETAMTWEKVLDF

SEQ ID NO: 2953538 - protein, 18 aa, Entamoeba invadens
LLVLPEFFKSFLEGDTME

SEQ ID NO: 2953539 - protein, 20 aa, Entamoeba invadens
LLVNCSINLISLELENIYGD

SEQ ID NO: 2953540 - protein, 17 aa, Entamoeba invadens
LLVNGKDNVVWMVDPLM

SEQ ID NO: 2953541 - protein, 18 aa, Entamoeba invadens
LLVNVPKMLLAVTNQISA

SEQ ID NO: 2953542 - protein, 19 aa, Entamoeba invadens
LLVSLFIDKPSNEDRLDPG

SEQ ID NO: 2953543 - protein, 22 aa, Entamoeba invadens
LLWCEADIYYGFDMLMMRIQDH

SEQ ID NO: 2953544 - protein, 18 aa, Entamoeba invadens
LLWSMACHLHLLVVEKNN

SEQ ID NO: 2953545 - protein, 23 aa, Entamoeba invadens
LLYDEWSSPVVPIEKWTMNYPLG

SEQ ID NO: 2953546 - protein, 23 aa, Entamoeba invadens
LLYDMPDLKAVPYVAQKPITFRS

SEQ ID NO: 2953547 - protein, 24 aa, Entamoeba invadens
LLYFFFKELQKIGGETNYEVDSEN

SEQ ID NO: 2953548 - protein, 19 aa, Entamoeba invadens
LLYHRRQDIITGKVTPFLE

SEQ ID NO: 2953549 - protein, 19 aa, Entamoeba invadens
LLYKDERIKLINLAKTLFL

SEQ ID NO: 2953550 - protein, 21 aa, Entamoeba invadens
LLYKMIEMLGMPPNEMLERGS

SEQ ID NO: 2953551 - protein, 24 aa, Entamoeba invadens
LLYKNEFYSALYISSMPEFGSTKN

SEQ ID NO: 2953552 - protein, 23 aa, Entamoeba invadens
LLYLFKKYILFGSVPENAHLTGE

SEQ ID NO: 2953553 - protein, 17 aa, Entamoeba invadens
LLYNLVILCRVIGSHVD

SEQ ID NO: 2953554 - protein, 18 aa, Entamoeba invadens
LLYPELPPSEFSDFVIKA

SEQ ID NO: 2953555 - protein, 25 aa, Entamoeba invadens
LLYSFRSVRKFAPYIKNYFLVTDDQ

SEQ ID NO: 2953556 - protein, 17 aa, Entamoeba invadens
LLYTLLISTKMAVGLIR

SEQ ID NO: 2953557 - protein, 18 aa, Entamoeba invadens
LLYVGVLKWIAMSFPKQL

SEQ ID NO: 2953558 - protein, 17 aa, Entamoeba invadens
LLYVVGEGKQFVFVCEM

SEQ ID NO: 2953559 - protein, 18 aa, Entamoeba invadens
LMAQFLIDNGFDILFTIG

SEQ ID NO: 2953560 - protein, 19 aa, Entamoeba invadens
LMCDTSCLTSVAFANKQNS

SEQ ID NO: 2953561 - protein, 25 aa, Entamoeba invadens
LMCESQKFPYCLDVNKMNDASKTVE

SEQ ID NO: 2953562 - protein, 17 aa, Entamoeba invadens
LMCGEQKGGMPMAKGVD

SEQ ID NO: 2953563 - protein, 30 aa, Entamoeba invadens
LMCLSRDYCVLLRFYEDRAECLFEQKSEGS

SEQ ID NO: 2953564 - protein, 17 aa, Entamoeba invadens
LMDAVVSALPEWWQNQK

SEQ ID NO: 2953565 - protein, 22 aa, Entamoeba invadens
LMDEFLKFRCVEQMEQDMSEGV

SEQ ID NO: 2953566 - protein, 24 aa, Entamoeba invadens
LMDEYYPRFKLNKEHLVEQNIPDG

SEQ ID NO: 2953567 - protein, 20 aa, Entamoeba invadens
LMDIRYLQLLGVMKQLLETK

SEQ ID NO: 2953568 - protein, 21 aa, Entamoeba invadens
LMDKYSQYAFRCGSDIDKRHR

SEQ ID NO: 2953569 - protein, 22 aa, Entamoeba invadens
LMDLLQEFGYLFEVVSTKGRNG

SEQ ID NO: 2953570 - protein, 25 aa, Entamoeba invadens
LMDMIKYKIDIPNTWSEGPDFGETV

SEQ ID NO: 2953571 - protein, 20 aa, Entamoeba invadens
LMDRYLLVKGLGKGSFGQVI

SEQ ID NO: 2953572 - protein, 17 aa, Entamoeba invadens
LMDSYGPMILLITDISG

SEQ ID NO: 2953573 - protein, 26 aa, Entamoeba invadens
LMDYLRLSLKPTMEMILKQDSRRLSV

SEQ ID NO: 2953574 - protein, 26 aa, Entamoeba invadens
LMEEQPLLVSRCVKAMPEAREPRYVI

SEQ ID NO: 2953575 - protein, 22 aa, Entamoeba invadens
LMEGGYLYLRRSYFDAEVMSGK

SEQ ID NO: 2953576 - protein, 22 aa, Entamoeba invadens
LMEGKRIIEWTRVIHGIVDSNN

SEQ ID NO: 2953577 - protein, 19 aa, Entamoeba invadens
LMEIKQRILNDSVNDANKH

SEQ ID NO: 2953578 - protein, 18 aa, Entamoeba invadens
LMEKHFKALQFWTKLNHF

SEQ ID NO: 2953579 - protein, 23 aa, Entamoeba invadens
LMELDLRGTRFGSVFNLKEVTSL

SEQ ID NO: 2953580 - protein, 23 aa, Entamoeba invadens
LMENFRRAIGLKMKEVKDVYIGE

SEQ ID NO: 2953581 - protein, 18 aa, Entamoeba invadens
LMFEGATFESRIGAWYFG

SEQ ID NO: 2953582 - protein, 20 aa, Entamoeba invadens
LMFKQCSKLVTITVENTPEN

SEQ ID NO: 2953583 - protein, 23 aa, Entamoeba invadens
LMFMACSIDGFVGFFKLTEAEVG

SEQ ID NO: 2953584 - protein, 18 aa, Entamoeba invadens
LMFPELLAVLKTYKKKEV

SEQ ID NO: 2953585 - protein, 18 aa, Entamoeba invadens
LMFSSCLVDLKLQNVCFV

SEQ ID NO: 2953586 - protein, 20 aa, Entamoeba invadens
LMGDDFYKNLQFLKMEMAYV

SEQ ID NO: 2953587 - protein, 23 aa, Entamoeba invadens
LMIARCSCPLLKVKVAEEQLKNT

SEQ ID NO: 2953588 - protein, 18 aa, Entamoeba invadens
LMISRAFGDTQFKKGNNP

SEQ ID NO: 2953589 - protein, 20 aa, Entamoeba invadens
LMKAKVPYFDEFVLFCSEEE

SEQ ID NO: 2953590 - protein, 24 aa, Entamoeba invadens
LMKCKRINEIGARNLLIDYSQGRG

SEQ ID NO: 2953591 - protein, 22 aa, Entamoeba invadens
LMKEENIHWLLMKNTEIYRNNF

SEQ ID NO: 2953592 - protein, 18 aa, Entamoeba invadens
LMKEMKGAMNTSKGELVI

SEQ ID NO: 2953593 - protein, 18 aa, Entamoeba invadens
LMKERISKTILMTFGTAS

SEQ ID NO: 2953594 - protein, 20 aa, Entamoeba invadens
LMKESWKEILGLANKISLTL

SEQ ID NO: 2953595 - protein, 27 aa, Entamoeba invadens
LMKHKTCIEIDMKLRVKYMIDAAKGIS

SEQ ID NO: 2953596 - protein, 18 aa, Entamoeba invadens
LMKISCSSLSNLKKWGDE

SEQ ID NO: 2953597 - protein, 30 aa, Entamoeba invadens
LMKKIIKMCGGEVRILYPIVPYKVVENNEV

SEQ ID NO: 2953598 - protein, 25 aa, Entamoeba invadens
LMKKMSREYFGFIGSLSDVRDTLDG

SEQ ID NO: 2953599 - protein, 26 aa, Entamoeba invadens
LMKKSVPQDTTRYILAKMREQNPEYF

SEQ ID NO: 2953600 - protein, 18 aa, Entamoeba invadens
LMKLEASDPFLGADASIK

SEQ ID NO: 2953601 - protein, 20 aa, Entamoeba invadens
LMKLPFNYFFDLMAVSMEPI

SEQ ID NO: 2953602 - protein, 32 aa, Entamoeba invadens
LMKRRECVRLLQDLLVEFGFIVCFEKETVDGF

SEQ ID NO: 2953603 - protein, 25 aa, Entamoeba invadens
LMKRVDKSACPWYDGPSLVELLDSI

SEQ ID NO: 2953604 - protein, 26 aa, Entamoeba invadens
LMKSHVAMVQDVQWHPLSPYLFASAA

SEQ ID NO: 2953605 - protein, 17 aa, Entamoeba invadens
LMKSVTSSGAFLKKNYV

SEQ ID NO: 2953606 - protein, 25 aa, Entamoeba invadens
LMKTFRWSYETALNHTVKCRPIICP

SEQ ID NO: 2953607 - protein, 21 aa, Entamoeba invadens
LMKTVCGYCSSSEKRNKNVEL

SEQ ID NO: 2953608 - protein, 18 aa, Entamoeba invadens
LMLFGNWFVGKSSLQLRF

SEQ ID NO: 2953609 - protein, 31 aa, Entamoeba invadens
LMLFKREFKRNLVLRLWDAFFAFPDERLFMF

SEQ ID NO: 2953610 - protein, 18 aa, Entamoeba invadens
LMLLRHWTLYDSLFHTRE

SEQ ID NO: 2953611 - protein, 20 aa, Entamoeba invadens
LMLMDQCLRRIEFVHKKGWI

SEQ ID NO: 2953612 - protein, 26 aa, Entamoeba invadens
LMLPIWRRLVWHGGYSIEIEEQSYLT

SEQ ID NO: 2953613 - protein, 23 aa, Entamoeba invadens
LMLPWNHLEFDWMLLHHKMVPFV

SEQ ID NO: 2953614 - protein, 17 aa, Entamoeba invadens
LMLRKSLVNEFLLKDLK

SEQ ID NO: 2953615 - protein, 18 aa, Entamoeba invadens
LMMDCAIMLKLAACNNYI

SEQ ID NO: 2953616 - protein, 24 aa, Entamoeba invadens
LMMYCKAVGCKKAITADLTNSEKV

SEQ ID NO: 2953617 - protein, 17 aa, Entamoeba invadens
LMNETLFSYLLLKSSDS

SEQ ID NO: 2953618 - protein, 24 aa, Entamoeba invadens
LMNGRLIACQAPIPTTVEDFLEMI

SEQ ID NO: 2953619 - protein, 22 aa, Entamoeba invadens
LMNIKAKIVFGAALPGCKYISK

SEQ ID NO: 2953620 - protein, 20 aa, Entamoeba invadens
LMNRVSRLHLVLGEKRLTHL

SEQ ID NO: 2953621 - protein, 19 aa, Entamoeba invadens
LMNSFDIQPALLGYDKEND

SEQ ID NO: 2953622 - protein, 22 aa, Entamoeba invadens
LMPCLFAIEGVHHIIVCGGTHT

SEQ ID NO: 2953623 - protein, 17 aa, Entamoeba invadens
LMPDPRRIDPFPREPPL

SEQ ID NO: 2953624 - protein, 24 aa, Entamoeba invadens
LMPELKGKGLGSILMGKVKTFAHD

SEQ ID NO: 2953625 - protein, 30 aa, Entamoeba invadens
LMPKAERSIGTSFRCGETLSDITSKHIIAL

SEQ ID NO: 2953626 - protein, 29 aa, Entamoeba invadens
LMPLPLPKRYGTILRLCIQNFDKKRGLFL

SEQ ID NO: 2953627 - protein, 17 aa, Entamoeba invadens
LMPPGMLPPPGLAPPGG

SEQ ID NO: 2953628 - protein, 17 aa, Entamoeba invadens
LMPPGMMPPPGLAPPGA

SEQ ID NO: 2953629 - protein, 26 aa, Entamoeba invadens
LMQIEARSLIQYEPFFVEFAIYEVID

SEQ ID NO: 2953630 - protein, 18 aa, Entamoeba invadens
LMQKKVCFERYLEKEVFS

SEQ ID NO: 2953631 - protein, 24 aa, Entamoeba invadens
LMRFEKLGAICRKTFLKDPSQILL

SEQ ID NO: 2953632 - protein, 21 aa, Entamoeba invadens
LMRFGEDVIDIIKSIPPLSQN

SEQ ID NO: 2953633 - protein, 27 aa, Entamoeba invadens
LMRGERYCGSLLFVVHFGKIVMSSSLN

SEQ ID NO: 2953634 - protein, 24 aa, Entamoeba invadens
LMRHLSGKLPVLSVFGSDYDTRDG

SEQ ID NO: 2953635 - protein, 24 aa, Entamoeba invadens
LMSFRLSKRKEYEALVSSQRKNPR

SEQ ID NO: 2953636 - protein, 19 aa, Entamoeba invadens
LMSHAAFSRDILKRAKTLA

SEQ ID NO: 2953637 - protein, 17 aa, Entamoeba invadens
LMSICSCLTNSVEDLEI

SEQ ID NO: 2953638 - protein, 29 aa, Entamoeba invadens
LMSLEVPKHITAIMSYCFAYHSDLISITI

SEQ ID NO: 2953639 - protein, 20 aa, Entamoeba invadens
LMSSDPFVKFEINGKKYKTK

SEQ ID NO: 2953640 - protein, 36 aa, Entamoeba invadens
LMSTMKLYLGRKILRICPLKLNYDIGCILEQKDMGI

SEQ ID NO: 2953641 - protein, 20 aa, Entamoeba invadens
LMSVKEVHKSIAKLYSIIEN

SEQ ID NO: 2953642 - protein, 21 aa, Entamoeba invadens
LMTQPEGIAFNVPVDPDALQI

SEQ ID NO: 2953643 - protein, 22 aa, Entamoeba invadens
LMTRNRYEWYILQFAMERQGII

SEQ ID NO: 2953644 - protein, 25 aa, Entamoeba invadens
LMWVEKKFGEKLSVKSLIDNVKDED

SEQ ID NO: 2953645 - protein, 18 aa, Entamoeba invadens
LMYFLNMFPKPFACSNGI

SEQ ID NO: 2953646 - protein, 24 aa, Entamoeba invadens
LMYILRRIYNAVYLKRGEKEASTC

SEQ ID NO: 2953647 - protein, 26 aa, Entamoeba invadens
LNAEINKANGGKVRYTVGADYKINDR

SEQ ID NO: 2953648 - protein, 25 aa, Entamoeba invadens
LNAEVASICLRNDFEEDYTCQRVGA

SEQ ID NO: 2953649 - protein, 24 aa, Entamoeba invadens
LNAHICGLKNVLFLIFIPNEHPLG

SEQ ID NO: 2953650 - protein, 23 aa, Entamoeba invadens
LNAISCMEWLLQLLKTVKSNEEN

SEQ ID NO: 2953651 - protein, 27 aa, Entamoeba invadens
LNAKHHVAYRMLKKCGNLQELEPLLPQ

SEQ ID NO: 2953652 - protein, 17 aa, Entamoeba invadens
LNALEGFTLIQLLIPQN

SEQ ID NO: 2953653 - protein, 20 aa, Entamoeba invadens
LNAMIYLLAQEGFSVNVLKT

SEQ ID NO: 2953654 - protein, 17 aa, Entamoeba invadens
LNAMWPKDGDSKAEEIW

SEQ ID NO: 2953655 - protein, 19 aa, Entamoeba invadens
LNAPLRYAKPSHFDKVKTV

SEQ ID NO: 2953656 - protein, 19 aa, Entamoeba invadens
LNAPLRYTKLSNFDKVKTV

SEQ ID NO: 2953657 - protein, 26 aa, Entamoeba invadens
LNAQKSLLIDAFRKALNVEGVRDSTK

SEQ ID NO: 2953658 - protein, 18 aa, Entamoeba invadens
LNASCSSVFSNIRKTLFI

SEQ ID NO: 2953659 - protein, 22 aa, Entamoeba invadens
LNASLKRKIAMKDWQRRNLQRQ

SEQ ID NO: 2953660 - protein, 33 aa, Entamoeba invadens
LNAVIWLEHYLMGWKKSLLLVSHDTSFLNNVCD

SEQ ID NO: 2953661 - protein, 17 aa, Entamoeba invadens
LNCACPIDLVCDTGMGA

SEQ ID NO: 2953662 - protein, 19 aa, Entamoeba invadens
LNCDADFLSGEKYSLVNTG

SEQ ID NO: 2953663 - protein, 19 aa, Entamoeba invadens
LNCHGKVHKAQGLTCAYCG

SEQ ID NO: 2953664 - protein, 21 aa, Entamoeba invadens
LNCIPQKLSVNLATGRSQDYL

SEQ ID NO: 2953665 - protein, 22 aa, Entamoeba invadens
LNCNFLPVSFGYLSKPIFIRNY

SEQ ID NO: 2953666 - protein, 17 aa, Entamoeba invadens
LNCNKHKLFYVYDQIGS

SEQ ID NO: 2953667 - protein, 21 aa, Entamoeba invadens
LNCPVHLNLSQIAAVLKTPSQ

SEQ ID NO: 2953668 - protein, 24 aa, Entamoeba invadens
LNDEKRESFEIVEIDNLAKIGGDA

SEQ ID NO: 2953669 - protein, 24 aa, Entamoeba invadens
LNDELKVLPLWGVNPDDPTHTYIP

SEQ ID NO: 2953670 - protein, 18 aa, Entamoeba invadens
LNDFVFLNCISLREIVLS

SEQ ID NO: 2953671 - protein, 34 aa, Entamoeba invadens
LNDGCTFKAWKYWPYSLHCHRLMWYANTVGKGGE

SEQ ID NO: 2953672 - protein, 17 aa, Entamoeba invadens
LNDKRIAVLSSTFESPY

SEQ ID NO: 2953673 - protein, 19 aa, Entamoeba invadens
LNDLFQLWNGMIANKLPSL

SEQ ID NO: 2953674 - protein, 18 aa, Entamoeba invadens
LNDLKTIVCLMLNHCPQS

SEQ ID NO: 2953675 - protein, 18 aa, Entamoeba invadens
LNDLLSIDFSSKKDVKFV

SEQ ID NO: 2953676 - protein, 20 aa, Entamoeba invadens
LNDRIRQYKSGIMRLKEDLS

SEQ ID NO: 2953677 - protein, 25 aa, Entamoeba invadens
LNDVLRNSMHYFKGTALEYTIEDDE

SEQ ID NO: 2953678 - protein, 24 aa, Entamoeba invadens
LNDYKGPLPFYALSLINGKLNVSN

SEQ ID NO: 2953679 - protein, 17 aa, Entamoeba invadens
LNECDGFTLTKISLNEL

SEQ ID NO: 2953680 - protein, 18 aa, Entamoeba invadens
LNECLKITQFKETVESIN

SEQ ID NO: 2953681 - protein, 29 aa, Entamoeba invadens
LNEDGKNWREIYKSLLVLDNVLKNGSEEA

SEQ ID NO: 2953682 - protein, 20 aa, Entamoeba invadens
LNEEIKRLMSSYQNEKQECD

SEQ ID NO: 2953683 - protein, 25 aa, Entamoeba invadens
LNEEIRLGNPVTWSSWFGDDTGHMV

SEQ ID NO: 2953684 - protein, 26 aa, Entamoeba invadens
LNEGLLSIGNYCFKNCTSLTEVELPK

SEQ ID NO: 2953685 - protein, 24 aa, Entamoeba invadens
LNEGLRFQPSFSDTDFNTSIVSTC

SEQ ID NO: 2953686 - protein, 17 aa, Entamoeba invadens
LNEHFAIELLFKERNAV

SEQ ID NO: 2953687 - protein, 23 aa, Entamoeba invadens
LNEKFLRLEPIIFVKGDTKIALY

SEQ ID NO: 2953688 - protein, 19 aa, Entamoeba invadens
LNEKLNLFIKNGFNATTAH

SEQ ID NO: 2953689 - protein, 23 aa, Entamoeba invadens
LNELPRNVFFISVCAKEPRVSSV

SEQ ID NO: 2953690 - protein, 24 aa, Entamoeba invadens
LNELQLQFKVIIKKCEYTTSDNDQ

SEQ ID NO: 2953691 - protein, 23 aa, Entamoeba invadens
LNENCKQFAKLVLDLQAVHTTLY

SEQ ID NO: 2953692 - protein, 17 aa, Entamoeba invadens
LNERMIFSQIVKAVNKE

SEQ ID NO: 2953693 - protein, 26 aa, Entamoeba invadens
LNERSRNLLGWLFNLMIEVSKNRDTN

SEQ ID NO: 2953694 - protein, 21 aa, Entamoeba invadens
LNERVTLFGIEIFGGCYAIDR

SEQ ID NO: 2953695 - protein, 27 aa, Entamoeba invadens
LNETFKFLNVVWTCFSSKENELWDILK

SEQ ID NO: 2953696 - protein, 17 aa, Entamoeba invadens
LNFAIKRCEAIKNEEMV

SEQ ID NO: 2953697 - protein, 28 aa, Entamoeba invadens
LNFASPRLRPADFCATPTAPVLHQEKIA

SEQ ID NO: 2953698 - protein, 19 aa, Entamoeba invadens
LNFETHIPIVMCGNKSDLE

SEQ ID NO: 2953699 - protein, 31 aa, Entamoeba invadens
LNFFPSSDFLAARFMIGWNEYIAVFTLAKMM

SEQ ID NO: 2953700 - protein, 18 aa, Entamoeba invadens
LNFGDYNAAFLIYSALAY

SEQ ID NO: 2953701 - protein, 21 aa, Entamoeba invadens
LNFKNIICAIVKSIGEQNNDH

SEQ ID NO: 2953702 - protein, 22 aa, Entamoeba invadens
LNFKNIICAIVKSIGEQNNDHD

SEQ ID NO: 2953703 - protein, 22 aa, Entamoeba invadens
LNFMEACLFAGTKINPEYINTF

SEQ ID NO: 2953704 - protein, 19 aa, Entamoeba invadens
LNFNSDCLTFIPSSSNYSS

SEQ ID NO: 2953705 - protein, 24 aa, Entamoeba invadens
LNFPESTKFCGIDTLTNCTKLSAL

SEQ ID NO: 2953706 - protein, 24 aa, Entamoeba invadens
LNFPESVNFIGERAFYLCVSLESI

SEQ ID NO: 2953707 - protein, 18 aa, Entamoeba invadens
LNFRCLVESGIVDIEKYD

SEQ ID NO: 2953708 - protein, 30 aa, Entamoeba invadens
LNFSLARAFNALSYTNCFTEIKLRNVKVKE

SEQ ID NO: 2953709 - protein, 18 aa, Entamoeba invadens
LNGARCWENSIYQLPIVI

SEQ ID NO: 2953710 - protein, 18 aa, Entamoeba invadens
LNGCKGCMKCRTHPDQFV

SEQ ID NO: 2953711 - protein, 24 aa, Entamoeba invadens
LNGEEFPSFLTVVPPVVTQTRNTE

SEQ ID NO: 2953712 - protein, 25 aa, Entamoeba invadens
LNGEELVDFLVLRKNVPYVVLRRCV

SEQ ID NO: 2953713 - protein, 23 aa, Entamoeba invadens
LNGELYFIGIIDILMDYTTRKKL

SEQ ID NO: 2953714 - protein, 27 aa, Entamoeba invadens
LNGEVGLARALGDLRCHPALTAEPEVL

SEQ ID NO: 2953715 - protein, 19 aa, Entamoeba invadens
LNGGFAFGGVENIKEVLNI

SEQ ID NO: 2953716 - protein, 25 aa, Entamoeba invadens
LNGLSHPEFTCLFDIKRSLDNMKKL

SEQ ID NO: 2953717 - protein, 17 aa, Entamoeba invadens
LNGTDKFAKEKEAKKLK

SEQ ID NO: 2953718 - protein, 17 aa, Entamoeba invadens
LNGVEYVVKYLKHPFLS

SEQ ID NO: 2953719 - protein, 24 aa, Entamoeba invadens
LNGVLEIWDYVALTKIRSYEIKAS

SEQ ID NO: 2953720 - protein, 21 aa, Entamoeba invadens
LNHCFAGKMYKTAIVTDNKVE

SEQ ID NO: 2953721 - protein, 18 aa, Entamoeba invadens
LNHHLVHYAIKYKIPEMV

SEQ ID NO: 2953722 - protein, 23 aa, Entamoeba invadens
LNHPNILKLLGFFEDSERWFLVL

SEQ ID NO: 2953723 - protein, 24 aa, Entamoeba invadens
LNHRGEVKLADFGISVQLTRSKAK

SEQ ID NO: 2953724 - protein, 18 aa, Entamoeba invadens
LNHVIACLIDAINLKYQN

SEQ ID NO: 2953725 - protein, 19 aa, Entamoeba invadens
LNHVKCVMCNTGYYPNEIG

SEQ ID NO: 2953726 - protein, 30 aa, Entamoeba invadens
LNHVLRWEKPRALVLYNCSLWVTRVVETYA

SEQ ID NO: 2953727 - protein, 17 aa, Entamoeba invadens
LNIANSFVEFVSDPKQF

SEQ ID NO: 2953728 - protein, 17 aa, Entamoeba invadens
LNIETLHLWSREDENFG

SEQ ID NO: 2953729 - protein, 20 aa, Entamoeba invadens
LNIFFCTTHSNTIFRQLIFE

SEQ ID NO: 2953730 - protein, 23 aa, Entamoeba invadens
LNIFLQCCKGIQWVHDKFNIAHN

SEQ ID NO: 2953731 - protein, 17 aa, Entamoeba invadens
LNIFSDVLKTFSVMDEG

SEQ ID NO: 2953732 - protein, 17 aa, Entamoeba invadens
LNIISIGNYCFYECNSF

SEQ ID NO: 2953733 - protein, 19 aa, Entamoeba invadens
LNIKCASTVLVIDVESSLN

SEQ ID NO: 2953734 - protein, 26 aa, Entamoeba invadens
LNIKEIQSTPILLVFTKTDLKPNFTF

SEQ ID NO: 2953735 - protein, 21 aa, Entamoeba invadens
LNIKYCGRLSVINLPQTLTLL

SEQ ID NO: 2953736 - protein, 21 aa, Entamoeba invadens
LNILITMPFPYPPGVLEQLVQ

SEQ ID NO: 2953737 - protein, 20 aa, Entamoeba invadens
LNILKRVFLFIERMTASENS

SEQ ID NO: 2953738 - protein, 17 aa, Entamoeba invadens
LNILSLYQKVVLKNNVM

SEQ ID NO: 2953739 - protein, 17 aa, Entamoeba invadens
LNIPFPVERWTDSVMKT

SEQ ID NO: 2953740 - protein, 19 aa, Entamoeba invadens
LNIPGLVYTTGEVSCQPNV

SEQ ID NO: 2953741 - protein, 33 aa, Entamoeba invadens
LNIPSCDFVAHKGWSFKGSWVGLYVVDRDQDYN

SEQ ID NO: 2953742 - protein, 23 aa, Entamoeba invadens
LNITIRNNFVWGAQFGVGYWGWN

SEQ ID NO: 2953743 - protein, 23 aa, Entamoeba invadens
LNKDLLPTVSFDFLSFELEKLAN

SEQ ID NO: 2953744 - protein, 22 aa, Entamoeba invadens
LNKDLPCEIKRHLFTLDIQSSY

SEQ ID NO: 2953745 - protein, 17 aa, Entamoeba invadens
LNKDVDIDDFFKENKVV

SEQ ID NO: 2953746 - protein, 24 aa, Entamoeba invadens
LNKERCCRGLYGSLNHNIKSQYQL

SEQ ID NO: 2953747 - protein, 20 aa, Entamoeba invadens
LNKFCFYGCNNLKNIVILPS

SEQ ID NO: 2953748 - protein, 18 aa, Entamoeba invadens
LNKFHFTTFVLPEDVKDA

SEQ ID NO: 2953749 - protein, 18 aa, Entamoeba invadens
LNKFKNIRIDTHKDNKKM

SEQ ID NO: 2953750 - protein, 19 aa, Entamoeba invadens
LNKGIKFHKAKNYLQKTNG

SEQ ID NO: 2953751 - protein, 23 aa, Entamoeba invadens
LNKGYNFPSFEIGFTKFIQLSGL

SEQ ID NO: 2953752 - protein, 26 aa, Entamoeba invadens
LNKICGVCGKAVMTMVEISEIGRLVN

SEQ ID NO: 2953753 - protein, 19 aa, Entamoeba invadens
LNKIRKMCFYSCSNLENVV

SEQ ID NO: 2953754 - protein, 18 aa, Entamoeba invadens
LNKLHCITTDGCATMCGV

SEQ ID NO: 2953755 - protein, 18 aa, Entamoeba invadens
LNKLIGYTYKPVGCAVWG

SEQ ID NO: 2953756 - protein, 22 aa, Entamoeba invadens
LNKLKILYFVKGVLPYPEKISS

SEQ ID NO: 2953757 - protein, 17 aa, Entamoeba invadens
LNKLQCIPREFSRLSNL

SEQ ID NO: 2953758 - protein, 23 aa, Entamoeba invadens
LNKPRIILWNSTYIHLNKNITGR

SEQ ID NO: 2953759 - protein, 25 aa, Entamoeba invadens
LNKQANCLLEQLKAFKKEKVDIEAT

SEQ ID NO: 2953760 - protein, 21 aa, Entamoeba invadens
LNKQFLGIGFVDFNEVVSKGK

SEQ ID NO: 2953761 - protein, 20 aa, Entamoeba invadens
LNKSCFKNCYNLVKIEMDEK

SEQ ID NO: 2953762 - protein, 36 aa, Entamoeba invadens
LNKSEPFRTAVDPIYYDVLDYFTIVKDPMDLYTVRK

SEQ ID NO: 2953763 - protein, 28 aa, Entamoeba invadens
LNKVQFCCAVSYLAQCRTIYQLTFDTPA

SEQ ID NO: 2953764 - protein, 19 aa, Entamoeba invadens
LNKYFEFPLALNWNNENME

SEQ ID NO: 2953765 - protein, 24 aa, Entamoeba invadens
LNKYTRLFTILGMKSAFTKDPGFN

SEQ ID NO: 2953766 - protein, 19 aa, Entamoeba invadens
LNLECLGIHQMICNSIRKY

SEQ ID NO: 2953767 - protein, 17 aa, Entamoeba invadens
LNLEFTNNCDVFVNKNC

SEQ ID NO: 2953768 - protein, 29 aa, Entamoeba invadens
LNLFADILFRTKFVLSEKMISEIKGITTF

SEQ ID NO: 2953769 - protein, 19 aa, Entamoeba invadens
LNLFYSCANLEELVISKNV

SEQ ID NO: 2953770 - protein, 25 aa, Entamoeba invadens
LNLIIRAGIYQDFWENTVNLLPRKI

SEQ ID NO: 2953771 - protein, 23 aa, Entamoeba invadens
LNLKIKGCDEVEFIDLTTFTYLN

SEQ ID NO: 2953772 - protein, 21 aa, Entamoeba invadens
LNLKNSLAIRDAWINENPDRA

SEQ ID NO: 2953773 - protein, 21 aa, Entamoeba invadens
LNLKTVWLIGPFYSNYFNTLL

SEQ ID NO: 2953774 - protein, 18 aa, Entamoeba invadens
LNLLISNFPFERIVNSCW

SEQ ID NO: 2953775 - protein, 20 aa, Entamoeba invadens
LNLLLLDILNMFGYTFSTEM

SEQ ID NO: 2953776 - protein, 23 aa, Entamoeba invadens
LNLLTKVYFTFIILREELTGMKI

SEQ ID NO: 2953777 - protein, 17 aa, Entamoeba invadens
LNLLVVFIYVQKQFHNE

SEQ ID NO: 2953778 - protein, 18 aa, Entamoeba invadens
LNLNSELFVKCKNTTFYF

SEQ ID NO: 2953779 - protein, 22 aa, Entamoeba invadens
LNLPECVECFEILPEDTMHSHQ

SEQ ID NO: 2953780 - protein, 24 aa, Entamoeba invadens
LNLPNCLFTRFLRAEVSLDETNFC

SEQ ID NO: 2953781 - protein, 25 aa, Entamoeba invadens
LNLQLPECIKEITFLNTTNVTLAAS

SEQ ID NO: 2953782 - protein, 20 aa, Entamoeba invadens
LNLQMYCGKCGGREENQGFR

SEQ ID NO: 2953783 - protein, 22 aa, Entamoeba invadens
LNLRDLFVLLSRYFNDVVPREG

SEQ ID NO: 2953784 - protein, 20 aa, Entamoeba invadens
LNLREDFIPTIKFSYTNLRS

SEQ ID NO: 2953785 - protein, 18 aa, Entamoeba invadens
LNLSRFVANLHFTPHEVL

SEQ ID NO: 2953786 - protein, 18 aa, Entamoeba invadens
LNLSTAICQCFLPRKNSV

SEQ ID NO: 2953787 - protein, 18 aa, Entamoeba invadens
LNLSVIVGNVSPKVTIED

SEQ ID NO: 2953788 - protein, 18 aa, Entamoeba invadens
LNLSYGVVGIEPFACINK

SEQ ID NO: 2953789 - protein, 27 aa, Entamoeba invadens
LNLVFECLNFRTLQRLRFVNKKIFFLT

SEQ ID NO: 2953790 - protein, 19 aa, Entamoeba invadens
LNLVLFRIFVGGTRLTNFD

SEQ ID NO: 2953791 - protein, 31 aa, Entamoeba invadens
LNLVRSRCLKCQLCSEAWPIRNSLYDTPLSE

SEQ ID NO: 2953792 - protein, 21 aa, Entamoeba invadens
LNLYLVMEFCPGGDLRCLLSH

SEQ ID NO: 2953793 - protein, 19 aa, Entamoeba invadens
LNMECWKQIPFEEIGIQII

SEQ ID NO: 2953794 - protein, 19 aa, Entamoeba invadens
LNMERERYAAAAKFNEESK

SEQ ID NO: 2953795 - protein, 23 aa, Entamoeba invadens
LNMKKEKRKLIIQEMYTTEKTYV

SEQ ID NO: 2953796 - protein, 18 aa, Entamoeba invadens
LNMKREFDYFCTQMPIRG

SEQ ID NO: 2953797 - protein, 30 aa, Entamoeba invadens
LNMLERITAFCFSECFNLSSVVLPTSVIEI

SEQ ID NO: 2953798 - protein, 18 aa, Entamoeba invadens
LNMLKKIGVCVVPGSGFE

SEQ ID NO: 2953799 - protein, 19 aa, Entamoeba invadens
LNMNGCKKVDISGVKEMSE

SEQ ID NO: 2953800 - protein, 17 aa, Entamoeba invadens
LNMPDLASFCFDVKKIK

SEQ ID NO: 2953801 - protein, 18 aa, Entamoeba invadens
LNMPRKLLKEGGLVKQCR

SEQ ID NO: 2953802 - protein, 25 aa, Entamoeba invadens
LNNAICGKENIMIVIVAKDGSVFGS

SEQ ID NO: 2953803 - protein, 23 aa, Entamoeba invadens
LNNCLICIITAVTANMFARIASD

SEQ ID NO: 2953804 - protein, 17 aa, Entamoeba invadens
LNNCLISAFVETRTPAQ

SEQ ID NO: 2953805 - protein, 17 aa, Entamoeba invadens
LNNFALIIQRGFNSLVI

SEQ ID NO: 2953806 - protein, 19 aa, Entamoeba invadens
LNNFEPIFYAIRIRNENSG

SEQ ID NO: 2953807 - protein, 17 aa, Entamoeba invadens
LNNFRLEKELTLDQQHF

SEQ ID NO: 2953808 - protein, 25 aa, Entamoeba invadens
LNNGMSGTTLGGIGGSVGGQAGVSV

SEQ ID NO: 2953809 - protein, 20 aa, Entamoeba invadens
LNNIEEIFQIMSMHAIEDIS

SEQ ID NO: 2953810 - protein, 18 aa, Entamoeba invadens
LNNILAFLRKKLRKSTFF

SEQ ID NO: 2953811 - protein, 17 aa, Entamoeba invadens
LNNKSFINFDHFTITSS

SEQ ID NO: 2953812 - protein, 17 aa, Entamoeba invadens
LNNLEIFEMERNQISEI

SEQ ID NO: 2953813 - protein, 18 aa, Entamoeba invadens
LNNLKIDLLINVVQTEIT

SEQ ID NO: 2953814 - protein, 18 aa, Entamoeba invadens
LNNLKKLHIKTCSRSKFV

SEQ ID NO: 2953815 - protein, 22 aa, Entamoeba invadens
LNNLPNGMIFFFDFGGGTLDTA

SEQ ID NO: 2953816 - protein, 18 aa, Entamoeba invadens
LNNPFYECISLDKFYTLT

SEQ ID NO: 2953817 - protein, 22 aa, Entamoeba invadens
LNNPHTIAFTFVVNAETQTAEI

SEQ ID NO: 2953818 - protein, 17 aa, Entamoeba invadens
LNNSALCQSVFSQLNKF

SEQ ID NO: 2953819 - protein, 17 aa, Entamoeba invadens
LNPGNGILVGFQRIYTE

SEQ ID NO: 2953820 - protein, 20 aa, Entamoeba invadens
LNPIVEYFKDISFNLPYYVP

SEQ ID NO: 2953821 - protein, 19 aa, Entamoeba invadens
LNPKCFKKIFVTLYDLAMV

SEQ ID NO: 2953822 - protein, 17 aa, Entamoeba invadens
LNPKIFLLKEGQADNAF

SEQ ID NO: 2953823 - protein, 26 aa, Entamoeba invadens
LNPKLQPWWIVRTCLTDQEGKVRYTD

SEQ ID NO: 2953824 - protein, 23 aa, Entamoeba invadens
LNPKSVTGWCYIAKASLSLKMMD

SEQ ID NO: 2953825 - protein, 17 aa, Entamoeba invadens
LNPLLNFSRKWKTSSDS

SEQ ID NO: 2953826 - protein, 19 aa, Entamoeba invadens
LNPPITLLNKRTIKSPEEY

SEQ ID NO: 2953827 - protein, 18 aa, Entamoeba invadens
LNPTAALYRICTDDHPPF

SEQ ID NO: 2953828 - protein, 18 aa, Entamoeba invadens
LNPTFSIFENGVISFYEE

SEQ ID NO: 2953829 - protein, 19 aa, Entamoeba invadens
LNQALNFELARKLSCCVPF

SEQ ID NO: 2953830 - protein, 17 aa, Entamoeba invadens
LNQCKDALKEVFEQNET

SEQ ID NO: 2953831 - protein, 27 aa, Entamoeba invadens
LNQEVLRSEALVNHIKGIVTTEITPLR

SEQ ID NO: 2953832 - protein, 17 aa, Entamoeba invadens
LNQFACRTVEPIGEMER

SEQ ID NO: 2953833 - protein, 17 aa, Entamoeba invadens
LNQFISIGVADIYEHMK

SEQ ID NO: 2953834 - protein, 18 aa, Entamoeba invadens
LNQIRFSKDPNLKQAKEM

SEQ ID NO: 2953835 - protein, 19 aa, Entamoeba invadens
LNQLPWRRVNVNFRTKSPD

SEQ ID NO: 2953836 - protein, 24 aa, Entamoeba invadens
LNQSQRAYKMLEWENKTVVDDLFK

SEQ ID NO: 2953837 - protein, 21 aa, Entamoeba invadens
LNQYLLRIALMNASVSTGGAN

SEQ ID NO: 2953838 - protein, 25 aa, Entamoeba invadens
LNREFFRIIVWFNVDFETFDRNKSR

SEQ ID NO: 2953839 - protein, 19 aa, Entamoeba invadens
LNREFIVRLEDLFSKTEIH

SEQ ID NO: 2953840 - protein, 18 aa, Entamoeba invadens
LNREVKMILISEGGVVET

SEQ ID NO: 2953841 - protein, 17 aa, Entamoeba invadens
LNRFEEIVKGYFEKGEK

SEQ ID NO: 2953842 - protein, 17 aa, Entamoeba invadens
LNRHEFEIIAKHTPNDF

SEQ ID NO: 2953843 - protein, 18 aa, Entamoeba invadens
LNRIKRYKELSAKRESGE

SEQ ID NO: 2953844 - protein, 20 aa, Entamoeba invadens
LNRKKDFSLFSFKMTSDFGI

SEQ ID NO: 2953845 - protein, 20 aa, Entamoeba invadens
LNRLLRLVMDPLLADYITAK

SEQ ID NO: 2953846 - protein, 21 aa, Entamoeba invadens
LNRLNTISMHFDKTVETTVTM

SEQ ID NO: 2953847 - protein, 19 aa, Entamoeba invadens
LNRMPKPLIGNLIHEMNKP

SEQ ID NO: 2953848 - protein, 23 aa, Entamoeba invadens
LNRMPRPMCGPFKKTIIYTEAPF

SEQ ID NO: 2953849 - protein, 25 aa, Entamoeba invadens
LNRTLRSLLKFSIKGVLCDEVILTD

SEQ ID NO: 2953850 - protein, 19 aa, Entamoeba invadens
LNRVLPVIINSGLYAKEGT

SEQ ID NO: 2953851 - protein, 19 aa, Entamoeba invadens
LNRVLSCGIKTYNNKKYNI

SEQ ID NO: 2953852 - protein, 18 aa, Entamoeba invadens
LNRYCSFEIERPGKESTI

SEQ ID NO: 2953853 - protein, 19 aa, Entamoeba invadens
LNSAFSSLGSRNFVNALNK

SEQ ID NO: 2953854 - protein, 22 aa, Entamoeba invadens
LNSELLLAPSYFEHFLERKDMV

SEQ ID NO: 2953855 - protein, 18 aa, Entamoeba invadens
LNSFDFKLPHDVVIISFL

SEQ ID NO: 2953856 - protein, 17 aa, Entamoeba invadens
LNSFLLQSPPCEYVELV

SEQ ID NO: 2953857 - protein, 21 aa, Entamoeba invadens
LNSHYKTCDFITGEASLFLIK

SEQ ID NO: 2953858 - protein, 19 aa, Entamoeba invadens
LNSIIFPTKLEYIGKSCFN

SEQ ID NO: 2953859 - protein, 17 aa, Entamoeba invadens
LNSIVFEDGRTFDIEKE

SEQ ID NO: 2953860 - protein, 23 aa, Entamoeba invadens
LNSLPRSLPLLLNIALNNTLDIP

SEQ ID NO: 2953861 - protein, 24 aa, Entamoeba invadens
LNSLRLSIELSKLLMVDDKKMLQN

SEQ ID NO: 2953862 - protein, 25 aa, Entamoeba invadens
LNSNCRSTSWTQCYATSAINSYVPI

SEQ ID NO: 2953863 - protein, 22 aa, Entamoeba invadens
LNSNDVYFDWVVASVPSVQVLF

SEQ ID NO: 2953864 - protein, 17 aa, Entamoeba invadens
LNSQRKVAEVLTELENI

SEQ ID NO: 2953865 - protein, 25 aa, Entamoeba invadens
LNSRACEWNCGLIAVAYQSIIHIVN

SEQ ID NO: 2953866 - protein, 24 aa, Entamoeba invadens
LNSSFKHFILFAANFNLLDKKEVA

SEQ ID NO: 2953867 - protein, 20 aa, Entamoeba invadens
LNSSFRAVFNTANIKRESPI

SEQ ID NO: 2953868 - protein, 19 aa, Entamoeba invadens
LNSSYLFDVMVKRIHEYKR

SEQ ID NO: 2953869 - protein, 26 aa, Entamoeba invadens
LNSVEILVMRALSLGLVKGFISQVQQ

SEQ ID NO: 2953870 - protein, 18 aa, Entamoeba invadens
LNSVKPWFEVVPRRLIKS

SEQ ID NO: 2953871 - protein, 19 aa, Entamoeba invadens
LNSVLQCLSHTEYLTEFAL

SEQ ID NO: 2953872 - protein, 27 aa, Entamoeba invadens
LNSWILDCLYGVFVPVFGFFNGDDDAV

SEQ ID NO: 2953873 - protein, 25 aa, Entamoeba invadens
LNTDVGWGCTIRAVQMMISNAMQTL

SEQ ID NO: 2953874 - protein, 17 aa, Entamoeba invadens
LNTEPQLKCSLQKCLVK

SEQ ID NO: 2953875 - protein, 17 aa, Entamoeba invadens
LNTFIIELRRNYKTPKS

SEQ ID NO: 2953876 - protein, 20 aa, Entamoeba invadens
LNTHQYRLPQSCVLQIDALL

SEQ ID NO: 2953877 - protein, 24 aa, Entamoeba invadens
LNTIMELFVVWLLPNPSKLPALKT

SEQ ID NO: 2953878 - protein, 19 aa, Entamoeba invadens
LNTIRVICERCPLVMNKGM

SEQ ID NO: 2953879 - protein, 20 aa, Entamoeba invadens
LNTKECIQQYVLKLKVEKKM

SEQ ID NO: 2953880 - protein, 20 aa, Entamoeba invadens
LNTLCPSGLPPHELLLKVGS

SEQ ID NO: 2953881 - protein, 19 aa, Entamoeba invadens
LNTLFIIQGGCYFYGSVSI

SEQ ID NO: 2953882 - protein, 25 aa, Entamoeba invadens
LNTLKLCGQFVLLISSGDFLFGAVV

SEQ ID NO: 2953883 - protein, 17 aa, Entamoeba invadens
LNTLVLADSFDFFELPE

SEQ ID NO: 2953884 - protein, 24 aa, Entamoeba invadens
LNTNCLSCKIGFYLDNKQCKRCDS

SEQ ID NO: 2953885 - protein, 21 aa, Entamoeba invadens
LNTPSGMQWAYCVRTRLFLFK

SEQ ID NO: 2953886 - protein, 20 aa, Entamoeba invadens
LNTPYGLLWSVHNNALIRTR

SEQ ID NO: 2953887 - protein, 17 aa, Entamoeba invadens
LNTRSSKMLEFEVFNKF

SEQ ID NO: 2953888 - protein, 18 aa, Entamoeba invadens
LNTYKFNFHVSFNTKQDE

SEQ ID NO: 2953889 - protein, 33 aa, Entamoeba invadens
LNVDDVWNSLHFEEVESLVFDTIICVKGRSENL

SEQ ID NO: 2953890 - protein, 19 aa, Entamoeba invadens
LNVDPKFLRTFKRQRKSSL

SEQ ID NO: 2953891 - protein, 17 aa, Entamoeba invadens
LNVEILSIINCERLLFK

SEQ ID NO: 2953892 - protein, 18 aa, Entamoeba invadens
LNVHFPYIIEIDSDPNLY

SEQ ID NO: 2953893 - protein, 24 aa, Entamoeba invadens
LNVIDVLYFGKFVFFNHDQIVGKG

SEQ ID NO: 2953894 - protein, 17 aa, Entamoeba invadens
LNVKFTFVPTMTVTTAE

SEQ ID NO: 2953895 - protein, 22 aa, Entamoeba invadens
LNVKPPLPLSEAFVTQCKHTNY

SEQ ID NO: 2953896 - protein, 19 aa, Entamoeba invadens
LNVLACKYVDEVIQKVPYV

SEQ ID NO: 2953897 - protein, 24 aa, Entamoeba invadens
LNVLANRCKYVGIGGGKSSNEIKD

SEQ ID NO: 2953898 - protein, 19 aa, Entamoeba invadens
LNVLEKAVYIRNFQIFTTE

SEQ ID NO: 2953899 - protein, 20 aa, Entamoeba invadens
LNVLIQWSVSSAFSKAIFQS

SEQ ID NO: 2953900 - protein, 18 aa, Entamoeba invadens
LNVNGVGFKVRRPERRSQ

SEQ ID NO: 2953901 - protein, 37 aa, Entamoeba invadens
LNVPEAYTLTFGDRWLNVFEWVLRGFVDYSKTVGEKP

SEQ ID NO: 2953902 - protein, 19 aa, Entamoeba invadens
LNVPINHMKYLYIATENEK

SEQ ID NO: 2953903 - protein, 17 aa, Entamoeba invadens
LNVRWAFDDPNPIAKAV

SEQ ID NO: 2953904 - protein, 19 aa, Entamoeba invadens
LNVSITRAKYGLVVVGNPS

SEQ ID NO: 2953905 - protein, 18 aa, Entamoeba invadens
LNVTSLGDWSFYKCTSLR

SEQ ID NO: 2953906 - protein, 18 aa, Entamoeba invadens
LNVWKSLNIGEAVKNNID

SEQ ID NO: 2953907 - protein, 23 aa, Entamoeba invadens
LNWEYSYCLPLLVITFGDGHPVN

SEQ ID NO: 2953908 - protein, 20 aa, Entamoeba invadens
LNWKGHKLTVQYARDDIMVQ

SEQ ID NO: 2953909 - protein, 21 aa, Entamoeba invadens
LNWLIRRHHLGVNSILADEMG

SEQ ID NO: 2953910 - protein, 25 aa, Entamoeba invadens
LNYFSTRGKLCLLFENVVDFEFENP

SEQ ID NO: 2953911 - protein, 19 aa, Entamoeba invadens
LNYKGSPLLVNDENLTEFE

SEQ ID NO: 2953912 - protein, 17 aa, Entamoeba invadens
LNYKGSSLLVNDENLTE

SEQ ID NO: 2953913 - protein, 30 aa, Entamoeba invadens
LNYTLAVGIKECWAAHMIGHELTAYYGVAH

SEQ ID NO: 2953914 - protein, 25 aa, Entamoeba invadens
LNYVSCSSFRIPVARIAAAQAQIRH

SEQ ID NO: 2953915 - protein, 21 aa, Entamoeba invadens
LNYYSCTNLYFSTTPSKCIEY

SEQ ID NO: 2953916 - protein, 19 aa, Entamoeba invadens
LNYYSCTNLYYSTTLSKCI

SEQ ID NO: 2953917 - protein, 20 aa, Entamoeba invadens
LPAECQVDYFALDKNIPREE

SEQ ID NO: 2953918 - protein, 17 aa, Entamoeba invadens
LPAEKLAQVIESDLPQY

SEQ ID NO: 2953919 - protein, 21 aa, Entamoeba invadens
LPAEMGHVWVDAHACKSGEQV

SEQ ID NO: 2953920 - protein, 26 aa, Entamoeba invadens
LPAGGGCAICKVGYYKVEKDCDACDE

SEQ ID NO: 2953921 - protein, 26 aa, Entamoeba invadens
LPAKKLMWMSMEFMDGGCLTDILENH

SEQ ID NO: 2953922 - protein, 18 aa, Entamoeba invadens
LPALEYILNHAREVNQNL

SEQ ID NO: 2953923 - protein, 17 aa, Entamoeba invadens
LPALKTFAKLLFVELVE

SEQ ID NO: 2953924 - protein, 17 aa, Entamoeba invadens
LPALNLFRLCELLYAKN

SEQ ID NO: 2953925 - protein, 18 aa, Entamoeba invadens
LPASLTYIGDDCFQKQVL

SEQ ID NO: 2953926 - protein, 21 aa, Entamoeba invadens
LPATFLCQVVSFCLEVSALSL

SEQ ID NO: 2953927 - protein, 21 aa, Entamoeba invadens
LPATFSLPLSTKRKVQKKRTA

SEQ ID NO: 2953928 - protein, 26 aa, Entamoeba invadens
LPATTWPWYKLISAIKLFTFPPGVNR

SEQ ID NO: 2953929 - protein, 22 aa, Entamoeba invadens
LPCKAYKFCFLLNISETKKLKE

SEQ ID NO: 2953930 - protein, 17 aa, Entamoeba invadens
LPCKDILKTLKNLPEAN

SEQ ID NO: 2953931 - protein, 21 aa, Entamoeba invadens
LPCNIIKKHVYLHAKGNALVL

SEQ ID NO: 2953932 - protein, 22 aa, Entamoeba invadens
LPCSVEKLYVSSCYEINIENLR

SEQ ID NO: 2953933 - protein, 18 aa, Entamoeba invadens
LPDAFLKVGAVAAADKLS

SEQ ID NO: 2953934 - protein, 17 aa, Entamoeba invadens
LPDAHIQHVAFVDEDSW

SEQ ID NO: 2953935 - protein, 19 aa, Entamoeba invadens
LPDDCVCFCLFSCRLTYEG

SEQ ID NO: 2953936 - protein, 19 aa, Entamoeba invadens
LPDDDFINFLFDRINHDIF

SEQ ID NO: 2953937 - protein, 23 aa, Entamoeba invadens
LPDDIKGVCALQHRKDDANKVRL

SEQ ID NO: 2953938 - protein, 18 aa, Entamoeba invadens
LPDDVLVDMLKTCLKDKK

SEQ ID NO: 2953939 - protein, 18 aa, Entamoeba invadens
LPDFRWTERGEMINHKKG

SEQ ID NO: 2953940 - protein, 17 aa, Entamoeba invadens
LPDGKEMIIARKRYGFP

SEQ ID NO: 2953941 - protein, 18 aa, Entamoeba invadens
LPDKTSITIGKERYLCTQ

SEQ ID NO: 2953942 - protein, 17 aa, Entamoeba invadens
LPDLERLLVQCDASTIT

SEQ ID NO: 2953943 - protein, 28 aa, Entamoeba invadens
LPDLLMRHCTLLAFNGGVFKLCNLSKIK

SEQ ID NO: 2953944 - protein, 22 aa, Entamoeba invadens
LPDNIKVIGKRVFSQCTNLSSV

SEQ ID NO: 2953945 - protein, 26 aa, Entamoeba invadens
LPDNKRINVFIIRDGIEQFSFDNVRL

SEQ ID NO: 2953946 - protein, 21 aa, Entamoeba invadens
LPDRDSRLSILKAKLRKTPVD

SEQ ID NO: 2953947 - protein, 18 aa, Entamoeba invadens
LPDSCFLGCQSLDNVEIP

SEQ ID NO: 2953948 - protein, 21 aa, Entamoeba invadens
LPDSVIPKTKYNEFLGLATTS

SEQ ID NO: 2953949 - protein, 19 aa, Entamoeba invadens
LPDTIRFIGNYCFIGCTSM

SEQ ID NO: 2953950 - protein, 18 aa, Entamoeba invadens
LPDVFQLLKLLSKTPSNA

SEQ ID NO: 2953951 - protein, 22 aa, Entamoeba invadens
LPEEHFNLLFSKFLNYSKKVSD

SEQ ID NO: 2953952 - protein, 27 aa, Entamoeba invadens
LPEEICILELPNLINLLANELNSKIYE

SEQ ID NO: 2953953 - protein, 18 aa, Entamoeba invadens
LPEFVIKQDEECVSLPKM

SEQ ID NO: 2953954 - protein, 24 aa, Entamoeba invadens
LPEGLKEIGCNCFQGCSFLEEIDI

SEQ ID NO: 2953955 - protein, 17 aa, Entamoeba invadens
LPEGTEVFMKWRRGDKK

SEQ ID NO: 2953956 - protein, 22 aa, Entamoeba invadens
LPEHCIAWASQIAWDNATINKA

SEQ ID NO: 2953957 - protein, 20 aa, Entamoeba invadens
LPEIELFKIILKVFPATEDV

SEQ ID NO: 2953958 - protein, 19 aa, Entamoeba invadens
LPEIKRVVVLYKVDYSYAN

SEQ ID NO: 2953959 - protein, 21 aa, Entamoeba invadens
LPEKCLVLFDKCFEGCSTLSK

SEQ ID NO: 2953960 - protein, 21 aa, Entamoeba invadens
LPEKKKVKFSITQAPEKTAPQ

SEQ ID NO: 2953961 - protein, 17 aa, Entamoeba invadens
LPEKLKEAEEFKISGNE

SEQ ID NO: 2953962 - protein, 17 aa, Entamoeba invadens
LPEKMFYGCIALSSIKN

SEQ ID NO: 2953963 - protein, 18 aa, Entamoeba invadens
LPEKVILPKSLSSVFYNR

SEQ ID NO: 2953964 - protein, 25 aa, Entamoeba invadens
LPEPLIPYNVYDEFIALPKEQNPEI

SEQ ID NO: 2953965 - protein, 28 aa, Entamoeba invadens
LPEQNRIPLEVGITFSITLPLERNTFFF

SEQ ID NO: 2953966 - protein, 18 aa, Entamoeba invadens
LPERCFKCCGKLSDVNIH

SEQ ID NO: 2953967 - protein, 20 aa, Entamoeba invadens
LPERIFGALVSNLKKGSPLV

SEQ ID NO: 2953968 - protein, 21 aa, Entamoeba invadens
LPERLLSLGNRCFEGCNLTDD

SEQ ID NO: 2953969 - protein, 21 aa, Entamoeba invadens
LPERRQIVLCSATLTPEVLEI

SEQ ID NO: 2953970 - protein, 26 aa, Entamoeba invadens
LPESDFKSVLAGFYLQMVNEFASFSL

SEQ ID NO: 2953971 - protein, 25 aa, Entamoeba invadens
LPESLRITLTPAIKLKLCSEMALGV

SEQ ID NO: 2953972 - protein, 19 aa, Entamoeba invadens
LPESLTCIGKDCFLKQCVL

SEQ ID NO: 2953973 - protein, 19 aa, Entamoeba invadens
LPESVTCLGRSCFEKCYSL

SEQ ID NO: 2953974 - protein, 29 aa, Entamoeba invadens
LPEVRNAKEGLPIILCGTASETTVVAEKE

SEQ ID NO: 2953975 - protein, 31 aa, Entamoeba invadens
LPEWKYEIEAPLKLCVEFSHKQLRDEDSKLL

SEQ ID NO: 2953976 - protein, 18 aa, Entamoeba invadens
LPFDESKLLYLKSYEVNG

SEQ ID NO: 2953977 - protein, 17 aa, Entamoeba invadens
LPFDYKSLYTINENVLH

SEQ ID NO: 2953978 - protein, 21 aa, Entamoeba invadens
LPFGVTKISSFAFMNNNIRII

SEQ ID NO: 2953979 - protein, 25 aa, Entamoeba invadens
LPFIPQILAIYLKLFKTCLPGVRPA

SEQ ID NO: 2953980 - protein, 24 aa, Entamoeba invadens
LPFKSACKYLYFDSPIIINSCERV

SEQ ID NO: 2953981 - protein, 17 aa, Entamoeba invadens
LPFLYFHSNHFFILQDV

SEQ ID NO: 2953982 - protein, 17 aa, Entamoeba invadens
LPFPESDLKFWDCSCDL

SEQ ID NO: 2953983 - protein, 17 aa, Entamoeba invadens
LPFPFLLDGTKPTFLDI

SEQ ID NO: 2953984 - protein, 29 aa, Entamoeba invadens
LPFSRVMWCSLVFYPIDWREDKLFECLSA

SEQ ID NO: 2953985 - protein, 18 aa, Entamoeba invadens
LPFVRIVDDIAFLLLMLE

SEQ ID NO: 2953986 - protein, 17 aa, Entamoeba invadens
LPFYEMFVPDNVLSKIK

SEQ ID NO: 2953987 - protein, 26 aa, Entamoeba invadens
LPFYLKYSLDACKGFEEITIYKMSEI

SEQ ID NO: 2953988 - protein, 17 aa, Entamoeba invadens
LPGCVNGIDVMRDNSAI

SEQ ID NO: 2953989 - protein, 18 aa, Entamoeba invadens
LPGGLMFMACSIDGFVGF

SEQ ID NO: 2953990 - protein, 21 aa, Entamoeba invadens
LPGIFRISQLDGIFDSIESEK

SEQ ID NO: 2953991 - protein, 17 aa, Entamoeba invadens
LPGLVSCLLVGGMDEMK

SEQ ID NO: 2953992 - protein, 21 aa, Entamoeba invadens
LPGQIHPGLGIGHEIDEMLME

SEQ ID NO: 2953993 - protein, 21 aa, Entamoeba invadens
LPHGPKKWRSRANNFISSILG

SEQ ID NO: 2953994 - protein, 18 aa, Entamoeba invadens
LPHKSVKAFEELKRVFDF

SEQ ID NO: 2953995 - protein, 21 aa, Entamoeba invadens
LPHLNAVCLLRPSKENMELLK

SEQ ID NO: 2953996 - protein, 17 aa, Entamoeba invadens
LPHLTRCCESFERAIKA

SEQ ID NO: 2953997 - protein, 22 aa, Entamoeba invadens
LPHQRTSLPYGDRPMTSLRPIS

SEQ ID NO: 2953998 - protein, 25 aa, Entamoeba invadens
LPHTEALSFAGLIVVSSEILYLPDN

SEQ ID NO: 2953999 - protein, 19 aa, Entamoeba invadens
LPHYWKEDYGFVTRGFCEN

SEQ ID NO: 2954000 - protein, 23 aa, Entamoeba invadens
LPIADFCPCPFKCGINNQPPTAV

SEQ ID NO: 2954001 - protein, 19 aa, Entamoeba invadens
LPIDLTKLSNLVMCDIGDN

SEQ ID NO: 2954002 - protein, 17 aa, Entamoeba invadens
LPIENTISFIQNQVMVC

SEQ ID NO: 2954003 - protein, 19 aa, Entamoeba invadens
LPIFFTYQINSTKFSFQSL

SEQ ID NO: 2954004 - protein, 17 aa, Entamoeba invadens
LPIGVSKRSVECWMHPD

SEQ ID NO: 2954005 - protein, 19 aa, Entamoeba invadens
LPIHKKRMDIINTIRENQA

SEQ ID NO: 2954006 - protein, 17 aa, Entamoeba invadens
LPIIFDFLKKSPVNEFL

SEQ ID NO: 2954007 - protein, 22 aa, Entamoeba invadens
LPIMRFEDYSVFSLASSSVTAP

SEQ ID NO: 2954008 - protein, 25 aa, Entamoeba invadens
LPIPPTMNMCFSILKVIEVMMDSGF

SEQ ID NO: 2954009 - protein, 24 aa, Entamoeba invadens
LPIQPKFGKCCKVSKAKIEESPNS

SEQ ID NO: 2954010 - protein, 22 aa, Entamoeba invadens
LPIQRLPRYQMLLIQIVNTIKD

SEQ ID NO: 2954011 - protein, 19 aa, Entamoeba invadens
LPISTYLIAPLSHFSVYPE

SEQ ID NO: 2954012 - protein, 25 aa, Entamoeba invadens
LPITKLRIDDMVKCFKNSTDHITKR

SEQ ID NO: 2954013 - protein, 18 aa, Entamoeba invadens
LPIVVKMILAETIEERNK

SEQ ID NO: 2954014 - protein, 24 aa, Entamoeba invadens
LPIYSLCAICNHSGSINFGHYTTS

SEQ ID NO: 2954015 - protein, 21 aa, Entamoeba invadens
LPKDLIVMISYIGKMELYYDL

SEQ ID NO: 2954016 - protein, 17 aa, Entamoeba invadens
LPKEALVSISDAIRAKM

SEQ ID NO: 2954017 - protein, 17 aa, Entamoeba invadens
LPKEEKIVVEQQNTVPM

SEQ ID NO: 2954018 - protein, 25 aa, Entamoeba invadens
LPKENGAAIKACFRATDPIKTLVIT

SEQ ID NO: 2954019 - protein, 20 aa, Entamoeba invadens
LPKFFPKYTKTEFLVNRMKI

SEQ ID NO: 2954020 - protein, 22 aa, Entamoeba invadens
LPKGLQYLGPLCFEKCNNLKEI

SEQ ID NO: 2954021 - protein, 17 aa, Entamoeba invadens
LPKGVCNQMIFKDSFYD

SEQ ID NO: 2954022 - protein, 17 aa, Entamoeba invadens
LPKGYEAVLKKAYKQTF

SEQ ID NO: 2954023 - protein, 18 aa, Entamoeba invadens
LPKHIKNIVIGLSTINSP

SEQ ID NO: 2954024 - protein, 21 aa, Entamoeba invadens
LPKIFEHYATFLKLTVGTNGN

SEQ ID NO: 2954025 - protein, 23 aa, Entamoeba invadens
LPKIKRLNVYVADNTLFNDTITS

SEQ ID NO: 2954026 - protein, 18 aa, Entamoeba invadens
LPKILERVNMNIVSNYQY

SEQ ID NO: 2954027 - protein, 25 aa, Entamoeba invadens
LPKIRGRKSLYFIIFDSNLNVFGVY

SEQ ID NO: 2954028 - protein, 18 aa, Entamoeba invadens
LPKKCFVSCVSLKTIEIP

SEQ ID NO: 2954029 - protein, 17 aa, Entamoeba invadens
LPKKDLLSSDPYVIVSI

SEQ ID NO: 2954030 - protein, 22 aa, Entamoeba invadens
LPKKMTGDFCLTDEIMCVEQNK

SEQ ID NO: 2954031 - protein, 26 aa, Entamoeba invadens
LPKKYFDNFHKLYVFFGITTQISVNV

SEQ ID NO: 2954032 - protein, 36 aa, Entamoeba invadens
LPKLKIVIINCIYKATPFLFSFDSVHSFNNILVQLT

SEQ ID NO: 2954033 - protein, 23 aa, Entamoeba invadens
LPKLLIRNTSLVLMPRTQIKGKM

SEQ ID NO: 2954034 - protein, 18 aa, Entamoeba invadens
LPKLPKFKDVIGKAIDNI

SEQ ID NO: 2954035 - protein, 21 aa, Entamoeba invadens
LPKLTLCFEDTFWSDYLIQKK

SEQ ID NO: 2954036 - protein, 20 aa, Entamoeba invadens
LPKNLEYIGEAAFGDCENLI

SEQ ID NO: 2954037 - protein, 17 aa, Entamoeba invadens
LPKPDIVCFLELSLDEA

SEQ ID NO: 2954038 - protein, 18 aa, Entamoeba invadens
LPKSFMLLTGLRKLTLQH

SEQ ID NO: 2954039 - protein, 25 aa, Entamoeba invadens
LPKSLIRLGKACFSNCIGLTELYLP

SEQ ID NO: 2954040 - protein, 17 aa, Entamoeba invadens
LPKSLQYTGNRAFEKCC

SEQ ID NO: 2954041 - protein, 26 aa, Entamoeba invadens
LPKSLSKYHCCRGLYGNVGFNVKSQF

SEQ ID NO: 2954042 - protein, 27 aa, Entamoeba invadens
LPKSLSYLPFCCFFKCVHLQMVKFPHH

SEQ ID NO: 2954043 - protein, 19 aa, Entamoeba invadens
LPKSVTKLSEFSFYGCVSL

SEQ ID NO: 2954044 - protein, 17 aa, Entamoeba invadens
LPKTLKFVDEQNVFVGC

SEQ ID NO: 2954045 - protein, 21 aa, Entamoeba invadens
LPKTVCKVSSNYGMAGLMKLI

SEQ ID NO: 2954046 - protein, 19 aa, Entamoeba invadens
LPKTYLKNQYCVACAIHGR

SEQ ID NO: 2954047 - protein, 30 aa, Entamoeba invadens
LPKVLPCFHVICRDCILSLMKVQKSYNTYS

SEQ ID NO: 2954048 - protein, 25 aa, Entamoeba invadens
LPKVPKCFLEATSLKSLKMEKEKEP

SEQ ID NO: 2954049 - protein, 25 aa, Entamoeba invadens
LPKYLTRLGLLCFEKCMSLKTLTIP

SEQ ID NO: 2954050 - protein, 27 aa, Entamoeba invadens
LPLDALRPAIVMFVGFYHKKFERTVLR

SEQ ID NO: 2954051 - protein, 21 aa, Entamoeba invadens
LPLDEVEAFLAKKSEEGETVE

SEQ ID NO: 2954052 - protein, 20 aa, Entamoeba invadens
LPLDGMSGWFTVKSTGKIVP

SEQ ID NO: 2954053 - protein, 21 aa, Entamoeba invadens
LPLDILKCILAYLPTGRYQTV

SEQ ID NO: 2954054 - protein, 17 aa, Entamoeba invadens
LPLEIPVLLNKDYSSSS

SEQ ID NO: 2954055 - protein, 33 aa, Entamoeba invadens
LPLEMNRPVCVVGLCKLLSLPQFTPVVVGQNLV

SEQ ID NO: 2954056 - protein, 17 aa, Entamoeba invadens
LPLFPNPLVKTLVEMIL

SEQ ID NO: 2954057 - protein, 19 aa, Entamoeba invadens
LPLHYYFKNLFDKMSTLQI

SEQ ID NO: 2954058 - protein, 17 aa, Entamoeba invadens
LPLIITRGNNVFGPHQF

SEQ ID NO: 2954059 - protein, 24 aa, Entamoeba invadens
LPLKLISIMEAHSFFTERSIEYAS

SEQ ID NO: 2954060 - protein, 19 aa, Entamoeba invadens
LPLKYATQIDIDWTNSVSS

SEQ ID NO: 2954061 - protein, 25 aa, Entamoeba invadens
LPLKYATQIDIDWTYTILSMENITL

SEQ ID NO: 2954062 - protein, 22 aa, Entamoeba invadens
LPLLNASGMMRWAEVGHKIVCK

SEQ ID NO: 2954063 - protein, 23 aa, Entamoeba invadens
LPLLRALFLKKCNTFRHITVPPG

SEQ ID NO: 2954064 - protein, 19 aa, Entamoeba invadens
LPLLSFKIPFTLGTNSEIG

SEQ ID NO: 2954065 - protein, 18 aa, Entamoeba invadens
LPLLSFKTPFTLGTNSEI

SEQ ID NO: 2954066 - protein, 17 aa, Entamoeba invadens
LPLLVYKFCNGMNNLED

SEQ ID NO: 2954067 - protein, 26 aa, Entamoeba invadens
LPLNFKRLPFKAFYNVTSLAEIEAKE

SEQ ID NO: 2954068 - protein, 25 aa, Entamoeba invadens
LPLNFKRLPFKAFYNVTSLTEIDAK

SEQ ID NO: 2954069 - protein, 18 aa, Entamoeba invadens
LPLPLVAPAINPKEQNFA

SEQ ID NO: 2954070 - protein, 23 aa, Entamoeba invadens
LPLPQKRKMPVLAPHENGSKKSS

SEQ ID NO: 2954071 - protein, 17 aa, Entamoeba invadens
LPLPYGVFAMLYTLLPL

SEQ ID NO: 2954072 - protein, 17 aa, Entamoeba invadens
LPLQPLLSLLIDTESVI

SEQ ID NO: 2954073 - protein, 19 aa, Entamoeba invadens
LPLRYRKNSVCGILADLYD

SEQ ID NO: 2954074 - protein, 21 aa, Entamoeba invadens
LPLSHPELYEEIGIKPPKGVI

SEQ ID NO: 2954075 - protein, 25 aa, Entamoeba invadens
LPLSLTRLGNYVVHDCLSLSTMNVP

SEQ ID NO: 2954076 - protein, 17 aa, Entamoeba invadens
LPLSLTSIGESCFVRCI

SEQ ID NO: 2954077 - protein, 17 aa, Entamoeba invadens
LPLTRLLPNEILRDPTM

SEQ ID NO: 2954078 - protein, 26 aa, Entamoeba invadens
LPLTTFKGRTSVVPSFGKDLNEQIKK

SEQ ID NO: 2954079 - protein, 18 aa, Entamoeba invadens
LPLVCILTLSGSGTEVTP

SEQ ID NO: 2954080 - protein, 24 aa, Entamoeba invadens
LPLVDFCPCNFKYGVNNQPTTSVP

SEQ ID NO: 2954081 - protein, 20 aa, Entamoeba invadens
LPLVKQLVIVGADLEKKNIN

SEQ ID NO: 2954082 - protein, 18 aa, Entamoeba invadens
LPMDLPREVPRELQRELP

SEQ ID NO: 2954083 - protein, 19 aa, Entamoeba invadens
LPMEVTMQMWDRMFVEVRG

SEQ ID NO: 2954084 - protein, 20 aa, Entamoeba invadens
LPMFVKRRTTTCLTQKETCD

SEQ ID NO: 2954085 - protein, 22 aa, Entamoeba invadens
LPMKKDVPSDVVFKLYQALEFE

SEQ ID NO: 2954086 - protein, 19 aa, Entamoeba invadens
LPMLCRRFKTTVVCDNFFC

SEQ ID NO: 2954087 - protein, 23 aa, Entamoeba invadens
LPMNIKAKIVFGAALPGCKYISK

SEQ ID NO: 2954088 - protein, 20 aa, Entamoeba invadens
LPMNSMDVIAAMPLLKHLNV

SEQ ID NO: 2954089 - protein, 21 aa, Entamoeba invadens
LPMRLIEALSYSCLNKKNNMY

SEQ ID NO: 2954090 - protein, 24 aa, Entamoeba invadens
LPMSLERLSVKHVFGDILCSHCHL

SEQ ID NO: 2954091 - protein, 23 aa, Entamoeba invadens
LPMTELITNIGLNCFSNDTTMTS

SEQ ID NO: 2954092 - protein, 27 aa, Entamoeba invadens
LPMVKSDTFVPAFSVKKSREFLEESFS

SEQ ID NO: 2954093 - protein, 26 aa, Entamoeba invadens
LPMWRIADNGIMEWFQLRNFGDFEIP

SEQ ID NO: 2954094 - protein, 20 aa, Entamoeba invadens
LPNALLHKDIVLFLTTISKD

SEQ ID NO: 2954095 - protein, 21 aa, Entamoeba invadens
LPNALRFCVQFNDRNIFRLAS

SEQ ID NO: 2954096 - protein, 26 aa, Entamoeba invadens
LPNCQDVGLFLGCKKENIFVFGGEYR

SEQ ID NO: 2954097 - protein, 24 aa, Entamoeba invadens
LPNELCTLNLYLLNVMENCLTSLP

SEQ ID NO: 2954098 - protein, 21 aa, Entamoeba invadens
LPNEMKPCFEIIKKKIVDEYG

SEQ ID NO: 2954099 - protein, 20 aa, Entamoeba invadens
LPNFHFINFTTLKEQYQEKV

SEQ ID NO: 2954100 - protein, 17 aa, Entamoeba invadens
LPNGEKPFEGQLVIFEN

SEQ ID NO: 2954101 - protein, 17 aa, Entamoeba invadens
LPNIETLHLWKKYNENF

SEQ ID NO: 2954102 - protein, 17 aa, Entamoeba invadens
LPNILRNKFNVDILESK

SEQ ID NO: 2954103 - protein, 19 aa, Entamoeba invadens
LPNKKSLVYDQNFSIDSIT

SEQ ID NO: 2954104 - protein, 17 aa, Entamoeba invadens
LPNKNFLQNFNVTPDPS

SEQ ID NO: 2954105 - protein, 25 aa, Entamoeba invadens
LPNKQCLLCQCLFLNKIPIKDLVIL

SEQ ID NO: 2954106 - protein, 22 aa, Entamoeba invadens
LPNLKSSTLLGVETDEENKVVV

SEQ ID NO: 2954107 - protein, 25 aa, Entamoeba invadens
LPNLPKAEGCSFVLIDQQVDVVPEN

SEQ ID NO: 2954108 - protein, 25 aa, Entamoeba invadens
LPNNQFWRVIKAYALSNTNQEEEAF

SEQ ID NO: 2954109 - protein, 28 aa, Entamoeba invadens
LPNSLKIIYRFCFQECKSLKEVTLPPQI

SEQ ID NO: 2954110 - protein, 19 aa, Entamoeba invadens
LPNSLTLVGERCFTNCLLK

SEQ ID NO: 2954111 - protein, 20 aa, Entamoeba invadens
LPNSVIVLCGFCFQNCYKLK

SEQ ID NO: 2954112 - protein, 17 aa, Entamoeba invadens
LPNTVRFLGEKCFARST

SEQ ID NO: 2954113 - protein, 20 aa, Entamoeba invadens
LPNVLLYLYRGGYVTKKALQ

SEQ ID NO: 2954114 - protein, 18 aa, Entamoeba invadens
LPNYVFAYICDSCALFDI

SEQ ID NO: 2954115 - protein, 17 aa, Entamoeba invadens
LPPAAALHKIVSDEIPP

SEQ ID NO: 2954116 - protein, 20 aa, Entamoeba invadens
LPPCIYKIIRHMKIQDNIMF

SEQ ID NO: 2954117 - protein, 18 aa, Entamoeba invadens
LPPCPLQPPPDLKKYKAI

SEQ ID NO: 2954118 - protein, 19 aa, Entamoeba invadens
LPPEAFLYNEFNRTCDTYA

SEQ ID NO: 2954119 - protein, 18 aa, Entamoeba invadens
LPPILPLNEMPLRSRSRS

SEQ ID NO: 2954120 - protein, 34 aa, Entamoeba invadens
LPPKLSLIGVQCFRRCSRLNLLELNSLISTIPQS

SEQ ID NO: 2954121 - protein, 19 aa, Entamoeba invadens
LPPKRLITTNTDFGDDNFQ

SEQ ID NO: 2954122 - protein, 18 aa, Entamoeba invadens
LPPLVLKSFHVHLSSAND

SEQ ID NO: 2954123 - protein, 21 aa, Entamoeba invadens
LPPNCSCRFGGNSIESIEFPE

SEQ ID NO: 2954124 - protein, 22 aa, Entamoeba invadens
LPPNLEKISKWAFKNSGLNEIE

SEQ ID NO: 2954125 - protein, 21 aa, Entamoeba invadens
LPPPGMPYGGMPNGYGAQQYP

SEQ ID NO: 2954126 - protein, 18 aa, Entamoeba invadens
LPPPPMCQPSYIEPSYQQ

SEQ ID NO: 2954127 - protein, 17 aa, Entamoeba invadens
LPPPPVLDSSYLESLNN

SEQ ID NO: 2954128 - protein, 34 aa, Entamoeba invadens
LPPPQFPCVYHIPSYDEFPPSFYKKSSERDDRRG

SEQ ID NO: 2954129 - protein, 17 aa, Entamoeba invadens
LPPPRKSTISIVPNTSI

SEQ ID NO: 2954130 - protein, 25 aa, Entamoeba invadens
LPPQKAGDVIFILTVGVDTVGNIEA

SEQ ID NO: 2954131 - protein, 26 aa, Entamoeba invadens
LPPRELAVKFVEAFGGVEKTLEIGQD

SEQ ID NO: 2954132 - protein, 21 aa, Entamoeba invadens
LPPTFPPTLIIPGKPYQTTYT

SEQ ID NO: 2954133 - protein, 20 aa, Entamoeba invadens
LPPTLTQLGIKCFSDCFYLS

SEQ ID NO: 2954134 - protein, 19 aa, Entamoeba invadens
LPPTVPKEVQSMMECELEE

SEQ ID NO: 2954135 - protein, 17 aa, Entamoeba invadens
LPQAKLFLSQTLLTKKE

SEQ ID NO: 2954136 - protein, 24 aa, Entamoeba invadens
LPQAPGIYSMNGFFTLNHDQVQLV

SEQ ID NO: 2954137 - protein, 17 aa, Entamoeba invadens
LPQELTIFADTRNAYEK

SEQ ID NO: 2954138 - protein, 19 aa, Entamoeba invadens
LPQEVLNVVQLVFSLLTSN

SEQ ID NO: 2954139 - protein, 24 aa, Entamoeba invadens
LPQITEIFPLLLRGIGIHHSGLLP

SEQ ID NO: 2954140 - protein, 19 aa, Entamoeba invadens
LPQLKRILEIPSLKKTISR

SEQ ID NO: 2954141 - protein, 21 aa, Entamoeba invadens
LPQLPLTLTQFFKENLPTENI

SEQ ID NO: 2954142 - protein, 25 aa, Entamoeba invadens
LPQNLKVLRSWAFYNVNHLKEIEIP

SEQ ID NO: 2954143 - protein, 25 aa, Entamoeba invadens
LPQPKNVYSPLLVVTPMDTPMVEDD

SEQ ID NO: 2954144 - protein, 30 aa, Entamoeba invadens
LPQSCAFLSLSESCFKNFELIQSITPQTSR

SEQ ID NO: 2954145 - protein, 25 aa, Entamoeba invadens
LPQSFKRFLVSKVAMLGFGDRSEKK

SEQ ID NO: 2954146 - protein, 20 aa, Entamoeba invadens
LPQSLQFIGDNAFENCHLKE

SEQ ID NO: 2954147 - protein, 24 aa, Entamoeba invadens
LPQTLKIIGKHAFSSCVNLVQIDI

SEQ ID NO: 2954148 - protein, 19 aa, Entamoeba invadens
LPRCSLKRVLNITLRQTTI

SEQ ID NO: 2954149 - protein, 25 aa, Entamoeba invadens
LPRDENMAPAFAFDANTKLPDDDTQ

SEQ ID NO: 2954150 - protein, 19 aa, Entamoeba invadens
LPRNFTASIELPKPQEDTF

SEQ ID NO: 2954151 - protein, 18 aa, Entamoeba invadens
LPRSLFYKLFRQDLLIAS

SEQ ID NO: 2954152 - protein, 18 aa, Entamoeba invadens
LPRSLSIIADGCFSECKN

SEQ ID NO: 2954153 - protein, 18 aa, Entamoeba invadens
LPRYELLLKDLLKHTEKS

SEQ ID NO: 2954154 - protein, 19 aa, Entamoeba invadens
LPSDLLVMISNISNMDKQY

SEQ ID NO: 2954155 - protein, 21 aa, Entamoeba invadens
LPSDLLVMISYISNMDRQYKD

SEQ ID NO: 2954156 - protein, 17 aa, Entamoeba invadens
LPSFFLEKKEPLWTTTD

SEQ ID NO: 2954157 - protein, 21 aa, Entamoeba invadens
LPSFHYQELFAGISDDTLNRP

SEQ ID NO: 2954158 - protein, 19 aa, Entamoeba invadens
LPSFNLRSFLTPEQEPQIS

SEQ ID NO: 2954159 - protein, 21 aa, Entamoeba invadens
LPSFSKWTSYKQMELIYDSKT

SEQ ID NO: 2954160 - protein, 26 aa, Entamoeba invadens
LPSGEACELEILLTLKCTTKMDESVV

SEQ ID NO: 2954161 - protein, 19 aa, Entamoeba invadens
LPSGLSFIGNNSFEECTNL

SEQ ID NO: 2954162 - protein, 25 aa, Entamoeba invadens
LPSLECLKIVTLNSIYQEPISLSLF

SEQ ID NO: 2954163 - protein, 19 aa, Entamoeba invadens
LPSLHLPEKCLVLFDKCFE

SEQ ID NO: 2954164 - protein, 24 aa, Entamoeba invadens
LPSLPGNVIYLGMATITFAATTPL

SEQ ID NO: 2954165 - protein, 18 aa, Entamoeba invadens
LPSLTSLRCPVLKIEETT

SEQ ID NO: 2954166 - protein, 22 aa, Entamoeba invadens
LPSNQKFLPLKKIQTITFSFGI

SEQ ID NO: 2954167 - protein, 21 aa, Entamoeba invadens
LPSPFSQQWLCNLSSQKYTVD

SEQ ID NO: 2954168 - protein, 21 aa, Entamoeba invadens
LPSQYLRIGFESDETTWRVFQ

SEQ ID NO: 2954169 - protein, 20 aa, Entamoeba invadens
LPSRHPAIIDRICFLAKNLP

SEQ ID NO: 2954170 - protein, 22 aa, Entamoeba invadens
LPSRLFEGCSLLTKIQFPNQFS

SEQ ID NO: 2954171 - protein, 17 aa, Entamoeba invadens
LPSRPSAMDRLRGEVPV

SEQ ID NO: 2954172 - protein, 18 aa, Entamoeba invadens
LPSSLAYKHLHFYSYGLM

SEQ ID NO: 2954173 - protein, 24 aa, Entamoeba invadens
LPSSLKYIPSQTFKKCVSLKEVEI

SEQ ID NO: 2954174 - protein, 19 aa, Entamoeba invadens
LPSSLNILITMPFPYPPGV

SEQ ID NO: 2954175 - protein, 19 aa, Entamoeba invadens
LPSSVSIICCCAFLSCGFE

SEQ ID NO: 2954176 - protein, 26 aa, Entamoeba invadens
LPSTLKSLGNFCFAECQSLRVLELPE

SEQ ID NO: 2954177 - protein, 17 aa, Entamoeba invadens
LPSVPKETIEFCGCKIP

SEQ ID NO: 2954178 - protein, 25 aa, Entamoeba invadens
LPSYKMRISNEVFLKIDHIKVQNMS

SEQ ID NO: 2954179 - protein, 26 aa, Entamoeba invadens
LPTAVCTDSPMRCENPGFSNIKNKTL

SEQ ID NO: 2954180 - protein, 18 aa, Entamoeba invadens
LPTDSLILLWDRLLTDLK

SEQ ID NO: 2954181 - protein, 24 aa, Entamoeba invadens
LPTFLPINLPSLFSHPIIGVPQYL

SEQ ID NO: 2954182 - protein, 31 aa, Entamoeba invadens
LPTKRLRDVSLRLQFMKAFDENKSLTWDDFI

SEQ ID NO: 2954183 - protein, 20 aa, Entamoeba invadens
LPTKRLRDVSLRLQYMKLIE

SEQ ID NO: 2954184 - protein, 23 aa, Entamoeba invadens
LPTLKDILTFISINKKCQDAVTS

SEQ ID NO: 2954185 - protein, 21 aa, Entamoeba invadens
LPTLKDIMTFITINKKCQVAV

SEQ ID NO: 2954186 - protein, 21 aa, Entamoeba invadens
LPTLKDLLNFVCINKNAHEVA

SEQ ID NO: 2954187 - protein, 24 aa, Entamoeba invadens
LPTLPLKNKMLIPDFTIPPFSFEN

SEQ ID NO: 2954188 - protein, 21 aa, Entamoeba invadens
LPTLRALYKFLQHVDAEEFIS

SEQ ID NO: 2954189 - protein, 27 aa, Entamoeba invadens
LPTNIPQQCKICFETKPILDKVPISFL

SEQ ID NO: 2954190 - protein, 21 aa, Entamoeba invadens
LPTNITQLGICCFKRCYHLKY

SEQ ID NO: 2954191 - protein, 19 aa, Entamoeba invadens
LPTNLLFIGNNCFNGAALE

SEQ ID NO: 2954192 - protein, 27 aa, Entamoeba invadens
LPTNNAKMFLKKSFFAVIEKKIEAKFN

SEQ ID NO: 2954193 - protein, 20 aa, Entamoeba invadens
LPTPEFFVTHLIRRHPHSKG

SEQ ID NO: 2954194 - protein, 17 aa, Entamoeba invadens
LPTRLRVLIKTLGDEGG

SEQ ID NO: 2954195 - protein, 22 aa, Entamoeba invadens
LPTSGKCAICKYSFDKVKKDCI

SEQ ID NO: 2954196 - protein, 24 aa, Entamoeba invadens
LPTSHAVLLLGWVNTWLAENKRVL

SEQ ID NO: 2954197 - protein, 30 aa, Entamoeba invadens
LPTSPHPLFALRIVSRFLTPTTMPAYTTSI

SEQ ID NO: 2954198 - protein, 21 aa, Entamoeba invadens
LPTTKYRLFCFKNDEEIEEPL

SEQ ID NO: 2954199 - protein, 19 aa, Entamoeba invadens
LPTTLTFIGDYSFIGCVNL

SEQ ID NO: 2954200 - protein, 25 aa, Entamoeba invadens
LPTVKPCFAVKCNPEPHLVELVGKL

SEQ ID NO: 2954201 - protein, 24 aa, Entamoeba invadens
LPTVNRLYMRPSYVRRTDSDDDDD

SEQ ID NO: 2954202 - protein, 21 aa, Entamoeba invadens
LPVDYVIQLLDIVCDLFTNTP

SEQ ID NO: 2954203 - protein, 20 aa, Entamoeba invadens
LPVIHSYGADITKLDCAVPL

SEQ ID NO: 2954204 - protein, 19 aa, Entamoeba invadens
LPVKAYPVLPNFANNKKPI

SEQ ID NO: 2954205 - protein, 18 aa, Entamoeba invadens
LPVLEYNKKILVGVSTSN

SEQ ID NO: 2954206 - protein, 18 aa, Entamoeba invadens
LPVLRFLAKNGHKEEIFG

SEQ ID NO: 2954207 - protein, 20 aa, Entamoeba invadens
LPVMTQCPIRISEADIEART

SEQ ID NO: 2954208 - protein, 18 aa, Entamoeba invadens
LPVQVVLRLQTKHIDVET

SEQ ID NO: 2954209 - protein, 19 aa, Entamoeba invadens
LPVRVLRRIEPEDDDRENS

SEQ ID NO: 2954210 - protein, 22 aa, Entamoeba invadens
LPVTAYLDAPVNRFLKYPKIFE

SEQ ID NO: 2954211 - protein, 18 aa, Entamoeba invadens
LPVTCIMLTHSHGDHIRG

SEQ ID NO: 2954212 - protein, 18 aa, Entamoeba invadens
LPVTSAFHGICLTPDSSA

SEQ ID NO: 2954213 - protein, 17 aa, Entamoeba invadens
LPVVFLIEDSHYDVHRS

SEQ ID NO: 2954214 - protein, 20 aa, Entamoeba invadens
LPYFIKRLNELLVVAKKTPK

SEQ ID NO: 2954215 - protein, 26 aa, Entamoeba invadens
LPYGQICKLCGTKIALREHLTYSNGQ

SEQ ID NO: 2954216 - protein, 21 aa, Entamoeba invadens
LPYIPPIKGTDIFLGTIDKNL

SEQ ID NO: 2954217 - protein, 18 aa, Entamoeba invadens
LPYKCFAGDINLIEITSP

SEQ ID NO: 2954218 - protein, 24 aa, Entamoeba invadens
LPYKLKVRMLFDTSRGMQFLHENR

SEQ ID NO: 2954219 - protein, 19 aa, Entamoeba invadens
LPYLPANILIDRMCYKQDA

SEQ ID NO: 2954220 - protein, 20 aa, Entamoeba invadens
LPYLPANILIDRMCYKQDAS

SEQ ID NO: 2954221 - protein, 23 aa, Entamoeba invadens
LPYNIKVIGGSCFMDCSQLTSMS

SEQ ID NO: 2954222 - protein, 19 aa, Entamoeba invadens
LPYPVTNPITIRFVKEVFP

SEQ ID NO: 2954223 - protein, 22 aa, Entamoeba invadens
LPYRTECYEVSPAELKCIKKFP

SEQ ID NO: 2954224 - protein, 20 aa, Entamoeba invadens
LPYSTAIDMWSFGCMAAELF

SEQ ID NO: 2954225 - protein, 28 aa, Entamoeba invadens
LPYYTIQLPYLFPGVQLTYIVKLPTSEV

SEQ ID NO: 2954226 - protein, 22 aa, Entamoeba invadens
LQAEMINCLTLANYVVQNSPTF

SEQ ID NO: 2954227 - protein, 24 aa, Entamoeba invadens
LQAESLLSSSGRRKEQLVYVIEGN

SEQ ID NO: 2954228 - protein, 21 aa, Entamoeba invadens
LQAIKIKLGFPEKFNQLDNDL

SEQ ID NO: 2954229 - protein, 22 aa, Entamoeba invadens
LQALQFRFANPFQKSTQLQMTP

SEQ ID NO: 2954230 - protein, 26 aa, Entamoeba invadens
LQAQCKALGLWDRWDEITQMYADVNK

SEQ ID NO: 2954231 - protein, 24 aa, Entamoeba invadens
LQASWILSTCVNYFPEDTIYVCVV

SEQ ID NO: 2954232 - protein, 17 aa, Entamoeba invadens
LQAYAFRDISKSPIQPS

SEQ ID NO: 2954233 - protein, 19 aa, Entamoeba invadens
LQCDSRWATHMYSGSKNKN

SEQ ID NO: 2954234 - protein, 25 aa, Entamoeba invadens
LQCKNCLSGYCLQSGCAVCTNNNYF

SEQ ID NO: 2954235 - protein, 17 aa, Entamoeba invadens
LQCPLNISVGNYYKDFV

SEQ ID NO: 2954236 - protein, 22 aa, Entamoeba invadens
LQCVCKNCNRLLLTDEEREYYL

SEQ ID NO: 2954237 - protein, 17 aa, Entamoeba invadens
LQDIRRKSGNFASHTQV

SEQ ID NO: 2954238 - protein, 17 aa, Entamoeba invadens
LQDKLKVEMDFLKINKV

SEQ ID NO: 2954239 - protein, 18 aa, Entamoeba invadens
LQDRRVINTIAFDGFVYD

SEQ ID NO: 2954240 - protein, 21 aa, Entamoeba invadens
LQDYKSFVVINDFSSVDNNIF

SEQ ID NO: 2954241 - protein, 26 aa, Entamoeba invadens
LQEDIKARCDLVNWVIAISQKYNLSS

SEQ ID NO: 2954242 - protein, 29 aa, Entamoeba invadens
LQEEMKEVRREKEMIGMQLEEAKNENEMI

SEQ ID NO: 2954243 - protein, 26 aa, Entamoeba invadens
LQEEMNAFCIIKHVIQYQGVYSQRSE

SEQ ID NO: 2954244 - protein, 22 aa, Entamoeba invadens
LQEFPRTSFGKLYAPKLKEMVK

SEQ ID NO: 2954245 - protein, 17 aa, Entamoeba invadens
LQEIAIFLSSLCIGGVT

SEQ ID NO: 2954246 - protein, 18 aa, Entamoeba invadens
LQEIDQLISYSIDIAKKL

SEQ ID NO: 2954247 - protein, 17 aa, Entamoeba invadens
LQEIERYASESVIKLLI

SEQ ID NO: 2954248 - protein, 25 aa, Entamoeba invadens
LQEIGFSLFELCYYYDDDLKKCASD

SEQ ID NO: 2954249 - protein, 25 aa, Entamoeba invadens
LQEKKTCSLEENMNIGIHYLPLICE

SEQ ID NO: 2954250 - protein, 22 aa, Entamoeba invadens
LQEKRKSNVLKESTKPTKSANA

SEQ ID NO: 2954251 - protein, 20 aa, Entamoeba invadens
LQELFKRVYVNKFNQLHGTY

SEQ ID NO: 2954252 - protein, 25 aa, Entamoeba invadens
LQELKYESIIGIPDKVFSCIRTTIE

SEQ ID NO: 2954253 - protein, 23 aa, Entamoeba invadens
LQEMKDSGALPIRVAHCDTKCNN

SEQ ID NO: 2954254 - protein, 17 aa, Entamoeba invadens
LQEMKITYTEEADHGLV

SEQ ID NO: 2954255 - protein, 21 aa, Entamoeba invadens
LQEQGSYGFVCLCGDGSQVNP

SEQ ID NO: 2954256 - protein, 24 aa, Entamoeba invadens
LQETYRFTKEFTDQITANQFKEIT

SEQ ID NO: 2954257 - protein, 21 aa, Entamoeba invadens
LQEVICLDRFFDALFTREFFK

SEQ ID NO: 2954258 - protein, 17 aa, Entamoeba invadens
LQFAKKLLETLKLKVSG

SEQ ID NO: 2954259 - protein, 26 aa, Entamoeba invadens
LQFDLPRFIGIGLFTDVGYSQGIRNM

SEQ ID NO: 2954260 - protein, 19 aa, Entamoeba invadens
LQFFNCCSSLSAVEIPREI

SEQ ID NO: 2954261 - protein, 24 aa, Entamoeba invadens
LQFFPKRCLVNLLYASQHSSLKDL

SEQ ID NO: 2954262 - protein, 17 aa, Entamoeba invadens
LQFGPIILFLLSDTILI

SEQ ID NO: 2954263 - protein, 17 aa, Entamoeba invadens
LQFLRTAYCNTMIEENF

SEQ ID NO: 2954264 - protein, 19 aa, Entamoeba invadens
LQFNRFIYDRVQLKVVKIT

SEQ ID NO: 2954265 - protein, 19 aa, Entamoeba invadens
LQFPFAEVVISPDQFKILL

SEQ ID NO: 2954266 - protein, 23 aa, Entamoeba invadens
LQFPKGTLLKRCTPHPLNNTYIH

SEQ ID NO: 2954267 - protein, 23 aa, Entamoeba invadens
LQFQYRMHPALSEFSSHTFYDGV

SEQ ID NO: 2954268 - protein, 19 aa, Entamoeba invadens
LQFSSTMFPVIPPKYNFVS

SEQ ID NO: 2954269 - protein, 24 aa, Entamoeba invadens
LQFVGPLLGFLVKHYQGIEAYVIC

SEQ ID NO: 2954270 - protein, 17 aa, Entamoeba invadens
LQFYYVKFFGSVFGEMN

SEQ ID NO: 2954271 - protein, 20 aa, Entamoeba invadens
LQGEVERIALMPAKAKTGEE

SEQ ID NO: 2954272 - protein, 25 aa, Entamoeba invadens
LQGILPNPLFPVMFVHCKGDEFYGV

SEQ ID NO: 2954273 - protein, 19 aa, Entamoeba invadens
LQGKLPWQGFSRQNNTEKF

SEQ ID NO: 2954274 - protein, 22 aa, Entamoeba invadens
LQGRFSGLIVQGVFTGKFESTS

SEQ ID NO: 2954275 - protein, 25 aa, Entamoeba invadens
LQGSYFSGWVGKVFLSCLIPKQDME

SEQ ID NO: 2954276 - protein, 28 aa, Entamoeba invadens
LQHFPPQMQIYFGYRFLALHSPEEKRIG

SEQ ID NO: 2954277 - protein, 18 aa, Entamoeba invadens
LQHIQACAFKNCRQLEVI

SEQ ID NO: 2954278 - protein, 18 aa, Entamoeba invadens
LQHLSKFFSGDSTLLSGT

SEQ ID NO: 2954279 - protein, 18 aa, Entamoeba invadens
LQHPCAMMMSELSKSQDI

SEQ ID NO: 2954280 - protein, 17 aa, Entamoeba invadens
LQIEGAILMMKEQIEQR

SEQ ID NO: 2954281 - protein, 30 aa, Entamoeba invadens
LQIESRLVSLVKMFPDYSIKVMGHSLGGGV

SEQ ID NO: 2954282 - protein, 17 aa, Entamoeba invadens
LQIGLTHYYNHLLNDKP

SEQ ID NO: 2954283 - protein, 19 aa, Entamoeba invadens
LQIHSCKSVTLILGSVNSL

SEQ ID NO: 2954284 - protein, 23 aa, Entamoeba invadens
LQIKEVKQAFVFGDINVSFICAV

SEQ ID NO: 2954285 - protein, 24 aa, Entamoeba invadens
LQIKNAMVGVFERFARKEEDQCKK

SEQ ID NO: 2954286 - protein, 28 aa, Entamoeba invadens
LQILKYCFSSSCTLCYETIQDIDTLSGV

SEQ ID NO: 2954287 - protein, 18 aa, Entamoeba invadens
LQISALIFLRQFVTETSN

SEQ ID NO: 2954288 - protein, 22 aa, Entamoeba invadens
LQKDCWESDVLWDEPQVSARKE

SEQ ID NO: 2954289 - protein, 21 aa, Entamoeba invadens
LQKEVLDLFEIVDKKEMDKDE

SEQ ID NO: 2954290 - protein, 18 aa, Entamoeba invadens
LQKFRCVKYTETDLSKFG

SEQ ID NO: 2954291 - protein, 19 aa, Entamoeba invadens
LQKHLKVVFERYFCQPSTP

SEQ ID NO: 2954292 - protein, 24 aa, Entamoeba invadens
LQKKFEFKTCQVVFDSTRTPLFSN

SEQ ID NO: 2954293 - protein, 26 aa, Entamoeba invadens
LQKKSCLETAKILKEKFCKPTKTKRD

SEQ ID NO: 2954294 - protein, 17 aa, Entamoeba invadens
LQKLKINPFRYGAVIDT

SEQ ID NO: 2954295 - protein, 18 aa, Entamoeba invadens
LQKLKINPFRYGAVIDTI

SEQ ID NO: 2954296 - protein, 19 aa, Entamoeba invadens
LQKLSWKGIAWQLRHKVWK

SEQ ID NO: 2954297 - protein, 19 aa, Entamoeba invadens
LQKNIRIFGINSRNHETVN

SEQ ID NO: 2954298 - protein, 18 aa, Entamoeba invadens
LQKNVGRGILFLKKWKIL

SEQ ID NO: 2954299 - protein, 19 aa, Entamoeba invadens
LQKRIEGLDMISILSLSLL

SEQ ID NO: 2954300 - protein, 23 aa, Entamoeba invadens
LQKRKPKQAKRRGGSWKPTDGPI

SEQ ID NO: 2954301 - protein, 19 aa, Entamoeba invadens
LQKRVTVSCNVTFSQEYPE

SEQ ID NO: 2954302 - protein, 24 aa, Entamoeba invadens
LQKSEIKSILNIIGKSTLKKVYIT

SEQ ID NO: 2954303 - protein, 18 aa, Entamoeba invadens
LQKTTCEFSMKKSNINFI

SEQ ID NO: 2954304 - protein, 21 aa, Entamoeba invadens
LQKYYCSIALLLSTQTANTLA

SEQ ID NO: 2954305 - protein, 25 aa, Entamoeba invadens
LQLECLKCGFDTRYNIQKTPSMPKS

SEQ ID NO: 2954306 - protein, 18 aa, Entamoeba invadens
LQLEILNLIKAVSKSTPQ

SEQ ID NO: 2954307 - protein, 26 aa, Entamoeba invadens
LQLFKEWKSGMPLPMVFVSTSNSVIR

SEQ ID NO: 2954308 - protein, 24 aa, Entamoeba invadens
LQLFKEYLIPVSKYQVSFSHGRIY

SEQ ID NO: 2954309 - protein, 24 aa, Entamoeba invadens
LQLGDTKIEICLWVLNHFSGLQRV

SEQ ID NO: 2954310 - protein, 17 aa, Entamoeba invadens
LQLIFKQCDYYTLMADS

SEQ ID NO: 2954311 - protein, 17 aa, Entamoeba invadens
LQLKQCFSDILKHFPEH

SEQ ID NO: 2954312 - protein, 20 aa, Entamoeba invadens
LQLLADWKMKIYNLKAKELF

SEQ ID NO: 2954313 - protein, 17 aa, Entamoeba invadens
LQLLEKCIDEIKRRVLV

SEQ ID NO: 2954314 - protein, 21 aa, Entamoeba invadens
LQLLHEFSFDEVVFIVECGTN

SEQ ID NO: 2954315 - protein, 17 aa, Entamoeba invadens
LQLLKVFAMSIEEIGDK

SEQ ID NO: 2954316 - protein, 24 aa, Entamoeba invadens
LQLLPICMDGFFLSRKAMADVTGN

SEQ ID NO: 2954317 - protein, 18 aa, Entamoeba invadens
LQLLTRRQCASFLACGFL

SEQ ID NO: 2954318 - protein, 25 aa, Entamoeba invadens
LQLMFKDFQKYLSFANNKLYQRKRI

SEQ ID NO: 2954319 - protein, 17 aa, Entamoeba invadens
LQLSLQFIKSLKEQTAE

SEQ ID NO: 2954320 - protein, 19 aa, Entamoeba invadens
LQLTPKCAEHIVLTSYNGT

SEQ ID NO: 2954321 - protein, 59 aa, Entamoeba invadens
LQLVKKDGIFQIKVRENVPVMGSREGFESEVKRVLNIEESWGKMKKELEMLERTNEKIK

SEQ ID NO: 2954322 - protein, 19 aa, Entamoeba invadens
LQLVLFLKGMGLDMDGTKK

SEQ ID NO: 2954323 - protein, 19 aa, Entamoeba invadens
LQMADWLSTLQNMRIEDVQ

SEQ ID NO: 2954324 - protein, 28 aa, Entamoeba invadens
LQMAVKCKDRLGGIGIALCCHAKGDGHY

SEQ ID NO: 2954325 - protein, 17 aa, Entamoeba invadens
LQMGIVACLVKFKCEVN

SEQ ID NO: 2954326 - protein, 23 aa, Entamoeba invadens
LQMQSLQLGMLWINCIRNEMQAF

SEQ ID NO: 2954327 - protein, 24 aa, Entamoeba invadens
LQMRLVCLSLPLGDSKSLRDWLGV

SEQ ID NO: 2954328 - protein, 18 aa, Entamoeba invadens
LQNARTSGALGFEKFETI

SEQ ID NO: 2954329 - protein, 17 aa, Entamoeba invadens
LQNCLKLTSVDLGDLTT

SEQ ID NO: 2954330 - protein, 19 aa, Entamoeba invadens
LQNCLPTNNSYGWSPTTAY

SEQ ID NO: 2954331 - protein, 17 aa, Entamoeba invadens
LQNCWIIQCNCMKYVDN

SEQ ID NO: 2954332 - protein, 27 aa, Entamoeba invadens
LQNEIVKLKEIIHVLESDLTQTKDDKS

SEQ ID NO: 2954333 - protein, 20 aa, Entamoeba invadens
LQNGLKYVLGHVDPRILLEQ

SEQ ID NO: 2954334 - protein, 26 aa, Entamoeba invadens
LQNGVMRMPLGLLPQRQPITQPQRQQ

SEQ ID NO: 2954335 - protein, 21 aa, Entamoeba invadens
LQNNRFLILQGEVERIALMPA

SEQ ID NO: 2954336 - protein, 19 aa, Entamoeba invadens
LQNSGALIMSGRVNGVIAV

SEQ ID NO: 2954337 - protein, 19 aa, Entamoeba invadens
LQNTGGFYTAVFVKKGETP

SEQ ID NO: 2954338 - protein, 17 aa, Entamoeba invadens
LQPDCFSGMKVEYTTQH

SEQ ID NO: 2954339 - protein, 24 aa, Entamoeba invadens
LQPIFKEILKGMVVAIDTKALTES

SEQ ID NO: 2954340 - protein, 19 aa, Entamoeba invadens
LQPLLPPFIESLLKRIDEI

SEQ ID NO: 2954341 - protein, 17 aa, Entamoeba invadens
LQPLLSLLIDTESVITV

SEQ ID NO: 2954342 - protein, 19 aa, Entamoeba invadens
LQPPIDMLPPPLAPPPLTT

SEQ ID NO: 2954343 - protein, 25 aa, Entamoeba invadens
LQPPLLRNRMSPINFTVQTKLDPIT

SEQ ID NO: 2954344 - protein, 29 aa, Entamoeba invadens
LQPPTGFLFSLQRNGVVFPQKFEGKTKGN

SEQ ID NO: 2954345 - protein, 18 aa, Entamoeba invadens
LQPTFEVGFRIYNQLQNS

SEQ ID NO: 2954346 - protein, 23 aa, Entamoeba invadens
LQQIKLPLALCNIGEEAFGMCTS

SEQ ID NO: 2954347 - protein, 20 aa, Entamoeba invadens
LQQLKFSFNYLCYTPSELSV

SEQ ID NO: 2954348 - protein, 18 aa, Entamoeba invadens
LQQMRGATQMRPMTRENF

SEQ ID NO: 2954349 - protein, 28 aa, Entamoeba invadens
LQQPQPFQWLFIARVIMFSLKRKMGKQD

SEQ ID NO: 2954350 - protein, 18 aa, Entamoeba invadens
LQRAEWDKANGIKDTTAS

SEQ ID NO: 2954351 - protein, 17 aa, Entamoeba invadens
LQRAKVSGIKIIAYSGN

SEQ ID NO: 2954352 - protein, 22 aa, Entamoeba invadens
LQRDKDGLLHMITQLKLDLMHK

SEQ ID NO: 2954353 - protein, 27 aa, Entamoeba invadens
LQRELEMRGTWGLPLLNASGMMRWAEV

SEQ ID NO: 2954354 - protein, 17 aa, Entamoeba invadens
LQRKSIIPFIRPKKATF

SEQ ID NO: 2954355 - protein, 31 aa, Entamoeba invadens
LQRRDKRPNLVREENTLIALKKKLENLRKTA

SEQ ID NO: 2954356 - protein, 24 aa, Entamoeba invadens
LQRRFPLIRLGLLHFYTDKGTLCY

SEQ ID NO: 2954357 - protein, 22 aa, Entamoeba invadens
LQRRPECFACGTKSVDLVLPLH

SEQ ID NO: 2954358 - protein, 24 aa, Entamoeba invadens
LQRRPSGYVRSGLKSVEELRREFE

SEQ ID NO: 2954359 - protein, 22 aa, Entamoeba invadens
LQRRVDALIAKAVEQDRLIFDL

SEQ ID NO: 2954360 - protein, 18 aa, Entamoeba invadens
LQRSASLFTLGGKKNVLK

SEQ ID NO: 2954361 - protein, 21 aa, Entamoeba invadens
LQRTETLSALEKTRNELSTSE

SEQ ID NO: 2954362 - protein, 21 aa, Entamoeba invadens
LQSCEFLKSIFLLNVNCEKLI

SEQ ID NO: 2954363 - protein, 18 aa, Entamoeba invadens
LQSERGIVYLSSIPRGIT

SEQ ID NO: 2954364 - protein, 20 aa, Entamoeba invadens
LQSEVFKMTRIIRGEVVKCV

SEQ ID NO: 2954365 - protein, 20 aa, Entamoeba invadens
LQSFCVMSIVSLDTVTALDL

SEQ ID NO: 2954366 - protein, 17 aa, Entamoeba invadens
LQSHKWFVENGLIVEKK

SEQ ID NO: 2954367 - protein, 22 aa, Entamoeba invadens
LQSIELLYVIMIFQECSAVRGA

SEQ ID NO: 2954368 - protein, 18 aa, Entamoeba invadens
LQSIFPEKEYFSLTTDVY

SEQ ID NO: 2954369 - protein, 19 aa, Entamoeba invadens
LQSIPGYVIATFISSQIVV

SEQ ID NO: 2954370 - protein, 20 aa, Entamoeba invadens
LQSKICRNRILKWKNGNIQL

SEQ ID NO: 2954371 - protein, 25 aa, Entamoeba invadens
LQSLCYLSLKSAHTVKHLLQQQVVM

SEQ ID NO: 2954372 - protein, 19 aa, Entamoeba invadens
LQSLDGLKIVGNLPGQSAW

SEQ ID NO: 2954373 - protein, 18 aa, Entamoeba invadens
LQSLFCIDEQLVKYFGHC

SEQ ID NO: 2954374 - protein, 18 aa, Entamoeba invadens
LQSQLSLLTSQSVSPSFE

SEQ ID NO: 2954375 - protein, 18 aa, Entamoeba invadens
LQSSGCDFLAVYIINSPK

SEQ ID NO: 2954376 - protein, 19 aa, Entamoeba invadens
LQSSLPLKSAQQIMTRIKW

SEQ ID NO: 2954377 - protein, 19 aa, Entamoeba invadens
LQSSRRFGTKPSALTSTSD

SEQ ID NO: 2954378 - protein, 17 aa, Entamoeba invadens
LQTAGLVNFIGRDDKHT

SEQ ID NO: 2954379 - protein, 23 aa, Entamoeba invadens
LQTFQKLEVVFDIRSNYKNYRTT

SEQ ID NO: 2954380 - protein, 18 aa, Entamoeba invadens
LQTITWLFSNICRTRLTT

SEQ ID NO: 2954381 - protein, 23 aa, Entamoeba invadens
LQTKRSSLTLKYETLQKEFNQYK

SEQ ID NO: 2954382 - protein, 21 aa, Entamoeba invadens
LQTLFKRLEKLPVGADTSVSQ

SEQ ID NO: 2954383 - protein, 27 aa, Entamoeba invadens
LQTLKPRPIVWRTNHSFMVADRVEDLT

SEQ ID NO: 2954384 - protein, 22 aa, Entamoeba invadens
LQTLKVYECEGILETISILIEK

SEQ ID NO: 2954385 - protein, 26 aa, Entamoeba invadens
LQTMLFRLERAIRCERFTSGPHTERI

SEQ ID NO: 2954386 - protein, 42 aa, Entamoeba invadens
LQTRKLLVGRCSRCGSIGHTALKCKNAPRFINDILDEIKEQN

SEQ ID NO: 2954387 - protein, 19 aa, Entamoeba invadens
LQVGEMNNAVGIMLAMSTI

SEQ ID NO: 2954388 - protein, 18 aa, Entamoeba invadens
LQVISSFHSVLGLLNGEE

SEQ ID NO: 2954389 - protein, 22 aa, Entamoeba invadens
LQVKYMNNWVVVKASLLLSSNA

SEQ ID NO: 2954390 - protein, 22 aa, Entamoeba invadens
LQVLMKLKFQFELRYFNCDQTI

SEQ ID NO: 2954391 - protein, 23 aa, Entamoeba invadens
LQVLRRLIEVGVRMNDLNNWSGL

SEQ ID NO: 2954392 - protein, 17 aa, Entamoeba invadens
LQVPIKLVKNVPNPEVN

SEQ ID NO: 2954393 - protein, 17 aa, Entamoeba invadens
LQVSLLSLYCKLGQAIG

SEQ ID NO: 2954394 - protein, 27 aa, Entamoeba invadens
LQWDCGIPGKKGTEWEGGIYPLTMDFS

SEQ ID NO: 2954395 - protein, 19 aa, Entamoeba invadens
LQYAHARCCGVERKAGLPI

SEQ ID NO: 2954396 - protein, 22 aa, Entamoeba invadens
LQYWPEESFNVLFDKRRLQGVV

SEQ ID NO: 2954397 - protein, 17 aa, Entamoeba invadens
LQYYRFTEILRFTTNTS

SEQ ID NO: 2954398 - protein, 17 aa, Entamoeba invadens
LRAAMTRVIGKYIEQNE

SEQ ID NO: 2954399 - protein, 18 aa, Entamoeba invadens
LRAAVLHEINEMMPEGIK

SEQ ID NO: 2954400 - protein, 22 aa, Entamoeba invadens
LRAELFLEHYKLVYFDQNQSFT

SEQ ID NO: 2954401 - protein, 17 aa, Entamoeba invadens
LRAFCHCSQIETGTFFT

SEQ ID NO: 2954402 - protein, 20 aa, Entamoeba invadens
LRAIKMNEIIVGKIQCQSIS

SEQ ID NO: 2954403 - protein, 18 aa, Entamoeba invadens
LRAKFYMNVLDKHMIQAA

SEQ ID NO: 2954404 - protein, 19 aa, Entamoeba invadens
LRALITVKDLYSYNRSSCN

SEQ ID NO: 2954405 - protein, 19 aa, Entamoeba invadens
LRALLYFLQIERRNAILNL

SEQ ID NO: 2954406 - protein, 23 aa, Entamoeba invadens
LRALQEIRVLKSLSHENIIKLEE

SEQ ID NO: 2954407 - protein, 20 aa, Entamoeba invadens
LRALVFVKLIGPALVSGLET

SEQ ID NO: 2954408 - protein, 18 aa, Entamoeba invadens
LRAQLRVVERETRNAESR

SEQ ID NO: 2954409 - protein, 19 aa, Entamoeba invadens
LRASLELFNKNNFFIKMGP

SEQ ID NO: 2954410 - protein, 19 aa, Entamoeba invadens
LRASLELFNKNNFFIQMGP

SEQ ID NO: 2954411 - protein, 28 aa, Entamoeba invadens
LRATLIPFPRWGSYQNFALFMAAFDNAD

SEQ ID NO: 2954412 - protein, 18 aa, Entamoeba invadens
LRAYIAYFDGILRFSKDD

SEQ ID NO: 2954413 - protein, 23 aa, Entamoeba invadens
LRAYVKRLMKCILTVLSDKGNSL

SEQ ID NO: 2954414 - protein, 20 aa, Entamoeba invadens
LRCKELKKLFLATENPKRME

SEQ ID NO: 2954415 - protein, 26 aa, Entamoeba invadens
LRCLSGGCKCCICMDVVRKLVDDYTY

SEQ ID NO: 2954416 - protein, 25 aa, Entamoeba invadens
LRCVSFKRVCCVDMSLLEHITQLTE

SEQ ID NO: 2954417 - protein, 29 aa, Entamoeba invadens
LRDALEMMLCCLERSSELFNECNKKRGIY

SEQ ID NO: 2954418 - protein, 20 aa, Entamoeba invadens
LRDALFLFHQCVVCPNKSLT

SEQ ID NO: 2954419 - protein, 17 aa, Entamoeba invadens
LRDAMGLTHTTGKGNVP

SEQ ID NO: 2954420 - protein, 26 aa, Entamoeba invadens
LRDAQFMWHPSGKKLVVRCLKPTKTT

SEQ ID NO: 2954421 - protein, 18 aa, Entamoeba invadens
LRDFCSRVVDFITAVSDI

SEQ ID NO: 2954422 - protein, 25 aa, Entamoeba invadens
LRDGTGYCQCVIFGKELCDAEKVKF

SEQ ID NO: 2954423 - protein, 21 aa, Entamoeba invadens
LRDIPSFECTFISSGNMFNCE

SEQ ID NO: 2954424 - protein, 26 aa, Entamoeba invadens
LRDKRLLLDVTICYRKCYKGMDPTVI

SEQ ID NO: 2954425 - protein, 25 aa, Entamoeba invadens
LRDNPDCYSSILARRRSRRKSRASR

SEQ ID NO: 2954426 - protein, 25 aa, Entamoeba invadens
LRDPEWCGGLITHLIKEDPDFGKND

SEQ ID NO: 2954427 - protein, 21 aa, Entamoeba invadens
LRDRIGQNFKEICVTNIEGLS

SEQ ID NO: 2954428 - protein, 19 aa, Entamoeba invadens
LRDTEDWIIHLQMTDKKKD

SEQ ID NO: 2954429 - protein, 20 aa, Entamoeba invadens
LRDVCLQSAAAPGYFDPLNN

SEQ ID NO: 2954430 - protein, 23 aa, Entamoeba invadens
LRDVIHAPLFRQFRDLLGYPSQP

SEQ ID NO: 2954431 - protein, 25 aa, Entamoeba invadens
LRDVQRPVIVLSMFNEKEVSAYKKA

SEQ ID NO: 2954432 - protein, 19 aa, Entamoeba invadens
LRDVRKLANPVWSFSAHTK

SEQ ID NO: 2954433 - protein, 24 aa, Entamoeba invadens
LRDVVKEAVGYPWNVYDLTGTPLE

SEQ ID NO: 2954434 - protein, 28 aa, Entamoeba invadens
LREAFTMFDQLFRYFGMKKAEFLKPGFQ

SEQ ID NO: 2954435 - protein, 24 aa, Entamoeba invadens
LREAILYHIFTFFASVNISDYASW

SEQ ID NO: 2954436 - protein, 31 aa, Entamoeba invadens
LREAVPKIHINFCFKIFRVLPNALYLNKTKP

SEQ ID NO: 2954437 - protein, 17 aa, Entamoeba invadens
LRECMKKDIVIYSVGAE

SEQ ID NO: 2954438 - protein, 24 aa, Entamoeba invadens
LREEGRRLRGRWENVNKRILNYVK

SEQ ID NO: 2954439 - protein, 21 aa, Entamoeba invadens
LREFCPKILNLLGTTERSVTS

SEQ ID NO: 2954440 - protein, 23 aa, Entamoeba invadens
LREFNMFMVNGLLYVFGGEIPLT

SEQ ID NO: 2954441 - protein, 20 aa, Entamoeba invadens
LREGSFGIVFKGTYRGNVVA

SEQ ID NO: 2954442 - protein, 23 aa, Entamoeba invadens
LREIRCLRLKHTLSCKENEEPQK

SEQ ID NO: 2954443 - protein, 23 aa, Entamoeba invadens
LREISFPKSLKIVCKNLFENNKQ

SEQ ID NO: 2954444 - protein, 26 aa, Entamoeba invadens
LREKASRSLGELMVNTRNNSIVPVAK

SEQ ID NO: 2954445 - protein, 26 aa, Entamoeba invadens
LREKGYKIGILRPAFITGNSKSGCCN

SEQ ID NO: 2954446 - protein, 20 aa, Entamoeba invadens
LREKMCPIKSTVKISDNPPL

SEQ ID NO: 2954447 - protein, 19 aa, Entamoeba invadens
LREKYEKMRDLYGADLSDM

SEQ ID NO: 2954448 - protein, 17 aa, Entamoeba invadens
LRELFNMFFKVEFFERV

SEQ ID NO: 2954449 - protein, 17 aa, Entamoeba invadens
LREMPKPILNYSDKAIL

SEQ ID NO: 2954450 - protein, 19 aa, Entamoeba invadens
LREPRCTDAILDLMEAERV

SEQ ID NO: 2954451 - protein, 19 aa, Entamoeba invadens
LREPYSIIRFFIERLPLEK

SEQ ID NO: 2954452 - protein, 24 aa, Entamoeba invadens
LREQKPVSWKSFFNKKPTTTELKV

SEQ ID NO: 2954453 - protein, 22 aa, Entamoeba invadens
LRERAGRCVVNLIQLLKNSRQL

SEQ ID NO: 2954454 - protein, 26 aa, Entamoeba invadens
LRERALKLLCRFLDLGPWACDQALEV

SEQ ID NO: 2954455 - protein, 24 aa, Entamoeba invadens
LRERFKRNFNGGVGIIELLYKSNL

SEQ ID NO: 2954456 - protein, 18 aa, Entamoeba invadens
LRERIKRIFTVKEGGVLY

SEQ ID NO: 2954457 - protein, 18 aa, Entamoeba invadens
LRESHGGSTFCAIQSISL

SEQ ID NO: 2954458 - protein, 21 aa, Entamoeba invadens
LRESRFKSIIAEFEKKEKEVE

SEQ ID NO: 2954459 - protein, 19 aa, Entamoeba invadens
LREVIKNEFGEYKEHVDEF

SEQ ID NO: 2954460 - protein, 19 aa, Entamoeba invadens
LRFAPVQMNGGINPPPPSG

SEQ ID NO: 2954461 - protein, 26 aa, Entamoeba invadens
LRFDTLKMIFKSGAFEKDVYNPLTKI

SEQ ID NO: 2954462 - protein, 17 aa, Entamoeba invadens
LRFGNDILDIQKFVRVR

SEQ ID NO: 2954463 - protein, 20 aa, Entamoeba invadens
LRFHARFLLVCLLTDKLKQG

SEQ ID NO: 2954464 - protein, 22 aa, Entamoeba invadens
LRFIGKSCFAYCSSLCEINLPP

SEQ ID NO: 2954465 - protein, 17 aa, Entamoeba invadens
LRFKAHDLLVATNRQAS

SEQ ID NO: 2954466 - protein, 17 aa, Entamoeba invadens
LRFKNATCLVVCDGCGW

SEQ ID NO: 2954467 - protein, 21 aa, Entamoeba invadens
LRFMIDPHNLPSILFEIYDWD

SEQ ID NO: 2954468 - protein, 19 aa, Entamoeba invadens
LRFPSSYPVIAKILRVDGN

SEQ ID NO: 2954469 - protein, 19 aa, Entamoeba invadens
LRFQNFYYFAEFLADDVIT

SEQ ID NO: 2954470 - protein, 19 aa, Entamoeba invadens
LRFQYMRTGDGYVIVYSIT

SEQ ID NO: 2954471 - protein, 26 aa, Entamoeba invadens
LRFVPFPPNVHRLGNFSFARCNLLTT

SEQ ID NO: 2954472 - protein, 19 aa, Entamoeba invadens
LRGHISKIYAMHWAADSTH

SEQ ID NO: 2954473 - protein, 17 aa, Entamoeba invadens
LRGIAYAVYHTRELAEN

SEQ ID NO: 2954474 - protein, 22 aa, Entamoeba invadens
LRGICILPVAAVIGSESLCEER

SEQ ID NO: 2954475 - protein, 18 aa, Entamoeba invadens
LRGKCVQCIVSSIENVTN

SEQ ID NO: 2954476 - protein, 17 aa, Entamoeba invadens
LRGLKYLPPTYIEFLKG

SEQ ID NO: 2954477 - protein, 20 aa, Entamoeba invadens
LRGNCQLTKIDVLDTKLWEN

SEQ ID NO: 2954478 - protein, 21 aa, Entamoeba invadens
LRGNHECRLLTTFFNFRQECC

SEQ ID NO: 2954479 - protein, 21 aa, Entamoeba invadens
LRGRASIALVTWDNYKTCVGC

SEQ ID NO: 2954480 - protein, 18 aa, Entamoeba invadens
LRGSCKLGNNCGYLHEYD

SEQ ID NO: 2954481 - protein, 22 aa, Entamoeba invadens
LRGSKWRKALLDAFNHCTLIQS

SEQ ID NO: 2954482 - protein, 26 aa, Entamoeba invadens
LRGTYAYCAPEIYFSQPFTEKSDVYS

SEQ ID NO: 2954483 - protein, 28 aa, Entamoeba invadens
LRGVTMFCCRECRGKYQSAVSNFYMEKC

SEQ ID NO: 2954484 - protein, 19 aa, Entamoeba invadens
LRGYDCGYVPQNFTTITSA

SEQ ID NO: 2954485 - protein, 17 aa, Entamoeba invadens
LRGYIVVDDTLRVIEPI

SEQ ID NO: 2954486 - protein, 18 aa, Entamoeba invadens
LRGYPTYQKIRIIKRDLE

SEQ ID NO: 2954487 - protein, 18 aa, Entamoeba invadens
LRHDKFVPVRVEIAQNKG

SEQ ID NO: 2954488 - protein, 17 aa, Entamoeba invadens
LRHGKFHAASAVMKELY

SEQ ID NO: 2954489 - protein, 25 aa, Entamoeba invadens
LRHLKHKRRWLWTTKRRPRRLPRTN

SEQ ID NO: 2954490 - protein, 18 aa, Entamoeba invadens
LRHQMCRVCESGMVINLQ

SEQ ID NO: 2954491 - protein, 18 aa, Entamoeba invadens
LRHSFTFDKTEPVIPAHT

SEQ ID NO: 2954492 - protein, 17 aa, Entamoeba invadens
LRIAEALKNCTSYKTLS

SEQ ID NO: 2954493 - protein, 20 aa, Entamoeba invadens
LRIAEKLRMKSVNILNKFLD

SEQ ID NO: 2954494 - protein, 23 aa, Entamoeba invadens
LRIAKLPRGPTCLFKVEEYSLKK

SEQ ID NO: 2954495 - protein, 17 aa, Entamoeba invadens
LRIANVVQNIDVKNKYR

SEQ ID NO: 2954496 - protein, 21 aa, Entamoeba invadens
LRIEFCHLESIKIPFEQLVNL

SEQ ID NO: 2954497 - protein, 18 aa, Entamoeba invadens
LRIEIDLYTLPEDLTKCD

SEQ ID NO: 2954498 - protein, 17 aa, Entamoeba invadens
LRIELARVVLSLVNSQY

SEQ ID NO: 2954499 - protein, 21 aa, Entamoeba invadens
LRIFYQVCHAVAYMHSQNPPL

SEQ ID NO: 2954500 - protein, 17 aa, Entamoeba invadens
LRIGEIVERHLEDGDIV

SEQ ID NO: 2954501 - protein, 19 aa, Entamoeba invadens
LRIHHVIKISHLKVAESER

SEQ ID NO: 2954502 - protein, 24 aa, Entamoeba invadens
LRIIDFGSACFSTYTLYSYIQSRH

SEQ ID NO: 2954503 - protein, 20 aa, Entamoeba invadens
LRIKCQRGSAMVFDQIFWVA

SEQ ID NO: 2954504 - protein, 18 aa, Entamoeba invadens
LRIKFEHVKNFVYPFEEL

SEQ ID NO: 2954505 - protein, 20 aa, Entamoeba invadens
LRILEFFSGIGGLRASLERS

SEQ ID NO: 2954506 - protein, 19 aa, Entamoeba invadens
LRILLPLENSFVVPKEFLS

SEQ ID NO: 2954507 - protein, 17 aa, Entamoeba invadens
LRIPFLREAGMETMGYS

SEQ ID NO: 2954508 - protein, 21 aa, Entamoeba invadens
LRIPNAKTFVWTFPCQLSKAQ

SEQ ID NO: 2954509 - protein, 19 aa, Entamoeba invadens
LRIQLELFFHRVEEKNENG

SEQ ID NO: 2954510 - protein, 17 aa, Entamoeba invadens
LRIQYRDALISIIIEVA

SEQ ID NO: 2954511 - protein, 25 aa, Entamoeba invadens
LRIVVYRNLLDFVFRTKKVTKMHLE

SEQ ID NO: 2954512 - protein, 22 aa, Entamoeba invadens
LRKAAHTQLPFHIAKKKVGYID

SEQ ID NO: 2954513 - protein, 25 aa, Entamoeba invadens
LRKAKNCGSGMIVTKNVGIAQKIAD

SEQ ID NO: 2954514 - protein, 24 aa, Entamoeba invadens
LRKAKQRNVELERSISLAEKTKDD

SEQ ID NO: 2954515 - protein, 28 aa, Entamoeba invadens
LRKDKIDFSRFAILSAKLFIMLESLNGD

SEQ ID NO: 2954516 - protein, 34 aa, Entamoeba invadens
LRKEKEDFVILPYKLKVRMLFDTARGMQFLHENK

SEQ ID NO: 2954517 - protein, 18 aa, Entamoeba invadens
LRKEWLRELIRNEEEEDS

SEQ ID NO: 2954518 - protein, 22 aa, Entamoeba invadens
LRKEYSCDITIDWTHAKQYLSS

SEQ ID NO: 2954519 - protein, 21 aa, Entamoeba invadens
LRKFLQILRPVFRTQANEVVL

SEQ ID NO: 2954520 - protein, 18 aa, Entamoeba invadens
LRKFMSINNWMDAIQSEL

SEQ ID NO: 2954521 - protein, 27 aa, Entamoeba invadens
LRKFQSFKVFFNWAKNISGFRFVIIIT

SEQ ID NO: 2954522 - protein, 23 aa, Entamoeba invadens
LRKGCACEFEVFISPVCTCKIDS

SEQ ID NO: 2954523 - protein, 20 aa, Entamoeba invadens
LRKGIVLNILNSNPFALNPM

SEQ ID NO: 2954524 - protein, 20 aa, Entamoeba invadens
LRKILKPVVDKIFESKQRPA

SEQ ID NO: 2954525 - protein, 25 aa, Entamoeba invadens
LRKKEGQLICGFAMETQDLIKNATE

SEQ ID NO: 2954526 - protein, 19 aa, Entamoeba invadens
LRKLDVMDFLVKPLQRLTK

SEQ ID NO: 2954527 - protein, 23 aa, Entamoeba invadens
LRKLSGDCLVSLVKERSDMFCEV

SEQ ID NO: 2954528 - protein, 25 aa, Entamoeba invadens
LRKNALRFYPIVPMADSDLTMKTKP

SEQ ID NO: 2954529 - protein, 20 aa, Entamoeba invadens
LRKNAVKCVVREAQINLKRR

SEQ ID NO: 2954530 - protein, 21 aa, Entamoeba invadens
LRKNMKNAFRVSKGVNAFQKV

SEQ ID NO: 2954531 - protein, 17 aa, Entamoeba invadens
LRKNSLLVKSFYDVAEN

SEQ ID NO: 2954532 - protein, 20 aa, Entamoeba invadens
LRKNVPYVVLRRCVDTLSNI

SEQ ID NO: 2954533 - protein, 23 aa, Entamoeba invadens
LRKQYNYVFVCCGRQSPYTFDKA

SEQ ID NO: 2954534 - protein, 34 aa, Entamoeba invadens
LRKSEGLFREMKRIKGFELLNLFIYKKAKLMSTD

SEQ ID NO: 2954535 - protein, 25 aa, Entamoeba invadens
LRKSLNSILDFVEKLQIEATNRLKK

SEQ ID NO: 2954536 - protein, 24 aa, Entamoeba invadens
LRKSLRLNTFVFRPHCGETGDPMH

SEQ ID NO: 2954537 - protein, 19 aa, Entamoeba invadens
LRKSLVFVEFFLLERENWI

SEQ ID NO: 2954538 - protein, 19 aa, Entamoeba invadens
LRKTEILEHQPNWGAIDAL

SEQ ID NO: 2954539 - protein, 18 aa, Entamoeba invadens
LRKTNRGSIEPLSLDDLA

SEQ ID NO: 2954540 - protein, 22 aa, Entamoeba invadens
LRKTRPNVRVCLVEFESNCRIY

SEQ ID NO: 2954541 - protein, 18 aa, Entamoeba invadens
LRKYEVFRSEALKQPQAK

SEQ ID NO: 2954542 - protein, 18 aa, Entamoeba invadens
LRKYHGYDIIHFPQSLKR

SEQ ID NO: 2954543 - protein, 33 aa, Entamoeba invadens
LRKYPIDVLKCLPVFKIKRVPYGEIVWENVDVT

SEQ ID NO: 2954544 - protein, 17 aa, Entamoeba invadens
LRLAFAEDDVMQEVNSY

SEQ ID NO: 2954545 - protein, 22 aa, Entamoeba invadens
LRLEAIKVINVIMDKCVCPTDK

SEQ ID NO: 2954546 - protein, 20 aa, Entamoeba invadens
LRLFIEKHIDFLKKSFQCVS

SEQ ID NO: 2954547 - protein, 17 aa, Entamoeba invadens
LRLFQCFSREEDVMVRD

SEQ ID NO: 2954548 - protein, 20 aa, Entamoeba invadens
LRLHTLLQWIKEMLQLIKDK

SEQ ID NO: 2954549 - protein, 18 aa, Entamoeba invadens
LRLLENFDGALFVTSNRP

SEQ ID NO: 2954550 - protein, 19 aa, Entamoeba invadens
LRLNISMTVTTALKTSKKI

SEQ ID NO: 2954551 - protein, 30 aa, Entamoeba invadens
LRLQECREKGILPWLCPDAKTQVTLEYEDV

SEQ ID NO: 2954552 - protein, 17 aa, Entamoeba invadens
LRLQQEYFFSSATIMDI

SEQ ID NO: 2954553 - protein, 18 aa, Entamoeba invadens
LRLSATQTLIEYSLSPLH

SEQ ID NO: 2954554 - protein, 21 aa, Entamoeba invadens
LRLSNGLTEFEFEREIEPVIV

SEQ ID NO: 2954555 - protein, 19 aa, Entamoeba invadens
LRLTLGELCNIDPMTRRII

SEQ ID NO: 2954556 - protein, 17 aa, Entamoeba invadens
LRLYECINNVVRFEDTK

SEQ ID NO: 2954557 - protein, 21 aa, Entamoeba invadens
LRLYFGEKVSTGFSRLSLSGN

SEQ ID NO: 2954558 - protein, 17 aa, Entamoeba invadens
LRLYSGYEEMVGVDEND

SEQ ID NO: 2954559 - protein, 19 aa, Entamoeba invadens
LRMAYDIGKTAGLHHIYVG

SEQ ID NO: 2954560 - protein, 20 aa, Entamoeba invadens
LRMKDCCVENTDGLILDQRM

SEQ ID NO: 2954561 - protein, 25 aa, Entamoeba invadens
LRMLFWKIAKREGIQFDGQFDWFNY

SEQ ID NO: 2954562 - protein, 23 aa, Entamoeba invadens
LRMLPEPLLTYKIGETISNMFAN

SEQ ID NO: 2954563 - protein, 18 aa, Entamoeba invadens
LRMNAEQALSHPWFKGVS

SEQ ID NO: 2954564 - protein, 19 aa, Entamoeba invadens
LRMSLKENQHEILMNETMD

SEQ ID NO: 2954565 - protein, 20 aa, Entamoeba invadens
LRMVDHFVFHHHICIVTELL

SEQ ID NO: 2954566 - protein, 17 aa, Entamoeba invadens
LRNGFGYALKDPITNQY

SEQ ID NO: 2954567 - protein, 25 aa, Entamoeba invadens
LRNIKENVHLPILFVGNKSDLEIQR

SEQ ID NO: 2954568 - protein, 19 aa, Entamoeba invadens
LRNIQKWDNLLGVTIVVPE

SEQ ID NO: 2954569 - protein, 17 aa, Entamoeba invadens
LRNKIYNSVYWKERCFG

SEQ ID NO: 2954570 - protein, 23 aa, Entamoeba invadens
LRNKTAKCGVLFFNDKTEHSPRL

SEQ ID NO: 2954571 - protein, 19 aa, Entamoeba invadens
LRNLDCPDVEPPKYSSYYE

SEQ ID NO: 2954572 - protein, 18 aa, Entamoeba invadens
LRNLFPFFEEHFERPFTD

SEQ ID NO: 2954573 - protein, 19 aa, Entamoeba invadens
LRNRRKALCDRTLREKEQL

SEQ ID NO: 2954574 - protein, 25 aa, Entamoeba invadens
LRNSVLFDCLIKVRFENETGEDVGG

SEQ ID NO: 2954575 - protein, 20 aa, Entamoeba invadens
LRNVAKLGIGEGVFELSKED

SEQ ID NO: 2954576 - protein, 24 aa, Entamoeba invadens
LRNVKVRRGYLCLDNTNCQLLGGE

SEQ ID NO: 2954577 - protein, 18 aa, Entamoeba invadens
LRNVSIPKILNYIASTIC

SEQ ID NO: 2954578 - protein, 19 aa, Entamoeba invadens
LRNYMAVWVYENRYEYAIH

SEQ ID NO: 2954579 - protein, 26 aa, Entamoeba invadens
LRNYRFINKRALEEIRCLKVNSHSIY

SEQ ID NO: 2954580 - protein, 22 aa, Entamoeba invadens
LRPETAQGIFTMFKRNLEYNGG

SEQ ID NO: 2954581 - protein, 27 aa, Entamoeba invadens
LRPFCGGVEKIPFVAPKPVWTKEDKKK

SEQ ID NO: 2954582 - protein, 20 aa, Entamoeba invadens
LRPIIEMAISISDKKDKVGE

SEQ ID NO: 2954583 - protein, 21 aa, Entamoeba invadens
LRPITKITVSFSIHYVTHFGE

SEQ ID NO: 2954584 - protein, 20 aa, Entamoeba invadens
LRPLLETMFECVFACTSNQL

SEQ ID NO: 2954585 - protein, 18 aa, Entamoeba invadens
LRPLSKIMSRLSIDDSVE

SEQ ID NO: 2954586 - protein, 22 aa, Entamoeba invadens
LRPLSYPGTDLFIVCYSTIQSI

SEQ ID NO: 2954587 - protein, 21 aa, Entamoeba invadens
LRPLSYPMTDVFLICFSVISK

SEQ ID NO: 2954588 - protein, 19 aa, Entamoeba invadens
LRPQMCSLGGYPSFAQTDP

SEQ ID NO: 2954589 - protein, 19 aa, Entamoeba invadens
LRPTIPPSTPQKMATLIRQ

SEQ ID NO: 2954590 - protein, 26 aa, Entamoeba invadens
LRPTVRLAALSGYPAIYVFTHDSIGV

SEQ ID NO: 2954591 - protein, 24 aa, Entamoeba invadens
LRPVCRRAETISFLFPTGGNANWG

SEQ ID NO: 2954592 - protein, 18 aa, Entamoeba invadens
LRPVLKPSVLPKRTTPKK

SEQ ID NO: 2954593 - protein, 22 aa, Entamoeba invadens
LRPYGVGLLVVGYDTKARLFET

SEQ ID NO: 2954594 - protein, 18 aa, Entamoeba invadens
LRQDVCKQIEFFVDAEKY

SEQ ID NO: 2954595 - protein, 21 aa, Entamoeba invadens
LRQFNALAFPILRLLIPHCEK

SEQ ID NO: 2954596 - protein, 30 aa, Entamoeba invadens
LRQKKWVFHKGYQKWFRKVNDNGFTSNVSE

SEQ ID NO: 2954597 - protein, 20 aa, Entamoeba invadens
LRQLKVISVRFFDFSVFLCP

SEQ ID NO: 2954598 - protein, 25 aa, Entamoeba invadens
LRQMAMKEIRIMKLFHHPNICSFFD

SEQ ID NO: 2954599 - protein, 18 aa, Entamoeba invadens
LRQRIFIVSDLNDSTLKL

SEQ ID NO: 2954600 - protein, 17 aa, Entamoeba invadens
LRQSVPVAVLFASSFQL

SEQ ID NO: 2954601 - protein, 20 aa, Entamoeba invadens
LRQTIKMTFLTVVNGNAMNV

SEQ ID NO: 2954602 - protein, 18 aa, Entamoeba invadens
LRRAKITLEAAQKRAAKP

SEQ ID NO: 2954603 - protein, 22 aa, Entamoeba invadens
LRRDFNKKAGIERNERQSQPSV

SEQ ID NO: 2954604 - protein, 25 aa, Entamoeba invadens
LRRGFRRSEIRGGLESAIEILENTP

SEQ ID NO: 2954605 - protein, 18 aa, Entamoeba invadens
LRRGQKVALSYNKDVQPI

SEQ ID NO: 2954606 - protein, 21 aa, Entamoeba invadens
LRRKDCPWTKQKKCNIIEDDD

SEQ ID NO: 2954607 - protein, 19 aa, Entamoeba invadens
LRRKLKKLRMRKAQIEKFR

SEQ ID NO: 2954608 - protein, 23 aa, Entamoeba invadens
LRRKMGNFFLCHGGISPDLGLIS

SEQ ID NO: 2954609 - protein, 30 aa, Entamoeba invadens
LRRMCIFKTCPEIAVEIALETLEIFNKNKQ

SEQ ID NO: 2954610 - protein, 18 aa, Entamoeba invadens
LRRNYSIKDISTLQWDRT

SEQ ID NO: 2954611 - protein, 17 aa, Entamoeba invadens
LRRTIQFTLKKNPVDDY

SEQ ID NO: 2954612 - protein, 19 aa, Entamoeba invadens
LRRTSRWLDKVKTMRDYKT

SEQ ID NO: 2954613 - protein, 23 aa, Entamoeba invadens
LRRVQFPVIPAFAMTINKSQGQS

SEQ ID NO: 2954614 - protein, 24 aa, Entamoeba invadens
LRSDKRIDFVGGIRGLGELKRRVD

SEQ ID NO: 2954615 - protein, 22 aa, Entamoeba invadens
LRSEICGKRSLLFVFQTKEYVF

SEQ ID NO: 2954616 - protein, 18 aa, Entamoeba invadens
LRSFFVDYVKLMKVNNKP

SEQ ID NO: 2954617 - protein, 19 aa, Entamoeba invadens
LRSGVDIVVGTPGRVLDHI

SEQ ID NO: 2954618 - protein, 33 aa, Entamoeba invadens
LRSKKVRARDSVYEIFQRFLIKKEKKEEKLINV

SEQ ID NO: 2954619 - protein, 24 aa, Entamoeba invadens
LRSKPDDFVLFGFGEHFSQGVSKR

SEQ ID NO: 2954620 - protein, 28 aa, Entamoeba invadens
LRSKPTLSEWFRKMCDLEEKDTKKWNQL

SEQ ID NO: 2954621 - protein, 19 aa, Entamoeba invadens
LRSLCEIFSKKACTTLRRA

SEQ ID NO: 2954622 - protein, 25 aa, Entamoeba invadens
LRSLISYKQKLAFIVETQDNIFGFY

SEQ ID NO: 2954623 - protein, 21 aa, Entamoeba invadens
LRSLLKLCSKIDSMSDINEMN

SEQ ID NO: 2954624 - protein, 26 aa, Entamoeba invadens
LRSLPSGQHKILWGVIMKYIVSLDSP

SEQ ID NO: 2954625 - protein, 23 aa, Entamoeba invadens
LRSNGRLGSPMKFDMKKSESETA

SEQ ID NO: 2954626 - protein, 20 aa, Entamoeba invadens
LRSNISCKDRLIFIFRVNGD

SEQ ID NO: 2954627 - protein, 28 aa, Entamoeba invadens
LRSNISCKDRLIFIFRVNGDIFGFYQDG

SEQ ID NO: 2954628 - protein, 21 aa, Entamoeba invadens
LRSNKFLNFLSHQRVISLMRN

SEQ ID NO: 2954629 - protein, 24 aa, Entamoeba invadens
LRSNTCKSIALGKFETVEKALTLG

SEQ ID NO: 2954630 - protein, 17 aa, Entamoeba invadens
LRSSLVMNDNDEQNSEG

SEQ ID NO: 2954631 - protein, 20 aa, Entamoeba invadens
LRSVEFARDFSVIGQRCFAG

SEQ ID NO: 2954632 - protein, 17 aa, Entamoeba invadens
LRSVVCGTYELVNYINP

SEQ ID NO: 2954633 - protein, 20 aa, Entamoeba invadens
LRSYLIMPVQRLPRYKLLLQ

SEQ ID NO: 2954634 - protein, 20 aa, Entamoeba invadens
LRSYVAPAFSFGTQAVKQVI

SEQ ID NO: 2954635 - protein, 23 aa, Entamoeba invadens
LRTAVKGIPGYWYHVLENSCYLE

SEQ ID NO: 2954636 - protein, 33 aa, Entamoeba invadens
LRTEKYSICLISFYCWEVFFRKLVMRADTCLQQ

SEQ ID NO: 2954637 - protein, 18 aa, Entamoeba invadens
LRTFKRVFATPIQRAQDG

SEQ ID NO: 2954638 - protein, 20 aa, Entamoeba invadens
LRTIDVGSFVLARGVETKKF

SEQ ID NO: 2954639 - protein, 19 aa, Entamoeba invadens
LRTKFVLDASKGILYFMRM

SEQ ID NO: 2954640 - protein, 21 aa, Entamoeba invadens
LRTKMKYNGCNEDCRLVVWEI

SEQ ID NO: 2954641 - protein, 23 aa, Entamoeba invadens
LRTKTTFKRNVDMFWDKTGQLIM

SEQ ID NO: 2954642 - protein, 26 aa, Entamoeba invadens
LRTLSYRDVDCFVVLFSYDSKESLIH

SEQ ID NO: 2954643 - protein, 21 aa, Entamoeba invadens
LRTPEAVKRALLFAERALAVD

SEQ ID NO: 2954644 - protein, 18 aa, Entamoeba invadens
LRTQFSCLLKRKMKKENH

SEQ ID NO: 2954645 - protein, 28 aa, Entamoeba invadens
LRTQKFCIDESVALKLAVMYLICAEFIP

SEQ ID NO: 2954646 - protein, 27 aa, Entamoeba invadens
LRTSTSCPHFKPKKLVTRNSYYKTETP

SEQ ID NO: 2954647 - protein, 18 aa, Entamoeba invadens
LRTVCKYFQNIEDFVSMI

SEQ ID NO: 2954648 - protein, 27 aa, Entamoeba invadens
LRTVEVPRLTSLVAHSSASYFVVGSSE

SEQ ID NO: 2954649 - protein, 34 aa, Entamoeba invadens
LRVAKSVDDLKMFKFQIVKEFTFNADVTLEVHPV

SEQ ID NO: 2954650 - protein, 17 aa, Entamoeba invadens
LRVALINAIGNRKAEKA

SEQ ID NO: 2954651 - protein, 20 aa, Entamoeba invadens
LRVCQLRLQPTLKNLEETFS

SEQ ID NO: 2954652 - protein, 20 aa, Entamoeba invadens
LRVDIKKGRIEKLIRTKQIA

SEQ ID NO: 2954653 - protein, 19 aa, Entamoeba invadens
LRVEGCVASGYAYSLMGEH

SEQ ID NO: 2954654 - protein, 25 aa, Entamoeba invadens
LRVERIHMIASGWKDDVPPKMSKDE

SEQ ID NO: 2954655 - protein, 18 aa, Entamoeba invadens
LRVFDYILMDGIVALMSV

SEQ ID NO: 2954656 - protein, 18 aa, Entamoeba invadens
LRVFLKTYCNTFSDGFIN

SEQ ID NO: 2954657 - protein, 20 aa, Entamoeba invadens
LRVGSPIVRENYRTVIQYTP

SEQ ID NO: 2954658 - protein, 17 aa, Entamoeba invadens
LRVGTSCKHPCTAKCHP

SEQ ID NO: 2954659 - protein, 18 aa, Entamoeba invadens
LRVIKQVDELKSWKFRIT

SEQ ID NO: 2954660 - protein, 25 aa, Entamoeba invadens
LRVKEASNFPIVFVANKVDLVKDRD

SEQ ID NO: 2954661 - protein, 17 aa, Entamoeba invadens
LRVKEEISRKVFAKVGT

SEQ ID NO: 2954662 - protein, 18 aa, Entamoeba invadens
LRVKELERRVYRWMLPVL

SEQ ID NO: 2954663 - protein, 22 aa, Entamoeba invadens
LRVKETPTFPIVFVANKVDLVK

SEQ ID NO: 2954664 - protein, 19 aa, Entamoeba invadens
LRVKFCLDTSKGILYLHTN

SEQ ID NO: 2954665 - protein, 19 aa, Entamoeba invadens
LRVKICLDAAKGILYLHEN

SEQ ID NO: 2954666 - protein, 18 aa, Entamoeba invadens
LRVKRIVNGKAKYPVDGV

SEQ ID NO: 2954667 - protein, 18 aa, Entamoeba invadens
LRVKYMIDAAKGISYLHE

SEQ ID NO: 2954668 - protein, 18 aa, Entamoeba invadens
LRVKYMIDAAKGISYLHT

SEQ ID NO: 2954669 - protein, 18 aa, Entamoeba invadens
LRVLIKTLGDEGGERKDV

SEQ ID NO: 2954670 - protein, 20 aa, Entamoeba invadens
LRVLMEIVEKGYMWDKVRVK

SEQ ID NO: 2954671 - protein, 17 aa, Entamoeba invadens
LRVLNMNGCKKVDISGV

SEQ ID NO: 2954672 - protein, 25 aa, Entamoeba invadens
LRVLVLRFVALLVRSHVGVKTVKEM

SEQ ID NO: 2954673 - protein, 27 aa, Entamoeba invadens
LRVLYRLKCQLSLRFTQISQSVNMNSV

SEQ ID NO: 2954674 - protein, 22 aa, Entamoeba invadens
LRVPADNVIFVFGNHERAVKEK

SEQ ID NO: 2954675 - protein, 17 aa, Entamoeba invadens
LRVPGFDERVCSIVDIL

SEQ ID NO: 2954676 - protein, 28 aa, Entamoeba invadens
LRVPSTFDLKRICRVTGSTPFISLTSEC

SEQ ID NO: 2954677 - protein, 22 aa, Entamoeba invadens
LRVQEICYLRKSAYQIVNEEKK

SEQ ID NO: 2954678 - protein, 22 aa, Entamoeba invadens
LRVSEKFLEKILRDKEEIDSVA

SEQ ID NO: 2954679 - protein, 18 aa, Entamoeba invadens
LRVSICNNLEDSFEPDTK

SEQ ID NO: 2954680 - protein, 18 aa, Entamoeba invadens
LRVSKKMFKAVQMHFPTF

SEQ ID NO: 2954681 - protein, 25 aa, Entamoeba invadens
LRVSMKPERHFAFIATPTRSDAERL

SEQ ID NO: 2954682 - protein, 24 aa, Entamoeba invadens
LRVSYKCGYNYFAPEILEKKELGF

SEQ ID NO: 2954683 - protein, 31 aa, Entamoeba invadens
LRWKDASMRRMGLRYVLMLVKGFVDASTEGK

SEQ ID NO: 2954684 - protein, 19 aa, Entamoeba invadens
LRYAERVGYPLVFCSSNTG

SEQ ID NO: 2954685 - protein, 17 aa, Entamoeba invadens
LRYAQGFSNDIFDEACR

SEQ ID NO: 2954686 - protein, 18 aa, Entamoeba invadens
LRYDNRIFLYENEINDNL

SEQ ID NO: 2954687 - protein, 17 aa, Entamoeba invadens
LRYFIDHVNYRFAKRKK

SEQ ID NO: 2954688 - protein, 17 aa, Entamoeba invadens
LRYLCKVINDGSLAAYP

SEQ ID NO: 2954689 - protein, 20 aa, Entamoeba invadens
LRYLDAISILYIKYNLQIKC

SEQ ID NO: 2954690 - protein, 19 aa, Entamoeba invadens
LRYLENFFASKAFQNTLND

SEQ ID NO: 2954691 - protein, 17 aa, Entamoeba invadens
LRYLGILLYMGAHHDII

SEQ ID NO: 2954692 - protein, 31 aa, Entamoeba invadens
LRYMIDAGIVGCSWVKAPPKRYVIIPDSNRI

SEQ ID NO: 2954693 - protein, 26 aa, Entamoeba invadens
LRYNFKTKIIYIALMVSWILKADETG

SEQ ID NO: 2954694 - protein, 17 aa, Entamoeba invadens
LRYPKQYFLIRGNHESV

SEQ ID NO: 2954695 - protein, 21 aa, Entamoeba invadens
LRYTDLLMRIGFEDEGLQQYV

SEQ ID NO: 2954696 - protein, 26 aa, Entamoeba invadens
LRYTNNFIYMYDWFKSYFDEDETTQM

SEQ ID NO: 2954697 - protein, 18 aa, Entamoeba invadens
LSAACVAGKVCGAFEELW

SEQ ID NO: 2954698 - protein, 24 aa, Entamoeba invadens
LSAAESRPEIARFFVSYPSTCTGS

SEQ ID NO: 2954699 - protein, 18 aa, Entamoeba invadens
LSAAIAFDVTKPITVNYG

SEQ ID NO: 2954700 - protein, 27 aa, Entamoeba invadens
LSACFKDLYPYLLVQKMESLFAVGQNA

SEQ ID NO: 2954701 - protein, 17 aa, Entamoeba invadens
LSACGKTPVDFAVLCQN

SEQ ID NO: 2954702 - protein, 25 aa, Entamoeba invadens
LSADAKFAISSSWDHTLRLWDLDKM

SEQ ID NO: 2954703 - protein, 17 aa, Entamoeba invadens
LSADCFSNCTSLESINL

SEQ ID NO: 2954704 - protein, 23 aa, Entamoeba invadens
LSADYNYFFSLFDQICFEVNQNI

SEQ ID NO: 2954705 - protein, 26 aa, Entamoeba invadens
LSAKKSVYLKLIIELEFQNIDLKSAE

SEQ ID NO: 2954706 - protein, 27 aa, Entamoeba invadens
LSAKRVCLNKSKFICDNSIESVESVSI

SEQ ID NO: 2954707 - protein, 18 aa, Entamoeba invadens
LSALCYIHSNGIGHRDLK

SEQ ID NO: 2954708 - protein, 18 aa, Entamoeba invadens
LSANCLFTTLTNVNFDEH

SEQ ID NO: 2954709 - protein, 21 aa, Entamoeba invadens
LSANKARAGSMSFSIENPHAQ

SEQ ID NO: 2954710 - protein, 25 aa, Entamoeba invadens
LSAVKKCFEKVWSIEKMELAMPTVS

SEQ ID NO: 2954711 - protein, 24 aa, Entamoeba invadens
LSAVLRLPDFPVLKSSNVQTGNYL

SEQ ID NO: 2954712 - protein, 19 aa, Entamoeba invadens
LSCDFKLSRPFRLITSGED

SEQ ID NO: 2954713 - protein, 19 aa, Entamoeba invadens
LSCEMTFSFIKERHQYFLV

SEQ ID NO: 2954714 - protein, 25 aa, Entamoeba invadens
LSCFSCKYLKSVLLSSSLKHLKQNA

SEQ ID NO: 2954715 - protein, 27 aa, Entamoeba invadens
LSCGHTFCLTCIRKIFREDNVCPTCQM

SEQ ID NO: 2954716 - protein, 22 aa, Entamoeba invadens
LSCGPSRVGHGVFLSKENVDLM

SEQ ID NO: 2954717 - protein, 19 aa, Entamoeba invadens
LSCNAIRTLGPLKRHQTLR

SEQ ID NO: 2954718 - protein, 19 aa, Entamoeba invadens
LSCNASVLIKAYLSNERPN

SEQ ID NO: 2954719 - protein, 17 aa, Entamoeba invadens
LSCRSKTALVYTIENLK

SEQ ID NO: 2954720 - protein, 26 aa, Entamoeba invadens
LSCSAKSAVISLELMRNQIVTCHMDG

SEQ ID NO: 2954721 - protein, 19 aa, Entamoeba invadens
LSCYGLKERLLWTTNINAL

SEQ ID NO: 2954722 - protein, 24 aa, Entamoeba invadens
LSDALKLNALFLLPPASSISDLKL

SEQ ID NO: 2954723 - protein, 23 aa, Entamoeba invadens
LSDDALKALIDWIYIDNSSPDMK

SEQ ID NO: 2954724 - protein, 24 aa, Entamoeba invadens
LSDDLKQILKDAGVKRKDLADPDT

SEQ ID NO: 2954725 - protein, 23 aa, Entamoeba invadens
LSDEEFQTVFGMTPEAFQALPTW

SEQ ID NO: 2954726 - protein, 19 aa, Entamoeba invadens
LSDGIILISLFEALTKKKV

SEQ ID NO: 2954727 - protein, 23 aa, Entamoeba invadens
LSDGKLLKFISCDIKQHKITSVN

SEQ ID NO: 2954728 - protein, 27 aa, Entamoeba invadens
LSDGSSFIICLCNTFGMRDSVYEILME

SEQ ID NO: 2954729 - protein, 25 aa, Entamoeba invadens
LSDIPRKSRHIKIAEDFDERLKTEK

SEQ ID NO: 2954730 - protein, 26 aa, Entamoeba invadens
LSDKKETRRLYSLLKHKIGLKEFPGL

SEQ ID NO: 2954731 - protein, 24 aa, Entamoeba invadens
LSDLAVNILPLWVTFMKDQKEWDL

SEQ ID NO: 2954732 - protein, 17 aa, Entamoeba invadens
LSDLHFGFNRVQNSYEK

SEQ ID NO: 2954733 - protein, 23 aa, Entamoeba invadens
LSDLKGVVLLKNKTLFTITKSSV

SEQ ID NO: 2954734 - protein, 21 aa, Entamoeba invadens
LSDLKRGVLVNSFQFDTGKND

SEQ ID NO: 2954735 - protein, 19 aa, Entamoeba invadens
LSDLKRHVLVNAFQFDTGE

SEQ ID NO: 2954736 - protein, 18 aa, Entamoeba invadens
LSDLRKNQVFDRCDFTHP

SEQ ID NO: 2954737 - protein, 22 aa, Entamoeba invadens
LSDLRVTIFSGFKRVLKHLLLK

SEQ ID NO: 2954738 - protein, 24 aa, Entamoeba invadens
LSDMLMPLLLRLIDEDDYFITWAN

SEQ ID NO: 2954739 - protein, 22 aa, Entamoeba invadens
LSDNAFRYFGYADERNLVRDDQ

SEQ ID NO: 2954740 - protein, 32 aa, Entamoeba invadens
LSDSVGECFQRFIPFLKVYKLFIGNNEVCLGS

SEQ ID NO: 2954741 - protein, 25 aa, Entamoeba invadens
LSDVKEIFKSKGIQLSEEDLVDAFK

SEQ ID NO: 2954742 - protein, 25 aa, Entamoeba invadens
LSDWKLIKKQTVCGYFIQETWCDAN

SEQ ID NO: 2954743 - protein, 26 aa, Entamoeba invadens
LSEAHVTIFPCFWDKEEQIAIVEEKP

SEQ ID NO: 2954744 - protein, 24 aa, Entamoeba invadens
LSEARFSSIVPVEINEAEIIQSSS

SEQ ID NO: 2954745 - protein, 17 aa, Entamoeba invadens
LSECRVVTLQAADPELM

SEQ ID NO: 2954746 - protein, 19 aa, Entamoeba invadens
LSEDPFVFGKSVSQMIEDI

SEQ ID NO: 2954747 - protein, 24 aa, Entamoeba invadens
LSEEAKSAIQSCLDKYNTMSLGSD

SEQ ID NO: 2954748 - protein, 23 aa, Entamoeba invadens
LSEFKSILSVKCPKSMSVYTKII

SEQ ID NO: 2954749 - protein, 20 aa, Entamoeba invadens
LSEFNLKKAKRFHIIQEMYT

SEQ ID NO: 2954750 - protein, 25 aa, Entamoeba invadens
LSEFSHCLVYFKFHLNTNTVYHPLV

SEQ ID NO: 2954751 - protein, 26 aa, Entamoeba invadens
LSEFVCPCTLNSLSITMCSSISSIEA

SEQ ID NO: 2954752 - protein, 18 aa, Entamoeba invadens
LSEHIPIVLCGNKCDLEL

SEQ ID NO: 2954753 - protein, 20 aa, Entamoeba invadens
LSEHPRVYIPTTIVEADIGC

SEQ ID NO: 2954754 - protein, 29 aa, Entamoeba invadens
LSEIGYRNKLEYYYSFILRVEMQSPNFTV

SEQ ID NO: 2954755 - protein, 27 aa, Entamoeba invadens
LSEIIWIKGNVIGNVIGKIFAISKDGV

SEQ ID NO: 2954756 - protein, 23 aa, Entamoeba invadens
LSEIPAYHKILLTGTPIQNNTDE

SEQ ID NO: 2954757 - protein, 18 aa, Entamoeba invadens
LSEITIPGSVTFIGSSCF

SEQ ID NO: 2954758 - protein, 25 aa, Entamoeba invadens
LSEKEYMSALGYLPARYKTLKEAVY

SEQ ID NO: 2954759 - protein, 23 aa, Entamoeba invadens
LSELGYKYTWIIESKKVGTAPHE

SEQ ID NO: 2954760 - protein, 18 aa, Entamoeba invadens
LSELILYIRDHNGFKSYS

SEQ ID NO: 2954761 - protein, 19 aa, Entamoeba invadens
LSELLTKRMNLFGNNKLLF

SEQ ID NO: 2954762 - protein, 21 aa, Entamoeba invadens
LSENGKRIFASQCDSVSNHIE

SEQ ID NO: 2954763 - protein, 19 aa, Entamoeba invadens
LSEPIVYKELPTFKPTSFS

SEQ ID NO: 2954764 - protein, 32 aa, Entamoeba invadens
LSEPYSIYTYRYFLRNWPNLCFLAKDEDTKKY

SEQ ID NO: 2954765 - protein, 25 aa, Entamoeba invadens
LSEQCHFCSLELKKIRDTKRSQMLS

SEQ ID NO: 2954766 - protein, 25 aa, Entamoeba invadens
LSEQLAAPMGLPFFSNQIVMNPSFH

SEQ ID NO: 2954767 - protein, 18 aa, Entamoeba invadens
LSERLCYNYRSGYYNLNT

SEQ ID NO: 2954768 - protein, 19 aa, Entamoeba invadens
LSESCFGYCSKLCLITIPT

SEQ ID NO: 2954769 - protein, 18 aa, Entamoeba invadens
LSEYKMVIMEDKDLLNQS

SEQ ID NO: 2954770 - protein, 20 aa, Entamoeba invadens
LSEYLPYVFSINRRLYDTYL

SEQ ID NO: 2954771 - protein, 17 aa, Entamoeba invadens
LSFADAAHRIHDLITIT

SEQ ID NO: 2954772 - protein, 22 aa, Entamoeba invadens
LSFAEKVFRCVTTSENKAFLLS

SEQ ID NO: 2954773 - protein, 17 aa, Entamoeba invadens
LSFCPKDDLIIDAIEAV

SEQ ID NO: 2954774 - protein, 24 aa, Entamoeba invadens
LSFDCIKTLCAKVTFILQKEPNVV

SEQ ID NO: 2954775 - protein, 34 aa, Entamoeba invadens
LSFDELKDVKLILEFYKKISRREVELLQMGSSEQ

SEQ ID NO: 2954776 - protein, 22 aa, Entamoeba invadens
LSFDKGGAISLMKMCQKGSNIE

SEQ ID NO: 2954777 - protein, 25 aa, Entamoeba invadens
LSFFYKVGKLYAGLVEGVFPSQLGV

SEQ ID NO: 2954778 - protein, 17 aa, Entamoeba invadens
LSFGVTKISSFAFTNNS

SEQ ID NO: 2954779 - protein, 18 aa, Entamoeba invadens
LSFICLPNTLNILPNACF

SEQ ID NO: 2954780 - protein, 31 aa, Entamoeba invadens
LSFNSLVSIAESFGYHFELKLIKSAKKTLQM

SEQ ID NO: 2954781 - protein, 20 aa, Entamoeba invadens
LSFRKSEYMILLGTSSSGWS

SEQ ID NO: 2954782 - protein, 17 aa, Entamoeba invadens
LSFTLVMNATDYVGRVY

SEQ ID NO: 2954783 - protein, 25 aa, Entamoeba invadens
LSFYARINHFFTFNVVTLTGRYYNI

SEQ ID NO: 2954784 - protein, 17 aa, Entamoeba invadens
LSGALAAFIAWSVLAPN

SEQ ID NO: 2954785 - protein, 33 aa, Entamoeba invadens
LSGDNRTKILLSYRGSAWFVMKVTPASNKFNSN

SEQ ID NO: 2954786 - protein, 25 aa, Entamoeba invadens
LSGEIKKVASGVMKKVVLDFEAKKK

SEQ ID NO: 2954787 - protein, 17 aa, Entamoeba invadens
LSGKEWNTSHFMLSAVD

SEQ ID NO: 2954788 - protein, 17 aa, Entamoeba invadens
LSGKFLAKIKERDGLNG

SEQ ID NO: 2954789 - protein, 25 aa, Entamoeba invadens
LSGKIVPPFLMLCVVAIKRDSTTLF

SEQ ID NO: 2954790 - protein, 26 aa, Entamoeba invadens
LSGKQQCVWGKMSFVDSVQKVVKQFG

SEQ ID NO: 2954791 - protein, 23 aa, Entamoeba invadens
LSGLRNSPDFLIERPHRKTFQKT

SEQ ID NO: 2954792 - protein, 25 aa, Entamoeba invadens
LSGMLKCLYFNKAYMMPIKLFEVGD

SEQ ID NO: 2954793 - protein, 19 aa, Entamoeba invadens
LSGQSLWDLYTFSSTKKDL

SEQ ID NO: 2954794 - protein, 22 aa, Entamoeba invadens
LSGRVFFKSTIIYVGEEDFDFE

SEQ ID NO: 2954795 - protein, 18 aa, Entamoeba invadens
LSGYHIMIVSIYFETIKD

SEQ ID NO: 2954796 - protein, 28 aa, Entamoeba invadens
LSHFLCIASGDFACCIFKSTKQKGSTNP

SEQ ID NO: 2954797 - protein, 18 aa, Entamoeba invadens
LSHIEYLEPLLVFMNVIP

SEQ ID NO: 2954798 - protein, 26 aa, Entamoeba invadens
LSHKPGCVVIPELLIGSVFPRVEKVF

SEQ ID NO: 2954799 - protein, 18 aa, Entamoeba invadens
LSHLKIIYISPLKALATE

SEQ ID NO: 2954800 - protein, 17 aa, Entamoeba invadens
LSHPSANDFLRMDCVNI

SEQ ID NO: 2954801 - protein, 26 aa, Entamoeba invadens
LSHQFPILYFLLGEMHFALFHRNEAL

SEQ ID NO: 2954802 - protein, 28 aa, Entamoeba invadens
LSHRDCVFDIACCPWDVSTFATASSDRS

SEQ ID NO: 2954803 - protein, 22 aa, Entamoeba invadens
LSHVKVFLGDYVDRGKYSTETM

SEQ ID NO: 2954804 - protein, 23 aa, Entamoeba invadens
LSIAANCLFELKKTAQAVATSKF

SEQ ID NO: 2954805 - protein, 20 aa, Entamoeba invadens
LSIALLFAGSCDKEIYEVFK

SEQ ID NO: 2954806 - protein, 18 aa, Entamoeba invadens
LSICLRALRRALYTGTYQ

SEQ ID NO: 2954807 - protein, 18 aa, Entamoeba invadens
LSIEGPDAEPFVFVDLIL

SEQ ID NO: 2954808 - protein, 23 aa, Entamoeba invadens
LSIFFDEKCRLLFPRSNTETYAF

SEQ ID NO: 2954809 - protein, 18 aa, Entamoeba invadens
LSIFKSKYFQDLKKMAQD

SEQ ID NO: 2954810 - protein, 26 aa, Entamoeba invadens
LSIGKACFCRCCFLKNVVILSSVTSI

SEQ ID NO: 2954811 - protein, 24 aa, Entamoeba invadens
LSIGKFCFLGCKSLEKVIIHKGLV

SEQ ID NO: 2954812 - protein, 26 aa, Entamoeba invadens
LSIGSPFLHTTFRIRSVPDMEYLTSD

SEQ ID NO: 2954813 - protein, 17 aa, Entamoeba invadens
LSIGYLDDFVRIIDNYI

SEQ ID NO: 2954814 - protein, 19 aa, Entamoeba invadens
LSIHKSQGLTLPRAEVNLE

SEQ ID NO: 2954815 - protein, 18 aa, Entamoeba invadens
LSIKECKNIIFDENCALP

SEQ ID NO: 2954816 - protein, 17 aa, Entamoeba invadens
LSIKQDGDFPLLLTQSF

SEQ ID NO: 2954817 - protein, 24 aa, Entamoeba invadens
LSIKTTKNGFLFVFNGEQEKIPEN

SEQ ID NO: 2954818 - protein, 17 aa, Entamoeba invadens
LSILKVFVKNHVFNTEK

SEQ ID NO: 2954819 - protein, 22 aa, Entamoeba invadens
LSIPFAEGGGCNIIVDAIQLTN

SEQ ID NO: 2954820 - protein, 24 aa, Entamoeba invadens
LSIPQRTVLNYALSKSPKYPENSL

SEQ ID NO: 2954821 - protein, 17 aa, Entamoeba invadens
LSIQITRDYIKLRNEKN

SEQ ID NO: 2954822 - protein, 18 aa, Entamoeba invadens
LSIQKCYSLNTVVDIDSL

SEQ ID NO: 2954823 - protein, 19 aa, Entamoeba invadens
LSIQLPDIIDQFRTVLTQM

SEQ ID NO: 2954824 - protein, 20 aa, Entamoeba invadens
LSIRISKEMSTLVPQNYKTK

SEQ ID NO: 2954825 - protein, 25 aa, Entamoeba invadens
LSIRMKLNDFKKIKWFKNGNKTRSD

SEQ ID NO: 2954826 - protein, 18 aa, Entamoeba invadens
LSISEIDLIFADVVPTVK

SEQ ID NO: 2954827 - protein, 19 aa, Entamoeba invadens
LSISLCFLGDVANRNTIDK

SEQ ID NO: 2954828 - protein, 20 aa, Entamoeba invadens
LSISLLRMMHTLEFNYQLTP

SEQ ID NO: 2954829 - protein, 32 aa, Entamoeba invadens
LSISSVILRKCVAEIGEYCFGCCSNLTRVKIT

SEQ ID NO: 2954830 - protein, 22 aa, Entamoeba invadens
LSISVNCADGIYFVLKNDKEDV

SEQ ID NO: 2954831 - protein, 20 aa, Entamoeba invadens
LSITELSPFCFDNCVSLETI

SEQ ID NO: 2954832 - protein, 21 aa, Entamoeba invadens
LSITELSPFCFDNCVSLETIN

SEQ ID NO: 2954833 - protein, 19 aa, Entamoeba invadens
LSKDEFKKFIQFTNKEIFN

SEQ ID NO: 2954834 - protein, 17 aa, Entamoeba invadens
LSKENPFNFSLLLFHTA

SEQ ID NO: 2954835 - protein, 17 aa, Entamoeba invadens
LSKENPYNFTLLVFHSP

SEQ ID NO: 2954836 - protein, 23 aa, Entamoeba invadens
LSKFEMRDTIAWVREKTQLQMNN

SEQ ID NO: 2954837 - protein, 17 aa, Entamoeba invadens
LSKFGNDFMAKFNGAMC

SEQ ID NO: 2954838 - protein, 20 aa, Entamoeba invadens
LSKHAYCFVPIITMKTSQGS

SEQ ID NO: 2954839 - protein, 23 aa, Entamoeba invadens
LSKHFYKLRGPFFELLRTFLQYD

SEQ ID NO: 2954840 - protein, 17 aa, Entamoeba invadens
LSKIFLRIDSFEMESPA

SEQ ID NO: 2954841 - protein, 20 aa, Entamoeba invadens
LSKISTCFQIFPVTYETVLQ

SEQ ID NO: 2954842 - protein, 22 aa, Entamoeba invadens
LSKKFCPKCGYHDLRRISYYVL

SEQ ID NO: 2954843 - protein, 17 aa, Entamoeba invadens
LSKKISYLYNDTYTCGK

SEQ ID NO: 2954844 - protein, 28 aa, Entamoeba invadens
LSKLEKFLPHLIEYMVRIYKEAQVNTAQ

SEQ ID NO: 2954845 - protein, 23 aa, Entamoeba invadens
LSKLPFPSFIESWFEITNSPFGD

SEQ ID NO: 2954846 - protein, 26 aa, Entamoeba invadens
LSKLPPNVCVYISYLSDIILDPLYKT

SEQ ID NO: 2954847 - protein, 26 aa, Entamoeba invadens
LSKLPPNVCVYISYLSDIILEPLYKT

SEQ ID NO: 2954848 - protein, 18 aa, Entamoeba invadens
LSKMACWLTSLNYKVMIA

SEQ ID NO: 2954849 - protein, 23 aa, Entamoeba invadens
LSKPTANIKVRFVDGKSKVLKVN

SEQ ID NO: 2954850 - protein, 20 aa, Entamoeba invadens
LSKQCLRRYHGYDIIHFPQS

SEQ ID NO: 2954851 - protein, 22 aa, Entamoeba invadens
LSKRIADGVSMQIDKQKDFFKS

SEQ ID NO: 2954852 - protein, 18 aa, Entamoeba invadens
LSKTDLKEFIVIESGVRV

SEQ ID NO: 2954853 - protein, 19 aa, Entamoeba invadens
LSKTILVRAVMARRKLYQM

SEQ ID NO: 2954854 - protein, 25 aa, Entamoeba invadens
LSKTKKSGSVWVTFKQYRHIDKPKK

SEQ ID NO: 2954855 - protein, 22 aa, Entamoeba invadens
LSKVCKKRTVIITKKSLPSVLE

SEQ ID NO: 2954856 - protein, 26 aa, Entamoeba invadens
LSKVKGTLPIKAFKTMVNETHDQLVK

SEQ ID NO: 2954857 - protein, 17 aa, Entamoeba invadens
LSKYCDDVLDVLKNNLL

SEQ ID NO: 2954858 - protein, 17 aa, Entamoeba invadens
LSLAEWSKFIPNVTNMK

SEQ ID NO: 2954859 - protein, 24 aa, Entamoeba invadens
LSLCVAPGKYIFKNTLSDLMKIII

SEQ ID NO: 2954860 - protein, 17 aa, Entamoeba invadens
LSLDLKNRLDFFESLCS

SEQ ID NO: 2954861 - protein, 19 aa, Entamoeba invadens
LSLELKKQFKALKTLVSDY

SEQ ID NO: 2954862 - protein, 19 aa, Entamoeba invadens
LSLETCEIFCELLYDTADM

SEQ ID NO: 2954863 - protein, 24 aa, Entamoeba invadens
LSLFLCISDGFFASPQGKNILGFS

SEQ ID NO: 2954864 - protein, 24 aa, Entamoeba invadens
LSLFPKKRVSFSIKSFVEIIKKWK

SEQ ID NO: 2954865 - protein, 18 aa, Entamoeba invadens
LSLGKSCFYYCSDLEDVS

SEQ ID NO: 2954866 - protein, 17 aa, Entamoeba invadens
LSLGLIRKKNINSLTAL

SEQ ID NO: 2954867 - protein, 25 aa, Entamoeba invadens
LSLHKGEIISVVWVYNEWGIGINER

SEQ ID NO: 2954868 - protein, 19 aa, Entamoeba invadens
LSLIFAIQRCDPAPFYLFD

SEQ ID NO: 2954869 - protein, 17 aa, Entamoeba invadens
LSLIFIECYGIHLGYIK

SEQ ID NO: 2954870 - protein, 17 aa, Entamoeba invadens
LSLIKIGIPKSVTKIGV

SEQ ID NO: 2954871 - protein, 25 aa, Entamoeba invadens
LSLIKRCFQILYLNHCFAGKMYKTA

SEQ ID NO: 2954872 - protein, 22 aa, Entamoeba invadens
LSLISRSEFQPHHLLMNNPLLS

SEQ ID NO: 2954873 - protein, 22 aa, Entamoeba invadens
LSLKIGEPLIDRLIQSHGNQTP

SEQ ID NO: 2954874 - protein, 22 aa, Entamoeba invadens
LSLKKLFIRLSMKTSADLIKLN

SEQ ID NO: 2954875 - protein, 20 aa, Entamoeba invadens
LSLKNCANCVFKCPETLCGL

SEQ ID NO: 2954876 - protein, 17 aa, Entamoeba invadens
LSLLPSLGISYGLVLPT

SEQ ID NO: 2954877 - protein, 19 aa, Entamoeba invadens
LSLLRIEFCEVSMLMEGFF

SEQ ID NO: 2954878 - protein, 18 aa, Entamoeba invadens
LSLNMSQFRRLCILKGIH

SEQ ID NO: 2954879 - protein, 21 aa, Entamoeba invadens
LSLPKALSYIGSCCFKGCISL

SEQ ID NO: 2954880 - protein, 20 aa, Entamoeba invadens
LSLRLWAVGMLIKAAPDRLE

SEQ ID NO: 2954881 - protein, 22 aa, Entamoeba invadens
LSLRTFSRMRVGEVEKTKEEVE

SEQ ID NO: 2954882 - protein, 17 aa, Entamoeba invadens
LSLSLPILVNLLSTIPC

SEQ ID NO: 2954883 - protein, 19 aa, Entamoeba invadens
LSLTLPHHLYDDFYFQDFD

SEQ ID NO: 2954884 - protein, 22 aa, Entamoeba invadens
LSLVDALICYSDDEALYMIVTP

SEQ ID NO: 2954885 - protein, 17 aa, Entamoeba invadens
LSLVFSEYFDLLTETTL

SEQ ID NO: 2954886 - protein, 18 aa, Entamoeba invadens
LSLVIVDNMRFLPIDILK

SEQ ID NO: 2954887 - protein, 18 aa, Entamoeba invadens
LSLVPGDEVEVISCENQW

SEQ ID NO: 2954888 - protein, 18 aa, Entamoeba invadens
LSLYCKLGQAIGQNSKVK

SEQ ID NO: 2954889 - protein, 19 aa, Entamoeba invadens
LSMKMGLTKSLTFLKPSEE

SEQ ID NO: 2954890 - protein, 19 aa, Entamoeba invadens
LSMKVFPFGGVRIVQNSNV

SEQ ID NO: 2954891 - protein, 23 aa, Entamoeba invadens
LSMKYPLQIMIKYFPKIETFYLN

SEQ ID NO: 2954892 - protein, 18 aa, Entamoeba invadens
LSMLKLKKQRIGMSEELG

SEQ ID NO: 2954893 - protein, 19 aa, Entamoeba invadens
LSMREMFDQFVMGGEGQVV

SEQ ID NO: 2954894 - protein, 20 aa, Entamoeba invadens
LSMRQICRIPSKKSSRKTKI

SEQ ID NO: 2954895 - protein, 26 aa, Entamoeba invadens
LSMRYDLTVPFARYIASNGVKKIKRY

SEQ ID NO: 2954896 - protein, 17 aa, Entamoeba invadens
LSNEGLEAISYLVTIPE

SEQ ID NO: 2954897 - protein, 25 aa, Entamoeba invadens
LSNFLKMLCCQIVPNRYTLLDYADN

SEQ ID NO: 2954898 - protein, 17 aa, Entamoeba invadens
LSNGFWDTVVIKIENGE

SEQ ID NO: 2954899 - protein, 20 aa, Entamoeba invadens
LSNGYKWLLLSYIPDKSKVR

SEQ ID NO: 2954900 - protein, 21 aa, Entamoeba invadens
LSNISNWLILRERLVADDIPY

SEQ ID NO: 2954901 - protein, 26 aa, Entamoeba invadens
LSNKISFVGGEHFKPFVSYEAEGMGT

SEQ ID NO: 2954902 - protein, 24 aa, Entamoeba invadens
LSNLKSLDNLQGWYNTADMYAPKD

SEQ ID NO: 2954903 - protein, 23 aa, Entamoeba invadens
LSNLMIDMPINWKEKLFTCNALT

SEQ ID NO: 2954904 - protein, 28 aa, Entamoeba invadens
LSNLPPVYTYFYLCVIVSSDGFVKISVL

SEQ ID NO: 2954905 - protein, 21 aa, Entamoeba invadens
LSNLRHCVSHFSKEYSETLFS

SEQ ID NO: 2954906 - protein, 22 aa, Entamoeba invadens
LSNLVIPEFVKDLSVSLYTHEK

SEQ ID NO: 2954907 - protein, 18 aa, Entamoeba invadens
LSNMGGFKVLDRVEKQVL

SEQ ID NO: 2954908 - protein, 24 aa, Entamoeba invadens
LSNNFKMIGCETLWSDAPVIKQVT

SEQ ID NO: 2954909 - protein, 17 aa, Entamoeba invadens
LSNNRVSTINIMKTLSW

SEQ ID NO: 2954910 - protein, 17 aa, Entamoeba invadens
LSNPKALGLVFALVSTR

SEQ ID NO: 2954911 - protein, 22 aa, Entamoeba invadens
LSNRIFCLMISILYNVLDTPNY

SEQ ID NO: 2954912 - protein, 28 aa, Entamoeba invadens
LSNRLRRFRMIFGFDKFVLVSKIEEMEL

SEQ ID NO: 2954913 - protein, 23 aa, Entamoeba invadens
LSNRRISLTVPKIYTESILNYKS

SEQ ID NO: 2954914 - protein, 30 aa, Entamoeba invadens
LSNVGTFGFRGEALYSIAAMAEVEVLTCDG

SEQ ID NO: 2954915 - protein, 18 aa, Entamoeba invadens
LSNYCFIPSVAIVDPEFT

SEQ ID NO: 2954916 - protein, 26 aa, Entamoeba invadens
LSNYYRRIRVDYARPVIKIITGTQIE

SEQ ID NO: 2954917 - protein, 22 aa, Entamoeba invadens
LSPCLLTKFVLPNLVNVAEVYA

SEQ ID NO: 2954918 - protein, 19 aa, Entamoeba invadens
LSPDFKMFIDEDGDLTKTV

SEQ ID NO: 2954919 - protein, 24 aa, Entamoeba invadens
LSPDIQMYFALRFMKKESAEEKRI

SEQ ID NO: 2954920 - protein, 17 aa, Entamoeba invadens
LSPEIISGLHITSETKE

SEQ ID NO: 2954921 - protein, 23 aa, Entamoeba invadens
LSPGSCFWLPHGTRIYNKLIDMM

SEQ ID NO: 2954922 - protein, 19 aa, Entamoeba invadens
LSPGSCTALGPALLVSTVA

SEQ ID NO: 2954923 - protein, 17 aa, Entamoeba invadens
LSPIITFINQFKPGENL

SEQ ID NO: 2954924 - protein, 18 aa, Entamoeba invadens
LSPKDMHVLMSFVLGLPS

SEQ ID NO: 2954925 - protein, 17 aa, Entamoeba invadens
LSPKKFVWKSLMVVKTM

SEQ ID NO: 2954926 - protein, 28 aa, Entamoeba invadens
LSPLIAIKCSLEAAGVGSLKGYENTSYF

SEQ ID NO: 2954927 - protein, 18 aa, Entamoeba invadens
LSPQVNFIVGENGSGKSA

SEQ ID NO: 2954928 - protein, 17 aa, Entamoeba invadens
LSPRIKFDQADKKDTMS

SEQ ID NO: 2954929 - protein, 24 aa, Entamoeba invadens
LSPRSPRVSNKCECSYKVDFMMKD

SEQ ID NO: 2954930 - protein, 18 aa, Entamoeba invadens
LSPYAFKSKFKIFTDLEC

SEQ ID NO: 2954931 - protein, 17 aa, Entamoeba invadens
LSPYMKAFGVFQYPIEV

SEQ ID NO: 2954932 - protein, 20 aa, Entamoeba invadens
LSQAFIYFLRHSEFSTVFLT

SEQ ID NO: 2954933 - protein, 18 aa, Entamoeba invadens
LSQECTKIVIDFVDKIIT

SEQ ID NO: 2954934 - protein, 24 aa, Entamoeba invadens
LSQEKKPFLGMAAALERYKQIIPS

SEQ ID NO: 2954935 - protein, 21 aa, Entamoeba invadens
LSQHCTLSLGRPHRQSYKTKQ

SEQ ID NO: 2954936 - protein, 18 aa, Entamoeba invadens
LSQKLECLFMEVTSKEGE

SEQ ID NO: 2954937 - protein, 23 aa, Entamoeba invadens
LSQKWMKKVVEWCDSDEFTLEQR

SEQ ID NO: 2954938 - protein, 24 aa, Entamoeba invadens
LSQLGKGCFKNCVSLVSIAFPPKV

SEQ ID NO: 2954939 - protein, 18 aa, Entamoeba invadens
LSQNEIQWVLSFLCGYCK

SEQ ID NO: 2954940 - protein, 20 aa, Entamoeba invadens
LSQSLARIRFSQEVSSGDVD

SEQ ID NO: 2954941 - protein, 22 aa, Entamoeba invadens
LSQSRLNEMTQFPIDMSTVKFV

SEQ ID NO: 2954942 - protein, 25 aa, Entamoeba invadens
LSQTILSLVCECVFNLVSPSCNEWK

SEQ ID NO: 2954943 - protein, 23 aa, Entamoeba invadens
LSQTKFDCFVTMAMDPYWTPKTA

SEQ ID NO: 2954944 - protein, 18 aa, Entamoeba invadens
LSQYAYIYTRFRVEFEDV

SEQ ID NO: 2954945 - protein, 26 aa, Entamoeba invadens
LSQYECTRVIVLFNMFFPEDLNNEQR

SEQ ID NO: 2954946 - protein, 43 aa, Entamoeba invadens
LSRAKKGCIVLGDLKTLNTRAWQCFFNYIAIHNAYFKKEGDIF

SEQ ID NO: 2954947 - protein, 17 aa, Entamoeba invadens
LSRCKLSLPPTSTHGGL

SEQ ID NO: 2954948 - protein, 23 aa, Entamoeba invadens
LSREVYDWMRVCFDVIICNGYGS

SEQ ID NO: 2954949 - protein, 19 aa, Entamoeba invadens
LSRGEGFTVLEVIHAMEKA

SEQ ID NO: 2954950 - protein, 21 aa, Entamoeba invadens
LSRKIERRWRLIGWGEVVKGT

SEQ ID NO: 2954951 - protein, 18 aa, Entamoeba invadens
LSRNFLVFCRKQAQKESF

SEQ ID NO: 2954952 - protein, 22 aa, Entamoeba invadens
LSRNVLPYVVIFLTDSILDVRV

SEQ ID NO: 2954953 - protein, 20 aa, Entamoeba invadens
LSRQYPTIKFCRVDTSQVQT

SEQ ID NO: 2954954 - protein, 19 aa, Entamoeba invadens
LSRRGDDLVVNKSVFITNG

SEQ ID NO: 2954955 - protein, 19 aa, Entamoeba invadens
LSRRMSHSFKSYKEKKSEQ

SEQ ID NO: 2954956 - protein, 22 aa, Entamoeba invadens
LSSAICSVSFLINQVGKAFQPH

SEQ ID NO: 2954957 - protein, 25 aa, Entamoeba invadens
LSSALEVMADLSLEGGEPAHSDISV

SEQ ID NO: 2954958 - protein, 19 aa, Entamoeba invadens
LSSCDFPRDMGETAETKKE

SEQ ID NO: 2954959 - protein, 25 aa, Entamoeba invadens
LSSCTKGRITSYVGWEKGGSCSFGP

SEQ ID NO: 2954960 - protein, 24 aa, Entamoeba invadens
LSSDANTAIVVWANTLIKTFLADN

SEQ ID NO: 2954961 - protein, 25 aa, Entamoeba invadens
LSSDGKFAITSSWDQSLRLWDLEKF

SEQ ID NO: 2954962 - protein, 24 aa, Entamoeba invadens
LSSDLNLDCVKQFAEFQLQQLYSS

SEQ ID NO: 2954963 - protein, 25 aa, Entamoeba invadens
LSSELKQILKNAGLRPSNLADKKVV

SEQ ID NO: 2954964 - protein, 19 aa, Entamoeba invadens
LSSEMAKLIAVDFQVSNMA

SEQ ID NO: 2954965 - protein, 18 aa, Entamoeba invadens
LSSEYKKSDILEFYEECA

SEQ ID NO: 2954966 - protein, 19 aa, Entamoeba invadens
LSSEYKKSDILEFYEECAD

SEQ ID NO: 2954967 - protein, 18 aa, Entamoeba invadens
LSSFHVFVNSLDFKDDVN

SEQ ID NO: 2954968 - protein, 24 aa, Entamoeba invadens
LSSFLFQFLLTFKSVLCVPIHVVS

SEQ ID NO: 2954969 - protein, 25 aa, Entamoeba invadens
LSSFYTMASVFSFTATKHLKEVSEM

SEQ ID NO: 2954970 - protein, 30 aa, Entamoeba invadens
LSSGCTRLTLHIPGRPLVVVAARDSNVPLN

SEQ ID NO: 2954971 - protein, 19 aa, Entamoeba invadens
LSSHLFFLPKAPKYFSKIE

SEQ ID NO: 2954972 - protein, 23 aa, Entamoeba invadens
LSSHSFFVVRSCLDNIQNVLNYP

SEQ ID NO: 2954973 - protein, 17 aa, Entamoeba invadens
LSSIILFFMEKETETVF

SEQ ID NO: 2954974 - protein, 28 aa, Entamoeba invadens
LSSIPPKDALECIFNWTVADRSTVSMVL

SEQ ID NO: 2954975 - protein, 19 aa, Entamoeba invadens
LSSITLPLSLQKIGQYFFY

SEQ ID NO: 2954976 - protein, 25 aa, Entamoeba invadens
LSSKAGGVGLNLIGCSRLILFDPDW

SEQ ID NO: 2954977 - protein, 32 aa, Entamoeba invadens
LSSKELTQKVLRSEALVNHIKGIATTAITPLR

SEQ ID NO: 2954978 - protein, 26 aa, Entamoeba invadens
LSSKLGEALSLFIPMLNVYKLYVGNS

SEQ ID NO: 2954979 - protein, 24 aa, Entamoeba invadens
LSSKYRVANNMSINAKTVCLEGAG

SEQ ID NO: 2954980 - protein, 23 aa, Entamoeba invadens
LSSLIKSSGLIPSRSSCSTKFEL

SEQ ID NO: 2954981 - protein, 21 aa, Entamoeba invadens
LSSLTRLYLMLLKEAEKSRSI

SEQ ID NO: 2954982 - protein, 30 aa, Entamoeba invadens
LSSNAWTSFSIALWYYGFTKIQGHHRLLAA

SEQ ID NO: 2954983 - protein, 17 aa, Entamoeba invadens
LSSNCYLNGFRSYLLTF

SEQ ID NO: 2954984 - protein, 21 aa, Entamoeba invadens
LSSNGLLDFKVHPLEFPSLQV

SEQ ID NO: 2954985 - protein, 19 aa, Entamoeba invadens
LSSQCPSQFTDSKKKVVLN

SEQ ID NO: 2954986 - protein, 21 aa, Entamoeba invadens
LSSQLREALGIGETQTPPWAD

SEQ ID NO: 2954987 - protein, 19 aa, Entamoeba invadens
LSSRFRPPVPLVKRTIESL

SEQ ID NO: 2954988 - protein, 26 aa, Entamoeba invadens
LSSRKFICGGPVYIIANMIEKPTQLC

SEQ ID NO: 2954989 - protein, 29 aa, Entamoeba invadens
LSSRYGVLAANVFRVLKMKHVLTDSQIAD

SEQ ID NO: 2954990 - protein, 24 aa, Entamoeba invadens
LSSSFRKERILQLELIQFSIEQTT

SEQ ID NO: 2954991 - protein, 18 aa, Entamoeba invadens
LSSSGDWWVGELNGKTGQ

SEQ ID NO: 2954992 - protein, 24 aa, Entamoeba invadens
LSSSLRLIKDGAFYQCGGLEHIVV

SEQ ID NO: 2954993 - protein, 19 aa, Entamoeba invadens
LSSSLTYLGIAAFNNCEKL

SEQ ID NO: 2954994 - protein, 20 aa, Entamoeba invadens
LSSSLTYLGIAAFNNCEKLE

SEQ ID NO: 2954995 - protein, 25 aa, Entamoeba invadens
LSSSPRFFKILKMNRPMLLDFQSSF

SEQ ID NO: 2954996 - protein, 23 aa, Entamoeba invadens
LSSSPRVALKMPKVPPQRDRMLK

SEQ ID NO: 2954997 - protein, 23 aa, Entamoeba invadens
LSSTARHGKRMSMIPTLSLSKTE

SEQ ID NO: 2954998 - protein, 32 aa, Entamoeba invadens
LSSTGKVGAWAKFSQVGGCDFGYVVDFQPSSF

SEQ ID NO: 2954999 - protein, 20 aa, Entamoeba invadens
LSSVCARFQKSASILRSARR

SEQ ID NO: 2955000 - protein, 17 aa, Entamoeba invadens
LSSVKFPLHLLSIENSA

SEQ ID NO: 2955001 - protein, 19 aa, Entamoeba invadens
LSSVPSFISSLISLEQLYL

SEQ ID NO: 2955002 - protein, 18 aa, Entamoeba invadens
LSSVVSRLIMVIGNVVRN

SEQ ID NO: 2955003 - protein, 26 aa, Entamoeba invadens
LSSYGLEMGISFLPSLPVDTTSEVPN

SEQ ID NO: 2955004 - protein, 24 aa, Entamoeba invadens
LSSYKKLGGIIAVCSHSRAVVIEG

SEQ ID NO: 2955005 - protein, 19 aa, Entamoeba invadens
LSTCLPPIIFALLHTGQNF

SEQ ID NO: 2955006 - protein, 26 aa, Entamoeba invadens
LSTDFPDVFHLISFVSQQDSNYRKRI

SEQ ID NO: 2955007 - protein, 19 aa, Entamoeba invadens
LSTEPYVVGAIGVEKKEEK

SEQ ID NO: 2955008 - protein, 19 aa, Entamoeba invadens
LSTEWFPKRVRKLRIFEQE

SEQ ID NO: 2955009 - protein, 26 aa, Entamoeba invadens
LSTEWFPKRVRSLHVFNEEVNVLADN

SEQ ID NO: 2955010 - protein, 17 aa, Entamoeba invadens
LSTKGFLVDLFQSNYCL

SEQ ID NO: 2955011 - protein, 25 aa, Entamoeba invadens
LSTKIKATLPLLRKIVLGRDAGQTE

SEQ ID NO: 2955012 - protein, 30 aa, Entamoeba invadens
LSTKNLRAFCYWAGCLFLRAKWYEQASSMF

SEQ ID NO: 2955013 - protein, 23 aa, Entamoeba invadens
LSTLCPPLALTLLSQRGLNQHKL

SEQ ID NO: 2955014 - protein, 19 aa, Entamoeba invadens
LSTLCPPTAVTHSVVSQMT

SEQ ID NO: 2955015 - protein, 23 aa, Entamoeba invadens
LSTLKSKTKWIIVYKNNIPITTD

SEQ ID NO: 2955016 - protein, 17 aa, Entamoeba invadens
LSTMNIIHCDIKTENLL

SEQ ID NO: 2955017 - protein, 25 aa, Entamoeba invadens
LSTNLKYISPRAFLSCLSLSKIDLP

SEQ ID NO: 2955018 - protein, 19 aa, Entamoeba invadens
LSTQFLALIAYAFVYQNCP

SEQ ID NO: 2955019 - protein, 21 aa, Entamoeba invadens
LSTRKIVSFKPAKCIVTKVNN

SEQ ID NO: 2955020 - protein, 20 aa, Entamoeba invadens
LSTSKFSILLNRDLLNSLAV

SEQ ID NO: 2955021 - protein, 26 aa, Entamoeba invadens
LSTTFYRLCCYIVVYLSFLSKGLSSR

SEQ ID NO: 2955022 - protein, 19 aa, Entamoeba invadens
LSTVYSGGIYNCHGVDLQI

SEQ ID NO: 2955023 - protein, 26 aa, Entamoeba invadens
LSTWGGLWRYIGIERHAQYGYYYNLG

SEQ ID NO: 2955024 - protein, 27 aa, Entamoeba invadens
LSTWGSLWRYIGIERHATYGYYYMLGY

SEQ ID NO: 2955025 - protein, 18 aa, Entamoeba invadens
LSVAFIFVSVNIMCFRKG

SEQ ID NO: 2955026 - protein, 17 aa, Entamoeba invadens
LSVAMIIEIRKGLLSSD

SEQ ID NO: 2955027 - protein, 26 aa, Entamoeba invadens
LSVEALSILFGRPMYQVSFGELGTTI

SEQ ID NO: 2955028 - protein, 22 aa, Entamoeba invadens
LSVEIAMSLSYLVDVTNTSIQD

SEQ ID NO: 2955029 - protein, 18 aa, Entamoeba invadens
LSVEILSVMSQIYNKSTK

SEQ ID NO: 2955030 - protein, 33 aa, Entamoeba invadens
LSVEKCGVPFFWVRLLYKLGLFMSYTPSDDDYI

SEQ ID NO: 2955031 - protein, 17 aa, Entamoeba invadens
LSVFKLTPNKNWLDSVV

SEQ ID NO: 2955032 - protein, 23 aa, Entamoeba invadens
LSVGKGCFKNCGKLKKFVGKIKK

SEQ ID NO: 2955033 - protein, 18 aa, Entamoeba invadens
LSVISIGQWCFCGCGNLK

SEQ ID NO: 2955034 - protein, 17 aa, Entamoeba invadens
LSVKEVTKGATFDLLGN

SEQ ID NO: 2955035 - protein, 19 aa, Entamoeba invadens
LSVKIPEVKDVAAVGCCYH

SEQ ID NO: 2955036 - protein, 26 aa, Entamoeba invadens
LSVKSIGEGCFRWCDSLNSITIPSSV

SEQ ID NO: 2955037 - protein, 19 aa, Entamoeba invadens
LSVKVPKDIIGITPRIKTM

SEQ ID NO: 2955038 - protein, 20 aa, Entamoeba invadens
LSVLLNWACHPPCLRASVFA

SEQ ID NO: 2955039 - protein, 21 aa, Entamoeba invadens
LSVLPRYKYLDFISTLLSTLN

SEQ ID NO: 2955040 - protein, 27 aa, Entamoeba invadens
LSVNLQLPLVLSKSVVYKTVLNAIKNA

SEQ ID NO: 2955041 - protein, 18 aa, Entamoeba invadens
LSVQICHGLTNYLISLKP

SEQ ID NO: 2955042 - protein, 19 aa, Entamoeba invadens
LSVREGISPEAYRVISEMW

SEQ ID NO: 2955043 - protein, 21 aa, Entamoeba invadens
LSVRNIFFIRGCQNCSFSDMD

SEQ ID NO: 2955044 - protein, 19 aa, Entamoeba invadens
LSVTLFGPRCFQGCRNLES

SEQ ID NO: 2955045 - protein, 17 aa, Entamoeba invadens
LSVTSLHVNPSFFDQKS

SEQ ID NO: 2955046 - protein, 18 aa, Entamoeba invadens
LSVTTLGAYCFNNCSNLK

SEQ ID NO: 2955047 - protein, 18 aa, Entamoeba invadens
LSVVRPKKIITLESFVLA

SEQ ID NO: 2955048 - protein, 25 aa, Entamoeba invadens
LSVVWRIGFCKSVTASIETTSIQTV

SEQ ID NO: 2955049 - protein, 26 aa, Entamoeba invadens
LSWIKDSFKLFTVVVLNFEFPSDIKN

SEQ ID NO: 2955050 - protein, 20 aa, Entamoeba invadens
LSWNNQRFSSLLYDSKENGM

SEQ ID NO: 2955051 - protein, 17 aa, Entamoeba invadens
LSYAPINDVFFFNDEHN

SEQ ID NO: 2955052 - protein, 20 aa, Entamoeba invadens
LSYCPRKFSSDDIPLIEVNN

SEQ ID NO: 2955053 - protein, 17 aa, Entamoeba invadens
LSYFTSIVKCWKMISKV

SEQ ID NO: 2955054 - protein, 21 aa, Entamoeba invadens
LSYGFFEPFFHLCEIVYKTKP

SEQ ID NO: 2955055 - protein, 26 aa, Entamoeba invadens
LSYGPCQFPVLFSCYKDFTNDANAIL

SEQ ID NO: 2955056 - protein, 17 aa, Entamoeba invadens
LSYIEGIRRTWCDVELQ

SEQ ID NO: 2955057 - protein, 27 aa, Entamoeba invadens
LSYIGSCCFKGCISLTTLQVAPSIKYG

SEQ ID NO: 2955058 - protein, 21 aa, Entamoeba invadens
LSYLIPLIEYMYRSQWFERGG

SEQ ID NO: 2955059 - protein, 25 aa, Entamoeba invadens
LSYLRLEKIGFVFQTFNLITSMNAI

SEQ ID NO: 2955060 - protein, 17 aa, Entamoeba invadens
LSYPNTDLFLLCFSVIS

SEQ ID NO: 2955061 - protein, 17 aa, Entamoeba invadens
LSYPQTDIFLICFSVVS

SEQ ID NO: 2955062 - protein, 31 aa, Entamoeba invadens
LSYTCVAHPFWLPKFANGFYYTLPMITENIN

SEQ ID NO: 2955063 - protein, 18 aa, Entamoeba invadens
LSYTTALTKVTRYTVSPL

SEQ ID NO: 2955064 - protein, 25 aa, Entamoeba invadens
LTADINYRLNVEGVLTHPWLCGNSV

SEQ ID NO: 2955065 - protein, 17 aa, Entamoeba invadens
LTADKLGSCKLVHEMSF

SEQ ID NO: 2955066 - protein, 22 aa, Entamoeba invadens
LTAERFKTVEFIKQKEEEKRVA

SEQ ID NO: 2955067 - protein, 18 aa, Entamoeba invadens
LTAETMLIHPWLYGPTVY

SEQ ID NO: 2955068 - protein, 17 aa, Entamoeba invadens
LTAFQVINKIIEKEGNI

SEQ ID NO: 2955069 - protein, 20 aa, Entamoeba invadens
LTAIELPKNITFVGKSCFSG

SEQ ID NO: 2955070 - protein, 20 aa, Entamoeba invadens
LTAILEFFPQVAMKEDQIAY

SEQ ID NO: 2955071 - protein, 33 aa, Entamoeba invadens
LTASYNCRGVLCFVPRLCNAAVQKNIFSVLDGS

SEQ ID NO: 2955072 - protein, 18 aa, Entamoeba invadens
LTAVNFVFDAATCKTPCI

SEQ ID NO: 2955073 - protein, 18 aa, Entamoeba invadens
LTCGVIRLQLPGNGETSH

SEQ ID NO: 2955074 - protein, 24 aa, Entamoeba invadens
LTCKKFGKILDRFRYNPILIKSTK

SEQ ID NO: 2955075 - protein, 18 aa, Entamoeba invadens
LTCLCGDLKMYGFDIPSS

SEQ ID NO: 2955076 - protein, 21 aa, Entamoeba invadens
LTCPSNLCSMTSLKSLDLSYN

SEQ ID NO: 2955077 - protein, 18 aa, Entamoeba invadens
LTCSSNADTWCTSCAEGY

SEQ ID NO: 2955078 - protein, 17 aa, Entamoeba invadens
LTCSSNAESTCLSCEGG

SEQ ID NO: 2955079 - protein, 20 aa, Entamoeba invadens
LTCYECLAMGNAVGMIEVVL

SEQ ID NO: 2955080 - protein, 18 aa, Entamoeba invadens
LTDCYLKYLQVIGDEKDE

SEQ ID NO: 2955081 - protein, 25 aa, Entamoeba invadens
LTDDLRPLFKINHCLLHRLSIANKR

SEQ ID NO: 2955082 - protein, 27 aa, Entamoeba invadens
LTDDLRPLFKINYCLLHRLSIANERTF

SEQ ID NO: 2955083 - protein, 35 aa, Entamoeba invadens
LTDDQMFAVAFTIALQKEGTLLILQKDIKHANKDE

SEQ ID NO: 2955084 - protein, 23 aa, Entamoeba invadens
LTDEEIDEFVGVFLNILSNKQKE

SEQ ID NO: 2955085 - protein, 30 aa, Entamoeba invadens
LTDGKEGLPTGFKFEGFGNVGSLATETPKV

SEQ ID NO: 2955086 - protein, 23 aa, Entamoeba invadens
LTDLCKLGIFGYSSVPNELYRNI

SEQ ID NO: 2955087 - protein, 23 aa, Entamoeba invadens
LTDLKIAKTISVDFDTEYSDPTF

SEQ ID NO: 2955088 - protein, 22 aa, Entamoeba invadens
LTDRGLREFECQNSKERESWLR

SEQ ID NO: 2955089 - protein, 30 aa, Entamoeba invadens
LTDSIARPKELPFMPIIFNFPPEFAGVPQE

SEQ ID NO: 2955090 - protein, 19 aa, Entamoeba invadens
LTDTLKYKIFQDVSMGLAA

SEQ ID NO: 2955091 - protein, 18 aa, Entamoeba invadens
LTDWCFKDTQIIEYKIPD

SEQ ID NO: 2955092 - protein, 24 aa, Entamoeba invadens
LTDWRDLYRGKLCCALTDTFTTDV

SEQ ID NO: 2955093 - protein, 29 aa, Entamoeba invadens
LTDYLARPARLPFLSLLLDLPPDVSDIQQ

SEQ ID NO: 2955094 - protein, 25 aa, Entamoeba invadens
LTEEGTCLMCGAIDQKGIQRYVKYI

SEQ ID NO: 2955095 - protein, 22 aa, Entamoeba invadens
LTEFALQYKLPYYIKGDQQRHY

SEQ ID NO: 2955096 - protein, 17 aa, Entamoeba invadens
LTEFNLNVFCKCKTLKT

SEQ ID NO: 2955097 - protein, 21 aa, Entamoeba invadens
LTEGEKYFFLCDLSICMEYLI

SEQ ID NO: 2955098 - protein, 20 aa, Entamoeba invadens
LTEGKLGMPGAIAHSENMVK

SEQ ID NO: 2955099 - protein, 27 aa, Entamoeba invadens
LTEIECFRLFFCEEIANNLLLFSNKKI

SEQ ID NO: 2955100 - protein, 26 aa, Entamoeba invadens
LTEISFKLKEMYYLLTQGGVAELELV

SEQ ID NO: 2955101 - protein, 18 aa, Entamoeba invadens
LTEKGNAFIQLNKQNQEN

SEQ ID NO: 2955102 - protein, 23 aa, Entamoeba invadens
LTELKIMLKQSFNNYAKPNDEGF

SEQ ID NO: 2955103 - protein, 23 aa, Entamoeba invadens
LTENACGQLKCGNLDEAEKLANR

SEQ ID NO: 2955104 - protein, 18 aa, Entamoeba invadens
LTEPGWREILKPIFQKYI

SEQ ID NO: 2955105 - protein, 24 aa, Entamoeba invadens
LTEQSLVDWVFKGIDAFQSANLHS

SEQ ID NO: 2955106 - protein, 25 aa, Entamoeba invadens
LTESCGGCTSCLPNMNDPNVISCGS

SEQ ID NO: 2955107 - protein, 26 aa, Entamoeba invadens
LTESHLTNIFGILAMIEGFKNDSDDT

SEQ ID NO: 2955108 - protein, 18 aa, Entamoeba invadens
LTETLKIPPEDIVIYGKG

SEQ ID NO: 2955109 - protein, 27 aa, Entamoeba invadens
LTEVECFRLFFEEITNNFLLFSNKKIA

SEQ ID NO: 2955110 - protein, 17 aa, Entamoeba invadens
LTFAIGDIDKESICDVI

SEQ ID NO: 2955111 - protein, 18 aa, Entamoeba invadens
LTFDKVHFNLQVIGVSAK

SEQ ID NO: 2955112 - protein, 17 aa, Entamoeba invadens
LTFKEGDIITVMKKEGD

SEQ ID NO: 2955113 - protein, 17 aa, Entamoeba invadens
LTFKSVELFELWEGLWF

SEQ ID NO: 2955114 - protein, 19 aa, Entamoeba invadens
LTFLTRGFYPEGLLKNMRL

SEQ ID NO: 2955115 - protein, 24 aa, Entamoeba invadens
LTFRGAKVRSGKVWSKVIDDTIVK

SEQ ID NO: 2955116 - protein, 33 aa, Entamoeba invadens
LTFSFKLDLFIQCCLGVQWFHEILKLVHGNIKP

SEQ ID NO: 2955117 - protein, 25 aa, Entamoeba invadens
LTFTVNLRLLLSLTDKTALPKSLPF

SEQ ID NO: 2955118 - protein, 19 aa, Entamoeba invadens
LTFVRSCDMDEWKYSELEV

SEQ ID NO: 2955119 - protein, 17 aa, Entamoeba invadens
LTGESLPVFGNGEYSPT

SEQ ID NO: 2955120 - protein, 21 aa, Entamoeba invadens
LTGKCYLKGTCIVEMLISFLS

SEQ ID NO: 2955121 - protein, 17 aa, Entamoeba invadens
LTGLHFVMKHLDGRELY

SEQ ID NO: 2955122 - protein, 18 aa, Entamoeba invadens
LTGLRAAMTRVIGKYIEQ

SEQ ID NO: 2955123 - protein, 29 aa, Entamoeba invadens
LTGLYFRTVAWRIWLGVYPKEITPEWVSV

SEQ ID NO: 2955124 - protein, 25 aa, Entamoeba invadens
LTGMYRYKYKVIQQIRMCKDLKHAI

SEQ ID NO: 2955125 - protein, 19 aa, Entamoeba invadens
LTGRSKFDIDVAFSNARRR

SEQ ID NO: 2955126 - protein, 23 aa, Entamoeba invadens
LTGTTFWLELTFRNYPEFRERTA

SEQ ID NO: 2955127 - protein, 18 aa, Entamoeba invadens
LTHCFAILTERVKNKTKE

SEQ ID NO: 2955128 - protein, 24 aa, Entamoeba invadens
LTHEMLLREIGMLEGWKSTVVKEY

SEQ ID NO: 2955129 - protein, 18 aa, Entamoeba invadens
LTHFANLASFVIDANTIP

SEQ ID NO: 2955130 - protein, 25 aa, Entamoeba invadens
LTHIFKMLLDYELFEELAYIIQLTF

SEQ ID NO: 2955131 - protein, 24 aa, Entamoeba invadens
LTHLERGIPLLVIDLIKSIYTDEN

SEQ ID NO: 2955132 - protein, 23 aa, Entamoeba invadens
LTHLKMKQHFSVSVGGKKLICKK

SEQ ID NO: 2955133 - protein, 32 aa, Entamoeba invadens
LTHNKFRITVFFQYERMMYRAFDLFAKGVNLV

SEQ ID NO: 2955134 - protein, 19 aa, Entamoeba invadens
LTHSFKLSSKHVIDVNGLN

SEQ ID NO: 2955135 - protein, 18 aa, Entamoeba invadens
LTICVPKINNFVNYQPQE

SEQ ID NO: 2955136 - protein, 25 aa, Entamoeba invadens
LTIDYSNGCVISYLAKTIVNRASRD

SEQ ID NO: 2955137 - protein, 26 aa, Entamoeba invadens
LTIFPSESHWIFAVQDAFYISVFPNQ

SEQ ID NO: 2955138 - protein, 17 aa, Entamoeba invadens
LTIGESVTISLNNMTTI

SEQ ID NO: 2955139 - protein, 24 aa, Entamoeba invadens
LTIGKHVLVSSVFYRGREENEDYV

SEQ ID NO: 2955140 - protein, 26 aa, Entamoeba invadens
LTIISYSYKTGFSITAKVCNNSGCLQ

SEQ ID NO: 2955141 - protein, 24 aa, Entamoeba invadens
LTIKPEIPIGVLLIDETTGELMSL

SEQ ID NO: 2955142 - protein, 17 aa, Entamoeba invadens
LTIYNAPQKEEGLAVDK

SEQ ID NO: 2955143 - protein, 17 aa, Entamoeba invadens
LTKAVGGVLAYFRNYIA

SEQ ID NO: 2955144 - protein, 18 aa, Entamoeba invadens
LTKDNGFFVFSLRNNTGD

SEQ ID NO: 2955145 - protein, 27 aa, Entamoeba invadens
LTKDQRKIISAYIMYKADHVAYKKLKK

SEQ ID NO: 2955146 - protein, 17 aa, Entamoeba invadens
LTKEAKIREFKRYTLKH

SEQ ID NO: 2955147 - protein, 19 aa, Entamoeba invadens
LTKEEWKNVVLAYEPVWAI

SEQ ID NO: 2955148 - protein, 18 aa, Entamoeba invadens
LTKEILNYYFNWRKDMKL

SEQ ID NO: 2955149 - protein, 22 aa, Entamoeba invadens
LTKEPILFKEMRAWLHNLPTTY

SEQ ID NO: 2955150 - protein, 17 aa, Entamoeba invadens
LTKKCFENCYSLETANV

SEQ ID NO: 2955151 - protein, 27 aa, Entamoeba invadens
LTKKFCDLEALKFIPHETCNKISEVEK

SEQ ID NO: 2955152 - protein, 25 aa, Entamoeba invadens
LTKKKALVHYGLFEPFCRTIQVLPN

SEQ ID NO: 2955153 - protein, 25 aa, Entamoeba invadens
LTKLKEKLHLLWGENKRLKTILECS

SEQ ID NO: 2955154 - protein, 22 aa, Entamoeba invadens
LTKLKFSHVVYLSRYQNTMDVL

SEQ ID NO: 2955155 - protein, 24 aa, Entamoeba invadens
LTKLKGIRMLENFPVYQGAVEMFL

SEQ ID NO: 2955156 - protein, 24 aa, Entamoeba invadens
LTKLKIGYNTSIFKKGNYACIAEM

SEQ ID NO: 2955157 - protein, 20 aa, Entamoeba invadens
LTKLKKFEKEVLKQEETFKK

SEQ ID NO: 2955158 - protein, 17 aa, Entamoeba invadens
LTKLMCKFLDWCNNPDV

SEQ ID NO: 2955159 - protein, 26 aa, Entamoeba invadens
LTKLPKCCFNKCFKLEKINLVNIREI

SEQ ID NO: 2955160 - protein, 18 aa, Entamoeba invadens
LTKNCSLFQYSLTPENLL

SEQ ID NO: 2955161 - protein, 20 aa, Entamoeba invadens
LTKNSVWEYFVYTLSEPDYI

SEQ ID NO: 2955162 - protein, 18 aa, Entamoeba invadens
LTKPHLYKQVAYIHEKLG

SEQ ID NO: 2955163 - protein, 27 aa, Entamoeba invadens
LTKQYDCIWIQWSILYLRDEDLVNMLQ

SEQ ID NO: 2955164 - protein, 17 aa, Entamoeba invadens
LTKRIEDGLNDSDMLKA

SEQ ID NO: 2955165 - protein, 17 aa, Entamoeba invadens
LTKRTGYAVEVGDLSKY

SEQ ID NO: 2955166 - protein, 21 aa, Entamoeba invadens
LTKSFSGRIVILSSKEITSTV

SEQ ID NO: 2955167 - protein, 23 aa, Entamoeba invadens
LTKTGSIPLIYALEAGNTEAAIL

SEQ ID NO: 2955168 - protein, 23 aa, Entamoeba invadens
LTKVEKIEESFGIFDDAPTDETP

SEQ ID NO: 2955169 - protein, 17 aa, Entamoeba invadens
LTKVIFSDQMLKIGKEA

SEQ ID NO: 2955170 - protein, 25 aa, Entamoeba invadens
LTKVKLCGEVEPFIAKISKRKYDKI

SEQ ID NO: 2955171 - protein, 19 aa, Entamoeba invadens
LTKVLDLFDTISFPASVNQ

SEQ ID NO: 2955172 - protein, 23 aa, Entamoeba invadens
LTKVPTREGGIICEYMKIICDTL

SEQ ID NO: 2955173 - protein, 17 aa, Entamoeba invadens
LTLASGRRYGLIGRNGC

SEQ ID NO: 2955174 - protein, 21 aa, Entamoeba invadens
LTLECFKHFSQKASQDQLIVD

SEQ ID NO: 2955175 - protein, 18 aa, Entamoeba invadens
LTLEDCEIVSYKSGTCFQ

SEQ ID NO: 2955176 - protein, 21 aa, Entamoeba invadens
LTLEGIKQFFIDVNKDEYKID

SEQ ID NO: 2955177 - protein, 17 aa, Entamoeba invadens
LTLGTPQQFISNKARWK

SEQ ID NO: 2955178 - protein, 19 aa, Entamoeba invadens
LTLGVLICLECCGAHRSLG

SEQ ID NO: 2955179 - protein, 24 aa, Entamoeba invadens
LTLKCSCDLYMHFINQARTVSDFS

SEQ ID NO: 2955180 - protein, 22 aa, Entamoeba invadens
LTLKGVSGYMLFVQWKCGEKSG

SEQ ID NO: 2955181 - protein, 17 aa, Entamoeba invadens
LTLKITKKIGVLKSVES

SEQ ID NO: 2955182 - protein, 29 aa, Entamoeba invadens
LTLKKPNFWKLRRRDCPWVKTKKTELTET

SEQ ID NO: 2955183 - protein, 19 aa, Entamoeba invadens
LTLKNCGITKIPPNVFNQT

SEQ ID NO: 2955184 - protein, 20 aa, Entamoeba invadens
LTLKVIGRSFFESCSSLLSL

SEQ ID NO: 2955185 - protein, 26 aa, Entamoeba invadens
LTLKYRYEDVNALCFQKEQISDETYG

SEQ ID NO: 2955186 - protein, 19 aa, Entamoeba invadens
LTLLCISSAFVSDTSTKAE

SEQ ID NO: 2955187 - protein, 18 aa, Entamoeba invadens
LTLLDFINRATLEKLSFK

SEQ ID NO: 2955188 - protein, 21 aa, Entamoeba invadens
LTLLDVFMLWKTTTIPRAINK

SEQ ID NO: 2955189 - protein, 18 aa, Entamoeba invadens
LTLLNGFSQLIALEPSKD

SEQ ID NO: 2955190 - protein, 18 aa, Entamoeba invadens
LTLLRGMNEIQMFSEVGG

SEQ ID NO: 2955191 - protein, 19 aa, Entamoeba invadens
LTLLRPLLEVLIEKKYEGM

SEQ ID NO: 2955192 - protein, 19 aa, Entamoeba invadens
LTLLTGRRYRQSELANQIS

SEQ ID NO: 2955193 - protein, 27 aa, Entamoeba invadens
LTLLVLQKFVRYVLDQKFAITMGSLME

SEQ ID NO: 2955194 - protein, 22 aa, Entamoeba invadens
LTLNGKIVFKTGFRSCDVEAAI

SEQ ID NO: 2955195 - protein, 24 aa, Entamoeba invadens
LTLPKFHPDSMMKSKLEHRNSISF

SEQ ID NO: 2955196 - protein, 24 aa, Entamoeba invadens
LTLQMFKLMDGMWKKEGLDFRMTI

SEQ ID NO: 2955197 - protein, 22 aa, Entamoeba invadens
LTLRAEEVVRSAATVNGTSFIT

SEQ ID NO: 2955198 - protein, 20 aa, Entamoeba invadens
LTLRTLYHACAFEEGTHNIT

SEQ ID NO: 2955199 - protein, 21 aa, Entamoeba invadens
LTLSGFLPINYNGKAFGIPLT

SEQ ID NO: 2955200 - protein, 18 aa, Entamoeba invadens
LTLSNCQNILFGKECVFL

SEQ ID NO: 2955201 - protein, 18 aa, Entamoeba invadens
LTLTCLQLLVLVRQSNSH

SEQ ID NO: 2955202 - protein, 25 aa, Entamoeba invadens
LTLVMYRLSTLIVEKIVLNTSSEEW

SEQ ID NO: 2955203 - protein, 20 aa, Entamoeba invadens
LTLYLHYLFMIHGLHTKCDI

SEQ ID NO: 2955204 - protein, 20 aa, Entamoeba invadens
LTMESRVALVGRNGCGKTTF

SEQ ID NO: 2955205 - protein, 18 aa, Entamoeba invadens
LTMIGEKSIIQWQLEVLE

SEQ ID NO: 2955206 - protein, 17 aa, Entamoeba invadens
LTMKELYSFESHSGPVT

SEQ ID NO: 2955207 - protein, 19 aa, Entamoeba invadens
LTMRVVVINTMCSFMMVSQ

SEQ ID NO: 2955208 - protein, 18 aa, Entamoeba invadens
LTMSVIDRIFTRIGASDD

SEQ ID NO: 2955209 - protein, 18 aa, Entamoeba invadens
LTMVCKGASYYSFMQNDT

SEQ ID NO: 2955210 - protein, 21 aa, Entamoeba invadens
LTNDIPIHYFQIMVFAKELIS

SEQ ID NO: 2955211 - protein, 20 aa, Entamoeba invadens
LTNDIVFYSRRIRVYQLGEN

SEQ ID NO: 2955212 - protein, 25 aa, Entamoeba invadens
LTNDKNFYCFKLGNFPEEFENDWHQ

SEQ ID NO: 2955213 - protein, 18 aa, Entamoeba invadens
LTNEVLMTCSFRVLDKTL

SEQ ID NO: 2955214 - protein, 34 aa, Entamoeba invadens
LTNHMDIHFMQRVFKCFMPFAGNLQARNWHGMMT

SEQ ID NO: 2955215 - protein, 19 aa, Entamoeba invadens
LTNITLLAIYGCNQLVHTK

SEQ ID NO: 2955216 - protein, 25 aa, Entamoeba invadens
LTNLERLVCHYNYITILPLSLLILP

SEQ ID NO: 2955217 - protein, 21 aa, Entamoeba invadens
LTNRGDYTPAMLMNEKLNCPE

SEQ ID NO: 2955218 - protein, 18 aa, Entamoeba invadens
LTNVLKEWVVHRDKESRQ

SEQ ID NO: 2955219 - protein, 17 aa, Entamoeba invadens
LTNVVIPHFIKVIIGNR

SEQ ID NO: 2955220 - protein, 26 aa, Entamoeba invadens
LTPDWKSYKLPISKKGTLVVEVKGVR

SEQ ID NO: 2955221 - protein, 23 aa, Entamoeba invadens
LTPEEIRDLISIITKPCKCTQIK

SEQ ID NO: 2955222 - protein, 21 aa, Entamoeba invadens
LTPEIFKTYFIPYTTYNKELF

SEQ ID NO: 2955223 - protein, 27 aa, Entamoeba invadens
LTPEMAITAIVGFCRGTTKRVFVTASS

SEQ ID NO: 2955224 - protein, 24 aa, Entamoeba invadens
LTPEQIPFVFSLHFIGSAAKFLVE

SEQ ID NO: 2955225 - protein, 25 aa, Entamoeba invadens
LTPERYRELVGLIMINLDEPNKHQD

SEQ ID NO: 2955226 - protein, 19 aa, Entamoeba invadens
LTPETFLKRRRTDLDLTSV

SEQ ID NO: 2955227 - protein, 18 aa, Entamoeba invadens
LTPFCFDNCVSLNTINLE

SEQ ID NO: 2955228 - protein, 18 aa, Entamoeba invadens
LTPGVLFIDEVHMLDAEC

SEQ ID NO: 2955229 - protein, 17 aa, Entamoeba invadens
LTPLMCVKGDLTCEGRV

SEQ ID NO: 2955230 - protein, 18 aa, Entamoeba invadens
LTPLRLSVKIPEVKDVAA

SEQ ID NO: 2955231 - protein, 19 aa, Entamoeba invadens
LTPNKNWLDSVVFYNNSLY

SEQ ID NO: 2955232 - protein, 24 aa, Entamoeba invadens
LTPQCSSKLFGFYKEMVTFTKKIN

SEQ ID NO: 2955233 - protein, 17 aa, Entamoeba invadens
LTPSEALTHPFIKSKTT

SEQ ID NO: 2955234 - protein, 18 aa, Entamoeba invadens
LTPYIIEKGTMTRVFEVS

SEQ ID NO: 2955235 - protein, 34 aa, Entamoeba invadens
LTQAFKPSKLKAHLTKLFSPFGVVLTVQVRKARA

SEQ ID NO: 2955236 - protein, 24 aa, Entamoeba invadens
LTQFRLKMISLYDCSVKRLILPKT

SEQ ID NO: 2955237 - protein, 18 aa, Entamoeba invadens
LTQHCAEVNKWLLSNKIQ

SEQ ID NO: 2955238 - protein, 20 aa, Entamoeba invadens
LTQIKKCAFCNCKKMTRLKL

SEQ ID NO: 2955239 - protein, 18 aa, Entamoeba invadens
LTQLKAFLTDQIVLKKKQ

SEQ ID NO: 2955240 - protein, 25 aa, Entamoeba invadens
LTQLYRLGIISMYFDKTVETTVTMP

SEQ ID NO: 2955241 - protein, 18 aa, Entamoeba invadens
LTQQFIVDAFLRIETNNL

SEQ ID NO: 2955242 - protein, 17 aa, Entamoeba invadens
LTQRIVALTGILDDIIF

SEQ ID NO: 2955243 - protein, 18 aa, Entamoeba invadens
LTQRMKAIAPNLTTLLGE

SEQ ID NO: 2955244 - protein, 20 aa, Entamoeba invadens
LTQSELYKQIGIDPPRGCLL

SEQ ID NO: 2955245 - protein, 26 aa, Entamoeba invadens
LTQTLPEFALKFLVSIAQQITTFSEL

SEQ ID NO: 2955246 - protein, 22 aa, Entamoeba invadens
LTQYPTRLAWRPFDLSQVDEVR

SEQ ID NO: 2955247 - protein, 26 aa, Entamoeba invadens
LTRDVWKTNPDFVFFVDAFDEEVMSD

SEQ ID NO: 2955248 - protein, 17 aa, Entamoeba invadens
LTREVPREMNIPREAQR

SEQ ID NO: 2955249 - protein, 24 aa, Entamoeba invadens
LTRGTSVIHLIKAATQMLMKEYSS

SEQ ID NO: 2955250 - protein, 22 aa, Entamoeba invadens
LTRIPFPVCITQARSFLESFTD

SEQ ID NO: 2955251 - protein, 22 aa, Entamoeba invadens
LTRLDLSFVQFFGEQQNMTRIT

SEQ ID NO: 2955252 - protein, 17 aa, Entamoeba invadens
LTRRQCASFLACGFLGL

SEQ ID NO: 2955253 - protein, 17 aa, Entamoeba invadens
LTRSTRGKKSWTTEQKE

SEQ ID NO: 2955254 - protein, 24 aa, Entamoeba invadens
LTRTELTRRIQVFLHKKNAKLEVE

SEQ ID NO: 2955255 - protein, 25 aa, Entamoeba invadens
LTRTMFKKRMEVLRKTYNERAVAEM

SEQ ID NO: 2955256 - protein, 17 aa, Entamoeba invadens
LTSEKRQLYSLLEETQK

SEQ ID NO: 2955257 - protein, 29 aa, Entamoeba invadens
LTSELYDWLRICTGAQIFQGYGLTESFGG

SEQ ID NO: 2955258 - protein, 18 aa, Entamoeba invadens
LTSFKLLLHSCFYNEVMF

SEQ ID NO: 2955259 - protein, 19 aa, Entamoeba invadens
LTSGIKIGDGFGVICFTSA

SEQ ID NO: 2955260 - protein, 19 aa, Entamoeba invadens
LTSHKVYWRLEGRRLNVVI

SEQ ID NO: 2955261 - protein, 25 aa, Entamoeba invadens
LTSHRIWLWIVNMPQIIHALNVMPP

SEQ ID NO: 2955262 - protein, 18 aa, Entamoeba invadens
LTSIELPSSVSIICCCAF

SEQ ID NO: 2955263 - protein, 20 aa, Entamoeba invadens
LTSIESVFCFIKDLEGKNIG

SEQ ID NO: 2955264 - protein, 28 aa, Entamoeba invadens
LTSIGSFAFKNCISLHRIQFPDSLKVIK

SEQ ID NO: 2955265 - protein, 20 aa, Entamoeba invadens
LTSIGSLCFYGCYSLAFVKF

SEQ ID NO: 2955266 - protein, 18 aa, Entamoeba invadens
LTSINWRNSVLTKRKTSF

SEQ ID NO: 2955267 - protein, 17 aa, Entamoeba invadens
LTSLDLFGSSVSRLPEM

SEQ ID NO: 2955268 - protein, 23 aa, Entamoeba invadens
LTSLKLKNYIPLLVAKKLNFLKS

SEQ ID NO: 2955269 - protein, 24 aa, Entamoeba invadens
LTSLKRLEMCFSDIGDMKLPTTIQ

SEQ ID NO: 2955270 - protein, 17 aa, Entamoeba invadens
LTSLPQYCFHGCSKLSG

SEQ ID NO: 2955271 - protein, 18 aa, Entamoeba invadens
LTSLRVLMGVGRKQIDLL

SEQ ID NO: 2955272 - protein, 22 aa, Entamoeba invadens
LTSLSFPPSVDFIGPGCFEKCS

SEQ ID NO: 2955273 - protein, 17 aa, Entamoeba invadens
LTSNIFPFIQSDSGLQF

SEQ ID NO: 2955274 - protein, 18 aa, Entamoeba invadens
LTSRIYPIMFNKDSLTKF

SEQ ID NO: 2955275 - protein, 27 aa, Entamoeba invadens
LTSSINYRPLPTFFVDLLVIDKNSGAL

SEQ ID NO: 2955276 - protein, 26 aa, Entamoeba invadens
LTSTKWEMRLAFITAMNSVLSSKKKS

SEQ ID NO: 2955277 - protein, 26 aa, Entamoeba invadens
LTSVSRKGRLRYIKKVEAIANGLKKK

SEQ ID NO: 2955278 - protein, 17 aa, Entamoeba invadens
LTSVYLKGLSEIPAGTF

SEQ ID NO: 2955279 - protein, 22 aa, Entamoeba invadens
LTSYFYREFYRIIVYEEVDYKT

SEQ ID NO: 2955280 - protein, 24 aa, Entamoeba invadens
LTTAVAICKTCCLHKIPEPIRLAD

SEQ ID NO: 2955281 - protein, 26 aa, Entamoeba invadens
LTTEEIRMLWTYRAMVMKTKPRALSR

SEQ ID NO: 2955282 - protein, 21 aa, Entamoeba invadens
LTTFNRYVIDYAPVKTTKGVS

SEQ ID NO: 2955283 - protein, 17 aa, Entamoeba invadens
LTTLFAIIDQNNANVDY

SEQ ID NO: 2955284 - protein, 31 aa, Entamoeba invadens
LTTLSEFCPIYRGLKFRRLPIPPQDDIFEYV

SEQ ID NO: 2955285 - protein, 18 aa, Entamoeba invadens
LTTLYTICMTNIGLFGEE

SEQ ID NO: 2955286 - protein, 18 aa, Entamoeba invadens
LTTNFAINYMYQDDEGKT

SEQ ID NO: 2955287 - protein, 17 aa, Entamoeba invadens
LTTPELQSYIVYTKIHF

SEQ ID NO: 2955288 - protein, 19 aa, Entamoeba invadens
LTTPLRVAVLFYIQNSLLM

SEQ ID NO: 2955289 - protein, 23 aa, Entamoeba invadens
LTTQRLQIELTRTLTNIKLKEVP

SEQ ID NO: 2955290 - protein, 26 aa, Entamoeba invadens
LTTQVMLCLPLKYYSVDQCTIEQPTL

SEQ ID NO: 2955291 - protein, 18 aa, Entamoeba invadens
LTTRKALNPVSASRAQTM

SEQ ID NO: 2955292 - protein, 38 aa, Entamoeba invadens
LTTRPVCWHLFPSLKCSFIIRYSVKIDLTRSFPTTFLH

SEQ ID NO: 2955293 - protein, 25 aa, Entamoeba invadens
LTTSDMKQIYKWCAKNVESVVFDSE

SEQ ID NO: 2955294 - protein, 22 aa, Entamoeba invadens
LTTTCPGWLCYAEKMQGDTIFP

SEQ ID NO: 2955295 - protein, 20 aa, Entamoeba invadens
LTTTRNGFFVVIQDKGGNLI

SEQ ID NO: 2955296 - protein, 17 aa, Entamoeba invadens
LTVDFLYVITMGNVSME

SEQ ID NO: 2955297 - protein, 17 aa, Entamoeba invadens
LTVEEFFALAGICQTCF

SEQ ID NO: 2955298 - protein, 20 aa, Entamoeba invadens
LTVEGVELFKSYTVKTTIRN

SEQ ID NO: 2955299 - protein, 21 aa, Entamoeba invadens
LTVELSYPFRLIVQDNPRVPT

SEQ ID NO: 2955300 - protein, 25 aa, Entamoeba invadens
LTVFCSKFPTLEYLCLKGSKITSFG

SEQ ID NO: 2955301 - protein, 23 aa, Entamoeba invadens
LTVGEWFYGINFGNGKKEKKGPY

SEQ ID NO: 2955302 - protein, 18 aa, Entamoeba invadens
LTVINSNCVQFPQFTFED

SEQ ID NO: 2955303 - protein, 23 aa, Entamoeba invadens
LTVKELFFAFKLTKMANPFLPFS

SEQ ID NO: 2955304 - protein, 17 aa, Entamoeba invadens
LTVLARREIDGCSANQL

SEQ ID NO: 2955305 - protein, 27 aa, Entamoeba invadens
LTVTLKAPHPFSIFFKTQMKSAPQHLQ

SEQ ID NO: 2955306 - protein, 17 aa, Entamoeba invadens
LTVTVKRQQVLQTLYAQ

SEQ ID NO: 2955307 - protein, 25 aa, Entamoeba invadens
LTVYKCNWDPSFVVENEWVLADSGY

SEQ ID NO: 2955308 - protein, 21 aa, Entamoeba invadens
LTWMHQIDGVFALQQQKMLVR

SEQ ID NO: 2955309 - protein, 28 aa, Entamoeba invadens
LTYERGWGKKLEYCIAFSNYEMRDVTSR

SEQ ID NO: 2955310 - protein, 17 aa, Entamoeba invadens
LTYGISSCITCEPNYYL

SEQ ID NO: 2955311 - protein, 25 aa, Entamoeba invadens
LTYIGKSCFGWCLSLCEFDIPKNID

SEQ ID NO: 2955312 - protein, 24 aa, Entamoeba invadens
LTYNRLKVLIFMKPDSNIGLIYSL

SEQ ID NO: 2955313 - protein, 20 aa, Entamoeba invadens
LTYNSGYSFKMLVSSLQSMV

SEQ ID NO: 2955314 - protein, 21 aa, Entamoeba invadens
LTYQEYCLRPFEVGNDENVFV

SEQ ID NO: 2955315 - protein, 18 aa, Entamoeba invadens
LVACGDGSVYWLNTGDLK

SEQ ID NO: 2955316 - protein, 29 aa, Entamoeba invadens
LVAECFFDPLKIDMCDGLVSLRPHPFDPF

SEQ ID NO: 2955317 - protein, 17 aa, Entamoeba invadens
LVAEMKLCYNEIEKKAV

SEQ ID NO: 2955318 - protein, 23 aa, Entamoeba invadens
LVAGCAPELIGILSSDNKTLMSD

SEQ ID NO: 2955319 - protein, 17 aa, Entamoeba invadens
LVANCAKSQDVHPDLIT

SEQ ID NO: 2955320 - protein, 18 aa, Entamoeba invadens
LVAPPKCNPLKNSVLTTG

SEQ ID NO: 2955321 - protein, 23 aa, Entamoeba invadens
LVAPRIHDIFARAMQVDCVRLWS

SEQ ID NO: 2955322 - protein, 19 aa, Entamoeba invadens
LVCFYNYIFYVLLHPEIQT

SEQ ID NO: 2955323 - protein, 26 aa, Entamoeba invadens
LVCKKFIHLLERYRYNPIPVTSKRLF

SEQ ID NO: 2955324 - protein, 24 aa, Entamoeba invadens
LVCKKYSCILDRFRYNPIPITSTK

SEQ ID NO: 2955325 - protein, 22 aa, Entamoeba invadens
LVCKSYMDFFFARGNKDVVITI

SEQ ID NO: 2955326 - protein, 23 aa, Entamoeba invadens
LVCKTSNVTFVFETLKDVSLFGA

SEQ ID NO: 2955327 - protein, 17 aa, Entamoeba invadens
LVCSWDTDLKCLVLTSK

SEQ ID NO: 2955328 - protein, 23 aa, Entamoeba invadens
LVCTCGGISLARVKSAIKEKQLT

SEQ ID NO: 2955329 - protein, 18 aa, Entamoeba invadens
LVDAHRRYFDAAFRRVSE

SEQ ID NO: 2955330 - protein, 21 aa, Entamoeba invadens
LVDFLPYNCHYCHKPFCKRCI

SEQ ID NO: 2955331 - protein, 19 aa, Entamoeba invadens
LVDFPDAFGQLSNIQILCA

SEQ ID NO: 2955332 - protein, 27 aa, Entamoeba invadens
LVDGWYDPRFPTIQGLLRRGLTLEAMK

SEQ ID NO: 2955333 - protein, 23 aa, Entamoeba invadens
LVDHPKWTKVILQIGDNKIRFNF

SEQ ID NO: 2955334 - protein, 24 aa, Entamoeba invadens
LVDKNFLYFYAIKVIETVTRDQAT

SEQ ID NO: 2955335 - protein, 24 aa, Entamoeba invadens
LVDLKLQNVCFVRIGGRKVAKVDI

SEQ ID NO: 2955336 - protein, 29 aa, Entamoeba invadens
LVDLRYLNLCGCTRITPAFLSTLLQNTPK

SEQ ID NO: 2955337 - protein, 19 aa, Entamoeba invadens
LVDPVSWYALDKAVWDNME

SEQ ID NO: 2955338 - protein, 21 aa, Entamoeba invadens
LVDRKSKFIAFVARVHSEKET

SEQ ID NO: 2955339 - protein, 22 aa, Entamoeba invadens
LVDRRTVCCKCRHRVAGGQAFV

SEQ ID NO: 2955340 - protein, 19 aa, Entamoeba invadens
LVDSDFTVKICDFGFAEVL

SEQ ID NO: 2955341 - protein, 19 aa, Entamoeba invadens
LVDVMKVFFDNMGDYKDDI

SEQ ID NO: 2955342 - protein, 24 aa, Entamoeba invadens
LVDYSEIVLRMFISPELITTHFSI

SEQ ID NO: 2955343 - protein, 33 aa, Entamoeba invadens
LVDYYRYNPLLWYRLASCVIMANYNMKRGSAFN

SEQ ID NO: 2955344 - protein, 17 aa, Entamoeba invadens
LVEAMKHVGVEPVKIYM

SEQ ID NO: 2955345 - protein, 23 aa, Entamoeba invadens
LVECYQVILDVAAWINETKLYEE

SEQ ID NO: 2955346 - protein, 25 aa, Entamoeba invadens
LVEEFKYKYNYVMDIRTWSPLMFAR

SEQ ID NO: 2955347 - protein, 25 aa, Entamoeba invadens
LVEEKIRKAWNFGGIRIEDDVLVTE

SEQ ID NO: 2955348 - protein, 20 aa, Entamoeba invadens
LVEFCCPGSLGPLRTFKRVF

SEQ ID NO: 2955349 - protein, 17 aa, Entamoeba invadens
LVEFGWDAEPLFFPIRV

SEQ ID NO: 2955350 - protein, 18 aa, Entamoeba invadens
LVEFLNFYGNIFKMGKTG

SEQ ID NO: 2955351 - protein, 33 aa, Entamoeba invadens
LVEGKLPRKSIMQLKNICAGIGTPNSMLSSESK

SEQ ID NO: 2955352 - protein, 24 aa, Entamoeba invadens
LVEGKWVVSKNWVLEGMRKRHGVK

SEQ ID NO: 2955353 - protein, 18 aa, Entamoeba invadens
LVEKAEKYIASNLVAISD

SEQ ID NO: 2955354 - protein, 25 aa, Entamoeba invadens
LVEKFKNEGCRVALLSIEVANCGVE

SEQ ID NO: 2955355 - protein, 18 aa, Entamoeba invadens
LVEKGCGLLMNIIVDPDA

SEQ ID NO: 2955356 - protein, 23 aa, Entamoeba invadens
LVEKVEIWFDPNLRESVVEEDRE

SEQ ID NO: 2955357 - protein, 26 aa, Entamoeba invadens
LVELGEVLYSICFEITEVTKKLVSGL

SEQ ID NO: 2955358 - protein, 19 aa, Entamoeba invadens
LVELGYHFQTKVSTGKNYS

SEQ ID NO: 2955359 - protein, 25 aa, Entamoeba invadens
LVELKGNPLVSCDVFAPTSETIQTH

SEQ ID NO: 2955360 - protein, 25 aa, Entamoeba invadens
LVELLGNLGCGFDCASLGEIKEVLK

SEQ ID NO: 2955361 - protein, 18 aa, Entamoeba invadens
LVELPVMKIQWDDIIPFS

SEQ ID NO: 2955362 - protein, 22 aa, Entamoeba invadens
LVELVGKLGCGFDCATLNEVKE

SEQ ID NO: 2955363 - protein, 21 aa, Entamoeba invadens
LVEQNRFGVVFTIQDMSEEGD

SEQ ID NO: 2955364 - protein, 25 aa, Entamoeba invadens
LVERKRAYQGLPFALSLKLKRMRDE

SEQ ID NO: 2955365 - protein, 23 aa, Entamoeba invadens
LVERYEIMAMPTFILIKDKIEIG

SEQ ID NO: 2955366 - protein, 23 aa, Entamoeba invadens
LVESKGICPLCKKPSELHSGISV

SEQ ID NO: 2955367 - protein, 23 aa, Entamoeba invadens
LVESLKLITYRNLFNTARQIVNT

SEQ ID NO: 2955368 - protein, 19 aa, Entamoeba invadens
LVEVCESAFENCCCLESVK

SEQ ID NO: 2955369 - protein, 21 aa, Entamoeba invadens
LVEVWDWRSVTQIIPNSTSPE

SEQ ID NO: 2955370 - protein, 25 aa, Entamoeba invadens
LVFAKKCKLLYLGVKNVLCGVELSG

SEQ ID NO: 2955371 - protein, 44 aa, Entamoeba invadens
LVFDKRISDTFVWYLNRFPIRVLVWKDYIAFLIESEHANHEVLN

SEQ ID NO: 2955372 - protein, 18 aa, Entamoeba invadens
LVFETICMLSLKYELTTA

SEQ ID NO: 2955373 - protein, 30 aa, Entamoeba invadens
LVFFWRSQSDLPFRIVIIGAGGCTLTLGIK

SEQ ID NO: 2955374 - protein, 29 aa, Entamoeba invadens
LVFHTECLRCKSCDSFIIGKHSFDRRCDD

SEQ ID NO: 2955375 - protein, 19 aa, Entamoeba invadens
LVFNRSCVIERGAFSKCTS

SEQ ID NO: 2955376 - protein, 17 aa, Entamoeba invadens
LVFPNGVTFVYNYIIKL

SEQ ID NO: 2955377 - protein, 25 aa, Entamoeba invadens
LVFSLCIRLCDDFESVCMLLDALVL

SEQ ID NO: 2955378 - protein, 23 aa, Entamoeba invadens
LVFYKRKEYVVALRLYNTKVGEV

SEQ ID NO: 2955379 - protein, 19 aa, Entamoeba invadens
LVGAAIIAFEMWKEALEEA

SEQ ID NO: 2955380 - protein, 22 aa, Entamoeba invadens
LVGCGNYKVELEKEVVFQSQLV

SEQ ID NO: 2955381 - protein, 20 aa, Entamoeba invadens
LVGGFVFLRLFCPAMAAPEG

SEQ ID NO: 2955382 - protein, 26 aa, Entamoeba invadens
LVGGILFLRVICAFIATPDANNLLYP

SEQ ID NO: 2955383 - protein, 28 aa, Entamoeba invadens
LVGGWTFNLPQSMCRRIMGDGCCVLPSI

SEQ ID NO: 2955384 - protein, 19 aa, Entamoeba invadens
LVGIEMPWGECVIADGLSV

SEQ ID NO: 2955385 - protein, 19 aa, Entamoeba invadens
LVGKGSFGKVCVVKKKDTG

SEQ ID NO: 2955386 - protein, 22 aa, Entamoeba invadens
LVGKRYGQWVEIKGHQFVTGKS

SEQ ID NO: 2955387 - protein, 28 aa, Entamoeba invadens
LVGLHYKELQKALNKCGITRTTLQMTID

SEQ ID NO: 2955388 - protein, 19 aa, Entamoeba invadens
LVGMKRFNIKKERKRDAFR

SEQ ID NO: 2955389 - protein, 18 aa, Entamoeba invadens
LVGQELGLSKAIRLLQKQ

SEQ ID NO: 2955390 - protein, 17 aa, Entamoeba invadens
LVGVAHAVERVFSTNKQ

SEQ ID NO: 2955391 - protein, 23 aa, Entamoeba invadens
LVGVYSKILLSFVGDTCVVEIPL

SEQ ID NO: 2955392 - protein, 25 aa, Entamoeba invadens
LVHFNELEMQLQIWDVCGRQRNCMM

SEQ ID NO: 2955393 - protein, 17 aa, Entamoeba invadens
LVHHLIMEYGIYQRLNI

SEQ ID NO: 2955394 - protein, 18 aa, Entamoeba invadens
LVHKRCPQSHSMMQNSST

SEQ ID NO: 2955395 - protein, 25 aa, Entamoeba invadens
LVHKRFSYFFFHWSDLIRNAFYHII

SEQ ID NO: 2955396 - protein, 19 aa, Entamoeba invadens
LVHRDIKSRNILVFTDPNK

SEQ ID NO: 2955397 - protein, 21 aa, Entamoeba invadens
LVIAYLIKTGMTFEEAYNHVM

SEQ ID NO: 2955398 - protein, 17 aa, Entamoeba invadens
LVICAESPFLQPEEMIK

SEQ ID NO: 2955399 - protein, 20 aa, Entamoeba invadens
LVIIECPRITTLKSSNKLKT

SEQ ID NO: 2955400 - protein, 17 aa, Entamoeba invadens
LVIIPKIVFTPSDKTLS

SEQ ID NO: 2955401 - protein, 19 aa, Entamoeba invadens
LVILLNWLASVTDADVQDW

SEQ ID NO: 2955402 - protein, 18 aa, Entamoeba invadens
LVILVRYLLHQGGFTSVI

SEQ ID NO: 2955403 - protein, 21 aa, Entamoeba invadens
LVINFLRSLLMYVQEAKGGAL

SEQ ID NO: 2955404 - protein, 24 aa, Entamoeba invadens
LVINKEILQNMLAAFTTKINEDTK

SEQ ID NO: 2955405 - protein, 19 aa, Entamoeba invadens
LVIPDSVVEFGMFVCQDCE

SEQ ID NO: 2955406 - protein, 19 aa, Entamoeba invadens
LVIPPEIIKSLPTRLRVLI

SEQ ID NO: 2955407 - protein, 17 aa, Entamoeba invadens
LVIPRSVTKIGNGFVSG

SEQ ID NO: 2955408 - protein, 21 aa, Entamoeba invadens
LVITRLVRQLGLYSYNNDNKV

SEQ ID NO: 2955409 - protein, 23 aa, Entamoeba invadens
LVIVCKREGFLVGDLAPLKNFST

SEQ ID NO: 2955410 - protein, 22 aa, Entamoeba invadens
LVIVKEIARVLVLSQKNLLEET

SEQ ID NO: 2955411 - protein, 21 aa, Entamoeba invadens
LVKATCVGILLVLKKDLLGLN

SEQ ID NO: 2955412 - protein, 18 aa, Entamoeba invadens
LVKEGMLVKVCRSGNKNR

SEQ ID NO: 2955413 - protein, 17 aa, Entamoeba invadens
LVKEGVLMKVCKKTNKL

SEQ ID NO: 2955414 - protein, 23 aa, Entamoeba invadens
LVKEKLGVSFLYEYKGDPCYRLK

SEQ ID NO: 2955415 - protein, 17 aa, Entamoeba invadens
LVKEQKLDTLVEGKLPR

SEQ ID NO: 2955416 - protein, 33 aa, Entamoeba invadens
LVKEYRTFINYFPKRGERFCCGKIDKVLKPNDT

SEQ ID NO: 2955417 - protein, 17 aa, Entamoeba invadens
LVKGFAKQMEYIIGSIN

SEQ ID NO: 2955418 - protein, 26 aa, Entamoeba invadens
LVKIAYKYALCKPSQFPVGGCCYCKE

SEQ ID NO: 2955419 - protein, 24 aa, Entamoeba invadens
LVKLSDAMILRFAIPSRKMTKEDI

SEQ ID NO: 2955420 - protein, 24 aa, Entamoeba invadens
LVKLSDAMILRFAIPSRKMTKEDL

SEQ ID NO: 2955421 - protein, 20 aa, Entamoeba invadens
LVKLSSSFQFTRGVHFLKSD

SEQ ID NO: 2955422 - protein, 25 aa, Entamoeba invadens
LVKNLCMKEYFGGYEEFCIDFDPTY

SEQ ID NO: 2955423 - protein, 33 aa, Entamoeba invadens
LVKQGGSWKSWKKRWCVLTPTGMIFYFKDKKDV

SEQ ID NO: 2955424 - protein, 18 aa, Entamoeba invadens
LVKQNIRFEDVVYDGYHD

SEQ ID NO: 2955425 - protein, 22 aa, Entamoeba invadens
LVKQRLEYEVSIGVLPKTAMRR

SEQ ID NO: 2955426 - protein, 24 aa, Entamoeba invadens
LVKRAKKAKLLRAFSKGTTPHSHK

SEQ ID NO: 2955427 - protein, 25 aa, Entamoeba invadens
LVKRRCKEMENVYILKGASQKTALR

SEQ ID NO: 2955428 - protein, 17 aa, Entamoeba invadens
LVKRRGDNWAMKKANGF

SEQ ID NO: 2955429 - protein, 18 aa, Entamoeba invadens
LVKTELCSTHNFNLLCDL

SEQ ID NO: 2955430 - protein, 20 aa, Entamoeba invadens
LVKTKGMEWWSCVIQGDEEI

SEQ ID NO: 2955431 - protein, 22 aa, Entamoeba invadens
LVKTPSLLLCDELLEIAMEVKR

SEQ ID NO: 2955432 - protein, 17 aa, Entamoeba invadens
LVKTRNEVVSFFVTDVL

SEQ ID NO: 2955433 - protein, 17 aa, Entamoeba invadens
LVKVFLLKDNDWKDAGT

SEQ ID NO: 2955434 - protein, 19 aa, Entamoeba invadens
LVKVWDLEVQQCKQTLVGH

SEQ ID NO: 2955435 - protein, 25 aa, Entamoeba invadens
LVKYFKRPLETMAYTSTEKGGRQDN

SEQ ID NO: 2955436 - protein, 23 aa, Entamoeba invadens
LVKYKRTGEMFALKMVEKKKVIE

SEQ ID NO: 2955437 - protein, 20 aa, Entamoeba invadens
LVKYLIDVFKCSRLAYCFDY

SEQ ID NO: 2955438 - protein, 25 aa, Entamoeba invadens
LVLCTSLFTFEEFDISAVLKLAQSN

SEQ ID NO: 2955439 - protein, 19 aa, Entamoeba invadens
LVLDFKLLKNYAHRVEYVL

SEQ ID NO: 2955440 - protein, 25 aa, Entamoeba invadens
LVLFPFKTAALIFIKTLLSLMGPIY

SEQ ID NO: 2955441 - protein, 26 aa, Entamoeba invadens
LVLHLKRFEFDYETMKKFKIYDKFAF

SEQ ID NO: 2955442 - protein, 18 aa, Entamoeba invadens
LVLIHGFNGIGKTTVVRQ

SEQ ID NO: 2955443 - protein, 18 aa, Entamoeba invadens
LVLKDFYSPLLLENTDEI

SEQ ID NO: 2955444 - protein, 23 aa, Entamoeba invadens
LVLKETLHLFLINFVPSECDERF

SEQ ID NO: 2955445 - protein, 18 aa, Entamoeba invadens
LVLKVCLTQNMIRLPISL

SEQ ID NO: 2955446 - protein, 17 aa, Entamoeba invadens
LVLLRCVFLMNVDRSIR

SEQ ID NO: 2955447 - protein, 32 aa, Entamoeba invadens
LVLQCLHSLSNIKGRLPTKAFTTLIKETCDKL

SEQ ID NO: 2955448 - protein, 20 aa, Entamoeba invadens
LVLRSKVQWLNNGQIASLLE

SEQ ID NO: 2955449 - protein, 21 aa, Entamoeba invadens
LVLSVCINYLLPNIDKVNITD

SEQ ID NO: 2955450 - protein, 19 aa, Entamoeba invadens
LVLTEFLKRRCVEQKNDDI

SEQ ID NO: 2955451 - protein, 25 aa, Entamoeba invadens
LVLVCKKCLMSSLSLLINPYYPMYP

SEQ ID NO: 2955452 - protein, 18 aa, Entamoeba invadens
LVMLGGGAVGKSAITVQL

SEQ ID NO: 2955453 - protein, 24 aa, Entamoeba invadens
LVMLSKLFRARAFTFDYPGYGLNK

SEQ ID NO: 2955454 - protein, 23 aa, Entamoeba invadens
LVNAGLCKRATCPVELCHWSFTS

SEQ ID NO: 2955455 - protein, 22 aa, Entamoeba invadens
LVNAGLCKRATCPVELCHWYFT

SEQ ID NO: 2955456 - protein, 19 aa, Entamoeba invadens
LVNAIAIGGSSDFVSQITS

SEQ ID NO: 2955457 - protein, 18 aa, Entamoeba invadens
LVNCGRLKNVHSFKKDFK

SEQ ID NO: 2955458 - protein, 35 aa, Entamoeba invadens
LVNEKAIKIILTWGQLYPDELCEYTVLRDKYLTGE

SEQ ID NO: 2955459 - protein, 24 aa, Entamoeba invadens
LVNFPTSGMLQFFVDPEDQYDTSR

SEQ ID NO: 2955460 - protein, 18 aa, Entamoeba invadens
LVNFRYPLSYREASEQKK

SEQ ID NO: 2955461 - protein, 26 aa, Entamoeba invadens
LVNIEIPCSVCVSSDVKICEKKMPER

SEQ ID NO: 2955462 - protein, 18 aa, Entamoeba invadens
LVNKKCYDSVEMLHIYSC

SEQ ID NO: 2955463 - protein, 17 aa, Entamoeba invadens
LVNKKVVGQLCCVGIGK

SEQ ID NO: 2955464 - protein, 20 aa, Entamoeba invadens
LVNKRAHEAIRCLKVNPRSI

SEQ ID NO: 2955465 - protein, 22 aa, Entamoeba invadens
LVNKRAHEAIRCLKVNPRSIYL

SEQ ID NO: 2955466 - protein, 24 aa, Entamoeba invadens
LVNKRVNVTLGFKDKECAKKFVDE

SEQ ID NO: 2955467 - protein, 21 aa, Entamoeba invadens
LVNLRNPYLVQCFGMSYFEGS

SEQ ID NO: 2955468 - protein, 18 aa, Entamoeba invadens
LVNMCLNMPHFLKESEKK

SEQ ID NO: 2955469 - protein, 24 aa, Entamoeba invadens
LVNRKGEHLIALWSVNGSAIQSIK

SEQ ID NO: 2955470 - protein, 17 aa, Entamoeba invadens
LVNSCWLVTKQTIEMRH

SEQ ID NO: 2955471 - protein, 25 aa, Entamoeba invadens
LVNSWKMCALRCVMASNTSIPLCDI

SEQ ID NO: 2955472 - protein, 27 aa, Entamoeba invadens
LVPARVLPFVIPKYFFLSQDVDRLVDL

SEQ ID NO: 2955473 - protein, 24 aa, Entamoeba invadens
LVPCYEYPEFTFARGSVTVQTHLD

SEQ ID NO: 2955474 - protein, 17 aa, Entamoeba invadens
LVPEKNGVFAITKRICS

SEQ ID NO: 2955475 - protein, 27 aa, Entamoeba invadens
LVPFDGCGHVLCRSCMIKHIAEQIEGP

SEQ ID NO: 2955476 - protein, 18 aa, Entamoeba invadens
LVPFPRNHFAMMSYSPIV

SEQ ID NO: 2955477 - protein, 19 aa, Entamoeba invadens
LVQALKFELHHSSELAFFL

SEQ ID NO: 2955478 - protein, 19 aa, Entamoeba invadens
LVQEYAIEACKDYRFRRMK

SEQ ID NO: 2955479 - protein, 28 aa, Entamoeba invadens
LVQFPSHLSVLFKYIFNVSITQELYLPF

SEQ ID NO: 2955480 - protein, 18 aa, Entamoeba invadens
LVQIKLSLFVNEHPTAEK

SEQ ID NO: 2955481 - protein, 27 aa, Entamoeba invadens
LVQIPKLYLKDGLSLYGIFDGSKEIEL

SEQ ID NO: 2955482 - protein, 18 aa, Entamoeba invadens
LVQKDFKGSNSVNMAHKY

SEQ ID NO: 2955483 - protein, 24 aa, Entamoeba invadens
LVQNEVKPLFVLKINQFKRVVEFL

SEQ ID NO: 2955484 - protein, 18 aa, Entamoeba invadens
LVQSRAFQKMELDTFKDQ

SEQ ID NO: 2955485 - protein, 25 aa, Entamoeba invadens
LVQTKLECNFLYEPFIKIPLTMNAL

SEQ ID NO: 2955486 - protein, 17 aa, Entamoeba invadens
LVRAMEVLFEYPNYRSD

SEQ ID NO: 2955487 - protein, 17 aa, Entamoeba invadens
LVRDIFGSFLIKETESF

SEQ ID NO: 2955488 - protein, 17 aa, Entamoeba invadens
LVRDIRANVKFEDVPVN

SEQ ID NO: 2955489 - protein, 24 aa, Entamoeba invadens
LVSARLNRDYGLFDLIRQRSAGIF

SEQ ID NO: 2955490 - protein, 18 aa, Entamoeba invadens
LVSFKSYWTKVIADELLN

SEQ ID NO: 2955491 - protein, 23 aa, Entamoeba invadens
LVSILKYILLYLLNQLTIEDIGN

SEQ ID NO: 2955492 - protein, 19 aa, Entamoeba invadens
LVSKKLVKETCNWKTLYWT

SEQ ID NO: 2955493 - protein, 22 aa, Entamoeba invadens
LVSKLLLEKVVLYKEQIKGGWV

SEQ ID NO: 2955494 - protein, 17 aa, Entamoeba invadens
LVSKYSDAFYFYVYPEE

SEQ ID NO: 2955495 - protein, 18 aa, Entamoeba invadens
LVSLNLFSLCSVWTEERG

SEQ ID NO: 2955496 - protein, 17 aa, Entamoeba invadens
LVSLVLIMVDPYYRTIE

SEQ ID NO: 2955497 - protein, 17 aa, Entamoeba invadens
LVSMVWYIEEFVGEESK

SEQ ID NO: 2955498 - protein, 24 aa, Entamoeba invadens
LVSNLKKGSPLVVHGCVNTFRYIV

SEQ ID NO: 2955499 - protein, 17 aa, Entamoeba invadens
LVSQWAYNCKIPANYLI

SEQ ID NO: 2955500 - protein, 17 aa, Entamoeba invadens
LVSQYSRQNLMDVSNLA

SEQ ID NO: 2955501 - protein, 18 aa, Entamoeba invadens
LVSRASCIPESFEDSDKK

SEQ ID NO: 2955502 - protein, 20 aa, Entamoeba invadens
LVSSGLKLQSIVSYNHLGNN

SEQ ID NO: 2955503 - protein, 22 aa, Entamoeba invadens
LVSSGLKLQSIVSYNHLGNNDG

SEQ ID NO: 2955504 - protein, 26 aa, Entamoeba invadens
LVSYSCYYNGCTVPNCETCNSSSVCT

SEQ ID NO: 2955505 - protein, 27 aa, Entamoeba invadens
LVTCGAAKCPLWDVGIMLSEVVCNPHT

SEQ ID NO: 2955506 - protein, 19 aa, Entamoeba invadens
LVTCGYMCYDDLMYIEKYD

SEQ ID NO: 2955507 - protein, 19 aa, Entamoeba invadens
LVTFYNLLRGISIIKNEIK

SEQ ID NO: 2955508 - protein, 20 aa, Entamoeba invadens
LVTIGYSCFNGCECLVNIKI

SEQ ID NO: 2955509 - protein, 24 aa, Entamoeba invadens
LVTIPKRRPSVLCRDVDGKTRCVL

SEQ ID NO: 2955510 - protein, 18 aa, Entamoeba invadens
LVTKCFNEHGSVLADIFE

SEQ ID NO: 2955511 - protein, 17 aa, Entamoeba invadens
LVTLEFADLVQFLQNLP

SEQ ID NO: 2955512 - protein, 24 aa, Entamoeba invadens
LVTMLKMPISLKIVNSCCFCDSVT

SEQ ID NO: 2955513 - protein, 22 aa, Entamoeba invadens
LVTPLYLPALFKEMCFDETIIA

SEQ ID NO: 2955514 - protein, 17 aa, Entamoeba invadens
LVTPTFRSKFSKDEMSL

SEQ ID NO: 2955515 - protein, 26 aa, Entamoeba invadens
LVTQIWEWGCSHMMSGLQGWNNLTKI

SEQ ID NO: 2955516 - protein, 17 aa, Entamoeba invadens
LVTSFCLYPKCQWQHHQ

SEQ ID NO: 2955517 - protein, 27 aa, Entamoeba invadens
LVTSLKSSEKFTCFYKKQIVKAPSNYV

SEQ ID NO: 2955518 - protein, 20 aa, Entamoeba invadens
LVTVMNECRLDIKLEDYIQQ

SEQ ID NO: 2955519 - protein, 19 aa, Entamoeba invadens
LVTYCSAPMPYVVGVKSNF

SEQ ID NO: 2955520 - protein, 22 aa, Entamoeba invadens
LVVCDGLLYLFWSESGILCCSP

SEQ ID NO: 2955521 - protein, 24 aa, Entamoeba invadens
LVVGELHLDVGLVLAAGIRQQALQ

SEQ ID NO: 2955522 - protein, 23 aa, Entamoeba invadens
LVVGGRLVFWFPVIFPQDHGKLF

SEQ ID NO: 2955523 - protein, 21 aa, Entamoeba invadens
LVVIDCFGLSFSKLQNIPLKH

SEQ ID NO: 2955524 - protein, 25 aa, Entamoeba invadens
LVVILECTKPVFTSALKETMFDVNY

SEQ ID NO: 2955525 - protein, 25 aa, Entamoeba invadens
LVVKRLVDMLKLKGVVEAWGTVVKK

SEQ ID NO: 2955526 - protein, 18 aa, Entamoeba invadens
LVVLKSNFVEFSQIRAKK

SEQ ID NO: 2955527 - protein, 17 aa, Entamoeba invadens
LVVLSRGVSEEVFSVLE

SEQ ID NO: 2955528 - protein, 27 aa, Entamoeba invadens
LVVPDRVYFLSEFCFLDCNNLREIVLP

SEQ ID NO: 2955529 - protein, 17 aa, Entamoeba invadens
LVVPHNVGFLSLKNLKL

SEQ ID NO: 2955530 - protein, 28 aa, Entamoeba invadens
LVVQCFSHKEVHLIFPTDHDIFSLTHIT

SEQ ID NO: 2955531 - protein, 18 aa, Entamoeba invadens
LVYKQRILTNQTLLNKSL

SEQ ID NO: 2955532 - protein, 18 aa, Entamoeba invadens
LVYKYRFTDTTWKTYMLN

SEQ ID NO: 2955533 - protein, 17 aa, Entamoeba invadens
LVYNIANSIGRGAFGEV

SEQ ID NO: 2955534 - protein, 19 aa, Entamoeba invadens
LVYPPRIDYVPGTEFLGEV

SEQ ID NO: 2955535 - protein, 19 aa, Entamoeba invadens
LVYQTKLSNYFPMGQAIVE

SEQ ID NO: 2955536 - protein, 26 aa, Entamoeba invadens
LVYRPFLRLRYKEGIEMLRAAGETIG

SEQ ID NO: 2955537 - protein, 24 aa, Entamoeba invadens
LWDEIPNPFLSYGYSSSQVPFTQQ

SEQ ID NO: 2955538 - protein, 18 aa, Entamoeba invadens
LWDSCLLIFPTIETDINF

SEQ ID NO: 2955539 - protein, 41 aa, Entamoeba invadens
LWEGQKWKKLGMTDLCDYDGVVTWYKKAVVLIHPDKNQFRS

SEQ ID NO: 2955540 - protein, 23 aa, Entamoeba invadens
LWEKLKEELKKEILQLVDEKVKV

SEQ ID NO: 2955541 - protein, 17 aa, Entamoeba invadens
LWIDLVFGSSQQSSTNF

SEQ ID NO: 2955542 - protein, 19 aa, Entamoeba invadens
LWIIIREVCRFVDEKKKKI

SEQ ID NO: 2955543 - protein, 19 aa, Entamoeba invadens
LWILMDLCAVGSVKDLMKK

SEQ ID NO: 2955544 - protein, 21 aa, Entamoeba invadens
LWINFFIMKDVKVISRAQKES

SEQ ID NO: 2955545 - protein, 27 aa, Entamoeba invadens
LWKGKSAHGSGLFSVLSTTLERPPLYQ

SEQ ID NO: 2955546 - protein, 19 aa, Entamoeba invadens
LWLCSIPLAVNLVDEETLS

SEQ ID NO: 2955547 - protein, 18 aa, Entamoeba invadens
LWLMKKLTIFDFLSKSKE

SEQ ID NO: 2955548 - protein, 23 aa, Entamoeba invadens
LWNENFKIAFFSRTVTVKNPLPV

SEQ ID NO: 2955549 - protein, 36 aa, Entamoeba invadens
LWNFCFGDGLRLKRRCPPEEFIPFVITDADANTKNV

SEQ ID NO: 2955550 - protein, 19 aa, Entamoeba invadens
LWPEEFCLSYRKKDEKHVP

SEQ ID NO: 2955551 - protein, 24 aa, Entamoeba invadens
LWPETYRYLCYVLFTEAEQAHLKP

SEQ ID NO: 2955552 - protein, 25 aa, Entamoeba invadens
LWPQFNSKTSLKCCVNKFTYSKVEK

SEQ ID NO: 2955553 - protein, 26 aa, Entamoeba invadens
LWQLFLTWSGVFPLETLNQIRMGMTM

SEQ ID NO: 2955554 - protein, 18 aa, Entamoeba invadens
LWSPRKLVIYNGKFVLYK

SEQ ID NO: 2955555 - protein, 24 aa, Entamoeba invadens
LWTKETRPYAVLAYQTTVTYIKKD

SEQ ID NO: 2955556 - protein, 17 aa, Entamoeba invadens
LWTPLLIAVAGAPSNTE

SEQ ID NO: 2955557 - protein, 18 aa, Entamoeba invadens
LWVKKCFSDISILINTIT

SEQ ID NO: 2955558 - protein, 18 aa, Entamoeba invadens
LWVMWKLGSVEMGVITLQ

SEQ ID NO: 2955559 - protein, 19 aa, Entamoeba invadens
LWVNPEFVSGLSAEKVIGR

SEQ ID NO: 2955560 - protein, 18 aa, Entamoeba invadens
LYAFFRTEMTAAIQSNNL

SEQ ID NO: 2955561 - protein, 18 aa, Entamoeba invadens
LYALKMIQKYGVVDCFHG

SEQ ID NO: 2955562 - protein, 17 aa, Entamoeba invadens
LYANGLEKEGLFRVSST

SEQ ID NO: 2955563 - protein, 17 aa, Entamoeba invadens
LYAPLIFSRCTSLKTVT

SEQ ID NO: 2955564 - protein, 19 aa, Entamoeba invadens
LYAPYAVGVTSDFPLLGLM

SEQ ID NO: 2955565 - protein, 25 aa, Entamoeba invadens
LYAQLTRYLPMKWLPNAPIATIDSV

SEQ ID NO: 2955566 - protein, 25 aa, Entamoeba invadens
LYASAKSVVICFSMGSQESYDDVIN

SEQ ID NO: 2955567 - protein, 17 aa, Entamoeba invadens
LYATFTRMCGTTQNSCF

SEQ ID NO: 2955568 - protein, 18 aa, Entamoeba invadens
LYATIPFDTTIYTDFRSD

SEQ ID NO: 2955569 - protein, 19 aa, Entamoeba invadens
LYCAEELFIENGISVVQEE

SEQ ID NO: 2955570 - protein, 18 aa, Entamoeba invadens
LYCFKQDEMISGFIKDLL

SEQ ID NO: 2955571 - protein, 22 aa, Entamoeba invadens
LYCGKIYLNQLCDVEKYPDFVI

SEQ ID NO: 2955572 - protein, 25 aa, Entamoeba invadens
LYCHSSETLISLQFENGIQLESVIL

SEQ ID NO: 2955573 - protein, 22 aa, Entamoeba invadens
LYCPYALGVTSPFPIHYTMRRW

SEQ ID NO: 2955574 - protein, 19 aa, Entamoeba invadens
LYDGESFNLIFYNLEHHLN

SEQ ID NO: 2955575 - protein, 19 aa, Entamoeba invadens
LYDGRGFLKFEMSNTRKSI

SEQ ID NO: 2955576 - protein, 18 aa, Entamoeba invadens
LYDICLEKGYFFNSRLAR

SEQ ID NO: 2955577 - protein, 20 aa, Entamoeba invadens
LYDICLELGFFFDSKLARKS

SEQ ID NO: 2955578 - protein, 22 aa, Entamoeba invadens
LYDIQVGCIIYQLVFAENPEHY

SEQ ID NO: 2955579 - protein, 17 aa, Entamoeba invadens
LYDKFPLIELDKKVHPK

SEQ ID NO: 2955580 - protein, 20 aa, Entamoeba invadens
LYDKKLVTFYNLLRGISIIK

SEQ ID NO: 2955581 - protein, 18 aa, Entamoeba invadens
LYDKMAIESSTKIKEFVY

SEQ ID NO: 2955582 - protein, 31 aa, Entamoeba invadens
LYDLHVIEVLDIFKLKALKVLDVVNLDKSSK

SEQ ID NO: 2955583 - protein, 22 aa, Entamoeba invadens
LYDMVVSYRFIDEFNSNDKMRF

SEQ ID NO: 2955584 - protein, 18 aa, Entamoeba invadens
LYDSILRVVDLCKTGLRL

SEQ ID NO: 2955585 - protein, 20 aa, Entamoeba invadens
LYDSSRDGLIPAAFNTTTSS

SEQ ID NO: 2955586 - protein, 17 aa, Entamoeba invadens
LYDTRISGFDSRDLRSL

SEQ ID NO: 2955587 - protein, 22 aa, Entamoeba invadens
LYDYAYKIAIEKTVKYTTLVQC

SEQ ID NO: 2955588 - protein, 18 aa, Entamoeba invadens
LYEALLWESASGLQKCDE

SEQ ID NO: 2955589 - protein, 22 aa, Entamoeba invadens
LYECDFLKKEIGNIFTSKCANY

SEQ ID NO: 2955590 - protein, 27 aa, Entamoeba invadens
LYECLLKNFLYEEGIYYTKFEILTKYF

SEQ ID NO: 2955591 - protein, 19 aa, Entamoeba invadens
LYEEIGIKPPKGVILYGPP

SEQ ID NO: 2955592 - protein, 17 aa, Entamoeba invadens
LYEERWKDLNVIELNSF

SEQ ID NO: 2955593 - protein, 17 aa, Entamoeba invadens
LYEEVQLILELLNQIDS

SEQ ID NO: 2955594 - protein, 18 aa, Entamoeba invadens
LYEGIDFYTSITRARFEE

SEQ ID NO: 2955595 - protein, 24 aa, Entamoeba invadens
LYEISLKALEVIPTVVMEELYDVL

SEQ ID NO: 2955596 - protein, 23 aa, Entamoeba invadens
LYEKCYHAVRMALKCGDKTVESV

SEQ ID NO: 2955597 - protein, 19 aa, Entamoeba invadens
LYEKMELEKTMGRMEKTVI

SEQ ID NO: 2955598 - protein, 18 aa, Entamoeba invadens
LYEKYGYFASNNKYYFCY

SEQ ID NO: 2955599 - protein, 25 aa, Entamoeba invadens
LYENVVFRNCKFNKSLFYNKDVDLI

SEQ ID NO: 2955600 - protein, 19 aa, Entamoeba invadens
LYEQNSMYRNSLKEISATV

SEQ ID NO: 2955601 - protein, 17 aa, Entamoeba invadens
LYESVLKSIFMKRKETG

SEQ ID NO: 2955602 - protein, 17 aa, Entamoeba invadens
LYETLKWEEAYDKDRFK

SEQ ID NO: 2955603 - protein, 17 aa, Entamoeba invadens
LYEVVCCCIAIIPSSAC

SEQ ID NO: 2955604 - protein, 20 aa, Entamoeba invadens
LYFELVLACRPEVFNLNIVN

SEQ ID NO: 2955605 - protein, 18 aa, Entamoeba invadens
LYFFKSLATFVGGICAKK

SEQ ID NO: 2955606 - protein, 23 aa, Entamoeba invadens
LYFIKRTNYLLLFASKKLGVTGF

SEQ ID NO: 2955607 - protein, 24 aa, Entamoeba invadens
LYFKCSPQTLLPSFKSFEWNHQYI

SEQ ID NO: 2955608 - protein, 18 aa, Entamoeba invadens
LYFKLKEKYPEFSDDTFN

SEQ ID NO: 2955609 - protein, 19 aa, Entamoeba invadens
LYFKRVVEAIKGISSSTVG

SEQ ID NO: 2955610 - protein, 17 aa, Entamoeba invadens
LYFPCLVPYNEALDALK

SEQ ID NO: 2955611 - protein, 20 aa, Entamoeba invadens
LYFRLFDDAWLFAKVYNIGE

SEQ ID NO: 2955612 - protein, 18 aa, Entamoeba invadens
LYFSENNIGFNIFLNKHG

SEQ ID NO: 2955613 - protein, 18 aa, Entamoeba invadens
LYFTFKNFQAEDLLDKVC

SEQ ID NO: 2955614 - protein, 18 aa, Entamoeba invadens
LYFVELRDGTGYCQCVIF

SEQ ID NO: 2955615 - protein, 18 aa, Entamoeba invadens
LYGAGCYQQAAIIATHAV

SEQ ID NO: 2955616 - protein, 17 aa, Entamoeba invadens
LYGAMFITNKVCVVTEL

SEQ ID NO: 2955617 - protein, 18 aa, Entamoeba invadens
LYGKGAGVGPTLCLAYKI

SEQ ID NO: 2955618 - protein, 24 aa, Entamoeba invadens
LYGKSPRWILFYELVMTTKEYVRQ

SEQ ID NO: 2955619 - protein, 23 aa, Entamoeba invadens
LYGLKSAQIQTLFDSFYTSTLQH

SEQ ID NO: 2955620 - protein, 21 aa, Entamoeba invadens
LYGNEGLPFITFEESRKMSEK

SEQ ID NO: 2955621 - protein, 17 aa, Entamoeba invadens
LYGNIVLSGGTSMYSGI

SEQ ID NO: 2955622 - protein, 17 aa, Entamoeba invadens
LYGTVPIIYSLGSNTGA

SEQ ID NO: 2955623 - protein, 17 aa, Entamoeba invadens
LYHALGYSDEYDATFKV

SEQ ID NO: 2955624 - protein, 22 aa, Entamoeba invadens
LYHCSVEFIAGIQFLSGKTNTV

SEQ ID NO: 2955625 - protein, 18 aa, Entamoeba invadens
LYHIGEVSTVLEISPSKM

SEQ ID NO: 2955626 - protein, 17 aa, Entamoeba invadens
LYHISKILKGTVIAINR

SEQ ID NO: 2955627 - protein, 23 aa, Entamoeba invadens
LYHKGEVDFNAFFNVEAKPGTQA

SEQ ID NO: 2955628 - protein, 20 aa, Entamoeba invadens
LYHKNCKKLEEMRKMESFLK

SEQ ID NO: 2955629 - protein, 17 aa, Entamoeba invadens
LYHLGAGCFVKCKNLSV

SEQ ID NO: 2955630 - protein, 28 aa, Entamoeba invadens
LYHLVLKFYPEYPINFQPKYVQTSLFYK

SEQ ID NO: 2955631 - protein, 19 aa, Entamoeba invadens
LYHNSCACIFVYDVANNDT

SEQ ID NO: 2955632 - protein, 20 aa, Entamoeba invadens
LYHSHLCIVTELLGDNLYHL

SEQ ID NO: 2955633 - protein, 20 aa, Entamoeba invadens
LYHSHLCIVTELLGKNLYQA

SEQ ID NO: 2955634 - protein, 19 aa, Entamoeba invadens
LYHTICVKKAVQVLKGGSP

SEQ ID NO: 2955635 - protein, 20 aa, Entamoeba invadens
LYHTICVKKAVQVLKGGSPK

SEQ ID NO: 2955636 - protein, 32 aa, Entamoeba invadens
LYIHRCGRVARAGRIGTCYNFVQTEEMGYLKD

SEQ ID NO: 2955637 - protein, 20 aa, Entamoeba invadens
LYIKGTTQFMVFRKISKNVG

SEQ ID NO: 2955638 - protein, 22 aa, Entamoeba invadens
LYILKNRVYFMSHLVYCEDGSK

SEQ ID NO: 2955639 - protein, 17 aa, Entamoeba invadens
LYINFLVRNAETHVKCL

SEQ ID NO: 2955640 - protein, 46 aa, Entamoeba invadens
LYIPIAKVCDCYGCFGVPLEIAVAYGKWKIPLPMYRAIQYLLMSDN

SEQ ID NO: 2955641 - protein, 18 aa, Entamoeba invadens
LYIPSLLIASHFDSMRSE

SEQ ID NO: 2955642 - protein, 18 aa, Entamoeba invadens
LYIPSTVVNFRIKVFDYG

SEQ ID NO: 2955643 - protein, 19 aa, Entamoeba invadens
LYIQSGFKLQPRLFSHLVQ

SEQ ID NO: 2955644 - protein, 17 aa, Entamoeba invadens
LYISAAFSNPRKEVLML

SEQ ID NO: 2955645 - protein, 17 aa, Entamoeba invadens
LYISLAIDPLWRKRAIE

SEQ ID NO: 2955646 - protein, 19 aa, Entamoeba invadens
LYITNLCKVLFTYSNKAFI

SEQ ID NO: 2955647 - protein, 26 aa, Entamoeba invadens
LYIYCIVGYLIFIREDFLAVKNTEKG

SEQ ID NO: 2955648 - protein, 22 aa, Entamoeba invadens
LYKHKLIEFIVDFMGEIDKEIS

SEQ ID NO: 2955649 - protein, 24 aa, Entamoeba invadens
LYKIKVEIQRSFGFKEGTDEMRVV

SEQ ID NO: 2955650 - protein, 31 aa, Entamoeba invadens
LYKIPDTYIKDVLRLGAEMLPQDYLQRLISL

SEQ ID NO: 2955651 - protein, 27 aa, Entamoeba invadens
LYKIVKEHYKAFMNYSLEHIREDDNSL

SEQ ID NO: 2955652 - protein, 23 aa, Entamoeba invadens
LYKKGHKTHQLFVIESISKNGTV

SEQ ID NO: 2955653 - protein, 19 aa, Entamoeba invadens
LYKQFGWPLAKEHGSLHDA

SEQ ID NO: 2955654 - protein, 19 aa, Entamoeba invadens
LYKQIGIDPPRGCLLYGPP

SEQ ID NO: 2955655 - protein, 20 aa, Entamoeba invadens
LYKQLKHLFLDTTHAPLPLK

SEQ ID NO: 2955656 - protein, 21 aa, Entamoeba invadens
LYKQLKHLFLDTTHAPLPLKK

SEQ ID NO: 2955657 - protein, 18 aa, Entamoeba invadens
LYKQMAIMGDFRRVFEVG

SEQ ID NO: 2955658 - protein, 18 aa, Entamoeba invadens
LYKSELQFAKKLLETLKL

SEQ ID NO: 2955659 - protein, 29 aa, Entamoeba invadens
LYKTSEVFVIHLKRFLEANGNLTEKVTTL

SEQ ID NO: 2955660 - protein, 30 aa, Entamoeba invadens
LYLATFLKRRVEAFLKGKRQFVVKDKEKLR

SEQ ID NO: 2955661 - protein, 20 aa, Entamoeba invadens
LYLDGKWYSLTAHKDIYDDN

SEQ ID NO: 2955662 - protein, 38 aa, Entamoeba invadens
LYLEGFSTFKCFQLVSKRCVLALKMLHINPPKLTTGIN

SEQ ID NO: 2955663 - protein, 23 aa, Entamoeba invadens
LYLEVQDFLPFITINSKCTDLFF

SEQ ID NO: 2955664 - protein, 17 aa, Entamoeba invadens
LYLKYAKEYTPEKYKEL

SEQ ID NO: 2955665 - protein, 18 aa, Entamoeba invadens
LYLLPECFSTGFDSELTK

SEQ ID NO: 2955666 - protein, 19 aa, Entamoeba invadens
LYLMCIVGSSAVKTKKISV

SEQ ID NO: 2955667 - protein, 18 aa, Entamoeba invadens
LYLMCTVGSACIFQKKVS

SEQ ID NO: 2955668 - protein, 25 aa, Entamoeba invadens
LYLMKCVKLRMGCLVCTLDDDFGSE

SEQ ID NO: 2955669 - protein, 18 aa, Entamoeba invadens
LYLNGGIDISEEREDICL

SEQ ID NO: 2955670 - protein, 18 aa, Entamoeba invadens
LYLPDNFKQMCFDENVCT

SEQ ID NO: 2955671 - protein, 23 aa, Entamoeba invadens
LYLPSLKDIMTFITINKKCQDAV

SEQ ID NO: 2955672 - protein, 19 aa, Entamoeba invadens
LYLPYEVDYDLSFLENLGT

SEQ ID NO: 2955673 - protein, 19 aa, Entamoeba invadens
LYLPYEVDYNLSFLENLGT

SEQ ID NO: 2955674 - protein, 22 aa, Entamoeba invadens
LYLRRYLETYNEVAGRLKKFQF

SEQ ID NO: 2955675 - protein, 25 aa, Entamoeba invadens
LYLRSGFYGRCFDYHIELITLDNLA

SEQ ID NO: 2955676 - protein, 23 aa, Entamoeba invadens
LYLSAIHRLKLATGKPIVIPQES

SEQ ID NO: 2955677 - protein, 24 aa, Entamoeba invadens
LYLTCQSLVLLPIFSSLPKNHIFI

SEQ ID NO: 2955678 - protein, 17 aa, Entamoeba invadens
LYLTRALVNIRRHTETF

SEQ ID NO: 2955679 - protein, 18 aa, Entamoeba invadens
LYLTYPEIYVIKNGAFDV

SEQ ID NO: 2955680 - protein, 17 aa, Entamoeba invadens
LYLVMEFCDSGNLEKYM

SEQ ID NO: 2955681 - protein, 17 aa, Entamoeba invadens
LYMKEGDAFVLVFSLQS

SEQ ID NO: 2955682 - protein, 17 aa, Entamoeba invadens
LYMKIHLTEIAFYKEQF

SEQ ID NO: 2955683 - protein, 25 aa, Entamoeba invadens
LYMSKGDVKRLIWGLDSESCHVEKT

SEQ ID NO: 2955684 - protein, 17 aa, Entamoeba invadens
LYNCICLGNDGIEFELR

SEQ ID NO: 2955685 - protein, 20 aa, Entamoeba invadens
LYNDESFKLLAYSMYELLSA

SEQ ID NO: 2955686 - protein, 24 aa, Entamoeba invadens
LYNFPQEEWFFVLNCTSLNTQLSK

SEQ ID NO: 2955687 - protein, 20 aa, Entamoeba invadens
LYNKLPFWVPKEIYRLTDYI

SEQ ID NO: 2955688 - protein, 22 aa, Entamoeba invadens
LYNLILDKQFDGIEILSKTVLY

SEQ ID NO: 2955689 - protein, 18 aa, Entamoeba invadens
LYNVIPHFHDLRVRLSQL

SEQ ID NO: 2955690 - protein, 19 aa, Entamoeba invadens
LYPDPRLRMNAEQALSHPW

SEQ ID NO: 2955691 - protein, 25 aa, Entamoeba invadens
LYPFFIKMNQIIGGSRDLHLSLSFA

SEQ ID NO: 2955692 - protein, 25 aa, Entamoeba invadens
LYPIAPHFSDYVWRDLLGNKTFLWN

SEQ ID NO: 2955693 - protein, 23 aa, Entamoeba invadens
LYPKEFIAACGQVFFPQEVEIKT

SEQ ID NO: 2955694 - protein, 17 aa, Entamoeba invadens
LYPKIVLMAEVYEDYQM

SEQ ID NO: 2955695 - protein, 22 aa, Entamoeba invadens
LYPSAIHRLKLATGKPIVIPNE

SEQ ID NO: 2955696 - protein, 20 aa, Entamoeba invadens
LYPSAINRLKLATGSPIVIP

SEQ ID NO: 2955697 - protein, 20 aa, Entamoeba invadens
LYPYIKDWVPLPSIYYKSYI

SEQ ID NO: 2955698 - protein, 17 aa, Entamoeba invadens
LYQFSSVALMEKALYEL

SEQ ID NO: 2955699 - protein, 37 aa, Entamoeba invadens
LYQHLKSAGVIFIQFAFRWINCCLLREFSLKSAVRLW

SEQ ID NO: 2955700 - protein, 19 aa, Entamoeba invadens
LYQLFPLFYRNLGFVLSTQ

SEQ ID NO: 2955701 - protein, 17 aa, Entamoeba invadens
LYQLKLREDTLEVKLYR

SEQ ID NO: 2955702 - protein, 28 aa, Entamoeba invadens
LYQLMYKFRLGNCSVRMVDFTKWVKGRI

SEQ ID NO: 2955703 - protein, 17 aa, Entamoeba invadens
LYQLYLLSNELNESYNK

SEQ ID NO: 2955704 - protein, 19 aa, Entamoeba invadens
LYQMRCIRVLRVCRSMGGS

SEQ ID NO: 2955705 - protein, 18 aa, Entamoeba invadens
LYQRCYSQLFQILRPNWK

SEQ ID NO: 2955706 - protein, 18 aa, Entamoeba invadens
LYREPFLIVGLLGGDNIP

SEQ ID NO: 2955707 - protein, 46 aa, Entamoeba invadens
LYRICTDDHPPFPLNASPLLKVLLLDCFKTDINIRASSKELLSNEW

SEQ ID NO: 2955708 - protein, 23 aa, Entamoeba invadens
LYRNSWYVFYVLFVIDDMTIINR

SEQ ID NO: 2955709 - protein, 20 aa, Entamoeba invadens
LYRNTMKFTIIDEYNEEGEI

SEQ ID NO: 2955710 - protein, 17 aa, Entamoeba invadens
LYRRCTMHFRESEKTKE

SEQ ID NO: 2955711 - protein, 24 aa, Entamoeba invadens
LYRTKPCKYFFETGTCRKGEHCNF

SEQ ID NO: 2955712 - protein, 31 aa, Entamoeba invadens
LYRVGKLPKIFKLLPSFEEWPQFLKMTNPAL

SEQ ID NO: 2955713 - protein, 18 aa, Entamoeba invadens
LYSAGVVLYYLLYGKLPF

SEQ ID NO: 2955714 - protein, 22 aa, Entamoeba invadens
LYSDSKLLLLLEHVRDNSSTLS

SEQ ID NO: 2955715 - protein, 23 aa, Entamoeba invadens
LYSEFYMSPFIKALVSEDLGRFP

SEQ ID NO: 2955716 - protein, 27 aa, Entamoeba invadens
LYSGSSDKTIKCWDLTSKHSIKTYTHH

SEQ ID NO: 2955717 - protein, 24 aa, Entamoeba invadens
LYSIKTLWLCYNYLSELNGIGGMR

SEQ ID NO: 2955718 - protein, 24 aa, Entamoeba invadens
LYSPEPSFWVSYTISANVPAIDET

SEQ ID NO: 2955719 - protein, 28 aa, Entamoeba invadens
LYSPKCAVCGKSLCGQYCIVNGQNMHKE

SEQ ID NO: 2955720 - protein, 26 aa, Entamoeba invadens
LYSPKDLKIGFPIAQELTVIKNQLKP

SEQ ID NO: 2955721 - protein, 18 aa, Entamoeba invadens
LYSSLTLSLVNAIPQTLS

SEQ ID NO: 2955722 - protein, 17 aa, Entamoeba invadens
LYSTIPVKIDDITAFVL

SEQ ID NO: 2955723 - protein, 17 aa, Entamoeba invadens
LYSVYKKPYISLKLLDS

SEQ ID NO: 2955724 - protein, 23 aa, Entamoeba invadens
LYSYYTTFCEYEIMFHVSTLLPE

SEQ ID NO: 2955725 - protein, 19 aa, Entamoeba invadens
LYTHLCVLYINGINSTTHL

SEQ ID NO: 2955726 - protein, 19 aa, Entamoeba invadens
LYTKIGMICPCAVINVSAK

SEQ ID NO: 2955727 - protein, 18 aa, Entamoeba invadens
LYVAAPTAWVHDDIRKAS

SEQ ID NO: 2955728 - protein, 17 aa, Entamoeba invadens
LYVAGGRNKEYILPLFV

SEQ ID NO: 2955729 - protein, 18 aa, Entamoeba invadens
LYVASYFVSRIFNTNLSC

SEQ ID NO: 2955730 - protein, 20 aa, Entamoeba invadens
LYVCAGNAMTIKLPSKKSKN

SEQ ID NO: 2955731 - protein, 18 aa, Entamoeba invadens
LYVDILFFVSDKANKSKP

SEQ ID NO: 2955732 - protein, 17 aa, Entamoeba invadens
LYVESYINTILFGPTNY

SEQ ID NO: 2955733 - protein, 23 aa, Entamoeba invadens
LYVKEICEIFISITQLYVIKQLY

SEQ ID NO: 2955734 - protein, 18 aa, Entamoeba invadens
LYVKLGFVKEQLLLKYYM

SEQ ID NO: 2955735 - protein, 18 aa, Entamoeba invadens
LYVLIKALWACDSSLSTE

SEQ ID NO: 2955736 - protein, 23 aa, Entamoeba invadens
LYVPIIEPVPFSYFVYVVSDSFV

SEQ ID NO: 2955737 - protein, 21 aa, Entamoeba invadens
LYVQTNMWFVMLVNAIDRMTE

SEQ ID NO: 2955738 - protein, 20 aa, Entamoeba invadens
LYVTFPLTLKVIGRSFFESC

SEQ ID NO: 2955739 - protein, 23 aa, Entamoeba invadens
LYYAKRRINPFIKPKSIFLKDNI

SEQ ID NO: 2955740 - protein, 18 aa, Entamoeba invadens
LYYCLSVMLHAFKNEMVP

SEQ ID NO: 2955741 - protein, 19 aa, Entamoeba invadens
LYYDLYLLLQQCLSVLDMY

SEQ ID NO: 2955742 - protein, 19 aa, Entamoeba invadens
LYYFSELKCVVTTNCNTPS

SEQ ID NO: 2955743 - protein, 25 aa, Entamoeba invadens
LYYICRGAVRLFEFAGKKDAAIVNL

SEQ ID NO: 2955744 - protein, 25 aa, Entamoeba invadens
LYYKNLKMCINNPIYTEREVLNISL

SEQ ID NO: 2955745 - protein, 19 aa, Entamoeba invadens
LYYLGMCYLSGIGKAIDPK

SEQ ID NO: 2955746 - protein, 20 aa, Entamoeba invadens
LYYLPKEFYIEAVVGEKIEF

SEQ ID NO: 2955747 - protein, 20 aa, Entamoeba invadens
LYYNPICYSFILREIALKGN

SEQ ID NO: 2955748 - protein, 17 aa, Entamoeba invadens
LYYPSHIIQELIKSEFV

SEQ ID NO: 2955749 - protein, 20 aa, Entamoeba invadens
LYYRGVGVVTPIFSLRTKAS

SEQ ID NO: 2955750 - protein, 19 aa, Entamoeba invadens
LYYVMSFKANGLHRFVLSM

SEQ ID NO: 2955751 - protein, 23 aa, Entamoeba invadens
LYYVSSLLRKALDNCFIVDEVKG

SEQ ID NO: 2955752 - protein, 17 aa, Entamoeba invadens
MAACVYCEYTFCRECLE

SEQ ID NO: 2955753 - protein, 24 aa, Entamoeba invadens
MAAERISGCNWMYCNPNVGGCGKG

SEQ ID NO: 2955754 - protein, 23 aa, Entamoeba invadens
MAALDFFATIAVIYSPETRLGQL

SEQ ID NO: 2955755 - protein, 20 aa, Entamoeba invadens
MAASLPMFYFTPISVNLPKF

SEQ ID NO: 2955756 - protein, 19 aa, Entamoeba invadens
MACEVCLTSNIVSKSITEY

SEQ ID NO: 2955757 - protein, 18 aa, Entamoeba invadens
MACRYCFMPIGGNEPCSL

SEQ ID NO: 2955758 - protein, 22 aa, Entamoeba invadens
MADLCIEEGYFFNYKLPRPSKK

SEQ ID NO: 2955759 - protein, 22 aa, Entamoeba invadens
MADMSIYFFIAQPFSREDYDMD

SEQ ID NO: 2955760 - protein, 19 aa, Entamoeba invadens
MADPKCWDPVLLEKLVSEF

SEQ ID NO: 2955761 - protein, 18 aa, Entamoeba invadens
MADSCFAYCYSLEQIKLD

SEQ ID NO: 2955762 - protein, 23 aa, Entamoeba invadens
MADSIKTLGFRCFKNCTRLSKVV

SEQ ID NO: 2955763 - protein, 23 aa, Entamoeba invadens
MAEDRAQISFVSKIGCEVMKDLK

SEQ ID NO: 2955764 - protein, 24 aa, Entamoeba invadens
MAEDRFRLLIVDSVTSLFRVDFSG

SEQ ID NO: 2955765 - protein, 17 aa, Entamoeba invadens
MAEEILKHDVNVDSVDF

SEQ ID NO: 2955766 - protein, 18 aa, Entamoeba invadens
MAEIRRVNVPSMGQGNGI

SEQ ID NO: 2955767 - protein, 26 aa, Entamoeba invadens
MAEYIKVVICKKCFACTKKKTMETKI

SEQ ID NO: 2955768 - protein, 23 aa, Entamoeba invadens
MAFARCEYLKEITIPKSVELFRE

SEQ ID NO: 2955769 - protein, 20 aa, Entamoeba invadens
MAGPVYLKIGDTIEICGRKY

SEQ ID NO: 2955770 - protein, 24 aa, Entamoeba invadens
MAHPFHKAARVGVVFTDDEVKEAK

SEQ ID NO: 2955771 - protein, 19 aa, Entamoeba invadens
MAHTCGYQGTSFADYSAFA

SEQ ID NO: 2955772 - protein, 17 aa, Entamoeba invadens
MAIVFDFEKKFIITPTI

SEQ ID NO: 2955773 - protein, 17 aa, Entamoeba invadens
MAKCLKTVVEVFNEQLN

SEQ ID NO: 2955774 - protein, 25 aa, Entamoeba invadens
MAKELKAKRYVECSSKSYETTHDVV

SEQ ID NO: 2955775 - protein, 24 aa, Entamoeba invadens
MAKLKSHFMKGGVLTISSLTALLD

SEQ ID NO: 2955776 - protein, 25 aa, Entamoeba invadens
MAKLWDIRMENCVATFTGHDADINA

SEQ ID NO: 2955777 - protein, 26 aa, Entamoeba invadens
MAKVPLCNPLSFFSLRKLKEAEVLTL

SEQ ID NO: 2955778 - protein, 19 aa, Entamoeba invadens
MALGCAHLVMHINASTQGK

SEQ ID NO: 2955779 - protein, 32 aa, Entamoeba invadens
MALLYGSEILKVFKRFGFRYTSVKQHYWLPVE

SEQ ID NO: 2955780 - protein, 20 aa, Entamoeba invadens
MALRSTFLSSLIQFVQSQKS

SEQ ID NO: 2955781 - protein, 18 aa, Entamoeba invadens
MALYKKTLGYSFLPTLTK

SEQ ID NO: 2955782 - protein, 26 aa, Entamoeba invadens
MAMPDAHSGYGFSIGGVAAMRLDEPE

SEQ ID NO: 2955783 - protein, 21 aa, Entamoeba invadens
MANDLNCLFFETSAKNNINVT

SEQ ID NO: 2955784 - protein, 26 aa, Entamoeba invadens
MANNIFKIFAAKSYRFFEDVDNNFVK

SEQ ID NO: 2955785 - protein, 19 aa, Entamoeba invadens
MAPAPCHIINDISLIETAL

SEQ ID NO: 2955786 - protein, 17 aa, Entamoeba invadens
MAPEMFQKIVGHIKKYD

SEQ ID NO: 2955787 - protein, 19 aa, Entamoeba invadens
MAPSELLGLFYRFSGTLAK

SEQ ID NO: 2955788 - protein, 25 aa, Entamoeba invadens
MAQCFKKAKDVLGFPNLLDPKETAN

SEQ ID NO: 2955789 - protein, 17 aa, Entamoeba invadens
MAQKIGVSKTITYLLET

SEQ ID NO: 2955790 - protein, 26 aa, Entamoeba invadens
MAQLKVFDICCPFKQLDFSSRSFYEC

SEQ ID NO: 2955791 - protein, 18 aa, Entamoeba invadens
MASLKRLEVGGIGHCMTT

SEQ ID NO: 2955792 - protein, 18 aa, Entamoeba invadens
MASPLTSQMIIQFVFQAL

SEQ ID NO: 2955793 - protein, 18 aa, Entamoeba invadens
MATGKTCILHRWVTNEFV

SEQ ID NO: 2955794 - protein, 24 aa, Entamoeba invadens
MATPTVSMAFDWLQSESSNTLYQQ

SEQ ID NO: 2955795 - protein, 18 aa, Entamoeba invadens
MAVCLAAHANCKVCAVDK

SEQ ID NO: 2955796 - protein, 18 aa, Entamoeba invadens
MAVGCKKANIPNKKMLVL

SEQ ID NO: 2955797 - protein, 17 aa, Entamoeba invadens
MAVKCSREIKVKSCVGN

SEQ ID NO: 2955798 - protein, 19 aa, Entamoeba invadens
MAVNAVIELQGRHQKTLLE

SEQ ID NO: 2955799 - protein, 25 aa, Entamoeba invadens
MAVRAGEAPKLIGRKMSDLNEIIDH

SEQ ID NO: 2955800 - protein, 19 aa, Entamoeba invadens
MCADLSFKNIASCVYTVGV

SEQ ID NO: 2955801 - protein, 22 aa, Entamoeba invadens
MCAEMWLSHIYFEERVNPKKDV

SEQ ID NO: 2955802 - protein, 20 aa, Entamoeba invadens
MCAFSDLAFHTCKSLSCIDT

SEQ ID NO: 2955803 - protein, 20 aa, Entamoeba invadens
MCDDRDAIVFDFGMKRIDAI

SEQ ID NO: 2955804 - protein, 20 aa, Entamoeba invadens
MCDMVCYSCGVSPNKTLAEK

SEQ ID NO: 2955805 - protein, 24 aa, Entamoeba invadens
MCEAKKYYGSVVFLMDGFYSEAFL

SEQ ID NO: 2955806 - protein, 19 aa, Entamoeba invadens
MCFEECGKLSKIDIPKSVT

SEQ ID NO: 2955807 - protein, 18 aa, Entamoeba invadens
MCFNGCYSLTSIKILKGV

SEQ ID NO: 2955808 - protein, 20 aa, Entamoeba invadens
MCFPPPPPFFGRFGGWERGR

SEQ ID NO: 2955809 - protein, 23 aa, Entamoeba invadens
MCFPPPPPFGRFGGWERGRRHHP

SEQ ID NO: 2955810 - protein, 22 aa, Entamoeba invadens
MCFPPPPPPFFGRFGGWERGRR

SEQ ID NO: 2955811 - protein, 18 aa, Entamoeba invadens
MCFQDCCKLEQIKLPKGL

SEQ ID NO: 2955812 - protein, 23 aa, Entamoeba invadens
MCFSCCRGLCHVKIPQTVTQIGY

SEQ ID NO: 2955813 - protein, 20 aa, Entamoeba invadens
MCGIVQGMLDELSKYSGYAQ

SEQ ID NO: 2955814 - protein, 20 aa, Entamoeba invadens
MCGPNGASFVYGFQKGATME

SEQ ID NO: 2955815 - protein, 30 aa, Entamoeba invadens
MCHIAKVLPWRTMRFNECVCTPYNADFDGD

SEQ ID NO: 2955816 - protein, 18 aa, Entamoeba invadens
MCKNGLFFFENFIVDNNR

SEQ ID NO: 2955817 - protein, 19 aa, Entamoeba invadens
MCKNIKKLLLPKCLQTSFN

SEQ ID NO: 2955818 - protein, 25 aa, Entamoeba invadens
MCLEAIKEFELQYVLPEDVQKERKR

SEQ ID NO: 2955819 - protein, 18 aa, Entamoeba invadens
MCLLEVFQQHEIYKDKPF

SEQ ID NO: 2955820 - protein, 23 aa, Entamoeba invadens
MCLPEVYFTPHVQDFGCFPQDTE

SEQ ID NO: 2955821 - protein, 22 aa, Entamoeba invadens
MCMDGKCIKCLDYAIYTNGECL

SEQ ID NO: 2955822 - protein, 17 aa, Entamoeba invadens
MCMVTEFALFGSLQDLM

SEQ ID NO: 2955823 - protein, 17 aa, Entamoeba invadens
MCMVTEFAQFGSLQDLI

SEQ ID NO: 2955824 - protein, 17 aa, Entamoeba invadens
MCNRLTAVFPALFEFFK

SEQ ID NO: 2955825 - protein, 26 aa, Entamoeba invadens
MCQCGMFYKGEFRCCQRHNKIEDFIL

SEQ ID NO: 2955826 - protein, 22 aa, Entamoeba invadens
MCREGRLAFANKIVNPIINEKD

SEQ ID NO: 2955827 - protein, 22 aa, Entamoeba invadens
MCREGRLAFANKIVNPVINEKD

SEQ ID NO: 2955828 - protein, 21 aa, Entamoeba invadens
MCRVFCGVVKNGDKLYILPPK

SEQ ID NO: 2955829 - protein, 22 aa, Entamoeba invadens
MCSKALFDAGFLLAKKLKEIME

SEQ ID NO: 2955830 - protein, 21 aa, Entamoeba invadens
MCSPTLFFTRMDDYEIAKQLT

SEQ ID NO: 2955831 - protein, 22 aa, Entamoeba invadens
MCSRCYKHPPRRVVKNESQSRF

SEQ ID NO: 2955832 - protein, 25 aa, Entamoeba invadens
MCTCSSTQQKVCWEDAFKSVKPQLL

SEQ ID NO: 2955833 - protein, 17 aa, Entamoeba invadens
MCTEFNDLIKLWDEFIT

SEQ ID NO: 2955834 - protein, 24 aa, Entamoeba invadens
MCTFARLKKIIIFQLAESLELVDL

SEQ ID NO: 2955835 - protein, 19 aa, Entamoeba invadens
MCTIAYRVATFGGKKGLNI

SEQ ID NO: 2955836 - protein, 17 aa, Entamoeba invadens
MCVLGRQNIGIIIITET

SEQ ID NO: 2955837 - protein, 27 aa, Entamoeba invadens
MCVYPLWKSSLLPPGITYGMWRNKECV

SEQ ID NO: 2955838 - protein, 25 aa, Entamoeba invadens
MCYLLSGLEKYFWTLKFEPESIEEF

SEQ ID NO: 2955839 - protein, 22 aa, Entamoeba invadens
MDAIIQYACRMFLNKNYEGSLD

SEQ ID NO: 2955840 - protein, 19 aa, Entamoeba invadens
MDDEMKLAIKMSMEPEKKD

SEQ ID NO: 2955841 - protein, 18 aa, Entamoeba invadens
MDDYEIAKQLTMVDSAIY

SEQ ID NO: 2955842 - protein, 21 aa, Entamoeba invadens
MDEEFAFIALRRMIGGEEVCL

SEQ ID NO: 2955843 - protein, 19 aa, Entamoeba invadens
MDEGVQWLSLTYYYICCLR

SEQ ID NO: 2955844 - protein, 18 aa, Entamoeba invadens
MDEMWKFNYVLDVCLEKL

SEQ ID NO: 2955845 - protein, 21 aa, Entamoeba invadens
MDEWKCEKCGKRGGTKTAEMV

SEQ ID NO: 2955846 - protein, 17 aa, Entamoeba invadens
MDFDMLVSMPFQHIMRY

SEQ ID NO: 2955847 - protein, 18 aa, Entamoeba invadens
MDFDVRIAKYTAFVKKMI

SEQ ID NO: 2955848 - protein, 17 aa, Entamoeba invadens
MDFLRAMAREQRLRQSQ

SEQ ID NO: 2955849 - protein, 17 aa, Entamoeba invadens
MDFMCLFSTKTDGFSLR

SEQ ID NO: 2955850 - protein, 17 aa, Entamoeba invadens
MDFVGTYGYPLRLAILK

SEQ ID NO: 2955851 - protein, 19 aa, Entamoeba invadens
MDGAIPFEKELDAFCSSFV

SEQ ID NO: 2955852 - protein, 17 aa, Entamoeba invadens
MDGGWFFKGELSCDIIR

SEQ ID NO: 2955853 - protein, 18 aa, Entamoeba invadens
MDGMVIRSYYVVFTDKFD

SEQ ID NO: 2955854 - protein, 21 aa, Entamoeba invadens
MDHATVCLLKVCDVTDITNFQ

SEQ ID NO: 2955855 - protein, 18 aa, Entamoeba invadens
MDIFCELGDIIGTHFSFV

SEQ ID NO: 2955856 - protein, 18 aa, Entamoeba invadens
MDIFPSKKAVGFDTDEMK

SEQ ID NO: 2955857 - protein, 17 aa, Entamoeba invadens
MDIKSNLPRKAIPQVVY

SEQ ID NO: 2955858 - protein, 25 aa, Entamoeba invadens
MDIRTWSPLMFARYLVHNGVAHRDA

SEQ ID NO: 2955859 - protein, 25 aa, Entamoeba invadens
MDIVMKWCSGVTFAQLVRESDKVMY

SEQ ID NO: 2955860 - protein, 24 aa, Entamoeba invadens
MDKCDESGCLLLRDVDRVVFTTVT

SEQ ID NO: 2955861 - protein, 17 aa, Entamoeba invadens
MDKGCLVVDLEKYKLGV

SEQ ID NO: 2955862 - protein, 25 aa, Entamoeba invadens
MDKKRLPKVLGLLEAYRILYLLATR

SEQ ID NO: 2955863 - protein, 17 aa, Entamoeba invadens
MDKRLFEILKENGYDVE

SEQ ID NO: 2955864 - protein, 22 aa, Entamoeba invadens
MDKRRVDAWLNTDFVDNTLRQT

SEQ ID NO: 2955865 - protein, 26 aa, Entamoeba invadens
MDKSCKEFSNAIAISYRSAPGDVLKI

SEQ ID NO: 2955866 - protein, 24 aa, Entamoeba invadens
MDLKFKDQFLAAVAKMECQMKNGD

SEQ ID NO: 2955867 - protein, 20 aa, Entamoeba invadens
MDLTHLLNSFGLEGIQEPPE

SEQ ID NO: 2955868 - protein, 18 aa, Entamoeba invadens
MDMIKRWGVEAEAEELKN

SEQ ID NO: 2955869 - protein, 21 aa, Entamoeba invadens
MDMKCNVFVKRVYSRQITSIK

SEQ ID NO: 2955870 - protein, 20 aa, Entamoeba invadens
MDMKEVQSLLPVVTGAVSWR

SEQ ID NO: 2955871 - protein, 18 aa, Entamoeba invadens
MDNNFPFPNVEEIELQKC

SEQ ID NO: 2955872 - protein, 23 aa, Entamoeba invadens
MDQETKEVIALKVLYQTRVNFSL

SEQ ID NO: 2955873 - protein, 19 aa, Entamoeba invadens
MDREDRKGSTFVVDVTKCN

SEQ ID NO: 2955874 - protein, 28 aa, Entamoeba invadens
MDRYKAFIFVGPVWSWDLCAPLKTACKE

SEQ ID NO: 2955875 - protein, 22 aa, Entamoeba invadens
MDSGFEIQKLKLFEKIRKMEKG

SEQ ID NO: 2955876 - protein, 32 aa, Entamoeba invadens
MDSGLKWPEYHPFKVNHYFILNSMKNKDLREL

SEQ ID NO: 2955877 - protein, 30 aa, Entamoeba invadens
MDSLIFRMCPSRFAHFLVTGFVPLFQSERP

SEQ ID NO: 2955878 - protein, 17 aa, Entamoeba invadens
MDSLLLISKLTNFIALL

SEQ ID NO: 2955879 - protein, 21 aa, Entamoeba invadens
MDSSIRFLRLDIKHESGITNS

SEQ ID NO: 2955880 - protein, 18 aa, Entamoeba invadens
MDSSWPILFDDFVKSLGK

SEQ ID NO: 2955881 - protein, 23 aa, Entamoeba invadens
MDTFCKLAKTFATKLVDSVSLLP

SEQ ID NO: 2955882 - protein, 18 aa, Entamoeba invadens
MDTPCFYMAMGNNQFPNA

SEQ ID NO: 2955883 - protein, 23 aa, Entamoeba invadens
MDTPCIGRTLVLGALKTCELFYE

SEQ ID NO: 2955884 - protein, 17 aa, Entamoeba invadens
MDTPLNLIKEKDTLFHG

SEQ ID NO: 2955885 - protein, 19 aa, Entamoeba invadens
MDVINMISKVIQFPTGGVF

SEQ ID NO: 2955886 - protein, 17 aa, Entamoeba invadens
MDVKGLLDVTCKTVANM

SEQ ID NO: 2955887 - protein, 26 aa, Entamoeba invadens
MDVYSCGVMVYMMLTSQFPFDMKMQS

SEQ ID NO: 2955888 - protein, 22 aa, Entamoeba invadens
MDWEVFVKTVLVPIRTKIVNFI

SEQ ID NO: 2955889 - protein, 17 aa, Entamoeba invadens
MDYAWLRLNKYYELKKK

SEQ ID NO: 2955890 - protein, 23 aa, Entamoeba invadens
MDYFPSLETMYLHTPKTAILRSV

SEQ ID NO: 2955891 - protein, 22 aa, Entamoeba invadens
MDYTSSFFKIFSEFVRDLSAVL

SEQ ID NO: 2955892 - protein, 25 aa, Entamoeba invadens
MDYVSAPQLHMTWITNLAKQHRERF

SEQ ID NO: 2955893 - protein, 35 aa, Entamoeba invadens
MEAFIFYQIRPSEFFGQAWAKVKYRYKAQHILEST

SEQ ID NO: 2955894 - protein, 19 aa, Entamoeba invadens
MEASKRWYGSGAEGRRNEK

SEQ ID NO: 2955895 - protein, 27 aa, Entamoeba invadens
MEASLPFLHFFDGFRTSHEIQKIHQLS

SEQ ID NO: 2955896 - protein, 19 aa, Entamoeba invadens
MEATEQFHTFFFKTKFVHF

SEQ ID NO: 2955897 - protein, 27 aa, Entamoeba invadens
MEAVWKIKVENLRAFILVDDKGNDFFK

SEQ ID NO: 2955898 - protein, 18 aa, Entamoeba invadens
MECISKLTASYEMTNHML

SEQ ID NO: 2955899 - protein, 20 aa, Entamoeba invadens
MECTGMAVVPIEDFGELTLR

SEQ ID NO: 2955900 - protein, 23 aa, Entamoeba invadens
MEDAICLSAVMLGKPHIDYSEDF

SEQ ID NO: 2955901 - protein, 24 aa, Entamoeba invadens
MEDEKRSTISFSVSSAVNSLNKII

SEQ ID NO: 2955902 - protein, 20 aa, Entamoeba invadens
MEDFFVIWNVFYDKKVQRAV

SEQ ID NO: 2955903 - protein, 18 aa, Entamoeba invadens
MEDFTRNTRFCLICNYIS

SEQ ID NO: 2955904 - protein, 26 aa, Entamoeba invadens
MEDIARFKIAVVGDCSVGKTCIIGRF

SEQ ID NO: 2955905 - protein, 25 aa, Entamoeba invadens
MEELGECFFGMFVLYSMQGAAATDM

SEQ ID NO: 2955906 - protein, 18 aa, Entamoeba invadens
MEEWKSIPDVVGRKRRGV

SEQ ID NO: 2955907 - protein, 24 aa, Entamoeba invadens
MEGALRIVTKLSAEGHFKEIERLS

SEQ ID NO: 2955908 - protein, 26 aa, Entamoeba invadens
MEGEFCPLRELIALKKIYGFYLYIDE

SEQ ID NO: 2955909 - protein, 23 aa, Entamoeba invadens
MEGESAAGFLYRVPLLLELVKIV

SEQ ID NO: 2955910 - protein, 26 aa, Entamoeba invadens
MEGQFCPLRELIALKKIYGFYLYIDE

SEQ ID NO: 2955911 - protein, 22 aa, Entamoeba invadens
MEGRKLFLERMVGKYQSFCVKK

SEQ ID NO: 2955912 - protein, 23 aa, Entamoeba invadens
MEHEVGKIFGLIGAIPPGKIRIE

SEQ ID NO: 2955913 - protein, 23 aa, Entamoeba invadens
MEIDTLRFFPFVNYHMYFEKRKL

SEQ ID NO: 2955914 - protein, 17 aa, Entamoeba invadens
MEIEVCISQENAWMYQD

SEQ ID NO: 2955915 - protein, 17 aa, Entamoeba invadens
MEIGALGYVECSAKFNV

SEQ ID NO: 2955916 - protein, 18 aa, Entamoeba invadens
MEIGLGLNGGNKTDVERL

SEQ ID NO: 2955917 - protein, 19 aa, Entamoeba invadens
MEILMDGFTIEKVPVPSNF

SEQ ID NO: 2955918 - protein, 26 aa, Entamoeba invadens
MEILMKFVSAVFPEFIGVMTGRALEQ

SEQ ID NO: 2955919 - protein, 33 aa, Entamoeba invadens
MEILSKLLPLVSIGRCVILVYKSLYEVHSSKCI

SEQ ID NO: 2955920 - protein, 17 aa, Entamoeba invadens
MEILSKRLGIPMTSVSK

SEQ ID NO: 2955921 - protein, 20 aa, Entamoeba invadens
MEIQEHFMKGGVLSTDSVMT

SEQ ID NO: 2955922 - protein, 21 aa, Entamoeba invadens
MEIQKVLVFNGIFDVIATCWE

SEQ ID NO: 2955923 - protein, 25 aa, Entamoeba invadens
MEITEIYCNGKLDNKYALEKTLTTI

SEQ ID NO: 2955924 - protein, 17 aa, Entamoeba invadens
MEIVLGKFPQTVASDSH

SEQ ID NO: 2955925 - protein, 26 aa, Entamoeba invadens
MEIVVLYKVRFVELIMPKTVKILKMK

SEQ ID NO: 2955926 - protein, 18 aa, Entamoeba invadens
MEIVWARMQMDVVCKDPN

SEQ ID NO: 2955927 - protein, 25 aa, Entamoeba invadens
MEKAKIGVCQFCISPPKTNMEGNVV

SEQ ID NO: 2955928 - protein, 26 aa, Entamoeba invadens
MEKCSTNFKGWEWFIIEKSPEKKMYT

SEQ ID NO: 2955929 - protein, 32 aa, Entamoeba invadens
MEKDESCVIIGKDVFKSIAVSKEFIGKYITIP

SEQ ID NO: 2955930 - protein, 18 aa, Entamoeba invadens
MEKFLAAKLKFGENEIVA

SEQ ID NO: 2955931 - protein, 24 aa, Entamoeba invadens
MEKHFMKPMMAVGIDKKVIKKIFV

SEQ ID NO: 2955932 - protein, 21 aa, Entamoeba invadens
MEKHMKLTFVFPKQIGTGTSG

SEQ ID NO: 2955933 - protein, 23 aa, Entamoeba invadens
MEKICAIGELGLDYDRLHFSDKA

SEQ ID NO: 2955934 - protein, 24 aa, Entamoeba invadens
MEKICSMSGRLNVGLTEIKNVGEE

SEQ ID NO: 2955935 - protein, 22 aa, Entamoeba invadens
MEKKEFNSLLADLRTKLKESQD

SEQ ID NO: 2955936 - protein, 22 aa, Entamoeba invadens
MEKSKAPFIVWCQEQLNNKDIK

SEQ ID NO: 2955937 - protein, 22 aa, Entamoeba invadens
MEKSQVEWLNWYNQKIREDILP

SEQ ID NO: 2955938 - protein, 20 aa, Entamoeba invadens
MEKYMVDGFGRFKNKKPYEK

SEQ ID NO: 2955939 - protein, 26 aa, Entamoeba invadens
MELAPVKLPKVFRILEDYITKNITVE

SEQ ID NO: 2955940 - protein, 26 aa, Entamoeba invadens
MELCHKSAEIIRMFPTDISEKFCRFM

SEQ ID NO: 2955941 - protein, 20 aa, Entamoeba invadens
MELEENFHINAFVTERSLNV

SEQ ID NO: 2955942 - protein, 26 aa, Entamoeba invadens
MELFKENCKLLWALSEMKGFDEMISM

SEQ ID NO: 2955943 - protein, 18 aa, Entamoeba invadens
MELLKLKILLHAKDCMKA

SEQ ID NO: 2955944 - protein, 35 aa, Entamoeba invadens
MELRLYPHIKYVLGLECVKLDLKLITRYNAQGDLK

SEQ ID NO: 2955945 - protein, 25 aa, Entamoeba invadens
MELSFKKGDLIKVISTKEDWYEAEI

SEQ ID NO: 2955946 - protein, 23 aa, Entamoeba invadens
MELTKVCYEKEFTEMDSILHMVG

SEQ ID NO: 2955947 - protein, 26 aa, Entamoeba invadens
MELVRAIKENVCYVALDYDAEMKKKA

SEQ ID NO: 2955948 - protein, 27 aa, Entamoeba invadens
MELVRAIKESVCYVALDYDSEMKRKAK

SEQ ID NO: 2955949 - protein, 20 aa, Entamoeba invadens
MEMGDRIGGIYVCKQNATNQ

SEQ ID NO: 2955950 - protein, 34 aa, Entamoeba invadens
MEMKTSLLCLRRIAFKLDQFFGPTALPFSDDILK

SEQ ID NO: 2955951 - protein, 21 aa, Entamoeba invadens
MEMLGLIYTWVLKNIESKVLI

SEQ ID NO: 2955952 - protein, 19 aa, Entamoeba invadens
MEMWSKLKVKSVVFDSNID

SEQ ID NO: 2955953 - protein, 29 aa, Entamoeba invadens
MENELKRLNELYGPLLQEKNEKDKQIEFG

SEQ ID NO: 2955954 - protein, 18 aa, Entamoeba invadens
MENIKMLLKTVVDLIHIS

SEQ ID NO: 2955955 - protein, 24 aa, Entamoeba invadens
MENLRYLNLSACIQFSNEFIGTIL

SEQ ID NO: 2955956 - protein, 18 aa, Entamoeba invadens
MENYQHKLVWEVHNETPE

SEQ ID NO: 2955957 - protein, 25 aa, Entamoeba invadens
MENYTCLKYMIALLYHLSLSEKSKM

SEQ ID NO: 2955958 - protein, 19 aa, Entamoeba invadens
MENYYKLRKSMGVIPGLER

SEQ ID NO: 2955959 - protein, 18 aa, Entamoeba invadens
MEPRPVIWGEDYHQHIPQ

SEQ ID NO: 2955960 - protein, 17 aa, Entamoeba invadens
MEPVFAYYKEHNGDESN

SEQ ID NO: 2955961 - protein, 18 aa, Entamoeba invadens
MEQARLTGFANLLNSFDI

SEQ ID NO: 2955962 - protein, 19 aa, Entamoeba invadens
MEQICSKLGFTDRLEKTTS

SEQ ID NO: 2955963 - protein, 24 aa, Entamoeba invadens
MEQKRIKKAGGFVDAAGRVSGLRV

SEQ ID NO: 2955964 - protein, 24 aa, Entamoeba invadens
MEQRGLVCYLVWLFNEESKKFGGK

SEQ ID NO: 2955965 - protein, 24 aa, Entamoeba invadens
MERRDIAFSFLRDMDEMWKFNYVL

SEQ ID NO: 2955966 - protein, 19 aa, Entamoeba invadens
MERSEFNMLPRWRKDAERR

SEQ ID NO: 2955967 - protein, 22 aa, Entamoeba invadens
MERYKANMKIMRSETLRPPRSV

SEQ ID NO: 2955968 - protein, 31 aa, Entamoeba invadens
MESGLGLPYPHWLLTFGRDYFASNLTQRAEG

SEQ ID NO: 2955969 - protein, 22 aa, Entamoeba invadens
MESIAFKISKLFSPDFSDHIMK

SEQ ID NO: 2955970 - protein, 26 aa, Entamoeba invadens
MESKEVQCLYTIYSQYVVHFHEFNSN

SEQ ID NO: 2955971 - protein, 26 aa, Entamoeba invadens
MESKEVRCLYTIYSQYVVHFHEFNSN

SEQ ID NO: 2955972 - protein, 19 aa, Entamoeba invadens
MESLAYLFVYLLKGSLPWQ

SEQ ID NO: 2955973 - protein, 24 aa, Entamoeba invadens
METDFKMRIPYCGDEFKISPEFRL

SEQ ID NO: 2955974 - protein, 27 aa, Entamoeba invadens
METIRFKSNVCVIVFDNRNSIFGGYYQ

SEQ ID NO: 2955975 - protein, 21 aa, Entamoeba invadens
METLLFLRFFLPPLASTPSVL

SEQ ID NO: 2955976 - protein, 23 aa, Entamoeba invadens
METLPWVVPRQVIQAETDVIPAQ

SEQ ID NO: 2955977 - protein, 32 aa, Entamoeba invadens
MEVFGAKRPVSWILICRVIIYSLMELHKGTIY

SEQ ID NO: 2955978 - protein, 19 aa, Entamoeba invadens
MEVGSTYCRFILFCSNVCG

SEQ ID NO: 2955979 - protein, 25 aa, Entamoeba invadens
MEVKRIGLSLTHRHGILLGEELSIR

SEQ ID NO: 2955980 - protein, 34 aa, Entamoeba invadens
MEVKRYGLECPGLWLKNLVIKFMLSKLGYTDERE

SEQ ID NO: 2955981 - protein, 23 aa, Entamoeba invadens
MEVLKILFVESYSLHCKETNCIV

SEQ ID NO: 2955982 - protein, 17 aa, Entamoeba invadens
MEVNGWVFKSRDEFEFE

SEQ ID NO: 2955983 - protein, 19 aa, Entamoeba invadens
MEVYMKFLPENGYLTDSGT

SEQ ID NO: 2955984 - protein, 17 aa, Entamoeba invadens
MEYFMRHALFNKDVNII

SEQ ID NO: 2955985 - protein, 17 aa, Entamoeba invadens
MEYTQHIPIILVGNKCD

SEQ ID NO: 2955986 - protein, 20 aa, Entamoeba invadens
MEYTQHIPIILVGNKCDLES

SEQ ID NO: 2955987 - protein, 23 aa, Entamoeba invadens
MFALFKMTFTWMMSNDLPQKMGP

SEQ ID NO: 2955988 - protein, 26 aa, Entamoeba invadens
MFAQPFKKYYPFVAGYIALYSNDMAE

SEQ ID NO: 2955989 - protein, 25 aa, Entamoeba invadens
MFAQPFKKYYSFVAGYIALYSNDMA

SEQ ID NO: 2955990 - protein, 19 aa, Entamoeba invadens
MFDNLSIRISKEMSTLVPQ

SEQ ID NO: 2955991 - protein, 38 aa, Entamoeba invadens
MFEELPEMLVFHLKRFVYNDVFEIVKYNGYFEYPEVVD

SEQ ID NO: 2955992 - protein, 21 aa, Entamoeba invadens
MFEKWANAIASYYGKTFSIAD

SEQ ID NO: 2955993 - protein, 29 aa, Entamoeba invadens
MFENCGKLKRFLMPKSKALAIAEFIQPND

SEQ ID NO: 2955994 - protein, 20 aa, Entamoeba invadens
MFETIFWKEAFSKSEFKYPW

SEQ ID NO: 2955995 - protein, 18 aa, Entamoeba invadens
MFETLKFEMSRISNVYRG

SEQ ID NO: 2955996 - protein, 21 aa, Entamoeba invadens
MFEVNYPCALRMKKIGYCNMK

SEQ ID NO: 2955997 - protein, 20 aa, Entamoeba invadens
MFFAFAAPMVLCLSETATES

SEQ ID NO: 2955998 - protein, 17 aa, Entamoeba invadens
MFFHSEIEYIGWKKNFL

SEQ ID NO: 2955999 - protein, 17 aa, Entamoeba invadens
MFFVLKKKFPEFEDKVI

SEQ ID NO: 2956000 - protein, 19 aa, Entamoeba invadens
MFGDVCAKCGEPVKNNEGV

SEQ ID NO: 2956001 - protein, 18 aa, Entamoeba invadens
MFGEFCFCGCDSLSAITL

SEQ ID NO: 2956002 - protein, 18 aa, Entamoeba invadens
MFGKCLLRYYQFELSVNV

SEQ ID NO: 2956003 - protein, 18 aa, Entamoeba invadens
MFGLPKVGKTTVIKDIVD

SEQ ID NO: 2956004 - protein, 25 aa, Entamoeba invadens
MFGRRWTHISSFLPHRAPNSIKNRF

SEQ ID NO: 2956005 - protein, 18 aa, Entamoeba invadens
MFHGRCLHFAIGDIDKES

SEQ ID NO: 2956006 - protein, 19 aa, Entamoeba invadens
MFHGRCLHFAIGDIDKKAL

SEQ ID NO: 2956007 - protein, 19 aa, Entamoeba invadens
MFHGRCLHFVIGDIDKESI

SEQ ID NO: 2956008 - protein, 17 aa, Entamoeba invadens
MFHVVWLMTFDEKLVEH

SEQ ID NO: 2956009 - protein, 21 aa, Entamoeba invadens
MFISCFSAFWIEHNGDVNFNV

SEQ ID NO: 2956010 - protein, 19 aa, Entamoeba invadens
MFKEFKLSHKWRYIIFKMN

SEQ ID NO: 2956011 - protein, 22 aa, Entamoeba invadens
MFKIEGFGWFDENRKRGDLFVT

SEQ ID NO: 2956012 - protein, 23 aa, Entamoeba invadens
MFKIKNEWDLLYVVGEGKQFVFV

SEQ ID NO: 2956013 - protein, 29 aa, Entamoeba invadens
MFKKRWKKRYLVWKNSYIIFFDKNSQNEK

SEQ ID NO: 2956014 - protein, 19 aa, Entamoeba invadens
MFKNCKALSKIEVPNSVVK

SEQ ID NO: 2956015 - protein, 17 aa, Entamoeba invadens
MFKNIIVDFYKNDQHDK

SEQ ID NO: 2956016 - protein, 18 aa, Entamoeba invadens
MFKTVIYGAQGLRDVRKA

SEQ ID NO: 2956017 - protein, 17 aa, Entamoeba invadens
MFLYRPGSVNGRSVTHA

SEQ ID NO: 2956018 - protein, 25 aa, Entamoeba invadens
MFMECPEMICGLFINTVMDDFTTIR

SEQ ID NO: 2956019 - protein, 18 aa, Entamoeba invadens
MFNCNGCKTLQKINIKNA

SEQ ID NO: 2956020 - protein, 19 aa, Entamoeba invadens
MFNGCEKLSAIEIPESVTK

SEQ ID NO: 2956021 - protein, 20 aa, Entamoeba invadens
MFNNDFEYFQMDGMTIKNHK

SEQ ID NO: 2956022 - protein, 20 aa, Entamoeba invadens
MFNNDFEYFQMNGVTIGNHK

SEQ ID NO: 2956023 - protein, 27 aa, Entamoeba invadens
MFNRWSFCDDLRLLFEIEKCGVGAYAM

SEQ ID NO: 2956024 - protein, 38 aa, Entamoeba invadens
MFNTLIGKVIEWSRIEMRPDVFLSYILLVGDMALSAQS

SEQ ID NO: 2956025 - protein, 20 aa, Entamoeba invadens
MFPCYPYEKDPFVLNEPFPD

SEQ ID NO: 2956026 - protein, 23 aa, Entamoeba invadens
MFPEMKIPFESLVDYQKGDGNFT

SEQ ID NO: 2956027 - protein, 18 aa, Entamoeba invadens
MFPKDWIALDNKIGLLRG

SEQ ID NO: 2956028 - protein, 18 aa, Entamoeba invadens
MFPYFCNDCETLFGVEVN

SEQ ID NO: 2956029 - protein, 18 aa, Entamoeba invadens
MFQKCLKGASKETVGRLV

SEQ ID NO: 2956030 - protein, 17 aa, Entamoeba invadens
MFQQNIVSLRWKYNKSE

SEQ ID NO: 2956031 - protein, 17 aa, Entamoeba invadens
MFQSCFSSLLSGLQVLY

SEQ ID NO: 2956032 - protein, 22 aa, Entamoeba invadens
MFQYTCSQCVVLFKPKQSPSKK

SEQ ID NO: 2956033 - protein, 22 aa, Entamoeba invadens
MFRSIPCKCYTVPSHIQRIEKD

SEQ ID NO: 2956034 - protein, 17 aa, Entamoeba invadens
MFSDFKLVNSCWLVTKQ

SEQ ID NO: 2956035 - protein, 17 aa, Entamoeba invadens
MFSILGIAFNSKYLMHT

SEQ ID NO: 2956036 - protein, 17 aa, Entamoeba invadens
MFSLCRIAKEAAPTPQN

SEQ ID NO: 2956037 - protein, 19 aa, Entamoeba invadens
MFTATAFKKQVELNLVMEF

SEQ ID NO: 2956038 - protein, 17 aa, Entamoeba invadens
MFTGCAKNGEIVDADKM

SEQ ID NO: 2956039 - protein, 20 aa, Entamoeba invadens
MFTGCYNLAEIVGLESVTKV

SEQ ID NO: 2956040 - protein, 23 aa, Entamoeba invadens
MFTKDGVSVFLAFPRNYDRVLKI

SEQ ID NO: 2956041 - protein, 23 aa, Entamoeba invadens
MFTKLAEIMLNFFKIIEPPQEEK

SEQ ID NO: 2956042 - protein, 18 aa, Entamoeba invadens
MFTRYMIKYPKKVRDPYG

SEQ ID NO: 2956043 - protein, 21 aa, Entamoeba invadens
MFVKAQFWDTAGVERYRSLLP

SEQ ID NO: 2956044 - protein, 19 aa, Entamoeba invadens
MFVNVVFEFNGVMCRTMAP

SEQ ID NO: 2956045 - protein, 24 aa, Entamoeba invadens
MFVTEFIKADLFRLIHSVDSLPPE

SEQ ID NO: 2956046 - protein, 20 aa, Entamoeba invadens
MFYDQTRVIVALKKAERVPT

SEQ ID NO: 2956047 - protein, 29 aa, Entamoeba invadens
MFYICASTPCPLDAPSVLGIAAVKKLILL

SEQ ID NO: 2956048 - protein, 22 aa, Entamoeba invadens
MFYSELIELFYFPDDIVNGIQP

SEQ ID NO: 2956049 - protein, 18 aa, Entamoeba invadens
MFYSLRMKLVDVIPDSLV

SEQ ID NO: 2956050 - protein, 21 aa, Entamoeba invadens
MGAVDCLKQLVSLFSTVKEEN

SEQ ID NO: 2956051 - protein, 25 aa, Entamoeba invadens
MGAVDCLRQIVSLFITKKEENSKNQ

SEQ ID NO: 2956052 - protein, 17 aa, Entamoeba invadens
MGDGVISFVSFNEGYPL

SEQ ID NO: 2956053 - protein, 17 aa, Entamoeba invadens
MGDSVFFMCGLQCFDMP

SEQ ID NO: 2956054 - protein, 22 aa, Entamoeba invadens
MGEGCFYGCKVLTKIVIPNKMK

SEQ ID NO: 2956055 - protein, 17 aa, Entamoeba invadens
MGEMQSMTDEIKKKEDV

SEQ ID NO: 2956056 - protein, 18 aa, Entamoeba invadens
MGERLGKPFLIYRQTISN

SEQ ID NO: 2956057 - protein, 26 aa, Entamoeba invadens
MGERLVRDIGLFLGKYIGQYLVKVYN

SEQ ID NO: 2956058 - protein, 18 aa, Entamoeba invadens
MGEYCFKNCDLLKEAVLS

SEQ ID NO: 2956059 - protein, 22 aa, Entamoeba invadens
MGEYCFNCCYNITSVDLPDALL

SEQ ID NO: 2956060 - protein, 18 aa, Entamoeba invadens
MGFLFTDIFILARSTIHN

SEQ ID NO: 2956061 - protein, 25 aa, Entamoeba invadens
MGGEEFKSRVLRDVKNVYPVPFVLL

SEQ ID NO: 2956062 - protein, 25 aa, Entamoeba invadens
MGGFIKRFPSFFKQDNTILTHEERS

SEQ ID NO: 2956063 - protein, 18 aa, Entamoeba invadens
MGGGKFDISLCVTINKTI

SEQ ID NO: 2956064 - protein, 21 aa, Entamoeba invadens
MGGLMTYKLLDYMGEEFTKKY

SEQ ID NO: 2956065 - protein, 27 aa, Entamoeba invadens
MGGLVTLQLFKFFGLAFCREHIEKLIT

SEQ ID NO: 2956066 - protein, 26 aa, Entamoeba invadens
MGGNYKCPLCGVMLTEDDISRNDFGD

SEQ ID NO: 2956067 - protein, 29 aa, Entamoeba invadens
MGGRTIFKRSSCLVLEYSLKSSTMIRKRV

SEQ ID NO: 2956068 - protein, 25 aa, Entamoeba invadens
MGGVPWKVDVDPIFADGMTVGIDVI

SEQ ID NO: 2956069 - protein, 25 aa, Entamoeba invadens
MGHFELMCDLVLKRANLLDTVFTLF

SEQ ID NO: 2956070 - protein, 19 aa, Entamoeba invadens
MGIDKLLLVDEVASGTIKP

SEQ ID NO: 2956071 - protein, 17 aa, Entamoeba invadens
MGIEKVVNFPFPSQISC

SEQ ID NO: 2956072 - protein, 25 aa, Entamoeba invadens
MGILCANVNGGVLAVCNTFFTKENI

SEQ ID NO: 2956073 - protein, 35 aa, Entamoeba invadens
MGKKFCKTREVSFHRITEVCLLMLMDVSQFTSMQK

SEQ ID NO: 2956074 - protein, 22 aa, Entamoeba invadens
MGKKYLECFGEEKLIEIGKKAY

SEQ ID NO: 2956075 - protein, 26 aa, Entamoeba invadens
MGKSEVFEKVFTCSRKNDNFIRKFEL

SEQ ID NO: 2956076 - protein, 17 aa, Entamoeba invadens
MGLDIPEEFCDTIMGTL

SEQ ID NO: 2956077 - protein, 19 aa, Entamoeba invadens
MGLSHHWSSFKIKFSPDKI

SEQ ID NO: 2956078 - protein, 19 aa, Entamoeba invadens
MGLVPVPLYATLGVNSINY

SEQ ID NO: 2956079 - protein, 17 aa, Entamoeba invadens
MGMGGMPNMAGMDPQQA

SEQ ID NO: 2956080 - protein, 19 aa, Entamoeba invadens
MGNIPKFELVLTLINRDDE

SEQ ID NO: 2956081 - protein, 31 aa, Entamoeba invadens
MGNLKKPLLHNGIRITMCSVFECQNNSKPVT

SEQ ID NO: 2956082 - protein, 17 aa, Entamoeba invadens
MGNTISVIFKSATNAQD

SEQ ID NO: 2956083 - protein, 21 aa, Entamoeba invadens
MGQMMLIRLFSLFVRDILVQK

SEQ ID NO: 2956084 - protein, 24 aa, Entamoeba invadens
MGQPLCSFPGCSKTTSTNPDNFCV

SEQ ID NO: 2956085 - protein, 26 aa, Entamoeba invadens
MGRIISRKGCCLIPLDCSGRTVEYIR

SEQ ID NO: 2956086 - protein, 21 aa, Entamoeba invadens
MGRSEALVMLEYHIMQLSSPY

SEQ ID NO: 2956087 - protein, 21 aa, Entamoeba invadens
MGRTDLWGGSYEQIEDSIKNK

SEQ ID NO: 2956088 - protein, 17 aa, Entamoeba invadens
MGRTHLQDAVPITYAQE

SEQ ID NO: 2956089 - protein, 21 aa, Entamoeba invadens
MGRTYKFLTELGIPGEHIRFR

SEQ ID NO: 2956090 - protein, 24 aa, Entamoeba invadens
MGSAKSIIVFWALKVIVTLLNPKV

SEQ ID NO: 2956091 - protein, 22 aa, Entamoeba invadens
MGSIDSKGGFTIKGNLNPTHLE

SEQ ID NO: 2956092 - protein, 25 aa, Entamoeba invadens
MGSNLTFLLRCHFITLKKCLSPEVK

SEQ ID NO: 2956093 - protein, 20 aa, Entamoeba invadens
MGTILKHFITPILKSAVASK

SEQ ID NO: 2956094 - protein, 21 aa, Entamoeba invadens
MGTTFYGCIVKKFLYKLTGAN

SEQ ID NO: 2956095 - protein, 23 aa, Entamoeba invadens
MGTTFYGCLVKKFLYKLTGANVR

SEQ ID NO: 2956096 - protein, 19 aa, Entamoeba invadens
MGVGKTCIVQRFCFHTYKD

SEQ ID NO: 2956097 - protein, 17 aa, Entamoeba invadens
MGVGQAIIFVNRKEEAV

SEQ ID NO: 2956098 - protein, 25 aa, Entamoeba invadens
MGVKDGACVTVVFLTPLKIYTAQCG

SEQ ID NO: 2956099 - protein, 17 aa, Entamoeba invadens
MGVMGFRKSVCEFIGDR

SEQ ID NO: 2956100 - protein, 17 aa, Entamoeba invadens
MGVQLGFVGMAKFVREY

SEQ ID NO: 2956101 - protein, 17 aa, Entamoeba invadens
MGVRFFLCCYSDGRCYF

SEQ ID NO: 2956102 - protein, 40 aa, Entamoeba invadens
MGVSFNPGECVVCKELSMDIECIRCHKKYHNKCFLHTVSE

SEQ ID NO: 2956103 - protein, 19 aa, Entamoeba invadens
MGVVLWEMLYEKKPFNEYY

SEQ ID NO: 2956104 - protein, 25 aa, Entamoeba invadens
MGYADRIPLHFFVLMERMKERMNNN

SEQ ID NO: 2956105 - protein, 29 aa, Entamoeba invadens
MHFAEELLAGIAMGRRSFFQFGVTLEHNE

SEQ ID NO: 2956106 - protein, 25 aa, Entamoeba invadens
MHFPTFKVSYAIARDVLSDTEQNQG

SEQ ID NO: 2956107 - protein, 26 aa, Entamoeba invadens
MHKMYLSVCFAIRMIKTMNRKGIMIT

SEQ ID NO: 2956108 - protein, 18 aa, Entamoeba invadens
MHLGWECYSIGYNGLDGC

SEQ ID NO: 2956109 - protein, 20 aa, Entamoeba invadens
MHLYAPAMLACFPMQDVLSL

SEQ ID NO: 2956110 - protein, 17 aa, Entamoeba invadens
MHMKIDIVQDLRLVNSS

SEQ ID NO: 2956111 - protein, 26 aa, Entamoeba invadens
MHNKLCVWLRLLGYDAKGSKDYEVKY

SEQ ID NO: 2956112 - protein, 22 aa, Entamoeba invadens
MHPNVILILGYCVEKSVNAIIY

SEQ ID NO: 2956113 - protein, 26 aa, Entamoeba invadens
MHQSQPCFKKGLKYSEFEDLTPALAG

SEQ ID NO: 2956114 - protein, 33 aa, Entamoeba invadens
MHTAELVFTEFMFCARLQIFQKHFEVYIRNEMA

SEQ ID NO: 2956115 - protein, 21 aa, Entamoeba invadens
MHTFCSLTGLSLIGALPVSYV

SEQ ID NO: 2956116 - protein, 18 aa, Entamoeba invadens
MHTKARRLRITSDQIDAL

SEQ ID NO: 2956117 - protein, 26 aa, Entamoeba invadens
MHTSAPHCWSFMLSGLVYLKELGDSI

SEQ ID NO: 2956118 - protein, 29 aa, Entamoeba invadens
MHVFIYKNVCYEVMRFCFVTRDEKMMNRG

SEQ ID NO: 2956119 - protein, 17 aa, Entamoeba invadens
MICFSGDSKWVYVRHQF

SEQ ID NO: 2956120 - protein, 20 aa, Entamoeba invadens
MICRRLETQYSIVIEKNDND

SEQ ID NO: 2956121 - protein, 20 aa, Entamoeba invadens
MIDALIALSFIKIVCDRQEI

SEQ ID NO: 2956122 - protein, 20 aa, Entamoeba invadens
MIDCLNNLTLAIIKKPYEMV

SEQ ID NO: 2956123 - protein, 20 aa, Entamoeba invadens
MIDCVFAYYSDSPLLLQSLQ

SEQ ID NO: 2956124 - protein, 21 aa, Entamoeba invadens
MIDFSCSFEGAQVMTFSIDES

SEQ ID NO: 2956125 - protein, 18 aa, Entamoeba invadens
MIDMHTVMPLDFKQQQKA

SEQ ID NO: 2956126 - protein, 23 aa, Entamoeba invadens
MIDSPCLTGSPTIEALVPTVEAS

SEQ ID NO: 2956127 - protein, 27 aa, Entamoeba invadens
MIDWSIIYQMNWFKTPINIRLFNDSFN

SEQ ID NO: 2956128 - protein, 20 aa, Entamoeba invadens
MIECPICSKEFNRIIIDTHI

SEQ ID NO: 2956129 - protein, 22 aa, Entamoeba invadens
MIEHVKKAVAIAHQIGSTTYFI

SEQ ID NO: 2956130 - protein, 24 aa, Entamoeba invadens
MIEICRGCVGIIFKATYKGRTVAV

SEQ ID NO: 2956131 - protein, 22 aa, Entamoeba invadens
MIERMKISCVVHGKCENGIGKN

SEQ ID NO: 2956132 - protein, 18 aa, Entamoeba invadens
MIEVMKMAMLVGNISSIT

SEQ ID NO: 2956133 - protein, 18 aa, Entamoeba invadens
MIEYFTVPEVDRFLVTIQ

SEQ ID NO: 2956134 - protein, 19 aa, Entamoeba invadens
MIFSFSFGVLTNGVYENKY

SEQ ID NO: 2956135 - protein, 19 aa, Entamoeba invadens
MIGGSRKGLPDGTRLRGDI

SEQ ID NO: 2956136 - protein, 23 aa, Entamoeba invadens
MIGSGRWVFESPLLTLAGVSQKN

SEQ ID NO: 2956137 - protein, 23 aa, Entamoeba invadens
MIGTPYISPVVMLEKGDEIIMSS

SEQ ID NO: 2956138 - protein, 27 aa, Entamoeba invadens
MIGYPECNFCLAQCALYIARAPKSVCT

SEQ ID NO: 2956139 - protein, 20 aa, Entamoeba invadens
MIHFLSDLVFFNGYNLTYSG

SEQ ID NO: 2956140 - protein, 21 aa, Entamoeba invadens
MIHKGVFEFPFATMTGTTHED

SEQ ID NO: 2956141 - protein, 17 aa, Entamoeba invadens
MIIGGSFTDEQLQQVVD

SEQ ID NO: 2956142 - protein, 31 aa, Entamoeba invadens
MIIGLSEIFPECRFYAGLAMLHGFGVKKNIK

SEQ ID NO: 2956143 - protein, 23 aa, Entamoeba invadens
MIIISALKFLQFVIQKTCPGNGP

SEQ ID NO: 2956144 - protein, 17 aa, Entamoeba invadens
MIIVKDITTPVNSFEIS

SEQ ID NO: 2956145 - protein, 18 aa, Entamoeba invadens
MIKACSVVQYVKFMNTLD

SEQ ID NO: 2956146 - protein, 19 aa, Entamoeba invadens
MIKDLCRKKKDHAKTQLIK

SEQ ID NO: 2956147 - protein, 25 aa, Entamoeba invadens
MIKHVKMKLFYGVHCPAHRCNLFAQ

SEQ ID NO: 2956148 - protein, 17 aa, Entamoeba invadens
MIKRLGQTIWNYCEVEK

SEQ ID NO: 2956149 - protein, 20 aa, Entamoeba invadens
MIKSAINYRSKGRFPVLTWF

SEQ ID NO: 2956150 - protein, 24 aa, Entamoeba invadens
MIKSGEAVIHLSCYGLKERLLWTT

SEQ ID NO: 2956151 - protein, 22 aa, Entamoeba invadens
MIKTMNRKGIMITYGQFKYLKD

SEQ ID NO: 2956152 - protein, 17 aa, Entamoeba invadens
MIKVFHKTFEEWKGVTL

SEQ ID NO: 2956153 - protein, 23 aa, Entamoeba invadens
MILMDEFFRKPLLSLAEQKVVAA

SEQ ID NO: 2956154 - protein, 29 aa, Entamoeba invadens
MINNSVCNSVEFLITMDVDFLKYEFPHFV

SEQ ID NO: 2956155 - protein, 19 aa, Entamoeba invadens
MINPILKFLEGILTIELVD

SEQ ID NO: 2956156 - protein, 20 aa, Entamoeba invadens
MINSELYLFQILQVVNGIEQ

SEQ ID NO: 2956157 - protein, 21 aa, Entamoeba invadens
MIPMVLEGMALHTYKINYDFL

SEQ ID NO: 2956158 - protein, 24 aa, Entamoeba invadens
MIPPNNCWPARIFVQKLFTAANRM

SEQ ID NO: 2956159 - protein, 24 aa, Entamoeba invadens
MIPPRDTVMLLSRDILKAFLDTAV

SEQ ID NO: 2956160 - protein, 19 aa, Entamoeba invadens
MIPVVQKWVKGCYRPSESD

SEQ ID NO: 2956161 - protein, 25 aa, Entamoeba invadens
MIQAKLSIIPVRRGYWGATIGTVHT

SEQ ID NO: 2956162 - protein, 18 aa, Entamoeba invadens
MIQLKRCYLLSLRKLLSD

SEQ ID NO: 2956163 - protein, 26 aa, Entamoeba invadens
MIQVKTFIVTSRFIPDGTHLVKPLEQ

SEQ ID NO: 2956164 - protein, 20 aa, Entamoeba invadens
MIRCSSSEVIHCFIEKLVEF

SEQ ID NO: 2956165 - protein, 24 aa, Entamoeba invadens
MIREEGRKLLLKNNFKKEDLTTDG

SEQ ID NO: 2956166 - protein, 20 aa, Entamoeba invadens
MIRMIMTCLRSVYQNMDVQL

SEQ ID NO: 2956167 - protein, 24 aa, Entamoeba invadens
MISLIVALYGRWLRDENELNRPRY

SEQ ID NO: 2956168 - protein, 25 aa, Entamoeba invadens
MISQGYRGSAAFSINNSGSYNKTMQ

SEQ ID NO: 2956169 - protein, 20 aa, Entamoeba invadens
MITQCFFNFYDISHTSQFPY

SEQ ID NO: 2956170 - protein, 17 aa, Entamoeba invadens
MIVGIPPFYDDDVSIMY

SEQ ID NO: 2956171 - protein, 18 aa, Entamoeba invadens
MIVSCYELDGSLSKSDKE

SEQ ID NO: 2956172 - protein, 24 aa, Entamoeba invadens
MIVSKYFMCLSDFKNMVFVCKKFQ

SEQ ID NO: 2956173 - protein, 25 aa, Entamoeba invadens
MKAHCENGMKVARWLETQEKVLKVN

SEQ ID NO: 2956174 - protein, 22 aa, Entamoeba invadens
MKAKEKMWKDKLETMEKQNDML

SEQ ID NO: 2956175 - protein, 18 aa, Entamoeba invadens
MKAKHPKKIVVMAGAGMS

SEQ ID NO: 2956176 - protein, 18 aa, Entamoeba invadens
MKALHVFSQNGTFSVITE

SEQ ID NO: 2956177 - protein, 19 aa, Entamoeba invadens
MKARILKRAVDSGRTDDNM

SEQ ID NO: 2956178 - protein, 35 aa, Entamoeba invadens
MKAYCNGFLPKKEMYYCLCLMDYLVENCPEFRKQV

SEQ ID NO: 2956179 - protein, 17 aa, Entamoeba invadens
MKCCSGMTVREVIEKNM

SEQ ID NO: 2956180 - protein, 19 aa, Entamoeba invadens
MKCKGESLVINSTKQVICI

SEQ ID NO: 2956181 - protein, 20 aa, Entamoeba invadens
MKCLKQIVMDRCMNVTIKEC

SEQ ID NO: 2956182 - protein, 21 aa, Entamoeba invadens
MKDAFSFLPTFLETFKTLKNI

SEQ ID NO: 2956183 - protein, 17 aa, Entamoeba invadens
MKDCFHNLVSLTSCSFP

SEQ ID NO: 2956184 - protein, 18 aa, Entamoeba invadens
MKDELNVVVADDGIFYME

SEQ ID NO: 2956185 - protein, 22 aa, Entamoeba invadens
MKDKRGVTCQFVTFPSMKEDFI

SEQ ID NO: 2956186 - protein, 22 aa, Entamoeba invadens
MKDKYIMCHNMSYYIERLFALY

SEQ ID NO: 2956187 - protein, 23 aa, Entamoeba invadens
MKDMPVSALWYGPIGDQCTIEPF

SEQ ID NO: 2956188 - protein, 31 aa, Entamoeba invadens
MKDSYVIQVCCFRRFPQFLTDFLQNKEISKL

SEQ ID NO: 2956189 - protein, 24 aa, Entamoeba invadens
MKDVNFGVLFSRHVVFGKEKGSKI

SEQ ID NO: 2956190 - protein, 24 aa, Entamoeba invadens
MKEADKNLGCLLSFGTTTSPGIWL

SEQ ID NO: 2956191 - protein, 19 aa, Entamoeba invadens
MKEAMKMLLKVDSVCTPIE

SEQ ID NO: 2956192 - protein, 17 aa, Entamoeba invadens
MKEDHPVVVIEENSDSN

SEQ ID NO: 2956193 - protein, 21 aa, Entamoeba invadens
MKEDKMQFVAPPVIVGLSEKE

SEQ ID NO: 2956194 - protein, 27 aa, Entamoeba invadens
MKEDSFFKENWGWFKVFVQTTFTADTE

SEQ ID NO: 2956195 - protein, 27 aa, Entamoeba invadens
MKEEVVVSVDCCVAAAVTLIFNKEGIE

SEQ ID NO: 2956196 - protein, 23 aa, Entamoeba invadens
MKEFKKLPLRKLYVAGNPVCNPS

SEQ ID NO: 2956197 - protein, 17 aa, Entamoeba invadens
MKEGDAFVLVFSLQSVS

SEQ ID NO: 2956198 - protein, 30 aa, Entamoeba invadens
MKEGYLLRRWKERFVVVKNTFLFYFVNEKS

SEQ ID NO: 2956199 - protein, 18 aa, Entamoeba invadens
MKEITSVLCNTGDTTFSA

SEQ ID NO: 2956200 - protein, 17 aa, Entamoeba invadens
MKEKELEVVKCKQKNVE

SEQ ID NO: 2956201 - protein, 32 aa, Entamoeba invadens
MKEKIFPYEVTSWMLKEWQKTRGSIQCHDERF

SEQ ID NO: 2956202 - protein, 17 aa, Entamoeba invadens
MKEKNWNGGENLAHEYV

SEQ ID NO: 2956203 - protein, 24 aa, Entamoeba invadens
MKEKSRLLFEYGKMNKGNVEVQLL

SEQ ID NO: 2956204 - protein, 51 aa, Entamoeba invadens
MKEKYPEMFECFKKQEIIDCPYPFFIFEWQYLWFIHAFNIETSLRVFDYIL

SEQ ID NO: 2956205 - protein, 24 aa, Entamoeba invadens
MKELGNPCIPYFGSFQNIFEKVLS

SEQ ID NO: 2956206 - protein, 19 aa, Entamoeba invadens
MKEMIQLLVQHCEIDQTKL

SEQ ID NO: 2956207 - protein, 17 aa, Entamoeba invadens
MKESWCHNLSGAFDGMK

SEQ ID NO: 2956208 - protein, 21 aa, Entamoeba invadens
MKEVIKRDYVYDVNRNYRDPE

SEQ ID NO: 2956209 - protein, 17 aa, Entamoeba invadens
MKFGMVLWDTVFETIAM

SEQ ID NO: 2956210 - protein, 18 aa, Entamoeba invadens
MKFKQRYKDFTLAGDGLF

SEQ ID NO: 2956211 - protein, 24 aa, Entamoeba invadens
MKFRRSEDSFGLFNMYCGNEKEEY

SEQ ID NO: 2956212 - protein, 18 aa, Entamoeba invadens
MKFTYCGIVHVRNSERVA

SEQ ID NO: 2956213 - protein, 22 aa, Entamoeba invadens
MKGDESFGALVSKIVNQTDALR

SEQ ID NO: 2956214 - protein, 31 aa, Entamoeba invadens
MKGGKKGDAYCKFRIYEELKKLCSDLETKTS

SEQ ID NO: 2956215 - protein, 23 aa, Entamoeba invadens
MKGILEAILLSRIVKKHPKFLKK

SEQ ID NO: 2956216 - protein, 20 aa, Entamoeba invadens
MKGLNTFDFRPHCGKTGHYS

SEQ ID NO: 2956217 - protein, 20 aa, Entamoeba invadens
MKGNKFGGVIFKTIQAEDLN

SEQ ID NO: 2956218 - protein, 22 aa, Entamoeba invadens
MKGRLEKCGFVFYSKKTKNAKM

SEQ ID NO: 2956219 - protein, 19 aa, Entamoeba invadens
MKGVMSLILPNGEEYMKKA

SEQ ID NO: 2956220 - protein, 20 aa, Entamoeba invadens
MKGVNIEPLILVYEYCSEGS

SEQ ID NO: 2956221 - protein, 20 aa, Entamoeba invadens
MKGVVFYKEEELTLFVRYDV

SEQ ID NO: 2956222 - protein, 30 aa, Entamoeba invadens
MKGYFYCVVEIKDLVYKTAYLQPINGTVTW

SEQ ID NO: 2956223 - protein, 21 aa, Entamoeba invadens
MKGYLSRYEKFMNVVDTNPIF

SEQ ID NO: 2956224 - protein, 22 aa, Entamoeba invadens
MKHPNLITMYGLFKSDDSIFMV

SEQ ID NO: 2956225 - protein, 18 aa, Entamoeba invadens
MKHVRVCNANIEPVFFAY

SEQ ID NO: 2956226 - protein, 25 aa, Entamoeba invadens
MKIAQARASIVWVIGEYSQMVPKLG

SEQ ID NO: 2956227 - protein, 17 aa, Entamoeba invadens
MKIDIDLNFARTAHTTL

SEQ ID NO: 2956228 - protein, 17 aa, Entamoeba invadens
MKIDLQAFTTPLDIKKT

SEQ ID NO: 2956229 - protein, 17 aa, Entamoeba invadens
MKIFVFKDQAVITVAEL

SEQ ID NO: 2956230 - protein, 19 aa, Entamoeba invadens
MKIGKKLSLSIPMKRIHTV

SEQ ID NO: 2956231 - protein, 19 aa, Entamoeba invadens
MKIGVFICTSCHYVKEIDV

SEQ ID NO: 2956232 - protein, 17 aa, Entamoeba invadens
MKIIGLSTESVRFVPID

SEQ ID NO: 2956233 - protein, 18 aa, Entamoeba invadens
MKIKNCNGSVLIIEDNEG

SEQ ID NO: 2956234 - protein, 17 aa, Entamoeba invadens
MKILQLIHNEGIVHGDI

SEQ ID NO: 2956235 - protein, 24 aa, Entamoeba invadens
MKILRDVAVGLTFIHDIKDMFHGD

SEQ ID NO: 2956236 - protein, 19 aa, Entamoeba invadens
MKILSVQSVTIFDVTCKTF

SEQ ID NO: 2956237 - protein, 17 aa, Entamoeba invadens
MKIQWDDIIPFSVTMIH

SEQ ID NO: 2956238 - protein, 29 aa, Entamoeba invadens
MKISDSIGFTSFMYPCCIIEFNNQKFSSS

SEQ ID NO: 2956239 - protein, 32 aa, Entamoeba invadens
MKISSKIEVVFYFKISNFFGHQIDYSGVLFDT

SEQ ID NO: 2956240 - protein, 19 aa, Entamoeba invadens
MKISVWKDSGKVWRMRASC

SEQ ID NO: 2956241 - protein, 19 aa, Entamoeba invadens
MKITVGAPFRGIVKKIMAA

SEQ ID NO: 2956242 - protein, 25 aa, Entamoeba invadens
MKIYLDAVFLPRVRKDKFPFLQEGW

SEQ ID NO: 2956243 - protein, 18 aa, Entamoeba invadens
MKKAGCVRTLVDMNLNEK

SEQ ID NO: 2956244 - protein, 19 aa, Entamoeba invadens
MKKAGCVRTLVDMNLNEKE

SEQ ID NO: 2956245 - protein, 17 aa, Entamoeba invadens
MKKAIVTIVDQYVTDNN

SEQ ID NO: 2956246 - protein, 23 aa, Entamoeba invadens
MKKDCTDLELLKVYNYYEQTWLG

SEQ ID NO: 2956247 - protein, 18 aa, Entamoeba invadens
MKKDVQFTYSMLLMKLSQ

SEQ ID NO: 2956248 - protein, 18 aa, Entamoeba invadens
MKKECADKAFVFCKQKQR

SEQ ID NO: 2956249 - protein, 19 aa, Entamoeba invadens
MKKECDCYAHLVKMDRDSK

SEQ ID NO: 2956250 - protein, 26 aa, Entamoeba invadens
MKKEGDWWMGELNGVQGYFPSNYVSP

SEQ ID NO: 2956251 - protein, 19 aa, Entamoeba invadens
MKKEIAVIKEMSFIEFSDE

SEQ ID NO: 2956252 - protein, 21 aa, Entamoeba invadens
MKKEMMDFIQFVEESECENYE

SEQ ID NO: 2956253 - protein, 18 aa, Entamoeba invadens
MKKFRLMGIYGHCNITPR

SEQ ID NO: 2956254 - protein, 17 aa, Entamoeba invadens
MKKGETLIDAFAGVGPF

SEQ ID NO: 2956255 - protein, 20 aa, Entamoeba invadens
MKKKATLSMKEFTIPGNKQA

SEQ ID NO: 2956256 - protein, 25 aa, Entamoeba invadens
MKKKCKRYSKEIISFIQTAFVDTSV

SEQ ID NO: 2956257 - protein, 23 aa, Entamoeba invadens
MKKKFVKKYGFEPVREEFLLFLS

SEQ ID NO: 2956258 - protein, 17 aa, Entamoeba invadens
MKKKYSFIILNKKRTNQ

SEQ ID NO: 2956259 - protein, 17 aa, Entamoeba invadens
MKKKYSFIILNKKRTSQ

SEQ ID NO: 2956260 - protein, 21 aa, Entamoeba invadens
MKKLFDMYEYLTFISKSSPVM

SEQ ID NO: 2956261 - protein, 27 aa, Entamoeba invadens
MKKLRMATPHFIRYAFFQMDRREDTTS

SEQ ID NO: 2956262 - protein, 18 aa, Entamoeba invadens
MKKNGIELLCRAHQMVDE

SEQ ID NO: 2956263 - protein, 21 aa, Entamoeba invadens
MKKNIVIQISHTFSVMTLNSL

SEQ ID NO: 2956264 - protein, 25 aa, Entamoeba invadens
MKKQLKTLWRLRIMDHRLRHLKHKR

SEQ ID NO: 2956265 - protein, 23 aa, Entamoeba invadens
MKKSIGGLQSRFPTKTEKFDEIE

SEQ ID NO: 2956266 - protein, 20 aa, Entamoeba invadens
MKKSLLVPDIEKLSARQLIL

SEQ ID NO: 2956267 - protein, 22 aa, Entamoeba invadens
MKKSYQLSSRFIETSALKDIGI

SEQ ID NO: 2956268 - protein, 24 aa, Entamoeba invadens
MKKVPKFVMGRVIRISNNEYEINI

SEQ ID NO: 2956269 - protein, 20 aa, Entamoeba invadens
MKKYAPDICVCFDEMQKYFK

SEQ ID NO: 2956270 - protein, 17 aa, Entamoeba invadens
MKLAIKMSMEPEKKDEK

SEQ ID NO: 2956271 - protein, 18 aa, Entamoeba invadens
MKLCEQKIDWIHRTESGE

SEQ ID NO: 2956272 - protein, 19 aa, Entamoeba invadens
MKLDAKGAVVLLDSTAETP

SEQ ID NO: 2956273 - protein, 18 aa, Entamoeba invadens
MKLDELVASLATLIFTIS

SEQ ID NO: 2956274 - protein, 18 aa, Entamoeba invadens
MKLESISIGPTCKDVHTP

SEQ ID NO: 2956275 - protein, 19 aa, Entamoeba invadens
MKLEVTLTYAALEDLFELM

SEQ ID NO: 2956276 - protein, 24 aa, Entamoeba invadens
MKLICNVHLIDAPILFSKFDESKM

SEQ ID NO: 2956277 - protein, 19 aa, Entamoeba invadens
MKLIYKLLKAQKCQESFEE

SEQ ID NO: 2956278 - protein, 18 aa, Entamoeba invadens
MKLKDSWNSHSELIVYEV

SEQ ID NO: 2956279 - protein, 24 aa, Entamoeba invadens
MKLKEMKRQFDLWKSQFEEKKREF

SEQ ID NO: 2956280 - protein, 19 aa, Entamoeba invadens
MKLLDMSAITWDYQLSQEY

SEQ ID NO: 2956281 - protein, 18 aa, Entamoeba invadens
MKLLNAKFIAVTAANQKG

SEQ ID NO: 2956282 - protein, 17 aa, Entamoeba invadens
MKLPCLQSLSVKQVTGY

SEQ ID NO: 2956283 - protein, 20 aa, Entamoeba invadens
MKLRTKFVLDASKGILYLHE

SEQ ID NO: 2956284 - protein, 17 aa, Entamoeba invadens
MKLSQEMEKKDVEIVTL

SEQ ID NO: 2956285 - protein, 18 aa, Entamoeba invadens
MKLTRLYTTPSRDECFGE

SEQ ID NO: 2956286 - protein, 18 aa, Entamoeba invadens
MKLYGGAQYERLMRETEA

SEQ ID NO: 2956287 - protein, 19 aa, Entamoeba invadens
MKMALYYKKELNSCDGIYS

SEQ ID NO: 2956288 - protein, 20 aa, Entamoeba invadens
MKMMNTRVLIVGLRGIGSEI

SEQ ID NO: 2956289 - protein, 21 aa, Entamoeba invadens
MKMQSYRAALELFIHQHLPKF

SEQ ID NO: 2956290 - protein, 25 aa, Entamoeba invadens
MKMSNWKLAVFSAETASELYVDTNQ

SEQ ID NO: 2956291 - protein, 18 aa, Entamoeba invadens
MKNCEVIALFDLPKLSTF

SEQ ID NO: 2956292 - protein, 19 aa, Entamoeba invadens
MKNEEAFYLVFEKIIMSKS

SEQ ID NO: 2956293 - protein, 18 aa, Entamoeba invadens
MKNFPVQVQIKYTKLNGF

SEQ ID NO: 2956294 - protein, 21 aa, Entamoeba invadens
MKNGVFWCCNSFVKFENFGDV

SEQ ID NO: 2956295 - protein, 17 aa, Entamoeba invadens
MKNKSSEIINKFNEELP

SEQ ID NO: 2956296 - protein, 17 aa, Entamoeba invadens
MKNLLLERKECLNDPKI

SEQ ID NO: 2956297 - protein, 26 aa, Entamoeba invadens
MKNLNPVFNETFTFNNVYPGTTAEFQ

SEQ ID NO: 2956298 - protein, 26 aa, Entamoeba invadens
MKNSKSCYCLLPVTKYYTCLTCSEGS

SEQ ID NO: 2956299 - protein, 18 aa, Entamoeba invadens
MKNTHYWKTQFDLNDTFT

SEQ ID NO: 2956300 - protein, 17 aa, Entamoeba invadens
MKNYKWISRVLKKSTSD

SEQ ID NO: 2956301 - protein, 23 aa, Entamoeba invadens
MKPEQIIRVGMWCVEAMEVTEYP

SEQ ID NO: 2956302 - protein, 17 aa, Entamoeba invadens
MKPIGFDTEKYLHLQKE

SEQ ID NO: 2956303 - protein, 22 aa, Entamoeba invadens
MKPKVRAKMYVQRFKTVIENDE

SEQ ID NO: 2956304 - protein, 18 aa, Entamoeba invadens
MKPLKVIAQSSFSWHNVE

SEQ ID NO: 2956305 - protein, 23 aa, Entamoeba invadens
MKPNRRLSLLSAVGTLSHRGLLN

SEQ ID NO: 2956306 - protein, 19 aa, Entamoeba invadens
MKQCLDKMYPFIKETLPND

SEQ ID NO: 2956307 - protein, 26 aa, Entamoeba invadens
MKQEMVCPIKRAYGKFLNKFEKASIG

SEQ ID NO: 2956308 - protein, 25 aa, Entamoeba invadens
MKQGLFFKTLHTFDIPNFTVLLNAL

SEQ ID NO: 2956309 - protein, 27 aa, Entamoeba invadens
MKQGTDLAHEWKVLFFETSAKNKINIT

SEQ ID NO: 2956310 - protein, 21 aa, Entamoeba invadens
MKQKAMLLIPFVGNEVERIAV

SEQ ID NO: 2956311 - protein, 25 aa, Entamoeba invadens
MKQRELFCGSAAFFPTLTSKDDFIE

SEQ ID NO: 2956312 - protein, 22 aa, Entamoeba invadens
MKQSDEVLAFYAVHLSEALRFE

SEQ ID NO: 2956313 - protein, 24 aa, Entamoeba invadens
MKQTEETYRFSAMTTVMTALATYC

SEQ ID NO: 2956314 - protein, 25 aa, Entamoeba invadens
MKQYYERGCCLLRGLLVPMSEKSAF

SEQ ID NO: 2956315 - protein, 17 aa, Entamoeba invadens
MKRENTGMILATIEMHD

SEQ ID NO: 2956316 - protein, 25 aa, Entamoeba invadens
MKRFEFPELPGSIVSVMTNLNSFYG

SEQ ID NO: 2956317 - protein, 17 aa, Entamoeba invadens
MKRGFSFYTGSVNFSVD

SEQ ID NO: 2956318 - protein, 17 aa, Entamoeba invadens
MKRICASNTNFTMKTVA

SEQ ID NO: 2956319 - protein, 25 aa, Entamoeba invadens
MKRKAKEVMKEFVVPGNEQASKFFQ

SEQ ID NO: 2956320 - protein, 19 aa, Entamoeba invadens
MKRKVEAQIELRNKKNKKG

SEQ ID NO: 2956321 - protein, 17 aa, Entamoeba invadens
MKRKVVPQVMFPKLKES

SEQ ID NO: 2956322 - protein, 19 aa, Entamoeba invadens
MKRMAGRAILLAGAPGTGK

SEQ ID NO: 2956323 - protein, 19 aa, Entamoeba invadens
MKRNCGVVENLSWKEKLAY

SEQ ID NO: 2956324 - protein, 32 aa, Entamoeba invadens
MKRTNIFLEAAGHKILIGTLTPIECEQITLDL

SEQ ID NO: 2956325 - protein, 17 aa, Entamoeba invadens
MKRYNLKKEDILVVDDM

SEQ ID NO: 2956326 - protein, 17 aa, Entamoeba invadens
MKSAFNMMFETQEKLKN

SEQ ID NO: 2956327 - protein, 17 aa, Entamoeba invadens
MKSAKSFTFKNSFFENV

SEQ ID NO: 2956328 - protein, 19 aa, Entamoeba invadens
MKSDLVWKALDKTPLVKTR

SEQ ID NO: 2956329 - protein, 19 aa, Entamoeba invadens
MKSESEFTLTQSTRERIQR

SEQ ID NO: 2956330 - protein, 28 aa, Entamoeba invadens
MKSGFFRFKKLYQMGVKIGMGTDVAGGY

SEQ ID NO: 2956331 - protein, 17 aa, Entamoeba invadens
MKSIGNYCFDGCKELKK

SEQ ID NO: 2956332 - protein, 18 aa, Entamoeba invadens
MKSISVFKFDEKATRNAV

SEQ ID NO: 2956333 - protein, 28 aa, Entamoeba invadens
MKSKATVELFCFKINRNLVNEMKYAMVW

SEQ ID NO: 2956334 - protein, 25 aa, Entamoeba invadens
MKSKECKEIDQMYTKACFVFNAGVF

SEQ ID NO: 2956335 - protein, 17 aa, Entamoeba invadens
MKSKIPVVNGYPLLAKE

SEQ ID NO: 2956336 - protein, 29 aa, Entamoeba invadens
MKSKLEHRNSISFSQQFKSRVDLKEQLEN

SEQ ID NO: 2956337 - protein, 19 aa, Entamoeba invadens
MKSKYEGTVNELNAKIEEM

SEQ ID NO: 2956338 - protein, 26 aa, Entamoeba invadens
MKSLRVFEEVIVWYCVRYDTVHEYND

SEQ ID NO: 2956339 - protein, 19 aa, Entamoeba invadens
MKSQDILKVGLECTEKSIR

SEQ ID NO: 2956340 - protein, 17 aa, Entamoeba invadens
MKSQLMVKRDGGSIENK

SEQ ID NO: 2956341 - protein, 28 aa, Entamoeba invadens
MKSSEFYKKMFVKFVMCIKKEIEDTVVL

SEQ ID NO: 2956342 - protein, 22 aa, Entamoeba invadens
MKSTAIGVIADFFVYSNFCPEQ

SEQ ID NO: 2956343 - protein, 18 aa, Entamoeba invadens
MKSVDGWLINVMYSTDFC

SEQ ID NO: 2956344 - protein, 24 aa, Entamoeba invadens
MKSVNELFPIFSTQVSRLDYFSHG

SEQ ID NO: 2956345 - protein, 18 aa, Entamoeba invadens
MKTCAPIHERCIADISLV

SEQ ID NO: 2956346 - protein, 18 aa, Entamoeba invadens
MKTDALKSLMWGEHYINM

SEQ ID NO: 2956347 - protein, 17 aa, Entamoeba invadens
MKTELEALEQAANTFKQ

SEQ ID NO: 2956348 - protein, 17 aa, Entamoeba invadens
MKTELEALEQVAKTYII

SEQ ID NO: 2956349 - protein, 17 aa, Entamoeba invadens
MKTELKALEQAAKTYKQ

SEQ ID NO: 2956350 - protein, 22 aa, Entamoeba invadens
MKTKEILNRFVDIPKTLLTRHD

SEQ ID NO: 2956351 - protein, 23 aa, Entamoeba invadens
MKTKKFCMYTLMGSSIEILSSEL

SEQ ID NO: 2956352 - protein, 20 aa, Entamoeba invadens
MKTKPSIAIIKFIKYLHTIN

SEQ ID NO: 2956353 - protein, 18 aa, Entamoeba invadens
MKTLPLRMKVHHENGLKV

SEQ ID NO: 2956354 - protein, 18 aa, Entamoeba invadens
MKTLPLRMQVHHENGLKV

SEQ ID NO: 2956355 - protein, 20 aa, Entamoeba invadens
MKTQASAGLAAFLKKPESFN

SEQ ID NO: 2956356 - protein, 28 aa, Entamoeba invadens
MKTRGFSIKEICILTDLTKDVVIKYIPD

SEQ ID NO: 2956357 - protein, 23 aa, Entamoeba invadens
MKTSHTFASLSGMVSYVSTPLRT

SEQ ID NO: 2956358 - protein, 20 aa, Entamoeba invadens
MKTSRVLPADNHLATYKLAK

SEQ ID NO: 2956359 - protein, 23 aa, Entamoeba invadens
MKTTCKPISYVVTREDAIESCFK

SEQ ID NO: 2956360 - protein, 25 aa, Entamoeba invadens
MKTTRLSILILRSLHCLNPQKDFFS

SEQ ID NO: 2956361 - protein, 17 aa, Entamoeba invadens
MKTTWVLPKSVSQLTLL

SEQ ID NO: 2956362 - protein, 19 aa, Entamoeba invadens
MKTVKRADAAAALATTLPG

SEQ ID NO: 2956363 - protein, 21 aa, Entamoeba invadens
MKTVVFKKCETILFAHKKNKN

SEQ ID NO: 2956364 - protein, 17 aa, Entamoeba invadens
MKTVWGMEGNDKQKMLT

SEQ ID NO: 2956365 - protein, 17 aa, Entamoeba invadens
MKTVWGMEGNDKQKMQT

SEQ ID NO: 2956366 - protein, 18 aa, Entamoeba invadens
MKVCTRFPPEPSGYLHLG

SEQ ID NO: 2956367 - protein, 25 aa, Entamoeba invadens
MKVDELFVKEYVNLFFSFLDKQLFV

SEQ ID NO: 2956368 - protein, 24 aa, Entamoeba invadens
MKVDIWSLGVVFYLLVTGEYPFGD

SEQ ID NO: 2956369 - protein, 20 aa, Entamoeba invadens
MKVFCIHENIEVFVYALFDK

SEQ ID NO: 2956370 - protein, 21 aa, Entamoeba invadens
MKVGFEAAWALVNAFNTFDSS

SEQ ID NO: 2956371 - protein, 20 aa, Entamoeba invadens
MKVLLDLDSYLGLNDENKSK

SEQ ID NO: 2956372 - protein, 19 aa, Entamoeba invadens
MKVLLDVLKAIQFLHKNNV

SEQ ID NO: 2956373 - protein, 21 aa, Entamoeba invadens
MKVMSCAMFDFVIIATQSEVS

SEQ ID NO: 2956374 - protein, 21 aa, Entamoeba invadens
MKVVCPHIAFSARDLQNGFSY

SEQ ID NO: 2956375 - protein, 25 aa, Entamoeba invadens
MKVYLDAVFLPRVRHDKYPFLQEGW

SEQ ID NO: 2956376 - protein, 20 aa, Entamoeba invadens
MKWANIMYGDGVAKLTATRR

SEQ ID NO: 2956377 - protein, 23 aa, Entamoeba invadens
MKWTFVTRLLGFRAVGTNYDNIE

SEQ ID NO: 2956378 - protein, 17 aa, Entamoeba invadens
MKYAMVWGTSVEHSPQR

SEQ ID NO: 2956379 - protein, 21 aa, Entamoeba invadens
MKYGKNEWARISSLITSKSPQ

SEQ ID NO: 2956380 - protein, 18 aa, Entamoeba invadens
MKYIDEFLSFQQFNYNFP

SEQ ID NO: 2956381 - protein, 22 aa, Entamoeba invadens
MKYIVLACDGLWDGINAEKVKE

SEQ ID NO: 2956382 - protein, 19 aa, Entamoeba invadens
MKYLCGIDAVPICIDSKVV

SEQ ID NO: 2956383 - protein, 22 aa, Entamoeba invadens
MKYLGLLKNHIEEFLKDLSDLT

SEQ ID NO: 2956384 - protein, 26 aa, Entamoeba invadens
MKYPYKRPADYFAEMFKDDSHMDKIR

SEQ ID NO: 2956385 - protein, 20 aa, Entamoeba invadens
MKYRGCRGIALQETYIKIIV

SEQ ID NO: 2956386 - protein, 20 aa, Entamoeba invadens
MKYTNFILSLWKLQIAPSCD

SEQ ID NO: 2956387 - protein, 17 aa, Entamoeba invadens
MLAFPPNLTGLILHECH

SEQ ID NO: 2956388 - protein, 19 aa, Entamoeba invadens
MLAPVRYYADLIRNKQKVT

SEQ ID NO: 2956389 - protein, 32 aa, Entamoeba invadens
MLAQLASTVEKLTCPAEKIVHKSVLEEKREEK

SEQ ID NO: 2956390 - protein, 26 aa, Entamoeba invadens
MLARCKEVFMDGTFRSCPKQFYQLYT

SEQ ID NO: 2956391 - protein, 21 aa, Entamoeba invadens
MLARGEYKSNVKFTDDDKQMY

SEQ ID NO: 2956392 - protein, 20 aa, Entamoeba invadens
MLCDCPGLVFPSFLSSKEEM

SEQ ID NO: 2956393 - protein, 18 aa, Entamoeba invadens
MLCDVAFVMGSTDNICVV

SEQ ID NO: 2956394 - protein, 18 aa, Entamoeba invadens
MLCFSECLHLIEVVIPTS

SEQ ID NO: 2956395 - protein, 21 aa, Entamoeba invadens
MLCGNKCDIAERIVTKEEAKT

SEQ ID NO: 2956396 - protein, 18 aa, Entamoeba invadens
MLCTVPTSMIPKVPSQQE

SEQ ID NO: 2956397 - protein, 17 aa, Entamoeba invadens
MLCVRTDISMSEGKKCA

SEQ ID NO: 2956398 - protein, 17 aa, Entamoeba invadens
MLDARLSSRRKARREAR

SEQ ID NO: 2956399 - protein, 25 aa, Entamoeba invadens
MLDFKFPDQKVRDFALKCLEPMDDA

SEQ ID NO: 2956400 - protein, 17 aa, Entamoeba invadens
MLDKFRCDYIIHFYGAV

SEQ ID NO: 2956401 - protein, 19 aa, Entamoeba invadens
MLDKFRCEYIIHFYGAVFI

SEQ ID NO: 2956402 - protein, 19 aa, Entamoeba invadens
MLDKFRCEYIVHFYGAVFI

SEQ ID NO: 2956403 - protein, 24 aa, Entamoeba invadens
MLDKFRSDYIIYFYGAVFIPSKVC

SEQ ID NO: 2956404 - protein, 18 aa, Entamoeba invadens
MLDKFRSDYIVHFYGAVF

SEQ ID NO: 2956405 - protein, 25 aa, Entamoeba invadens
MLDKFRYKYIVYFYGAVLYQTRRVW

SEQ ID NO: 2956406 - protein, 25 aa, Entamoeba invadens
MLDKKFLEYDIEWFPSQWKVNFAKR

SEQ ID NO: 2956407 - protein, 24 aa, Entamoeba invadens
MLDLRTVTNIAIFRIQSACSGLFR

SEQ ID NO: 2956408 - protein, 17 aa, Entamoeba invadens
MLDSAKERLAIEGKSDF

SEQ ID NO: 2956409 - protein, 19 aa, Entamoeba invadens
MLDVFKGYNSWVYGIEKGF

SEQ ID NO: 2956410 - protein, 17 aa, Entamoeba invadens
MLEASEEKKGCVIEEKV

SEQ ID NO: 2956411 - protein, 30 aa, Entamoeba invadens
MLEDQLSVYLWRFERDGEFDVWRCFYEINK

SEQ ID NO: 2956412 - protein, 26 aa, Entamoeba invadens
MLEESWWYYIDVYRLLYPELPPSEFS

SEQ ID NO: 2956413 - protein, 18 aa, Entamoeba invadens
MLEFVKSHFDAHSEHEHL

SEQ ID NO: 2956414 - protein, 39 aa, Entamoeba invadens
MLEKKIFSSVCWDKSGAVSFLLEEVVVFLIGNASEIFVD

SEQ ID NO: 2956415 - protein, 19 aa, Entamoeba invadens
MLELSCNFIKDVTPITNLV

SEQ ID NO: 2956416 - protein, 22 aa, Entamoeba invadens
MLERAQVPFVLVTNGHGNSEYK

SEQ ID NO: 2956417 - protein, 20 aa, Entamoeba invadens
MLERKRFVGNDVVVVVFKEM

SEQ ID NO: 2956418 - protein, 19 aa, Entamoeba invadens
MLETLMAMETQYEAIKKKE

SEQ ID NO: 2956419 - protein, 28 aa, Entamoeba invadens
MLFCPLLRLCTDFSAVSRQFCFELCRDV

SEQ ID NO: 2956420 - protein, 24 aa, Entamoeba invadens
MLFDEAWFPYAHFHPFYASYHSMN

SEQ ID NO: 2956421 - protein, 18 aa, Entamoeba invadens
MLFEHKEFMQVFKKQFLS

SEQ ID NO: 2956422 - protein, 19 aa, Entamoeba invadens
MLFFNAIITVCWDPVPQNR

SEQ ID NO: 2956423 - protein, 22 aa, Entamoeba invadens
MLFGRPFSWEDPIFIQKKETKM

SEQ ID NO: 2956424 - protein, 26 aa, Entamoeba invadens
MLFPPYNFYMCFTLSAVTLPSTLKSL

SEQ ID NO: 2956425 - protein, 23 aa, Entamoeba invadens
MLGAPYDWRYFRFDEYSHKENWY

SEQ ID NO: 2956426 - protein, 18 aa, Entamoeba invadens
MLGCSLLAGMALNAITSQ

SEQ ID NO: 2956427 - protein, 19 aa, Entamoeba invadens
MLGDCYFLASLASLAEFPK

SEQ ID NO: 2956428 - protein, 20 aa, Entamoeba invadens
MLGGLKPFYVVPVRNKYGII

SEQ ID NO: 2956429 - protein, 19 aa, Entamoeba invadens
MLGHFSRSELSPMIEDIDE

SEQ ID NO: 2956430 - protein, 29 aa, Entamoeba invadens
MLGVAELKVLLKWREFVLRKIKIAQNDAE

SEQ ID NO: 2956431 - protein, 17 aa, Entamoeba invadens
MLHHRFHTKFSLVDFMR

SEQ ID NO: 2956432 - protein, 21 aa, Entamoeba invadens
MLHNKLCLRFEQDHIVKRFAK

SEQ ID NO: 2956433 - protein, 25 aa, Entamoeba invadens
MLHTLSLEWSCMSFDFVPDTLGALR

SEQ ID NO: 2956434 - protein, 17 aa, Entamoeba invadens
MLIELGIASPVSRTDSG

SEQ ID NO: 2956435 - protein, 19 aa, Entamoeba invadens
MLIPCSVAAEVCRIGFIIS

SEQ ID NO: 2956436 - protein, 29 aa, Entamoeba invadens
MLKGEMKNEIFKNFHIELHATSLDDLKEE

SEQ ID NO: 2956437 - protein, 24 aa, Entamoeba invadens
MLKIKGEISDYFSRTRGFFSVADI

SEQ ID NO: 2956438 - protein, 19 aa, Entamoeba invadens
MLKKEVDLVETLRNELQKE

SEQ ID NO: 2956439 - protein, 19 aa, Entamoeba invadens
MLKKHFKTSQFIVVSLKSG

SEQ ID NO: 2956440 - protein, 26 aa, Entamoeba invadens
MLKLKGMCYTRVKFKCVVVKDPNTRT

SEQ ID NO: 2956441 - protein, 23 aa, Entamoeba invadens
MLKNEGYSKCIIRLGTAGFDRAS

SEQ ID NO: 2956442 - protein, 22 aa, Entamoeba invadens
MLKQFRESLCIFDSRGVIDDGR

SEQ ID NO: 2956443 - protein, 20 aa, Entamoeba invadens
MLKRGKRVADPLVIANALAK

SEQ ID NO: 2956444 - protein, 25 aa, Entamoeba invadens
MLLESSTKCFISFVLESQKFERLND

SEQ ID NO: 2956445 - protein, 17 aa, Entamoeba invadens
MLLKKTVLELLRNDFAA

SEQ ID NO: 2956446 - protein, 20 aa, Entamoeba invadens
MLLSKFKFKITINNTLSNPV

SEQ ID NO: 2956447 - protein, 25 aa, Entamoeba invadens
MLLSKGRLYTWGSFSFGQLGIPDAR

SEQ ID NO: 2956448 - protein, 23 aa, Entamoeba invadens
MLMERRFISLFAQGGYEDFFSTD

SEQ ID NO: 2956449 - protein, 35 aa, Entamoeba invadens
MLMQCLVDFCAIPNIACWCFYNFDLMPSRLSVLTL

SEQ ID NO: 2956450 - protein, 21 aa, Entamoeba invadens
MLMQYDLFRRIPVEELLSQGW

SEQ ID NO: 2956451 - protein, 17 aa, Entamoeba invadens
MLMRFFSSVGIPFSQIR

SEQ ID NO: 2956452 - protein, 18 aa, Entamoeba invadens
MLMTELFFIDALAISSGL

SEQ ID NO: 2956453 - protein, 17 aa, Entamoeba invadens
MLMVWDIRKPEVPFKTI

SEQ ID NO: 2956454 - protein, 23 aa, Entamoeba invadens
MLNHCPQSFNLLFNGKGGLDTAR

SEQ ID NO: 2956455 - protein, 19 aa, Entamoeba invadens
MLNHPNILKFVAYGSNTLI

SEQ ID NO: 2956456 - protein, 21 aa, Entamoeba invadens
MLNMYKPIISDGVSLTSSKNK

SEQ ID NO: 2956457 - protein, 17 aa, Entamoeba invadens
MLNSVMYPEALKCGFEV

SEQ ID NO: 2956458 - protein, 25 aa, Entamoeba invadens
MLPLTEYTLRWDVMKKELQNSYKNK

SEQ ID NO: 2956459 - protein, 23 aa, Entamoeba invadens
MLPWLCKFLSIPIFMAQPTLSVL

SEQ ID NO: 2956460 - protein, 19 aa, Entamoeba invadens
MLQASCHVHPTVPLMRERG

SEQ ID NO: 2956461 - protein, 26 aa, Entamoeba invadens
MLQKELNGLLVHRAIYFTALLLQFHA

SEQ ID NO: 2956462 - protein, 18 aa, Entamoeba invadens
MLQLLVPVNHTFITYNVT

SEQ ID NO: 2956463 - protein, 24 aa, Entamoeba invadens
MLQMPAYCRLPLGIYVTTHRYDEF

SEQ ID NO: 2956464 - protein, 17 aa, Entamoeba invadens
MLQRVCDVCAVSADNNV

SEQ ID NO: 2956465 - protein, 18 aa, Entamoeba invadens
MLREIKICGKTVVDKDAF

SEQ ID NO: 2956466 - protein, 25 aa, Entamoeba invadens
MLRLREIGEPIKLFSESFEDRRERL

SEQ ID NO: 2956467 - protein, 19 aa, Entamoeba invadens
MLRNANFKYVRAVAALYLR

SEQ ID NO: 2956468 - protein, 22 aa, Entamoeba invadens
MLRSTHLLEFVAVFLDNNQDDT

SEQ ID NO: 2956469 - protein, 23 aa, Entamoeba invadens
MLSACISCDFGLYLEGDGNCVEC

SEQ ID NO: 2956470 - protein, 21 aa, Entamoeba invadens
MLSIKELLEYPEMNEENKDVD

SEQ ID NO: 2956471 - protein, 24 aa, Entamoeba invadens
MLSKDPNKVFSIAFRTPVTNNKGI

SEQ ID NO: 2956472 - protein, 23 aa, Entamoeba invadens
MLSKSCFSGCLSLSEIVLESTLI

SEQ ID NO: 2956473 - protein, 17 aa, Entamoeba invadens
MLSNHLVRIVCHGNMTE

SEQ ID NO: 2956474 - protein, 18 aa, Entamoeba invadens
MLSRFKLKTLTVHFKSEK

SEQ ID NO: 2956475 - protein, 17 aa, Entamoeba invadens
MLSRGELRCIGATTLEE

SEQ ID NO: 2956476 - protein, 18 aa, Entamoeba invadens
MLSVTLCHNLVVCNENGF

SEQ ID NO: 2956477 - protein, 24 aa, Entamoeba invadens
MLTDLNEGYAFWITKIMKEALDEY

SEQ ID NO: 2956478 - protein, 32 aa, Entamoeba invadens
MLTEIPYFRTILLAHFSCPYCHYSNTEVQQTI

SEQ ID NO: 2956479 - protein, 18 aa, Entamoeba invadens
MLTELLRGLHFGFDLIGM

SEQ ID NO: 2956480 - protein, 26 aa, Entamoeba invadens
MLTKIFRARCITFDYPGYGLNKNDKS

SEQ ID NO: 2956481 - protein, 25 aa, Entamoeba invadens
MLTVVKYFVCFNDFVHLQMSCKKYR

SEQ ID NO: 2956482 - protein, 18 aa, Entamoeba invadens
MLVADGIFGYLEKIIHSA

SEQ ID NO: 2956483 - protein, 21 aa, Entamoeba invadens
MLVEILYCFNKVVKYLSFEER

SEQ ID NO: 2956484 - protein, 26 aa, Entamoeba invadens
MLVLDDRFLAILVHFYTEMTSVFKPN

SEQ ID NO: 2956485 - protein, 18 aa, Entamoeba invadens
MLVSMPFQHIMRYKIQIN

SEQ ID NO: 2956486 - protein, 20 aa, Entamoeba invadens
MLYEKEMVTSIKQCYELLQY

SEQ ID NO: 2956487 - protein, 17 aa, Entamoeba invadens
MLYEKRAYLGVYRVQSR

SEQ ID NO: 2956488 - protein, 19 aa, Entamoeba invadens
MLYKWINFLGYPPKKLLDA

SEQ ID NO: 2956489 - protein, 18 aa, Entamoeba invadens
MLYRSSKSENCFIFVHTS

SEQ ID NO: 2956490 - protein, 21 aa, Entamoeba invadens
MLYYLNFLQGVFYGSLEMRGF

SEQ ID NO: 2956491 - protein, 20 aa, Entamoeba invadens
MMCERAAVFGGRRDFTKATA

SEQ ID NO: 2956492 - protein, 17 aa, Entamoeba invadens
MMCYFPKLHALAAADNM

SEQ ID NO: 2956493 - protein, 18 aa, Entamoeba invadens
MMEDSLSLHDVENIIQQG

SEQ ID NO: 2956494 - protein, 18 aa, Entamoeba invadens
MMEEWMVNMAKYFDFQNL

SEQ ID NO: 2956495 - protein, 23 aa, Entamoeba invadens
MMEGNWWKGIFGNFYNFLRTVWN

SEQ ID NO: 2956496 - protein, 27 aa, Entamoeba invadens
MMEMKGTVFKCFVPQSVLDGKDKGSEV

SEQ ID NO: 2956497 - protein, 29 aa, Entamoeba invadens
MMENTTLKGYRKWFSSGIDTASLLLIGVS

SEQ ID NO: 2956498 - protein, 18 aa, Entamoeba invadens
MMENVLMVWALRHPACGY

SEQ ID NO: 2956499 - protein, 18 aa, Entamoeba invadens
MMEWVDGKMDADVKQKTP

SEQ ID NO: 2956500 - protein, 21 aa, Entamoeba invadens
MMEYGLSFVIACNSRTRQTQD

SEQ ID NO: 2956501 - protein, 26 aa, Entamoeba invadens
MMEYVKQYGMCWEVVHDRLVVYNEFR

SEQ ID NO: 2956502 - protein, 17 aa, Entamoeba invadens
MMFSLACGNMFLGDRFS

SEQ ID NO: 2956503 - protein, 18 aa, Entamoeba invadens
MMGYKCGFCNELIDRDDS

SEQ ID NO: 2956504 - protein, 18 aa, Entamoeba invadens
MMHTLEFNYQLTPREQMN

SEQ ID NO: 2956505 - protein, 17 aa, Entamoeba invadens
MMIELIILDILITSTEY

SEQ ID NO: 2956506 - protein, 25 aa, Entamoeba invadens
MMIHLRHDLVFEIPKNFMETVSTSL

SEQ ID NO: 2956507 - protein, 17 aa, Entamoeba invadens
MMITFVVWYNVDYNTFV

SEQ ID NO: 2956508 - protein, 27 aa, Entamoeba invadens
MMIVCKYLKLFRDVRNLVLVSKKNSEL

SEQ ID NO: 2956509 - protein, 17 aa, Entamoeba invadens
MMKEYFAGCFDVKSAMT

SEQ ID NO: 2956510 - protein, 21 aa, Entamoeba invadens
MMKMDVCDIPKAIQRNYEKFI

SEQ ID NO: 2956511 - protein, 24 aa, Entamoeba invadens
MMKWMNLKYLFKLLPNLVTVVGKS

SEQ ID NO: 2956512 - protein, 22 aa, Entamoeba invadens
MMLCSDNCWLGTDFRTPQDRID

SEQ ID NO: 2956513 - protein, 19 aa, Entamoeba invadens
MMLEKKMYRDVLYKIVASK

SEQ ID NO: 2956514 - protein, 18 aa, Entamoeba invadens
MMLMCFETLTALKPEVKF

SEQ ID NO: 2956515 - protein, 17 aa, Entamoeba invadens
MMLQKNVVCMFVNAEEA

SEQ ID NO: 2956516 - protein, 18 aa, Entamoeba invadens
MMLQVRISNTAALHMYEK

SEQ ID NO: 2956517 - protein, 18 aa, Entamoeba invadens
MMLRSIVVSLCVDGIWSV

SEQ ID NO: 2956518 - protein, 18 aa, Entamoeba invadens
MMMLCSGIPQLKHVEDVQ

SEQ ID NO: 2956519 - protein, 17 aa, Entamoeba invadens
MMNEIYHRMTVTNLDEL

SEQ ID NO: 2956520 - protein, 25 aa, Entamoeba invadens
MMNRLIKISEEFNVAVVITNQVMSD

SEQ ID NO: 2956521 - protein, 33 aa, Entamoeba invadens
MMPPPGMGMPGMMPPPGMGMPGMMGGAQKPNSF

SEQ ID NO: 2956522 - protein, 21 aa, Entamoeba invadens
MMPQTRPPPIPTQQKNTQTVQ

SEQ ID NO: 2956523 - protein, 22 aa, Entamoeba invadens
MMPSQSYLFVGLMELNASKSYT

SEQ ID NO: 2956524 - protein, 27 aa, Entamoeba invadens
MMQAQGFPKLIGCLTHMDEFKKSKGLL

SEQ ID NO: 2956525 - protein, 19 aa, Entamoeba invadens
MMQPCRGAVAVFLPPYNRI

SEQ ID NO: 2956526 - protein, 25 aa, Entamoeba invadens
MMRGEAVQLLFCFDNNLEMAADHFL

SEQ ID NO: 2956527 - protein, 17 aa, Entamoeba invadens
MMRPSIMANDFTLINVE

SEQ ID NO: 2956528 - protein, 25 aa, Entamoeba invadens
MMSEWYRVKVVNWKVCQEEYSCEER

SEQ ID NO: 2956529 - protein, 19 aa, Entamoeba invadens
MMSLFKWTVYKEDRTTEIA

SEQ ID NO: 2956530 - protein, 22 aa, Entamoeba invadens
MMSRPFGVALLVAGVDETGPRL

SEQ ID NO: 2956531 - protein, 24 aa, Entamoeba invadens
MMTEVMFYVLLKFKAFEGNEEVLM

SEQ ID NO: 2956532 - protein, 26 aa, Entamoeba invadens
MMTFKEFFNGAAIERGRLKDSLHNHT

SEQ ID NO: 2956533 - protein, 20 aa, Entamoeba invadens
MMTTLHIFNSFQFINNTPYH

SEQ ID NO: 2956534 - protein, 24 aa, Entamoeba invadens
MMVMFPYDYPIKPPFFLTDPSPEM

SEQ ID NO: 2956535 - protein, 22 aa, Entamoeba invadens
MMWLDQIYLVLFPFSHTTKSII

SEQ ID NO: 2956536 - protein, 19 aa, Entamoeba invadens
MMYDTSWIDKRYCQNTHID

SEQ ID NO: 2956537 - protein, 18 aa, Entamoeba invadens
MMYIRNTIMRVMETDPKK

SEQ ID NO: 2956538 - protein, 24 aa, Entamoeba invadens
MNAEGPMKFSCRQIAQRALTNKRM

SEQ ID NO: 2956539 - protein, 17 aa, Entamoeba invadens
MNAFDYDGRKVGICGEQ

SEQ ID NO: 2956540 - protein, 22 aa, Entamoeba invadens
MNCALPKAMAGGLLKKYDGYTP

SEQ ID NO: 2956541 - protein, 17 aa, Entamoeba invadens
MNCEKRLTAETMLIHPW

SEQ ID NO: 2956542 - protein, 22 aa, Entamoeba invadens
MNCSIHGINFFIHDKRHLIRAS

SEQ ID NO: 2956543 - protein, 18 aa, Entamoeba invadens
MNDFKWNNDGVIFLTTFE

SEQ ID NO: 2956544 - protein, 20 aa, Entamoeba invadens
MNDLRLVWTNGMKYNYPGTL

SEQ ID NO: 2956545 - protein, 17 aa, Entamoeba invadens
MNDTTWKKLTAVAQNCD

SEQ ID NO: 2956546 - protein, 21 aa, Entamoeba invadens
MNEDRASVVISSIKCTQPVFD

SEQ ID NO: 2956547 - protein, 33 aa, Entamoeba invadens
MNEITCIPKYCFHNCYGLEKINMKNCKEIGASA

SEQ ID NO: 2956548 - protein, 17 aa, Entamoeba invadens
MNESTTKYFGMVAENIT

SEQ ID NO: 2956549 - protein, 19 aa, Entamoeba invadens
MNFDLPKLQKFAVDNTTVP

SEQ ID NO: 2956550 - protein, 18 aa, Entamoeba invadens
MNFFKINIWFEVNYQTVL

SEQ ID NO: 2956551 - protein, 26 aa, Entamoeba invadens
MNFLKQRLDALIGFKKRCGYGMKRCV

SEQ ID NO: 2956552 - protein, 23 aa, Entamoeba invadens
MNFPEVLRNLVLVNLPNFARKSL

SEQ ID NO: 2956553 - protein, 17 aa, Entamoeba invadens
MNGIELIKVSSKSGNNI

SEQ ID NO: 2956554 - protein, 22 aa, Entamoeba invadens
MNGKAAECLEMGRESSLKLHQQ

SEQ ID NO: 2956555 - protein, 25 aa, Entamoeba invadens
MNGKCLWSVGGKDIGKGIPFDQFEL

SEQ ID NO: 2956556 - protein, 20 aa, Entamoeba invadens
MNGKELAGKVLRVVVSDPSK

SEQ ID NO: 2956557 - protein, 26 aa, Entamoeba invadens
MNGKMAGKIAVEWDSVCAAITCNEIN

SEQ ID NO: 2956558 - protein, 24 aa, Entamoeba invadens
MNGSEHRLRIGGNFEGTLKNSVFK

SEQ ID NO: 2956559 - protein, 17 aa, Entamoeba invadens
MNGTGLKEGLKWLKKEV

SEQ ID NO: 2956560 - protein, 30 aa, Entamoeba invadens
MNIDAVPELVWKGSVTFTEQGQLCITTVGF

SEQ ID NO: 2956561 - protein, 20 aa, Entamoeba invadens
MNIEALKLSWISGASETQRV

SEQ ID NO: 2956562 - protein, 24 aa, Entamoeba invadens
MNIELRSPFYYSVLGGHCEVCDLL

SEQ ID NO: 2956563 - protein, 17 aa, Entamoeba invadens
MNIGIHYLPLICEEEVQ

SEQ ID NO: 2956564 - protein, 17 aa, Entamoeba invadens
MNISPKFGFSNLVSEIS

SEQ ID NO: 2956565 - protein, 22 aa, Entamoeba invadens
MNKEFVEAVSYMALDKNKPPPP

SEQ ID NO: 2956566 - protein, 20 aa, Entamoeba invadens
MNKIRRHRVISAPETTLHLN

SEQ ID NO: 2956567 - protein, 18 aa, Entamoeba invadens
MNKNQLFALLKASITLDV

SEQ ID NO: 2956568 - protein, 17 aa, Entamoeba invadens
MNKNWKGKIVSKKEAFG

SEQ ID NO: 2956569 - protein, 23 aa, Entamoeba invadens
MNKSDCVKQIFLCEGFFQIFVNV

SEQ ID NO: 2956570 - protein, 24 aa, Entamoeba invadens
MNKSVEMIFNFLVTYIGDAIWFTQ

SEQ ID NO: 2956571 - protein, 21 aa, Entamoeba invadens
MNKVMIRKFCDFEFFEKYKEK

SEQ ID NO: 2956572 - protein, 22 aa, Entamoeba invadens
MNLGSISSFWKKWNGTRSVSEI

SEQ ID NO: 2956573 - protein, 18 aa, Entamoeba invadens
MNLIQGLFHGLMVFKDKF

SEQ ID NO: 2956574 - protein, 25 aa, Entamoeba invadens
MNLLAPKIRCCCITHYHVDHVGMLP

SEQ ID NO: 2956575 - protein, 17 aa, Entamoeba invadens
MNLRYTNNFIYMYDWFK

SEQ ID NO: 2956576 - protein, 19 aa, Entamoeba invadens
MNLTESIIPSSLYDQVVLS

SEQ ID NO: 2956577 - protein, 26 aa, Entamoeba invadens
MNMCALECDCLLCKMQEVIQHNRYIP

SEQ ID NO: 2956578 - protein, 18 aa, Entamoeba invadens
MNMDWKCVDWTDDTDQSL

SEQ ID NO: 2956579 - protein, 19 aa, Entamoeba invadens
MNMINAVSFLKLTNYLTLK

SEQ ID NO: 2956580 - protein, 19 aa, Entamoeba invadens
MNNAVGIMLAMSTINMRIK

SEQ ID NO: 2956581 - protein, 17 aa, Entamoeba invadens
MNNCLIAAFVKTRTTAQ

SEQ ID NO: 2956582 - protein, 18 aa, Entamoeba invadens
MNNIFTISNWKCVDITNL

SEQ ID NO: 2956583 - protein, 19 aa, Entamoeba invadens
MNNLMELWNLMDFTTDGEL

SEQ ID NO: 2956584 - protein, 24 aa, Entamoeba invadens
MNNMGCLTCDIGYYTDGQICFECD

SEQ ID NO: 2956585 - protein, 37 aa, Entamoeba invadens
MNPKCKFSREYTKVCLCSVCGGEMCLSLLQNKYSCFC

SEQ ID NO: 2956586 - protein, 26 aa, Entamoeba invadens
MNPNYAKGYGRLSIVLSKRKDYEKAL

SEQ ID NO: 2956587 - protein, 18 aa, Entamoeba invadens
MNQFGMACEVCLTSNIVS

SEQ ID NO: 2956588 - protein, 26 aa, Entamoeba invadens
MNRDLLDWLFALLIKVSKHKDENKMT

SEQ ID NO: 2956589 - protein, 23 aa, Entamoeba invadens
MNRMVNIAILFECRKSSDIGQTK

SEQ ID NO: 2956590 - protein, 17 aa, Entamoeba invadens
MNRVRMIDIEWVISSIS

SEQ ID NO: 2956591 - protein, 20 aa, Entamoeba invadens
MNSALQCLLHTMPLNEFFNT

SEQ ID NO: 2956592 - protein, 21 aa, Entamoeba invadens
MNSCDVCLSVFAGTISTLINR

SEQ ID NO: 2956593 - protein, 20 aa, Entamoeba invadens
MNSMYELWVLGALNESGALT

SEQ ID NO: 2956594 - protein, 19 aa, Entamoeba invadens
MNSSSCLSVFYSKTHEGKY

SEQ ID NO: 2956595 - protein, 26 aa, Entamoeba invadens
MNSVFFKNYFQIVVCEEIDYKTVTDT

SEQ ID NO: 2956596 - protein, 19 aa, Entamoeba invadens
MNSVLKKEYGWRQVECRMM

SEQ ID NO: 2956597 - protein, 18 aa, Entamoeba invadens
MNTCEVGLKYVFSLLKYA

SEQ ID NO: 2956598 - protein, 17 aa, Entamoeba invadens
MNTFECEALMKFLYNNA

SEQ ID NO: 2956599 - protein, 18 aa, Entamoeba invadens
MNTFRKAQIRDEFESKKD

SEQ ID NO: 2956600 - protein, 25 aa, Entamoeba invadens
MNTLCLKNSIAARDAWVKEDPKREK

SEQ ID NO: 2956601 - protein, 26 aa, Entamoeba invadens
MNTLCLKNSIAAREAWVKEDPKREKQ

SEQ ID NO: 2956602 - protein, 19 aa, Entamoeba invadens
MNTLDCPHGQYVIMDYNKG

SEQ ID NO: 2956603 - protein, 25 aa, Entamoeba invadens
MNTNICYWEYLALIQKYYTFDKKPK

SEQ ID NO: 2956604 - protein, 17 aa, Entamoeba invadens
MNTSVLILGMKSVTIKD

SEQ ID NO: 2956605 - protein, 25 aa, Entamoeba invadens
MNTWNDILCSLAIDAVTVCAGGDLK

SEQ ID NO: 2956606 - protein, 18 aa, Entamoeba invadens
MNVAFRKGQYSSCVNFFE

SEQ ID NO: 2956607 - protein, 20 aa, Entamoeba invadens
MNVASFLLADKERLTKKEEN

SEQ ID NO: 2956608 - protein, 24 aa, Entamoeba invadens
MNVECQYCKALHFKCEASKNKNVK

SEQ ID NO: 2956609 - protein, 18 aa, Entamoeba invadens
MNVGEGVADLYKAADLPL

SEQ ID NO: 2956610 - protein, 26 aa, Entamoeba invadens
MNVKVARNCFENCPNVEFVNIEEYND

SEQ ID NO: 2956611 - protein, 25 aa, Entamoeba invadens
MNVNFPKTVSLFSCNDRPIEATMET

SEQ ID NO: 2956612 - protein, 18 aa, Entamoeba invadens
MNVPNYFAQLLQLSYSSQ

SEQ ID NO: 2956613 - protein, 23 aa, Entamoeba invadens
MNVTCLREGMYLLSSQLKTVTLS

SEQ ID NO: 2956614 - protein, 20 aa, Entamoeba invadens
MNVYYGFGMFYIIKAEEVIV

SEQ ID NO: 2956615 - protein, 19 aa, Entamoeba invadens
MNWLGDWGSQFGLLAIGFE

SEQ ID NO: 2956616 - protein, 18 aa, Entamoeba invadens
MNYIPLIFSISVPLLLQS

SEQ ID NO: 2956617 - protein, 26 aa, Entamoeba invadens
MNYSKVFRVYCYKAKNSFLNSKKVMS

SEQ ID NO: 2956618 - protein, 23 aa, Entamoeba invadens
MPAPKPHVIQSFFHLFDDLKHES

SEQ ID NO: 2956619 - protein, 20 aa, Entamoeba invadens
MPASMKTSVLSREKKRPDKR

SEQ ID NO: 2956620 - protein, 20 aa, Entamoeba invadens
MPDLASFCFDVKKIKSGLLI

SEQ ID NO: 2956621 - protein, 23 aa, Entamoeba invadens
MPDLTDCFSKLKVIMSTHLSSPK

SEQ ID NO: 2956622 - protein, 23 aa, Entamoeba invadens
MPDPEYVNGVAFSVRQHCKISVW

SEQ ID NO: 2956623 - protein, 19 aa, Entamoeba invadens
MPELFRLAFGEVTDDENIE

SEQ ID NO: 2956624 - protein, 21 aa, Entamoeba invadens
MPENFEIRTAVCLETQNYPDS

SEQ ID NO: 2956625 - protein, 26 aa, Entamoeba invadens
MPESIRFENCLVPLRLKKEMDYVSTH

SEQ ID NO: 2956626 - protein, 23 aa, Entamoeba invadens
MPFDEFIKFAVKIERKLQDVKSK

SEQ ID NO: 2956627 - protein, 20 aa, Entamoeba invadens
MPFGKYRGDVTDMFVVTKEE

SEQ ID NO: 2956628 - protein, 20 aa, Entamoeba invadens
MPGELLCGAQSIMEIVKNST

SEQ ID NO: 2956629 - protein, 18 aa, Entamoeba invadens
MPGGFSFGGMPGGMPGGQ

SEQ ID NO: 2956630 - protein, 20 aa, Entamoeba invadens
MPGNVYPISISQVFLQLFRT

SEQ ID NO: 2956631 - protein, 26 aa, Entamoeba invadens
MPHQKIDYFLAVGISRKTSSLWTRRP

SEQ ID NO: 2956632 - protein, 19 aa, Entamoeba invadens
MPHQLRELFVFVCTINNTF

SEQ ID NO: 2956633 - protein, 18 aa, Entamoeba invadens
MPIKNCIENDVLLHPKDL

SEQ ID NO: 2956634 - protein, 19 aa, Entamoeba invadens
MPINAVYSFDGMVFDDNFK

SEQ ID NO: 2956635 - protein, 21 aa, Entamoeba invadens
MPKERILSCLQIPDNCVVDTM

SEQ ID NO: 2956636 - protein, 31 aa, Entamoeba invadens
MPKFECKNIKLKNCQNIEIMVLSGVDIVVEN

SEQ ID NO: 2956637 - protein, 19 aa, Entamoeba invadens
MPKQAEWGLVGNHDVQTSE

SEQ ID NO: 2956638 - protein, 19 aa, Entamoeba invadens
MPKSIERIGYFSFFSCTSL

SEQ ID NO: 2956639 - protein, 22 aa, Entamoeba invadens
MPLLKKFKAVFLPSPQDHTIAK

SEQ ID NO: 2956640 - protein, 25 aa, Entamoeba invadens
MPLRSRSRSLGFFKMEEEPLGANED

SEQ ID NO: 2956641 - protein, 21 aa, Entamoeba invadens
MPLTNICGRVCTRQCEDTCIK

SEQ ID NO: 2956642 - protein, 22 aa, Entamoeba invadens
MPMKGMLWWISYFGFDGICQEL

SEQ ID NO: 2956643 - protein, 21 aa, Entamoeba invadens
MPNEICVMEFNTLNVINTISL

SEQ ID NO: 2956644 - protein, 18 aa, Entamoeba invadens
MPNKYMKVLLFTVKCAGK

SEQ ID NO: 2956645 - protein, 24 aa, Entamoeba invadens
MPNQMPPQMGIQYDQMYPGQMPPQ

SEQ ID NO: 2956646 - protein, 21 aa, Entamoeba invadens
MPPPGTSVVSFIAKLFELVNN

SEQ ID NO: 2956647 - protein, 17 aa, Entamoeba invadens
MPPPPPMPVYQPQSVMD

SEQ ID NO: 2956648 - protein, 25 aa, Entamoeba invadens
MPQIRFRIAQLEFKKKEYKKVEDRL

SEQ ID NO: 2956649 - protein, 25 aa, Entamoeba invadens
MPQTEFKWIYNILDGVSEQENVLFK

SEQ ID NO: 2956650 - protein, 22 aa, Entamoeba invadens
MPSCVLPKIKSVFIDPFNFFRL

SEQ ID NO: 2956651 - protein, 26 aa, Entamoeba invadens
MPSCVLPKIKSVFIDPFNFFRLRVDQ

SEQ ID NO: 2956652 - protein, 17 aa, Entamoeba invadens
MPSLFMMLPKGFYEERV

SEQ ID NO: 2956653 - protein, 27 aa, Entamoeba invadens
MPSSIKSIGEWCFCFCDSLSSVTIPSS

SEQ ID NO: 2956654 - protein, 23 aa, Entamoeba invadens
MPTNARLLLVGWDGFSILESTWV

SEQ ID NO: 2956655 - protein, 25 aa, Entamoeba invadens
MPTSLPFPVNFKYVLFSTLKPIERL

SEQ ID NO: 2956656 - protein, 18 aa, Entamoeba invadens
MPTYTRPSSSKPYRQVTP

SEQ ID NO: 2956657 - protein, 18 aa, Entamoeba invadens
MPVFLIFFPHINTLYYNI

SEQ ID NO: 2956658 - protein, 26 aa, Entamoeba invadens
MPVINLEFYSSYLLIVTPMRILLIQN

SEQ ID NO: 2956659 - protein, 25 aa, Entamoeba invadens
MPVQRLPRYKLLLQELLKNTENTHE

SEQ ID NO: 2956660 - protein, 24 aa, Entamoeba invadens
MPVQRLPRYNLLLTDLLKNTPQDH

SEQ ID NO: 2956661 - protein, 25 aa, Entamoeba invadens
MPVQRVPRYRMLLEDLLKHTEDSYQ

SEQ ID NO: 2956662 - protein, 24 aa, Entamoeba invadens
MPVVKKLMKQICEKYKKDGKPRVN

SEQ ID NO: 2956663 - protein, 22 aa, Entamoeba invadens
MPWSNKTLLHFGAVDYECTIFL

SEQ ID NO: 2956664 - protein, 17 aa, Entamoeba invadens
MQAGWVPKNAFGNHILK

SEQ ID NO: 2956665 - protein, 25 aa, Entamoeba invadens
MQALNEWAKDVGVVLRKGSGNNKSM

SEQ ID NO: 2956666 - protein, 23 aa, Entamoeba invadens
MQCDPRYVSIVKFGTLSYTDDIG

SEQ ID NO: 2956667 - protein, 21 aa, Entamoeba invadens
MQDEFRTPEEIVGNMINSIAK

SEQ ID NO: 2956668 - protein, 19 aa, Entamoeba invadens
MQDFQYKALNSFNNTVSMY

SEQ ID NO: 2956669 - protein, 21 aa, Entamoeba invadens
MQDGCVTCYNLLKSNKLSEQQ

SEQ ID NO: 2956670 - protein, 17 aa, Entamoeba invadens
MQDKWICDNNIIKLKND

SEQ ID NO: 2956671 - protein, 17 aa, Entamoeba invadens
MQDVLSLKAKYIEGRDP

SEQ ID NO: 2956672 - protein, 24 aa, Entamoeba invadens
MQECYDHFEEAWKTANDLYALSSI

SEQ ID NO: 2956673 - protein, 22 aa, Entamoeba invadens
MQENMFRMCCALQRVYVTENME

SEQ ID NO: 2956674 - protein, 18 aa, Entamoeba invadens
MQINKNAIPSAFVPVQCL

SEQ ID NO: 2956675 - protein, 20 aa, Entamoeba invadens
MQIPSVLPLKSTQMEEEKID

SEQ ID NO: 2956676 - protein, 21 aa, Entamoeba invadens
MQKGIRGFQMIINKNHNNELI

SEQ ID NO: 2956677 - protein, 24 aa, Entamoeba invadens
MQKRRELREAGVMVGSLKKQKGPD

SEQ ID NO: 2956678 - protein, 17 aa, Entamoeba invadens
MQKVMKLQETFGPMMSQ

SEQ ID NO: 2956679 - protein, 21 aa, Entamoeba invadens
MQKVREMELQYGIPSSTNLHI

SEQ ID NO: 2956680 - protein, 20 aa, Entamoeba invadens
MQKYKVLEAMQLKVYPELLN

SEQ ID NO: 2956681 - protein, 18 aa, Entamoeba invadens
MQLAALKTARTEQVSTHE

SEQ ID NO: 2956682 - protein, 18 aa, Entamoeba invadens
MQLADAYCRPEYVEDIKT

SEQ ID NO: 2956683 - protein, 18 aa, Entamoeba invadens
MQLKEGQCYLPFLQGLTG

SEQ ID NO: 2956684 - protein, 17 aa, Entamoeba invadens
MQLLCFFLENNGFVACV

SEQ ID NO: 2956685 - protein, 20 aa, Entamoeba invadens
MQLLKVLKYFPSAKCLQCDT

SEQ ID NO: 2956686 - protein, 25 aa, Entamoeba invadens
MQLSPEFKNSVFLVASNFNAVESVS

SEQ ID NO: 2956687 - protein, 25 aa, Entamoeba invadens
MQLTPEFKNSVFLVASNFNAVESVS

SEQ ID NO: 2956688 - protein, 17 aa, Entamoeba invadens
MQLYSAVIDVGRVDFTV

SEQ ID NO: 2956689 - protein, 24 aa, Entamoeba invadens
MQMMSETYVSVVIENAMKSADQSS

SEQ ID NO: 2956690 - protein, 20 aa, Entamoeba invadens
MQNGYCKKGDNCTFSHDVST

SEQ ID NO: 2956691 - protein, 17 aa, Entamoeba invadens
MQNSFGAIGPMRSCEPD

SEQ ID NO: 2956692 - protein, 39 aa, Entamoeba invadens
MQQEMTCGWLMKEGGSWKSWKRRYFDLVEDNLSYYKDEA

SEQ ID NO: 2956693 - protein, 27 aa, Entamoeba invadens
MQQRRLKTLSMCWVKGNIPVVLTHVRQ

SEQ ID NO: 2956694 - protein, 17 aa, Entamoeba invadens
MQQSKCCQICFKPIENP

SEQ ID NO: 2956695 - protein, 17 aa, Entamoeba invadens
MQQTFGLEIETFTKGNV

SEQ ID NO: 2956696 - protein, 22 aa, Entamoeba invadens
MQREVYDIAVFFSAGFDREEAQ

SEQ ID NO: 2956697 - protein, 18 aa, Entamoeba invadens
MQRKVWISVGDVVLVSLR

SEQ ID NO: 2956698 - protein, 28 aa, Entamoeba invadens
MQRVIRGFLTRRVCTFKMISKRKKVFNE

SEQ ID NO: 2956699 - protein, 26 aa, Entamoeba invadens
MQSAWKEGKMELAWMFFNKAKDLVKD

SEQ ID NO: 2956700 - protein, 23 aa, Entamoeba invadens
MQSLTIPQAIRFTDYSSSIKILN

SEQ ID NO: 2956701 - protein, 19 aa, Entamoeba invadens
MQSVQILNCKYRLCAFAFS

SEQ ID NO: 2956702 - protein, 26 aa, Entamoeba invadens
MQSVQILNCKYRLCAFAFSNCKLLKS

SEQ ID NO: 2956703 - protein, 17 aa, Entamoeba invadens
MQTKIIGVIGEITEQIV

SEQ ID NO: 2956704 - protein, 23 aa, Entamoeba invadens
MQTKPRVGLSMTLKELSRQTFQT

SEQ ID NO: 2956705 - protein, 25 aa, Entamoeba invadens
MQTYLFDFCEQLGFVFDSKRSKQSN

SEQ ID NO: 2956706 - protein, 25 aa, Entamoeba invadens
MQWAYCVRTRLFLFKTNETLEHAYD

SEQ ID NO: 2956707 - protein, 21 aa, Entamoeba invadens
MQYLKCLIKKNMFTEVLEINN

SEQ ID NO: 2956708 - protein, 25 aa, Entamoeba invadens
MRDIPEFDSLFVFSCDHCERSSKSE

SEQ ID NO: 2956709 - protein, 23 aa, Entamoeba invadens
MREKEKRSNEEIAKKNENNEQLQ

SEQ ID NO: 2956710 - protein, 23 aa, Entamoeba invadens
MREKGVVGVAEFVLMKSYNVRNM

SEQ ID NO: 2956711 - protein, 21 aa, Entamoeba invadens
MREMCGTFPQCFWAEPSKFFT

SEQ ID NO: 2956712 - protein, 27 aa, Entamoeba invadens
MRERGGKKCICVLCNDRYYIEDGESLL

SEQ ID NO: 2956713 - protein, 19 aa, Entamoeba invadens
MRFKQMYTPHLLEEETRAK

SEQ ID NO: 2956714 - protein, 18 aa, Entamoeba invadens
MRFLFLLELAHWYYMDNW

SEQ ID NO: 2956715 - protein, 18 aa, Entamoeba invadens
MRGGGGVDGCIHDAAGDE

SEQ ID NO: 2956716 - protein, 18 aa, Entamoeba invadens
MRGYTVLHYAVFMNNTSF

SEQ ID NO: 2956717 - protein, 19 aa, Entamoeba invadens
MRHATMWRNAIKELNKKRA

SEQ ID NO: 2956718 - protein, 18 aa, Entamoeba invadens
MRHDARISSTFGNKMIGM

SEQ ID NO: 2956719 - protein, 17 aa, Entamoeba invadens
MRIENYIDKQNMTSSQI

SEQ ID NO: 2956720 - protein, 19 aa, Entamoeba invadens
MRIGEYFYNIFMSNAVQQY

SEQ ID NO: 2956721 - protein, 20 aa, Entamoeba invadens
MRIKSIDFGDGEVLVLTEFL

SEQ ID NO: 2956722 - protein, 24 aa, Entamoeba invadens
MRIRKTALDFLKFCKLMNLTERES

SEQ ID NO: 2956723 - protein, 22 aa, Entamoeba invadens
MRISSDYLVNGFLCVQYSLNEY

SEQ ID NO: 2956724 - protein, 18 aa, Entamoeba invadens
MRITLRAMKEQRLYFLKC

SEQ ID NO: 2956725 - protein, 19 aa, Entamoeba invadens
MRIYIPYITSRFIYRSEVV

SEQ ID NO: 2956726 - protein, 20 aa, Entamoeba invadens
MRKANPFIRTMCVVDFTEDD

SEQ ID NO: 2956727 - protein, 22 aa, Entamoeba invadens
MRKDYASLVILRALRETTKKHN

SEQ ID NO: 2956728 - protein, 23 aa, Entamoeba invadens
MRKEFRINEQLRREKMKEMLKSV

SEQ ID NO: 2956729 - protein, 19 aa, Entamoeba invadens
MRKELYRIEMVLSELEVPP

SEQ ID NO: 2956730 - protein, 24 aa, Entamoeba invadens
MRKHLKLCKYFRAQYSIDPNDKPI

SEQ ID NO: 2956731 - protein, 23 aa, Entamoeba invadens
MRKKVDCRIFIVSLKEVFEFGTK

SEQ ID NO: 2956732 - protein, 17 aa, Entamoeba invadens
MRKLAMAMRKLREEEEV

SEQ ID NO: 2956733 - protein, 17 aa, Entamoeba invadens
MRLCVHPNVVAFHEYIS

SEQ ID NO: 2956734 - protein, 18 aa, Entamoeba invadens
MRLEGVKLYDGLLYFKDD

SEQ ID NO: 2956735 - protein, 21 aa, Entamoeba invadens
MRLKERFKRTFSGGLKIVELL

SEQ ID NO: 2956736 - protein, 17 aa, Entamoeba invadens
MRLKKFHASQTIKFSFD

SEQ ID NO: 2956737 - protein, 25 aa, Entamoeba invadens
MRLLQDFISELGFLVVVENETVEGY

SEQ ID NO: 2956738 - protein, 24 aa, Entamoeba invadens
MRLSHGCPVCMASKVGVLKTVYDS

SEQ ID NO: 2956739 - protein, 20 aa, Entamoeba invadens
MRLYCKFYFCQDVRILKEGQ

SEQ ID NO: 2956740 - protein, 19 aa, Entamoeba invadens
MRLYQYICNSFLASLYKDA

SEQ ID NO: 2956741 - protein, 17 aa, Entamoeba invadens
MRMDKFRIFGASTLFVY

SEQ ID NO: 2956742 - protein, 17 aa, Entamoeba invadens
MRMNISPKFGFSNLVSE

SEQ ID NO: 2956743 - protein, 19 aa, Entamoeba invadens
MRMNNIFAFILTHTKTIFP

SEQ ID NO: 2956744 - protein, 27 aa, Entamoeba invadens
MRNEGKYIWKFGQFEVESIRDLTLGID

SEQ ID NO: 2956745 - protein, 17 aa, Entamoeba invadens
MRNFGYFPICASGTSAA

SEQ ID NO: 2956746 - protein, 17 aa, Entamoeba invadens
MRNRNNLTFTFQKKADL

SEQ ID NO: 2956747 - protein, 28 aa, Entamoeba invadens
MRNVIYKMCEIFAIKIRILMKFLESQNA

SEQ ID NO: 2956748 - protein, 19 aa, Entamoeba invadens
MRPFIPCSLGIGIEKDQIV

SEQ ID NO: 2956749 - protein, 29 aa, Entamoeba invadens
MRPLSYPGTHCFLICFSIISRASFENVEY

SEQ ID NO: 2956750 - protein, 18 aa, Entamoeba invadens
MRPPRYCPGQVIQFNLYN

SEQ ID NO: 2956751 - protein, 22 aa, Entamoeba invadens
MRPSLPRITYSFTVNEEADKKE

SEQ ID NO: 2956752 - protein, 26 aa, Entamoeba invadens
MRQDEVFKMIAQWIVLIKTKAQSASE

SEQ ID NO: 2956753 - protein, 19 aa, Entamoeba invadens
MRQKQCCDEISSLESGFQN

SEQ ID NO: 2956754 - protein, 26 aa, Entamoeba invadens
MRQKVSFLEIIPIYKQMNAELESLIQ

SEQ ID NO: 2956755 - protein, 22 aa, Entamoeba invadens
MRQSEFFMRISAMVQPTLEIVF

SEQ ID NO: 2956756 - protein, 17 aa, Entamoeba invadens
MRRGLDMVSYENQQRLI

SEQ ID NO: 2956757 - protein, 22 aa, Entamoeba invadens
MRRHLNHCRFYLAENKQTLAKP

SEQ ID NO: 2956758 - protein, 22 aa, Entamoeba invadens
MRRKVIPMLKMNGGRLLTNRVS

SEQ ID NO: 2956759 - protein, 25 aa, Entamoeba invadens
MRRMSVSVKQRYKVVESKGRPSQSI

SEQ ID NO: 2956760 - protein, 25 aa, Entamoeba invadens
MRRNAGVLVCLVALCFFFDDKIDKK

SEQ ID NO: 2956761 - protein, 25 aa, Entamoeba invadens
MRRSRRMSECLVVCLAEGMNDDKEI

SEQ ID NO: 2956762 - protein, 19 aa, Entamoeba invadens
MRRVLKRLGYVSEDDIIQV

SEQ ID NO: 2956763 - protein, 21 aa, Entamoeba invadens
MRRVPGCHISHIVGRLEDQPE

SEQ ID NO: 2956764 - protein, 17 aa, Entamoeba invadens
MRRVSTFNTFYILEDCK

SEQ ID NO: 2956765 - protein, 17 aa, Entamoeba invadens
MRSICGDGNLTPPNIGA

SEQ ID NO: 2956766 - protein, 23 aa, Entamoeba invadens
MRSVYKYLPYVKNYFIVTADQVP

SEQ ID NO: 2956767 - protein, 18 aa, Entamoeba invadens
MRTDEEIFLAFVGGMMEG

SEQ ID NO: 2956768 - protein, 25 aa, Entamoeba invadens
MRTKCAMSLKHIRELIATLSQMLRE

SEQ ID NO: 2956769 - protein, 18 aa, Entamoeba invadens
MRTLHFFVWKRYTLPNNK

SEQ ID NO: 2956770 - protein, 17 aa, Entamoeba invadens
MRTTLLASIEKAIQAEN

SEQ ID NO: 2956771 - protein, 19 aa, Entamoeba invadens
MRVGNILIICPLTLISHWV

SEQ ID NO: 2956772 - protein, 18 aa, Entamoeba invadens
MRVPLCSRSKDVIEPRVK

SEQ ID NO: 2956773 - protein, 18 aa, Entamoeba invadens
MRVPLMNVPVNFDITVSV

SEQ ID NO: 2956774 - protein, 19 aa, Entamoeba invadens
MRYLIAFLAAMILEVECSV

SEQ ID NO: 2956775 - protein, 23 aa, Entamoeba invadens
MSALKRKMLQILSSFLKMEHYSD

SEQ ID NO: 2956776 - protein, 19 aa, Entamoeba invadens
MSALLRERLFLASDRYQVY

SEQ ID NO: 2956777 - protein, 17 aa, Entamoeba invadens
MSALLVQIEYYFCDLNI

SEQ ID NO: 2956778 - protein, 25 aa, Entamoeba invadens
MSAPWEMRYSLPLCEKYKQMLTDIA

SEQ ID NO: 2956779 - protein, 24 aa, Entamoeba invadens
MSARLVQMPIHFIEYCPNRTILVG

SEQ ID NO: 2956780 - protein, 18 aa, Entamoeba invadens
MSCEVLITLLCMKVNDPK

SEQ ID NO: 2956781 - protein, 26 aa, Entamoeba invadens
MSCMNRFKLLVTYLRDSYGCKMIKNT

SEQ ID NO: 2956782 - protein, 26 aa, Entamoeba invadens
MSCVTRTEFIGGLELLKKGKVSDSVL

SEQ ID NO: 2956783 - protein, 17 aa, Entamoeba invadens
MSDHFFANVTLSLCPKI

SEQ ID NO: 2956784 - protein, 27 aa, Entamoeba invadens
MSDILLPKSLCLFGHQCFVFCAQLSTI

SEQ ID NO: 2956785 - protein, 23 aa, Entamoeba invadens
MSDKGLCCIDEFDKMTEMTRSVL

SEQ ID NO: 2956786 - protein, 18 aa, Entamoeba invadens
MSDLKTILNNVGKVVDMK

SEQ ID NO: 2956787 - protein, 18 aa, Entamoeba invadens
MSDLLCFDGGSSNLIGTT

SEQ ID NO: 2956788 - protein, 19 aa, Entamoeba invadens
MSDLLKLVINFITDQNGLV

SEQ ID NO: 2956789 - protein, 17 aa, Entamoeba invadens
MSECVKLSEVVLPETVV

SEQ ID NO: 2956790 - protein, 24 aa, Entamoeba invadens
MSEECMRLAFLIGYLNVKGVGFML

SEQ ID NO: 2956791 - protein, 20 aa, Entamoeba invadens
MSEFKKKYGGTLTIPEFTVC

SEQ ID NO: 2956792 - protein, 22 aa, Entamoeba invadens
MSEILKNVVISGVSKLTVCDTF

SEQ ID NO: 2956793 - protein, 20 aa, Entamoeba invadens
MSELLEFLNYFYKFSEDKGD

SEQ ID NO: 2956794 - protein, 22 aa, Entamoeba invadens
MSELRIPENLFLESRTCSLVNS

SEQ ID NO: 2956795 - protein, 26 aa, Entamoeba invadens
MSFFEFSHFCFFKIRQSEDVKISNLV

SEQ ID NO: 2956796 - protein, 17 aa, Entamoeba invadens
MSFKKGEAVIVVGQPEN

SEQ ID NO: 2956797 - protein, 20 aa, Entamoeba invadens
MSFYGKYIVLSPHIESLIVS

SEQ ID NO: 2956798 - protein, 17 aa, Entamoeba invadens
MSGLIGWVPHSDTFHQL

SEQ ID NO: 2956799 - protein, 25 aa, Entamoeba invadens
MSGVGKSRIKIRFVQGHFVEVYDPV

SEQ ID NO: 2956800 - protein, 22 aa, Entamoeba invadens
MSIGPLLNVYFVFDFDLTLLAQ

SEQ ID NO: 2956801 - protein, 25 aa, Entamoeba invadens
MSIMGSSCGKCCQVAHPTNLKTREV

SEQ ID NO: 2956802 - protein, 24 aa, Entamoeba invadens
MSIRGFKGVKAMEIRQRVVEDEER

SEQ ID NO: 2956803 - protein, 23 aa, Entamoeba invadens
MSISRCSLLRAFSALAEQFLAQI

SEQ ID NO: 2956804 - protein, 41 aa, Entamoeba invadens
MSIVLKLLYFKSDVVYKWLKRYADHLLELTLFAQAKTKTPE

SEQ ID NO: 2956805 - protein, 18 aa, Entamoeba invadens
MSKCFKGEQTGLVPTSNL

SEQ ID NO: 2956806 - protein, 24 aa, Entamoeba invadens
MSKDKTRCLVKWQKLGYNEATWEN

SEQ ID NO: 2956807 - protein, 18 aa, Entamoeba invadens
MSKEAGAYIVLQERATPK

SEQ ID NO: 2956808 - protein, 19 aa, Entamoeba invadens
MSKHNCLYSSLTLSLVNAI

SEQ ID NO: 2956809 - protein, 18 aa, Entamoeba invadens
MSKIFNYVASDTVIRYAK

SEQ ID NO: 2956810 - protein, 18 aa, Entamoeba invadens
MSKILLNLIKSFREVTKK

SEQ ID NO: 2956811 - protein, 22 aa, Entamoeba invadens
MSKKCICGKIDEMIMAFYSRNL

SEQ ID NO: 2956812 - protein, 24 aa, Entamoeba invadens
MSKKSKRGFQLERLKHVFFNNQFI

SEQ ID NO: 2956813 - protein, 42 aa, Entamoeba invadens
MSKLRMMLTKIPFFKEVTIFAFSCDNCGFKTNEIKCGGEVSQ

SEQ ID NO: 2956814 - protein, 21 aa, Entamoeba invadens
MSKQLCDAQKIKSESEQYANE

SEQ ID NO: 2956815 - protein, 18 aa, Entamoeba invadens
MSKREYTQFMKIYSPKIV

SEQ ID NO: 2956816 - protein, 23 aa, Entamoeba invadens
MSKTCTAQKIFARHNQIASIDSS

SEQ ID NO: 2956817 - protein, 21 aa, Entamoeba invadens
MSKTEFRCYLKALKGRGEPLC

SEQ ID NO: 2956818 - protein, 21 aa, Entamoeba invadens
MSKTIWASIVLNIDLFKQESV

SEQ ID NO: 2956819 - protein, 22 aa, Entamoeba invadens
MSLADVFHNFAFNRPFMDYSMC

SEQ ID NO: 2956820 - protein, 19 aa, Entamoeba invadens
MSLEKMCLQGNKVVSTDVK

SEQ ID NO: 2956821 - protein, 18 aa, Entamoeba invadens
MSLLVGLLHKLCFNDESV

SEQ ID NO: 2956822 - protein, 21 aa, Entamoeba invadens
MSLYRKFTCETVVTILGFTVT

SEQ ID NO: 2956823 - protein, 18 aa, Entamoeba invadens
MSMCALKCSDNWGTVSKS

SEQ ID NO: 2956824 - protein, 25 aa, Entamoeba invadens
MSMFFQCLSGLFKVDVKIEADQLYY

SEQ ID NO: 2956825 - protein, 17 aa, Entamoeba invadens
MSMLLSNIRDWFDPSYD

SEQ ID NO: 2956826 - protein, 19 aa, Entamoeba invadens
MSMMARLDVAPGCVTNEFQ

SEQ ID NO: 2956827 - protein, 22 aa, Entamoeba invadens
MSNAKLIFDSRVDEIDSRNLNS

SEQ ID NO: 2956828 - protein, 25 aa, Entamoeba invadens
MSNLRKGLQHNGIKLVLSGVFECQS

SEQ ID NO: 2956829 - protein, 20 aa, Entamoeba invadens
MSNLRVGVQILAAANKQAIA

SEQ ID NO: 2956830 - protein, 22 aa, Entamoeba invadens
MSNMVYCGVSFDENVASVVDKQ

SEQ ID NO: 2956831 - protein, 17 aa, Entamoeba invadens
MSNPLGAQTGINPNVHY

SEQ ID NO: 2956832 - protein, 24 aa, Entamoeba invadens
MSNWKPPKNWLKTRANEVKKQKTE

SEQ ID NO: 2956833 - protein, 20 aa, Entamoeba invadens
MSPELFGIIQKCWKQSQHER

SEQ ID NO: 2956834 - protein, 27 aa, Entamoeba invadens
MSQASGIWQQLSSSLIKSHASKNPPEN

SEQ ID NO: 2956835 - protein, 19 aa, Entamoeba invadens
MSQIFLHFNDVFYINSVLL

SEQ ID NO: 2956836 - protein, 20 aa, Entamoeba invadens
MSQMCNNLTLLKCSNDDERT

SEQ ID NO: 2956837 - protein, 21 aa, Entamoeba invadens
MSQMKILFFIVYSFVTHTERA

SEQ ID NO: 2956838 - protein, 20 aa, Entamoeba invadens
MSQSKYTALTLFDNSVDTFI

SEQ ID NO: 2956839 - protein, 25 aa, Entamoeba invadens
MSRESFQHLGYWIDRVRSVEPDVFI

SEQ ID NO: 2956840 - protein, 17 aa, Entamoeba invadens
MSRRAKYMYGCYDQHAI

SEQ ID NO: 2956841 - protein, 23 aa, Entamoeba invadens
MSRVYYSGSLGALIMCDVTKMNT

SEQ ID NO: 2956842 - protein, 19 aa, Entamoeba invadens
MSSCLECNKSYLLVDNSLK

SEQ ID NO: 2956843 - protein, 19 aa, Entamoeba invadens
MSSFMRKEGLSVLENYINP

SEQ ID NO: 2956844 - protein, 18 aa, Entamoeba invadens
MSSIFGRDNLMLVNETES

SEQ ID NO: 2956845 - protein, 20 aa, Entamoeba invadens
MSSLEFPSKVEFLGDNMFYC

SEQ ID NO: 2956846 - protein, 18 aa, Entamoeba invadens
MSSLKVRPMFDCIVTDPP

SEQ ID NO: 2956847 - protein, 23 aa, Entamoeba invadens
MSSSPIIDRLIYLRVLIERTKPI

SEQ ID NO: 2956848 - protein, 24 aa, Entamoeba invadens
MSSVKFSGLCFCRSSIERASKVQY

SEQ ID NO: 2956849 - protein, 28 aa, Entamoeba invadens
MSSYEKALCCAMFFCKKSGGVISVGELF

SEQ ID NO: 2956850 - protein, 27 aa, Entamoeba invadens
MSTCVAVGLIRRSECDYTVSIQNIEEF

SEQ ID NO: 2956851 - protein, 22 aa, Entamoeba invadens
MSTDSLLVLLSFAGVDPSKRDS

SEQ ID NO: 2956852 - protein, 19 aa, Entamoeba invadens
MSTELLITLLCMKYNTPTT

SEQ ID NO: 2956853 - protein, 18 aa, Entamoeba invadens
MSTELYNTVDIGSKTEIL

SEQ ID NO: 2956854 - protein, 31 aa, Entamoeba invadens
MSTRMWASVVARPSLKIKHVYQHSQVTLPKF

SEQ ID NO: 2956855 - protein, 17 aa, Entamoeba invadens
MSTRYGFDAFYFNVQNS

SEQ ID NO: 2956856 - protein, 17 aa, Entamoeba invadens
MSTYIVAFVSGEFTSYT

SEQ ID NO: 2956857 - protein, 20 aa, Entamoeba invadens
MSVCSYKFGVLYCQSNQSNE

SEQ ID NO: 2956858 - protein, 21 aa, Entamoeba invadens
MSVFVDCNFVFDEDRNKGFVE

SEQ ID NO: 2956859 - protein, 22 aa, Entamoeba invadens
MSVKFLGRIPLDPVIARSCDVG

SEQ ID NO: 2956860 - protein, 24 aa, Entamoeba invadens
MSVKGKSKMAGTVVLMSDVLLVLS

SEQ ID NO: 2956861 - protein, 24 aa, Entamoeba invadens
MSVLPPRSKECVPMLFRDIMNSTT

SEQ ID NO: 2956862 - protein, 23 aa, Entamoeba invadens
MSVLPPSFVFEVMRSNIVKKEKK

SEQ ID NO: 2956863 - protein, 27 aa, Entamoeba invadens
MSVTKIGYKCFTGCPLDGEKVFKIPKN

SEQ ID NO: 2956864 - protein, 19 aa, Entamoeba invadens
MSWAIPVVNGVVYKEISEK

SEQ ID NO: 2956865 - protein, 18 aa, Entamoeba invadens
MSYEVLSVHGNYIKATTR

SEQ ID NO: 2956866 - protein, 20 aa, Entamoeba invadens
MSYLHFLYIQFERPYSQLFE

SEQ ID NO: 2956867 - protein, 17 aa, Entamoeba invadens
MSYVTSMECCISGYITK

SEQ ID NO: 2956868 - protein, 24 aa, Entamoeba invadens
MTAGYYRGCHGIIVMFDVTNRDSF

SEQ ID NO: 2956869 - protein, 21 aa, Entamoeba invadens
MTAMSFCPGKLSTALEMKQKP

SEQ ID NO: 2956870 - protein, 18 aa, Entamoeba invadens
MTAVEIKNGNFCLNVLPE

SEQ ID NO: 2956871 - protein, 18 aa, Entamoeba invadens
MTCGFCGDTVRYKKMFDY

SEQ ID NO: 2956872 - protein, 24 aa, Entamoeba invadens
MTDAAMLRKVIITMIEKYNDVFMD

SEQ ID NO: 2956873 - protein, 21 aa, Entamoeba invadens
MTDILCKWSSSQQCRIIYTTE

SEQ ID NO: 2956874 - protein, 28 aa, Entamoeba invadens
MTDKIGSSNFFWAFPSASIVERRTECEN

SEQ ID NO: 2956875 - protein, 21 aa, Entamoeba invadens
MTEKMVFPSIIPDQLKRLVSN

SEQ ID NO: 2956876 - protein, 23 aa, Entamoeba invadens
MTEKRMLVRRVKLLSKEDLQMCI

SEQ ID NO: 2956877 - protein, 17 aa, Entamoeba invadens
MTFGLDVVDQFKINEIT

SEQ ID NO: 2956878 - protein, 26 aa, Entamoeba invadens
MTFLKNWKIAGKMGSQEYLYIIGDSD

SEQ ID NO: 2956879 - protein, 26 aa, Entamoeba invadens
MTFSFIKERHQYFLVPDYYFVDVKQT

SEQ ID NO: 2956880 - protein, 19 aa, Entamoeba invadens
MTFTKRIGTPVYMAPEVLQ

SEQ ID NO: 2956881 - protein, 17 aa, Entamoeba invadens
MTHGDAFVCDRATLDKY

SEQ ID NO: 2956882 - protein, 19 aa, Entamoeba invadens
MTHIFGFERECTWKYDSGV

SEQ ID NO: 2956883 - protein, 26 aa, Entamoeba invadens
MTHRSELRSVFNIKKLHIGHICKSFG

SEQ ID NO: 2956884 - protein, 22 aa, Entamoeba invadens
MTHSRFRNVYGYFREIIEYVKT

SEQ ID NO: 2956885 - protein, 25 aa, Entamoeba invadens
MTIEMPLPHYMIFKEGETVMNDVAK

SEQ ID NO: 2956886 - protein, 23 aa, Entamoeba invadens
MTIIANQAWIVMKIVDENWIIGK

SEQ ID NO: 2956887 - protein, 26 aa, Entamoeba invadens
MTIIREIIYRNGMRVALINRNENTLQ

SEQ ID NO: 2956888 - protein, 18 aa, Entamoeba invadens
MTIRVGACGLNITGASRV

SEQ ID NO: 2956889 - protein, 19 aa, Entamoeba invadens
MTKAIKILGMLASVEIRLA

SEQ ID NO: 2956890 - protein, 26 aa, Entamoeba invadens
MTKDLNEKRGLCELLEEYKKRWKGEW

SEQ ID NO: 2956891 - protein, 20 aa, Entamoeba invadens
MTKEDFAYFINVCDKCLEIR

SEQ ID NO: 2956892 - protein, 26 aa, Entamoeba invadens
MTKEIWKYKRSYLVYCQDSEIINFYD

SEQ ID NO: 2956893 - protein, 19 aa, Entamoeba invadens
MTKHWKKRIMMTMADCLSS

SEQ ID NO: 2956894 - protein, 17 aa, Entamoeba invadens
MTKMTLFEMFKRRCDLW

SEQ ID NO: 2956895 - protein, 32 aa, Entamoeba invadens
MTKNEIDFMFCWRSIALLFKREFKKEDVLRIW

SEQ ID NO: 2956896 - protein, 28 aa, Entamoeba invadens
MTKQRVVPIVLHFSYLFKETVLSIECEK

SEQ ID NO: 2956897 - protein, 23 aa, Entamoeba invadens
MTKVPRKMKSMCCDINCTESYLI

SEQ ID NO: 2956898 - protein, 24 aa, Entamoeba invadens
MTLECVSRMVMFYELECKKVEGFE

SEQ ID NO: 2956899 - protein, 27 aa, Entamoeba invadens
MTLFEMFKRRCDLWPEEFCLSYRKKDE

SEQ ID NO: 2956900 - protein, 26 aa, Entamoeba invadens
MTLIGRKAFRMCAFKNFTVEKNVFID

SEQ ID NO: 2956901 - protein, 19 aa, Entamoeba invadens
MTLLSYGMLNFDDLYAVIQ

SEQ ID NO: 2956902 - protein, 23 aa, Entamoeba invadens
MTLNDLIRLCWGVMTVSDFTSRR

SEQ ID NO: 2956903 - protein, 40 aa, Entamoeba invadens
MTLNRISYLTIRCGPTSFLKGEIFFKSSITLKALKDKEKS

SEQ ID NO: 2956904 - protein, 22 aa, Entamoeba invadens
MTLQLKSLVSLGQHFHEFNDPK

SEQ ID NO: 2956905 - protein, 23 aa, Entamoeba invadens
MTLVECPNDIEGMLDCAKIADVA

SEQ ID NO: 2956906 - protein, 18 aa, Entamoeba invadens
MTMIHIFTNEVPYKDLSN

SEQ ID NO: 2956907 - protein, 20 aa, Entamoeba invadens
MTMKIEWTKKSKWKNIKLIQ

SEQ ID NO: 2956908 - protein, 19 aa, Entamoeba invadens
MTMTYGFHTECQWKYNELI

SEQ ID NO: 2956909 - protein, 18 aa, Entamoeba invadens
MTMWELFYCKNLLTEFMK

SEQ ID NO: 2956910 - protein, 26 aa, Entamoeba invadens
MTMYEVFEWKEAYAREQFKYPWAIAE

SEQ ID NO: 2956911 - protein, 23 aa, Entamoeba invadens
MTMYEVLQWDFVFKKDDERFLHV

SEQ ID NO: 2956912 - protein, 18 aa, Entamoeba invadens
MTMYHMFTNEIPYKDLSN

SEQ ID NO: 2956913 - protein, 19 aa, Entamoeba invadens
MTNCPMLVIPQEDRIKFVY

SEQ ID NO: 2956914 - protein, 18 aa, Entamoeba invadens
MTNFDMILTTGFSRNAER

SEQ ID NO: 2956915 - protein, 21 aa, Entamoeba invadens
MTNKICLVTEFALYGSLQDLM

SEQ ID NO: 2956916 - protein, 17 aa, Entamoeba invadens
MTNMLVIEFSKGTVKKQ

SEQ ID NO: 2956917 - protein, 23 aa, Entamoeba invadens
MTNQFCLRQCAFQHLPREFERLK

SEQ ID NO: 2956918 - protein, 17 aa, Entamoeba invadens
MTNQWLITIESALKRFG

SEQ ID NO: 2956919 - protein, 25 aa, Entamoeba invadens
MTNSIYGCLGFKGGRFYCQKIAEWI

SEQ ID NO: 2956920 - protein, 23 aa, Entamoeba invadens
MTNVLKIGKKCFFRCSKLPSVMF

SEQ ID NO: 2956921 - protein, 24 aa, Entamoeba invadens
MTPDMKRTWAMEKVRINAEDLRPE

SEQ ID NO: 2956922 - protein, 18 aa, Entamoeba invadens
MTPDRFKRRSAIPQMIGE

SEQ ID NO: 2956923 - protein, 17 aa, Entamoeba invadens
MTPHFGCFCDPNIMLRN

SEQ ID NO: 2956924 - protein, 28 aa, Entamoeba invadens
MTPKAKVVFMNAFIKFLVKFNKDLSFFS

SEQ ID NO: 2956925 - protein, 18 aa, Entamoeba invadens
MTPTADAIFLDWYPSDLE

SEQ ID NO: 2956926 - protein, 18 aa, Entamoeba invadens
MTPTRPETGYGYINYSTE

SEQ ID NO: 2956927 - protein, 17 aa, Entamoeba invadens
MTPYLMFLNEHREEFRE

SEQ ID NO: 2956928 - protein, 29 aa, Entamoeba invadens
MTQAEGLLRMGLHPTIIVDGYRAGLKYFV

SEQ ID NO: 2956929 - protein, 24 aa, Entamoeba invadens
MTQFIKAGKGFHLTPEMKEMIQLL

SEQ ID NO: 2956930 - protein, 23 aa, Entamoeba invadens
MTQPTVSIKVRFVDGKQKVFKVN

SEQ ID NO: 2956931 - protein, 25 aa, Entamoeba invadens
MTQQICVGIIDFLRTFTWDKQIESF

SEQ ID NO: 2956932 - protein, 25 aa, Entamoeba invadens
MTRKTGFEILKKVFWANWTEIERNF

SEQ ID NO: 2956933 - protein, 21 aa, Entamoeba invadens
MTRVRCLDGNTVGDVVVTVSP

SEQ ID NO: 2956934 - protein, 25 aa, Entamoeba invadens
MTSEKAKKFFGKKWDQMKKGMKDKL

SEQ ID NO: 2956935 - protein, 19 aa, Entamoeba invadens
MTSGMPFYIYNLIEELDEE

SEQ ID NO: 2956936 - protein, 19 aa, Entamoeba invadens
MTSGMPFYIYNLVEELDEE

SEQ ID NO: 2956937 - protein, 19 aa, Entamoeba invadens
MTSHTCNPVNLFIRDFDYK

SEQ ID NO: 2956938 - protein, 20 aa, Entamoeba invadens
MTSPELKDNLDFGTVSFVSG

SEQ ID NO: 2956939 - protein, 26 aa, Entamoeba invadens
MTSSLPKYEFMWTFSTDDSDFIEIVY

SEQ ID NO: 2956940 - protein, 17 aa, Entamoeba invadens
MTSSMPIVLSLELNGDN

SEQ ID NO: 2956941 - protein, 27 aa, Entamoeba invadens
MTSTPMPYPIVVFDIGIKFKSDLSNFL

SEQ ID NO: 2956942 - protein, 26 aa, Entamoeba invadens
MTSYLRYSIEYDIIVDYWKMMKQSAL

SEQ ID NO: 2956943 - protein, 26 aa, Entamoeba invadens
MTTLNKFKYLLSIDEYIGVLQHFKDA

SEQ ID NO: 2956944 - protein, 25 aa, Entamoeba invadens
MTTNVIRFGDKLGFVENELTIGECY

SEQ ID NO: 2956945 - protein, 26 aa, Entamoeba invadens
MTVEFPDEEFVGMTVAGLKQKIQQQQ

SEQ ID NO: 2956946 - protein, 17 aa, Entamoeba invadens
MTVIFSIKFDDKDDAVF

SEQ ID NO: 2956947 - protein, 17 aa, Entamoeba invadens
MTVIVALLKIASRHSEL

SEQ ID NO: 2956948 - protein, 25 aa, Entamoeba invadens
MTVNLKMPFDIWCQQCNKQIAKGSR

SEQ ID NO: 2956949 - protein, 20 aa, Entamoeba invadens
MTVNLPLDYTRINTAYRAVI

SEQ ID NO: 2956950 - protein, 18 aa, Entamoeba invadens
MTVVDVYPLRKYFSNTYE

SEQ ID NO: 2956951 - protein, 20 aa, Entamoeba invadens
MTWTSGNNWRCEVEITNVPF

SEQ ID NO: 2956952 - protein, 30 aa, Entamoeba invadens
MTYACSILYKSRLPLIVVFTKTDVSPATKL

SEQ ID NO: 2956953 - protein, 17 aa, Entamoeba invadens
MTYFGFTTFVLMFRDWF

SEQ ID NO: 2956954 - protein, 20 aa, Entamoeba invadens
MVAAAREFMGSTSIDSETKF

SEQ ID NO: 2956955 - protein, 31 aa, Entamoeba invadens
MVAACCGYFFWDLMHFIPYPLVEKLFDFVYK

SEQ ID NO: 2956956 - protein, 21 aa, Entamoeba invadens
MVAALPSEWVTIFVDGFVAST

SEQ ID NO: 2956957 - protein, 17 aa, Entamoeba invadens
MVAEADGVLEFYLEILK

SEQ ID NO: 2956958 - protein, 22 aa, Entamoeba invadens
MVAKYHPTKVILRVPSFNENMV

SEQ ID NO: 2956959 - protein, 26 aa, Entamoeba invadens
MVAPQLCIRKFVTVVCDNFFCSLRLA

SEQ ID NO: 2956960 - protein, 18 aa, Entamoeba invadens
MVCASCGQNSAIKKIQVP

SEQ ID NO: 2956961 - protein, 19 aa, Entamoeba invadens
MVDPLMMRKVKSFVNDDYI

SEQ ID NO: 2956962 - protein, 23 aa, Entamoeba invadens
MVDRRPGDVPVIYAECKKAEKEL

SEQ ID NO: 2956963 - protein, 24 aa, Entamoeba invadens
MVDSFFRDGFLRKRVETKSQSPAE

SEQ ID NO: 2956964 - protein, 20 aa, Entamoeba invadens
MVEASVKSLMTWSEKQRMSV

SEQ ID NO: 2956965 - protein, 18 aa, Entamoeba invadens
MVEFKFPRHLYFIGNNSF

SEQ ID NO: 2956966 - protein, 23 aa, Entamoeba invadens
MVEKILKCLPKLETLQVDYQTAL

SEQ ID NO: 2956967 - protein, 18 aa, Entamoeba invadens
MVEKLGCPNIQFKELYSL

SEQ ID NO: 2956968 - protein, 19 aa, Entamoeba invadens
MVEKVCVMLLILFNDNASY

SEQ ID NO: 2956969 - protein, 24 aa, Entamoeba invadens
MVELPLRHPQLFKNIGIKPPRGVL

SEQ ID NO: 2956970 - protein, 39 aa, Entamoeba invadens
MVEMVSKYCKGRFGMFSQIYEIPEYVDVQGITMNYDEDI

SEQ ID NO: 2956971 - protein, 17 aa, Entamoeba invadens
MVFEEVFVRSSKLILVD

SEQ ID NO: 2956972 - protein, 24 aa, Entamoeba invadens
MVFEKANQVFRAWVENMKMYYFVN

SEQ ID NO: 2956973 - protein, 18 aa, Entamoeba invadens
MVFKKSLMCGHYFLTPLV

SEQ ID NO: 2956974 - protein, 21 aa, Entamoeba invadens
MVFPFCFPEGDAIIEKKDNLV

SEQ ID NO: 2956975 - protein, 26 aa, Entamoeba invadens
MVFYRYPQAWIVCAQYFQRRGNIDLA

SEQ ID NO: 2956976 - protein, 17 aa, Entamoeba invadens
MVGEAKTNFNTMKNLAA

SEQ ID NO: 2956977 - protein, 18 aa, Entamoeba invadens
MVGICVGCTEIFPLQSKH

SEQ ID NO: 2956978 - protein, 25 aa, Entamoeba invadens
MVGRNCSNVSWALCSKIVCLKTVEK

SEQ ID NO: 2956979 - protein, 17 aa, Entamoeba invadens
MVGTFVLTNYRVEFQTT

SEQ ID NO: 2956980 - protein, 38 aa, Entamoeba invadens
MVGWKQYHFNPSIKLARRFLPHVQNMDGFFVCKLKLYV

SEQ ID NO: 2956981 - protein, 23 aa, Entamoeba invadens
MVHCGSRGLGHQVCQDYVAISMK

SEQ ID NO: 2956982 - protein, 20 aa, Entamoeba invadens
MVHCVRFVSIKIIELLVQND

SEQ ID NO: 2956983 - protein, 17 aa, Entamoeba invadens
MVHFLKYLQYWKQPNYI

SEQ ID NO: 2956984 - protein, 25 aa, Entamoeba invadens
MVIASKFPGLVKVDLRKSSVTSTGL

SEQ ID NO: 2956985 - protein, 19 aa, Entamoeba invadens
MVILMKKYLNYVLGESNEI

SEQ ID NO: 2956986 - protein, 19 aa, Entamoeba invadens
MVIRRAYDGSLSYQANGNV

SEQ ID NO: 2956987 - protein, 26 aa, Entamoeba invadens
MVKIVIETKFKFSIQIKFKDNEQIVR

SEQ ID NO: 2956988 - protein, 22 aa, Entamoeba invadens
MVKSVTFEGCMSLKTVTLGGDK

SEQ ID NO: 2956989 - protein, 22 aa, Entamoeba invadens
MVLAIRCVETLYKDSQDMVPLS

SEQ ID NO: 2956990 - protein, 27 aa, Entamoeba invadens
MVLELLGLYDIINCWIGISPPLLKSVA

SEQ ID NO: 2956991 - protein, 30 aa, Entamoeba invadens
MVLGNVCFLTIMKGEFNSIYIGDCQTITLR

SEQ ID NO: 2956992 - protein, 22 aa, Entamoeba invadens
MVLKLLELRPHVLVSTPGKLVS

SEQ ID NO: 2956993 - protein, 17 aa, Entamoeba invadens
MVLKWCDHPNIIKSHGI

SEQ ID NO: 2956994 - protein, 17 aa, Entamoeba invadens
MVLPKILERVNMNIVSN

SEQ ID NO: 2956995 - protein, 21 aa, Entamoeba invadens
MVLPRGCLLQTLPKPFDEYPY

SEQ ID NO: 2956996 - protein, 20 aa, Entamoeba invadens
MVLVPFKFLSKMYKNSTQLK

SEQ ID NO: 2956997 - protein, 21 aa, Entamoeba invadens
MVMCDVCNLADVAYQSGVISE

SEQ ID NO: 2956998 - protein, 24 aa, Entamoeba invadens
MVMNEFQLCIKWCEYNSLSKFPVL

SEQ ID NO: 2956999 - protein, 17 aa, Entamoeba invadens
MVNCLKNNVSLSKIVLQ

SEQ ID NO: 2957000 - protein, 39 aa, Entamoeba invadens
MVNHWTLKQSFLFCKAKRSVVCPNPGFIIQLYQFQIKMG

SEQ ID NO: 2957001 - protein, 31 aa, Entamoeba invadens
MVNMCWQAIQLLRIDFLNVLSSYQYFYELNI

SEQ ID NO: 2957002 - protein, 27 aa, Entamoeba invadens
MVNMVPFPRLHFFSSSIAPLSSALAIQ

SEQ ID NO: 2957003 - protein, 18 aa, Entamoeba invadens
MVPPCDITPEYTGYYHSA

SEQ ID NO: 2957004 - protein, 18 aa, Entamoeba invadens
MVQTAWSVFFSRLENSIK

SEQ ID NO: 2957005 - protein, 17 aa, Entamoeba invadens
MVQWATQLVDLFMLARR

SEQ ID NO: 2957006 - protein, 18 aa, Entamoeba invadens
MVRDGVYANIHFVDENTF

SEQ ID NO: 2957007 - protein, 19 aa, Entamoeba invadens
MVRGELWVAKKVMISPMKE

SEQ ID NO: 2957008 - protein, 21 aa, Entamoeba invadens
MVSIRDWLGLLSAVLKVRVIC

SEQ ID NO: 2957009 - protein, 22 aa, Entamoeba invadens
MVSKGRVSGFISQFREDKICEL

SEQ ID NO: 2957010 - protein, 18 aa, Entamoeba invadens
MVSKHVYSAFRHMKTNPF

SEQ ID NO: 2957011 - protein, 18 aa, Entamoeba invadens
MVSLKLSQLQHVEGQVDY

SEQ ID NO: 2957012 - protein, 18 aa, Entamoeba invadens
MVSLKVVDIVYLFTGIER

SEQ ID NO: 2957013 - protein, 23 aa, Entamoeba invadens
MVSNLCSVFKFILEDKKPEDVTK

SEQ ID NO: 2957014 - protein, 18 aa, Entamoeba invadens
MVTAPRFKNEVVEYEKQI

SEQ ID NO: 2957015 - protein, 25 aa, Entamoeba invadens
MVTEALKFYKHPRLTFHYVSNVDGT

SEQ ID NO: 2957016 - protein, 23 aa, Entamoeba invadens
MVTLDPNMTFSILFKTPAINDKG

SEQ ID NO: 2957017 - protein, 29 aa, Entamoeba invadens
MVTSIKQCYELLQYHFLNFNKIIESVTKQ

SEQ ID NO: 2957018 - protein, 18 aa, Entamoeba invadens
MVVGFTCDEGLGLDPADL

SEQ ID NO: 2957019 - protein, 18 aa, Entamoeba invadens
MVVSKYFSSMIDFINFTL

SEQ ID NO: 2957020 - protein, 23 aa, Entamoeba invadens
MVYKEFIKTSSFAKYATDKMEKF

SEQ ID NO: 2957021 - protein, 21 aa, Entamoeba invadens
MWDCVGNVCGIDLKEVVQEWT

SEQ ID NO: 2957022 - protein, 20 aa, Entamoeba invadens
MWDIKPKKRILCDEIVKRLE

SEQ ID NO: 2957023 - protein, 21 aa, Entamoeba invadens
MWEMVPQKLFVMSGGDLLFSI

SEQ ID NO: 2957024 - protein, 17 aa, Entamoeba invadens
MWFGDLVTMKWWDDIWL

SEQ ID NO: 2957025 - protein, 22 aa, Entamoeba invadens
MWHKEDCKRFIVQKIQTIKKEL

SEQ ID NO: 2957026 - protein, 20 aa, Entamoeba invadens
MWKFDCLLDSAMQCGEFLDD

SEQ ID NO: 2957027 - protein, 17 aa, Entamoeba invadens
MWKKLGPEEKNKYIEVA

SEQ ID NO: 2957028 - protein, 25 aa, Entamoeba invadens
MWKVSYICSSLCWTDLKTTDNSFHL

SEQ ID NO: 2957029 - protein, 22 aa, Entamoeba invadens
MWNIPISFWNFHKSITLNEKEI

SEQ ID NO: 2957030 - protein, 25 aa, Entamoeba invadens
MWSEHCRPACGFCREGFVCTTAGRC

SEQ ID NO: 2957031 - protein, 30 aa, Entamoeba invadens
MWSFGCMAAELFVGIPIFPGNCEYNMLYKF

SEQ ID NO: 2957032 - protein, 23 aa, Entamoeba invadens
MWTKEGFELIQPHRLFILEGNVM

SEQ ID NO: 2957033 - protein, 18 aa, Entamoeba invadens
MYCGVSFDKNVASVVNSQ

SEQ ID NO: 2957034 - protein, 28 aa, Entamoeba invadens
MYCMKDVALLASRYGKIGIYSLKTTRKI

SEQ ID NO: 2957035 - protein, 24 aa, Entamoeba invadens
MYCNLKSVCIPKLVTSIGQNCFLD

SEQ ID NO: 2957036 - protein, 24 aa, Entamoeba invadens
MYCNLKSVCIPKLVTSIGQNCFLG

SEQ ID NO: 2957037 - protein, 24 aa, Entamoeba invadens
MYDHFLYCGHLCIVTELLGSSLHE

SEQ ID NO: 2957038 - protein, 19 aa, Entamoeba invadens
MYEGITWRDPYPKENFKFA

SEQ ID NO: 2957039 - protein, 21 aa, Entamoeba invadens
MYEICVCERPTLMSLDDDKIK

SEQ ID NO: 2957040 - protein, 17 aa, Entamoeba invadens
MYEIFNWEKCYNKENFN

SEQ ID NO: 2957041 - protein, 25 aa, Entamoeba invadens
MYELYDPVTVMFFFRKKHIQVDLGT

SEQ ID NO: 2957042 - protein, 19 aa, Entamoeba invadens
MYETFNWGDAYPKNKFQYA

SEQ ID NO: 2957043 - protein, 23 aa, Entamoeba invadens
MYEVGVCGFRIAKKTTNKSYYDH

SEQ ID NO: 2957044 - protein, 22 aa, Entamoeba invadens
MYEVKYQFNFFYLFQTLEDMLL

SEQ ID NO: 2957045 - protein, 18 aa, Entamoeba invadens
MYFPELKAICTAEEINRL

SEQ ID NO: 2957046 - protein, 17 aa, Entamoeba invadens
MYGLHPLFYAICNALYY

SEQ ID NO: 2957047 - protein, 18 aa, Entamoeba invadens
MYHISKLFAVPETMRDFF

SEQ ID NO: 2957048 - protein, 17 aa, Entamoeba invadens
MYIEMVEKGILRVEQYA

SEQ ID NO: 2957049 - protein, 17 aa, Entamoeba invadens
MYIGAWYINPAIDTAIN

SEQ ID NO: 2957050 - protein, 23 aa, Entamoeba invadens
MYKIFLEIVQAFKTLHDTGSIVQ

SEQ ID NO: 2957051 - protein, 23 aa, Entamoeba invadens
MYLCSSSLPIVSNFEKSLIITPF

SEQ ID NO: 2957052 - protein, 25 aa, Entamoeba invadens
MYLEGSMRNCLFKTGSVIEKLTLKT

SEQ ID NO: 2957053 - protein, 18 aa, Entamoeba invadens
MYLEPSLVQLCENVYDFV

SEQ ID NO: 2957054 - protein, 17 aa, Entamoeba invadens
MYLTPLCTFVGVTEKST

SEQ ID NO: 2957055 - protein, 26 aa, Entamoeba invadens
MYMIFAAVLIRPSPTLQPLFLQVEED

SEQ ID NO: 2957056 - protein, 25 aa, Entamoeba invadens
MYMRIAPELYLKELVVGGINRVYEI

SEQ ID NO: 2957057 - protein, 19 aa, Entamoeba invadens
MYNALIRFENFFTYNRYKF

SEQ ID NO: 2957058 - protein, 24 aa, Entamoeba invadens
MYNECYRLNGEIEKHKKQIEELKE

SEQ ID NO: 2957059 - protein, 18 aa, Entamoeba invadens
MYNNFPFPNVEEIELHNC

SEQ ID NO: 2957060 - protein, 25 aa, Entamoeba invadens
MYNRYNVTNVFGLKWGYEGLNPETS

SEQ ID NO: 2957061 - protein, 17 aa, Entamoeba invadens
MYPALGFSTCYSVSVNF

SEQ ID NO: 2957062 - protein, 26 aa, Entamoeba invadens
MYQDYPCANSSCLGFLQQSEQQSQSG

SEQ ID NO: 2957063 - protein, 20 aa, Entamoeba invadens
MYQMTSCELFKNMIGVQDET

SEQ ID NO: 2957064 - protein, 25 aa, Entamoeba invadens
MYQPFPMCNPFQYQPMMFPQQFPPF

SEQ ID NO: 2957065 - protein, 23 aa, Entamoeba invadens
MYQTKRLEAVKVLDKKDAKLAEI

SEQ ID NO: 2957066 - protein, 18 aa, Entamoeba invadens
MYRCAGCFQHYYCEKCCV

SEQ ID NO: 2957067 - protein, 24 aa, Entamoeba invadens
MYRGSCYPSFGVIDGDLCDFYNQM

SEQ ID NO: 2957068 - protein, 26 aa, Entamoeba invadens
MYRPMLSQEIDFFFGNYSYFVNNLND

SEQ ID NO: 2957069 - protein, 17 aa, Entamoeba invadens
MYRQWFNQLTELTIDKV

SEQ ID NO: 2957070 - protein, 29 aa, Entamoeba invadens
MYRSQWFERGGLCALVMAPTRELAQQIFD

SEQ ID NO: 2957071 - protein, 18 aa, Entamoeba invadens
MYRTLCLVQYLIEHKQFE

SEQ ID NO: 2957072 - protein, 17 aa, Entamoeba invadens
MYSCPEILQKSSPSVKS

SEQ ID NO: 2957073 - protein, 25 aa, Entamoeba invadens
MYSFIEKMLCVFNRMISDFAKETTD

SEQ ID NO: 2957074 - protein, 27 aa, Entamoeba invadens
MYTDGCTWATHFSRLFKNLHQLATFEE

SEQ ID NO: 2957075 - protein, 17 aa, Entamoeba invadens
MYTFKFLNDLDVMLEVT

SEQ ID NO: 2957076 - protein, 25 aa, Entamoeba invadens
MYTKACFVFNAGVFRRNVNVYFFEK

SEQ ID NO: 2957077 - protein, 37 aa, Entamoeba invadens
MYTLYFTPRPLEGVFRCCAEAKALPWYNKLIGGMDYQ

SEQ ID NO: 2957078 - protein, 31 aa, Entamoeba invadens
MYTVKDCNSTVCGVECLELPIKHDDSNVCEN

SEQ ID NO: 2957079 - protein, 17 aa, Entamoeba invadens
MYYDTFVVREEFLSAFN

SEQ ID NO: 2957080 - protein, 33 aa, Entamoeba invadens
MYYIKYHKRCCGDCVLRKVIIPELIGNGERKWK

SEQ ID NO: 2957081 - protein, 22 aa, Entamoeba invadens
NAADLYQLVDILGLVYHENVDS

SEQ ID NO: 2957082 - protein, 18 aa, Entamoeba invadens
NAAFKLLTLLSQNMLAEF

SEQ ID NO: 2957083 - protein, 30 aa, Entamoeba invadens
NAAIDRLTGLGFSKAQAIQAYVACDKNENL

SEQ ID NO: 2957084 - protein, 24 aa, Entamoeba invadens
NAAKICKLIGEPSLIKAIDYICRS

SEQ ID NO: 2957085 - protein, 18 aa, Entamoeba invadens
NAAKRKEVLFALRELQLA

SEQ ID NO: 2957086 - protein, 19 aa, Entamoeba invadens
NAAKRKEVLFALRELQLAA

SEQ ID NO: 2957087 - protein, 20 aa, Entamoeba invadens
NAALYWLHRMVLAGENPKYI

SEQ ID NO: 2957088 - protein, 25 aa, Entamoeba invadens
NAAMMRCGDGIFSLHDKSSTARFSV

SEQ ID NO: 2957089 - protein, 19 aa, Entamoeba invadens
NAARFAVHELCVKAAIIAG

SEQ ID NO: 2957090 - protein, 17 aa, Entamoeba invadens
NAARKVAPVWYPIYHTS

SEQ ID NO: 2957091 - protein, 24 aa, Entamoeba invadens
NAATFFRRRERVLDVQRITPEVSY

SEQ ID NO: 2957092 - protein, 18 aa, Entamoeba invadens
NACAYIKDSSYRIISSLG

SEQ ID NO: 2957093 - protein, 30 aa, Entamoeba invadens
NACDIFYIIYCLRKGLPVTSMITIMNIIGL

SEQ ID NO: 2957094 - protein, 33 aa, Entamoeba invadens
NACDIKGKIVMDVGCGLGILSLFAARAGAKHVY

SEQ ID NO: 2957095 - protein, 26 aa, Entamoeba invadens
NACDIKRLDLSNVISFGSQYDMNFLT

SEQ ID NO: 2957096 - protein, 21 aa, Entamoeba invadens
NACFANCRGLMGVTLPTTLEF

SEQ ID NO: 2957097 - protein, 30 aa, Entamoeba invadens
NACIPESGLECYMLLYYCFNLTTVNILKSN

SEQ ID NO: 2957098 - protein, 24 aa, Entamoeba invadens
NACLKICSLLFEKIDEHIMQSYLP

SEQ ID NO: 2957099 - protein, 19 aa, Entamoeba invadens
NADDIWISQSLSPIFRIQF

SEQ ID NO: 2957100 - protein, 22 aa, Entamoeba invadens
NADFMCCLCAVSGDEKLSDDVF

SEQ ID NO: 2957101 - protein, 19 aa, Entamoeba invadens
NADGFLVVYSITDRVSFDE

SEQ ID NO: 2957102 - protein, 24 aa, Entamoeba invadens
NADKWSREMNNFVGSCLETIPENR

SEQ ID NO: 2957103 - protein, 23 aa, Entamoeba invadens
NADLRGLTCLTLLEIYCYNKVTL

SEQ ID NO: 2957104 - protein, 27 aa, Entamoeba invadens
NADNIPDDIIVCFDHSYVMAEDLQLVY

SEQ ID NO: 2957105 - protein, 29 aa, Entamoeba invadens
NADPTWKNPYLRIKIHKFLNLDSLVVLVW

SEQ ID NO: 2957106 - protein, 19 aa, Entamoeba invadens
NADSGKLITSLSCGIPSTV

SEQ ID NO: 2957107 - protein, 24 aa, Entamoeba invadens
NADSRTKWNVMGGYGLHREQIDIM

SEQ ID NO: 2957108 - protein, 26 aa, Entamoeba invadens
NADVVLKNFLLAKAREDYSKQELSYK

SEQ ID NO: 2957109 - protein, 27 aa, Entamoeba invadens
NAECPFETVIEIKRLIHYNVANLGDVF

SEQ ID NO: 2957110 - protein, 26 aa, Entamoeba invadens
NAEERRLKGQYGYQWVRTPSEQAALN

SEQ ID NO: 2957111 - protein, 22 aa, Entamoeba invadens
NAEGKVVGYALIKMDEDSKIPF

SEQ ID NO: 2957112 - protein, 17 aa, Entamoeba invadens
NAESFNKVVSGMILDEW

SEQ ID NO: 2957113 - protein, 26 aa, Entamoeba invadens
NAEYPVTCKSAFRRSAETGALVAPKF

SEQ ID NO: 2957114 - protein, 17 aa, Entamoeba invadens
NAFCDSFLSKGLTKITN

SEQ ID NO: 2957115 - protein, 21 aa, Entamoeba invadens
NAFCNCFHLCRVVLPKYTKVS

SEQ ID NO: 2957116 - protein, 20 aa, Entamoeba invadens
NAFDGCPLTSIVLSKNLTSL

SEQ ID NO: 2957117 - protein, 25 aa, Entamoeba invadens
NAFDSCGLEKLYIPESVRVIQKYAF

SEQ ID NO: 2957118 - protein, 18 aa, Entamoeba invadens
NAFDVLYLDGVDLMRKPL

SEQ ID NO: 2957119 - protein, 18 aa, Entamoeba invadens
NAFEDCKLLEHIRIPKSV

SEQ ID NO: 2957120 - protein, 22 aa, Entamoeba invadens
NAFEFTMKKSYMVPELSIIAST

SEQ ID NO: 2957121 - protein, 25 aa, Entamoeba invadens
NAFEKCGFETFDMPSSIYSIENDAF

SEQ ID NO: 2957122 - protein, 25 aa, Entamoeba invadens
NAFEKCGFETFDMPSSIYSIGYEAF

SEQ ID NO: 2957123 - protein, 17 aa, Entamoeba invadens
NAFGGWVPSWVMNSLIS

SEQ ID NO: 2957124 - protein, 27 aa, Entamoeba invadens
NAFKDCRRLKEVVLPPNLNQVSSHCFE

SEQ ID NO: 2957125 - protein, 18 aa, Entamoeba invadens
NAFKELRDSQAIQQGVLI

SEQ ID NO: 2957126 - protein, 17 aa, Entamoeba invadens
NAFKGCKKLKLNSQENK

SEQ ID NO: 2957127 - protein, 18 aa, Entamoeba invadens
NAFKKCYSLHSIVLNDGL

SEQ ID NO: 2957128 - protein, 18 aa, Entamoeba invadens
NAFKSCVLLKSIHLPPTL

SEQ ID NO: 2957129 - protein, 26 aa, Entamoeba invadens
NAFNGYCYLEELVIPKSVTKIGNGFV

SEQ ID NO: 2957130 - protein, 18 aa, Entamoeba invadens
NAFQKCYSLKSVTIGANH

SEQ ID NO: 2957131 - protein, 17 aa, Entamoeba invadens
NAFSALRINPNYYSQKA

SEQ ID NO: 2957132 - protein, 21 aa, Entamoeba invadens
NAFSGCLFQRFDIPKKVKEMK

SEQ ID NO: 2957133 - protein, 29 aa, Entamoeba invadens
NAFTTLIFLRYLFVPFMRFPNLLKNFQAT

SEQ ID NO: 2957134 - protein, 21 aa, Entamoeba invadens
NAFVGCYSFDISLYTKQKKAE

SEQ ID NO: 2957135 - protein, 23 aa, Entamoeba invadens
NAFVTLLFLRYLYTPFMKNVQIL

SEQ ID NO: 2957136 - protein, 17 aa, Entamoeba invadens
NAGDCRCLLVGDDCVEQ

SEQ ID NO: 2957137 - protein, 25 aa, Entamoeba invadens
NAGDKWMCLNCVNKFNRTNFLTEQV

SEQ ID NO: 2957138 - protein, 18 aa, Entamoeba invadens
NAGDSRCVLFKGNKVKGM

SEQ ID NO: 2957139 - protein, 27 aa, Entamoeba invadens
NAGFGRKEILYAISTCRKNLHQMVEFM

SEQ ID NO: 2957140 - protein, 17 aa, Entamoeba invadens
NAGISFTQLIFAQSGNL

SEQ ID NO: 2957141 - protein, 31 aa, Entamoeba invadens
NAGKEMLKKLCVSPGKLCWVVYVDAIVVEDD

SEQ ID NO: 2957142 - protein, 24 aa, Entamoeba invadens
NAGKRLVHERCFVCKKCKVPIEGR

SEQ ID NO: 2957143 - protein, 28 aa, Entamoeba invadens
NAGYCMPEEAFLLPAFPQKPFVFGSEIV

SEQ ID NO: 2957144 - protein, 24 aa, Entamoeba invadens
NAIGNRLTFNYVFNKKYDKMGLSF

SEQ ID NO: 2957145 - protein, 25 aa, Entamoeba invadens
NAIKDLMTKFGLAFTALPDAYSKFV

SEQ ID NO: 2957146 - protein, 21 aa, Entamoeba invadens
NAIKEIARFEEMLKLQNVLPT

SEQ ID NO: 2957147 - protein, 31 aa, Entamoeba invadens
NAIKHLTLLNVLKFIKIKAVVVKGTSISQRE

SEQ ID NO: 2957148 - protein, 22 aa, Entamoeba invadens
NAIKRNCEMMGAVMQSLVRVDG

SEQ ID NO: 2957149 - protein, 24 aa, Entamoeba invadens
NAIKSEMFFFDAFYLAEKIILLGI

SEQ ID NO: 2957150 - protein, 25 aa, Entamoeba invadens
NAIPDQNKDGLLFYLIFPVQHPARY

SEQ ID NO: 2957151 - protein, 17 aa, Entamoeba invadens
NAIPMKGVMSLILPNGE

SEQ ID NO: 2957152 - protein, 39 aa, Entamoeba invadens
NAIPQVVFNMCWWIYTYGHSIEGIFRISGKTDFAKKKVS

SEQ ID NO: 2957153 - protein, 19 aa, Entamoeba invadens
NAIPSHAKVTIAVKECIAD

SEQ ID NO: 2957154 - protein, 19 aa, Entamoeba invadens
NAITYKAPLVITMTSKKEF

SEQ ID NO: 2957155 - protein, 23 aa, Entamoeba invadens
NAIWASCFFNCKALCDVTLPHKA

SEQ ID NO: 2957156 - protein, 22 aa, Entamoeba invadens
NAIYFKGIWREKFDILNDKHVF

SEQ ID NO: 2957157 - protein, 19 aa, Entamoeba invadens
NAKEFLKISLEFTKQQLEK

SEQ ID NO: 2957158 - protein, 24 aa, Entamoeba invadens
NAKELKIIHQWFGNLIGQPIRSTK

SEQ ID NO: 2957159 - protein, 21 aa, Entamoeba invadens
NAKGELLFYVFRQAGQVMNQL

SEQ ID NO: 2957160 - protein, 18 aa, Entamoeba invadens
NAKGVGFQPPLILQQNNV

SEQ ID NO: 2957161 - protein, 18 aa, Entamoeba invadens
NAKHYACMCFPYNKVETI

SEQ ID NO: 2957162 - protein, 21 aa, Entamoeba invadens
NAKICGKKNVMIFVKTTDNCL

SEQ ID NO: 2957163 - protein, 21 aa, Entamoeba invadens
NAKKFFAFAIEESFNGTWITG

SEQ ID NO: 2957164 - protein, 23 aa, Entamoeba invadens
NAKLTQIVPYTFDYTLWVNKVFK

SEQ ID NO: 2957165 - protein, 24 aa, Entamoeba invadens
NAKMKVPLATVLQCKYNDILYTTD

SEQ ID NO: 2957166 - protein, 32 aa, Entamoeba invadens
NAKNDVCIGFTCDHFYHASCILKEIKKHQTPW

SEQ ID NO: 2957167 - protein, 17 aa, Entamoeba invadens
NAKRLLSACSMVETAES

SEQ ID NO: 2957168 - protein, 22 aa, Entamoeba invadens
NAKRYFRIGVESIELNFDLNTV

SEQ ID NO: 2957169 - protein, 25 aa, Entamoeba invadens
NAKTLKYKYLPLLNYCFESRRETLV

SEQ ID NO: 2957170 - protein, 24 aa, Entamoeba invadens
NAKVADLVVCLYIDKDYYFNTIDD

SEQ ID NO: 2957171 - protein, 29 aa, Entamoeba invadens
NAKVKMVIERKGKSLLLVNDFFKPPLEKA

SEQ ID NO: 2957172 - protein, 25 aa, Entamoeba invadens
NALFKANAVDLILPFLADPTLCQEA

SEQ ID NO: 2957173 - protein, 18 aa, Entamoeba invadens
NALFSLPFLNRVSLSERS

SEQ ID NO: 2957174 - protein, 25 aa, Entamoeba invadens
NALKEESRYSLSYWDSPFREKLCDE

SEQ ID NO: 2957175 - protein, 19 aa, Entamoeba invadens
NALKMANVRYELVDIKPED

SEQ ID NO: 2957176 - protein, 21 aa, Entamoeba invadens
NALKSPVDWEIVKSLNDKVAL

SEQ ID NO: 2957177 - protein, 33 aa, Entamoeba invadens
NALKSVVYTCWFKEAMTGINFIQRRGKYYDIVN

SEQ ID NO: 2957178 - protein, 23 aa, Entamoeba invadens
NALPSPLRQCLFVSDEDSLQTNR

SEQ ID NO: 2957179 - protein, 22 aa, Entamoeba invadens
NALREEIILLKITHENEKTSFK

SEQ ID NO: 2957180 - protein, 20 aa, Entamoeba invadens
NALSCIVDTFGIVFSSKGFD

SEQ ID NO: 2957181 - protein, 23 aa, Entamoeba invadens
NALSIWLKLSVRRDGEVYEIDFS

SEQ ID NO: 2957182 - protein, 19 aa, Entamoeba invadens
NALVALKAREEGIIDDSYD

SEQ ID NO: 2957183 - protein, 24 aa, Entamoeba invadens
NAMFSGLHALKICRDTIADEDDDV

SEQ ID NO: 2957184 - protein, 17 aa, Entamoeba invadens
NAMTRFSKMVSLNNFDV

SEQ ID NO: 2957185 - protein, 24 aa, Entamoeba invadens
NANEYLKSLGFRTAVKKDNDENMT

SEQ ID NO: 2957186 - protein, 22 aa, Entamoeba invadens
NANFFRNYLLGFREVFTSGQIP

SEQ ID NO: 2957187 - protein, 23 aa, Entamoeba invadens
NANFKIPFDVLKGNIEECPLLDT

SEQ ID NO: 2957188 - protein, 25 aa, Entamoeba invadens
NANFLFSPQIHKIVFYDVVFINFFD

SEQ ID NO: 2957189 - protein, 18 aa, Entamoeba invadens
NANFRTGNEWFTCASTLM

SEQ ID NO: 2957190 - protein, 24 aa, Entamoeba invadens
NANKVFPCGLIQLSIDQQTIPQKS

SEQ ID NO: 2957191 - protein, 20 aa, Entamoeba invadens
NANLAFRLFEVGTKFGNSKA

SEQ ID NO: 2957192 - protein, 17 aa, Entamoeba invadens
NANLMRNGTDFAVYINT

SEQ ID NO: 2957193 - protein, 19 aa, Entamoeba invadens
NAPLKCYHGKFGKFIVTPN

SEQ ID NO: 2957194 - protein, 22 aa, Entamoeba invadens
NAPPYLGCELLDILENEKHKNV

SEQ ID NO: 2957195 - protein, 20 aa, Entamoeba invadens
NAQIALRVQLISKMKAYCNG

SEQ ID NO: 2957196 - protein, 27 aa, Entamoeba invadens
NAQIKARRTQIRYLKIKALKDVLSKKL

SEQ ID NO: 2957197 - protein, 22 aa, Entamoeba invadens
NAQMLKEVYFFYSNLAATKSLP

SEQ ID NO: 2957198 - protein, 25 aa, Entamoeba invadens
NAQNVCGRCGKPIAVGTSMISAMGQ

SEQ ID NO: 2957199 - protein, 29 aa, Entamoeba invadens
NARDCSIAVPFLCKGVTVSLDIISQEENT

SEQ ID NO: 2957200 - protein, 28 aa, Entamoeba invadens
NAREVLSDLVCDIPLKKLKNLNSYTSSR

SEQ ID NO: 2957201 - protein, 19 aa, Entamoeba invadens
NARIKLFVDTFVDKWFYTL

SEQ ID NO: 2957202 - protein, 18 aa, Entamoeba invadens
NARPFPKDIQSFYTNPEK

SEQ ID NO: 2957203 - protein, 18 aa, Entamoeba invadens
NARVELVELPNSLSEFGD

SEQ ID NO: 2957204 - protein, 24 aa, Entamoeba invadens
NARVFKLLKYRRVSHISMIIVLIN

SEQ ID NO: 2957205 - protein, 18 aa, Entamoeba invadens
NASAPSFTAAGFSTEPLP

SEQ ID NO: 2957206 - protein, 17 aa, Entamoeba invadens
NASFKSKGVPVFMYSSQ

SEQ ID NO: 2957207 - protein, 25 aa, Entamoeba invadens
NASGTRPCLYVPQTAFENLIAKQVK

SEQ ID NO: 2957208 - protein, 25 aa, Entamoeba invadens
NASGTRPCLYVPQTAFENLIAKQVR

SEQ ID NO: 2957209 - protein, 25 aa, Entamoeba invadens
NASKKITEMWVNWKAKLAANPKTAA

SEQ ID NO: 2957210 - protein, 17 aa, Entamoeba invadens
NASKRPTIEDLLKNIFE

SEQ ID NO: 2957211 - protein, 26 aa, Entamoeba invadens
NASLLQRWSNAIGRFPITFNDEEEEV

SEQ ID NO: 2957212 - protein, 23 aa, Entamoeba invadens
NASLSVPHIPVFQPKRQNTPMRP

SEQ ID NO: 2957213 - protein, 22 aa, Entamoeba invadens
NASVAFFKIVVWHDVEYQVVVD

SEQ ID NO: 2957214 - protein, 18 aa, Entamoeba invadens
NASVELCQNCFQDCCSLC

SEQ ID NO: 2957215 - protein, 26 aa, Entamoeba invadens
NASVGGCSDCYGRITLNEEMAIEASA

SEQ ID NO: 2957216 - protein, 20 aa, Entamoeba invadens
NATCNQIEFSRVLATNYDQV

SEQ ID NO: 2957217 - protein, 19 aa, Entamoeba invadens
NATCSLNCFQMCSKLANVQ

SEQ ID NO: 2957218 - protein, 24 aa, Entamoeba invadens
NATDKRILVDLTFFEAVKDAIFKG

SEQ ID NO: 2957219 - protein, 19 aa, Entamoeba invadens
NATIFFSYLHYFRVCVHCR

SEQ ID NO: 2957220 - protein, 25 aa, Entamoeba invadens
NATKCGVCYEMVGPVGTLRFRVEDS

SEQ ID NO: 2957221 - protein, 19 aa, Entamoeba invadens
NATNCPFKLNYNIQKEKER

SEQ ID NO: 2957222 - protein, 18 aa, Entamoeba invadens
NATSLPCISSFYQMFNDS

SEQ ID NO: 2957223 - protein, 19 aa, Entamoeba invadens
NATSVLYLFVKSNFERNEN

SEQ ID NO: 2957224 - protein, 18 aa, Entamoeba invadens
NATVPTLLAIFFSHFEYR

SEQ ID NO: 2957225 - protein, 24 aa, Entamoeba invadens
NATWSTKLSNIWSESAAISKSELF

SEQ ID NO: 2957226 - protein, 24 aa, Entamoeba invadens
NAVCPGDTFVLRWTSDEQLAMRFG

SEQ ID NO: 2957227 - protein, 26 aa, Entamoeba invadens
NAVDCPLLKLYESFCYLISGREREGL

SEQ ID NO: 2957228 - protein, 26 aa, Entamoeba invadens
NAVDWGWQILECSKLAVRNASLNKKE

SEQ ID NO: 2957229 - protein, 23 aa, Entamoeba invadens
NAVGNRLTFNYVFNKKYDKMGLS

SEQ ID NO: 2957230 - protein, 24 aa, Entamoeba invadens
NAVGNRLTFNYVFNKKYDKMGLSF

SEQ ID NO: 2957231 - protein, 19 aa, Entamoeba invadens
NAVHYFSKCHALRSVTFLD

SEQ ID NO: 2957232 - protein, 23 aa, Entamoeba invadens
NAVIYFRFVEDVITLKLVNKKCL

SEQ ID NO: 2957233 - protein, 17 aa, Entamoeba invadens
NAVKEFLDAIGAKCLIR

SEQ ID NO: 2957234 - protein, 23 aa, Entamoeba invadens
NAVKGLLRLGADPNKGNSDGVLP

SEQ ID NO: 2957235 - protein, 22 aa, Entamoeba invadens
NAVKRFLELNGDVTRIRYMILK

SEQ ID NO: 2957236 - protein, 22 aa, Entamoeba invadens
NAVLAKMLGFFVIEHHVQQTTE

SEQ ID NO: 2957237 - protein, 26 aa, Entamoeba invadens
NAVLPMKRVEMEIVVTIPENYCKVAD

SEQ ID NO: 2957238 - protein, 17 aa, Entamoeba invadens
NAVLRGDMAKIVIGENS

SEQ ID NO: 2957239 - protein, 17 aa, Entamoeba invadens
NAVMIKYQLTAGDFPPI

SEQ ID NO: 2957240 - protein, 18 aa, Entamoeba invadens
NAVPLVVICLGRLQKDTQ

SEQ ID NO: 2957241 - protein, 18 aa, Entamoeba invadens
NAVRDEFENLIGFKGDDD

SEQ ID NO: 2957242 - protein, 19 aa, Entamoeba invadens
NAVYFLSLFPKKRVSFSIK

SEQ ID NO: 2957243 - protein, 23 aa, Entamoeba invadens
NAYELFARRCNKYPTADVLGYKE

SEQ ID NO: 2957244 - protein, 17 aa, Entamoeba invadens
NAYGTDVSRCASMFETL

SEQ ID NO: 2957245 - protein, 23 aa, Entamoeba invadens
NAYLKNIVLRDGIETIGEKAFAS

SEQ ID NO: 2957246 - protein, 25 aa, Entamoeba invadens
NAYTESRLKGISSYFEVSGNDLKAK

SEQ ID NO: 2957247 - protein, 17 aa, Entamoeba invadens
NAYVATIGADWSKKEFK

SEQ ID NO: 2957248 - protein, 19 aa, Entamoeba invadens
NCAICSSTFERKCEMCNTG

SEQ ID NO: 2957249 - protein, 30 aa, Entamoeba invadens
NCAQPIRFPILLPVLLELVFKQICPLDLYV

SEQ ID NO: 2957250 - protein, 18 aa, Entamoeba invadens
NCCFSYDGSMLLTLQKDI

SEQ ID NO: 2957251 - protein, 25 aa, Entamoeba invadens
NCDSIRVGGLIIHPECDHCYLCRCP

SEQ ID NO: 2957252 - protein, 19 aa, Entamoeba invadens
NCEDGFDFSVDVDQFDLDK

SEQ ID NO: 2957253 - protein, 26 aa, Entamoeba invadens
NCEKGFFYLVRAVKCFCGKTPDICTL

SEQ ID NO: 2957254 - protein, 20 aa, Entamoeba invadens
NCEKLKELVFNEACEIEEGV

SEQ ID NO: 2957255 - protein, 26 aa, Entamoeba invadens
NCESCFDLTMCMSCVDGYFLSDYTCK

SEQ ID NO: 2957256 - protein, 19 aa, Entamoeba invadens
NCFANCLALKTVELLNVNK

SEQ ID NO: 2957257 - protein, 17 aa, Entamoeba invadens
NCFDGCKALKTVIVENK

SEQ ID NO: 2957258 - protein, 17 aa, Entamoeba invadens
NCFDGCTSLEEITIPKS

SEQ ID NO: 2957259 - protein, 17 aa, Entamoeba invadens
NCFDGCTSLSKIELSRR

SEQ ID NO: 2957260 - protein, 17 aa, Entamoeba invadens
NCFENCVLLSAIEIPQN

SEQ ID NO: 2957261 - protein, 17 aa, Entamoeba invadens
NCFFGCDALRLKLISNE

SEQ ID NO: 2957262 - protein, 18 aa, Entamoeba invadens
NCFFGCKNLECVNIPLGV

SEQ ID NO: 2957263 - protein, 20 aa, Entamoeba invadens
NCFKDCLKLSEITFCANIVK

SEQ ID NO: 2957264 - protein, 19 aa, Entamoeba invadens
NCFKNCLNVTMVAENKKVS

SEQ ID NO: 2957265 - protein, 20 aa, Entamoeba invadens
NCFLCVRDICFICGANSILI

SEQ ID NO: 2957266 - protein, 17 aa, Entamoeba invadens
NCFNLKFISKVKHLKGG

SEQ ID NO: 2957267 - protein, 17 aa, Entamoeba invadens
NCFQGCSFLEEIDIPQS

SEQ ID NO: 2957268 - protein, 18 aa, Entamoeba invadens
NCFQMCSKLANVQNLEAV

SEQ ID NO: 2957269 - protein, 17 aa, Entamoeba invadens
NCFRGCTNLKIIEFDPD

SEQ ID NO: 2957270 - protein, 18 aa, Entamoeba invadens
NCFSGCYNLNKVVLPSTV

SEQ ID NO: 2957271 - protein, 18 aa, Entamoeba invadens
NCFSMCDLTSISIPDSVI

SEQ ID NO: 2957272 - protein, 17 aa, Entamoeba invadens
NCFTIKAGTIKAASTKI

SEQ ID NO: 2957273 - protein, 18 aa, Entamoeba invadens
NCFYERFVYYLKEKDKPN

SEQ ID NO: 2957274 - protein, 17 aa, Entamoeba invadens
NCFYQCISMKSIELPQN

SEQ ID NO: 2957275 - protein, 21 aa, Entamoeba invadens
NCGDKECYILWTNVQPVYEKG

SEQ ID NO: 2957276 - protein, 20 aa, Entamoeba invadens
NCGKCGKPVAGGYKALDRIW

SEQ ID NO: 2957277 - protein, 17 aa, Entamoeba invadens
NCGKELSQFEVIHCPLC

SEQ ID NO: 2957278 - protein, 19 aa, Entamoeba invadens
NCGKISKIEAFESQKFSFF

SEQ ID NO: 2957279 - protein, 25 aa, Entamoeba invadens
NCGNDAVGMACHLIAHLLVNADEKQ

SEQ ID NO: 2957280 - protein, 19 aa, Entamoeba invadens
NCGVLYALGATGKIEMKTA

SEQ ID NO: 2957281 - protein, 22 aa, Entamoeba invadens
NCHKELKIFETIECPLCNLQFC

SEQ ID NO: 2957282 - protein, 17 aa, Entamoeba invadens
NCIACGCCSSVCPVGAI

SEQ ID NO: 2957283 - protein, 26 aa, Entamoeba invadens
NCIDITYKGVCVGLGNVIFRVDNETN

SEQ ID NO: 2957284 - protein, 17 aa, Entamoeba invadens
NCIELKVVHVPNSIASL

SEQ ID NO: 2957285 - protein, 18 aa, Entamoeba invadens
NCIFCSDGYMTLNSNDNG

SEQ ID NO: 2957286 - protein, 34 aa, Entamoeba invadens
NCIFMKEVIQFFPFVDIIELCFVSKRFHMMITKT

SEQ ID NO: 2957287 - protein, 22 aa, Entamoeba invadens
NCIGCGSCALSCRDNSTTAIKK

SEQ ID NO: 2957288 - protein, 17 aa, Entamoeba invadens
NCIGFKHLTDVKVPPGD

SEQ ID NO: 2957289 - protein, 17 aa, Entamoeba invadens
NCIKSDLQLKNELVNIE

SEQ ID NO: 2957290 - protein, 21 aa, Entamoeba invadens
NCIKSDLQLKNELVNIERLNF

SEQ ID NO: 2957291 - protein, 22 aa, Entamoeba invadens
NCISELIGIKVPEHITALHDYC

SEQ ID NO: 2957292 - protein, 19 aa, Entamoeba invadens
NCKAACWMKTLDDIKKLIV

SEQ ID NO: 2957293 - protein, 18 aa, Entamoeba invadens
NCKAESLWNVINKENIRF

SEQ ID NO: 2957294 - protein, 20 aa, Entamoeba invadens
NCKDSLAFYFEFLKEQIQKI

SEQ ID NO: 2957295 - protein, 19 aa, Entamoeba invadens
NCKGQYQYYLGFYDGNPAN

SEQ ID NO: 2957296 - protein, 20 aa, Entamoeba invadens
NCKLIDFIFDRTMKSMTISD

SEQ ID NO: 2957297 - protein, 27 aa, Entamoeba invadens
NCKNLRCVYIPQNVKLLGNVPFKKCPK

SEQ ID NO: 2957298 - protein, 19 aa, Entamoeba invadens
NCKNLSCVMLPKDLTKIKE

SEQ ID NO: 2957299 - protein, 24 aa, Entamoeba invadens
NCKQCGQTTFKKCYECETDFRPDP

SEQ ID NO: 2957300 - protein, 19 aa, Entamoeba invadens
NCKSLKYVVIENMQMEIGN

SEQ ID NO: 2957301 - protein, 21 aa, Entamoeba invadens
NCKSVVLPQKCRAFEIIDCEG

SEQ ID NO: 2957302 - protein, 21 aa, Entamoeba invadens
NCKTCTILFARYCNECNDHFK

SEQ ID NO: 2957303 - protein, 23 aa, Entamoeba invadens
NCKTIIGGICIELGGAFDYGNKE

SEQ ID NO: 2957304 - protein, 26 aa, Entamoeba invadens
NCKVEICGRFAYLGIPGRCVDTAKLA

SEQ ID NO: 2957305 - protein, 17 aa, Entamoeba invadens
NCLHYDLQISFRTSNEG

SEQ ID NO: 2957306 - protein, 25 aa, Entamoeba invadens
NCLKVDPLGKCIRCEEKFYLNDKHV

SEQ ID NO: 2957307 - protein, 21 aa, Entamoeba invadens
NCLKVGYYGCEVCADGYYLSH

SEQ ID NO: 2957308 - protein, 19 aa, Entamoeba invadens
NCLQIAIKTFGECNKTCLR

SEQ ID NO: 2957309 - protein, 20 aa, Entamoeba invadens
NCLTCSSSFDRICVTCKNTE

SEQ ID NO: 2957310 - protein, 17 aa, Entamoeba invadens
NCMGFKHLVDVKIPPGD

SEQ ID NO: 2957311 - protein, 22 aa, Entamoeba invadens
NCMGQSPLLLAIKKNYKDTINV

SEQ ID NO: 2957312 - protein, 23 aa, Entamoeba invadens
NCMGQSPLLLAIKYNHLSTINIL

SEQ ID NO: 2957313 - protein, 20 aa, Entamoeba invadens
NCMSCINATVCIECEGGFSV

SEQ ID NO: 2957314 - protein, 20 aa, Entamoeba invadens
NCNFLQITIETMKKAVYIRN

SEQ ID NO: 2957315 - protein, 22 aa, Entamoeba invadens
NCNSLKTVSFFGIGRTKEKTVV

SEQ ID NO: 2957316 - protein, 25 aa, Entamoeba invadens
NCNYCEGGKCKRCNEKYMIQSFKLC

SEQ ID NO: 2957317 - protein, 18 aa, Entamoeba invadens
NCPKRECNKITFTSQKIE

SEQ ID NO: 2957318 - protein, 18 aa, Entamoeba invadens
NCPKRECNKITFTSQKNE

SEQ ID NO: 2957319 - protein, 21 aa, Entamoeba invadens
NCPLLTTLELRMCSLVTDSGI

SEQ ID NO: 2957320 - protein, 22 aa, Entamoeba invadens
NCPYFCLVSQPVLSLMSTGQST

SEQ ID NO: 2957321 - protein, 19 aa, Entamoeba invadens
NCQACSTKTVGIPVCITCY

SEQ ID NO: 2957322 - protein, 17 aa, Entamoeba invadens
NCQNCCPTNLDAKRMVH

SEQ ID NO: 2957323 - protein, 18 aa, Entamoeba invadens
NCQSCGRIHCSEEVPGKC

SEQ ID NO: 2957324 - protein, 20 aa, Entamoeba invadens
NCQTIKAAIMYKEPSLNKYE

SEQ ID NO: 2957325 - protein, 21 aa, Entamoeba invadens
NCRPECGFCREGFVCTTAGKC

SEQ ID NO: 2957326 - protein, 20 aa, Entamoeba invadens
NCSEEALTIAAMLTVPNVFV

SEQ ID NO: 2957327 - protein, 22 aa, Entamoeba invadens
NCSEYFCLFKKIKFPITPLYQV

SEQ ID NO: 2957328 - protein, 20 aa, Entamoeba invadens
NCSHHLICLNHFKRYSTNKT

SEQ ID NO: 2957329 - protein, 24 aa, Entamoeba invadens
NCSISYSTAEFVKWMDDREKLIYK

SEQ ID NO: 2957330 - protein, 25 aa, Entamoeba invadens
NCSIYKAKVLLVFPQKNRYLVRLAK

SEQ ID NO: 2957331 - protein, 18 aa, Entamoeba invadens
NCSKLSVFDMPQCVNHIG

SEQ ID NO: 2957332 - protein, 21 aa, Entamoeba invadens
NCSLARNLTKAMAFLIENDFI

SEQ ID NO: 2957333 - protein, 18 aa, Entamoeba invadens
NCSNLKCVNFKNNLISFG

SEQ ID NO: 2957334 - protein, 19 aa, Entamoeba invadens
NCSSLCEICIGKNLECIGG

SEQ ID NO: 2957335 - protein, 24 aa, Entamoeba invadens
NCSTCDKSGLGTCQVCKNNNYAQD

SEQ ID NO: 2957336 - protein, 23 aa, Entamoeba invadens
NCTCKISSLLKLIYIDFKTAKET

SEQ ID NO: 2957337 - protein, 17 aa, Entamoeba invadens
NCTECEFLRTNCPKREC

SEQ ID NO: 2957338 - protein, 21 aa, Entamoeba invadens
NCTFGGVSYRGIFNDPYQSSQ

SEQ ID NO: 2957339 - protein, 20 aa, Entamoeba invadens
NCTFKTLKIVNSTIGEYSNL

SEQ ID NO: 2957340 - protein, 29 aa, Entamoeba invadens
NCTHFSAQLRYIVKYAHLYKPNTTFDIFI

SEQ ID NO: 2957341 - protein, 17 aa, Entamoeba invadens
NCTNCQVGYVFMEPKSV

SEQ ID NO: 2957342 - protein, 19 aa, Entamoeba invadens
NCTNISLEFEVTRTNEMLI

SEQ ID NO: 2957343 - protein, 21 aa, Entamoeba invadens
NCTQLPRIISIKVNEEEPVNV

SEQ ID NO: 2957344 - protein, 21 aa, Entamoeba invadens
NCTSCASGLVFTSPPSTVCEV

SEQ ID NO: 2957345 - protein, 21 aa, Entamoeba invadens
NCTSCKNGTFLQDNKCITCDV

SEQ ID NO: 2957346 - protein, 17 aa, Entamoeba invadens
NCTTKLPEIIKRVDDVI

SEQ ID NO: 2957347 - protein, 18 aa, Entamoeba invadens
NCVARKEVNFVFVVLKQF

SEQ ID NO: 2957348 - protein, 18 aa, Entamoeba invadens
NCVLWKGKSDIIKTALSR

SEQ ID NO: 2957349 - protein, 28 aa, Entamoeba invadens
NCVPEDFAARCLYWYNFGFSEVGDIKPS

SEQ ID NO: 2957350 - protein, 26 aa, Entamoeba invadens
NCVSELADLKELFSLPSTLKKADKYL

SEQ ID NO: 2957351 - protein, 18 aa, Entamoeba invadens
NCVTRITSVMAITDASEV

SEQ ID NO: 2957352 - protein, 20 aa, Entamoeba invadens
NCYFEKLPFIREIDNSADIK

SEQ ID NO: 2957353 - protein, 26 aa, Entamoeba invadens
NCYSLKRAWVPPHVFALKNHFFFGCV

SEQ ID NO: 2957354 - protein, 19 aa, Entamoeba invadens
NCYVKNCEFVNGMKELQQL

SEQ ID NO: 2957355 - protein, 25 aa, Entamoeba invadens
NDAETVKLIMAFFEIFVLRKVTVMK

SEQ ID NO: 2957356 - protein, 29 aa, Entamoeba invadens
NDAFYQFSFNPEQQVYVLFVIDSIVKNDV

SEQ ID NO: 2957357 - protein, 18 aa, Entamoeba invadens
NDAGAIYSGRRWDWRGNV

SEQ ID NO: 2957358 - protein, 22 aa, Entamoeba invadens
NDAIKARVSWDIKKDIKRTKLE

SEQ ID NO: 2957359 - protein, 25 aa, Entamoeba invadens
NDALVKIKLSFRPGAVDAEKAVAPR

SEQ ID NO: 2957360 - protein, 31 aa, Entamoeba invadens
NDAMAFMVFNFFKIRIEKSFTEKCVKPLKNI

SEQ ID NO: 2957361 - protein, 18 aa, Entamoeba invadens
NDAPRIILQNEPILLEIE

SEQ ID NO: 2957362 - protein, 18 aa, Entamoeba invadens
NDAYREWILSKFGKSSDS

SEQ ID NO: 2957363 - protein, 18 aa, Entamoeba invadens
NDCDEILSQRLIFQIQND

SEQ ID NO: 2957364 - protein, 24 aa, Entamoeba invadens
NDCELPSITYFIVWYKILYSQITT

SEQ ID NO: 2957365 - protein, 19 aa, Entamoeba invadens
NDCFKGCISLTSIDLPNLI

SEQ ID NO: 2957366 - protein, 25 aa, Entamoeba invadens
NDCPQVFSLFKKCDIIPIIYNSLRL

SEQ ID NO: 2957367 - protein, 18 aa, Entamoeba invadens
NDCVARNALYTLVELAQR

SEQ ID NO: 2957368 - protein, 27 aa, Entamoeba invadens
NDDCLKHELDLLFKYYPKVGVAVNKEF

SEQ ID NO: 2957369 - protein, 28 aa, Entamoeba invadens
NDDFRCVCLPPPTGKGMRSSKEKTVEER

SEQ ID NO: 2957370 - protein, 27 aa, Entamoeba invadens
NDDFRCVCLPPPTGKGVRSSKEKTVEE

SEQ ID NO: 2957371 - protein, 18 aa, Entamoeba invadens
NDDPEGMERVFLTCTVVH

SEQ ID NO: 2957372 - protein, 23 aa, Entamoeba invadens
NDDVDYCRSLYESPMWNADDVKE

SEQ ID NO: 2957373 - protein, 25 aa, Entamoeba invadens
NDECGGCTYQSMGYPHQLKLKADQV

SEQ ID NO: 2957374 - protein, 23 aa, Entamoeba invadens
NDEGFELGVKMLGHFSRSELSPM

SEQ ID NO: 2957375 - protein, 18 aa, Entamoeba invadens
NDELRVLKEECESMKKKR

SEQ ID NO: 2957376 - protein, 22 aa, Entamoeba invadens
NDERIVEVLKRYPLEDNTLREG

SEQ ID NO: 2957377 - protein, 19 aa, Entamoeba invadens
NDFCRVVGAPLPLPQIVLD

SEQ ID NO: 2957378 - protein, 24 aa, Entamoeba invadens
NDFEALPKLYSMRYEERTKFLQNC

SEQ ID NO: 2957379 - protein, 25 aa, Entamoeba invadens
NDFEEIPETIQLFSTMKKVSFSNNQ

SEQ ID NO: 2957380 - protein, 22 aa, Entamoeba invadens
NDFIKICFGEKIQSFDEFVDYL

SEQ ID NO: 2957381 - protein, 21 aa, Entamoeba invadens
NDFIPEISWVKFVANCKYLKT

SEQ ID NO: 2957382 - protein, 23 aa, Entamoeba invadens
NDFKENFEFLKLGFYHDENNIET

SEQ ID NO: 2957383 - protein, 17 aa, Entamoeba invadens
NDFKVTHLPTMLAGYVE

SEQ ID NO: 2957384 - protein, 20 aa, Entamoeba invadens
NDFLEFLAVLGDGVELRGFP

SEQ ID NO: 2957385 - protein, 24 aa, Entamoeba invadens
NDFLNKRLGGMANLVLEKENEQLR

SEQ ID NO: 2957386 - protein, 20 aa, Entamoeba invadens
NDFMRPILCGKNVLVETTDI

SEQ ID NO: 2957387 - protein, 20 aa, Entamoeba invadens
NDFRKVCEFCDSENETPVAV

SEQ ID NO: 2957388 - protein, 27 aa, Entamoeba invadens
NDFVVYWMRDIYKFKSIGVRLVEEEYE

SEQ ID NO: 2957389 - protein, 19 aa, Entamoeba invadens
NDGAKCFALNIGSDVPPYL

SEQ ID NO: 2957390 - protein, 20 aa, Entamoeba invadens
NDGFISYWRLFRNGRWKPVK

SEQ ID NO: 2957391 - protein, 22 aa, Entamoeba invadens
NDGFKYLVFKDKTYVKIFEGKL

SEQ ID NO: 2957392 - protein, 27 aa, Entamoeba invadens
NDGLEILLVMCLWKIVCPEYIHFLRGN

SEQ ID NO: 2957393 - protein, 18 aa, Entamoeba invadens
NDGLRFAIEKIDHISTSM

SEQ ID NO: 2957394 - protein, 17 aa, Entamoeba invadens
NDGNWQILFAWKNIDLH

SEQ ID NO: 2957395 - protein, 22 aa, Entamoeba invadens
NDGQNPFVFFLRFHDEPTVKEC

SEQ ID NO: 2957396 - protein, 24 aa, Entamoeba invadens
NDHKSGKSKGVFSKRVNKGGKSSG

SEQ ID NO: 2957397 - protein, 24 aa, Entamoeba invadens
NDIACAFNYAKIEIPRMFEHNSFE

SEQ ID NO: 2957398 - protein, 20 aa, Entamoeba invadens
NDIDSAINFCCINTKCFDAL

SEQ ID NO: 2957399 - protein, 23 aa, Entamoeba invadens
NDIEAAALCLKTMHSVEKKNVLI

SEQ ID NO: 2957400 - protein, 25 aa, Entamoeba invadens
NDIETRWFSKLGMLCSVRDNVEEIN

SEQ ID NO: 2957401 - protein, 21 aa, Entamoeba invadens
NDIFDEACRAILDLMMKKNVF

SEQ ID NO: 2957402 - protein, 22 aa, Entamoeba invadens
NDIFKNKIFAFLKEMQISHRSI

SEQ ID NO: 2957403 - protein, 17 aa, Entamoeba invadens
NDIFRNAYVATIGADWS

SEQ ID NO: 2957404 - protein, 23 aa, Entamoeba invadens
NDIKDGAVVTVVFVTPKKIYTAQ

SEQ ID NO: 2957405 - protein, 22 aa, Entamoeba invadens
NDIKIEGNAALSTRLDPTELID

SEQ ID NO: 2957406 - protein, 23 aa, Entamoeba invadens
NDIKSLYVVFFFIIKNLREETIQ

SEQ ID NO: 2957407 - protein, 17 aa, Entamoeba invadens
NDILKMTQNMFPLGDQQ

SEQ ID NO: 2957408 - protein, 18 aa, Entamoeba invadens
NDIMKMVSFVDLTKNGVS

SEQ ID NO: 2957409 - protein, 33 aa, Entamoeba invadens
NDINKLFCVQPIPRLPRKFCSTIQIQMFSIFFD

SEQ ID NO: 2957410 - protein, 17 aa, Entamoeba invadens
NDIPILMEKCMEGRKDE

SEQ ID NO: 2957411 - protein, 17 aa, Entamoeba invadens
NDIRLAFFDLVSAQSVV

SEQ ID NO: 2957412 - protein, 17 aa, Entamoeba invadens
NDISDAEIIGFEEKAQL

SEQ ID NO: 2957413 - protein, 18 aa, Entamoeba invadens
NDISELIALKELTLSSNV

SEQ ID NO: 2957414 - protein, 26 aa, Entamoeba invadens
NDISGKGGDCLILLETASATPVTVMA

SEQ ID NO: 2957415 - protein, 18 aa, Entamoeba invadens
NDKALVYLTIWYNIITSR

SEQ ID NO: 2957416 - protein, 25 aa, Entamoeba invadens
NDKFKNVECFICKGYGHKQWDCPQK

SEQ ID NO: 2957417 - protein, 33 aa, Entamoeba invadens
NDKNCLRKMVDVFKAEWWFGGITKDDAVATLEG

SEQ ID NO: 2957418 - protein, 19 aa, Entamoeba invadens
NDKNVGWVRCVEAANPTNI

SEQ ID NO: 2957419 - protein, 25 aa, Entamoeba invadens
NDKRIPSWCDRILYKTERRHGVTVE

SEQ ID NO: 2957420 - protein, 21 aa, Entamoeba invadens
NDKRKMVNVAFRMPTGGTTKS

SEQ ID NO: 2957421 - protein, 17 aa, Entamoeba invadens
NDKTALLKETKRLNNTV

SEQ ID NO: 2957422 - protein, 18 aa, Entamoeba invadens
NDKVKCIVDKTVMNNEFV

SEQ ID NO: 2957423 - protein, 24 aa, Entamoeba invadens
NDLCKGFDDHGHFADIMTYIHKML

SEQ ID NO: 2957424 - protein, 19 aa, Entamoeba invadens
NDLDLRKYVKCYDQKTLPI

SEQ ID NO: 2957425 - protein, 19 aa, Entamoeba invadens
NDLEGWVKEIRRYCEITTS

SEQ ID NO: 2957426 - protein, 20 aa, Entamoeba invadens
NDLFARFPYTIEVLSEPKMS

SEQ ID NO: 2957427 - protein, 21 aa, Entamoeba invadens
NDLFVKLVMDTAMYYGDAEKI

SEQ ID NO: 2957428 - protein, 24 aa, Entamoeba invadens
NDLGEALYSFIDDLHMFSDEETVG

SEQ ID NO: 2957429 - protein, 27 aa, Entamoeba invadens
NDLKFDVVDKIDCCNEVIHRVQKMPLM

SEQ ID NO: 2957430 - protein, 25 aa, Entamoeba invadens
NDLKKAYRKLALKWHPDRNPNNKEE

SEQ ID NO: 2957431 - protein, 21 aa, Entamoeba invadens
NDLKTVCNILDKLGFACDLKK

SEQ ID NO: 2957432 - protein, 20 aa, Entamoeba invadens
NDLLHVLSCLEVFEEAASVL

SEQ ID NO: 2957433 - protein, 18 aa, Entamoeba invadens
NDLLNFISKISCERSELI

SEQ ID NO: 2957434 - protein, 20 aa, Entamoeba invadens
NDLPFRTGISASSYFAVLLL

SEQ ID NO: 2957435 - protein, 24 aa, Entamoeba invadens
NDLSAFVKRLMKCMITVLSDKGNT

SEQ ID NO: 2957436 - protein, 22 aa, Entamoeba invadens
NDLVMGGVVFKFEKTHTYGEDD

SEQ ID NO: 2957437 - protein, 19 aa, Entamoeba invadens
NDLVMGKFIGKGCYGSVYK

SEQ ID NO: 2957438 - protein, 17 aa, Entamoeba invadens
NDLVQRHLVSSNPQQME

SEQ ID NO: 2957439 - protein, 19 aa, Entamoeba invadens
NDLVYGMFHVVWLMTFDEK

SEQ ID NO: 2957440 - protein, 17 aa, Entamoeba invadens
NDMKWKTEMLDQKETQE

SEQ ID NO: 2957441 - protein, 24 aa, Entamoeba invadens
NDMMLQYHLVTVFILIVQTKSIPL

SEQ ID NO: 2957442 - protein, 23 aa, Entamoeba invadens
NDMNEADTLLNMFIDINTLLAAN

SEQ ID NO: 2957443 - protein, 20 aa, Entamoeba invadens
NDMSEMKTELEALEQAANTF

SEQ ID NO: 2957444 - protein, 17 aa, Entamoeba invadens
NDMVKEWEHGYTSDAKD

SEQ ID NO: 2957445 - protein, 19 aa, Entamoeba invadens
NDMYRSVILLLFQPQKKSV

SEQ ID NO: 2957446 - protein, 18 aa, Entamoeba invadens
NDNYSHYQICEWHSKELK

SEQ ID NO: 2957447 - protein, 26 aa, Entamoeba invadens
NDPESFCITARFYFKMLDNDENGVIS

SEQ ID NO: 2957448 - protein, 22 aa, Entamoeba invadens
NDPEWRVRSSVQLMLPQIVSYF

SEQ ID NO: 2957449 - protein, 31 aa, Entamoeba invadens
NDPFARVILFRFVFCRLVLFSLKLPADAGST

SEQ ID NO: 2957450 - protein, 18 aa, Entamoeba invadens
NDPFFQPPVQPFVQQNHF

SEQ ID NO: 2957451 - protein, 20 aa, Entamoeba invadens
NDPIYGIGWYKTRNNRMKAV

SEQ ID NO: 2957452 - protein, 23 aa, Entamoeba invadens
NDPKEIITFDSLWDILNKKYTYE

SEQ ID NO: 2957453 - protein, 22 aa, Entamoeba invadens
NDPKEKPTELVIKGEKQNEMPL

SEQ ID NO: 2957454 - protein, 21 aa, Entamoeba invadens
NDPKTRYALSAQWYNVTFKRA

SEQ ID NO: 2957455 - protein, 26 aa, Entamoeba invadens
NDPMKRYTLDLLMKVFLEETSFTKYQ

SEQ ID NO: 2957456 - protein, 22 aa, Entamoeba invadens
NDPTLCCLSPRIKFDQADKKDT

SEQ ID NO: 2957457 - protein, 23 aa, Entamoeba invadens
NDPYLNEIVKFVYNMLVGEDARE

SEQ ID NO: 2957458 - protein, 31 aa, Entamoeba invadens
NDQEIFCVMLRLVKGRKCYSLPLILNQYKGQ

SEQ ID NO: 2957459 - protein, 26 aa, Entamoeba invadens
NDQPIKWCWPIGVIFDALHNGSLPME

SEQ ID NO: 2957460 - protein, 17 aa, Entamoeba invadens
NDQRYTLDISKLKALGW

SEQ ID NO: 2957461 - protein, 25 aa, Entamoeba invadens
NDRESLCELIRPFFDNIGEHKETIK

SEQ ID NO: 2957462 - protein, 26 aa, Entamoeba invadens
NDRILLKLPIAYLFDVFAVSLDPTPV

SEQ ID NO: 2957463 - protein, 24 aa, Entamoeba invadens
NDRITCGSLNMIIYQFVMENNTFE

SEQ ID NO: 2957464 - protein, 24 aa, Entamoeba invadens
NDRMDIKVCYDLGQNSVEKPDVAN

SEQ ID NO: 2957465 - protein, 17 aa, Entamoeba invadens
NDRVEIIANDQGNRTTP

SEQ ID NO: 2957466 - protein, 25 aa, Entamoeba invadens
NDRVKRIQAALLYVWSITLILKNAF

SEQ ID NO: 2957467 - protein, 20 aa, Entamoeba invadens
NDSAESWAKHMVEDPSSSTW

SEQ ID NO: 2957468 - protein, 17 aa, Entamoeba invadens
NDSDGFMTMFNKLNEEM

SEQ ID NO: 2957469 - protein, 17 aa, Entamoeba invadens
NDSFTVSVQSALVKLDM

SEQ ID NO: 2957470 - protein, 17 aa, Entamoeba invadens
NDSLLIKTENLFIDQPK

SEQ ID NO: 2957471 - protein, 24 aa, Entamoeba invadens
NDSRDCSYFYGYEAIVTFLENNDL

SEQ ID NO: 2957472 - protein, 17 aa, Entamoeba invadens
NDSTGFVKSVCSRDETK

SEQ ID NO: 2957473 - protein, 18 aa, Entamoeba invadens
NDSVPISTIFKYFVPSTE

SEQ ID NO: 2957474 - protein, 29 aa, Entamoeba invadens
NDTKCVLFKLADSVPYPPFPISPNVSGMV

SEQ ID NO: 2957475 - protein, 26 aa, Entamoeba invadens
NDTKKCGKYTFFLNPSFFDQKISLTQ

SEQ ID NO: 2957476 - protein, 24 aa, Entamoeba invadens
NDTLYRRAFMFSFPVFTTAKKVID

SEQ ID NO: 2957477 - protein, 26 aa, Entamoeba invadens
NDTVCLQCGDGIWTLVQIDFGSNRHW

SEQ ID NO: 2957478 - protein, 24 aa, Entamoeba invadens
NDTYFKFKLILADFPIGQESKDLV

SEQ ID NO: 2957479 - protein, 23 aa, Entamoeba invadens
NDTYLYLHCCAVELVRQLNWTII

SEQ ID NO: 2957480 - protein, 19 aa, Entamoeba invadens
NDVFCVAWPLGEIDSELSF

SEQ ID NO: 2957481 - protein, 21 aa, Entamoeba invadens
NDVKESFDLSRIHNSEINTFK

SEQ ID NO: 2957482 - protein, 22 aa, Entamoeba invadens
NDVKKTFSVFAVFKNPETAENI

SEQ ID NO: 2957483 - protein, 20 aa, Entamoeba invadens
NDVKMAIKMRHRTTTSTSKD

SEQ ID NO: 2957484 - protein, 17 aa, Entamoeba invadens
NDVKNRYFGSLKKNLSK

SEQ ID NO: 2957485 - protein, 19 aa, Entamoeba invadens
NDVKTLGNYCFNDCKNLKS

SEQ ID NO: 2957486 - protein, 25 aa, Entamoeba invadens
NDVLEVLASLLFRSMMHQRLSENIN

SEQ ID NO: 2957487 - protein, 25 aa, Entamoeba invadens
NDVMGCGFLINKKMVFFTRNGSFLC

SEQ ID NO: 2957488 - protein, 24 aa, Entamoeba invadens
NDVPRELVELLEVVKMQNSKIYEM

SEQ ID NO: 2957489 - protein, 18 aa, Entamoeba invadens
NDVPRTATLLKFPEEEAE

SEQ ID NO: 2957490 - protein, 26 aa, Entamoeba invadens
NDVRAAIHLLIRLGYKDVVSVLKEVF

SEQ ID NO: 2957491 - protein, 23 aa, Entamoeba invadens
NDVVEVWDAIFAYGEHLKLIEGM

SEQ ID NO: 2957492 - protein, 24 aa, Entamoeba invadens
NDVYNCTQEFFDLMRVEDLDMIKT

SEQ ID NO: 2957493 - protein, 23 aa, Entamoeba invadens
NDWPHRFAALSAFSQVVPRGKFV

SEQ ID NO: 2957494 - protein, 18 aa, Entamoeba invadens
NDYTSAFESAERWYKVAK

SEQ ID NO: 2957495 - protein, 24 aa, Entamoeba invadens
NEADEMMLILSFLKSDLALTARFF

SEQ ID NO: 2957496 - protein, 26 aa, Entamoeba invadens
NEAFNYRVTPLIPKEVTSLGTRLFTE

SEQ ID NO: 2957497 - protein, 25 aa, Entamoeba invadens
NEAIKAYFKAVGLTPQLPEVWYNMG

SEQ ID NO: 2957498 - protein, 22 aa, Entamoeba invadens
NEAKGANFIRPVFVPDSESPEC

SEQ ID NO: 2957499 - protein, 18 aa, Entamoeba invadens
NEAKGCSAIVLWLDCDRE

SEQ ID NO: 2957500 - protein, 18 aa, Entamoeba invadens
NEALKAFLSGGGAIKPIK

SEQ ID NO: 2957501 - protein, 19 aa, Entamoeba invadens
NEALKCYQLALSLDSNLLS

SEQ ID NO: 2957502 - protein, 20 aa, Entamoeba invadens
NEAPFERTLKENVQKLVETD

SEQ ID NO: 2957503 - protein, 21 aa, Entamoeba invadens
NEAPSGMLARGEYKSNVKFTD

SEQ ID NO: 2957504 - protein, 21 aa, Entamoeba invadens
NEARHQCEFLIYGKKQPSLEK

SEQ ID NO: 2957505 - protein, 24 aa, Entamoeba invadens
NEATKLKSALAYVLRKYNDSVDDD

SEQ ID NO: 2957506 - protein, 24 aa, Entamoeba invadens
NEAVRCIKETTLPIDDLVKQVKDK

SEQ ID NO: 2957507 - protein, 19 aa, Entamoeba invadens
NEAWLNILLGCMGESVDFT

SEQ ID NO: 2957508 - protein, 24 aa, Entamoeba invadens
NECEELKKKIAMMECEKIKESDLI

SEQ ID NO: 2957509 - protein, 20 aa, Entamoeba invadens
NECFRYCKNLEIGIPNTVNS

SEQ ID NO: 2957510 - protein, 21 aa, Entamoeba invadens
NECTIRRFLPMKNKVAIGKIF

SEQ ID NO: 2957511 - protein, 18 aa, Entamoeba invadens
NEDAEFDPSIQLETSVKP

SEQ ID NO: 2957512 - protein, 26 aa, Entamoeba invadens
NEDECVWWEKNLCKKSQIYEGVYDAE

SEQ ID NO: 2957513 - protein, 17 aa, Entamoeba invadens
NEDEMRNAVLLVFANKH

SEQ ID NO: 2957514 - protein, 25 aa, Entamoeba invadens
NEDEVKEFLSDFNIRKVTQIIKKKG

SEQ ID NO: 2957515 - protein, 33 aa, Entamoeba invadens
NEDGWYKEKVEMFDFLDDVKRFEGVYKGLKDST

SEQ ID NO: 2957516 - protein, 21 aa, Entamoeba invadens
NEDKCPLKVYGRINESGLGLT

SEQ ID NO: 2957517 - protein, 46 aa, Entamoeba invadens
NEDLKYIGNFAFKYCKQLKIAHLKKKVCYVGTFAFMGCEKLEEIVI

SEQ ID NO: 2957518 - protein, 24 aa, Entamoeba invadens
NEDLRQLLFLFIAELLRFQDTLPK

SEQ ID NO: 2957519 - protein, 26 aa, Entamoeba invadens
NEEECWKALIPRVDTLHTFFEFSNEL

SEQ ID NO: 2957520 - protein, 23 aa, Entamoeba invadens
NEEEVYWAFNMIINGTKYNLREM

SEQ ID NO: 2957521 - protein, 24 aa, Entamoeba invadens
NEEFLKKFILEKKWMELEENDSEE

SEQ ID NO: 2957522 - protein, 24 aa, Entamoeba invadens
NEEFLSHLLPMWSDDLLYKDLEKM

SEQ ID NO: 2957523 - protein, 24 aa, Entamoeba invadens
NEEFRLAICPHIPIEDVAEFVLKG

SEQ ID NO: 2957524 - protein, 18 aa, Entamoeba invadens
NEEGRLLPQETIYQESLS

SEQ ID NO: 2957525 - protein, 18 aa, Entamoeba invadens
NEEGWKGAKEMYSLTKAM

SEQ ID NO: 2957526 - protein, 23 aa, Entamoeba invadens
NEEHKIHIPILFDSVQEFNLDSS

SEQ ID NO: 2957527 - protein, 26 aa, Entamoeba invadens
NEEILRRIGFNLPFNNEFCERSRPDV

SEQ ID NO: 2957528 - protein, 24 aa, Entamoeba invadens
NEEKAEVLRTCIIYQLNDFLDTVK

SEQ ID NO: 2957529 - protein, 25 aa, Entamoeba invadens
NEEKEIPQFLFGHSMGGLLTSILAS

SEQ ID NO: 2957530 - protein, 24 aa, Entamoeba invadens
NEEKKVIIIMDVFYKQFVDELNLE

SEQ ID NO: 2957531 - protein, 18 aa, Entamoeba invadens
NEELRNCRFPMADTKELE

SEQ ID NO: 2957532 - protein, 26 aa, Entamoeba invadens
NEENRMNVQIPWGLEKALKYLFDKGL

SEQ ID NO: 2957533 - protein, 26 aa, Entamoeba invadens
NEEPETLAMCFACLAKGSQKNPHSPI

SEQ ID NO: 2957534 - protein, 20 aa, Entamoeba invadens
NEERTEGGAQREKRDDRREG

SEQ ID NO: 2957535 - protein, 19 aa, Entamoeba invadens
NEESALAFELYELCEIKDQ

SEQ ID NO: 2957536 - protein, 23 aa, Entamoeba invadens
NEESLQVVWFWSVLEEMNQLLRN

SEQ ID NO: 2957537 - protein, 23 aa, Entamoeba invadens
NEEYNLICECWRQKREERLVIED

SEQ ID NO: 2957538 - protein, 25 aa, Entamoeba invadens
NEFDPEKRSTIGVEFATRSIQHEQK

SEQ ID NO: 2957539 - protein, 24 aa, Entamoeba invadens
NEFIQRMSFINVSNLTNWGIALKY

SEQ ID NO: 2957540 - protein, 23 aa, Entamoeba invadens
NEFSTDLLKTWTVFDDILPDIDS

SEQ ID NO: 2957541 - protein, 24 aa, Entamoeba invadens
NEFVRNRFYSFIGHCQEQPTTKEI

SEQ ID NO: 2957542 - protein, 29 aa, Entamoeba invadens
NEGFLMMIFYYLGCEITLKRTLKEGKFQK

SEQ ID NO: 2957543 - protein, 19 aa, Entamoeba invadens
NEGGVVMLQALIRGHFVKK

SEQ ID NO: 2957544 - protein, 20 aa, Entamoeba invadens
NEGLEAISYLVTIPEGCDQL

SEQ ID NO: 2957545 - protein, 18 aa, Entamoeba invadens
NEGLLGLVNKWEKYYEPR

SEQ ID NO: 2957546 - protein, 26 aa, Entamoeba invadens
NEGMYRYTPLWIFKIMMWLRKLLYPR

SEQ ID NO: 2957547 - protein, 27 aa, Entamoeba invadens
NEGRRKQVFLRRNVLVWNLKSDFTMAE

SEQ ID NO: 2957548 - protein, 21 aa, Entamoeba invadens
NEGVIPRLVFELFDVLEKKGL

SEQ ID NO: 2957549 - protein, 23 aa, Entamoeba invadens
NEGWELGCDICLLKEMDREGLEY

SEQ ID NO: 2957550 - protein, 19 aa, Entamoeba invadens
NEHGLSIDYIRHFMNDINN

SEQ ID NO: 2957551 - protein, 18 aa, Entamoeba invadens
NEHIHTIESLSGVYGVSD

SEQ ID NO: 2957552 - protein, 17 aa, Entamoeba invadens
NEHIPIVLCGNKCDLEC

SEQ ID NO: 2957553 - protein, 25 aa, Entamoeba invadens
NEHLFELNIPDTFFLELSKEKMENW

SEQ ID NO: 2957554 - protein, 19 aa, Entamoeba invadens
NEHPLGFYSKDIIPLSTQF

SEQ ID NO: 2957555 - protein, 21 aa, Entamoeba invadens
NEHPLMYPDFVIGDRDKNADL

SEQ ID NO: 2957556 - protein, 26 aa, Entamoeba invadens
NEHQAHSMGYFFPVLPFQDPNTSTFK

SEQ ID NO: 2957557 - protein, 19 aa, Entamoeba invadens
NEIAAVLYYVFAVTPNIID

SEQ ID NO: 2957558 - protein, 23 aa, Entamoeba invadens
NEIAPRNGLLRVREFTLAEIEYF

SEQ ID NO: 2957559 - protein, 19 aa, Entamoeba invadens
NEICKLYKLEVVTPSPNKI

SEQ ID NO: 2957560 - protein, 21 aa, Entamoeba invadens
NEIEYSWGMGIDIILCTNCVV

SEQ ID NO: 2957561 - protein, 26 aa, Entamoeba invadens
NEIFDCPIKICAMTSLRTLDLSYNGD

SEQ ID NO: 2957562 - protein, 17 aa, Entamoeba invadens
NEIFWMFIEDDVRADVV

SEQ ID NO: 2957563 - protein, 26 aa, Entamoeba invadens
NEIGVACCYECKFLNKIEIPDKITMI

SEQ ID NO: 2957564 - protein, 27 aa, Entamoeba invadens
NEIIKLIKLFMVRTFIFTCSQIALESV

SEQ ID NO: 2957565 - protein, 20 aa, Entamoeba invadens
NEIINCLTLTNFVVQNSPTF

SEQ ID NO: 2957566 - protein, 25 aa, Entamoeba invadens
NEIIPKLGNIFVYRLPVECLIKPIM

SEQ ID NO: 2957567 - protein, 17 aa, Entamoeba invadens
NEIITCLTEELNALREE

SEQ ID NO: 2957568 - protein, 21 aa, Entamoeba invadens
NEIKEYAFAHSKLQTTTLKNV

SEQ ID NO: 2957569 - protein, 21 aa, Entamoeba invadens
NEILHSCFLQPFLSQQQIEKM

SEQ ID NO: 2957570 - protein, 26 aa, Entamoeba invadens
NEINNLKFLFKYYLLVSNYVAAVGVL

SEQ ID NO: 2957571 - protein, 17 aa, Entamoeba invadens
NEIPKSVNIYSLSLLNN

SEQ ID NO: 2957572 - protein, 25 aa, Entamoeba invadens
NEIPRIVERLGFIRRTIGIKSESVL

SEQ ID NO: 2957573 - protein, 17 aa, Entamoeba invadens
NEIRVVSCRQVRNISVF

SEQ ID NO: 2957574 - protein, 21 aa, Entamoeba invadens
NEITLAYLIPALDKYLYDYDD

SEQ ID NO: 2957575 - protein, 18 aa, Entamoeba invadens
NEIVKWKIFSISPVKRDI

SEQ ID NO: 2957576 - protein, 21 aa, Entamoeba invadens
NEIYGRVPYRIFKTMKNVVCN

SEQ ID NO: 2957577 - protein, 17 aa, Entamoeba invadens
NEIYVAGCLKFVSQVSD

SEQ ID NO: 2957578 - protein, 19 aa, Entamoeba invadens
NEKAELFLQIVDFNINVFV

SEQ ID NO: 2957579 - protein, 26 aa, Entamoeba invadens
NEKALLCISRIFKFTASCINDIPNTT

SEQ ID NO: 2957580 - protein, 27 aa, Entamoeba invadens
NEKCKVRAIKLLRSWCGQTDEIWNSMD

SEQ ID NO: 2957581 - protein, 20 aa, Entamoeba invadens
NEKCLICNDIFLLNNENVCV

SEQ ID NO: 2957582 - protein, 20 aa, Entamoeba invadens
NEKCLQCQDGYFMLEDFTCS

SEQ ID NO: 2957583 - protein, 41 aa, Entamoeba invadens
NEKDFSYVYVRAIYKDVNFSFCLHHHKWLLSENEKDHSSYK

SEQ ID NO: 2957584 - protein, 17 aa, Entamoeba invadens
NEKDLTTLFAIIDQNNA

SEQ ID NO: 2957585 - protein, 27 aa, Entamoeba invadens
NEKDVLNWLVKLAWSMSKIYEMNLSHL

SEQ ID NO: 2957586 - protein, 21 aa, Entamoeba invadens
NEKEVLNVFVVIWDTLSSTDQ

SEQ ID NO: 2957587 - protein, 28 aa, Entamoeba invadens
NEKHLLCQFRMNCSFFGLLVDTQVNVKY

SEQ ID NO: 2957588 - protein, 23 aa, Entamoeba invadens
NEKKCEEILEGGAISLCADLGGE

SEQ ID NO: 2957589 - protein, 24 aa, Entamoeba invadens
NEKKIKIENRMAKIVDEKQNFENE

SEQ ID NO: 2957590 - protein, 21 aa, Entamoeba invadens
NEKKPKKKRVSDYEKAEKLKR

SEQ ID NO: 2957591 - protein, 19 aa, Entamoeba invadens
NEKMNLFVAHVLNLPVVVE

SEQ ID NO: 2957592 - protein, 19 aa, Entamoeba invadens
NEKNVWTLPLIDYMNDCIE

SEQ ID NO: 2957593 - protein, 22 aa, Entamoeba invadens
NEKRFAFVTMFFQQMIVHTKLN

SEQ ID NO: 2957594 - protein, 21 aa, Entamoeba invadens
NEKRIICSIASTTKNLSISDI

SEQ ID NO: 2957595 - protein, 17 aa, Entamoeba invadens
NEKRKAAELTLYDVMEV

SEQ ID NO: 2957596 - protein, 32 aa, Entamoeba invadens
NEKRLNYPIKVFLKRTSSTIVDLTGFTNDEFD

SEQ ID NO: 2957597 - protein, 21 aa, Entamoeba invadens
NEKRYKWELEYSSNGRLACDI

SEQ ID NO: 2957598 - protein, 24 aa, Entamoeba invadens
NEKSFESLDTWKAEFIKGACPSNP

SEQ ID NO: 2957599 - protein, 26 aa, Entamoeba invadens
NEKSPDFFISVAYIYTFAFLKENKKI

SEQ ID NO: 2957600 - protein, 23 aa, Entamoeba invadens
NEKSSSLIQCRFVEGSQMGFKLR

SEQ ID NO: 2957601 - protein, 20 aa, Entamoeba invadens
NEKTRMCWFNSTSQSLNDYK

SEQ ID NO: 2957602 - protein, 21 aa, Entamoeba invadens
NEKVAPYGLRVNKLGEDIKDG

SEQ ID NO: 2957603 - protein, 20 aa, Entamoeba invadens
NEKWSIPAVQSILGEFGVRV

SEQ ID NO: 2957604 - protein, 25 aa, Entamoeba invadens
NELAESAFRVMFPLDEFVQTMLSLK

SEQ ID NO: 2957605 - protein, 27 aa, Entamoeba invadens
NELCKRARLAKVNAYIVSYLREQMPTF

SEQ ID NO: 2957606 - protein, 20 aa, Entamoeba invadens
NELCLRLFKPTIYNDAAVER

SEQ ID NO: 2957607 - protein, 22 aa, Entamoeba invadens
NELCVKIGKKAYTLKVVVVSGD

SEQ ID NO: 2957608 - protein, 32 aa, Entamoeba invadens
NELDLVRCELYGGGNWPSWFDRDLGVCGRVIT

SEQ ID NO: 2957609 - protein, 24 aa, Entamoeba invadens
NELEIWINFLLYRDWKNIIKPDYS

SEQ ID NO: 2957610 - protein, 19 aa, Entamoeba invadens
NELEMPLFAPEIVEKLLGF

SEQ ID NO: 2957611 - protein, 23 aa, Entamoeba invadens
NELEVSLVLKLERNKVVSADVLT

SEQ ID NO: 2957612 - protein, 19 aa, Entamoeba invadens
NELEYRRTPKSFVIRRGRI

SEQ ID NO: 2957613 - protein, 23 aa, Entamoeba invadens
NELGEFYAMVSFVNPNVLSEIST

SEQ ID NO: 2957614 - protein, 18 aa, Entamoeba invadens
NELGLPAVMGQLYNSLYL

SEQ ID NO: 2957615 - protein, 26 aa, Entamoeba invadens
NELIFKSKFFYVKRYEYLDQIYKSNK

SEQ ID NO: 2957616 - protein, 17 aa, Entamoeba invadens
NELKGDLINKVRWIDST

SEQ ID NO: 2957617 - protein, 21 aa, Entamoeba invadens
NELKGDLINKVRWIDSTKETT

SEQ ID NO: 2957618 - protein, 24 aa, Entamoeba invadens
NELKHRKAKDKKKITDLEQQLQDL

SEQ ID NO: 2957619 - protein, 20 aa, Entamoeba invadens
NELKKVIKKCHHIRHKVHVC

SEQ ID NO: 2957620 - protein, 17 aa, Entamoeba invadens
NELKPQAIIHENQSFVN

SEQ ID NO: 2957621 - protein, 19 aa, Entamoeba invadens
NELKRRQSIEDTPQQKASI

SEQ ID NO: 2957622 - protein, 17 aa, Entamoeba invadens
NELPIENTISFIQNQVM

SEQ ID NO: 2957623 - protein, 17 aa, Entamoeba invadens
NELPKEEKIVVEQQNTV

SEQ ID NO: 2957624 - protein, 27 aa, Entamoeba invadens
NELQDGKMKWALLSRRIDQLDQLFNML

SEQ ID NO: 2957625 - protein, 25 aa, Entamoeba invadens
NELQTLLEILCEWSQNGGVPKFQRR

SEQ ID NO: 2957626 - protein, 17 aa, Entamoeba invadens
NELRTFRFINFFVKSTS

SEQ ID NO: 2957627 - protein, 25 aa, Entamoeba invadens
NELSEKGKVFDVWKQMKTLNVLYAA

SEQ ID NO: 2957628 - protein, 23 aa, Entamoeba invadens
NELSRPFVKSEFLEKIEKMRKGD

SEQ ID NO: 2957629 - protein, 20 aa, Entamoeba invadens
NELTSTFWQRCNASHLNSLS

SEQ ID NO: 2957630 - protein, 18 aa, Entamoeba invadens
NELVAMGAVDCLKQLVSL

SEQ ID NO: 2957631 - protein, 26 aa, Entamoeba invadens
NELVDCVKCVKATHIVPTVVNPDQDP

SEQ ID NO: 2957632 - protein, 21 aa, Entamoeba invadens
NEMKLFCSYLSEFSSDKTTHG

SEQ ID NO: 2957633 - protein, 21 aa, Entamoeba invadens
NEMLSSVIFCHQEDASWPFEE

SEQ ID NO: 2957634 - protein, 29 aa, Entamoeba invadens
NEMMELKGNIRVFCRVRPIIFAPSATMYV

SEQ ID NO: 2957635 - protein, 23 aa, Entamoeba invadens
NEMNALNVIGLFFAIKSPNEQPE

SEQ ID NO: 2957636 - protein, 18 aa, Entamoeba invadens
NEMSGAFGSHLILEKYCK

SEQ ID NO: 2957637 - protein, 24 aa, Entamoeba invadens
NENECYRTHMRWIVNNFGITESKR

SEQ ID NO: 2957638 - protein, 25 aa, Entamoeba invadens
NENECYRTHMRWIVNNFGITESKRN

SEQ ID NO: 2957639 - protein, 30 aa, Entamoeba invadens
NENFKCFMTKKLRNVRVFTKFLSNNTNEAV

SEQ ID NO: 2957640 - protein, 23 aa, Entamoeba invadens
NENFPNFDVYKIHIHIDKTLYNT

SEQ ID NO: 2957641 - protein, 26 aa, Entamoeba invadens
NENIKRKRGVLVHCECGISRSASIVI

SEQ ID NO: 2957642 - protein, 24 aa, Entamoeba invadens
NENVGMAFSIKRSGNGYQVVALFS

SEQ ID NO: 2957643 - protein, 19 aa, Entamoeba invadens
NENYKKEVYYGFMHEEELQ

SEQ ID NO: 2957644 - protein, 17 aa, Entamoeba invadens
NEPCIFGSADLGRPLWV

SEQ ID NO: 2957645 - protein, 31 aa, Entamoeba invadens
NEPELRDQFVFFKCRDEVERVFANFTDKQKA

SEQ ID NO: 2957646 - protein, 23 aa, Entamoeba invadens
NEPFLITKLQIWLELRNITDDID

SEQ ID NO: 2957647 - protein, 21 aa, Entamoeba invadens
NEPIATFPPQEKKFYPHYSGI

SEQ ID NO: 2957648 - protein, 17 aa, Entamoeba invadens
NEPLYDYSLGKIVDDVM

SEQ ID NO: 2957649 - protein, 28 aa, Entamoeba invadens
NEPLYYCPFCGSSMGKSSVRIHFDKWHL

SEQ ID NO: 2957650 - protein, 19 aa, Entamoeba invadens
NEPPTWLSQMPFVSPESNN

SEQ ID NO: 2957651 - protein, 19 aa, Entamoeba invadens
NEPRSRPVPKKEEYQEEPI

SEQ ID NO: 2957652 - protein, 26 aa, Entamoeba invadens
NEPTEKKFAAAIVKFLMWAEKKFGKK

SEQ ID NO: 2957653 - protein, 20 aa, Entamoeba invadens
NEQAAKMVLLLTSFFDSYHY

SEQ ID NO: 2957654 - protein, 24 aa, Entamoeba invadens
NEQEIFCVLLRLVKGRKCYSMPLI

SEQ ID NO: 2957655 - protein, 18 aa, Entamoeba invadens
NEQFPTLEMIASKQANHT

SEQ ID NO: 2957656 - protein, 20 aa, Entamoeba invadens
NEQFVHMLLHGVLRIFYEND

SEQ ID NO: 2957657 - protein, 25 aa, Entamoeba invadens
NEQGHCISVGVLAEIEEIRENRVTE

SEQ ID NO: 2957658 - protein, 27 aa, Entamoeba invadens
NEQIVRVEIPWFCLKSVGMDCENGSWV

SEQ ID NO: 2957659 - protein, 27 aa, Entamoeba invadens
NEQKAFIKKLWGLHVNKYYKDGYDLNT

SEQ ID NO: 2957660 - protein, 20 aa, Entamoeba invadens
NEQKSALELGIFGQLKFGIQ

SEQ ID NO: 2957661 - protein, 17 aa, Entamoeba invadens
NEQPLFVIHILWQRVLQ

SEQ ID NO: 2957662 - protein, 21 aa, Entamoeba invadens
NEQYNILSLSWKQCPNDRIEI

SEQ ID NO: 2957663 - protein, 18 aa, Entamoeba invadens
NEREILKGILEETIKEEM

SEQ ID NO: 2957664 - protein, 22 aa, Entamoeba invadens
NERENVCFFVFVKGKPDVCVGC

SEQ ID NO: 2957665 - protein, 19 aa, Entamoeba invadens
NERGTGCYFGLDVLCNFLN

SEQ ID NO: 2957666 - protein, 25 aa, Entamoeba invadens
NERHLPVTLPFLFHVLITTFFGVEP

SEQ ID NO: 2957667 - protein, 17 aa, Entamoeba invadens
NERIAKEKVELEEKERL

SEQ ID NO: 2957668 - protein, 19 aa, Entamoeba invadens
NERLGIGFVSDHRRMNVAL

SEQ ID NO: 2957669 - protein, 29 aa, Entamoeba invadens
NERLLLRYPDWRVMEEFEIENETETPIII

SEQ ID NO: 2957670 - protein, 19 aa, Entamoeba invadens
NERLMYWFLYHFTPDTVDF

SEQ ID NO: 2957671 - protein, 22 aa, Entamoeba invadens
NERLVNCPYDLTSLLHNTIYEE

SEQ ID NO: 2957672 - protein, 24 aa, Entamoeba invadens
NERMGVTVKCERFVIEINKNKTVL

SEQ ID NO: 2957673 - protein, 24 aa, Entamoeba invadens
NERRFSIARAKFYSAEILLALEHL

SEQ ID NO: 2957674 - protein, 21 aa, Entamoeba invadens
NERRIPGNKTWVTVVRQSVEN

SEQ ID NO: 2957675 - protein, 23 aa, Entamoeba invadens
NERTQCCLDYPFVSGVVCGVETR

SEQ ID NO: 2957676 - protein, 17 aa, Entamoeba invadens
NERVDVMEYIDLRRVVK

SEQ ID NO: 2957677 - protein, 26 aa, Entamoeba invadens
NESFKQPEIFTQISTGLQTEYQNAVS

SEQ ID NO: 2957678 - protein, 22 aa, Entamoeba invadens
NESLFKPCLKQIVMDEYSSELT

SEQ ID NO: 2957679 - protein, 18 aa, Entamoeba invadens
NESLKFEDILSIEHVYST

SEQ ID NO: 2957680 - protein, 20 aa, Entamoeba invadens
NESRMANDILGMLEKKVMEE

SEQ ID NO: 2957681 - protein, 26 aa, Entamoeba invadens
NESRPKLLFELFAPLFRFKDQALTLA

SEQ ID NO: 2957682 - protein, 29 aa, Entamoeba invadens
NESSQYKSGVPCFWLHVLKNSEIFEDLQG

SEQ ID NO: 2957683 - protein, 21 aa, Entamoeba invadens
NESVCVLLGGLTRILKFLLPF

SEQ ID NO: 2957684 - protein, 22 aa, Entamoeba invadens
NESVFTFLYNRLLRIYQALVNL

SEQ ID NO: 2957685 - protein, 24 aa, Entamoeba invadens
NESVHCPYCRTQLTKKDVHRLFVN

SEQ ID NO: 2957686 - protein, 19 aa, Entamoeba invadens
NESVYFLKWHILLPDYAIN

SEQ ID NO: 2957687 - protein, 20 aa, Entamoeba invadens
NESYKFLHLMYGLSERLFFG

SEQ ID NO: 2957688 - protein, 21 aa, Entamoeba invadens
NESYYKWDVATYCFIPNEKSV

SEQ ID NO: 2957689 - protein, 24 aa, Entamoeba invadens
NETESGDVFGCYIKKKINDNGDIS

SEQ ID NO: 2957690 - protein, 23 aa, Entamoeba invadens
NETHKQLLFEIGRRLAGNTQVGE

SEQ ID NO: 2957691 - protein, 21 aa, Entamoeba invadens
NETHMKWIFDNFGMNSNKRNY

SEQ ID NO: 2957692 - protein, 28 aa, Entamoeba invadens
NETIVLLRRRRLVILKSIEQLAKSLKSV

SEQ ID NO: 2957693 - protein, 28 aa, Entamoeba invadens
NETIVLLRRRRLVILKSVEQLAKSLKSV

SEQ ID NO: 2957694 - protein, 24 aa, Entamoeba invadens
NETKDLFPPEMMKEKTFFQEWSPQ

SEQ ID NO: 2957695 - protein, 24 aa, Entamoeba invadens
NETLLKMVRLYFERSNLHVIESNL

SEQ ID NO: 2957696 - protein, 20 aa, Entamoeba invadens
NETLLYCAPELLELNSKSRG

SEQ ID NO: 2957697 - protein, 24 aa, Entamoeba invadens
NETLPLKQIVSINFKRYFKLVYGS

SEQ ID NO: 2957698 - protein, 24 aa, Entamoeba invadens
NETMKKLKFMMELYTKQKEENAKL

SEQ ID NO: 2957699 - protein, 23 aa, Entamoeba invadens
NETSECKMCYSSFDNCKLCQKPY

SEQ ID NO: 2957700 - protein, 25 aa, Entamoeba invadens
NETSIGYFCFRGCSNLTSVTIPSSV

SEQ ID NO: 2957701 - protein, 21 aa, Entamoeba invadens
NETVRYNFSLIFSKFEPPLRL

SEQ ID NO: 2957702 - protein, 31 aa, Entamoeba invadens
NEVANLIKLWFRELPTLCLNPLSSTQIQAPS

SEQ ID NO: 2957703 - protein, 21 aa, Entamoeba invadens
NEVCKVFALRMDLNKVEKDLL

SEQ ID NO: 2957704 - protein, 23 aa, Entamoeba invadens
NEVEDLYEIMGRVMALCKKGIMI

SEQ ID NO: 2957705 - protein, 18 aa, Entamoeba invadens
NEVEIFYVFSKVMEMVER

SEQ ID NO: 2957706 - protein, 26 aa, Entamoeba invadens
NEVETLKFYFTFVIARHLEQRAFSPE

SEQ ID NO: 2957707 - protein, 18 aa, Entamoeba invadens
NEVICLAEDLNIPVYYQD

SEQ ID NO: 2957708 - protein, 30 aa, Entamoeba invadens
NEVKAFPGALEILKKLKGLGMKVAIATSSQ

SEQ ID NO: 2957709 - protein, 39 aa, Entamoeba invadens
NEVKLILDLEHEFYQRMGYLDMYPRIIFSNNFVSILTNT

SEQ ID NO: 2957710 - protein, 17 aa, Entamoeba invadens
NEVKTTGVYLLIPPKIS

SEQ ID NO: 2957711 - protein, 17 aa, Entamoeba invadens
NEVMCLVEDLIISIYYQ

SEQ ID NO: 2957712 - protein, 26 aa, Entamoeba invadens
NEVMGIGELCSFLYQNVNGIEALQNI

SEQ ID NO: 2957713 - protein, 28 aa, Entamoeba invadens
NEVPDWDWHFTFHIDHFEQLLGRFFEYE

SEQ ID NO: 2957714 - protein, 25 aa, Entamoeba invadens
NEVPSRLKIITNIIKRAIMILSQYP

SEQ ID NO: 2957715 - protein, 19 aa, Entamoeba invadens
NEVRELFRVYGTLRGVRVP

SEQ ID NO: 2957716 - protein, 23 aa, Entamoeba invadens
NEVRRWVEAEGDYYVPQAICVFS

SEQ ID NO: 2957717 - protein, 18 aa, Entamoeba invadens
NEVSCPSIRSDSVLTNTC

SEQ ID NO: 2957718 - protein, 24 aa, Entamoeba invadens
NEVVFKHCMSLYWNDLLKANGNKV

SEQ ID NO: 2957719 - protein, 24 aa, Entamoeba invadens
NEWFKMLWHEGLFNYYRKELKMTE

SEQ ID NO: 2957720 - protein, 25 aa, Entamoeba invadens
NEYEPEKKFTIGVEFATRTIEYDGK

SEQ ID NO: 2957721 - protein, 21 aa, Entamoeba invadens
NEYFIRQLLIKHFGLTHHNMI

SEQ ID NO: 2957722 - protein, 27 aa, Entamoeba invadens
NEYHIRLNREQCIKLTPPQDQIQTTTA

SEQ ID NO: 2957723 - protein, 18 aa, Entamoeba invadens
NEYQFQVLQKISEIEKRM

SEQ ID NO: 2957724 - protein, 22 aa, Entamoeba invadens
NEYSKRIMIGHRIERFYKSLTT

SEQ ID NO: 2957725 - protein, 18 aa, Entamoeba invadens
NEYWKSWIASNCNDLTEI

SEQ ID NO: 2957726 - protein, 24 aa, Entamoeba invadens
NEYYKWKVFEAVMKKYNMNPLVKD

SEQ ID NO: 2957727 - protein, 24 aa, Entamoeba invadens
NFAGVKYPLEWISKFKAEKTGKNN

SEQ ID NO: 2957728 - protein, 20 aa, Entamoeba invadens
NFAIFSVFIMDVLVFLDQLD

SEQ ID NO: 2957729 - protein, 30 aa, Entamoeba invadens
NFALKTEIRSFLTILSLVCFSLKKIKQTLG

SEQ ID NO: 2957730 - protein, 23 aa, Entamoeba invadens
NFAQSFLLLDLVKLLRDVTTNNR

SEQ ID NO: 2957731 - protein, 21 aa, Entamoeba invadens
NFATKCNFTSFKRLTNLTKIS

SEQ ID NO: 2957732 - protein, 19 aa, Entamoeba invadens
NFCALELKDGISKIKPEFA

SEQ ID NO: 2957733 - protein, 23 aa, Entamoeba invadens
NFCFRDCTCLTRVVLHEGIESFG

SEQ ID NO: 2957734 - protein, 18 aa, Entamoeba invadens
NFCLEMYARFGSDNIEIP

SEQ ID NO: 2957735 - protein, 23 aa, Entamoeba invadens
NFCTGRWKSVWNVTLNSSNVEVT

SEQ ID NO: 2957736 - protein, 25 aa, Entamoeba invadens
NFCVCSVCKCSYCEQHKSELEIVIP

SEQ ID NO: 2957737 - protein, 23 aa, Entamoeba invadens
NFCYIKRIIGLPYERIRYPEFFP

SEQ ID NO: 2957738 - protein, 23 aa, Entamoeba invadens
NFDIDHFFCFGITSLIKMLQEIH

SEQ ID NO: 2957739 - protein, 20 aa, Entamoeba invadens
NFDIPKGRVEFIPKIIEKAT

SEQ ID NO: 2957740 - protein, 25 aa, Entamoeba invadens
NFDTVLCIMLLFGTSAIHRLKRTFE

SEQ ID NO: 2957741 - protein, 18 aa, Entamoeba invadens
NFDTVVCIVSLFETSALH

SEQ ID NO: 2957742 - protein, 45 aa, Entamoeba invadens
NFEEFIMTWGCILLLKGDFNLLPKFCLIVRKFLEEKVKNGTSLEN

SEQ ID NO: 2957743 - protein, 17 aa, Entamoeba invadens
NFEFKDFVMFYSNCTAI

SEQ ID NO: 2957744 - protein, 20 aa, Entamoeba invadens
NFEIALQCVYDGVNVNKDET

SEQ ID NO: 2957745 - protein, 31 aa, Entamoeba invadens
NFELARKLSCCVPFGTPLVKMDNEWVKAFYK

SEQ ID NO: 2957746 - protein, 26 aa, Entamoeba invadens
NFELPFPITKSEYFQIYSFTDTSNLD

SEQ ID NO: 2957747 - protein, 25 aa, Entamoeba invadens
NFEPKKFCTLFESFHNVKTSDNCCF

SEQ ID NO: 2957748 - protein, 18 aa, Entamoeba invadens
NFEQLQFLFIDYTMTAKE

SEQ ID NO: 2957749 - protein, 19 aa, Entamoeba invadens
NFETLKLLDKANCTLGNPT

SEQ ID NO: 2957750 - protein, 24 aa, Entamoeba invadens
NFETLKLLDKANCTLGNPTPTSVS

SEQ ID NO: 2957751 - protein, 21 aa, Entamoeba invadens
NFFDALCDVCVMRQMHDDFSR

SEQ ID NO: 2957752 - protein, 26 aa, Entamoeba invadens
NFFEFLCFEWYYLASWYQNKKQIEYL

SEQ ID NO: 2957753 - protein, 34 aa, Entamoeba invadens
NFFEFPIPIKEEGEWKMSKFVSMSPRVEVVGNEI

SEQ ID NO: 2957754 - protein, 23 aa, Entamoeba invadens
NFFFTVFSAFWILSEGVGYIHQN

SEQ ID NO: 2957755 - protein, 20 aa, Entamoeba invadens
NFFFVPKMLLLVSHLTFNYQ

SEQ ID NO: 2957756 - protein, 18 aa, Entamoeba invadens
NFFGEETLLIGVEAKTPK

SEQ ID NO: 2957757 - protein, 17 aa, Entamoeba invadens
NFFLFSFKLTDSTPSVY

SEQ ID NO: 2957758 - protein, 24 aa, Entamoeba invadens
NFFNRLQNFLIFEILDQKNIEERV

SEQ ID NO: 2957759 - protein, 26 aa, Entamoeba invadens
NFFTYNRYKFGVLYAAPGQTKEMEFY

SEQ ID NO: 2957760 - protein, 24 aa, Entamoeba invadens
NFGFTCVWCGMQVHTECLDKITYY

SEQ ID NO: 2957761 - protein, 26 aa, Entamoeba invadens
NFGLISVCGLNFRYVTFFEDIVIQQL

SEQ ID NO: 2957762 - protein, 20 aa, Entamoeba invadens
NFGVFSFFESMKMRSDVISV

SEQ ID NO: 2957763 - protein, 19 aa, Entamoeba invadens
NFHIEFANWAIPMMTTDAV

SEQ ID NO: 2957764 - protein, 24 aa, Entamoeba invadens
NFIALKFELVMKLNELRDRTTKNK

SEQ ID NO: 2957765 - protein, 23 aa, Entamoeba invadens
NFIDFFEQFFPKTFLFIITNNKT

SEQ ID NO: 2957766 - protein, 23 aa, Entamoeba invadens
NFIEAFKGVEKCIGDTQDKVFIP

SEQ ID NO: 2957767 - protein, 17 aa, Entamoeba invadens
NFIIVGSEMKRCKPYAD

SEQ ID NO: 2957768 - protein, 19 aa, Entamoeba invadens
NFIRGCTTLTKLSFENNTV

SEQ ID NO: 2957769 - protein, 28 aa, Entamoeba invadens
NFIRLSDALKTWTGREEMLVLFDSDIDD

SEQ ID NO: 2957770 - protein, 26 aa, Entamoeba invadens
NFISIKGPELLTMWFGESEGNVREVF

SEQ ID NO: 2957771 - protein, 24 aa, Entamoeba invadens
NFKAWSVNPDDMFKEYPKPENGVI

SEQ ID NO: 2957772 - protein, 22 aa, Entamoeba invadens
NFKFQWKIAEFVMSGKRLERKE

SEQ ID NO: 2957773 - protein, 26 aa, Entamoeba invadens
NFKGKEIDEALRLVFEAFVMGGESQV

SEQ ID NO: 2957774 - protein, 19 aa, Entamoeba invadens
NFKKVDIIKVPKSVKKVDD

SEQ ID NO: 2957775 - protein, 18 aa, Entamoeba invadens
NFKLLCFEPEVVPAELAK

SEQ ID NO: 2957776 - protein, 28 aa, Entamoeba invadens
NFKMRKRVDEFYDAINMFSDVNVSKSFV

SEQ ID NO: 2957777 - protein, 26 aa, Entamoeba invadens
NFKPEKEQLVSIFLSSMSKLLKEEIL

SEQ ID NO: 2957778 - protein, 28 aa, Entamoeba invadens
NFKRVSLLHFLVYYFGQDWQKVANAPQG

SEQ ID NO: 2957779 - protein, 20 aa, Entamoeba invadens
NFKVKVCDFGFAEIANEKEK

SEQ ID NO: 2957780 - protein, 21 aa, Entamoeba invadens
NFKYKFFIFYKSCFYPFNFIH

SEQ ID NO: 2957781 - protein, 19 aa, Entamoeba invadens
NFLACKDYILTLCYNSLKD

SEQ ID NO: 2957782 - protein, 19 aa, Entamoeba invadens
NFLAMNLWTNLKFTRLSLV

SEQ ID NO: 2957783 - protein, 22 aa, Entamoeba invadens
NFLFDIALELGFTFDSKLSRKS

SEQ ID NO: 2957784 - protein, 24 aa, Entamoeba invadens
NFLFNIKTVFSFGIVEVLRDESPS

SEQ ID NO: 2957785 - protein, 22 aa, Entamoeba invadens
NFLFTCYAAFWITSNAKIYPHN

SEQ ID NO: 2957786 - protein, 25 aa, Entamoeba invadens
NFLILPVQRFPRYVMLLESLLKATP

SEQ ID NO: 2957787 - protein, 20 aa, Entamoeba invadens
NFLKLLLNIRCDDYANVLIG

SEQ ID NO: 2957788 - protein, 18 aa, Entamoeba invadens
NFLKSGMELDDFIKEKTK

SEQ ID NO: 2957789 - protein, 19 aa, Entamoeba invadens
NFLNGGVVTIEIEDCFFKY

SEQ ID NO: 2957790 - protein, 18 aa, Entamoeba invadens
NFLQVFPADHPTLKTLKL

SEQ ID NO: 2957791 - protein, 25 aa, Entamoeba invadens
NFLRAAPSFDEIYIWTINNENKIPL

SEQ ID NO: 2957792 - protein, 19 aa, Entamoeba invadens
NFLRGFTYSNWVKVKVISE

SEQ ID NO: 2957793 - protein, 17 aa, Entamoeba invadens
NFMEALSVKVSQLERNN

SEQ ID NO: 2957794 - protein, 18 aa, Entamoeba invadens
NFMFKNCVRLESVKMHEG

SEQ ID NO: 2957795 - protein, 18 aa, Entamoeba invadens
NFMGLPFLDEVVPFDDRF

SEQ ID NO: 2957796 - protein, 24 aa, Entamoeba invadens
NFMMKGFHMIGLFDGHGGDNVSKM

SEQ ID NO: 2957797 - protein, 19 aa, Entamoeba invadens
NFMNYKINFFFPSEKQNKT

SEQ ID NO: 2957798 - protein, 17 aa, Entamoeba invadens
NFMSLPLLQSVDLKNVI

SEQ ID NO: 2957799 - protein, 20 aa, Entamoeba invadens
NFMTCDDLEWALSRVGAVET

SEQ ID NO: 2957800 - protein, 19 aa, Entamoeba invadens
NFNDLRASLELFNKNNFFI

SEQ ID NO: 2957801 - protein, 20 aa, Entamoeba invadens
NFNKLRAIYKLIKKYEAYKN

SEQ ID NO: 2957802 - protein, 24 aa, Entamoeba invadens
NFNLDFYEGDLLKRENYKVVCDIF

SEQ ID NO: 2957803 - protein, 26 aa, Entamoeba invadens
NFNNRVSKSFGLECKMAVEVAEGIKD

SEQ ID NO: 2957804 - protein, 21 aa, Entamoeba invadens
NFPEVYLLEGGFKYFYENVNE

SEQ ID NO: 2957805 - protein, 26 aa, Entamoeba invadens
NFPGYLIELAKVFKINFNPHEPYQYL

SEQ ID NO: 2957806 - protein, 26 aa, Entamoeba invadens
NFPKTDPFMRYLIVFHILFGELQNLE

SEQ ID NO: 2957807 - protein, 26 aa, Entamoeba invadens
NFPNSLQFIGSFAFSNAKLVDVTIPE

SEQ ID NO: 2957808 - protein, 26 aa, Entamoeba invadens
NFPSKLMHLGKFCFEQCCSIKEIEIP

SEQ ID NO: 2957809 - protein, 24 aa, Entamoeba invadens
NFPTSILAFGAFCFTGCQMESIVL

SEQ ID NO: 2957810 - protein, 43 aa, Entamoeba invadens
NFQNIKGKILANLYLIVCYDFCVKLAQNLFFDVFFKVGKMSEN

SEQ ID NO: 2957811 - protein, 21 aa, Entamoeba invadens
NFQSLAAFYFGFEYPPVSRLG

SEQ ID NO: 2957812 - protein, 21 aa, Entamoeba invadens
NFRASKDICRVVGKENLFSLT

SEQ ID NO: 2957813 - protein, 24 aa, Entamoeba invadens
NFREPKFRDIFLLMFRLFTTPECF

SEQ ID NO: 2957814 - protein, 20 aa, Entamoeba invadens
NFRQECCFKYGDQIYNEVMK

SEQ ID NO: 2957815 - protein, 25 aa, Entamoeba invadens
NFRSKGRIPAMSWWNYEKKMYLLRS

SEQ ID NO: 2957816 - protein, 19 aa, Entamoeba invadens
NFSAIFEMFLLKELEREYP

SEQ ID NO: 2957817 - protein, 24 aa, Entamoeba invadens
NFSEELLGGIAMGRRSCYQFGNYL

SEQ ID NO: 2957818 - protein, 17 aa, Entamoeba invadens
NFSFARCNLLTTVVIPS

SEQ ID NO: 2957819 - protein, 31 aa, Entamoeba invadens
NFSKLREVMKIAVSPCIPFLGSTMGDLVFAD

SEQ ID NO: 2957820 - protein, 30 aa, Entamoeba invadens
NFSLGQRQLICLARALLKNSKILIMDEATA

SEQ ID NO: 2957821 - protein, 23 aa, Entamoeba invadens
NFSNPSCEEAFNLFMKRSADINK

SEQ ID NO: 2957822 - protein, 18 aa, Entamoeba invadens
NFSNRSLCYLKLENNASA

SEQ ID NO: 2957823 - protein, 25 aa, Entamoeba invadens
NFSRRCIICNTGFYPNDSGKCVSCG

SEQ ID NO: 2957824 - protein, 24 aa, Entamoeba invadens
NFSSFRREFEFEYFNNAELNVMDL

SEQ ID NO: 2957825 - protein, 20 aa, Entamoeba invadens
NFSTSAFGRIEMKNCNFVAS

SEQ ID NO: 2957826 - protein, 21 aa, Entamoeba invadens
NFSYHFKYYYSIKTSKSKNEM

SEQ ID NO: 2957827 - protein, 19 aa, Entamoeba invadens
NFTGIKEFTQWKASHDKDG

SEQ ID NO: 2957828 - protein, 20 aa, Entamoeba invadens
NFTHCLACSDGFFVENGICM

SEQ ID NO: 2957829 - protein, 18 aa, Entamoeba invadens
NFTMTLTMSEDWRRSHGI

SEQ ID NO: 2957830 - protein, 20 aa, Entamoeba invadens
NFTNRGKRACDVIKTGESQC

SEQ ID NO: 2957831 - protein, 18 aa, Entamoeba invadens
NFVFSNCCIFRIELKNAK

SEQ ID NO: 2957832 - protein, 23 aa, Entamoeba invadens
NFVGQFKAVVVFYNHVQISVHAI

SEQ ID NO: 2957833 - protein, 27 aa, Entamoeba invadens
NFVSDWADGFLMKFLFASETPFEKFQQ

SEQ ID NO: 2957834 - protein, 18 aa, Entamoeba invadens
NFVSFCINNGNKIYTLKC

SEQ ID NO: 2957835 - protein, 26 aa, Entamoeba invadens
NFVSIKGPELLTMWFGESEANVRNIF

SEQ ID NO: 2957836 - protein, 18 aa, Entamoeba invadens
NFVYEVIEKFVLGKGKRL

SEQ ID NO: 2957837 - protein, 22 aa, Entamoeba invadens
NFVYNCTNGFYGDGKGPSAYKT

SEQ ID NO: 2957838 - protein, 21 aa, Entamoeba invadens
NFYEMRRVVLAKADKTLESRE

SEQ ID NO: 2957839 - protein, 23 aa, Entamoeba invadens
NFYEWISCAKFEVLYDSERPIPI

SEQ ID NO: 2957840 - protein, 19 aa, Entamoeba invadens
NFYKCAANAYAAGYTKSQF

SEQ ID NO: 2957841 - protein, 23 aa, Entamoeba invadens
NFYSSFKPKHFVLMQRTRGKEWW

SEQ ID NO: 2957842 - protein, 18 aa, Entamoeba invadens
NFYYKIYIKLSYKKNMQN

SEQ ID NO: 2957843 - protein, 19 aa, Entamoeba invadens
NGAFYGCIDLKKYFCRICL

SEQ ID NO: 2957844 - protein, 17 aa, Entamoeba invadens
NGAKCGRLNSFNESCNE

SEQ ID NO: 2957845 - protein, 23 aa, Entamoeba invadens
NGAKEECLWENLVATIKKTIDVM

SEQ ID NO: 2957846 - protein, 23 aa, Entamoeba invadens
NGALDFPEFLKLMTALDAMPDNS

SEQ ID NO: 2957847 - protein, 21 aa, Entamoeba invadens
NGAYPKKLVVYRGTVNSGDLK

SEQ ID NO: 2957848 - protein, 18 aa, Entamoeba invadens
NGCASCAEQTYSLVNSSM

SEQ ID NO: 2957849 - protein, 19 aa, Entamoeba invadens
NGCFEGCAMLSKVDISSTV

SEQ ID NO: 2957850 - protein, 24 aa, Entamoeba invadens
NGCIMKIGILGAVHFWEEERVKEN

SEQ ID NO: 2957851 - protein, 26 aa, Entamoeba invadens
NGCRGFGVNVARTFLQQILQTLIVLY

SEQ ID NO: 2957852 - protein, 22 aa, Entamoeba invadens
NGCSICKPGYYSTNNECGICSN

SEQ ID NO: 2957853 - protein, 19 aa, Entamoeba invadens
NGDLKIRNKLIFKNINIMA

SEQ ID NO: 2957854 - protein, 24 aa, Entamoeba invadens
NGDLKTILLHKSFNLDTMEMKQET

SEQ ID NO: 2957855 - protein, 24 aa, Entamoeba invadens
NGDRRSGFGGGRFGGDRNNGDRNN

SEQ ID NO: 2957856 - protein, 18 aa, Entamoeba invadens
NGDVLCSAYCPDTSSLIA

SEQ ID NO: 2957857 - protein, 21 aa, Entamoeba invadens
NGDVMGCGYLADKKMIFFTKN

SEQ ID NO: 2957858 - protein, 25 aa, Entamoeba invadens
NGEACEFEILLTLKCITKMDECVVL

SEQ ID NO: 2957859 - protein, 19 aa, Entamoeba invadens
NGEISNFEYLMSLNCRAGR

SEQ ID NO: 2957860 - protein, 21 aa, Entamoeba invadens
NGEKKALCGKVHPEKFELKRL

SEQ ID NO: 2957861 - protein, 23 aa, Entamoeba invadens
NGEKRRILLVSGFIQVAYIQSIE

SEQ ID NO: 2957862 - protein, 19 aa, Entamoeba invadens
NGELGRIIFDRRWNGNYEK

SEQ ID NO: 2957863 - protein, 22 aa, Entamoeba invadens
NGELWKFTLYIMSIFPTSVISE

SEQ ID NO: 2957864 - protein, 18 aa, Entamoeba invadens
NGEMRRLYRFYKKNYGEQ

SEQ ID NO: 2957865 - protein, 24 aa, Entamoeba invadens
NGERTCMLCGVFVNNSVRSTERMI

SEQ ID NO: 2957866 - protein, 28 aa, Entamoeba invadens
NGEYSYYLTNLFGAISFLLQVTGKQLTI

SEQ ID NO: 2957867 - protein, 18 aa, Entamoeba invadens
NGFCVAKCNKSEERVGGE

SEQ ID NO: 2957868 - protein, 23 aa, Entamoeba invadens
NGFEFVVCVGFQPFGRIIKIRRN

SEQ ID NO: 2957869 - protein, 20 aa, Entamoeba invadens
NGFFSLDVIQLMSIDELKNL

SEQ ID NO: 2957870 - protein, 26 aa, Entamoeba invadens
NGFGELNLYCCVSLLTYFKSDLMKMD

SEQ ID NO: 2957871 - protein, 25 aa, Entamoeba invadens
NGFGGFGVLVVHFWALGKGGMDVTQ

SEQ ID NO: 2957872 - protein, 17 aa, Entamoeba invadens
NGFGSILIFGEQSPYEI

SEQ ID NO: 2957873 - protein, 17 aa, Entamoeba invadens
NGFGYALKDPITNQYWM

SEQ ID NO: 2957874 - protein, 21 aa, Entamoeba invadens
NGFHGFPYNFNRSVAKQLLHS

SEQ ID NO: 2957875 - protein, 22 aa, Entamoeba invadens
NGFHGFPYNFNRSVAKQLLHSL

SEQ ID NO: 2957876 - protein, 21 aa, Entamoeba invadens
NGFIQMCLMFLYSMEDNEASN

SEQ ID NO: 2957877 - protein, 25 aa, Entamoeba invadens
NGFISTDIFLAWFRDVVLTYIIKKC

SEQ ID NO: 2957878 - protein, 25 aa, Entamoeba invadens
NGFISTDIFLAWFRDVVLTYIIKKT

SEQ ID NO: 2957879 - protein, 34 aa, Entamoeba invadens
NGFKLTEPQMAFVLREVMRGLLYLHQRHKIHRDI

SEQ ID NO: 2957880 - protein, 24 aa, Entamoeba invadens
NGFKVFHLYVCVAILKKYSAKLVT

SEQ ID NO: 2957881 - protein, 26 aa, Entamoeba invadens
NGFLSDWRFKKVLNETLKNILMNNEL

SEQ ID NO: 2957882 - protein, 17 aa, Entamoeba invadens
NGFSHFHVYVCVSLIEK

SEQ ID NO: 2957883 - protein, 34 aa, Entamoeba invadens
NGFSKCVLDGMSMFTLKGSVEFGESSTLSLKGYS

SEQ ID NO: 2957884 - protein, 32 aa, Entamoeba invadens
NGGFAVKYEYSGMVLEVFLRRTKSSEIEKRKV

SEQ ID NO: 2957885 - protein, 26 aa, Entamoeba invadens
NGGFNIPGLTFNFSMPLTTTTAPQPT

SEQ ID NO: 2957886 - protein, 24 aa, Entamoeba invadens
NGGGHAITMWGYELGDYDMVDAEE

SEQ ID NO: 2957887 - protein, 18 aa, Entamoeba invadens
NGGMLYCLEYLESNVDWM

SEQ ID NO: 2957888 - protein, 18 aa, Entamoeba invadens
NGGNLCYLNSALQVLYSI

SEQ ID NO: 2957889 - protein, 18 aa, Entamoeba invadens
NGGTDPWHALGVTQQEGQ

SEQ ID NO: 2957890 - protein, 18 aa, Entamoeba invadens
NGHCFKCDNDQGKCIECT

SEQ ID NO: 2957891 - protein, 21 aa, Entamoeba invadens
NGHVLRIYNHFFTNKNSPLEL

SEQ ID NO: 2957892 - protein, 20 aa, Entamoeba invadens
NGICHSCTLIPNCQNCSSIE

SEQ ID NO: 2957893 - protein, 17 aa, Entamoeba invadens
NGICTFKNLEVLDSNVI

SEQ ID NO: 2957894 - protein, 17 aa, Entamoeba invadens
NGIEVFQLLLTLKVKYP

SEQ ID NO: 2957895 - protein, 27 aa, Entamoeba invadens
NGIIELLKRRGNLMEIMPTRSSSKSVK

SEQ ID NO: 2957896 - protein, 19 aa, Entamoeba invadens
NGIINRFVMINAKELKIIH

SEQ ID NO: 2957897 - protein, 24 aa, Entamoeba invadens
NGIKESRLLCTPDYVAPESLKEFF

SEQ ID NO: 2957898 - protein, 21 aa, Entamoeba invadens
NGIKGCVKLIDKKEEKFERKE

SEQ ID NO: 2957899 - protein, 34 aa, Entamoeba invadens
NGIKRRRKYLIKKECKDQAFWLGKASRAKYFQVG

SEQ ID NO: 2957900 - protein, 26 aa, Entamoeba invadens
NGIKVLDFGSACFDNYTLYTYVQSRH

SEQ ID NO: 2957901 - protein, 18 aa, Entamoeba invadens
NGILGCLYLQNFGNKLVL

SEQ ID NO: 2957902 - protein, 24 aa, Entamoeba invadens
NGILLRPIPRAKRILSSPRYLPHV

SEQ ID NO: 2957903 - protein, 24 aa, Entamoeba invadens
NGILLRPIPRAKRLLSSPRHLPHV

SEQ ID NO: 2957904 - protein, 19 aa, Entamoeba invadens
NGILMQMGYILSRVRDDAI

SEQ ID NO: 2957905 - protein, 22 aa, Entamoeba invadens
NGIMFHIDFGYILGKECKPFPP

SEQ ID NO: 2957906 - protein, 27 aa, Entamoeba invadens
NGINAVRWVGGVELELLAIATGARIVP

SEQ ID NO: 2957907 - protein, 24 aa, Entamoeba invadens
NGIRLHSQYHLRAAVRTLQQAAKI

SEQ ID NO: 2957908 - protein, 17 aa, Entamoeba invadens
NGISMCELNFTPIDEPK

SEQ ID NO: 2957909 - protein, 18 aa, Entamoeba invadens
NGISVVHRTEVLKKISPN

SEQ ID NO: 2957910 - protein, 27 aa, Entamoeba invadens
NGITELKMYCCPVLKSFSLPQKVKNLS

SEQ ID NO: 2957911 - protein, 18 aa, Entamoeba invadens
NGITGVVDIDTWRTEDYT

SEQ ID NO: 2957912 - protein, 29 aa, Entamoeba invadens
NGKAFGIPLTISFTFEYPISAPEILCDIK

SEQ ID NO: 2957913 - protein, 19 aa, Entamoeba invadens
NGKCASCNDGYYFTPNQTC

SEQ ID NO: 2957914 - protein, 18 aa, Entamoeba invadens
NGKEAIHTTGYWRSKEHV

SEQ ID NO: 2957915 - protein, 25 aa, Entamoeba invadens
NGKEGWNLELEKFFKGMGEQFKDVG

SEQ ID NO: 2957916 - protein, 18 aa, Entamoeba invadens
NGKFLRCNVLTQNLEGGG

SEQ ID NO: 2957917 - protein, 18 aa, Entamoeba invadens
NGKHVVFGEVKKGYDVVQ

SEQ ID NO: 2957918 - protein, 26 aa, Entamoeba invadens
NGKISYKNICLFDFERRMNYNTIPQN

SEQ ID NO: 2957919 - protein, 19 aa, Entamoeba invadens
NGKKLVAMIAPSTRLGVAE

SEQ ID NO: 2957920 - protein, 22 aa, Entamoeba invadens
NGKLEMLDPTVIAKIEKMKKKE

SEQ ID NO: 2957921 - protein, 22 aa, Entamoeba invadens
NGKLQLPFVVCEKTWKEMNCDV

SEQ ID NO: 2957922 - protein, 26 aa, Entamoeba invadens
NGKLVYKKKFESVKVAAALAFNDINK

SEQ ID NO: 2957923 - protein, 23 aa, Entamoeba invadens
NGKLYRTSWAFKEKTGKHSYYIP

SEQ ID NO: 2957924 - protein, 22 aa, Entamoeba invadens
NGKTPLGLKMLNFFQEYTNLSE

SEQ ID NO: 2957925 - protein, 24 aa, Entamoeba invadens
NGKVEQFTGFLLDKSFVGMTAPAT

SEQ ID NO: 2957926 - protein, 17 aa, Entamoeba invadens
NGKVLKIEFSRPGGKEI

SEQ ID NO: 2957927 - protein, 36 aa, Entamoeba invadens
NGKYKVLVFYCKDYSIVCPKELVAFNEKFKSFQDNN

SEQ ID NO: 2957928 - protein, 19 aa, Entamoeba invadens
NGKYLFGQKEVDRRGTLIS

SEQ ID NO: 2957929 - protein, 22 aa, Entamoeba invadens
NGLCLICASGTFYNETEKTCQK

SEQ ID NO: 2957930 - protein, 21 aa, Entamoeba invadens
NGLECGICIESGDGITQFSVI

SEQ ID NO: 2957931 - protein, 22 aa, Entamoeba invadens
NGLEKLALVLLDYLDDRKEVEA

SEQ ID NO: 2957932 - protein, 18 aa, Entamoeba invadens
NGLFKIEFDKAVDKEHIP

SEQ ID NO: 2957933 - protein, 20 aa, Entamoeba invadens
NGLGRFLCTHGGISPQLQTL

SEQ ID NO: 2957934 - protein, 25 aa, Entamoeba invadens
NGLKQRYSQMFPYSITLIQTYRVTE

SEQ ID NO: 2957935 - protein, 23 aa, Entamoeba invadens
NGLLCISLKCVKNGIPPPKLSVV

SEQ ID NO: 2957936 - protein, 20 aa, Entamoeba invadens
NGLLDGCLKITKVILPDTPT

SEQ ID NO: 2957937 - protein, 27 aa, Entamoeba invadens
NGLPEVEARWILYQVVSALYYLHTHSI

SEQ ID NO: 2957938 - protein, 28 aa, Entamoeba invadens
NGLSFFLTIECLRSVYLHVDPRLLPPPN

SEQ ID NO: 2957939 - protein, 20 aa, Entamoeba invadens
NGLTKIGFGAFQNMTSISVI

SEQ ID NO: 2957940 - protein, 18 aa, Entamoeba invadens
NGMDVCRIVTNDIACAFN

SEQ ID NO: 2957941 - protein, 26 aa, Entamoeba invadens
NGMRLFSKFLYIFIQMCKMNKIEDPK

SEQ ID NO: 2957942 - protein, 23 aa, Entamoeba invadens
NGMTLLFEFCKNSHIRLDVSNQY

SEQ ID NO: 2957943 - protein, 25 aa, Entamoeba invadens
NGNAFLRSSLRAVYAPSGIPVVGMY

SEQ ID NO: 2957944 - protein, 21 aa, Entamoeba invadens
NGNHVIQRFIEFMPSIYSSMI

SEQ ID NO: 2957945 - protein, 20 aa, Entamoeba invadens
NGNLKGIRPHDAVEKSRNLT

SEQ ID NO: 2957946 - protein, 19 aa, Entamoeba invadens
NGNNSLNFTDFVEYIKDFI

SEQ ID NO: 2957947 - protein, 22 aa, Entamoeba invadens
NGNRLKLDLAQITHPTNLTTSG

SEQ ID NO: 2957948 - protein, 19 aa, Entamoeba invadens
NGNVACWMKSLLEGKNIQV

SEQ ID NO: 2957949 - protein, 19 aa, Entamoeba invadens
NGNVCKFTFVKEDHTAGNM

SEQ ID NO: 2957950 - protein, 25 aa, Entamoeba invadens
NGNYEILKFADLCSQNLNLIATVDK

SEQ ID NO: 2957951 - protein, 18 aa, Entamoeba invadens
NGPFCREYPIGVHVVPFS

SEQ ID NO: 2957952 - protein, 27 aa, Entamoeba invadens
NGPQTKLVCLFDWGFVQDCCPKTYEKF

SEQ ID NO: 2957953 - protein, 19 aa, Entamoeba invadens
NGQCLTCYAGYRLNSNGTC

SEQ ID NO: 2957954 - protein, 25 aa, Entamoeba invadens
NGQLKAFPWNCLALMTTTGAKGSKV

SEQ ID NO: 2957955 - protein, 26 aa, Entamoeba invadens
NGQLKYSVLFPKIFSAVPNLYTYLVS

SEQ ID NO: 2957956 - protein, 22 aa, Entamoeba invadens
NGQLRGCIGCFSPHKPFYELVQ

SEQ ID NO: 2957957 - protein, 21 aa, Entamoeba invadens
NGQVLKGGMLVDTSSFDKDLL

SEQ ID NO: 2957958 - protein, 19 aa, Entamoeba invadens
NGQVLKGGMLVDTSSLDKE

SEQ ID NO: 2957959 - protein, 20 aa, Entamoeba invadens
NGQVLKGGMLVDTSSLDKEL

SEQ ID NO: 2957960 - protein, 20 aa, Entamoeba invadens
NGQVLKGGMLVDTSSLNKEL

SEQ ID NO: 2957961 - protein, 18 aa, Entamoeba invadens
NGRCAVCGISGSKIIYNC

SEQ ID NO: 2957962 - protein, 22 aa, Entamoeba invadens
NGRCLTPIPSCEIYLNGWCIQC

SEQ ID NO: 2957963 - protein, 19 aa, Entamoeba invadens
NGRCSTCAPIYSLNGSTLF

SEQ ID NO: 2957964 - protein, 17 aa, Entamoeba invadens
NGRDCGAFTCKFADCIS

SEQ ID NO: 2957965 - protein, 24 aa, Entamoeba invadens
NGRILCPHHIVVLWENGTLTSTRY

SEQ ID NO: 2957966 - protein, 18 aa, Entamoeba invadens
NGRNCYKGIISPANDRYW

SEQ ID NO: 2957967 - protein, 25 aa, Entamoeba invadens
NGRQIFTFDRCRSNCSSSRNHHKDQ

SEQ ID NO: 2957968 - protein, 27 aa, Entamoeba invadens
NGRQYLCCGLASIYYAQLLKSGERPEW

SEQ ID NO: 2957969 - protein, 23 aa, Entamoeba invadens
NGSEGFDPFDLFNSMFGGMDGMP

SEQ ID NO: 2957970 - protein, 18 aa, Entamoeba invadens
NGSIKRLQRHLEANNSEL

SEQ ID NO: 2957971 - protein, 18 aa, Entamoeba invadens
NGSIPKDDKILIEFIKSD

SEQ ID NO: 2957972 - protein, 17 aa, Entamoeba invadens
NGSLFIVDGCDHNSILG

SEQ ID NO: 2957973 - protein, 18 aa, Entamoeba invadens
NGSPMGISVYYKNGGGHA

SEQ ID NO: 2957974 - protein, 25 aa, Entamoeba invadens
NGSSITPAWLRFISDTPKSKMSFVV

SEQ ID NO: 2957975 - protein, 24 aa, Entamoeba invadens
NGSTMMPGFVERFNTDLTKIAPES

SEQ ID NO: 2957976 - protein, 22 aa, Entamoeba invadens
NGTFARKFQVVVFLENEKVIFK

SEQ ID NO: 2957977 - protein, 20 aa, Entamoeba invadens
NGTFFFKNGNSLGISVHCPE

SEQ ID NO: 2957978 - protein, 17 aa, Entamoeba invadens
NGTIPTVFVLKTLLSFY

SEQ ID NO: 2957979 - protein, 23 aa, Entamoeba invadens
NGTKDLKVFLSFNDINTINTVLD

SEQ ID NO: 2957980 - protein, 17 aa, Entamoeba invadens
NGTKILLVLCATKCDLE

SEQ ID NO: 2957981 - protein, 25 aa, Entamoeba invadens
NGTKRYHMIWQWGRIGSSLKETTRQ

SEQ ID NO: 2957982 - protein, 21 aa, Entamoeba invadens
NGTLCTPLFTLTAHTLPVTHI

SEQ ID NO: 2957983 - protein, 17 aa, Entamoeba invadens
NGTLLFDGKLHREAWNA

SEQ ID NO: 2957984 - protein, 28 aa, Entamoeba invadens
NGTNIRKCFVCGKFGHKSQDCPEKESEK

SEQ ID NO: 2957985 - protein, 23 aa, Entamoeba invadens
NGTQVKYEFCQRIVSSKILETIT

SEQ ID NO: 2957986 - protein, 28 aa, Entamoeba invadens
NGTSVIFKWCPMGHLVLAITSTEFDETG

SEQ ID NO: 2957987 - protein, 24 aa, Entamoeba invadens
NGVGKRVLSGFGDHVLETKLMVNR

SEQ ID NO: 2957988 - protein, 22 aa, Entamoeba invadens
NGVILCKTCGDIHKKALGSNIV

SEQ ID NO: 2957989 - protein, 22 aa, Entamoeba invadens
NGVPKLAKSTVESVSEEDTQIK

SEQ ID NO: 2957990 - protein, 19 aa, Entamoeba invadens
NGVQPFAYIPMKRGNKKSQ

SEQ ID NO: 2957991 - protein, 25 aa, Entamoeba invadens
NGVRHPSSSIVYRIDNKNELLQLKG

SEQ ID NO: 2957992 - protein, 19 aa, Entamoeba invadens
NGVSVGRVLLPKESSVVKQ

SEQ ID NO: 2957993 - protein, 18 aa, Entamoeba invadens
NGVVALSEIRRELSEHER

SEQ ID NO: 2957994 - protein, 18 aa, Entamoeba invadens
NGVVQLGEYCFKNYKKVD

SEQ ID NO: 2957995 - protein, 21 aa, Entamoeba invadens
NGYAELCLRAVSILRAIGTRY

SEQ ID NO: 2957996 - protein, 18 aa, Entamoeba invadens
NGYCKKGENCTFSHDISA

SEQ ID NO: 2957997 - protein, 24 aa, Entamoeba invadens
NGYFSLKYDVHWFIVDHWYLFSQL

SEQ ID NO: 2957998 - protein, 17 aa, Entamoeba invadens
NGYGAKLANIFSNSFEI

SEQ ID NO: 2957999 - protein, 19 aa, Entamoeba invadens
NGYKENKSLIEFFTGEIYT

SEQ ID NO: 2958000 - protein, 17 aa, Entamoeba invadens
NHAIGQVIIFLKSTEGF

SEQ ID NO: 2958001 - protein, 17 aa, Entamoeba invadens
NHALTFFSGLKALVVDS

SEQ ID NO: 2958002 - protein, 18 aa, Entamoeba invadens
NHAQIRFLAINYSNEDPY

SEQ ID NO: 2958003 - protein, 25 aa, Entamoeba invadens
NHAVYKCLLCNKVVGVCFSNNDVFI

SEQ ID NO: 2958004 - protein, 28 aa, Entamoeba invadens
NHEKPRLPLDFIYSDVLDICYAPNKETI

SEQ ID NO: 2958005 - protein, 27 aa, Entamoeba invadens
NHESRRMTSKFGFKEECIRKYDLEVYN

SEQ ID NO: 2958006 - protein, 25 aa, Entamoeba invadens
NHETRLMCEYMTFLLECNAKYNIKV

SEQ ID NO: 2958007 - protein, 24 aa, Entamoeba invadens
NHFCRELPNLSSLSKMTYFNFGNG

SEQ ID NO: 2958008 - protein, 18 aa, Entamoeba invadens
NHFNEMFADVALRNCDKM

SEQ ID NO: 2958009 - protein, 17 aa, Entamoeba invadens
NHFNFPLVVGNFSDQWN

SEQ ID NO: 2958010 - protein, 22 aa, Entamoeba invadens
NHFNLKVKLLIGGVENSKVNED

SEQ ID NO: 2958011 - protein, 18 aa, Entamoeba invadens
NHFRGFFSEDELIEIDKR

SEQ ID NO: 2958012 - protein, 22 aa, Entamoeba invadens
NHFSVYICPNLLIQNYSEYNTK

SEQ ID NO: 2958013 - protein, 18 aa, Entamoeba invadens
NHFYPQIFHALAIVAKHD

SEQ ID NO: 2958014 - protein, 23 aa, Entamoeba invadens
NHGYPIHSLCPLADMETFLSADF

SEQ ID NO: 2958015 - protein, 21 aa, Entamoeba invadens
NHIDAAIGLNIFNKITINYGE

SEQ ID NO: 2958016 - protein, 22 aa, Entamoeba invadens
NHITEWCGVIMDFSKYPNRQEQ

SEQ ID NO: 2958017 - protein, 18 aa, Entamoeba invadens
NHKDGCGITENIPKELVK

SEQ ID NO: 2958018 - protein, 23 aa, Entamoeba invadens
NHKGEVKLADFGVSVQLTKSKTK

SEQ ID NO: 2958019 - protein, 24 aa, Entamoeba invadens
NHKISESFGLMSFTGVSNRATVII

SEQ ID NO: 2958020 - protein, 17 aa, Entamoeba invadens
NHLKPTFNLSSYNSIKE

SEQ ID NO: 2958021 - protein, 17 aa, Entamoeba invadens
NHLTRFIHRVVLEMIST

SEQ ID NO: 2958022 - protein, 28 aa, Entamoeba invadens
NHMTCPKCHGEWCWMCRGDWKNHGPKTG

SEQ ID NO: 2958023 - protein, 30 aa, Entamoeba invadens
NHMTCSRCKGEWCWMCRGDWKTHGTQTGGF

SEQ ID NO: 2958024 - protein, 20 aa, Entamoeba invadens
NHNIRFCGEVADLLDKLRSS

SEQ ID NO: 2958025 - protein, 26 aa, Entamoeba invadens
NHNTLWYFFSFLRRVIEKEKINKMNS

SEQ ID NO: 2958026 - protein, 21 aa, Entamoeba invadens
NHPEDLVFVLPHQLEVVRNKN

SEQ ID NO: 2958027 - protein, 24 aa, Entamoeba invadens
NHPELIRRLGCIAMNGLIEADIYG

SEQ ID NO: 2958028 - protein, 17 aa, Entamoeba invadens
NHPFIVKLHYAFQSPEK

SEQ ID NO: 2958029 - protein, 33 aa, Entamoeba invadens
NHPKLLNYFGLLFKCWELIYLIDFSQDVSKESR

SEQ ID NO: 2958030 - protein, 20 aa, Entamoeba invadens
NHPNKMFKYYVPSTQLFYTT

SEQ ID NO: 2958031 - protein, 22 aa, Entamoeba invadens
NHPPRIPSPVLTVFQDEGTTPR

SEQ ID NO: 2958032 - protein, 18 aa, Entamoeba invadens
NHPVDRDPKCGYVGIIDN

SEQ ID NO: 2958033 - protein, 17 aa, Entamoeba invadens
NHQELFLQFLLQDTPIT

SEQ ID NO: 2958034 - protein, 24 aa, Entamoeba invadens
NHRNEYCGFCFVEYKTREDADYAK

SEQ ID NO: 2958035 - protein, 31 aa, Entamoeba invadens
NHRPQFRSAVLMFQREFALRLVATPEDPLYC

SEQ ID NO: 2958036 - protein, 27 aa, Entamoeba invadens
NHSLSEFKFPISDCGKLDNVENVRDVL

SEQ ID NO: 2958037 - protein, 18 aa, Entamoeba invadens
NHVEMKALHVFSQNGTFS

SEQ ID NO: 2958038 - protein, 24 aa, Entamoeba invadens
NHVFFDFQIAHIFQYGTNPDNYKN

SEQ ID NO: 2958039 - protein, 20 aa, Entamoeba invadens
NHVKQFIGLAEFGGNFMTCD

SEQ ID NO: 2958040 - protein, 21 aa, Entamoeba invadens
NHVLQQFVEFFFTNGQISKFE

SEQ ID NO: 2958041 - protein, 20 aa, Entamoeba invadens
NHVLTFLMDFAFEGELTVKG

SEQ ID NO: 2958042 - protein, 20 aa, Entamoeba invadens
NHWDKICHLEQLKAKNWRKS

SEQ ID NO: 2958043 - protein, 19 aa, Entamoeba invadens
NHYMAINFMPQFKGKSIIE

SEQ ID NO: 2958044 - protein, 30 aa, Entamoeba invadens
NHYVRMFFCELLLYRSTMSPSWNRVKTNTL

SEQ ID NO: 2958045 - protein, 18 aa, Entamoeba invadens
NIARRMVACAGEDVGVAD

SEQ ID NO: 2958046 - protein, 29 aa, Entamoeba invadens
NICNFKMNWLNIEMVKLSAYLVSNKTTLK

SEQ ID NO: 2958047 - protein, 28 aa, Entamoeba invadens
NICPEHIPMFCCVCGNDFTTAFARTLRT

SEQ ID NO: 2958048 - protein, 31 aa, Entamoeba invadens
NICQIKPDLRWAWDKIIEEWTQFEDEVKNDP

SEQ ID NO: 2958049 - protein, 25 aa, Entamoeba invadens
NIDEMFKSDIFHYLLEFLVFPFEVG

SEQ ID NO: 2958050 - protein, 25 aa, Entamoeba invadens
NIDFASQELRCWRENKIENAIRLNL

SEQ ID NO: 2958051 - protein, 25 aa, Entamoeba invadens
NIDIPRVEWGVGMGHKNIHGGLTPG

SEQ ID NO: 2958052 - protein, 20 aa, Entamoeba invadens
NIDKLLLLEGEVFAKGCRLV

SEQ ID NO: 2958053 - protein, 17 aa, Entamoeba invadens
NIDLCIYIGKTLPPELQ

SEQ ID NO: 2958054 - protein, 21 aa, Entamoeba invadens
NIDLRFSLVEYKDHKPIEPSF

SEQ ID NO: 2958055 - protein, 18 aa, Entamoeba invadens
NIDPTRFVTITRPISVNL

SEQ ID NO: 2958056 - protein, 22 aa, Entamoeba invadens
NIEAIKILILLGKVCANETVNY

SEQ ID NO: 2958057 - protein, 26 aa, Entamoeba invadens
NIEEEIAYKCTYRFCARTTDHMREDN

SEQ ID NO: 2958058 - protein, 21 aa, Entamoeba invadens
NIEFPRTVKFVEFCLEEEDKT

SEQ ID NO: 2958059 - protein, 24 aa, Entamoeba invadens
NIEGKKQQQVLCRFEAKDVFLQAP

SEQ ID NO: 2958060 - protein, 24 aa, Entamoeba invadens
NIEIGSSMSSCFDVVSSKNSITEY

SEQ ID NO: 2958061 - protein, 26 aa, Entamoeba invadens
NIEIPACVVCKFLAMNGIIMEKMGYY

SEQ ID NO: 2958062 - protein, 32 aa, Entamoeba invadens
NIEKITPCFWEYVMSASCRFINPAYDKTSSGM

SEQ ID NO: 2958063 - protein, 41 aa, Entamoeba invadens
NIEKKCLATALAVAVLRKFFFERIVEWKLLEKKALNYLEKH

SEQ ID NO: 2958064 - protein, 23 aa, Entamoeba invadens
NIEKVDCFLVIYSITDKDTLLHL

SEQ ID NO: 2958065 - protein, 22 aa, Entamoeba invadens
NIELLRSLSLTTGNKRCMDCQA

SEQ ID NO: 2958066 - protein, 24 aa, Entamoeba invadens
NIENLRCKWHLEKNEFCFEGYRKK

SEQ ID NO: 2958067 - protein, 24 aa, Entamoeba invadens
NIENVLGVNLCWTNNVKASIRRIG

SEQ ID NO: 2958068 - protein, 23 aa, Entamoeba invadens
NIETILDVLIKFVKAQTEDITNR

SEQ ID NO: 2958069 - protein, 20 aa, Entamoeba invadens
NIETINWFFDDCSQLFKTVF

SEQ ID NO: 2958070 - protein, 21 aa, Entamoeba invadens
NIETLHLWKKHNENFGNGFII

SEQ ID NO: 2958071 - protein, 24 aa, Entamoeba invadens
NIETRKLLFNYVALGVKLMNTQNT

SEQ ID NO: 2958072 - protein, 20 aa, Entamoeba invadens
NIETVWRFVTKTLKQSPSRV

SEQ ID NO: 2958073 - protein, 17 aa, Entamoeba invadens
NIFDIVAAQCSELSPIV

SEQ ID NO: 2958074 - protein, 26 aa, Entamoeba invadens
NIFFALRGALDIQKEVTAKEIIHEVF

SEQ ID NO: 2958075 - protein, 25 aa, Entamoeba invadens
NIFFSLKYDAHWFVTDHWYLFSQLP

SEQ ID NO: 2958076 - protein, 17 aa, Entamoeba invadens
NIFKLPLEMNRPVCVVG

SEQ ID NO: 2958077 - protein, 18 aa, Entamoeba invadens
NIFLLPFNQYMLLETFPI

SEQ ID NO: 2958078 - protein, 22 aa, Entamoeba invadens
NIFLSDLWKTSGHWQHYKDDMF

SEQ ID NO: 2958079 - protein, 19 aa, Entamoeba invadens
NIFNCNKITFTQKISETLQ

SEQ ID NO: 2958080 - protein, 28 aa, Entamoeba invadens
NIFPSLKRLNCPLVYLSTITFNNQNEKN

SEQ ID NO: 2958081 - protein, 25 aa, Entamoeba invadens
NIFQCIQIPVLLVFATQDQYVPYSS

SEQ ID NO: 2958082 - protein, 26 aa, Entamoeba invadens
NIFSQEVPNSFYLVKANVEMISHTLE

SEQ ID NO: 2958083 - protein, 24 aa, Entamoeba invadens
NIFTVSYFLSFDFFNIQGDKKNYM

SEQ ID NO: 2958084 - protein, 25 aa, Entamoeba invadens
NIFVFDFTTGCLHRVIGGGHSDDVN

SEQ ID NO: 2958085 - protein, 20 aa, Entamoeba invadens
NIGDFCFACATQLERVVLPS

SEQ ID NO: 2958086 - protein, 21 aa, Entamoeba invadens
NIGDSMVFILKNGILSRVGKD

SEQ ID NO: 2958087 - protein, 19 aa, Entamoeba invadens
NIGELFKNFIPYFRVYYQF

SEQ ID NO: 2958088 - protein, 23 aa, Entamoeba invadens
NIGGAPPAFLALMKHPNRTKYNL

SEQ ID NO: 2958089 - protein, 21 aa, Entamoeba invadens
NIGGLQALWVMWKLGSVEMGV

SEQ ID NO: 2958090 - protein, 21 aa, Entamoeba invadens
NIGIFPHFGFEVLYKEENPAT

SEQ ID NO: 2958091 - protein, 25 aa, Entamoeba invadens
NIGIVPLLREWLSVIEQIIQTPIEP

SEQ ID NO: 2958092 - protein, 17 aa, Entamoeba invadens
NIGKCCDAFPGDALSDD

SEQ ID NO: 2958093 - protein, 21 aa, Entamoeba invadens
NIGSVFRFMYLLADTQYCNDY

SEQ ID NO: 2958094 - protein, 17 aa, Entamoeba invadens
NIHEEILEFNVPQYSEE

SEQ ID NO: 2958095 - protein, 28 aa, Entamoeba invadens
NIHHFRPNTLFCLSKFKPPLSPRPSTLG

SEQ ID NO: 2958096 - protein, 23 aa, Entamoeba invadens
NIHKERILSLLGYVAGEYDMATP

SEQ ID NO: 2958097 - protein, 18 aa, Entamoeba invadens
NIHLKVTRTLLLFDETFR

SEQ ID NO: 2958098 - protein, 32 aa, Entamoeba invadens
NIHVECYNTFYVCVKQLLKYAVTQDVIDYVVQ

SEQ ID NO: 2958099 - protein, 29 aa, Entamoeba invadens
NIHVRYEAVNTWTGLRYAIGTSIESIKLY

SEQ ID NO: 2958100 - protein, 21 aa, Entamoeba invadens
NIICAECKEVGVKEPLTKEKL

SEQ ID NO: 2958101 - protein, 29 aa, Entamoeba invadens
NIIEIWKSGIKMFGCKDIEEKGVKVSKYL

SEQ ID NO: 2958102 - protein, 21 aa, Entamoeba invadens
NIIFDSRLSGMDQRELKAQIV

SEQ ID NO: 2958103 - protein, 22 aa, Entamoeba invadens
NIIHIFFQLDFVPTVYNIIDNV

SEQ ID NO: 2958104 - protein, 23 aa, Entamoeba invadens
NIIKRAIMILSQYPLPILLDVEN

SEQ ID NO: 2958105 - protein, 23 aa, Entamoeba invadens
NIILENMYQLWILAELDLFDPEH

SEQ ID NO: 2958106 - protein, 22 aa, Entamoeba invadens
NIINRCVKPIIQQLVVVLLESV

SEQ ID NO: 2958107 - protein, 17 aa, Entamoeba invadens
NIIPHFPADCQYLKVIK

SEQ ID NO: 2958108 - protein, 17 aa, Entamoeba invadens
NIIRLYLNGGIDISEER

SEQ ID NO: 2958109 - protein, 21 aa, Entamoeba invadens
NIKAAIWCPTTAVVDPYEMTI

SEQ ID NO: 2958110 - protein, 20 aa, Entamoeba invadens
NIKEDVLYNKQRNELLQQEN

SEQ ID NO: 2958111 - protein, 24 aa, Entamoeba invadens
NIKEKNMFIILDFEFDPTKLEQYR

SEQ ID NO: 2958112 - protein, 22 aa, Entamoeba invadens
NIKELFGCVAKLLMDAAKEENA

SEQ ID NO: 2958113 - protein, 24 aa, Entamoeba invadens
NIKFKCLQKLVIKKSVNEKLLIKI

SEQ ID NO: 2958114 - protein, 20 aa, Entamoeba invadens
NIKGTGVALDLQAMDMDEEC

SEQ ID NO: 2958115 - protein, 33 aa, Entamoeba invadens
NIKIVAELLKWYGYDERSVICLQNILYEISESG

SEQ ID NO: 2958116 - protein, 27 aa, Entamoeba invadens
NIKKLKFEVVFFWKFIDDNTLYFYDNK

SEQ ID NO: 2958117 - protein, 25 aa, Entamoeba invadens
NIKLIDFGSACFENFTMNTYIQSRH

SEQ ID NO: 2958118 - protein, 23 aa, Entamoeba invadens
NIKRETAILSAKYDNARAEIAAL

SEQ ID NO: 2958119 - protein, 23 aa, Entamoeba invadens
NIKRGRGSLFFFGEDKGRWKKGE

SEQ ID NO: 2958120 - protein, 17 aa, Entamoeba invadens
NIKRITTSFNWLSELLS

SEQ ID NO: 2958121 - protein, 23 aa, Entamoeba invadens
NIKSECFKNCFNLRNVILPERLL

SEQ ID NO: 2958122 - protein, 23 aa, Entamoeba invadens
NIKSYKLLNEFLRRIHPIVRKSN

SEQ ID NO: 2958123 - protein, 20 aa, Entamoeba invadens
NIKTGEGIQEMFKSVLNDVL

SEQ ID NO: 2958124 - protein, 20 aa, Entamoeba invadens
NIKTVFLEKICGVPNVCVII

SEQ ID NO: 2958125 - protein, 25 aa, Entamoeba invadens
NIKVSCYCGHEFCFGCGRERHEPAT

SEQ ID NO: 2958126 - protein, 28 aa, Entamoeba invadens
NILACGGRALMSWSFMPPQTFVSNFSSH

SEQ ID NO: 2958127 - protein, 23 aa, Entamoeba invadens
NILCAHSLFCLDVVKGGKKAGTE

SEQ ID NO: 2958128 - protein, 26 aa, Entamoeba invadens
NILDFSFKTAYFFAAVKKRITVKLYN

SEQ ID NO: 2958129 - protein, 17 aa, Entamoeba invadens
NILDFYYLTGLEQVVTT

SEQ ID NO: 2958130 - protein, 21 aa, Entamoeba invadens
NILDVVLKWVNQMWNDQNPKT

SEQ ID NO: 2958131 - protein, 25 aa, Entamoeba invadens
NILEKCCLSIFQRCEKTIKETLEKG

SEQ ID NO: 2958132 - protein, 18 aa, Entamoeba invadens
NILELSGMRCLQIVSPSV

SEQ ID NO: 2958133 - protein, 19 aa, Entamoeba invadens
NILEVFCVVANGSVFKAKV

SEQ ID NO: 2958134 - protein, 23 aa, Entamoeba invadens
NILGETPLICAIDANSSECALFL

SEQ ID NO: 2958135 - protein, 17 aa, Entamoeba invadens
NILIFSLDINDNVNAKL

SEQ ID NO: 2958136 - protein, 27 aa, Entamoeba invadens
NILIPRSVTSIGLLCFDGCISLKEVRI

SEQ ID NO: 2958137 - protein, 25 aa, Entamoeba invadens
NILPTIIFVPLRLGPVNAEEDFRPI

SEQ ID NO: 2958138 - protein, 19 aa, Entamoeba invadens
NILQFWRKHFTTYENLFEV

SEQ ID NO: 2958139 - protein, 18 aa, Entamoeba invadens
NILRRGRNAVDCPLLKLY

SEQ ID NO: 2958140 - protein, 20 aa, Entamoeba invadens
NILSEYVDSFAFSKLALQLY

SEQ ID NO: 2958141 - protein, 26 aa, Entamoeba invadens
NILTRRIVHIFERLFDVAIGAMENIT

SEQ ID NO: 2958142 - protein, 20 aa, Entamoeba invadens
NILTRTSFEIFKFENDNLVP

SEQ ID NO: 2958143 - protein, 19 aa, Entamoeba invadens
NILVISLDFNNNVNAKLTD

SEQ ID NO: 2958144 - protein, 22 aa, Entamoeba invadens
NIMFKNKFPWVTEDISVLNYIK

SEQ ID NO: 2958145 - protein, 25 aa, Entamoeba invadens
NINELEFMIGPKLYEASWQDLANQG

SEQ ID NO: 2958146 - protein, 23 aa, Entamoeba invadens
NINLMEMEKIWAINKKVIDPIVP

SEQ ID NO: 2958147 - protein, 25 aa, Entamoeba invadens
NINPNSKSTCVFGCQDRQIQFTQHD

SEQ ID NO: 2958148 - protein, 22 aa, Entamoeba invadens
NIPAAILLDIIRRFVAVDKLGI

SEQ ID NO: 2958149 - protein, 22 aa, Entamoeba invadens
NIPESFVNLLLYTLNEYISDSK

SEQ ID NO: 2958150 - protein, 18 aa, Entamoeba invadens
NIPKSGGDMLKDMVGKMT

SEQ ID NO: 2958151 - protein, 24 aa, Entamoeba invadens
NIPKYPKGICKFAVTFEITANGFL

SEQ ID NO: 2958152 - protein, 20 aa, Entamoeba invadens
NIPLKDWNCWLVERLSKEVL

SEQ ID NO: 2958153 - protein, 25 aa, Entamoeba invadens
NIPTLRCLRILRGGATNEPLEPFNL

SEQ ID NO: 2958154 - protein, 38 aa, Entamoeba invadens
NIQIIQFAFRWFNCFLLREFSFKQGLRLWDTYLSDEDG

SEQ ID NO: 2958155 - protein, 19 aa, Entamoeba invadens
NIQIWPIIQFNINETLMAH

SEQ ID NO: 2958156 - protein, 24 aa, Entamoeba invadens
NIQKLCLRIVTKLATPENVKEIVQ

SEQ ID NO: 2958157 - protein, 19 aa, Entamoeba invadens
NIQNILSFLPPVYYSTLKM

SEQ ID NO: 2958158 - protein, 24 aa, Entamoeba invadens
NIQPPEQFQIVSFVDEQQHQNVQP

SEQ ID NO: 2958159 - protein, 19 aa, Entamoeba invadens
NIQRVCVALSEVGEVVLTF

SEQ ID NO: 2958160 - protein, 19 aa, Entamoeba invadens
NIRALYDMIDKAALNAYKT

SEQ ID NO: 2958161 - protein, 24 aa, Entamoeba invadens
NIRDFKAAHGLDRVVILWTATTER

SEQ ID NO: 2958162 - protein, 25 aa, Entamoeba invadens
NIRDFKAAHGLDRVVILWTATTERY

SEQ ID NO: 2958163 - protein, 25 aa, Entamoeba invadens
NIRKVELTNMNFIFTTFKTIIADYS

SEQ ID NO: 2958164 - protein, 22 aa, Entamoeba invadens
NIRLFPRLSQIVFSIDYDSELD

SEQ ID NO: 2958165 - protein, 21 aa, Entamoeba invadens
NIRMDGCSFCIENIATTNTIL

SEQ ID NO: 2958166 - protein, 33 aa, Entamoeba invadens
NISAFPRYLALLNFERIKVIFKVIGLKQSIYES

SEQ ID NO: 2958167 - protein, 25 aa, Entamoeba invadens
NISDKEMFYVFCLCDHLVVNSHTFR

SEQ ID NO: 2958168 - protein, 18 aa, Entamoeba invadens
NISEVKRILGVPFGDDSI

SEQ ID NO: 2958169 - protein, 18 aa, Entamoeba invadens
NISFRLEAMGGIKEIGNF

SEQ ID NO: 2958170 - protein, 25 aa, Entamoeba invadens
NISGFRFVIIITHADVFLKKFLNLF

SEQ ID NO: 2958171 - protein, 18 aa, Entamoeba invadens
NISGIPFIQTMESSTVHF

SEQ ID NO: 2958172 - protein, 23 aa, Entamoeba invadens
NISGKCLTCYAGYEFTGNANCEI

SEQ ID NO: 2958173 - protein, 28 aa, Entamoeba invadens
NISKKLCLEKACLVEVVMLMMNVSQLLI

SEQ ID NO: 2958174 - protein, 27 aa, Entamoeba invadens
NISLINYCMFNYYAGVTMLIKNMTVEA

SEQ ID NO: 2958175 - protein, 30 aa, Entamoeba invadens
NISMKMYFNKTCSYLGNVIALDFITSENSE

SEQ ID NO: 2958176 - protein, 17 aa, Entamoeba invadens
NISQLVRGECHLDHNYA

SEQ ID NO: 2958177 - protein, 20 aa, Entamoeba invadens
NISRYLLLKEEDMWDKIKTV

SEQ ID NO: 2958178 - protein, 19 aa, Entamoeba invadens
NISSFGEFLIYYQVIEKAI

SEQ ID NO: 2958179 - protein, 23 aa, Entamoeba invadens
NISSFIRNVVMWKVSNDNSHIFR

SEQ ID NO: 2958180 - protein, 23 aa, Entamoeba invadens
NITEGALKCKFSPTETNIIGITN

SEQ ID NO: 2958181 - protein, 19 aa, Entamoeba invadens
NITELFKAITERLCSIEPI

SEQ ID NO: 2958182 - protein, 24 aa, Entamoeba invadens
NITEPVKHFILLASAVIGVDNGEE

SEQ ID NO: 2958183 - protein, 23 aa, Entamoeba invadens
NITRYLSTHGWDFTEDRLKQSLM

SEQ ID NO: 2958184 - protein, 18 aa, Entamoeba invadens
NIVDLLFIKATNIFIETK

SEQ ID NO: 2958185 - protein, 18 aa, Entamoeba invadens
NIVEPGGEEVVKFNLTTL

SEQ ID NO: 2958186 - protein, 21 aa, Entamoeba invadens
NIVGFEGCWIFDNRVYIGMEY

SEQ ID NO: 2958187 - protein, 23 aa, Entamoeba invadens
NIVGMCLVLASGRSNTVFNNIFF

SEQ ID NO: 2958188 - protein, 26 aa, Entamoeba invadens
NIVIHFPFVVCVYTDCIRVYNFINGK

SEQ ID NO: 2958189 - protein, 25 aa, Entamoeba invadens
NIVKNLEAEAAWANVRDQCLAVKST

SEQ ID NO: 2958190 - protein, 27 aa, Entamoeba invadens
NIVKVVECIFLFVTECFKQYDIKPFPE

SEQ ID NO: 2958191 - protein, 19 aa, Entamoeba invadens
NIVLPKLSSAYSIKKGGPM

SEQ ID NO: 2958192 - protein, 19 aa, Entamoeba invadens
NIVMRRYNLAAGDFPPIDV

SEQ ID NO: 2958193 - protein, 18 aa, Entamoeba invadens
NIVQARFDKIPLITQNVP

SEQ ID NO: 2958194 - protein, 27 aa, Entamoeba invadens
NIVRIYNCFFCYFGGSLQFWIIMESCT

SEQ ID NO: 2958195 - protein, 21 aa, Entamoeba invadens
NIVRRELRRIYTVSTLTDPEL

SEQ ID NO: 2958196 - protein, 18 aa, Entamoeba invadens
NIVSLRWKYNKSEGTFKK

SEQ ID NO: 2958197 - protein, 18 aa, Entamoeba invadens
NIWCKKEVAPVPPFITTD

SEQ ID NO: 2958198 - protein, 23 aa, Entamoeba invadens
NIWNFCFGDGLKVRRTNQSIEVI

SEQ ID NO: 2958199 - protein, 17 aa, Entamoeba invadens
NIWSYLIQYKVHDKSKN

SEQ ID NO: 2958200 - protein, 18 aa, Entamoeba invadens
NIYDCGSSEESLEYSDES

SEQ ID NO: 2958201 - protein, 28 aa, Entamoeba invadens
NIYFPRKRMQDLLLSWTVIFKEQVPTQL

SEQ ID NO: 2958202 - protein, 34 aa, Entamoeba invadens
NIYHTMLLHGLLYWKHRPCIEFKDMMSNFKKFAY

SEQ ID NO: 2958203 - protein, 20 aa, Entamoeba invadens
NIYMYAFKISKKYEQSCSKC

SEQ ID NO: 2958204 - protein, 18 aa, Entamoeba invadens
NIYRGADLLKVRNELESQ

SEQ ID NO: 2958205 - protein, 20 aa, Entamoeba invadens
NIYSHLKLMFGSNVSSLAPR

SEQ ID NO: 2958206 - protein, 18 aa, Entamoeba invadens
NIYTVGIMPCVAKKVEAA

SEQ ID NO: 2958207 - protein, 20 aa, Entamoeba invadens
NIYVLNFINKLLLDITQRNG

SEQ ID NO: 2958208 - protein, 19 aa, Entamoeba invadens
NKACGLSLKLCDFGFARYV

SEQ ID NO: 2958209 - protein, 18 aa, Entamoeba invadens
NKAFKEMVELLGEPHRRL

SEQ ID NO: 2958210 - protein, 21 aa, Entamoeba invadens
NKAFRGCEILSQIILPNNLSE

SEQ ID NO: 2958211 - protein, 22 aa, Entamoeba invadens
NKAGDIGDDFYVFKCGHYVCSE

SEQ ID NO: 2958212 - protein, 31 aa, Entamoeba invadens
NKAINMSGKFFKEGIPLFVADSNSQQNRNVS

SEQ ID NO: 2958213 - protein, 22 aa, Entamoeba invadens
NKAKVYGSVTCGNWVDQDTIEL

SEQ ID NO: 2958214 - protein, 20 aa, Entamoeba invadens
NKAMPRNVFQLINANIETYD

SEQ ID NO: 2958215 - protein, 24 aa, Entamoeba invadens
NKARWKCFVCSCCEQDKMERNNFI

SEQ ID NO: 2958216 - protein, 26 aa, Entamoeba invadens
NKATMHHLCLLRAKLVKYKKELAPVQ

SEQ ID NO: 2958217 - protein, 30 aa, Entamoeba invadens
NKAVFKKKFYRIIVWFNLDFETVDKNKSRN

SEQ ID NO: 2958218 - protein, 21 aa, Entamoeba invadens
NKAVKMCWGCSKENRPKVFSV

SEQ ID NO: 2958219 - protein, 17 aa, Entamoeba invadens
NKAYCLDGISLLFESGV

SEQ ID NO: 2958220 - protein, 25 aa, Entamoeba invadens
NKCDLVPTWATARWIQVLSKEFPTI

SEQ ID NO: 2958221 - protein, 21 aa, Entamoeba invadens
NKCECSYKVDFMMKDNELLKT

SEQ ID NO: 2958222 - protein, 24 aa, Entamoeba invadens
NKCEVTCLHFAIGDIDKESISRII

SEQ ID NO: 2958223 - protein, 17 aa, Entamoeba invadens
NKCKLCFDEHQNSGKCS

SEQ ID NO: 2958224 - protein, 17 aa, Entamoeba invadens
NKCNLAFTQPDVYFSTA

SEQ ID NO: 2958225 - protein, 17 aa, Entamoeba invadens
NKCNLCFDEHQNSGKCS

SEQ ID NO: 2958226 - protein, 21 aa, Entamoeba invadens
NKCQLGVILFNIYKTSVATSF

SEQ ID NO: 2958227 - protein, 17 aa, Entamoeba invadens
NKCVEEFLNELNNNSVI

SEQ ID NO: 2958228 - protein, 21 aa, Entamoeba invadens
NKCVLCKSGYVLNDNSKCISS

SEQ ID NO: 2958229 - protein, 18 aa, Entamoeba invadens
NKCYPKCRFNVLDCKVCS

SEQ ID NO: 2958230 - protein, 22 aa, Entamoeba invadens
NKDECVVYRTFYYSRDNRTKYP

SEQ ID NO: 2958231 - protein, 19 aa, Entamoeba invadens
NKDGLLLLFPLIGKPIPTT

SEQ ID NO: 2958232 - protein, 21 aa, Entamoeba invadens
NKDILCIKSLYENINKITLEN

SEQ ID NO: 2958233 - protein, 25 aa, Entamoeba invadens
NKDILESVFLWFVGKDKKFMSLEKL

SEQ ID NO: 2958234 - protein, 24 aa, Entamoeba invadens
NKDLFALMYWKNLFSKLTGAKIQN

SEQ ID NO: 2958235 - protein, 17 aa, Entamoeba invadens
NKDLMVINEYLFAPKIL

SEQ ID NO: 2958236 - protein, 33 aa, Entamoeba invadens
NKDTQKYICWSEQFKRRAIFIPDPVEFSKQILP

SEQ ID NO: 2958237 - protein, 25 aa, Entamoeba invadens
NKDWKEPRPRGAVLSDFPISAFCDY

SEQ ID NO: 2958238 - protein, 23 aa, Entamoeba invadens
NKEACKFVFEIAVKFTKHVIPMI

SEQ ID NO: 2958239 - protein, 24 aa, Entamoeba invadens
NKEDRLPIFNAFDHQVLSNFSLNN

SEQ ID NO: 2958240 - protein, 34 aa, Entamoeba invadens
NKEDVGRAWQWKSFSSKSAFCFASTKDNHEFMMH

SEQ ID NO: 2958241 - protein, 18 aa, Entamoeba invadens
NKEDVIWLLRSLGSDDGA

SEQ ID NO: 2958242 - protein, 25 aa, Entamoeba invadens
NKEDVLQCSSLYLKGNFMDLLHFKF

SEQ ID NO: 2958243 - protein, 19 aa, Entamoeba invadens
NKEFKDIFIGGDIDKYGRC

SEQ ID NO: 2958244 - protein, 18 aa, Entamoeba invadens
NKEFTIFSSTQFKTLLNS

SEQ ID NO: 2958245 - protein, 17 aa, Entamoeba invadens
NKEIIPFDMRRMTKEER

SEQ ID NO: 2958246 - protein, 18 aa, Entamoeba invadens
NKEIKILIQFANEKFQNG

SEQ ID NO: 2958247 - protein, 24 aa, Entamoeba invadens
NKEKEWKKNLKISKNQQFEAQKKK

SEQ ID NO: 2958248 - protein, 23 aa, Entamoeba invadens
NKEKLKRLTVFYTLGGKCELIKN

SEQ ID NO: 2958249 - protein, 30 aa, Entamoeba invadens
NKEKPICDFFFKIGACRHGDSCKKQHFRPE

SEQ ID NO: 2958250 - protein, 22 aa, Entamoeba invadens
NKELCPGLHIFPFCITLPEDLS

SEQ ID NO: 2958251 - protein, 19 aa, Entamoeba invadens
NKELFRYFRKLKKSTKQQN

SEQ ID NO: 2958252 - protein, 19 aa, Entamoeba invadens
NKELYRYFRKLKKSTKQQN

SEQ ID NO: 2958253 - protein, 25 aa, Entamoeba invadens
NKEMQAEKLFLVPNPIPVPFPQNNE

SEQ ID NO: 2958254 - protein, 27 aa, Entamoeba invadens
NKENGKWWCGNLIVVEFSETIESKRSR

SEQ ID NO: 2958255 - protein, 24 aa, Entamoeba invadens
NKESLGMLVSMGFDQKSSEICLKV

SEQ ID NO: 2958256 - protein, 26 aa, Entamoeba invadens
NKESLLVCWNCQTLVMYTEQKNMTTP

SEQ ID NO: 2958257 - protein, 23 aa, Entamoeba invadens
NKETFFKVVVWYEVNYKTSQKNT

SEQ ID NO: 2958258 - protein, 26 aa, Entamoeba invadens
NKEVCDKFRTCVLGVGNAVPADVAFK

SEQ ID NO: 2958259 - protein, 21 aa, Entamoeba invadens
NKEVHWGMEYWMKHAVFDSDK

SEQ ID NO: 2958260 - protein, 21 aa, Entamoeba invadens
NKEVTSLCVFKHMKKLGLSIP

SEQ ID NO: 2958261 - protein, 20 aa, Entamoeba invadens
NKFFILKVVHQKLRRENDDV

SEQ ID NO: 2958262 - protein, 25 aa, Entamoeba invadens
NKFFKDITSTIGIDFRMKRMEFEGM

SEQ ID NO: 2958263 - protein, 17 aa, Entamoeba invadens
NKFGGVIFSKISKAGQC

SEQ ID NO: 2958264 - protein, 17 aa, Entamoeba invadens
NKFKEEVIKTYKKDGFV

SEQ ID NO: 2958265 - protein, 22 aa, Entamoeba invadens
NKFKGLCNEKAEKLGIKTARLP

SEQ ID NO: 2958266 - protein, 17 aa, Entamoeba invadens
NKFKLKLHPKVVFLKLE

SEQ ID NO: 2958267 - protein, 24 aa, Entamoeba invadens
NKFREVLRTVLTIIMDDNPPGKLQ

SEQ ID NO: 2958268 - protein, 23 aa, Entamoeba invadens
NKFRKANDIVISFLHAAVTVEEN

SEQ ID NO: 2958269 - protein, 21 aa, Entamoeba invadens
NKFTECLHLLIDILTELGYFF

SEQ ID NO: 2958270 - protein, 17 aa, Entamoeba invadens
NKFVFDAARGILYLHNN

SEQ ID NO: 2958271 - protein, 32 aa, Entamoeba invadens
NKFYEVHNLLQWLSSISVEFAQKYALKFLQQE

SEQ ID NO: 2958272 - protein, 27 aa, Entamoeba invadens
NKFYRAIMSKTRFLQIVNSLRFDKFAG

SEQ ID NO: 2958273 - protein, 22 aa, Entamoeba invadens
NKFYTSFSFKKKLTILPHFSTC

SEQ ID NO: 2958274 - protein, 22 aa, Entamoeba invadens
NKGCREAFNRAPFPKIPVLHLW

SEQ ID NO: 2958275 - protein, 20 aa, Entamoeba invadens
NKGGRAFRDLQLEEEILQKA

SEQ ID NO: 2958276 - protein, 26 aa, Entamoeba invadens
NKGKICLIHAHPFFIIKFIEENKRVK

SEQ ID NO: 2958277 - protein, 18 aa, Entamoeba invadens
NKGKMRIEGQIYGDTKRV

SEQ ID NO: 2958278 - protein, 23 aa, Entamoeba invadens
NKGMLICVYNFIVDIPTAIKYTD

SEQ ID NO: 2958279 - protein, 19 aa, Entamoeba invadens
NKGMMLIESFILLNRDKTV

SEQ ID NO: 2958280 - protein, 22 aa, Entamoeba invadens
NKGNDFFASLNFAKPKQTETAQ

SEQ ID NO: 2958281 - protein, 23 aa, Entamoeba invadens
NKGRRVICPQIIYTDTYEYHALS

SEQ ID NO: 2958282 - protein, 21 aa, Entamoeba invadens
NKGTRELLCLGNKSKHGEACG

SEQ ID NO: 2958283 - protein, 29 aa, Entamoeba invadens
NKGVLKKEFFRIIVWFNVDFKTVDRNKNR

SEQ ID NO: 2958284 - protein, 19 aa, Entamoeba invadens
NKGVLKKKFFRIIVWSSVD

SEQ ID NO: 2958285 - protein, 22 aa, Entamoeba invadens
NKGVLKREFYRIIVWFYVGFEI

SEQ ID NO: 2958286 - protein, 27 aa, Entamoeba invadens
NKGYCLKTTVCYSSCNCLMMGGMGNLM

SEQ ID NO: 2958287 - protein, 27 aa, Entamoeba invadens
NKHFCQMGYSPEEARAHAIEEEKALSE

SEQ ID NO: 2958288 - protein, 22 aa, Entamoeba invadens
NKHFKIMFDIADIEENGSLNVN

SEQ ID NO: 2958289 - protein, 19 aa, Entamoeba invadens
NKIAIPLTAVNFVFDAATC

SEQ ID NO: 2958290 - protein, 19 aa, Entamoeba invadens
NKICIEFHSELALFRDRDI

SEQ ID NO: 2958291 - protein, 23 aa, Entamoeba invadens
NKIDDEFLMFLFYYTQGTPLQAQ

SEQ ID NO: 2958292 - protein, 20 aa, Entamoeba invadens
NKIDLFIFKDGILRNDVKKT

SEQ ID NO: 2958293 - protein, 26 aa, Entamoeba invadens
NKIDSILPIRAFYGLEKLSMKNNLLT

SEQ ID NO: 2958294 - protein, 18 aa, Entamoeba invadens
NKIFITRNITVIGENCFK

SEQ ID NO: 2958295 - protein, 22 aa, Entamoeba invadens
NKIGKIVIVKGIVTRVTDVRPL

SEQ ID NO: 2958296 - protein, 17 aa, Entamoeba invadens
NKIGLGTIWQKTSQQKA

SEQ ID NO: 2958297 - protein, 25 aa, Entamoeba invadens
NKIICNNLSWIIMLVSSWKAMGPIN

SEQ ID NO: 2958298 - protein, 22 aa, Entamoeba invadens
NKIKEEKEMLLKDLSNGSDLSS

SEQ ID NO: 2958299 - protein, 24 aa, Entamoeba invadens
NKIKEILPTGAIVYEKCPACGNET

SEQ ID NO: 2958300 - protein, 17 aa, Entamoeba invadens
NKIKIGLLGDMGVGKTC

SEQ ID NO: 2958301 - protein, 28 aa, Entamoeba invadens
NKIKTVPIRLCFDLKCIQRIDLSCNFIN

SEQ ID NO: 2958302 - protein, 22 aa, Entamoeba invadens
NKILIRLSRILGHYITLHPEAD

SEQ ID NO: 2958303 - protein, 21 aa, Entamoeba invadens
NKILSGYLIKASEPINSTRIV

SEQ ID NO: 2958304 - protein, 17 aa, Entamoeba invadens
NKIPHFVRKISEQSFEG

SEQ ID NO: 2958305 - protein, 17 aa, Entamoeba invadens
NKIQCTDVFFTRKDVKR

SEQ ID NO: 2958306 - protein, 19 aa, Entamoeba invadens
NKIQECIGMLLEPKHSESV

SEQ ID NO: 2958307 - protein, 20 aa, Entamoeba invadens
NKIQSEWRDGTLLCELLEKE

SEQ ID NO: 2958308 - protein, 26 aa, Entamoeba invadens
NKITCICGAYFCYLCGKEISGYNHFG

SEQ ID NO: 2958309 - protein, 25 aa, Entamoeba invadens
NKITLFIRKYFYLHSNEYIFQSVDI

SEQ ID NO: 2958310 - protein, 19 aa, Entamoeba invadens
NKITYEFQEKYNLNLTISG

SEQ ID NO: 2958311 - protein, 24 aa, Entamoeba invadens
NKIVCTSAVMLCMNIVDNVCLMTK

SEQ ID NO: 2958312 - protein, 23 aa, Entamoeba invadens
NKKCFECMQSLYINPFVNLEIET

SEQ ID NO: 2958313 - protein, 20 aa, Entamoeba invadens
NKKCFSECYSLVAIPKLKNV

SEQ ID NO: 2958314 - protein, 21 aa, Entamoeba invadens
NKKCLKCEDGFVLVNDECVSL

SEQ ID NO: 2958315 - protein, 24 aa, Entamoeba invadens
NKKCQSCLTSLYINPYIDVSNEIL

SEQ ID NO: 2958316 - protein, 24 aa, Entamoeba invadens
NKKCSSCLSGLYINPFIDVSVQSF

SEQ ID NO: 2958317 - protein, 23 aa, Entamoeba invadens
NKKDFYKIVVWYQVDFDTFHKVA

SEQ ID NO: 2958318 - protein, 17 aa, Entamoeba invadens
NKKEITTIMALANDSFP

SEQ ID NO: 2958319 - protein, 22 aa, Entamoeba invadens
NKKELAKFLKLIGTTKKEDIDK

SEQ ID NO: 2958320 - protein, 19 aa, Entamoeba invadens
NKKGLDFGCFKNDREYDID

SEQ ID NO: 2958321 - protein, 22 aa, Entamoeba invadens
NKKIHFILGGAFGNRETMINKL

SEQ ID NO: 2958322 - protein, 24 aa, Entamoeba invadens
NKKIKVRLVPRFDIQKYQTIAKKK

SEQ ID NO: 2958323 - protein, 18 aa, Entamoeba invadens
NKKIPVVLADDITRLPQD

SEQ ID NO: 2958324 - protein, 20 aa, Entamoeba invadens
NKKKGAFSFSNPKEKRVKRG

SEQ ID NO: 2958325 - protein, 19 aa, Entamoeba invadens
NKKKIGVFVIDKIQKKTKN

SEQ ID NO: 2958326 - protein, 19 aa, Entamoeba invadens
NKKKIGVFVIDNIQKKTNN

SEQ ID NO: 2958327 - protein, 21 aa, Entamoeba invadens
NKKKIGVFVIYNIQKKTKNEL

SEQ ID NO: 2958328 - protein, 19 aa, Entamoeba invadens
NKKKMVIEKRGPVERSHIG

SEQ ID NO: 2958329 - protein, 23 aa, Entamoeba invadens
NKKLDSLAVFFSCEEEIAVRGAK

SEQ ID NO: 2958330 - protein, 30 aa, Entamoeba invadens
NKKLEGVTLDLLCKVLTSLLIPIQSKEFEQ

SEQ ID NO: 2958331 - protein, 19 aa, Entamoeba invadens
NKKLFGILVEANYIENSFH

SEQ ID NO: 2958332 - protein, 24 aa, Entamoeba invadens
NKKLNCECRQLYTINKELEIKSSE

SEQ ID NO: 2958333 - protein, 21 aa, Entamoeba invadens
NKKLPIKRYSLKNSIPTAYAS

SEQ ID NO: 2958334 - protein, 20 aa, Entamoeba invadens
NKKMLVLLPVPMKLEKDEYY

SEQ ID NO: 2958335 - protein, 22 aa, Entamoeba invadens
NKKNLRCGIVIPNNVIYQTEND

SEQ ID NO: 2958336 - protein, 23 aa, Entamoeba invadens
NKKPSKTNFLFARKEVGVNQVCP

SEQ ID NO: 2958337 - protein, 24 aa, Entamoeba invadens
NKKRLDLVLLLLKYGANINIKNVS

SEQ ID NO: 2958338 - protein, 26 aa, Entamoeba invadens
NKKRSLSFKKLSLFSFKKDEDSHKKS

SEQ ID NO: 2958339 - protein, 18 aa, Entamoeba invadens
NKKSDCPFRTFLVVSRRV

SEQ ID NO: 2958340 - protein, 20 aa, Entamoeba invadens
NKKSFNLSVKVPKDIIGITP

SEQ ID NO: 2958341 - protein, 23 aa, Entamoeba invadens
NKKSKCQNGIIVLHVHQGGVVEY

SEQ ID NO: 2958342 - protein, 21 aa, Entamoeba invadens
NKKVKCVLWDTAGQERFMNIS

SEQ ID NO: 2958343 - protein, 29 aa, Entamoeba invadens
NKKWKKRYLLWKGMTLYLFDKKGTKEPSK

SEQ ID NO: 2958344 - protein, 23 aa, Entamoeba invadens
NKKYFIPKCVAKKLLDNVEGFED

SEQ ID NO: 2958345 - protein, 25 aa, Entamoeba invadens
NKKYLKCVLQHFLAMLNEIQTVLYE

SEQ ID NO: 2958346 - protein, 22 aa, Entamoeba invadens
NKKYNIMSVFSFNSNGFDEFVV

SEQ ID NO: 2958347 - protein, 22 aa, Entamoeba invadens
NKLALAKWKGRLEFSDPKTQNE

SEQ ID NO: 2958348 - protein, 26 aa, Entamoeba invadens
NKLCTSCGVSSCETCVTSPTNKCDTC

SEQ ID NO: 2958349 - protein, 27 aa, Entamoeba invadens
NKLEAIPMEIGSLLSLEYLNISENALQ

SEQ ID NO: 2958350 - protein, 24 aa, Entamoeba invadens
NKLEFKFPWKIAEFVISGKRLPKK

SEQ ID NO: 2958351 - protein, 23 aa, Entamoeba invadens
NKLELKKLVYLYLMNYSRSQPER

SEQ ID NO: 2958352 - protein, 21 aa, Entamoeba invadens
NKLERIQKCFFNSGNTTIYIV

SEQ ID NO: 2958353 - protein, 22 aa, Entamoeba invadens
NKLETFNSYVILPVQRIPRYRL

SEQ ID NO: 2958354 - protein, 25 aa, Entamoeba invadens
NKLEVFGCYVPTPPKPRTWTKDPNV

SEQ ID NO: 2958355 - protein, 21 aa, Entamoeba invadens
NKLFILKVVHKRFRREGDDVV

SEQ ID NO: 2958356 - protein, 21 aa, Entamoeba invadens
NKLFKHLWPPTISLSEKISFD

SEQ ID NO: 2958357 - protein, 20 aa, Entamoeba invadens
NKLGLTKSLTFLKPSEELDN

SEQ ID NO: 2958358 - protein, 21 aa, Entamoeba invadens
NKLGVLGNFLFYIREGKARVT

SEQ ID NO: 2958359 - protein, 17 aa, Entamoeba invadens
NKLKLGVLKFLESYKDV

SEQ ID NO: 2958360 - protein, 29 aa, Entamoeba invadens
NKLKPLIGIPLEPKFNVLQSEKFVGVTDF

SEQ ID NO: 2958361 - protein, 21 aa, Entamoeba invadens
NKLLCINARAFYNCSNIKELN

SEQ ID NO: 2958362 - protein, 23 aa, Entamoeba invadens
NKLNNFQLLYGIIQAFDQKSKIW

SEQ ID NO: 2958363 - protein, 21 aa, Entamoeba invadens
NKLPSAISFHLNRSLPSISLL

SEQ ID NO: 2958364 - protein, 23 aa, Entamoeba invadens
NKLPVDLYPIISIDLPKENGAAI

SEQ ID NO: 2958365 - protein, 23 aa, Entamoeba invadens
NKLRKEKRLPLLSREQLIESSEL

SEQ ID NO: 2958366 - protein, 18 aa, Entamoeba invadens
NKLYQCFMMSTSKDRPRQ

SEQ ID NO: 2958367 - protein, 22 aa, Entamoeba invadens
NKMCFDMCSSLWGFKMPMNMLD

SEQ ID NO: 2958368 - protein, 17 aa, Entamoeba invadens
NKMCMVTEFALFGSLQD

SEQ ID NO: 2958369 - protein, 23 aa, Entamoeba invadens
NKMDITFEVLQKIALQTDESTFV

SEQ ID NO: 2958370 - protein, 24 aa, Entamoeba invadens
NKMEVYQLAALFSVFVFEPSNESM

SEQ ID NO: 2958371 - protein, 19 aa, Entamoeba invadens
NKMGFSFNFILFEYRPPKN

SEQ ID NO: 2958372 - protein, 18 aa, Entamoeba invadens
NKMHFFGIKGSWTALDMG

SEQ ID NO: 2958373 - protein, 24 aa, Entamoeba invadens
NKMKFPKMIFLRKCDANMWSNQPI

SEQ ID NO: 2958374 - protein, 20 aa, Entamoeba invadens
NKMSMFFAYSSPMMKVLTDA

SEQ ID NO: 2958375 - protein, 25 aa, Entamoeba invadens
NKNCQIDGWLPCIGTYAISPELPIM

SEQ ID NO: 2958376 - protein, 22 aa, Entamoeba invadens
NKNECFEHVLPSGVSDSSSSIE

SEQ ID NO: 2958377 - protein, 25 aa, Entamoeba invadens
NKNEFAVKIVDEFVENKRKEVTQKM

SEQ ID NO: 2958378 - protein, 31 aa, Entamoeba invadens
NKNELGLCFICGEFGHPAFRCPLKKSEEMKI

SEQ ID NO: 2958379 - protein, 31 aa, Entamoeba invadens
NKNFDMRPGMIVKNLCLKRPIFQKTAVGGHF

SEQ ID NO: 2958380 - protein, 26 aa, Entamoeba invadens
NKNILGKCDLFEGCDSLRYLDFGNDD

SEQ ID NO: 2958381 - protein, 25 aa, Entamoeba invadens
NKNILWLLIRFLRKVTDNTELTQMT

SEQ ID NO: 2958382 - protein, 24 aa, Entamoeba invadens
NKNIRSAKTIQHWECNHKINQKIE

SEQ ID NO: 2958383 - protein, 24 aa, Entamoeba invadens
NKNKRISHEEFIKYYINSFNDALN

SEQ ID NO: 2958384 - protein, 20 aa, Entamoeba invadens
NKNLRFVQFGLKEIQIAQLE

SEQ ID NO: 2958385 - protein, 26 aa, Entamoeba invadens
NKNLTDFPRSVIINFTYDNERLIYGI

SEQ ID NO: 2958386 - protein, 20 aa, Entamoeba invadens
NKNMVSWKKSFFDNEQTRIL

SEQ ID NO: 2958387 - protein, 27 aa, Entamoeba invadens
NKNNKCVLCKTGFVLNEQFECISSEIC

SEQ ID NO: 2958388 - protein, 23 aa, Entamoeba invadens
NKNSIPLSLVFRYCNNIKVFCEV

SEQ ID NO: 2958389 - protein, 18 aa, Entamoeba invadens
NKNVKFAPFNACCHHGKI

SEQ ID NO: 2958390 - protein, 29 aa, Entamoeba invadens
NKNYHCWSHRVWVCNKFNCWAGELEYTEK

SEQ ID NO: 2958391 - protein, 19 aa, Entamoeba invadens
NKPIKRSIATLQFLNVKQI

SEQ ID NO: 2958392 - protein, 20 aa, Entamoeba invadens
NKPKLVYDIMQFEEFKTFYG

SEQ ID NO: 2958393 - protein, 22 aa, Entamoeba invadens
NKPKRKSSLHVLKKDDINLYDF

SEQ ID NO: 2958394 - protein, 21 aa, Entamoeba invadens
NKPLAMARLSRVVPHEKDYQQ

SEQ ID NO: 2958395 - protein, 25 aa, Entamoeba invadens
NKPRASKEDMEWLRKVFDGIESEAK

SEQ ID NO: 2958396 - protein, 25 aa, Entamoeba invadens
NKQALCKQLGLILDFVLAFDNKKVT

SEQ ID NO: 2958397 - protein, 19 aa, Entamoeba invadens
NKQCLKYFTALSEFESSWL

SEQ ID NO: 2958398 - protein, 20 aa, Entamoeba invadens
NKQDFCVVISKSTLFVVNKQ

SEQ ID NO: 2958399 - protein, 18 aa, Entamoeba invadens
NKQFKCVRCKGKTKQDGV

SEQ ID NO: 2958400 - protein, 24 aa, Entamoeba invadens
NKQIAKVRTRLRLCEKDTRSALSK

SEQ ID NO: 2958401 - protein, 19 aa, Entamoeba invadens
NKQKALPFLNFFFKIITDG

SEQ ID NO: 2958402 - protein, 25 aa, Entamoeba invadens
NKQKETRGILALAIYDSVKLDLPRS

SEQ ID NO: 2958403 - protein, 19 aa, Entamoeba invadens
NKQMYSIYTTEYFSDAQFS

SEQ ID NO: 2958404 - protein, 26 aa, Entamoeba invadens
NKQQELWCSCKMNAFDYDGRKVGICG

SEQ ID NO: 2958405 - protein, 20 aa, Entamoeba invadens
NKRAIQIASVIVLTVKPYLI

SEQ ID NO: 2958406 - protein, 18 aa, Entamoeba invadens
NKRDIWLLSETGEIVTYK

SEQ ID NO: 2958407 - protein, 20 aa, Entamoeba invadens
NKRDLQWKVTRQEVQEICVA

SEQ ID NO: 2958408 - protein, 28 aa, Entamoeba invadens
NKRDMSFVIAFLLYKGVIVRELTKQLFN

SEQ ID NO: 2958409 - protein, 17 aa, Entamoeba invadens
NKREFKYILDAIPKKFE

SEQ ID NO: 2958410 - protein, 18 aa, Entamoeba invadens
NKRLYIIATTCLAPEILR

SEQ ID NO: 2958411 - protein, 22 aa, Entamoeba invadens
NKRSTIGRIFFWLIKSELHIPE

SEQ ID NO: 2958412 - protein, 26 aa, Entamoeba invadens
NKSCRRFIVSGSCKFCEGEETKMRRG

SEQ ID NO: 2958413 - protein, 24 aa, Entamoeba invadens
NKSGLCYVNKAPLCIDNKEYLDFS

SEQ ID NO: 2958414 - protein, 20 aa, Entamoeba invadens
NKSGNAAVMRRCLVESEIND

SEQ ID NO: 2958415 - protein, 22 aa, Entamoeba invadens
NKSGQLFAFCHFLNVDLALVIL

SEQ ID NO: 2958416 - protein, 24 aa, Entamoeba invadens
NKSKCAYNPSKECVDLTKELQAEE

SEQ ID NO: 2958417 - protein, 18 aa, Entamoeba invadens
NKSLTTPALCAWKKATLL

SEQ ID NO: 2958418 - protein, 26 aa, Entamoeba invadens
NKSMMFDPRLQAIVLNIVDVSYGGLN

SEQ ID NO: 2958419 - protein, 24 aa, Entamoeba invadens
NKSRECSYFYGYNAVVNFLQDNDL

SEQ ID NO: 2958420 - protein, 24 aa, Entamoeba invadens
NKSRSCKTPFLMSTHRKKTPELFD

SEQ ID NO: 2958421 - protein, 29 aa, Entamoeba invadens
NKSTKTYLDFCEMFGPELQAVSFPKEYAA

SEQ ID NO: 2958422 - protein, 21 aa, Entamoeba invadens
NKSYPPIRIKARDPARLASQR

SEQ ID NO: 2958423 - protein, 23 aa, Entamoeba invadens
NKTALSWKGVLSLSHDYNVSEYM

SEQ ID NO: 2958424 - protein, 19 aa, Entamoeba invadens
NKTAMPFNTAIERQLEEMT

SEQ ID NO: 2958425 - protein, 24 aa, Entamoeba invadens
NKTDWSIEIHREYSNELVGIFKEI

SEQ ID NO: 2958426 - protein, 23 aa, Entamoeba invadens
NKTEIFEFFISVAYECLEISEYN

SEQ ID NO: 2958427 - protein, 26 aa, Entamoeba invadens
NKTEIGFYFTKVYIFTLFFLDTPVQK

SEQ ID NO: 2958428 - protein, 25 aa, Entamoeba invadens
NKTELSVSMVNEWAYEKGTTQRKNI

SEQ ID NO: 2958429 - protein, 24 aa, Entamoeba invadens
NKTFENTHLWLANKIQTSTAKHKI

SEQ ID NO: 2958430 - protein, 24 aa, Entamoeba invadens
NKTFLEHFVALCLQICKNPTSKMS

SEQ ID NO: 2958431 - protein, 25 aa, Entamoeba invadens
NKTFLEYFVPLCLKIVEHKTSKMNV

SEQ ID NO: 2958432 - protein, 17 aa, Entamoeba invadens
NKTGIPIFYMTLFKEST

SEQ ID NO: 2958433 - protein, 25 aa, Entamoeba invadens
NKTIALRKCVGCFGTEDLLTTQVML

SEQ ID NO: 2958434 - protein, 17 aa, Entamoeba invadens
NKTICVVGSHLAAHQME

SEQ ID NO: 2958435 - protein, 17 aa, Entamoeba invadens
NKTIGFYQKMGFVVIRQ

SEQ ID NO: 2958436 - protein, 33 aa, Entamoeba invadens
NKTKKFACKMCGAKQSYRHIFGISNQAKDLRLL

SEQ ID NO: 2958437 - protein, 20 aa, Entamoeba invadens
NKTLFKTICREMNVYSQDST

SEQ ID NO: 2958438 - protein, 21 aa, Entamoeba invadens
NKTLQFFYVMETFYYCNRLSF

SEQ ID NO: 2958439 - protein, 24 aa, Entamoeba invadens
NKTMDRIRMFLGYPLPHQIEKSCL

SEQ ID NO: 2958440 - protein, 18 aa, Entamoeba invadens
NKTTSVIFNFAFENSPTW

SEQ ID NO: 2958441 - protein, 19 aa, Entamoeba invadens
NKTTVWREKDRVVSMTQSN

SEQ ID NO: 2958442 - protein, 17 aa, Entamoeba invadens
NKTYTVQCSQGFIMNQA

SEQ ID NO: 2958443 - protein, 24 aa, Entamoeba invadens
NKVDPNFIATFAMDSDKVTIIDVR

SEQ ID NO: 2958444 - protein, 17 aa, Entamoeba invadens
NKVEPFPICSTHFPFET

SEQ ID NO: 2958445 - protein, 28 aa, Entamoeba invadens
NKVEVGVTGLVRFEGFVTVLKQGFMTFI

SEQ ID NO: 2958446 - protein, 18 aa, Entamoeba invadens
NKVFKVRIEKEGWNVTDK

SEQ ID NO: 2958447 - protein, 22 aa, Entamoeba invadens
NKVGECLHLLQKTAEFLGFSFK

SEQ ID NO: 2958448 - protein, 24 aa, Entamoeba invadens
NKVIIRRVIRTEYKITYPYLYAQR

SEQ ID NO: 2958449 - protein, 23 aa, Entamoeba invadens
NKVKSLGKMCFSQNLTITELVIP

SEQ ID NO: 2958450 - protein, 18 aa, Entamoeba invadens
NKVLKERNDFLFQRCEIL

SEQ ID NO: 2958451 - protein, 19 aa, Entamoeba invadens
NKVNATLFPQPQVKHQEKQ

SEQ ID NO: 2958452 - protein, 19 aa, Entamoeba invadens
NKVNFWRNVYGFNMTPMRA

SEQ ID NO: 2958453 - protein, 21 aa, Entamoeba invadens
NKVQVDIPYIFLLKNNPEVIR

SEQ ID NO: 2958454 - protein, 23 aa, Entamoeba invadens
NKVRGTRVWEWAGCFEERRGDVG

SEQ ID NO: 2958455 - protein, 22 aa, Entamoeba invadens
NKVRLVREVQDFPIFKESIFFY

SEQ ID NO: 2958456 - protein, 21 aa, Entamoeba invadens
NKVVESFLFWLKQRKHKSFSP

SEQ ID NO: 2958457 - protein, 25 aa, Entamoeba invadens
NKVVLFLKDLFDAFSSFYNEYQTQV

SEQ ID NO: 2958458 - protein, 20 aa, Entamoeba invadens
NKVVQCALNLLTEERSESVA

SEQ ID NO: 2958459 - protein, 19 aa, Entamoeba invadens
NKVWIVRYPPPEWNQSLDL

SEQ ID NO: 2958460 - protein, 25 aa, Entamoeba invadens
NKVYEKGCATLGVMYEVTRRNSSQF

SEQ ID NO: 2958461 - protein, 18 aa, Entamoeba invadens
NKWKAMGPINKEKKKFKR

SEQ ID NO: 2958462 - protein, 17 aa, Entamoeba invadens
NKYANMFDFETHEVEVK

SEQ ID NO: 2958463 - protein, 17 aa, Entamoeba invadens
NKYHCISDPEVLKQLSL

SEQ ID NO: 2958464 - protein, 26 aa, Entamoeba invadens
NKYHCTRCGDFVNAIKRSCFKVLPNT

SEQ ID NO: 2958465 - protein, 22 aa, Entamoeba invadens
NKYIFFKIVVWYNVDYNTFVIN

SEQ ID NO: 2958466 - protein, 25 aa, Entamoeba invadens
NKYIFFKIVVWYNVDYNTFVLNKNS

SEQ ID NO: 2958467 - protein, 21 aa, Entamoeba invadens
NKYLREFIFTLVINAVCASNV

SEQ ID NO: 2958468 - protein, 25 aa, Entamoeba invadens
NKYSCFCCTCESHIEWSADVKKATI

SEQ ID NO: 2958469 - protein, 22 aa, Entamoeba invadens
NKYSGKGFGKYRAETIELASMT

SEQ ID NO: 2958470 - protein, 20 aa, Entamoeba invadens
NKYTFKGDVVLYYIDMNSID

SEQ ID NO: 2958471 - protein, 27 aa, Entamoeba invadens
NKYVEKGIVFPPPIVRKDTHLEQQEST

SEQ ID NO: 2958472 - protein, 28 aa, Entamoeba invadens
NLAEYCRFEEKLFKCNFDDGPLRYSEAI

SEQ ID NO: 2958473 - protein, 17 aa, Entamoeba invadens
NLAICFAPTLFTFAKEE

SEQ ID NO: 2958474 - protein, 18 aa, Entamoeba invadens
NLAICLAPCMLHDEKADI

SEQ ID NO: 2958475 - protein, 18 aa, Entamoeba invadens
NLAILLTTFHNWNDVTQA

SEQ ID NO: 2958476 - protein, 18 aa, Entamoeba invadens
NLAVCWTPTMFNVLTDDI

SEQ ID NO: 2958477 - protein, 33 aa, Entamoeba invadens
NLAVHFFVVLFFKHYVAIPFIKFAPFKTALIKL

SEQ ID NO: 2958478 - protein, 17 aa, Entamoeba invadens
NLAVLAYVDVPRSVKDK

SEQ ID NO: 2958479 - protein, 25 aa, Entamoeba invadens
NLAYKTILCFIRFGDLVERYDVTEL

SEQ ID NO: 2958480 - protein, 22 aa, Entamoeba invadens
NLCFCGCMFSSIKIPDGVVYMG

SEQ ID NO: 2958481 - protein, 23 aa, Entamoeba invadens
NLCFMNKLRVLRIEFCHLESIKI

SEQ ID NO: 2958482 - protein, 22 aa, Entamoeba invadens
NLCGKKTFDGLVTYSQMQQLKR

SEQ ID NO: 2958483 - protein, 28 aa, Entamoeba invadens
NLCNLRYLNKIQCKWEVLGKCDGSEVVT

SEQ ID NO: 2958484 - protein, 22 aa, Entamoeba invadens
NLDELVPLVFKRKSGLKSLELG

SEQ ID NO: 2958485 - protein, 27 aa, Entamoeba invadens
NLDGAFCESIGWLGGALQEFADLLIEL

SEQ ID NO: 2958486 - protein, 19 aa, Entamoeba invadens
NLDTCPFSFGMDDQSFIQL

SEQ ID NO: 2958487 - protein, 26 aa, Entamoeba invadens
NLDYKVFCILTYKLGQVTILKNSLLL

SEQ ID NO: 2958488 - protein, 20 aa, Entamoeba invadens
NLECSACQSGMAFERDTESS

SEQ ID NO: 2958489 - protein, 25 aa, Entamoeba invadens
NLEDFKGKFVVLLFYPLDWTFVCPT

SEQ ID NO: 2958490 - protein, 17 aa, Entamoeba invadens
NLEDVFIAPSFEDKFMN

SEQ ID NO: 2958491 - protein, 19 aa, Entamoeba invadens
NLEIETFVLFKEPREALYS

SEQ ID NO: 2958492 - protein, 36 aa, Entamoeba invadens
NLEIFLGSTQEVVWKRLKKLIITGCKIREIPVGVFS

SEQ ID NO: 2958493 - protein, 21 aa, Entamoeba invadens
NLEKCKECVILKVLSNAKLTQ

SEQ ID NO: 2958494 - protein, 24 aa, Entamoeba invadens
NLEKLHLFGPLTYFELPTPKKTET

SEQ ID NO: 2958495 - protein, 18 aa, Entamoeba invadens
NLEKSRYGNISFRTWHQR

SEQ ID NO: 2958496 - protein, 21 aa, Entamoeba invadens
NLELIFYSSFDGFDPRDFRNK

SEQ ID NO: 2958497 - protein, 24 aa, Entamoeba invadens
NLELLRVSCCNLRKIPEDVFTAVK

SEQ ID NO: 2958498 - protein, 23 aa, Entamoeba invadens
NLELSILCVNTFYKDCRAANPIV

SEQ ID NO: 2958499 - protein, 27 aa, Entamoeba invadens
NLEQALKFIVADGIKLVNIDAQNIFEG

SEQ ID NO: 2958500 - protein, 18 aa, Entamoeba invadens
NLEQDFDIEILYIFEILT

SEQ ID NO: 2958501 - protein, 21 aa, Entamoeba invadens
NLETWRQLWRVVERSEVVLII

SEQ ID NO: 2958502 - protein, 23 aa, Entamoeba invadens
NLETYKKLFALESEMLREMKGVI

SEQ ID NO: 2958503 - protein, 21 aa, Entamoeba invadens
NLEVCLDKFLKVMAATVEYFS

SEQ ID NO: 2958504 - protein, 22 aa, Entamoeba invadens
NLEVIKKLAFSNCVTLKEVVIP

SEQ ID NO: 2958505 - protein, 19 aa, Entamoeba invadens
NLFCVSWMMGVADSDLKTS

SEQ ID NO: 2958506 - protein, 19 aa, Entamoeba invadens
NLFDGCVSLKIVILPDSLI

SEQ ID NO: 2958507 - protein, 22 aa, Entamoeba invadens
NLFELRWSLKEDVYVQVFLYIY

SEQ ID NO: 2958508 - protein, 19 aa, Entamoeba invadens
NLFETKWLPPKIKKLRVSY

SEQ ID NO: 2958509 - protein, 27 aa, Entamoeba invadens
NLFFPESLLSRFDLIFIVLDSTTEEID

SEQ ID NO: 2958510 - protein, 20 aa, Entamoeba invadens
NLFGAEGICVFESKNTIVLA

SEQ ID NO: 2958511 - protein, 17 aa, Entamoeba invadens
NLFKYAEAYIRKFANEV

SEQ ID NO: 2958512 - protein, 18 aa, Entamoeba invadens
NLFNEVIYMLGVDLGQAF

SEQ ID NO: 2958513 - protein, 19 aa, Entamoeba invadens
NLFVISCCFCNEDIEINPL

SEQ ID NO: 2958514 - protein, 21 aa, Entamoeba invadens
NLGALYIKADFPVNKLSYAEY

SEQ ID NO: 2958515 - protein, 17 aa, Entamoeba invadens
NLGECFIYLNDDVFFNK

SEQ ID NO: 2958516 - protein, 17 aa, Entamoeba invadens
NLGECFIYLNDDVFFNR

SEQ ID NO: 2958517 - protein, 25 aa, Entamoeba invadens
NLGERVMGLLACRYVDDVIIGAPKG

SEQ ID NO: 2958518 - protein, 29 aa, Entamoeba invadens
NLGLTGLISCLERIRLFWMNYEDSQALSL

SEQ ID NO: 2958519 - protein, 29 aa, Entamoeba invadens
NLGNIFGPCVYWKDYSIKSINDVRCINAF

SEQ ID NO: 2958520 - protein, 23 aa, Entamoeba invadens
NLGPDYWLIAARLMRSVLQSVED

SEQ ID NO: 2958521 - protein, 19 aa, Entamoeba invadens
NLGTFIIELRRNYKTQKSQ

SEQ ID NO: 2958522 - protein, 17 aa, Entamoeba invadens
NLHDAIVSIECGIIDND

SEQ ID NO: 2958523 - protein, 19 aa, Entamoeba invadens
NLHRLKVFSNFATKCNFTS

SEQ ID NO: 2958524 - protein, 17 aa, Entamoeba invadens
NLIAMAFPATGFSQQWR

SEQ ID NO: 2958525 - protein, 24 aa, Entamoeba invadens
NLIARTIIIEYFRDEGFRIELTNY

SEQ ID NO: 2958526 - protein, 17 aa, Entamoeba invadens
NLICSPSVFTIFVEMFK

SEQ ID NO: 2958527 - protein, 19 aa, Entamoeba invadens
NLIDQVFCAGINVRQGGGA

SEQ ID NO: 2958528 - protein, 24 aa, Entamoeba invadens
NLIEFLRKRYDGISNAKIVQLIVW

SEQ ID NO: 2958529 - protein, 21 aa, Entamoeba invadens
NLIGGHGLKKMDIRSSDPYCI

SEQ ID NO: 2958530 - protein, 17 aa, Entamoeba invadens
NLIGLPLQRGITVTSLS

SEQ ID NO: 2958531 - protein, 21 aa, Entamoeba invadens
NLIHAYDCIGALIKNNMDGLV

SEQ ID NO: 2958532 - protein, 21 aa, Entamoeba invadens
NLIILDARFPFEYEQGHIINS

SEQ ID NO: 2958533 - protein, 19 aa, Entamoeba invadens
NLIPLKIFLVELVAVIVTK

SEQ ID NO: 2958534 - protein, 18 aa, Entamoeba invadens
NLISTKWLGQTVVQSPAL

SEQ ID NO: 2958535 - protein, 29 aa, Entamoeba invadens
NLKAKAEKLFKRWCDVVTSDMEKIGNSIM

SEQ ID NO: 2958536 - protein, 27 aa, Entamoeba invadens
NLKEAKYRVTYKIGEHGAYTIHCTLNN

SEQ ID NO: 2958537 - protein, 29 aa, Entamoeba invadens
NLKEIAQEIYIRWKTRKLIRERNYDDDRA

SEQ ID NO: 2958538 - protein, 26 aa, Entamoeba invadens
NLKEIAQEIYVRWKTRKLVKERSYDL

SEQ ID NO: 2958539 - protein, 22 aa, Entamoeba invadens
NLKEIEIFGCQNLDDFALEKIS

SEQ ID NO: 2958540 - protein, 19 aa, Entamoeba invadens
NLKEVGGDVLLKFHLTTFV

SEQ ID NO: 2958541 - protein, 18 aa, Entamoeba invadens
NLKFYVIGDFHIPHRTAA

SEQ ID NO: 2958542 - protein, 20 aa, Entamoeba invadens
NLKHVRVFGEFCFCGCDSLS

SEQ ID NO: 2958543 - protein, 18 aa, Entamoeba invadens
NLKHVRVFGEYCFCGCDS

SEQ ID NO: 2958544 - protein, 18 aa, Entamoeba invadens
NLKIEDIVLPKLVNNLQN

SEQ ID NO: 2958545 - protein, 21 aa, Entamoeba invadens
NLKIEELKQSIAEKDEENTKM

SEQ ID NO: 2958546 - protein, 20 aa, Entamoeba invadens
NLKISKPVFLEGRTEMIQIL

SEQ ID NO: 2958547 - protein, 27 aa, Entamoeba invadens
NLKIVSLCAWKLPKYVLRDVYESNSVT

SEQ ID NO: 2958548 - protein, 24 aa, Entamoeba invadens
NLKKCGRYPFYDVLSIQHVTASSS

SEQ ID NO: 2958549 - protein, 18 aa, Entamoeba invadens
NLKKIFVEDCERLNELNN

SEQ ID NO: 2958550 - protein, 20 aa, Entamoeba invadens
NLKKIGWMAFGFCEKLTNIE

SEQ ID NO: 2958551 - protein, 20 aa, Entamoeba invadens
NLKKLECSFENLPLSLPSLE

SEQ ID NO: 2958552 - protein, 23 aa, Entamoeba invadens
NLKKRKKGGFGLNEDIETLRELM

SEQ ID NO: 2958553 - protein, 25 aa, Entamoeba invadens
NLKKRVVLYCMEILISDVLKEKKRI

SEQ ID NO: 2958554 - protein, 17 aa, Entamoeba invadens
NLKNCTLKPMSNENEKS

SEQ ID NO: 2958555 - protein, 21 aa, Entamoeba invadens
NLKNLRWFPTTQRTIEYHDHV

SEQ ID NO: 2958556 - protein, 20 aa, Entamoeba invadens
NLKNSLAIRDAWINENPDRA

SEQ ID NO: 2958557 - protein, 22 aa, Entamoeba invadens
NLKRQFPIARYFKIHTKQLDFD

SEQ ID NO: 2958558 - protein, 19 aa, Entamoeba invadens
NLKSCSVKLRECFHEGNGF

SEQ ID NO: 2958559 - protein, 38 aa, Entamoeba invadens
NLKSDDEIFVSIEYLFFDALWVPLKMEILEEEIEEDTQ

SEQ ID NO: 2958560 - protein, 33 aa, Entamoeba invadens
NLKSLLYYETCAWMWRRGFTMTFKENNEFSIYR

SEQ ID NO: 2958561 - protein, 19 aa, Entamoeba invadens
NLKSLRFGSQLEEIGDNAF

SEQ ID NO: 2958562 - protein, 24 aa, Entamoeba invadens
NLKTCLRQAALKGKDFSFSTDVVL

SEQ ID NO: 2958563 - protein, 20 aa, Entamoeba invadens
NLLAELGLAYKSGKMLFLGL

SEQ ID NO: 2958564 - protein, 21 aa, Entamoeba invadens
NLLDYSFKLSNDIYKSIYNTF

SEQ ID NO: 2958565 - protein, 17 aa, Entamoeba invadens
NLLELGDAFTWFSKAQE

SEQ ID NO: 2958566 - protein, 24 aa, Entamoeba invadens
NLLFDIALELGFFFDSKLSRKSAK

SEQ ID NO: 2958567 - protein, 23 aa, Entamoeba invadens
NLLFDIALELGFFFESKLSRKSS

SEQ ID NO: 2958568 - protein, 23 aa, Entamoeba invadens
NLLFDICLELGFWFDSKPSRKSQ

SEQ ID NO: 2958569 - protein, 18 aa, Entamoeba invadens
NLLFPDIYVVDGGFLSLF

SEQ ID NO: 2958570 - protein, 19 aa, Entamoeba invadens
NLLGLKVLILLSPQIEHLV

SEQ ID NO: 2958571 - protein, 26 aa, Entamoeba invadens
NLLHFPRCVCNLTTLKTLFLSNNLIT

SEQ ID NO: 2958572 - protein, 17 aa, Entamoeba invadens
NLLIFGIDINEMVNAKL

SEQ ID NO: 2958573 - protein, 18 aa, Entamoeba invadens
NLLIHSTPSFGLSQLTHL

SEQ ID NO: 2958574 - protein, 17 aa, Entamoeba invadens
NLLKRGIGMLMFEAIKG

SEQ ID NO: 2958575 - protein, 17 aa, Entamoeba invadens
NLLKTLLPQCVLETPRT

SEQ ID NO: 2958576 - protein, 23 aa, Entamoeba invadens
NLLLKSSCPKVVMSQLEEVKAKK

SEQ ID NO: 2958577 - protein, 25 aa, Entamoeba invadens
NLLNKGCLLFVIQCTDGCMSIVYLK

SEQ ID NO: 2958578 - protein, 17 aa, Entamoeba invadens
NLLPFPFLLDGTKPTFL

SEQ ID NO: 2958579 - protein, 18 aa, Entamoeba invadens
NLLPWSFCTVFGSKQKEL

SEQ ID NO: 2958580 - protein, 25 aa, Entamoeba invadens
NLLQLRPSFEFTKDFRIKSRSQFCR

SEQ ID NO: 2958581 - protein, 24 aa, Entamoeba invadens
NLLRRILLCVPDNGTHDISIVFYR

SEQ ID NO: 2958582 - protein, 27 aa, Entamoeba invadens
NLLYCMSMKLCFGFPKYVIDEVVDLFV

SEQ ID NO: 2958583 - protein, 17 aa, Entamoeba invadens
NLMDVFGTYYLRALSSV

SEQ ID NO: 2958584 - protein, 20 aa, Entamoeba invadens
NLMGIKLLYQLLIQPDERAR

SEQ ID NO: 2958585 - protein, 19 aa, Entamoeba invadens
NLMKHYVSVVFKDIESVNQ

SEQ ID NO: 2958586 - protein, 25 aa, Entamoeba invadens
NLMKRLKEEIVWECAKDVEVVETEK

SEQ ID NO: 2958587 - protein, 36 aa, Entamoeba invadens
NLMKSACVFCSALLGINVDTIFKISLSKAYGLKLNI

SEQ ID NO: 2958588 - protein, 24 aa, Entamoeba invadens
NLMLLCDFSLPILFASLPVNLILD

SEQ ID NO: 2958589 - protein, 24 aa, Entamoeba invadens
NLMLRLGGMKSKINHLIAWNDVML

SEQ ID NO: 2958590 - protein, 19 aa, Entamoeba invadens
NLMQTCVQILIKMLNGKDE

SEQ ID NO: 2958591 - protein, 20 aa, Entamoeba invadens
NLMRKYRVAIREKKAKVFAK

SEQ ID NO: 2958592 - protein, 20 aa, Entamoeba invadens
NLMVYKQHFVDGIDIQQKIL

SEQ ID NO: 2958593 - protein, 20 aa, Entamoeba invadens
NLNFCFYIKHISSITNKVTE

SEQ ID NO: 2958594 - protein, 21 aa, Entamoeba invadens
NLNGTKSWNIWMEKDDSGDVV

SEQ ID NO: 2958595 - protein, 20 aa, Entamoeba invadens
NLNKGNVFYGLKFYKDEGMK

SEQ ID NO: 2958596 - protein, 25 aa, Entamoeba invadens
NLNLPSCKNHVGWIEGGVGMHSDDG

SEQ ID NO: 2958597 - protein, 18 aa, Entamoeba invadens
NLPDVWFEPDEVWEIKGA

SEQ ID NO: 2958598 - protein, 19 aa, Entamoeba invadens
NLPFKLSDEEFKKLFEKYE

SEQ ID NO: 2958599 - protein, 23 aa, Entamoeba invadens
NLPKDLIVMISYIGKMELYYDLI

SEQ ID NO: 2958600 - protein, 19 aa, Entamoeba invadens
NLPLFKILQSHSYQTSKTS

SEQ ID NO: 2958601 - protein, 20 aa, Entamoeba invadens
NLPLKEGFNLSQDEKNKAFK

SEQ ID NO: 2958602 - protein, 21 aa, Entamoeba invadens
NLPNKRLRDVSLRVKYMKAKE

SEQ ID NO: 2958603 - protein, 26 aa, Entamoeba invadens
NLPPVYTYFYLCVIVSSDGFVKISVL

SEQ ID NO: 2958604 - protein, 27 aa, Entamoeba invadens
NLPPVYTYFYLCVIVSSDGFVKISVLV

SEQ ID NO: 2958605 - protein, 26 aa, Entamoeba invadens
NLPQMKLSVLFEKIGVEFSVKRYDFL

SEQ ID NO: 2958606 - protein, 23 aa, Entamoeba invadens
NLPSHLVEFIIPFECKTEAITNA

SEQ ID NO: 2958607 - protein, 19 aa, Entamoeba invadens
NLPSIEFGQDLYIDGEKVN

SEQ ID NO: 2958608 - protein, 18 aa, Entamoeba invadens
NLPSILFEIYDWDRFKTD

SEQ ID NO: 2958609 - protein, 23 aa, Entamoeba invadens
NLPSLQPQPGMPHQFNGQPMIKQ

SEQ ID NO: 2958610 - protein, 21 aa, Entamoeba invadens
NLPTELCDPVYTKKEYNKYVL

SEQ ID NO: 2958611 - protein, 24 aa, Entamoeba invadens
NLPYETKWLLLQKHVPDASQSKMR

SEQ ID NO: 2958612 - protein, 20 aa, Entamoeba invadens
NLQEGMRMNNGIYNYNNNII

SEQ ID NO: 2958613 - protein, 18 aa, Entamoeba invadens
NLQEKIYIGKTCGAIKSA

SEQ ID NO: 2958614 - protein, 23 aa, Entamoeba invadens
NLQLMKWQLFKSLDLEMLKQTKC

SEQ ID NO: 2958615 - protein, 24 aa, Entamoeba invadens
NLQREVAFLFGRVVKAVIAVVTKN

SEQ ID NO: 2958616 - protein, 26 aa, Entamoeba invadens
NLQRKLCADLVKGEGCAEHLKRAFSE

SEQ ID NO: 2958617 - protein, 20 aa, Entamoeba invadens
NLQSQSNFFGMGQVQGPAGT

SEQ ID NO: 2958618 - protein, 25 aa, Entamoeba invadens
NLQTLQQCLCICLLSEFADITIKQP

SEQ ID NO: 2958619 - protein, 19 aa, Entamoeba invadens
NLRCSTRRGIEISPVHVYE

SEQ ID NO: 2958620 - protein, 21 aa, Entamoeba invadens
NLRDLLQIRHEHFPFTNMYDQ

SEQ ID NO: 2958621 - protein, 18 aa, Entamoeba invadens
NLRGSRREKKERNIEQQA

SEQ ID NO: 2958622 - protein, 18 aa, Entamoeba invadens
NLRIMTGCILLYDTVVPT

SEQ ID NO: 2958623 - protein, 23 aa, Entamoeba invadens
NLRTELYGNIMLAGGSTMMPGFV

SEQ ID NO: 2958624 - protein, 26 aa, Entamoeba invadens
NLSDNCCAHPFNFCTAENSPSVEENG

SEQ ID NO: 2958625 - protein, 19 aa, Entamoeba invadens
NLSFPKDLEMFATHNCKMT

SEQ ID NO: 2958626 - protein, 19 aa, Entamoeba invadens
NLSGCSRAGPLTLAQLFDS

SEQ ID NO: 2958627 - protein, 25 aa, Entamoeba invadens
NLSGLRRGKKGLIGDNYFDMKKGNL

SEQ ID NO: 2958628 - protein, 18 aa, Entamoeba invadens
NLSLCILCQAFDSNCESC

SEQ ID NO: 2958629 - protein, 19 aa, Entamoeba invadens
NLSRCPVWITVPLAADGWQ

SEQ ID NO: 2958630 - protein, 32 aa, Entamoeba invadens
NLSRDILIKNCIFRHSGLKGIYLSGNHSTITN

SEQ ID NO: 2958631 - protein, 17 aa, Entamoeba invadens
NLSSLFKIFCIPKSQVL

SEQ ID NO: 2958632 - protein, 18 aa, Entamoeba invadens
NLSTIIKKGLDFRNSVNA

SEQ ID NO: 2958633 - protein, 24 aa, Entamoeba invadens
NLSTLSLKMPWAVKKSKPLLEEID

SEQ ID NO: 2958634 - protein, 19 aa, Entamoeba invadens
NLSVCWTPTMFAVGNDDLS

SEQ ID NO: 2958635 - protein, 19 aa, Entamoeba invadens
NLSVGYKEFVRMCIENDIF

SEQ ID NO: 2958636 - protein, 18 aa, Entamoeba invadens
NLTCPLLVEIVWTTVVNN

SEQ ID NO: 2958637 - protein, 22 aa, Entamoeba invadens
NLTDILKLLTFVQNKEFIKQIL

SEQ ID NO: 2958638 - protein, 20 aa, Entamoeba invadens
NLTFVGLIFNYLVRLNYECQ

SEQ ID NO: 2958639 - protein, 20 aa, Entamoeba invadens
NLTKHAKALISLFDKKSKGA

SEQ ID NO: 2958640 - protein, 19 aa, Entamoeba invadens
NLTKVLRIVGGGIPLENGY

SEQ ID NO: 2958641 - protein, 17 aa, Entamoeba invadens
NLTLKTRVVPPPQSQSE

SEQ ID NO: 2958642 - protein, 24 aa, Entamoeba invadens
NLTNFRIVKLIGIGNVGRVYLVQL

SEQ ID NO: 2958643 - protein, 23 aa, Entamoeba invadens
NLTPEFLSVFLLISQFFTSEGKT

SEQ ID NO: 2958644 - protein, 24 aa, Entamoeba invadens
NLTQEKYIFLALLLGSDFTEGVGK

SEQ ID NO: 2958645 - protein, 18 aa, Entamoeba invadens
NLTTPAFVPVPYLPFTFE

SEQ ID NO: 2958646 - protein, 19 aa, Entamoeba invadens
NLTVYKIGDFVLGRRVGFG

SEQ ID NO: 2958647 - protein, 25 aa, Entamoeba invadens
NLTYGKRLAMDFVSMMLKEEFATHK

SEQ ID NO: 2958648 - protein, 24 aa, Entamoeba invadens
NLVCGCSVGSILASFLVCGYDPDT

SEQ ID NO: 2958649 - protein, 26 aa, Entamoeba invadens
NLVCKNCNRLSKIMWVGNVICAVAGV

SEQ ID NO: 2958650 - protein, 18 aa, Entamoeba invadens
NLVCTTFKVFECIKDDFV

SEQ ID NO: 2958651 - protein, 27 aa, Entamoeba invadens
NLVEVKGLECVITFKTFAFGGHTKLNK

SEQ ID NO: 2958652 - protein, 23 aa, Entamoeba invadens
NLVIKNCRLGIIVLKKENMECLN

SEQ ID NO: 2958653 - protein, 23 aa, Entamoeba invadens
NLVKKGRCVECWADELKMNLTHQ

SEQ ID NO: 2958654 - protein, 19 aa, Entamoeba invadens
NLVKKSLEMFAEISENKDD

SEQ ID NO: 2958655 - protein, 24 aa, Entamoeba invadens
NLVKRVKNKAGFETPLVVEIINSS

SEQ ID NO: 2958656 - protein, 23 aa, Entamoeba invadens
NLVKSGRVCYVSAAFSLESKTSF

SEQ ID NO: 2958657 - protein, 30 aa, Entamoeba invadens
NLVKSVQVQDGWKVVCQWISDINNTPNKTD

SEQ ID NO: 2958658 - protein, 19 aa, Entamoeba invadens
NLVKTYLVGTEWEESQKVL

SEQ ID NO: 2958659 - protein, 18 aa, Entamoeba invadens
NLVLRTTIFQEVAKTDAK

SEQ ID NO: 2958660 - protein, 17 aa, Entamoeba invadens
NLVPFVEDYGCGMLSIH

SEQ ID NO: 2958661 - protein, 25 aa, Entamoeba invadens
NLVREGVLLKQCRKAQKERYFFLFN

SEQ ID NO: 2958662 - protein, 23 aa, Entamoeba invadens
NLVREIKEKFVYLANDYEEELKK

SEQ ID NO: 2958663 - protein, 17 aa, Entamoeba invadens
NLVRELSVVRPKKIITL

SEQ ID NO: 2958664 - protein, 19 aa, Entamoeba invadens
NLVRGRGLLVSSVLRAQDA

SEQ ID NO: 2958665 - protein, 17 aa, Entamoeba invadens
NLVRLGGSVFQGCKGLL

SEQ ID NO: 2958666 - protein, 19 aa, Entamoeba invadens
NLVRQWCLSLKRNAPKMVK

SEQ ID NO: 2958667 - protein, 25 aa, Entamoeba invadens
NLVRRKCDMSPCSLTSAENSFEDLL

SEQ ID NO: 2958668 - protein, 21 aa, Entamoeba invadens
NLYECSLCRATPSDVEKFVFK

SEQ ID NO: 2958669 - protein, 20 aa, Entamoeba invadens
NLYEIPDKCFFICTKLKEID

SEQ ID NO: 2958670 - protein, 20 aa, Entamoeba invadens
NLYEIPDKCFYLCANLKEID

SEQ ID NO: 2958671 - protein, 18 aa, Entamoeba invadens
NLYLPIVDYMAKFFCNVP

SEQ ID NO: 2958672 - protein, 25 aa, Entamoeba invadens
NLYRDIHHPDILGMVGIVLTSSTIL

SEQ ID NO: 2958673 - protein, 29 aa, Entamoeba invadens
NLYYCYKDGRFNEKFCAQLFPKITRLTFY

SEQ ID NO: 2958674 - protein, 24 aa, Entamoeba invadens
NMAFRKMTLCNGFFETNFDTVSFT

SEQ ID NO: 2958675 - protein, 27 aa, Entamoeba invadens
NMAVAECFRGILKVCVECNGFSKVLEQ

SEQ ID NO: 2958676 - protein, 19 aa, Entamoeba invadens
NMCCIDWGTDTIKVSTQKQ

SEQ ID NO: 2958677 - protein, 22 aa, Entamoeba invadens
NMCDTFNLFVCNDIPIQVNDKG

SEQ ID NO: 2958678 - protein, 22 aa, Entamoeba invadens
NMCEICGFPSTTKCDKCDTYYC

SEQ ID NO: 2958679 - protein, 26 aa, Entamoeba invadens
NMCNRLRKFVKPEMKPLVEEFEKIVV

SEQ ID NO: 2958680 - protein, 27 aa, Entamoeba invadens
NMEEECSPAFFKFMALIGNKTELLGYS

SEQ ID NO: 2958681 - protein, 24 aa, Entamoeba invadens
NMEFHRALEFLIVFMKNLKDSVIP

SEQ ID NO: 2958682 - protein, 20 aa, Entamoeba invadens
NMFGPGVMKVECSTTTIDVK

SEQ ID NO: 2958683 - protein, 23 aa, Entamoeba invadens
NMFYCCSALRYFELPKNIKHLGI

SEQ ID NO: 2958684 - protein, 21 aa, Entamoeba invadens
NMGFPCLLTLQPSKGSTATAE

SEQ ID NO: 2958685 - protein, 25 aa, Entamoeba invadens
NMGKEEFSMILQIKLIYEKFNEINE

SEQ ID NO: 2958686 - protein, 27 aa, Entamoeba invadens
NMHKECFKCTECGKPIDGQYMLKDGKI

SEQ ID NO: 2958687 - protein, 17 aa, Entamoeba invadens
NMHRVFEKLGAQQTFQE

SEQ ID NO: 2958688 - protein, 21 aa, Entamoeba invadens
NMIFCDLENFLFVPESVTGLT

SEQ ID NO: 2958689 - protein, 22 aa, Entamoeba invadens
NMINTCAFYRCSNLECAKNMKK

SEQ ID NO: 2958690 - protein, 17 aa, Entamoeba invadens
NMKITFVEIPNIEIISR

SEQ ID NO: 2958691 - protein, 17 aa, Entamoeba invadens
NMKQLKENYGFLKTNNF

SEQ ID NO: 2958692 - protein, 23 aa, Entamoeba invadens
NMKRVVLYIPHFSVVKLNKFNFI

SEQ ID NO: 2958693 - protein, 20 aa, Entamoeba invadens
NMKSSSRFSFRSEPSTLKLR

SEQ ID NO: 2958694 - protein, 26 aa, Entamoeba invadens
NMKVIPYCVCYNCPNLRTVTLPDNLV

SEQ ID NO: 2958695 - protein, 18 aa, Entamoeba invadens
NMLIDLTQKYGYDFTIRG

SEQ ID NO: 2958696 - protein, 26 aa, Entamoeba invadens
NMLVCANDIFPQISMKFIESRLEEVL

SEQ ID NO: 2958697 - protein, 25 aa, Entamoeba invadens
NMLVLEAPIYVCGDIHGQFYDLLTI

SEQ ID NO: 2958698 - protein, 20 aa, Entamoeba invadens
NMMFPIGVTVPIVLDIFANL

SEQ ID NO: 2958699 - protein, 17 aa, Entamoeba invadens
NMMKFHFNPIPLNKKNI

SEQ ID NO: 2958700 - protein, 24 aa, Entamoeba invadens
NMPIGNVFQGLKFSSKTQQLYYEI

SEQ ID NO: 2958701 - protein, 21 aa, Entamoeba invadens
NMPSETYQFLTLKTANGVLSE

SEQ ID NO: 2958702 - protein, 26 aa, Entamoeba invadens
NMPSPLLSRFDLIFVLVDNPDSESDR

SEQ ID NO: 2958703 - protein, 25 aa, Entamoeba invadens
NMQAYCASHLFLTLLPSNFNLKEFM

SEQ ID NO: 2958704 - protein, 19 aa, Entamoeba invadens
NMRDYKTAIEKLMRTKTEL

SEQ ID NO: 2958705 - protein, 23 aa, Entamoeba invadens
NMRKFKMSDDFVMKMATFVIDIS

SEQ ID NO: 2958706 - protein, 26 aa, Entamoeba invadens
NMRLDGDIGLDCAVHSMVFSPNSLSL

SEQ ID NO: 2958707 - protein, 19 aa, Entamoeba invadens
NMRSQVWKLLLGYYTPLKN

SEQ ID NO: 2958708 - protein, 24 aa, Entamoeba invadens
NMSEKLRAENCLLREKASRSLGEL

SEQ ID NO: 2958709 - protein, 24 aa, Entamoeba invadens
NMSISACAAGELFFLFDSKVLSIL

SEQ ID NO: 2958710 - protein, 20 aa, Entamoeba invadens
NMSQCFPCTTFDVKCLTCAS

SEQ ID NO: 2958711 - protein, 23 aa, Entamoeba invadens
NMSRGFVKIKGFVTIPPDGLNYL

SEQ ID NO: 2958712 - protein, 18 aa, Entamoeba invadens
NMSSVRFLSDGVRITPDK

SEQ ID NO: 2958713 - protein, 24 aa, Entamoeba invadens
NMSYHVCKLFEAIKVKCLSVCYTS

SEQ ID NO: 2958714 - protein, 24 aa, Entamoeba invadens
NMTFRKMTLCNGFFETNFDTVSFT

SEQ ID NO: 2958715 - protein, 19 aa, Entamoeba invadens
NMTRRAAKFMNDYKKKGDE

SEQ ID NO: 2958716 - protein, 17 aa, Entamoeba invadens
NMVGKTCQVWINEMAHD

SEQ ID NO: 2958717 - protein, 29 aa, Entamoeba invadens
NMVLGNVCFLNIMKGEFNSIYIGDCQTIT

SEQ ID NO: 2958718 - protein, 19 aa, Entamoeba invadens
NMVSIFYRPPESFICTTEF

SEQ ID NO: 2958719 - protein, 19 aa, Entamoeba invadens
NMYLPSLIGYYLKNNMPNE

SEQ ID NO: 2958720 - protein, 18 aa, Entamoeba invadens
NMYVKFIGAMDGWLKTLE

SEQ ID NO: 2958721 - protein, 23 aa, Entamoeba invadens
NNAGKREPFVFLEPSVFDYKNVT

SEQ ID NO: 2958722 - protein, 24 aa, Entamoeba invadens
NNAKMKIIMCIESPQCFKIENCRS

SEQ ID NO: 2958723 - protein, 19 aa, Entamoeba invadens
NNALIRTRFIFSVKSLHSD

SEQ ID NO: 2958724 - protein, 27 aa, Entamoeba invadens
NNARIIYPRIDPFTCFSYYNPTLHLKL

SEQ ID NO: 2958725 - protein, 28 aa, Entamoeba invadens
NNAVLKRKFFCVIVWFNVDFETVDRNKS

SEQ ID NO: 2958726 - protein, 17 aa, Entamoeba invadens
NNCDIFVNKSCAKDINL

SEQ ID NO: 2958727 - protein, 31 aa, Entamoeba invadens
NNCFKEGYEYLRLLFGPVKIPFPPGTYVENF

SEQ ID NO: 2958728 - protein, 27 aa, Entamoeba invadens
NNCFLCVRNVCFICGANSILINGSCQT

SEQ ID NO: 2958729 - protein, 18 aa, Entamoeba invadens
NNCFRGCKSLKNIIFPPT

SEQ ID NO: 2958730 - protein, 21 aa, Entamoeba invadens
NNCKYKDELGFDLKEQPSNCV

SEQ ID NO: 2958731 - protein, 26 aa, Entamoeba invadens
NNCMSCINATVCIECEGGFSVSSNGT

SEQ ID NO: 2958732 - protein, 22 aa, Entamoeba invadens
NNCPLCRHDNKLVVFSKKKGKF

SEQ ID NO: 2958733 - protein, 20 aa, Entamoeba invadens
NNCVKIKFIDFVLSSGEGYC

SEQ ID NO: 2958734 - protein, 26 aa, Entamoeba invadens
NNDDKFRVGISFGKDGVHLYTETFKA

SEQ ID NO: 2958735 - protein, 24 aa, Entamoeba invadens
NNDGCLRLSNIYFDDIFSNGNQTG

SEQ ID NO: 2958736 - protein, 18 aa, Entamoeba invadens
NNDMDWFSYFPTIMETLN

SEQ ID NO: 2958737 - protein, 25 aa, Entamoeba invadens
NNDNCCAHPFNFCTAENSPSVEENG

SEQ ID NO: 2958738 - protein, 25 aa, Entamoeba invadens
NNDYKIAMNVLRYFVDFTALNNVCA

SEQ ID NO: 2958739 - protein, 17 aa, Entamoeba invadens
NNEGCFFDSGSGVDLKF

SEQ ID NO: 2958740 - protein, 22 aa, Entamoeba invadens
NNEGRTPLHYAVMGGNMECVKY

SEQ ID NO: 2958741 - protein, 26 aa, Entamoeba invadens
NNEIKSNCFVFFKLVKNNFKSNKMGF

SEQ ID NO: 2958742 - protein, 18 aa, Entamoeba invadens
NNEIVKFNMLKDENERVN

SEQ ID NO: 2958743 - protein, 23 aa, Entamoeba invadens
NNEKFKVIYIAPMKSLVQEMVGT

SEQ ID NO: 2958744 - protein, 23 aa, Entamoeba invadens
NNELKMNITNTLSELEKLKNEKN

SEQ ID NO: 2958745 - protein, 24 aa, Entamoeba invadens
NNENAFKIISEWEEDKNVMDMLEK

SEQ ID NO: 2958746 - protein, 23 aa, Entamoeba invadens
NNERIFSLFADFDVKDERIVRLY

SEQ ID NO: 2958747 - protein, 18 aa, Entamoeba invadens
NNETAILIQIDFQEKTGD

SEQ ID NO: 2958748 - protein, 25 aa, Entamoeba invadens
NNEVRFYSLELIKILLKNPQENARL

SEQ ID NO: 2958749 - protein, 24 aa, Entamoeba invadens
NNFCLSCPNGFYLNSQKTCISCGN

SEQ ID NO: 2958750 - protein, 18 aa, Entamoeba invadens
NNFDFGMKVFVNGNLVQP

SEQ ID NO: 2958751 - protein, 21 aa, Entamoeba invadens
NNFFGLCAIVFAFHKIPDFDY

SEQ ID NO: 2958752 - protein, 17 aa, Entamoeba invadens
NNFFSHLIELFMKSTDI

SEQ ID NO: 2958753 - protein, 17 aa, Entamoeba invadens
NNFKIKITNDFINTVIM

SEQ ID NO: 2958754 - protein, 24 aa, Entamoeba invadens
NNFLLDLCTEIGYVFNTRLSKISK

SEQ ID NO: 2958755 - protein, 24 aa, Entamoeba invadens
NNFLPEQMNIFALRNTLLGKVVNI

SEQ ID NO: 2958756 - protein, 24 aa, Entamoeba invadens
NNFLVDVALELGFVFDSKYSRKSR

SEQ ID NO: 2958757 - protein, 17 aa, Entamoeba invadens
NNFPGLYTALAKFSNPL

SEQ ID NO: 2958758 - protein, 17 aa, Entamoeba invadens
NNFPLVDILLLELTILY

SEQ ID NO: 2958759 - protein, 24 aa, Entamoeba invadens
NNGAYKMCIGRIVDIVVSKMNQKS

SEQ ID NO: 2958760 - protein, 24 aa, Entamoeba invadens
NNGCSETEINFCVPVPSPFASIKD

SEQ ID NO: 2958761 - protein, 19 aa, Entamoeba invadens
NNGINCLHGGVGFDKKVFQ

SEQ ID NO: 2958762 - protein, 24 aa, Entamoeba invadens
NNGLKIPAIALGTWLAEKDLVGNA

SEQ ID NO: 2958763 - protein, 23 aa, Entamoeba invadens
NNGLKIPAIALGTWLSEKDLVGN

SEQ ID NO: 2958764 - protein, 24 aa, Entamoeba invadens
NNGLKKTYLINAFMPSLSYDNFLN

SEQ ID NO: 2958765 - protein, 25 aa, Entamoeba invadens
NNGVYGNSCEVVGCVDRYVMDKDGK

SEQ ID NO: 2958766 - protein, 27 aa, Entamoeba invadens
NNIATLPLEFSQLISLTKLHASDNKFT

SEQ ID NO: 2958767 - protein, 28 aa, Entamoeba invadens
NNIDHTIQWARDRFEGLFKNDIDQIESY

SEQ ID NO: 2958768 - protein, 28 aa, Entamoeba invadens
NNIDHTIQWARDRFEGLFKSDIEPVESY

SEQ ID NO: 2958769 - protein, 25 aa, Entamoeba invadens
NNIDLKCVIYGKGFQIQFVCDNAEV

SEQ ID NO: 2958770 - protein, 20 aa, Entamoeba invadens
NNIKIFVPQFMKLELEDVLS

SEQ ID NO: 2958771 - protein, 18 aa, Entamoeba invadens
NNIKNRWFSHLVDLTPKS

SEQ ID NO: 2958772 - protein, 27 aa, Entamoeba invadens
NNIKRTCAYCGNKFCYNCREKTWHEEF

SEQ ID NO: 2958773 - protein, 26 aa, Entamoeba invadens
NNIKTLMGLGASRQLAIEAYIVCKKN

SEQ ID NO: 2958774 - protein, 24 aa, Entamoeba invadens
NNILKRQNMYLGLMMTTKFDENST

SEQ ID NO: 2958775 - protein, 24 aa, Entamoeba invadens
NNINCYIYITYVYGVYSFGEQGKK

SEQ ID NO: 2958776 - protein, 25 aa, Entamoeba invadens
NNIPLFCNFTGVFGYPLLSTSTKKK

SEQ ID NO: 2958777 - protein, 25 aa, Entamoeba invadens
NNIPSCVKFIGLQCFYECSSLRSLN

SEQ ID NO: 2958778 - protein, 23 aa, Entamoeba invadens
NNIPSTIVPPNFEIRNENCENVE

SEQ ID NO: 2958779 - protein, 17 aa, Entamoeba invadens
NNIRVILNKAFTLAHIR

SEQ ID NO: 2958780 - protein, 17 aa, Entamoeba invadens
NNIRVILNKAFTLARIR

SEQ ID NO: 2958781 - protein, 20 aa, Entamoeba invadens
NNISCMGRNLFLNCSKLEKI

SEQ ID NO: 2958782 - protein, 17 aa, Entamoeba invadens
NNISWSKIYSEWVCASV

SEQ ID NO: 2958783 - protein, 17 aa, Entamoeba invadens
NNITKIGDFCFACATQL

SEQ ID NO: 2958784 - protein, 17 aa, Entamoeba invadens
NNITKIGDFCFACATRL

SEQ ID NO: 2958785 - protein, 26 aa, Entamoeba invadens
NNKCLKENWTTLGFEALLLNKTEDAV

SEQ ID NO: 2958786 - protein, 17 aa, Entamoeba invadens
NNKFGGVVSRQIPRRGT

SEQ ID NO: 2958787 - protein, 21 aa, Entamoeba invadens
NNKGKCVIQNFIVMLKSCGET

SEQ ID NO: 2958788 - protein, 24 aa, Entamoeba invadens
NNKGRRVICPQIIYTDTYEYHALS

SEQ ID NO: 2958789 - protein, 19 aa, Entamoeba invadens
NNKIADWLSSFKKDVPNAQ

SEQ ID NO: 2958790 - protein, 20 aa, Entamoeba invadens
NNKIPSLLMCPSTYSTIIGK

SEQ ID NO: 2958791 - protein, 21 aa, Entamoeba invadens
NNKKCIWSAFYTSKQHSKYIK

SEQ ID NO: 2958792 - protein, 19 aa, Entamoeba invadens
NNKKCPIQYTRKAKLDTTL

SEQ ID NO: 2958793 - protein, 17 aa, Entamoeba invadens
NNKKLVCRVKAFDRHFN

SEQ ID NO: 2958794 - protein, 25 aa, Entamoeba invadens
NNKKMCLQMLNWIIADKSVAAFMRP

SEQ ID NO: 2958795 - protein, 24 aa, Entamoeba invadens
NNKRDLWLTAVGFKDVNYFKLIQD

SEQ ID NO: 2958796 - protein, 24 aa, Entamoeba invadens
NNKRGCNGFNFVITDMEALNDKQV

SEQ ID NO: 2958797 - protein, 24 aa, Entamoeba invadens
NNKWAEGFTVFSDYLKACGVKVRP

SEQ ID NO: 2958798 - protein, 22 aa, Entamoeba invadens
NNLCFPQILHVCFDQTPKENSE

SEQ ID NO: 2958799 - protein, 18 aa, Entamoeba invadens
NNLCGVFFPVILALFHNN

SEQ ID NO: 2958800 - protein, 25 aa, Entamoeba invadens
NNLEECWERCLSSLLRVERIHMIAS

SEQ ID NO: 2958801 - protein, 23 aa, Entamoeba invadens
NNLEYLVRMRIEITPYTIPMLIT

SEQ ID NO: 2958802 - protein, 24 aa, Entamoeba invadens
NNLFDFGSAFGETSHKIDENPQSE

SEQ ID NO: 2958803 - protein, 44 aa, Entamoeba invadens
NNLFVGALFFCEMMFSKFRVISEWLQSVDLEFLVALQRIFDLIK

SEQ ID NO: 2958804 - protein, 23 aa, Entamoeba invadens
NNLGELWTLLNYIEPKKFGSLEE

SEQ ID NO: 2958805 - protein, 23 aa, Entamoeba invadens
NNLGLNWKFAVNTEEEKNCWESI

SEQ ID NO: 2958806 - protein, 24 aa, Entamoeba invadens
NNLKRISAVGGTVIKSPVACFMKE

SEQ ID NO: 2958807 - protein, 25 aa, Entamoeba invadens
NNLLHFPRSVFALASLKTLFMSNNQ

SEQ ID NO: 2958808 - protein, 17 aa, Entamoeba invadens
NNLLIFDIDLEKWLFEI

SEQ ID NO: 2958809 - protein, 17 aa, Entamoeba invadens
NNLLRYGDHVKMRSSYE

SEQ ID NO: 2958810 - protein, 21 aa, Entamoeba invadens
NNLLTCVKDIIAFPQTTTLRI

SEQ ID NO: 2958811 - protein, 19 aa, Entamoeba invadens
NNLLTLLFHKLDSGIFDAG

SEQ ID NO: 2958812 - protein, 27 aa, Entamoeba invadens
NNLMSVAFPCISTGIFGYSNTKACPVV

SEQ ID NO: 2958813 - protein, 17 aa, Entamoeba invadens
NNLRKQYNYVFVCCGRQ

SEQ ID NO: 2958814 - protein, 22 aa, Entamoeba invadens
NNLSRRAAKFMNDFKKSGEHFL

SEQ ID NO: 2958815 - protein, 18 aa, Entamoeba invadens
NNLTFTFQKKADLRLIAS

SEQ ID NO: 2958816 - protein, 19 aa, Entamoeba invadens
NNLTGSFIMLRYVNPAIFS

SEQ ID NO: 2958817 - protein, 25 aa, Entamoeba invadens
NNLVFKRVDIPSVNTYVFKGVKYEI

SEQ ID NO: 2958818 - protein, 25 aa, Entamoeba invadens
NNLVLSCYSSFWIKKNKQIEFNVCK

SEQ ID NO: 2958819 - protein, 17 aa, Entamoeba invadens
NNLWSPRKLVIYNGKFV

SEQ ID NO: 2958820 - protein, 19 aa, Entamoeba invadens
NNLYKFTGLKKIDAINTKK

SEQ ID NO: 2958821 - protein, 18 aa, Entamoeba invadens
NNMDGLVEIMKYCEISNV

SEQ ID NO: 2958822 - protein, 17 aa, Entamoeba invadens
NNMVEVFRREKGLRFVK

SEQ ID NO: 2958823 - protein, 25 aa, Entamoeba invadens
NNNEVFEYLGTVYLVSYLYTEKTVI

SEQ ID NO: 2958824 - protein, 18 aa, Entamoeba invadens
NNNFELIACQGVLFKISL

SEQ ID NO: 2958825 - protein, 24 aa, Entamoeba invadens
NNNIFKSCWFLEKVVIGGNITKIG

SEQ ID NO: 2958826 - protein, 29 aa, Entamoeba invadens
NNNKLKEVPLCFTNLMKLKNIYLSFNQIS

SEQ ID NO: 2958827 - protein, 26 aa, Entamoeba invadens
NNNLVLSCYSSFWITKNGQIGFNLCA

SEQ ID NO: 2958828 - protein, 29 aa, Entamoeba invadens
NNNSEVFQFLFGRLEKIYKSLQMMYDAAR

SEQ ID NO: 2958829 - protein, 19 aa, Entamoeba invadens
  misc_feature (19)..(19): Xaa can be any naturally occurring amino acid
NNNSSRFGKFIEIQCQANX

SEQ ID NO: 2958830 - protein, 21 aa, Entamoeba invadens
NNNSSRFGKFIEIQFQANKVI

SEQ ID NO: 2958831 - protein, 20 aa, Entamoeba invadens
NNQFGLVLIHGFNGIGKTTV

SEQ ID NO: 2958832 - protein, 25 aa, Entamoeba invadens
NNQHFKRVVATPISTYKAIYTYNSY

SEQ ID NO: 2958833 - protein, 24 aa, Entamoeba invadens
NNQLKRLPATIGEMRQLNRLELAH

SEQ ID NO: 2958834 - protein, 23 aa, Entamoeba invadens
NNQRIEYITGLLLGSNFITDRNT

SEQ ID NO: 2958835 - protein, 21 aa, Entamoeba invadens
NNQRIPFGFYKRTLPHYWKED

SEQ ID NO: 2958836 - protein, 24 aa, Entamoeba invadens
NNQVCPKGKWIAIVGTTVETANPE

SEQ ID NO: 2958837 - protein, 17 aa, Entamoeba invadens
NNRCVGCDALFGCSECE

SEQ ID NO: 2958838 - protein, 19 aa, Entamoeba invadens
NNRFTDCPKILSELPNIQR

SEQ ID NO: 2958839 - protein, 20 aa, Entamoeba invadens
NNRIPGFISVSLDNTVKCWK

SEQ ID NO: 2958840 - protein, 27 aa, Entamoeba invadens
NNRSVLWSFRILRKVRIILRDETHIQK

SEQ ID NO: 2958841 - protein, 23 aa, Entamoeba invadens
NNRTVLQLAKLVFLMTIKSFYWK

SEQ ID NO: 2958842 - protein, 25 aa, Entamoeba invadens
NNRVFFFRRAFVFFSSEGKGISVQY

SEQ ID NO: 2958843 - protein, 19 aa, Entamoeba invadens
NNRYEFPRELDLFKYSAEF

SEQ ID NO: 2958844 - protein, 23 aa, Entamoeba invadens
NNSCGLCVCIAHECGKVIFMQPE

SEQ ID NO: 2958845 - protein, 19 aa, Entamoeba invadens
NNSLDCFSLGSVDNAMFNM

SEQ ID NO: 2958846 - protein, 23 aa, Entamoeba invadens
NNSQCIKCPLGTYSDTIGAITCL

SEQ ID NO: 2958847 - protein, 17 aa, Entamoeba invadens
NNSQKCCDMCEIRKDSE

SEQ ID NO: 2958848 - protein, 19 aa, Entamoeba invadens
NNTCLKCTDSHHITKGKCE

SEQ ID NO: 2958849 - protein, 19 aa, Entamoeba invadens
NNTCLKCTDSHYITKGMCE

SEQ ID NO: 2958850 - protein, 22 aa, Entamoeba invadens
NNTEAGLICYVFYDEDDGEEVG

SEQ ID NO: 2958851 - protein, 17 aa, Entamoeba invadens
NNTEMVIHFASNYQVNR

SEQ ID NO: 2958852 - protein, 29 aa, Entamoeba invadens
NNTFCAVGTSWGCTRCINGFYYSYNTKTC

SEQ ID NO: 2958853 - protein, 18 aa, Entamoeba invadens
NNTFLKREEQILETLEHP

SEQ ID NO: 2958854 - protein, 26 aa, Entamoeba invadens
NNTIVLLKIRIWRMSSNRRVLIKAAS

SEQ ID NO: 2958855 - protein, 24 aa, Entamoeba invadens
NNTKRWATKINFFSYEKVLIPINI

SEQ ID NO: 2958856 - protein, 20 aa, Entamoeba invadens
NNTKSSFSLVVKKMKTDNAH

SEQ ID NO: 2958857 - protein, 18 aa, Entamoeba invadens
NNTLELLCVDFNKEIENY

SEQ ID NO: 2958858 - protein, 36 aa, Entamoeba invadens
NNTLFLRPEIREMISACFPEAASLPDNVMQFINAHQ

SEQ ID NO: 2958859 - protein, 20 aa, Entamoeba invadens
NNTNKCFICQKEGHTNKMCP

SEQ ID NO: 2958860 - protein, 24 aa, Entamoeba invadens
NNTNPMWVCPNGRVLVETTKPQSK

SEQ ID NO: 2958861 - protein, 22 aa, Entamoeba invadens
NNTPVGLSWGYLFGINGLNLDP

SEQ ID NO: 2958862 - protein, 22 aa, Entamoeba invadens
NNTRYATLFIRNIMDTQGLFSR

SEQ ID NO: 2958863 - protein, 25 aa, Entamoeba invadens
NNTSVPLFWWWVYQDSSIPIEISPY

SEQ ID NO: 2958864 - protein, 24 aa, Entamoeba invadens
NNVIKLSSVLARVVRIRLSKNVPE

SEQ ID NO: 2958865 - protein, 24 aa, Entamoeba invadens
NNVIQCLNCIILNALPLEKKFFSE

SEQ ID NO: 2958866 - protein, 24 aa, Entamoeba invadens
NNVKGCPNFKFYIADITDAHTMQK

SEQ ID NO: 2958867 - protein, 23 aa, Entamoeba invadens
NNVKIGAKCWIVESIEDGNTVFI

SEQ ID NO: 2958868 - protein, 21 aa, Entamoeba invadens
NNVKKILSFLCEDDLESPLDE

SEQ ID NO: 2958869 - protein, 28 aa, Entamoeba invadens
NNVLRLTLHMYGCRVVQKAVEYAAMKDR

SEQ ID NO: 2958870 - protein, 24 aa, Entamoeba invadens
NNVMLKILLCQQFVRIFNRKHEEL

SEQ ID NO: 2958871 - protein, 23 aa, Entamoeba invadens
NNVRGCFHLKMFIVTNQKVKGYK

SEQ ID NO: 2958872 - protein, 23 aa, Entamoeba invadens
NNVYEVYQFLGIEAGRIQLASEF

SEQ ID NO: 2958873 - protein, 23 aa, Entamoeba invadens
NNYHVRILLKYFKSRGYLTELLT

SEQ ID NO: 2958874 - protein, 24 aa, Entamoeba invadens
NNYIKMASCLIKLKDFAAAVEAAK

SEQ ID NO: 2958875 - protein, 24 aa, Entamoeba invadens
NNYILDLLPTFGYSITISTCGGFD

SEQ ID NO: 2958876 - protein, 18 aa, Entamoeba invadens
NNYLAQFMKGRLEKCGFV

SEQ ID NO: 2958877 - protein, 18 aa, Entamoeba invadens
NNYPQYKRTLSITQEENV

SEQ ID NO: 2958878 - protein, 19 aa, Entamoeba invadens
NNYVLRFKGVPGTILSLES

SEQ ID NO: 2958879 - protein, 17 aa, Entamoeba invadens
NPAAFPLVASINSPPTI

SEQ ID NO: 2958880 - protein, 26 aa, Entamoeba invadens
NPAFFLQQVEAILDCIVSNPAFTLAV

SEQ ID NO: 2958881 - protein, 23 aa, Entamoeba invadens
NPARRPTALMLAGEFKKYTAEVF

SEQ ID NO: 2958882 - protein, 24 aa, Entamoeba invadens
NPCCCPNSRILYWSLSGATREIIS

SEQ ID NO: 2958883 - protein, 23 aa, Entamoeba invadens
NPDHARLGLIVSQTDYLLSDHII

SEQ ID NO: 2958884 - protein, 22 aa, Entamoeba invadens
NPDIFGVFGFEIELNTKFAEFG

SEQ ID NO: 2958885 - protein, 23 aa, Entamoeba invadens
NPDKACPCYNDISGKGGDCLILL

SEQ ID NO: 2958886 - protein, 23 aa, Entamoeba invadens
NPDKRTPRCCFADENGVFEEREI

SEQ ID NO: 2958887 - protein, 24 aa, Entamoeba invadens
NPDLLCTWYLDNTCSVWNVETRQM

SEQ ID NO: 2958888 - protein, 21 aa, Entamoeba invadens
NPDLLEWFECIANFEKSKKKK

SEQ ID NO: 2958889 - protein, 23 aa, Entamoeba invadens
NPDNKFQVLFACDDKHPTAMGFV

SEQ ID NO: 2958890 - protein, 17 aa, Entamoeba invadens
NPDNKFQVLFASKDEYP

SEQ ID NO: 2958891 - protein, 22 aa, Entamoeba invadens
NPDNTFEGFTFVQNTALGENGT

SEQ ID NO: 2958892 - protein, 18 aa, Entamoeba invadens
NPEIYRFLVGGLGVESVL

SEQ ID NO: 2958893 - protein, 18 aa, Entamoeba invadens
NPEKRPTFTQIKEQLQNV

SEQ ID NO: 2958894 - protein, 21 aa, Entamoeba invadens
NPELYRNRLLGFVNSVFMVMP

SEQ ID NO: 2958895 - protein, 19 aa, Entamoeba invadens
NPEMTEFVIFNFSNKHPLV

SEQ ID NO: 2958896 - protein, 24 aa, Entamoeba invadens
NPENFCSMHVLLLGNGNEKVRLTV

SEQ ID NO: 2958897 - protein, 28 aa, Entamoeba invadens
NPETKKWGQAHCQARFALYKTVEKSGAV

SEQ ID NO: 2958898 - protein, 20 aa, Entamoeba invadens
NPFFGMSLNEKWICKHFLVF

SEQ ID NO: 2958899 - protein, 19 aa, Entamoeba invadens
NPFLMPFAVGMTQANSQQN

SEQ ID NO: 2958900 - protein, 18 aa, Entamoeba invadens
NPFNFSLLLFHTAGKDLS

SEQ ID NO: 2958901 - protein, 18 aa, Entamoeba invadens
NPFPDYLIAHVLKGILSG

SEQ ID NO: 2958902 - protein, 24 aa, Entamoeba invadens
NPFPLTRKTIFYFPNIETLHLWKL

SEQ ID NO: 2958903 - protein, 31 aa, Entamoeba invadens
NPFPPFLESAVFKMDFDFRDFLLQKIINAER

SEQ ID NO: 2958904 - protein, 27 aa, Entamoeba invadens
NPFTFDLANNLVRVEFSLKLMEFELAD

SEQ ID NO: 2958905 - protein, 19 aa, Entamoeba invadens
NPFTSPKVYPSVLLINSKK

SEQ ID NO: 2958906 - protein, 28 aa, Entamoeba invadens
NPFYRSVFSEHRFKQILRVIRFDKNAKN

SEQ ID NO: 2958907 - protein, 22 aa, Entamoeba invadens
NPGCAFSYVLGAEWVESVGQKA

SEQ ID NO: 2958908 - protein, 20 aa, Entamoeba invadens
NPGCFPENIVDLGTEKADNR

SEQ ID NO: 2958909 - protein, 25 aa, Entamoeba invadens
NPGMKRKVGLCGKVDHSTILSVRIE

SEQ ID NO: 2958910 - protein, 18 aa, Entamoeba invadens
NPHAVAFVIYGELCGGNK

SEQ ID NO: 2958911 - protein, 27 aa, Entamoeba invadens
NPIEAPTLFFFFKGNLLNIVPPHEITQ

SEQ ID NO: 2958912 - protein, 21 aa, Entamoeba invadens
NPIHFGLLCQELVKAVNNADL

SEQ ID NO: 2958913 - protein, 17 aa, Entamoeba invadens
NPIHILRYIPFLFEYSS

SEQ ID NO: 2958914 - protein, 24 aa, Entamoeba invadens
NPIIRLTLAVAYRFLNDEQMAGFC

SEQ ID NO: 2958915 - protein, 20 aa, Entamoeba invadens
NPILRFYQDADFVELEVKRI

SEQ ID NO: 2958916 - protein, 17 aa, Entamoeba invadens
NPIPVKSTKLFPYMETQ

SEQ ID NO: 2958917 - protein, 17 aa, Entamoeba invadens
NPIPVTSKRLFPYMETQ

SEQ ID NO: 2958918 - protein, 17 aa, Entamoeba invadens
NPIRLSKEFLPKYLRHS

SEQ ID NO: 2958919 - protein, 24 aa, Entamoeba invadens
NPIRRKEFFISEHLYSLVNDTQYQ

SEQ ID NO: 2958920 - protein, 20 aa, Entamoeba invadens
NPISELWNEKHWKPNIYNKA

SEQ ID NO: 2958921 - protein, 19 aa, Entamoeba invadens
NPISVKTKTLFPCMETQYL

SEQ ID NO: 2958922 - protein, 27 aa, Entamoeba invadens
NPITCAFPLIFGERGLGMDVKNTVCLS

SEQ ID NO: 2958923 - protein, 17 aa, Entamoeba invadens
NPIVLGSTCLAFLKVCP

SEQ ID NO: 2958924 - protein, 17 aa, Entamoeba invadens
NPIYITRNPKYVCSVFP

SEQ ID NO: 2958925 - protein, 25 aa, Entamoeba invadens
NPIYLKDFWTPFSQVIPSCILPHLY

SEQ ID NO: 2958926 - protein, 21 aa, Entamoeba invadens
NPKAINLLKGKTFAKTSSLYY

SEQ ID NO: 2958927 - protein, 24 aa, Entamoeba invadens
NPKEEICALFLERLYLTKTTLPFL

SEQ ID NO: 2958928 - protein, 29 aa, Entamoeba invadens
NPKETINCLLERVGSNLGIDQSDNNRGNA

SEQ ID NO: 2958929 - protein, 25 aa, Entamoeba invadens
NPKGIPMILDHALSLGGENAVTTIS

SEQ ID NO: 2958930 - protein, 29 aa, Entamoeba invadens
NPKKAYVKKCFEKGLPVVSMAWLDECLKL

SEQ ID NO: 2958931 - protein, 23 aa, Entamoeba invadens
NPKKDCYHAIILGEQVGIIDVST

SEQ ID NO: 2958932 - protein, 22 aa, Entamoeba invadens
NPKLSLLFRDVKKLTVDPLATM

SEQ ID NO: 2958933 - protein, 30 aa, Entamoeba invadens
NPLAVYSVEYLRGFSLFALKQWFESKKLVL

SEQ ID NO: 2958934 - protein, 23 aa, Entamoeba invadens
NPLEVTKMLWAISGNEKCAECGK

SEQ ID NO: 2958935 - protein, 27 aa, Entamoeba invadens
NPLEYKRIRECGGYVIGSRTNGNLAIS

SEQ ID NO: 2958936 - protein, 21 aa, Entamoeba invadens
NPLKNCLKTNVNANNEISSSS

SEQ ID NO: 2958937 - protein, 22 aa, Entamoeba invadens
NPLNGMCGYIGTIQYRKSGIAT

SEQ ID NO: 2958938 - protein, 19 aa, Entamoeba invadens
NPLNKWIKVSGYQFEGELV

SEQ ID NO: 2958939 - protein, 28 aa, Entamoeba invadens
NPLPCFFQISELFAMDLLQYVKSQYAPL

SEQ ID NO: 2958940 - protein, 23 aa, Entamoeba invadens
NPLPKKFIPLSFPKEFQNIRSKI

SEQ ID NO: 2958941 - protein, 20 aa, Entamoeba invadens
NPLQVFNMFEGWDKVFTFVS

SEQ ID NO: 2958942 - protein, 30 aa, Entamoeba invadens
NPLRKDPFCKVKIPGATLVYRSRNDDSVFR

SEQ ID NO: 2958943 - protein, 21 aa, Entamoeba invadens
NPLSMPLVGMITSYQQLPQNQ

SEQ ID NO: 2958944 - protein, 21 aa, Entamoeba invadens
NPLYWCSIGNLYYQTEQYNEA

SEQ ID NO: 2958945 - protein, 19 aa, Entamoeba invadens
NPMESAPFVKLRKVEKQKP

SEQ ID NO: 2958946 - protein, 18 aa, Entamoeba invadens
NPNAKYFGGETFMDSPQL

SEQ ID NO: 2958947 - protein, 19 aa, Entamoeba invadens
NPNDVKFFIVDEADAILDD

SEQ ID NO: 2958948 - protein, 25 aa, Entamoeba invadens
NPNFEMANPLDAFKIGIDVDAVDDE

SEQ ID NO: 2958949 - protein, 19 aa, Entamoeba invadens
NPNFSFGLLTNFKEIVDRY

SEQ ID NO: 2958950 - protein, 23 aa, Entamoeba invadens
NPNLKVCVSIGGWNFNANAKTKH

SEQ ID NO: 2958951 - protein, 20 aa, Entamoeba invadens
NPNNGFWCQLYHFAKSLNLL

SEQ ID NO: 2958952 - protein, 24 aa, Entamoeba invadens
NPNRNVLCALDLQTNRGIWFGDVA

SEQ ID NO: 2958953 - protein, 27 aa, Entamoeba invadens
NPNYFKAYEIRLTIKNQISRFNDLVQR

SEQ ID NO: 2958954 - protein, 19 aa, Entamoeba invadens
NPPCVMLNIVRKEQDTIPF

SEQ ID NO: 2958955 - protein, 21 aa, Entamoeba invadens
NPPETLRFVLSVYDTNLQEKL

SEQ ID NO: 2958956 - protein, 18 aa, Entamoeba invadens
NPPKLVFKSEFWHPNVYP

SEQ ID NO: 2958957 - protein, 23 aa, Entamoeba invadens
NPPLPPVNPRRGLSHQNESQESQ

SEQ ID NO: 2958958 - protein, 31 aa, Entamoeba invadens
NPPLPQEQCVFCFRTAAPLTQRTPKDYQCFH

SEQ ID NO: 2958959 - protein, 18 aa, Entamoeba invadens
NPPPILRANLYQLLSKII

SEQ ID NO: 2958960 - protein, 17 aa, Entamoeba invadens
NPPRPSFQAPRPPKSPE

SEQ ID NO: 2958961 - protein, 24 aa, Entamoeba invadens
NPQFEILMKTCAAFHEERKIVCEK

SEQ ID NO: 2958962 - protein, 22 aa, Entamoeba invadens
NPQKCVFSVNYNLVIEVMKNII

SEQ ID NO: 2958963 - protein, 23 aa, Entamoeba invadens
NPQLCAKAFQFFCQGQSGMRAVP

SEQ ID NO: 2958964 - protein, 20 aa, Entamoeba invadens
NPQTCGICFYSKHESNALIF

SEQ ID NO: 2958965 - protein, 25 aa, Entamoeba invadens
NPQYFKPETALLWFSLLPIPTYPDD

SEQ ID NO: 2958966 - protein, 17 aa, Entamoeba invadens
NPQYKVARRGVFENYTE

SEQ ID NO: 2958967 - protein, 26 aa, Entamoeba invadens
NPRGIFSVCYNRRIFAYPSAQMGRII

SEQ ID NO: 2958968 - protein, 19 aa, Entamoeba invadens
NPRKYCLFCLAKRVEERGQ

SEQ ID NO: 2958969 - protein, 18 aa, Entamoeba invadens
NPRLIPAAFAKFYLNDAF

SEQ ID NO: 2958970 - protein, 17 aa, Entamoeba invadens
NPRVFVLQRQFQIQTQY

SEQ ID NO: 2958971 - protein, 18 aa, Entamoeba invadens
NPSEGVVYLLTAARYYND

SEQ ID NO: 2958972 - protein, 17 aa, Entamoeba invadens
NPSELKEVIGLVEMEGK

SEQ ID NO: 2958973 - protein, 23 aa, Entamoeba invadens
NPSHLVVVLLFNYLHKLYDDNSE

SEQ ID NO: 2958974 - protein, 17 aa, Entamoeba invadens
NPSKRRLKIQFSATENI

SEQ ID NO: 2958975 - protein, 17 aa, Entamoeba invadens
NPSLEVFIGEDLKRFPN

SEQ ID NO: 2958976 - protein, 24 aa, Entamoeba invadens
NPSLGESILSMIIGLKAVENHCLT

SEQ ID NO: 2958977 - protein, 22 aa, Entamoeba invadens
NPSLKYKTFEWLFWDVSGAPKF

SEQ ID NO: 2958978 - protein, 23 aa, Entamoeba invadens
NPSPAFWKFMDLIAKKEKLKGYD

SEQ ID NO: 2958979 - protein, 19 aa, Entamoeba invadens
NPSPPVQRFQVLANLTLKV

SEQ ID NO: 2958980 - protein, 23 aa, Entamoeba invadens
NPSPRILSRRSIIPLINALQLTE

SEQ ID NO: 2958981 - protein, 24 aa, Entamoeba invadens
NPSPRVAETLHHLSLETKEKNSKS

SEQ ID NO: 2958982 - protein, 17 aa, Entamoeba invadens
NPSQSLYCYLFENKPLF

SEQ ID NO: 2958983 - protein, 23 aa, Entamoeba invadens
NPSSPFSCMYCHLSCPNGCSTTT

SEQ ID NO: 2958984 - protein, 20 aa, Entamoeba invadens
NPSWIFGVGNSYLFDIGVCK

SEQ ID NO: 2958985 - protein, 23 aa, Entamoeba invadens
NPTDKGILLGMKEWNTIMKSVPF

SEQ ID NO: 2958986 - protein, 27 aa, Entamoeba invadens
NPTIFKLDNSCIIPSQNGFILKTNQFS

SEQ ID NO: 2958987 - protein, 18 aa, Entamoeba invadens
NPTILYHKMDLLKQQFCY

SEQ ID NO: 2958988 - protein, 22 aa, Entamoeba invadens
NPTKRKALAKPVSKAGTMTGSS

SEQ ID NO: 2958989 - protein, 17 aa, Entamoeba invadens
NPTLIFHIMLVYFEHIS

SEQ ID NO: 2958990 - protein, 23 aa, Entamoeba invadens
NPTNIISTFSCEHEILKMRRFDK

SEQ ID NO: 2958991 - protein, 36 aa, Entamoeba invadens
NPTPDLKLCFVRSCGIHFSSFFKYFIFLCQPLNKDL

SEQ ID NO: 2958992 - protein, 27 aa, Entamoeba invadens
NPTSSKNVFCFLEFARHSSALNAMKNA

SEQ ID NO: 2958993 - protein, 22 aa, Entamoeba invadens
NPTVYRCVIGHSKENKVIPNAV

SEQ ID NO: 2958994 - protein, 17 aa, Entamoeba invadens
NPTWASAPYGIFLCINC

SEQ ID NO: 2958995 - protein, 20 aa, Entamoeba invadens
NPVCNPSIISQLTVNFPYLQ

SEQ ID NO: 2958996 - protein, 22 aa, Entamoeba invadens
NPVHFHFPLDFDSFIIHRKTPR

SEQ ID NO: 2958997 - protein, 24 aa, Entamoeba invadens
NPVTCAFPMLFGKTGNVNVRPQDV

SEQ ID NO: 2958998 - protein, 17 aa, Entamoeba invadens
NPVVPVRTGTTMRKSTL

SEQ ID NO: 2958999 - protein, 20 aa, Entamoeba invadens
NPYDFLVHLSDFLGKVQQVI

SEQ ID NO: 2959000 - protein, 24 aa, Entamoeba invadens
NPYEMYEVFTKRARIQTKIDEMLE

SEQ ID NO: 2959001 - protein, 23 aa, Entamoeba invadens
NQAALKIAWIFLHGAEGIPADKT

SEQ ID NO: 2959002 - protein, 21 aa, Entamoeba invadens
NQCYMCSLGSYGNNSQCIKCP

SEQ ID NO: 2959003 - protein, 22 aa, Entamoeba invadens
NQCYRCANSICKQCNLDPSKCS

SEQ ID NO: 2959004 - protein, 25 aa, Entamoeba invadens
NQDLKVGVLVLEFFTDVMKSETKEL

SEQ ID NO: 2959005 - protein, 23 aa, Entamoeba invadens
NQDSLWVVCSFLVLVIQNKDVTK

SEQ ID NO: 2959006 - protein, 20 aa, Entamoeba invadens
NQEDFDRCSVTGAVRVELPI

SEQ ID NO: 2959007 - protein, 17 aa, Entamoeba invadens
NQEMSLFSNRKVTVLTT

SEQ ID NO: 2959008 - protein, 18 aa, Entamoeba invadens
NQEYRAMIQYDIKESEGI

SEQ ID NO: 2959009 - protein, 23 aa, Entamoeba invadens
NQFCQRHKIDLNRLSIHQIGEFE

SEQ ID NO: 2959010 - protein, 21 aa, Entamoeba invadens
NQFDHKVCYTLSKLFLNGNTQ

SEQ ID NO: 2959011 - protein, 24 aa, Entamoeba invadens
NQFIKKQRIQLELQNHENEQRIQI

SEQ ID NO: 2959012 - protein, 18 aa, Entamoeba invadens
NQFKEITTEFGVITVDEQ

SEQ ID NO: 2959013 - protein, 24 aa, Entamoeba invadens
NQFRACALAQLLFLFLNPSNTFKH

SEQ ID NO: 2959014 - protein, 21 aa, Entamoeba invadens
NQGCLCLAQFNYIHIGVYLVS

SEQ ID NO: 2959015 - protein, 23 aa, Entamoeba invadens
NQGDCGGCYAFGSLSSLEGRLLM

SEQ ID NO: 2959016 - protein, 19 aa, Entamoeba invadens
NQGFKTTMFPYDFSTGTVD

SEQ ID NO: 2959017 - protein, 17 aa, Entamoeba invadens
NQGFRVTIDMVAPQLCM

SEQ ID NO: 2959018 - protein, 21 aa, Entamoeba invadens
NQGFRVTIDMVAPQLCMGKVE

SEQ ID NO: 2959019 - protein, 24 aa, Entamoeba invadens
NQGKFRRTKIWFVIDEKADNPQED

SEQ ID NO: 2959020 - protein, 19 aa, Entamoeba invadens
NQGVFSQDVVNTWTQYISE

SEQ ID NO: 2959021 - protein, 23 aa, Entamoeba invadens
NQHPFVVAGFKYIDKIMSDFDAL

SEQ ID NO: 2959022 - protein, 18 aa, Entamoeba invadens
NQIFSFYSTNGFVLCNSK

SEQ ID NO: 2959023 - protein, 27 aa, Entamoeba invadens
NQIHSWWRLGGWYYFYLQFEEDGKRST

SEQ ID NO: 2959024 - protein, 29 aa, Entamoeba invadens
NQIIPKEVWRLCGFIVPHLGEKNLFTTFP

SEQ ID NO: 2959025 - protein, 20 aa, Entamoeba invadens
NQIKGVPGMNGVNVQQGNEQ

SEQ ID NO: 2959026 - protein, 24 aa, Entamoeba invadens
NQILRRRRPTMIGDMPKYSNFSLL

SEQ ID NO: 2959027 - protein, 23 aa, Entamoeba invadens
NQIMKGNVFGLVQAFCNDEKNGS

SEQ ID NO: 2959028 - protein, 24 aa, Entamoeba invadens
NQIPNRRFTLWWSPTINRGSVYVG

SEQ ID NO: 2959029 - protein, 33 aa, Entamoeba invadens
NQIRSLAMLFSHLFSSNAIEWNLFRFVIITEDE

SEQ ID NO: 2959030 - protein, 25 aa, Entamoeba invadens
NQKLIRFCPTVAFNNIVKCKLTHFL

SEQ ID NO: 2959031 - protein, 24 aa, Entamoeba invadens
NQKLPLNLPDPFGKKALKLEYNNE

SEQ ID NO: 2959032 - protein, 26 aa, Entamoeba invadens
NQKLTNFRFDWDVCDYFLVKNKGNSF

SEQ ID NO: 2959033 - protein, 24 aa, Entamoeba invadens
NQKMKELQGLYLSRQKLISQKNEN

SEQ ID NO: 2959034 - protein, 17 aa, Entamoeba invadens
NQKVVIRSPTLLNRNKL

SEQ ID NO: 2959035 - protein, 17 aa, Entamoeba invadens
NQLFPVIIARIERPDGT

SEQ ID NO: 2959036 - protein, 20 aa, Entamoeba invadens
NQLICIDCLSSIKTLEDVNC

SEQ ID NO: 2959037 - protein, 18 aa, Entamoeba invadens
NQLIKVVFPFASTKSNMF

SEQ ID NO: 2959038 - protein, 17 aa, Entamoeba invadens
NQLKRIQFEKEQIENDK

SEQ ID NO: 2959039 - protein, 17 aa, Entamoeba invadens
NQLLMDITEQLRIFVLD

SEQ ID NO: 2959040 - protein, 18 aa, Entamoeba invadens
NQLRRYCENVTQVVKDED

SEQ ID NO: 2959041 - protein, 25 aa, Entamoeba invadens
NQMFGVEAFEIFESRGILQVVLESV

SEQ ID NO: 2959042 - protein, 17 aa, Entamoeba invadens
NQMIKKYGKKDVKTLNP

SEQ ID NO: 2959043 - protein, 22 aa, Entamoeba invadens
NQMKNIYSYDGFAKQLETFKTK

SEQ ID NO: 2959044 - protein, 22 aa, Entamoeba invadens
NQMKNIYSYDGFAKQLETFKTT

SEQ ID NO: 2959045 - protein, 25 aa, Entamoeba invadens
NQMPTCNYNLFVYMISFIKEVLKKN

SEQ ID NO: 2959046 - protein, 17 aa, Entamoeba invadens
NQNDLNCFDKIVEELSE

SEQ ID NO: 2959047 - protein, 24 aa, Entamoeba invadens
NQNIKFVFEVAAWKNAVKECVILH

SEQ ID NO: 2959048 - protein, 24 aa, Entamoeba invadens
NQNKFKIVLKAVGKYTLGAEALKN

SEQ ID NO: 2959049 - protein, 18 aa, Entamoeba invadens
NQNMEGMKALKDLEDMTE

SEQ ID NO: 2959050 - protein, 23 aa, Entamoeba invadens
NQNRLPAPTKWKIKADSPGVDWT

SEQ ID NO: 2959051 - protein, 24 aa, Entamoeba invadens
NQPCVDLKLIRFVEESIKSSYVDP

SEQ ID NO: 2959052 - protein, 20 aa, Entamoeba invadens
NQPPVNCIITPPVNVVNLDF

SEQ ID NO: 2959053 - protein, 23 aa, Entamoeba invadens
NQREVIALYGVFCMDRILMSTNA

SEQ ID NO: 2959054 - protein, 18 aa, Entamoeba invadens
NQRGKFKAVGEVYEDLGV

SEQ ID NO: 2959055 - protein, 20 aa, Entamoeba invadens
NQRLYIDSSIPKEYRRRPKD

SEQ ID NO: 2959056 - protein, 21 aa, Entamoeba invadens
NQRRIVFVVPPAFFETHEITP

SEQ ID NO: 2959057 - protein, 23 aa, Entamoeba invadens
NQSCIKLGLDKVFICDKDEEMVT

SEQ ID NO: 2959058 - protein, 24 aa, Entamoeba invadens
NQSEMEFNRFFTIFNRVYSLTYME

SEQ ID NO: 2959059 - protein, 25 aa, Entamoeba invadens
NQSNELVCTLFLLAQVFLDGNVINN

SEQ ID NO: 2959060 - protein, 20 aa, Entamoeba invadens
NQTCLICTSGTYKNTETSCE

SEQ ID NO: 2959061 - protein, 19 aa, Entamoeba invadens
NQTCLSCSSGTYNNTETSC

SEQ ID NO: 2959062 - protein, 22 aa, Entamoeba invadens
NQTDCFLLCFAMNDRKSFEDIK

SEQ ID NO: 2959063 - protein, 17 aa, Entamoeba invadens
NQTHFPKLEVLDMSNNL

SEQ ID NO: 2959064 - protein, 24 aa, Entamoeba invadens
NQTSGCLIFAMLEYLLSPEISPVV

SEQ ID NO: 2959065 - protein, 24 aa, Entamoeba invadens
NQVEVCAKCGQSLGNDVLEALGKK

SEQ ID NO: 2959066 - protein, 24 aa, Entamoeba invadens
NQVRGYKKIGLCLYDDVINVSSII

SEQ ID NO: 2959067 - protein, 25 aa, Entamoeba invadens
NQVSLRAQVGFIFKNYGKTSFCTDR

SEQ ID NO: 2959068 - protein, 19 aa, Entamoeba invadens
NQWYCCNDTSISKMNNGDI

SEQ ID NO: 2959069 - protein, 19 aa, Entamoeba invadens
NQYDRCLTTLFELKQFPVI

SEQ ID NO: 2959070 - protein, 28 aa, Entamoeba invadens
NQYSQWSCLFSRWISYEIVRVKDLEKRK

SEQ ID NO: 2959071 - protein, 17 aa, Entamoeba invadens
NRACNLSLFTALRRVTI

SEQ ID NO: 2959072 - protein, 22 aa, Entamoeba invadens
NRAEYNPFLLFCKDHRENVREK

SEQ ID NO: 2959073 - protein, 18 aa, Entamoeba invadens
NRAFGFGQTRPMFFQNQH

SEQ ID NO: 2959074 - protein, 19 aa, Entamoeba invadens
NRAGKFPTLLGKNEDIKAK

SEQ ID NO: 2959075 - protein, 18 aa, Entamoeba invadens
NRAHMILCHCGINSFNYK

SEQ ID NO: 2959076 - protein, 21 aa, Entamoeba invadens
NRARGALLGVEYISDKMAFYG

SEQ ID NO: 2959077 - protein, 18 aa, Entamoeba invadens
NRARNIFIQHVNKDTTIE

SEQ ID NO: 2959078 - protein, 18 aa, Entamoeba invadens
NRAVSFILKGEFCKDDQY

SEQ ID NO: 2959079 - protein, 17 aa, Entamoeba invadens
NRCFKHCPFTYITLPDS

SEQ ID NO: 2959080 - protein, 21 aa, Entamoeba invadens
NRCIQCFIQPLSEFLVGGESS

SEQ ID NO: 2959081 - protein, 25 aa, Entamoeba invadens
NRCSDLKRYTLLLTNLPHKRLRDVA

SEQ ID NO: 2959082 - protein, 26 aa, Entamoeba invadens
NRDGKIFHSRCFNLWKKQQQLEQKHK

SEQ ID NO: 2959083 - protein, 22 aa, Entamoeba invadens
NRDISAWMGGAMFASLSTFESA

SEQ ID NO: 2959084 - protein, 22 aa, Entamoeba invadens
NRDISAWMGGAMFASLTTFESA

SEQ ID NO: 2959085 - protein, 17 aa, Entamoeba invadens
NRDNFKTIYNFFKSYFA

SEQ ID NO: 2959086 - protein, 20 aa, Entamoeba invadens
NRDVKTCCASVVVNSPTPFC

SEQ ID NO: 2959087 - protein, 26 aa, Entamoeba invadens
NRDVLSFVVDHWYFFQNLEQFRAPQE

SEQ ID NO: 2959088 - protein, 19 aa, Entamoeba invadens
NREAQMSNGVLYFLTHLGF

SEQ ID NO: 2959089 - protein, 25 aa, Entamoeba invadens
NREESFFVTPKVFWRTFLDDTDKGT

SEQ ID NO: 2959090 - protein, 38 aa, Entamoeba invadens
NREKRSFKGAPVFCFFCGGEGHTFRDCPFKSHHNETKV

SEQ ID NO: 2959091 - protein, 23 aa, Entamoeba invadens
NRERACSVYYGYAALNEFLEKNG

SEQ ID NO: 2959092 - protein, 18 aa, Entamoeba invadens
NRERRYGDQQGREQHDGK

SEQ ID NO: 2959093 - protein, 19 aa, Entamoeba invadens
NREVKELVETTAKKLNFDE

SEQ ID NO: 2959094 - protein, 22 aa, Entamoeba invadens
NRFAPHLFRCYNKEKVPPFVHF

SEQ ID NO: 2959095 - protein, 20 aa, Entamoeba invadens
NRFDSINVLQFIQTRSKEQA

SEQ ID NO: 2959096 - protein, 22 aa, Entamoeba invadens
NRFEIVSLNIFSDVLKTFSVMD

SEQ ID NO: 2959097 - protein, 17 aa, Entamoeba invadens
NRFELGMHCVDTTDFEK

SEQ ID NO: 2959098 - protein, 17 aa, Entamoeba invadens
NRFFGHLNKFYKTNQRN

SEQ ID NO: 2959099 - protein, 19 aa, Entamoeba invadens
NRFGFTGNVKITFPDGRVM

SEQ ID NO: 2959100 - protein, 17 aa, Entamoeba invadens
NRFHFGKFIEHYNPPIS

SEQ ID NO: 2959101 - protein, 24 aa, Entamoeba invadens
NRFLPEIITPMVLLVIDADYNVKT

SEQ ID NO: 2959102 - protein, 32 aa, Entamoeba invadens
NRFMYKIVDEFPRYIWYPFLPQIITQMQSSSF

SEQ ID NO: 2959103 - protein, 30 aa, Entamoeba invadens
NRFTECLHFLSDLLSEFGYFFNTTKSQGKN

SEQ ID NO: 2959104 - protein, 24 aa, Entamoeba invadens
NRFVNKVPFFLARKVVKNPKMHSV

SEQ ID NO: 2959105 - protein, 28 aa, Entamoeba invadens
NRGAQAKCISCVRLLFEDSYITKGGKLE

SEQ ID NO: 2959106 - protein, 18 aa, Entamoeba invadens
NRGDGCLDQSVYGESIIV

SEQ ID NO: 2959107 - protein, 28 aa, Entamoeba invadens
NRGYKPSVVCADTFRAGAYEQLQMNAKR

SEQ ID NO: 2959108 - protein, 18 aa, Entamoeba invadens
NRHFKAIHYIPSGFQKVD

SEQ ID NO: 2959109 - protein, 20 aa, Entamoeba invadens
NRHSPVLIDFEVNDKIKTIK

SEQ ID NO: 2959110 - protein, 20 aa, Entamoeba invadens
NRIGFKCFNECLSLKSVVIP

SEQ ID NO: 2959111 - protein, 28 aa, Entamoeba invadens
NRIIYNEFLKRYFFLGTNINKKTSDAMP

SEQ ID NO: 2959112 - protein, 19 aa, Entamoeba invadens
NRIPMLLKLQGHLVKNAQL

SEQ ID NO: 2959113 - protein, 24 aa, Entamoeba invadens
NRIRSCTLAPILDLVEVDDEDDCC

SEQ ID NO: 2959114 - protein, 22 aa, Entamoeba invadens
NRISRCQLEISLDYRDLVNLGF

SEQ ID NO: 2959115 - protein, 19 aa, Entamoeba invadens
NRISSRITEMARFVQDIMR

SEQ ID NO: 2959116 - protein, 21 aa, Entamoeba invadens
NRKDLWFFFNKIIVLSRRQTN

SEQ ID NO: 2959117 - protein, 19 aa, Entamoeba invadens
NRKGLYFIVICRNGTVFGN

SEQ ID NO: 2959118 - protein, 25 aa, Entamoeba invadens
NRKISFDYYPFIGPFTETIFKSLPL

SEQ ID NO: 2959119 - protein, 19 aa, Entamoeba invadens
NRKLSCFSVSKKSTYEIVT

SEQ ID NO: 2959120 - protein, 23 aa, Entamoeba invadens
NRKNQEMQLLFAAAKGEVEVAKS

SEQ ID NO: 2959121 - protein, 30 aa, Entamoeba invadens
NRKRHCAMCSKCVCANCSKGKIPLPPKNDI

SEQ ID NO: 2959122 - protein, 19 aa, Entamoeba invadens
NRKRIVSEFLARLKNSQTL

SEQ ID NO: 2959123 - protein, 22 aa, Entamoeba invadens
NRKTIIPTFCMEGSGEVQVNWG

SEQ ID NO: 2959124 - protein, 17 aa, Entamoeba invadens
NRLCNYTKNLLGTKGEE

SEQ ID NO: 2959125 - protein, 22 aa, Entamoeba invadens
NRLDIFKVLGKKECERPTHAAS

SEQ ID NO: 2959126 - protein, 37 aa, Entamoeba invadens
NRLDTNVLCLLKLFLLEKRVLVVASREQALLASETVL

SEQ ID NO: 2959127 - protein, 17 aa, Entamoeba invadens
NRLDVLKHFEFIDKETN

SEQ ID NO: 2959128 - protein, 20 aa, Entamoeba invadens
NRLFEMIGHRTLRRVILTIY

SEQ ID NO: 2959129 - protein, 19 aa, Entamoeba invadens
NRLFYSLVYSLIFTNKEMT

SEQ ID NO: 2959130 - protein, 18 aa, Entamoeba invadens
NRLGATTDIFGRERHLTD

SEQ ID NO: 2959131 - protein, 20 aa, Entamoeba invadens
NRLNECPSFSQLPKLFKLDL

SEQ ID NO: 2959132 - protein, 25 aa, Entamoeba invadens
NRLPPSEWLISIIKMQGLEYKVDKE

SEQ ID NO: 2959133 - protein, 20 aa, Entamoeba invadens
NRLQDLFIWAFQKEFLQNGK

SEQ ID NO: 2959134 - protein, 20 aa, Entamoeba invadens
NRMEWLTGIKNYRPKASIFQ

SEQ ID NO: 2959135 - protein, 17 aa, Entamoeba invadens
NRMKTTEILSGFIKETG

SEQ ID NO: 2959136 - protein, 20 aa, Entamoeba invadens
NRMNVKIGFKNEEDAKKFMD

SEQ ID NO: 2959137 - protein, 19 aa, Entamoeba invadens
NRMQIVPAVDGYVIDSAIE

SEQ ID NO: 2959138 - protein, 20 aa, Entamoeba invadens
NRMQIVPAVDGYVIDSAIEK

SEQ ID NO: 2959139 - protein, 19 aa, Entamoeba invadens
NRMVNHFIAEFKRKYKKDI

SEQ ID NO: 2959140 - protein, 19 aa, Entamoeba invadens
NRMVNHFITEFKRKYKKIN

SEQ ID NO: 2959141 - protein, 19 aa, Entamoeba invadens
NRNAYLISVVQAIELPQLI

SEQ ID NO: 2959142 - protein, 18 aa, Entamoeba invadens
NRNLFVYLCSFAQKMVEL

SEQ ID NO: 2959143 - protein, 23 aa, Entamoeba invadens
NRNMFCCWSPFNVFQVESQLIKN

SEQ ID NO: 2959144 - protein, 27 aa, Entamoeba invadens
NRNMISWRKSFFDFEHRETKRSGSEEI

SEQ ID NO: 2959145 - protein, 17 aa, Entamoeba invadens
NRNNFTLQQTFCICLLS

SEQ ID NO: 2959146 - protein, 17 aa, Entamoeba invadens
NRNNLTFTFQKKADLRL

SEQ ID NO: 2959147 - protein, 18 aa, Entamoeba invadens
NRNRSRINLMIERANGDV

SEQ ID NO: 2959148 - protein, 23 aa, Entamoeba invadens
NRPLELFPVLSCLLDTIHSVGMK

SEQ ID NO: 2959149 - protein, 19 aa, Entamoeba invadens
NRPLLHSELLKIEKRLIEL

SEQ ID NO: 2959150 - protein, 21 aa, Entamoeba invadens
NRPYIGIDFLDVGRYRQMCGR

SEQ ID NO: 2959151 - protein, 24 aa, Entamoeba invadens
NRQLKIVSPISVFNTTSQRIVVYF

SEQ ID NO: 2959152 - protein, 22 aa, Entamoeba invadens
NRQMIQHYEWFYLDKDEKELSK

SEQ ID NO: 2959153 - protein, 18 aa, Entamoeba invadens
NRQYKFGVVYVKPNQDES

SEQ ID NO: 2959154 - protein, 23 aa, Entamoeba invadens
NRREKTIKCAELKIEKIPDVVEE

SEQ ID NO: 2959155 - protein, 26 aa, Entamoeba invadens
NRRIICFKQNVYLGAIEMEPLGVKGN

SEQ ID NO: 2959156 - protein, 25 aa, Entamoeba invadens
NRRKDMKYSETFKVYTLDKESESKD

SEQ ID NO: 2959157 - protein, 17 aa, Entamoeba invadens
NRRNGVVRELPKKQETT

SEQ ID NO: 2959158 - protein, 26 aa, Entamoeba invadens
NRRVLLDFLKKIFVMDPEQRMTPEEA

SEQ ID NO: 2959159 - protein, 26 aa, Entamoeba invadens
NRSPIQFMPVFIPKKVVKDIGMDDTN

SEQ ID NO: 2959160 - protein, 28 aa, Entamoeba invadens
NRSRYSHDFGRAESWFTTALDISIFVKN

SEQ ID NO: 2959161 - protein, 23 aa, Entamoeba invadens
NRSSLIYICIAPEMEFRLNCDEM

SEQ ID NO: 2959162 - protein, 25 aa, Entamoeba invadens
NRTSMRLSLTKKRSYLSFVATSGKP

SEQ ID NO: 2959163 - protein, 30 aa, Entamoeba invadens
NRTTCYKGMLRLHGRMNLLLTQIEKKEKVK

SEQ ID NO: 2959164 - protein, 17 aa, Entamoeba invadens
NRTVVVLNMSLMYGEVV

SEQ ID NO: 2959165 - protein, 25 aa, Entamoeba invadens
NRVCLKENIMFLVFTKEGHLFGSFN

SEQ ID NO: 2959166 - protein, 28 aa, Entamoeba invadens
NRVKLPEFDPARCLDEFYDRNYVPVEKE

SEQ ID NO: 2959167 - protein, 23 aa, Entamoeba invadens
NRVKMIEGMCFQDCCKLEQIKLP

SEQ ID NO: 2959168 - protein, 18 aa, Entamoeba invadens
NRVKVCDARRSYFNYFTK

SEQ ID NO: 2959169 - protein, 17 aa, Entamoeba invadens
NRVMYRVIENNLIRDKR

SEQ ID NO: 2959170 - protein, 25 aa, Entamoeba invadens
NRVNDMFVDPVCVIVGIGETSGVDL

SEQ ID NO: 2959171 - protein, 20 aa, Entamoeba invadens
NRVNSGILFPGSTIIKKGKK

SEQ ID NO: 2959172 - protein, 27 aa, Entamoeba invadens
NRVNVISFGNLVLSWDVITSVGSKMNM

SEQ ID NO: 2959173 - protein, 17 aa, Entamoeba invadens
NRVPLFAEMEIKKTVEV

SEQ ID NO: 2959174 - protein, 18 aa, Entamoeba invadens
NRYFGHIKRLGISELELV

SEQ ID NO: 2959175 - protein, 17 aa, Entamoeba invadens
NRYIYMDELMDDLEKEH

SEQ ID NO: 2959176 - protein, 20 aa, Entamoeba invadens
NRYYYSIYTNWWGGEFKWRD

SEQ ID NO: 2959177 - protein, 19 aa, Entamoeba invadens
NSACAIIKTLEGYQFDVGE

SEQ ID NO: 2959178 - protein, 17 aa, Entamoeba invadens
NSAFCFREMSKKAQKWM

SEQ ID NO: 2959179 - protein, 21 aa, Entamoeba invadens
NSAFSRCKFLKLEIPENVTQI

SEQ ID NO: 2959180 - protein, 26 aa, Entamoeba invadens
NSCIKLAVLYLEHRVDLFMNFDKDLF

SEQ ID NO: 2959181 - protein, 19 aa, Entamoeba invadens
NSCLSCFRIPSTITSLDAS

SEQ ID NO: 2959182 - protein, 26 aa, Entamoeba invadens
NSCYILDCYSEMYMWVGGRLAKDRRQ

SEQ ID NO: 2959183 - protein, 25 aa, Entamoeba invadens
NSDGFKLFVSLCCDTFLILRKNFHG

SEQ ID NO: 2959184 - protein, 25 aa, Entamoeba invadens
NSDIPFFCLFPLFITQNSFILRQDD

SEQ ID NO: 2959185 - protein, 24 aa, Entamoeba invadens
NSDLHSGVALIKFLEKETGKPAKK

SEQ ID NO: 2959186 - protein, 18 aa, Entamoeba invadens
NSDPIKRCSIKEVIYKLE

SEQ ID NO: 2959187 - protein, 25 aa, Entamoeba invadens
NSDVFIKVVQWIVGGDGWAYDIGYN

SEQ ID NO: 2959188 - protein, 24 aa, Entamoeba invadens
NSDVKRKWIQAKYRMPNISVFDFT

SEQ ID NO: 2959189 - protein, 23 aa, Entamoeba invadens
NSDVLKVLVGVRCLHSEEDYIIT

SEQ ID NO: 2959190 - protein, 17 aa, Entamoeba invadens
NSDWCIGMDIASMSADV

SEQ ID NO: 2959191 - protein, 17 aa, Entamoeba invadens
NSECLSVHSNDYVTVCE

SEQ ID NO: 2959192 - protein, 20 aa, Entamoeba invadens
NSEDYYKCLEHLKQLPDLDK

SEQ ID NO: 2959193 - protein, 21 aa, Entamoeba invadens
NSEFFFEWVEKILVPDVKRKR

SEQ ID NO: 2959194 - protein, 26 aa, Entamoeba invadens
NSEFRKRKGFEIGLRKKEVFGKEIDI

SEQ ID NO: 2959195 - protein, 26 aa, Entamoeba invadens
NSEFSFRGSSKLDFTSILQSLFLSGS

SEQ ID NO: 2959196 - protein, 23 aa, Entamoeba invadens
NSEGEAFCKQVCGNGQIPQDLMN

SEQ ID NO: 2959197 - protein, 17 aa, Entamoeba invadens
NSELFLLDKYVVIYNTV

SEQ ID NO: 2959198 - protein, 23 aa, Entamoeba invadens
NSELKVTSALLIKREDHQQSCSY

SEQ ID NO: 2959199 - protein, 26 aa, Entamoeba invadens
NSETMLFYFVRRLDEILPMTNDRVKR

SEQ ID NO: 2959200 - protein, 19 aa, Entamoeba invadens
NSETYPQRAIGEFYDKVDM

SEQ ID NO: 2959201 - protein, 17 aa, Entamoeba invadens
NSFAFSLFSNGRIDGQQ

SEQ ID NO: 2959202 - protein, 20 aa, Entamoeba invadens
NSFCSRCLMTYTTMTSANQY

SEQ ID NO: 2959203 - protein, 19 aa, Entamoeba invadens
NSFCVVVMTIYYLQQRGLL

SEQ ID NO: 2959204 - protein, 27 aa, Entamoeba invadens
NSFDGFVDFCLRHDFEYGYSSLSDSEF

SEQ ID NO: 2959205 - protein, 20 aa, Entamoeba invadens
NSFECLLKCGVHLDNNLLRY

SEQ ID NO: 2959206 - protein, 21 aa, Entamoeba invadens
NSFERLDFLTSLEFANTPLFI

SEQ ID NO: 2959207 - protein, 25 aa, Entamoeba invadens
NSFETVQIVIAFLIFVIDNYPTLFP

SEQ ID NO: 2959208 - protein, 18 aa, Entamoeba invadens
NSFFEVIRQLGLSTNSVI

SEQ ID NO: 2959209 - protein, 18 aa, Entamoeba invadens
NSFFFTKLSDTWKLKGNE

SEQ ID NO: 2959210 - protein, 17 aa, Entamoeba invadens
NSFIKELPPSLKEFKGL

SEQ ID NO: 2959211 - protein, 18 aa, Entamoeba invadens
NSFIKRPNYWISSDETVI

SEQ ID NO: 2959212 - protein, 24 aa, Entamoeba invadens
NSFISNKMPLFYNGIDNVDEIVGM

SEQ ID NO: 2959213 - protein, 23 aa, Entamoeba invadens
NSFKELYYSTSFLSQNVVHDAIR

SEQ ID NO: 2959214 - protein, 18 aa, Entamoeba invadens
NSFQECGIISFMVTPKYI

SEQ ID NO: 2959215 - protein, 24 aa, Entamoeba invadens
NSFRDCANLHKIVFSTNLTSLGGF

SEQ ID NO: 2959216 - protein, 29 aa, Entamoeba invadens
NSFTIKSKRAHPLPNWNKRTEILLNTELK

SEQ ID NO: 2959217 - protein, 18 aa, Entamoeba invadens
NSFVEGWMTQNFPTVVMY

SEQ ID NO: 2959218 - protein, 17 aa, Entamoeba invadens
NSFWIIKETCITRVSMA

SEQ ID NO: 2959219 - protein, 25 aa, Entamoeba invadens
NSFYNCGFERLIIPSSIYVIENSAF

SEQ ID NO: 2959220 - protein, 24 aa, Entamoeba invadens
NSGEKTPVLATKRRTPRLQRAESS

SEQ ID NO: 2959221 - protein, 19 aa, Entamoeba invadens
NSGFLVFDMEIIRVIAKEG

SEQ ID NO: 2959222 - protein, 20 aa, Entamoeba invadens
NSGMKRGLLTAHFKYNNRIF

SEQ ID NO: 2959223 - protein, 25 aa, Entamoeba invadens
NSGNLKRILVEKGVALFSSLISFDV

SEQ ID NO: 2959224 - protein, 20 aa, Entamoeba invadens
NSGTCLVCTGTTTLLLSLTL

SEQ ID NO: 2959225 - protein, 23 aa, Entamoeba invadens
NSGVKGKNTIIFGYYNNTAKPVT

SEQ ID NO: 2959226 - protein, 20 aa, Entamoeba invadens
NSHFKQVEFLCGFTGSAAVV

SEQ ID NO: 2959227 - protein, 18 aa, Entamoeba invadens
NSIACHDMRIAVSVENVG

SEQ ID NO: 2959228 - protein, 19 aa, Entamoeba invadens
NSIAMKEKYTFTLLADTGR

SEQ ID NO: 2959229 - protein, 23 aa, Entamoeba invadens
NSIEIFNFYKPMFGDCDKSCMCS

SEQ ID NO: 2959230 - protein, 17 aa, Entamoeba invadens
NSIEKISPFLISETSEQ

SEQ ID NO: 2959231 - protein, 19 aa, Entamoeba invadens
NSIEKISSFLVPSTQQEAY

SEQ ID NO: 2959232 - protein, 18 aa, Entamoeba invadens
NSIENARQNMSMFRMAQE

SEQ ID NO: 2959233 - protein, 20 aa, Entamoeba invadens
NSIFCALNMKQIVYNKKEIK

SEQ ID NO: 2959234 - protein, 21 aa, Entamoeba invadens
NSIFCALNMKYIVYNKKEIKV

SEQ ID NO: 2959235 - protein, 28 aa, Entamoeba invadens
NSIGHAFSYRNELVFGEIVLSFDGKIRG

SEQ ID NO: 2959236 - protein, 17 aa, Entamoeba invadens
NSIGSGVFVDCRDAFAI

SEQ ID NO: 2959237 - protein, 23 aa, Entamoeba invadens
NSIKIILQYCFDNCQKLKNISLP

SEQ ID NO: 2959238 - protein, 26 aa, Entamoeba invadens
NSIKVKDLQKILALDLKIVMLLYNSV

SEQ ID NO: 2959239 - protein, 21 aa, Entamoeba invadens
NSILCIPNFAGPDHFLFGISE

SEQ ID NO: 2959240 - protein, 18 aa, Entamoeba invadens
NSILMIFGTLALKNETYF

SEQ ID NO: 2959241 - protein, 18 aa, Entamoeba invadens
NSIQAFCFKDCNNLTDVK

SEQ ID NO: 2959242 - protein, 27 aa, Entamoeba invadens
NSIRGELFVSPSLKRNKKIFSLSSTPV

SEQ ID NO: 2959243 - protein, 40 aa, Entamoeba invadens
NSIRILVMKKMFKWKLSKLTPRLLFQMGITENSEQMKLSK

SEQ ID NO: 2959244 - protein, 17 aa, Entamoeba invadens
NSIRLVGDYELQRKLGE

SEQ ID NO: 2959245 - protein, 39 aa, Entamoeba invadens
NSISIPEAVTFIGSYAFKNCVNLTCFKCGESIQNISKSA

SEQ ID NO: 2959246 - protein, 31 aa, Entamoeba invadens
NSIVFRLTAVGPRAGVFVKAVGMFLTTITTP

SEQ ID NO: 2959247 - protein, 17 aa, Entamoeba invadens
NSIWAVYTNQIFVLDID

SEQ ID NO: 2959248 - protein, 19 aa, Entamoeba invadens
NSIYNCSEYFCLFKKIKFP

SEQ ID NO: 2959249 - protein, 23 aa, Entamoeba invadens
NSKCATCKFWYAPSSDGTSCAKK

SEQ ID NO: 2959250 - protein, 17 aa, Entamoeba invadens
NSKCVFVGVPKTIDGDL

SEQ ID NO: 2959251 - protein, 26 aa, Entamoeba invadens
NSKDFFEIIFAFALPLKPNAREVLSD

SEQ ID NO: 2959252 - protein, 24 aa, Entamoeba invadens
NSKEGLPDVVSRAFVLLSQTIVIT

SEQ ID NO: 2959253 - protein, 25 aa, Entamoeba invadens
NSKFKFPWKIAEFVVSGKRLKKPKT

SEQ ID NO: 2959254 - protein, 22 aa, Entamoeba invadens
NSKGDYALVSALAQSLSDEKET

SEQ ID NO: 2959255 - protein, 25 aa, Entamoeba invadens
NSKHHVAYRMLKKCDSVKEMVPLIV

SEQ ID NO: 2959256 - protein, 24 aa, Entamoeba invadens
NSKIPDQIPFIIVCDRFNYVEEMT

SEQ ID NO: 2959257 - protein, 26 aa, Entamoeba invadens
NSKISCGCGFNYCSMECQKKAYDEYH

SEQ ID NO: 2959258 - protein, 18 aa, Entamoeba invadens
NSKLEMINLNEFVRSKDI

SEQ ID NO: 2959259 - protein, 27 aa, Entamoeba invadens
NSKLLIHPLENCSYKSQNQRVKPSHSK

SEQ ID NO: 2959260 - protein, 24 aa, Entamoeba invadens
NSKREFYHQFILSKSNDSTWYIIS

SEQ ID NO: 2959261 - protein, 20 aa, Entamoeba invadens
NSKTMFDQQCNLVMDTLRDN

SEQ ID NO: 2959262 - protein, 18 aa, Entamoeba invadens
NSKVKRFIHVSTDEVYGQ

SEQ ID NO: 2959263 - protein, 20 aa, Entamoeba invadens
NSKYFAELIQKFFIKNLRKV

SEQ ID NO: 2959264 - protein, 24 aa, Entamoeba invadens
NSKYIFELSEGFSIHENGEVVIFP

SEQ ID NO: 2959265 - protein, 22 aa, Entamoeba invadens
NSKYSNHVCFLPGGQEKKISIE

SEQ ID NO: 2959266 - protein, 23 aa, Entamoeba invadens
NSLAPCKNLSVLGLMNNNISSTA

SEQ ID NO: 2959267 - protein, 17 aa, Entamoeba invadens
NSLEFLPALSCILNNYT

SEQ ID NO: 2959268 - protein, 25 aa, Entamoeba invadens
NSLEICIPNSITLFGEKCFEGCKSV

SEQ ID NO: 2959269 - protein, 21 aa, Entamoeba invadens
NSLEKISPFLVSDNADQARQN

SEQ ID NO: 2959270 - protein, 19 aa, Entamoeba invadens
NSLFKSLLSAFNFSSESQP

SEQ ID NO: 2959271 - protein, 24 aa, Entamoeba invadens
NSLFSLYCQYVIRRQDTLFKHRNC

SEQ ID NO: 2959272 - protein, 26 aa, Entamoeba invadens
NSLFSLYCQYVLYRKSTLLKHRTFYK

SEQ ID NO: 2959273 - protein, 26 aa, Entamoeba invadens
NSLINYKGGLLLPFRSELYIECNSLE

SEQ ID NO: 2959274 - protein, 24 aa, Entamoeba invadens
NSLKELHLRKSVIPGNVMKDVLLN

SEQ ID NO: 2959275 - protein, 17 aa, Entamoeba invadens
NSLKIVVAKVKNCGTPE

SEQ ID NO: 2959276 - protein, 17 aa, Entamoeba invadens
NSLKRFWFVQNRPMMFV

SEQ ID NO: 2959277 - protein, 18 aa, Entamoeba invadens
NSLLALAENFGYVFELKQ

SEQ ID NO: 2959278 - protein, 19 aa, Entamoeba invadens
NSLNFLINHFERFKSLLDI

SEQ ID NO: 2959279 - protein, 27 aa, Entamoeba invadens
NSLPLYTCVFKIFKALLLSINKENANC

SEQ ID NO: 2959280 - protein, 20 aa, Entamoeba invadens
NSLQEFRLINSFFEKPFSFI

SEQ ID NO: 2959281 - protein, 27 aa, Entamoeba invadens
NSLQLKMRFARDCFGLFEVLCGDEKEE

SEQ ID NO: 2959282 - protein, 24 aa, Entamoeba invadens
NSLQSFGKEVFKGCKKLKKVDFGG

SEQ ID NO: 2959283 - protein, 24 aa, Entamoeba invadens
NSLRKKAAFRLKVINEMVTTETDY

SEQ ID NO: 2959284 - protein, 20 aa, Entamoeba invadens
NSLRLYYFFFQKVANHFIFK

SEQ ID NO: 2959285 - protein, 25 aa, Entamoeba invadens
NSLTKLGGYSFRGCTALTKVDLPKY

SEQ ID NO: 2959286 - protein, 35 aa, Entamoeba invadens
NSLVKMTKPWYLRFEYWKLILPLTRSIGEMVNSMI

SEQ ID NO: 2959287 - protein, 20 aa, Entamoeba invadens
NSLVNAIADWFGMDYTSSFF

SEQ ID NO: 2959288 - protein, 26 aa, Entamoeba invadens
NSLYEVAPCDAVFTLKKRHFIQEGEL

SEQ ID NO: 2959289 - protein, 18 aa, Entamoeba invadens
NSMCKCFGGTEAVQKYIR

SEQ ID NO: 2959290 - protein, 19 aa, Entamoeba invadens
NSMKIPKGLCYDFFEEYSC

SEQ ID NO: 2959291 - protein, 17 aa, Entamoeba invadens
NSMKMEYFKSLKVLKTL

SEQ ID NO: 2959292 - protein, 18 aa, Entamoeba invadens
NSMKRCQRLIINNCKGCE

SEQ ID NO: 2959293 - protein, 22 aa, Entamoeba invadens
NSMPHDMFKFISSHFETYDVSQ

SEQ ID NO: 2959294 - protein, 21 aa, Entamoeba invadens
NSNERIVGCTFVNQNLAIIFP

SEQ ID NO: 2959295 - protein, 19 aa, Entamoeba invadens
NSNFEFVHLHSLFKATPLR

SEQ ID NO: 2959296 - protein, 23 aa, Entamoeba invadens
NSNICGLTDVMIVVISSEGYSFG

SEQ ID NO: 2959297 - protein, 24 aa, Entamoeba invadens
NSNKKGTICFVVLGTKEITEYPTP

SEQ ID NO: 2959298 - protein, 18 aa, Entamoeba invadens
NSNLKIVAILSHAKKLRN

SEQ ID NO: 2959299 - protein, 23 aa, Entamoeba invadens
NSNLKRLDLTNVIQIGEQSNMKS

SEQ ID NO: 2959300 - protein, 25 aa, Entamoeba invadens
NSNVLRMSVPIEWRKMFRKIQQTCS

SEQ ID NO: 2959301 - protein, 24 aa, Entamoeba invadens
NSPKRWYKNIGLGFVTPDEAINGN

SEQ ID NO: 2959302 - protein, 19 aa, Entamoeba invadens
NSPMKDYFLHNSMNTPMTD

SEQ ID NO: 2959303 - protein, 17 aa, Entamoeba invadens
NSPREECHFDFVGDEKM

SEQ ID NO: 2959304 - protein, 33 aa, Entamoeba invadens
NSPRFMLLKKICPHITFSFVINKLQQRVESLSS

SEQ ID NO: 2959305 - protein, 22 aa, Entamoeba invadens
NSPSDSAFFCISFDTEIVRRSG

SEQ ID NO: 2959306 - protein, 19 aa, Entamoeba invadens
NSQEAGKCFICGESGHFSN

SEQ ID NO: 2959307 - protein, 22 aa, Entamoeba invadens
NSQKIKDCFNFYDRDYDGKINV

SEQ ID NO: 2959308 - protein, 17 aa, Entamoeba invadens
NSQRKGNVIPFKPQEPP

SEQ ID NO: 2959309 - protein, 17 aa, Entamoeba invadens
NSQSLKSVTSWFEATFV

SEQ ID NO: 2959310 - protein, 24 aa, Entamoeba invadens
NSRAEYQYYLGFYDGNPANLNPLT

SEQ ID NO: 2959311 - protein, 29 aa, Entamoeba invadens
NSRISKCRCALCRYKVLCHMLTKPPFPVE

SEQ ID NO: 2959312 - protein, 20 aa, Entamoeba invadens
NSRIWGCSKAGLHCGGKDTR

SEQ ID NO: 2959313 - protein, 20 aa, Entamoeba invadens
NSRKCPKCETFIEKNGGCQW

SEQ ID NO: 2959314 - protein, 20 aa, Entamoeba invadens
NSRKEFDFMMLKQLKKLNIV

SEQ ID NO: 2959315 - protein, 23 aa, Entamoeba invadens
NSRNLKGPRVFFIVTENSVDHES

SEQ ID NO: 2959316 - protein, 21 aa, Entamoeba invadens
NSRPFTLNGIELKETIEGVQA

SEQ ID NO: 2959317 - protein, 19 aa, Entamoeba invadens
NSRTVIFLFSRISFVSVLN

SEQ ID NO: 2959318 - protein, 27 aa, Entamoeba invadens
NSRYYYIHACMNYMALARNYQFIVLNQ

SEQ ID NO: 2959319 - protein, 25 aa, Entamoeba invadens
NSSAKVCDLVHFFYQLLTHIGVFKD

SEQ ID NO: 2959320 - protein, 33 aa, Entamoeba invadens
NSSANPTLKCLNCFECFFTIKKLLEHTKVCRTP

SEQ ID NO: 2959321 - protein, 19 aa, Entamoeba invadens
NSSCFKDCVNLVNIQFLGG

SEQ ID NO: 2959322 - protein, 24 aa, Entamoeba invadens
NSSDKRLRVFLSILTAPFTPDEVF

SEQ ID NO: 2959323 - protein, 31 aa, Entamoeba invadens
NSSFEIFAKMFYLKESDAFLEYVANQIVLKI

SEQ ID NO: 2959324 - protein, 18 aa, Entamoeba invadens
NSSHIFLILDYVPGGELY

SEQ ID NO: 2959325 - protein, 25 aa, Entamoeba invadens
NSSIFPLYIAHCLTVGSETSFVADR

SEQ ID NO: 2959326 - protein, 30 aa, Entamoeba invadens
NSSIQCIVHVMPLVKYFERGMWKNEVNTTN

SEQ ID NO: 2959327 - protein, 18 aa, Entamoeba invadens
NSSLCFSCVTLQQVKKIT

SEQ ID NO: 2959328 - protein, 19 aa, Entamoeba invadens
NSSLIKRYLIPRYTPNLVR

SEQ ID NO: 2959329 - protein, 23 aa, Entamoeba invadens
NSSRGCSYMYGYAGVKEFLETND

SEQ ID NO: 2959330 - protein, 35 aa, Entamoeba invadens
NSSSFSTRFFCLHWFITKCHSFMIIIFDTISNPIV

SEQ ID NO: 2959331 - protein, 31 aa, Entamoeba invadens
NSTCFKFKQGVFGFKIEAVWLNAPSAKTICG

SEQ ID NO: 2959332 - protein, 25 aa, Entamoeba invadens
NSTCLCLNFQIGKVVLDFSAYKIGD

SEQ ID NO: 2959333 - protein, 19 aa, Entamoeba invadens
NSTCLKCSEGTYPNRVGKC

SEQ ID NO: 2959334 - protein, 26 aa, Entamoeba invadens
NSTEFSACMPFLFRYNTFLSQHASQF

SEQ ID NO: 2959335 - protein, 18 aa, Entamoeba invadens
NSTFKRVYDNLSPSRALL

SEQ ID NO: 2959336 - protein, 17 aa, Entamoeba invadens
NSTFSIEKQKAFETIDK

SEQ ID NO: 2959337 - protein, 17 aa, Entamoeba invadens
NSTGFGGFDCVDVNRLA

SEQ ID NO: 2959338 - protein, 20 aa, Entamoeba invadens
NSTGICYENGILIIDKNEYR

SEQ ID NO: 2959339 - protein, 18 aa, Entamoeba invadens
NSTIPAKKSQIFSTYADN

SEQ ID NO: 2959340 - protein, 24 aa, Entamoeba invadens
NSTIRLSPRSNYNFFEIVNEQMII

SEQ ID NO: 2959341 - protein, 24 aa, Entamoeba invadens
NSTKFDIKICAGGVENFVKCKPEN

SEQ ID NO: 2959342 - protein, 23 aa, Entamoeba invadens
NSTKKRPNCLTFIRCYDHRVLDM

SEQ ID NO: 2959343 - protein, 24 aa, Entamoeba invadens
NSTKRWYKNIGLGFVTPDEAINGT

SEQ ID NO: 2959344 - protein, 26 aa, Entamoeba invadens
NSTLMSCLNLKCVFVDFPDLSLNDVA

SEQ ID NO: 2959345 - protein, 17 aa, Entamoeba invadens
NSTPPASFIFRGNSAFT

SEQ ID NO: 2959346 - protein, 30 aa, Entamoeba invadens
NSTREGYLRCLLAMKLGVFYFQIGQDDDAW

SEQ ID NO: 2959347 - protein, 28 aa, Entamoeba invadens
NSTSLDIMACLQRDFSNLPPLKKRKENL

SEQ ID NO: 2959348 - protein, 18 aa, Entamoeba invadens
NSTSSIFLDIQNVSKDIL

SEQ ID NO: 2959349 - protein, 24 aa, Entamoeba invadens
NSTYCLSCNSTLYLTSGECKTLDY

SEQ ID NO: 2959350 - protein, 17 aa, Entamoeba invadens
NSVDAFRVNIGKSPFVF

SEQ ID NO: 2959351 - protein, 23 aa, Entamoeba invadens
NSVEELSVLLGRLGLNERERNDF

SEQ ID NO: 2959352 - protein, 25 aa, Entamoeba invadens
NSVEILNLILNWVHFKKYKCLFQRN

SEQ ID NO: 2959353 - protein, 25 aa, Entamoeba invadens
NSVIDLFTHICEWAHSRKLVEKDEE

SEQ ID NO: 2959354 - protein, 18 aa, Entamoeba invadens
NSVIRLHICCSHCLSDGR

SEQ ID NO: 2959355 - protein, 18 aa, Entamoeba invadens
NSVIRLHLCCSHCLSDGR

SEQ ID NO: 2959356 - protein, 24 aa, Entamoeba invadens
NSVKNRFCAHIAMIPKRSQNNKEN

SEQ ID NO: 2959357 - protein, 17 aa, Entamoeba invadens
NSVKRCPNNQGDRFSKI

SEQ ID NO: 2959358 - protein, 19 aa, Entamoeba invadens
NSVLLLNDRATLFAVSTDF

SEQ ID NO: 2959359 - protein, 24 aa, Entamoeba invadens
NSVPINYTKKVVCLQQVTLNDYLS

SEQ ID NO: 2959360 - protein, 30 aa, Entamoeba invadens
NSVSFIGEKCFKNCGLTAIEFSSDKTDMPC

SEQ ID NO: 2959361 - protein, 19 aa, Entamoeba invadens
NSVTRLGHRCFFLCINLAK

SEQ ID NO: 2959362 - protein, 22 aa, Entamoeba invadens
NSVTVKGRIVGVGDFDGKLVVV

SEQ ID NO: 2959363 - protein, 19 aa, Entamoeba invadens
NSVVKFGNYVCKNCEHLKN

SEQ ID NO: 2959364 - protein, 25 aa, Entamoeba invadens
NSVVWEIVNKLKLLAFYKQSEIEKR

SEQ ID NO: 2959365 - protein, 18 aa, Entamoeba invadens
NSVYKFSITFKDQGLYAT

SEQ ID NO: 2959366 - protein, 48 aa, Entamoeba invadens
NSYFTRLKTVFAFARTKFVKAFENFDAMFVLCCCFCNVDIQINPLIAE

SEQ ID NO: 2959367 - protein, 21 aa, Entamoeba invadens
NSYIHFSVCLFNDIYTLVNEL

SEQ ID NO: 2959368 - protein, 18 aa, Entamoeba invadens
NSYPYPQHVSCSDSFNPD

SEQ ID NO: 2959369 - protein, 26 aa, Entamoeba invadens
NSYRKKEMTFRLSVNNNYLKSTDSAL

SEQ ID NO: 2959370 - protein, 25 aa, Entamoeba invadens
NSYWIFGDDVIRQFNDVASLLGVFT

SEQ ID NO: 2959371 - protein, 24 aa, Entamoeba invadens
NSYWPEIPANVIVISSSYFEVTGG

SEQ ID NO: 2959372 - protein, 17 aa, Entamoeba invadens
NSYYPKYPDCISCDIKC

SEQ ID NO: 2959373 - protein, 27 aa, Entamoeba invadens
NTAKFCSAHFVEFFLAKIQEGKIDEGW

SEQ ID NO: 2959374 - protein, 17 aa, Entamoeba invadens
NTAQYLNVFFDCMDAVK

SEQ ID NO: 2959375 - protein, 24 aa, Entamoeba invadens
NTARMRFATEFSHFKETRKLFYEL

SEQ ID NO: 2959376 - protein, 20 aa, Entamoeba invadens
NTCAVCFDGFVLNTKDNTCT

SEQ ID NO: 2959377 - protein, 17 aa, Entamoeba invadens
NTCFMNSALQCLLHTMP

SEQ ID NO: 2959378 - protein, 17 aa, Entamoeba invadens
NTCPISFQTVFFDFTVK

SEQ ID NO: 2959379 - protein, 24 aa, Entamoeba invadens
NTCRKDYKLPLGKIKILEQPTTCP

SEQ ID NO: 2959380 - protein, 19 aa, Entamoeba invadens
NTCYLNSVLQCLSHTEYLT

SEQ ID NO: 2959381 - protein, 18 aa, Entamoeba invadens
NTDCMRHGYSTTLGDTPA

SEQ ID NO: 2959382 - protein, 24 aa, Entamoeba invadens
NTDELWTLLNYVNPIGFPSIEAFH

SEQ ID NO: 2959383 - protein, 24 aa, Entamoeba invadens
NTDFGVCICVKCNEHPLLPIGLFD

SEQ ID NO: 2959384 - protein, 22 aa, Entamoeba invadens
NTDIWQRRSSFKVPSQTVEEHR

SEQ ID NO: 2959385 - protein, 28 aa, Entamoeba invadens
NTDVKQWLLRKLNSFQAKKTDLDNQIKE

SEQ ID NO: 2959386 - protein, 27 aa, Entamoeba invadens
NTDVKRVIEFLAVFLMNLTESIIPSSL

SEQ ID NO: 2959387 - protein, 25 aa, Entamoeba invadens
NTDWLLETYCGFIISGNEVMFNKRM

SEQ ID NO: 2959388 - protein, 21 aa, Entamoeba invadens
NTEANMWYLPMNDWISERCSE

SEQ ID NO: 2959389 - protein, 24 aa, Entamoeba invadens
NTECSEAFWKFMNLISKEEEVKGW

SEQ ID NO: 2959390 - protein, 18 aa, Entamoeba invadens
NTEFLVWNERVDVMEYID

SEQ ID NO: 2959391 - protein, 24 aa, Entamoeba invadens
NTEFNQRRLGGLTLVDLAGSEKLN

SEQ ID NO: 2959392 - protein, 24 aa, Entamoeba invadens
NTEIARKYFIHFFASGVSDIQELT

SEQ ID NO: 2959393 - protein, 23 aa, Entamoeba invadens
NTEKADCRWIDFSHYYNNTKNVT

SEQ ID NO: 2959394 - protein, 23 aa, Entamoeba invadens
NTELDSFASFFALFGEDMSVTQQ

SEQ ID NO: 2959395 - protein, 19 aa, Entamoeba invadens
NTELIDLLLKYGASVGQTY

SEQ ID NO: 2959396 - protein, 21 aa, Entamoeba invadens
NTEMIFSFYIEHEKIKDLIDY

SEQ ID NO: 2959397 - protein, 26 aa, Entamoeba invadens
NTERNIPSVMLYKDRDLPDKDMKYTP

SEQ ID NO: 2959398 - protein, 26 aa, Entamoeba invadens
NTERRCSVYFGYKAVDSFFNENCIEL

SEQ ID NO: 2959399 - protein, 24 aa, Entamoeba invadens
NTEVKVFMKRGSVLPTDSNTPDDV

SEQ ID NO: 2959400 - protein, 33 aa, Entamoeba invadens
NTFCSRVMTYYARISCRSFLRQTLKNVINEINS

SEQ ID NO: 2959401 - protein, 18 aa, Entamoeba invadens
NTFDGCISISAIQWLCQS

SEQ ID NO: 2959402 - protein, 19 aa, Entamoeba invadens
NTFFKSYVLLISHRKNYVR

SEQ ID NO: 2959403 - protein, 24 aa, Entamoeba invadens
NTFGIPMPFAMRLSVATPVNERNF

SEQ ID NO: 2959404 - protein, 26 aa, Entamoeba invadens
NTFICCVSCLLLVLTDKYYRTYEGFI

SEQ ID NO: 2959405 - protein, 25 aa, Entamoeba invadens
NTFIRGRCLSYPFVVKDVDTLIQKY

SEQ ID NO: 2959406 - protein, 23 aa, Entamoeba invadens
NTFKFPWKIAEFVISGERLPRLD

SEQ ID NO: 2959407 - protein, 18 aa, Entamoeba invadens
NTFKTSGSVKAWEEKQKT

SEQ ID NO: 2959408 - protein, 19 aa, Entamoeba invadens
NTFLYLTETAICFQYFLKD

SEQ ID NO: 2959409 - protein, 21 aa, Entamoeba invadens
NTFNLLFFIRTVFPVFHAPQH

SEQ ID NO: 2959410 - protein, 25 aa, Entamoeba invadens
NTFPDLRLRKRRNTKKKAYIKYIVE

SEQ ID NO: 2959411 - protein, 24 aa, Entamoeba invadens
NTFRECHNLEKIVIPSTVTKINEN

SEQ ID NO: 2959412 - protein, 17 aa, Entamoeba invadens
NTFRKMKYVYFVCTDAM

SEQ ID NO: 2959413 - protein, 28 aa, Entamoeba invadens
NTFRPKEIAALFFKKLMNQIKTKIPTIV

SEQ ID NO: 2959414 - protein, 20 aa, Entamoeba invadens
NTFRPVLMLFDAMIVDGYNI

SEQ ID NO: 2959415 - protein, 24 aa, Entamoeba invadens
NTFSDFTGFGFNRPMAEMEKKEPF

SEQ ID NO: 2959416 - protein, 21 aa, Entamoeba invadens
NTFYCFIPFAFDSNVSMECIY

SEQ ID NO: 2959417 - protein, 28 aa, Entamoeba invadens
NTGCHLLKLKVCVENSVSEILYSVLPST

SEQ ID NO: 2959418 - protein, 20 aa, Entamoeba invadens
NTGFIALSFLKLIPEKFAIP

SEQ ID NO: 2959419 - protein, 23 aa, Entamoeba invadens
NTGIHSIHLSGYITKISQEENAM

SEQ ID NO: 2959420 - protein, 25 aa, Entamoeba invadens
NTGRHCSVFYGFKAVDKFFKKNGFI

SEQ ID NO: 2959421 - protein, 27 aa, Entamoeba invadens
NTGRIKSVLCTGNLCGKETYDILRTLA

SEQ ID NO: 2959422 - protein, 17 aa, Entamoeba invadens
NTHILFFAIMRNRITSS

SEQ ID NO: 2959423 - protein, 18 aa, Entamoeba invadens
NTHLCSLQDTTLCLQNLL

SEQ ID NO: 2959424 - protein, 23 aa, Entamoeba invadens
NTHLSRLQPFFDVLNINTTKDGI

SEQ ID NO: 2959425 - protein, 17 aa, Entamoeba invadens
NTHWVLGVINNIDKTVS

SEQ ID NO: 2959426 - protein, 22 aa, Entamoeba invadens
NTICPFPSLEIFIPEIVEEKNA

SEQ ID NO: 2959427 - protein, 17 aa, Entamoeba invadens
NTICYKKECENSDKVVE

SEQ ID NO: 2959428 - protein, 24 aa, Entamoeba invadens
NTIECYIDWCCRLSSVTIPSSVKS

SEQ ID NO: 2959429 - protein, 17 aa, Entamoeba invadens
NTIEFKVGGDLISGKKG

SEQ ID NO: 2959430 - protein, 21 aa, Entamoeba invadens
NTIEKCFYDDLLVLHVGETYI

SEQ ID NO: 2959431 - protein, 17 aa, Entamoeba invadens
NTIFKDQCKAFIKKIVD

SEQ ID NO: 2959432 - protein, 26 aa, Entamoeba invadens
NTIFKKEFFYMIVWFIVDFETVDRNK

SEQ ID NO: 2959433 - protein, 18 aa, Entamoeba invadens
NTIHDLWDGIYIANDITD

SEQ ID NO: 2959434 - protein, 19 aa, Entamoeba invadens
NTIICFIGIGMYNDVFPSE

SEQ ID NO: 2959435 - protein, 19 aa, Entamoeba invadens
NTIKACKANLFLSNVFVET

SEQ ID NO: 2959436 - protein, 18 aa, Entamoeba invadens
NTIKKLKISQDVIDEKVY

SEQ ID NO: 2959437 - protein, 24 aa, Entamoeba invadens
NTIKMPWWHSDLMGEECMIFANGY

SEQ ID NO: 2959438 - protein, 25 aa, Entamoeba invadens
NTIKSLGRMAFARCTNLKSVIITES

SEQ ID NO: 2959439 - protein, 30 aa, Entamoeba invadens
NTILIANKRLQAILRDRRTEIKDLQSQLSL

SEQ ID NO: 2959440 - protein, 18 aa, Entamoeba invadens
NTILNFMEACLFAGTKIN

SEQ ID NO: 2959441 - protein, 30 aa, Entamoeba invadens
NTIMFCFFNNPRLTFACLIKMSALEHFFNI

SEQ ID NO: 2959442 - protein, 25 aa, Entamoeba invadens
NTINFGLRCFMYNNLLIAITLSCNL

SEQ ID NO: 2959443 - protein, 26 aa, Entamoeba invadens
NTINYCPIKLLSKELPEVLMYYFPST

SEQ ID NO: 2959444 - protein, 24 aa, Entamoeba invadens
NTIPDLCFEGCASLKEINLKNVSV

SEQ ID NO: 2959445 - protein, 20 aa, Entamoeba invadens
NTIRAYLCAMSHGLIPNLLD

SEQ ID NO: 2959446 - protein, 24 aa, Entamoeba invadens
NTIRCFMELVQPFVWQHVYIPILP

SEQ ID NO: 2959447 - protein, 19 aa, Entamoeba invadens
NTISIGMNAFRSCENLKEV

SEQ ID NO: 2959448 - protein, 17 aa, Entamoeba invadens
NTITCLYTLHSLIDNTC

SEQ ID NO: 2959449 - protein, 19 aa, Entamoeba invadens
NTITRLGVRCFSNCTSMTS

SEQ ID NO: 2959450 - protein, 27 aa, Entamoeba invadens
NTIVFPIFLQLCTWTLTPKLSWNNSEK

SEQ ID NO: 2959451 - protein, 27 aa, Entamoeba invadens
NTIYKSKRIFYSWCFDVVFVTIEKTFS

SEQ ID NO: 2959452 - protein, 26 aa, Entamoeba invadens
NTKEEKCKILSELNALKGEKENVTNE

SEQ ID NO: 2959453 - protein, 32 aa, Entamoeba invadens
NTKLFGGNVCKLKLLVFFTGKGRARLNFSSKT

SEQ ID NO: 2959454 - protein, 24 aa, Entamoeba invadens
NTKLLGCGCFYACTSLSAFNIPSS

SEQ ID NO: 2959455 - protein, 17 aa, Entamoeba invadens
NTKLPMFHVYQATNGFR

SEQ ID NO: 2959456 - protein, 22 aa, Entamoeba invadens
NTKNALKWTVRYLGRGTELCVL

SEQ ID NO: 2959457 - protein, 17 aa, Entamoeba invadens
NTKNMKGQMTLEAFFHT

SEQ ID NO: 2959458 - protein, 18 aa, Entamoeba invadens
NTKNVCFLVVYSPLPKHV

SEQ ID NO: 2959459 - protein, 18 aa, Entamoeba invadens
NTKRVIQYIATIAGRSSA

SEQ ID NO: 2959460 - protein, 30 aa, Entamoeba invadens
NTKSEQAHYILHKRVHDVSMISSALEVLQT

SEQ ID NO: 2959461 - protein, 18 aa, Entamoeba invadens
NTKWGIRNVDLYQKKQYN

SEQ ID NO: 2959462 - protein, 19 aa, Entamoeba invadens
NTLCDTLISFFENKMSTSV

SEQ ID NO: 2959463 - protein, 18 aa, Entamoeba invadens
NTLDSFAFHNCTQLTEVS

SEQ ID NO: 2959464 - protein, 19 aa, Entamoeba invadens
NTLEKFLIGIFAQIDMPRS

SEQ ID NO: 2959465 - protein, 25 aa, Entamoeba invadens
NTLEPKFELGIPFKPVEQLMSVLPP

SEQ ID NO: 2959466 - protein, 24 aa, Entamoeba invadens
NTLFECFPVFSAYCAQRPLGFIPE

SEQ ID NO: 2959467 - protein, 22 aa, Entamoeba invadens
NTLFMNCLTKWINLSNNEIIFT

SEQ ID NO: 2959468 - protein, 17 aa, Entamoeba invadens
NTLFRRYCVIKELSETE

SEQ ID NO: 2959469 - protein, 18 aa, Entamoeba invadens
NTLFSNFIKSLGFTTKTS

SEQ ID NO: 2959470 - protein, 20 aa, Entamoeba invadens
NTLFSYSLKTNVILSHIALP

SEQ ID NO: 2959471 - protein, 20 aa, Entamoeba invadens
NTLGRFSIEIPRTVEDLIAT

SEQ ID NO: 2959472 - protein, 32 aa, Entamoeba invadens
NTLKALPSCFLKECAFTSFSMHSTITKIGDMA

SEQ ID NO: 2959473 - protein, 17 aa, Entamoeba invadens
NTLKYVYFRVERLMTTT

SEQ ID NO: 2959474 - protein, 17 aa, Entamoeba invadens
NTLLIHLVFKISSKTQA

SEQ ID NO: 2959475 - protein, 25 aa, Entamoeba invadens
NTLLLDFCIEIGYFFDYKKKKGKNE

SEQ ID NO: 2959476 - protein, 23 aa, Entamoeba invadens
NTLLTFPLIYPISLEPELLKENR

SEQ ID NO: 2959477 - protein, 17 aa, Entamoeba invadens
NTLPFQVKLRTSGSGPK

SEQ ID NO: 2959478 - protein, 17 aa, Entamoeba invadens
NTLQELYLNVAPVEENL

SEQ ID NO: 2959479 - protein, 18 aa, Entamoeba invadens
NTLQKLRGTYAYCAPEIY

SEQ ID NO: 2959480 - protein, 28 aa, Entamoeba invadens
NTLQKSAQCFIDLKMKILDEFTQSTKRL

SEQ ID NO: 2959481 - protein, 19 aa, Entamoeba invadens
NTLRLHVCCTHAVCDGRTI

SEQ ID NO: 2959482 - protein, 17 aa, Entamoeba invadens
NTLRMVDHFVFHHHICI

SEQ ID NO: 2959483 - protein, 17 aa, Entamoeba invadens
NTLRRPTLTPVITMITL

SEQ ID NO: 2959484 - protein, 22 aa, Entamoeba invadens
NTLTTLPFMCFSSCRQLKEIEI

SEQ ID NO: 2959485 - protein, 37 aa, Entamoeba invadens
NTLVTAFKPQVALRFGLPFDRPFYLVHRNTFLESNLS

SEQ ID NO: 2959486 - protein, 25 aa, Entamoeba invadens
NTLYSHRFFPYYSFSILTGLSVKGE

SEQ ID NO: 2959487 - protein, 22 aa, Entamoeba invadens
NTMLPRLNKILTPPFKMANDPL

SEQ ID NO: 2959488 - protein, 23 aa, Entamoeba invadens
NTMLTCFSAFKIDKDGTISVSPH

SEQ ID NO: 2959489 - protein, 17 aa, Entamoeba invadens
NTNGFTFKDYLEKETLA

SEQ ID NO: 2959490 - protein, 18 aa, Entamoeba invadens
NTNKVIRWEFLENNTNRM

SEQ ID NO: 2959491 - protein, 27 aa, Entamoeba invadens
NTNLHSTMFNVWFKKIIGREIDFSMEY

SEQ ID NO: 2959492 - protein, 20 aa, Entamoeba invadens
NTNMVFAMKLMRKKDMIERG

SEQ ID NO: 2959493 - protein, 19 aa, Entamoeba invadens
NTNNAWWNGYCERYSKLFE

SEQ ID NO: 2959494 - protein, 23 aa, Entamoeba invadens
NTNNCVFKNNFVYSPNDYFSAAV

SEQ ID NO: 2959495 - protein, 17 aa, Entamoeba invadens
NTNNLWSPRKLVIYNGK

SEQ ID NO: 2959496 - protein, 24 aa, Entamoeba invadens
NTNYLWKQNCFLITSYTSFIKFEK

SEQ ID NO: 2959497 - protein, 23 aa, Entamoeba invadens
NTPEIFCKSELSVNDAFGSGDDV

SEQ ID NO: 2959498 - protein, 17 aa, Entamoeba invadens
NTPKFNVTPLRFLVLDE

SEQ ID NO: 2959499 - protein, 24 aa, Entamoeba invadens
NTPKYGVIFGASFIQKADPKNKGR

SEQ ID NO: 2959500 - protein, 23 aa, Entamoeba invadens
NTPPNKMVFLFLFNDVLLETIPT

SEQ ID NO: 2959501 - protein, 22 aa, Entamoeba invadens
NTPRLESIPILRSTSPKPDNKI

SEQ ID NO: 2959502 - protein, 33 aa, Entamoeba invadens
NTPTKAFVATLWLKSIFELHLSYLMSVKEVHKS

SEQ ID NO: 2959503 - protein, 22 aa, Entamoeba invadens
NTPVEMPQRFMVNNLVGGTIQR

SEQ ID NO: 2959504 - protein, 25 aa, Entamoeba invadens
NTPVRLELRLSIYGRSMDEWENLAE

SEQ ID NO: 2959505 - protein, 19 aa, Entamoeba invadens
NTQIPFGLEKALKYLYTSG

SEQ ID NO: 2959506 - protein, 27 aa, Entamoeba invadens
NTQPSEFFSFITFHLWSYGEYTINYNI

SEQ ID NO: 2959507 - protein, 23 aa, Entamoeba invadens
NTQRLEGAEGWYDHERTYISSVL

SEQ ID NO: 2959508 - protein, 25 aa, Entamoeba invadens
NTQYYKCLIFKPEVHVLVVTHHVWP

SEQ ID NO: 2959509 - protein, 17 aa, Entamoeba invadens
NTRGVIVCYQLYGENNI

SEQ ID NO: 2959510 - protein, 18 aa, Entamoeba invadens
NTRLCVLILQALKEISPI

SEQ ID NO: 2959511 - protein, 19 aa, Entamoeba invadens
NTRMLKCYFHNEMPNFYTE

SEQ ID NO: 2959512 - protein, 18 aa, Entamoeba invadens
NTRQLICNYFDKYMPFNI

SEQ ID NO: 2959513 - protein, 21 aa, Entamoeba invadens
NTRSRTYAALNKISEDTELDD

SEQ ID NO: 2959514 - protein, 26 aa, Entamoeba invadens
NTRWFYYQLLVKFCFENLEKIEIFVK

SEQ ID NO: 2959515 - protein, 25 aa, Entamoeba invadens
NTSFFKVFAEWLFLNRDGLLRNSVK

SEQ ID NO: 2959516 - protein, 17 aa, Entamoeba invadens
NTSFPYSKHTTVINQKQ

SEQ ID NO: 2959517 - protein, 19 aa, Entamoeba invadens
NTSGVPIVSVDWVEASLKS

SEQ ID NO: 2959518 - protein, 17 aa, Entamoeba invadens
NTSIPVRILLLSNDGMA

SEQ ID NO: 2959519 - protein, 23 aa, Entamoeba invadens
NTSKSRASLYFQIAPNCKYCAIK

SEQ ID NO: 2959520 - protein, 17 aa, Entamoeba invadens
NTSMKIKTFHEVVEAIG

SEQ ID NO: 2959521 - protein, 23 aa, Entamoeba invadens
NTSRLTESVAVFKDIMTNEFLKN

SEQ ID NO: 2959522 - protein, 20 aa, Entamoeba invadens
NTSSLALYVKLGFVKEQLLL

SEQ ID NO: 2959523 - protein, 25 aa, Entamoeba invadens
NTSTFKLSPQFTYSLITYDNKEVNG

SEQ ID NO: 2959524 - protein, 19 aa, Entamoeba invadens
NTTALGFKAMAMFHLADID

SEQ ID NO: 2959525 - protein, 29 aa, Entamoeba invadens
NTTECPKCKKQICVKCFCDSVKANGQCPI

SEQ ID NO: 2959526 - protein, 23 aa, Entamoeba invadens
NTTECQKCLTPCAGGCCTKVSSS

SEQ ID NO: 2959527 - protein, 24 aa, Entamoeba invadens
NTTIPTRVSREFTTTNDFQREVDV

SEQ ID NO: 2959528 - protein, 24 aa, Entamoeba invadens
NTTKEIGELLVLPFNTFDETNDTT

SEQ ID NO: 2959529 - protein, 28 aa, Entamoeba invadens
NTTLKFEFWDEITFKIQVDEFGKIKLVV

SEQ ID NO: 2959530 - protein, 24 aa, Entamoeba invadens
NTTQRLNAWYALQKLTKCYVKYLE

SEQ ID NO: 2959531 - protein, 24 aa, Entamoeba invadens
NTTRGCSYYYGFSAVRRFLARNDI

SEQ ID NO: 2959532 - protein, 18 aa, Entamoeba invadens
NTTSLWKKPYGFENGTWE

SEQ ID NO: 2959533 - protein, 24 aa, Entamoeba invadens
NTTSRLLKELAFPNDVLYIKEMCC

SEQ ID NO: 2959534 - protein, 18 aa, Entamoeba invadens
NTTWKTNVLVARHAFTKN

SEQ ID NO: 2959535 - protein, 25 aa, Entamoeba invadens
NTTYQCTFSYLPRGKQNCTLLLNDK

SEQ ID NO: 2959536 - protein, 19 aa, Entamoeba invadens
NTVDCRRTMVLRYFGENFD

SEQ ID NO: 2959537 - protein, 19 aa, Entamoeba invadens
NTVECIISWSDLSNSHPSF

SEQ ID NO: 2959538 - protein, 18 aa, Entamoeba invadens
NTVFTKFLIIEDHTVSTL

SEQ ID NO: 2959539 - protein, 19 aa, Entamoeba invadens
NTVIGWNFQNIKGKILANL

SEQ ID NO: 2959540 - protein, 17 aa, Entamoeba invadens
NTVKCWKYGEVTPTASF

SEQ ID NO: 2959541 - protein, 21 aa, Entamoeba invadens
NTVKSICNFCFTRCSNLVEIN

SEQ ID NO: 2959542 - protein, 18 aa, Entamoeba invadens
NTVLRCISEVAVKMDDTF

SEQ ID NO: 2959543 - protein, 24 aa, Entamoeba invadens
NTVMTCADDFYVLKECEKGSELLK

SEQ ID NO: 2959544 - protein, 24 aa, Entamoeba invadens
NTVQELLKLPGIGPYTANAVFIFS

SEQ ID NO: 2959545 - protein, 17 aa, Entamoeba invadens
NTVRFLGEKCFARSTGL

SEQ ID NO: 2959546 - protein, 24 aa, Entamoeba invadens
NTVTLPKFDFSIVVFSNSSSQNTN

SEQ ID NO: 2959547 - protein, 18 aa, Entamoeba invadens
NTWVGKKIFSLLRQMVGF

SEQ ID NO: 2959548 - protein, 18 aa, Entamoeba invadens
NTWVSDKNSFVIFRSEGV

SEQ ID NO: 2959549 - protein, 22 aa, Entamoeba invadens
NTYLLCFDDYGSVFGVFLKNAI

SEQ ID NO: 2959550 - protein, 20 aa, Entamoeba invadens
NVACKCCRRKFHKQCIFTWF

SEQ ID NO: 2959551 - protein, 17 aa, Entamoeba invadens
NVAESLSSREVMSQKLE

SEQ ID NO: 2959552 - protein, 22 aa, Entamoeba invadens
NVAFKAAKKMLSKDATKKKRAH

SEQ ID NO: 2959553 - protein, 21 aa, Entamoeba invadens
NVAFKAAKKMLSKDSTNKKKR

SEQ ID NO: 2959554 - protein, 19 aa, Entamoeba invadens
NVAFSREDVKLFGGEIPTS

SEQ ID NO: 2959555 - protein, 20 aa, Entamoeba invadens
NVAGKWKFVAQISHCHVDGA

SEQ ID NO: 2959556 - protein, 26 aa, Entamoeba invadens
NVAIRECLLDLLKRLLVYDPSSRLTP

SEQ ID NO: 2959557 - protein, 19 aa, Entamoeba invadens
NVAQGGRTFNCQNLHKIDP

SEQ ID NO: 2959558 - protein, 21 aa, Entamoeba invadens
NVASKVKRRIYIRVVEDELNE

SEQ ID NO: 2959559 - protein, 22 aa, Entamoeba invadens
NVASKVKRRIYIRVVEDELNES

SEQ ID NO: 2959560 - protein, 25 aa, Entamoeba invadens
NVCIPMKRIQTANVNGVFYTAEKIL

SEQ ID NO: 2959561 - protein, 17 aa, Entamoeba invadens
NVCKKNKEPNCIVQNSF

SEQ ID NO: 2959562 - protein, 25 aa, Entamoeba invadens
NVCTDCITETLILEGNFFVATQSTN

SEQ ID NO: 2959563 - protein, 18 aa, Entamoeba invadens
NVDDGFLEACCRGLKAGL

SEQ ID NO: 2959564 - protein, 17 aa, Entamoeba invadens
NVDLEYFMYKIAYICRL

SEQ ID NO: 2959565 - protein, 30 aa, Entamoeba invadens
NVDVKLPMIRRLEINASRHAFDLKYLSTLE

SEQ ID NO: 2959566 - protein, 26 aa, Entamoeba invadens
NVEDMLRAKFGMYGVIEKITRIENAK

SEQ ID NO: 2959567 - protein, 29 aa, Entamoeba invadens
NVEDVVECIGWYGKEFLCYEFYAEKMQGM

SEQ ID NO: 2959568 - protein, 24 aa, Entamoeba invadens
NVEGKFDFCLPIPSTVYPNCKRLA

SEQ ID NO: 2959569 - protein, 24 aa, Entamoeba invadens
NVEKLKRIVQIIGLDQKCPLVLVN

SEQ ID NO: 2959570 - protein, 24 aa, Entamoeba invadens
NVEKVCQTLCDILDKTDFWGDGVF

SEQ ID NO: 2959571 - protein, 23 aa, Entamoeba invadens
NVETVVLKKCIRVTFDEKTQFEK

SEQ ID NO: 2959572 - protein, 17 aa, Entamoeba invadens
NVEVIGCDMRKMNMPNK

SEQ ID NO: 2959573 - protein, 22 aa, Entamoeba invadens
NVEVVALVFKKFLRNLPVRIFN

SEQ ID NO: 2959574 - protein, 25 aa, Entamoeba invadens
NVFCPNPKCGRAIVVLSSEQTSNNI

SEQ ID NO: 2959575 - protein, 23 aa, Entamoeba invadens
NVFDCLPIAAIVSRTTGDFFCSH

SEQ ID NO: 2959576 - protein, 22 aa, Entamoeba invadens
NVFDLFLKKRCEGEKQNMVSVK

SEQ ID NO: 2959577 - protein, 20 aa, Entamoeba invadens
NVFENCSSLRGFQVGGHHTA

SEQ ID NO: 2959578 - protein, 17 aa, Entamoeba invadens
NVFESTELVVICKAAMD

SEQ ID NO: 2959579 - protein, 24 aa, Entamoeba invadens
NVFFKRFVLNKVNILIPLKRCLKL

SEQ ID NO: 2959580 - protein, 24 aa, Entamoeba invadens
NVFIKVLICGEVGSGKKSLINALN

SEQ ID NO: 2959581 - protein, 19 aa, Entamoeba invadens
NVFKEGIVRVLLVTIDQLN

SEQ ID NO: 2959582 - protein, 20 aa, Entamoeba invadens
NVFKMFSINFVKVVECMDQS

SEQ ID NO: 2959583 - protein, 26 aa, Entamoeba invadens
NVFMKDLFRLSGSYLGKFVFAETEAV

SEQ ID NO: 2959584 - protein, 17 aa, Entamoeba invadens
NVFMLYVVFVRNCLECV

SEQ ID NO: 2959585 - protein, 21 aa, Entamoeba invadens
NVFNFSEQFIIKTVGTRAGEC

SEQ ID NO: 2959586 - protein, 19 aa, Entamoeba invadens
NVFNPDKPFTEWLESKNKE

SEQ ID NO: 2959587 - protein, 17 aa, Entamoeba invadens
NVFNPPPPSPRVIDRSE

SEQ ID NO: 2959588 - protein, 25 aa, Entamoeba invadens
NVFNPRFKYGRLMTDEDFKEEMRTE

SEQ ID NO: 2959589 - protein, 24 aa, Entamoeba invadens
NVFPQCQKCGALLTTKSLCPICEQ

SEQ ID NO: 2959590 - protein, 22 aa, Entamoeba invadens
NVFSFEDCEPFTIQYEPMVKQC

SEQ ID NO: 2959591 - protein, 19 aa, Entamoeba invadens
NVFTSEMIEYFTVPEVDRF

SEQ ID NO: 2959592 - protein, 21 aa, Entamoeba invadens
NVFTSEMIEYFTVPEVDRFLV

SEQ ID NO: 2959593 - protein, 18 aa, Entamoeba invadens
NVFVTRLPKEITHDTFLE

SEQ ID NO: 2959594 - protein, 20 aa, Entamoeba invadens
NVFYGLKFYKDEGMKDEQLL

SEQ ID NO: 2959595 - protein, 17 aa, Entamoeba invadens
NVGCSMIHSVIATRNVQ

SEQ ID NO: 2959596 - protein, 17 aa, Entamoeba invadens
NVGCWYQVGDGVAQDSN

SEQ ID NO: 2959597 - protein, 23 aa, Entamoeba invadens
NVGEHLFKMAACEMEKKNILERK

SEQ ID NO: 2959598 - protein, 20 aa, Entamoeba invadens
NVGGCLVCNNSYYPKYPDCI

SEQ ID NO: 2959599 - protein, 17 aa, Entamoeba invadens
NVGGFKAAPSGLKEGYV

SEQ ID NO: 2959600 - protein, 17 aa, Entamoeba invadens
NVGKTCMLMCYTSDEFP

SEQ ID NO: 2959601 - protein, 22 aa, Entamoeba invadens
NVGLILRSRCLGYCDDVADVFD

SEQ ID NO: 2959602 - protein, 33 aa, Entamoeba invadens
NVGRCERFEENAFRNCVVLKLSINEMNVKVARN

SEQ ID NO: 2959603 - protein, 19 aa, Entamoeba invadens
NVHFIKIAGCSNVRNLNIP

SEQ ID NO: 2959604 - protein, 19 aa, Entamoeba invadens
NVHIKSNMVSIFYRPPESF

SEQ ID NO: 2959605 - protein, 23 aa, Entamoeba invadens
NVHLKCFVCKTPIQSNFGFTCVW

SEQ ID NO: 2959606 - protein, 26 aa, Entamoeba invadens
NVHLKLPVIQAQLFSLIGDFKMNNLD

SEQ ID NO: 2959607 - protein, 19 aa, Entamoeba invadens
NVICTIDLSSNFTIKSADI

SEQ ID NO: 2959608 - protein, 21 aa, Entamoeba invadens
NVIEIRKQFIIDSIAREIEKI

SEQ ID NO: 2959609 - protein, 19 aa, Entamoeba invadens
NVIGSIGLRCLCGDATMYG

SEQ ID NO: 2959610 - protein, 26 aa, Entamoeba invadens
NVIIGNRCLFGYETLSSVAIPTSVIM

SEQ ID NO: 2959611 - protein, 18 aa, Entamoeba invadens
NVILSGDQPVQWDVFDEL

SEQ ID NO: 2959612 - protein, 17 aa, Entamoeba invadens
NVINLRCYFGTKILNGF

SEQ ID NO: 2959613 - protein, 25 aa, Entamoeba invadens
NVIPKDKLEVIFLHFPDVSSINDAF

SEQ ID NO: 2959614 - protein, 22 aa, Entamoeba invadens
NVITLGRSCFAACLAVSKVCLP

SEQ ID NO: 2959615 - protein, 17 aa, Entamoeba invadens
NVKEIGLNLPISDESAR

SEQ ID NO: 2959616 - protein, 25 aa, Entamoeba invadens
NVKESKCELHRKMRRTTGYPLRLSL

SEQ ID NO: 2959617 - protein, 23 aa, Entamoeba invadens
NVKEVFEALTTLILQNKTLMDNL

SEQ ID NO: 2959618 - protein, 19 aa, Entamoeba invadens
NVKEVFPAVLNTLANIVIH

SEQ ID NO: 2959619 - protein, 20 aa, Entamoeba invadens
NVKFKARINREVLLMRTVKS

SEQ ID NO: 2959620 - protein, 22 aa, Entamoeba invadens
NVKGVGFMLARRAKRAEKSLQY

SEQ ID NO: 2959621 - protein, 24 aa, Entamoeba invadens
NVKKLPRYCFGKAICLKEINIPST

SEQ ID NO: 2959622 - protein, 20 aa, Entamoeba invadens
NVKLCELLRSYDCSKDVVSE

SEQ ID NO: 2959623 - protein, 21 aa, Entamoeba invadens
NVKNLGECFVYFNDDFILNRP

SEQ ID NO: 2959624 - protein, 20 aa, Entamoeba invadens
NVKNLGECFVYFNDDVLLTR

SEQ ID NO: 2959625 - protein, 26 aa, Entamoeba invadens
NVKNWKKRWFDFMSDGVLNYYTNRQE

SEQ ID NO: 2959626 - protein, 19 aa, Entamoeba invadens
NVKRPEGYMQRNVIGVMTC

SEQ ID NO: 2959627 - protein, 27 aa, Entamoeba invadens
NVKSLGDNCFRCCSSLSSIAIPSSVTS

SEQ ID NO: 2959628 - protein, 18 aa, Entamoeba invadens
NVKTCLGSEMLGVVEASL

SEQ ID NO: 2959629 - protein, 20 aa, Entamoeba invadens
NVKVCGEFKALNAAQIIISP

SEQ ID NO: 2959630 - protein, 18 aa, Entamoeba invadens
NVKVFKIVAASLLTQRNT

SEQ ID NO: 2959631 - protein, 27 aa, Entamoeba invadens
NVKVKELDKALAFFLRRNEYIKVLEVV

SEQ ID NO: 2959632 - protein, 18 aa, Entamoeba invadens
NVKYWVLTEEDLLVFDSV

SEQ ID NO: 2959633 - protein, 25 aa, Entamoeba invadens
NVLDRLSGGSWKLSNEQKKELQKIK

SEQ ID NO: 2959634 - protein, 19 aa, Entamoeba invadens
NVLDRVRMNPIQITPKTKN

SEQ ID NO: 2959635 - protein, 28 aa, Entamoeba invadens
NVLEKYLPTCFLLRQYLLLIQKPSDFSK

SEQ ID NO: 2959636 - protein, 20 aa, Entamoeba invadens
NVLELKSHFYSKISCTEDIC

SEQ ID NO: 2959637 - protein, 25 aa, Entamoeba invadens
NVLIPEFVTRIGIRSFEYCVSLKTI

SEQ ID NO: 2959638 - protein, 34 aa, Entamoeba invadens
NVLKQKEMELAAWRSGVVDTYLKSVFSKMEKKSK

SEQ ID NO: 2959639 - protein, 17 aa, Entamoeba invadens
NVLKRIKSSFVKSLGKV

SEQ ID NO: 2959640 - protein, 24 aa, Entamoeba invadens
NVLKRKECIPFRKHNGGVGRSGQT

SEQ ID NO: 2959641 - protein, 24 aa, Entamoeba invadens
NVLKRKECVPFRKHNGGVGRSAQT

SEQ ID NO: 2959642 - protein, 17 aa, Entamoeba invadens
NVLLFSCEICYEDKPYS

SEQ ID NO: 2959643 - protein, 24 aa, Entamoeba invadens
NVLLKEAVSFIVLNCTNVSECADL

SEQ ID NO: 2959644 - protein, 21 aa, Entamoeba invadens
NVLNELPLVYLNVLKTLIQFL

SEQ ID NO: 2959645 - protein, 29 aa, Entamoeba invadens
NVLPENYKNLVLFIVHFLKDFSKFSNETK

SEQ ID NO: 2959646 - protein, 25 aa, Entamoeba invadens
NVLRKGARNSRLWIHAMETENNIGK

SEQ ID NO: 2959647 - protein, 20 aa, Entamoeba invadens
NVLRRACEIEQQIMVQTSEY

SEQ ID NO: 2959648 - protein, 22 aa, Entamoeba invadens
NVLSEIALVYGIADKSIIKDVQ

SEQ ID NO: 2959649 - protein, 26 aa, Entamoeba invadens
NVLYDPKRLFGLVLDYIPKDEKKSFT

SEQ ID NO: 2959650 - protein, 18 aa, Entamoeba invadens
NVLYFKAIILGVKLALLD

SEQ ID NO: 2959651 - protein, 29 aa, Entamoeba invadens
NVLYIGKKCFAHCDALRTIIIGKGMNQLI

SEQ ID NO: 2959652 - protein, 17 aa, Entamoeba invadens
NVMCLRMLKKFKSTNGP

SEQ ID NO: 2959653 - protein, 22 aa, Entamoeba invadens
NVMGEMKSIFMGALPNNEQQNT

SEQ ID NO: 2959654 - protein, 19 aa, Entamoeba invadens
NVMKGRIGILKKSIEDDHK

SEQ ID NO: 2959655 - protein, 24 aa, Entamoeba invadens
NVMKTCKTLRGLVLGYDAVWKVMY

SEQ ID NO: 2959656 - protein, 29 aa, Entamoeba invadens
NVMQYLIGLCLRGGWNQVKVYPKFAKHLF

SEQ ID NO: 2959657 - protein, 17 aa, Entamoeba invadens
NVMTELWLTEESHVQSL

SEQ ID NO: 2959658 - protein, 17 aa, Entamoeba invadens
NVMVGVRNIEIAKKIVT

SEQ ID NO: 2959659 - protein, 23 aa, Entamoeba invadens
NVNEYTVALFLQFFTNNPAFVLH

SEQ ID NO: 2959660 - protein, 20 aa, Entamoeba invadens
NVNFAVSEFMTWVEDEERLS

SEQ ID NO: 2959661 - protein, 18 aa, Entamoeba invadens
NVNFCQLFKTGLMDEDFA

SEQ ID NO: 2959662 - protein, 26 aa, Entamoeba invadens
NVNFNLYSIDAFKVLLDPSVGGNEKF

SEQ ID NO: 2959663 - protein, 20 aa, Entamoeba invadens
NVNKKCFDALGMVRQYPYNL

SEQ ID NO: 2959664 - protein, 20 aa, Entamoeba invadens
NVNNYLKMRIENYIDKQNMT

SEQ ID NO: 2959665 - protein, 25 aa, Entamoeba invadens
NVNRSIGFVDIRMSTPVTFNYSERR

SEQ ID NO: 2959666 - protein, 23 aa, Entamoeba invadens
NVNVGVECLVVWVTNVGVHVSEI

SEQ ID NO: 2959667 - protein, 20 aa, Entamoeba invadens
NVPCLLVGTKLDLKYDKNTI

SEQ ID NO: 2959668 - protein, 17 aa, Entamoeba invadens
NVPELQHGAILVLTSLL

SEQ ID NO: 2959669 - protein, 25 aa, Entamoeba invadens
NVPFGCFDLLLARVELTKGPKGDEY

SEQ ID NO: 2959670 - protein, 22 aa, Entamoeba invadens
NVPKCVFPSIVGYSKTNETDIF

SEQ ID NO: 2959671 - protein, 25 aa, Entamoeba invadens
NVPLEAFSEFLAIHVDPKILENIKG

SEQ ID NO: 2959672 - protein, 24 aa, Entamoeba invadens
NVPLRQLLFTTLRCIIPYACDVFV

SEQ ID NO: 2959673 - protein, 25 aa, Entamoeba invadens
NVPMWKRGTFTLPFSYLNFPQKRVV

SEQ ID NO: 2959674 - protein, 23 aa, Entamoeba invadens
NVPRAFPSYILDGAYFGTTFANL

SEQ ID NO: 2959675 - protein, 25 aa, Entamoeba invadens
NVPTCGLDVIVFLDPKLGFQINDKQ

SEQ ID NO: 2959676 - protein, 17 aa, Entamoeba invadens
NVPVCVSPITQRYWNDN

SEQ ID NO: 2959677 - protein, 28 aa, Entamoeba invadens
NVPVNIRVALCFTPLFTTAAHFQIDAIF

SEQ ID NO: 2959678 - protein, 19 aa, Entamoeba invadens
NVQCFKSLINMNLPGEENS

SEQ ID NO: 2959679 - protein, 26 aa, Entamoeba invadens
NVQELGRLGGMKGLLTILDVLCTEIK

SEQ ID NO: 2959680 - protein, 28 aa, Entamoeba invadens
NVQGVDSWGVAAVMCYLFGTNITKKSMV

SEQ ID NO: 2959681 - protein, 20 aa, Entamoeba invadens
NVQIFECMTGVAIFNDANPL

SEQ ID NO: 2959682 - protein, 29 aa, Entamoeba invadens
NVQNSDVLLLEFCQYCELNSLVVKSLGGN

SEQ ID NO: 2959683 - protein, 18 aa, Entamoeba invadens
NVQSCFLNVFYLDTVSLQ

SEQ ID NO: 2959684 - protein, 23 aa, Entamoeba invadens
NVRDGTCVTVVFVTPTKIYTAQC

SEQ ID NO: 2959685 - protein, 18 aa, Entamoeba invadens
NVRGETPLFVAIAANQLE

SEQ ID NO: 2959686 - protein, 17 aa, Entamoeba invadens
NVRQCPIVLEIINHQIF

SEQ ID NO: 2959687 - protein, 23 aa, Entamoeba invadens
NVRRLHGLLDFPIVSQKEFDENE

SEQ ID NO: 2959688 - protein, 25 aa, Entamoeba invadens
NVSCTPLTMQICNGEIPPIVNSLKK

SEQ ID NO: 2959689 - protein, 23 aa, Entamoeba invadens
NVSDLFLQRCELYVIDSMQANDL

SEQ ID NO: 2959690 - protein, 18 aa, Entamoeba invadens
NVSHNLFQPLTLQQKEYP

SEQ ID NO: 2959691 - protein, 25 aa, Entamoeba invadens
NVSKKEIRKFLELIGQKYTDDEFET

SEQ ID NO: 2959692 - protein, 27 aa, Entamoeba invadens
NVSKKLFYRIIVWFGVDFETVDKNKTQ

SEQ ID NO: 2959693 - protein, 28 aa, Entamoeba invadens
NVSLYFKSQETILCFIQVNKKCLLSVTS

SEQ ID NO: 2959694 - protein, 26 aa, Entamoeba invadens
NVSMWEIPKAFFLVDAHRRYFDAAFR

SEQ ID NO: 2959695 - protein, 25 aa, Entamoeba invadens
NVSPECRNPLLSIHFKKFLILDKLY

SEQ ID NO: 2959696 - protein, 22 aa, Entamoeba invadens
NVTAIVRLLIRVSYTVQKEDTA

SEQ ID NO: 2959697 - protein, 17 aa, Entamoeba invadens
NVTEHIFDFLPLESLLC

SEQ ID NO: 2959698 - protein, 24 aa, Entamoeba invadens
NVTESWGRMPVLKPREKYVEKKVL

SEQ ID NO: 2959699 - protein, 24 aa, Entamoeba invadens
NVTFGDKEAFVFTLKENGKKKCGK

SEQ ID NO: 2959700 - protein, 25 aa, Entamoeba invadens
NVTGFPRLKKVKIHDSNNVKIDLEK

SEQ ID NO: 2959701 - protein, 17 aa, Entamoeba invadens
NVTGIGINSFFDCKSLS

SEQ ID NO: 2959702 - protein, 19 aa, Entamoeba invadens
NVTGKLHIGHALTNSIQDT

SEQ ID NO: 2959703 - protein, 26 aa, Entamoeba invadens
NVTIWNCTHISYLNTICDCISEVNLK

SEQ ID NO: 2959704 - protein, 17 aa, Entamoeba invadens
NVTKLGNKCFKNCKLLS

SEQ ID NO: 2959705 - protein, 19 aa, Entamoeba invadens
NVTKSAFRPTFICNNFSSN

SEQ ID NO: 2959706 - protein, 18 aa, Entamoeba invadens
NVTLKDGCFEDCSSLSKV

SEQ ID NO: 2959707 - protein, 18 aa, Entamoeba invadens
NVTLPIYYVPVAISVVNN

SEQ ID NO: 2959708 - protein, 22 aa, Entamoeba invadens
NVTLPIYYVPVAISYVNNTPFA

SEQ ID NO: 2959709 - protein, 26 aa, Entamoeba invadens
NVTREAFVFTFRCYTEQNVVLQKFLE

SEQ ID NO: 2959710 - protein, 26 aa, Entamoeba invadens
NVTSIGYNCFRGCISLSSVTIPSNVS

SEQ ID NO: 2959711 - protein, 26 aa, Entamoeba invadens
NVTSRLKVGGIFLGTTVNAYRVVKKL

SEQ ID NO: 2959712 - protein, 25 aa, Entamoeba invadens
NVTTREAMCAWDWKMRSIEGDERFG

SEQ ID NO: 2959713 - protein, 17 aa, Entamoeba invadens
NVVDFVWSNDAFLESQE

SEQ ID NO: 2959714 - protein, 24 aa, Entamoeba invadens
NVVDLLKRLSALREQKVYDTYENE

SEQ ID NO: 2959715 - protein, 18 aa, Entamoeba invadens
NVVDLRYNALKIINTVIS

SEQ ID NO: 2959716 - protein, 19 aa, Entamoeba invadens
NVVEFWKYWMDSTPQPDAL

SEQ ID NO: 2959717 - protein, 22 aa, Entamoeba invadens
NVVEVLRVFGLELSEKTKSGRT

SEQ ID NO: 2959718 - protein, 25 aa, Entamoeba invadens
NVVFASAIDGWGFDLEMISTIYSKR

SEQ ID NO: 2959719 - protein, 17 aa, Entamoeba invadens
NVVKCIDTGVVVSVGKK

SEQ ID NO: 2959720 - protein, 19 aa, Entamoeba invadens
NVVKCWNRKILTGGEDKGL

SEQ ID NO: 2959721 - protein, 23 aa, Entamoeba invadens
NVVKIPYGCFVNCYSLETLTLPK

SEQ ID NO: 2959722 - protein, 23 aa, Entamoeba invadens
NVVKISYCCFVNCFNLKTIELPT

SEQ ID NO: 2959723 - protein, 23 aa, Entamoeba invadens
NVVKRKWADTTLQPLLKKCEKEN

SEQ ID NO: 2959724 - protein, 19 aa, Entamoeba invadens
NVVLKCFNEIEAMRTQHIG

SEQ ID NO: 2959725 - protein, 18 aa, Entamoeba invadens
NVVLYFKTIDDIRSFVFV

SEQ ID NO: 2959726 - protein, 26 aa, Entamoeba invadens
NVVMREMMPSFKYLFSHLIDLVSTCG

SEQ ID NO: 2959727 - protein, 23 aa, Entamoeba invadens
NVVRRKTIHLVVFETLKKLIKEH

SEQ ID NO: 2959728 - protein, 21 aa, Entamoeba invadens
NVYALALIFWQTFSQKPLFEE

SEQ ID NO: 2959729 - protein, 17 aa, Entamoeba invadens
NVYGFNMTPMRAQVLNE

SEQ ID NO: 2959730 - protein, 29 aa, Entamoeba invadens
NVYLQKACDLCIKDLISLCELVLNLDNYK

SEQ ID NO: 2959731 - protein, 21 aa, Entamoeba invadens
NVYPVCDICAPGYNLNSNNEF

SEQ ID NO: 2959732 - protein, 21 aa, Entamoeba invadens
NWDGKAGYLLLKSERTGKTKR

SEQ ID NO: 2959733 - protein, 24 aa, Entamoeba invadens
NWDYKPKLITSWRGIPKPVVSQAV

SEQ ID NO: 2959734 - protein, 26 aa, Entamoeba invadens
NWEGVKGMWAKGFFMFQWADNSLPIA

SEQ ID NO: 2959735 - protein, 26 aa, Entamoeba invadens
NWGTSEYKDVEVLPRYKEWAEEAHKI

SEQ ID NO: 2959736 - protein, 21 aa, Entamoeba invadens
NWICPLCNSRNQLPNDPRCYQ

SEQ ID NO: 2959737 - protein, 18 aa, Entamoeba invadens
NWINFLLYRDWKNIIKPD

SEQ ID NO: 2959738 - protein, 31 aa, Entamoeba invadens
NWKAPKLGKKSILRKGEYAYEPEINNINELT

SEQ ID NO: 2959739 - protein, 24 aa, Entamoeba invadens
NWKQKLIAWHLYKVYANFSAETVD

SEQ ID NO: 2959740 - protein, 21 aa, Entamoeba invadens
NWKSINFTCGCELYTNYWNYY

SEQ ID NO: 2959741 - protein, 19 aa, Entamoeba invadens
NWMKGMVQAALYAPFDLIF

SEQ ID NO: 2959742 - protein, 25 aa, Entamoeba invadens
NWMSRQCVLLLPGHEHYVMSAYFHP

SEQ ID NO: 2959743 - protein, 20 aa, Entamoeba invadens
NWNRGAEDWELLRTSMEKHF

SEQ ID NO: 2959744 - protein, 26 aa, Entamoeba invadens
NWNTVHPLFQFKSLPVQVVLRLQTKH

SEQ ID NO: 2959745 - protein, 28 aa, Entamoeba invadens
NWQKSEVFTKFIIRQEIDEMMTYAKVKQ

SEQ ID NO: 2959746 - protein, 51 aa, Entamoeba invadens
NWQTFMFEYFMLWFCRKFPVELEVRVLDIIFLEGWEIVFSFFSTILHFSKE

SEQ ID NO: 2959747 - protein, 17 aa, Entamoeba invadens
NWSKTVSVHPLFTQSRP

SEQ ID NO: 2959748 - protein, 19 aa, Entamoeba invadens
NWSQYRTATVGGWPSKFTP

SEQ ID NO: 2959749 - protein, 25 aa, Entamoeba invadens
NWTSDENFFVFSLLRGGVPVYGFYK

SEQ ID NO: 2959750 - protein, 23 aa, Entamoeba invadens
NWVGMRYGGVVFDSEVDAMNSST

SEQ ID NO: 2959751 - protein, 25 aa, Entamoeba invadens
NWYWSLVGYCVASYVLGLADRHNDN

SEQ ID NO: 2959752 - protein, 31 aa, Entamoeba invadens
NYAFSCCYNSCFSGCIKWSKVELPESLTTMG

SEQ ID NO: 2959753 - protein, 23 aa, Entamoeba invadens
NYAGDTPLHFAVNCYLSDTEIGT

SEQ ID NO: 2959754 - protein, 23 aa, Entamoeba invadens
NYCFYECSRLTSVTIPSSVTSIG

SEQ ID NO: 2959755 - protein, 23 aa, Entamoeba invadens
NYDDRKRLVVGSIKTLFENKKKS

SEQ ID NO: 2959756 - protein, 34 aa, Entamoeba invadens
NYDLFKLAIKVSAKRLFPNFVFLDAPFNKKYYKK

SEQ ID NO: 2959757 - protein, 19 aa, Entamoeba invadens
NYDVMVCIMQIFTTACMFR

SEQ ID NO: 2959758 - protein, 24 aa, Entamoeba invadens
NYEKKRYDQFVGIYADCVTLSGND

SEQ ID NO: 2959759 - protein, 20 aa, Entamoeba invadens
NYFHGWRIAAKQVVSVRDNI

SEQ ID NO: 2959760 - protein, 28 aa, Entamoeba invadens
NYFILRFPPDFFTDIKIYRVHSEVLQTL

SEQ ID NO: 2959761 - protein, 25 aa, Entamoeba invadens
NYFWKELFASIPMWIFNDSLRRHCA

SEQ ID NO: 2959762 - protein, 42 aa, Entamoeba invadens
NYGEVPNGQKKECVQILQLLNAHRRTIDWMNTTAEEISQGLA

SEQ ID NO: 2959763 - protein, 23 aa, Entamoeba invadens
NYGLLKTPFHLIADSQTCCGETH

SEQ ID NO: 2959764 - protein, 21 aa, Entamoeba invadens
NYGLMEGVALWTLKKPFNEVI

SEQ ID NO: 2959765 - protein, 34 aa, Entamoeba invadens
NYGMRIREWYGWHFPELSKFVADQLSYCELVVKI

SEQ ID NO: 2959766 - protein, 26 aa, Entamoeba invadens
NYHIFPLVMIWLEFGNEKCIEICLQI

SEQ ID NO: 2959767 - protein, 20 aa, Entamoeba invadens
NYHIFYQCWLNKTSPNEIMV

SEQ ID NO: 2959768 - protein, 24 aa, Entamoeba invadens
NYHTEPRCCLSVPQEDLIIHRLTE

SEQ ID NO: 2959769 - protein, 19 aa, Entamoeba invadens
NYIALRLLFELKVQRNFIN

SEQ ID NO: 2959770 - protein, 20 aa, Entamoeba invadens
NYICLGICRKYSRFVQNEFF

SEQ ID NO: 2959771 - protein, 18 aa, Entamoeba invadens
NYIELGYYQLCGVLIYIF

SEQ ID NO: 2959772 - protein, 25 aa, Entamoeba invadens
NYIFAVTSAFGFWKTQLFDDNSGYI

SEQ ID NO: 2959773 - protein, 31 aa, Entamoeba invadens
NYIKKFENATCDMKTMNMCHVNVRSRKYAKT

SEQ ID NO: 2959774 - protein, 31 aa, Entamoeba invadens
NYIKKFENATCDMKTVNMCHVNVKSRKYAKS

SEQ ID NO: 2959775 - protein, 18 aa, Entamoeba invadens
NYIKNCGRVINELITRER

SEQ ID NO: 2959776 - protein, 23 aa, Entamoeba invadens
NYIKTIRLNGEMYANSTAEEIEA

SEQ ID NO: 2959777 - protein, 23 aa, Entamoeba invadens
NYILSIGDKCFSNCPTLVDINIP

SEQ ID NO: 2959778 - protein, 26 aa, Entamoeba invadens
NYISEYGIRLLLLTGKTDERSVKLQS

SEQ ID NO: 2959779 - protein, 19 aa, Entamoeba invadens
NYISQLFLQNVLPLFFEEY

SEQ ID NO: 2959780 - protein, 24 aa, Entamoeba invadens
NYISYCKEYCVPRLTESASSKLAD

SEQ ID NO: 2959781 - protein, 23 aa, Entamoeba invadens
NYIYRGNMWTAFASEKMGKTFYY

SEQ ID NO: 2959782 - protein, 23 aa, Entamoeba invadens
NYIYRGNMWTAYAPDKMGKTFYY

SEQ ID NO: 2959783 - protein, 23 aa, Entamoeba invadens
NYIYRGNMWTAYAPEKMGKTFYY

SEQ ID NO: 2959784 - protein, 21 aa, Entamoeba invadens
NYKDFLLRNLPSIEFGQDLYI

SEQ ID NO: 2959785 - protein, 29 aa, Entamoeba invadens
NYKFSDEQLKFFFLYLITRLEPISNTNFS

SEQ ID NO: 2959786 - protein, 25 aa, Entamoeba invadens
NYKNLKKFLCMNSMRYISFFDNNQK

SEQ ID NO: 2959787 - protein, 25 aa, Entamoeba invadens
NYKPFICFNCGGYGHKSSECVNLKK

SEQ ID NO: 2959788 - protein, 20 aa, Entamoeba invadens
NYKPSMVIERFLKTVQRVRT

SEQ ID NO: 2959789 - protein, 18 aa, Entamoeba invadens
NYKTFAIKYACRNNSVFD

SEQ ID NO: 2959790 - protein, 19 aa, Entamoeba invadens
NYKYLRVMLLQPHNQVCAD

SEQ ID NO: 2959791 - protein, 17 aa, Entamoeba invadens
NYLCTFPQLSHTFTQET

SEQ ID NO: 2959792 - protein, 18 aa, Entamoeba invadens
NYLIFSLDINDCVNAKLT

SEQ ID NO: 2959793 - protein, 18 aa, Entamoeba invadens
NYLKRRSANDIVAIYVKM

SEQ ID NO: 2959794 - protein, 32 aa, Entamoeba invadens
NYLLRLNYFALQGICINDGYIFIEQAEFLNTL

SEQ ID NO: 2959795 - protein, 23 aa, Entamoeba invadens
NYLMRIVEVDLMFHSDLQLTVLI

SEQ ID NO: 2959796 - protein, 20 aa, Entamoeba invadens
NYLREIKLVLVNTEGSEELV

SEQ ID NO: 2959797 - protein, 25 aa, Entamoeba invadens
NYLRVNCWREIITVICYVIEEGFLE

SEQ ID NO: 2959798 - protein, 20 aa, Entamoeba invadens
NYLSGLLVALYYNASFLSKC

SEQ ID NO: 2959799 - protein, 17 aa, Entamoeba invadens
NYLSKMYNFFGSAYQLS

SEQ ID NO: 2959800 - protein, 21 aa, Entamoeba invadens
NYLSVFVKKQIDVMHQSCKTL

SEQ ID NO: 2959801 - protein, 25 aa, Entamoeba invadens
NYLYTKGCGTYGIFRDTTQKMKIEV

SEQ ID NO: 2959802 - protein, 23 aa, Entamoeba invadens
NYNERCKYAFITSFFPPNGSQDD

SEQ ID NO: 2959803 - protein, 17 aa, Entamoeba invadens
NYNFGVSVLQKIDLEPV

SEQ ID NO: 2959804 - protein, 20 aa, Entamoeba invadens
NYNIPMMVMFPYDYPIKPPF

SEQ ID NO: 2959805 - protein, 17 aa, Entamoeba invadens
NYNKCYEISTVFDAEKM

SEQ ID NO: 2959806 - protein, 20 aa, Entamoeba invadens
NYNLPLKLTAFQVINKIIEK

SEQ ID NO: 2959807 - protein, 19 aa, Entamoeba invadens
NYNTVRLVDHFLYHSHLCI

SEQ ID NO: 2959808 - protein, 25 aa, Entamoeba invadens
NYPESYRFPSRLDLSDEVKDLIRHL

SEQ ID NO: 2959809 - protein, 26 aa, Entamoeba invadens
NYPNLLEVFKAASLPLAQNYLQTLIN

SEQ ID NO: 2959810 - protein, 18 aa, Entamoeba invadens
NYPRRRTMEDAHFIMDPL

SEQ ID NO: 2959811 - protein, 20 aa, Entamoeba invadens
NYQICAWSGMGVYVNDVGNT

SEQ ID NO: 2959812 - protein, 19 aa, Entamoeba invadens
NYRIKLYRDFLIKNNFKYN

SEQ ID NO: 2959813 - protein, 21 aa, Entamoeba invadens
NYRKESSKVIVWIADAPPHGF

SEQ ID NO: 2959814 - protein, 23 aa, Entamoeba invadens
NYRLKSGLHPSVYISAPKLKELE

SEQ ID NO: 2959815 - protein, 19 aa, Entamoeba invadens
NYRQLKFQLAISFSLANGA

SEQ ID NO: 2959816 - protein, 20 aa, Entamoeba invadens
NYRSWDQAELAVFTKRLESY

SEQ ID NO: 2959817 - protein, 18 aa, Entamoeba invadens
NYRVYEQGVLLAILNRHF

SEQ ID NO: 2959818 - protein, 20 aa, Entamoeba invadens
NYSDSMLFKIQGLLNDNTNT

SEQ ID NO: 2959819 - protein, 18 aa, Entamoeba invadens
NYSLCYDKIPNFEHLIHG

SEQ ID NO: 2959820 - protein, 18 aa, Entamoeba invadens
NYSLKFDTIKSFQLGKFS

SEQ ID NO: 2959821 - protein, 22 aa, Entamoeba invadens
NYSPLRKCYFVEEGVEVDFLTQ

SEQ ID NO: 2959822 - protein, 19 aa, Entamoeba invadens
NYTIFLTFLDNMRHAFATS

SEQ ID NO: 2959823 - protein, 19 aa, Entamoeba invadens
NYTNWIRQLIQLIKDTPFD

SEQ ID NO: 2959824 - protein, 17 aa, Entamoeba invadens
NYTQRMCSTCSGEKTQE

SEQ ID NO: 2959825 - protein, 19 aa, Entamoeba invadens
NYTVLKFGKLTVLKSVCIN

SEQ ID NO: 2959826 - protein, 18 aa, Entamoeba invadens
NYVECAKLILGQLTLPFV

SEQ ID NO: 2959827 - protein, 17 aa, Entamoeba invadens
NYVGFIAAGSESKRILV

SEQ ID NO: 2959828 - protein, 25 aa, Entamoeba invadens
NYVGMSFNFLKMVIRRAYDGSLSYQ

SEQ ID NO: 2959829 - protein, 34 aa, Entamoeba invadens
NYVHLPVKCFQYFKALKTVNVWSHKDFQDIFNYY

SEQ ID NO: 2959830 - protein, 26 aa, Entamoeba invadens
NYVRCANCGCTGCASKSKCKDEDNDV

SEQ ID NO: 2959831 - protein, 19 aa, Entamoeba invadens
NYVSIPITTCHLHIYDCDT

SEQ ID NO: 2959832 - protein, 26 aa, Entamoeba invadens
NYVTKIGRKCFKGCDSLAEIVLPKSI

SEQ ID NO: 2959833 - protein, 17 aa, Entamoeba invadens
NYYKKKDIGRCYGNKDA

SEQ ID NO: 2959834 - protein, 24 aa, Entamoeba invadens
NYYLKDFLCVLTLFDSECISKGKI

SEQ ID NO: 2959835 - protein, 25 aa, Entamoeba invadens
NYYLYPSPLKGVAPLDCVNDKCTPS

SEQ ID NO: 2959836 - protein, 24 aa, Entamoeba invadens
NYYYTAHFFPNFGDKGLQNRITLE

SEQ ID NO: 2959837 - protein, 25 aa, Entamoeba invadens
PAAAPAMNPFGGFNPAAVKLKKAGA

SEQ ID NO: 2959838 - protein, 22 aa, Entamoeba invadens
PAACYMKTILEQDGCSSKHYYY

SEQ ID NO: 2959839 - protein, 19 aa, Entamoeba invadens
PAAEKVVFDFTFPDDENQA

SEQ ID NO: 2959840 - protein, 26 aa, Entamoeba invadens
PAAFAKFYLNDAFKCHVCKKPCDPLI

SEQ ID NO: 2959841 - protein, 27 aa, Entamoeba invadens
PACSITACRVRFCISAAHTDADMEKAF

SEQ ID NO: 2959842 - protein, 21 aa, Entamoeba invadens
PACTKETLENVIQWIDSEEVL

SEQ ID NO: 2959843 - protein, 19 aa, Entamoeba invadens
PADFLSLIQVCKKFVFLLD

SEQ ID NO: 2959844 - protein, 18 aa, Entamoeba invadens
PADLEFDSLPFLSNLKSI

SEQ ID NO: 2959845 - protein, 19 aa, Entamoeba invadens
PADLFSFAITMLECLLWDN

SEQ ID NO: 2959846 - protein, 23 aa, Entamoeba invadens
PADLPAMTFCYILNPESEDVIKV

SEQ ID NO: 2959847 - protein, 25 aa, Entamoeba invadens
PADQTWVKCGFYLSIYNGNLYSEKI

SEQ ID NO: 2959848 - protein, 27 aa, Entamoeba invadens
PADSYSEFKRLALLLTNLPTKRLRDVS

SEQ ID NO: 2959849 - protein, 23 aa, Entamoeba invadens
PADTCYTYWIGATLKTLGCEALI

SEQ ID NO: 2959850 - protein, 27 aa, Entamoeba invadens
PADYKKMKFGVCLNKIQLVLTNENKVI

SEQ ID NO: 2959851 - protein, 25 aa, Entamoeba invadens
PAEFLLHVAHAIHWSDRKEVGRFIT

SEQ ID NO: 2959852 - protein, 17 aa, Entamoeba invadens
PAELYKGVRIDAEKLIN

SEQ ID NO: 2959853 - protein, 27 aa, Entamoeba invadens
PAESYTEFKRLALLLTNLPTKRLRDVS

SEQ ID NO: 2959854 - protein, 25 aa, Entamoeba invadens
PAFLEIFKLYLPALHVSDCQQNTPV

SEQ ID NO: 2959855 - protein, 25 aa, Entamoeba invadens
PAGELPWPSIVKRIVDQRTVILEIL

SEQ ID NO: 2959856 - protein, 23 aa, Entamoeba invadens
PAHEWYCRVCSYRLQLNKLTIPK

SEQ ID NO: 2959857 - protein, 21 aa, Entamoeba invadens
PAIKDELFSLILVEQAQKQTK

SEQ ID NO: 2959858 - protein, 25 aa, Entamoeba invadens
PAILKPKPLWTGKQVFTLILPPINY

SEQ ID NO: 2959859 - protein, 20 aa, Entamoeba invadens
PAIRCIAGLGLCDLFVNDKR

SEQ ID NO: 2959860 - protein, 18 aa, Entamoeba invadens
PAIVHKMVLEPGRPSEIR

SEQ ID NO: 2959861 - protein, 23 aa, Entamoeba invadens
PAKFYKVRCVVGVVRDTSEPNSR

SEQ ID NO: 2959862 - protein, 18 aa, Entamoeba invadens
PAKRLMFLVFDRTHTLLP

SEQ ID NO: 2959863 - protein, 20 aa, Entamoeba invadens
PAKSEARPLNALETKEKIIP

SEQ ID NO: 2959864 - protein, 18 aa, Entamoeba invadens
PALPEGDLDILLEKYYQD

SEQ ID NO: 2959865 - protein, 17 aa, Entamoeba invadens
PALPPPRKSTISIVPNT

SEQ ID NO: 2959866 - protein, 17 aa, Entamoeba invadens
PALRMFGNYPSSPYSQQ

SEQ ID NO: 2959867 - protein, 22 aa, Entamoeba invadens
PAMFKGPFELVNEFVNDEPLAN

SEQ ID NO: 2959868 - protein, 25 aa, Entamoeba invadens
PAMFRYNPIYLFSHFNFFPNVETYH

SEQ ID NO: 2959869 - protein, 20 aa, Entamoeba invadens
PAMLACFPLQDILSLRLKYI

SEQ ID NO: 2959870 - protein, 30 aa, Entamoeba invadens
PANTRLGAKRIHDVRCRFGIIKRRALRLDV

SEQ ID NO: 2959871 - protein, 42 aa, Entamoeba invadens
PANTRLGAKRIHDVRCRFGIIKRRALRLDVGYFTWVSQAMTK

SEQ ID NO: 2959872 - protein, 22 aa, Entamoeba invadens
PANVTRLGYFNTPFMVVTPHGT

SEQ ID NO: 2959873 - protein, 20 aa, Entamoeba invadens
PANVVLFNYKKFIDINAKLA

SEQ ID NO: 2959874 - protein, 17 aa, Entamoeba invadens
PAQIGWGTLGVDYVVES

SEQ ID NO: 2959875 - protein, 34 aa, Entamoeba invadens
PAQLRGYILGDTCGPFFQVKLLKLLRVMNPTNTN

SEQ ID NO: 2959876 - protein, 25 aa, Entamoeba invadens
PAQPKFYLTGAFLFSLMYAGSNIKE

SEQ ID NO: 2959877 - protein, 24 aa, Entamoeba invadens
PAQVKLLLDRTVSLFNWSDFSPKK

SEQ ID NO: 2959878 - protein, 19 aa, Entamoeba invadens
PAQYIKRFFQFIRKTVRTK

SEQ ID NO: 2959879 - protein, 22 aa, Entamoeba invadens
PARYNKTHFIFTSWYDEKRTDQ

SEQ ID NO: 2959880 - protein, 24 aa, Entamoeba invadens
PASAYLLYCQEVRPSVKEKNPEMK

SEQ ID NO: 2959881 - protein, 27 aa, Entamoeba invadens
PASFIFRGNSAFTRLFFYYLESSTQDF

SEQ ID NO: 2959882 - protein, 17 aa, Entamoeba invadens
PASLQWENKKGIFLGSE

SEQ ID NO: 2959883 - protein, 25 aa, Entamoeba invadens
PASPFPKLYLSPVAYLLPFVDAEIE

SEQ ID NO: 2959884 - protein, 22 aa, Entamoeba invadens
PASPQILFKWFSVVQSVAGDGC

SEQ ID NO: 2959885 - protein, 17 aa, Entamoeba invadens
PASYGIGNQTYFFVYNL

SEQ ID NO: 2959886 - protein, 17 aa, Entamoeba invadens
PATIAAVAICYVAENQG

SEQ ID NO: 2959887 - protein, 26 aa, Entamoeba invadens
PATIRNELLTGMKIYVGGKTKIQNHT

SEQ ID NO: 2959888 - protein, 29 aa, Entamoeba invadens
PATQRITAAVFWKSMRGEYLIVGLATGMI

SEQ ID NO: 2959889 - protein, 24 aa, Entamoeba invadens
PATREFLLRKAVNGERTSMFSTAF

SEQ ID NO: 2959890 - protein, 23 aa, Entamoeba invadens
PATRIGIAEAFGLPMGSQALHQL

SEQ ID NO: 2959891 - protein, 25 aa, Entamoeba invadens
PATTWPWYKLISAIKLFTFPPGVNR

SEQ ID NO: 2959892 - protein, 18 aa, Entamoeba invadens
PAVFCSIFGLSLDTKTPL

SEQ ID NO: 2959893 - protein, 17 aa, Entamoeba invadens
PAVGVLHPHHFYELQQC

SEQ ID NO: 2959894 - protein, 19 aa, Entamoeba invadens
PAVIRVLIVNKMKAYCTGF

SEQ ID NO: 2959895 - protein, 25 aa, Entamoeba invadens
PAVKGDYNVNCKLNRRHIANSPFKQ

SEQ ID NO: 2959896 - protein, 21 aa, Entamoeba invadens
PAVKPKASFLDDINKGGHILK

SEQ ID NO: 2959897 - protein, 33 aa, Entamoeba invadens
PAVTELFLQMFSLRALIPQAFSPIIQEIENATR

SEQ ID NO: 2959898 - protein, 20 aa, Entamoeba invadens
PAVYPNWKAGNALKNDDLFL

SEQ ID NO: 2959899 - protein, 20 aa, Entamoeba invadens
PAYIRQSALYFINTFVEYQL

SEQ ID NO: 2959900 - protein, 20 aa, Entamoeba invadens
PAYKYIYNVFVTRLPKEITH

SEQ ID NO: 2959901 - protein, 22 aa, Entamoeba invadens
PCAGAYTISLATNFNGFQSREH

SEQ ID NO: 2959902 - protein, 19 aa, Entamoeba invadens
PCDKCHLVDFLPYNCHYCH

SEQ ID NO: 2959903 - protein, 20 aa, Entamoeba invadens
PCEVPLKKNKMCTFTITLTP

SEQ ID NO: 2959904 - protein, 26 aa, Entamoeba invadens
PCGEVELKGGPIFKGYFHNPTETENA

SEQ ID NO: 2959905 - protein, 18 aa, Entamoeba invadens
PCGLIHFGENVVSGCDSL

SEQ ID NO: 2959906 - protein, 17 aa, Entamoeba invadens
PCKIALPPIEDRVLTSS

SEQ ID NO: 2959907 - protein, 18 aa, Entamoeba invadens
PCMAACPVNAISNTKDGV

SEQ ID NO: 2959908 - protein, 20 aa, Entamoeba invadens
PCNGFGHVLQRYNEITPAVQ

SEQ ID NO: 2959909 - protein, 17 aa, Entamoeba invadens
PCNIKKVPVKKGMCDAV

SEQ ID NO: 2959910 - protein, 21 aa, Entamoeba invadens
PCPICGELFPVTQIEQHANFC

SEQ ID NO: 2959911 - protein, 31 aa, Entamoeba invadens
PCQDNKFVISWGKIRINVGVSPSFNTEMRKT

SEQ ID NO: 2959912 - protein, 18 aa, Entamoeba invadens
PCSILLKDGLSFQDDIPK

SEQ ID NO: 2959913 - protein, 27 aa, Entamoeba invadens
PCSLKTLGKYCFKNCIKITSLDIPNFI

SEQ ID NO: 2959914 - protein, 20 aa, Entamoeba invadens
PCVIDPLLCSVDIDNVSMNE

SEQ ID NO: 2959915 - protein, 19 aa, Entamoeba invadens
PCVSDFPFVTVEFEAEKTI

SEQ ID NO: 2959916 - protein, 20 aa, Entamoeba invadens
PCVSESCPIVPKTHRPIFLV

SEQ ID NO: 2959917 - protein, 20 aa, Entamoeba invadens
PDALLDFSMKYQKDEEKVEM

SEQ ID NO: 2959918 - protein, 17 aa, Entamoeba invadens
PDAPFVISYNFKGAYKH

SEQ ID NO: 2959919 - protein, 24 aa, Entamoeba invadens
PDCFKNCRKLENFILPENVRYIGF

SEQ ID NO: 2959920 - protein, 20 aa, Entamoeba invadens
PDCGTELFSGLRNDKFVAQR

SEQ ID NO: 2959921 - protein, 24 aa, Entamoeba invadens
PDDEICYFIEVLSCDPNFSFFESE

SEQ ID NO: 2959922 - protein, 31 aa, Entamoeba invadens
PDDGYDYSKHFAERGWGVFVQQDGKILQPEN

SEQ ID NO: 2959923 - protein, 21 aa, Entamoeba invadens
PDDKPVCCFGKNCKLTNPLHR

SEQ ID NO: 2959924 - protein, 30 aa, Entamoeba invadens
PDDQCFECGIKILYEFFLIFVNAETKVDSF

SEQ ID NO: 2959925 - protein, 29 aa, Entamoeba invadens
PDDVDSGIYRRTQCLDFLSTSPTFLSSMN

SEQ ID NO: 2959926 - protein, 17 aa, Entamoeba invadens
PDDYCWRCICVHQSVQF

SEQ ID NO: 2959927 - protein, 24 aa, Entamoeba invadens
PDDYLKPYLRRSTLIKEIIEKNDP

SEQ ID NO: 2959928 - protein, 21 aa, Entamoeba invadens
PDDYRGVTTGWVWYNNPAPRP

SEQ ID NO: 2959929 - protein, 18 aa, Entamoeba invadens
PDEAFKIESRRSVRDRVN

SEQ ID NO: 2959930 - protein, 22 aa, Entamoeba invadens
PDEAYRCVLYFNEELKREINEL

SEQ ID NO: 2959931 - protein, 24 aa, Entamoeba invadens
PDEEVRIYALKCIDAMKDYELVDF

SEQ ID NO: 2959932 - protein, 21 aa, Entamoeba invadens
PDEFLSCVEQLILVDKEWMPE

SEQ ID NO: 2959933 - protein, 23 aa, Entamoeba invadens
PDEHAFEWLSNVMKTRGQKLDFS

SEQ ID NO: 2959934 - protein, 23 aa, Entamoeba invadens
PDEKLSSLFKWTRKSEYDILYDS

SEQ ID NO: 2959935 - protein, 29 aa, Entamoeba invadens
PDELPGIFKALLPHISHFDEVFRTRKSGG

SEQ ID NO: 2959936 - protein, 18 aa, Entamoeba invadens
PDELPNWVDRSCLENYLN

SEQ ID NO: 2959937 - protein, 25 aa, Entamoeba invadens
PDEYIPTCFIDFGKIVLIEKTPVDL

SEQ ID NO: 2959938 - protein, 24 aa, Entamoeba invadens
PDEYIPTCIIDFSKIVLIEKTPVD

SEQ ID NO: 2959939 - protein, 25 aa, Entamoeba invadens
PDEYRHLFCYIVSFIKKLKILGEEP

SEQ ID NO: 2959940 - protein, 18 aa, Entamoeba invadens
PDFDDIKGPFPYIHKDDK

SEQ ID NO: 2959941 - protein, 19 aa, Entamoeba invadens
PDFGETVYFEEQKQEEQSD

SEQ ID NO: 2959942 - protein, 20 aa, Entamoeba invadens
PDFLLIRGACMGVFGQNWKN

SEQ ID NO: 2959943 - protein, 17 aa, Entamoeba invadens
PDFLWEVPKILELGDDV

SEQ ID NO: 2959944 - protein, 26 aa, Entamoeba invadens
PDFTRKCLVCLDGFYLDATNHTCEPC

SEQ ID NO: 2959945 - protein, 18 aa, Entamoeba invadens
PDFYEFYVVIASQNARVF

SEQ ID NO: 2959946 - protein, 24 aa, Entamoeba invadens
PDGLMKIGEYCFSKCTTLEYLELP

SEQ ID NO: 2959947 - protein, 17 aa, Entamoeba invadens
PDGLPGKLDHTTIALVC

SEQ ID NO: 2959948 - protein, 21 aa, Entamoeba invadens
PDGPMKVVITNIIGLLATVNA

SEQ ID NO: 2959949 - protein, 26 aa, Entamoeba invadens
PDGRYLAIGVGYDWSYGVYGSSLMKE

SEQ ID NO: 2959950 - protein, 17 aa, Entamoeba invadens
PDGSSFPNGGLRNTHQA

SEQ ID NO: 2959951 - protein, 17 aa, Entamoeba invadens
PDHFLFAAVDGHLGNVV

SEQ ID NO: 2959952 - protein, 17 aa, Entamoeba invadens
PDHPCELSYTAKLITMV

SEQ ID NO: 2959953 - protein, 26 aa, Entamoeba invadens
PDIKTHIWKTFLAIPHILSEDNARGV

SEQ ID NO: 2959954 - protein, 25 aa, Entamoeba invadens
PDILFDLFANYDCEKNGLPILEEYL

SEQ ID NO: 2959955 - protein, 21 aa, Entamoeba invadens
PDILTRFLIDNNLKYLVRSHE

SEQ ID NO: 2959956 - protein, 19 aa, Entamoeba invadens
PDIQILFSPVFQKTPTILF

SEQ ID NO: 2959957 - protein, 18 aa, Entamoeba invadens
PDKCRVNSFLEVLNIKCA

SEQ ID NO: 2959958 - protein, 18 aa, Entamoeba invadens
PDKFCTNVQFLRNVKNPI

SEQ ID NO: 2959959 - protein, 19 aa, Entamoeba invadens
PDKFLKRLEVHKVRTKNGF

SEQ ID NO: 2959960 - protein, 23 aa, Entamoeba invadens
PDLCGIPKIAANIFEDRLYYKED

SEQ ID NO: 2959961 - protein, 23 aa, Entamoeba invadens
PDLCKSLKSGTVLCFVTKMIDDD

SEQ ID NO: 2959962 - protein, 18 aa, Entamoeba invadens
PDLDVVLFGVGFGPTNTQ

SEQ ID NO: 2959963 - protein, 21 aa, Entamoeba invadens
PDLEDGTILMRFVEQITTNFY

SEQ ID NO: 2959964 - protein, 22 aa, Entamoeba invadens
PDLFLQNHVELMKSPEEETRHF

SEQ ID NO: 2959965 - protein, 18 aa, Entamoeba invadens
PDLFNISAAESWEKINKG

SEQ ID NO: 2959966 - protein, 18 aa, Entamoeba invadens
PDLLHWDKEFPLKRCCSS

SEQ ID NO: 2959967 - protein, 19 aa, Entamoeba invadens
PDLQIGYFANYSEFSSIES

SEQ ID NO: 2959968 - protein, 25 aa, Entamoeba invadens
PDLRDRGLFYWRLLAHDPDLAKEMV

SEQ ID NO: 2959969 - protein, 24 aa, Entamoeba invadens
PDLSKMRIITCSNIGLYDHMNDPY

SEQ ID NO: 2959970 - protein, 17 aa, Entamoeba invadens
PDMKEKAVLNLPPILVR

SEQ ID NO: 2959971 - protein, 20 aa, Entamoeba invadens
PDMRIAFRASVAEDEVRAYE

SEQ ID NO: 2959972 - protein, 17 aa, Entamoeba invadens
PDMTDAFLVKNGIVEMK

SEQ ID NO: 2959973 - protein, 20 aa, Entamoeba invadens
PDNFLVFSIELNDLVNAKLT

SEQ ID NO: 2959974 - protein, 20 aa, Entamoeba invadens
PDNFLVFSLDLNQRVNAKLT

SEQ ID NO: 2959975 - protein, 23 aa, Entamoeba invadens
PDNFQGSILYMWNNKSIPDEVQR

SEQ ID NO: 2959976 - protein, 21 aa, Entamoeba invadens
PDNILMFSMDFFEKVNAKLTD

SEQ ID NO: 2959977 - protein, 21 aa, Entamoeba invadens
PDNILVFSMDFLEKVNAKLTD

SEQ ID NO: 2959978 - protein, 19 aa, Entamoeba invadens
PDNILVFSMDVNERVNAKL

SEQ ID NO: 2959979 - protein, 22 aa, Entamoeba invadens
PDNISRFGIECFSRCSSLSGIK

SEQ ID NO: 2959980 - protein, 19 aa, Entamoeba invadens
PDNLRFVGHHCFSCCAVQN

SEQ ID NO: 2959981 - protein, 22 aa, Entamoeba invadens
PDNQYKALCDFQSVIKVIETKR

SEQ ID NO: 2959982 - protein, 18 aa, Entamoeba invadens
PDNVCCIGISCFDNQGLL

SEQ ID NO: 2959983 - protein, 20 aa, Entamoeba invadens
PDNYGQLALHYAAAVGCDVD

SEQ ID NO: 2959984 - protein, 20 aa, Entamoeba invadens
PDNYGQLALHYAAAVGLPLE

SEQ ID NO: 2959985 - protein, 18 aa, Entamoeba invadens
PDPDEWPEFNTLKSSLKP

SEQ ID NO: 2959986 - protein, 18 aa, Entamoeba invadens
PDPIRLNIDPTRFVTITR

SEQ ID NO: 2959987 - protein, 17 aa, Entamoeba invadens
PDPRDVEIFPDLIRKKT

SEQ ID NO: 2959988 - protein, 20 aa, Entamoeba invadens
PDPSLKRGLFANQLSRRKRE

SEQ ID NO: 2959989 - protein, 34 aa, Entamoeba invadens
PDQFFDFSVCDKLRRLSLTYAFEIKSEPEKNIDP

SEQ ID NO: 2959990 - protein, 18 aa, Entamoeba invadens
PDQQNAVCLSILRPFATT

SEQ ID NO: 2959991 - protein, 25 aa, Entamoeba invadens
PDRKGRGVMVVSIPEGFGFGWCDVF

SEQ ID NO: 2959992 - protein, 21 aa, Entamoeba invadens
PDSASWRSVCEQISVYELPTK

SEQ ID NO: 2959993 - protein, 20 aa, Entamoeba invadens
PDSHRPFLLPIIKSKPVRTA

SEQ ID NO: 2959994 - protein, 23 aa, Entamoeba invadens
PDSLKVIKEYAFLYCGLTQITIP

SEQ ID NO: 2959995 - protein, 19 aa, Entamoeba invadens
PDSLSVLGNYCFIACSNLK

SEQ ID NO: 2959996 - protein, 20 aa, Entamoeba invadens
PDSPFYLPVEPINFKAVALP

SEQ ID NO: 2959997 - protein, 20 aa, Entamoeba invadens
PDSSRLLFSNGVDGSVCSML

SEQ ID NO: 2959998 - protein, 21 aa, Entamoeba invadens
PDSVLLSSLFIFGIELAQVKQ

SEQ ID NO: 2959999 - protein, 29 aa, Entamoeba invadens
PDTDKLVECYKLILDVAAWINEKKLYEEE

SEQ ID NO: 2960000 - protein, 20 aa, Entamoeba invadens
PDTEKCIIEGEGIKTGEVLV

SEQ ID NO: 2960001 - protein, 18 aa, Entamoeba invadens
PDTIRYIGNNAFSSCGNL

SEQ ID NO: 2960002 - protein, 18 aa, Entamoeba invadens
PDTKRTRTILNFFSSFLL

SEQ ID NO: 2960003 - protein, 20 aa, Entamoeba invadens
PDTNFLPSYFIVTFTTPQGT

SEQ ID NO: 2960004 - protein, 25 aa, Entamoeba invadens
PDTVKMFGEYCFAGCIALPEIHIPT

SEQ ID NO: 2960005 - protein, 24 aa, Entamoeba invadens
PDVERILSLVLFKMIDKDGNGTVD

SEQ ID NO: 2960006 - protein, 17 aa, Entamoeba invadens
PDVFDVFMHWLEYYDNN

SEQ ID NO: 2960007 - protein, 20 aa, Entamoeba invadens
PDVFFKAPFFIENKTFVVLN

SEQ ID NO: 2960008 - protein, 17 aa, Entamoeba invadens
PDVKKAAALQEQKDDIT

SEQ ID NO: 2960009 - protein, 21 aa, Entamoeba invadens
PDVLESIAIYCTDRTKKLVRG

SEQ ID NO: 2960010 - protein, 23 aa, Entamoeba invadens
PDVMLKEIKFIFVGEDSQSVHSL

SEQ ID NO: 2960011 - protein, 21 aa, Entamoeba invadens
PDVMMKHPFFKNMDFDLVLAK

SEQ ID NO: 2960012 - protein, 26 aa, Entamoeba invadens
PDVMYCSLYTRLLVLLLPHLKVLNTS

SEQ ID NO: 2960013 - protein, 23 aa, Entamoeba invadens
PDVPGVDLEKEWGLVENHAYTVI

SEQ ID NO: 2960014 - protein, 20 aa, Entamoeba invadens
PDVQKWRTTFDMYDANKDGL

SEQ ID NO: 2960015 - protein, 22 aa, Entamoeba invadens
PDVRNELYGNIVIAGGNTMIPG

SEQ ID NO: 2960016 - protein, 23 aa, Entamoeba invadens
PDVRNELYGNIVLAGGNTMMPGF

SEQ ID NO: 2960017 - protein, 22 aa, Entamoeba invadens
PDVSRLTSYIVDFAVTDVERGE

SEQ ID NO: 2960018 - protein, 27 aa, Entamoeba invadens
PDVTEFPRGCLVPCTLSGSYPSRDPYR

SEQ ID NO: 2960019 - protein, 19 aa, Entamoeba invadens
PDVTVVIEIFSRGLGHNTL

SEQ ID NO: 2960020 - protein, 24 aa, Entamoeba invadens
PDYFSMFCVPEYVLTEATISLIEI

SEQ ID NO: 2960021 - protein, 18 aa, Entamoeba invadens
PDYKYKLTLKKYIETCFP

SEQ ID NO: 2960022 - protein, 17 aa, Entamoeba invadens
PDYRDGEKEEFCITAEP

SEQ ID NO: 2960023 - protein, 17 aa, Entamoeba invadens
PDYVWSLMYEVKYQFNF

SEQ ID NO: 2960024 - protein, 17 aa, Entamoeba invadens
PDYWEYYCLVCQRERDG

SEQ ID NO: 2960025 - protein, 22 aa, Entamoeba invadens
PEAASLEYPEATVLAKEQAFQF

SEQ ID NO: 2960026 - protein, 20 aa, Entamoeba invadens
PEAFVKTYLATFLLLQPVDF

SEQ ID NO: 2960027 - protein, 25 aa, Entamoeba invadens
PEALKCGFEVISIIWSKMPEDGEIV

SEQ ID NO: 2960028 - protein, 20 aa, Entamoeba invadens
PEANPFLSPVDPIAQNLPDY

SEQ ID NO: 2960029 - protein, 19 aa, Entamoeba invadens
PEAPFVISYNYKGECKHNR

SEQ ID NO: 2960030 - protein, 26 aa, Entamoeba invadens
PEAPTFKTPYGITVHDILKGIDIERD

SEQ ID NO: 2960031 - protein, 30 aa, Entamoeba invadens
PEAPTFKTPYGITVHDILKGIDIERDSTEK

SEQ ID NO: 2960032 - protein, 18 aa, Entamoeba invadens
PEASSIPYWVLKPEMEED

SEQ ID NO: 2960033 - protein, 17 aa, Entamoeba invadens
PEDALKMLDTVNERIKK

SEQ ID NO: 2960034 - protein, 19 aa, Entamoeba invadens
PEDALNCQCIARIQFTKPT

SEQ ID NO: 2960035 - protein, 20 aa, Entamoeba invadens
PEDFVKFQIFLKIPTLSALI

SEQ ID NO: 2960036 - protein, 20 aa, Entamoeba invadens
PEDGFYLYVMSYLGETKEFG

SEQ ID NO: 2960037 - protein, 18 aa, Entamoeba invadens
PEDILLELLTGCRFKEKK

SEQ ID NO: 2960038 - protein, 20 aa, Entamoeba invadens
PEDLYFLMKRAVSIRKHLER

SEQ ID NO: 2960039 - protein, 21 aa, Entamoeba invadens
PEDMLPLPINPKFSKTLVFAI

SEQ ID NO: 2960040 - protein, 25 aa, Entamoeba invadens
PEDVIKCALAATCHKESVIETHQSD

SEQ ID NO: 2960041 - protein, 24 aa, Entamoeba invadens
PEDVPQCVIDGSFIKDLVEKKLSK

SEQ ID NO: 2960042 - protein, 27 aa, Entamoeba invadens
PEEFECLRFELESVYERKMNWESVGHI

SEQ ID NO: 2960043 - protein, 18 aa, Entamoeba invadens
PEEHALFVEGLNLYHRDW

SEQ ID NO: 2960044 - protein, 26 aa, Entamoeba invadens
PEEHRELFLYVCSKVHITYENMVANT

SEQ ID NO: 2960045 - protein, 18 aa, Entamoeba invadens
PEEIVGRYLPKLNGKVKE

SEQ ID NO: 2960046 - protein, 17 aa, Entamoeba invadens
PEEKVFPSDYISLRNTR

SEQ ID NO: 2960047 - protein, 25 aa, Entamoeba invadens
PEELFKGYFDFVVFGHEHMCQVATG

SEQ ID NO: 2960048 - protein, 25 aa, Entamoeba invadens
PEELFSVLFSFALEFLDKYKTVPEI

SEQ ID NO: 2960049 - protein, 17 aa, Entamoeba invadens
PEELMKWVQSRKELLIT

SEQ ID NO: 2960050 - protein, 20 aa, Entamoeba invadens
PEERANCLKEIALMKKVFHP

SEQ ID NO: 2960051 - protein, 21 aa, Entamoeba invadens
PEERFVKLVQFFLSGFYVNPK

SEQ ID NO: 2960052 - protein, 17 aa, Entamoeba invadens
PEESIGVVLTQFCEPTK

SEQ ID NO: 2960053 - protein, 19 aa, Entamoeba invadens
PEETARFYLAEVLLALEYL

SEQ ID NO: 2960054 - protein, 20 aa, Entamoeba invadens
PEETFEFDISSFPIGINLMC

SEQ ID NO: 2960055 - protein, 26 aa, Entamoeba invadens
PEETYKFKSVHNFKFFDENFDKFNSI

SEQ ID NO: 2960056 - protein, 27 aa, Entamoeba invadens
PEEYFRFEWELRLVFNNELTQFSEVGM

SEQ ID NO: 2960057 - protein, 20 aa, Entamoeba invadens
PEEYGTILMEVEKPDEVKQT

SEQ ID NO: 2960058 - protein, 17 aa, Entamoeba invadens
PEFEGIRAPMRINSYVL

SEQ ID NO: 2960059 - protein, 18 aa, Entamoeba invadens
PEFKRLARALASMPDGSE

SEQ ID NO: 2960060 - protein, 26 aa, Entamoeba invadens
PEFLGYGECLLPFFQGVFLGQLPKIL

SEQ ID NO: 2960061 - protein, 21 aa, Entamoeba invadens
PEFLMKRCIEKGVDPATLKDY

SEQ ID NO: 2960062 - protein, 28 aa, Entamoeba invadens
PEFRERTAFREKCVWPDFEGKNKVKFDV

SEQ ID NO: 2960063 - protein, 21 aa, Entamoeba invadens
PEFYEETSFMWFVSKFEPKTL

SEQ ID NO: 2960064 - protein, 17 aa, Entamoeba invadens
PEGEKIFSIIARNGTKF

SEQ ID NO: 2960065 - protein, 19 aa, Entamoeba invadens
PEGEQCGLVKMLSLMAQIT

SEQ ID NO: 2960066 - protein, 18 aa, Entamoeba invadens
PEGESCGLVKNFSLLTEV

SEQ ID NO: 2960067 - protein, 22 aa, Entamoeba invadens
PEGGEGKVLLSVVLPNECTIRR

SEQ ID NO: 2960068 - protein, 43 aa, Entamoeba invadens
PEGIARFPFEMVLPQKCCTTVVMGKCFLKWEMVAQIEELSCKI

SEQ ID NO: 2960069 - protein, 26 aa, Entamoeba invadens
PEGIKSGTFSGIFKVCVTPQEDCKKN

SEQ ID NO: 2960070 - protein, 25 aa, Entamoeba invadens
PEGKMKTVFVHFCLSDCTCKDENNC

SEQ ID NO: 2960071 - protein, 23 aa, Entamoeba invadens
PEGMRRISYNLKQWALDDNTRAL

SEQ ID NO: 2960072 - protein, 21 aa, Entamoeba invadens
PEGVSSIGMCAFKECISLSQI

SEQ ID NO: 2960073 - protein, 21 aa, Entamoeba invadens
PEHALEVYCYLMDLMTDKMPT

SEQ ID NO: 2960074 - protein, 24 aa, Entamoeba invadens
PEHITALHYCCFCCCNKLLTGITI

SEQ ID NO: 2960075 - protein, 21 aa, Entamoeba invadens
PEHLHKLVWPTVSAYSITQKC

SEQ ID NO: 2960076 - protein, 28 aa, Entamoeba invadens
PEHREKAWGELCKFLKCRYEEAENNCNI

SEQ ID NO: 2960077 - protein, 27 aa, Entamoeba invadens
PEICIPLTHFQCFLGFVDNNILKQQMT

SEQ ID NO: 2960078 - protein, 17 aa, Entamoeba invadens
PEIEHEMDINFSFVIDP

SEQ ID NO: 2960079 - protein, 20 aa, Entamoeba invadens
PEIKDLVLENLVGKEIERRG

SEQ ID NO: 2960080 - protein, 25 aa, Entamoeba invadens
PEIKMLKILCQWFCRKRSMSDYNQH

SEQ ID NO: 2960081 - protein, 25 aa, Entamoeba invadens
PEIKMLKILCRWFCRKRRLSDYNQH

SEQ ID NO: 2960082 - protein, 30 aa, Entamoeba invadens
PEILAGISGANCLVSGPGVDGGDELDDCND

SEQ ID NO: 2960083 - protein, 26 aa, Entamoeba invadens
PEILEAYNRFEIEIPIYIPVNCINEI

SEQ ID NO: 2960084 - protein, 17 aa, Entamoeba invadens
PEILRGVVYDGFKTDVW

SEQ ID NO: 2960085 - protein, 17 aa, Entamoeba invadens
PEIMWKEEAVIVKRADA

SEQ ID NO: 2960086 - protein, 33 aa, Entamoeba invadens
PEIPIALRISGHLLLGICRIYTRKVKYLLQDCN

SEQ ID NO: 2960087 - protein, 18 aa, Entamoeba invadens
PEIRRLNRDIPILLVGLK

SEQ ID NO: 2960088 - protein, 20 aa, Entamoeba invadens
PEISQRLSRFEYFGQYGEIV

SEQ ID NO: 2960089 - protein, 21 aa, Entamoeba invadens
PEITDITVLQGWTGKMSYRML

SEQ ID NO: 2960090 - protein, 20 aa, Entamoeba invadens
PEITQRCQFQSTKINIDGTN

SEQ ID NO: 2960091 - protein, 22 aa, Entamoeba invadens
PEIVLGLPYSCAIDMWSVGCIA

SEQ ID NO: 2960092 - protein, 22 aa, Entamoeba invadens
PEIVLGLPYSCAIDMWSVGCMT

SEQ ID NO: 2960093 - protein, 25 aa, Entamoeba invadens
PEIVPFRFTLNIRDCLGATKDEGLF

SEQ ID NO: 2960094 - protein, 25 aa, Entamoeba invadens
PEIVYKWIGCEHMKAIFDSEVDGWN

SEQ ID NO: 2960095 - protein, 25 aa, Entamoeba invadens
PEKAEVAEDVWLRLMLTCIGETFEH

SEQ ID NO: 2960096 - protein, 17 aa, Entamoeba invadens
PEKCFADCYSLSKVELQ

SEQ ID NO: 2960097 - protein, 18 aa, Entamoeba invadens
PEKCKFVDKMILKLQETP

SEQ ID NO: 2960098 - protein, 20 aa, Entamoeba invadens
PEKCSSCFKDMVLYESGLCY

SEQ ID NO: 2960099 - protein, 23 aa, Entamoeba invadens
PEKDARMAVLLANCRLPRDDENE

SEQ ID NO: 2960100 - protein, 18 aa, Entamoeba invadens
PEKDSVIQIANYVVELGS

SEQ ID NO: 2960101 - protein, 22 aa, Entamoeba invadens
PEKEIICAVCKKVICHLKNVKR

SEQ ID NO: 2960102 - protein, 23 aa, Entamoeba invadens
PEKHLSGCFVCADKNSFVVMENE

SEQ ID NO: 2960103 - protein, 21 aa, Entamoeba invadens
PEKIVCFTENWFIERDAASYN

SEQ ID NO: 2960104 - protein, 24 aa, Entamoeba invadens
PEKLLQTLFEWYVPKEQVLMPIST

SEQ ID NO: 2960105 - protein, 17 aa, Entamoeba invadens
PEKNGVFAITKRICSLS

SEQ ID NO: 2960106 - protein, 18 aa, Entamoeba invadens
PEKVTLPKALSCEFYNRN

SEQ ID NO: 2960107 - protein, 19 aa, Entamoeba invadens
PEKVTRFSKLFLKNAKNVC

SEQ ID NO: 2960108 - protein, 17 aa, Entamoeba invadens
PEKVVLPKSLSSVFYNR

SEQ ID NO: 2960109 - protein, 21 aa, Entamoeba invadens
PEKYFWMKKLFMDCPHILVQN

SEQ ID NO: 2960110 - protein, 27 aa, Entamoeba invadens
PEKYGICTAETLTLKNKRNLALIAKIL

SEQ ID NO: 2960111 - protein, 23 aa, Entamoeba invadens
PELHCCPDGWEFEQLSMKNKDCP

SEQ ID NO: 2960112 - protein, 19 aa, Entamoeba invadens
PELISLKKGFACEFSMYLT

SEQ ID NO: 2960113 - protein, 26 aa, Entamoeba invadens
PELKSLIPGCIAIRGNFVGDIGMDDV

SEQ ID NO: 2960114 - protein, 22 aa, Entamoeba invadens
PELKVGVQAVGKCEDEYTIGTI

SEQ ID NO: 2960115 - protein, 20 aa, Entamoeba invadens
PELLRDYLVNEMADEEFGTQ

SEQ ID NO: 2960116 - protein, 21 aa, Entamoeba invadens
PELLSTEGLFRIGANTSEVKR

SEQ ID NO: 2960117 - protein, 24 aa, Entamoeba invadens
PELMLADCVIKCYGFSALKDATDL

SEQ ID NO: 2960118 - protein, 20 aa, Entamoeba invadens
PELNMNCLVYALKQAKIDDK

SEQ ID NO: 2960119 - protein, 20 aa, Entamoeba invadens
PELNNNCLIYALQQDKIDEK

SEQ ID NO: 2960120 - protein, 17 aa, Entamoeba invadens
PELNQFVHFAFTTQDDF

SEQ ID NO: 2960121 - protein, 21 aa, Entamoeba invadens
PELNTNCLIYALQQAKIDDKI

SEQ ID NO: 2960122 - protein, 17 aa, Entamoeba invadens
PELPVWNAIDALLKKKD

SEQ ID NO: 2960123 - protein, 22 aa, Entamoeba invadens
PELQAVSFPKEYAALGDESITL

SEQ ID NO: 2960124 - protein, 22 aa, Entamoeba invadens
PELQSYIVYTKIHFFPEITEEA

SEQ ID NO: 2960125 - protein, 17 aa, Entamoeba invadens
PELSYRSIERLILGEEL

SEQ ID NO: 2960126 - protein, 28 aa, Entamoeba invadens
PELTEIVFYRSLYRCCVPEFPHENQRVL

SEQ ID NO: 2960127 - protein, 18 aa, Entamoeba invadens
PELVDFVNKCFIYDPEKR

SEQ ID NO: 2960128 - protein, 24 aa, Entamoeba invadens
PELVYPKRRYIVLETTKKLIEAFV

SEQ ID NO: 2960129 - protein, 22 aa, Entamoeba invadens
PELWYPDIYVLNGGYRLFREIY

SEQ ID NO: 2960130 - protein, 17 aa, Entamoeba invadens
PELYRKEPYGFKVDIWA

SEQ ID NO: 2960131 - protein, 25 aa, Entamoeba invadens
PEMEKELYFKGLVFYIFGHNKDLLM

SEQ ID NO: 2960132 - protein, 34 aa, Entamoeba invadens
PEMFHYNPICLRSHFKFFPNVETYYIYKKNDKVV

SEQ ID NO: 2960133 - protein, 26 aa, Entamoeba invadens
PEMKQKDILGVIGKMWKDLSESEKKK

SEQ ID NO: 2960134 - protein, 17 aa, Entamoeba invadens
PEMNEIGEMAVLNETEE

SEQ ID NO: 2960135 - protein, 23 aa, Entamoeba invadens
PEMQAFVSWKFVRIERLVLSWLD

SEQ ID NO: 2960136 - protein, 24 aa, Entamoeba invadens
PEMQRFALRTLLIKRTTRFTTLFQ

SEQ ID NO: 2960137 - protein, 21 aa, Entamoeba invadens
PENCFLLHDFLNIQSKKNYVE

SEQ ID NO: 2960138 - protein, 21 aa, Entamoeba invadens
PENFISIFTNIFLKFKVEKLM

SEQ ID NO: 2960139 - protein, 19 aa, Entamoeba invadens
PENILICADGYLRLTDFGL

SEQ ID NO: 2960140 - protein, 20 aa, Entamoeba invadens
PENITQLGITKLDLSNNYIN

SEQ ID NO: 2960141 - protein, 17 aa, Entamoeba invadens
PENKVNATLFPQPQVKH

SEQ ID NO: 2960142 - protein, 21 aa, Entamoeba invadens
PENQKKCDIPKTEKSPVDIDF

SEQ ID NO: 2960143 - protein, 19 aa, Entamoeba invadens
PENRKFYLEMFAAIEKDLK

SEQ ID NO: 2960144 - protein, 20 aa, Entamoeba invadens
PENRVSWEVLVDSMKTIETF

SEQ ID NO: 2960145 - protein, 22 aa, Entamoeba invadens
PENVKRIYSSLHLSIKKVSLAE

SEQ ID NO: 2960146 - protein, 22 aa, Entamoeba invadens
PENYCKVADPVLKKSGKVAGMN

SEQ ID NO: 2960147 - protein, 28 aa, Entamoeba invadens
PENYPALKTHIWKTFIGTHFLMQKENAI

SEQ ID NO: 2960148 - protein, 31 aa, Entamoeba invadens
PEPHLYFYVQHCLKAFISSMYPPVTVSGDYM

SEQ ID NO: 2960149 - protein, 23 aa, Entamoeba invadens
PEPKTVCYKEWLTCTWSKDNSSD

SEQ ID NO: 2960150 - protein, 25 aa, Entamoeba invadens
PEPLFFLELRISPYHYEEDLIHQYK

SEQ ID NO: 2960151 - protein, 23 aa, Entamoeba invadens
PEPLIPFDLYQDFIAIPTRKDGK

SEQ ID NO: 2960152 - protein, 21 aa, Entamoeba invadens
PEPTIPQDLFMMIQETISSSV

SEQ ID NO: 2960153 - protein, 18 aa, Entamoeba invadens
PEPVTYSFVEYVVNGYYS

SEQ ID NO: 2960154 - protein, 22 aa, Entamoeba invadens
PEQEMKFSLKKLKFYDPFTTDA

SEQ ID NO: 2960155 - protein, 26 aa, Entamoeba invadens
PEQLEKRRITALKRMRQSEEITSAPI

SEQ ID NO: 2960156 - protein, 25 aa, Entamoeba invadens
PEQLFRKKSVLNWFDQEGKEQPTMG

SEQ ID NO: 2960157 - protein, 23 aa, Entamoeba invadens
PEQRAYHALCINLVRIINNKEVT

SEQ ID NO: 2960158 - protein, 20 aa, Entamoeba invadens
PEQRPLIFFEYYETHPVKAD

SEQ ID NO: 2960159 - protein, 21 aa, Entamoeba invadens
PEQVNATGFWCFSNCTSLSKV

SEQ ID NO: 2960160 - protein, 25 aa, Entamoeba invadens
PEQVTSIGVNAFWGCVKLESVKLPK

SEQ ID NO: 2960161 - protein, 24 aa, Entamoeba invadens
PEQWEVKTSFILEFVDATKIAFDL

SEQ ID NO: 2960162 - protein, 25 aa, Entamoeba invadens
PERDLRIIGKMSKLLIDMKIAQARA

SEQ ID NO: 2960163 - protein, 26 aa, Entamoeba invadens
PERDYDKSFPVFAVKCRPGYETDIAM

SEQ ID NO: 2960164 - protein, 17 aa, Entamoeba invadens
PEREFPFKIYGHSVSSF

SEQ ID NO: 2960165 - protein, 22 aa, Entamoeba invadens
PEREMYYFICASILLENAPVIM

SEQ ID NO: 2960166 - protein, 27 aa, Entamoeba invadens
PERLEPLKTYVFRQVQLREFRTRNMNY

SEQ ID NO: 2960167 - protein, 18 aa, Entamoeba invadens
PERYALKTVQYLIINDVY

SEQ ID NO: 2960168 - protein, 20 aa, Entamoeba invadens
PESCIFCQECTVYSKDIGQR

SEQ ID NO: 2960169 - protein, 19 aa, Entamoeba invadens
PESDGRRSLVFDLDDTLIH

SEQ ID NO: 2960170 - protein, 24 aa, Entamoeba invadens
PESFKEGMKLGVIGYHKKKTGSTL

SEQ ID NO: 2960171 - protein, 19 aa, Entamoeba invadens
PESGRLVLNPIDYPDLPFF

SEQ ID NO: 2960172 - protein, 17 aa, Entamoeba invadens
PESKELMTYLVKRVKGV

SEQ ID NO: 2960173 - protein, 18 aa, Entamoeba invadens
PESLEIIEDMAFANNEIL

SEQ ID NO: 2960174 - protein, 18 aa, Entamoeba invadens
PESLHCVGEFCFSLCNAL

SEQ ID NO: 2960175 - protein, 23 aa, Entamoeba invadens
PESLKNFKNLIGVDFSMNQLQTI

SEQ ID NO: 2960176 - protein, 17 aa, Entamoeba invadens
PESLLNLPEFVKMSPDE

SEQ ID NO: 2960177 - protein, 20 aa, Entamoeba invadens
PESLWRVVVTRLGKEDPDFA

SEQ ID NO: 2960178 - protein, 18 aa, Entamoeba invadens
PESPRILENPTLLFEYVP

SEQ ID NO: 2960179 - protein, 21 aa, Entamoeba invadens
PESRIRSVLLPVIANKVPITD

SEQ ID NO: 2960180 - protein, 24 aa, Entamoeba invadens
PESSVSFDRRVFVVIKINKKQKSQ

SEQ ID NO: 2960181 - protein, 19 aa, Entamoeba invadens
PESVFFELTLNRLKMKNGL

SEQ ID NO: 2960182 - protein, 20 aa, Entamoeba invadens
PESYKVDSFFELVPTTPTIT

SEQ ID NO: 2960183 - protein, 25 aa, Entamoeba invadens
PETALPALLVYKGDVMVKSLFGKEA

SEQ ID NO: 2960184 - protein, 26 aa, Entamoeba invadens
PETAYHLYNMFSLFGSISKVNVLSSK

SEQ ID NO: 2960185 - protein, 29 aa, Entamoeba invadens
PETEAPANMMLYFSEFEALYGADNFCVVM

SEQ ID NO: 2960186 - protein, 30 aa, Entamoeba invadens
PETEQMSLLILKKDLCDLAALLENNLAGVN

SEQ ID NO: 2960187 - protein, 26 aa, Entamoeba invadens
PETFCITARLYFKLMDLDDGGNIAKE

SEQ ID NO: 2960188 - protein, 26 aa, Entamoeba invadens
PETFIDIFYTRIGKIYEVYKRRCRRF

SEQ ID NO: 2960189 - protein, 21 aa, Entamoeba invadens
PETFSILGNMSVNFNDSTSTI

SEQ ID NO: 2960190 - protein, 17 aa, Entamoeba invadens
PETGYFSLVRDIYEKNI

SEQ ID NO: 2960191 - protein, 24 aa, Entamoeba invadens
PETHPKIMEEFLYKKSTIISKQGG

SEQ ID NO: 2960192 - protein, 29 aa, Entamoeba invadens
PETKEKYKPCVIEMGALPRSSDLLASRFL

SEQ ID NO: 2960193 - protein, 17 aa, Entamoeba invadens
PETKPRYLMGVGYPVEM

SEQ ID NO: 2960194 - protein, 25 aa, Entamoeba invadens
PETLEWLQHPTLKFTLPQILITLDV

SEQ ID NO: 2960195 - protein, 19 aa, Entamoeba invadens
PETLFKIIEKCWKQNPKER

SEQ ID NO: 2960196 - protein, 19 aa, Entamoeba invadens
PETLKQRLVAMGFNPNNCT

SEQ ID NO: 2960197 - protein, 25 aa, Entamoeba invadens
PETLKRFGNMVFYGCCCLKTIHLPK

SEQ ID NO: 2960198 - protein, 24 aa, Entamoeba invadens
PETLRRLEVSIVRKYSIEANLKNV

SEQ ID NO: 2960199 - protein, 32 aa, Entamoeba invadens
PETLTSLPPYCFRFCSALSSFSFPDHLKSIGD

SEQ ID NO: 2960200 - protein, 25 aa, Entamoeba invadens
PETNYMCLKAMFYVCDENKDDKLSE

SEQ ID NO: 2960201 - protein, 22 aa, Entamoeba invadens
PEVDAAFKKLLVNKRINQFIPS

SEQ ID NO: 2960202 - protein, 20 aa, Entamoeba invadens
PEVECNAVLIQTELYKIVKE

SEQ ID NO: 2960203 - protein, 22 aa, Entamoeba invadens
PEVEPRFVVYSYKYPRSDGRVT

SEQ ID NO: 2960204 - protein, 24 aa, Entamoeba invadens
PEVETYSIVACNFGEEDKIKIVGF

SEQ ID NO: 2960205 - protein, 25 aa, Entamoeba invadens
PEVILGIPYSTAIDMWSLGCVVAEL

SEQ ID NO: 2960206 - protein, 26 aa, Entamoeba invadens
PEVILGLPYSSAIDMWSLGCIAAEFF

SEQ ID NO: 2960207 - protein, 21 aa, Entamoeba invadens
PEVILGLPYSTAIDMWSFGCM

SEQ ID NO: 2960208 - protein, 19 aa, Entamoeba invadens
PEVLFGKMVESFLLSSKKK

SEQ ID NO: 2960209 - protein, 20 aa, Entamoeba invadens
PEVLKQLSLLNPTSYCKDTL

SEQ ID NO: 2960210 - protein, 21 aa, Entamoeba invadens
PEVMKKLALELKRKVYSETVN

SEQ ID NO: 2960211 - protein, 17 aa, Entamoeba invadens
PEVVCQLSKVTILMLQQ

SEQ ID NO: 2960212 - protein, 26 aa, Entamoeba invadens
PEVVLGLPYSCAIDMWSIGCMTAELF

SEQ ID NO: 2960213 - protein, 25 aa, Entamoeba invadens
PEVVTLKSGFACEFSVYYVKPLCSC

SEQ ID NO: 2960214 - protein, 25 aa, Entamoeba invadens
PEVYKTECMYCAKSIETKLLDTLYV

SEQ ID NO: 2960215 - protein, 17 aa, Entamoeba invadens
PEWVEFRINCVNEVVKE

SEQ ID NO: 2960216 - protein, 20 aa, Entamoeba invadens
PEWVSLTLGVLICLECCGAH

SEQ ID NO: 2960217 - protein, 18 aa, Entamoeba invadens
PEYEIDSIIPSYQIIVDL

SEQ ID NO: 2960218 - protein, 18 aa, Entamoeba invadens
PEYIRAITRMADFKETVA

SEQ ID NO: 2960219 - protein, 24 aa, Entamoeba invadens
PEYIVKDVQLVFGLLSSENVLLRV

SEQ ID NO: 2960220 - protein, 17 aa, Entamoeba invadens
PEYKEFIQLIGNIIPLK

SEQ ID NO: 2960221 - protein, 23 aa, Entamoeba invadens
PEYLDAFSSYTERTLTFGQIEKM

SEQ ID NO: 2960222 - protein, 22 aa, Entamoeba invadens
PEYTKGKKFRVLSLDGGGVKCV

SEQ ID NO: 2960223 - protein, 17 aa, Entamoeba invadens
PFANYVLQRMLTVMNKD

SEQ ID NO: 2960224 - protein, 19 aa, Entamoeba invadens
PFAPSMFPCYPYEKDPFVL

SEQ ID NO: 2960225 - protein, 20 aa, Entamoeba invadens
PFAVCLPLMRLEGVKLYDGL

SEQ ID NO: 2960226 - protein, 25 aa, Entamoeba invadens
PFCHIPKEYCEFGPNAKKCKKAQAE

SEQ ID NO: 2960227 - protein, 18 aa, Entamoeba invadens
PFCTMNLCDEIMIISLDL

SEQ ID NO: 2960228 - protein, 26 aa, Entamoeba invadens
PFDASSLRSSCLIHLKRDDIIKKACE

SEQ ID NO: 2960229 - protein, 17 aa, Entamoeba invadens
PFDFFAVPFVKRAYLKV

SEQ ID NO: 2960230 - protein, 17 aa, Entamoeba invadens
PFDFSVMTADHIVTDVD

SEQ ID NO: 2960231 - protein, 21 aa, Entamoeba invadens
PFDPPTYCVKWDCESADKYRR

SEQ ID NO: 2960232 - protein, 27 aa, Entamoeba invadens
PFDSGPVIEVCLDKGVYYMDYNNNLRS

SEQ ID NO: 2960233 - protein, 17 aa, Entamoeba invadens
PFEFTKLPIPVVPQNNS

SEQ ID NO: 2960234 - protein, 22 aa, Entamoeba invadens
PFEKELDAFCSSFVVKELKESN

SEQ ID NO: 2960235 - protein, 24 aa, Entamoeba invadens
PFEKRMVIQNGYTREEELEFIERY

SEQ ID NO: 2960236 - protein, 18 aa, Entamoeba invadens
PFELYKLRVEAVAIEILD

SEQ ID NO: 2960237 - protein, 26 aa, Entamoeba invadens
PFESLKELVSIFFHICDKNNDGFLNY

SEQ ID NO: 2960238 - protein, 18 aa, Entamoeba invadens
PFEVKKRSKIIGLDQIVR

SEQ ID NO: 2960239 - protein, 18 aa, Entamoeba invadens
PFEVPKEGTVFILDCHNY

SEQ ID NO: 2960240 - protein, 17 aa, Entamoeba invadens
PFFRTMCLTSFSGEYFF

SEQ ID NO: 2960241 - protein, 24 aa, Entamoeba invadens
PFFTLQFVTDFSCENVFEFPHPFC

SEQ ID NO: 2960242 - protein, 21 aa, Entamoeba invadens
PFGEICSRWSKYIESNMLLPV

SEQ ID NO: 2960243 - protein, 20 aa, Entamoeba invadens
PFGGKVVIVGGDFRQTLPVV

SEQ ID NO: 2960244 - protein, 26 aa, Entamoeba invadens
PFGPHPLEVFAMIAAMKILCSKNFVL

SEQ ID NO: 2960245 - protein, 17 aa, Entamoeba invadens
PFGTRGFENNKDIDSIL

SEQ ID NO: 2960246 - protein, 18 aa, Entamoeba invadens
PFGTRGFENNKEIDSILM

SEQ ID NO: 2960247 - protein, 18 aa, Entamoeba invadens
PFHKIGLVYVQKGQTDQL

SEQ ID NO: 2960248 - protein, 24 aa, Entamoeba invadens
PFIHQILCLINFLLSVKNNTFESC

SEQ ID NO: 2960249 - protein, 18 aa, Entamoeba invadens
PFIIPSIFLPNTFYHFEL

SEQ ID NO: 2960250 - protein, 20 aa, Entamoeba invadens
PFKDEMTRQLVLEIDGKSMA

SEQ ID NO: 2960251 - protein, 23 aa, Entamoeba invadens
PFKEVYLPTEITCLTSMDYLSNI

SEQ ID NO: 2960252 - protein, 21 aa, Entamoeba invadens
PFKIITRNRIGQPLKKGGQKF

SEQ ID NO: 2960253 - protein, 25 aa, Entamoeba invadens
PFKVLLEGHLLRYGTSDKIYCHVNH

SEQ ID NO: 2960254 - protein, 18 aa, Entamoeba invadens
PFLCNPFLPLAPSISLPF

SEQ ID NO: 2960255 - protein, 17 aa, Entamoeba invadens
PFLDMGFNISFRVDDME

SEQ ID NO: 2960256 - protein, 56 aa, Entamoeba invadens
PFLEKRCLIEIYFGKLKTVFAFARTKFVKAFEIFDAMFVLCCCFCNVDIQINPLIA

SEQ ID NO: 2960257 - protein, 17 aa, Entamoeba invadens
PFLFKITPPLKLQIESL

SEQ ID NO: 2960258 - protein, 19 aa, Entamoeba invadens
PFLFLLKVEATVFGYFVNT

SEQ ID NO: 2960259 - protein, 18 aa, Entamoeba invadens
PFLGQLIQKGREFVDLGI

SEQ ID NO: 2960260 - protein, 26 aa, Entamoeba invadens
PFLLKIKAIYGRVFALAKCYTKSMST

SEQ ID NO: 2960261 - protein, 19 aa, Entamoeba invadens
PFLRMRPSQAINHPFITKR

SEQ ID NO: 2960262 - protein, 19 aa, Entamoeba invadens
PFLRNTGILFEFFDVFLKD

SEQ ID NO: 2960263 - protein, 24 aa, Entamoeba invadens
PFLSKREILHFIVFGKTDNQVSAS

SEQ ID NO: 2960264 - protein, 20 aa, Entamoeba invadens
PFMCPVKTKGSVPVTVYVCH

SEQ ID NO: 2960265 - protein, 27 aa, Entamoeba invadens
PFMCSCCPSVYCSECFKLVNNTLNAGD

SEQ ID NO: 2960266 - protein, 17 aa, Entamoeba invadens
PFMKVVLDFGKYNKAND

SEQ ID NO: 2960267 - protein, 21 aa, Entamoeba invadens
PFMRTKFGGEILVRGTDKNTL

SEQ ID NO: 2960268 - protein, 30 aa, Entamoeba invadens
PFMSLRHPRVCGNVLKQSYIFSTWATKYVV

SEQ ID NO: 2960269 - protein, 17 aa, Entamoeba invadens
PFNAIRSDTDFSLYQSH

SEQ ID NO: 2960270 - protein, 28 aa, Entamoeba invadens
PFNLPDFFDCFSFSLPTFMEVIVNILSE

SEQ ID NO: 2960271 - protein, 26 aa, Entamoeba invadens
PFPKMLRTIGSFAFSGCINLLEIPLP

SEQ ID NO: 2960272 - protein, 17 aa, Entamoeba invadens
PFQACVETLISLISERL

SEQ ID NO: 2960273 - protein, 18 aa, Entamoeba invadens
PFQKACEPACGVCRDGFV

SEQ ID NO: 2960274 - protein, 18 aa, Entamoeba invadens
PFQRRFQKTSAIKEEEPK

SEQ ID NO: 2960275 - protein, 18 aa, Entamoeba invadens
PFQSQYLKFGFHGLSYEF

SEQ ID NO: 2960276 - protein, 22 aa, Entamoeba invadens
PFQVKETFLNVGILSLQNSSPD

SEQ ID NO: 2960277 - protein, 21 aa, Entamoeba invadens
PFRIGDFPSSVQIDLPTDVCA

SEQ ID NO: 2960278 - protein, 19 aa, Entamoeba invadens
PFRPPEVVRPVTTPPLQEC

SEQ ID NO: 2960279 - protein, 25 aa, Entamoeba invadens
PFSEIPKGFVGYRIFSQCNNLSEVT

SEQ ID NO: 2960280 - protein, 18 aa, Entamoeba invadens
PFSGCGHVISFEEIYQII

SEQ ID NO: 2960281 - protein, 17 aa, Entamoeba invadens
PFSKKCVPKSCRALLNS

SEQ ID NO: 2960282 - protein, 24 aa, Entamoeba invadens
PFSLLPEKLIVRFDQERQDREKKR

SEQ ID NO: 2960283 - protein, 21 aa, Entamoeba invadens
PFSSPLVCAPVEQKHDKDGNV

SEQ ID NO: 2960284 - protein, 18 aa, Entamoeba invadens
PFSVLKIKPLQTTNQPTP

SEQ ID NO: 2960285 - protein, 20 aa, Entamoeba invadens
PFTDWTLMLLKCCFKDKKPS

SEQ ID NO: 2960286 - protein, 19 aa, Entamoeba invadens
PFTFVPMRISSDYLVNGFL

SEQ ID NO: 2960287 - protein, 25 aa, Entamoeba invadens
PFTPDEVFAFLSFYKDYEVDCGLSD

SEQ ID NO: 2960288 - protein, 23 aa, Entamoeba invadens
PFTPRSLVVCRICEAKVMVDALA

SEQ ID NO: 2960289 - protein, 19 aa, Entamoeba invadens
PFTRLESIENCNLVSLDLF

SEQ ID NO: 2960290 - protein, 26 aa, Entamoeba invadens
PFVFIVQFIPKWFKALTDCGVPVEKI

SEQ ID NO: 2960291 - protein, 17 aa, Entamoeba invadens
PFVGRKIFSSKLSPKKF

SEQ ID NO: 2960292 - protein, 17 aa, Entamoeba invadens
PFVKKVVLFLIEKCKGY

SEQ ID NO: 2960293 - protein, 17 aa, Entamoeba invadens
PFVWKLVLEYYPFSSTS

SEQ ID NO: 2960294 - protein, 20 aa, Entamoeba invadens
PFWFDLSQRLGLSTRDVLSQ

SEQ ID NO: 2960295 - protein, 18 aa, Entamoeba invadens
PFYIKSLLQFYSSRGKLT

SEQ ID NO: 2960296 - protein, 21 aa, Entamoeba invadens
PFYLHDSLWRGQQLSHLGKAL

SEQ ID NO: 2960297 - protein, 19 aa, Entamoeba invadens
PFYLKNRVEMNKWALDHNK

SEQ ID NO: 2960298 - protein, 21 aa, Entamoeba invadens
PFYYRRSKTLYSLRTQTKLAK

SEQ ID NO: 2960299 - protein, 17 aa, Entamoeba invadens
PGANFSLLPAFLKERES

SEQ ID NO: 2960300 - protein, 20 aa, Entamoeba invadens
PGAPPGGLMPPGMLPPPGGL

SEQ ID NO: 2960301 - protein, 18 aa, Entamoeba invadens
PGAVPFRSNDTFNTFAPF

SEQ ID NO: 2960302 - protein, 21 aa, Entamoeba invadens
PGCAFGMSPMMRRAEPTAMPM

SEQ ID NO: 2960303 - protein, 27 aa, Entamoeba invadens
PGDARKRLQPEFAEKLPPKKVVKSEMS

SEQ ID NO: 2960304 - protein, 21 aa, Entamoeba invadens
PGDELPCDKICQILFGEFKGR

SEQ ID NO: 2960305 - protein, 26 aa, Entamoeba invadens
PGDESVSPGIEWGCGDGMMGYPQGTK

SEQ ID NO: 2960306 - protein, 19 aa, Entamoeba invadens
PGDFANFKSGVSLAEPIVR

SEQ ID NO: 2960307 - protein, 18 aa, Entamoeba invadens
PGEDGCFDVDMKRNNKDV

SEQ ID NO: 2960308 - protein, 27 aa, Entamoeba invadens
PGEHTPDMFSWFPFFFPIQPPIDLKRG

SEQ ID NO: 2960309 - protein, 20 aa, Entamoeba invadens
PGEIGSAMMKYFATEDSTEV

SEQ ID NO: 2960310 - protein, 18 aa, Entamoeba invadens
PGEKCKRTECALPVGTPF

SEQ ID NO: 2960311 - protein, 18 aa, Entamoeba invadens
PGELCDRMNCHVSTNTRF

SEQ ID NO: 2960312 - protein, 21 aa, Entamoeba invadens
PGETPQTLHLLAFDLLVDSAK

SEQ ID NO: 2960313 - protein, 19 aa, Entamoeba invadens
PGEVVTCKSTVRMLCGIPS

SEQ ID NO: 2960314 - protein, 20 aa, Entamoeba invadens
PGEVVTCKSTVRMLCGIPSS

SEQ ID NO: 2960315 - protein, 25 aa, Entamoeba invadens
PGFVDRFKTELAERVPNSKKMNVTA

SEQ ID NO: 2960316 - protein, 25 aa, Entamoeba invadens
PGGCSMPWITRFCSMPGHEYFVEVD

SEQ ID NO: 2960317 - protein, 17 aa, Entamoeba invadens
PGGEAHGGYTYCAVSAL

SEQ ID NO: 2960318 - protein, 17 aa, Entamoeba invadens
PGGESLLSMSYMGTNCF

SEQ ID NO: 2960319 - protein, 25 aa, Entamoeba invadens
PGGLFDYLLCFQFFEYSKIEVLYQL

SEQ ID NO: 2960320 - protein, 19 aa, Entamoeba invadens
PGGMGSYKFSGNYAPGIVP

SEQ ID NO: 2960321 - protein, 24 aa, Entamoeba invadens
PGHYLYCGMLIYLLQQNQSGFFDI

SEQ ID NO: 2960322 - protein, 20 aa, Entamoeba invadens
PGIDFMLTKCLDFCARPDVF

SEQ ID NO: 2960323 - protein, 19 aa, Entamoeba invadens
PGIEMLIPHYIRYINEVIF

SEQ ID NO: 2960324 - protein, 21 aa, Entamoeba invadens
PGIIKDVFETIELKIPLETGG

SEQ ID NO: 2960325 - protein, 18 aa, Entamoeba invadens
PGKCDHGTVIAFKIKKRI

SEQ ID NO: 2960326 - protein, 19 aa, Entamoeba invadens
PGKCFRLYTEAAFDHEMTQ

SEQ ID NO: 2960327 - protein, 25 aa, Entamoeba invadens
PGKEAVWLYTFCVASLLDVINQKRS

SEQ ID NO: 2960328 - protein, 25 aa, Entamoeba invadens
PGKFGDLYIHFKIQFPAYLTEKQRT

SEQ ID NO: 2960329 - protein, 18 aa, Entamoeba invadens
PGKHKVEVFYEDKQLKQS

SEQ ID NO: 2960330 - protein, 18 aa, Entamoeba invadens
PGKITPKGIMQFGEEKVY

SEQ ID NO: 2960331 - protein, 18 aa, Entamoeba invadens
PGKKGGLMVIYRSKLTDI

SEQ ID NO: 2960332 - protein, 28 aa, Entamoeba invadens
PGKLIPKEAIPMFFLWDDALDAKGDDEK

SEQ ID NO: 2960333 - protein, 21 aa, Entamoeba invadens
PGKMARFVWDLADPKENPIAG

SEQ ID NO: 2960334 - protein, 17 aa, Entamoeba invadens
PGKSAPNRAVFNMMIRS

SEQ ID NO: 2960335 - protein, 24 aa, Entamoeba invadens
PGKVMCVICKQSLDPDELLDHLKR

SEQ ID NO: 2960336 - protein, 24 aa, Entamoeba invadens
PGLCKTMKCTVLFDEINWKLEKLI

SEQ ID NO: 2960337 - protein, 25 aa, Entamoeba invadens
PGLLPEPQELYFFGFLRVVDVDKVK

SEQ ID NO: 2960338 - protein, 25 aa, Entamoeba invadens
PGLMRKADMGFTSIAVIAPVLNNAL

SEQ ID NO: 2960339 - protein, 18 aa, Entamoeba invadens
PGLNRAGKFPTLLGKNED

SEQ ID NO: 2960340 - protein, 18 aa, Entamoeba invadens
PGLVSSLLPILDPLFLSS

SEQ ID NO: 2960341 - protein, 17 aa, Entamoeba invadens
PGNFRFQVRLNKEQLDT

SEQ ID NO: 2960342 - protein, 24 aa, Entamoeba invadens
PGNGETSHRCTLDITLDQIERPKD

SEQ ID NO: 2960343 - protein, 18 aa, Entamoeba invadens
PGNGILVGFQRIYTEDFK

SEQ ID NO: 2960344 - protein, 24 aa, Entamoeba invadens
PGNGVLRTSCLIYSMCKKIVLKNY

SEQ ID NO: 2960345 - protein, 24 aa, Entamoeba invadens
PGNHEYMMRASFELPSIRDEETDK

SEQ ID NO: 2960346 - protein, 26 aa, Entamoeba invadens
PGNIDRLGGFEAPPSFVSMFIGERLE

SEQ ID NO: 2960347 - protein, 19 aa, Entamoeba invadens
PGNIFSVGSGSPFAVSVID

SEQ ID NO: 2960348 - protein, 19 aa, Entamoeba invadens
PGNNPPWMGDVDVTRSIGV

SEQ ID NO: 2960349 - protein, 17 aa, Entamoeba invadens
PGQCVGEVLFYIANENN

SEQ ID NO: 2960350 - protein, 18 aa, Entamoeba invadens
PGQMKRFGNFTVTCGAVL

SEQ ID NO: 2960351 - protein, 23 aa, Entamoeba invadens
PGQSAWRVNPKVLQFYKEHDKCF

SEQ ID NO: 2960352 - protein, 18 aa, Entamoeba invadens
PGRIYLRRDTVLLRETVV

SEQ ID NO: 2960353 - protein, 20 aa, Entamoeba invadens
PGRNVSPTPIRLRIVSPNVV

SEQ ID NO: 2960354 - protein, 20 aa, Entamoeba invadens
PGRRIRKLKRCSVSMMMGCK

SEQ ID NO: 2960355 - protein, 19 aa, Entamoeba invadens
PGSFPEYFTLSHLSTAISQ

SEQ ID NO: 2960356 - protein, 18 aa, Entamoeba invadens
PGSICIEFEELGILITGD

SEQ ID NO: 2960357 - protein, 17 aa, Entamoeba invadens
PGSIPNTKFIVPTFEPK

SEQ ID NO: 2960358 - protein, 24 aa, Entamoeba invadens
PGSRYRVLCLLGQGAFGQVVKCFD

SEQ ID NO: 2960359 - protein, 27 aa, Entamoeba invadens
PGTGECKGFAFLKFSSLEDGNRAICEM

SEQ ID NO: 2960360 - protein, 26 aa, Entamoeba invadens
PGTQYNVRVASRFYKGPELLVDFQEY

SEQ ID NO: 2960361 - protein, 25 aa, Entamoeba invadens
PGVCSCTSGCWCWKNEIEQSPQQLH

SEQ ID NO: 2960362 - protein, 17 aa, Entamoeba invadens
PGVLSFRKSEYMILLGT

SEQ ID NO: 2960363 - protein, 19 aa, Entamoeba invadens
PGVPLVCASNSVTQDESII

SEQ ID NO: 2960364 - protein, 30 aa, Entamoeba invadens
PGVQTCVCFLPSEKCQIGLFTLSGKYIKIG

SEQ ID NO: 2960365 - protein, 24 aa, Entamoeba invadens
PGVYEGWLRKRGVKIRTWKRRYFV

SEQ ID NO: 2960366 - protein, 18 aa, Entamoeba invadens
PGYQDIPVKYVLSKENPY

SEQ ID NO: 2960367 - protein, 19 aa, Entamoeba invadens
PHAFCSVFYQIKTASLEAL

SEQ ID NO: 2960368 - protein, 23 aa, Entamoeba invadens
PHAFPSRMTIGMLIESMASKVGA

SEQ ID NO: 2960369 - protein, 17 aa, Entamoeba invadens
PHAFTLSACTGVIEYET

SEQ ID NO: 2960370 - protein, 22 aa, Entamoeba invadens
PHAKNGFLLYDCYGVLKYESFK

SEQ ID NO: 2960371 - protein, 18 aa, Entamoeba invadens
PHEGIFCDLLWSDPLSDD

SEQ ID NO: 2960372 - protein, 20 aa, Entamoeba invadens
PHEKLKVAIELKKKSEEDKM

SEQ ID NO: 2960373 - protein, 24 aa, Entamoeba invadens
PHESDELFCAPYCIVDMNNGSVKC

SEQ ID NO: 2960374 - protein, 19 aa, Entamoeba invadens
PHEVAELFATANKKRVVRV

SEQ ID NO: 2960375 - protein, 27 aa, Entamoeba invadens
PHEVLNRYLCVLIDFLSGLELSNEQSY

SEQ ID NO: 2960376 - protein, 26 aa, Entamoeba invadens
PHFAAPEHFLLVAIDGHNGCYVPYMF

SEQ ID NO: 2960377 - protein, 18 aa, Entamoeba invadens
PHFHDLRVRLSQLDESVS

SEQ ID NO: 2960378 - protein, 18 aa, Entamoeba invadens
PHFSTCFVNYSSKESNFI

SEQ ID NO: 2960379 - protein, 19 aa, Entamoeba invadens
PHFVIKKKFGIFLESIEMS

SEQ ID NO: 2960380 - protein, 17 aa, Entamoeba invadens
PHGTVRPVCVVVTNLTP

SEQ ID NO: 2960381 - protein, 26 aa, Entamoeba invadens
PHIGSLASLLHKPPEVFISSLKAQAG

SEQ ID NO: 2960382 - protein, 21 aa, Entamoeba invadens
PHIKEWEFLEIVKTSDKKYTI

SEQ ID NO: 2960383 - protein, 20 aa, Entamoeba invadens
PHIKKTFLAAKGKFISELFS

SEQ ID NO: 2960384 - protein, 17 aa, Entamoeba invadens
PHIPMFRTIVTNYMNCD

SEQ ID NO: 2960385 - protein, 18 aa, Entamoeba invadens
PHKAQIPKIDFVPQEVVK

SEQ ID NO: 2960386 - protein, 23 aa, Entamoeba invadens
PHKECCVNCGKILSNTDDIITLP

SEQ ID NO: 2960387 - protein, 18 aa, Entamoeba invadens
PHKILAYQEVNFGTAVVR

SEQ ID NO: 2960388 - protein, 17 aa, Entamoeba invadens
PHKSGVAVIDVIDQNRF

SEQ ID NO: 2960389 - protein, 18 aa, Entamoeba invadens
PHKTLPKISIEKGSGENG

SEQ ID NO: 2960390 - protein, 19 aa, Entamoeba invadens
PHLDNGLVEECIAQANGDI

SEQ ID NO: 2960391 - protein, 19 aa, Entamoeba invadens
PHLRIIDQVRYCVVRNEEI

SEQ ID NO: 2960392 - protein, 17 aa, Entamoeba invadens
PHLTEFMSPPVILETDN

SEQ ID NO: 2960393 - protein, 18 aa, Entamoeba invadens
PHLTSISVLQRFHQVSRN

SEQ ID NO: 2960394 - protein, 17 aa, Entamoeba invadens
PHMPDLHIESRKFFVEL

SEQ ID NO: 2960395 - protein, 18 aa, Entamoeba invadens
PHMWSYGLDTFRGKDETA

SEQ ID NO: 2960396 - protein, 28 aa, Entamoeba invadens
PHNLGVVWGPNLVWRSWLEASEVDTVAI

SEQ ID NO: 2960397 - protein, 20 aa, Entamoeba invadens
PHNLPSILFEIYDWDRFKTD

SEQ ID NO: 2960398 - protein, 23 aa, Entamoeba invadens
PHNRNRLSGVVKFTHNHPKIAPQ

SEQ ID NO: 2960399 - protein, 23 aa, Entamoeba invadens
PHNRNRLSVVVACAHNHPKIAPQ

SEQ ID NO: 2960400 - protein, 25 aa, Entamoeba invadens
PHRDLSIIEHVVWETIKFINSKNNL

SEQ ID NO: 2960401 - protein, 18 aa, Entamoeba invadens
PHRRLIITPLDYPYHSLP

SEQ ID NO: 2960402 - protein, 18 aa, Entamoeba invadens
PHSILVFYASVLRIVAVI

SEQ ID NO: 2960403 - protein, 19 aa, Entamoeba invadens
PHSKGFISLNGIQGVIETD

SEQ ID NO: 2960404 - protein, 17 aa, Entamoeba invadens
PHSRSVLELTKSGTEKI

SEQ ID NO: 2960405 - protein, 29 aa, Entamoeba invadens
PHSVTTIGRKCFRGSASLINIVIGCNVKV

SEQ ID NO: 2960406 - protein, 18 aa, Entamoeba invadens
PHTFGFCCDIVIPDNVTT

SEQ ID NO: 2960407 - protein, 18 aa, Entamoeba invadens
PHTPHRITVTVVFKQKVN

SEQ ID NO: 2960408 - protein, 19 aa, Entamoeba invadens
PHTTFPLIRAIRALTRNAN

SEQ ID NO: 2960409 - protein, 25 aa, Entamoeba invadens
PHTVFPFHVVQYFYQYLGIVNRDDK

SEQ ID NO: 2960410 - protein, 34 aa, Entamoeba invadens
PHVNRYVRRKDTDMCIVMGCDGVWDVLTNEKVAD

SEQ ID NO: 2960411 - protein, 35 aa, Entamoeba invadens
PHVNRYVRRKDTDMCIVMGCDGVWDVLTNEKVADI

SEQ ID NO: 2960412 - protein, 18 aa, Entamoeba invadens
PHVRRSSRIRKHQLEQGV

SEQ ID NO: 2960413 - protein, 18 aa, Entamoeba invadens
PHVYQFKSEFPVTKAGVF

SEQ ID NO: 2960414 - protein, 17 aa, Entamoeba invadens
PHWCIKEITEQPIAASA

SEQ ID NO: 2960415 - protein, 18 aa, Entamoeba invadens
PHYIRYINEVIFKVNPPP

SEQ ID NO: 2960416 - protein, 25 aa, Entamoeba invadens
PIAEDTCRIILPLLFSASYSGITLL

SEQ ID NO: 2960417 - protein, 17 aa, Entamoeba invadens
PIAEGAMGKVFIGNYRS

SEQ ID NO: 2960418 - protein, 17 aa, Entamoeba invadens
PIAKPKGVVDLKTSVTI

SEQ ID NO: 2960419 - protein, 28 aa, Entamoeba invadens
PIALEISVLRYGYGYDVFNEGLDVSLVY

SEQ ID NO: 2960420 - protein, 20 aa, Entamoeba invadens
PIAPSYIAGFKWMPKCELVM

SEQ ID NO: 2960421 - protein, 19 aa, Entamoeba invadens
PICGPYECVTKYKYHLKIT

SEQ ID NO: 2960422 - protein, 18 aa, Entamoeba invadens
PICGSLCISDEFGPIAED

SEQ ID NO: 2960423 - protein, 17 aa, Entamoeba invadens
PICKKSMKYFCYNCRKS

SEQ ID NO: 2960424 - protein, 25 aa, Entamoeba invadens
PIDEQREALNFGSYNYLGFGGVNPK

SEQ ID NO: 2960425 - protein, 20 aa, Entamoeba invadens
PIDICCLRPENFGSDSTGVG

SEQ ID NO: 2960426 - protein, 25 aa, Entamoeba invadens
PIDKLEKLFVRFAEKIGEDVTHLKF

SEQ ID NO: 2960427 - protein, 18 aa, Entamoeba invadens
PIDRDPREYPPRRDDYQL

SEQ ID NO: 2960428 - protein, 18 aa, Entamoeba invadens
PIEEGITPKSSKKEKNKK

SEQ ID NO: 2960429 - protein, 20 aa, Entamoeba invadens
PIEFSGAHGKPILQDENYVY

SEQ ID NO: 2960430 - protein, 17 aa, Entamoeba invadens
PIEGCLTGETCAVVSNK

SEQ ID NO: 2960431 - protein, 23 aa, Entamoeba invadens
PIEITCYSFAFLAGKIPPQPTDR

SEQ ID NO: 2960432 - protein, 26 aa, Entamoeba invadens
PIEKEKPKSALSFTIKKDPKVDTDEL

SEQ ID NO: 2960433 - protein, 23 aa, Entamoeba invadens
PIEKILLFFPNIETLYFNSYSTR

SEQ ID NO: 2960434 - protein, 30 aa, Entamoeba invadens
PIEPKSPRGINAWYVWKILPNINGNDKCFI

SEQ ID NO: 2960435 - protein, 19 aa, Entamoeba invadens
PIEQLKSFIVLMVGLQGRF

SEQ ID NO: 2960436 - protein, 17 aa, Entamoeba invadens
PIEQMAQCFKKAKDVLG

SEQ ID NO: 2960437 - protein, 18 aa, Entamoeba invadens
PIFCGMDYVKTYDRNTLV

SEQ ID NO: 2960438 - protein, 22 aa, Entamoeba invadens
PIFRELQCVVNVILLYSEDDVD

SEQ ID NO: 2960439 - protein, 19 aa, Entamoeba invadens
PIFSTSFFYRTIQRAISIY

SEQ ID NO: 2960440 - protein, 20 aa, Entamoeba invadens
PIGILKSRGMCRSLIECEKR

SEQ ID NO: 2960441 - protein, 17 aa, Entamoeba invadens
PIGVFRFPINSTITKSR

SEQ ID NO: 2960442 - protein, 24 aa, Entamoeba invadens
PIHKNAKFLLAMFENHSRHEFRDK

SEQ ID NO: 2960443 - protein, 28 aa, Entamoeba invadens
PIHNKVAVFGCCAFYPRVCGVGSGDVYY

SEQ ID NO: 2960444 - protein, 18 aa, Entamoeba invadens
PIHTPVHYKESGVCLGRI

SEQ ID NO: 2960445 - protein, 29 aa, Entamoeba invadens
PIHTSCAVLEILLCYKGCGEIELDIPSVV

SEQ ID NO: 2960446 - protein, 26 aa, Entamoeba invadens
PIHYTMRRWLCGVLSNKLSRSEIEEE

SEQ ID NO: 2960447 - protein, 20 aa, Entamoeba invadens
PIHYWRYRCHVDLDDILSDN

SEQ ID NO: 2960448 - protein, 17 aa, Entamoeba invadens
PIIEKVVMNYDFTSADS

SEQ ID NO: 2960449 - protein, 25 aa, Entamoeba invadens
PIIEVFSRMNFAYVLLSKRNLNLFV

SEQ ID NO: 2960450 - protein, 25 aa, Entamoeba invadens
PIIKSELDHLCNIFIVKPFKKTTKE

SEQ ID NO: 2960451 - protein, 21 aa, Entamoeba invadens
PIKESFSYIYERCKNYKTLNA

SEQ ID NO: 2960452 - protein, 21 aa, Entamoeba invadens
PIKILCFDFIKNRNLFVRTCL

SEQ ID NO: 2960453 - protein, 24 aa, Entamoeba invadens
PIKNFRYGFLNKWYSSEYSFEKLY

SEQ ID NO: 2960454 - protein, 23 aa, Entamoeba invadens
PIKRSVLTLQLFKIEELTEGNDC

SEQ ID NO: 2960455 - protein, 19 aa, Entamoeba invadens
PIKTICAFVEKRLTSHGHI

SEQ ID NO: 2960456 - protein, 20 aa, Entamoeba invadens
PILARYVYTIGELDKIEVMC

SEQ ID NO: 2960457 - protein, 20 aa, Entamoeba invadens
PILCGGSYPPYKCKVNAYVE

SEQ ID NO: 2960458 - protein, 19 aa, Entamoeba invadens
PILCRFCGKTPHFPHAEFF

SEQ ID NO: 2960459 - protein, 20 aa, Entamoeba invadens
PILFAVCGREKISEAEAAQV

SEQ ID NO: 2960460 - protein, 26 aa, Entamoeba invadens
PILFKESRATLPLFSVSGRNESGFTI

SEQ ID NO: 2960461 - protein, 23 aa, Entamoeba invadens
PILGEVFRCMWADPKTSAKTFYV

SEQ ID NO: 2960462 - protein, 25 aa, Entamoeba invadens
PILLNDLRFFTALKYLAINKYEEET

SEQ ID NO: 2960463 - protein, 30 aa, Entamoeba invadens
PILPHSIVSGFLFLRVICPALTTPEASVFD

SEQ ID NO: 2960464 - protein, 19 aa, Entamoeba invadens
PILRLLIPHCEKLKRRVNN

SEQ ID NO: 2960465 - protein, 17 aa, Entamoeba invadens
PILSDGVSLTSSKNKLF

SEQ ID NO: 2960466 - protein, 23 aa, Entamoeba invadens
PINEFKFPWKIAEFVMEGKRLNN

SEQ ID NO: 2960467 - protein, 23 aa, Entamoeba invadens
PINEFKFPWKIAEFVMEGKRLNR

SEQ ID NO: 2960468 - protein, 18 aa, Entamoeba invadens
PINFNKIEVLKLVSVSNV

SEQ ID NO: 2960469 - protein, 21 aa, Entamoeba invadens
PINGSPCPTPILFDRTPTPSL

SEQ ID NO: 2960470 - protein, 18 aa, Entamoeba invadens
PINLEFEKVFWPYLLISK

SEQ ID NO: 2960471 - protein, 19 aa, Entamoeba invadens
PINLSRGFGFIDVKTEEDA

SEQ ID NO: 2960472 - protein, 20 aa, Entamoeba invadens
PINPKESFKIFIAPNSFIET

SEQ ID NO: 2960473 - protein, 17 aa, Entamoeba invadens
PINPKFSKTLVFAINQA

SEQ ID NO: 2960474 - protein, 25 aa, Entamoeba invadens
PINTLCQCGSCSSDITTHLQSPQQL

SEQ ID NO: 2960475 - protein, 17 aa, Entamoeba invadens
PINVCAIFNTLVYVLLE

SEQ ID NO: 2960476 - protein, 18 aa, Entamoeba invadens
PINVGPLIHFLYETYPEG

SEQ ID NO: 2960477 - protein, 24 aa, Entamoeba invadens
PIPDLRNVPTLSVLLKQTYVQLLD

SEQ ID NO: 2960478 - protein, 22 aa, Entamoeba invadens
PIPEDDRPPLVVDHSSESIEYV

SEQ ID NO: 2960479 - protein, 26 aa, Entamoeba invadens
PIPISLKTAHLFPKLETQYLYTEKDE

SEQ ID NO: 2960480 - protein, 21 aa, Entamoeba invadens
PIPKLKVANCFEHVRYETPKD

SEQ ID NO: 2960481 - protein, 17 aa, Entamoeba invadens
PIPLLKVRMTNGNVSEM

SEQ ID NO: 2960482 - protein, 22 aa, Entamoeba invadens
PIPLTCKTFRFFRNIETLHLWN

SEQ ID NO: 2960483 - protein, 18 aa, Entamoeba invadens
PIPLTLKTFKFFSKIETL

SEQ ID NO: 2960484 - protein, 17 aa, Entamoeba invadens
PIPPIMPLRSFIVSLNI

SEQ ID NO: 2960485 - protein, 17 aa, Entamoeba invadens
PIPRSYLSDDWKDKKFM

SEQ ID NO: 2960486 - protein, 25 aa, Entamoeba invadens
PIQHPLRYVLHLEQIVKSMPKYLTE

SEQ ID NO: 2960487 - protein, 23 aa, Entamoeba invadens
PIQLETFLTIPLDTKFNEFIEVL

SEQ ID NO: 2960488 - protein, 23 aa, Entamoeba invadens
PIQRGRFSLLSDVNRKGGNLFPV

SEQ ID NO: 2960489 - protein, 21 aa, Entamoeba invadens
PIRIFLKKLPLSPSMKNVGNI

SEQ ID NO: 2960490 - protein, 29 aa, Entamoeba invadens
PIRKLEVGLIPPLWEAHAQTKLEDYEKVY

SEQ ID NO: 2960491 - protein, 17 aa, Entamoeba invadens
PIRLMVGDVKRMPVIPL

SEQ ID NO: 2960492 - protein, 24 aa, Entamoeba invadens
PIRLNKHTFPFFSHIETLHVYSKE

SEQ ID NO: 2960493 - protein, 24 aa, Entamoeba invadens
PIRRMKSCLDFIAFEKTQHRADVI

SEQ ID NO: 2960494 - protein, 26 aa, Entamoeba invadens
PISEYGQACFEMCVKSPSSLFEILAK

SEQ ID NO: 2960495 - protein, 18 aa, Entamoeba invadens
PISIICVGVGDGPFDTME

SEQ ID NO: 2960496 - protein, 19 aa, Entamoeba invadens
PISKELFAVVVGTKQSHIG

SEQ ID NO: 2960497 - protein, 23 aa, Entamoeba invadens
PISLSCKTFEYFLNIETLHLWNV

SEQ ID NO: 2960498 - protein, 19 aa, Entamoeba invadens
PISPGSCFIAKELAKCNGF

SEQ ID NO: 2960499 - protein, 17 aa, Entamoeba invadens
PISPMPVTQPLTVHLHS

SEQ ID NO: 2960500 - protein, 21 aa, Entamoeba invadens
PISQPRSIVTMIWDKMAKGVG

SEQ ID NO: 2960501 - protein, 26 aa, Entamoeba invadens
PISRKCDVWALGCLLFELATGVPPFS

SEQ ID NO: 2960502 - protein, 25 aa, Entamoeba invadens
PISSMKLFPCIQTQYLYSENDQIFL

SEQ ID NO: 2960503 - protein, 25 aa, Entamoeba invadens
PISTLCGLLKSFLMEMNPRFLNEDQ

SEQ ID NO: 2960504 - protein, 26 aa, Entamoeba invadens
PITCIDEMQHEIGIASDLFKQYGAVE

SEQ ID NO: 2960505 - protein, 24 aa, Entamoeba invadens
PITCSHCNSIFSYLDKIENLSWKC

SEQ ID NO: 2960506 - protein, 17 aa, Entamoeba invadens
PITDLYGSVEFTHTQDS

SEQ ID NO: 2960507 - protein, 30 aa, Entamoeba invadens
PITDVFFLYEILVMMSIKFSNSVTSAAKTI

SEQ ID NO: 2960508 - protein, 25 aa, Entamoeba invadens
PITEIRCPFEYKFFMKNSKKGQVYW

SEQ ID NO: 2960509 - protein, 19 aa, Entamoeba invadens
PITIIRPSFANIVFSDYEN

SEQ ID NO: 2960510 - protein, 24 aa, Entamoeba invadens
PITKELTRTVAICFESNGETERFI

SEQ ID NO: 2960511 - protein, 19 aa, Entamoeba invadens
PITSADECVLFFSKISFVC

SEQ ID NO: 2960512 - protein, 22 aa, Entamoeba invadens
PITSPCRRNLILITKILQNIAN

SEQ ID NO: 2960513 - protein, 26 aa, Entamoeba invadens
PITTLKEHGDWVLNVDWHYSGRYVAS

SEQ ID NO: 2960514 - protein, 17 aa, Entamoeba invadens
PIVEFLLQNGKVGFLRL

SEQ ID NO: 2960515 - protein, 23 aa, Entamoeba invadens
PIVIDPKTGFLKKFTMGKWILNF

SEQ ID NO: 2960516 - protein, 17 aa, Entamoeba invadens
PIVKQSPKSVGKKPNPF

SEQ ID NO: 2960517 - protein, 19 aa, Entamoeba invadens
PIVLCGNKCDLECNRIVTT

SEQ ID NO: 2960518 - protein, 17 aa, Entamoeba invadens
PIVLCGNKCDLENERQV

SEQ ID NO: 2960519 - protein, 18 aa, Entamoeba invadens
PIVPFGGIMTKDFLVTDE

SEQ ID NO: 2960520 - protein, 19 aa, Entamoeba invadens
PIVPKTHRPIFLVKYKLME

SEQ ID NO: 2960521 - protein, 18 aa, Entamoeba invadens
PIVRELFGLFYKINTYSD

SEQ ID NO: 2960522 - protein, 27 aa, Entamoeba invadens
PIVRSIGEKCFRWCGSLSSVNIPSSVR

SEQ ID NO: 2960523 - protein, 18 aa, Entamoeba invadens
PIVRTAVTLPQNVDVSKL

SEQ ID NO: 2960524 - protein, 39 aa, Entamoeba invadens
PIYDMLDVLSHDWSFILREGIFRVPGNYAVIKQVTDFYE

SEQ ID NO: 2960525 - protein, 21 aa, Entamoeba invadens
PIYETLCMKTLKIFEFLYPSI

SEQ ID NO: 2960526 - protein, 21 aa, Entamoeba invadens
PIYGEDAKLYCEGKGTVYVLA

SEQ ID NO: 2960527 - protein, 20 aa, Entamoeba invadens
PIYGKIADRLGVSYLSKTLN

SEQ ID NO: 2960528 - protein, 24 aa, Entamoeba invadens
PIYNFRGGPLVSKKKMEFVIYKVS

SEQ ID NO: 2960529 - protein, 20 aa, Entamoeba invadens
PIYRFDCLDNLPKEHLDTVA

SEQ ID NO: 2960530 - protein, 17 aa, Entamoeba invadens
PIYRSNTHIIVFVNPTD

SEQ ID NO: 2960531 - protein, 29 aa, Entamoeba invadens
PIYTHPCKLRFLANLSQTAFVFVDVKNVV

SEQ ID NO: 2960532 - protein, 17 aa, Entamoeba invadens
PKADFDLTSGVRTVSLN

SEQ ID NO: 2960533 - protein, 17 aa, Entamoeba invadens
PKAIPFNTIVKKYIEFC

SEQ ID NO: 2960534 - protein, 20 aa, Entamoeba invadens
PKAISICVGPTIFRMSVGNT

SEQ ID NO: 2960535 - protein, 17 aa, Entamoeba invadens
PKAKIGVVLTIPATGTE

SEQ ID NO: 2960536 - protein, 19 aa, Entamoeba invadens
PKALGLVFALVSTRYRQYE

SEQ ID NO: 2960537 - protein, 24 aa, Entamoeba invadens
PKALNIFLAQAIDWEDLHEVEEAK

SEQ ID NO: 2960538 - protein, 18 aa, Entamoeba invadens
PKATGRTKQVAQFEVPTI

SEQ ID NO: 2960539 - protein, 19 aa, Entamoeba invadens
PKCCFSRSKLEELVVPPNV

SEQ ID NO: 2960540 - protein, 20 aa, Entamoeba invadens
PKCEAHLKGGAKKFIISAPS

SEQ ID NO: 2960541 - protein, 20 aa, Entamoeba invadens
PKCEAHLKGGAKKVIISAPS

SEQ ID NO: 2960542 - protein, 21 aa, Entamoeba invadens
PKCEAHLKGGAKKVIISAPSA

SEQ ID NO: 2960543 - protein, 21 aa, Entamoeba invadens
PKCEAHLKGGAKNLIISAPSA

SEQ ID NO: 2960544 - protein, 20 aa, Entamoeba invadens
PKCEEFANYIMTKCKDVFAI

SEQ ID NO: 2960545 - protein, 19 aa, Entamoeba invadens
PKCETFIEKNGGCQWMSCY

SEQ ID NO: 2960546 - protein, 17 aa, Entamoeba invadens
PKCMACEDKSFTLHDDR

SEQ ID NO: 2960547 - protein, 25 aa, Entamoeba invadens
PKCPISVVTLSLWICTKIEKMLTSL

SEQ ID NO: 2960548 - protein, 19 aa, Entamoeba invadens
PKCSCKIDDKIIIFSKNLE

SEQ ID NO: 2960549 - protein, 19 aa, Entamoeba invadens
PKCSCKIDDKIILFSKNLE

SEQ ID NO: 2960550 - protein, 33 aa, Entamoeba invadens
PKCTELVEKKCFCGKGRVRVCCYIESASCGEKC

SEQ ID NO: 2960551 - protein, 25 aa, Entamoeba invadens
PKDCVEPEGMLGIIFLKNKEAVTKS

SEQ ID NO: 2960552 - protein, 19 aa, Entamoeba invadens
PKDDKILIEFIKSDKNVDD

SEQ ID NO: 2960553 - protein, 24 aa, Entamoeba invadens
PKDEFKFPWKIAEFVISGKRVVKC

SEQ ID NO: 2960554 - protein, 20 aa, Entamoeba invadens
PKDIQKDVCTSTYKNHLTKY

SEQ ID NO: 2960555 - protein, 26 aa, Entamoeba invadens
PKDKPCYKCGKYGHISKDCPDAWKFT

SEQ ID NO: 2960556 - protein, 18 aa, Entamoeba invadens
PKDKRCVISEALCIGCGL

SEQ ID NO: 2960557 - protein, 41 aa, Entamoeba invadens
PKDRIIIHGKFLRRRFCVFVVMKLASICSVDMLKEVLPFAL

SEQ ID NO: 2960558 - protein, 17 aa, Entamoeba invadens
PKDTCLFTIEISPTYSG

SEQ ID NO: 2960559 - protein, 27 aa, Entamoeba invadens
PKDYNKRVFPVVVCHLSQIGNDVNLPL

SEQ ID NO: 2960560 - protein, 28 aa, Entamoeba invadens
PKDYNKRVFPVVVCHLSQIKINTNLPLV

SEQ ID NO: 2960561 - protein, 17 aa, Entamoeba invadens
PKEFITIFENLLDEQKK

SEQ ID NO: 2960562 - protein, 19 aa, Entamoeba invadens
PKEGTVFILDCHNYNNMGM

SEQ ID NO: 2960563 - protein, 26 aa, Entamoeba invadens
PKEICKGVIDLAKFADLNGEKKDCQV

SEQ ID NO: 2960564 - protein, 21 aa, Entamoeba invadens
PKEIGEKALAMYQYIVHSCEI

SEQ ID NO: 2960565 - protein, 18 aa, Entamoeba invadens
PKEKIKEIVKIRKMFNKF

SEQ ID NO: 2960566 - protein, 34 aa, Entamoeba invadens
PKEKNFYTFFSFRDKAKVSGWRLDYFDVSKELVD

SEQ ID NO: 2960567 - protein, 20 aa, Entamoeba invadens
PKEKPTELVRKGEKQNEMPL

SEQ ID NO: 2960568 - protein, 23 aa, Entamoeba invadens
PKEKVFRKSFMTFERPKREKLSL

SEQ ID NO: 2960569 - protein, 25 aa, Entamoeba invadens
PKELCKLCVEEALLPAEVSNDSLRN

SEQ ID NO: 2960570 - protein, 26 aa, Entamoeba invadens
PKELDEFLLFEKFKLFTAQLKQNEVD

SEQ ID NO: 2960571 - protein, 19 aa, Entamoeba invadens
PKELYRIVDRILKKYSKGC

SEQ ID NO: 2960572 - protein, 18 aa, Entamoeba invadens
PKEMWNQYCCKTRTNNIC

SEQ ID NO: 2960573 - protein, 32 aa, Entamoeba invadens
PKEQQQFFIRPWRKFVLETQVDLLFKDKHNKL

SEQ ID NO: 2960574 - protein, 21 aa, Entamoeba invadens
PKESETFCRRVYTRSPEKIDE

SEQ ID NO: 2960575 - protein, 19 aa, Entamoeba invadens
PKETRVLLYTLFRNLASTS

SEQ ID NO: 2960576 - protein, 20 aa, Entamoeba invadens
PKEWLRCCGFTKEERKGTSD

SEQ ID NO: 2960577 - protein, 19 aa, Entamoeba invadens
PKFACQFKLIRYIFPLALL

SEQ ID NO: 2960578 - protein, 20 aa, Entamoeba invadens
PKFFQVRCCVGYLESKEEAY

SEQ ID NO: 2960579 - protein, 23 aa, Entamoeba invadens
PKFKRIGNLFYFVAEHLTEDDKE

SEQ ID NO: 2960580 - protein, 19 aa, Entamoeba invadens
PKFLRKLPNLYDIMITDSM

SEQ ID NO: 2960581 - protein, 20 aa, Entamoeba invadens
PKFMKETHVTLSMKQTTKNQ

SEQ ID NO: 2960582 - protein, 19 aa, Entamoeba invadens
PKFQLKPQDLFNVFFGTPE

SEQ ID NO: 2960583 - protein, 18 aa, Entamoeba invadens
PKFQYGVDMSNGTKGTQQ

SEQ ID NO: 2960584 - protein, 31 aa, Entamoeba invadens
PKFSNKRVMELGCGQALPSILLKLNGATVDV

SEQ ID NO: 2960585 - protein, 17 aa, Entamoeba invadens
PKFVKRLPTQATGQERV

SEQ ID NO: 2960586 - protein, 23 aa, Entamoeba invadens
PKFVPAQTASLCERYLVNFCQLK

SEQ ID NO: 2960587 - protein, 24 aa, Entamoeba invadens
PKGARPATLPMTASMNGMTYSQYM

SEQ ID NO: 2960588 - protein, 26 aa, Entamoeba invadens
PKGEACEFEILLTIKCTTKIDENVVL

SEQ ID NO: 2960589 - protein, 21 aa, Entamoeba invadens
PKGELHIQIIFGPNTIQQQSY

SEQ ID NO: 2960590 - protein, 17 aa, Entamoeba invadens
PKGGLGVVPIQIANEDI

SEQ ID NO: 2960591 - protein, 29 aa, Entamoeba invadens
PKGIKVLPNFCFRGCSSLHDIKIPTNVVA

SEQ ID NO: 2960592 - protein, 21 aa, Entamoeba invadens
PKGKFYPTIYQDWCVANHFES

SEQ ID NO: 2960593 - protein, 19 aa, Entamoeba invadens
PKGLTFIGPYCFEDNSTLT

SEQ ID NO: 2960594 - protein, 21 aa, Entamoeba invadens
PKGQMGWQQEAKKTFLITQPQ

SEQ ID NO: 2960595 - protein, 20 aa, Entamoeba invadens
PKGRRLCIVSTNVAETSLTI

SEQ ID NO: 2960596 - protein, 18 aa, Entamoeba invadens
PKGSVAIDSVKTGDIDDW

SEQ ID NO: 2960597 - protein, 18 aa, Entamoeba invadens
PKGVFGFITNRTLCGFEL

SEQ ID NO: 2960598 - protein, 20 aa, Entamoeba invadens
PKGVLFSEMCSRLFSHDKSD

SEQ ID NO: 2960599 - protein, 20 aa, Entamoeba invadens
PKHCFVFCQWLTHVELPNTL

SEQ ID NO: 2960600 - protein, 24 aa, Entamoeba invadens
PKHLKEVYVNSCFITTLPQICSES

SEQ ID NO: 2960601 - protein, 18 aa, Entamoeba invadens
PKHVRTIIVRSFNGGVPT

SEQ ID NO: 2960602 - protein, 19 aa, Entamoeba invadens
PKIALPSTLEKLVCSNCSV

SEQ ID NO: 2960603 - protein, 17 aa, Entamoeba invadens
PKIAVAKLITLLYKPSR

SEQ ID NO: 2960604 - protein, 25 aa, Entamoeba invadens
PKICPPEDLSTVFLGFDDVFRINEK

SEQ ID NO: 2960605 - protein, 19 aa, Entamoeba invadens
PKIEFLKMFAKTSFKENIS

SEQ ID NO: 2960606 - protein, 25 aa, Entamoeba invadens
PKIEHLKRGIFWCCNSLVKFDNFGD

SEQ ID NO: 2960607 - protein, 17 aa, Entamoeba invadens
PKIETLNIWSILDETFG

SEQ ID NO: 2960608 - protein, 22 aa, Entamoeba invadens
PKIETLQCVDFMLGDANKVINK

SEQ ID NO: 2960609 - protein, 26 aa, Entamoeba invadens
PKIETLQCYDYMLGNDDKLVYKVKKI

SEQ ID NO: 2960610 - protein, 18 aa, Entamoeba invadens
PKIKIYFENVETLHLYSK

SEQ ID NO: 2960611 - protein, 19 aa, Entamoeba invadens
PKILLSRFPQVCTKIQKGM

SEQ ID NO: 2960612 - protein, 19 aa, Entamoeba invadens
PKILPQLPIHRATKPEQKP

SEQ ID NO: 2960613 - protein, 19 aa, Entamoeba invadens
PKILRLRLSKTTKQKTDFI

SEQ ID NO: 2960614 - protein, 26 aa, Entamoeba invadens
PKINGRSGVMIIVFPTLYEPFGCFID

SEQ ID NO: 2960615 - protein, 33 aa, Entamoeba invadens
PKINTFRSTPSFSYDLLKAFRTKISFLDFSQEI

SEQ ID NO: 2960616 - protein, 21 aa, Entamoeba invadens
PKINYPCYLSFMREYAPSIPP

SEQ ID NO: 2960617 - protein, 19 aa, Entamoeba invadens
PKIPFYKLAAKIKRETDTT

SEQ ID NO: 2960618 - protein, 20 aa, Entamoeba invadens
PKIPIDPILLEKAKQTNTVE

SEQ ID NO: 2960619 - protein, 20 aa, Entamoeba invadens
PKIQFLKRGVFWCCNSLVKF

SEQ ID NO: 2960620 - protein, 19 aa, Entamoeba invadens
PKIRADITFTQQKYFLANQ

SEQ ID NO: 2960621 - protein, 21 aa, Entamoeba invadens
PKIRLKKKDPAVIQAEKQQKE

SEQ ID NO: 2960622 - protein, 25 aa, Entamoeba invadens
PKIVNLMSGYACEFEIFLTPLCTMN

SEQ ID NO: 2960623 - protein, 27 aa, Entamoeba invadens
PKIVTLKSGFACEFEVFITPYCTMDLS

SEQ ID NO: 2960624 - protein, 17 aa, Entamoeba invadens
PKIVVMVVGNKADLSQT

SEQ ID NO: 2960625 - protein, 23 aa, Entamoeba invadens
PKKDKQLECGICFSESDQSFFYT

SEQ ID NO: 2960626 - protein, 18 aa, Entamoeba invadens
PKKEASMFDAKDSPNRLV

SEQ ID NO: 2960627 - protein, 20 aa, Entamoeba invadens
PKKEIDFALANNYPKVAFEQ

SEQ ID NO: 2960628 - protein, 20 aa, Entamoeba invadens
PKKEIYRTFTTGHILEDNTP

SEQ ID NO: 2960629 - protein, 17 aa, Entamoeba invadens
PKKELIDTWNLIKKFEC

SEQ ID NO: 2960630 - protein, 19 aa, Entamoeba invadens
PKKFLNLKMRNRSSNRNVE

SEQ ID NO: 2960631 - protein, 20 aa, Entamoeba invadens
PKKFPHVVPFNRNEEFCVGF

SEQ ID NO: 2960632 - protein, 23 aa, Entamoeba invadens
PKKFRIRDSKGFCYDEWDRPEEG

SEQ ID NO: 2960633 - protein, 19 aa, Entamoeba invadens
PKKGRFSLIDSSFEDLDEK

SEQ ID NO: 2960634 - protein, 18 aa, Entamoeba invadens
PKKIIIVGGVLKSEEQLT

SEQ ID NO: 2960635 - protein, 22 aa, Entamoeba invadens
PKKIVEPEMSFKITYTDTKEQI

SEQ ID NO: 2960636 - protein, 24 aa, Entamoeba invadens
PKKKKKKRICYYAPHKSEKKQRKE

SEQ ID NO: 2960637 - protein, 25 aa, Entamoeba invadens
PKKLDVRMMLPMSVRCNACGEYMYK

SEQ ID NO: 2960638 - protein, 24 aa, Entamoeba invadens
PKKMSVVTSVKWAKKKYVIPENQA

SEQ ID NO: 2960639 - protein, 21 aa, Entamoeba invadens
PKKNPPLCPSKKPTKLPLPRV

SEQ ID NO: 2960640 - protein, 19 aa, Entamoeba invadens
PKKREVEFVLSLFETDIRD

SEQ ID NO: 2960641 - protein, 25 aa, Entamoeba invadens
PKKRSTVNFCFPDLLEIDFGKDKMD

SEQ ID NO: 2960642 - protein, 24 aa, Entamoeba invadens
PKKSIKIANNIVVVGATFPEDKDI

SEQ ID NO: 2960643 - protein, 18 aa, Entamoeba invadens
PKLACDMYYTNSYIEEQP

SEQ ID NO: 2960644 - protein, 19 aa, Entamoeba invadens
PKLDVAPQYSLNPFSDTQN

SEQ ID NO: 2960645 - protein, 24 aa, Entamoeba invadens
PKLEKSGGFPSWLKVTPNKFEFSK

SEQ ID NO: 2960646 - protein, 18 aa, Entamoeba invadens
PKLETLYLPYEVDYDLSF

SEQ ID NO: 2960647 - protein, 19 aa, Entamoeba invadens
PKLETLYLPYEVDYNLSFL

SEQ ID NO: 2960648 - protein, 18 aa, Entamoeba invadens
PKLETLYLPYKVDYDLSF

SEQ ID NO: 2960649 - protein, 19 aa, Entamoeba invadens
PKLETWCIYNIQRKLEVPN

SEQ ID NO: 2960650 - protein, 19 aa, Entamoeba invadens
PKLFLPFMRTKFGGEILVR

SEQ ID NO: 2960651 - protein, 18 aa, Entamoeba invadens
PKLFTLKLNKCILPLSTV

SEQ ID NO: 2960652 - protein, 19 aa, Entamoeba invadens
PKLHCPLFVISFPRSGSTF

SEQ ID NO: 2960653 - protein, 20 aa, Entamoeba invadens
PKLIGKEIVKTVEFDYQMPE

SEQ ID NO: 2960654 - protein, 23 aa, Entamoeba invadens
PKLKELRRRMWAAKHTEPFPEDD

SEQ ID NO: 2960655 - protein, 23 aa, Entamoeba invadens
PKLKKEIAVPIFLNNLKEKLNKG

SEQ ID NO: 2960656 - protein, 25 aa, Entamoeba invadens
PKLKKISSIISRYGGGASFVNRPTY

SEQ ID NO: 2960657 - protein, 20 aa, Entamoeba invadens
PKLLFQLGSMYEKAGMFEQA

SEQ ID NO: 2960658 - protein, 17 aa, Entamoeba invadens
PKLLKQHHIHEGKVTAL

SEQ ID NO: 2960659 - protein, 22 aa, Entamoeba invadens
PKLLNIRRNTISVSKPVKQEEN

SEQ ID NO: 2960660 - protein, 20 aa, Entamoeba invadens
PKLSDLATFVCINKKSCDVS

SEQ ID NO: 2960661 - protein, 19 aa, Entamoeba invadens
PKLSDLINFVCINKKSCDV

SEQ ID NO: 2960662 - protein, 19 aa, Entamoeba invadens
PKLSPIAFLNCEKLHEIYL

SEQ ID NO: 2960663 - protein, 17 aa, Entamoeba invadens
PKLSSLILPNTPILFMK

SEQ ID NO: 2960664 - protein, 19 aa, Entamoeba invadens
PKLTTGINYLFGVLPNINT

SEQ ID NO: 2960665 - protein, 17 aa, Entamoeba invadens
PKLVFLFQGDALIDVYC

SEQ ID NO: 2960666 - protein, 22 aa, Entamoeba invadens
PKLVIQYTPSMHKIVITHEPEI

SEQ ID NO: 2960667 - protein, 25 aa, Entamoeba invadens
PKLVKAESVASCLPAEGEFTKTHAQ

SEQ ID NO: 2960668 - protein, 26 aa, Entamoeba invadens
PKLVNFGRNCFKGCKRLEEQILVPDD

SEQ ID NO: 2960669 - protein, 22 aa, Entamoeba invadens
PKLYEVVCCCIAIIPSSACIER

SEQ ID NO: 2960670 - protein, 20 aa, Entamoeba invadens
PKLYNNIMLCGGNANMHGLT

SEQ ID NO: 2960671 - protein, 31 aa, Entamoeba invadens
PKLYPEKVSLCPVCNKKAYPMEAISIEGVTM

SEQ ID NO: 2960672 - protein, 20 aa, Entamoeba invadens
PKLYRLHFLDVEIKIEEFLS

SEQ ID NO: 2960673 - protein, 21 aa, Entamoeba invadens
PKMCFAYCKSLTKVVFSSELS

SEQ ID NO: 2960674 - protein, 20 aa, Entamoeba invadens
PKMCGSFGKRCFQMCSTLTS

SEQ ID NO: 2960675 - protein, 20 aa, Entamoeba invadens
PKMFAEQLFALDLWLMKKLT

SEQ ID NO: 2960676 - protein, 24 aa, Entamoeba invadens
PKMKQEGWYVIVLRPDGSLAALKK

SEQ ID NO: 2960677 - protein, 28 aa, Entamoeba invadens
PKMKYEILPLAQEGFRWEKNDNGNYFGN

SEQ ID NO: 2960678 - protein, 22 aa, Entamoeba invadens
PKMLLLVSHLTFNYQLYKETAK

SEQ ID NO: 2960679 - protein, 24 aa, Entamoeba invadens
PKMPTEINEGIFLTFDFGGGTLDT

SEQ ID NO: 2960680 - protein, 25 aa, Entamoeba invadens
PKMPTEINEGIFLTFDFGRGTLETT

SEQ ID NO: 2960681 - protein, 21 aa, Entamoeba invadens
PKMSTYILAFVTGEFTSYTKV

SEQ ID NO: 2960682 - protein, 17 aa, Entamoeba invadens
PKMSTYIVAFVSGEFTS

SEQ ID NO: 2960683 - protein, 18 aa, Entamoeba invadens
PKMTTELYNTLCNEDQTF

SEQ ID NO: 2960684 - protein, 26 aa, Entamoeba invadens
PKNKKDDFAGLSFEAEIANFNKQLKD

SEQ ID NO: 2960685 - protein, 26 aa, Entamoeba invadens
PKNKKDDFAGLSFETEIAKIKKQQDD

SEQ ID NO: 2960686 - protein, 25 aa, Entamoeba invadens
PKNKKDDFAGLSFETEIGDIKKQQK

SEQ ID NO: 2960687 - protein, 25 aa, Entamoeba invadens
PKNKKKKRTLIMPWNPHQNDEVENE

SEQ ID NO: 2960688 - protein, 24 aa, Entamoeba invadens
PKNKYDILAELSMQQQQESASVSS

SEQ ID NO: 2960689 - protein, 18 aa, Entamoeba invadens
PKNVCPLDNSFSSFAKES

SEQ ID NO: 2960690 - protein, 17 aa, Entamoeba invadens
PKNVIALHCKAGKGRTG

SEQ ID NO: 2960691 - protein, 19 aa, Entamoeba invadens
PKNVIPRRTIERRKSQIFD

SEQ ID NO: 2960692 - protein, 26 aa, Entamoeba invadens
PKNVKRLGERCFAGCALLTSVVVPKG

SEQ ID NO: 2960693 - protein, 19 aa, Entamoeba invadens
PKNVLSIGKFCFLGCKSLE

SEQ ID NO: 2960694 - protein, 19 aa, Entamoeba invadens
PKNWRRSYSSLFVSVNSQQ

SEQ ID NO: 2960695 - protein, 22 aa, Entamoeba invadens
PKPEIPMVISSSYDGTVRVWDI

SEQ ID NO: 2960696 - protein, 23 aa, Entamoeba invadens
PKPESQGVIFIECDLPKEKQKEE

SEQ ID NO: 2960697 - protein, 17 aa, Entamoeba invadens
PKPFWKMAEELHKIKAY

SEQ ID NO: 2960698 - protein, 18 aa, Entamoeba invadens
PKPHSFFEGGMPGMKKKN

SEQ ID NO: 2960699 - protein, 20 aa, Entamoeba invadens
PKPKCYKVSLTASELNTFKT

SEQ ID NO: 2960700 - protein, 20 aa, Entamoeba invadens
PKPKESNYRIKVTSDIFYSL

SEQ ID NO: 2960701 - protein, 20 aa, Entamoeba invadens
PKPKKEVRIYTPVVVEPPIQ

SEQ ID NO: 2960702 - protein, 24 aa, Entamoeba invadens
PKPLKRPLEIQAEVLIFDPQVLTV

SEQ ID NO: 2960703 - protein, 23 aa, Entamoeba invadens
PKPNRNTLCYICMYLDEIVKNSD

SEQ ID NO: 2960704 - protein, 22 aa, Entamoeba invadens
PKPNRWKNVFTLNSSDSSELYV

SEQ ID NO: 2960705 - protein, 20 aa, Entamoeba invadens
PKPPRRARQPAPEGAEGTSA

SEQ ID NO: 2960706 - protein, 36 aa, Entamoeba invadens
PKPQSCCDCTFPLFCFPVCYQCKKVVYNCSHQTDIR

SEQ ID NO: 2960707 - protein, 23 aa, Entamoeba invadens
PKPRYFVLCTDLLFYTAPKKREV

SEQ ID NO: 2960708 - protein, 22 aa, Entamoeba invadens
PKQEGDFCFTEILYGQFRREVP

SEQ ID NO: 2960709 - protein, 30 aa, Entamoeba invadens
PKQEPKKWWKFAFEATRIKYTHTLFRKNLV

SEQ ID NO: 2960710 - protein, 25 aa, Entamoeba invadens
PKQKFKFPWTIAEYVIRGNRLPKPD

SEQ ID NO: 2960711 - protein, 23 aa, Entamoeba invadens
PKQVLKFFPNVTVINLWNNEQLN

SEQ ID NO: 2960712 - protein, 20 aa, Entamoeba invadens
PKRFLYWVTNVFPQIPESLR

SEQ ID NO: 2960713 - protein, 21 aa, Entamoeba invadens
PKRGEKTSVFATRSPHRPNNI

SEQ ID NO: 2960714 - protein, 20 aa, Entamoeba invadens
PKRPNFKAPMPPSGSQKVER

SEQ ID NO: 2960715 - protein, 17 aa, Entamoeba invadens
PKRYSFRGQDLEAMKKL

SEQ ID NO: 2960716 - protein, 25 aa, Entamoeba invadens
PKSDRGVVFVTRWLGENKVDFRATL

SEQ ID NO: 2960717 - protein, 21 aa, Entamoeba invadens
PKSDRGVVYASRWFGGDKLDF

SEQ ID NO: 2960718 - protein, 31 aa, Entamoeba invadens
PKSEILLFVTCLKLGVLTSELERITPKGEEV

SEQ ID NO: 2960719 - protein, 19 aa, Entamoeba invadens
PKSILVFVIGGITLGEIAT

SEQ ID NO: 2960720 - protein, 20 aa, Entamoeba invadens
PKSKKCLCRVISPYEEEATE

SEQ ID NO: 2960721 - protein, 25 aa, Entamoeba invadens
PKSKKEYFDSIVFENELFNENRLLF

SEQ ID NO: 2960722 - protein, 26 aa, Entamoeba invadens
PKSLCFIGNFCFKGCSSLKSVILPNE

SEQ ID NO: 2960723 - protein, 26 aa, Entamoeba invadens
PKSLCSVGIQTFCRCGLVTVDLSATV

SEQ ID NO: 2960724 - protein, 29 aa, Entamoeba invadens
PKSLKKVGERCFAFCYSLESVCCESQEVV

SEQ ID NO: 2960725 - protein, 26 aa, Entamoeba invadens
PKSLPRIYIDGCYDLFHWGHANVFRQ

SEQ ID NO: 2960726 - protein, 24 aa, Entamoeba invadens
PKSLQCIGEGAFISCHIKEITIPE

SEQ ID NO: 2960727 - protein, 26 aa, Entamoeba invadens
PKSLSKYHCCRELYGNVGYNVKSQYQ

SEQ ID NO: 2960728 - protein, 24 aa, Entamoeba invadens
PKSMKEKILIKRLKKFETIKNERK

SEQ ID NO: 2960729 - protein, 18 aa, Entamoeba invadens
PKSPNCFDTLSFAIIEDS

SEQ ID NO: 2960730 - protein, 17 aa, Entamoeba invadens
PKSPPIEILNATNEQNK

SEQ ID NO: 2960731 - protein, 20 aa, Entamoeba invadens
PKSQKSQMLYLKQQLEKSEK

SEQ ID NO: 2960732 - protein, 29 aa, Entamoeba invadens
PKSQMLRKDEWLMLYDFFNNIKEDLSNYQ

SEQ ID NO: 2960733 - protein, 19 aa, Entamoeba invadens
PKSRRDVIEDVPYVDCTDY

SEQ ID NO: 2960734 - protein, 18 aa, Entamoeba invadens
PKSSAGWVQGALVEESLG

SEQ ID NO: 2960735 - protein, 31 aa, Entamoeba invadens
PKSSEVRPEVVLKQAFKFVMDNFKKTNDYDY

SEQ ID NO: 2960736 - protein, 24 aa, Entamoeba invadens
PKSVCFVASNAFGWCESLKELTFS

SEQ ID NO: 2960737 - protein, 30 aa, Entamoeba invadens
PKSVERIGQFAFFWCRSLLIFNGGDSLENV

SEQ ID NO: 2960738 - protein, 19 aa, Entamoeba invadens
PKSVPKLSPIAFLNCEKLH

SEQ ID NO: 2960739 - protein, 28 aa, Entamoeba invadens
PKSVTKIGAFAFRKCLSLTTFEIPENVL

SEQ ID NO: 2960740 - protein, 17 aa, Entamoeba invadens
PKSVVLLSGLSPETKGK

SEQ ID NO: 2960741 - protein, 17 aa, Entamoeba invadens
PKSVYFFHSKLREIHPI

SEQ ID NO: 2960742 - protein, 19 aa, Entamoeba invadens
PKTAIAVISCLSFLAGVPN

SEQ ID NO: 2960743 - protein, 17 aa, Entamoeba invadens
PKTETKGTVLLKDADQF

SEQ ID NO: 2960744 - protein, 20 aa, Entamoeba invadens
PKTHTAFFTRCGKLVKETEV

SEQ ID NO: 2960745 - protein, 27 aa, Entamoeba invadens
PKTKDFVLSCLGFFAIKQTGCKINSPE

SEQ ID NO: 2960746 - protein, 23 aa, Entamoeba invadens
PKTKSTDVVPSFEIGRSDKGPWS

SEQ ID NO: 2960747 - protein, 20 aa, Entamoeba invadens
PKTLIKMIGCGTRESYVGEE

SEQ ID NO: 2960748 - protein, 24 aa, Entamoeba invadens
PKTLKRFALVGVYSDLPKLGELNS

SEQ ID NO: 2960749 - protein, 23 aa, Entamoeba invadens
PKTLLSIGDFCFQMCVSISTLNI

SEQ ID NO: 2960750 - protein, 19 aa, Entamoeba invadens
PKTNYLTVYEWKTETYLMK

SEQ ID NO: 2960751 - protein, 24 aa, Entamoeba invadens
PKTPREDRFSLAINEGAEGSRLSH

SEQ ID NO: 2960752 - protein, 22 aa, Entamoeba invadens
PKTPRLEDLGAIDLSINNLDVS

SEQ ID NO: 2960753 - protein, 25 aa, Entamoeba invadens
PKTQFKYPWVIAKFVIEGKRLDKKE

SEQ ID NO: 2960754 - protein, 24 aa, Entamoeba invadens
PKTRRPNSPYPRRSASSESGEKEF

SEQ ID NO: 2960755 - protein, 18 aa, Entamoeba invadens
PKTVICLENANAKELDDE

SEQ ID NO: 2960756 - protein, 19 aa, Entamoeba invadens
PKTVTNLGLSCFNSTQKTA

SEQ ID NO: 2960757 - protein, 35 aa, Entamoeba invadens
PKTWPSTGSVEFIDFKFKYRRGLPMKLKGINAKIE

SEQ ID NO: 2960758 - protein, 17 aa, Entamoeba invadens
PKTYKAISLMIPNMEVM

SEQ ID NO: 2960759 - protein, 29 aa, Entamoeba invadens
PKVCFLFKNIFVVCKVKNYQGKVLDKKGM

SEQ ID NO: 2960760 - protein, 19 aa, Entamoeba invadens
PKVDGDFFLLFSHGKVKNI

SEQ ID NO: 2960761 - protein, 26 aa, Entamoeba invadens
PKVDSRYRFQGGYYCMVNRADGKAIR

SEQ ID NO: 2960762 - protein, 17 aa, Entamoeba invadens
PKVECLFTTDEEPGLLG

SEQ ID NO: 2960763 - protein, 19 aa, Entamoeba invadens
PKVEIVLKEMQRCEETIEQ

SEQ ID NO: 2960764 - protein, 27 aa, Entamoeba invadens
PKVELSDGFSYFGIGAFCEAKNIVKIA

SEQ ID NO: 2960765 - protein, 18 aa, Entamoeba invadens
PKVEVMWNSTLIELVGDG

SEQ ID NO: 2960766 - protein, 20 aa, Entamoeba invadens
PKVFLIKNVMERGMSLVSSF

SEQ ID NO: 2960767 - protein, 23 aa, Entamoeba invadens
PKVGSPEKRGFGSNTGAPKVTKD

SEQ ID NO: 2960768 - protein, 22 aa, Entamoeba invadens
PKVIDLAFCKLYGVANTNKFVL

SEQ ID NO: 2960769 - protein, 20 aa, Entamoeba invadens
PKVIKFIIFDRYLKHIKSFE

SEQ ID NO: 2960770 - protein, 17 aa, Entamoeba invadens
PKVKAEIEVKEKKQKKQ

SEQ ID NO: 2960771 - protein, 25 aa, Entamoeba invadens
PKVKCRGSCLQLVITENSNGGRDSH

SEQ ID NO: 2960772 - protein, 17 aa, Entamoeba invadens
PKVNFGENLFCDEEQKL

SEQ ID NO: 2960773 - protein, 22 aa, Entamoeba invadens
PKVPHAPNFFGIQLEPMTPYFR

SEQ ID NO: 2960774 - protein, 18 aa, Entamoeba invadens
PKVRCVGEDFWQKRMSES

SEQ ID NO: 2960775 - protein, 18 aa, Entamoeba invadens
PKVSVIVPLSSGCTRLTL

SEQ ID NO: 2960776 - protein, 19 aa, Entamoeba invadens
PKVTEKRAILQPPPKKTPQ

SEQ ID NO: 2960777 - protein, 20 aa, Entamoeba invadens
PKVTLSLGKFFPAAIVNAIK

SEQ ID NO: 2960778 - protein, 25 aa, Entamoeba invadens
PKVVKRCYNYLLEIIRVVLTVHHPE

SEQ ID NO: 2960779 - protein, 27 aa, Entamoeba invadens
PKWMNRSCGCAFGFGGKFVSYNENEIL

SEQ ID NO: 2960780 - protein, 21 aa, Entamoeba invadens
PKYDINLCVKNDVIPVPPFIM

SEQ ID NO: 2960781 - protein, 26 aa, Entamoeba invadens
PKYDLLLYTMKAFFKMLCFGEHLLNE

SEQ ID NO: 2960782 - protein, 24 aa, Entamoeba invadens
PKYERFIRPAAMRFTKAHVTHPEL

SEQ ID NO: 2960783 - protein, 22 aa, Entamoeba invadens
PKYFERRGSLGRSFTKAIFKAK

SEQ ID NO: 2960784 - protein, 22 aa, Entamoeba invadens
PKYFNVCMCCRAPLDNPRKYCL

SEQ ID NO: 2960785 - protein, 20 aa, Entamoeba invadens
PKYGLRYLVSNDERDKVPTY

SEQ ID NO: 2960786 - protein, 27 aa, Entamoeba invadens
PKYGRNALLFNLVFVFSRDTSDSTISR

SEQ ID NO: 2960787 - protein, 24 aa, Entamoeba invadens
PKYIARRLIRFSSEDIGLADTNAL

SEQ ID NO: 2960788 - protein, 18 aa, Entamoeba invadens
PKYIKLLINIIQTALSSH

SEQ ID NO: 2960789 - protein, 23 aa, Entamoeba invadens
PKYQLKLNLFNGGEKEEISRQIT

SEQ ID NO: 2960790 - protein, 19 aa, Entamoeba invadens
PKYSQFAFNCFDDAHHRLF

SEQ ID NO: 2960791 - protein, 18 aa, Entamoeba invadens
PKYVCSVFPKINTFRSTP

SEQ ID NO: 2960792 - protein, 27 aa, Entamoeba invadens
PKYVSLVGVWCFKGCDSLVTIQCSSTL

SEQ ID NO: 2960793 - protein, 21 aa, Entamoeba invadens
PKYYPRFDFAKVECISINISP

SEQ ID NO: 2960794 - protein, 24 aa, Entamoeba invadens
PLALREIKTAFDLNPNDRFFYNKA

SEQ ID NO: 2960795 - protein, 18 aa, Entamoeba invadens
PLANFLLSYGYFDKEIIC

SEQ ID NO: 2960796 - protein, 19 aa, Entamoeba invadens
PLANTITSIGFFNLPTKCT

SEQ ID NO: 2960797 - protein, 23 aa, Entamoeba invadens
PLARDLFNFAFFASWEESPENTK

SEQ ID NO: 2960798 - protein, 19 aa, Entamoeba invadens
PLARSWTFWVDDFAIKNAS

SEQ ID NO: 2960799 - protein, 17 aa, Entamoeba invadens
PLAVMRNIFTYLTQTDI

SEQ ID NO: 2960800 - protein, 18 aa, Entamoeba invadens
PLCEQCVLAQKMVCPFYC

SEQ ID NO: 2960801 - protein, 26 aa, Entamoeba invadens
PLCNVFATNMFLTFSVANALSKTVST

SEQ ID NO: 2960802 - protein, 21 aa, Entamoeba invadens
PLCTHVLKLLEEFPENEVLVK

SEQ ID NO: 2960803 - protein, 22 aa, Entamoeba invadens
PLDILRKQICILPQEATLFSGS

SEQ ID NO: 2960804 - protein, 18 aa, Entamoeba invadens
PLDKVEIPVMQWQEVQTR

SEQ ID NO: 2960805 - protein, 27 aa, Entamoeba invadens
PLDLFRGFCCDGLDMGISMGICIVGIM

SEQ ID NO: 2960806 - protein, 23 aa, Entamoeba invadens
PLDSCAPRMAYSGSPRARKPAMY

SEQ ID NO: 2960807 - protein, 24 aa, Entamoeba invadens
PLDVPLKIDLFLQCCERIQWLHNV

SEQ ID NO: 2960808 - protein, 17 aa, Entamoeba invadens
PLDWKNAILRHFFQHGF

SEQ ID NO: 2960809 - protein, 17 aa, Entamoeba invadens
PLEDRIKYAESLFTQLE

SEQ ID NO: 2960810 - protein, 28 aa, Entamoeba invadens
PLEGSSGGFGWCDRLLLRTIKVDHGCDS

SEQ ID NO: 2960811 - protein, 18 aa, Entamoeba invadens
PLEIKITCFKYQNEIEKR

SEQ ID NO: 2960812 - protein, 20 aa, Entamoeba invadens
PLEKHFDAVCVKKGVIRKEY

SEQ ID NO: 2960813 - protein, 25 aa, Entamoeba invadens
PLEKKRILFLKRWLVQLQGEDDGTL

SEQ ID NO: 2960814 - protein, 17 aa, Entamoeba invadens
PLENCIESISLPPWAHN

SEQ ID NO: 2960815 - protein, 19 aa, Entamoeba invadens
PLEQIKSLIPLLLGAQGRF

SEQ ID NO: 2960816 - protein, 18 aa, Entamoeba invadens
PLEQYRMMCHRFHGKNPS

SEQ ID NO: 2960817 - protein, 18 aa, Entamoeba invadens
PLESLCLQILLFGETDPV

SEQ ID NO: 2960818 - protein, 18 aa, Entamoeba invadens
PLFAEMEIKKTVEVCSRL

SEQ ID NO: 2960819 - protein, 19 aa, Entamoeba invadens
PLFIRRIGTVLSPLREFIA

SEQ ID NO: 2960820 - protein, 22 aa, Entamoeba invadens
PLFKESLVFKDIMCVLNELEYH

SEQ ID NO: 2960821 - protein, 23 aa, Entamoeba invadens
PLFMPKKLGQRINIDVEKDEFIG

SEQ ID NO: 2960822 - protein, 25 aa, Entamoeba invadens
PLFNCDFPHGYICLEYCQNGNLESF

SEQ ID NO: 2960823 - protein, 18 aa, Entamoeba invadens
PLFPIKNKINTEVVTKKN

SEQ ID NO: 2960824 - protein, 26 aa, Entamoeba invadens
PLFPNVETLNVWSLFDYFYNFYDLVK

SEQ ID NO: 2960825 - protein, 17 aa, Entamoeba invadens
PLFPSGRERYAPFDSPR

SEQ ID NO: 2960826 - protein, 24 aa, Entamoeba invadens
PLFVAKMLRKKGVRVKKTTYTERD

SEQ ID NO: 2960827 - protein, 18 aa, Entamoeba invadens
PLFWNWKNASFKSKGVPV

SEQ ID NO: 2960828 - protein, 29 aa, Entamoeba invadens
PLGAGREVGRSCFVLKYMGHNIMLDCGVH

SEQ ID NO: 2960829 - protein, 25 aa, Entamoeba invadens
PLGFSYLRTLMRAVSELTHGQYASL

SEQ ID NO: 2960830 - protein, 18 aa, Entamoeba invadens
PLGQPISCKIRLQNTSEE

SEQ ID NO: 2960831 - protein, 18 aa, Entamoeba invadens
PLHIACLYANKSLVETLL

SEQ ID NO: 2960832 - protein, 37 aa, Entamoeba invadens
PLHLFCAFFPNPNCAEAFHLFLRRGADLNARNKTGET

SEQ ID NO: 2960833 - protein, 21 aa, Entamoeba invadens
PLHLLQTGWTYWFDPGTNQVF

SEQ ID NO: 2960834 - protein, 19 aa, Entamoeba invadens
PLHMKSESITTVEDINNQK

SEQ ID NO: 2960835 - protein, 23 aa, Entamoeba invadens
PLHPHLKPIVFINGNPIELDISI

SEQ ID NO: 2960836 - protein, 20 aa, Entamoeba invadens
PLHPRLGKLLHLLNKEELGE

SEQ ID NO: 2960837 - protein, 20 aa, Entamoeba invadens
PLIDIPTCVTFIAKTAFGGN

SEQ ID NO: 2960838 - protein, 24 aa, Entamoeba invadens
PLIESSMCYIIFDLCDVDNDGYLD

SEQ ID NO: 2960839 - protein, 20 aa, Entamoeba invadens
PLIEVLKMTINVAKGVQALN

SEQ ID NO: 2960840 - protein, 19 aa, Entamoeba invadens
PLIEWKIGTEPNYYPISAP

SEQ ID NO: 2960841 - protein, 19 aa, Entamoeba invadens
PLIFSISVPLLLQSNDVLL

SEQ ID NO: 2960842 - protein, 23 aa, Entamoeba invadens
PLIPRTSTTLVRFLTTRINETYR

SEQ ID NO: 2960843 - protein, 17 aa, Entamoeba invadens
PLIPRYSNPSIFKFLKC

SEQ ID NO: 2960844 - protein, 21 aa, Entamoeba invadens
PLITCRPVPLTSHQQFQAQNS

SEQ ID NO: 2960845 - protein, 19 aa, Entamoeba invadens
PLIVQCVRSDVPKEYGLFE

SEQ ID NO: 2960846 - protein, 18 aa, Entamoeba invadens
PLIVQCVRTDVPKEYGLF

SEQ ID NO: 2960847 - protein, 22 aa, Entamoeba invadens
PLIWKCIMQPYTSRGYSSTQIP

SEQ ID NO: 2960848 - protein, 25 aa, Entamoeba invadens
PLKDVLELWSGLGYNSRAKRLRDLA

SEQ ID NO: 2960849 - protein, 20 aa, Entamoeba invadens
PLKEGVCQSVNKKVFYNDVA

SEQ ID NO: 2960850 - protein, 21 aa, Entamoeba invadens
PLKEHLKYGIINLDKPANPSS

SEQ ID NO: 2960851 - protein, 23 aa, Entamoeba invadens
PLKIPQCDELGFLSPKCPQSPNE

SEQ ID NO: 2960852 - protein, 18 aa, Entamoeba invadens
PLKLFSECVTCFERNNNT

SEQ ID NO: 2960853 - protein, 22 aa, Entamoeba invadens
PLKLLKTRVGRCGEYANCFTFI

SEQ ID NO: 2960854 - protein, 18 aa, Entamoeba invadens
PLKMCTKLRNQFDRLRDL

SEQ ID NO: 2960855 - protein, 29 aa, Entamoeba invadens
PLKMKSTEIKYGRLSSILNDKPPLQQQKT

SEQ ID NO: 2960856 - protein, 18 aa, Entamoeba invadens
PLKNACKEVLKTVKQTQD

SEQ ID NO: 2960857 - protein, 20 aa, Entamoeba invadens
PLKRLKMFKMCNVQGVDKWY

SEQ ID NO: 2960858 - protein, 32 aa, Entamoeba invadens
PLKSCPLTLLLRYLETLTGFAITSESLNNILN

SEQ ID NO: 2960859 - protein, 26 aa, Entamoeba invadens
PLKVLYFDVAIQFSKTYQYRIMCFLF

SEQ ID NO: 2960860 - protein, 26 aa, Entamoeba invadens
PLLELKKIYNVLGLRHKVLKDRHEEC

SEQ ID NO: 2960861 - protein, 19 aa, Entamoeba invadens
PLLEVLIEKKYEGMSVQTR

SEQ ID NO: 2960862 - protein, 18 aa, Entamoeba invadens
PLLFKRFVYNFAHGRYVY

SEQ ID NO: 2960863 - protein, 26 aa, Entamoeba invadens
PLLKAFKARGGILVVVSFSSAENINK

SEQ ID NO: 2960864 - protein, 24 aa, Entamoeba invadens
PLLKRSKNNFCIQRQVSGYHFEAD

SEQ ID NO: 2960865 - protein, 18 aa, Entamoeba invadens
PLLPLGKCVNILGEEWRV

SEQ ID NO: 2960866 - protein, 27 aa, Entamoeba invadens
PLLQMCVKRKRPLIIIADTIDGDALTT

SEQ ID NO: 2960867 - protein, 24 aa, Entamoeba invadens
PLLYKRCLLTDALIRVEEENEAQR

SEQ ID NO: 2960868 - protein, 28 aa, Entamoeba invadens
PLMNMGCDFTCMPSMFEPSGLVQQESFL

SEQ ID NO: 2960869 - protein, 23 aa, Entamoeba invadens
PLMQQCGMPQMVGVQPQPAMGPL

SEQ ID NO: 2960870 - protein, 20 aa, Entamoeba invadens
PLMVACFYLNIENMDILIKA

SEQ ID NO: 2960871 - protein, 26 aa, Entamoeba invadens
PLMVACFYMNLEIMQFLINAGAKIDR

SEQ ID NO: 2960872 - protein, 29 aa, Entamoeba invadens
PLNCIGSSCTKPPFNFGMGDSYEDPVYIS

SEQ ID NO: 2960873 - protein, 25 aa, Entamoeba invadens
PLNCKTIEYFPCVETLHLWQKEDEN

SEQ ID NO: 2960874 - protein, 17 aa, Entamoeba invadens
PLNCKTLGYFSNIETLH

SEQ ID NO: 2960875 - protein, 27 aa, Entamoeba invadens
PLNIIGKCVLLIYKDLHQVPTSKCITW

SEQ ID NO: 2960876 - protein, 17 aa, Entamoeba invadens
PLNKDVKEEFSFTSTFQ

SEQ ID NO: 2960877 - protein, 21 aa, Entamoeba invadens
PLNKIMTIIYIPWIVQQIGKG

SEQ ID NO: 2960878 - protein, 18 aa, Entamoeba invadens
PLNLPFSVKIHLPKELQK

SEQ ID NO: 2960879 - protein, 20 aa, Entamoeba invadens
PLNPFSMAFTQKFLGMLESK

SEQ ID NO: 2960880 - protein, 19 aa, Entamoeba invadens
PLPALGRVSEELRKNGRIE

SEQ ID NO: 2960881 - protein, 21 aa, Entamoeba invadens
PLPCEGVYFVLYKTNFDTLLK

SEQ ID NO: 2960882 - protein, 17 aa, Entamoeba invadens
PLPDMTDAFLVKNGIVE

SEQ ID NO: 2960883 - protein, 19 aa, Entamoeba invadens
PLPFAKLSIPSKVVYLDNG

SEQ ID NO: 2960884 - protein, 18 aa, Entamoeba invadens
PLPFKTGLRNGFEVLSIY

SEQ ID NO: 2960885 - protein, 17 aa, Entamoeba invadens
PLPKEFDCICSPFHNIF

SEQ ID NO: 2960886 - protein, 18 aa, Entamoeba invadens
PLPKLVNCSIRFCSTMNG

SEQ ID NO: 2960887 - protein, 20 aa, Entamoeba invadens
PLPKRTGIKDRLAFFEKMSQ

SEQ ID NO: 2960888 - protein, 18 aa, Entamoeba invadens
PLPLCFTIFSAPNYCDQY

SEQ ID NO: 2960889 - protein, 17 aa, Entamoeba invadens
PLPLPQIVLDFLKALGP

SEQ ID NO: 2960890 - protein, 26 aa, Entamoeba invadens
PLPLQSICWPLLLSAKNVFATSDINS

SEQ ID NO: 2960891 - protein, 18 aa, Entamoeba invadens
PLPLRKAKITCEAAKKKS

SEQ ID NO: 2960892 - protein, 18 aa, Entamoeba invadens
PLPNMALYDGNSAKGVFN

SEQ ID NO: 2960893 - protein, 18 aa, Entamoeba invadens
PLPPRPGTPPSPSRQHRP

SEQ ID NO: 2960894 - protein, 20 aa, Entamoeba invadens
PLPQFVIWFPVTHDYAKEFE

SEQ ID NO: 2960895 - protein, 17 aa, Entamoeba invadens
PLPQLPEGAVGGRPRTP

SEQ ID NO: 2960896 - protein, 24 aa, Entamoeba invadens
PLQLKEVILRGEVVSIKLNSGLER

SEQ ID NO: 2960897 - protein, 24 aa, Entamoeba invadens
PLQMKINMCEMLFKEEAESVRFVD

SEQ ID NO: 2960898 - protein, 25 aa, Entamoeba invadens
PLQNWLRPGQTVSVRIFEMPTEFLQ

SEQ ID NO: 2960899 - protein, 26 aa, Entamoeba invadens
PLQPYEFLKLLTLYFIVMKKDKKNLF

SEQ ID NO: 2960900 - protein, 25 aa, Entamoeba invadens
PLQQQCIQNNPILKKPAHVKKDVSV

SEQ ID NO: 2960901 - protein, 26 aa, Entamoeba invadens
PLQYFADGCVYQLFVLVAKGMLKVNE

SEQ ID NO: 2960902 - protein, 20 aa, Entamoeba invadens
PLRYRAAYGGPLDKFDQKEK

SEQ ID NO: 2960903 - protein, 20 aa, Entamoeba invadens
PLRYSEAIISIFCAEKNSSV

SEQ ID NO: 2960904 - protein, 21 aa, Entamoeba invadens
PLSDLKITLIFEDPLDANAWF

SEQ ID NO: 2960905 - protein, 17 aa, Entamoeba invadens
PLSELFTEKIIRLDNNR

SEQ ID NO: 2960906 - protein, 19 aa, Entamoeba invadens
PLSESFRGGSKMANEKIKQ

SEQ ID NO: 2960907 - protein, 21 aa, Entamoeba invadens
PLSFGALFYFLEKTMSIVLKL

SEQ ID NO: 2960908 - protein, 24 aa, Entamoeba invadens
PLSKKKSLVTWFIKEVLVNEENPN

SEQ ID NO: 2960909 - protein, 18 aa, Entamoeba invadens
PLSMVVKMYQSFAVPTPL

SEQ ID NO: 2960910 - protein, 26 aa, Entamoeba invadens
PLSPIKGSCKSSCWDGEILYVGGSAK

SEQ ID NO: 2960911 - protein, 27 aa, Entamoeba invadens
PLSSFKYCPKCGSPEFVVSTFKSKKCN

SEQ ID NO: 2960912 - protein, 22 aa, Entamoeba invadens
PLSSFPSMFSLSGIQKEIYPYN

SEQ ID NO: 2960913 - protein, 28 aa, Entamoeba invadens
PLSSTRGDLFIKFTVIFPKIEEIQKNLE

SEQ ID NO: 2960914 - protein, 26 aa, Entamoeba invadens
PLSVLNYYLQFVFSFIASTEITSRKA

SEQ ID NO: 2960915 - protein, 18 aa, Entamoeba invadens
PLSYPQTDIFVLCFSVIY

SEQ ID NO: 2960916 - protein, 17 aa, Entamoeba invadens
PLSYPQTDVFLICFSVV

SEQ ID NO: 2960917 - protein, 18 aa, Entamoeba invadens
PLSYPQTDVFLICFSVVL

SEQ ID NO: 2960918 - protein, 18 aa, Entamoeba invadens
PLSYPQTDVFLICFSVVS

SEQ ID NO: 2960919 - protein, 18 aa, Entamoeba invadens
PLTAKEMEIVTAINQRPD

SEQ ID NO: 2960920 - protein, 23 aa, Entamoeba invadens
PLTCKTIRFFLNIETLHLWHKND

SEQ ID NO: 2960921 - protein, 22 aa, Entamoeba invadens
PLTEFQRIWYKKVLMGDITTII

SEQ ID NO: 2960922 - protein, 26 aa, Entamoeba invadens
PLTIIPICECVKVIKQGKESVKITSY

SEQ ID NO: 2960923 - protein, 20 aa, Entamoeba invadens
PLTLFEEIEKFIVDSFTNEV

SEQ ID NO: 2960924 - protein, 24 aa, Entamoeba invadens
PLTPDEINEFLAIVKSANNDEEIR

SEQ ID NO: 2960925 - protein, 25 aa, Entamoeba invadens
PLTPRGSTQPSLFAPQPVYPQTPIK

SEQ ID NO: 2960926 - protein, 22 aa, Entamoeba invadens
PLTRESISIIPKVDDFEKSEDS

SEQ ID NO: 2960927 - protein, 18 aa, Entamoeba invadens
PLTSIVISKNMTSLSDGV

SEQ ID NO: 2960928 - protein, 17 aa, Entamoeba invadens
PLTSRRPLLQHIVLAGG

SEQ ID NO: 2960929 - protein, 17 aa, Entamoeba invadens
PLTVNHDLYPLGVCLYR

SEQ ID NO: 2960930 - protein, 19 aa, Entamoeba invadens
PLVAHAIVDLSLYDKTREM

SEQ ID NO: 2960931 - protein, 25 aa, Entamoeba invadens
PLVDGNCGKGVYMYRNYSDAIADSS

SEQ ID NO: 2960932 - protein, 18 aa, Entamoeba invadens
PLVHGYPLTRAVMIDHPL

SEQ ID NO: 2960933 - protein, 24 aa, Entamoeba invadens
PLVIKTDCLCGTEILATRPESDDE

SEQ ID NO: 2960934 - protein, 19 aa, Entamoeba invadens
PLVNYFVGGIVFGKESMMF

SEQ ID NO: 2960935 - protein, 21 aa, Entamoeba invadens
PLVQSCTWDTLAVQVILEALG

SEQ ID NO: 2960936 - protein, 18 aa, Entamoeba invadens
PLVRCVTGLSRIIALRAQ

SEQ ID NO: 2960937 - protein, 25 aa, Entamoeba invadens
PLVREVRYASLRFHLHLLVSECMKA

SEQ ID NO: 2960938 - protein, 36 aa, Entamoeba invadens
PLVSNELFVALALLRFGVRIPDIFTYILPLNEEFLT

SEQ ID NO: 2960939 - protein, 18 aa, Entamoeba invadens
PLVSTSSSIVKWWTPQDT

SEQ ID NO: 2960940 - protein, 19 aa, Entamoeba invadens
PLVTLKPGYACEFEISIKP

SEQ ID NO: 2960941 - protein, 18 aa, Entamoeba invadens
PLVVFKYIEACARAGQFQ

SEQ ID NO: 2960942 - protein, 20 aa, Entamoeba invadens
PLVVKLLRYLVSNNEVVRVC

SEQ ID NO: 2960943 - protein, 28 aa, Entamoeba invadens
PLVVPLYRGARFNCFEDIMADDRPSLLR

SEQ ID NO: 2960944 - protein, 23 aa, Entamoeba invadens
PLWGQFEKLGMLFQKNYSGFRAE

SEQ ID NO: 2960945 - protein, 23 aa, Entamoeba invadens
PLWKMWDYVIELAIPKLVNSTKQ

SEQ ID NO: 2960946 - protein, 24 aa, Entamoeba invadens
PLWMKEVFEGNGFVVQNVKYTKDD

SEQ ID NO: 2960947 - protein, 17 aa, Entamoeba invadens
PLYALSFLLDSRSLQVS

SEQ ID NO: 2960948 - protein, 23 aa, Entamoeba invadens
PLYDCVIQNAFLFPEEKKQNGDV

SEQ ID NO: 2960949 - protein, 24 aa, Entamoeba invadens
PLYIKARSRMADFLETLGKFVNDD

SEQ ID NO: 2960950 - protein, 18 aa, Entamoeba invadens
PLYLTQIIIPYGVSQINS

SEQ ID NO: 2960951 - protein, 20 aa, Entamoeba invadens
PLYNIPRKSRHLKISEDTLK

SEQ ID NO: 2960952 - protein, 23 aa, Entamoeba invadens
PLYPAVCPTGAVSDKVMAEEVAK

SEQ ID NO: 2960953 - protein, 30 aa, Entamoeba invadens
PLYRRVPYYDFRWGMTIDDFPELKEEDNKW

SEQ ID NO: 2960954 - protein, 26 aa, Entamoeba invadens
PLYYKRTPICIIVYFFVYCYSVNTNG

SEQ ID NO: 2960955 - protein, 18 aa, Entamoeba invadens
PMAPRKKNSVSRFELIRK

SEQ ID NO: 2960956 - protein, 18 aa, Entamoeba invadens
PMAVPGIDNLSVMEIDVK

SEQ ID NO: 2960957 - protein, 20 aa, Entamoeba invadens
PMCCGNLWSVPDNDLDTMTL

SEQ ID NO: 2960958 - protein, 19 aa, Entamoeba invadens
PMCSSLSKYFALIRNSGVK

SEQ ID NO: 2960959 - protein, 19 aa, Entamoeba invadens
PMDDLMLLVARRVVDEYPL

SEQ ID NO: 2960960 - protein, 22 aa, Entamoeba invadens
PMDLKIRFPVHVVFPDKYQSAA

SEQ ID NO: 2960961 - protein, 18 aa, Entamoeba invadens
PMDSLEIYEHIRRIKDPE

SEQ ID NO: 2960962 - protein, 20 aa, Entamoeba invadens
PMEQRIVPHIALNKTATFTV

SEQ ID NO: 2960963 - protein, 18 aa, Entamoeba invadens
PMFHVYQATNGFRSQDYL

SEQ ID NO: 2960964 - protein, 25 aa, Entamoeba invadens
PMFYHYKNKVCMIKYVRYFEVKAGY

SEQ ID NO: 2960965 - protein, 17 aa, Entamoeba invadens
PMGLTRIHVRPSVRKRY

SEQ ID NO: 2960966 - protein, 19 aa, Entamoeba invadens
PMKSSAFLKSPRTISTLKL

SEQ ID NO: 2960967 - protein, 19 aa, Entamoeba invadens
PMLGIAPKWCSFLENLTEE

SEQ ID NO: 2960968 - protein, 32 aa, Entamoeba invadens
PMLHKERFQLLNIRPSRGVLLYGPSGCAKTSV

SEQ ID NO: 2960969 - protein, 24 aa, Entamoeba invadens
PMLHPEAFENLGIDPPKGVLLYGP

SEQ ID NO: 2960970 - protein, 17 aa, Entamoeba invadens
PMNKNFEAHHLFIDFLR

SEQ ID NO: 2960971 - protein, 18 aa, Entamoeba invadens
PMNRFLRGEFDDQLDDED

SEQ ID NO: 2960972 - protein, 25 aa, Entamoeba invadens
PMPGDNSCLFHCLEYLFYNKSTQDP

SEQ ID NO: 2960973 - protein, 20 aa, Entamoeba invadens
PMPIQLLIKAEFFQKMMSQV

SEQ ID NO: 2960974 - protein, 28 aa, Entamoeba invadens
PMQCSALRKGGYVVIKGRPCKLVEMSTS

SEQ ID NO: 2960975 - protein, 19 aa, Entamoeba invadens
PMRVLLKFYEQCCPHPIDE

SEQ ID NO: 2960976 - protein, 25 aa, Entamoeba invadens
PMSDLTDAIGYEWFGDEVVNAFVSL

SEQ ID NO: 2960977 - protein, 21 aa, Entamoeba invadens
PMSGIPNGKGNEWGGYVCDET

SEQ ID NO: 2960978 - protein, 18 aa, Entamoeba invadens
PMSLFPFLNDMWVGCANC

SEQ ID NO: 2960979 - protein, 25 aa, Entamoeba invadens
PMSLPLKLVSPLIIEPLNVLKKSEK

SEQ ID NO: 2960980 - protein, 23 aa, Entamoeba invadens
PMSYSVSFTGTFFVSKDSVKEKD

SEQ ID NO: 2960981 - protein, 25 aa, Entamoeba invadens
PMTSTLCDCNPCFLGQRDTIATAKE

SEQ ID NO: 2960982 - protein, 18 aa, Entamoeba invadens
PMTTCFNVDMTYLMDKVK

SEQ ID NO: 2960983 - protein, 17 aa, Entamoeba invadens
PMVLCLSETATESVKGG

SEQ ID NO: 2960984 - protein, 19 aa, Entamoeba invadens
PMVYRLIWLNFPERKLRLV

SEQ ID NO: 2960985 - protein, 18 aa, Entamoeba invadens
PMVYTVFGAQGYYKESDK

SEQ ID NO: 2960986 - protein, 19 aa, Entamoeba invadens
PNAGRSFIRDGVMSVKGKS

SEQ ID NO: 2960987 - protein, 23 aa, Entamoeba invadens
PNAKVIRMMESFMSIENYKNFFL

SEQ ID NO: 2960988 - protein, 23 aa, Entamoeba invadens
PNAPELLKTALIKERNGPLKCSA

SEQ ID NO: 2960989 - protein, 19 aa, Entamoeba invadens
PNAVFKIGPLKMLDFALND

SEQ ID NO: 2960990 - protein, 24 aa, Entamoeba invadens
PNAVFSLQLFRDFPLTTSPQFARI

SEQ ID NO: 2960991 - protein, 21 aa, Entamoeba invadens
PNAYFGFAGVVTFKNAKNVLD

SEQ ID NO: 2960992 - protein, 19 aa, Entamoeba invadens
PNCDIPLDNYVEAASSGAA

SEQ ID NO: 2960993 - protein, 20 aa, Entamoeba invadens
PNCQRPACYTSHGSSYDDNP

SEQ ID NO: 2960994 - protein, 25 aa, Entamoeba invadens
PNCRYCPKCGNAILGDPNTPEIFCR

SEQ ID NO: 2960995 - protein, 18 aa, Entamoeba invadens
PNCTLFTILRDVASALSF

SEQ ID NO: 2960996 - protein, 17 aa, Entamoeba invadens
PNCVTKIGQRCFENCPL

SEQ ID NO: 2960997 - protein, 25 aa, Entamoeba invadens
PNDFVGSGFLFKKDGVLYLRVGLKN

SEQ ID NO: 2960998 - protein, 26 aa, Entamoeba invadens
PNDKEMIESFLVMYKDFFFVGQSNLQ

SEQ ID NO: 2960999 - protein, 19 aa, Entamoeba invadens
PNDKFGIEGNAKFGKENGK

SEQ ID NO: 2961000 - protein, 19 aa, Entamoeba invadens
PNDKFGIEGNAKFGKENRK

SEQ ID NO: 2961001 - protein, 25 aa, Entamoeba invadens
PNDLETRLSVILKNENIEVASEKIE

SEQ ID NO: 2961002 - protein, 26 aa, Entamoeba invadens
PNDLNELLKLIWWYDDERSKKYIIKF

SEQ ID NO: 2961003 - protein, 26 aa, Entamoeba invadens
PNDRLLLLYLFCRYNNLKMIRDMCIP

SEQ ID NO: 2961004 - protein, 18 aa, Entamoeba invadens
PNDVFCFMDKFYNAQRSV

SEQ ID NO: 2961005 - protein, 18 aa, Entamoeba invadens
PNDWNIKIDEQMKCFKET

SEQ ID NO: 2961006 - protein, 19 aa, Entamoeba invadens
PNECEIVYVTGLKVEEWLK

SEQ ID NO: 2961007 - protein, 22 aa, Entamoeba invadens
PNECQWMPFYFENDIENIDDKK

SEQ ID NO: 2961008 - protein, 23 aa, Entamoeba invadens
PNECYARIIPRMSMTIDHIPQAY

SEQ ID NO: 2961009 - protein, 21 aa, Entamoeba invadens
PNEFLMMVLFELGECKVTLKK

SEQ ID NO: 2961010 - protein, 23 aa, Entamoeba invadens
PNEFPCSHCLILREQTRTLNDKN

SEQ ID NO: 2961011 - protein, 24 aa, Entamoeba invadens
PNEFYKIQFFDALMLKNEYNKIFD

SEQ ID NO: 2961012 - protein, 22 aa, Entamoeba invadens
PNEIFCLKEVLGTGSFGTVYRA

SEQ ID NO: 2961013 - protein, 25 aa, Entamoeba invadens
PNEKFNLPILWSRECAGGDTSVYDH

SEQ ID NO: 2961014 - protein, 18 aa, Entamoeba invadens
PNENSVREQTRMEKVFNE

SEQ ID NO: 2961015 - protein, 27 aa, Entamoeba invadens
PNEYFRFLWELRMTFSRDLTQLEGLVM

SEQ ID NO: 2961016 - protein, 17 aa, Entamoeba invadens
PNFLCKMPNLKNVKLIG

SEQ ID NO: 2961017 - protein, 23 aa, Entamoeba invadens
PNFLKRPLNETVYILKDGEYTLE

SEQ ID NO: 2961018 - protein, 25 aa, Entamoeba invadens
PNFLWRILYEKIYDFGLEGTHICVY

SEQ ID NO: 2961019 - protein, 17 aa, Entamoeba invadens
PNFQFTPTIKPSVVEKK

SEQ ID NO: 2961020 - protein, 22 aa, Entamoeba invadens
PNFSTSAFGRVEMKKCNFVAPF

SEQ ID NO: 2961021 - protein, 18 aa, Entamoeba invadens
PNFVESMFNYNSYALTED

SEQ ID NO: 2961022 - protein, 20 aa, Entamoeba invadens
PNFVRFGWETSKRIVEKKYP

SEQ ID NO: 2961023 - protein, 18 aa, Entamoeba invadens
PNFWDALFQFNFPTEDLT

SEQ ID NO: 2961024 - protein, 18 aa, Entamoeba invadens
PNGDLCQFMIYRIQTDLN

SEQ ID NO: 2961025 - protein, 19 aa, Entamoeba invadens
PNGIADLIQKCWSTEPEQR

SEQ ID NO: 2961026 - protein, 27 aa, Entamoeba invadens
PNGKKGRYPISKNFFEFNSSLPTQNEN

SEQ ID NO: 2961027 - protein, 21 aa, Entamoeba invadens
PNGMIKRKWYDDVIFKNQGKK

SEQ ID NO: 2961028 - protein, 23 aa, Entamoeba invadens
PNGMPGVRLQGGMTINNPLTGGI

SEQ ID NO: 2961029 - protein, 17 aa, Entamoeba invadens
PNGYFVVDDFGFFENVE

SEQ ID NO: 2961030 - protein, 17 aa, Entamoeba invadens
PNHKEFLQAGGRNDAHL

SEQ ID NO: 2961031 - protein, 23 aa, Entamoeba invadens
PNIKTLYLPSYRFKVPKSVTSQI

SEQ ID NO: 2961032 - protein, 21 aa, Entamoeba invadens
PNIQNIVLWFKVSCKTMKESP

SEQ ID NO: 2961033 - protein, 25 aa, Entamoeba invadens
PNISLSLMEFIGYFESLKGIMPPVV

SEQ ID NO: 2961034 - protein, 25 aa, Entamoeba invadens
PNITSIGKYCFGYCSSLNSVNIPSS

SEQ ID NO: 2961035 - protein, 28 aa, Entamoeba invadens
PNIVGFEGCWLYRNQVFIGMEYCSLGTL

SEQ ID NO: 2961036 - protein, 24 aa, Entamoeba invadens
PNKCAECGQPLGPQRITALGRNYH

SEQ ID NO: 2961037 - protein, 19 aa, Entamoeba invadens
PNKKCFVCGNEILPLEIEL

SEQ ID NO: 2961038 - protein, 25 aa, Entamoeba invadens
PNKQANCLEIAMKLSEEAMKVKDAT

SEQ ID NO: 2961039 - protein, 19 aa, Entamoeba invadens
PNKQCRVCIDGYYPSNANL

SEQ ID NO: 2961040 - protein, 25 aa, Entamoeba invadens
PNKRCMVTLPFLRLDTVTFSKEDVV

SEQ ID NO: 2961041 - protein, 17 aa, Entamoeba invadens
PNLETLHIYSFYSDQFS

SEQ ID NO: 2961042 - protein, 18 aa, Entamoeba invadens
PNLETLHIYSFYSDQFSD

SEQ ID NO: 2961043 - protein, 21 aa, Entamoeba invadens
PNLIFAICHYFDHYAAPRPVD

SEQ ID NO: 2961044 - protein, 25 aa, Entamoeba invadens
PNLKELEIRKSLFLIGDLTNDGLTK

SEQ ID NO: 2961045 - protein, 19 aa, Entamoeba invadens
PNLKGCFLKLLEVKEGDII

SEQ ID NO: 2961046 - protein, 23 aa, Entamoeba invadens
PNLKISDGLFGYVEMIIVRLMIA

SEQ ID NO: 2961047 - protein, 27 aa, Entamoeba invadens
PNLMKKDKRLTVQMLQEKLLRATNDLT

SEQ ID NO: 2961048 - protein, 17 aa, Entamoeba invadens
PNLNLERLLRTSTRLGL

SEQ ID NO: 2961049 - protein, 22 aa, Entamoeba invadens
PNLPEIVKPLSPVTHSETQTTP

SEQ ID NO: 2961050 - protein, 22 aa, Entamoeba invadens
PNLPNYEAWAAYFDEIYDKVTF

SEQ ID NO: 2961051 - protein, 18 aa, Entamoeba invadens
PNLQSGAVPLQILHDRAL

SEQ ID NO: 2961052 - protein, 24 aa, Entamoeba invadens
PNLRTELYGNIVLANGSTMMPGFV

SEQ ID NO: 2961053 - protein, 22 aa, Entamoeba invadens
PNLSDLRFALLNDNEARHQCEF

SEQ ID NO: 2961054 - protein, 19 aa, Entamoeba invadens
PNLTGLILHECHTLTFYPN

SEQ ID NO: 2961055 - protein, 19 aa, Entamoeba invadens
PNLVFLKAFGRTQSRLVCR

SEQ ID NO: 2961056 - protein, 28 aa, Entamoeba invadens
PNLVPKHLFEIFKIPFVPLAIDSNKMLS

SEQ ID NO: 2961057 - protein, 18 aa, Entamoeba invadens
PNMETIYLYFPLNEEEEG

SEQ ID NO: 2961058 - protein, 19 aa, Entamoeba invadens
PNMLHNFSLYLDGKWYSLT

SEQ ID NO: 2961059 - protein, 20 aa, Entamoeba invadens
PNMQMQGFQNPMGTQQNVMN

SEQ ID NO: 2961060 - protein, 37 aa, Entamoeba invadens
PNMTCLKLSSLCLYTRLSAVRWAFYLNMSVRYKHVLF

SEQ ID NO: 2961061 - protein, 24 aa, Entamoeba invadens
PNMVCDLCTTSTTFVQCVDCNQKL

SEQ ID NO: 2961062 - protein, 17 aa, Entamoeba invadens
PNMYKKKLADDNLAILL

SEQ ID NO: 2961063 - protein, 18 aa, Entamoeba invadens
PNNCIQWIEFGGIEASNK

SEQ ID NO: 2961064 - protein, 19 aa, Entamoeba invadens
PNNCRLGSQCFENCEQLTK

SEQ ID NO: 2961065 - protein, 22 aa, Entamoeba invadens
PNNEIYDALLFDSTQINFNTLD

SEQ ID NO: 2961066 - protein, 17 aa, Entamoeba invadens
PNNFKAQHLSGIRSDGF

SEQ ID NO: 2961067 - protein, 21 aa, Entamoeba invadens
PNNIDCIRYEVAMNGRNYTRT

SEQ ID NO: 2961068 - protein, 23 aa, Entamoeba invadens
PNNIHKVNCDFAPNNINVLALAD

SEQ ID NO: 2961069 - protein, 19 aa, Entamoeba invadens
PNNITKIGDFCFACATQLE

SEQ ID NO: 2961070 - protein, 18 aa, Entamoeba invadens
PNNITQIGNFCFACATQL

SEQ ID NO: 2961071 - protein, 18 aa, Entamoeba invadens
PNNLKEFGEHVFSDNINI

SEQ ID NO: 2961072 - protein, 24 aa, Entamoeba invadens
PNNLTTLGSFCFSYCKSLTSISLP

SEQ ID NO: 2961073 - protein, 18 aa, Entamoeba invadens
PNNVIPCEKCGAKNVVYF

SEQ ID NO: 2961074 - protein, 18 aa, Entamoeba invadens
PNPFCRTNVLSVFILPIN

SEQ ID NO: 2961075 - protein, 24 aa, Entamoeba invadens
PNPFCVTCYQNSYIKGAKYGLIII

SEQ ID NO: 2961076 - protein, 20 aa, Entamoeba invadens
PNPIKMLRPSVHCMGQKYNY

SEQ ID NO: 2961077 - protein, 23 aa, Entamoeba invadens
PNPMKKDRMLTEVQFNLDEANNT

SEQ ID NO: 2961078 - protein, 24 aa, Entamoeba invadens
PNPTSFKMTGKFDGELNFINGSLS

SEQ ID NO: 2961079 - protein, 17 aa, Entamoeba invadens
PNQKICVVQFSKDVKIL

SEQ ID NO: 2961080 - protein, 22 aa, Entamoeba invadens
PNQVPGWPALIYPFVRQLLNLK

SEQ ID NO: 2961081 - protein, 25 aa, Entamoeba invadens
PNQYFYCLHCDKWFKKSQTAKHTSE

SEQ ID NO: 2961082 - protein, 29 aa, Entamoeba invadens
PNRIIYNEFLKRYFFLGTNINKKTSDAMP

SEQ ID NO: 2961083 - protein, 27 aa, Entamoeba invadens
PNRRCGQAMGVGEYFAADPLISVGYSK

SEQ ID NO: 2961084 - protein, 17 aa, Entamoeba invadens
PNSFGCSEESTCVWGKK

SEQ ID NO: 2961085 - protein, 21 aa, Entamoeba invadens
PNSGKMATCLSQLYHELKKNN

SEQ ID NO: 2961086 - protein, 19 aa, Entamoeba invadens
PNSIASLGDQCFSNCSSLT

SEQ ID NO: 2961087 - protein, 17 aa, Entamoeba invadens
PNSICFEQFDAVEHPMY

SEQ ID NO: 2961088 - protein, 29 aa, Entamoeba invadens
PNSIKSHPWFKGYDWDGLFQKKITPPYVP

SEQ ID NO: 2961089 - protein, 24 aa, Entamoeba invadens
PNSILRFGINITPTLFVTNNICVD

SEQ ID NO: 2961090 - protein, 17 aa, Entamoeba invadens
PNSLKMFNCNGCKTLQK

SEQ ID NO: 2961091 - protein, 30 aa, Entamoeba invadens
PNSPFKFQYVVLKKGKRPSALLENTSELLT

SEQ ID NO: 2961092 - protein, 18 aa, Entamoeba invadens
PNSVIVLCGFCFQNCYKL

SEQ ID NO: 2961093 - protein, 29 aa, Entamoeba invadens
PNTKRNWGKRIGYSYMKQFLLENQLTSII

SEQ ID NO: 2961094 - protein, 27 aa, Entamoeba invadens
PNTLFTMCGFEVRILPKCRANEEEFSM

SEQ ID NO: 2961095 - protein, 18 aa, Entamoeba invadens
PNTLISIKNCSKFEINTK

SEQ ID NO: 2961096 - protein, 19 aa, Entamoeba invadens
PNTLTSIGNRCFKHCPFTY

SEQ ID NO: 2961097 - protein, 20 aa, Entamoeba invadens
PNTLVTYLFELSHVIASAHS

SEQ ID NO: 2961098 - protein, 20 aa, Entamoeba invadens
PNTSSIELITPIQPTDALND

SEQ ID NO: 2961099 - protein, 17 aa, Entamoeba invadens
PNTVRGMSVFFGEDVCE

SEQ ID NO: 2961100 - protein, 21 aa, Entamoeba invadens
PNTVSSLGMRCFDNCVSLTKI

SEQ ID NO: 2961101 - protein, 25 aa, Entamoeba invadens
PNVCALDDFCFIGSGLQTIKVPKSV

SEQ ID NO: 2961102 - protein, 20 aa, Entamoeba invadens
PNVECLMFLLSQSHVQLPEY

SEQ ID NO: 2961103 - protein, 25 aa, Entamoeba invadens
PNVGGCGKGYCYVCSKLCDHFSPHI

SEQ ID NO: 2961104 - protein, 24 aa, Entamoeba invadens
PNVGKLCIHRTIHQFKLCCKRNEK

SEQ ID NO: 2961105 - protein, 21 aa, Entamoeba invadens
PNVIESCVTFLMKYVGAPGFG

SEQ ID NO: 2961106 - protein, 17 aa, Entamoeba invadens
PNVISFYTLQPSEPFSD

SEQ ID NO: 2961107 - protein, 25 aa, Entamoeba invadens
PNVRLFSSFRGFNFFGLKEGITSPN

SEQ ID NO: 2961108 - protein, 27 aa, Entamoeba invadens
PNVTSLGKWCFYNCIDLSNVLIPLSVT

SEQ ID NO: 2961109 - protein, 22 aa, Entamoeba invadens
PNVTSLGKWCFYNCTNLSSVVI

SEQ ID NO: 2961110 - protein, 27 aa, Entamoeba invadens
PNVTSLGKWCFYNCTNLSSVVIPLSVT

SEQ ID NO: 2961111 - protein, 17 aa, Entamoeba invadens
PNVVLFIGMAMSQNLPM

SEQ ID NO: 2961112 - protein, 24 aa, Entamoeba invadens
PNWKEAEAVMFLFGCVVNKGWTSD

SEQ ID NO: 2961113 - protein, 18 aa, Entamoeba invadens
PNWKLHMRSNLVITESGL

SEQ ID NO: 2961114 - protein, 17 aa, Entamoeba invadens
PNYACEFEISLKPNFTS

SEQ ID NO: 2961115 - protein, 27 aa, Entamoeba invadens
PNYFLFKYIEKYGRVVSAVQNINVPDV

SEQ ID NO: 2961116 - protein, 24 aa, Entamoeba invadens
PNYGCEFSLFLTPLCNSNMESSFV

SEQ ID NO: 2961117 - protein, 25 aa, Entamoeba invadens
PNYGCEFSLFLTPLCNSTMESSFVI

SEQ ID NO: 2961118 - protein, 20 aa, Entamoeba invadens
PNYGRPGNNPPWMGDVDVTR

SEQ ID NO: 2961119 - protein, 19 aa, Entamoeba invadens
PNYIDGISCCGFSNDGILE

SEQ ID NO: 2961120 - protein, 23 aa, Entamoeba invadens
PNYRECPCRKPIILLYDENGTKG

SEQ ID NO: 2961121 - protein, 28 aa, Entamoeba invadens
PNYTVEIAKILPCLQFGTDCKLDGASFT

SEQ ID NO: 2961122 - protein, 22 aa, Entamoeba invadens
PPAKLRIGVQYLNIQWKGAKDL

SEQ ID NO: 2961123 - protein, 24 aa, Entamoeba invadens
PPAKYKAMIAHSFPQIDPECITVC

SEQ ID NO: 2961124 - protein, 17 aa, Entamoeba invadens
PPASLNFAQLLQKQTTT

SEQ ID NO: 2961125 - protein, 20 aa, Entamoeba invadens
PPCVPFLGSTLGDLVFTKEN

SEQ ID NO: 2961126 - protein, 19 aa, Entamoeba invadens
PPDKHIVGFSKQRKAGYLS

SEQ ID NO: 2961127 - protein, 27 aa, Entamoeba invadens
PPDPRLPKPLFAWNLPKGYEAVLKKAY

SEQ ID NO: 2961128 - protein, 18 aa, Entamoeba invadens
PPDTRVINKFALTEKNLD

SEQ ID NO: 2961129 - protein, 20 aa, Entamoeba invadens
PPDYAQLIQSCWKQDGKERP

SEQ ID NO: 2961130 - protein, 19 aa, Entamoeba invadens
PPEDGLFCDLLWSDPLDDS

SEQ ID NO: 2961131 - protein, 19 aa, Entamoeba invadens
PPEDGLFCDLLWSDPQDDS

SEQ ID NO: 2961132 - protein, 22 aa, Entamoeba invadens
PPEFYQQFKMLRKQQAAAQQAP

SEQ ID NO: 2961133 - protein, 18 aa, Entamoeba invadens
PPEFYRITPRKALNAIYI

SEQ ID NO: 2961134 - protein, 18 aa, Entamoeba invadens
PPEILLKMSQYTHLCDIF

SEQ ID NO: 2961135 - protein, 26 aa, Entamoeba invadens
PPEILQILLNLCEFMEREGIKVPIKS

SEQ ID NO: 2961136 - protein, 17 aa, Entamoeba invadens
PPEKLFKRDEVFKEWLL

SEQ ID NO: 2961137 - protein, 18 aa, Entamoeba invadens
PPERDVFTYSEMFSDGQF

SEQ ID NO: 2961138 - protein, 29 aa, Entamoeba invadens
PPESFICTTEFPFAIDIWSIGCVFYTLLT

SEQ ID NO: 2961139 - protein, 17 aa, Entamoeba invadens
PPESIFEIIRKVLKNGK

SEQ ID NO: 2961140 - protein, 21 aa, Entamoeba invadens
PPEVPRFHPITVQTLETQLST

SEQ ID NO: 2961141 - protein, 25 aa, Entamoeba invadens
PPEWKDTLRRAGVKRRELENADQST

SEQ ID NO: 2961142 - protein, 17 aa, Entamoeba invadens
PPFDYKSLYAINEDVLH

SEQ ID NO: 2961143 - protein, 19 aa, Entamoeba invadens
PPFSCTCVIQEIKRFLGKD

SEQ ID NO: 2961144 - protein, 25 aa, Entamoeba invadens
PPGCGKTFCAKALANECKANFIAVK

SEQ ID NO: 2961145 - protein, 19 aa, Entamoeba invadens
PPGCGKTMIARAIANETGA

SEQ ID NO: 2961146 - protein, 25 aa, Entamoeba invadens
PPGIFKLPFTFNLPQNFQPTLIVPD

SEQ ID NO: 2961147 - protein, 17 aa, Entamoeba invadens
PPGIYTFPFSFKVPLDT

SEQ ID NO: 2961148 - protein, 17 aa, Entamoeba invadens
PPGKHRLDFSFYLPQNF

SEQ ID NO: 2961149 - protein, 17 aa, Entamoeba invadens
PPHFTRRLHPLYHVVDI

SEQ ID NO: 2961150 - protein, 17 aa, Entamoeba invadens
PPHIEMLVLNSAMITCT

SEQ ID NO: 2961151 - protein, 17 aa, Entamoeba invadens
PPHPFAKAFPEKYAIEL

SEQ ID NO: 2961152 - protein, 24 aa, Entamoeba invadens
PPHPSKRAAPPLPKQKVVENTVDE

SEQ ID NO: 2961153 - protein, 20 aa, Entamoeba invadens
PPHQAKSGFGAVRTGAPPKA

SEQ ID NO: 2961154 - protein, 18 aa, Entamoeba invadens
PPHQKFKRSSCGIASTKS

SEQ ID NO: 2961155 - protein, 20 aa, Entamoeba invadens
PPIAPKDVDNLLGLFNTSNS

SEQ ID NO: 2961156 - protein, 19 aa, Entamoeba invadens
PPIEESSCPVVMNQTINQN

SEQ ID NO: 2961157 - protein, 17 aa, Entamoeba invadens
PPIMPLRSFIVSLNIPV

SEQ ID NO: 2961158 - protein, 17 aa, Entamoeba invadens
PPIPRKEVEGESVYDKQ

SEQ ID NO: 2961159 - protein, 21 aa, Entamoeba invadens
PPITLERIDVIYPKQNYTQLQ

SEQ ID NO: 2961160 - protein, 17 aa, Entamoeba invadens
PPKEFSDILELYKTGVI

SEQ ID NO: 2961161 - protein, 17 aa, Entamoeba invadens
PPKEGDESFPLYKKEKE

SEQ ID NO: 2961162 - protein, 24 aa, Entamoeba invadens
PPKKEIKLFVPLTEFQRIWYKKVL

SEQ ID NO: 2961163 - protein, 21 aa, Entamoeba invadens
PPKMLGASLCSFTTSKEMYAQ

SEQ ID NO: 2961164 - protein, 17 aa, Entamoeba invadens
PPKNEFQALELPKNDWN

SEQ ID NO: 2961165 - protein, 20 aa, Entamoeba invadens
PPKPKRSSLQMQEQTPPPKP

SEQ ID NO: 2961166 - protein, 24 aa, Entamoeba invadens
PPKPRRLSQNKGKTIPKMEEEVSK

SEQ ID NO: 2961167 - protein, 19 aa, Entamoeba invadens
PPLFPKYLNGARCDRVEIY

SEQ ID NO: 2961168 - protein, 17 aa, Entamoeba invadens
PPLRALFKISTKGIPPV

SEQ ID NO: 2961169 - protein, 27 aa, Entamoeba invadens
PPLSVASRTRWLEIVKHIRDIEENYGL

SEQ ID NO: 2961170 - protein, 23 aa, Entamoeba invadens
PPLTCIPDTFILPLNQIQRILIA

SEQ ID NO: 2961171 - protein, 17 aa, Entamoeba invadens
PPLVFKIPMSSKVEKVV

SEQ ID NO: 2961172 - protein, 17 aa, Entamoeba invadens
PPMCCPPPQFGYDQIGC

SEQ ID NO: 2961173 - protein, 17 aa, Entamoeba invadens
PPMCCPPPQFGYDQMGC

SEQ ID NO: 2961174 - protein, 17 aa, Entamoeba invadens
PPMGAPVYPPMGAPGMA

SEQ ID NO: 2961175 - protein, 20 aa, Entamoeba invadens
PPMNVCSLSAVSVLATSAKQ

SEQ ID NO: 2961176 - protein, 17 aa, Entamoeba invadens
PPMRYVRYQQGYDQQNR

SEQ ID NO: 2961177 - protein, 17 aa, Entamoeba invadens
PPMSFTNDMSGDYANSF

SEQ ID NO: 2961178 - protein, 18 aa, Entamoeba invadens
PPMVCVGFVGYRKTVKGL

SEQ ID NO: 2961179 - protein, 24 aa, Entamoeba invadens
PPMYMSRPVIRQNVRPVIRTQPLH

SEQ ID NO: 2961180 - protein, 24 aa, Entamoeba invadens
PPNKMYALSCGHYFCVNCWKSYVN

SEQ ID NO: 2961181 - protein, 18 aa, Entamoeba invadens
PPPGLEPPGGMLPPPGLA

SEQ ID NO: 2961182 - protein, 20 aa, Entamoeba invadens
PPPKELKRSFSQNVQTNLKP

SEQ ID NO: 2961183 - protein, 23 aa, Entamoeba invadens
PPPKPRRMSLVPTEEIEQKEIQE

SEQ ID NO: 2961184 - protein, 19 aa, Entamoeba invadens
PPPMCCPPPQFGYDQIGCG

SEQ ID NO: 2961185 - protein, 19 aa, Entamoeba invadens
PPPMCCPPPQFGYDQMGCG

SEQ ID NO: 2961186 - protein, 21 aa, Entamoeba invadens
PPPPGCCPRTIPLGGALPPLS

SEQ ID NO: 2961187 - protein, 20 aa, Entamoeba invadens
PPPPMCCPLHQFGYDQMGCG

SEQ ID NO: 2961188 - protein, 17 aa, Entamoeba invadens
PPPPMPVYQPQSVMDSR

SEQ ID NO: 2961189 - protein, 19 aa, Entamoeba invadens
PPPPPAAPGCAFGMSPMMR

SEQ ID NO: 2961190 - protein, 23 aa, Entamoeba invadens
PPPPRPQFAPVHHKTNSAETKIP

SEQ ID NO: 2961191 - protein, 26 aa, Entamoeba invadens
PPPPSGIFRPVFNPVGVEGQFVPYQY

SEQ ID NO: 2961192 - protein, 21 aa, Entamoeba invadens
PPPSNGIPLISPVHRTVSMYE

SEQ ID NO: 2961193 - protein, 17 aa, Entamoeba invadens
PPPSPRVIDRSEQKLDK

SEQ ID NO: 2961194 - protein, 21 aa, Entamoeba invadens
PPQIRYCHNFYYYLSVSPREV

SEQ ID NO: 2961195 - protein, 17 aa, Entamoeba invadens
PPQKKKVTLIFENENIL

SEQ ID NO: 2961196 - protein, 17 aa, Entamoeba invadens
PPQQALESFSYLQSQNA

SEQ ID NO: 2961197 - protein, 19 aa, Entamoeba invadens
PPQSIHMAKSFQGASSPQE

SEQ ID NO: 2961198 - protein, 23 aa, Entamoeba invadens
PPRARSIPELGFLDSVQPILKTE

SEQ ID NO: 2961199 - protein, 24 aa, Entamoeba invadens
PPRELAVKFVEAFGGVEKTLEIGQ

SEQ ID NO: 2961200 - protein, 20 aa, Entamoeba invadens
PPRPNHAAPQPKRKIKPSPP

SEQ ID NO: 2961201 - protein, 22 aa, Entamoeba invadens
PPSCSCQKCIDGPPDQREGGII

SEQ ID NO: 2961202 - protein, 22 aa, Entamoeba invadens
PPSDCDKIFASCWVSEDTVATG

SEQ ID NO: 2961203 - protein, 23 aa, Entamoeba invadens
PPSLEVYCGCAMYNTLQHVNVVT

SEQ ID NO: 2961204 - protein, 20 aa, Entamoeba invadens
PPSNIFIFDIFDYRMKACGE

SEQ ID NO: 2961205 - protein, 25 aa, Entamoeba invadens
PPSPRDGIPFCEKFTTLSLLPSFAP

SEQ ID NO: 2961206 - protein, 18 aa, Entamoeba invadens
PPSRVCVFCKTFDNKCET

SEQ ID NO: 2961207 - protein, 17 aa, Entamoeba invadens
PPSTFRVLSLSTTNNRL

SEQ ID NO: 2961208 - protein, 20 aa, Entamoeba invadens
PPSTKLVAPPKCNPLKNSVL

SEQ ID NO: 2961209 - protein, 23 aa, Entamoeba invadens
PPTACPRSSFNSVLSSPKGNPRV

SEQ ID NO: 2961210 - protein, 20 aa, Entamoeba invadens
PPTECPASACSVRKMEEDSQ

SEQ ID NO: 2961211 - protein, 26 aa, Entamoeba invadens
PPTFIVSVKDPFEWEDPHPITSFSVD

SEQ ID NO: 2961212 - protein, 19 aa, Entamoeba invadens
PPTFRQYKLLEAFLSIMKD

SEQ ID NO: 2961213 - protein, 29 aa, Entamoeba invadens
PPTFTSLFLRWEYFIIISIPPQKVQSSSI

SEQ ID NO: 2961214 - protein, 17 aa, Entamoeba invadens
PPTIVPVKHIEPKEKEE

SEQ ID NO: 2961215 - protein, 18 aa, Entamoeba invadens
PPTKWELFAKRKGIVKPK

SEQ ID NO: 2961216 - protein, 24 aa, Entamoeba invadens
PPTMLSIGWNCFYYCTSLSAIDVP

SEQ ID NO: 2961217 - protein, 17 aa, Entamoeba invadens
PPTNNVFANKPTQQIEK

SEQ ID NO: 2961218 - protein, 20 aa, Entamoeba invadens
PPTQFALGWFGQFKSRKQME

SEQ ID NO: 2961219 - protein, 31 aa, Entamoeba invadens
PPTSVCAHLKHPLLYVGCVDGTVLLLNNTLQ

SEQ ID NO: 2961220 - protein, 19 aa, Entamoeba invadens
PPTYIEFLKGLKFDPKEVT

SEQ ID NO: 2961221 - protein, 24 aa, Entamoeba invadens
PPVFVELQIRFYLLTRLLGVKTSE

SEQ ID NO: 2961222 - protein, 32 aa, Entamoeba invadens
PPVLDLFGGLCLKCMDAVKYFETVSVYSTLQH

SEQ ID NO: 2961223 - protein, 19 aa, Entamoeba invadens
PPVPVMRPSLPRITYSFTV

SEQ ID NO: 2961224 - protein, 24 aa, Entamoeba invadens
PPVRAEAYNTFFGKDEGYFVFTMK

SEQ ID NO: 2961225 - protein, 19 aa, Entamoeba invadens
PPVSRLGATTALLTPQSTK

SEQ ID NO: 2961226 - protein, 18 aa, Entamoeba invadens
PPVTPRNQMCFNNVCTPL

SEQ ID NO: 2961227 - protein, 26 aa, Entamoeba invadens
PPYDPKFVDEFPLLFRMVEDEYINAL

SEQ ID NO: 2961228 - protein, 25 aa, Entamoeba invadens
PPYMEFPPLRALFLITTKGIPPLKN

SEQ ID NO: 2961229 - protein, 21 aa, Entamoeba invadens
PQCHCKMLSNHLVRIVCHGNM

SEQ ID NO: 2961230 - protein, 18 aa, Entamoeba invadens
PQCPLGYSVSENGKCTES

SEQ ID NO: 2961231 - protein, 19 aa, Entamoeba invadens
PQCPLGYSVSENGKCTESI

SEQ ID NO: 2961232 - protein, 27 aa, Entamoeba invadens
PQDEFKFPWKIAEFISSGKRLKKIDCI

SEQ ID NO: 2961233 - protein, 24 aa, Entamoeba invadens
PQDHGKLFPEMVMGCLKRESNCLQ

SEQ ID NO: 2961234 - protein, 19 aa, Entamoeba invadens
PQDYLQRLISLSQRDVDLC

SEQ ID NO: 2961235 - protein, 24 aa, Entamoeba invadens
PQEFKRIKEYGGYTERGRVFGDYI

SEQ ID NO: 2961236 - protein, 17 aa, Entamoeba invadens
PQEGVFDLRINGPKEMK

SEQ ID NO: 2961237 - protein, 23 aa, Entamoeba invadens
PQEKIEMVDNFDLEFGDVKLGDE

SEQ ID NO: 2961238 - protein, 19 aa, Entamoeba invadens
PQEKKFYPHYSGISDIFNL

SEQ ID NO: 2961239 - protein, 17 aa, Entamoeba invadens
PQELCEFFFEVPDEVGL

SEQ ID NO: 2961240 - protein, 19 aa, Entamoeba invadens
PQELFDVIQKCWAQDMSKR

SEQ ID NO: 2961241 - protein, 17 aa, Entamoeba invadens
PQEPILFNMIIPTEKVP

SEQ ID NO: 2961242 - protein, 24 aa, Entamoeba invadens
PQERLWTCWFCMSSTSSFDDKLLI

SEQ ID NO: 2961243 - protein, 23 aa, Entamoeba invadens
PQEVAKKIPTRVVKVDETQPHTE

SEQ ID NO: 2961244 - protein, 20 aa, Entamoeba invadens
PQFDYEVYTPFNLPPKNTYL

SEQ ID NO: 2961245 - protein, 23 aa, Entamoeba invadens
PQFKFPEDSVHQFVKSNDIICST

SEQ ID NO: 2961246 - protein, 19 aa, Entamoeba invadens
PQFKRYYQMYEEIKKEMQE

SEQ ID NO: 2961247 - protein, 24 aa, Entamoeba invadens
PQFKTEIPSLLAQIVQKNSFKELY

SEQ ID NO: 2961248 - protein, 18 aa, Entamoeba invadens
PQFLEFMEKCFVYDYTKR

SEQ ID NO: 2961249 - protein, 25 aa, Entamoeba invadens
PQFREISFQFDFFGVKKMVKAVPNT

SEQ ID NO: 2961250 - protein, 17 aa, Entamoeba invadens
PQGTFRATFEAKLAKND

SEQ ID NO: 2961251 - protein, 20 aa, Entamoeba invadens
PQHARLRIRKLYDRKTRHDN

SEQ ID NO: 2961252 - protein, 17 aa, Entamoeba invadens
PQHFLDCQELWKINAGN

SEQ ID NO: 2961253 - protein, 24 aa, Entamoeba invadens
PQHLCVGIVADLFGGKLTLTKVSP

SEQ ID NO: 2961254 - protein, 25 aa, Entamoeba invadens
PQHLPPGYICRRCGKPGHFIRDCPE

SEQ ID NO: 2961255 - protein, 22 aa, Entamoeba invadens
PQHSLNLTGTFNLTNPPNPNVQ

SEQ ID NO: 2961256 - protein, 19 aa, Entamoeba invadens
PQIAKEIFEAISSKPVNFC

SEQ ID NO: 2961257 - protein, 17 aa, Entamoeba invadens
PQICSLGDLAFSYSNIT

SEQ ID NO: 2961258 - protein, 23 aa, Entamoeba invadens
PQIIIPRRYYIGGDSMIYNKKKC

SEQ ID NO: 2961259 - protein, 24 aa, Entamoeba invadens
PQIKALEAQKKMALDDKAEAEKTA

SEQ ID NO: 2961260 - protein, 22 aa, Entamoeba invadens
PQIKETFLAAQGKFISELFSLH

SEQ ID NO: 2961261 - protein, 32 aa, Entamoeba invadens
PQIPNLRWALLRPSEFNGVSSLTKREQKIAEN

SEQ ID NO: 2961262 - protein, 29 aa, Entamoeba invadens
PQIRVNAKLRCCLFKLDLKRVENIIFRNR

SEQ ID NO: 2961263 - protein, 26 aa, Entamoeba invadens
PQISLEKFGNAKLVYEGLLSSGCQYM

SEQ ID NO: 2961264 - protein, 26 aa, Entamoeba invadens
PQIVTLKSGFACEFEVFITPYCTMDL

SEQ ID NO: 2961265 - protein, 19 aa, Entamoeba invadens
PQIYLFFPQMQTFYVETTL

SEQ ID NO: 2961266 - protein, 20 aa, Entamoeba invadens
PQKCRAFEIIDCEGNVCAEQ

SEQ ID NO: 2961267 - protein, 24 aa, Entamoeba invadens
PQKGNCTFEIGMNATMVFSYLNDY

SEQ ID NO: 2961268 - protein, 24 aa, Entamoeba invadens
PQKKAVVYEQFFLVERIWSGEDKV

SEQ ID NO: 2961269 - protein, 24 aa, Entamoeba invadens
PQKKEYPPPLSINPLSLQQNVQNN

SEQ ID NO: 2961270 - protein, 20 aa, Entamoeba invadens
PQKKFVIPFTAQPSEQIPQP

SEQ ID NO: 2961271 - protein, 18 aa, Entamoeba invadens
PQKLVVCQNPTKSAKRDS

SEQ ID NO: 2961272 - protein, 17 aa, Entamoeba invadens
PQKPVSSGRKWQPPAKA

SEQ ID NO: 2961273 - protein, 23 aa, Entamoeba invadens
PQKRVGVDFPLNFTPVHLMVYQN

SEQ ID NO: 2961274 - protein, 18 aa, Entamoeba invadens
PQKRVTLGLVNVNIEKYY

SEQ ID NO: 2961275 - protein, 21 aa, Entamoeba invadens
PQKTCRSCQNLEEVVMDNTVE

SEQ ID NO: 2961276 - protein, 17 aa, Entamoeba invadens
PQKTVLVTPTFRSKFSK

SEQ ID NO: 2961277 - protein, 24 aa, Entamoeba invadens
PQKVTRLGRWCFINCSSLEKINTL

SEQ ID NO: 2961278 - protein, 17 aa, Entamoeba invadens
PQLACFGHLHYSFGAVR

SEQ ID NO: 2961279 - protein, 18 aa, Entamoeba invadens
PQLCISPVTLLIPYVSQL

SEQ ID NO: 2961280 - protein, 19 aa, Entamoeba invadens
PQLERNVLNSFDFKLPHDV

SEQ ID NO: 2961281 - protein, 20 aa, Entamoeba invadens
PQLLQLCASFLASGNYQVQT

SEQ ID NO: 2961282 - protein, 17 aa, Entamoeba invadens
PQLPAVFDDDIRQMTYK

SEQ ID NO: 2961283 - protein, 37 aa, Entamoeba invadens
PQLVTLKKGFVCEFEVFITPHCTLNFNDNFVIVSLDI

SEQ ID NO: 2961284 - protein, 18 aa, Entamoeba invadens
PQMGNSLFGNTPSQIGSN

SEQ ID NO: 2961285 - protein, 27 aa, Entamoeba invadens
PQMYPPMPDICGMDYSQQMQFMQQQQT

SEQ ID NO: 2961286 - protein, 25 aa, Entamoeba invadens
PQNCKEMKEGAFVVSFQNVVLENDT

SEQ ID NO: 2961287 - protein, 18 aa, Entamoeba invadens
PQNFKAVQFSKCFDDEER

SEQ ID NO: 2961288 - protein, 18 aa, Entamoeba invadens
PQNLEFFANPATTLIGQF

SEQ ID NO: 2961289 - protein, 20 aa, Entamoeba invadens
PQNLKSLIIKKCQFDSIQLT

SEQ ID NO: 2961290 - protein, 19 aa, Entamoeba invadens
PQNSVGIVEQVAFNKPIGK

SEQ ID NO: 2961291 - protein, 19 aa, Entamoeba invadens
PQPEHFIAFRGDSGTQCRL

SEQ ID NO: 2961292 - protein, 23 aa, Entamoeba invadens
PQPKGSPIIVRFIIDSSGLFTVE

SEQ ID NO: 2961293 - protein, 17 aa, Entamoeba invadens
PQPLKHSKLQDVVVLDD

SEQ ID NO: 2961294 - protein, 24 aa, Entamoeba invadens
PQPNLSKVYYFFFAEGCTLRSLPT

SEQ ID NO: 2961295 - protein, 23 aa, Entamoeba invadens
PQPSCKPLTFGVLTEDSKKLILG

SEQ ID NO: 2961296 - protein, 20 aa, Entamoeba invadens
PQQAYPGYPQQPAQQPQQGA

SEQ ID NO: 2961297 - protein, 22 aa, Entamoeba invadens
PQQCKARWYSWLDPSIKKTEWT

SEQ ID NO: 2961298 - protein, 33 aa, Entamoeba invadens
PQQILYLLIRTFEICVPRIPFDDTFLQIPRSLN

SEQ ID NO: 2961299 - protein, 19 aa, Entamoeba invadens
PQQMPPFNPQMYPYPPMPL

SEQ ID NO: 2961300 - protein, 24 aa, Entamoeba invadens
PQQQFQFTANSLFGNQQGLANTQG

SEQ ID NO: 2961301 - protein, 24 aa, Entamoeba invadens
PQQQFQFTANSLFGTQQPMANTQQ

SEQ ID NO: 2961302 - protein, 29 aa, Entamoeba invadens
PQQRSEWRLEAPDKYRLIYQNKTSPNEIM

SEQ ID NO: 2961303 - protein, 24 aa, Entamoeba invadens
PQQYPGYPPQQGYGYPPQGQYGYP

SEQ ID NO: 2961304 - protein, 29 aa, Entamoeba invadens
PQRIERLGDFCFFNCQILSEIVFNEKLTS

SEQ ID NO: 2961305 - protein, 18 aa, Entamoeba invadens
PQRPLTMLPPSAPPPKAP

SEQ ID NO: 2961306 - protein, 18 aa, Entamoeba invadens
PQRVCDQCALNAKNKKTL

SEQ ID NO: 2961307 - protein, 18 aa, Entamoeba invadens
PQSFIFDAVIGKIEGFYP

SEQ ID NO: 2961308 - protein, 26 aa, Entamoeba invadens
PQSHMKRFFKIYTEDFMKIVHNYYKN

SEQ ID NO: 2961309 - protein, 19 aa, Entamoeba invadens
PQSIIARSEIQNIALSDEQ

SEQ ID NO: 2961310 - protein, 25 aa, Entamoeba invadens
PQSKYPPPLRKLQEFPSRDQKLQNE

SEQ ID NO: 2961311 - protein, 21 aa, Entamoeba invadens
PQSRSRRAKFSKKRNGFSGFE

SEQ ID NO: 2961312 - protein, 20 aa, Entamoeba invadens
PQSVEFGSACMDEVPVHVGM

SEQ ID NO: 2961313 - protein, 20 aa, Entamoeba invadens
PQSVPENWVYAKGFGPNTAP

SEQ ID NO: 2961314 - protein, 20 aa, Entamoeba invadens
PQTAAAPFTAFPTFSPYVPQ

SEQ ID NO: 2961315 - protein, 24 aa, Entamoeba invadens
PQTDFKEWAFCISSDVKASEILNF

SEQ ID NO: 2961316 - protein, 24 aa, Entamoeba invadens
PQTGRPRGFGFVEFPTHEDALKAK

SEQ ID NO: 2961317 - protein, 20 aa, Entamoeba invadens
PQTKLLFVMINDGKYKSKAY

SEQ ID NO: 2961318 - protein, 18 aa, Entamoeba invadens
PQTKRFVGRTRTDSETNS

SEQ ID NO: 2961319 - protein, 26 aa, Entamoeba invadens
PQTLIPRFYGMYRIKPKHGDEYRYVV

SEQ ID NO: 2961320 - protein, 17 aa, Entamoeba invadens
PQTLKFIDSNAFENCKL

SEQ ID NO: 2961321 - protein, 18 aa, Entamoeba invadens
PQTNFVFDNENFEKQKAV

SEQ ID NO: 2961322 - protein, 19 aa, Entamoeba invadens
PQTRSIVSPSTFYGNSAFT

SEQ ID NO: 2961323 - protein, 18 aa, Entamoeba invadens
PQVDMTFKILIIGESAVG

SEQ ID NO: 2961324 - protein, 26 aa, Entamoeba invadens
PQVIFKSWYKRIGINATLSSLTQMAQ

SEQ ID NO: 2961325 - protein, 18 aa, Entamoeba invadens
PQYCGFTQIHGHHRFLAA

SEQ ID NO: 2961326 - protein, 22 aa, Entamoeba invadens
PQYGFKSRRAMLSMSQGEDVSS

SEQ ID NO: 2961327 - protein, 18 aa, Entamoeba invadens
PQYIDCKVMKEFLTTLLS

SEQ ID NO: 2961328 - protein, 21 aa, Entamoeba invadens
PQYPTLAAINFLLRRKRIEEL

SEQ ID NO: 2961329 - protein, 19 aa, Entamoeba invadens
PQYQIRPAYLISEVVQKSE

SEQ ID NO: 2961330 - protein, 19 aa, Entamoeba invadens
PQYSCAYVACINAIEKSKF

SEQ ID NO: 2961331 - protein, 19 aa, Entamoeba invadens
PRAKEVTSIMTVKDIGQSV

SEQ ID NO: 2961332 - protein, 19 aa, Entamoeba invadens
PRALKILKGLGFQEDEMRK

SEQ ID NO: 2961333 - protein, 24 aa, Entamoeba invadens
PRANPTTMLLGFNSLVFRKILDLL

SEQ ID NO: 2961334 - protein, 19 aa, Entamoeba invadens
PRAPPKRKRVYFFVEDLDD

SEQ ID NO: 2961335 - protein, 18 aa, Entamoeba invadens
PRDGVMYMGNIPLQMSDE

SEQ ID NO: 2961336 - protein, 24 aa, Entamoeba invadens
PRDHTKHFVSFDFLDKEDKDELLR

SEQ ID NO: 2961337 - protein, 17 aa, Entamoeba invadens
PRDPWLKDCTIVNTDET

SEQ ID NO: 2961338 - protein, 20 aa, Entamoeba invadens
PREECHFDFVGDEKMTQRSL

SEQ ID NO: 2961339 - protein, 20 aa, Entamoeba invadens
PREFPMQTIFPLYQPSMRMN

SEQ ID NO: 2961340 - protein, 19 aa, Entamoeba invadens
PREGMKPTWQFVIGSEVCG

SEQ ID NO: 2961341 - protein, 19 aa, Entamoeba invadens
PREILLLPCRHVAMCAECY

SEQ ID NO: 2961342 - protein, 23 aa, Entamoeba invadens
PREIYRIGWEDYLTAFNSIQKKC

SEQ ID NO: 2961343 - protein, 23 aa, Entamoeba invadens
PREKREVVVIGHVDINWGVRSVL

SEQ ID NO: 2961344 - protein, 19 aa, Entamoeba invadens
PRERTSLRTPLEQEKYTFE

SEQ ID NO: 2961345 - protein, 18 aa, Entamoeba invadens
PRETISLINDKITFSTYI

SEQ ID NO: 2961346 - protein, 25 aa, Entamoeba invadens
PREVVLPVHFEKMYECEKGEKEIVL

SEQ ID NO: 2961347 - protein, 33 aa, Entamoeba invadens
PREWKICKPDFIRLLKTMECCIDLCDKTPTFYE

SEQ ID NO: 2961348 - protein, 20 aa, Entamoeba invadens
PREYPPRRDDYQLPYTPQGE

SEQ ID NO: 2961349 - protein, 20 aa, Entamoeba invadens
PRFDYYAKPKIEGGMVDSQG

SEQ ID NO: 2961350 - protein, 20 aa, Entamoeba invadens
PRFFYINTMKGITRKLILNN

SEQ ID NO: 2961351 - protein, 21 aa, Entamoeba invadens
PRFKEDTPLGLVFLKTDSEKH

SEQ ID NO: 2961352 - protein, 17 aa, Entamoeba invadens
PRFLATLIEKAKFSITT

SEQ ID NO: 2961353 - protein, 19 aa, Entamoeba invadens
PRFRVTEGEQAPIEDEFLP

SEQ ID NO: 2961354 - protein, 19 aa, Entamoeba invadens
PRFRVTEGEQAPIEDNLIN

SEQ ID NO: 2961355 - protein, 19 aa, Entamoeba invadens
PRGIPINLVPIITKYLVGK

SEQ ID NO: 2961356 - protein, 18 aa, Entamoeba invadens
PRGSIPTFITSSYKTNDA

SEQ ID NO: 2961357 - protein, 18 aa, Entamoeba invadens
PRGSSFYNGLPFDQVKNL

SEQ ID NO: 2961358 - protein, 19 aa, Entamoeba invadens
PRHFILFNDIFLYGMGDEA

SEQ ID NO: 2961359 - protein, 22 aa, Entamoeba invadens
PRHPYQRIPVGVTTYYSPTMLQ

SEQ ID NO: 2961360 - protein, 20 aa, Entamoeba invadens
PRIILPTSVVSLRMKGCPLL

SEQ ID NO: 2961361 - protein, 20 aa, Entamoeba invadens
PRILENPTLLFEYVPSYYER

SEQ ID NO: 2961362 - protein, 19 aa, Entamoeba invadens
PRILTSHFNSVFVVVSPMK

SEQ ID NO: 2961363 - protein, 18 aa, Entamoeba invadens
PRISELAKSYGVVININT

SEQ ID NO: 2961364 - protein, 19 aa, Entamoeba invadens
PRIVKNFYDMLSLMDAPDL

SEQ ID NO: 2961365 - protein, 18 aa, Entamoeba invadens
PRIYPQWFSQKLKKVRLY

SEQ ID NO: 2961366 - protein, 17 aa, Entamoeba invadens
PRIYVCNRYSGNQRFLM

SEQ ID NO: 2961367 - protein, 20 aa, Entamoeba invadens
PRKEPVIKLKIGTKEEKIDF

SEQ ID NO: 2961368 - protein, 20 aa, Entamoeba invadens
PRKEVLCGNETTFKSEQSVN

SEQ ID NO: 2961369 - protein, 22 aa, Entamoeba invadens
PRKEVLMLMEYCPNTLVEILQK

SEQ ID NO: 2961370 - protein, 24 aa, Entamoeba invadens
PRKEVRTKFYYKNFVRGFLIKQLI

SEQ ID NO: 2961371 - protein, 19 aa, Entamoeba invadens
PRKFQFAPNRAFLEPTEEN

SEQ ID NO: 2961372 - protein, 18 aa, Entamoeba invadens
PRKHLLRNVSIPKILNYI

SEQ ID NO: 2961373 - protein, 17 aa, Entamoeba invadens
PRKLVIYNGKFVLYKEG

SEQ ID NO: 2961374 - protein, 25 aa, Entamoeba invadens
PRKRGMKEGEEYSRIIEVVGNYAIH

SEQ ID NO: 2961375 - protein, 26 aa, Entamoeba invadens
PRKTELLCLNASLQLLTDVDAFCDFT

SEQ ID NO: 2961376 - protein, 30 aa, Entamoeba invadens
PRKTHRGLRKVACVGAWHPARVGWTVARAG

SEQ ID NO: 2961377 - protein, 20 aa, Entamoeba invadens
PRKVGMERKELISINTRIMK

SEQ ID NO: 2961378 - protein, 24 aa, Entamoeba invadens
PRLASEQCIDCIATLAKVQDQKRG

SEQ ID NO: 2961379 - protein, 21 aa, Entamoeba invadens
PRLETLVCTYAFLRESKDDNL

SEQ ID NO: 2961380 - protein, 19 aa, Entamoeba invadens
PRLFPFVEYGKTMSLDQKD

SEQ ID NO: 2961381 - protein, 20 aa, Entamoeba invadens
PRLGNGPVDLQPVIPQKPMK

SEQ ID NO: 2961382 - protein, 20 aa, Entamoeba invadens
PRLKIADYGLSRAFGDDSQL

SEQ ID NO: 2961383 - protein, 19 aa, Entamoeba invadens
PRLKLIDLGSCCFDNCTLY

SEQ ID NO: 2961384 - protein, 21 aa, Entamoeba invadens
PRLLELVQLVIYLPIFDLIMS

SEQ ID NO: 2961385 - protein, 26 aa, Entamoeba invadens
PRLQRAESSMSLSLDMTTAKETNPLF

SEQ ID NO: 2961386 - protein, 22 aa, Entamoeba invadens
PRLYCVSEFNKLISPIVYSYKD

SEQ ID NO: 2961387 - protein, 20 aa, Entamoeba invadens
PRLYRDLVEECWRQNPRERP

SEQ ID NO: 2961388 - protein, 18 aa, Entamoeba invadens
PRMKELVMFAKRNISTPS

SEQ ID NO: 2961389 - protein, 19 aa, Entamoeba invadens
PRMVMPANYQQYYELQGFT

SEQ ID NO: 2961390 - protein, 23 aa, Entamoeba invadens
PRNEFKRALEIDPNCTPAIVGLA

SEQ ID NO: 2961391 - protein, 28 aa, Entamoeba invadens
PRNIGEMSFFCFYLLVSAFLTSNLQIDK

SEQ ID NO: 2961392 - protein, 21 aa, Entamoeba invadens
PRNKFKNCIEEATARLKKQFG

SEQ ID NO: 2961393 - protein, 19 aa, Entamoeba invadens
PRNLFKVSVVSTFQSYNDS

SEQ ID NO: 2961394 - protein, 17 aa, Entamoeba invadens
PRNMKRFTVTQINSVNV

SEQ ID NO: 2961395 - protein, 18 aa, Entamoeba invadens
PRNQHIAQLISMIETMRV

SEQ ID NO: 2961396 - protein, 20 aa, Entamoeba invadens
PRNQMCFNNVCTPLNTHQQT

SEQ ID NO: 2961397 - protein, 19 aa, Entamoeba invadens
PRPIFCPFFQTHPVTIKIT

SEQ ID NO: 2961398 - protein, 21 aa, Entamoeba invadens
PRPKLPKRAQPPIPPLVTKNK

SEQ ID NO: 2961399 - protein, 17 aa, Entamoeba invadens
PRPLLIGEVWFGGCEYR

SEQ ID NO: 2961400 - protein, 21 aa, Entamoeba invadens
PRPLTMLLETVERQLICIYLA

SEQ ID NO: 2961401 - protein, 21 aa, Entamoeba invadens
PRPPHSLNMKMLLHLPPQTKQ

SEQ ID NO: 2961402 - protein, 20 aa, Entamoeba invadens
PRPRTIRYFYRRQQKDDLDS

SEQ ID NO: 2961403 - protein, 20 aa, Entamoeba invadens
PRPSEIPQKMEIEKVENNSK

SEQ ID NO: 2961404 - protein, 19 aa, Entamoeba invadens
PRPVTIGPLHKEKVEDQRF

SEQ ID NO: 2961405 - protein, 17 aa, Entamoeba invadens
PRQFKFDANHKFFHVFD

SEQ ID NO: 2961406 - protein, 20 aa, Entamoeba invadens
PRQITSLGVGCFANAKFLSK

SEQ ID NO: 2961407 - protein, 17 aa, Entamoeba invadens
PRQQAKFASRSPTELAG

SEQ ID NO: 2961408 - protein, 21 aa, Entamoeba invadens
PRQSKAEVFTTIFRELLDNKE

SEQ ID NO: 2961409 - protein, 19 aa, Entamoeba invadens
PRRIAATAMAERVSEEMGE

SEQ ID NO: 2961410 - protein, 17 aa, Entamoeba invadens
PRRKHLVFQGGAVLAGV

SEQ ID NO: 2961411 - protein, 18 aa, Entamoeba invadens
PRRKMIFEQLGLKFEVVV

SEQ ID NO: 2961412 - protein, 21 aa, Entamoeba invadens
PRRRIPMSVNGNFFLTKYHLE

SEQ ID NO: 2961413 - protein, 25 aa, Entamoeba invadens
PRRTIERRKSQIFDLNDIQKQMSDA

SEQ ID NO: 2961414 - protein, 17 aa, Entamoeba invadens
PRRVAAISVSTRVAKEM

SEQ ID NO: 2961415 - protein, 22 aa, Entamoeba invadens
PRRVAAVSVCERVSVEMSSTVG

SEQ ID NO: 2961416 - protein, 22 aa, Entamoeba invadens
PRRVIECGTTFWKIENEKRTDL

SEQ ID NO: 2961417 - protein, 22 aa, Entamoeba invadens
PRSEKELSLVPGDKVEVLSFEG

SEQ ID NO: 2961418 - protein, 23 aa, Entamoeba invadens
PRSEYKITLIKAVVKTAIEYGDV

SEQ ID NO: 2961419 - protein, 23 aa, Entamoeba invadens
PRSFHPRKLLKFIQDKLVSDAEK

SEQ ID NO: 2961420 - protein, 21 aa, Entamoeba invadens
PRSIPKISLLISTPRGVQKSQ

SEQ ID NO: 2961421 - protein, 26 aa, Entamoeba invadens
PRSPEAFLEFCKLCLQENTRENYYEV

SEQ ID NO: 2961422 - protein, 21 aa, Entamoeba invadens
PRSPLSNFFELKRFIFQFEYD

SEQ ID NO: 2961423 - protein, 22 aa, Entamoeba invadens
PRSPPLAVFDEYTYVMGLKSVR

SEQ ID NO: 2961424 - protein, 18 aa, Entamoeba invadens
PRSPRGAVLPQIDASKIT

SEQ ID NO: 2961425 - protein, 20 aa, Entamoeba invadens
PRSPRLSQFSYYIIPHHSHR

SEQ ID NO: 2961426 - protein, 20 aa, Entamoeba invadens
PRSQKYYIFIAPLTQINIDE

SEQ ID NO: 2961427 - protein, 19 aa, Entamoeba invadens
PRSQSLMEVELPRKENKVK

SEQ ID NO: 2961428 - protein, 20 aa, Entamoeba invadens
PRSVVKIGERCFKGCDKLKT

SEQ ID NO: 2961429 - protein, 20 aa, Entamoeba invadens
PRTDIIQSFCYGFVELVTSA

SEQ ID NO: 2961430 - protein, 18 aa, Entamoeba invadens
PRTGWVYCKVPNPESISD

SEQ ID NO: 2961431 - protein, 19 aa, Entamoeba invadens
PRTKNILNIKFVKRTKTKT

SEQ ID NO: 2961432 - protein, 25 aa, Entamoeba invadens
PRTRGPLVDGFRCVEKGIYAAGNQL

SEQ ID NO: 2961433 - protein, 17 aa, Entamoeba invadens
PRTTRWWYSISNHSQTT

SEQ ID NO: 2961434 - protein, 18 aa, Entamoeba invadens
PRVARSALVANFPVDALL

SEQ ID NO: 2961435 - protein, 22 aa, Entamoeba invadens
PRVKNEWWYPLASSVAASEFRG

SEQ ID NO: 2961436 - protein, 22 aa, Entamoeba invadens
PRVKNEWWYPLASSVAATEFRG

SEQ ID NO: 2961437 - protein, 20 aa, Entamoeba invadens
PRVKTLNLWSENDENFGYDF

SEQ ID NO: 2961438 - protein, 22 aa, Entamoeba invadens
PRVLLRNISCCLMEEKSISEGD

SEQ ID NO: 2961439 - protein, 28 aa, Entamoeba invadens
PRVPTRWQFSNKKLWAFPNMEKEDEIPF

SEQ ID NO: 2961440 - protein, 19 aa, Entamoeba invadens
PRVREHLLVLYQRLAKVLV

SEQ ID NO: 2961441 - protein, 18 aa, Entamoeba invadens
PRVSSTLYGWVNVKDHKK

SEQ ID NO: 2961442 - protein, 24 aa, Entamoeba invadens
PRVTKIGYKCFGYCISLSNVTIPL

SEQ ID NO: 2961443 - protein, 24 aa, Entamoeba invadens
PRVYRPHSPVTFSVMQNTMANQQS

SEQ ID NO: 2961444 - protein, 18 aa, Entamoeba invadens
PRWKWQRYMKHMKINYYF

SEQ ID NO: 2961445 - protein, 23 aa, Entamoeba invadens
PRYEIRSSAFSYDGEVFVTSSGD

SEQ ID NO: 2961446 - protein, 21 aa, Entamoeba invadens
PRYEKDTPLNFCKITMENEEA

SEQ ID NO: 2961447 - protein, 20 aa, Entamoeba invadens
PRYFPKAKTLFQIQQNITIL

SEQ ID NO: 2961448 - protein, 20 aa, Entamoeba invadens
PRYLPHVVQLLLTASPQLID

SEQ ID NO: 2961449 - protein, 19 aa, Entamoeba invadens
PRYTKCFLTVLQMTRNLSD

SEQ ID NO: 2961450 - protein, 25 aa, Entamoeba invadens
PRYVISIKEYARFVAGKSAKVDKDS

SEQ ID NO: 2961451 - protein, 19 aa, Entamoeba invadens
PSAAAYCYGLEKLEDGLFF

SEQ ID NO: 2961452 - protein, 24 aa, Entamoeba invadens
PSAFRSCLNMTQFTFSDIKSLPLL

SEQ ID NO: 2961453 - protein, 28 aa, Entamoeba invadens
PSAFVPVQCLPSFFSVENNVSNTFGRTT

SEQ ID NO: 2961454 - protein, 24 aa, Entamoeba invadens
PSAHWKCGVCLLKGEKERENVLRR

SEQ ID NO: 2961455 - protein, 17 aa, Entamoeba invadens
PSAIAICSEGVETPQKG

SEQ ID NO: 2961456 - protein, 21 aa, Entamoeba invadens
PSAKNWRLIKYLVINEPKLTK

SEQ ID NO: 2961457 - protein, 21 aa, Entamoeba invadens
PSALPECLTFTINLDEKNKVI

SEQ ID NO: 2961458 - protein, 28 aa, Entamoeba invadens
PSATSRPKKGWVVTRPTLSMSNGQGAQA

SEQ ID NO: 2961459 - protein, 21 aa, Entamoeba invadens
PSATTARRVFNILVSSVCKIK

SEQ ID NO: 2961460 - protein, 20 aa, Entamoeba invadens
PSCAVLEYLREAKIQDLDNK

SEQ ID NO: 2961461 - protein, 27 aa, Entamoeba invadens
PSCNEWKENLCFLKQQTFMINMEKFIN

SEQ ID NO: 2961462 - protein, 22 aa, Entamoeba invadens
PSCPSFYKVYFDLTVMGSAEIS

SEQ ID NO: 2961463 - protein, 25 aa, Entamoeba invadens
PSDFNEVLPLIYLKKCFPVMNELVT

SEQ ID NO: 2961464 - protein, 25 aa, Entamoeba invadens
PSDIEKAFCFEVVYNKQYVFMCKSE

SEQ ID NO: 2961465 - protein, 19 aa, Entamoeba invadens
PSDLVPHFLNTTIVLLRNN

SEQ ID NO: 2961466 - protein, 17 aa, Entamoeba invadens
PSDVIEVKEEVKVEEKP

SEQ ID NO: 2961467 - protein, 19 aa, Entamoeba invadens
PSDYSKLSYVNYFLSGITA

SEQ ID NO: 2961468 - protein, 38 aa, Entamoeba invadens
PSEIESIGLLYAMCDEILHLVCKTWRGIQVEIVEGRPF

SEQ ID NO: 2961469 - protein, 22 aa, Entamoeba invadens
PSEIRLIIDRVIINSIDVNISI

SEQ ID NO: 2961470 - protein, 19 aa, Entamoeba invadens
PSELMSVLQGMGKYLQRGS

SEQ ID NO: 2961471 - protein, 25 aa, Entamoeba invadens
PSEMCPWNKKGANMADYFNYGFDEQ

SEQ ID NO: 2961472 - protein, 17 aa, Entamoeba invadens
PSENFAFQFRLYSASNL

SEQ ID NO: 2961473 - protein, 18 aa, Entamoeba invadens
PSEQHFVTFNGLYGKITD

SEQ ID NO: 2961474 - protein, 21 aa, Entamoeba invadens
PSESDAVLMLYKLSQEKNKAD

SEQ ID NO: 2961475 - protein, 17 aa, Entamoeba invadens
PSFEKRLTVSISSDMSG

SEQ ID NO: 2961476 - protein, 20 aa, Entamoeba invadens
PSFRKWESFGNFVSSKNSRS

SEQ ID NO: 2961477 - protein, 24 aa, Entamoeba invadens
PSFSNTRFNFVASVSSVLFECFDM

SEQ ID NO: 2961478 - protein, 25 aa, Entamoeba invadens
PSFTFPCGHSFCLGCSRDTVTTQLR

SEQ ID NO: 2961479 - protein, 17 aa, Entamoeba invadens
PSFYKEKKFVVLNTDSH

SEQ ID NO: 2961480 - protein, 35 aa, Entamoeba invadens
PSFYSTCFVLNFLFTEGFLRSSCQHFGSSTHICSS

SEQ ID NO: 2961481 - protein, 21 aa, Entamoeba invadens
PSGAFWTWKATALGKNMTTVK

SEQ ID NO: 2961482 - protein, 26 aa, Entamoeba invadens
PSGEACEFEILLTLKCTTKFNENIIL

SEQ ID NO: 2961483 - protein, 26 aa, Entamoeba invadens
PSGEACEFEILLTLKCTTKIDENIIL

SEQ ID NO: 2961484 - protein, 20 aa, Entamoeba invadens
PSGFDIKASLPGIKLSNTFH

SEQ ID NO: 2961485 - protein, 26 aa, Entamoeba invadens
PSGKYKGDFPLNVAFQNPHCIGFLLE

SEQ ID NO: 2961486 - protein, 18 aa, Entamoeba invadens
PSGQCYKINKDTGCKTFW

SEQ ID NO: 2961487 - protein, 17 aa, Entamoeba invadens
PSGRFVIGGPMGDAGLT

SEQ ID NO: 2961488 - protein, 22 aa, Entamoeba invadens
PSGSGDYLLKWKRGDKDINKGV

SEQ ID NO: 2961489 - protein, 31 aa, Entamoeba invadens
PSGTGNGGRSCWGVELKDEFCGMKHDSVGVI

SEQ ID NO: 2961490 - protein, 21 aa, Entamoeba invadens
PSHHCYFMLTDTLNFMENTWK

SEQ ID NO: 2961491 - protein, 27 aa, Entamoeba invadens
PSHHNDIMFYRGYKFVISLKVSGVALG

SEQ ID NO: 2961492 - protein, 30 aa, Entamoeba invadens
PSHPCFISLLDLDVSFGMLNLIGEHKLETY

SEQ ID NO: 2961493 - protein, 18 aa, Entamoeba invadens
PSHPSMFHRIFSAVFDQP

SEQ ID NO: 2961494 - protein, 27 aa, Entamoeba invadens
PSHVKSVGYYSCFSCVNLKEVVLPEGI

SEQ ID NO: 2961495 - protein, 31 aa, Entamoeba invadens
PSHVTEILGPWLRREVLLFESVSLCESIKSI

SEQ ID NO: 2961496 - protein, 19 aa, Entamoeba invadens
PSIEECWNGYCTLPQMNRD

SEQ ID NO: 2961497 - protein, 24 aa, Entamoeba invadens
PSIEEGAKCPICKKTVKQKDSIQC

SEQ ID NO: 2961498 - protein, 20 aa, Entamoeba invadens
PSIELILRLNSAMSTVLSTN

SEQ ID NO: 2961499 - protein, 19 aa, Entamoeba invadens
PSIHFINGVGVYYTLIATL

SEQ ID NO: 2961500 - protein, 24 aa, Entamoeba invadens
PSIKECTFQPWAEITQRGREQSII

SEQ ID NO: 2961501 - protein, 24 aa, Entamoeba invadens
PSIKGWWCSAHGFHLVGESCDTEP

SEQ ID NO: 2961502 - protein, 25 aa, Entamoeba invadens
PSIKLKITTSFLLKKSYDKIVIVKD

SEQ ID NO: 2961503 - protein, 26 aa, Entamoeba invadens
PSINKNCLWYIFDYLNLVVKHNEVNL

SEQ ID NO: 2961504 - protein, 17 aa, Entamoeba invadens
PSIPLLKGNWHVTIQGD

SEQ ID NO: 2961505 - protein, 23 aa, Entamoeba invadens
PSIPRIEYHYQISISDSIKITIM

SEQ ID NO: 2961506 - protein, 25 aa, Entamoeba invadens
PSIQKGLYCLMHILLQYHDPQLCYC

SEQ ID NO: 2961507 - protein, 25 aa, Entamoeba invadens
PSIRKSALEVLDFFCTKMDEKEAQV

SEQ ID NO: 2961508 - protein, 22 aa, Entamoeba invadens
PSISLPFSLFIRKNAHLQTDRL

SEQ ID NO: 2961509 - protein, 19 aa, Entamoeba invadens
PSISLSFYDVFHWKNSQNA

SEQ ID NO: 2961510 - protein, 20 aa, Entamoeba invadens
PSITCFLKITVNSIYGTSRA

SEQ ID NO: 2961511 - protein, 19 aa, Entamoeba invadens
PSIYKRWADMYKVLMSIKK

SEQ ID NO: 2961512 - protein, 20 aa, Entamoeba invadens
PSKAEFKPSPTLQKSAQSEY

SEQ ID NO: 2961513 - protein, 18 aa, Entamoeba invadens
PSKALLPYFRRSLEEFNF

SEQ ID NO: 2961514 - protein, 20 aa, Entamoeba invadens
PSKCSDCYDGLYLNSDSECC

SEQ ID NO: 2961515 - protein, 26 aa, Entamoeba invadens
PSKHILKERIEAIVVNSLKESQEWSR

SEQ ID NO: 2961516 - protein, 19 aa, Entamoeba invadens
PSKLTRFGSYAFNNCSVLK

SEQ ID NO: 2961517 - protein, 17 aa, Entamoeba invadens
PSKQARVTTQFQKVKTI

SEQ ID NO: 2961518 - protein, 17 aa, Entamoeba invadens
PSKRTTTTFQFLYIKEI

SEQ ID NO: 2961519 - protein, 18 aa, Entamoeba invadens
PSKVGGPVASLLFSPTTA

SEQ ID NO: 2961520 - protein, 19 aa, Entamoeba invadens
PSKYFSDAVTVALNINYSE

SEQ ID NO: 2961521 - protein, 20 aa, Entamoeba invadens
PSKYPTKSAKRVRMIVREDI

SEQ ID NO: 2961522 - protein, 23 aa, Entamoeba invadens
PSLAELFLAGFAKSRRYYTNTRG

SEQ ID NO: 2961523 - protein, 18 aa, Entamoeba invadens
PSLAKSLIENYTFPQFKF

SEQ ID NO: 2961524 - protein, 18 aa, Entamoeba invadens
PSLCGGYLDAVLPTVHQV

SEQ ID NO: 2961525 - protein, 17 aa, Entamoeba invadens
PSLDEFIFLLSSKAGGC

SEQ ID NO: 2961526 - protein, 18 aa, Entamoeba invadens
PSLFEAWAKKQGGSVKSW

SEQ ID NO: 2961527 - protein, 24 aa, Entamoeba invadens
PSLKEIDVSFNFIKALPVDIENLK

SEQ ID NO: 2961528 - protein, 28 aa, Entamoeba invadens
PSLLEDKKRLFSMLVVRYEALLKNQKTT

SEQ ID NO: 2961529 - protein, 17 aa, Entamoeba invadens
PSLLLDFFNAFTSFFTL

SEQ ID NO: 2961530 - protein, 18 aa, Entamoeba invadens
PSLNEMWYVFKGSNAQFS

SEQ ID NO: 2961531 - protein, 18 aa, Entamoeba invadens
PSLQNGLVALLDMPSNDA

SEQ ID NO: 2961532 - protein, 20 aa, Entamoeba invadens
PSLRLYFDRFVSSEMTDSTN

SEQ ID NO: 2961533 - protein, 27 aa, Entamoeba invadens
PSLRYQCLCWCSSLSHLTIPTSVTSLG

SEQ ID NO: 2961534 - protein, 38 aa, Entamoeba invadens
PSLSIPLEMGVDFDDFFECFNGFFVREKSVIHCVDLNE

SEQ ID NO: 2961535 - protein, 25 aa, Entamoeba invadens
PSLSKMRVIACSNIGYYENMNDPYL

SEQ ID NO: 2961536 - protein, 24 aa, Entamoeba invadens
PSLSLTRLAFCFLNEVSTQITSRD

SEQ ID NO: 2961537 - protein, 18 aa, Entamoeba invadens
PSLSQIIEMFFGKKKENV

SEQ ID NO: 2961538 - protein, 17 aa, Entamoeba invadens
PSLTELLAMQKAGKLPD

SEQ ID NO: 2961539 - protein, 19 aa, Entamoeba invadens
PSLTFAMFGISLVKDPLEF

SEQ ID NO: 2961540 - protein, 24 aa, Entamoeba invadens
PSLVNPLKKRVIEIDSEADEQTII

SEQ ID NO: 2961541 - protein, 25 aa, Entamoeba invadens
PSLVSRFDLWLSKYYPFGEAILKEL

SEQ ID NO: 2961542 - protein, 20 aa, Entamoeba invadens
PSLYLLIKVGYILFKYKTIN

SEQ ID NO: 2961543 - protein, 24 aa, Entamoeba invadens
PSLYQLGNFCFSFCASLKQIELPE

SEQ ID NO: 2961544 - protein, 17 aa, Entamoeba invadens
PSLYSTIPVKIDDITAF

SEQ ID NO: 2961545 - protein, 19 aa, Entamoeba invadens
PSMKEDFIQSALRSNTCKS

SEQ ID NO: 2961546 - protein, 24 aa, Entamoeba invadens
PSMLRDDPKHFVFSLSSPFLETPT

SEQ ID NO: 2961547 - protein, 21 aa, Entamoeba invadens
PSNEFYEGRLADGVKIEKINS

SEQ ID NO: 2961548 - protein, 20 aa, Entamoeba invadens
PSNFYKLKIICHNVNFENYN

SEQ ID NO: 2961549 - protein, 18 aa, Entamoeba invadens
PSNILVGDRLCVKLCDFG

SEQ ID NO: 2961550 - protein, 27 aa, Entamoeba invadens
PSNLMRLGIYLFYGCSRVKEIHLPKLV

SEQ ID NO: 2961551 - protein, 28 aa, Entamoeba invadens
PSNPCPLPMLFRLFLRKDYTVEVFSMLC

SEQ ID NO: 2961552 - protein, 19 aa, Entamoeba invadens
PSNSKIVLTFSIKNGKKTK

SEQ ID NO: 2961553 - protein, 18 aa, Entamoeba invadens
PSNTSSVFFSFKEEEEVE

SEQ ID NO: 2961554 - protein, 28 aa, Entamoeba invadens
PSNVKSIGKYCFRDCSSLSNVVLPLILT

SEQ ID NO: 2961555 - protein, 18 aa, Entamoeba invadens
PSNVRGYVSSCCIAVIQM

SEQ ID NO: 2961556 - protein, 29 aa, Entamoeba invadens
PSNVSSIGFACFGDCYKLTTVNILSLNVS

SEQ ID NO: 2961557 - protein, 34 aa, Entamoeba invadens
PSPDLSKMFLVVSCLLELYELFFPLNETSKKMQL

SEQ ID NO: 2961558 - protein, 19 aa, Entamoeba invadens
PSPIFPKLLFADIRHNVSA

SEQ ID NO: 2961559 - protein, 21 aa, Entamoeba invadens
PSPLCTEFYKLIGETVTLKGY

SEQ ID NO: 2961560 - protein, 21 aa, Entamoeba invadens
PSPLPKQWSVPIESLTPVKNQ

SEQ ID NO: 2961561 - protein, 20 aa, Entamoeba invadens
PSQDGYCWSYKCDVNSGYCI

SEQ ID NO: 2961562 - protein, 24 aa, Entamoeba invadens
PSQEVIDMPSFRTAGKRIYTVLCN

SEQ ID NO: 2961563 - protein, 17 aa, Entamoeba invadens
PSQIPVLVQQTFLQFVL

SEQ ID NO: 2961564 - protein, 18 aa, Entamoeba invadens
PSQKVFGVVAGIYQWKNS

SEQ ID NO: 2961565 - protein, 22 aa, Entamoeba invadens
PSQLETLAFCKFLTAIQCVSEK

SEQ ID NO: 2961566 - protein, 24 aa, Entamoeba invadens
PSQNLRFVAFLSGASIVRAGLERY

SEQ ID NO: 2961567 - protein, 17 aa, Entamoeba invadens
PSQPVGVLIKNTQKGMS

SEQ ID NO: 2961568 - protein, 22 aa, Entamoeba invadens
PSQSRSGACWFIDNTDDITRVA

SEQ ID NO: 2961569 - protein, 20 aa, Entamoeba invadens
PSRFASKAMQLFVVNDVITN

SEQ ID NO: 2961570 - protein, 17 aa, Entamoeba invadens
PSRFASKTMQLFVIRDV

SEQ ID NO: 2961571 - protein, 25 aa, Entamoeba invadens
PSRGGCPPPPPGRRPGPPTSSSGMQ

SEQ ID NO: 2961572 - protein, 18 aa, Entamoeba invadens
PSRLKSIGRYCFLKCEKL

SEQ ID NO: 2961573 - protein, 24 aa, Entamoeba invadens
PSRLTKLSAAFTYVYNLRDLVIPS

SEQ ID NO: 2961574 - protein, 19 aa, Entamoeba invadens
PSRNTRKSFDNDFKDQSMF

SEQ ID NO: 2961575 - protein, 18 aa, Entamoeba invadens
PSRSVGWTKGITRSKSPQ

SEQ ID NO: 2961576 - protein, 24 aa, Entamoeba invadens
PSSAEWGVVCKFIKAVSTNYTLRL

SEQ ID NO: 2961577 - protein, 18 aa, Entamoeba invadens
PSSAKLYIHRCGRVARAG

SEQ ID NO: 2961578 - protein, 20 aa, Entamoeba invadens
PSSESPLVFEKYTKNTNCFT

SEQ ID NO: 2961579 - protein, 26 aa, Entamoeba invadens
PSSFKGCISLHKIGCLQLLHFSTSSL

SEQ ID NO: 2961580 - protein, 23 aa, Entamoeba invadens
PSSFPSLYEKLSLYYIGELLTYK

SEQ ID NO: 2961581 - protein, 20 aa, Entamoeba invadens
PSSIEWCHMIGLNYVSCSSF

SEQ ID NO: 2961582 - protein, 19 aa, Entamoeba invadens
PSSISISFVKDCVAKFVDE

SEQ ID NO: 2961583 - protein, 24 aa, Entamoeba invadens
PSSITALTPFCFDNCVSLKTINLE

SEQ ID NO: 2961584 - protein, 20 aa, Entamoeba invadens
PSSITLIGYWCFSECSSLSS

SEQ ID NO: 2961585 - protein, 18 aa, Entamoeba invadens
PSSKIAIVGLKIDLREST

SEQ ID NO: 2961586 - protein, 22 aa, Entamoeba invadens
PSSLESLGIYCFNRCSSLNDLI

SEQ ID NO: 2961587 - protein, 18 aa, Entamoeba invadens
PSSLKYIPPLTFNRCVSL

SEQ ID NO: 2961588 - protein, 18 aa, Entamoeba invadens
PSSLVITCGCGKYRFYRE

SEQ ID NO: 2961589 - protein, 25 aa, Entamoeba invadens
PSSNLLMSICCNLIYDPKDPFCQTN

SEQ ID NO: 2961590 - protein, 20 aa, Entamoeba invadens
PSSPYYKFNIFPRKVGSETI

SEQ ID NO: 2961591 - protein, 22 aa, Entamoeba invadens
PSSVESLGIYCFNRCSSLNDII

SEQ ID NO: 2961592 - protein, 17 aa, Entamoeba invadens
PSSVLYGKSPRWILFYE

SEQ ID NO: 2961593 - protein, 22 aa, Entamoeba invadens
PSSVTSLGKWCFASCTNLTSAD

SEQ ID NO: 2961594 - protein, 17 aa, Entamoeba invadens
PSSYPIWEIIKDRVSRL

SEQ ID NO: 2961595 - protein, 23 aa, Entamoeba invadens
PSTACLLNSYAYGPGVDGKIGID

SEQ ID NO: 2961596 - protein, 20 aa, Entamoeba invadens
PSTEEMEPVFAYYKEHNGDE

SEQ ID NO: 2961597 - protein, 22 aa, Entamoeba invadens
PSTEWICGGVPLTVMMNMEQRN

SEQ ID NO: 2961598 - protein, 18 aa, Entamoeba invadens
PSTFFSHRKSRNCETRIS

SEQ ID NO: 2961599 - protein, 24 aa, Entamoeba invadens
PSTIPLQLSFEIVRIYLDSLTDPI

SEQ ID NO: 2961600 - protein, 17 aa, Entamoeba invadens
PSTIVGHGFSFGLSSFN

SEQ ID NO: 2961601 - protein, 25 aa, Entamoeba invadens
PSTKETKGLIGYDLVMKMPKNGLLV

SEQ ID NO: 2961602 - protein, 30 aa, Entamoeba invadens
PSTKSAKAEEIWKFVQIFSDLDQENHASGC

SEQ ID NO: 2961603 - protein, 17 aa, Entamoeba invadens
PSTKWEGVDKMKGYNKP

SEQ ID NO: 2961604 - protein, 19 aa, Entamoeba invadens
PSTLKGFMRIVNFSEDGKY

SEQ ID NO: 2961605 - protein, 25 aa, Entamoeba invadens
PSTLKTLRLHTCGDLYKIDVSRATD

SEQ ID NO: 2961606 - protein, 20 aa, Entamoeba invadens
PSTLLSIGNYCFLNCCKLSE

SEQ ID NO: 2961607 - protein, 26 aa, Entamoeba invadens
PSTNPIRLGLVLNFSVFYYEIMNDPE

SEQ ID NO: 2961608 - protein, 17 aa, Entamoeba invadens
PSTSGGLVHCIVVGPQA

SEQ ID NO: 2961609 - protein, 20 aa, Entamoeba invadens
PSTSPRPPISPMPVTQPLTV

SEQ ID NO: 2961610 - protein, 20 aa, Entamoeba invadens
PSTVGGFIFSCDSAFWLSDG

SEQ ID NO: 2961611 - protein, 19 aa, Entamoeba invadens
PSTVTAIGYDCFGDDCGVL

SEQ ID NO: 2961612 - protein, 17 aa, Entamoeba invadens
PSTVVLNLSRFVANLHF

SEQ ID NO: 2961613 - protein, 18 aa, Entamoeba invadens
PSVIAVFGGCNFGHIRGC

SEQ ID NO: 2961614 - protein, 18 aa, Entamoeba invadens
PSVNPDWNQAFRCKATVG

SEQ ID NO: 2961615 - protein, 28 aa, Entamoeba invadens
PSVRSIGQFCFRWCGNLSSITIPSSVTS

SEQ ID NO: 2961616 - protein, 20 aa, Entamoeba invadens
PSVTLIGDFCFGRCYNLDSI

SEQ ID NO: 2961617 - protein, 25 aa, Entamoeba invadens
PSVTLIGDFCFGRCYNLDSIDIPSS

SEQ ID NO: 2961618 - protein, 24 aa, Entamoeba invadens
PSVTYCPILPNIVGLLLSCCSVDE

SEQ ID NO: 2961619 - protein, 29 aa, Entamoeba invadens
PSVVLQVLMKLRFQFELRYFNCDQTINVN

SEQ ID NO: 2961620 - protein, 21 aa, Entamoeba invadens
PSVYRDEFTVAMFECDGNYPL

SEQ ID NO: 2961621 - protein, 21 aa, Entamoeba invadens
PSYDKGYCSFDNLNVFNEAYR

SEQ ID NO: 2961622 - protein, 23 aa, Entamoeba invadens
PSYMKSVGVAYIYVDSRKTLGEM

SEQ ID NO: 2961623 - protein, 24 aa, Entamoeba invadens
PSYNSAMLPPGWAMGMDYGETYFI

SEQ ID NO: 2961624 - protein, 21 aa, Entamoeba invadens
PSYPEFVKFIIANDTGNYLPI

SEQ ID NO: 2961625 - protein, 18 aa, Entamoeba invadens
PSYWFPNASVAFFKIVVW

SEQ ID NO: 2961626 - protein, 20 aa, Entamoeba invadens
PTAEDMCTIAYRVATFGGKK

SEQ ID NO: 2961627 - protein, 18 aa, Entamoeba invadens
PTAHYVACFVHNIVHIYQ

SEQ ID NO: 2961628 - protein, 24 aa, Entamoeba invadens
PTAKTILVGLKIDLREEGNKEHTS

SEQ ID NO: 2961629 - protein, 27 aa, Entamoeba invadens
PTAPPKRRVGVPVTRNSLITPPNENFQ

SEQ ID NO: 2961630 - protein, 25 aa, Entamoeba invadens
PTASPFGGFNPAAAKLKKTTKKVVE

SEQ ID NO: 2961631 - protein, 25 aa, Entamoeba invadens
PTAVDPRLPIALSQTVGTAPLEPLT

SEQ ID NO: 2961632 - protein, 29 aa, Entamoeba invadens
PTDCRGIISWQHICRIILFSLTVKENPKK

SEQ ID NO: 2961633 - protein, 29 aa, Entamoeba invadens
PTDEIRDAIRLKLPSTLKHSSAENYDENK

SEQ ID NO: 2961634 - protein, 19 aa, Entamoeba invadens
PTDFPRVVSEEGFGKNDFV

SEQ ID NO: 2961635 - protein, 24 aa, Entamoeba invadens
PTDISEKFCRFMVAIGEHKDKLDF

SEQ ID NO: 2961636 - protein, 18 aa, Entamoeba invadens
PTDKVTIGANGKYSKTNG

SEQ ID NO: 2961637 - protein, 24 aa, Entamoeba invadens
PTDRFLVLACDGVWDVMSNQEVAL

SEQ ID NO: 2961638 - protein, 18 aa, Entamoeba invadens
PTDSKRIVFKCAIAGCRK

SEQ ID NO: 2961639 - protein, 30 aa, Entamoeba invadens
PTDSKRIVFKCAIVGCRKRIKVEYQGSAMV

SEQ ID NO: 2961640 - protein, 19 aa, Entamoeba invadens
PTDYRLHVVNEVYDTEDSY

SEQ ID NO: 2961641 - protein, 26 aa, Entamoeba invadens
PTECDERIDALWLWVNGTDPTWISKY

SEQ ID NO: 2961642 - protein, 25 aa, Entamoeba invadens
PTECNGRIDALWLWVNGTDPTWISK

SEQ ID NO: 2961643 - protein, 24 aa, Entamoeba invadens
PTEIKRIHGFPETFTTNVAGVSEK

SEQ ID NO: 2961644 - protein, 20 aa, Entamoeba invadens
PTEISCLISNSFSNSNIIFI

SEQ ID NO: 2961645 - protein, 17 aa, Entamoeba invadens
PTEKWVAIIALLQRNNE

SEQ ID NO: 2961646 - protein, 26 aa, Entamoeba invadens
PTELCEALESLRCESVLTFLEYQRKV

SEQ ID NO: 2961647 - protein, 27 aa, Entamoeba invadens
PTELCEALESLRCESVLTFLEYQRKVI

SEQ ID NO: 2961648 - protein, 19 aa, Entamoeba invadens
PTELFMVHVFLFNSNTPPS

SEQ ID NO: 2961649 - protein, 17 aa, Entamoeba invadens
PTENMNLPVGWAMGYFR

SEQ ID NO: 2961650 - protein, 20 aa, Entamoeba invadens
PTETDKFIWSSVLNNSQPFS

SEQ ID NO: 2961651 - protein, 25 aa, Entamoeba invadens
PTEVHLPDVISFSVIIDNKRIISTV

SEQ ID NO: 2961652 - protein, 20 aa, Entamoeba invadens
PTFEKLEEISAFFMSKVQVV

SEQ ID NO: 2961653 - protein, 19 aa, Entamoeba invadens
PTFEQCYTKFLEVFGESSV

SEQ ID NO: 2961654 - protein, 17 aa, Entamoeba invadens
PTFKDCVSLVYVDLGFN

SEQ ID NO: 2961655 - protein, 17 aa, Entamoeba invadens
PTFPKMFQPILFPETLS

SEQ ID NO: 2961656 - protein, 19 aa, Entamoeba invadens
PTFQKSLIVFQKWKKNLPT

SEQ ID NO: 2961657 - protein, 23 aa, Entamoeba invadens
PTFSEIFKFFTHIVGILQYVDGP

SEQ ID NO: 2961658 - protein, 19 aa, Entamoeba invadens
PTFTEAVVQLVFFVFAYFE

SEQ ID NO: 2961659 - protein, 17 aa, Entamoeba invadens
PTFVSLFQHADMIYYKT

SEQ ID NO: 2961660 - protein, 24 aa, Entamoeba invadens
PTGADLFLKRLLKRVSDEMNVPML

SEQ ID NO: 2961661 - protein, 23 aa, Entamoeba invadens
PTGELNFKIGKLSLNQMNNIQNT

SEQ ID NO: 2961662 - protein, 24 aa, Entamoeba invadens
PTGETIGDILILWDEFILNPNKHI

SEQ ID NO: 2961663 - protein, 20 aa, Entamoeba invadens
PTGHSLAVSSVELYKLPTIP

SEQ ID NO: 2961664 - protein, 20 aa, Entamoeba invadens
PTGKARLGKTIKEIYKELFG

SEQ ID NO: 2961665 - protein, 24 aa, Entamoeba invadens
PTGKARLGKTIKEIYKELFGEDFK

SEQ ID NO: 2961666 - protein, 19 aa, Entamoeba invadens
PTGKFSFESSIDYVETNGQ

SEQ ID NO: 2961667 - protein, 25 aa, Entamoeba invadens
PTGKYPKDIGFSWYTGEQALQIANE

SEQ ID NO: 2961668 - protein, 19 aa, Entamoeba invadens
PTGNLKCFDTISLYDKSNI

SEQ ID NO: 2961669 - protein, 24 aa, Entamoeba invadens
PTGNPLKPFGMLVVHIVIDKDNLS

SEQ ID NO: 2961670 - protein, 25 aa, Entamoeba invadens
PTGPSRKEMLSSYYNSVITSLYVPL

SEQ ID NO: 2961671 - protein, 27 aa, Entamoeba invadens
PTIAPTVAPPAMFTPPTPFVGFDNKTP

SEQ ID NO: 2961672 - protein, 24 aa, Entamoeba invadens
PTIFECISMSATHTFSLKAPAKTS

SEQ ID NO: 2961673 - protein, 26 aa, Entamoeba invadens
PTIFHMAWLAFLFYKSLKEGCAKEDE

SEQ ID NO: 2961674 - protein, 19 aa, Entamoeba invadens
PTIIRGAYEFVPPTQSSRY

SEQ ID NO: 2961675 - protein, 19 aa, Entamoeba invadens
PTIIRGAYEFVPPTRSSRY

SEQ ID NO: 2961676 - protein, 17 aa, Entamoeba invadens
PTIKKIDYGLCSVKQNY

SEQ ID NO: 2961677 - protein, 19 aa, Entamoeba invadens
PTIQRCVWKGNDETVFPTC

SEQ ID NO: 2961678 - protein, 18 aa, Entamoeba invadens
PTISLRRQEEVIGRSIIS

SEQ ID NO: 2961679 - protein, 18 aa, Entamoeba invadens
PTITFGKAVTEFGNMAFK

SEQ ID NO: 2961680 - protein, 23 aa, Entamoeba invadens
PTITKLSYKCFAMCEKLKSIEIP

SEQ ID NO: 2961681 - protein, 24 aa, Entamoeba invadens
PTKDEVMGAFGMGRNDEKAARIVV

SEQ ID NO: 2961682 - protein, 23 aa, Entamoeba invadens
PTKEFRGSLLYCAPEVYDDRYDK

SEQ ID NO: 2961683 - protein, 23 aa, Entamoeba invadens
PTKELKHTYTLLLKLEQDLALKY

SEQ ID NO: 2961684 - protein, 21 aa, Entamoeba invadens
PTKKAPRKSLAEMIAEQRFMM

SEQ ID NO: 2961685 - protein, 20 aa, Entamoeba invadens
PTKQFFKRLVYRAPEVFSKF

SEQ ID NO: 2961686 - protein, 19 aa, Entamoeba invadens
PTKSICLIQKIDILNFFTI

SEQ ID NO: 2961687 - protein, 18 aa, Entamoeba invadens
PTKYDYIFIPPVGVTLND

SEQ ID NO: 2961688 - protein, 17 aa, Entamoeba invadens
PTLAELIAMQKAGNLPK

SEQ ID NO: 2961689 - protein, 24 aa, Entamoeba invadens
PTLEIPKLSALGLNVLYLAVEDVA

SEQ ID NO: 2961690 - protein, 18 aa, Entamoeba invadens
PTLGENMLFFNAIITVCW

SEQ ID NO: 2961691 - protein, 18 aa, Entamoeba invadens
PTLKALGYQAFFKCPLLK

SEQ ID NO: 2961692 - protein, 17 aa, Entamoeba invadens
PTLKISLIQIFRAHLWQ

SEQ ID NO: 2961693 - protein, 17 aa, Entamoeba invadens
PTLKRRRKLVDKKNKKR

SEQ ID NO: 2961694 - protein, 19 aa, Entamoeba invadens
PTLKRRRVDEELAAKDKEI

SEQ ID NO: 2961695 - protein, 34 aa, Entamoeba invadens
PTLKYTYQLNFLFKENPYLLSPTCSLKISYKLGD

SEQ ID NO: 2961696 - protein, 23 aa, Entamoeba invadens
PTLRNCPTYDEIIFNNVHDRNGL

SEQ ID NO: 2961697 - protein, 19 aa, Entamoeba invadens
PTLSIPLLLLQIRDSLLKF

SEQ ID NO: 2961698 - protein, 20 aa, Entamoeba invadens
PTLTFFVENIACDFLKVMLS

SEQ ID NO: 2961699 - protein, 25 aa, Entamoeba invadens
PTLTHPKIVPAPLVKPQQLQTVNPF

SEQ ID NO: 2961700 - protein, 17 aa, Entamoeba invadens
PTLVGLHYKELQKALNK

SEQ ID NO: 2961701 - protein, 18 aa, Entamoeba invadens
PTMVVWEKYFTRHKLKER

SEQ ID NO: 2961702 - protein, 18 aa, Entamoeba invadens
PTMYYLLDLKKDCYNLIF

SEQ ID NO: 2961703 - protein, 22 aa, Entamoeba invadens
PTNGIAHCLQLYSQVTQSIVLS

SEQ ID NO: 2961704 - protein, 20 aa, Entamoeba invadens
PTNKMCLGNVLTCFVGSVKC

SEQ ID NO: 2961705 - protein, 28 aa, Entamoeba invadens
PTNKTGRVRWQWFDGKLFIDYPDNQNIK

SEQ ID NO: 2961706 - protein, 20 aa, Entamoeba invadens
PTNKYSLMIADFIDDDDELK

SEQ ID NO: 2961707 - protein, 23 aa, Entamoeba invadens
PTNLFKSQFFFQVAKALKTGGTF

SEQ ID NO: 2961708 - protein, 25 aa, Entamoeba invadens
PTNLKFGDANFENKILELMNKKTEE

SEQ ID NO: 2961709 - protein, 23 aa, Entamoeba invadens
PTNLKFPLAEQFLVVGTHKNNDT

SEQ ID NO: 2961710 - protein, 20 aa, Entamoeba invadens
PTNLRFVLFTDNCLQTYTDW

SEQ ID NO: 2961711 - protein, 20 aa, Entamoeba invadens
PTNPDWKFSDSIKVEDNRIV

SEQ ID NO: 2961712 - protein, 18 aa, Entamoeba invadens
PTNVPRKVVERVLKGAPR

SEQ ID NO: 2961713 - protein, 28 aa, Entamoeba invadens
PTPEVYSQIVSLIWQLLIIDLQKRISKS

SEQ ID NO: 2961714 - protein, 32 aa, Entamoeba invadens
PTPEYVKIVLCKKCYLATRRKSEKTRREAKNH

SEQ ID NO: 2961715 - protein, 30 aa, Entamoeba invadens
PTPIKCPICQSVFCSVCLQGNHVGSCYGKD

SEQ ID NO: 2961716 - protein, 24 aa, Entamoeba invadens
PTPKIPILPLWMGDIIHAQTLFSS

SEQ ID NO: 2961717 - protein, 18 aa, Entamoeba invadens
PTPLSESEYCFVRNDAGF

SEQ ID NO: 2961718 - protein, 20 aa, Entamoeba invadens
PTPNIAEYIKSIPAWSPEEQ

SEQ ID NO: 2961719 - protein, 35 aa, Entamoeba invadens
PTQDTEVLFGITFKTRANAITKRAQPTSFNDQNKP

SEQ ID NO: 2961720 - protein, 17 aa, Entamoeba invadens
PTQHEWGNGYSYFSDIH

SEQ ID NO: 2961721 - protein, 17 aa, Entamoeba invadens
PTQKCYLFIDYLGKCLN

SEQ ID NO: 2961722 - protein, 24 aa, Entamoeba invadens
PTQQCKRSSLLTEVKTVGSPTIQN

SEQ ID NO: 2961723 - protein, 20 aa, Entamoeba invadens
PTRIDGHTNFVRSLDISNDL

SEQ ID NO: 2961724 - protein, 18 aa, Entamoeba invadens
PTRKFLSLVKERFPEDTE

SEQ ID NO: 2961725 - protein, 21 aa, Entamoeba invadens
PTRLQCVIDALLVEKNRVSWE

SEQ ID NO: 2961726 - protein, 25 aa, Entamoeba invadens
PTRPFKRMTYADAIKFCNDNKILNK

SEQ ID NO: 2961727 - protein, 19 aa, Entamoeba invadens
PTRVEIITELVLDFKLLKN

SEQ ID NO: 2961728 - protein, 23 aa, Entamoeba invadens
PTSEIYGSLPFTLINIQPTDIKT

SEQ ID NO: 2961729 - protein, 23 aa, Entamoeba invadens
PTSFSFKGTKAYVNVPASIFGNP

SEQ ID NO: 2961730 - protein, 20 aa, Entamoeba invadens
PTSIKKLGCSCFVKSLNNSI

SEQ ID NO: 2961731 - protein, 17 aa, Entamoeba invadens
PTSILYFGERCFKGVGL

SEQ ID NO: 2961732 - protein, 19 aa, Entamoeba invadens
PTSITKIGVHNIWYGLLPK

SEQ ID NO: 2961733 - protein, 18 aa, Entamoeba invadens
PTSKTIVVGLKIDLRDSV

SEQ ID NO: 2961734 - protein, 24 aa, Entamoeba invadens
PTSLEVFAVPPPRDRERRYEKRFP

SEQ ID NO: 2961735 - protein, 24 aa, Entamoeba invadens
PTSLEYVGPLVFFDCKKMKELVFH

SEQ ID NO: 2961736 - protein, 19 aa, Entamoeba invadens
PTSLIKLDVPWDVRVANKR

SEQ ID NO: 2961737 - protein, 18 aa, Entamoeba invadens
PTSLLKIGNECFMNCESL

SEQ ID NO: 2961738 - protein, 25 aa, Entamoeba invadens
PTSMTITSYFSFDFNQFYYTQSDVG

SEQ ID NO: 2961739 - protein, 20 aa, Entamoeba invadens
PTSPRLASRGNVIQPNSPKV

SEQ ID NO: 2961740 - protein, 24 aa, Entamoeba invadens
PTSQCLYATVGDTFWTSTDSLINK

SEQ ID NO: 2961741 - protein, 20 aa, Entamoeba invadens
PTSTMSWEDFYILNKDTPPT

SEQ ID NO: 2961742 - protein, 18 aa, Entamoeba invadens
PTSYRVLDSLLFELKGIK

SEQ ID NO: 2961743 - protein, 34 aa, Entamoeba invadens
PTSYVESGYIWLPMYPVICGPMYIIPQQQTQLNE

SEQ ID NO: 2961744 - protein, 19 aa, Entamoeba invadens
PTTEPLVYEVIRVINSKVL

SEQ ID NO: 2961745 - protein, 23 aa, Entamoeba invadens
PTTETPYTFALKKMLKPLLESKT

SEQ ID NO: 2961746 - protein, 19 aa, Entamoeba invadens
PTTFKAKSPLVLKNATEME

SEQ ID NO: 2961747 - protein, 26 aa, Entamoeba invadens
PTTFPYSIPISSARLLIVLTDDNQLF

SEQ ID NO: 2961748 - protein, 18 aa, Entamoeba invadens
PTTIAYRKIDQYKDVLKV

SEQ ID NO: 2961749 - protein, 22 aa, Entamoeba invadens
PTTKEIPSYISVERTGFDKVLP

SEQ ID NO: 2961750 - protein, 24 aa, Entamoeba invadens
PTTLELKIGAFVMVTKNISIEKNL

SEQ ID NO: 2961751 - protein, 23 aa, Entamoeba invadens
PTTLKIRVVNIVGLGYSYCSKNG

SEQ ID NO: 2961752 - protein, 17 aa, Entamoeba invadens
PTTLKPKVVQLIKTEYE

SEQ ID NO: 2961753 - protein, 32 aa, Entamoeba invadens
PTTLKTIGKFAFKNCYSLESLTFPKSLENVED

SEQ ID NO: 2961754 - protein, 19 aa, Entamoeba invadens
PTTLVGNAFLLKRKVPKEP

SEQ ID NO: 2961755 - protein, 23 aa, Entamoeba invadens
PTTNCIGKYCFHNCTRLRQVNIP

SEQ ID NO: 2961756 - protein, 24 aa, Entamoeba invadens
PTTPLRFTDIILFGVTLPSSGQLS

SEQ ID NO: 2961757 - protein, 24 aa, Entamoeba invadens
PTTSRDSWNLGIALIELLTGRVFC

SEQ ID NO: 2961758 - protein, 18 aa, Entamoeba invadens
PTTTFSLKQNFVVDEYLD

SEQ ID NO: 2961759 - protein, 27 aa, Entamoeba invadens
PTTVIKRYGQNLSHPFFEAFNTYLEDT

SEQ ID NO: 2961760 - protein, 18 aa, Entamoeba invadens
PTTYRKICYSGYNHYDDI

SEQ ID NO: 2961761 - protein, 17 aa, Entamoeba invadens
PTVECPFGYQWSVVDEI

SEQ ID NO: 2961762 - protein, 18 aa, Entamoeba invadens
PTVIICGNKADLIERRRV

SEQ ID NO: 2961763 - protein, 27 aa, Entamoeba invadens
PTVLDCCGFLKILRCNPLACRNLSQKT

SEQ ID NO: 2961764 - protein, 21 aa, Entamoeba invadens
PTVPEGMDWDTFVKDIVAPGR

SEQ ID NO: 2961765 - protein, 19 aa, Entamoeba invadens
PTVRSLLVVLIYRVIAMGH

SEQ ID NO: 2961766 - protein, 17 aa, Entamoeba invadens
PTVSLKNLVYYIHQTDV

SEQ ID NO: 2961767 - protein, 29 aa, Entamoeba invadens
PTVVFVFGKHCFRGCTKILGNVKIPLHCF

SEQ ID NO: 2961768 - protein, 26 aa, Entamoeba invadens
PTWEINCYSFAPAGVFSREIAGCPEM

SEQ ID NO: 2961769 - protein, 20 aa, Entamoeba invadens
PTWNETFEFHNVVLGSMAVF

SEQ ID NO: 2961770 - protein, 26 aa, Entamoeba invadens
PTYIKFIGDSCFEFSKNLKTVLLASN

SEQ ID NO: 2961771 - protein, 26 aa, Entamoeba invadens
PVALCLPRLVGCGISLDTIFCLNITD

SEQ ID NO: 2961772 - protein, 18 aa, Entamoeba invadens
PVAMSYGYVVEYLQHVNE

SEQ ID NO: 2961773 - protein, 26 aa, Entamoeba invadens
PVCGVGRRICPLFVTKGFDRIAVSSQ

SEQ ID NO: 2961774 - protein, 20 aa, Entamoeba invadens
PVCQTIVRFSTHSQKQKIEA

SEQ ID NO: 2961775 - protein, 24 aa, Entamoeba invadens
PVDDKSSECTVFMQRKRMFENRIQ

SEQ ID NO: 2961776 - protein, 17 aa, Entamoeba invadens
PVDKEVTSLLVVQDNEE

SEQ ID NO: 2961777 - protein, 25 aa, Entamoeba invadens
PVDKMCKFIILLKVLQVPYRLSCST

SEQ ID NO: 2961778 - protein, 17 aa, Entamoeba invadens
PVDLCFENILFNCRYTK

SEQ ID NO: 2961779 - protein, 24 aa, Entamoeba invadens
PVDLKEVVAFLFCVRRGTNDQEKV

SEQ ID NO: 2961780 - protein, 17 aa, Entamoeba invadens
PVDSKDLKLEWQKLNSK

SEQ ID NO: 2961781 - protein, 24 aa, Entamoeba invadens
PVDSLECLTIAKAQLDKIIEKRNQ

SEQ ID NO: 2961782 - protein, 25 aa, Entamoeba invadens
PVDVKRNSYSIIFYDFWTHNLYKDL

SEQ ID NO: 2961783 - protein, 29 aa, Entamoeba invadens
PVEFPDKFRKFGMEPSKGVLFFGPPGCGK

SEQ ID NO: 2961784 - protein, 26 aa, Entamoeba invadens
PVEKIPHEVDLSILPEEQFATTPTVI

SEQ ID NO: 2961785 - protein, 23 aa, Entamoeba invadens
PVENFGAAMLRGMGWKEPQTKEV

SEQ ID NO: 2961786 - protein, 28 aa, Entamoeba invadens
PVESVCRALCAFEGKLLAGIGTTLRMYD

SEQ ID NO: 2961787 - protein, 18 aa, Entamoeba invadens
PVETRECVLANKGKNVPI

SEQ ID NO: 2961788 - protein, 24 aa, Entamoeba invadens
PVEYKGELAYLFKYDKTIPDMDKT

SEQ ID NO: 2961789 - protein, 25 aa, Entamoeba invadens
PVFCTSISPDFKWIVSGSEDSSVRL

SEQ ID NO: 2961790 - protein, 17 aa, Entamoeba invadens
PVFKIPEPFPSNYMNTK

SEQ ID NO: 2961791 - protein, 27 aa, Entamoeba invadens
PVFKKAFYKIIVWFNVDFETVDQNKSR

SEQ ID NO: 2961792 - protein, 27 aa, Entamoeba invadens
PVFKKAFYKIIVWFNVNFETVDQNKSR

SEQ ID NO: 2961793 - protein, 25 aa, Entamoeba invadens
PVFKKEFFCIIVWFDVDFETFDRNK

SEQ ID NO: 2961794 - protein, 19 aa, Entamoeba invadens
PVFKVLACCVERNSMDFNC

SEQ ID NO: 2961795 - protein, 18 aa, Entamoeba invadens
PVFLKMIEKSLVLYLEGS

SEQ ID NO: 2961796 - protein, 25 aa, Entamoeba invadens
PVFPELFKYKCIDIDDSVLLDITPF

SEQ ID NO: 2961797 - protein, 19 aa, Entamoeba invadens
PVFVRGGAAIPIKERRRRS

SEQ ID NO: 2961798 - protein, 23 aa, Entamoeba invadens
PVFYEGRQNFWFDSDVLEEIKFM

SEQ ID NO: 2961799 - protein, 24 aa, Entamoeba invadens
PVGVPRIPIIQVWIEDTKSVELSS

SEQ ID NO: 2961800 - protein, 20 aa, Entamoeba invadens
PVHFKNCTHFSAQLRYIVKY

SEQ ID NO: 2961801 - protein, 19 aa, Entamoeba invadens
PVHKYIRIVQWVNSNDDSI

SEQ ID NO: 2961802 - protein, 18 aa, Entamoeba invadens
PVIKRKSPKLSQSTSDVA

SEQ ID NO: 2961803 - protein, 23 aa, Entamoeba invadens
PVILRPGGVTLEMLREVIPTTCV

SEQ ID NO: 2961804 - protein, 19 aa, Entamoeba invadens
PVKEALNLIKLIKTVTPLY

SEQ ID NO: 2961805 - protein, 20 aa, Entamoeba invadens
PVKEESRLLSEFQKKANELE

SEQ ID NO: 2961806 - protein, 17 aa, Entamoeba invadens
PVKKLTLNTLFALMTQE

SEQ ID NO: 2961807 - protein, 24 aa, Entamoeba invadens
PVKMFKVLISQDFEQYIDKIKESL

SEQ ID NO: 2961808 - protein, 23 aa, Entamoeba invadens
PVKMFKVLVSQEFEQYIDKIKES

SEQ ID NO: 2961809 - protein, 18 aa, Entamoeba invadens
PVLDGVYNDSDWYDNESG

SEQ ID NO: 2961810 - protein, 24 aa, Entamoeba invadens
PVLQGMWFYPLVKSIRSEQFTKIV

SEQ ID NO: 2961811 - protein, 21 aa, Entamoeba invadens
PVLRKSRENRNNFTLQQTFCI

SEQ ID NO: 2961812 - protein, 21 aa, Entamoeba invadens
PVLRKSRENRNNFTLQQTLCV

SEQ ID NO: 2961813 - protein, 19 aa, Entamoeba invadens
PVMSISWSSFPTVPLRCLY

SEQ ID NO: 2961814 - protein, 30 aa, Entamoeba invadens
PVNCMLSKINYCYLPSAHVFDNEIVLSFVY

SEQ ID NO: 2961815 - protein, 22 aa, Entamoeba invadens
PVNIKKGCAVEFTMTVHPLCTL

SEQ ID NO: 2961816 - protein, 20 aa, Entamoeba invadens
PVNLILDVFEAVVLETSVIF

SEQ ID NO: 2961817 - protein, 18 aa, Entamoeba invadens
PVNYNIPLVLPKTLKGLQ

SEQ ID NO: 2961818 - protein, 26 aa, Entamoeba invadens
PVPDLKMFTKYLGMPDVEMITQRTNP

SEQ ID NO: 2961819 - protein, 33 aa, Entamoeba invadens
PVPERKLRIFHGLTFRVGYCGVTERTLIISLIK

SEQ ID NO: 2961820 - protein, 27 aa, Entamoeba invadens
PVPFKSSRCTFALFKNMLEVGMTNVYV

SEQ ID NO: 2961821 - protein, 25 aa, Entamoeba invadens
PVPPKKCHCSLCQKKDVFQAEDPKM

SEQ ID NO: 2961822 - protein, 18 aa, Entamoeba invadens
PVPPPHQAKSGFGAVRTG

SEQ ID NO: 2961823 - protein, 23 aa, Entamoeba invadens
PVPTHITALMSFFSSRGKLIDLL

SEQ ID NO: 2961824 - protein, 20 aa, Entamoeba invadens
PVPYVHCPPIKYKIQEMEEH

SEQ ID NO: 2961825 - protein, 23 aa, Entamoeba invadens
PVQHPARYNLLLRELLKNTQQTD

SEQ ID NO: 2961826 - protein, 17 aa, Entamoeba invadens
PVQKLKDIISFVQRSKN

SEQ ID NO: 2961827 - protein, 23 aa, Entamoeba invadens
PVQRIPRYILLMREYIKATDKDH

SEQ ID NO: 2961828 - protein, 27 aa, Entamoeba invadens
PVQRIPRYRLLLTELLKTMTPQHGEYI

SEQ ID NO: 2961829 - protein, 26 aa, Entamoeba invadens
PVQRLPRYKLLLEDLINHTPEDHLDL

SEQ ID NO: 2961830 - protein, 27 aa, Entamoeba invadens
PVQRLPRYKLLLSDLFEHTKFKDVDYS

SEQ ID NO: 2961831 - protein, 27 aa, Entamoeba invadens
PVQRLPRYKLMLVDLLKHYRLDHHDYF

SEQ ID NO: 2961832 - protein, 20 aa, Entamoeba invadens
PVQRVMRYPLLIDAIIKGTS

SEQ ID NO: 2961833 - protein, 24 aa, Entamoeba invadens
PVQRVMRYPMLIKEIIKLTKRSHP

SEQ ID NO: 2961834 - protein, 18 aa, Entamoeba invadens
PVRFSITKAPKSSVVIEQ

SEQ ID NO: 2961835 - protein, 17 aa, Entamoeba invadens
PVRIFEGHHAPVWSISW

SEQ ID NO: 2961836 - protein, 26 aa, Entamoeba invadens
PVRNIAFVRYRMRGAAEFAKVAMGDQ

SEQ ID NO: 2961837 - protein, 24 aa, Entamoeba invadens
PVSKNSVISLCFQPLIEWKIGTEP

SEQ ID NO: 2961838 - protein, 25 aa, Entamoeba invadens
PVSLLRGHDDWVFGSKFVDNNVVFS

SEQ ID NO: 2961839 - protein, 24 aa, Entamoeba invadens
PVSNCGDCQILVHIKNCRHYTFSC

SEQ ID NO: 2961840 - protein, 18 aa, Entamoeba invadens
PVSPDVSGFYSFRKEVIC

SEQ ID NO: 2961841 - protein, 27 aa, Entamoeba invadens
PVSSDGLKRFAFEGEQWNKVVRRMYNL

SEQ ID NO: 2961842 - protein, 25 aa, Entamoeba invadens
PVTAKLYFREMFSIKENVVVETKTV

SEQ ID NO: 2961843 - protein, 26 aa, Entamoeba invadens
PVTIGYRNRMDFTFGDRMKGGELECG

SEQ ID NO: 2961844 - protein, 21 aa, Entamoeba invadens
PVTRRLFELFDRYDGNEQVQF

SEQ ID NO: 2961845 - protein, 18 aa, Entamoeba invadens
PVTTLMIGTLFPTSFATD

SEQ ID NO: 2961846 - protein, 17 aa, Entamoeba invadens
PVVEIAHFLPVIMEDIL

SEQ ID NO: 2961847 - protein, 30 aa, Entamoeba invadens
PVVGHARSSTFLATNRKATFGEKVKQEEPP

SEQ ID NO: 2961848 - protein, 23 aa, Entamoeba invadens
PVVKELMKQICEKYKKDGKPRVN

SEQ ID NO: 2961849 - protein, 25 aa, Entamoeba invadens
PVVKWLWEILHEYPIDLKKKFLFFA

SEQ ID NO: 2961850 - protein, 19 aa, Entamoeba invadens
PVVNCSRKTLLEDDGEAKL

SEQ ID NO: 2961851 - protein, 19 aa, Entamoeba invadens
PVVSLRNGVPVLKVVEKIV

SEQ ID NO: 2961852 - protein, 21 aa, Entamoeba invadens
PVVTCPYPLDPGLDVGAVNKS

SEQ ID NO: 2961853 - protein, 19 aa, Entamoeba invadens
PVVVLKFVDRLCRNEKKAV

SEQ ID NO: 2961854 - protein, 21 aa, Entamoeba invadens
PVWLYKFRGLGTMYYCEICGG

SEQ ID NO: 2961855 - protein, 18 aa, Entamoeba invadens
PVYDTLCYFHHHPDLLET

SEQ ID NO: 2961856 - protein, 27 aa, Entamoeba invadens
PVYGFYKKRSGVYCKQRSIRMVYDDET

SEQ ID NO: 2961857 - protein, 20 aa, Entamoeba invadens
PVYNIKSLMIRKELAKNDKM

SEQ ID NO: 2961858 - protein, 18 aa, Entamoeba invadens
PWALMTIEMMMDKMIEYY

SEQ ID NO: 2961859 - protein, 17 aa, Entamoeba invadens
PWFRRLNTQITKLKTLR

SEQ ID NO: 2961860 - protein, 20 aa, Entamoeba invadens
PWGLLTILDLVTKCFNEHGS

SEQ ID NO: 2961861 - protein, 17 aa, Entamoeba invadens
PWHFAGTNPEEFRMEKG

SEQ ID NO: 2961862 - protein, 20 aa, Entamoeba invadens
PWHNEHLLEKFVMSVSKKYV

SEQ ID NO: 2961863 - protein, 28 aa, Entamoeba invadens
PWLQAEGENVVEFWKYWMDSTPQPDALE

SEQ ID NO: 2961864 - protein, 22 aa, Entamoeba invadens
PWPRKNRELSIVAGLLLLPMQR

SEQ ID NO: 2961865 - protein, 22 aa, Entamoeba invadens
PWRKFVMKLNVKLNWGGKNTTP

SEQ ID NO: 2961866 - protein, 18 aa, Entamoeba invadens
PWRTELLNQLNVLVKTYV

SEQ ID NO: 2961867 - protein, 19 aa, Entamoeba invadens
PWSSIVLPMDEWTKVELKQ

SEQ ID NO: 2961868 - protein, 19 aa, Entamoeba invadens
PWVHPESRNLATLRGAALH

SEQ ID NO: 2961869 - protein, 17 aa, Entamoeba invadens
PWVVAYLQLHKFEVFLS

SEQ ID NO: 2961870 - protein, 25 aa, Entamoeba invadens
PYAALDAVAAFYARFTDSTEQLPVM

SEQ ID NO: 2961871 - protein, 23 aa, Entamoeba invadens
PYAGLSNMFSFVFFPENTPTALV

SEQ ID NO: 2961872 - protein, 17 aa, Entamoeba invadens
PYAHSFGLTKPVKTNLA

SEQ ID NO: 2961873 - protein, 32 aa, Entamoeba invadens
PYAKDGKHVIVWDRRFIKGVKYFDIKPTTAKS

SEQ ID NO: 2961874 - protein, 17 aa, Entamoeba invadens
PYCFSRHAMPTIIVTKN

SEQ ID NO: 2961875 - protein, 17 aa, Entamoeba invadens
PYCSLKRNSAGTKFLKN

SEQ ID NO: 2961876 - protein, 19 aa, Entamoeba invadens
PYCSPEMILQNGWTYATDL

SEQ ID NO: 2961877 - protein, 18 aa, Entamoeba invadens
PYDCFEHCVCLSSVIIPS

SEQ ID NO: 2961878 - protein, 17 aa, Entamoeba invadens
PYDCKVDVWSLGCVAQE

SEQ ID NO: 2961879 - protein, 25 aa, Entamoeba invadens
PYDGCPMAFEYPSFLYKHCAAQHQK

SEQ ID NO: 2961880 - protein, 26 aa, Entamoeba invadens
PYDRLLMRMSEGIAIVPRRKPRRQFP

SEQ ID NO: 2961881 - protein, 18 aa, Entamoeba invadens
PYDRNCLIKTKVRRDDDQ

SEQ ID NO: 2961882 - protein, 21 aa, Entamoeba invadens
PYEAKEAGAYIFATGRGDFPN

SEQ ID NO: 2961883 - protein, 21 aa, Entamoeba invadens
PYEAKEAGAYIVATGRGDFPN

SEQ ID NO: 2961884 - protein, 26 aa, Entamoeba invadens
PYERIRYPEFFPFQINSKGTDEPTIS

SEQ ID NO: 2961885 - protein, 23 aa, Entamoeba invadens
PYETKVCYLPIVNNRVGNFPIVL

SEQ ID NO: 2961886 - protein, 23 aa, Entamoeba invadens
PYFEATTVISLYPTVNPPRRNFY

SEQ ID NO: 2961887 - protein, 18 aa, Entamoeba invadens
PYFEQELYVFIPSEITPV

SEQ ID NO: 2961888 - protein, 19 aa, Entamoeba invadens
PYFGEKNVCTDCITETLIL

SEQ ID NO: 2961889 - protein, 19 aa, Entamoeba invadens
PYFVAKLIHNVKCTNVVFA

SEQ ID NO: 2961890 - protein, 19 aa, Entamoeba invadens
PYGGMPNGYGAQQYPTPYG

SEQ ID NO: 2961891 - protein, 23 aa, Entamoeba invadens
PYHELRSVFDIQTYVNSGKRLKI

SEQ ID NO: 2961892 - protein, 24 aa, Entamoeba invadens
PYHLKLCFCPLCTKGMTVLSKERS

SEQ ID NO: 2961893 - protein, 19 aa, Entamoeba invadens
PYHLQRFLTHEVCTVMGET

SEQ ID NO: 2961894 - protein, 18 aa, Entamoeba invadens
PYIECSALTGTKIEDIFT

SEQ ID NO: 2961895 - protein, 23 aa, Entamoeba invadens
PYINVSHPFFVIHGIQDEPSGKC

SEQ ID NO: 2961896 - protein, 17 aa, Entamoeba invadens
PYIRKAAALAIPKIYNL

SEQ ID NO: 2961897 - protein, 26 aa, Entamoeba invadens
PYIRQSQCFMIIYSINNKETFACAQK

SEQ ID NO: 2961898 - protein, 25 aa, Entamoeba invadens
PYITSRFIYRSEVVENCMGLNFKEA

SEQ ID NO: 2961899 - protein, 27 aa, Entamoeba invadens
PYIYKLLCTINYLLRVKKNFQFTDLPE

SEQ ID NO: 2961900 - protein, 21 aa, Entamoeba invadens
PYKELKSVFEIKDHVEKGKRL

SEQ ID NO: 2961901 - protein, 20 aa, Entamoeba invadens
PYKLVEIGDYCFYNCTSLVD

SEQ ID NO: 2961902 - protein, 28 aa, Entamoeba invadens
PYKNIFFKALIFWLGRSASLLHRGKAAA

SEQ ID NO: 2961903 - protein, 21 aa, Entamoeba invadens
PYKPQRRKLALVDPLDFFLNF

SEQ ID NO: 2961904 - protein, 32 aa, Entamoeba invadens
PYKRKSRKLARKFCKCKEVILKTSKLDILNEE

SEQ ID NO: 2961905 - protein, 24 aa, Entamoeba invadens
PYKRMKLITLWYLTGFSNAMKLVR

SEQ ID NO: 2961906 - protein, 18 aa, Entamoeba invadens
PYKTISVGPDVTSACVHE

SEQ ID NO: 2961907 - protein, 17 aa, Entamoeba invadens
PYLEAVVNIIRQMLVMK

SEQ ID NO: 2961908 - protein, 18 aa, Entamoeba invadens
PYLEHIHQFCIKNNDIFV

SEQ ID NO: 2961909 - protein, 17 aa, Entamoeba invadens
PYLHELKVLNVMSKSDN

SEQ ID NO: 2961910 - protein, 28 aa, Entamoeba invadens
PYLLKALNFLSMIYIRGGDIKTVNSTKL

SEQ ID NO: 2961911 - protein, 20 aa, Entamoeba invadens
PYLPEWLHFACDYIIANGLC

SEQ ID NO: 2961912 - protein, 23 aa, Entamoeba invadens
PYLPRTFLVYFLLQHTFPKPSIQ

SEQ ID NO: 2961913 - protein, 24 aa, Entamoeba invadens
PYMDFPPMRALFLITTKGIPPMKN

SEQ ID NO: 2961914 - protein, 24 aa, Entamoeba invadens
PYMELPPLRALFLITTKGIPPLKE

SEQ ID NO: 2961915 - protein, 23 aa, Entamoeba invadens
PYMNGRLHLGHTFTLTKAEFAAR

SEQ ID NO: 2961916 - protein, 24 aa, Entamoeba invadens
PYMTWKVPDGERMVCCKIPKLNGF

SEQ ID NO: 2961917 - protein, 23 aa, Entamoeba invadens
PYNEIFIGGEWVEMHLVGPMRSW

SEQ ID NO: 2961918 - protein, 19 aa, Entamoeba invadens
PYNEIFIGGEWVERHLVGP

SEQ ID NO: 2961919 - protein, 17 aa, Entamoeba invadens
PYNFTLLVFHSPEKDLT

SEQ ID NO: 2961920 - protein, 22 aa, Entamoeba invadens
PYNIEFLGYFGIGIDAYSLTAK

SEQ ID NO: 2961921 - protein, 21 aa, Entamoeba invadens
PYNKKVFCELLGLGEDSLKNP

SEQ ID NO: 2961922 - protein, 20 aa, Entamoeba invadens
PYNQSVRWAIENAKEEDKES

SEQ ID NO: 2961923 - protein, 19 aa, Entamoeba invadens
PYNTLKMVECYPLPGILLL

SEQ ID NO: 2961924 - protein, 21 aa, Entamoeba invadens
PYPGQAMPVYGQQPGYPPQAY

SEQ ID NO: 2961925 - protein, 24 aa, Entamoeba invadens
PYPLNKYLLFSLLKLHLPPNRMLI

SEQ ID NO: 2961926 - protein, 18 aa, Entamoeba invadens
PYPPFPISPNVSGMVSKL

SEQ ID NO: 2961927 - protein, 19 aa, Entamoeba invadens
PYQTGFCCHYDRFKNVLHT

SEQ ID NO: 2961928 - protein, 24 aa, Entamoeba invadens
PYRDEFRPFQSFKRSPSRSPRRSP

SEQ ID NO: 2961929 - protein, 23 aa, Entamoeba invadens
PYRELGMLKGLFKVATVGAPGLR

SEQ ID NO: 2961930 - protein, 26 aa, Entamoeba invadens
PYRKEFSNGGSIKFLVTKGSYVRLQN

SEQ ID NO: 2961931 - protein, 22 aa, Entamoeba invadens
PYSAPLKAARKVIPDKDVLHTG

SEQ ID NO: 2961932 - protein, 23 aa, Entamoeba invadens
PYSKCSSCTFWYSPSDDGTHCSK

SEQ ID NO: 2961933 - protein, 18 aa, Entamoeba invadens
PYSLCLNDRLNWKNETEA

SEQ ID NO: 2961934 - protein, 18 aa, Entamoeba invadens
PYSLGFEVSESLIDVFLA

SEQ ID NO: 2961935 - protein, 25 aa, Entamoeba invadens
PYSQILKIYLTFNISPEPTIPQDLF

SEQ ID NO: 2961936 - protein, 18 aa, Entamoeba invadens
PYSTAIDMWSFGCMAAEL

SEQ ID NO: 2961937 - protein, 25 aa, Entamoeba invadens
PYTCQCDIWSLGVIAYLAISGNLPF

SEQ ID NO: 2961938 - protein, 20 aa, Entamoeba invadens
PYTSCSYLRNALTPFLNSRA

SEQ ID NO: 2961939 - protein, 22 aa, Entamoeba invadens
PYVEHIKFLVQVMSQALNTYRP

SEQ ID NO: 2961940 - protein, 19 aa, Entamoeba invadens
PYVKCASTLILPKNDDFEA

SEQ ID NO: 2961941 - protein, 27 aa, Entamoeba invadens
PYVPKCFQIVIPLIGYKASFKVRNMAV

SEQ ID NO: 2961942 - protein, 19 aa, Entamoeba invadens
PYVPKGWPLYHKKNEVEVG

SEQ ID NO: 2961943 - protein, 26 aa, Entamoeba invadens
PYVRKTAVLCVLKLYCMNPQLIEQRG

SEQ ID NO: 2961944 - protein, 24 aa, Entamoeba invadens
PYVVLRRCVDTLSNIASIDILIQL

SEQ ID NO: 2961945 - protein, 28 aa, Entamoeba invadens
PYYYETALFCARANITRKMFDTLNQKIE

SEQ ID NO: 2961946 - protein, 19 aa, Entamoeba invadens
QAAGISKIVMRLKPMIVVK

SEQ ID NO: 2961947 - protein, 18 aa, Entamoeba invadens
QAAGWKESLAFGFDYNMA

SEQ ID NO: 2961948 - protein, 17 aa, Entamoeba invadens
QAAKYALAQKDFVTPRR

SEQ ID NO: 2961949 - protein, 27 aa, Entamoeba invadens
QACAAFDYKCVLVLGICDNPIIEKHKG

SEQ ID NO: 2961950 - protein, 20 aa, Entamoeba invadens
QACELFNFNCVLVVGICEDS

SEQ ID NO: 2961951 - protein, 24 aa, Entamoeba invadens
QAFDNCRSLERIQIPEGVCEIGDD

SEQ ID NO: 2961952 - protein, 23 aa, Entamoeba invadens
QAFFVKIFLDRFSIPSVVLNSDF

SEQ ID NO: 2961953 - protein, 17 aa, Entamoeba invadens
QAFKQNEVEDIRDKTTT

SEQ ID NO: 2961954 - protein, 24 aa, Entamoeba invadens
QAFLRDCNDPNPIVRALAIRTMGA

SEQ ID NO: 2961955 - protein, 26 aa, Entamoeba invadens
QAFVFQICLEISRLLEYNKVRGSVLT

SEQ ID NO: 2961956 - protein, 20 aa, Entamoeba invadens
QAFYMFSERMIKKFNDDIVI

SEQ ID NO: 2961957 - protein, 20 aa, Entamoeba invadens
QAGLPMHLTAGMPNTIVNGM

SEQ ID NO: 2961958 - protein, 23 aa, Entamoeba invadens
QAGRLYALGLIFGGHGTQIMPTL

SEQ ID NO: 2961959 - protein, 34 aa, Entamoeba invadens
QAHLKPLQCVGGFLILRLICPAIMQPNKSGFCQE

SEQ ID NO: 2961960 - protein, 31 aa, Entamoeba invadens
QAHPQNNSWGFKYMHAESFVIAKNNITRKMY

SEQ ID NO: 2961961 - protein, 29 aa, Entamoeba invadens
QAIASAFCSGCDFIRAEGFVFGHVADEGY

SEQ ID NO: 2961962 - protein, 22 aa, Entamoeba invadens
QAIEVFSLLMLYKVMYPTRISL

SEQ ID NO: 2961963 - protein, 17 aa, Entamoeba invadens
QAIQRTCRCTPTRGRFC

SEQ ID NO: 2961964 - protein, 22 aa, Entamoeba invadens
QAISFYLILPIQRIPRYELLIR

SEQ ID NO: 2961965 - protein, 26 aa, Entamoeba invadens
QAKGLCSGLASGALCAIKGESAGECW

SEQ ID NO: 2961966 - protein, 19 aa, Entamoeba invadens
QAKLKLLSLEIHNSPTQEM

SEQ ID NO: 2961967 - protein, 17 aa, Entamoeba invadens
QAKSGTEEFKFGKIKIF

SEQ ID NO: 2961968 - protein, 24 aa, Entamoeba invadens
QAKVFLTQFVLEFQGKFDEVLDTA

SEQ ID NO: 2961969 - protein, 21 aa, Entamoeba invadens
QALCTPRFLGITKQLSDSLAL

SEQ ID NO: 2961970 - protein, 22 aa, Entamoeba invadens
QALDFMCQNPALTRSMLAMNPQ

SEQ ID NO: 2961971 - protein, 23 aa, Entamoeba invadens
QALLRKRMDMEFFKNGLDLQNKR

SEQ ID NO: 2961972 - protein, 27 aa, Entamoeba invadens
QALNEGKRLCDFCPFLMESFENKKELE

SEQ ID NO: 2961973 - protein, 19 aa, Entamoeba invadens
QALSHPFIIGIPIEGYVPS

SEQ ID NO: 2961974 - protein, 27 aa, Entamoeba invadens
QAMLKERGITSLFPIQISTYAPIYEGL

SEQ ID NO: 2961975 - protein, 30 aa, Entamoeba invadens
QAMSDSRFNFTFSHFKPISSVLAKSDKGGR

SEQ ID NO: 2961976 - protein, 24 aa, Entamoeba invadens
QANAFRSSIAIAREPLIIPHTLGG

SEQ ID NO: 2961977 - protein, 19 aa, Entamoeba invadens
QANFLWKILYDKIGSMGND

SEQ ID NO: 2961978 - protein, 25 aa, Entamoeba invadens
QAPEEFFKPIAAFMKAWRDAVEQNR

SEQ ID NO: 2961979 - protein, 18 aa, Entamoeba invadens
QAPQYFFDLTDWYIGYLI

SEQ ID NO: 2961980 - protein, 25 aa, Entamoeba invadens
QAQEEPRVPFVPPEVTQVEATTNPY

SEQ ID NO: 2961981 - protein, 24 aa, Entamoeba invadens
QAQILKRYLPVSLDSDKLKGVVLP

SEQ ID NO: 2961982 - protein, 19 aa, Entamoeba invadens
QAQTFEWINCFFEINKDRA

SEQ ID NO: 2961983 - protein, 21 aa, Entamoeba invadens
QARGIFIDWKGPKAKGMLKVR

SEQ ID NO: 2961984 - protein, 17 aa, Entamoeba invadens
QARGIFIDWKGPKARAM

SEQ ID NO: 2961985 - protein, 20 aa, Entamoeba invadens
QARLFLHSDVLILPDVLCGV

SEQ ID NO: 2961986 - protein, 17 aa, Entamoeba invadens
QASGLKLADNTEVFAKW

SEQ ID NO: 2961987 - protein, 18 aa, Entamoeba invadens
QASGVFQFRIKNVSDEVL

SEQ ID NO: 2961988 - protein, 24 aa, Entamoeba invadens
QASKIWQQLSSSLIKSHASKNPPE

SEQ ID NO: 2961989 - protein, 18 aa, Entamoeba invadens
QASQECICIGLLNDFCSF

SEQ ID NO: 2961990 - protein, 21 aa, Entamoeba invadens
QASTIKSVILIGGSSQIPKVK

SEQ ID NO: 2961991 - protein, 25 aa, Entamoeba invadens
QASVSIKVYSIWEFLRGECDCQKAI

SEQ ID NO: 2961992 - protein, 18 aa, Entamoeba invadens
QATVFCAKNAALTNESVK

SEQ ID NO: 2961993 - protein, 22 aa, Entamoeba invadens
QAVCTKLSCVFDMEDTSLCDTQ

SEQ ID NO: 2961994 - protein, 18 aa, Entamoeba invadens
QAVEKFNLVSELRKKDDR

SEQ ID NO: 2961995 - protein, 31 aa, Entamoeba invadens
QAVIPTEKYFAGPRPTFGRCVNKATVDGVSR

SEQ ID NO: 2961996 - protein, 18 aa, Entamoeba invadens
QAVSEGFALTKLGDEKRE

SEQ ID NO: 2961997 - protein, 23 aa, Entamoeba invadens
QAVTELLAAVGIVGFITKDMSEE

SEQ ID NO: 2961998 - protein, 22 aa, Entamoeba invadens
QAWDSVHIVSFISSEEALSDVV

SEQ ID NO: 2961999 - protein, 19 aa, Entamoeba invadens
QAYKKMCLIHHPDKNGGDD

SEQ ID NO: 2962000 - protein, 23 aa, Entamoeba invadens
QCAALRAYLLPAITKLGEATTPV

SEQ ID NO: 2962001 - protein, 19 aa, Entamoeba invadens
QCALYIARAPKSVCTLKAM

SEQ ID NO: 2962002 - protein, 17 aa, Entamoeba invadens
QCAPEGVEMQFFGNDDL

SEQ ID NO: 2962003 - protein, 20 aa, Entamoeba invadens
QCAYYNKTKMCDYVASNDSD

SEQ ID NO: 2962004 - protein, 18 aa, Entamoeba invadens
QCDLPFRRISGGSNIFAK

SEQ ID NO: 2962005 - protein, 18 aa, Entamoeba invadens
QCEPILIDDCQTIASDAT

SEQ ID NO: 2962006 - protein, 17 aa, Entamoeba invadens
QCFFECKLLSKVTLHDS

SEQ ID NO: 2962007 - protein, 22 aa, Entamoeba invadens
QCFMNCFNLKFISKVKHLKSGV

SEQ ID NO: 2962008 - protein, 27 aa, Entamoeba invadens
QCFRIWKKEYLSSFTRKCPVVYLTLAN

SEQ ID NO: 2962009 - protein, 22 aa, Entamoeba invadens
QCGCGVADILTGRVNPSGRLPM

SEQ ID NO: 2962010 - protein, 18 aa, Entamoeba invadens
QCGFSFKTKSRMMKGFVN

SEQ ID NO: 2962011 - protein, 25 aa, Entamoeba invadens
QCGSLKLSEEIPMFDDSHIILDNAL

SEQ ID NO: 2962012 - protein, 23 aa, Entamoeba invadens
QCHSYKIGLLYAKQGQRTEMEFL

SEQ ID NO: 2962013 - protein, 27 aa, Entamoeba invadens
QCIDALKMYKDRVVFLKNEQQKKLQTT

SEQ ID NO: 2962014 - protein, 21 aa, Entamoeba invadens
QCIDRRAIYNFLMSCKFPDGS

SEQ ID NO: 2962015 - protein, 21 aa, Entamoeba invadens
QCIKTAIEAACTLLRVDDVVS

SEQ ID NO: 2962016 - protein, 26 aa, Entamoeba invadens
QCIKVSPFRGCHHVKIMVMLYEGGLR

SEQ ID NO: 2962017 - protein, 18 aa, Entamoeba invadens
QCIQFVCIVTKFAKHGSL

SEQ ID NO: 2962018 - protein, 17 aa, Entamoeba invadens
QCISCKNGYYLGENNKC

SEQ ID NO: 2962019 - protein, 21 aa, Entamoeba invadens
QCKMDPWYTIAFRNVPDEMPD

SEQ ID NO: 2962020 - protein, 22 aa, Entamoeba invadens
QCKPFPYPVFDVMKRYNLKKED

SEQ ID NO: 2962021 - protein, 17 aa, Entamoeba invadens
QCKWKMQINKNAIPSAF

SEQ ID NO: 2962022 - protein, 18 aa, Entamoeba invadens
QCLCPCGAIKDFDMSEYK

SEQ ID NO: 2962023 - protein, 41 aa, Entamoeba invadens
QCLKIVCVSCDFGVRVCQELCSMPSTFTLLCDLCEAAKSFE

SEQ ID NO: 2962024 - protein, 19 aa, Entamoeba invadens
QCLLCQRGFVKFARHPTWK

SEQ ID NO: 2962025 - protein, 17 aa, Entamoeba invadens
QCLSALITHLIKFNPGI

SEQ ID NO: 2962026 - protein, 21 aa, Entamoeba invadens
QCLVEGNGLNGGYVNEKQFFT

SEQ ID NO: 2962027 - protein, 18 aa, Entamoeba invadens
QCMKIEFQNSVIDCFDGY

SEQ ID NO: 2962028 - protein, 18 aa, Entamoeba invadens
QCNAICLGLHLRKHTAQV

SEQ ID NO: 2962029 - protein, 21 aa, Entamoeba invadens
QCNDFTFLHTFHMYAVSQKYL

SEQ ID NO: 2962030 - protein, 17 aa, Entamoeba invadens
QCNFSIFDFQKSTKIKS

SEQ ID NO: 2962031 - protein, 20 aa, Entamoeba invadens
QCQLTRIHGLFEIIPYKVYQ

SEQ ID NO: 2962032 - protein, 27 aa, Entamoeba invadens
QCQVKFQLKKVLCMGVAVGNVTLTEDQ

SEQ ID NO: 2962033 - protein, 19 aa, Entamoeba invadens
QCRRCLLYEATMYARCNNL

SEQ ID NO: 2962034 - protein, 21 aa, Entamoeba invadens
QCSLCQKKSFFMTSCPKVKTT

SEQ ID NO: 2962035 - protein, 19 aa, Entamoeba invadens
QCSRLSSIVIPSRVSELSG

SEQ ID NO: 2962036 - protein, 17 aa, Entamoeba invadens
QCTKLDYSSTVYTAHQE

SEQ ID NO: 2962037 - protein, 25 aa, Entamoeba invadens
QCVGRCLRGKMDYAVVIYADKRYKF

SEQ ID NO: 2962038 - protein, 22 aa, Entamoeba invadens
QCVRSDVPKEYGLFEHTGDKRY

SEQ ID NO: 2962039 - protein, 21 aa, Entamoeba invadens
QCVTTAIAIVILRKYYADREV

SEQ ID NO: 2962040 - protein, 18 aa, Entamoeba invadens
QCVVKYAKSLLCSPTLAT

SEQ ID NO: 2962041 - protein, 33 aa, Entamoeba invadens
QDAKKAFSIPFWVSLRFYQSFMFDMSKLSRAHS

SEQ ID NO: 2962042 - protein, 19 aa, Entamoeba invadens
QDANNVFGVVVTKPAEKPG

SEQ ID NO: 2962043 - protein, 24 aa, Entamoeba invadens
QDAVVFRFIAFRNYITKHINEIDR

SEQ ID NO: 2962044 - protein, 18 aa, Entamoeba invadens
QDDFDLVRVIGRGSFGKV

SEQ ID NO: 2962045 - protein, 25 aa, Entamoeba invadens
QDDFELLQVIGRGSFGKVMLVRKKD

SEQ ID NO: 2962046 - protein, 18 aa, Entamoeba invadens
QDDFKPLLANALRKTTQE

SEQ ID NO: 2962047 - protein, 21 aa, Entamoeba invadens
QDDIFEYVVYGLLFNNDIIVR

SEQ ID NO: 2962048 - protein, 28 aa, Entamoeba invadens
QDDIRPMSDVLLRSLGYEPITLPATSPK

SEQ ID NO: 2962049 - protein, 24 aa, Entamoeba invadens
QDDKLRYGDSIPHHIKRVDSQCFK

SEQ ID NO: 2962050 - protein, 33 aa, Entamoeba invadens
QDDRDFWCKCAHFTTICLLQLKTLDAQTPTNLY

SEQ ID NO: 2962051 - protein, 24 aa, Entamoeba invadens
QDEDELKRLIAIFDQCEKENVPPE

SEQ ID NO: 2962052 - protein, 18 aa, Entamoeba invadens
QDEGELFSLFSNTILIMK

SEQ ID NO: 2962053 - protein, 24 aa, Entamoeba invadens
QDEIKPTVSLWINFFIMKDVKVIS

SEQ ID NO: 2962054 - protein, 20 aa, Entamoeba invadens
QDEKKCFPLIFINHKGTESS

SEQ ID NO: 2962055 - protein, 19 aa, Entamoeba invadens
QDESCFDYSLKTCDNCSKN

SEQ ID NO: 2962056 - protein, 19 aa, Entamoeba invadens
QDFARFCVFEGESEKTENN

SEQ ID NO: 2962057 - protein, 17 aa, Entamoeba invadens
QDFICLELGQKINSGND

SEQ ID NO: 2962058 - protein, 19 aa, Entamoeba invadens
QDFNCANYSGSVCTTCQQN

SEQ ID NO: 2962059 - protein, 24 aa, Entamoeba invadens
QDFPIFKESIFFYGEKEYNKSITR

SEQ ID NO: 2962060 - protein, 20 aa, Entamoeba invadens
QDFYLCAIWVLKNVNMQLLQ

SEQ ID NO: 2962061 - protein, 22 aa, Entamoeba invadens
QDGDFPLLLTQFFECENVKLLN

SEQ ID NO: 2962062 - protein, 33 aa, Entamoeba invadens
QDGFAGLRYRSVRKPGQHCWALMTPRNVLSIVQ

SEQ ID NO: 2962063 - protein, 17 aa, Entamoeba invadens
QDGRIVISDEFNKLYDG

SEQ ID NO: 2962064 - protein, 23 aa, Entamoeba invadens
QDGRLRPGMELIEATSGNTGIGL

SEQ ID NO: 2962065 - protein, 24 aa, Entamoeba invadens
QDIKRGEIFGAKCAQVEASLRLFV

SEQ ID NO: 2962066 - protein, 19 aa, Entamoeba invadens
QDILEVDCCVVKNAKRTEK

SEQ ID NO: 2962067 - protein, 21 aa, Entamoeba invadens
QDINLRLGINTEDGYSIFEAV

SEQ ID NO: 2962068 - protein, 21 aa, Entamoeba invadens
QDIYGVWALLISKLKLLITDV

SEQ ID NO: 2962069 - protein, 28 aa, Entamoeba invadens
QDKFAIARLNMFSHLSVFIENPYYNPNY

SEQ ID NO: 2962070 - protein, 18 aa, Entamoeba invadens
QDKFGLNLSQFFTSMPEK

SEQ ID NO: 2962071 - protein, 23 aa, Entamoeba invadens
QDKGGNLIGGFVSHRVAKDGAFV

SEQ ID NO: 2962072 - protein, 34 aa, Entamoeba invadens
QDKLKTKFVYYSRDWEDFLKKNQHSISVNISARK

SEQ ID NO: 2962073 - protein, 27 aa, Entamoeba invadens
QDKPLPEKVEMSWKEWFGSSQVKKVRV

SEQ ID NO: 2962074 - protein, 23 aa, Entamoeba invadens
QDKRYIVDIFLLYGNIAVDTSES

SEQ ID NO: 2962075 - protein, 21 aa, Entamoeba invadens
QDLFRCIRDIAQFGNVEQISL

SEQ ID NO: 2962076 - protein, 27 aa, Entamoeba invadens
QDLIRLLCLPLTIANKCIIQKTLSLIG

SEQ ID NO: 2962077 - protein, 31 aa, Entamoeba invadens
QDLLRKERQGLGAPRTIGFLGLGDADVQTVL

SEQ ID NO: 2962078 - protein, 21 aa, Entamoeba invadens
QDLLSDIRKGTTLKPPTITND

SEQ ID NO: 2962079 - protein, 17 aa, Entamoeba invadens
QDLPPLVLKSFHVHLSS

SEQ ID NO: 2962080 - protein, 23 aa, Entamoeba invadens
QDLRALALDLRRKRDKLRFDVQE

SEQ ID NO: 2962081 - protein, 23 aa, Entamoeba invadens
QDLSEILGRITGLQNQFFEDGTI

SEQ ID NO: 2962082 - protein, 17 aa, Entamoeba invadens
QDMLVEILYCFNKVVKY

SEQ ID NO: 2962083 - protein, 19 aa, Entamoeba invadens
QDNCSKARELILMTGGATV

SEQ ID NO: 2962084 - protein, 28 aa, Entamoeba invadens
QDNNCLFGIGGANGWIAVHKPKFDTSRC

SEQ ID NO: 2962085 - protein, 32 aa, Entamoeba invadens
QDNTCFALGTSDGFSVYGIEHMRLKERFKRTF

SEQ ID NO: 2962086 - protein, 23 aa, Entamoeba invadens
QDPDIYFQLNMNNVYKKKGDADK

SEQ ID NO: 2962087 - protein, 24 aa, Entamoeba invadens
QDPEKRPDYKFILNSLNEFGRSTP

SEQ ID NO: 2962088 - protein, 22 aa, Entamoeba invadens
QDPEKRPGSSVVVKTLQNAVLV

SEQ ID NO: 2962089 - protein, 19 aa, Entamoeba invadens
QDPTFGILVLKSIKTQFNY

SEQ ID NO: 2962090 - protein, 18 aa, Entamoeba invadens
QDRRLIGRLPEILNAVPK

SEQ ID NO: 2962091 - protein, 17 aa, Entamoeba invadens
QDSFLFIGPTKHSYIST

SEQ ID NO: 2962092 - protein, 21 aa, Entamoeba invadens
QDSLHKWTKREIGQVAFDSTV

SEQ ID NO: 2962093 - protein, 27 aa, Entamoeba invadens
QDSMFIACSLLQFGVSIPNSLNYALKF

SEQ ID NO: 2962094 - protein, 23 aa, Entamoeba invadens
QDSNRASPIVFQKTADRENSKQK

SEQ ID NO: 2962095 - protein, 19 aa, Entamoeba invadens
QDSTYKNCFGCYKENTIEE

SEQ ID NO: 2962096 - protein, 23 aa, Entamoeba invadens
QDSYRTSIFVDREMVLLDVLDTA

SEQ ID NO: 2962097 - protein, 18 aa, Entamoeba invadens
QDTFGNFTIYCGLVEEQL

SEQ ID NO: 2962098 - protein, 18 aa, Entamoeba invadens
QDTIFKEKMDVLNEELVA

SEQ ID NO: 2962099 - protein, 27 aa, Entamoeba invadens
QDTKCPLSSLWKLLASTPMNTGPISVE

SEQ ID NO: 2962100 - protein, 23 aa, Entamoeba invadens
QDTKWKALFDHPMITTGDFRYWN

SEQ ID NO: 2962101 - protein, 25 aa, Entamoeba invadens
QDTLRLLTILFKYGKYQEVEEAIVD

SEQ ID NO: 2962102 - protein, 25 aa, Entamoeba invadens
QDTLRLLTILFKYGKYQEVEEAIVE

SEQ ID NO: 2962103 - protein, 25 aa, Entamoeba invadens
QDTLRLLTLLFKFGKFREVEHAVTA

SEQ ID NO: 2962104 - protein, 30 aa, Entamoeba invadens
QDVKRKNLEMLLKWIELVHLPITAVGPIFS

SEQ ID NO: 2962105 - protein, 30 aa, Entamoeba invadens
QDVKRYVSENCYFPRMFMKIEDDCVRMLNS

SEQ ID NO: 2962106 - protein, 20 aa, Entamoeba invadens
QDVLFRPNWIQLEQIDLSER

SEQ ID NO: 2962107 - protein, 23 aa, Entamoeba invadens
QDVMSRLELVDGYVLNNTQTLNE

SEQ ID NO: 2962108 - protein, 19 aa, Entamoeba invadens
QDYECPICMSVPHPSHAIE

SEQ ID NO: 2962109 - protein, 26 aa, Entamoeba invadens
QDYSCFALGTTHGFSVYGIDQNHLRE

SEQ ID NO: 2962110 - protein, 30 aa, Entamoeba invadens
QDYSCFALGTTRGFCVFGIEQTRLRERFKR

SEQ ID NO: 2962111 - protein, 29 aa, Entamoeba invadens
QEAARLIIKFLKENKFTIDIVGHRFVHGG

SEQ ID NO: 2962112 - protein, 18 aa, Entamoeba invadens
QEACALAITEKDEKPKKT

SEQ ID NO: 2962113 - protein, 18 aa, Entamoeba invadens
QEAHAFIRNWMAANISKE

SEQ ID NO: 2962114 - protein, 23 aa, Entamoeba invadens
QEAKSPFGFSFGNFQSKLDSRLN

SEQ ID NO: 2962115 - protein, 17 aa, Entamoeba invadens
QEALLWTDGRYYIQATA

SEQ ID NO: 2962116 - protein, 21 aa, Entamoeba invadens
QECAEKAGVCAKCRLPKPIYK

SEQ ID NO: 2962117 - protein, 25 aa, Entamoeba invadens
QECKEWLTRPLSTYVICRCAYDTVC

SEQ ID NO: 2962118 - protein, 25 aa, Entamoeba invadens
QEDCKVAFEIKDKISVIGIDTTYAI

SEQ ID NO: 2962119 - protein, 18 aa, Entamoeba invadens
QEDFSFDKPFAFESTPTP

SEQ ID NO: 2962120 - protein, 19 aa, Entamoeba invadens
QEDMKHWSFTVVNDGNDKP

SEQ ID NO: 2962121 - protein, 19 aa, Entamoeba invadens
QEEFFFVGVILRSVQFSEI

SEQ ID NO: 2962122 - protein, 18 aa, Entamoeba invadens
QEEHPGMELVTFQNKDGT

SEQ ID NO: 2962123 - protein, 22 aa, Entamoeba invadens
QEEKSFIFVFWERVQLFRMYLI

SEQ ID NO: 2962124 - protein, 29 aa, Entamoeba invadens
QEEPLRKSNFLNRRMSRAGSGKRFTTDST

SEQ ID NO: 2962125 - protein, 38 aa, Entamoeba invadens
QEERWLLEGNMPYLDIFPKCRGYQLPSLFDTQRGDSGK

SEQ ID NO: 2962126 - protein, 19 aa, Entamoeba invadens
QEEVFKIVAGMLHMGNVCY

SEQ ID NO: 2962127 - protein, 31 aa, Entamoeba invadens
QEEVFKIVAGMLHMGNVCYVDGKDMAEISNL

SEQ ID NO: 2962128 - protein, 19 aa, Entamoeba invadens
QEEVNNWKAPKLGKKSILR

SEQ ID NO: 2962129 - protein, 23 aa, Entamoeba invadens
QEFKELAEAVMLFNSKEYVSKKS

SEQ ID NO: 2962130 - protein, 28 aa, Entamoeba invadens
QEFNGMKIWCFNAGHILGAAMFCLEING

SEQ ID NO: 2962131 - protein, 24 aa, Entamoeba invadens
QEFTQLRCEFQANFKIELVNVKLF

SEQ ID NO: 2962132 - protein, 19 aa, Entamoeba invadens
QEFYFRRCSYHSATDMNIP

SEQ ID NO: 2962133 - protein, 19 aa, Entamoeba invadens
QEGCAVKMMYCVPENRKFY

SEQ ID NO: 2962134 - protein, 20 aa, Entamoeba invadens
QEGGTYYVEFVKVNIPQTIQ

SEQ ID NO: 2962135 - protein, 20 aa, Entamoeba invadens
QEGHLCIVFELLSLNLYDVL

SEQ ID NO: 2962136 - protein, 25 aa, Entamoeba invadens
QEGHLCIVFELLSLNLYDVLNQNGF

SEQ ID NO: 2962137 - protein, 21 aa, Entamoeba invadens
QEGKKAVVVKKYFHGQIKPLM

SEQ ID NO: 2962138 - protein, 20 aa, Entamoeba invadens
QEGVFRGCVALVNVTLSTNM

SEQ ID NO: 2962139 - protein, 17 aa, Entamoeba invadens
QEHMEVFKSNARANNPL

SEQ ID NO: 2962140 - protein, 29 aa, Entamoeba invadens
QEIDAEKLYKIFNKWISAGIFSSKKLEEA

SEQ ID NO: 2962141 - protein, 19 aa, Entamoeba invadens
QEIDEMVSCFVKAMACTDN

SEQ ID NO: 2962142 - protein, 22 aa, Entamoeba invadens
QEIERDWCVPLMMDTKTDHTND

SEQ ID NO: 2962143 - protein, 21 aa, Entamoeba invadens
QEIFGTSYLFTFPVNKEQQNI

SEQ ID NO: 2962144 - protein, 21 aa, Entamoeba invadens
QEIHSSEILVFNLINDKIDSL

SEQ ID NO: 2962145 - protein, 20 aa, Entamoeba invadens
QEIHVDLGIIEVKTCERTGI

SEQ ID NO: 2962146 - protein, 20 aa, Entamoeba invadens
QEIIQIPLLRQQDLDKLTNK

SEQ ID NO: 2962147 - protein, 23 aa, Entamoeba invadens
QEIKLLGTVIKFDANLFKRPSLK

SEQ ID NO: 2962148 - protein, 27 aa, Entamoeba invadens
QEIPENIFWCKYFRLLFTVQDRESDYK

SEQ ID NO: 2962149 - protein, 24 aa, Entamoeba invadens
QEISFSLVELCYYYDDDLKKCESD

SEQ ID NO: 2962150 - protein, 34 aa, Entamoeba invadens
QEITRINYYITLYLKVRLSKVLQMARMGSNDTAK

SEQ ID NO: 2962151 - protein, 25 aa, Entamoeba invadens
QEIVREQKLNIGRSIREITRESKRL

SEQ ID NO: 2962152 - protein, 19 aa, Entamoeba invadens
QEKAEFWVEPNIDNVTYHK

SEQ ID NO: 2962153 - protein, 18 aa, Entamoeba invadens
QEKALCIPYKVYRPKIPS

SEQ ID NO: 2962154 - protein, 19 aa, Entamoeba invadens
QEKCLKKSVLAIFANKQDD

SEQ ID NO: 2962155 - protein, 29 aa, Entamoeba invadens
QEKFKSFCDFLRRRGHTDMLEQLVMLVDI

SEQ ID NO: 2962156 - protein, 22 aa, Entamoeba invadens
QEKKEGWWFTNLFYNENSLIEQ

SEQ ID NO: 2962157 - protein, 18 aa, Entamoeba invadens
QEKKWASRLIKRSMDALS

SEQ ID NO: 2962158 - protein, 24 aa, Entamoeba invadens
QELAMRTKYGWVFDEFCEDCNCPK

SEQ ID NO: 2962159 - protein, 23 aa, Entamoeba invadens
QELEHRFNLHLYLDLRKVQVGNN

SEQ ID NO: 2962160 - protein, 20 aa, Entamoeba invadens
QELFFPILVEIIVKPQSMVT

SEQ ID NO: 2962161 - protein, 19 aa, Entamoeba invadens
QELLSDVAYPEWKEGEEPP

SEQ ID NO: 2962162 - protein, 25 aa, Entamoeba invadens
QELQRAGYVVICLVRSQSIGDGIRR

SEQ ID NO: 2962163 - protein, 26 aa, Entamoeba invadens
QELRDADDIGCCFAIVFGGNELEQKK

SEQ ID NO: 2962164 - protein, 26 aa, Entamoeba invadens
QELRKRKKLPLGFPYIQHIKEEHFEQ

SEQ ID NO: 2962165 - protein, 22 aa, Entamoeba invadens
QELRVTKELCAKAQTTVLQHSQ

SEQ ID NO: 2962166 - protein, 23 aa, Entamoeba invadens
QELSDKLLLMVFEYLCLEDVISA

SEQ ID NO: 2962167 - protein, 19 aa, Entamoeba invadens
QELYCRDVLCGVHEKTAKR

SEQ ID NO: 2962168 - protein, 25 aa, Entamoeba invadens
QELYFMKFCSVGFNGENGFTIVQYK

SEQ ID NO: 2962169 - protein, 19 aa, Entamoeba invadens
QELYLGMLLDPTTEVVYLT

SEQ ID NO: 2962170 - protein, 21 aa, Entamoeba invadens
QELYLPFLQILKYCFSSSCTL

SEQ ID NO: 2962171 - protein, 17 aa, Entamoeba invadens
QEMCLNCTLKMIQDSQA

SEQ ID NO: 2962172 - protein, 19 aa, Entamoeba invadens
QEMEMAMGSVPAGLSVTSD

SEQ ID NO: 2962173 - protein, 23 aa, Entamoeba invadens
QEMFRSVVPMYFRNSSCVLLVFD

SEQ ID NO: 2962174 - protein, 25 aa, Entamoeba invadens
QEMKAKQPSICLEFFRSGKCTRENC

SEQ ID NO: 2962175 - protein, 34 aa, Entamoeba invadens
QEMLVQFKVSSSFKLRSSDSISLSGLLWAKSNIR

SEQ ID NO: 2962176 - protein, 23 aa, Entamoeba invadens
QEMPNIPMRIHQASDRSISTNPQ

SEQ ID NO: 2962177 - protein, 24 aa, Entamoeba invadens
QEMPRCSMCRAFMSKQMTWTRLGG

SEQ ID NO: 2962178 - protein, 22 aa, Entamoeba invadens
QENAREALGLIVEMVKMKRMAG

SEQ ID NO: 2962179 - protein, 23 aa, Entamoeba invadens
QENCKYNALVAGIVSDKIDSLEE

SEQ ID NO: 2962180 - protein, 23 aa, Entamoeba invadens
QENGLKDVCVFSMFSNLQEIDLS

SEQ ID NO: 2962181 - protein, 23 aa, Entamoeba invadens
QENIKFPPIIRPTSNVHMELVDN

SEQ ID NO: 2962182 - protein, 17 aa, Entamoeba invadens
QENVRWLMTGNMKEYQK

SEQ ID NO: 2962183 - protein, 23 aa, Entamoeba invadens
QEPERKVVMLLDYCPVSTINVLE

SEQ ID NO: 2962184 - protein, 24 aa, Entamoeba invadens
QEPFPNTEANLWNLPMNAWINERC

SEQ ID NO: 2962185 - protein, 23 aa, Entamoeba invadens
QEPLCVLLKGMVIWDDMSVWMSL

SEQ ID NO: 2962186 - protein, 17 aa, Entamoeba invadens
QEPRYPPIDSRYPMDRY

SEQ ID NO: 2962187 - protein, 17 aa, Entamoeba invadens
QEPTRCLFCDTILKPLG

SEQ ID NO: 2962188 - protein, 21 aa, Entamoeba invadens
QEPYIFRFYYYDGDNACQYPE

SEQ ID NO: 2962189 - protein, 20 aa, Entamoeba invadens
QEQIDFGVSFIKNPKSVDAE

SEQ ID NO: 2962190 - protein, 31 aa, Entamoeba invadens
QEQLCRALNAFLKFDVETFIAFQKSINKQEE

SEQ ID NO: 2962191 - protein, 31 aa, Entamoeba invadens
QERFRILTSSFYRKCCGAFLVFDLNDRNSFQ

SEQ ID NO: 2962192 - protein, 22 aa, Entamoeba invadens
QERIKFTFIITIFDDAHAEQVQ

SEQ ID NO: 2962193 - protein, 24 aa, Entamoeba invadens
QERKEFRVRQLVQFIGKGKMQRDF

SEQ ID NO: 2962194 - protein, 21 aa, Entamoeba invadens
QERKKRQLLRTAERQKQIYTP

SEQ ID NO: 2962195 - protein, 37 aa, Entamoeba invadens
QERRCTMQLPLMVSRAAFNLPYGRCVAVLLKSETTAE

SEQ ID NO: 2962196 - protein, 17 aa, Entamoeba invadens
QERRKDLVLSMVEFYSE

SEQ ID NO: 2962197 - protein, 17 aa, Entamoeba invadens
QERSMKYIDEFLSFQQF

SEQ ID NO: 2962198 - protein, 21 aa, Entamoeba invadens
QESCKSLSVLAMKYTQIDRPT

SEQ ID NO: 2962199 - protein, 17 aa, Entamoeba invadens
QESILVYLINNFCSITI

SEQ ID NO: 2962200 - protein, 17 aa, Entamoeba invadens
QESPCILTLDSISNVLC

SEQ ID NO: 2962201 - protein, 32 aa, Entamoeba invadens
QETELLNVISYRFYKVLFLRDLDYDQVPPLWD

SEQ ID NO: 2962202 - protein, 29 aa, Entamoeba invadens
QETFMPNPASFAFGFNMMGNDMPQFNVPQ

SEQ ID NO: 2962203 - protein, 20 aa, Entamoeba invadens
QETNSLYYVMSFKANGLHRF

SEQ ID NO: 2962204 - protein, 23 aa, Entamoeba invadens
QETQIKFPWIVRSCVISNEQASV

SEQ ID NO: 2962205 - protein, 23 aa, Entamoeba invadens
QETREFILRKVINAERTALFSTA

SEQ ID NO: 2962206 - protein, 26 aa, Entamoeba invadens
QEVDKEIQRLGAKVIDSEAKLVDAGA

SEQ ID NO: 2962207 - protein, 17 aa, Entamoeba invadens
QEVDWSGFHVIELSAKQ

SEQ ID NO: 2962208 - protein, 24 aa, Entamoeba invadens
QEVEVYNVLSLWTNYMNFEIIYNS

SEQ ID NO: 2962209 - protein, 21 aa, Entamoeba invadens
QEVFRCYYLKFDYRLLHQIGE

SEQ ID NO: 2962210 - protein, 24 aa, Entamoeba invadens
QEVIEINGGLNWTKPIDGANNEMY

SEQ ID NO: 2962211 - protein, 21 aa, Entamoeba invadens
QEVKMPVVFEAQRTLSPPVFL

SEQ ID NO: 2962212 - protein, 25 aa, Entamoeba invadens
QEVNFGTAVVRRAVLVRSELQDDTK

SEQ ID NO: 2962213 - protein, 17 aa, Entamoeba invadens
QEVPQLVSKEVQEVGKD

SEQ ID NO: 2962214 - protein, 24 aa, Entamoeba invadens
QEVSFDVFCGVVLNDGQVEMLSFE

SEQ ID NO: 2962215 - protein, 26 aa, Entamoeba invadens
QEVSFDVFCGVVLYDGHIEMLSFVNQ

SEQ ID NO: 2962216 - protein, 24 aa, Entamoeba invadens
QEWSFPEIYLLDGGFKCIYEQIPF

SEQ ID NO: 2962217 - protein, 25 aa, Entamoeba invadens
QEYEVYRADLIVPMSINEIADKRQA

SEQ ID NO: 2962218 - protein, 17 aa, Entamoeba invadens
QEYYDKEMVSLKNLAAK

SEQ ID NO: 2962219 - protein, 20 aa, Entamoeba invadens
QFAAQFVSVFYNSFDTNKAN

SEQ ID NO: 2962220 - protein, 17 aa, Entamoeba invadens
QFACRTVEPIGEMERCF

SEQ ID NO: 2962221 - protein, 18 aa, Entamoeba invadens
QFACSLENEFPKLITELS

SEQ ID NO: 2962222 - protein, 17 aa, Entamoeba invadens
QFAKLRNVLAILKAKFS

SEQ ID NO: 2962223 - protein, 33 aa, Entamoeba invadens
QFAMYEPMLAYHCYEFAFQFGVKTDEVNYKKTQ

SEQ ID NO: 2962224 - protein, 27 aa, Entamoeba invadens
QFDHRIPSLIYFCCVYLSEPRNAIKPG

SEQ ID NO: 2962225 - protein, 18 aa, Entamoeba invadens
QFDLRGRFERSIVGGFLY

SEQ ID NO: 2962226 - protein, 22 aa, Entamoeba invadens
QFDNKFIICFNTTSKVLYAFDQ

SEQ ID NO: 2962227 - protein, 19 aa, Entamoeba invadens
QFEENSCECPVEMGTTNMC

SEQ ID NO: 2962228 - protein, 21 aa, Entamoeba invadens
QFEKHGTCALGEYNGENGALN

SEQ ID NO: 2962229 - protein, 21 aa, Entamoeba invadens
QFELVKLKSILEEKEKDLNSS

SEQ ID NO: 2962230 - protein, 24 aa, Entamoeba invadens
QFERYIILCVMLRSLHPIYQTLTN

SEQ ID NO: 2962231 - protein, 19 aa, Entamoeba invadens
QFESVLLKCHSPLLFISKH

SEQ ID NO: 2962232 - protein, 17 aa, Entamoeba invadens
QFFEPFGKVVSVDIMHR

SEQ ID NO: 2962233 - protein, 23 aa, Entamoeba invadens
QFFFIVKFWGSFFTNLSLNDFTT

SEQ ID NO: 2962234 - protein, 26 aa, Entamoeba invadens
QFFGISVKALKEFFEIASKECVDSLL

SEQ ID NO: 2962235 - protein, 19 aa, Entamoeba invadens
QFGCTICKSGFYLNNGRCF

SEQ ID NO: 2962236 - protein, 21 aa, Entamoeba invadens
QFGEFEFAHFLVQNLVAIVFY

SEQ ID NO: 2962237 - protein, 30 aa, Entamoeba invadens
QFGFYRFVTEFKTAFPSILLTLLSGLQVIV

SEQ ID NO: 2962238 - protein, 26 aa, Entamoeba invadens
QFGIGRPTIQNDFTGFASAFCPNATD

SEQ ID NO: 2962239 - protein, 25 aa, Entamoeba invadens
QFGIYMKSRIGLVGPNGTGKSTLMK

SEQ ID NO: 2962240 - protein, 21 aa, Entamoeba invadens
QFGKTHLKKLLGVLDDAMYSE

SEQ ID NO: 2962241 - protein, 20 aa, Entamoeba invadens
QFGPHFFKLELSMQEILLKM

SEQ ID NO: 2962242 - protein, 18 aa, Entamoeba invadens
QFGRACFENCKALGEILY

SEQ ID NO: 2962243 - protein, 20 aa, Entamoeba invadens
QFGRWMSFSLEKEGELEMVR

SEQ ID NO: 2962244 - protein, 24 aa, Entamoeba invadens
QFHDFKEVFNIGGRLPDTNYLFLG

SEQ ID NO: 2962245 - protein, 24 aa, Entamoeba invadens
QFHDLKELFSIAGTPPETTFVFLG

SEQ ID NO: 2962246 - protein, 20 aa, Entamoeba invadens
QFHIEGVDFKTLGYIGETKS

SEQ ID NO: 2962247 - protein, 30 aa, Entamoeba invadens
QFHKKYNCFDGRFQFVTGTTFPDHLNNREM

SEQ ID NO: 2962248 - protein, 19 aa, Entamoeba invadens
QFHPAEFARQITLLQSEMF

SEQ ID NO: 2962249 - protein, 21 aa, Entamoeba invadens
QFHRLPWEAMKDVQDVMYSRL

SEQ ID NO: 2962250 - protein, 20 aa, Entamoeba invadens
QFIDRFRYSATRGPQVQSRI

SEQ ID NO: 2962251 - protein, 20 aa, Entamoeba invadens
QFIEKCCESLDSLKSYTTRL

SEQ ID NO: 2962252 - protein, 18 aa, Entamoeba invadens
QFKEIKSSIHLREKEIDV

SEQ ID NO: 2962253 - protein, 23 aa, Entamoeba invadens
QFKGDYMSTIGMDFNTKTVTVNG

SEQ ID NO: 2962254 - protein, 26 aa, Entamoeba invadens
QFKLKYLNLAGCFGMNGDIIMETYHP

SEQ ID NO: 2962255 - protein, 21 aa, Entamoeba invadens
QFKNLRWVKEESVSRQQIKEK

SEQ ID NO: 2962256 - protein, 25 aa, Entamoeba invadens
QFKQPNWKKAILDAFNHCTSIQSGK

SEQ ID NO: 2962257 - protein, 21 aa, Entamoeba invadens
QFKSTLLGIVSNYFKNLITTI

SEQ ID NO: 2962258 - protein, 23 aa, Entamoeba invadens
QFKTEVKKEMSINQVKTVKRRKD

SEQ ID NO: 2962259 - protein, 19 aa, Entamoeba invadens
QFLAIGGFGNLPGDVEIFE

SEQ ID NO: 2962260 - protein, 17 aa, Entamoeba invadens
QFLPLLINYFIKTIDDH

SEQ ID NO: 2962261 - protein, 24 aa, Entamoeba invadens
QFLRAHNRFADFATTLNTFVDEEE

SEQ ID NO: 2962262 - protein, 20 aa, Entamoeba invadens
QFLSRDGFKYSIEKIKDASV

SEQ ID NO: 2962263 - protein, 33 aa, Entamoeba invadens
QFLTVKAFWARNDVIEFNRFIQRRVKEIREYAI

SEQ ID NO: 2962264 - protein, 18 aa, Entamoeba invadens
QFLYLEKLAKGWYPEKEI

SEQ ID NO: 2962265 - protein, 21 aa, Entamoeba invadens
QFMLPSLLGIMTLFINNFSTL

SEQ ID NO: 2962266 - protein, 24 aa, Entamoeba invadens
QFMTRGQITLSFLPLSHVYEHQID

SEQ ID NO: 2962267 - protein, 25 aa, Entamoeba invadens
QFNDALKALAFATALDKFFIFQSKF

SEQ ID NO: 2962268 - protein, 24 aa, Entamoeba invadens
QFNGGKEVDLWSKLEMSGMLKKVG

SEQ ID NO: 2962269 - protein, 18 aa, Entamoeba invadens
QFNISIARVPSCSYTSKL

SEQ ID NO: 2962270 - protein, 21 aa, Entamoeba invadens
QFNKIKFVFLLLDYWFEDYQK

SEQ ID NO: 2962271 - protein, 28 aa, Entamoeba invadens
QFNLHTCKFLTGFELEELVNLFDIIVSN

SEQ ID NO: 2962272 - protein, 19 aa, Entamoeba invadens
QFNRDFYPIFSALAGNDYT

SEQ ID NO: 2962273 - protein, 26 aa, Entamoeba invadens
QFNVKRPDDFITFLLDFLQKTVTRIT

SEQ ID NO: 2962274 - protein, 26 aa, Entamoeba invadens
QFNVTKGKCFRLCLNPFDSENQSDLF

SEQ ID NO: 2962275 - protein, 21 aa, Entamoeba invadens
QFPDLLELFRVGGRVPETNYI

SEQ ID NO: 2962276 - protein, 22 aa, Entamoeba invadens
QFPFLRKVHFTAIIAQKLENFF

SEQ ID NO: 2962277 - protein, 28 aa, Entamoeba invadens
QFPLQFKFDLKGSLYGRKADENERGKKS

SEQ ID NO: 2962278 - protein, 29 aa, Entamoeba invadens
QFQANKVIGCKMTMYLLEKSRIVSQAKED

SEQ ID NO: 2962279 - protein, 23 aa, Entamoeba invadens
QFQDTLCALPLYSSLDPEKQRKV

SEQ ID NO: 2962280 - protein, 24 aa, Entamoeba invadens
QFQKFLKVRSSEYITQEVKKGVSR

SEQ ID NO: 2962281 - protein, 18 aa, Entamoeba invadens
QFQVRLSSLLGVIQKEIS

SEQ ID NO: 2962282 - protein, 35 aa, Entamoeba invadens
QFQVSIPLFYCFAEETTQLWLPLGNYLFATFSSTG

SEQ ID NO: 2962283 - protein, 19 aa, Entamoeba invadens
QFQYVFKFVVVGEVAVGKS

SEQ ID NO: 2962284 - protein, 19 aa, Entamoeba invadens
QFRMDKVRAGLHSLNKDIE

SEQ ID NO: 2962285 - protein, 22 aa, Entamoeba invadens
QFRQMFLNALSLYYDQEINTVS

SEQ ID NO: 2962286 - protein, 21 aa, Entamoeba invadens
QFRQMFLNSLSLYYNQEKNTI

SEQ ID NO: 2962287 - protein, 18 aa, Entamoeba invadens
QFRVGMINGVLSTVKNES

SEQ ID NO: 2962288 - protein, 19 aa, Entamoeba invadens
QFRVGMINGVLSTVKNESV

SEQ ID NO: 2962289 - protein, 21 aa, Entamoeba invadens
QFSDINFYRRVYWRPVSYRIY

SEQ ID NO: 2962290 - protein, 29 aa, Entamoeba invadens
QFSDINFYRRVYWRPVSYRIYLQPHDNVI

SEQ ID NO: 2962291 - protein, 17 aa, Entamoeba invadens
QFSSCFWVLNKIVELNV

SEQ ID NO: 2962292 - protein, 29 aa, Entamoeba invadens
QFSVAFPKFREAYIKSILPALVAKLEEFK

SEQ ID NO: 2962293 - protein, 19 aa, Entamoeba invadens
QFVALQFVWEMIRKYEDMF

SEQ ID NO: 2962294 - protein, 24 aa, Entamoeba invadens
QFVEMLSALFLQRKVFIKSANRCL

SEQ ID NO: 2962295 - protein, 22 aa, Entamoeba invadens
QFVENCCFILGFASQECTDKET

SEQ ID NO: 2962296 - protein, 25 aa, Entamoeba invadens
QFVLSVFSAFWVLKTGEVYVHQNIK

SEQ ID NO: 2962297 - protein, 20 aa, Entamoeba invadens
QFVNLRIVHLNAWRRNIPLI

SEQ ID NO: 2962298 - protein, 17 aa, Entamoeba invadens
QFVYMWLNFKQKEDALS

SEQ ID NO: 2962299 - protein, 17 aa, Entamoeba invadens
QFYDLLKLFSIGGDLPE

SEQ ID NO: 2962300 - protein, 22 aa, Entamoeba invadens
QFYMCSDSFKGFLKCPRGTKCG

SEQ ID NO: 2962301 - protein, 22 aa, Entamoeba invadens
QFYSHIADFIFRVFENIETLQC

SEQ ID NO: 2962302 - protein, 17 aa, Entamoeba invadens
QGALRFGAKEHFINAIL

SEQ ID NO: 2962303 - protein, 21 aa, Entamoeba invadens
QGCIHYVTIMLLKIIGTKYNI

SEQ ID NO: 2962304 - protein, 18 aa, Entamoeba invadens
QGDHLKRAMGRIAGKDGK

SEQ ID NO: 2962305 - protein, 18 aa, Entamoeba invadens
QGDSILLLRSFKWNLNKM

SEQ ID NO: 2962306 - protein, 23 aa, Entamoeba invadens
QGEAKLRSSGVLINPMIELVMPG

SEQ ID NO: 2962307 - protein, 21 aa, Entamoeba invadens
QGEGSLMVLRLIAETKVKMIE

SEQ ID NO: 2962308 - protein, 23 aa, Entamoeba invadens
QGEKEIALAPAFKPIEKKKEEKT

SEQ ID NO: 2962309 - protein, 21 aa, Entamoeba invadens
QGEKVVAFVLLKKGGNTIDNE

SEQ ID NO: 2962310 - protein, 22 aa, Entamoeba invadens
QGEPLEIMGILKGQTKGDAFII

SEQ ID NO: 2962311 - protein, 18 aa, Entamoeba invadens
QGEWLKQQCQAIANVFEQ

SEQ ID NO: 2962312 - protein, 21 aa, Entamoeba invadens
QGFLILVLACNGFEVKVNKLY

SEQ ID NO: 2962313 - protein, 19 aa, Entamoeba invadens
QGFRVTIDMVAPRLCMGKF

SEQ ID NO: 2962314 - protein, 17 aa, Entamoeba invadens
QGFRVVRDMVLPMLSRG

SEQ ID NO: 2962315 - protein, 23 aa, Entamoeba invadens
QGGHIKGSIPLPSLQELYNLFFR

SEQ ID NO: 2962316 - protein, 23 aa, Entamoeba invadens
QGGKEYFRVFGLIESAEIVRETR

SEQ ID NO: 2962317 - protein, 30 aa, Entamoeba invadens
QGGKWKTWKRRFFVLKDRKLWYFEAPDSLS

SEQ ID NO: 2962318 - protein, 19 aa, Entamoeba invadens
QGHEYALRDEFSFLTKEIL

SEQ ID NO: 2962319 - protein, 17 aa, Entamoeba invadens
QGHKVGLAFYDTAGQEK

SEQ ID NO: 2962320 - protein, 18 aa, Entamoeba invadens
QGHSKFRDMCLENLNIDV

SEQ ID NO: 2962321 - protein, 22 aa, Entamoeba invadens
QGIKSGCFEHIVLQQIEEAEDV

SEQ ID NO: 2962322 - protein, 18 aa, Entamoeba invadens
QGILRGGLLYLMNHFVNG

SEQ ID NO: 2962323 - protein, 25 aa, Entamoeba invadens
QGILSGRPFYIFNLLEELDEEGEYY

SEQ ID NO: 2962324 - protein, 30 aa, Entamoeba invadens
QGIRMLIVICYDLRFPAFIRYSETNDYDII

SEQ ID NO: 2962325 - protein, 24 aa, Entamoeba invadens
QGKYSWHCPGHMGGVAYLRSPPGK

SEQ ID NO: 2962326 - protein, 17 aa, Entamoeba invadens
QGLEGIAKRAAWIERDL

SEQ ID NO: 2962327 - protein, 22 aa, Entamoeba invadens
QGLEMPPRPVISNDFTATTVPY

SEQ ID NO: 2962328 - protein, 21 aa, Entamoeba invadens
QGLKLCLKYYYDPLMQNNVIP

SEQ ID NO: 2962329 - protein, 19 aa, Entamoeba invadens
QGLMSGLVFYVQKEVAQNV

SEQ ID NO: 2962330 - protein, 21 aa, Entamoeba invadens
QGLRYSAGISEWKVVDRNYNE

SEQ ID NO: 2962331 - protein, 26 aa, Entamoeba invadens
QGLTEIGFCCFLECYSLVTLKLPQSL

SEQ ID NO: 2962332 - protein, 20 aa, Entamoeba invadens
QGLVPLLRLAWNRFDANYIA

SEQ ID NO: 2962333 - protein, 20 aa, Entamoeba invadens
QGLVYYKYSFGFDNGIDQGF

SEQ ID NO: 2962334 - protein, 18 aa, Entamoeba invadens
QGMGKLCEVPWKTNTPKV

SEQ ID NO: 2962335 - protein, 23 aa, Entamoeba invadens
QGMKCGTLLLNRFIEIIKTKDIK

SEQ ID NO: 2962336 - protein, 22 aa, Entamoeba invadens
QGMVPPRILIGGTEVLNSQKFI

SEQ ID NO: 2962337 - protein, 18 aa, Entamoeba invadens
QGNIKRGKEDLGKLTTEY

SEQ ID NO: 2962338 - protein, 25 aa, Entamoeba invadens
QGNPDFLRRCVSTFEIRSDQKNDEI

SEQ ID NO: 2962339 - protein, 24 aa, Entamoeba invadens
QGNPRLTTVSVFGTGVLILFSVEV

SEQ ID NO: 2962340 - protein, 25 aa, Entamoeba invadens
QGPCWADSIGKNFNYIKGMVYSNEP

SEQ ID NO: 2962341 - protein, 23 aa, Entamoeba invadens
QGQECKRAIVVYRGQLSSVIVQF

SEQ ID NO: 2962342 - protein, 17 aa, Entamoeba invadens
QGQPAVIVGLKVNGIVQ

SEQ ID NO: 2962343 - protein, 25 aa, Entamoeba invadens
QGREPIRFQMQFSKWDQKRAGYQDT

SEQ ID NO: 2962344 - protein, 20 aa, Entamoeba invadens
QGRFSGLIVQGVFTGKFEST

SEQ ID NO: 2962345 - protein, 19 aa, Entamoeba invadens
QGRIARLTGGVAVISVGGS

SEQ ID NO: 2962346 - protein, 18 aa, Entamoeba invadens
QGRMSICVRRPVVISDTS

SEQ ID NO: 2962347 - protein, 33 aa, Entamoeba invadens
QGRNCPTLDKGACARLTVDLHMTLKDEGKEFRV

SEQ ID NO: 2962348 - protein, 26 aa, Entamoeba invadens
QGRTFEVPLWLARTLQRNGYVRIVVD

SEQ ID NO: 2962349 - protein, 30 aa, Entamoeba invadens
QGSFKMRKPFPLPWRGLRDEKMSEVTGVEG

SEQ ID NO: 2962350 - protein, 18 aa, Entamoeba invadens
QGSIPYYTFENMEIPDFE

SEQ ID NO: 2962351 - protein, 25 aa, Entamoeba invadens
QGSLFIYLFRLMLATGIPELRSEDD

SEQ ID NO: 2962352 - protein, 26 aa, Entamoeba invadens
QGSVKFTGLCDGFFDVRYFPSLDNNA

SEQ ID NO: 2962353 - protein, 25 aa, Entamoeba invadens
QGTSSLRGEVVIGDIANVDKKLEGT

SEQ ID NO: 2962354 - protein, 24 aa, Entamoeba invadens
QGTTRLDAKVVFTVILGTIHPTKI

SEQ ID NO: 2962355 - protein, 17 aa, Entamoeba invadens
QGVFSREEIDKWTQDVE

SEQ ID NO: 2962356 - protein, 19 aa, Entamoeba invadens
QGVKGRLGDLGKIDDRYDV

SEQ ID NO: 2962357 - protein, 25 aa, Entamoeba invadens
QGVKVFSCLYGKYLANLDVKRSDLV

SEQ ID NO: 2962358 - protein, 25 aa, Entamoeba invadens
QGVLFKISLGNFFLFEKDGVEYQVS

SEQ ID NO: 2962359 - protein, 23 aa, Entamoeba invadens
QGYACAILSVPLQSFSVRIIQGK

SEQ ID NO: 2962360 - protein, 23 aa, Entamoeba invadens
QGYAESKAREALKKTQNDKEKAL

SEQ ID NO: 2962361 - protein, 23 aa, Entamoeba invadens
QGYYIQAGLNWFFTGASQLQYPQ

SEQ ID NO: 2962362 - protein, 18 aa, Entamoeba invadens
QHDQSKRPKFNVIVAKLN

SEQ ID NO: 2962363 - protein, 23 aa, Entamoeba invadens
QHEDLLFRVHVKLLMDDTLIDSI

SEQ ID NO: 2962364 - protein, 23 aa, Entamoeba invadens
QHEDMLFRIRVVVSDKGKPVGEV

SEQ ID NO: 2962365 - protein, 23 aa, Entamoeba invadens
QHEVIKCAKKLHSDVVRVSSLTG

SEQ ID NO: 2962366 - protein, 19 aa, Entamoeba invadens
QHFLLDKGYVFKTINLQKI

SEQ ID NO: 2962367 - protein, 19 aa, Entamoeba invadens
QHFSLKFLLEKYVGVEADK

SEQ ID NO: 2962368 - protein, 25 aa, Entamoeba invadens
QHFVNFEFTDTLIAFLFSALTENRY

SEQ ID NO: 2962369 - protein, 24 aa, Entamoeba invadens
QHGIEFPAAASFIRKEVEESKVPK

SEQ ID NO: 2962370 - protein, 26 aa, Entamoeba invadens
QHGPLFIYLFRLMLATGIPELQKVND

SEQ ID NO: 2962371 - protein, 19 aa, Entamoeba invadens
QHICEGCSCLKQVMFDDSI

SEQ ID NO: 2962372 - protein, 17 aa, Entamoeba invadens
QHIEEFMIMFVVDLNLY

SEQ ID NO: 2962373 - protein, 19 aa, Entamoeba invadens
QHIKYIIQYIQLIVDNLNN

SEQ ID NO: 2962374 - protein, 25 aa, Entamoeba invadens
QHIVECKTFPPGFTYFMSKVSQELH

SEQ ID NO: 2962375 - protein, 25 aa, Entamoeba invadens
QHKDCFKIKAGIRTKVKLQGTVLSP

SEQ ID NO: 2962376 - protein, 21 aa, Entamoeba invadens
QHKEFRIFMIMGYYTETLNQI

SEQ ID NO: 2962377 - protein, 21 aa, Entamoeba invadens
QHLKMVFDMANIEENGFLTSN

SEQ ID NO: 2962378 - protein, 23 aa, Entamoeba invadens
QHLKNGVFWGCNSLVKFDSFENV

SEQ ID NO: 2962379 - protein, 29 aa, Entamoeba invadens
QHLSEAVDRCCESGLPPTVPKEVQSMMEC

SEQ ID NO: 2962380 - protein, 24 aa, Entamoeba invadens
QHLTIRLIYCSSFTISNSNDILCD

SEQ ID NO: 2962381 - protein, 30 aa, Entamoeba invadens
QHMSGENLQKCFICGSLDHAAKDCYYKKAV

SEQ ID NO: 2962382 - protein, 26 aa, Entamoeba invadens
QHNAMKFSICFQWMSIPFKRKKTALQ

SEQ ID NO: 2962383 - protein, 25 aa, Entamoeba invadens
QHPPPYFIRLGTRSAKDAFSPDMKL

SEQ ID NO: 2962384 - protein, 25 aa, Entamoeba invadens
QHRGVKRTVTIAGLPYKTEEEDVRK

SEQ ID NO: 2962385 - protein, 21 aa, Entamoeba invadens
QHSFYKIVYWGSITYDNYINY

SEQ ID NO: 2962386 - protein, 29 aa, Entamoeba invadens
QHSLDTATLWSILKGRRNIMIVIEDTRGD

SEQ ID NO: 2962387 - protein, 23 aa, Entamoeba invadens
QHSRICLCLDLPGGPFYSTPFVL

SEQ ID NO: 2962388 - protein, 24 aa, Entamoeba invadens
QHSRSVVFSIKRFVTINQKDQQST

SEQ ID NO: 2962389 - protein, 25 aa, Entamoeba invadens
QHTKFKFPWKIAEFVIKGNHLKIIE

SEQ ID NO: 2962390 - protein, 19 aa, Entamoeba invadens
QHVFLALSYKFRKNIGDKK

SEQ ID NO: 2962391 - protein, 24 aa, Entamoeba invadens
QHVMSAVCKVFLAELVSETQRVRE

SEQ ID NO: 2962392 - protein, 25 aa, Entamoeba invadens
QHYDNRPTFREILDVLDSFTRILEV

SEQ ID NO: 2962393 - protein, 17 aa, Entamoeba invadens
QHYGIQFVIIKTLMEQL

SEQ ID NO: 2962394 - protein, 27 aa, Entamoeba invadens
QIAAILTRCMFLYGELEMCKKRQSEAI

SEQ ID NO: 2962395 - protein, 23 aa, Entamoeba invadens
QIADCKYSLISQFKCVECLDTFK

SEQ ID NO: 2962396 - protein, 23 aa, Entamoeba invadens
QIAECAFIFCIELRRTTKDCTRK

SEQ ID NO: 2962397 - protein, 21 aa, Entamoeba invadens
QIAGLIFKNLFKNRANSQTMA

SEQ ID NO: 2962398 - protein, 19 aa, Entamoeba invadens
QIAKRVGFTLVKNSEMKST

SEQ ID NO: 2962399 - protein, 24 aa, Entamoeba invadens
QIALKGEDGINCMIQNNQLNIEGK

SEQ ID NO: 2962400 - protein, 25 aa, Entamoeba invadens
QIAMLDCLFSIWRVLLDCLSKLDHL

SEQ ID NO: 2962401 - protein, 18 aa, Entamoeba invadens
QIANRVFSAIIFESVETE

SEQ ID NO: 2962402 - protein, 24 aa, Entamoeba invadens
QIASLLSRVFIRGVQMDFLVLPIL

SEQ ID NO: 2962403 - protein, 18 aa, Entamoeba invadens
QIASPCFEKIKATTPHLE

SEQ ID NO: 2962404 - protein, 25 aa, Entamoeba invadens
QICEFCFRSCNKLKSVVIGNCTEAL

SEQ ID NO: 2962405 - protein, 21 aa, Entamoeba invadens
QICKETCRFIQMIVVAFEKGL

SEQ ID NO: 2962406 - protein, 21 aa, Entamoeba invadens
QICNDFCLLTHAFHSIIPEPS

SEQ ID NO: 2962407 - protein, 18 aa, Entamoeba invadens
QIDGIFVGMKFEVLSVAL

SEQ ID NO: 2962408 - protein, 21 aa, Entamoeba invadens
QIDGLYMDFHVLKINMQTTEV

SEQ ID NO: 2962409 - protein, 18 aa, Entamoeba invadens
QIDHPFAKIVLEHRKVGK

SEQ ID NO: 2962410 - protein, 24 aa, Entamoeba invadens
QIDIFKRAIRAVAMGNSVVLPNRA

SEQ ID NO: 2962411 - protein, 20 aa, Entamoeba invadens
QIDLCMSEIRSIRDAANGNY

SEQ ID NO: 2962412 - protein, 23 aa, Entamoeba invadens
QIDLTFLCTGGWVYMNSGNVRYF

SEQ ID NO: 2962413 - protein, 26 aa, Entamoeba invadens
QIDLWKKTQLIREREVVIMQREKEKE

SEQ ID NO: 2962414 - protein, 18 aa, Entamoeba invadens
QIDPILEIFLPFEHSNTI

SEQ ID NO: 2962415 - protein, 18 aa, Entamoeba invadens
QIDSFKNLWREKCYEMEQ

SEQ ID NO: 2962416 - protein, 26 aa, Entamoeba invadens
QIDVFKHCWLPFSLLLASIKQVGADQ

SEQ ID NO: 2962417 - protein, 18 aa, Entamoeba invadens
QIELALGLFYSMNTENIR

SEQ ID NO: 2962418 - protein, 18 aa, Entamoeba invadens
QIELKIISGIFIVNKCSP

SEQ ID NO: 2962419 - protein, 24 aa, Entamoeba invadens
QIEMKECSEVRGWHEDVKYYEAYD

SEQ ID NO: 2962420 - protein, 29 aa, Entamoeba invadens
QIEMPEYWLEAGNPWEVMRADVKYEIKFG

SEQ ID NO: 2962421 - protein, 23 aa, Entamoeba invadens
QIERNGLCELCDPIFSSLISISG

SEQ ID NO: 2962422 - protein, 25 aa, Entamoeba invadens
QIESLCFKNCYSLDTIRLPVNLKSI

SEQ ID NO: 2962423 - protein, 22 aa, Entamoeba invadens
QIETVCLLLLMKVKYPDRIHLL

SEQ ID NO: 2962424 - protein, 24 aa, Entamoeba invadens
QIEVKGKWPNDGFINNKKLFGILV

SEQ ID NO: 2962425 - protein, 17 aa, Entamoeba invadens
QIFDIIAKFEPPVNIVS

SEQ ID NO: 2962426 - protein, 23 aa, Entamoeba invadens
QIFFVNECFFHIAKIEKEPKTKL

SEQ ID NO: 2962427 - protein, 25 aa, Entamoeba invadens
QIFTDKRLADFVPWNKDSLEAIHTR

SEQ ID NO: 2962428 - protein, 32 aa, Entamoeba invadens
QIGDRCLRGLVLNCYEIPNGVIRLCSSSFEYV

SEQ ID NO: 2962429 - protein, 31 aa, Entamoeba invadens
QIGDRCLRGLVLNCYEIPNGVTRLCSSSFEY

SEQ ID NO: 2962430 - protein, 32 aa, Entamoeba invadens
QIGDRCLRGLVLNCYEIPNGVTRLCSSSFEYV

SEQ ID NO: 2962431 - protein, 17 aa, Entamoeba invadens
QIGELEGSFGYHVPSGI

SEQ ID NO: 2962432 - protein, 33 aa, Entamoeba invadens
QIGICIEVCKSLKLWENTVCELFNINKHTLSKE

SEQ ID NO: 2962433 - protein, 19 aa, Entamoeba invadens
QIGNFCFACATQLENVILP

SEQ ID NO: 2962434 - protein, 17 aa, Entamoeba invadens
QIGWGKLGVDYVVESTG

SEQ ID NO: 2962435 - protein, 25 aa, Entamoeba invadens
QIHFAGHGPALFGNERINKFWRTKR

SEQ ID NO: 2962436 - protein, 23 aa, Entamoeba invadens
QIHIKVVEVFPIYENEGDFTTKK

SEQ ID NO: 2962437 - protein, 23 aa, Entamoeba invadens
QIHIPNCRTFFAKVDVFTSRFLE

SEQ ID NO: 2962438 - protein, 24 aa, Entamoeba invadens
QIIESLKRKKCFGQQQWDENNPLA

SEQ ID NO: 2962439 - protein, 25 aa, Entamoeba invadens
QIIFCKKCLEQIRMNTVDGIELAGG

SEQ ID NO: 2962440 - protein, 22 aa, Entamoeba invadens
QIIFKTATSRDVFVQKTDNTTI

SEQ ID NO: 2962441 - protein, 22 aa, Entamoeba invadens
QIIGKEKLLFVFVSKMGDVFGF

SEQ ID NO: 2962442 - protein, 19 aa, Entamoeba invadens
QIIISPNCELFSTNEKTKN

SEQ ID NO: 2962443 - protein, 22 aa, Entamoeba invadens
QIIKRRCLDIGVPTQCIEVDTV

SEQ ID NO: 2962444 - protein, 26 aa, Entamoeba invadens
QIILAIECLHQLNVIYRDIKLENVLM

SEQ ID NO: 2962445 - protein, 33 aa, Entamoeba invadens
QIILEKFGNAKLVFESILSLKYISNTICDKKDA

SEQ ID NO: 2962446 - protein, 26 aa, Entamoeba invadens
QIIRKELRSTCEFVMGKNTLIRKAIK

SEQ ID NO: 2962447 - protein, 23 aa, Entamoeba invadens
QIISRFEFLRVLDISKCDGIKLL

SEQ ID NO: 2962448 - protein, 18 aa, Entamoeba invadens
QIKAEALSDVSTLDTDTQ

SEQ ID NO: 2962449 - protein, 21 aa, Entamoeba invadens
QIKAFEAQKKMALDDKTEDEK

SEQ ID NO: 2962450 - protein, 19 aa, Entamoeba invadens
QIKALEAQKKMALDDKAEA

SEQ ID NO: 2962451 - protein, 22 aa, Entamoeba invadens
QIKALEAQKKMALDDKTDDEKT

SEQ ID NO: 2962452 - protein, 25 aa, Entamoeba invadens
QIKDLRVLQKYGTKLNAFLYLMNSQ

SEQ ID NO: 2962453 - protein, 21 aa, Entamoeba invadens
QIKETFLAAQGKFISELFSLH

SEQ ID NO: 2962454 - protein, 17 aa, Entamoeba invadens
QIKFNKWLLSIGNGELV

SEQ ID NO: 2962455 - protein, 18 aa, Entamoeba invadens
QIKHGCLLPDHTILELCF

SEQ ID NO: 2962456 - protein, 19 aa, Entamoeba invadens
QIKHGCLLPDHTILELCFL

SEQ ID NO: 2962457 - protein, 23 aa, Entamoeba invadens
QIKKAYKKMAIKYHPDKNPGDTV

SEQ ID NO: 2962458 - protein, 18 aa, Entamoeba invadens
QIKKFRLQMLQPLSTIVL

SEQ ID NO: 2962459 - protein, 23 aa, Entamoeba invadens
QIKKKILKYIVTFRGDLTQISEV

SEQ ID NO: 2962460 - protein, 24 aa, Entamoeba invadens
QIKKLPYFWYYVVVNSSWAERLLS

SEQ ID NO: 2962461 - protein, 24 aa, Entamoeba invadens
QIKQRLLIEKVFFYPYSRDEAVTA

SEQ ID NO: 2962462 - protein, 25 aa, Entamoeba invadens
QIKTPMVYQFLSFVFTQFNKLFPQC

SEQ ID NO: 2962463 - protein, 22 aa, Entamoeba invadens
QILCELVKLLSFAEEVSTLEVT

SEQ ID NO: 2962464 - protein, 30 aa, Entamoeba invadens
QILGWGIKEGGSWKSWKKRMFRLNTQKLEY

SEQ ID NO: 2962465 - protein, 22 aa, Entamoeba invadens
QILKFVKMVSPIGVYTSGKGSS

SEQ ID NO: 2962466 - protein, 26 aa, Entamoeba invadens
QILKVPRSLFPVALSKSGINENITKG

SEQ ID NO: 2962467 - protein, 17 aa, Entamoeba invadens
QILPLCNVFATNMFLTF

SEQ ID NO: 2962468 - protein, 26 aa, Entamoeba invadens
QILRVDRFTIPFIFFVITENEVLLNC

SEQ ID NO: 2962469 - protein, 17 aa, Entamoeba invadens
QILVLWRLKNDLFGYEK

SEQ ID NO: 2962470 - protein, 35 aa, Entamoeba invadens
QIMKSNMICLSKFYPGDFSIIFNCVKGVRTHGQVT

SEQ ID NO: 2962471 - protein, 25 aa, Entamoeba invadens
QIMPKCTLCGFNWFNAYYTPGVSRI

SEQ ID NO: 2962472 - protein, 20 aa, Entamoeba invadens
QIMWGDCGVGNFFISKENLK

SEQ ID NO: 2962473 - protein, 25 aa, Entamoeba invadens
QINAVRFGQYLKFYLLSRQYFDDIK

SEQ ID NO: 2962474 - protein, 37 aa, Entamoeba invadens
QININFKLPYFLKTWLRFIHLCGSPAQLQDAAVVLVI

SEQ ID NO: 2962475 - protein, 37 aa, Entamoeba invadens
QINNFCSYYELIELPTLFRSNFIEICSAMQRNYISSI

SEQ ID NO: 2962476 - protein, 26 aa, Entamoeba invadens
QINPCGRGSKTFFLRATECGNGFVIV

SEQ ID NO: 2962477 - protein, 27 aa, Entamoeba invadens
QIPEHLAILLKIVFLKVQESYGNNLAV

SEQ ID NO: 2962478 - protein, 18 aa, Entamoeba invadens
QIPFTVLEANEWKMVKFM

SEQ ID NO: 2962479 - protein, 26 aa, Entamoeba invadens
QIPKVKEMLRRVFPNRQLLDCEDGNL

SEQ ID NO: 2962480 - protein, 23 aa, Entamoeba invadens
QIPPMKIRVKMMIDGARGVLYLH

SEQ ID NO: 2962481 - protein, 24 aa, Entamoeba invadens
QIPPTGGYCELMWSDPDENQLEKF

SEQ ID NO: 2962482 - protein, 23 aa, Entamoeba invadens
QIPQHSLEIPIYGEDAKLYCEGK

SEQ ID NO: 2962483 - protein, 24 aa, Entamoeba invadens
QIQEIRQFLGRFGLKGDTPKQRIE

SEQ ID NO: 2962484 - protein, 25 aa, Entamoeba invadens
QIQNVFKRYGIPLLTFEKLKEIGTV

SEQ ID NO: 2962485 - protein, 26 aa, Entamoeba invadens
QIQPDAACSFVRIGNMELLDREKGKL

SEQ ID NO: 2962486 - protein, 20 aa, Entamoeba invadens
QIQTSICCIVQCLAIDKTSG

SEQ ID NO: 2962487 - protein, 20 aa, Entamoeba invadens
QIRALKSKVEGLVMDLEVEK

SEQ ID NO: 2962488 - protein, 17 aa, Entamoeba invadens
QIRPKVCTMDRDSIEVE

SEQ ID NO: 2962489 - protein, 24 aa, Entamoeba invadens
QIRVCEKLANPLAFLKSAIDRKDL

SEQ ID NO: 2962490 - protein, 25 aa, Entamoeba invadens
QIRVIDFGSACFENSTLYTYIQSRH

SEQ ID NO: 2962491 - protein, 27 aa, Entamoeba invadens
QISCEGLKRAVRLLQLIGLLDKKEDIT

SEQ ID NO: 2962492 - protein, 26 aa, Entamoeba invadens
QISCKYGNECVEIFLSDLDNNSVVYF

SEQ ID NO: 2962493 - protein, 25 aa, Entamoeba invadens
QISDNWKVISGYVAPISLDKIETQE

SEQ ID NO: 2962494 - protein, 18 aa, Entamoeba invadens
QISEVFKMRSTVVEEVPD

SEQ ID NO: 2962495 - protein, 25 aa, Entamoeba invadens
QISLWDIGGTSSFRSVWNRYIDESN

SEQ ID NO: 2962496 - protein, 26 aa, Entamoeba invadens
QISRIKWDVDKGIFLCDKRSTMSVPV

SEQ ID NO: 2962497 - protein, 20 aa, Entamoeba invadens
QISSIFVCEYFFKRGTFTQN

SEQ ID NO: 2962498 - protein, 18 aa, Entamoeba invadens
QISSMQFTPGVLSVPQQP

SEQ ID NO: 2962499 - protein, 25 aa, Entamoeba invadens
QITCPICISPIKECCVTKCGHAFCK

SEQ ID NO: 2962500 - protein, 21 aa, Entamoeba invadens
QITFECWDWDKMNSDDFLGKV

SEQ ID NO: 2962501 - protein, 27 aa, Entamoeba invadens
QITILKKFEIMDGIVIKGEKIPIRLPL

SEQ ID NO: 2962502 - protein, 23 aa, Entamoeba invadens
QITIPGYMSVVIPQHGELKIFSI

SEQ ID NO: 2962503 - protein, 18 aa, Entamoeba invadens
QITKEAKLNWDVRSVLLI

SEQ ID NO: 2962504 - protein, 33 aa, Entamoeba invadens
QITLIEFNKFIAIPISELYFWDSSQRENSSPNI

SEQ ID NO: 2962505 - protein, 17 aa, Entamoeba invadens
QITLLGLRRRRITERYT

SEQ ID NO: 2962506 - protein, 25 aa, Entamoeba invadens
QITLMIKQCINLAVSDDTTAKKEIE

SEQ ID NO: 2962507 - protein, 27 aa, Entamoeba invadens
QITLPQYLLCLIIYKSRYFSLTNAEKV

SEQ ID NO: 2962508 - protein, 23 aa, Entamoeba invadens
QITLSVASAIFWLAKDEVLKTER

SEQ ID NO: 2962509 - protein, 31 aa, Entamoeba invadens
QITNQCCQSVIWLHTRCDIVHRNLQPKTFLI

SEQ ID NO: 2962510 - protein, 19 aa, Entamoeba invadens
QITPFKCKIVVSDNDSERR

SEQ ID NO: 2962511 - protein, 20 aa, Entamoeba invadens
QIVAMTSTFVSIQFNDIDQH

SEQ ID NO: 2962512 - protein, 17 aa, Entamoeba invadens
QIVCEMKYLVNLNSVKQ

SEQ ID NO: 2962513 - protein, 24 aa, Entamoeba invadens
QIVKDLKTLFGLADTARCFLRRED

SEQ ID NO: 2962514 - protein, 33 aa, Entamoeba invadens
QIVKGSEYKLDFAYHPVPFSFFLQNGDGVQQAY

SEQ ID NO: 2962515 - protein, 18 aa, Entamoeba invadens
QIVKMMRQDEVFKMIAQW

SEQ ID NO: 2962516 - protein, 18 aa, Entamoeba invadens
QIVLKLAVVPSFKSLTQK

SEQ ID NO: 2962517 - protein, 24 aa, Entamoeba invadens
QIVSCKQHGLALVTAQHNKKITQI

SEQ ID NO: 2962518 - protein, 24 aa, Entamoeba invadens
QIVSDIFSSFVFNRFPDFSQYTSL

SEQ ID NO: 2962519 - protein, 34 aa, Entamoeba invadens
QIVTPQIKWLNPMTGMGKLAFKYNSMTHSTQISK

SEQ ID NO: 2962520 - protein, 25 aa, Entamoeba invadens
QIVTYYRKGEWVFGMKDGIITMHLQ

SEQ ID NO: 2962521 - protein, 18 aa, Entamoeba invadens
QIVVKDCPFLLSNTKHDK

SEQ ID NO: 2962522 - protein, 21 aa, Entamoeba invadens
QIWAHSIDAYFPHTEKMLKKI

SEQ ID NO: 2962523 - protein, 18 aa, Entamoeba invadens
QIYAYKMFVNYVNSDNPF

SEQ ID NO: 2962524 - protein, 17 aa, Entamoeba invadens
QIYKIIRMIGIPPSALL

SEQ ID NO: 2962525 - protein, 22 aa, Entamoeba invadens
QIYKYKCWKEISLENIGINKED

SEQ ID NO: 2962526 - protein, 27 aa, Entamoeba invadens
QIYLSPKFDFFRINVWFEVNYTSTQTC

SEQ ID NO: 2962527 - protein, 17 aa, Entamoeba invadens
QIYNFIAGWLAETFELG

SEQ ID NO: 2962528 - protein, 24 aa, Entamoeba invadens
QIYQKDCIKYEKIIDMINETQFNN

SEQ ID NO: 2962529 - protein, 25 aa, Entamoeba invadens
QIYSWLLDLLHICSVRVFPSNTPSY

SEQ ID NO: 2962530 - protein, 23 aa, Entamoeba invadens
QKADLYKDMDIFCDIRKSIDKMK

SEQ ID NO: 2962531 - protein, 21 aa, Entamoeba invadens
QKAEKCALAFDLYINQLTKTI

SEQ ID NO: 2962532 - protein, 18 aa, Entamoeba invadens
QKAFAFYRDVLKSPHVIL

SEQ ID NO: 2962533 - protein, 17 aa, Entamoeba invadens
QKAFLMCDVVNFFFEEH

SEQ ID NO: 2962534 - protein, 20 aa, Entamoeba invadens
QKAIKIAFLLYGDGDRIDEN

SEQ ID NO: 2962535 - protein, 24 aa, Entamoeba invadens
QKALLRLEGATVFLDYPDFMVTDS

SEQ ID NO: 2962536 - protein, 17 aa, Entamoeba invadens
QKAMRQAVCVEFVTNVL

SEQ ID NO: 2962537 - protein, 26 aa, Entamoeba invadens
QKAPPKLPQRIPELYDFTSDEKQEVE

SEQ ID NO: 2962538 - protein, 20 aa, Entamoeba invadens
QKAVFVGDVVFGRNVKGNNL

SEQ ID NO: 2962539 - protein, 26 aa, Entamoeba invadens
QKAVIDWKYDSCFGKVMLSCMQNMLP

SEQ ID NO: 2962540 - protein, 17 aa, Entamoeba invadens
QKCFNWYTPPLPLYGIA

SEQ ID NO: 2962541 - protein, 18 aa, Entamoeba invadens
QKCFVFKLKEKGREKFDR

SEQ ID NO: 2962542 - protein, 22 aa, Entamoeba invadens
QKCPYHFPPGLLIYKDPERKIA

SEQ ID NO: 2962543 - protein, 18 aa, Entamoeba invadens
QKCSQTIRKCESCVDGKY

SEQ ID NO: 2962544 - protein, 24 aa, Entamoeba invadens
QKCSSLKLIIKLDVLLRNIAQMPE

SEQ ID NO: 2962545 - protein, 20 aa, Entamoeba invadens
QKCVEKGDRSMVMDVVKALN

SEQ ID NO: 2962546 - protein, 17 aa, Entamoeba invadens
QKCWCTNPIDRLNITQI

SEQ ID NO: 2962547 - protein, 20 aa, Entamoeba invadens
QKDDCLDTYICVRSQTPTIK

SEQ ID NO: 2962548 - protein, 21 aa, Entamoeba invadens
QKDFATKNMKSWNTIMKEIYD

SEQ ID NO: 2962549 - protein, 17 aa, Entamoeba invadens
QKDGAYWTIKRDKIAGA

SEQ ID NO: 2962550 - protein, 31 aa, Entamoeba invadens
QKDISYFFCYKWNALLFKRFFKTEDLIRIWD

SEQ ID NO: 2962551 - protein, 27 aa, Entamoeba invadens
QKDKEKIVLCVMRMKNVVSGLEDRVQM

SEQ ID NO: 2962552 - protein, 19 aa, Entamoeba invadens
QKDKVAFIIECLQKGRRED

SEQ ID NO: 2962553 - protein, 20 aa, Entamoeba invadens
QKDQECWGVYGHPSYEGHKR

SEQ ID NO: 2962554 - protein, 21 aa, Entamoeba invadens
QKDRKCIVMPLISTLNNETLP

SEQ ID NO: 2962555 - protein, 27 aa, Entamoeba invadens
QKEAFTVAPKNVWKFVLATNIAETSVT

SEQ ID NO: 2962556 - protein, 18 aa, Entamoeba invadens
QKEGFPLKTARRKTQSIK

SEQ ID NO: 2962557 - protein, 18 aa, Entamoeba invadens
QKEIEKIVEINKAEIKPK

SEQ ID NO: 2962558 - protein, 18 aa, Entamoeba invadens
QKEKKCKDIIDAVTKEHS

SEQ ID NO: 2962559 - protein, 18 aa, Entamoeba invadens
QKEKVVPVIIPPVRPHLR

SEQ ID NO: 2962560 - protein, 19 aa, Entamoeba invadens
QKELFVFNWIDTIRGKVEF

SEQ ID NO: 2962561 - protein, 23 aa, Entamoeba invadens
QKEVALRLVADVAGYYLNMPNNG

SEQ ID NO: 2962562 - protein, 17 aa, Entamoeba invadens
QKFCFSKCKKLEKIDIP

SEQ ID NO: 2962563 - protein, 23 aa, Entamoeba invadens
QKFDGRFENVISIFDEFEPIQKK

SEQ ID NO: 2962564 - protein, 19 aa, Entamoeba invadens
QKFDPFFIVMKQIFYNLNR

SEQ ID NO: 2962565 - protein, 19 aa, Entamoeba invadens
QKFELKRIVVEKDQTSITE

SEQ ID NO: 2962566 - protein, 21 aa, Entamoeba invadens
QKFFMKFINFFASVTTLPLEM

SEQ ID NO: 2962567 - protein, 20 aa, Entamoeba invadens
QKFIMLLKEFEGVQDTFVQH

SEQ ID NO: 2962568 - protein, 18 aa, Entamoeba invadens
QKFIPFPEVKTIATHLNP

SEQ ID NO: 2962569 - protein, 27 aa, Entamoeba invadens
QKFKMLCARIGLKPLPSMLKQFRESLC

SEQ ID NO: 2962570 - protein, 17 aa, Entamoeba invadens
QKFLSDIALIFLFLYST

SEQ ID NO: 2962571 - protein, 27 aa, Entamoeba invadens
QKFPRREFNDLDMFTRYMIKYPKKVRD

SEQ ID NO: 2962572 - protein, 19 aa, Entamoeba invadens
QKFQDWYCANIEKVEQIAN

SEQ ID NO: 2962573 - protein, 24 aa, Entamoeba invadens
QKFQRKRLDVGLRFCNDDNCVFGL

SEQ ID NO: 2962574 - protein, 20 aa, Entamoeba invadens
QKGFCQICRAPHTKKPIEMH

SEQ ID NO: 2962575 - protein, 25 aa, Entamoeba invadens
QKGFNRTSSLFAHGIPNTLKKIGSQ

SEQ ID NO: 2962576 - protein, 18 aa, Entamoeba invadens
QKGISVWTNGISEITMNG

SEQ ID NO: 2962577 - protein, 28 aa, Entamoeba invadens
QKGKKDDEFCCFLFNDYLVFAKVRREDV

SEQ ID NO: 2962578 - protein, 25 aa, Entamoeba invadens
QKHFKKDFSGIFVDSVFGLGNMLQE

SEQ ID NO: 2962579 - protein, 20 aa, Entamoeba invadens
QKHLAIHLLDVFTADHKDSE

SEQ ID NO: 2962580 - protein, 18 aa, Entamoeba invadens
QKHLEGVVQEMGRIISRK

SEQ ID NO: 2962581 - protein, 25 aa, Entamoeba invadens
QKHSFESFLLLERVTDLGLLSEEYC

SEQ ID NO: 2962582 - protein, 17 aa, Entamoeba invadens
QKIACKENLVFVIQTEF

SEQ ID NO: 2962583 - protein, 22 aa, Entamoeba invadens
QKICKTCPVPFFPGTKGMLESS

SEQ ID NO: 2962584 - protein, 22 aa, Entamoeba invadens
QKIDYFVDRCVDIEARKREMEI

SEQ ID NO: 2962585 - protein, 17 aa, Entamoeba invadens
QKIEEIAQDEGLGVFFD

SEQ ID NO: 2962586 - protein, 35 aa, Entamoeba invadens
QKIKIIPLEVPMAIFHFGGTFTHIINETPIEIAIE

SEQ ID NO: 2962587 - protein, 24 aa, Entamoeba invadens
QKILDMFLELFLNPTVQSSVFRHY

SEQ ID NO: 2962588 - protein, 18 aa, Entamoeba invadens
QKILKRFNVTSAEYTVVF

SEQ ID NO: 2962589 - protein, 18 aa, Entamoeba invadens
QKIPNCSLYNYVIVPNNY

SEQ ID NO: 2962590 - protein, 17 aa, Entamoeba invadens
QKIRKLRVNVEQIKARN

SEQ ID NO: 2962591 - protein, 17 aa, Entamoeba invadens
QKISFSLFDSFLRFVLA

SEQ ID NO: 2962592 - protein, 21 aa, Entamoeba invadens
QKITSCYVVGAIRDIWNTISS

SEQ ID NO: 2962593 - protein, 22 aa, Entamoeba invadens
QKITSCYVVGAIRDIWNTISSS

SEQ ID NO: 2962594 - protein, 17 aa, Entamoeba invadens
QKIVLCCEPIFWMYANY

SEQ ID NO: 2962595 - protein, 20 aa, Entamoeba invadens
QKIVRRFHSFGIALDPSISP

SEQ ID NO: 2962596 - protein, 23 aa, Entamoeba invadens
QKKAEATPQFIAFKETEKSPAEY

SEQ ID NO: 2962597 - protein, 18 aa, Entamoeba invadens
QKKCLKSRSESFGVSECK

SEQ ID NO: 2962598 - protein, 24 aa, Entamoeba invadens
QKKDRVNTNIIFPKLENFKSPIEY

SEQ ID NO: 2962599 - protein, 24 aa, Entamoeba invadens
QKKEFFRVVFWYNVSYSITQKFKT

SEQ ID NO: 2962600 - protein, 28 aa, Entamoeba invadens
QKKFQDQAVWMLNAMWLKEKDARAEELW

SEQ ID NO: 2962601 - protein, 19 aa, Entamoeba invadens
QKKGIEWDKVEALPAECQV

SEQ ID NO: 2962602 - protein, 22 aa, Entamoeba invadens
QKKGRRPIRMKKEDEDLSMSSN

SEQ ID NO: 2962603 - protein, 17 aa, Entamoeba invadens
QKKGVTIDEIFKQREKF

SEQ ID NO: 2962604 - protein, 17 aa, Entamoeba invadens
QKKIETFQHLHNKSEKE

SEQ ID NO: 2962605 - protein, 18 aa, Entamoeba invadens
QKKIGDFFFGYKDQNDIA

SEQ ID NO: 2962606 - protein, 17 aa, Entamoeba invadens
QKKIVEWTNMCQYRVLY

SEQ ID NO: 2962607 - protein, 23 aa, Entamoeba invadens
QKKKEWRLLAWSIYKDYYHSVAL

SEQ ID NO: 2962608 - protein, 20 aa, Entamoeba invadens
QKKKFSFAINSRGVKGEREF

SEQ ID NO: 2962609 - protein, 22 aa, Entamoeba invadens
QKKKGGVSMRFCQSSCKLSGGK

SEQ ID NO: 2962610 - protein, 17 aa, Entamoeba invadens
QKKKPSLEISMYNTEDE

SEQ ID NO: 2962611 - protein, 20 aa, Entamoeba invadens
QKKLLAEQMAQLAKDEEQRK

SEQ ID NO: 2962612 - protein, 25 aa, Entamoeba invadens
QKKLNKCKEACILKDKEGGETALAE

SEQ ID NO: 2962613 - protein, 25 aa, Entamoeba invadens
QKKLRVSYLVLRYAQMKKYEINSTI

SEQ ID NO: 2962614 - protein, 25 aa, Entamoeba invadens
QKKLWEISDFVILWGGNNGDTQKFS

SEQ ID NO: 2962615 - protein, 23 aa, Entamoeba invadens
QKKNGWEKSEFPPLGALPQKGEK

SEQ ID NO: 2962616 - protein, 18 aa, Entamoeba invadens
QKKRPVKKFEIFELTEDY

SEQ ID NO: 2962617 - protein, 27 aa, Entamoeba invadens
QKKVENLEHDKKLLINQIEEVKNEKEL

SEQ ID NO: 2962618 - protein, 18 aa, Entamoeba invadens
QKLAKAFGSQAIKKVVVY

SEQ ID NO: 2962619 - protein, 17 aa, Entamoeba invadens
QKLCPHCNSPISFHKTS

SEQ ID NO: 2962620 - protein, 20 aa, Entamoeba invadens
QKLDAFCRVKTIAHCSLFDD

SEQ ID NO: 2962621 - protein, 17 aa, Entamoeba invadens
QKLEFGMEEEELIGSEY

SEQ ID NO: 2962622 - protein, 26 aa, Entamoeba invadens
QKLGELFTVWFNSWFVKDNTLVLTKM

SEQ ID NO: 2962623 - protein, 24 aa, Entamoeba invadens
QKLIKWPIHVDPFFSNKNVMCLRM

SEQ ID NO: 2962624 - protein, 25 aa, Entamoeba invadens
QKLKCSICGQLGHTHQNCTCTKQQQ

SEQ ID NO: 2962625 - protein, 17 aa, Entamoeba invadens
QKLKKFTGTNCIMQSLN

SEQ ID NO: 2962626 - protein, 21 aa, Entamoeba invadens
QKLKTPLCLLPPEKMPTANMF

SEQ ID NO: 2962627 - protein, 21 aa, Entamoeba invadens
QKLLEKFKEVVSNKVSNWADL

SEQ ID NO: 2962628 - protein, 19 aa, Entamoeba invadens
QKLLIKRIVEGTSKSMGVE

SEQ ID NO: 2962629 - protein, 17 aa, Entamoeba invadens
QKLLKIHSFVLSETENS

SEQ ID NO: 2962630 - protein, 26 aa, Entamoeba invadens
QKLLKRGGIKIHVKFEVSNFTMYDHF

SEQ ID NO: 2962631 - protein, 18 aa, Entamoeba invadens
QKLMNNVVEFWDGVRREL

SEQ ID NO: 2962632 - protein, 18 aa, Entamoeba invadens
QKLNGWFLNIKRKENYKP

SEQ ID NO: 2962633 - protein, 22 aa, Entamoeba invadens
QKLPDTFSVPIKKRKPHRRTSS

SEQ ID NO: 2962634 - protein, 18 aa, Entamoeba invadens
QKLPFTLRDERVLRDYQV

SEQ ID NO: 2962635 - protein, 21 aa, Entamoeba invadens
QKLRIFNCKSVTVAQSEYSNL

SEQ ID NO: 2962636 - protein, 25 aa, Entamoeba invadens
QKLRVVQIPQYRSGRMNEQLALGLE

SEQ ID NO: 2962637 - protein, 18 aa, Entamoeba invadens
QKLSEAFYRPTTPSSSVV

SEQ ID NO: 2962638 - protein, 27 aa, Entamoeba invadens
QKLSLFYVRNVELCINKECAKNITCTN

SEQ ID NO: 2962639 - protein, 25 aa, Entamoeba invadens
QKLSLLSVRNVELFINKECAKNITC

SEQ ID NO: 2962640 - protein, 18 aa, Entamoeba invadens
QKMAARFEIANIFDKQGK

SEQ ID NO: 2962641 - protein, 30 aa, Entamoeba invadens
QKMDVESLKHLKSFVFGRTDVGQIEWKNVD

SEQ ID NO: 2962642 - protein, 17 aa, Entamoeba invadens
QKMFPSTNLNEFNDVSE

SEQ ID NO: 2962643 - protein, 24 aa, Entamoeba invadens
QKMKNSIFPLNFDYMNFFDKIEPP

SEQ ID NO: 2962644 - protein, 17 aa, Entamoeba invadens
QKMLIELGIASPVSRTD

SEQ ID NO: 2962645 - protein, 26 aa, Entamoeba invadens
QKMPRSTSKFILCGKGQRGILNLETL

SEQ ID NO: 2962646 - protein, 20 aa, Entamoeba invadens
QKMQFCIEFKTSSRKKKNTA

SEQ ID NO: 2962647 - protein, 21 aa, Entamoeba invadens
QKMREVIKILPKREQYRAIRN

SEQ ID NO: 2962648 - protein, 18 aa, Entamoeba invadens
QKNDITWESYCAQNIKSS

SEQ ID NO: 2962649 - protein, 19 aa, Entamoeba invadens
QKNGICVNPSLPQNATTEN

SEQ ID NO: 2962650 - protein, 24 aa, Entamoeba invadens
QKNGKVILCTDGMANVGIGILENG

SEQ ID NO: 2962651 - protein, 24 aa, Entamoeba invadens
QKNLRLVFDEAFKVAISYKTNDQS

SEQ ID NO: 2962652 - protein, 23 aa, Entamoeba invadens
QKNPTLIVPYLFLGAVNATKDPA

SEQ ID NO: 2962653 - protein, 17 aa, Entamoeba invadens
QKNRYLVRLAKSTWKNN

SEQ ID NO: 2962654 - protein, 21 aa, Entamoeba invadens
QKNSLPPGLTRLVIPSTVEIM

SEQ ID NO: 2962655 - protein, 20 aa, Entamoeba invadens
QKPFQCLVLVTGHAYFALYN

SEQ ID NO: 2962656 - protein, 24 aa, Entamoeba invadens
QKPFQFTGLLLSFSGVVDINNSSK

SEQ ID NO: 2962657 - protein, 23 aa, Entamoeba invadens
QKPKEGYVDWIYVKHQLDDQYEK

SEQ ID NO: 2962658 - protein, 18 aa, Entamoeba invadens
QKPLDLVPPLAPPQTKQP

SEQ ID NO: 2962659 - protein, 19 aa, Entamoeba invadens
QKPTVNWFWGPTGSGKTRK

SEQ ID NO: 2962660 - protein, 17 aa, Entamoeba invadens
QKPVCQTIVRFSTHSQK

SEQ ID NO: 2962661 - protein, 22 aa, Entamoeba invadens
QKPVCQTIVRFSTHSQKQKIDA

SEQ ID NO: 2962662 - protein, 27 aa, Entamoeba invadens
QKPWEEFCVTCQFQPFQLPSTQKPYVQ

SEQ ID NO: 2962663 - protein, 22 aa, Entamoeba invadens
QKQELKQKIGLDKKETKKQKKI

SEQ ID NO: 2962664 - protein, 18 aa, Entamoeba invadens
QKQFKFCEVVGRGGFSVV

SEQ ID NO: 2962665 - protein, 18 aa, Entamoeba invadens
QKQFKFYFEFIPNIETVQ

SEQ ID NO: 2962666 - protein, 19 aa, Entamoeba invadens
QKQGLKMDLMLNRIKRYKE

SEQ ID NO: 2962667 - protein, 27 aa, Entamoeba invadens
QKQKGPVCDPAKYYGCGPTSNTNTGYR

SEQ ID NO: 2962668 - protein, 24 aa, Entamoeba invadens
QKQKLSFRFKEDFGSATVTAKVGD

SEQ ID NO: 2962669 - protein, 23 aa, Entamoeba invadens
QKQKMFWISDAFRINSEDKSYIS

SEQ ID NO: 2962670 - protein, 23 aa, Entamoeba invadens
QKQLYPYIKDWVPLPSIYYKSYI

SEQ ID NO: 2962671 - protein, 24 aa, Entamoeba invadens
QKQYFRVESPLQWLEDSSAMILSN

SEQ ID NO: 2962672 - protein, 24 aa, Entamoeba invadens
QKQYKKRSAPTFILDDKLVSSEVF

SEQ ID NO: 2962673 - protein, 19 aa, Entamoeba invadens
QKRINTFFSSQLFYEFLRR

SEQ ID NO: 2962674 - protein, 26 aa, Entamoeba invadens
QKRMIKQKRNWGMFVFQLHQQHRSAD

SEQ ID NO: 2962675 - protein, 17 aa, Entamoeba invadens
QKRRIAIERALIQIPKI

SEQ ID NO: 2962676 - protein, 25 aa, Entamoeba invadens
QKRVLAPMVGICFSSYRTMCLEHGA

SEQ ID NO: 2962677 - protein, 23 aa, Entamoeba invadens
QKRYKLNYFREMLEKLHSSDCQS

SEQ ID NO: 2962678 - protein, 21 aa, Entamoeba invadens
QKSCRTSIVGTPYWMPPELIR

SEQ ID NO: 2962679 - protein, 22 aa, Entamoeba invadens
QKSDSSLFIRSFETKFPPLESS

SEQ ID NO: 2962680 - protein, 22 aa, Entamoeba invadens
QKSELNLIIYRREKVIDQLYEY

SEQ ID NO: 2962681 - protein, 24 aa, Entamoeba invadens
QKSFRLGDVEARKDLTKAWRKVSV

SEQ ID NO: 2962682 - protein, 18 aa, Entamoeba invadens
QKSIEFNELLELQGLTPQ

SEQ ID NO: 2962683 - protein, 23 aa, Entamoeba invadens
QKSIKPFLLRRVKSDVEKSIPPK

SEQ ID NO: 2962684 - protein, 24 aa, Entamoeba invadens
QKSQKIRIDENFLDEDFDEEKFDK

SEQ ID NO: 2962685 - protein, 18 aa, Entamoeba invadens
QKSVFHFDEIVKKIESVV

SEQ ID NO: 2962686 - protein, 21 aa, Entamoeba invadens
QKTCRSCKNLEEVVMDNTVEI

SEQ ID NO: 2962687 - protein, 20 aa, Entamoeba invadens
QKTCRSCQNLEEVVMDNTVE

SEQ ID NO: 2962688 - protein, 18 aa, Entamoeba invadens
QKTFLIRILTKVFLEDGQ

SEQ ID NO: 2962689 - protein, 18 aa, Entamoeba invadens
QKTKEEYLQLGLTPLETK

SEQ ID NO: 2962690 - protein, 21 aa, Entamoeba invadens
QKTKLRISALRSIKKISRTSQ

SEQ ID NO: 2962691 - protein, 26 aa, Entamoeba invadens
QKTKTWRSEMVQGFYGRKKRGGYKGY

SEQ ID NO: 2962692 - protein, 22 aa, Entamoeba invadens
QKTLRYQFVMMFQSEGMTRFVL

SEQ ID NO: 2962693 - protein, 24 aa, Entamoeba invadens
QKTMKYGISFSFPFLQSKPLSFRK

SEQ ID NO: 2962694 - protein, 21 aa, Entamoeba invadens
QKTMRICVKQSPFVSSISSFS

SEQ ID NO: 2962695 - protein, 22 aa, Entamoeba invadens
QKTPKLIVVSSFTTDKLNEEIS

SEQ ID NO: 2962696 - protein, 18 aa, Entamoeba invadens
QKTQRIFEELCSKNCEEP

SEQ ID NO: 2962697 - protein, 28 aa, Entamoeba invadens
QKTVFPFCFSEGDALLKQRSLFQEPTTS

SEQ ID NO: 2962698 - protein, 27 aa, Entamoeba invadens
QKVALKKEWGYILSLMMQYPTKVRPVI

SEQ ID NO: 2962699 - protein, 24 aa, Entamoeba invadens
QKVECIICHQKVLASTLFEHVKNH

SEQ ID NO: 2962700 - protein, 23 aa, Entamoeba invadens
QKVFSELFLSGEIDFEEMTSLNT

SEQ ID NO: 2962701 - protein, 22 aa, Entamoeba invadens
QKVKRIGMKCFYDCSTLSIIQL

SEQ ID NO: 2962702 - protein, 25 aa, Entamoeba invadens
QKVKRKFDGYVIFRPKYRRFEVYED

SEQ ID NO: 2962703 - protein, 18 aa, Entamoeba invadens
QKVMKEKELEVVKCKQKN

SEQ ID NO: 2962704 - protein, 20 aa, Entamoeba invadens
QKVMYPFEFAPLKQYESFSG

SEQ ID NO: 2962705 - protein, 27 aa, Entamoeba invadens
QKVNCSICGQLGHTHENCICIKQQQEE

SEQ ID NO: 2962706 - protein, 23 aa, Entamoeba invadens
QKVSFRDLCLFSEYTEGLFRGIC

SEQ ID NO: 2962707 - protein, 25 aa, Entamoeba invadens
QKVTMSINCFVKFLDYFDHYETCED

SEQ ID NO: 2962708 - protein, 18 aa, Entamoeba invadens
QKVVIRPSVLDNEEVCVA

SEQ ID NO: 2962709 - protein, 23 aa, Entamoeba invadens
QKWSVDPEALFSCKVKKEEANPK

SEQ ID NO: 2962710 - protein, 21 aa, Entamoeba invadens
QKWTKLKKMTFLKNWKIAGKM

SEQ ID NO: 2962711 - protein, 17 aa, Entamoeba invadens
QKYALKFLQQEVHPALL

SEQ ID NO: 2962712 - protein, 18 aa, Entamoeba invadens
QKYFEMVERLWNVYNGIA

SEQ ID NO: 2962713 - protein, 19 aa, Entamoeba invadens
QKYFKKKRGASENYEEDIK

SEQ ID NO: 2962714 - protein, 25 aa, Entamoeba invadens
QKYFSAMNCCANFAFANRGMITYQI

SEQ ID NO: 2962715 - protein, 17 aa, Entamoeba invadens
QKYGEVWGTKKGLNPQM

SEQ ID NO: 2962716 - protein, 21 aa, Entamoeba invadens
QKYGFPIVKLHNWEYKHKSNE

SEQ ID NO: 2962717 - protein, 32 aa, Entamoeba invadens
QKYGNVYGQYFYLREVRMLSSLKREPNIAEII

SEQ ID NO: 2962718 - protein, 19 aa, Entamoeba invadens
QKYPFFSFEEALRMVNSIL

SEQ ID NO: 2962719 - protein, 17 aa, Entamoeba invadens
QKYSHLVLYTFDSIIIW

SEQ ID NO: 2962720 - protein, 17 aa, Entamoeba invadens
QKYTSFNITCFSGLDLH

SEQ ID NO: 2962721 - protein, 17 aa, Entamoeba invadens
QKYWASQTEKFYPQVHY

SEQ ID NO: 2962722 - protein, 21 aa, Entamoeba invadens
QLASLLPHWIVHFTATSYSSL

SEQ ID NO: 2962723 - protein, 22 aa, Entamoeba invadens
QLASLPPIGFAKVNIKEASPSS

SEQ ID NO: 2962724 - protein, 17 aa, Entamoeba invadens
QLCEIRRTSKVLEAELE

SEQ ID NO: 2962725 - protein, 39 aa, Entamoeba invadens
QLCMGKFVIVVCDNFFCSLRLVHYLAQYGSTLLGTVRKN

SEQ ID NO: 2962726 - protein, 20 aa, Entamoeba invadens
QLCMKSLKIEEGVYDTGIIK

SEQ ID NO: 2962727 - protein, 24 aa, Entamoeba invadens
QLCPSDCCLIELDANGTVLKYIND

SEQ ID NO: 2962728 - protein, 21 aa, Entamoeba invadens
QLCYFLDHFNGVTNWVSSTLV

SEQ ID NO: 2962729 - protein, 26 aa, Entamoeba invadens
QLDDAQKVFAEMFLNDEIDLDEMNSL

SEQ ID NO: 2962730 - protein, 26 aa, Entamoeba invadens
QLDFKKRANVKFVLVIYDTYSYQENL

SEQ ID NO: 2962731 - protein, 19 aa, Entamoeba invadens
QLDGAFSMEMWGGATFDVC

SEQ ID NO: 2962732 - protein, 24 aa, Entamoeba invadens
QLDLFKIRATRGILLHGPPGNSKT

SEQ ID NO: 2962733 - protein, 28 aa, Entamoeba invadens
QLDYNCNFAFYSWCDFAQSPVFSVMSDA

SEQ ID NO: 2962734 - protein, 26 aa, Entamoeba invadens
QLEEIKLRTDDIVKEKTELCKQLGIS

SEQ ID NO: 2962735 - protein, 18 aa, Entamoeba invadens
QLEEKIKALEKENAELNQ

SEQ ID NO: 2962736 - protein, 24 aa, Entamoeba invadens
QLEERLKEIVLWATGSAKDAQKMG

SEQ ID NO: 2962737 - protein, 21 aa, Entamoeba invadens
QLEEYNRYSVLALSIQQKTNE

SEQ ID NO: 2962738 - protein, 34 aa, Entamoeba invadens
QLEFSVPATKHFVMKGVSHFVALSGMLETFGQLS

SEQ ID NO: 2962739 - protein, 22 aa, Entamoeba invadens
QLEIPFAPSHKVFMMQAVDKND

SEQ ID NO: 2962740 - protein, 23 aa, Entamoeba invadens
QLEMRKDVVLQFVSKVVDRRLSF

SEQ ID NO: 2962741 - protein, 33 aa, Entamoeba invadens
QLENEFANFVLKQVYPFTALPSFTVAPLNVYTN

SEQ ID NO: 2962742 - protein, 25 aa, Entamoeba invadens
QLERFCLRLLLLHVKGARSYKEIKC

SEQ ID NO: 2962743 - protein, 30 aa, Entamoeba invadens
QLERIASVFYKGRLTLDFQEFVLCGKEVTD

SEQ ID NO: 2962744 - protein, 23 aa, Entamoeba invadens
QLERKRFVGNDVVVIIFKEKEDD

SEQ ID NO: 2962745 - protein, 22 aa, Entamoeba invadens
QLERLKHVFFNNQFIMGKKEIE

SEQ ID NO: 2962746 - protein, 25 aa, Entamoeba invadens
QLESLRGKMDFSWVPEVTVIEIYGM

SEQ ID NO: 2962747 - protein, 17 aa, Entamoeba invadens
QLETIKFFLGQSQLEQF

SEQ ID NO: 2962748 - protein, 22 aa, Entamoeba invadens
QLFKEFKLDTATVEFVGHAVAL

SEQ ID NO: 2962749 - protein, 17 aa, Entamoeba invadens
QLFLFLKEVQKFSNNGT

SEQ ID NO: 2962750 - protein, 17 aa, Entamoeba invadens
QLFRLYVWTNQSNGNVI

SEQ ID NO: 2962751 - protein, 17 aa, Entamoeba invadens
QLGICCFKRCYHLKYVI

SEQ ID NO: 2962752 - protein, 19 aa, Entamoeba invadens
QLGNTFLTYIDRVFGLQSQ

SEQ ID NO: 2962753 - protein, 18 aa, Entamoeba invadens
QLGRLSVFIDEIPPVNLE

SEQ ID NO: 2962754 - protein, 22 aa, Entamoeba invadens
QLHANKDFREWVLKSDSKGSHA

SEQ ID NO: 2962755 - protein, 21 aa, Entamoeba invadens
QLHNRIKYLTGKKPAKKTDEF

SEQ ID NO: 2962756 - protein, 18 aa, Entamoeba invadens
QLHTCPLPSDSVFTKTQS

SEQ ID NO: 2962757 - protein, 18 aa, Entamoeba invadens
QLHWSALNNPTWKRVERI

SEQ ID NO: 2962758 - protein, 24 aa, Entamoeba invadens
QLHYKYKVRFGAGQKELFDVLHSF

SEQ ID NO: 2962759 - protein, 19 aa, Entamoeba invadens
QLIAIKFALSHVKANKKVF

SEQ ID NO: 2962760 - protein, 21 aa, Entamoeba invadens
QLIECAITFGSKCLVYQMQYP

SEQ ID NO: 2962761 - protein, 17 aa, Entamoeba invadens
QLIFINKGKVEIVATNK

SEQ ID NO: 2962762 - protein, 24 aa, Entamoeba invadens
QLILWRIDTLTPFLYFTRDDYHDK

SEQ ID NO: 2962763 - protein, 17 aa, Entamoeba invadens
QLIQKIEKCRIFSDFQS

SEQ ID NO: 2962764 - protein, 20 aa, Entamoeba invadens
QLISKMKAYCNGFLPKKEMY

SEQ ID NO: 2962765 - protein, 24 aa, Entamoeba invadens
QLKAKLGLTFNIFFLCELKDDSKV

SEQ ID NO: 2962766 - protein, 18 aa, Entamoeba invadens
QLKDIVFNTIQSVPEKRK

SEQ ID NO: 2962767 - protein, 22 aa, Entamoeba invadens
QLKEMTKTFLLGHYNDGPFKSE

SEQ ID NO: 2962768 - protein, 19 aa, Entamoeba invadens
QLKENYGFLKTNNFVCEVH

SEQ ID NO: 2962769 - protein, 23 aa, Entamoeba invadens
QLKFDVLRYNKIFLYDKYKVRMQ

SEQ ID NO: 2962770 - protein, 18 aa, Entamoeba invadens
QLKKLRVSISQTKTTSEG

SEQ ID NO: 2962771 - protein, 25 aa, Entamoeba invadens
QLKLLRREIDVMKKLSNHPNVVKLY

SEQ ID NO: 2962772 - protein, 21 aa, Entamoeba invadens
QLKLVNFFRVRMYGLMLKEIV

SEQ ID NO: 2962773 - protein, 26 aa, Entamoeba invadens
QLKPCVKEGYLVKKGADFHTWKKRWF

SEQ ID NO: 2962774 - protein, 30 aa, Entamoeba invadens
QLKPSVEAFKAFYGLGVTYNFISNFVAIKN

SEQ ID NO: 2962775 - protein, 24 aa, Entamoeba invadens
QLKTCGWATLSIYRHKGIKDLFDF

SEQ ID NO: 2962776 - protein, 22 aa, Entamoeba invadens
QLKTLFDIEIFSFDYGRTKGDG

SEQ ID NO: 2962777 - protein, 19 aa, Entamoeba invadens
QLLCVATNILNLWRANSTI

SEQ ID NO: 2962778 - protein, 20 aa, Entamoeba invadens
QLLDDLFVSMSYRNSKDGVL

SEQ ID NO: 2962779 - protein, 19 aa, Entamoeba invadens
QLLEAVAYLHTHRILHRNI

SEQ ID NO: 2962780 - protein, 23 aa, Entamoeba invadens
QLLEDFYNVIPLRNRFAEAHHEV

SEQ ID NO: 2962781 - protein, 20 aa, Entamoeba invadens
QLLFDEWSSPVVPVEKWEMK

SEQ ID NO: 2962782 - protein, 23 aa, Entamoeba invadens
QLLGHPFLKSACQTQEFAQLIAD

SEQ ID NO: 2962783 - protein, 26 aa, Entamoeba invadens
QLLHKYAQYAFHCFTDDYEALFYICN

SEQ ID NO: 2962784 - protein, 25 aa, Entamoeba invadens
QLLILKRIVEKFPHFLDNVDMICSV

SEQ ID NO: 2962785 - protein, 17 aa, Entamoeba invadens
QLLKGFYGISIINVASD

SEQ ID NO: 2962786 - protein, 27 aa, Entamoeba invadens
QLLKKKKYRLAYDCLEFIQPPPKDKER

SEQ ID NO: 2962787 - protein, 21 aa, Entamoeba invadens
QLLLYTFIEPLKFSEVSTSLN

SEQ ID NO: 2962788 - protein, 20 aa, Entamoeba invadens
QLLQCISCRSTSHLEVVMDH

SEQ ID NO: 2962789 - protein, 20 aa, Entamoeba invadens
QLLQCLEVLFDAHIIHCDIK

SEQ ID NO: 2962790 - protein, 18 aa, Entamoeba invadens
QLLQFGMSVGLTRGQAFN

SEQ ID NO: 2962791 - protein, 19 aa, Entamoeba invadens
QLLQMVKFIEFEANSKRQE

SEQ ID NO: 2962792 - protein, 17 aa, Entamoeba invadens
QLLRAVAGIAPRSIYTT

SEQ ID NO: 2962793 - protein, 19 aa, Entamoeba invadens
QLLRVEVIRSLRDVINVND

SEQ ID NO: 2962794 - protein, 17 aa, Entamoeba invadens
QLLVDIVRELGFFVETE

SEQ ID NO: 2962795 - protein, 25 aa, Entamoeba invadens
QLMCDRAALFGGRRDFTKMTAFYGS

SEQ ID NO: 2962796 - protein, 27 aa, Entamoeba invadens
QLMFERFKTPLLYFSMQPILSLFAAEK

SEQ ID NO: 2962797 - protein, 19 aa, Entamoeba invadens
QLMLPQIVSYFGLELSERV

SEQ ID NO: 2962798 - protein, 22 aa, Entamoeba invadens
QLMRHKLDLGEDCEDDEISESE

SEQ ID NO: 2962799 - protein, 29 aa, Entamoeba invadens
QLMSYELFMKALLKHSWNNYEELNELKRV

SEQ ID NO: 2962800 - protein, 19 aa, Entamoeba invadens
QLNDFGFEYFQIVTRIHTS

SEQ ID NO: 2962801 - protein, 18 aa, Entamoeba invadens
QLNDPQCHCECIEQQNTN

SEQ ID NO: 2962802 - protein, 26 aa, Entamoeba invadens
QLNEFLPRRLHFVLTETLNPLARTSV

SEQ ID NO: 2962803 - protein, 24 aa, Entamoeba invadens
QLNGYACAYYSYKWAEVLEADAFE

SEQ ID NO: 2962804 - protein, 18 aa, Entamoeba invadens
QLNLRLQVIESTLPTQYN

SEQ ID NO: 2962805 - protein, 24 aa, Entamoeba invadens
QLNPCRPVPFVLQNCLPTNNSYGW

SEQ ID NO: 2962806 - protein, 22 aa, Entamoeba invadens
QLNPPQIPAWEVSPQKPMIQPS

SEQ ID NO: 2962807 - protein, 17 aa, Entamoeba invadens
QLNRVLLDGKWEDIETE

SEQ ID NO: 2962808 - protein, 26 aa, Entamoeba invadens
QLNYNLQCIFCIYHFNRKSTQDKQSA

SEQ ID NO: 2962809 - protein, 19 aa, Entamoeba invadens
QLPKIRMFKDIKSNVENFH

SEQ ID NO: 2962810 - protein, 20 aa, Entamoeba invadens
QLPLNFLPFAPTPLKAPTQQ

SEQ ID NO: 2962811 - protein, 17 aa, Entamoeba invadens
QLPLQFFNCCSSLSAVE

SEQ ID NO: 2962812 - protein, 24 aa, Entamoeba invadens
QLPSPELYKALNLSKTISTPLDTK

SEQ ID NO: 2962813 - protein, 23 aa, Entamoeba invadens
QLPTREYRTLVGRYEGRLREMSK

SEQ ID NO: 2962814 - protein, 17 aa, Entamoeba invadens
QLQEVYKPGDFVMNDKI

SEQ ID NO: 2962815 - protein, 24 aa, Entamoeba invadens
QLQLNLRLSPDFQQHNFSSYLDFG

SEQ ID NO: 2962816 - protein, 24 aa, Entamoeba invadens
QLQMKVKSAFVFWKNNFSIKGKEV

SEQ ID NO: 2962817 - protein, 23 aa, Entamoeba invadens
QLRCFGKAFFRPLLTPQCSSKLF

SEQ ID NO: 2962818 - protein, 18 aa, Entamoeba invadens
QLREEMAHIIGFNTIADF

SEQ ID NO: 2962819 - protein, 22 aa, Entamoeba invadens
QLRLRYQKSILCDISKNANGNK

SEQ ID NO: 2962820 - protein, 27 aa, Entamoeba invadens
QLRMLFWKIAKREGIVFDGKFDWTGFK

SEQ ID NO: 2962821 - protein, 26 aa, Entamoeba invadens
QLRNRNGIYSGIKFILQIKGRPYYYA

SEQ ID NO: 2962822 - protein, 17 aa, Entamoeba invadens
QLRPDLMDTREWVNELT

SEQ ID NO: 2962823 - protein, 20 aa, Entamoeba invadens
QLRYENCQLHHIVYSLIKTR

SEQ ID NO: 2962824 - protein, 17 aa, Entamoeba invadens
QLSFKMSLIEYITERIL

SEQ ID NO: 2962825 - protein, 17 aa, Entamoeba invadens
QLSKFKILREIAVGLAF

SEQ ID NO: 2962826 - protein, 24 aa, Entamoeba invadens
QLSKHKWVATFILKEANIDNRFIK

SEQ ID NO: 2962827 - protein, 18 aa, Entamoeba invadens
QLSLTLGSWEFKLKVGGL

SEQ ID NO: 2962828 - protein, 25 aa, Entamoeba invadens
QLSNLMFENCISLREITGFDGVTFS

SEQ ID NO: 2962829 - protein, 24 aa, Entamoeba invadens
QLSSKCIFTASGMRADMNELTDQL

SEQ ID NO: 2962830 - protein, 24 aa, Entamoeba invadens
QLTLKLLLYELIDWMRDHPSYTIP

SEQ ID NO: 2962831 - protein, 19 aa, Entamoeba invadens
QLTLKRVFVVLKLNTFSEI

SEQ ID NO: 2962832 - protein, 19 aa, Entamoeba invadens
QLTMEEFAALGIKDEEEIN

SEQ ID NO: 2962833 - protein, 20 aa, Entamoeba invadens
QLTVQLCHFKSDIVAVHPVK

SEQ ID NO: 2962834 - protein, 17 aa, Entamoeba invadens
QLVDFIMQNRVNKYIEQ

SEQ ID NO: 2962835 - protein, 19 aa, Entamoeba invadens
QLVHCLRLVGFDYVFDINS

SEQ ID NO: 2962836 - protein, 20 aa, Entamoeba invadens
QLVIYLPIFDLIMSKLTVDP

SEQ ID NO: 2962837 - protein, 19 aa, Entamoeba invadens
QLVKEWTKDVVENMVQNMI

SEQ ID NO: 2962838 - protein, 17 aa, Entamoeba invadens
QLVKSRSIKGCKLHDVV

SEQ ID NO: 2962839 - protein, 24 aa, Entamoeba invadens
QLVNEYFIGLSWVLKYYYQGCQCW

SEQ ID NO: 2962840 - protein, 23 aa, Entamoeba invadens
QLVPRSEGLSVVGQFAPLTLGPG

SEQ ID NO: 2962841 - protein, 21 aa, Entamoeba invadens
QLWYWSYNGTKLYMYINTPIR

SEQ ID NO: 2962842 - protein, 19 aa, Entamoeba invadens
QLYDRKKIALNVFFKNTTQ

SEQ ID NO: 2962843 - protein, 18 aa, Entamoeba invadens
QLYGESFLYYTLSNLVLH

SEQ ID NO: 2962844 - protein, 21 aa, Entamoeba invadens
QLYGLNCLLITAFEVGEATFL

SEQ ID NO: 2962845 - protein, 23 aa, Entamoeba invadens
QLYPEIKYLGGIDKRTYDKLTSS

SEQ ID NO: 2962846 - protein, 21 aa, Entamoeba invadens
QLYYRVVNILCQVLVAERISD

SEQ ID NO: 2962847 - protein, 20 aa, Entamoeba invadens
QMAECTFISFALNYEEQQKL

SEQ ID NO: 2962848 - protein, 17 aa, Entamoeba invadens
QMALFAIFDGHGGKEAA

SEQ ID NO: 2962849 - protein, 18 aa, Entamoeba invadens
QMDLSIMWDDTLIFEKDN

SEQ ID NO: 2962850 - protein, 20 aa, Entamoeba invadens
QMEECSACAQLLNMSSRGVG

SEQ ID NO: 2962851 - protein, 24 aa, Entamoeba invadens
QMEVDGRKGINVMIDDVYKEAYDV

SEQ ID NO: 2962852 - protein, 19 aa, Entamoeba invadens
QMEYLKSIAPKSIQDTFVD

SEQ ID NO: 2962853 - protein, 25 aa, Entamoeba invadens
QMEYNKECINLRIASEQDIKSYLSL

SEQ ID NO: 2962854 - protein, 20 aa, Entamoeba invadens
QMFCGCIAGIPSQFVAKKYN

SEQ ID NO: 2962855 - protein, 20 aa, Entamoeba invadens
QMGMMPAFGFQPMGINASPK

SEQ ID NO: 2962856 - protein, 23 aa, Entamoeba invadens
QMGNPLCEFLKNILAYKESVDFT

SEQ ID NO: 2962857 - protein, 24 aa, Entamoeba invadens
QMHTLKVVVFYLCNTYSQELPLFI

SEQ ID NO: 2962858 - protein, 21 aa, Entamoeba invadens
QMIKTDGFLTESFFAEDQPYQ

SEQ ID NO: 2962859 - protein, 18 aa, Entamoeba invadens
QMILKSEFIQLMKLISNG

SEQ ID NO: 2962860 - protein, 17 aa, Entamoeba invadens
QMIVIKITPTFTLLNST

SEQ ID NO: 2962861 - protein, 19 aa, Entamoeba invadens
QMKECLEEMYVPLKDLMSP

SEQ ID NO: 2962862 - protein, 19 aa, Entamoeba invadens
QMKEFFLSTLRTMKLANDE

SEQ ID NO: 2962863 - protein, 26 aa, Entamoeba invadens
QMKEILKIRIKICDVVASTLSKCAFC

SEQ ID NO: 2962864 - protein, 20 aa, Entamoeba invadens
QMKRMWKWHMMNQMYNRLPP

SEQ ID NO: 2962865 - protein, 20 aa, Entamoeba invadens
QMKRMWKWHMMNQMYNRPPP

SEQ ID NO: 2962866 - protein, 22 aa, Entamoeba invadens
QMKTHSWFKSFSFDDLYQKKLT

SEQ ID NO: 2962867 - protein, 24 aa, Entamoeba invadens
QMLLPTCFYRVLLSLISRSEFQPH

SEQ ID NO: 2962868 - protein, 19 aa, Entamoeba invadens
QMMLYNFTSGVLRELSSKW

SEQ ID NO: 2962869 - protein, 23 aa, Entamoeba invadens
QMNAELESLIQHFKERRNTLTFQ

SEQ ID NO: 2962870 - protein, 24 aa, Entamoeba invadens
QMNAKRAGVPFFGIKDESDPVKAA

SEQ ID NO: 2962871 - protein, 22 aa, Entamoeba invadens
QMNEMIEAIVLPMTQKEKFEKL

SEQ ID NO: 2962872 - protein, 20 aa, Entamoeba invadens
QMPPQMQGQMPGMYPGQQMS

SEQ ID NO: 2962873 - protein, 18 aa, Entamoeba invadens
QMQFCKKSQLSVSERNTL

SEQ ID NO: 2962874 - protein, 28 aa, Entamoeba invadens
QMQVVLYLPRLLDVFIFSQVNHTASVAV

SEQ ID NO: 2962875 - protein, 17 aa, Entamoeba invadens
QMRFPPPPFGRFGGWER

SEQ ID NO: 2962876 - protein, 18 aa, Entamoeba invadens
QMRGWFKVEREFIQNVLS

SEQ ID NO: 2962877 - protein, 18 aa, Entamoeba invadens
QMRQLFEKFFKLPKDKKV

SEQ ID NO: 2962878 - protein, 21 aa, Entamoeba invadens
QMRYECSTLPTAGKAKVGSAV

SEQ ID NO: 2962879 - protein, 18 aa, Entamoeba invadens
QMSGERPLAFQVEENDHS

SEQ ID NO: 2962880 - protein, 22 aa, Entamoeba invadens
QMTEALNRYILDNKRRNAQHRT

SEQ ID NO: 2962881 - protein, 23 aa, Entamoeba invadens
QMTEVYKGANLYYLDTTSTNGSL

SEQ ID NO: 2962882 - protein, 20 aa, Entamoeba invadens
QMTIHWELQTWIPLGTYLLP

SEQ ID NO: 2962883 - protein, 21 aa, Entamoeba invadens
QMTLFRVLRTWALGDKDIGYV

SEQ ID NO: 2962884 - protein, 18 aa, Entamoeba invadens
QMTSMAFGDITTDVAPPI

SEQ ID NO: 2962885 - protein, 27 aa, Entamoeba invadens
QMTSPMKLPVIFTCPISINEIKQRIIE

SEQ ID NO: 2962886 - protein, 23 aa, Entamoeba invadens
QMVKCLKANFQSLFIGVEASGIH

SEQ ID NO: 2962887 - protein, 17 aa, Entamoeba invadens
QMYIEMVEKGILEVEQY

SEQ ID NO: 2962888 - protein, 21 aa, Entamoeba invadens
QMYNFLKCIYISPNTKIAVMN

SEQ ID NO: 2962889 - protein, 23 aa, Entamoeba invadens
QMYYKKMYGDLKVFSVSNEGSVR

SEQ ID NO: 2962890 - protein, 25 aa, Entamoeba invadens
QNAMKRILFLYALRHPACGYVQGLN

SEQ ID NO: 2962891 - protein, 23 aa, Entamoeba invadens
QNATEMLMRMQMMPPMQNLEQPP

SEQ ID NO: 2962892 - protein, 17 aa, Entamoeba invadens
QNCFEDVSMKFNKWCLN

SEQ ID NO: 2962893 - protein, 17 aa, Entamoeba invadens
QNCTLERLLSMPELQSE

SEQ ID NO: 2962894 - protein, 21 aa, Entamoeba invadens
QNCVSWWKDSMGITETPIKIK

SEQ ID NO: 2962895 - protein, 23 aa, Entamoeba invadens
QNDIFKFPWKIAEFVIEGKRLER

SEQ ID NO: 2962896 - protein, 22 aa, Entamoeba invadens
QNDIPSFFFNKALVMEPVPWAL

SEQ ID NO: 2962897 - protein, 23 aa, Entamoeba invadens
QNDLKEFPVLECPKLRQINASYN

SEQ ID NO: 2962898 - protein, 23 aa, Entamoeba invadens
QNEFKKETLCLVWEDEEEETSVA

SEQ ID NO: 2962899 - protein, 17 aa, Entamoeba invadens
QNEFWAVVCKLIETGNI

SEQ ID NO: 2962900 - protein, 20 aa, Entamoeba invadens
QNELFKSYVVVVSDHPSPQV

SEQ ID NO: 2962901 - protein, 18 aa, Entamoeba invadens
QNELRIVDVFDNATVADY

SEQ ID NO: 2962902 - protein, 23 aa, Entamoeba invadens
QNEPRFHLPSPVAPQKKEYPPPL

SEQ ID NO: 2962903 - protein, 18 aa, Entamoeba invadens
QNESFYIQKAKMMPQTTR

SEQ ID NO: 2962904 - protein, 17 aa, Entamoeba invadens
QNEVEDIRDKTTTEKGT

SEQ ID NO: 2962905 - protein, 24 aa, Entamoeba invadens
QNFCGKGYHLLSLFDGHGGAETAR

SEQ ID NO: 2962906 - protein, 23 aa, Entamoeba invadens
QNFKLSFKLEQIFEKDFQLKFKP

SEQ ID NO: 2962907 - protein, 24 aa, Entamoeba invadens
QNFMYKHFICIMMVSKSKKKEAAF

SEQ ID NO: 2962908 - protein, 25 aa, Entamoeba invadens
QNFSFWPGFNTFDFDFAFSEEEMTI

SEQ ID NO: 2962909 - protein, 23 aa, Entamoeba invadens
QNFSMKVAVPKWIDLALQPPSGN

SEQ ID NO: 2962910 - protein, 24 aa, Entamoeba invadens
QNFTSMFRFPVTVNTYIPDLQIGY

SEQ ID NO: 2962911 - protein, 26 aa, Entamoeba invadens
QNGCRGFGASVARGFVKQILETLIQL

SEQ ID NO: 2962912 - protein, 23 aa, Entamoeba invadens
QNGCSICKPGYYSTNNECGICSN

SEQ ID NO: 2962913 - protein, 17 aa, Entamoeba invadens
QNGQCPHDPLTVNEAVY

SEQ ID NO: 2962914 - protein, 22 aa, Entamoeba invadens
QNGRLGFSGAFYSDKKQMREAV

SEQ ID NO: 2962915 - protein, 19 aa, Entamoeba invadens
QNGVFILCCESCLFDEVTK

SEQ ID NO: 2962916 - protein, 20 aa, Entamoeba invadens
QNGWKLISRNDCYDLYYDRF

SEQ ID NO: 2962917 - protein, 18 aa, Entamoeba invadens
QNHFGVFPTIVSKAEYRN

SEQ ID NO: 2962918 - protein, 19 aa, Entamoeba invadens
QNHVLKLLYEFVPNGPNET

SEQ ID NO: 2962919 - protein, 28 aa, Entamoeba invadens
QNIDAASISLVLKSRMLKDDTQTIQAVG

SEQ ID NO: 2962920 - protein, 19 aa, Entamoeba invadens
QNIELKVIHPFTFTQENPY

SEQ ID NO: 2962921 - protein, 23 aa, Entamoeba invadens
QNIFKTFYRVVVNFPVDYEDYFL

SEQ ID NO: 2962922 - protein, 24 aa, Entamoeba invadens
QNIKKLFFKVNVWYEVSYKKYTES

SEQ ID NO: 2962923 - protein, 25 aa, Entamoeba invadens
QNILAIKYFCFNRCGNLTSFEFPKF

SEQ ID NO: 2962924 - protein, 18 aa, Entamoeba invadens
QNILKGLPKVHSKTTAVF

SEQ ID NO: 2962925 - protein, 19 aa, Entamoeba invadens
QNILNCYYVFIGPEETPFE

SEQ ID NO: 2962926 - protein, 21 aa, Entamoeba invadens
QNIMALFQMICEDVVASTNNN

SEQ ID NO: 2962927 - protein, 17 aa, Entamoeba invadens
QNIMLLKIYMIMTHARY

SEQ ID NO: 2962928 - protein, 23 aa, Entamoeba invadens
QNIPHPRLLFVFTPDEEIGESCD

SEQ ID NO: 2962929 - protein, 25 aa, Entamoeba invadens
QNIRKLLCIDTFFPVEETISKFETP

SEQ ID NO: 2962930 - protein, 21 aa, Entamoeba invadens
QNIRQCFSFFVPQEIPENIFW

SEQ ID NO: 2962931 - protein, 19 aa, Entamoeba invadens
QNISPYLDVSRQILAETLQ

SEQ ID NO: 2962932 - protein, 18 aa, Entamoeba invadens
QNIVKLILHYNESVAPIL

SEQ ID NO: 2962933 - protein, 17 aa, Entamoeba invadens
QNIVSFRAYVTAALFHG

SEQ ID NO: 2962934 - protein, 25 aa, Entamoeba invadens
QNIVVLRCCCSVFANVGPYIIDLPS

SEQ ID NO: 2962935 - protein, 31 aa, Entamoeba invadens
QNKCYLEALRKCGCCPKCLAEAEKQQKKLKA

SEQ ID NO: 2962936 - protein, 22 aa, Entamoeba invadens
QNKEFIKQILVYQQLYDGLNVL

SEQ ID NO: 2962937 - protein, 21 aa, Entamoeba invadens
QNKERLIRLISKMTDGDLVLN

SEQ ID NO: 2962938 - protein, 18 aa, Entamoeba invadens
QNKFENVFLLKGKDEIKK

SEQ ID NO: 2962939 - protein, 24 aa, Entamoeba invadens
QNKFMLRKVELCDISSKTNPDSLA

SEQ ID NO: 2962940 - protein, 17 aa, Entamoeba invadens
QNKFSFKQHRHMPSCVL

SEQ ID NO: 2962941 - protein, 18 aa, Entamoeba invadens
QNKFSFKQHRHMPSCVLP

SEQ ID NO: 2962942 - protein, 20 aa, Entamoeba invadens
QNKKLFAFGYGQINDYDICV

SEQ ID NO: 2962943 - protein, 35 aa, Entamoeba invadens
QNKKVIVYSCLMGRIGVLVPLNFKNEAEFFVNLET

SEQ ID NO: 2962944 - protein, 17 aa, Entamoeba invadens
QNKLMYIECSFLSQDRN

SEQ ID NO: 2962945 - protein, 17 aa, Entamoeba invadens
QNKLVNLHRLFYGSAGV

SEQ ID NO: 2962946 - protein, 20 aa, Entamoeba invadens
QNKQICAFHQHFAINDMRYS

SEQ ID NO: 2962947 - protein, 17 aa, Entamoeba invadens
QNLALKHVVHKENVNEN

SEQ ID NO: 2962948 - protein, 25 aa, Entamoeba invadens
QNLKEIVFPPGLKKIPNKVCMACFS

SEQ ID NO: 2962949 - protein, 22 aa, Entamoeba invadens
QNLKKTVPFLLEKLLADAWNSD

SEQ ID NO: 2962950 - protein, 28 aa, Entamoeba invadens
QNLKQAFKRLYCLKVIHLEGNPIAEDDY

SEQ ID NO: 2962951 - protein, 22 aa, Entamoeba invadens
QNLLKKKIDSFFTQQENKEICR

SEQ ID NO: 2962952 - protein, 18 aa, Entamoeba invadens
QNLPCLVSVKYIYQPKST

SEQ ID NO: 2962953 - protein, 17 aa, Entamoeba invadens
QNLPYFYYTLMINNLLK

SEQ ID NO: 2962954 - protein, 19 aa, Entamoeba invadens
QNLQDLFVDLSMFSANSND

SEQ ID NO: 2962955 - protein, 17 aa, Entamoeba invadens
QNLQQFSLRKCNKVTVL

SEQ ID NO: 2962956 - protein, 18 aa, Entamoeba invadens
QNLTRLVVRNLPITHIPG

SEQ ID NO: 2962957 - protein, 25 aa, Entamoeba invadens
QNMCRRSELLLTRYAIHRLSPDVEM

SEQ ID NO: 2962958 - protein, 20 aa, Entamoeba invadens
QNNFDILHVYSLHSKTSSAT

SEQ ID NO: 2962959 - protein, 36 aa, Entamoeba invadens
QNNFIPLGLFTKLLRFLRLLLKFNQFKDNEGLVQST

SEQ ID NO: 2962960 - protein, 24 aa, Entamoeba invadens
QNNLAELWSLFDFVYPGKLGTLPV

SEQ ID NO: 2962961 - protein, 17 aa, Entamoeba invadens
QNPEYKDKVLAFNGIIL

SEQ ID NO: 2962962 - protein, 22 aa, Entamoeba invadens
QNPGYFTAYEIRVTVKNQIARF

SEQ ID NO: 2962963 - protein, 19 aa, Entamoeba invadens
QNPKFCLCPQNVGEKKSST

SEQ ID NO: 2962964 - protein, 26 aa, Entamoeba invadens
QNPTIFKRSLDIIASFTHKMTNTLDD

SEQ ID NO: 2962965 - protein, 19 aa, Entamoeba invadens
QNPWLVKILMTLRAVYDAM

SEQ ID NO: 2962966 - protein, 19 aa, Entamoeba invadens
QNRCNPHLLIYKSDYDTQL

SEQ ID NO: 2962967 - protein, 18 aa, Entamoeba invadens
QNRCRIIESNDDCFVVLK

SEQ ID NO: 2962968 - protein, 19 aa, Entamoeba invadens
QNRLPRSLTTMKWEDSCVT

SEQ ID NO: 2962969 - protein, 19 aa, Entamoeba invadens
QNRLRKVFDVDPNVYQAYT

SEQ ID NO: 2962970 - protein, 18 aa, Entamoeba invadens
QNRQHLLEIIAKETPSQD

SEQ ID NO: 2962971 - protein, 24 aa, Entamoeba invadens
QNSKPVWRPIKRGKTLEDLELDKH

SEQ ID NO: 2962972 - protein, 20 aa, Entamoeba invadens
QNSVIYYTTFDKFEETKYVK

SEQ ID NO: 2962973 - protein, 17 aa, Entamoeba invadens
QNTGGFFCALFEKTGAI

SEQ ID NO: 2962974 - protein, 17 aa, Entamoeba invadens
QNTGGFYTAVFVKKGET

SEQ ID NO: 2962975 - protein, 24 aa, Entamoeba invadens
QNTKTKRRLVCGVDNFDSPDFTYM

SEQ ID NO: 2962976 - protein, 26 aa, Entamoeba invadens
QNTLHELWALLQFLLPGIFRISQLDG

SEQ ID NO: 2962977 - protein, 18 aa, Entamoeba invadens
QNTLKCFDIIPISLGMLQ

SEQ ID NO: 2962978 - protein, 25 aa, Entamoeba invadens
QNTLKELWSLLHFLHPEQFPNFEDF

SEQ ID NO: 2962979 - protein, 21 aa, Entamoeba invadens
QNTLWYLMQFVHLVAQHTEEN

SEQ ID NO: 2962980 - protein, 25 aa, Entamoeba invadens
QNTMSWYIPKRVVNFIFDEESQKRR

SEQ ID NO: 2962981 - protein, 18 aa, Entamoeba invadens
QNTPYIFGLLPTLAFADT

SEQ ID NO: 2962982 - protein, 29 aa, Entamoeba invadens
QNTRFTLFGAAWCFRPAERMIKSLKINPT

SEQ ID NO: 2962983 - protein, 17 aa, Entamoeba invadens
QNTRLDAAKKDMKKQSV

SEQ ID NO: 2962984 - protein, 20 aa, Entamoeba invadens
QNTSNCPTKFGIKKLGEVLK

SEQ ID NO: 2962985 - protein, 22 aa, Entamoeba invadens
QNTTDLFSGMTVQPTVQQPQQQ

SEQ ID NO: 2962986 - protein, 17 aa, Entamoeba invadens
QNVIAFVQAFEWIDENA

SEQ ID NO: 2962987 - protein, 27 aa, Entamoeba invadens
QNVIPSVFGIRWIKMVFTREFHINDVV

SEQ ID NO: 2962988 - protein, 24 aa, Entamoeba invadens
QNVKFVIECVGGMIVTDVNDEQIT

SEQ ID NO: 2962989 - protein, 23 aa, Entamoeba invadens
QNVKRRLLDIFNEITQFEPKEKR

SEQ ID NO: 2962990 - protein, 18 aa, Entamoeba invadens
QNVLLFSCEICYEDKPYS

SEQ ID NO: 2962991 - protein, 26 aa, Entamoeba invadens
QNVNCLRWSPDGELLAAGTDDGIVSI

SEQ ID NO: 2962992 - protein, 18 aa, Entamoeba invadens
QNVRQLKENYGFLKTNNF

SEQ ID NO: 2962993 - protein, 17 aa, Entamoeba invadens
QNVTYLGNRCFSYCYSL

SEQ ID NO: 2962994 - protein, 29 aa, Entamoeba invadens
QNVYFCPFCKRCLRRTCRSTHYTNSHVDR

SEQ ID NO: 2962995 - protein, 26 aa, Entamoeba invadens
QNYFHLGCKLLRMGVGEILNYSLHVV

SEQ ID NO: 2962996 - protein, 18 aa, Entamoeba invadens
QNYIKEFVPILIEKFQRK

SEQ ID NO: 2962997 - protein, 20 aa, Entamoeba invadens
QNYKCVIKVYTLLDVELVKR

SEQ ID NO: 2962998 - protein, 21 aa, Entamoeba invadens
QNYLLDVLRRCGFFFESTFPF

SEQ ID NO: 2962999 - protein, 19 aa, Entamoeba invadens
QNYPGCPIYTTFTQETGEK

SEQ ID NO: 2963000 - protein, 21 aa, Entamoeba invadens
QNYRATVQLTNERLHDYYNSQ

SEQ ID NO: 2963001 - protein, 26 aa, Entamoeba invadens
QNYVHLDFMGVFGLKRNELIPYAHSF

SEQ ID NO: 2963002 - protein, 17 aa, Entamoeba invadens
QPDELRRNYSIKDISTL

SEQ ID NO: 2963003 - protein, 22 aa, Entamoeba invadens
QPDFKISNFLNYVVSLISGTPY

SEQ ID NO: 2963004 - protein, 28 aa, Entamoeba invadens
QPDLVAAVFKKFLRELPEHLFDAEVTKL

SEQ ID NO: 2963005 - protein, 23 aa, Entamoeba invadens
QPDSKVSYGLVKKVLEQKGLLQT

SEQ ID NO: 2963006 - protein, 22 aa, Entamoeba invadens
QPEIPVLFTRSLIIAIGKYARF

SEQ ID NO: 2963007 - protein, 23 aa, Entamoeba invadens
QPEKPKCGKCGKKTTVKVDENIE

SEQ ID NO: 2963008 - protein, 26 aa, Entamoeba invadens
QPEPDFPSRLAIYLSVALDQKQIVQE

SEQ ID NO: 2963009 - protein, 18 aa, Entamoeba invadens
QPFAGFFKGFDSLTDGKE

SEQ ID NO: 2963010 - protein, 19 aa, Entamoeba invadens
QPFEEEICNTILMDVPVCF

SEQ ID NO: 2963011 - protein, 17 aa, Entamoeba invadens
QPFHLNLSASYQNTNEV

SEQ ID NO: 2963012 - protein, 24 aa, Entamoeba invadens
QPFIPKKRHVVGLASPSCISPSFN

SEQ ID NO: 2963013 - protein, 28 aa, Entamoeba invadens
QPFIPYKYSETFLKRKAVFEADDPSAQV

SEQ ID NO: 2963014 - protein, 31 aa, Entamoeba invadens
QPGMNPYGAMGGMPGMNPYGMQQPGMNPYGG

SEQ ID NO: 2963015 - protein, 33 aa, Entamoeba invadens
QPGMNQYGAMGGMPGQQMGAMDPYGMQQPGMNP

SEQ ID NO: 2963016 - protein, 21 aa, Entamoeba invadens
QPGQRLGMAPQIFIPQMQMAG

SEQ ID NO: 2963017 - protein, 24 aa, Entamoeba invadens
QPGTTVLVKLEFFNPMSSVKDRIA

SEQ ID NO: 2963018 - protein, 23 aa, Entamoeba invadens
QPHPLKYVIEMTIRTDGVITPKV

SEQ ID NO: 2963019 - protein, 54 aa, Entamoeba invadens
QPIFSRKFSQAVMPSYRSNGIVPMIRPNMRNSAYGYDQSQRFSMQPTVTNQYLV

SEQ ID NO: 2963020 - protein, 21 aa, Entamoeba invadens
QPIQRIPRYVLLLETLLKCLP

SEQ ID NO: 2963021 - protein, 21 aa, Entamoeba invadens
QPISFPSYVNVEFHLQDLIKK

SEQ ID NO: 2963022 - protein, 18 aa, Entamoeba invadens
QPKIKIQPVQPVQQVQRS

SEQ ID NO: 2963023 - protein, 28 aa, Entamoeba invadens
QPKKERKHKCFICKSTGHLTKECPNKVT

SEQ ID NO: 2963024 - protein, 25 aa, Entamoeba invadens
QPKPALSPRKAVEMRKKEEEKKEEK

SEQ ID NO: 2963025 - protein, 21 aa, Entamoeba invadens
QPKPQCFGPPGGPQGVPQSTT

SEQ ID NO: 2963026 - protein, 22 aa, Entamoeba invadens
QPKRMTPQSGYTFNRISNFPRI

SEQ ID NO: 2963027 - protein, 22 aa, Entamoeba invadens
QPKYYPRFDFAKVECISINISP

SEQ ID NO: 2963028 - protein, 23 aa, Entamoeba invadens
QPLLPKGCVIIGREWKKFDKIVD

SEQ ID NO: 2963029 - protein, 17 aa, Entamoeba invadens
QPLQQWAVEMVKTTLVI

SEQ ID NO: 2963030 - protein, 20 aa, Entamoeba invadens
QPMECVPLPSLDKAQQPQDH

SEQ ID NO: 2963031 - protein, 21 aa, Entamoeba invadens
QPMRRQRPVYQQVPQQMMQIP

SEQ ID NO: 2963032 - protein, 18 aa, Entamoeba invadens
QPNCYRVLDVLRETCDIP

SEQ ID NO: 2963033 - protein, 30 aa, Entamoeba invadens
QPNFIKIRADFMVVLFIEFFRAIDTNMGGT

SEQ ID NO: 2963034 - protein, 26 aa, Entamoeba invadens
QPNLFNMFGGMGMPQGGMPNVQGLES

SEQ ID NO: 2963035 - protein, 20 aa, Entamoeba invadens
QPNLIYSINFLHSIAELCGK

SEQ ID NO: 2963036 - protein, 21 aa, Entamoeba invadens
QPNYGFLWTFYRGDDINAIVI

SEQ ID NO: 2963037 - protein, 25 aa, Entamoeba invadens
QPPKGFPPQYLEAFNQADDQTKRSI

SEQ ID NO: 2963038 - protein, 24 aa, Entamoeba invadens
QPPPDLKKYKAIREKKGTRGTDKS

SEQ ID NO: 2963039 - protein, 22 aa, Entamoeba invadens
QPPSRGVLFYGPPGCGKTMMAK

SEQ ID NO: 2963040 - protein, 22 aa, Entamoeba invadens
QPQCLDLVWTLFKKVSEQQMTA

SEQ ID NO: 2963041 - protein, 22 aa, Entamoeba invadens
QPQDRPFITGKKVSKVQVASKE

SEQ ID NO: 2963042 - protein, 18 aa, Entamoeba invadens
QPQEALKYARMCVSETPD

SEQ ID NO: 2963043 - protein, 25 aa, Entamoeba invadens
QPQFPGMGGMGAMPGMGMGGMPNMA

SEQ ID NO: 2963044 - protein, 24 aa, Entamoeba invadens
QPQFPNGLRIHGWSQRRINNTDVK

SEQ ID NO: 2963045 - protein, 20 aa, Entamoeba invadens
QPQKRRGLQIGARAQQQQTE

SEQ ID NO: 2963046 - protein, 23 aa, Entamoeba invadens
QPQNNFAGMGSFFNQQQGTNVNG

SEQ ID NO: 2963047 - protein, 18 aa, Entamoeba invadens
QPQQRFQQGGPWQNSAFA

SEQ ID NO: 2963048 - protein, 25 aa, Entamoeba invadens
QPQQRMAYAPMRYEEEYYPPQQYVP

SEQ ID NO: 2963049 - protein, 19 aa, Entamoeba invadens
QPRAKLRHFRGRNYSVRIR

SEQ ID NO: 2963050 - protein, 21 aa, Entamoeba invadens
QPRTAVLLHRLFSLGMAVCDV

SEQ ID NO: 2963051 - protein, 22 aa, Entamoeba invadens
QPSDIKSFEFVSTKCHTAIEMM

SEQ ID NO: 2963052 - protein, 25 aa, Entamoeba invadens
QPSNMKQGYCKSALKEFESKSNEGD

SEQ ID NO: 2963053 - protein, 32 aa, Entamoeba invadens
QPTADAYCVWRCANFMVFCVCDGCGWGQDSSY

SEQ ID NO: 2963054 - protein, 20 aa, Entamoeba invadens
QPTFLPSAFLTYTTFSKSQI

SEQ ID NO: 2963055 - protein, 27 aa, Entamoeba invadens
QPTLEQKLRGAIPFDPKVFAKNLWGDF

SEQ ID NO: 2963056 - protein, 19 aa, Entamoeba invadens
QPTNCIYKNISYGVDDRYT

SEQ ID NO: 2963057 - protein, 17 aa, Entamoeba invadens
QPTNCVEPINSVDYTDT

SEQ ID NO: 2963058 - protein, 19 aa, Entamoeba invadens
QPTSMCFLTGLPNDDLFLC

SEQ ID NO: 2963059 - protein, 17 aa, Entamoeba invadens
QPVQMVQPMMSMKNVSP

SEQ ID NO: 2963060 - protein, 23 aa, Entamoeba invadens
QPVRPRFSSPVEVKRKTQKNVIT

SEQ ID NO: 2963061 - protein, 21 aa, Entamoeba invadens
QPWRYCTFYGECFVNTVQSFC

SEQ ID NO: 2963062 - protein, 19 aa, Entamoeba invadens
QPYGLPGMYPPQGQQQRQR

SEQ ID NO: 2963063 - protein, 25 aa, Entamoeba invadens
QPYYDYPELLGILLDLASNERTQSI

SEQ ID NO: 2963064 - protein, 24 aa, Entamoeba invadens
QPYYDYPELLGLLLELANSERNET

SEQ ID NO: 2963065 - protein, 17 aa, Entamoeba invadens
QQALPLYLAQKMDSAQI

SEQ ID NO: 2963066 - protein, 27 aa, Entamoeba invadens
QQARYYYYLGRIQCINLKYSDAYESLT

SEQ ID NO: 2963067 - protein, 19 aa, Entamoeba invadens
QQCKEWLLTTNFKKIEIGL

SEQ ID NO: 2963068 - protein, 26 aa, Entamoeba invadens
QQDEVKRLKLLILKQEDSQTEIVSSY

SEQ ID NO: 2963069 - protein, 18 aa, Entamoeba invadens
QQDLFSFDLIESEKNTED

SEQ ID NO: 2963070 - protein, 19 aa, Entamoeba invadens
QQDTKLFEGFSFVAEEKEK

SEQ ID NO: 2963071 - protein, 17 aa, Entamoeba invadens
QQEVLRTSNTITELDQN

SEQ ID NO: 2963072 - protein, 33 aa, Entamoeba invadens
QQFDDFYQRLVWAHQVFWSRAFLVIYPDPIGDV

SEQ ID NO: 2963073 - protein, 22 aa, Entamoeba invadens
QQFFQFDYGKLVYDSQGNCIDE

SEQ ID NO: 2963074 - protein, 17 aa, Entamoeba invadens
QQFKCTRKIDLIRKVIL

SEQ ID NO: 2963075 - protein, 23 aa, Entamoeba invadens
QQFKIQRLEVWTAASVALISTIS

SEQ ID NO: 2963076 - protein, 17 aa, Entamoeba invadens
QQFQPMSAPVFYQQQQQ

SEQ ID NO: 2963077 - protein, 21 aa, Entamoeba invadens
QQFRTPRFCEDFEKDVLYLFG

SEQ ID NO: 2963078 - protein, 26 aa, Entamoeba invadens
QQFSLRKCNKVTVLHLVNSLEKVIIE

SEQ ID NO: 2963079 - protein, 28 aa, Entamoeba invadens
QQFSNMCLEFDPLMACFVSTVEDQLMEF

SEQ ID NO: 2963080 - protein, 17 aa, Entamoeba invadens
QQFWAEQILQYYEEHPE

SEQ ID NO: 2963081 - protein, 18 aa, Entamoeba invadens
QQGGFVIIDVFEKNVPKE

SEQ ID NO: 2963082 - protein, 25 aa, Entamoeba invadens
QQHELLNFPGPVVFTTNCLMKPKPE

SEQ ID NO: 2963083 - protein, 23 aa, Entamoeba invadens
QQHFLQRWQFYGGEMQTAPAQKK

SEQ ID NO: 2963084 - protein, 27 aa, Entamoeba invadens
QQHIGDCFGVFCKLKKLSVHTLQYTSR

SEQ ID NO: 2963085 - protein, 23 aa, Entamoeba invadens
QQHKEQLKALGIPNNLLTLLFHK

SEQ ID NO: 2963086 - protein, 29 aa, Entamoeba invadens
QQIEFNIIRGYYWTGCKSNIINLRSQLKK

SEQ ID NO: 2963087 - protein, 24 aa, Entamoeba invadens
QQIEFNIIRGYYWTGCKSNVFSNE

SEQ ID NO: 2963088 - protein, 19 aa, Entamoeba invadens
QQIEFNIIRGYYWTGNPLQ

SEQ ID NO: 2963089 - protein, 18 aa, Entamoeba invadens
QQIFAVAFASYVQNKNFD

SEQ ID NO: 2963090 - protein, 19 aa, Entamoeba invadens
QQIHFGILLVEAICATTDN

SEQ ID NO: 2963091 - protein, 35 aa, Entamoeba invadens
QQIILEKFGNAKLVFESILSLKYISNTICDKKDAQ

SEQ ID NO: 2963092 - protein, 17 aa, Entamoeba invadens
QQIKARIINGVKYWVEY

SEQ ID NO: 2963093 - protein, 18 aa, Entamoeba invadens
QQIKGVVATTAWDGMNVF

SEQ ID NO: 2963094 - protein, 34 aa, Entamoeba invadens
QQILEACLDSGAKERLSSVRLVKPEKARQVEDMI

SEQ ID NO: 2963095 - protein, 17 aa, Entamoeba invadens
QQILKDEVHVMGTEVST

SEQ ID NO: 2963096 - protein, 25 aa, Entamoeba invadens
QQIPKIFNFWEKQRSFSILFSNKLA

SEQ ID NO: 2963097 - protein, 20 aa, Entamoeba invadens
QQITAWCSKCVGDVIFDSNI

SEQ ID NO: 2963098 - protein, 31 aa, Entamoeba invadens
QQITSRVKWIAIKTTMSWEDYCENIKTSVVT

SEQ ID NO: 2963099 - protein, 17 aa, Entamoeba invadens
QQIYKFNMFAGIVSGIG

SEQ ID NO: 2963100 - protein, 22 aa, Entamoeba invadens
QQKAWFTILSPFEKRMVIQNGY

SEQ ID NO: 2963101 - protein, 18 aa, Entamoeba invadens
QQKFFEWMKYAFHATNFF

SEQ ID NO: 2963102 - protein, 17 aa, Entamoeba invadens
QQKGAICLYETSAKNNI

SEQ ID NO: 2963103 - protein, 29 aa, Entamoeba invadens
QQKKMLFEVFGRFEFDFSKLFAKKKSCGI

SEQ ID NO: 2963104 - protein, 22 aa, Entamoeba invadens
QQKLKVSQVLSIKSQIQNKEMP

SEQ ID NO: 2963105 - protein, 21 aa, Entamoeba invadens
QQKSFAKHVLVMTGLSKDTDS

SEQ ID NO: 2963106 - protein, 20 aa, Entamoeba invadens
QQKTILPFCFPEEGDEQHTD

SEQ ID NO: 2963107 - protein, 17 aa, Entamoeba invadens
QQKVLSFVPPEGKFSLF

SEQ ID NO: 2963108 - protein, 27 aa, Entamoeba invadens
QQLIKDTGCLPVPMNIRNAATNLMGKM

SEQ ID NO: 2963109 - protein, 17 aa, Entamoeba invadens
QQLKEFIIKYGDKDKIA

SEQ ID NO: 2963110 - protein, 24 aa, Entamoeba invadens
QQLKEIELLKCFTHKETEKLQKLS

SEQ ID NO: 2963111 - protein, 21 aa, Entamoeba invadens
QQLNCVYGQFDLENESTKEIF

SEQ ID NO: 2963112 - protein, 25 aa, Entamoeba invadens
QQLQDKFPFCRGGTTNGRDFIIFVV

SEQ ID NO: 2963113 - protein, 23 aa, Entamoeba invadens
QQLSLYEFELFKSIETKDFLGSA

SEQ ID NO: 2963114 - protein, 23 aa, Entamoeba invadens
QQLTEHKQFISGLIQSITNFCDC

SEQ ID NO: 2963115 - protein, 27 aa, Entamoeba invadens
QQLYFKTRITTYIAFSKCLSKFSDVHT

SEQ ID NO: 2963116 - protein, 25 aa, Entamoeba invadens
QQMAGSMPPMAPMPHPQINPDHKDK

SEQ ID NO: 2963117 - protein, 18 aa, Entamoeba invadens
QQMFCVVDTMTPDAKIEP

SEQ ID NO: 2963118 - protein, 30 aa, Entamoeba invadens
QQMGQPSMCLRLCFCPLCDKQQMLLQQPQP

SEQ ID NO: 2963119 - protein, 17 aa, Entamoeba invadens
QQMKIIFQGLAGLQALK

SEQ ID NO: 2963120 - protein, 22 aa, Entamoeba invadens
QQMYADYLFRNTLLLADGDGMT

SEQ ID NO: 2963121 - protein, 17 aa, Entamoeba invadens
QQNIVSLRWKYNKSEGT

SEQ ID NO: 2963122 - protein, 22 aa, Entamoeba invadens
QQNLPIQLSFNINDVERPTRIT

SEQ ID NO: 2963123 - protein, 23 aa, Entamoeba invadens
QQNLPIQLSFNINDVERPTRITK

SEQ ID NO: 2963124 - protein, 18 aa, Entamoeba invadens
QQNYRISEELALTIVDRL

SEQ ID NO: 2963125 - protein, 23 aa, Entamoeba invadens
QQPPLCHLCCNLERLKSLTTAAK

SEQ ID NO: 2963126 - protein, 28 aa, Entamoeba invadens
QQQCKGLKLRLAVLILKQVGESLDVLYN

SEQ ID NO: 2963127 - protein, 23 aa, Entamoeba invadens
QQQEYKEAFQLFDKDNDGKITAE

SEQ ID NO: 2963128 - protein, 17 aa, Entamoeba invadens
QQQFMAMLMPQIAASKQ

SEQ ID NO: 2963129 - protein, 23 aa, Entamoeba invadens
QQQKFCPQTAFFQQRQQSNTQST

SEQ ID NO: 2963130 - protein, 26 aa, Entamoeba invadens
QQQKLRNDALFDFDFEPQQGETIHQA

SEQ ID NO: 2963131 - protein, 17 aa, Entamoeba invadens
QQQMRVAQQGLPRATGM

SEQ ID NO: 2963132 - protein, 26 aa, Entamoeba invadens
QQRELLNFPGPVVFTSNCLMKPRPEY

SEQ ID NO: 2963133 - protein, 20 aa, Entamoeba invadens
QQRKEFCPTPSIYSDVPSVF

SEQ ID NO: 2963134 - protein, 29 aa, Entamoeba invadens
QQRLPYVPLLLKYIESMTFYSNDFKEIEE

SEQ ID NO: 2963135 - protein, 23 aa, Entamoeba invadens
QQRSYRSQVTFHKKRIMDPTAEA

SEQ ID NO: 2963136 - protein, 24 aa, Entamoeba invadens
QQSFLIGWLGYLGYHVRVNRLYKK

SEQ ID NO: 2963137 - protein, 26 aa, Entamoeba invadens
QQTQFPLNWCQKSGCLGAEVQPNCLE

SEQ ID NO: 2963138 - protein, 22 aa, Entamoeba invadens
QQTQPTAFQGFQNQMGGQQNQM

SEQ ID NO: 2963139 - protein, 29 aa, Entamoeba invadens
QQTRATGFRKEGFKRPNVIDPQQLELTKS

SEQ ID NO: 2963140 - protein, 18 aa, Entamoeba invadens
QQYHQYFLNCHTIGANYS

SEQ ID NO: 2963141 - protein, 23 aa, Entamoeba invadens
QRAAPKPVKRHLPNQHSPQSFSP

SEQ ID NO: 2963142 - protein, 32 aa, Entamoeba invadens
QRAGRAGRCMAGYCYRMYSSAMYHDTFTQFTE

SEQ ID NO: 2963143 - protein, 19 aa, Entamoeba invadens
QRAKLLIHQTMRLSMPHVV

SEQ ID NO: 2963144 - protein, 22 aa, Entamoeba invadens
QRAPRPESRMGPAPQQQPTPTA

SEQ ID NO: 2963145 - protein, 17 aa, Entamoeba invadens
QRAPYLFEIEYYTILND

SEQ ID NO: 2963146 - protein, 22 aa, Entamoeba invadens
QRASALKWLVALVLQTNAIQQD

SEQ ID NO: 2963147 - protein, 21 aa, Entamoeba invadens
QRCDPDFIHAMGYVKEATAFA

SEQ ID NO: 2963148 - protein, 32 aa, Entamoeba invadens
QRDCCSKTHINVPMCKKFLTRIVAAMNKGDIF

SEQ ID NO: 2963149 - protein, 33 aa, Entamoeba invadens
QRDCCSKTHINVPMCKKFLTRIVAAMNKGDIFN

SEQ ID NO: 2963150 - protein, 25 aa, Entamoeba invadens
QRDCMKKSCFMCWHGTWSYENATGI

SEQ ID NO: 2963151 - protein, 18 aa, Entamoeba invadens
QRDFPLPGESVVASKSLK

SEQ ID NO: 2963152 - protein, 22 aa, Entamoeba invadens
QRDMYQCLCQTFQLQQEDYYHM

SEQ ID NO: 2963153 - protein, 18 aa, Entamoeba invadens
QREFLLRRIKTLVTTYEK

SEQ ID NO: 2963154 - protein, 19 aa, Entamoeba invadens
QREILELGNKVKELKGKFE

SEQ ID NO: 2963155 - protein, 27 aa, Entamoeba invadens
QREKKKGCFLINCYIRKEDTKFHRDDT

SEQ ID NO: 2963156 - protein, 26 aa, Entamoeba invadens
QRENCRCFECGAANPTWASAPYGIFL

SEQ ID NO: 2963157 - protein, 18 aa, Entamoeba invadens
QRERADFEQKAKLAKIES

SEQ ID NO: 2963158 - protein, 23 aa, Entamoeba invadens
QRERLHSLFSLYVTERLRRIEKI

SEQ ID NO: 2963159 - protein, 21 aa, Entamoeba invadens
QREVIKFAKKWNMSLIETSAK

SEQ ID NO: 2963160 - protein, 19 aa, Entamoeba invadens
QRFDEPRAKFYAAEIGLVL

SEQ ID NO: 2963161 - protein, 27 aa, Entamoeba invadens
QRFDFVYIRMEGFIDWEFLEHHSRYNI

SEQ ID NO: 2963162 - protein, 19 aa, Entamoeba invadens
QRFEVCAIALYWILFQQNY

SEQ ID NO: 2963163 - protein, 26 aa, Entamoeba invadens
QRFKIKYPLKKCDWIALPDFEAGAME

SEQ ID NO: 2963164 - protein, 19 aa, Entamoeba invadens
QRFQDWYCANIEKIEEIAN

SEQ ID NO: 2963165 - protein, 17 aa, Entamoeba invadens
QRFSSLLYDSKENGMDP

SEQ ID NO: 2963166 - protein, 24 aa, Entamoeba invadens
QRGGLKKRMTFVPLNKISPQVANP

SEQ ID NO: 2963167 - protein, 19 aa, Entamoeba invadens
QRGSAMVFDQIFWVADKEE

SEQ ID NO: 2963168 - protein, 26 aa, Entamoeba invadens
QRGSIKLCVVFTIPIFQNCVHFVVME

SEQ ID NO: 2963169 - protein, 25 aa, Entamoeba invadens
QRHPRYKTEICQTFQQTGSCKYGSR

SEQ ID NO: 2963170 - protein, 27 aa, Entamoeba invadens
QRIALAPVAIEYCWFFLDIIIKSLTLY

SEQ ID NO: 2963171 - protein, 24 aa, Entamoeba invadens
QRIEEMKRRTSISSSFVNTKQIGE

SEQ ID NO: 2963172 - protein, 21 aa, Entamoeba invadens
QRIFRNLSFHDLLMCRSVSKK

SEQ ID NO: 2963173 - protein, 17 aa, Entamoeba invadens
QRIGFDIINNTLVTGND

SEQ ID NO: 2963174 - protein, 23 aa, Entamoeba invadens
QRIKARRIPVRTIPRNPPIRPPV

SEQ ID NO: 2963175 - protein, 20 aa, Entamoeba invadens
QRIPQLLRIISSLNAQETAL

SEQ ID NO: 2963176 - protein, 24 aa, Entamoeba invadens
QRIPRYKLLLEELIKTMPDNHPEL

SEQ ID NO: 2963177 - protein, 19 aa, Entamoeba invadens
QRIPRYQLLLKELLKTIHP

SEQ ID NO: 2963178 - protein, 18 aa, Entamoeba invadens
QRIQHTFGAINLEDISQP

SEQ ID NO: 2963179 - protein, 19 aa, Entamoeba invadens
QRIQHTFGAINLEDISQPN

SEQ ID NO: 2963180 - protein, 18 aa, Entamoeba invadens
QRIQQWALSFNKSFYYAL

SEQ ID NO: 2963181 - protein, 17 aa, Entamoeba invadens
QRIRADVIVPWCEIDQK

SEQ ID NO: 2963182 - protein, 19 aa, Entamoeba invadens
QRIRESFAKTSIMHKDEEE

SEQ ID NO: 2963183 - protein, 22 aa, Entamoeba invadens
QRIRNLVNFLLYRDWKNIIKPD

SEQ ID NO: 2963184 - protein, 20 aa, Entamoeba invadens
QRISCDVSTIFTLIFSDNKK

SEQ ID NO: 2963185 - protein, 23 aa, Entamoeba invadens
QRIWPCPRCYTVVHFQCVSNWAT

SEQ ID NO: 2963186 - protein, 23 aa, Entamoeba invadens
QRKFTLRLKSVMLGGTSDFEKIH

SEQ ID NO: 2963187 - protein, 17 aa, Entamoeba invadens
QRKGNVIPFKPQEPPQQ

SEQ ID NO: 2963188 - protein, 20 aa, Entamoeba invadens
QRKHGFKEKHFVRRRNDIWE

SEQ ID NO: 2963189 - protein, 17 aa, Entamoeba invadens
QRKPITFGEQDLGELSI

SEQ ID NO: 2963190 - protein, 22 aa, Entamoeba invadens
QRKQGLCWYYDALFVLEENNLE

SEQ ID NO: 2963191 - protein, 25 aa, Entamoeba invadens
QRKSFKRFHYQQLIKHLKTLQQTYL

SEQ ID NO: 2963192 - protein, 21 aa, Entamoeba invadens
QRLDILKCVSNNIGIISKNIH

SEQ ID NO: 2963193 - protein, 20 aa, Entamoeba invadens
QRLDPRWDQVKAEMRRQKEL

SEQ ID NO: 2963194 - protein, 21 aa, Entamoeba invadens
QRLDRKCYANMFLKEQVKKAL

SEQ ID NO: 2963195 - protein, 22 aa, Entamoeba invadens
QRLFICPEGYKLMTEISRGMSA

SEQ ID NO: 2963196 - protein, 25 aa, Entamoeba invadens
QRLGNECFKNCYNLVAVTLSSNLTA

SEQ ID NO: 2963197 - protein, 31 aa, Entamoeba invadens
QRLGTYCFKDCRSLKEFSIPIGVKSVANGCF

SEQ ID NO: 2963198 - protein, 18 aa, Entamoeba invadens
QRLLEVSLYCTKKTDDHM

SEQ ID NO: 2963199 - protein, 21 aa, Entamoeba invadens
QRLPRYELLLMDLIKSPQLQG

SEQ ID NO: 2963200 - protein, 19 aa, Entamoeba invadens
QRLQFYKKYSFLNENFSIK

SEQ ID NO: 2963201 - protein, 19 aa, Entamoeba invadens
QRLQNEIQKFTPFETKVIE

SEQ ID NO: 2963202 - protein, 25 aa, Entamoeba invadens
QRLQSCPRVGRAMAEILGTTKREVG

SEQ ID NO: 2963203 - protein, 18 aa, Entamoeba invadens
QRLRELTERLRFLEERDA

SEQ ID NO: 2963204 - protein, 21 aa, Entamoeba invadens
QRLSEIPVFEFCSELIEESPS

SEQ ID NO: 2963205 - protein, 18 aa, Entamoeba invadens
QRLVFGEAVYRANKQPIY

SEQ ID NO: 2963206 - protein, 20 aa, Entamoeba invadens
QRMAQCINFFSPNIKPFKRE

SEQ ID NO: 2963207 - protein, 23 aa, Entamoeba invadens
QRMFQKLCALEILGNSVAFKGWE

SEQ ID NO: 2963208 - protein, 18 aa, Entamoeba invadens
QRMHLRFLLEEVNTRLES

SEQ ID NO: 2963209 - protein, 20 aa, Entamoeba invadens
QRMKLGRSLSLLWGSSKDNP

SEQ ID NO: 2963210 - protein, 17 aa, Entamoeba invadens
QRMRRLKKDSSDDEENE

SEQ ID NO: 2963211 - protein, 25 aa, Entamoeba invadens
QRMYEEISLLFSRNFYDVKSTEPFR

SEQ ID NO: 2963212 - protein, 23 aa, Entamoeba invadens
QRNSLKVPILFLNFHSQLKKKAS

SEQ ID NO: 2963213 - protein, 17 aa, Entamoeba invadens
QRPGIRIEDSLFGFVET

SEQ ID NO: 2963214 - protein, 18 aa, Entamoeba invadens
QRPPVAHRPVRAGTRKAP

SEQ ID NO: 2963215 - protein, 24 aa, Entamoeba invadens
QRPWKCVHYKNIVVMLLIEKNALQ

SEQ ID NO: 2963216 - protein, 28 aa, Entamoeba invadens
QRQGELFPEHTCPYVFVYQSNFSSAVSS

SEQ ID NO: 2963217 - protein, 19 aa, Entamoeba invadens
QRQIDWNPNCLTLVVSPDK

SEQ ID NO: 2963218 - protein, 17 aa, Entamoeba invadens
QRQMCQQYHQYFLNCHT

SEQ ID NO: 2963219 - protein, 23 aa, Entamoeba invadens
QRQSCPPPSILQSKREMMQRIEF

SEQ ID NO: 2963220 - protein, 25 aa, Entamoeba invadens
QRRAAPPPPQRGGPKKERVRCGFDY

SEQ ID NO: 2963221 - protein, 24 aa, Entamoeba invadens
QRRKGFPDFPAKVEMLDLVEEEDK

SEQ ID NO: 2963222 - protein, 23 aa, Entamoeba invadens
QRRVRTLMGIFCDILDIIDNCKN

SEQ ID NO: 2963223 - protein, 25 aa, Entamoeba invadens
QRRYFPYKYRKVYTHRVIPKYLNKY

SEQ ID NO: 2963224 - protein, 33 aa, Entamoeba invadens; identical to SEQ ID NO: 2501540

SEQ ID NO: 2963225 - protein, 17 aa, Entamoeba invadens
QRSESKEIIGLVMSEII

SEQ ID NO: 2963226 - protein, 19 aa, Entamoeba invadens
QRSFLRAMCYLLSGLEKYF

SEQ ID NO: 2963227 - protein, 19 aa, Entamoeba invadens
QRSGPRKGRTVQVPLKCNL

SEQ ID NO: 2963228 - protein, 25 aa, Entamoeba invadens
QRSIKRICKNRGNLVFIVTGKNGNQ

SEQ ID NO: 2963229 - protein, 20 aa, Entamoeba invadens
QRSKSSLSFDFERSKTPEIF

SEQ ID NO: 2963230 - protein, 19 aa, Entamoeba invadens
QRSSSFGVGADYTSKKLTA

SEQ ID NO: 2963231 - protein, 17 aa, Entamoeba invadens
QRSVPLLNFLIEILEEK

SEQ ID NO: 2963232 - protein, 23 aa, Entamoeba invadens
QRTETFMKFGPVVLQMIQNGVFP

SEQ ID NO: 2963233 - protein, 24 aa, Entamoeba invadens
QRTPKQLPLAIAKTISMLNSSNLS

SEQ ID NO: 2963234 - protein, 17 aa, Entamoeba invadens
QRTRLKAYIAIGDGKGH

SEQ ID NO: 2963235 - protein, 17 aa, Entamoeba invadens
QRVCDVCAVSADNNVEV

SEQ ID NO: 2963236 - protein, 18 aa, Entamoeba invadens
QRVCLGCDTPAHLEVLNF

SEQ ID NO: 2963237 - protein, 19 aa, Entamoeba invadens
QRVDLCLNQDVTKKDGRII

SEQ ID NO: 2963238 - protein, 17 aa, Entamoeba invadens
QRVFALCNSRQLFNASF

SEQ ID NO: 2963239 - protein, 18 aa, Entamoeba invadens
QRVFPAFVQHIVSDTNLM

SEQ ID NO: 2963240 - protein, 17 aa, Entamoeba invadens
QRVGAVAPNPTAMKYGR

SEQ ID NO: 2963241 - protein, 18 aa, Entamoeba invadens
QRVIGKCYLIFHRPSHIT

SEQ ID NO: 2963242 - protein, 18 aa, Entamoeba invadens
QRVLGCVYSACLQLPIKL

SEQ ID NO: 2963243 - protein, 17 aa, Entamoeba invadens
QRVLLVIYSKRIVKPGI

SEQ ID NO: 2963244 - protein, 21 aa, Entamoeba invadens
QRVPNKFLKAEIKFYKKILQT

SEQ ID NO: 2963245 - protein, 20 aa, Entamoeba invadens
QRVPRYSLLINELYKNTLPA

SEQ ID NO: 2963246 - protein, 19 aa, Entamoeba invadens
QRVPRYSLLLSDFLKHTKK

SEQ ID NO: 2963247 - protein, 22 aa, Entamoeba invadens
QRVRDCPVAYSMYKKFTNELPQ

SEQ ID NO: 2963248 - protein, 20 aa, Entamoeba invadens
QRVTSWKAFLKNKGKTNGDC

SEQ ID NO: 2963249 - protein, 24 aa, Entamoeba invadens
QRVVDLRKKFGLFNSIIYIQRDEG

SEQ ID NO: 2963250 - protein, 25 aa, Entamoeba invadens
QRWVEEEIPHIIILVTGRYSTLYLR

SEQ ID NO: 2963251 - protein, 23 aa, Entamoeba invadens
QRYCFSNSLIKEFAVPQSVRKIE

SEQ ID NO: 2963252 - protein, 33 aa, Entamoeba invadens
QRYFANFTCSVWGYKFYLSHGVECRDVGFFYKD

SEQ ID NO: 2963253 - protein, 20 aa, Entamoeba invadens
QRYFCVHGGLSPSLKKIDQI

SEQ ID NO: 2963254 - protein, 21 aa, Entamoeba invadens
QRYGFCRKGDECNFQHIPSTG

SEQ ID NO: 2963255 - protein, 17 aa, Entamoeba invadens
QRYLNLVIGLSRNNTEL

SEQ ID NO: 2963256 - protein, 18 aa, Entamoeba invadens
QRYNLRKKLLLLLSKADQ

SEQ ID NO: 2963257 - protein, 17 aa, Entamoeba invadens
QRYNTRVDFKFTPNIFL

SEQ ID NO: 2963258 - protein, 23 aa, Entamoeba invadens
QRYRKIATFDFLKSEIINEVVLK

SEQ ID NO: 2963259 - protein, 17 aa, Entamoeba invadens
QRYSLFSKYDEGILMDR

SEQ ID NO: 2963260 - protein, 23 aa, Entamoeba invadens
QRYTPVCALKLIDAMTVAVGSSH

SEQ ID NO: 2963261 - protein, 26 aa, Entamoeba invadens
QSAEQFSGFQIPPNFAQLSPEMQQQF

SEQ ID NO: 2963262 - protein, 26 aa, Entamoeba invadens
QSAKLYMRIGNAFYKQSKFTEALEYY

SEQ ID NO: 2963263 - protein, 24 aa, Entamoeba invadens
QSALKERQAACLVAQLVSALVYLH

SEQ ID NO: 2963264 - protein, 37 aa, Entamoeba invadens
QSAPKFCPNCGVKLNGSVKFCSECGAKIGGETTSTKK

SEQ ID NO: 2963265 - protein, 24 aa, Entamoeba invadens
QSARPEVSIVLCGTHLGEQHEVIP

SEQ ID NO: 2963266 - protein, 17 aa, Entamoeba invadens
QSARVFLARAYCLLGLN

SEQ ID NO: 2963267 - protein, 26 aa, Entamoeba invadens
QSATIGIDVFRIFDCFNDINSMETCV

SEQ ID NO: 2963268 - protein, 19 aa, Entamoeba invadens
QSCFSECFGFDEFEIPNTV

SEQ ID NO: 2963269 - protein, 17 aa, Entamoeba invadens
QSCFSFCNSLREIKFFP

SEQ ID NO: 2963270 - protein, 19 aa, Entamoeba invadens
QSCHNNNCAFCEYDKCTIC

SEQ ID NO: 2963271 - protein, 22 aa, Entamoeba invadens
QSCKTLKRFIGKIKGVQVVVKN

SEQ ID NO: 2963272 - protein, 25 aa, Entamoeba invadens
QSDALYILGVMYFKGENVCEDKQLS

SEQ ID NO: 2963273 - protein, 17 aa, Entamoeba invadens
QSDFRWTRQTEVGIQAF

SEQ ID NO: 2963274 - protein, 20 aa, Entamoeba invadens
QSDPGKCPMWGKTIESDSEI

SEQ ID NO: 2963275 - protein, 18 aa, Entamoeba invadens
QSDPILISACIRVIIKVT

SEQ ID NO: 2963276 - protein, 31 aa, Entamoeba invadens
QSDRRWKTKRENMLNSRIAEIQTQLDEERQK

SEQ ID NO: 2963277 - protein, 20 aa, Entamoeba invadens
QSDRRWKTKSNTQCTTNNTE

SEQ ID NO: 2963278 - protein, 24 aa, Entamoeba invadens
QSDTLKRFYLFREYETPPLSVASR

SEQ ID NO: 2963279 - protein, 18 aa, Entamoeba invadens
QSEDFSLTYVFRLLTNVI

SEQ ID NO: 2963280 - protein, 29 aa, Entamoeba invadens
QSEGFEELRLEFCRLMVKYYSHEMNYIEN

SEQ ID NO: 2963281 - protein, 40 aa, Entamoeba invadens
QSEGRKKKSFGIFRKSRKDDFDLSSSPGFEEKSESTNDSE

SEQ ID NO: 2963282 - protein, 26 aa, Entamoeba invadens
QSEIEWLKKKIAVREKLDEKKKLEKQ

SEQ ID NO: 2963283 - protein, 18 aa, Entamoeba invadens
QSEISYVEFLEEFQNAQM

SEQ ID NO: 2963284 - protein, 22 aa, Entamoeba invadens
QSEKLVRYIFQLAMYDNSFDIR

SEQ ID NO: 2963285 - protein, 25 aa, Entamoeba invadens
QSELCFMKFPTVQIPEFIKYAKSSK

SEQ ID NO: 2963286 - protein, 28 aa, Entamoeba invadens
QSERVGLCCECLLFFLANLHDAIVSIEC

SEQ ID NO: 2963287 - protein, 20 aa, Entamoeba invadens
QSEVRMEFIVGKKVVEDNEV

SEQ ID NO: 2963288 - protein, 24 aa, Entamoeba invadens
QSEWKMPICSQQALVTVKYPELQK

SEQ ID NO: 2963289 - protein, 24 aa, Entamoeba invadens
QSFGCLYIVMEYMESGSLLNIVKQ

SEQ ID NO: 2963290 - protein, 17 aa, Entamoeba invadens
QSFKFIWWTKIALILSK

SEQ ID NO: 2963291 - protein, 21 aa, Entamoeba invadens
QSFKSWWGYIDLFDDTHFQEK

SEQ ID NO: 2963292 - protein, 23 aa, Entamoeba invadens
QSFLLALFVSHGFDIKLKKLYKK

SEQ ID NO: 2963293 - protein, 18 aa, Entamoeba invadens
QSFQCDWEALLTETQNEY

SEQ ID NO: 2963294 - protein, 24 aa, Entamoeba invadens
QSFTLRLTALLPQNFEKVSQLMLI

SEQ ID NO: 2963295 - protein, 24 aa, Entamoeba invadens
QSFVLEFNQLYALNSTELFNRTTE

SEQ ID NO: 2963296 - protein, 20 aa, Entamoeba invadens
QSFYEAINFSKIHYSPFDSA

SEQ ID NO: 2963297 - protein, 25 aa, Entamoeba invadens
QSFYLKGSFKFFGYLEIEIKNGSKS

SEQ ID NO: 2963298 - protein, 23 aa, Entamoeba invadens
QSGMIQKMVDFFWNVGAPENEID

SEQ ID NO: 2963299 - protein, 25 aa, Entamoeba invadens
QSGNVIKMYLVKWVLGREVFVSEET

SEQ ID NO: 2963300 - protein, 27 aa, Entamoeba invadens
QSGQTCCWCGLEIDKAHIVECSLCHQT

SEQ ID NO: 2963301 - protein, 17 aa, Entamoeba invadens
QSGRFVPRAIFVDTEPT

SEQ ID NO: 2963302 - protein, 28 aa, Entamoeba invadens
QSGVYHARWEIISDIKKRVAIPVIANGG

SEQ ID NO: 2963303 - protein, 30 aa, Entamoeba invadens
QSHGCLYIVMEFMESGSLLNIVKQFKQLNE

SEQ ID NO: 2963304 - protein, 18 aa, Entamoeba invadens
QSHLELHLTEFFNHTSDI

SEQ ID NO: 2963305 - protein, 17 aa, Entamoeba invadens
QSIFDNFGFDDDVKEQK

SEQ ID NO: 2963306 - protein, 17 aa, Entamoeba invadens
QSIFNQFCEAFKEVLRR

SEQ ID NO: 2963307 - protein, 18 aa, Entamoeba invadens
QSIFRRVLALGFSDRYKD

SEQ ID NO: 2963308 - protein, 17 aa, Entamoeba invadens
QSIGCPVLGITTAPDAI

SEQ ID NO: 2963309 - protein, 17 aa, Entamoeba invadens
QSIIALHSLVKVFVLMN

SEQ ID NO: 2963310 - protein, 20 aa, Entamoeba invadens
QSIILKTQFSLSLTTLDTTQ

SEQ ID NO: 2963311 - protein, 19 aa, Entamoeba invadens
QSIIYWDIPFAEYKLGRTL

SEQ ID NO: 2963312 - protein, 18 aa, Entamoeba invadens
QSIKCFESALVLDKTCLD

SEQ ID NO: 2963313 - protein, 26 aa, Entamoeba invadens
QSIKLELIKVFGIIGAIDTYKYKLLT

SEQ ID NO: 2963314 - protein, 20 aa, Entamoeba invadens
QSIKMFNDVQIIRDEKNEFN

SEQ ID NO: 2963315 - protein, 24 aa, Entamoeba invadens
QSIKYEKVGICLTLGDKSQYIAEG

SEQ ID NO: 2963316 - protein, 24 aa, Entamoeba invadens
QSIPSAWPICSFKNNIIALPDQSG

SEQ ID NO: 2963317 - protein, 24 aa, Entamoeba invadens
QSIQQLPCFQRIFIECNGDDLFKL

SEQ ID NO: 2963318 - protein, 20 aa, Entamoeba invadens
QSIRSTVDFNSYPVKVATES

SEQ ID NO: 2963319 - protein, 20 aa, Entamoeba invadens
QSKCCQICFKPIENPSKCEY

SEQ ID NO: 2963320 - protein, 24 aa, Entamoeba invadens
QSKDVESFKMFFSLADSDENGALD

SEQ ID NO: 2963321 - protein, 23 aa, Entamoeba invadens
QSKELMCQLLGAFPTKGMYDVLI

SEQ ID NO: 2963322 - protein, 17 aa, Entamoeba invadens
QSKFLFEAEDRSVWVTK

SEQ ID NO: 2963323 - protein, 26 aa, Entamoeba invadens
QSKFPPARKEFYTFLEEFKRQGVSEM

SEQ ID NO: 2963324 - protein, 20 aa, Entamoeba invadens
QSKFPPYRYEQFLIDIIEKT

SEQ ID NO: 2963325 - protein, 26 aa, Entamoeba invadens
QSKGGVLSEVMWKCRSIGAYYGEESY

SEQ ID NO: 2963326 - protein, 27 aa, Entamoeba invadens
QSKIRPLWRHYYEDAKAVVFVVDASDN

SEQ ID NO: 2963327 - protein, 20 aa, Entamoeba invadens
QSKLLLKPRPIFCPFFQTHP

SEQ ID NO: 2963328 - protein, 24 aa, Entamoeba invadens
QSKNYFGLCAIVFAFHKIGDFEYM

SEQ ID NO: 2963329 - protein, 24 aa, Entamoeba invadens
QSKPRPTVTVTLYLFPEVNPKQEK

SEQ ID NO: 2963330 - protein, 18 aa, Entamoeba invadens
QSKRIWGELWKVVDSSDI

SEQ ID NO: 2963331 - protein, 38 aa, Entamoeba invadens
QSKTSWVCLGAFIFLRYICPAIIQPLEWGLAYEPPTDM

SEQ ID NO: 2963332 - protein, 24 aa, Entamoeba invadens
QSKVREMFPCLILCSRGFPDNATL

SEQ ID NO: 2963333 - protein, 18 aa, Entamoeba invadens
QSKYKASVEFKTMSMWSS

SEQ ID NO: 2963334 - protein, 17 aa, Entamoeba invadens
QSLCPVATYDEITRVLD

SEQ ID NO: 2963335 - protein, 24 aa, Entamoeba invadens
QSLFKKCVPPVIQARRQPEVKTEN

SEQ ID NO: 2963336 - protein, 19 aa, Entamoeba invadens
QSLFTLFALNKFPITHEIL

SEQ ID NO: 2963337 - protein, 18 aa, Entamoeba invadens
QSLGVFLKKTLKRPEIIR

SEQ ID NO: 2963338 - protein, 17 aa, Entamoeba invadens
QSLKRIQIPNGVTSIGM

SEQ ID NO: 2963339 - protein, 18 aa, Entamoeba invadens
QSLKRPNLFQQFVRNNND

SEQ ID NO: 2963340 - protein, 28 aa, Entamoeba invadens
QSLLCKCGNLLIGAVFVFCCGETICENC

SEQ ID NO: 2963341 - protein, 25 aa, Entamoeba invadens
QSLLTFHICHPLLVFIPKDVNKLHE

SEQ ID NO: 2963342 - protein, 19 aa, Entamoeba invadens
QSLQHFDYVFGNDTQIVHI

SEQ ID NO: 2963343 - protein, 17 aa, Entamoeba invadens
QSLRYVYDLPKYKQNPF

SEQ ID NO: 2963344 - protein, 19 aa, Entamoeba invadens
QSLVCQDRMCLWCYKDTEL

SEQ ID NO: 2963345 - protein, 23 aa, Entamoeba invadens
QSLVKCNKKWVGVPWTGVGKIAL

SEQ ID NO: 2963346 - protein, 18 aa, Entamoeba invadens
QSLWRKVNTLGLSSRFKE

SEQ ID NO: 2963347 - protein, 28 aa, Entamoeba invadens
QSLYLTLFGRVGLMKNTLLVGNVNVPTP

SEQ ID NO: 2963348 - protein, 20 aa, Entamoeba invadens
QSLYRRVLTMGLSRRFVEGD

SEQ ID NO: 2963349 - protein, 24 aa, Entamoeba invadens
QSMCLNCCLYSLNLSFGVTKISSF

SEQ ID NO: 2963350 - protein, 18 aa, Entamoeba invadens
QSMDNCKLLLIFHHSPRN

SEQ ID NO: 2963351 - protein, 25 aa, Entamoeba invadens
QSMKGGDLYSGMLLSGITKSEQTEV

SEQ ID NO: 2963352 - protein, 22 aa, Entamoeba invadens
QSMKMFPDKAGLVYGGNDGRAN

SEQ ID NO: 2963353 - protein, 19 aa, Entamoeba invadens
QSMTLWWNVMRHINEMWLN

SEQ ID NO: 2963354 - protein, 17 aa, Entamoeba invadens
QSNIELFEDKPETNLRD

SEQ ID NO: 2963355 - protein, 19 aa, Entamoeba invadens
QSNLKENCCLGSRVSKIPV

SEQ ID NO: 2963356 - protein, 26 aa, Entamoeba invadens
QSNNFPGAMPVNFGRTSFEIIQKSPY

SEQ ID NO: 2963357 - protein, 26 aa, Entamoeba invadens
QSNRKGFKDPIKWNTKRNVKCGICIK

SEQ ID NO: 2963358 - protein, 24 aa, Entamoeba invadens
QSPKRRKCFGPIYTSYSCKRCYGD

SEQ ID NO: 2963359 - protein, 21 aa, Entamoeba invadens
QSPQITKVFPRSCELQNAVDV

SEQ ID NO: 2963360 - protein, 19 aa, Entamoeba invadens
QSPQRILVRFNEIKIQTTF

SEQ ID NO: 2963361 - protein, 22 aa, Entamoeba invadens
QSPRPSFLTAEFLITMTNQLSM

SEQ ID NO: 2963362 - protein, 21 aa, Entamoeba invadens
QSQIKQTEMLLAELKEEENRL

SEQ ID NO: 2963363 - protein, 24 aa, Entamoeba invadens
QSQIPRFSGLIPFLDGNTQPPPNF

SEQ ID NO: 2963364 - protein, 24 aa, Entamoeba invadens
QSQLCSDVVDNFCMNQIKQKESQQ

SEQ ID NO: 2963365 - protein, 20 aa, Entamoeba invadens
QSQRICFIATISSSVSNAVE

SEQ ID NO: 2963366 - protein, 17 aa, Entamoeba invadens
QSRDFVTIDLFIKTTKE

SEQ ID NO: 2963367 - protein, 18 aa, Entamoeba invadens
QSRFEMSDFFSISEKVSV

SEQ ID NO: 2963368 - protein, 25 aa, Entamoeba invadens
QSRFLRPGEYIQMSGRAGRRGKDDQ

SEQ ID NO: 2963369 - protein, 20 aa, Entamoeba invadens
QSRSKRAISTAMLIYHFLWE

SEQ ID NO: 2963370 - protein, 18 aa, Entamoeba invadens
QSSDFWRMKEHIMIKHKE

SEQ ID NO: 2963371 - protein, 22 aa, Entamoeba invadens
QSSEIYNLFVVNGLSFTLRSHI

SEQ ID NO: 2963372 - protein, 18 aa, Entamoeba invadens
QSSLSETLVRCFKQRKVE

SEQ ID NO: 2963373 - protein, 17 aa, Entamoeba invadens
QSSQGSVCFDPIRLMVG

SEQ ID NO: 2963374 - protein, 22 aa, Entamoeba invadens
QSSRVCGLLVARSVGDIKNKPI

SEQ ID NO: 2963375 - protein, 30 aa, Entamoeba invadens
QSSWISATEWLLRVLTGGLFSPLMAKPVVP

SEQ ID NO: 2963376 - protein, 25 aa, Entamoeba invadens
QSTFKTTFGHKFECYESELKTVGKS

SEQ ID NO: 2963377 - protein, 23 aa, Entamoeba invadens
QSTKLKLVHDVIFVISDQGYTLQ

SEQ ID NO: 2963378 - protein, 24 aa, Entamoeba invadens
QSTPICELCNSGVTFTLQDKPIEE

SEQ ID NO: 2963379 - protein, 24 aa, Entamoeba invadens
QSTTEWANSVSRPIVREVDPEFKR

SEQ ID NO: 2963380 - protein, 46 aa, Entamoeba invadens
QSTVADCLAFIKSFLKACGYRYDTCLRIANFLVELNAATDFYQIKK

SEQ ID NO: 2963381 - protein, 26 aa, Entamoeba invadens
QSTVALCCAKVKILHFKNGEIDVMNL

SEQ ID NO: 2963382 - protein, 19 aa, Entamoeba invadens
QSVANRWNLLCLDCSAKTK

SEQ ID NO: 2963383 - protein, 18 aa, Entamoeba invadens
QSVFKDMMLFTSTFTLLR

SEQ ID NO: 2963384 - protein, 24 aa, Entamoeba invadens
QSVGHLLWDYGIPTAMSLSDCCTI

SEQ ID NO: 2963385 - protein, 25 aa, Entamoeba invadens
QSVGLKFCMEKAFPTYKEFPIITPT

SEQ ID NO: 2963386 - protein, 21 aa, Entamoeba invadens
QSVKKFIKFYGIPKDTTTDEF

SEQ ID NO: 2963387 - protein, 32 aa, Entamoeba invadens
QSVLQWKNEFLRWSTVKAESLKLCISDKKEQL

SEQ ID NO: 2963388 - protein, 17 aa, Entamoeba invadens
QSVNQFVLDNAFAQYAG

SEQ ID NO: 2963389 - protein, 22 aa, Entamoeba invadens
QSVNRLCYLQAILKQKQKHLLR

SEQ ID NO: 2963390 - protein, 23 aa, Entamoeba invadens
QSVQSLSLFLFVACCHPTAEIRQ

SEQ ID NO: 2963391 - protein, 27 aa, Entamoeba invadens
QSVQSQRLVSCIKPHFSKEKTESVIKE

SEQ ID NO: 2963392 - protein, 17 aa, Entamoeba invadens
QSVRLLAPMVFGKRLTG

SEQ ID NO: 2963393 - protein, 21 aa, Entamoeba invadens
QSVSPSVILPVAPQSRSESYQ

SEQ ID NO: 2963394 - protein, 19 aa, Entamoeba invadens
QSYIFSTWATKYVVIKENV

SEQ ID NO: 2963395 - protein, 24 aa, Entamoeba invadens
QSYKYKLVGVVIHSGGAHGGHYFS

SEQ ID NO: 2963396 - protein, 27 aa, Entamoeba invadens
QSYLIMPIQRIPRYVLLIKDMLKCAPP

SEQ ID NO: 2963397 - protein, 26 aa, Entamoeba invadens
QSYLIMPIQRIPRYVLLIKDMLKNAP

SEQ ID NO: 2963398 - protein, 22 aa, Entamoeba invadens
QSYPKNRMVGWDKDALGYHSDD

SEQ ID NO: 2963399 - protein, 18 aa, Entamoeba invadens
QTAIEMMHINPVTSTGLS

SEQ ID NO: 2963400 - protein, 21 aa, Entamoeba invadens
QTALLPFKAIEFLFYQPSFFS

SEQ ID NO: 2963401 - protein, 17 aa, Entamoeba invadens
QTALMLKDLKLFEDNDK

SEQ ID NO: 2963402 - protein, 31 aa, Entamoeba invadens
QTAQECICIALLNKYCSFSFKQPAKKSTVAP

SEQ ID NO: 2963403 - protein, 18 aa, Entamoeba invadens
QTATCLMSKMLTVQLATL

SEQ ID NO: 2963404 - protein, 21 aa, Entamoeba invadens
QTCCKCNKEIYGRVIDVDTKK

SEQ ID NO: 2963405 - protein, 29 aa, Entamoeba invadens
QTCFAIGTTCGFRVFGMENGWFRERFSRT

SEQ ID NO: 2963406 - protein, 25 aa, Entamoeba invadens
QTCSDGPFRVCVIGAKSSGKSTFVN

SEQ ID NO: 2963407 - protein, 23 aa, Entamoeba invadens
QTCYYQQVHLVLYIIDDDGCVFD

SEQ ID NO: 2963408 - protein, 34 aa, Entamoeba invadens
QTDCLKASSVELIRLISNFCRFKPHISFEGFDGF

SEQ ID NO: 2963409 - protein, 17 aa, Entamoeba invadens
QTDLECFLLSLLSQRYG

SEQ ID NO: 2963410 - protein, 20 aa, Entamoeba invadens
QTDLEVWVNMCLSAIEQTET

SEQ ID NO: 2963411 - protein, 23 aa, Entamoeba invadens
QTDLLPMLVMYEADESFQVSALF

SEQ ID NO: 2963412 - protein, 24 aa, Entamoeba invadens
QTDPAGTWTEWKAHVVGRNAKTVD

SEQ ID NO: 2963413 - protein, 17 aa, Entamoeba invadens
QTDPHLMFFGFVVDSNS

SEQ ID NO: 2963414 - protein, 39 aa, Entamoeba invadens
QTEECFKRAFIVNSDRHPTCFAFGIGYDIGAMIVDGEME

SEQ ID NO: 2963415 - protein, 18 aa, Entamoeba invadens
QTEFSFREVVSVKSKRVR

SEQ ID NO: 2963416 - protein, 34 aa, Entamoeba invadens
QTEKYGTVFLLKCCSDCANALLYLSSHDIIHRNV

SEQ ID NO: 2963417 - protein, 21 aa, Entamoeba invadens
QTESFYCLSIPLKRTSISFGL

SEQ ID NO: 2963418 - protein, 17 aa, Entamoeba invadens
QTFCFSKLYELRDVPTL

SEQ ID NO: 2963419 - protein, 22 aa, Entamoeba invadens
QTFCPFRLVDEINQGMDPLNER

SEQ ID NO: 2963420 - protein, 18 aa, Entamoeba invadens
QTFHFPLPSLLTSEYDQA

SEQ ID NO: 2963421 - protein, 17 aa, Entamoeba invadens
QTFKEDLMLGILKGEDI

SEQ ID NO: 2963422 - protein, 25 aa, Entamoeba invadens
QTFKFPWKIAEFVTAGQHLENRENI

SEQ ID NO: 2963423 - protein, 19 aa, Entamoeba invadens
QTFKHLKFVKCAPMWFQFM

SEQ ID NO: 2963424 - protein, 19 aa, Entamoeba invadens
QTGARICIRGKDPKKMGKL

SEQ ID NO: 2963425 - protein, 24 aa, Entamoeba invadens
QTGESFLDILTCEVSSFDFAIGDN

SEQ ID NO: 2963426 - protein, 23 aa, Entamoeba invadens
QTHDPDCRGPLFLVQTREKEMWM

SEQ ID NO: 2963427 - protein, 27 aa, Entamoeba invadens
QTHTNFFLRPCWSPEATQMLLVGAVQK

SEQ ID NO: 2963428 - protein, 18 aa, Entamoeba invadens
QTIDSFRFDILEKKIDII

SEQ ID NO: 2963429 - protein, 18 aa, Entamoeba invadens
QTIEFPSKVRGIGLNCYN

SEQ ID NO: 2963430 - protein, 26 aa, Entamoeba invadens
QTIEIPKSVTLLGFCSFKDCNNLKQV

SEQ ID NO: 2963431 - protein, 33 aa, Entamoeba invadens
QTIFSCKKAYCLSLKRSFELYGVLLELKDFTEK

SEQ ID NO: 2963432 - protein, 21 aa, Entamoeba invadens
QTILFCFDISSKNSFNSIQYW

SEQ ID NO: 2963433 - protein, 22 aa, Entamoeba invadens
QTILKERLTTIQFKIIETPGLW

SEQ ID NO: 2963434 - protein, 24 aa, Entamoeba invadens
QTIPDLCFEGCASLKEINLEHVSE

SEQ ID NO: 2963435 - protein, 27 aa, Entamoeba invadens
QTIRLPCFSLFFLPTIFPAILNIEVLY

SEQ ID NO: 2963436 - protein, 18 aa, Entamoeba invadens
QTISNVLDRTCPKYIHIR

SEQ ID NO: 2963437 - protein, 24 aa, Entamoeba invadens
QTIVPCVVQKAMAKPRIQLNDETV

SEQ ID NO: 2963438 - protein, 23 aa, Entamoeba invadens
QTKECSNCLTPISVTFKSVNVKK

SEQ ID NO: 2963439 - protein, 23 aa, Entamoeba invadens
QTKFRLDLELLFNQRRLLLMRKE

SEQ ID NO: 2963440 - protein, 28 aa, Entamoeba invadens
QTKIDTRCFVCFNMSMYLQHAGIKEEVE

SEQ ID NO: 2963441 - protein, 27 aa, Entamoeba invadens
QTKIREAMKFILKYYNIEGVIIDGFTD

SEQ ID NO: 2963442 - protein, 26 aa, Entamoeba invadens
QTKNGAMKVMFPKTLGKVSKRKGNQT

SEQ ID NO: 2963443 - protein, 24 aa, Entamoeba invadens
QTKRVHLFISEMMIYLLLGQLRIT

SEQ ID NO: 2963444 - protein, 21 aa, Entamoeba invadens
QTLCADCFDFVASHNLHELTD

SEQ ID NO: 2963445 - protein, 18 aa, Entamoeba invadens
QTLCDLTSVVDLDISNNL

SEQ ID NO: 2963446 - protein, 17 aa, Entamoeba invadens
QTLCSLGLAAFKQEQTN

SEQ ID NO: 2963447 - protein, 19 aa, Entamoeba invadens
QTLEARAEISVLMMTPTQI

SEQ ID NO: 2963448 - protein, 19 aa, Entamoeba invadens
QTLIGRLDIYADYFALYHK

SEQ ID NO: 2963449 - protein, 19 aa, Entamoeba invadens
QTLIKVFFNMLPKRIIDIT

SEQ ID NO: 2963450 - protein, 19 aa, Entamoeba invadens
QTLIPRFYGMYRIKPKHGD

SEQ ID NO: 2963451 - protein, 31 aa, Entamoeba invadens
QTLKTKWFPPKVRKLRILWNEIDTVAKNKDN

SEQ ID NO: 2963452 - protein, 25 aa, Entamoeba invadens
QTLMASCFKIFFNCVDKKLVWKARF

SEQ ID NO: 2963453 - protein, 23 aa, Entamoeba invadens
QTLNRLKTLFSMSERKRNILDFY

SEQ ID NO: 2963454 - protein, 18 aa, Entamoeba invadens
QTLQGFYPHIESIAMNCG

SEQ ID NO: 2963455 - protein, 17 aa, Entamoeba invadens
QTLVLSCEPKWIHLKRL

SEQ ID NO: 2963456 - protein, 18 aa, Entamoeba invadens
QTMLKPLPFNGSLEEDEV

SEQ ID NO: 2963457 - protein, 21 aa, Entamoeba invadens
QTMSFHYMWNSFFVDETKKGT

SEQ ID NO: 2963458 - protein, 26 aa, Entamoeba invadens
QTNCKRLREKIGYKILFSLNIEELSQ

SEQ ID NO: 2963459 - protein, 24 aa, Entamoeba invadens
QTNDCDPERSWGYLKDGNECFEQK

SEQ ID NO: 2963460 - protein, 24 aa, Entamoeba invadens
QTNLFEVCLTFTLSGDNRTKILLS

SEQ ID NO: 2963461 - protein, 17 aa, Entamoeba invadens
QTPRRPVTISGTPIQQI

SEQ ID NO: 2963462 - protein, 18 aa, Entamoeba invadens
QTPTLGFCVQRYKDILNF

SEQ ID NO: 2963463 - protein, 21 aa, Entamoeba invadens
QTPYEFGKLLKMVKKIGYENS

SEQ ID NO: 2963464 - protein, 19 aa, Entamoeba invadens
QTQCPKCKQQMCVECFANS

SEQ ID NO: 2963465 - protein, 20 aa, Entamoeba invadens
QTQISPRPVTIGPLHKEKVE

SEQ ID NO: 2963466 - protein, 24 aa, Entamoeba invadens
QTQLHYLLSFAFDGDLFPDVIEPI

SEQ ID NO: 2963467 - protein, 24 aa, Entamoeba invadens
QTQRIPQLLRFVSSLTPQESAVIH

SEQ ID NO: 2963468 - protein, 17 aa, Entamoeba invadens
QTRELGFLEQVRPFLEN

SEQ ID NO: 2963469 - protein, 20 aa, Entamoeba invadens
QTRIDALIVRIMKKEKKMTV

SEQ ID NO: 2963470 - protein, 17 aa, Entamoeba invadens
QTRNGRPSFGKAGNAPA

SEQ ID NO: 2963471 - protein, 19 aa, Entamoeba invadens
QTRVLRLTLGELCNIDPMT

SEQ ID NO: 2963472 - protein, 23 aa, Entamoeba invadens
QTRVPPPVPLKRSVIDQDIAMMD

SEQ ID NO: 2963473 - protein, 21 aa, Entamoeba invadens
QTRYVEYFGELLSRQILFVGR

SEQ ID NO: 2963474 - protein, 19 aa, Entamoeba invadens
QTSGAFRFWNRKDRDSKDI

SEQ ID NO: 2963475 - protein, 17 aa, Entamoeba invadens
QTSKLVFLRKGEKVGQL

SEQ ID NO: 2963476 - protein, 29 aa, Entamoeba invadens
QTSNVLRYPRPVSATSEILFQPSYTHNSM

SEQ ID NO: 2963477 - protein, 22 aa, Entamoeba invadens
QTSRFFKKKGTIAIKENTPPSV

SEQ ID NO: 2963478 - protein, 18 aa, Entamoeba invadens
QTSTAKHKIVFTHHCPTK

SEQ ID NO: 2963479 - protein, 23 aa, Entamoeba invadens
QTTCSLCQVGYYWDGFSCMNNKG

SEQ ID NO: 2963480 - protein, 24 aa, Entamoeba invadens
QTTFGDIMGHYDFVYGNDPIDGSL

SEQ ID NO: 2963481 - protein, 25 aa, Entamoeba invadens
QTTFGDIMGHYDFVYGNDPIDGSLE

SEQ ID NO: 2963482 - protein, 18 aa, Entamoeba invadens
QTTLLKRQVPVLKDLKVI

SEQ ID NO: 2963483 - protein, 23 aa, Entamoeba invadens
QTTLLNGLRIIDLGKSCKQSNER

SEQ ID NO: 2963484 - protein, 20 aa, Entamoeba invadens
QTVCGIKLIPPIPLQEVPPQ

SEQ ID NO: 2963485 - protein, 24 aa, Entamoeba invadens
QTVEMGIKILMTIYRATLQHKTRM

SEQ ID NO: 2963486 - protein, 29 aa, Entamoeba invadens
QTVKCKLCGFSIHKTCVENCFTLCRGTFV

SEQ ID NO: 2963487 - protein, 24 aa, Entamoeba invadens
QTVQVKFAPLFPMNRNTPSDLEKN

SEQ ID NO: 2963488 - protein, 23 aa, Entamoeba invadens
QTVSCGALEEFQCGKCLEKCTFD

SEQ ID NO: 2963489 - protein, 19 aa, Entamoeba invadens
QTVYHYAWSIADDISAGKR

SEQ ID NO: 2963490 - protein, 23 aa, Entamoeba invadens
QTYECVICMSPIFKFQRIWPCPR

SEQ ID NO: 2963491 - protein, 22 aa, Entamoeba invadens
QVAMMHVVDFIPILGQARSVSI

SEQ ID NO: 2963492 - protein, 28 aa, Entamoeba invadens
QVAPCNIIPFRAKHCGAQVAFINCTKTP

SEQ ID NO: 2963493 - protein, 17 aa, Entamoeba invadens
QVASLFVDYESPDDQTK

SEQ ID NO: 2963494 - protein, 19 aa, Entamoeba invadens
QVCEQCFMLLLLNKYAEIE

SEQ ID NO: 2963495 - protein, 21 aa, Entamoeba invadens
QVCKKGAHLLIIFQSKKKVKN

SEQ ID NO: 2963496 - protein, 24 aa, Entamoeba invadens
QVDCSKCLKEIITDFKIETINNFN

SEQ ID NO: 2963497 - protein, 24 aa, Entamoeba invadens
QVDKCTVETFYLLRKIVPPYKGLA

SEQ ID NO: 2963498 - protein, 19 aa, Entamoeba invadens
QVDKLKLVLIAFKKQFSDE

SEQ ID NO: 2963499 - protein, 26 aa, Entamoeba invadens
QVDLERFSFLLSVFGEFVTKKELFQK

SEQ ID NO: 2963500 - protein, 21 aa, Entamoeba invadens
QVEASLRLFVENGKVKNIEVF

SEQ ID NO: 2963501 - protein, 24 aa, Entamoeba invadens
QVETARSGLWLNYNSVLKSIKADK

SEQ ID NO: 2963502 - protein, 17 aa, Entamoeba invadens
QVFLKAYITRIASTLEG

SEQ ID NO: 2963503 - protein, 21 aa, Entamoeba invadens
QVFNACFFFNGPEKASGTIPP

SEQ ID NO: 2963504 - protein, 18 aa, Entamoeba invadens
QVFSRGQLYVALSRSKDK

SEQ ID NO: 2963505 - protein, 19 aa, Entamoeba invadens
QVFSSCGIKQFVFPNIEIY

SEQ ID NO: 2963506 - protein, 22 aa, Entamoeba invadens
QVGEIYSGTVIGKRMNKMLVRL

SEQ ID NO: 2963507 - protein, 22 aa, Entamoeba invadens
QVGICDLDICGPSIPQMFGQVG

SEQ ID NO: 2963508 - protein, 20 aa, Entamoeba invadens
QVGKVVKRCVVEEEPEAEEV

SEQ ID NO: 2963509 - protein, 27 aa, Entamoeba invadens
QVGLLCLEKRYFRCYNYSTKQYDTADV

SEQ ID NO: 2963510 - protein, 21 aa, Entamoeba invadens
QVGSVYFIYCRQFKEIKSSIH

SEQ ID NO: 2963511 - protein, 18 aa, Entamoeba invadens
QVHIQWKSVSTFPEEYKG

SEQ ID NO: 2963512 - protein, 20 aa, Entamoeba invadens
QVICLCLIAVWFSQHRKASS

SEQ ID NO: 2963513 - protein, 22 aa, Entamoeba invadens
QVIENFCFENCFSLKHINIPMS

SEQ ID NO: 2963514 - protein, 26 aa, Entamoeba invadens
QVIKIAKMCFELKGFNIAYILFSVLV

SEQ ID NO: 2963515 - protein, 18 aa, Entamoeba invadens
QVIKKGCFDMCSSLTKIV

SEQ ID NO: 2963516 - protein, 24 aa, Entamoeba invadens
QVIKTGRVNINWKCTFSNCCLLKE

SEQ ID NO: 2963517 - protein, 24 aa, Entamoeba invadens
QVIKTGRVNINWKCTFSNCCLPKE

SEQ ID NO: 2963518 - protein, 17 aa, Entamoeba invadens
QVILRFIVQSGHSTLPK

SEQ ID NO: 2963519 - protein, 36 aa, Entamoeba invadens
QVIPCPCELCRRGFRANQKMTWNLLLRVIFTSLHSL

SEQ ID NO: 2963520 - protein, 17 aa, Entamoeba invadens
QVIPEMGEDEMLKIFNE

SEQ ID NO: 2963521 - protein, 18 aa, Entamoeba invadens
QVIPKRKREFIIVGNKIA

SEQ ID NO: 2963522 - protein, 17 aa, Entamoeba invadens
QVIPSIEEKSCFENLIY

SEQ ID NO: 2963523 - protein, 24 aa, Entamoeba invadens
QVIQARLVVIMKFKRVLKFSQLIA

SEQ ID NO: 2963524 - protein, 25 aa, Entamoeba invadens
QVIQFNLYNSFGWSLLNEVEGGYFK

SEQ ID NO: 2963525 - protein, 37 aa, Entamoeba invadens
QVIRKRLVSGLVLEIPKIKATRIVEKIGLSYGMNETQ

SEQ ID NO: 2963526 - protein, 23 aa, Entamoeba invadens
QVKCIRSPTLVFFAKDKLLTDEF

SEQ ID NO: 2963527 - protein, 21 aa, Entamoeba invadens
QVKCVDCKLFIADITLPDGIY

SEQ ID NO: 2963528 - protein, 19 aa, Entamoeba invadens
QVKEVLPTFPAGGANTYLR

SEQ ID NO: 2963529 - protein, 21 aa, Entamoeba invadens
QVKTPPSVIGMRLESLNRMPR

SEQ ID NO: 2963530 - protein, 19 aa, Entamoeba invadens
QVLAFLFFQIPEFREDLLE

SEQ ID NO: 2963531 - protein, 33 aa, Entamoeba invadens
QVLAGGCWHEEFLKMSCVIIGEYAQCLGNLAQH

SEQ ID NO: 2963532 - protein, 24 aa, Entamoeba invadens
QVLEPQSFVTLCRGQKSILLGDLQ

SEQ ID NO: 2963533 - protein, 18 aa, Entamoeba invadens
QVLESIEAYLWKGEETPT

SEQ ID NO: 2963534 - protein, 20 aa, Entamoeba invadens
QVLGNKWKLISTFLPGRAPN

SEQ ID NO: 2963535 - protein, 24 aa, Entamoeba invadens
QVLNRITFTSALAYLRKISSPVEG

SEQ ID NO: 2963536 - protein, 25 aa, Entamoeba invadens
QVLPALRWYFFLFFSQNVETLKLGL

SEQ ID NO: 2963537 - protein, 17 aa, Entamoeba invadens
QVLSDVMKEIPIEDVNI

SEQ ID NO: 2963538 - protein, 24 aa, Entamoeba invadens
QVLSRLSYISALGMMTRLNSHFEK

SEQ ID NO: 2963539 - protein, 26 aa, Entamoeba invadens
QVLYLRPRLSSMHTMTCFMTIHCTTR

SEQ ID NO: 2963540 - protein, 18 aa, Entamoeba invadens
QVMSRLETVTARLEKIEG

SEQ ID NO: 2963541 - protein, 17 aa, Entamoeba invadens
QVNDWLMKKECDCYAHL

SEQ ID NO: 2963542 - protein, 17 aa, Entamoeba invadens
QVNGLNFVCRAHQLIQE

SEQ ID NO: 2963543 - protein, 18 aa, Entamoeba invadens
QVNTGVFSMKGKLETTTQ

SEQ ID NO: 2963544 - protein, 17 aa, Entamoeba invadens
QVPDGFKQSLLPTNQKY

SEQ ID NO: 2963545 - protein, 22 aa, Entamoeba invadens
QVPEPLFIYEIIIEPYDYKHDD

SEQ ID NO: 2963546 - protein, 35 aa, Entamoeba invadens
QVPGSVPMLFIKVIGRLTIDGENPLLFTESFILTQ

SEQ ID NO: 2963547 - protein, 24 aa, Entamoeba invadens
QVPKEIYRLVDWIYKKYSVGCFER

SEQ ID NO: 2963548 - protein, 17 aa, Entamoeba invadens
QVPRVKIFAGKAATSYE

SEQ ID NO: 2963549 - protein, 22 aa, Entamoeba invadens
QVQCILQVYSVLHIFLEQTNPN

SEQ ID NO: 2963550 - protein, 19 aa, Entamoeba invadens
QVQQPFVLQGMPFPQTMNY

SEQ ID NO: 2963551 - protein, 21 aa, Entamoeba invadens
QVRDFLCNSSRVGFKTRVPWT

SEQ ID NO: 2963552 - protein, 17 aa, Entamoeba invadens
QVRDFLQEFSIGEITLL

SEQ ID NO: 2963553 - protein, 17 aa, Entamoeba invadens
QVRFEIPERVKVFELKN

SEQ ID NO: 2963554 - protein, 25 aa, Entamoeba invadens
QVRIKEVYGGWTFLQQEFEYDFEKK

SEQ ID NO: 2963555 - protein, 21 aa, Entamoeba invadens
QVRKCFYRPGYKRAANGTANA

SEQ ID NO: 2963556 - protein, 18 aa, Entamoeba invadens
QVSCMDKSRLDYIFHLKR

SEQ ID NO: 2963557 - protein, 23 aa, Entamoeba invadens
QVSGGGRIKGDWKDKMSIDDCEI

SEQ ID NO: 2963558 - protein, 26 aa, Entamoeba invadens
QVSKVCLSALCSLKVNPVFMTESSVI

SEQ ID NO: 2963559 - protein, 28 aa, Entamoeba invadens
QVSPFLKEQFKQFVFFTVKTQYETNVQL

SEQ ID NO: 2963560 - protein, 25 aa, Entamoeba invadens
QVTADVLAAVSLRIPQIAKEIFEAI

SEQ ID NO: 2963561 - protein, 25 aa, Entamoeba invadens
QVTCPECQNTFCFKCREMWHKDFTC

SEQ ID NO: 2963562 - protein, 20 aa, Entamoeba invadens
QVTCVQFFKSGVCVAFSDGR

SEQ ID NO: 2963563 - protein, 17 aa, Entamoeba invadens
QVTFYFLLLSGFLEKQY

SEQ ID NO: 2963564 - protein, 19 aa, Entamoeba invadens
QVTSLPTFVFFQDQKVAKK

SEQ ID NO: 2963565 - protein, 24 aa, Entamoeba invadens
QVVEKRPGDVPAIYAECKKAEKEF

SEQ ID NO: 2963566 - protein, 22 aa, Entamoeba invadens
QVVERLEIVISRIEEYIKTPLA

SEQ ID NO: 2963567 - protein, 23 aa, Entamoeba invadens
QVVFKELRKMAADSAKLPKLSAL

SEQ ID NO: 2963568 - protein, 22 aa, Entamoeba invadens
QVVIHFKVSFQIYLTNSNKNFV

SEQ ID NO: 2963569 - protein, 17 aa, Entamoeba invadens
QVVKDLYLLLGSADFLG

SEQ ID NO: 2963570 - protein, 18 aa, Entamoeba invadens
QVVKSLSHNCFKDTNVTK

SEQ ID NO: 2963571 - protein, 17 aa, Entamoeba invadens
QVVNSDFLQLFERAAEL

SEQ ID NO: 2963572 - protein, 21 aa, Entamoeba invadens
QVVPRGKFVIKSNITELLQLG

SEQ ID NO: 2963573 - protein, 23 aa, Entamoeba invadens
QVVQIAKTIFCVCKGKSKKCSLI

SEQ ID NO: 2963574 - protein, 19 aa, Entamoeba invadens
QVVVKEFLIFILSQKNEDL

SEQ ID NO: 2963575 - protein, 25 aa, Entamoeba invadens
QVVYNLCWWIYTYGYLIEGIFRVTS

SEQ ID NO: 2963576 - protein, 19 aa, Entamoeba invadens
QVWAPSFIISRGIALHKMI

SEQ ID NO: 2963577 - protein, 27 aa, Entamoeba invadens
QVYEAKGGMCGIVYPYTWISNDVTVLV

SEQ ID NO: 2963578 - protein, 25 aa, Entamoeba invadens
QVYEIDFPISFGVFQKFLKNGVQCK

SEQ ID NO: 2963579 - protein, 17 aa, Entamoeba invadens
QVYGLLVCFFARQLSVH

SEQ ID NO: 2963580 - protein, 28 aa, Entamoeba invadens
QVYPTLPYEYAMRALNKFKLDDFNLSRI

SEQ ID NO: 2963581 - protein, 18 aa, Entamoeba invadens
QWATFKLTSPYMPYEKES

SEQ ID NO: 2963582 - protein, 21 aa, Entamoeba invadens
QWATQLVDLFMLARRDETVKE

SEQ ID NO: 2963583 - protein, 19 aa, Entamoeba invadens
QWCDLCIDNDITMTQIKIT

SEQ ID NO: 2963584 - protein, 22 aa, Entamoeba invadens
QWDERPCHVMFVQTFPKHVEPN

SEQ ID NO: 2963585 - protein, 19 aa, Entamoeba invadens
QWDSLLLKREKLRQIDDSN

SEQ ID NO: 2963586 - protein, 28 aa, Entamoeba invadens
QWFQYTYLYVCLKRSEGGVGYDDLNSLI

SEQ ID NO: 2963587 - protein, 22 aa, Entamoeba invadens
QWHRKEHFEAFQSVAQCTYNQT

SEQ ID NO: 2963588 - protein, 25 aa, Entamoeba invadens
QWIFDCVNENFLLPCAEYEIGKKLP

SEQ ID NO: 2963589 - protein, 19 aa, Entamoeba invadens
QWISKAVKIVSDFIPTLPP

SEQ ID NO: 2963590 - protein, 29 aa, Entamoeba invadens
QWLSLTYYYICCLRSPKMYSVDDKDIEND

SEQ ID NO: 2963591 - protein, 18 aa, Entamoeba invadens
QWLVFPRFFIRSCLSRIP

SEQ ID NO: 2963592 - protein, 27 aa, Entamoeba invadens
QWMSCYKCQSFFCWVCMQITNDHQHKP

SEQ ID NO: 2963593 - protein, 22 aa, Entamoeba invadens
QWSDNFKKFFGDCCQSDVEKRP

SEQ ID NO: 2963594 - protein, 20 aa, Entamoeba invadens
QWTKEDFIKTAFGEKTQPAA

SEQ ID NO: 2963595 - protein, 21 aa, Entamoeba invadens
QWVEIKGHQFVTGKSPDEIVN

SEQ ID NO: 2963596 - protein, 25 aa, Entamoeba invadens
QWVVKREEFNWSEVTRCVLSAVGNW

SEQ ID NO: 2963597 - protein, 22 aa, Entamoeba invadens
QWYCSSVCRILLLNSSDQFEVG

SEQ ID NO: 2963598 - protein, 26 aa, Entamoeba invadens
QYAIHRIRAFYMRKVKYCSQSYHDRL

SEQ ID NO: 2963599 - protein, 18 aa, Entamoeba invadens
QYCCKTRTNNICESFHSV

SEQ ID NO: 2963600 - protein, 18 aa, Entamoeba invadens
QYCRCTQKVYKTICQTGR

SEQ ID NO: 2963601 - protein, 25 aa, Entamoeba invadens
QYDDVLRINCKLVRVADECPECSKK

SEQ ID NO: 2963602 - protein, 18 aa, Entamoeba invadens
QYDFCYIPPVVGNYAIAI

SEQ ID NO: 2963603 - protein, 24 aa, Entamoeba invadens
QYDGACYEVAPPMYIYVKPTVEED

SEQ ID NO: 2963604 - protein, 25 aa, Entamoeba invadens
QYDIIHLFISLKIKNFVKAFGQVLL

SEQ ID NO: 2963605 - protein, 18 aa, Entamoeba invadens
QYDLKGHGFVGLENLGCT

SEQ ID NO: 2963606 - protein, 28 aa, Entamoeba invadens
QYDSVPSCKLDFVLRLLKSIHKLSKMKV

SEQ ID NO: 2963607 - protein, 17 aa, Entamoeba invadens
QYEEKWFLISFNENVKV

SEQ ID NO: 2963608 - protein, 24 aa, Entamoeba invadens
QYEIKRLGLVKVVGKESVKLLNRS

SEQ ID NO: 2963609 - protein, 24 aa, Entamoeba invadens
QYEKGNMMKFLFDVADDKNLNIIT

SEQ ID NO: 2963610 - protein, 25 aa, Entamoeba invadens
QYELPYHILKMFHFLFEVGYATTGI

SEQ ID NO: 2963611 - protein, 29 aa, Entamoeba invadens
QYESFSGAFMRLKYVLRVNILSKSPSSPV

SEQ ID NO: 2963612 - protein, 24 aa, Entamoeba invadens
QYFFKLRDPLMWGLQRVFLEMTSI

SEQ ID NO: 2963613 - protein, 18 aa, Entamoeba invadens
QYFFYEFTSLTSIDIPSN

SEQ ID NO: 2963614 - protein, 24 aa, Entamoeba invadens
QYFRGIELFELFLWNTSKEKCQAL

SEQ ID NO: 2963615 - protein, 28 aa, Entamoeba invadens
QYFYIYSCLSYLAMKKKYSFIILNKKRT

SEQ ID NO: 2963616 - protein, 25 aa, Entamoeba invadens
QYGDIPLMFCSALSGDGVKEVFDFA

SEQ ID NO: 2963617 - protein, 24 aa, Entamoeba invadens
QYGDIPLMFCSALSSDGVKEVFDF

SEQ ID NO: 2963618 - protein, 18 aa, Entamoeba invadens
QYGIPKGIFFSMPVICYG

SEQ ID NO: 2963619 - protein, 18 aa, Entamoeba invadens
QYHPAEFARQISYLQNNI

SEQ ID NO: 2963620 - protein, 25 aa, Entamoeba invadens
QYIECGLCARYAQILSTPFDNKYLN

SEQ ID NO: 2963621 - protein, 23 aa, Entamoeba invadens
QYIEVTELYGLVELSHGQLLDIV

SEQ ID NO: 2963622 - protein, 25 aa, Entamoeba invadens
QYIKSSAIFFLLSVIFPFKYESPVI

SEQ ID NO: 2963623 - protein, 18 aa, Entamoeba invadens
QYIQLVVTLILKRLIMKE

SEQ ID NO: 2963624 - protein, 23 aa, Entamoeba invadens
QYKAAKIEAADEIFRLVQNLFAR

SEQ ID NO: 2963625 - protein, 26 aa, Entamoeba invadens
QYKEDFAHILFEWIPYGIKTSTNTQQ

SEQ ID NO: 2963626 - protein, 25 aa, Entamoeba invadens
QYKERIKGKMFDWVENIAKSDYKQT

SEQ ID NO: 2963627 - protein, 18 aa, Entamoeba invadens
QYKESGFAWLDTEIAEAK

SEQ ID NO: 2963628 - protein, 21 aa, Entamoeba invadens
QYKGKGAVISTPFVTVYELTK

SEQ ID NO: 2963629 - protein, 20 aa, Entamoeba invadens
QYKSAAYTLWALKNIVDFYK

SEQ ID NO: 2963630 - protein, 18 aa, Entamoeba invadens
QYKSGIMRLKEDLSQLEI

SEQ ID NO: 2963631 - protein, 22 aa, Entamoeba invadens
QYKTAELLLRLKANASHLNRTG

SEQ ID NO: 2963632 - protein, 24 aa, Entamoeba invadens
QYLEERHLLELGYKLYPTSTYANA

SEQ ID NO: 2963633 - protein, 25 aa, Entamoeba invadens
QYLNDFYKIKWFNPIQPILITKQPE

SEQ ID NO: 2963634 - protein, 22 aa, Entamoeba invadens
QYLQRLEIAVSINCQLSTIVRA

SEQ ID NO: 2963635 - protein, 20 aa, Entamoeba invadens
QYMLMEWSFIAIIYSMKGSK

SEQ ID NO: 2963636 - protein, 28 aa, Entamoeba invadens
QYMPRAICPNCFMDLQFIQDALTVTTLY

SEQ ID NO: 2963637 - protein, 26 aa, Entamoeba invadens
QYMTELATEFILFISSEVADVSNNSS

SEQ ID NO: 2963638 - protein, 19 aa, Entamoeba invadens
QYMVRMVAVEKEFNRKYNV

SEQ ID NO: 2963639 - protein, 18 aa, Entamoeba invadens
QYNLVPIVAPKRDRVPSR

SEQ ID NO: 2963640 - protein, 17 aa, Entamoeba invadens
QYPSMLIFVDTYNQMKQ

SEQ ID NO: 2963641 - protein, 19 aa, Entamoeba invadens
QYQAIRLLHILKRSDRISL

SEQ ID NO: 2963642 - protein, 18 aa, Entamoeba invadens
QYQFPINLPDGFYDVKIL

SEQ ID NO: 2963643 - protein, 18 aa, Entamoeba invadens
QYQVWYRVSFFGMHGVGI

SEQ ID NO: 2963644 - protein, 25 aa, Entamoeba invadens
QYRDTPTFRRSVIGFFVKVVSGKDE

SEQ ID NO: 2963645 - protein, 18 aa, Entamoeba invadens
QYRKCFECDKTRIDELRR

SEQ ID NO: 2963646 - protein, 24 aa, Entamoeba invadens
QYRNEVFEIVDFVFETLAKREITT

SEQ ID NO: 2963647 - protein, 20 aa, Entamoeba invadens
QYSIAKFVIKSGGLFDFTNL

SEQ ID NO: 2963648 - protein, 23 aa, Entamoeba invadens
QYSKEILPILVALSADTVRLFPD

SEQ ID NO: 2963649 - protein, 24 aa, Entamoeba invadens
QYSNTRFLYIATISNMVFDNLNEL

SEQ ID NO: 2963650 - protein, 34 aa, Entamoeba invadens
QYVFEEFEVPSLLFGRPSVMAMFASGRPSGIVVM

SEQ ID NO: 2963651 - protein, 23 aa, Entamoeba invadens
QYVQLKLCFEMKETVESEKEYLK

SEQ ID NO: 2963652 - protein, 20 aa, Entamoeba invadens
QYVYFPFPFCVIDPAQRTVQ

SEQ ID NO: 2963653 - protein, 22 aa, Entamoeba invadens
QYWYWYPFTLALSLSFAPTTII

SEQ ID NO: 2963654 - protein, 20 aa, Entamoeba invadens
QYYCMVRGWMNLEFEEKTDD

SEQ ID NO: 2963655 - protein, 23 aa, Entamoeba invadens
QYYIKGDGFVMVYSIDNKNSFHA

SEQ ID NO: 2963656 - protein, 23 aa, Entamoeba invadens
RAAELIKTAIKWVAVEDKVELFD

SEQ ID NO: 2963657 - protein, 17 aa, Entamoeba invadens
RAAESKAAGIAQPQIGK

SEQ ID NO: 2963658 - protein, 18 aa, Entamoeba invadens
RAAIHAALCDNFDTPTAM

SEQ ID NO: 2963659 - protein, 20 aa, Entamoeba invadens
RAAKKRPGYDRIYTAGEKEY

SEQ ID NO: 2963660 - protein, 20 aa, Entamoeba invadens
RACGVSRDVIAVALLGDKGT

SEQ ID NO: 2963661 - protein, 24 aa, Entamoeba invadens
RACLEMYREIGFNLVVEKLVEQSE

SEQ ID NO: 2963662 - protein, 18 aa, Entamoeba invadens
RADCTIMKMITARFQDQI

SEQ ID NO: 2963663 - protein, 20 aa, Entamoeba invadens
RADDYYKMFIDGGTNHALKQ

SEQ ID NO: 2963664 - protein, 25 aa, Entamoeba invadens
RADFYKWISCAKFEVLYDSERPIPI

SEQ ID NO: 2963665 - protein, 23 aa, Entamoeba invadens
RADLKKKIETAGLVAKNAAIQEL

SEQ ID NO: 2963666 - protein, 21 aa, Entamoeba invadens
RADVMSLVRALGYAPSPEEED

SEQ ID NO: 2963667 - protein, 21 aa, Entamoeba invadens
RAECNPFLLFCKDHRENVREK

SEQ ID NO: 2963668 - protein, 17 aa, Entamoeba invadens
RAEEGTFDWVQENTSNI

SEQ ID NO: 2963669 - protein, 21 aa, Entamoeba invadens
RAEGFSPMNGWVWDYDPEMYI

SEQ ID NO: 2963670 - protein, 18 aa, Entamoeba invadens
RAEILEMVGDLPFAEIKP

SEQ ID NO: 2963671 - protein, 25 aa, Entamoeba invadens
RAEKFSVFLGLRLLKTEDVLTEAFV

SEQ ID NO: 2963672 - protein, 21 aa, Entamoeba invadens
RAEKLWRRFVEEKKGKWSELK

SEQ ID NO: 2963673 - protein, 21 aa, Entamoeba invadens
RAEKVIIPFVSTHSGELPLTL

SEQ ID NO: 2963674 - protein, 20 aa, Entamoeba invadens
RAELLRKRAQDLSTSFEKLF

SEQ ID NO: 2963675 - protein, 17 aa, Entamoeba invadens
RAELLRKRHRTYQLYLR

SEQ ID NO: 2963676 - protein, 26 aa, Entamoeba invadens
RAELLRRRAQDLSTLFEKLFWNEEKG

SEQ ID NO: 2963677 - protein, 21 aa, Entamoeba invadens
RAERAYLCFHYSSYQKGVGSI

SEQ ID NO: 2963678 - protein, 27 aa, Entamoeba invadens
RAESMKFPWYSAVSYFKAAFVSENQEA

SEQ ID NO: 2963679 - protein, 21 aa, Entamoeba invadens
RAESMNILIEELRKVGYVFES

SEQ ID NO: 2963680 - protein, 28 aa, Entamoeba invadens
RAEVKDIYSTPCIPFIGTYLTDYTFLDD

SEQ ID NO: 2963681 - protein, 21 aa, Entamoeba invadens
RAEVTRKNFLSAINQTIASLK

SEQ ID NO: 2963682 - protein, 18 aa, Entamoeba invadens
RAFHPTDLLEIIKQKLQE

SEQ ID NO: 2963683 - protein, 17 aa, Entamoeba invadens
RAFLDFIQKCLRYDPES

SEQ ID NO: 2963684 - protein, 22 aa, Entamoeba invadens
RAFPEIYKKLTSAYPDVENHNK

SEQ ID NO: 2963685 - protein, 21 aa, Entamoeba invadens
RAGALLGIGTCCSGVKSDVDF

SEQ ID NO: 2963686 - protein, 23 aa, Entamoeba invadens
RAGDDLRDITGFFVDNKGIIRAD

SEQ ID NO: 2963687 - protein, 27 aa, Entamoeba invadens
RAGKGELPFCLEMMYKDGWERSCDVCL

SEQ ID NO: 2963688 - protein, 28 aa, Entamoeba invadens
RAGMGRCQGSYCTPRVMEILSKRLGIPM

SEQ ID NO: 2963689 - protein, 25 aa, Entamoeba invadens
RAGRTQSGVCYRMFTESTYNRDLLD

SEQ ID NO: 2963690 - protein, 20 aa, Entamoeba invadens
RAGSASVIYAAQKMHIPVIV

SEQ ID NO: 2963691 - protein, 18 aa, Entamoeba invadens
RAGSMSFSIENPHAQKKK

SEQ ID NO: 2963692 - protein, 24 aa, Entamoeba invadens
RAGTDFFNRFDLFNASYKIGGEDL

SEQ ID NO: 2963693 - protein, 25 aa, Entamoeba invadens
RAGTFCGSCLQAGGKHPKKYYLDDV

SEQ ID NO: 2963694 - protein, 19 aa, Entamoeba invadens
RAHCAHCPTGSFFPSPGFK

SEQ ID NO: 2963695 - protein, 23 aa, Entamoeba invadens
RAHSTRRALCVASSNSATEVFAN

SEQ ID NO: 2963696 - protein, 24 aa, Entamoeba invadens
RAIADCGIDFLVHAVEAYVSVMAD

SEQ ID NO: 2963697 - protein, 22 aa, Entamoeba invadens
RAIDALRPFSYLMHAKLSSKQC

SEQ ID NO: 2963698 - protein, 19 aa, Entamoeba invadens
RAIEVKTLHSFQKIKESTG

SEQ ID NO: 2963699 - protein, 26 aa, Entamoeba invadens
RAISPKEEYILAAFFFPITRDGDLFE

SEQ ID NO: 2963700 - protein, 19 aa, Entamoeba invadens
RAISTAMLIYHFLWEEGRI

SEQ ID NO: 2963701 - protein, 19 aa, Entamoeba invadens
RAKALQIIIEILKVEKQSS

SEQ ID NO: 2963702 - protein, 23 aa, Entamoeba invadens
RAKELRALLMISKKLKQKRLEAG

SEQ ID NO: 2963703 - protein, 24 aa, Entamoeba invadens
RAKNSAPCVIFFDELDALAPKRSE

SEQ ID NO: 2963704 - protein, 21 aa, Entamoeba invadens
RAKRIRFISKFAVGVQTIPIA

SEQ ID NO: 2963705 - protein, 19 aa, Entamoeba invadens
RAKYMYGCYDQHAITHCTT

SEQ ID NO: 2963706 - protein, 24 aa, Entamoeba invadens
RALANFSGTFGFYLVGQIEKTEKR

SEQ ID NO: 2963707 - protein, 19 aa, Entamoeba invadens
RALDCGALYSGAHWEYSGN

SEQ ID NO: 2963708 - protein, 20 aa, Entamoeba invadens
RALDIVETYGQVGISLPSVN

SEQ ID NO: 2963709 - protein, 18 aa, Entamoeba invadens
RALEELYGLGAFNQNGEL

SEQ ID NO: 2963710 - protein, 19 aa, Entamoeba invadens
RALEILGFGKYRPDVISAN

SEQ ID NO: 2963711 - protein, 22 aa, Entamoeba invadens
RALEIPNCCFDDFLVYDKLLQN

SEQ ID NO: 2963712 - protein, 23 aa, Entamoeba invadens
RALEVKWRFEISTQRPLIQNTLE

SEQ ID NO: 2963713 - protein, 23 aa, Entamoeba invadens
RALEVRKKLTWSATNFVRTKDLD

SEQ ID NO: 2963714 - protein, 20 aa, Entamoeba invadens
RALILPLLFFEGSVPPPTLR

SEQ ID NO: 2963715 - protein, 20 aa, Entamoeba invadens
RALKCNKFFTKLKVEQTPLN

SEQ ID NO: 2963716 - protein, 18 aa, Entamoeba invadens
RALKDFDYHPIKKYEAKV

SEQ ID NO: 2963717 - protein, 26 aa, Entamoeba invadens
RALNTLEQWAKLDFSQERFFGKQEEL

SEQ ID NO: 2963718 - protein, 26 aa, Entamoeba invadens
RALPYEIEAALSILLQGNFEKLPLKV

SEQ ID NO: 2963719 - protein, 17 aa, Entamoeba invadens
RALQKLRIRDFPKRVEF

SEQ ID NO: 2963720 - protein, 21 aa, Entamoeba invadens
RALSATGVFCAPEKVAAFIHE

SEQ ID NO: 2963721 - protein, 21 aa, Entamoeba invadens
RALSEYCCSNAHSYKIVSHSS

SEQ ID NO: 2963722 - protein, 19 aa, Entamoeba invadens
RALSFPQTDIFLICFSVVS

SEQ ID NO: 2963723 - protein, 17 aa, Entamoeba invadens
RALYDMIDIAALNAYKT

SEQ ID NO: 2963724 - protein, 21 aa, Entamoeba invadens
RAMCSLLKRNECADAVMRSGY

SEQ ID NO: 2963725 - protein, 17 aa, Entamoeba invadens
RAMKSIFAELKKKEKYV

SEQ ID NO: 2963726 - protein, 25 aa, Entamoeba invadens
RAMSARVALEIGIGSLHITVVNKTI

SEQ ID NO: 2963727 - protein, 19 aa, Entamoeba invadens
RAMVLHKSILMEGSPGNQS

SEQ ID NO: 2963728 - protein, 17 aa, Entamoeba invadens
RANCVSGGQGLQNKENK

SEQ ID NO: 2963729 - protein, 18 aa, Entamoeba invadens
RANIGRLGVDVIDQNREE

SEQ ID NO: 2963730 - protein, 18 aa, Entamoeba invadens
RANLKIETLFAMLQEALG

SEQ ID NO: 2963731 - protein, 24 aa, Entamoeba invadens
RANRIGFLCFGYCYSLEEVIVPST

SEQ ID NO: 2963732 - protein, 20 aa, Entamoeba invadens
RAPEILFKMPSYTSAVDMWS

SEQ ID NO: 2963733 - protein, 22 aa, Entamoeba invadens
RAPEVILGLHWGCPVDVWSHGC

SEQ ID NO: 2963734 - protein, 18 aa, Entamoeba invadens
RAPHDPWRAFKCSCGGII

SEQ ID NO: 2963735 - protein, 25 aa, Entamoeba invadens
RAPKSVCTLKAMLLANDLIKKTGAL

SEQ ID NO: 2963736 - protein, 24 aa, Entamoeba invadens
RAPNVCKMLSRLDAISHWIGTTIL

SEQ ID NO: 2963737 - protein, 30 aa, Entamoeba invadens
RAQESKELYEFFMPFAKAMLEKVVTLHMDC

SEQ ID NO: 2963738 - protein, 18 aa, Entamoeba invadens
RAQQAMRIAEEYENLPAN

SEQ ID NO: 2963739 - protein, 17 aa, Entamoeba invadens
RARCHEGIVRDYRVNGT

SEQ ID NO: 2963740 - protein, 22 aa, Entamoeba invadens
RAREILKYGIDHVGKLSAALLY

SEQ ID NO: 2963741 - protein, 17 aa, Entamoeba invadens
RAREITNDSIVIVPKED

SEQ ID NO: 2963742 - protein, 17 aa, Entamoeba invadens
RARNHIRDTVLKKHEDI

SEQ ID NO: 2963743 - protein, 23 aa, Entamoeba invadens
RARSICFEELLDLLDVYETSVNV

SEQ ID NO: 2963744 - protein, 19 aa, Entamoeba invadens
RARVLEVLKKCAAKEHAKT

SEQ ID NO: 2963745 - protein, 17 aa, Entamoeba invadens
RASECEEMLFVRNAVVQ

SEQ ID NO: 2963746 - protein, 20 aa, Entamoeba invadens
RASNMSFGGIPLHSIGNQII

SEQ ID NO: 2963747 - protein, 17 aa, Entamoeba invadens
RASRSCESCVTNAIVYT

SEQ ID NO: 2963748 - protein, 24 aa, Entamoeba invadens
RATAEQVLGMNFFKSEPTPLLPWQ

SEQ ID NO: 2963749 - protein, 17 aa, Entamoeba invadens
RATAIQHRKHIKALFKK

SEQ ID NO: 2963750 - protein, 17 aa, Entamoeba invadens
RATAKECLQHEWFSDVT

SEQ ID NO: 2963751 - protein, 17 aa, Entamoeba invadens
RATCPVELCHWYFTSIE

SEQ ID NO: 2963752 - protein, 19 aa, Entamoeba invadens
RATELKTRVVQFVNQTTLF

SEQ ID NO: 2963753 - protein, 19 aa, Entamoeba invadens
RATFPFKISNDCIMENVHL

SEQ ID NO: 2963754 - protein, 18 aa, Entamoeba invadens
RATKCYKIVLDCSNTVKG

SEQ ID NO: 2963755 - protein, 24 aa, Entamoeba invadens
RATLKGESGVTCFGTIAKSNGIVI

SEQ ID NO: 2963756 - protein, 19 aa, Entamoeba invadens
RATSVYVISKVIKFYPDYF

SEQ ID NO: 2963757 - protein, 26 aa, Entamoeba invadens
RATSYFPFSGVHGVFLVYKFDDEMSF

SEQ ID NO: 2963758 - protein, 20 aa, Entamoeba invadens
RATTLFCATIFREFKDKNGR

SEQ ID NO: 2963759 - protein, 20 aa, Entamoeba invadens
RATYLLPMVYNLWYKYVKLE

SEQ ID NO: 2963760 - protein, 19 aa, Entamoeba invadens
RAVEITRWMFSTLRLDVSL

SEQ ID NO: 2963761 - protein, 21 aa, Entamoeba invadens
RAVKALEEFNNLDAFFMKRNG

SEQ ID NO: 2963762 - protein, 19 aa, Entamoeba invadens
RAVKWKRMLETWKQNGSIP

SEQ ID NO: 2963763 - protein, 24 aa, Entamoeba invadens
RAVPKKREGGLFLKATSKDDLIKS

SEQ ID NO: 2963764 - protein, 19 aa, Entamoeba invadens
RAVVDKAVFCYLGCCAEKE

SEQ ID NO: 2963765 - protein, 29 aa, Entamoeba invadens
RAYRMFRKDNKVFGWLFIRVLSLSDHFPY

SEQ ID NO: 2963766 - protein, 17 aa, Entamoeba invadens
RAYVAAVKWLNTHYSVN

SEQ ID NO: 2963767 - protein, 22 aa, Entamoeba invadens
RCAACQVTNFLMCDGDIGKCIK

SEQ ID NO: 2963768 - protein, 18 aa, Entamoeba invadens
RCAYERKIIELGGVVASK

SEQ ID NO: 2963769 - protein, 19 aa, Entamoeba invadens
RCCFAVCSSLSSVTIPTNV

SEQ ID NO: 2963770 - protein, 18 aa, Entamoeba invadens
RCCGVERKAGLPIPTLDE

SEQ ID NO: 2963771 - protein, 18 aa, Entamoeba invadens
RCDFFKQYFSMPSQEKLE

SEQ ID NO: 2963772 - protein, 25 aa, Entamoeba invadens
RCDLCGMTAHTNCLRRVNLDCKSFE

SEQ ID NO: 2963773 - protein, 20 aa, Entamoeba invadens
RCDLSITILGKWLVVLYEHG

SEQ ID NO: 2963774 - protein, 19 aa, Entamoeba invadens
RCEGRWAKYGQKIREETLK

SEQ ID NO: 2963775 - protein, 28 aa, Entamoeba invadens
RCEHSLSVHSCRDFSNSIFKNALQEGAE

SEQ ID NO: 2963776 - protein, 18 aa, Entamoeba invadens
RCESLQCVTLHAPLHLLD

SEQ ID NO: 2963777 - protein, 18 aa, Entamoeba invadens
RCESYRIMEHLHVLMDVL

SEQ ID NO: 2963778 - protein, 20 aa, Entamoeba invadens
RCFANCRRLKELNVPNTVKL

SEQ ID NO: 2963779 - protein, 19 aa, Entamoeba invadens
RCFANCYLLESVCCESQEV

SEQ ID NO: 2963780 - protein, 21 aa, Entamoeba invadens
RCFCNCSGLSSIVIPSSVESI

SEQ ID NO: 2963781 - protein, 17 aa, Entamoeba invadens
RCFECNKSFDDFFVPNL

SEQ ID NO: 2963782 - protein, 19 aa, Entamoeba invadens
RCFECNKSFDDFFVPNLIG

SEQ ID NO: 2963783 - protein, 25 aa, Entamoeba invadens
RCFEGCKGLKALSLPSTVKVYDNVF

SEQ ID NO: 2963784 - protein, 19 aa, Entamoeba invadens
RCFEGCVLLTSISCNTNVI

SEQ ID NO: 2963785 - protein, 21 aa, Entamoeba invadens
RCFESQWGLAIESFLDGLTVQ

SEQ ID NO: 2963786 - protein, 17 aa, Entamoeba invadens
RCFKCCGKLSDVNIHSG

SEQ ID NO: 2963787 - protein, 18 aa, Entamoeba invadens
RCFLGCTALSSISVPSGV

SEQ ID NO: 2963788 - protein, 17 aa, Entamoeba invadens
RCFPVEREKRGIGLTDN

SEQ ID NO: 2963789 - protein, 21 aa, Entamoeba invadens
RCFRKKPGMVKYVYYPEVSYT

SEQ ID NO: 2963790 - protein, 26 aa, Entamoeba invadens
RCGAARIFYLQRAFKQSIKCFESALV

SEQ ID NO: 2963791 - protein, 19 aa, Entamoeba invadens
RCGCKCLNVMFTLEDRMEF

SEQ ID NO: 2963792 - protein, 17 aa, Entamoeba invadens
RCGDFMFDGGRVCPCQL

SEQ ID NO: 2963793 - protein, 24 aa, Entamoeba invadens
RCGHRFCKSCIRDSIKEQKTNTWR

SEQ ID NO: 2963794 - protein, 18 aa, Entamoeba invadens
RCGIKCVNMYLDSIEYEQ

SEQ ID NO: 2963795 - protein, 26 aa, Entamoeba invadens
RCGNLTSFEFPKFVNHIGRSCFEGCS

SEQ ID NO: 2963796 - protein, 19 aa, Entamoeba invadens
RCIFEVKLKPKTVVGEVVK

SEQ ID NO: 2963797 - protein, 21 aa, Entamoeba invadens
RCIKVTGLLFDTTPITFISIE

SEQ ID NO: 2963798 - protein, 17 aa, Entamoeba invadens
RCKATVGEKIVFKLYDH

SEQ ID NO: 2963799 - protein, 26 aa, Entamoeba invadens
RCKENFVLGNWFYWYLTVECGCKDGD

SEQ ID NO: 2963800 - protein, 26 aa, Entamoeba invadens
RCKERFALDLKNGVPMKTAKRRIETN

SEQ ID NO: 2963801 - protein, 25 aa, Entamoeba invadens
RCKGKTKQDGVCLVTKDAIFVLLEN

SEQ ID NO: 2963802 - protein, 20 aa, Entamoeba invadens
RCKRAEIIRLRKEVAKQNAE

SEQ ID NO: 2963803 - protein, 25 aa, Entamoeba invadens
RCKRAMCVPDPLKVVLTNVPDDYCI

SEQ ID NO: 2963804 - protein, 24 aa, Entamoeba invadens
RCLCFKAVSRIASRAFPRYDDIVY

SEQ ID NO: 2963805 - protein, 17 aa, Entamoeba invadens
RCLDVFSDAMFDAPFFN

SEQ ID NO: 2963806 - protein, 21 aa, Entamoeba invadens
RCLELAFNYSNFLRIFFNILA

SEQ ID NO: 2963807 - protein, 21 aa, Entamoeba invadens
RCLESLKMLHINPWYISVDNI

SEQ ID NO: 2963808 - protein, 17 aa, Entamoeba invadens
RCMFGYETLSSVEIPTS

SEQ ID NO: 2963809 - protein, 20 aa, Entamoeba invadens
RCMMETLEFQTWCFKAHYFL

SEQ ID NO: 2963810 - protein, 20 aa, Entamoeba invadens
RCNCLKEVLIDANIITLPQN

SEQ ID NO: 2963811 - protein, 21 aa, Entamoeba invadens
RCNGTLAAFAIKKGVEVITGK

SEQ ID NO: 2963812 - protein, 17 aa, Entamoeba invadens
RCPEKLQLVQNVLSGAD

SEQ ID NO: 2963813 - protein, 26 aa, Entamoeba invadens
RCQKDGKCWQEDPVIDELCSKIVAAD

SEQ ID NO: 2963814 - protein, 25 aa, Entamoeba invadens
RCRRMKRINLPSGLKEIKLLCFENC

SEQ ID NO: 2963815 - protein, 17 aa, Entamoeba invadens
RCRVCRNGYKIIANETC

SEQ ID NO: 2963816 - protein, 17 aa, Entamoeba invadens
RCSFNCEYQIIVKPTIG

SEQ ID NO: 2963817 - protein, 24 aa, Entamoeba invadens
RCSKAEVLEPKFLKHTCLPLIKDW

SEQ ID NO: 2963818 - protein, 21 aa, Entamoeba invadens
RCSSLSKILIGKSVAKIQENC

SEQ ID NO: 2963819 - protein, 28 aa, Entamoeba invadens
RCTFKADAAKVFEFLKTSTFEQQKVYDT

SEQ ID NO: 2963820 - protein, 19 aa, Entamoeba invadens
RCTIKDGKCVSSNEIGTLC

SEQ ID NO: 2963821 - protein, 20 aa, Entamoeba invadens
RCTNVFYVIENELQWFSKET

SEQ ID NO: 2963822 - protein, 19 aa, Entamoeba invadens
RCVDGFVSLSIILVKQLNE

SEQ ID NO: 2963823 - protein, 25 aa, Entamoeba invadens
RCVDTAKLARWVLDTPLSFDDKIKF

SEQ ID NO: 2963824 - protein, 19 aa, Entamoeba invadens
RCYEPAVDEQAFWFCIQNA

SEQ ID NO: 2963825 - protein, 20 aa, Entamoeba invadens
RCYLPEGFFHPNVFPNGQIC

SEQ ID NO: 2963826 - protein, 19 aa, Entamoeba invadens
RDAELGEFIVLYLSFIRAG

SEQ ID NO: 2963827 - protein, 21 aa, Entamoeba invadens
RDAELGEFIVLYLSFMSAGSG

SEQ ID NO: 2963828 - protein, 20 aa, Entamoeba invadens
RDAFQQSFLLGMLVKCGYNV

SEQ ID NO: 2963829 - protein, 31 aa, Entamoeba invadens
RDAFYKFWFEVTFIKKCFCIYHHKIRRKRAI

SEQ ID NO: 2963830 - protein, 18 aa, Entamoeba invadens
RDAIKRVDTTFEYEHATG

SEQ ID NO: 2963831 - protein, 21 aa, Entamoeba invadens
RDCIKNLYFVLPLPQKRKMPV

SEQ ID NO: 2963832 - protein, 23 aa, Entamoeba invadens
RDCKILLMMQKLVGMEITNTLNL

SEQ ID NO: 2963833 - protein, 22 aa, Entamoeba invadens
RDCKRIPRNNSEILIGELEVSK

SEQ ID NO: 2963834 - protein, 17 aa, Entamoeba invadens
RDCNFEALYKFCEKPNE

SEQ ID NO: 2963835 - protein, 18 aa, Entamoeba invadens
RDCPEKRGRYRSRSRSRS

SEQ ID NO: 2963836 - protein, 20 aa, Entamoeba invadens
RDCSIQSFLIDSGKYSNLNL

SEQ ID NO: 2963837 - protein, 18 aa, Entamoeba invadens
RDCVDPEIIEHIETEDKQ

SEQ ID NO: 2963838 - protein, 23 aa, Entamoeba invadens
RDDDLPKIGIRVEDDGKTQWKLG

SEQ ID NO: 2963839 - protein, 36 aa, Entamoeba invadens
RDDKIMKSLEYHYFEAVWTALKMQVIEYGGSKSMLK

SEQ ID NO: 2963840 - protein, 22 aa, Entamoeba invadens
RDDLKIVVMSATLEASKFREYF

SEQ ID NO: 2963841 - protein, 25 aa, Entamoeba invadens
RDDLTCFSMCVCCFSTFNYYSPIFS

SEQ ID NO: 2963842 - protein, 19 aa, Entamoeba invadens
RDDNVFRPATHISQGEPAP

SEQ ID NO: 2963843 - protein, 17 aa, Entamoeba invadens
RDDRRGRSRSRSRSRSD

SEQ ID NO: 2963844 - protein, 28 aa, Entamoeba invadens
RDEESFLLPQFVHAMFDRLFIDAPKTEG

SEQ ID NO: 2963845 - protein, 32 aa, Entamoeba invadens
RDEFSYDIFKSLILFHYLCRNGSPQIFNEVEQ

SEQ ID NO: 2963846 - protein, 23 aa, Entamoeba invadens
RDEREILYRKQMNDMIEQTTKKI

SEQ ID NO: 2963847 - protein, 23 aa, Entamoeba invadens
RDEREILYRKQMNELSQQATKKI

SEQ ID NO: 2963848 - protein, 18 aa, Entamoeba invadens
RDFDVAILKLKKLNVDVF

SEQ ID NO: 2963849 - protein, 18 aa, Entamoeba invadens
RDFFCIVVEPTRELAAQV

SEQ ID NO: 2963850 - protein, 18 aa, Entamoeba invadens
RDFFSYVLVCKKFRDTLM

SEQ ID NO: 2963851 - protein, 24 aa, Entamoeba invadens
RDFHFCIFCGKMFNRRKYMKHSLE

SEQ ID NO: 2963852 - protein, 20 aa, Entamoeba invadens
RDFIEDFPPLVFESDSSQED

SEQ ID NO: 2963853 - protein, 22 aa, Entamoeba invadens
RDFLKVTSCFSNFAKVKQKAFL

SEQ ID NO: 2963854 - protein, 20 aa, Entamoeba invadens
RDFLPRCDFKPESVFGNEYT

SEQ ID NO: 2963855 - protein, 30 aa, Entamoeba invadens
RDFMLCLISDCYKCYLNSPISGDCKQERLR

SEQ ID NO: 2963856 - protein, 21 aa, Entamoeba invadens
RDFPVLYIRGDLVVIVSPEQQ

SEQ ID NO: 2963857 - protein, 17 aa, Entamoeba invadens
RDFQVETLRSWENFLPS

SEQ ID NO: 2963858 - protein, 21 aa, Entamoeba invadens
RDFTKATAFYGKHFRVPPHYE

SEQ ID NO: 2963859 - protein, 20 aa, Entamoeba invadens
RDFTKMTAFYGSHFRMSPNY

SEQ ID NO: 2963860 - protein, 23 aa, Entamoeba invadens
RDGCGRTPLHVAVVMNDAICVQF

SEQ ID NO: 2963861 - protein, 19 aa, Entamoeba invadens
RDGKPSECIVYYSQVDVKK

SEQ ID NO: 2963862 - protein, 19 aa, Entamoeba invadens
RDGLIPAAFNTTTSSVTNM

SEQ ID NO: 2963863 - protein, 18 aa, Entamoeba invadens
RDGRTMYTHIIIDEAHER

SEQ ID NO: 2963864 - protein, 24 aa, Entamoeba invadens
RDGTCIRDYLHVVDLAKGHVAALK

SEQ ID NO: 2963865 - protein, 20 aa, Entamoeba invadens
RDGVLVKLQIEQGVVPNQDA

SEQ ID NO: 2963866 - protein, 20 aa, Entamoeba invadens
RDGWELRLYFGEKVSTGFSR

SEQ ID NO: 2963867 - protein, 27 aa, Entamoeba invadens
RDHRFVMRRFASIFVIIGFDEDENELA

SEQ ID NO: 2963868 - protein, 19 aa, Entamoeba invadens
RDIEENYGLILLYQQQPKA

SEQ ID NO: 2963869 - protein, 19 aa, Entamoeba invadens
RDIEIRMEAFKEIERESKI

SEQ ID NO: 2963870 - protein, 19 aa, Entamoeba invadens
RDIEVLKKMRMTSEEDKKK

SEQ ID NO: 2963871 - protein, 17 aa, Entamoeba invadens
RDIFERIAMDASSLTRN

SEQ ID NO: 2963872 - protein, 22 aa, Entamoeba invadens
RDIFKNKYIKIGKLENYQYSLE

SEQ ID NO: 2963873 - protein, 21 aa, Entamoeba invadens
RDIIPDFLLLRNFPTDFRGKM

SEQ ID NO: 2963874 - protein, 22 aa, Entamoeba invadens
RDIKEKICYVASNFVEAIQRSQ

SEQ ID NO: 2963875 - protein, 22 aa, Entamoeba invadens
RDIKERKGYVVLDYNEKIQQVE

SEQ ID NO: 2963876 - protein, 28 aa, Entamoeba invadens
RDIKNVVIFDDCELVWTMTQDKLVVCKR

SEQ ID NO: 2963877 - protein, 25 aa, Entamoeba invadens
RDIKTLPLHKLRKPIGMVGQKPVLF

SEQ ID NO: 2963878 - protein, 19 aa, Entamoeba invadens
RDILDCPIDVISTPSTAEM

SEQ ID NO: 2963879 - protein, 17 aa, Entamoeba invadens
RDILMYLHHQFLDRFTT

SEQ ID NO: 2963880 - protein, 22 aa, Entamoeba invadens
RDILRKEYEIAFDKLTTKKYEK

SEQ ID NO: 2963881 - protein, 17 aa, Entamoeba invadens
RDIPHQMIKLYLQTLNT

SEQ ID NO: 2963882 - protein, 25 aa, Entamoeba invadens
RDKDGRLFYCYTYLVKNKAGEEHEQ

SEQ ID NO: 2963883 - protein, 19 aa, Entamoeba invadens
RDKIAGALNPIEFSGAHGK

SEQ ID NO: 2963884 - protein, 32 aa, Entamoeba invadens
RDKIANFVREIFCVIMTKFAFLYSDFGKEKKT

SEQ ID NO: 2963885 - protein, 22 aa, Entamoeba invadens
RDKLPDYHVEAIVYQHNKTGAT

SEQ ID NO: 2963886 - protein, 17 aa, Entamoeba invadens
RDKMFLAEKKKWEEEQQ

SEQ ID NO: 2963887 - protein, 26 aa, Entamoeba invadens
RDKRGTFLMNRLISMLSAFQAATTRQ

SEQ ID NO: 2963888 - protein, 22 aa, Entamoeba invadens
RDKRPLVLINMKNFPYKNYKFS

SEQ ID NO: 2963889 - protein, 19 aa, Entamoeba invadens
RDKSAVIAHTFDKIETSPK

SEQ ID NO: 2963890 - protein, 21 aa, Entamoeba invadens
RDKSFAISFLRRVKSERLQKV

SEQ ID NO: 2963891 - protein, 23 aa, Entamoeba invadens
RDLAQNCFKEIVVTNFENIQREE

SEQ ID NO: 2963892 - protein, 28 aa, Entamoeba invadens
RDLFMEHGDAWKMGRYSNETGIKEDYCR

SEQ ID NO: 2963893 - protein, 24 aa, Entamoeba invadens
RDLFNCAFHSYFIMLKENKKNEIL

SEQ ID NO: 2963894 - protein, 18 aa, Entamoeba invadens
RDLIPEIITEVGSETTSE

SEQ ID NO: 2963895 - protein, 17 aa, Entamoeba invadens
RDLKVSKLKLSIEENTL

SEQ ID NO: 2963896 - protein, 18 aa, Entamoeba invadens
RDLLRRINGGYKIKLTQL

SEQ ID NO: 2963897 - protein, 19 aa, Entamoeba invadens
RDLPDLSCLKELQTLDLSN

SEQ ID NO: 2963898 - protein, 21 aa, Entamoeba invadens
RDLPEPILPKEGYSILIEAAR

SEQ ID NO: 2963899 - protein, 19 aa, Entamoeba invadens
RDLQICGALLSLQTLRRVV

SEQ ID NO: 2963900 - protein, 24 aa, Entamoeba invadens
RDLSRFSFRNSRNIASATQSILVA

SEQ ID NO: 2963901 - protein, 19 aa, Entamoeba invadens
RDLTVLACFILVVESLLPL

SEQ ID NO: 2963902 - protein, 17 aa, Entamoeba invadens
RDLVLKTFGELCNSPEI

SEQ ID NO: 2963903 - protein, 23 aa, Entamoeba invadens
RDLYMKTGQGFVLVYSIIAQSTY

SEQ ID NO: 2963904 - protein, 19 aa, Entamoeba invadens
RDMAVYGWENYIKKLKKSW

SEQ ID NO: 2963905 - protein, 24 aa, Entamoeba invadens
RDMDDYDLLTSMGVKGFGSSKGLK

SEQ ID NO: 2963906 - protein, 18 aa, Entamoeba invadens
RDNLLSWLLDGFLGLAPD

SEQ ID NO: 2963907 - protein, 20 aa, Entamoeba invadens
RDNVVKYFVERSASERNLCT

SEQ ID NO: 2963908 - protein, 20 aa, Entamoeba invadens
RDPALFKINLIKKIEETKKR

SEQ ID NO: 2963909 - protein, 17 aa, Entamoeba invadens
RDPLFYYSRDLVKYIKE

SEQ ID NO: 2963910 - protein, 17 aa, Entamoeba invadens
RDPYFAYICYKKKNLDD

SEQ ID NO: 2963911 - protein, 29 aa, Entamoeba invadens
RDPYPKENFKFAWCIAEYVDKGGRPERVE

SEQ ID NO: 2963912 - protein, 25 aa, Entamoeba invadens
RDQAQCGSCYSFGSLASLEGRLLMI

SEQ ID NO: 2963913 - protein, 24 aa, Entamoeba invadens
RDQFKTILCDLKLYMTKGAAMITE

SEQ ID NO: 2963914 - protein, 24 aa, Entamoeba invadens
RDQRTRLAYDTTIVRVCLLDDLKR

SEQ ID NO: 2963915 - protein, 22 aa, Entamoeba invadens
RDRAHIYWRILFNHPEEAKKII

SEQ ID NO: 2963916 - protein, 22 aa, Entamoeba invadens
RDRFSFEQMEAINLEEIALNPA

SEQ ID NO: 2963917 - protein, 17 aa, Entamoeba invadens
RDRIYATALQKGEQSLW

SEQ ID NO: 2963918 - protein, 28 aa, Entamoeba invadens
RDRNYHAICGIVFSFVRINDIETLKKKL

SEQ ID NO: 2963919 - protein, 17 aa, Entamoeba invadens
RDSKLVAEEDNSKDLEK

SEQ ID NO: 2963920 - protein, 24 aa, Entamoeba invadens
RDSMYCKECKLDISLSNEKTPPHV

SEQ ID NO: 2963921 - protein, 18 aa, Entamoeba invadens
RDSSILSIRSLRQQHVPF

SEQ ID NO: 2963922 - protein, 26 aa, Entamoeba invadens
RDSTRFLMCTLSFHLTNISGMEIVKK

SEQ ID NO: 2963923 - protein, 27 aa, Entamoeba invadens
RDSTRFLMCTLSFHLTYISGIEIVKEG

SEQ ID NO: 2963924 - protein, 32 aa, Entamoeba invadens
RDSTRFLMCTLSFHLTYISGMEIVKEGRGTYR

SEQ ID NO: 2963925 - protein, 27 aa, Entamoeba invadens
RDSTRFLTCTLSFHLTYISGLEIIKKG

SEQ ID NO: 2963926 - protein, 19 aa, Entamoeba invadens
RDTCNIANCNICSQNNPNF

SEQ ID NO: 2963927 - protein, 21 aa, Entamoeba invadens
RDTEVKIGEDIVVKCDGVEMG

SEQ ID NO: 2963928 - protein, 18 aa, Entamoeba invadens
RDTIFGMWMGFPVVHGKS

SEQ ID NO: 2963929 - protein, 21 aa, Entamoeba invadens
RDTIWRFNKAVLEIKTKRAEI

SEQ ID NO: 2963930 - protein, 20 aa, Entamoeba invadens
RDTQKRFSVCAMNTSTSGLL

SEQ ID NO: 2963931 - protein, 20 aa, Entamoeba invadens
RDTRELKTNFQLEEGGSIIE

SEQ ID NO: 2963932 - protein, 20 aa, Entamoeba invadens
RDVAESIALGKKVDSKDLMF

SEQ ID NO: 2963933 - protein, 25 aa, Entamoeba invadens
RDVAPKKIMYCLSIHVTTLKRTSNG

SEQ ID NO: 2963934 - protein, 26 aa, Entamoeba invadens
RDVCDKKPFVCISVGGWIGVAKIPDF

SEQ ID NO: 2963935 - protein, 17 aa, Entamoeba invadens
RDVCLFYNLREIDLSNN

SEQ ID NO: 2963936 - protein, 17 aa, Entamoeba invadens
RDVFCQHCQTAFSINKK

SEQ ID NO: 2963937 - protein, 22 aa, Entamoeba invadens
RDVFEKLLEIMIFRENKNRKTG

SEQ ID NO: 2963938 - protein, 24 aa, Entamoeba invadens
RDVGNLLVEVCVQSHLAIFRPDVQ

SEQ ID NO: 2963939 - protein, 24 aa, Entamoeba invadens
RDVGRAALSLSLLTRIDFCEVKYV

SEQ ID NO: 2963940 - protein, 22 aa, Entamoeba invadens
RDVKDNQNVFVFDEEIVSEKEK

SEQ ID NO: 2963941 - protein, 20 aa, Entamoeba invadens
RDVLPYLLIQPRKVIKKYSV

SEQ ID NO: 2963942 - protein, 19 aa, Entamoeba invadens
RDVRMSVLLANCRLPRDDE

SEQ ID NO: 2963943 - protein, 18 aa, Entamoeba invadens
RDVVKILSIIERLKNFPK

SEQ ID NO: 2963944 - protein, 18 aa, Entamoeba invadens
RDWLGVSTGNAFSFSPQS

SEQ ID NO: 2963945 - protein, 21 aa, Entamoeba invadens
RDWNGVVMFCCYSQKDTDTYM

SEQ ID NO: 2963946 - protein, 32 aa, Entamoeba invadens
RDYEDFGIITSIVFDSSIWREADDLIQQLERN

SEQ ID NO: 2963947 - protein, 24 aa, Entamoeba invadens
RDYLICYLSSYGPDVCCFENYLAL

SEQ ID NO: 2963948 - protein, 29 aa, Entamoeba invadens
RDYLKRYRVSVGFPIKGYKECLVLDIRNG

SEQ ID NO: 2963949 - protein, 17 aa, Entamoeba invadens
RDYTIYLLLADKYNNVI

SEQ ID NO: 2963950 - protein, 22 aa, Entamoeba invadens
RDYYVREFKNAVVGGFKNGSPM

SEQ ID NO: 2963951 - protein, 23 aa, Entamoeba invadens
REAEVSKSLGCFCEEDKSYKEML

SEQ ID NO: 2963952 - protein, 19 aa, Entamoeba invadens
REAEYKVFEDSVCGLMKCW

SEQ ID NO: 2963953 - protein, 20 aa, Entamoeba invadens
REAFLKCQMLSVIDLSASPL

SEQ ID NO: 2963954 - protein, 18 aa, Entamoeba invadens
REAIRWLDRSLIRLCQRF

SEQ ID NO: 2963955 - protein, 23 aa, Entamoeba invadens
REALKALYLHKVSDLVLNSAGKS

SEQ ID NO: 2963956 - protein, 20 aa, Entamoeba invadens
REALNFGSYNYLGFGGLHPI

SEQ ID NO: 2963957 - protein, 17 aa, Entamoeba invadens
REALVFITKNSVMIYTP

SEQ ID NO: 2963958 - protein, 18 aa, Entamoeba invadens
REALYSSIFNFIINAFPK

SEQ ID NO: 2963959 - protein, 26 aa, Entamoeba invadens
REANKVAQCCICFTGDFMSPEEKIYT

SEQ ID NO: 2963960 - protein, 17 aa, Entamoeba invadens
REAPKIKGSKNVRNCIS

SEQ ID NO: 2963961 - protein, 25 aa, Entamoeba invadens
REAQRMKYEAIHLSKKTLEDAKKAK

SEQ ID NO: 2963962 - protein, 17 aa, Entamoeba invadens
REATLIHIFQFSKVFLT

SEQ ID NO: 2963963 - protein, 21 aa, Entamoeba invadens
REATRLLNLLMFNALTSKTQD

SEQ ID NO: 2963964 - protein, 22 aa, Entamoeba invadens
REAVRYLIKFLSTLNQFAVNIN

SEQ ID NO: 2963965 - protein, 19 aa, Entamoeba invadens
REAYVKHLIDEGLFDAVVS

SEQ ID NO: 2963966 - protein, 17 aa, Entamoeba invadens
RECLEPWHVGRTCEQWK

SEQ ID NO: 2963967 - protein, 19 aa, Entamoeba invadens
RECMPLQPIAGMKYYKNST

SEQ ID NO: 2963968 - protein, 18 aa, Entamoeba invadens
RECSWKYSESLYIKFALL

SEQ ID NO: 2963969 - protein, 19 aa, Entamoeba invadens
REDGCLRIHQFPFLNRFAD

SEQ ID NO: 2963970 - protein, 18 aa, Entamoeba invadens
REDINLYSRHTIWVTYRK

SEQ ID NO: 2963971 - protein, 29 aa, Entamoeba invadens
REDKMLLELNFEEIYGFAESFFKKYNKYT

SEQ ID NO: 2963972 - protein, 23 aa, Entamoeba invadens
REDLETMLSILFNNAINERKYVK

SEQ ID NO: 2963973 - protein, 20 aa, Entamoeba invadens
REDLKLFLEDVEKWKTANLL

SEQ ID NO: 2963974 - protein, 21 aa, Entamoeba invadens
REDLRLTPTLSNTLFNEVDAY

SEQ ID NO: 2963975 - protein, 17 aa, Entamoeba invadens
REDVKLFGGEIPTSKEV

SEQ ID NO: 2963976 - protein, 17 aa, Entamoeba invadens
REEALKFAIGDSTHDVS

SEQ ID NO: 2963977 - protein, 25 aa, Entamoeba invadens
REEALLCYIDFLRYWFFLREDQKWF

SEQ ID NO: 2963978 - protein, 19 aa, Entamoeba invadens
REEELKKSVPITVTYKEMK

SEQ ID NO: 2963979 - protein, 26 aa, Entamoeba invadens
REEEREKWKKLELVAKNDEKDKNEKV

SEQ ID NO: 2963980 - protein, 19 aa, Entamoeba invadens
REEFPFTILNTVNYCHSPT

SEQ ID NO: 2963981 - protein, 20 aa, Entamoeba invadens
REEILRVWDAIVAYPTHNFH

SEQ ID NO: 2963982 - protein, 27 aa, Entamoeba invadens
REEKILVKVLPKYFAFIQENPQTLIPR

SEQ ID NO: 2963983 - protein, 23 aa, Entamoeba invadens
REELKFYCKECIPPNKEYLYKEC

SEQ ID NO: 2963984 - protein, 17 aa, Entamoeba invadens
REELLGIVFGERCKIVE

SEQ ID NO: 2963985 - protein, 18 aa, Entamoeba invadens
REEMMSIVIDNVFQSVHW

SEQ ID NO: 2963986 - protein, 27 aa, Entamoeba invadens
REEMRFLQDILFEFGYYVEISSETIDG

SEQ ID NO: 2963987 - protein, 23 aa, Entamoeba invadens
REENERKEKEIIEENNQVITENN

SEQ ID NO: 2963988 - protein, 21 aa, Entamoeba invadens
REEPLVYKVNKTCCKIDSCDS

SEQ ID NO: 2963989 - protein, 23 aa, Entamoeba invadens
REEREVGCFLKIIGEGESFVVGG

SEQ ID NO: 2963990 - protein, 24 aa, Entamoeba invadens
REETKPRLANRMLENAQIRRQFLE

SEQ ID NO: 2963991 - protein, 25 aa, Entamoeba invadens
REEVKCWIKFIGMCDEKGETKLGLS

SEQ ID NO: 2963992 - protein, 24 aa, Entamoeba invadens
REFCFKGLTSLECVKIKNTTCLIG

SEQ ID NO: 2963993 - protein, 21 aa, Entamoeba invadens
REFDYFCTQMPIRGCSFLTGQ

SEQ ID NO: 2963994 - protein, 20 aa, Entamoeba invadens
REFERLKSCCNEIDESVFRA

SEQ ID NO: 2963995 - protein, 17 aa, Entamoeba invadens
REFGDMATIGTRIREVV

SEQ ID NO: 2963996 - protein, 20 aa, Entamoeba invadens
REFLKDKYLLDAYGYTKEYL

SEQ ID NO: 2963997 - protein, 26 aa, Entamoeba invadens
REFRVKGCLIVLIGNGPFKNALFNCW

SEQ ID NO: 2963998 - protein, 27 aa, Entamoeba invadens
REFVFARVRFELDGEVYIVSSSVNSNK

SEQ ID NO: 2963999 - protein, 19 aa, Entamoeba invadens
REGEIAWQSAIKSINRKYG

SEQ ID NO: 2964000 - protein, 18 aa, Entamoeba invadens
REGFKYIPKNLIDDELKE

SEQ ID NO: 2964001 - protein, 19 aa, Entamoeba invadens
REGIVKRKKFEILSDCANF

SEQ ID NO: 2964002 - protein, 23 aa, Entamoeba invadens
REGKKCQPGWVCDRSGKVLTEAK

SEQ ID NO: 2964003 - protein, 24 aa, Entamoeba invadens
REGKKCQPGWVCDRSGKVLTEAQP

SEQ ID NO: 2964004 - protein, 19 aa, Entamoeba invadens
REGKKLFKNLVGKRPSLGF

SEQ ID NO: 2964005 - protein, 34 aa, Entamoeba invadens
REGKNKGVLKREFFRIIVWFNVDFETVDRNKNRN

SEQ ID NO: 2964006 - protein, 19 aa, Entamoeba invadens
REGLLSYPFCIELYTRVLV

SEQ ID NO: 2964007 - protein, 20 aa, Entamoeba invadens
REGNFKVFSFFSETRLCHPK

SEQ ID NO: 2964008 - protein, 22 aa, Entamoeba invadens
REGRLSIDCALELVRAAKALLL

SEQ ID NO: 2964009 - protein, 24 aa, Entamoeba invadens
REGVDRFDYYLTREKELPTDLLRV

SEQ ID NO: 2964010 - protein, 22 aa, Entamoeba invadens
REHAPSIIFMDEIDSIGSTRVE

SEQ ID NO: 2964011 - protein, 24 aa, Entamoeba invadens
REHFDEIDWSYGYTLLKDMMCATA

SEQ ID NO: 2964012 - protein, 26 aa, Entamoeba invadens
REHMPGMPIDYSARVSLTRFHPNDNL

SEQ ID NO: 2964013 - protein, 19 aa, Entamoeba invadens
REIAFKNFLQLALKCLEIR

SEQ ID NO: 2964014 - protein, 18 aa, Entamoeba invadens
REIDGCSANQLFRGNGAF

SEQ ID NO: 2964015 - protein, 19 aa, Entamoeba invadens
REIDLLSFLKLYNEELDNN

SEQ ID NO: 2964016 - protein, 17 aa, Entamoeba invadens
REIEIPNSVTFLGDSVF

SEQ ID NO: 2964017 - protein, 17 aa, Entamoeba invadens
REIFEEIVVVASSMINT

SEQ ID NO: 2964018 - protein, 17 aa, Entamoeba invadens
REIFELVTMGNKENSNL

SEQ ID NO: 2964019 - protein, 19 aa, Entamoeba invadens
REIFSHLFEIVASLQEDNC

SEQ ID NO: 2964020 - protein, 17 aa, Entamoeba invadens
REIGMACFKNCKIERIC

SEQ ID NO: 2964021 - protein, 26 aa, Entamoeba invadens
REIHNLEELCCLSRIELNDCSGIESA

SEQ ID NO: 2964022 - protein, 25 aa, Entamoeba invadens
REIILKKDFDGIVVWFEVIYATYEK

SEQ ID NO: 2964023 - protein, 25 aa, Entamoeba invadens
REILDKLKLHFKIMILNVNDFSVFN

SEQ ID NO: 2964024 - protein, 27 aa, Entamoeba invadens
REILERLKHPFLVNLYAEFESPKYHLF

SEQ ID NO: 2964025 - protein, 29 aa, Entamoeba invadens
REIMESALPFGHRMVEHLKKTSGLDKSDM

SEQ ID NO: 2964026 - protein, 21 aa, Entamoeba invadens
REISCKLVKTMERYGVDKYYW

SEQ ID NO: 2964027 - protein, 24 aa, Entamoeba invadens
REISRRLTTEFSQSVLCRCESKKL

SEQ ID NO: 2964028 - protein, 18 aa, Entamoeba invadens
REITAASVNTMFDLIFED

SEQ ID NO: 2964029 - protein, 18 aa, Entamoeba invadens
REIVCFNSSCFYGCSSLV

SEQ ID NO: 2964030 - protein, 21 aa, Entamoeba invadens
REIVLPKSLSFISKSAFYNCT

SEQ ID NO: 2964031 - protein, 22 aa, Entamoeba invadens
REIVLPKSLSFISKSAFYNCTS

SEQ ID NO: 2964032 - protein, 17 aa, Entamoeba invadens
REIVSTFESFIFDRPAP

SEQ ID NO: 2964033 - protein, 27 aa, Entamoeba invadens
REIVYLSVLDCMGYSFVLTRPKKTVVK

SEQ ID NO: 2964034 - protein, 18 aa, Entamoeba invadens
REIYIGGIAPELNEGDII

SEQ ID NO: 2964035 - protein, 17 aa, Entamoeba invadens
REIYIPNSVTFLGDNAF

SEQ ID NO: 2964036 - protein, 20 aa, Entamoeba invadens
REKELRKWHFSCGCSLCEED

SEQ ID NO: 2964037 - protein, 18 aa, Entamoeba invadens
REKFFEENKIISIDVKDF

SEQ ID NO: 2964038 - protein, 24 aa, Entamoeba invadens
REKGLRFVKRIFSLLPDDLKAQVA

SEQ ID NO: 2964039 - protein, 20 aa, Entamoeba invadens
REKIDCVIERLWDILTPTGV

SEQ ID NO: 2964040 - protein, 17 aa, Entamoeba invadens
REKKARELVKETKKERM

SEQ ID NO: 2964041 - protein, 20 aa, Entamoeba invadens
REKNLIFDFEFGTFDMSLIA

SEQ ID NO: 2964042 - protein, 20 aa, Entamoeba invadens
REKNLIFDFEFGTFDMSLIV

SEQ ID NO: 2964043 - protein, 28 aa, Entamoeba invadens
REKPEKKMECKIKMGFKTKKKPVVIQEE

SEQ ID NO: 2964044 - protein, 21 aa, Entamoeba invadens
REKVFPYEVSRELLKDWQKSR

SEQ ID NO: 2964045 - protein, 27 aa, Entamoeba invadens
REKVLPFGRRFYVAIPLRGKCVQCIVS

SEQ ID NO: 2964046 - protein, 18 aa, Entamoeba invadens
REKYPRLKIADYGLSRAF

SEQ ID NO: 2964047 - protein, 21 aa, Entamoeba invadens
RELAEKFYLYASQHENTFVHD

SEQ ID NO: 2964048 - protein, 22 aa, Entamoeba invadens
RELAFQHHLYFLGYHDTSIFLS

SEQ ID NO: 2964049 - protein, 24 aa, Entamoeba invadens
RELAIQICDQFRVFGESINIKVVQ

SEQ ID NO: 2964050 - protein, 17 aa, Entamoeba invadens
RELAWSLCLGFLDYKKT

SEQ ID NO: 2964051 - protein, 18 aa, Entamoeba invadens
RELDLFKYSAEFLKDPTI

SEQ ID NO: 2964052 - protein, 27 aa, Entamoeba invadens
RELEKEKHKTRRPHTRTSTKDKTEEKN

SEQ ID NO: 2964053 - protein, 17 aa, Entamoeba invadens
RELFGEYMIPGEVHLLP

SEQ ID NO: 2964054 - protein, 18 aa, Entamoeba invadens
RELFVFVCTINNTFDALS

SEQ ID NO: 2964055 - protein, 22 aa, Entamoeba invadens
RELKEVVQYPVEFPDKFRKFGM

SEQ ID NO: 2964056 - protein, 23 aa, Entamoeba invadens
RELMSDPELTRYGVVLLDEAHER

SEQ ID NO: 2964057 - protein, 21 aa, Entamoeba invadens
RELNPSSCMEVFYSKTHEDKF

SEQ ID NO: 2964058 - protein, 18 aa, Entamoeba invadens
RELNRLVVSDGWYTITLI

SEQ ID NO: 2964059 - protein, 23 aa, Entamoeba invadens
RELPIELDFKCLKIPERWFTSKK

SEQ ID NO: 2964060 - protein, 26 aa, Entamoeba invadens
RELPLMFRKIYASSMMPLKIKETLSL

SEQ ID NO: 2964061 - protein, 18 aa, Entamoeba invadens
RELQFPFVNVEELKLVNL

SEQ ID NO: 2964062 - protein, 17 aa, Entamoeba invadens
RELREIKIGNNVESVGD

SEQ ID NO: 2964063 - protein, 17 aa, Entamoeba invadens
RELRGFAKTDLIKIDSS

SEQ ID NO: 2964064 - protein, 17 aa, Entamoeba invadens
RELSATFRRTYMGEQLQ

SEQ ID NO: 2964065 - protein, 20 aa, Entamoeba invadens
RELVKVFQFHFFSSEDICFF

SEQ ID NO: 2964066 - protein, 20 aa, Entamoeba invadens
REMCLKKREEDVLQKEINIH

SEQ ID NO: 2964067 - protein, 24 aa, Entamoeba invadens
REMDKAHLVSLFSVVRTYVEQNVE

SEQ ID NO: 2964068 - protein, 22 aa, Entamoeba invadens
REMEESIKMCNEMENHMIYDEK

SEQ ID NO: 2964069 - protein, 20 aa, Entamoeba invadens
REMFKRATEREAFKNSKSLE

SEQ ID NO: 2964070 - protein, 20 aa, Entamoeba invadens
REMFYESGCVTVVRMECIKI

SEQ ID NO: 2964071 - protein, 24 aa, Entamoeba invadens
REMMQRIEFEKGINPEILEAYNRF

SEQ ID NO: 2964072 - protein, 19 aa, Entamoeba invadens
REMNCIVLVFRGTLSLQDL

SEQ ID NO: 2964073 - protein, 17 aa, Entamoeba invadens
REMSLMYANDVVDFITK

SEQ ID NO: 2964074 - protein, 21 aa, Entamoeba invadens
REMYEQIMLPQIKKIPSSVTQ

SEQ ID NO: 2964075 - protein, 25 aa, Entamoeba invadens
RENALRVLKLRKIRQRQLTEVTNQR

SEQ ID NO: 2964076 - protein, 24 aa, Entamoeba invadens
RENCLSVMKSIRLYGSEPNTIIPE

SEQ ID NO: 2964077 - protein, 20 aa, Entamoeba invadens
RENCSYDRLSGCDECIEDHH

SEQ ID NO: 2964078 - protein, 22 aa, Entamoeba invadens
RENEIKRKMSMKVVEPQHAATF

SEQ ID NO: 2964079 - protein, 24 aa, Entamoeba invadens
RENFKNIFLEMGFEEMPTDMYVES

SEQ ID NO: 2964080 - protein, 19 aa, Entamoeba invadens
RENFSMFIVSCRELRVPLL

SEQ ID NO: 2964081 - protein, 19 aa, Entamoeba invadens
RENLKVKRYFSMPKSRRQS

SEQ ID NO: 2964082 - protein, 23 aa, Entamoeba invadens
RENSEKYASVLLALKEMEDGKEG

SEQ ID NO: 2964083 - protein, 19 aa, Entamoeba invadens
RENVHLLNLPFYQTGQIVK

SEQ ID NO: 2964084 - protein, 24 aa, Entamoeba invadens
RENVPSVLLFRLKFPQLKFEMTHS

SEQ ID NO: 2964085 - protein, 18 aa, Entamoeba invadens
RENYRTVIQYTPEQMVSF

SEQ ID NO: 2964086 - protein, 20 aa, Entamoeba invadens
REPAPFVLTRSMLFVFAGES

SEQ ID NO: 2964087 - protein, 22 aa, Entamoeba invadens
REPILVSLFYNYGVLPLNNLSR

SEQ ID NO: 2964088 - protein, 23 aa, Entamoeba invadens
REPKYREIFLLMFRLYTSPEVVM

SEQ ID NO: 2964089 - protein, 20 aa, Entamoeba invadens
REPPAAGLFCDLLWSDPVDE

SEQ ID NO: 2964090 - protein, 23 aa, Entamoeba invadens
REPSTQRSLRFGFVTYNTTEEAK

SEQ ID NO: 2964091 - protein, 19 aa, Entamoeba invadens
REQCGICLFEEGVLICACG

SEQ ID NO: 2964092 - protein, 17 aa, Entamoeba invadens
REQHLMIFGKIRVLTCV

SEQ ID NO: 2964093 - protein, 30 aa, Entamoeba invadens
REQNPEYFKAYEIRLTIKDQIDRFNKLIQH

SEQ ID NO: 2964094 - protein, 26 aa, Entamoeba invadens
RERDLKEVRKGICATIEIDSLSKKVK

SEQ ID NO: 2964095 - protein, 24 aa, Entamoeba invadens
RERFKRNFNGGVGIIELLYKSNLV

SEQ ID NO: 2964096 - protein, 18 aa, Entamoeba invadens
RERIKAACMGLMDEGVLW

SEQ ID NO: 2964097 - protein, 18 aa, Entamoeba invadens
RERIRKALQLYCSEPTEP

SEQ ID NO: 2964098 - protein, 18 aa, Entamoeba invadens
RERKRDVAESIALGKKVD

SEQ ID NO: 2964099 - protein, 20 aa, Entamoeba invadens
RERLSNACVIGLYVCAGNAM

SEQ ID NO: 2964100 - protein, 27 aa, Entamoeba invadens
RERMEFVTKRCEAVVGFYLTNARKEPT

SEQ ID NO: 2964101 - protein, 19 aa, Entamoeba invadens
RERRAWADKEKKYREEISQ

SEQ ID NO: 2964102 - protein, 18 aa, Entamoeba invadens
RERRCVTCVIETMCSLCV

SEQ ID NO: 2964103 - protein, 17 aa, Entamoeba invadens
RERSGALLIATKLTQTP

SEQ ID NO: 2964104 - protein, 19 aa, Entamoeba invadens
RERVLKIPVINPVTKKKDD

SEQ ID NO: 2964105 - protein, 17 aa, Entamoeba invadens
RERVLKLSDRVLHIDEL

SEQ ID NO: 2964106 - protein, 18 aa, Entamoeba invadens
RESAVLMCEVHFEEKSEE

SEQ ID NO: 2964107 - protein, 17 aa, Entamoeba invadens
RESIIKMVLVGESGVGK

SEQ ID NO: 2964108 - protein, 22 aa, Entamoeba invadens
RESKFGEIGVMRRLKKVEFLGS

SEQ ID NO: 2964109 - protein, 23 aa, Entamoeba invadens
RESPIKFGMEHVMKFFEVSTLLP

SEQ ID NO: 2964110 - protein, 20 aa, Entamoeba invadens
RESREYLCTGFEIYVTHEPC

SEQ ID NO: 2964111 - protein, 22 aa, Entamoeba invadens
RESSIRRSVLRFGENLIDPVRQ

SEQ ID NO: 2964112 - protein, 18 aa, Entamoeba invadens
RESVKFIEKVSEEIKLKK

SEQ ID NO: 2964113 - protein, 17 aa, Entamoeba invadens
RETALYWGLVLIQKMFA

SEQ ID NO: 2964114 - protein, 19 aa, Entamoeba invadens
RETFKNCFSLTEFEFAYGT

SEQ ID NO: 2964115 - protein, 28 aa, Entamoeba invadens
RETKKSKGCGFVKFVYRDDAVSCYNYHK

SEQ ID NO: 2964116 - protein, 26 aa, Entamoeba invadens
RETLKFFPHIETLFLYSIKDPILRDG

SEQ ID NO: 2964117 - protein, 29 aa, Entamoeba invadens
RETSHLLAMINMKYSWWVNHTIRTLPEQR

SEQ ID NO: 2964118 - protein, 17 aa, Entamoeba invadens
RETVCSGDGLNVFNIFF

SEQ ID NO: 2964119 - protein, 25 aa, Entamoeba invadens
RETVRVIRQIICFNLHDFNKQLMTA

SEQ ID NO: 2964120 - protein, 25 aa, Entamoeba invadens
RETYGQLFDCFKKVFNKKDESDDKS

SEQ ID NO: 2964121 - protein, 20 aa, Entamoeba invadens
REVASSIGFDVQVFVYDIKY

SEQ ID NO: 2964122 - protein, 19 aa, Entamoeba invadens
REVEICGTDVKILTVEERK

SEQ ID NO: 2964123 - protein, 19 aa, Entamoeba invadens
REVGGGWRGLSVVHLGDRD

SEQ ID NO: 2964124 - protein, 17 aa, Entamoeba invadens
REVKALKTISPKWIKSG

SEQ ID NO: 2964125 - protein, 30 aa, Entamoeba invadens
REVKGVRLVKEGFCINFDFEVDVLYFNGKW

SEQ ID NO: 2964126 - protein, 20 aa, Entamoeba invadens
REVKTKISVLNGYIETLKSP

SEQ ID NO: 2964127 - protein, 19 aa, Entamoeba invadens
REVLEKSGVLIFKDSSANK

SEQ ID NO: 2964128 - protein, 21 aa, Entamoeba invadens
REVLGRQGLQREAALAALEHH

SEQ ID NO: 2964129 - protein, 19 aa, Entamoeba invadens
REVQRYCDPDVSINILGFG

SEQ ID NO: 2964130 - protein, 19 aa, Entamoeba invadens
REVRVLKMLNHPNILKFVA

SEQ ID NO: 2964131 - protein, 20 aa, Entamoeba invadens
REVTRIDCFTTYKNFINIRL

SEQ ID NO: 2964132 - protein, 17 aa, Entamoeba invadens
REWYAPKEQCFPADYTK

SEQ ID NO: 2964133 - protein, 20 aa, Entamoeba invadens
REYDVLYTLSTNFYMASSTY

SEQ ID NO: 2964134 - protein, 19 aa, Entamoeba invadens
REYFAYKSLEDIAMKVNFR

SEQ ID NO: 2964135 - protein, 20 aa, Entamoeba invadens
REYFSYKTLEDIAMKVNFRV

SEQ ID NO: 2964136 - protein, 24 aa, Entamoeba invadens
REYFSYKTLEDIAMKVNFRVSASD

SEQ ID NO: 2964137 - protein, 17 aa, Entamoeba invadens
REYGESKVLGTIRADGG

SEQ ID NO: 2964138 - protein, 20 aa, Entamoeba invadens
REYLFHNVVSLLSLLPPPKS

SEQ ID NO: 2964139 - protein, 28 aa, Entamoeba invadens
REYLKRNRVTVGFPIKGYEECLVLDIRN

SEQ ID NO: 2964140 - protein, 17 aa, Entamoeba invadens
REYQLKNNEIMASIKGK

SEQ ID NO: 2964141 - protein, 21 aa, Entamoeba invadens
REYSIRDVIFYMFERDSTRFL

SEQ ID NO: 2964142 - protein, 21 aa, Entamoeba invadens
REYSIRDVVFYMFERDSTRFL

SEQ ID NO: 2964143 - protein, 21 aa, Entamoeba invadens
REYSTGYSKCFVCKKQTGSSL

SEQ ID NO: 2964144 - protein, 21 aa, Entamoeba invadens
REYTQFMKIYSPKIVQLVLKC

SEQ ID NO: 2964145 - protein, 21 aa, Entamoeba invadens
REYVMLRRMFDFLKVKNNNIL

SEQ ID NO: 2964146 - protein, 19 aa, Entamoeba invadens
REYYETRLLIGCGVSTCQN

SEQ ID NO: 2964147 - protein, 25 aa, Entamoeba invadens
RFAEPLTERVLSLWSLSILCKNKVF

SEQ ID NO: 2964148 - protein, 18 aa, Entamoeba invadens
RFAPSASNKQEWRIVISE

SEQ ID NO: 2964149 - protein, 27 aa, Entamoeba invadens
RFCASQFPECFASILGKNTQTSIEDGL

SEQ ID NO: 2964150 - protein, 17 aa, Entamoeba invadens
RFCLQRGTTEIALNIPH

SEQ ID NO: 2964151 - protein, 18 aa, Entamoeba invadens
RFDDLYFEQWERLKEIEK

SEQ ID NO: 2964152 - protein, 19 aa, Entamoeba invadens
RFDETVPLLRSHKGPVTTC

SEQ ID NO: 2964153 - protein, 19 aa, Entamoeba invadens
RFDGFSGVVQRELKVMQIE

SEQ ID NO: 2964154 - protein, 24 aa, Entamoeba invadens
RFDILEKKIDIILFRTDLIMKELR

SEQ ID NO: 2964155 - protein, 20 aa, Entamoeba invadens
RFDLKYLLRDSLSHTWCCDF

SEQ ID NO: 2964156 - protein, 24 aa, Entamoeba invadens
RFDNDCFRCCKSLKRIVLPLNLRE

SEQ ID NO: 2964157 - protein, 21 aa, Entamoeba invadens
RFDNTMLHLLLSYIRKPVPPN

SEQ ID NO: 2964158 - protein, 19 aa, Entamoeba invadens
RFEFDYETMDRIKLNNRYE

SEQ ID NO: 2964159 - protein, 21 aa, Entamoeba invadens
RFEGFRNYFTFELKTQLPEKR

SEQ ID NO: 2964160 - protein, 23 aa, Entamoeba invadens
RFEIGEGDIKVWKNVDEKMMCRC

SEQ ID NO: 2964161 - protein, 25 aa, Entamoeba invadens
RFEKEHPERCVLFLQKIGMNEDRAS

SEQ ID NO: 2964162 - protein, 24 aa, Entamoeba invadens
RFEKNRKVFLGNFLVDLAKQLGFD

SEQ ID NO: 2964163 - protein, 26 aa, Entamoeba invadens
RFEKSGGEKLVYCTVGVMLRKVLGNP

SEQ ID NO: 2964164 - protein, 17 aa, Entamoeba invadens
RFFCNKTGLLPCSLSDI

SEQ ID NO: 2964165 - protein, 24 aa, Entamoeba invadens
RFFDCIKTQIFVFLVMEFVEGQTL

SEQ ID NO: 2964166 - protein, 17 aa, Entamoeba invadens
RFFQFIRKIVRTKIEHL

SEQ ID NO: 2964167 - protein, 20 aa, Entamoeba invadens
RFFVMEGVLTKVCRKANKER

SEQ ID NO: 2964168 - protein, 18 aa, Entamoeba invadens
RFGDRYCANQTYSKYKDY

SEQ ID NO: 2964169 - protein, 25 aa, Entamoeba invadens
RFGNFTVTCGAVLFGDPQTIGRMEM

SEQ ID NO: 2964170 - protein, 22 aa, Entamoeba invadens
RFGRNGVAINFVLDSEMNELKD

SEQ ID NO: 2964171 - protein, 18 aa, Entamoeba invadens
RFHDEPTVKECIHAFVGA

SEQ ID NO: 2964172 - protein, 18 aa, Entamoeba invadens
RFHHFVSLRIDTTLDELP

SEQ ID NO: 2964173 - protein, 18 aa, Entamoeba invadens
RFIEFMPSIYSSMISEEI

SEQ ID NO: 2964174 - protein, 24 aa, Entamoeba invadens
RFIGESAFCRTKLPKITISPNYVL

SEQ ID NO: 2964175 - protein, 26 aa, Entamoeba invadens
RFINCARFSPDGAFCVCVSSDKIVSV

SEQ ID NO: 2964176 - protein, 20 aa, Entamoeba invadens
RFISHGSFGLVFEVEKDGKC

SEQ ID NO: 2964177 - protein, 24 aa, Entamoeba invadens
RFISLMKLVLCLATNLKDKQVLLS

SEQ ID NO: 2964178 - protein, 23 aa, Entamoeba invadens
RFKEPPKEGLFCDLLWSDPVSVE

SEQ ID NO: 2964179 - protein, 18 aa, Entamoeba invadens
RFKLDGVVSTRMEKVNSA

SEQ ID NO: 2964180 - protein, 36 aa, Entamoeba invadens
RFKNDFNFVCCGKFKKRVKLSLTMDTVVDLVFQDRC

SEQ ID NO: 2964181 - protein, 22 aa, Entamoeba invadens
RFKNSGGAFPIEFTMTQMNAKM

SEQ ID NO: 2964182 - protein, 23 aa, Entamoeba invadens
RFKQRKRIMCEYSIDDMLKLHKF

SEQ ID NO: 2964183 - protein, 17 aa, Entamoeba invadens
RFKRKLIENECIIKVTR

SEQ ID NO: 2964184 - protein, 19 aa, Entamoeba invadens
RFLAMAIGFDRIELTITKE

SEQ ID NO: 2964185 - protein, 20 aa, Entamoeba invadens
RFLEKTPKAILVITSEYNPF

SEQ ID NO: 2964186 - protein, 19 aa, Entamoeba invadens
RFLHVWNIADFISSGKRLA

SEQ ID NO: 2964187 - protein, 21 aa, Entamoeba invadens
RFLIFKYPHFKEELNTIEAHT

SEQ ID NO: 2964188 - protein, 18 aa, Entamoeba invadens
RFLNGRPFEYQNKFPVMY

SEQ ID NO: 2964189 - protein, 18 aa, Entamoeba invadens
RFLQLFLVSVSKELTVDE

SEQ ID NO: 2964190 - protein, 37 aa, Entamoeba invadens
RFLSAKKKWDGVVNINCPIDFPLFFDFLRITNSRLKH

SEQ ID NO: 2964191 - protein, 23 aa, Entamoeba invadens
RFLWDRRIVNLTTFEVWNNGYSN

SEQ ID NO: 2964192 - protein, 22 aa, Entamoeba invadens
RFMNPEMNKFVFLLCTRAGGFG

SEQ ID NO: 2964193 - protein, 26 aa, Entamoeba invadens
RFNDGEVMGCGYLADKKMIFFTKNGY

SEQ ID NO: 2964194 - protein, 23 aa, Entamoeba invadens
RFNELLRMYLPIRIEIQGGIRPS

SEQ ID NO: 2964195 - protein, 20 aa, Entamoeba invadens
RFNFELNKYYLISDVGAITN

SEQ ID NO: 2964196 - protein, 21 aa, Entamoeba invadens
RFNFFKIAKDFFVEKKPENVD

SEQ ID NO: 2964197 - protein, 18 aa, Entamoeba invadens
RFNGKVISKGFAFVELKT

SEQ ID NO: 2964198 - protein, 20 aa, Entamoeba invadens
RFNKIREEFEYNVLYSSDKK

SEQ ID NO: 2964199 - protein, 18 aa, Entamoeba invadens
RFNLMLSALLRDIPSFEC

SEQ ID NO: 2964200 - protein, 21 aa, Entamoeba invadens
RFNWIGDTVVRCFNECPKSER

SEQ ID NO: 2964201 - protein, 20 aa, Entamoeba invadens
RFPEELLQIRSLELVQLSSN

SEQ ID NO: 2964202 - protein, 19 aa, Entamoeba invadens
RFPLLPFGEICSRWSKYIE

SEQ ID NO: 2964203 - protein, 23 aa, Entamoeba invadens
RFPNLHFPTKVVITISRKNNEPI

SEQ ID NO: 2964204 - protein, 18 aa, Entamoeba invadens
RFQKSASILRSARREKAM

SEQ ID NO: 2964205 - protein, 25 aa, Entamoeba invadens
RFQLSLPSIFSYPSYCVYVSDGSKG

SEQ ID NO: 2964206 - protein, 18 aa, Entamoeba invadens
RFQRRSSIHKSASKPVTE

SEQ ID NO: 2964207 - protein, 19 aa, Entamoeba invadens
RFQYLSGTFGKFYSDKRLF

SEQ ID NO: 2964208 - protein, 23 aa, Entamoeba invadens
RFRCPEALFQPSFLGMEASDIHE

SEQ ID NO: 2964209 - protein, 23 aa, Entamoeba invadens
RFRCPETLFQPSFLGMEASGIHE

SEQ ID NO: 2964210 - protein, 27 aa, Entamoeba invadens
RFRDMRETDVLISWGCSSDKCSDQSQD

SEQ ID NO: 2964211 - protein, 26 aa, Entamoeba invadens
RFRDVGDIGKIEWKRNVFDNLNKKLY

SEQ ID NO: 2964212 - protein, 17 aa, Entamoeba invadens
RFRENPIALSLDNKKLF

SEQ ID NO: 2964213 - protein, 23 aa, Entamoeba invadens
RFREVGFTLALTELFANFNEMND

SEQ ID NO: 2964214 - protein, 20 aa, Entamoeba invadens
RFSCMREIKEETGVQLTLEQ

SEQ ID NO: 2964215 - protein, 25 aa, Entamoeba invadens
RFSIPSVVLNSDFPRDIRTDIINQF

SEQ ID NO: 2964216 - protein, 20 aa, Entamoeba invadens
RFTETQMFWMFIEEQQTNFE

SEQ ID NO: 2964217 - protein, 17 aa, Entamoeba invadens
RFTHPGGPPIHTKRVSR

SEQ ID NO: 2964218 - protein, 25 aa, Entamoeba invadens
RFTKMELTGNFALNLKVLVIYSTLT

SEQ ID NO: 2964219 - protein, 23 aa, Entamoeba invadens
RFTPEITEKPFALKRETPSVDFV

SEQ ID NO: 2964220 - protein, 23 aa, Entamoeba invadens
RFTPERLKQIILARVGKEVIDLV

SEQ ID NO: 2964221 - protein, 18 aa, Entamoeba invadens
RFTVAQCLEHSFIQGRKH

SEQ ID NO: 2964222 - protein, 29 aa, Entamoeba invadens
RFVFLLCTRAGGIGINLSEADTVIIYDSD

SEQ ID NO: 2964223 - protein, 19 aa, Entamoeba invadens
RFVFLMSVFGKFYKKKEVL

SEQ ID NO: 2964224 - protein, 20 aa, Entamoeba invadens
RFVIDSGLGKWKVYNPKIGM

SEQ ID NO: 2964225 - protein, 23 aa, Entamoeba invadens
RFVPEGFLIHGFWPQSNEGFINC

SEQ ID NO: 2964226 - protein, 26 aa, Entamoeba invadens
RFVRFYKMFLDFLGGELVDLEKGEIR

SEQ ID NO: 2964227 - protein, 20 aa, Entamoeba invadens
RFVSLSVAFYRGADCCGLVF

SEQ ID NO: 2964228 - protein, 28 aa, Entamoeba invadens
RFYCKTSDCIIKLTPLVPTFDILETQTL

SEQ ID NO: 2964229 - protein, 27 aa, Entamoeba invadens
RFYHVNCFRCHYCLRVQIGDEINADFM

SEQ ID NO: 2964230 - protein, 21 aa, Entamoeba invadens
RFYLAEILLALEYLHLNGIIY

SEQ ID NO: 2964231 - protein, 19 aa, Entamoeba invadens
RFYLAEVLLALEYLHLNGI

SEQ ID NO: 2964232 - protein, 19 aa, Entamoeba invadens
RFYLLNVILYLNKRETILK

SEQ ID NO: 2964233 - protein, 19 aa, Entamoeba invadens
RFYQPRPLTMLLETVERQL

SEQ ID NO: 2964234 - protein, 18 aa, Entamoeba invadens
RGADLLKVRKELESQLRQ

SEQ ID NO: 2964235 - protein, 18 aa, Entamoeba invadens
RGADLLKVRNELESQLRQ

SEQ ID NO: 2964236 - protein, 20 aa, Entamoeba invadens
RGADLLKVRNELESQLRQTS

SEQ ID NO: 2964237 - protein, 25 aa, Entamoeba invadens
RGAKKDCDEYDPMPAPGQKSTRKKH

SEQ ID NO: 2964238 - protein, 21 aa, Entamoeba invadens
RGAKVRSGKIWSKALDDAIVS

SEQ ID NO: 2964239 - protein, 28 aa, Entamoeba invadens
RGAMFPCSHCFHLLCIKNEFKQHPTAFA

SEQ ID NO: 2964240 - protein, 17 aa, Entamoeba invadens
RGARGYYSKQLITGKKE

SEQ ID NO: 2964241 - protein, 19 aa, Entamoeba invadens
RGCEALREVVLPNSLTKLG

SEQ ID NO: 2964242 - protein, 17 aa, Entamoeba invadens
RGCETKNAIDFLVSILV

SEQ ID NO: 2964243 - protein, 22 aa, Entamoeba invadens
RGCGNSTMFYCMSGDGVCLSPL

SEQ ID NO: 2964244 - protein, 18 aa, Entamoeba invadens
RGCLKNLEMIITYNSTFE

SEQ ID NO: 2964245 - protein, 28 aa, Entamoeba invadens
RGDFKGEILISLSTFCYLLPQTEQTTCE

SEQ ID NO: 2964246 - protein, 19 aa, Entamoeba invadens
RGDGTFVYRDLLFQLCSKE

SEQ ID NO: 2964247 - protein, 21 aa, Entamoeba invadens
RGDLKPVVEFFKLYTSNGTEL

SEQ ID NO: 2964248 - protein, 19 aa, Entamoeba invadens
RGDLVEFVRPGQTCTFIGM

SEQ ID NO: 2964249 - protein, 18 aa, Entamoeba invadens
RGDMFGVYVYGTIDKTDV

SEQ ID NO: 2964250 - protein, 26 aa, Entamoeba invadens
RGDPFCFVLEAIRFALVPFIDAAKGL

SEQ ID NO: 2964251 - protein, 19 aa, Entamoeba invadens
RGDQCRAQVTAIIKTCEAL

SEQ ID NO: 2964252 - protein, 18 aa, Entamoeba invadens
RGDRGNMTRCCVKTDAGT

SEQ ID NO: 2964253 - protein, 25 aa, Entamoeba invadens
RGDTHYLLYICDLMRNECLEQNVLY

SEQ ID NO: 2964254 - protein, 22 aa, Entamoeba invadens
RGDVFLTELEKIYSSIFDTQKC

SEQ ID NO: 2964255 - protein, 17 aa, Entamoeba invadens
RGEIKVILFNHSDVEFK

SEQ ID NO: 2964256 - protein, 18 aa, Entamoeba invadens
RGEIPSVISQSDISNDVS

SEQ ID NO: 2964257 - protein, 21 aa, Entamoeba invadens
RGELWCIEATIQKNDIDTNFL

SEQ ID NO: 2964258 - protein, 17 aa, Entamoeba invadens
RGERPNFHISIRTNRNG

SEQ ID NO: 2964259 - protein, 26 aa, Entamoeba invadens
RGESGLFKMEFCKSKEMSTIELEKMK

SEQ ID NO: 2964260 - protein, 20 aa, Entamoeba invadens
RGETVLAHVMMQVNGVLLRK

SEQ ID NO: 2964261 - protein, 18 aa, Entamoeba invadens
RGEVPVKYTPTVLSDKDL

SEQ ID NO: 2964262 - protein, 22 aa, Entamoeba invadens
RGFDWSICDTLTRISLTDKITQ

SEQ ID NO: 2964263 - protein, 17 aa, Entamoeba invadens
RGFEKYVGFTWISDQTI

SEQ ID NO: 2964264 - protein, 17 aa, Entamoeba invadens
RGFNGFVTVVFPDERNS

SEQ ID NO: 2964265 - protein, 32 aa, Entamoeba invadens
RGGDVYRQLLFLDYLNGVSIDFQQHVFNGTDN

SEQ ID NO: 2964266 - protein, 22 aa, Entamoeba invadens
RGGEANVVFLLDRSGSMEGVGI

SEQ ID NO: 2964267 - protein, 18 aa, Entamoeba invadens
RGGKRVKRIREMYSMTEI

SEQ ID NO: 2964268 - protein, 22 aa, Entamoeba invadens
RGGLRSYPIIDIIKRIKKSINE

SEQ ID NO: 2964269 - protein, 17 aa, Entamoeba invadens
RGGMVSRFVDGKWRFYD

SEQ ID NO: 2964270 - protein, 27 aa, Entamoeba invadens
RGGPKKERVRCGFDYTAQEQGELTFKE

SEQ ID NO: 2964271 - protein, 18 aa, Entamoeba invadens
RGGQFKKFTKVFMQLSDQ

SEQ ID NO: 2964272 - protein, 17 aa, Entamoeba invadens
RGGRFGFYSSNGISSRY

SEQ ID NO: 2964273 - protein, 23 aa, Entamoeba invadens
RGHIVEMPLDFGLEEGSSMSLGN

SEQ ID NO: 2964274 - protein, 17 aa, Entamoeba invadens
RGHKHKRSQVDYNSFED

SEQ ID NO: 2964275 - protein, 18 aa, Entamoeba invadens
RGIDPIGNVILFPNKVLP

SEQ ID NO: 2964276 - protein, 24 aa, Entamoeba invadens
RGIHKGDVAFLVICASLNFEDQKE

SEQ ID NO: 2964277 - protein, 19 aa, Entamoeba invadens
RGITNLVAIGCVFDNDLTS

SEQ ID NO: 2964278 - protein, 19 aa, Entamoeba invadens
RGKEDLGKLTTEYKKLEAD

SEQ ID NO: 2964279 - protein, 19 aa, Entamoeba invadens
RGKEGVAQFFPTKEETERA

SEQ ID NO: 2964280 - protein, 23 aa, Entamoeba invadens
RGKFKRIEISNVDCVEFMECEVE

SEQ ID NO: 2964281 - protein, 17 aa, Entamoeba invadens
RGKGMSTLSQMWKDLPE

SEQ ID NO: 2964282 - protein, 17 aa, Entamoeba invadens
RGKGMTTLSGMWKLLPD

SEQ ID NO: 2964283 - protein, 22 aa, Entamoeba invadens
RGKKLPDLDILFSKLDLAQKCT

SEQ ID NO: 2964284 - protein, 21 aa, Entamoeba invadens
RGKKSPCYKDIDFLDQKAVIK

SEQ ID NO: 2964285 - protein, 20 aa, Entamoeba invadens
RGKMNCFEFQCFVLDCYNQQ

SEQ ID NO: 2964286 - protein, 18 aa, Entamoeba invadens
RGKPVLVIMDSINRVNEF

SEQ ID NO: 2964287 - protein, 19 aa, Entamoeba invadens
RGKSAILIIYSLRDVGTLN

SEQ ID NO: 2964288 - protein, 20 aa, Entamoeba invadens
RGKSAILIIYSLRDVGTLNE

SEQ ID NO: 2964289 - protein, 22 aa, Entamoeba invadens
RGKTLKFTKCETLSDIYVNTKM

SEQ ID NO: 2964290 - protein, 28 aa, Entamoeba invadens
RGKYSAFGDVCFWLDVHSPTFTFFITQE

SEQ ID NO: 2964291 - protein, 21 aa, Entamoeba invadens
RGLEAYICFLVQCVISTAGKY

SEQ ID NO: 2964292 - protein, 21 aa, Entamoeba invadens
RGLEILKDVYLTPITKSSIAD

SEQ ID NO: 2964293 - protein, 17 aa, Entamoeba invadens
RGLLISVHLRKIIEIIE

SEQ ID NO: 2964294 - protein, 29 aa, Entamoeba invadens
RGLMNMPCVWELIPLLLAGNGMREEEILY

SEQ ID NO: 2964295 - protein, 18 aa, Entamoeba invadens
RGLMPTAEDMCTIAYRVA

SEQ ID NO: 2964296 - protein, 27 aa, Entamoeba invadens
RGLMSCEVITTLFFMKLFNPTRVFLLR

SEQ ID NO: 2964297 - protein, 19 aa, Entamoeba invadens
RGLPCGHNCILECHYGECV

SEQ ID NO: 2964298 - protein, 20 aa, Entamoeba invadens
RGLPHAHILIVLDFKSKLKT

SEQ ID NO: 2964299 - protein, 17 aa, Entamoeba invadens
RGLPLFFALDFTLQQRP

SEQ ID NO: 2964300 - protein, 17 aa, Entamoeba invadens
RGNIRCLIPNEIVKMKE

SEQ ID NO: 2964301 - protein, 26 aa, Entamoeba invadens
RGNLQIIIKILLEFHQGIGDDKVIDL

SEQ ID NO: 2964302 - protein, 19 aa, Entamoeba invadens
RGNMTRCCVKTDAGTTKSQ

SEQ ID NO: 2964303 - protein, 19 aa, Entamoeba invadens
RGNMVVYVLTKYVGMFCLY

SEQ ID NO: 2964304 - protein, 19 aa, Entamoeba invadens
RGNRQLKGKLRAFDQHLNL

SEQ ID NO: 2964305 - protein, 23 aa, Entamoeba invadens
RGPKNPLVVRFIEKLFKMVNECR

SEQ ID NO: 2964306 - protein, 24 aa, Entamoeba invadens
RGPKYCEFPSPFPFVHLHNNNEAI

SEQ ID NO: 2964307 - protein, 22 aa, Entamoeba invadens
RGPSFFCSCGLDLSQEVIESES

SEQ ID NO: 2964308 - protein, 18 aa, Entamoeba invadens
RGPYRYHYEKGATYNLLE

SEQ ID NO: 2964309 - protein, 17 aa, Entamoeba invadens
RGQKEFSQTTPFSFTYR

SEQ ID NO: 2964310 - protein, 17 aa, Entamoeba invadens
RGQLSSVIVQFVNSSEQ

SEQ ID NO: 2964311 - protein, 17 aa, Entamoeba invadens
RGRDWKWSDQDGGNGKL

SEQ ID NO: 2964312 - protein, 17 aa, Entamoeba invadens
RGRHIHISNNYVEGCVM

SEQ ID NO: 2964313 - protein, 24 aa, Entamoeba invadens
RGRKTRPDLIVGICGEHGGEPSSI

SEQ ID NO: 2964314 - protein, 18 aa, Entamoeba invadens
RGRLPYFIAPPTPKLNDT

SEQ ID NO: 2964315 - protein, 17 aa, Entamoeba invadens
RGSAMFIQVPPIEESSC

SEQ ID NO: 2964316 - protein, 21 aa, Entamoeba invadens
RGSDCCVLCFDVTNRESFNHL

SEQ ID NO: 2964317 - protein, 25 aa, Entamoeba invadens
RGSFCGCEPLSISCCVRNLPPEVFD

SEQ ID NO: 2964318 - protein, 17 aa, Entamoeba invadens
RGSGPAVNYTHCEINPA

SEQ ID NO: 2964319 - protein, 25 aa, Entamoeba invadens
RGSIKKLKRVFSFSKQKGNKEDKKE

SEQ ID NO: 2964320 - protein, 18 aa, Entamoeba invadens
RGSLFDRRVFNLRRYDMK

SEQ ID NO: 2964321 - protein, 26 aa, Entamoeba invadens
RGTFGSIIGLFGEFFKATGKSLTNSG

SEQ ID NO: 2964322 - protein, 18 aa, Entamoeba invadens
RGTKGVCGLQNLGNTCFM

SEQ ID NO: 2964323 - protein, 17 aa, Entamoeba invadens
RGTLKMETIKKIYWNGR

SEQ ID NO: 2964324 - protein, 25 aa, Entamoeba invadens
RGTQYRVECCLKRVSEDFELFSPTP

SEQ ID NO: 2964325 - protein, 20 aa, Entamoeba invadens
RGTSNFYRTFILTMDGKIIN

SEQ ID NO: 2964326 - protein, 20 aa, Entamoeba invadens
RGTVGLSGYLVRKENDKVVV

SEQ ID NO: 2964327 - protein, 18 aa, Entamoeba invadens
RGVCYIKTDHIEEFTQKV

SEQ ID NO: 2964328 - protein, 17 aa, Entamoeba invadens
RGVDVKQTWSSLINEES

SEQ ID NO: 2964329 - protein, 28 aa, Entamoeba invadens
RGVESTCCINCSALSLVIEDFANTISFT

SEQ ID NO: 2964330 - protein, 21 aa, Entamoeba invadens
RGVFKTIYAIDDFINAINKLV

SEQ ID NO: 2964331 - protein, 17 aa, Entamoeba invadens
RGVFWCCNSLVKFERFG

SEQ ID NO: 2964332 - protein, 18 aa, Entamoeba invadens
RGVFWCCNSLVKFERFGD

SEQ ID NO: 2964333 - protein, 23 aa, Entamoeba invadens
RGVKGEREFLIFVESETDLKGFL

SEQ ID NO: 2964334 - protein, 19 aa, Entamoeba invadens
RGVNFKFEKTHGYDSYDGP

SEQ ID NO: 2964335 - protein, 18 aa, Entamoeba invadens
RGVPEIEERDALAAVQLV

SEQ ID NO: 2964336 - protein, 17 aa, Entamoeba invadens
RGVPVVIASSGRKEHIS

SEQ ID NO: 2964337 - protein, 25 aa, Entamoeba invadens
RGVTLCGDIGVLSKYTSFPFDEHYE

SEQ ID NO: 2964338 - protein, 17 aa, Entamoeba invadens
RGVVVCGGCDGKVLFFW

SEQ ID NO: 2964339 - protein, 29 aa, Entamoeba invadens
RGWIGGQMIELLKAQGFEVVSGEARLEER

SEQ ID NO: 2964340 - protein, 33 aa, Entamoeba invadens
RGYACEVEILLLIRCTLKIKSEVLIVSKNLQSN

SEQ ID NO: 2964341 - protein, 17 aa, Entamoeba invadens
RGYADMFVFHRMNGDQF

SEQ ID NO: 2964342 - protein, 17 aa, Entamoeba invadens
RGYCEVSNDFKFYYRDR

SEQ ID NO: 2964343 - protein, 21 aa, Entamoeba invadens
RGYILDCIKTVLPDFTTENPA

SEQ ID NO: 2964344 - protein, 18 aa, Entamoeba invadens
RGYILRRSGVYARASISR

SEQ ID NO: 2964345 - protein, 21 aa, Entamoeba invadens
RGYKLYLKLRDLFKNTERNIP

SEQ ID NO: 2964346 - protein, 22 aa, Entamoeba invadens
RGYRPHRRAPRRYQHDEKRVES

SEQ ID NO: 2964347 - protein, 20 aa, Entamoeba invadens
RGYSAWDYNSSVFVIKDEFG

SEQ ID NO: 2964348 - protein, 23 aa, Entamoeba invadens
RGYYCLETVLLLLSLKVKFPERI

SEQ ID NO: 2964349 - protein, 21 aa, Entamoeba invadens
RHAEFAEALYLAEKASAEENA

SEQ ID NO: 2964350 - protein, 28 aa, Entamoeba invadens
RHAKNQWAREMKEFGLTRIDGIRRDIQD

SEQ ID NO: 2964351 - protein, 17 aa, Entamoeba invadens
RHFAFKLQCKSGCEPTK

SEQ ID NO: 2964352 - protein, 24 aa, Entamoeba invadens
RHFDKSRASLCVNMLIDLTQKYGY

SEQ ID NO: 2964353 - protein, 33 aa, Entamoeba invadens
RHHCRMCGRCICGDCSRGKIQLAPKGPEERVCK

SEQ ID NO: 2964354 - protein, 27 aa, Entamoeba invadens
RHINGMNCYCFQRWRVLMEKNSKFDMK

SEQ ID NO: 2964355 - protein, 24 aa, Entamoeba invadens
RHISGAKYLDWIVVVMQPDMYRSE

SEQ ID NO: 2964356 - protein, 17 aa, Entamoeba invadens
RHKELRFFDQVLANLPK

SEQ ID NO: 2964357 - protein, 25 aa, Entamoeba invadens
RHKGIKDLFDFIAYGVSIPCFSPTR

SEQ ID NO: 2964358 - protein, 25 aa, Entamoeba invadens
RHKNDFGAIMLLDMRYNRPNNRKMM

SEQ ID NO: 2964359 - protein, 22 aa, Entamoeba invadens
RHKSLKGCVGVRLELFDSSMCF

SEQ ID NO: 2964360 - protein, 27 aa, Entamoeba invadens
RHLLGLLYLLFRKYRLDTIKNDEGTEK

SEQ ID NO: 2964361 - protein, 26 aa, Entamoeba invadens
RHLQILEGNKAYSFVQIHYLGWPDMG

SEQ ID NO: 2964362 - protein, 18 aa, Entamoeba invadens
RHLREINELNLLKQMSQE

SEQ ID NO: 2964363 - protein, 18 aa, Entamoeba invadens
RHLSEIGDECFSKCNNLL

SEQ ID NO: 2964364 - protein, 22 aa, Entamoeba invadens
RHMTLLVVRQFLFGKELEKSSK

SEQ ID NO: 2964365 - protein, 25 aa, Entamoeba invadens
RHNLYCPYISFKLSNGQVITIGNKR

SEQ ID NO: 2964366 - protein, 27 aa, Entamoeba invadens
RHPALSAVFMKSGYRTLLSLKGFTEQG

SEQ ID NO: 2964367 - protein, 17 aa, Entamoeba invadens
RHPASSRVLMKNECQTL

SEQ ID NO: 2964368 - protein, 28 aa, Entamoeba invadens
RHPDFHGELFKKAYDTLLSLKGFTDSGK

SEQ ID NO: 2964369 - protein, 17 aa, Entamoeba invadens
RHPHSKGFISLNGIQGV

SEQ ID NO: 2964370 - protein, 27 aa, Entamoeba invadens
RHSELYGMDVFFPKMLVFTSLCSVVEK

SEQ ID NO: 2964371 - protein, 20 aa, Entamoeba invadens
RHSFSMMELVAGQFLQDQNY

SEQ ID NO: 2964372 - protein, 30 aa, Entamoeba invadens
RHSKVPSHLPLSVRFYWDSKVPKGYYNKEY

SEQ ID NO: 2964373 - protein, 25 aa, Entamoeba invadens
RHTMMKYMMVYVFALPFNDFIETAM

SEQ ID NO: 2964374 - protein, 24 aa, Entamoeba invadens
RHYNECIQPQMTQCVNGMNDFNNF

SEQ ID NO: 2964375 - protein, 26 aa, Entamoeba invadens
RHYRAPEIILGIPYNNSIDMWSAGCI

SEQ ID NO: 2964376 - protein, 25 aa, Entamoeba invadens
RHYRAPEVILGLPYSCAIDVWSAGC

SEQ ID NO: 2964377 - protein, 20 aa, Entamoeba invadens
RHYRAPEVILGLPYSSAIDM

SEQ ID NO: 2964378 - protein, 31 aa, Entamoeba invadens
RHYRAPEVILGLPYSSAIDMWSLGCIAAEFF

SEQ ID NO: 2964379 - protein, 20 aa, Entamoeba invadens
RHYRAPEVVLGLPYSCAIDM

SEQ ID NO: 2964380 - protein, 20 aa, Entamoeba invadens
RHYRSPEVILGIPYSTAIDM

SEQ ID NO: 2964381 - protein, 18 aa, Entamoeba invadens
RIAEAFGAQVSYFSTTEK

SEQ ID NO: 2964382 - protein, 24 aa, Entamoeba invadens
RIAEQKKLVVINMNFLQYEMSTDK

SEQ ID NO: 2964383 - protein, 37 aa, Entamoeba invadens
RIAHKYSKERGVFRFLPEFLSAFFYNAHVYLYPQKTV

SEQ ID NO: 2964384 - protein, 20 aa, Entamoeba invadens
RIAIEAKPFAAMTAYNKVNG

SEQ ID NO: 2964385 - protein, 23 aa, Entamoeba invadens
RIAMPDCRIVFLLFSSIPSTCVG

SEQ ID NO: 2964386 - protein, 18 aa, Entamoeba invadens
RIAQMVIERICKCPVVEV

SEQ ID NO: 2964387 - protein, 18 aa, Entamoeba invadens
RIAQRAPRPESRMGPAPQ

SEQ ID NO: 2964388 - protein, 19 aa, Entamoeba invadens
RIASIVGRYEEIDKKKAEE

SEQ ID NO: 2964389 - protein, 20 aa, Entamoeba invadens
RICEKIADFVGIEYHSVLDI

SEQ ID NO: 2964390 - protein, 24 aa, Entamoeba invadens
RICSDLRVNIKYLKYVENIESIVV

SEQ ID NO: 2964391 - protein, 21 aa, Entamoeba invadens
RICSICKPNMFPDVNGICKAC

SEQ ID NO: 2964392 - protein, 22 aa, Entamoeba invadens
RICTKCLSGYYLQDGECLQIKN

SEQ ID NO: 2964393 - protein, 27 aa, Entamoeba invadens
RIDFPRGYLVMECCNGDLNAYVEGYLK

SEQ ID NO: 2964394 - protein, 25 aa, Entamoeba invadens
RIDGLKYKICFKMSYDQFTRLEGKY

SEQ ID NO: 2964395 - protein, 17 aa, Entamoeba invadens
RIDKLLAATPVREAKLY

SEQ ID NO: 2964396 - protein, 17 aa, Entamoeba invadens
RIDNLYISFPHQLEEWA

SEQ ID NO: 2964397 - protein, 18 aa, Entamoeba invadens
RIDTLFVELTSFFNSLFK

SEQ ID NO: 2964398 - protein, 19 aa, Entamoeba invadens
RIDWGEIAIIGGITIASIG

SEQ ID NO: 2964399 - protein, 24 aa, Entamoeba invadens
RIEEICQRLSVTHFDEMPCDVVAN

SEQ ID NO: 2964400 - protein, 25 aa, Entamoeba invadens
RIEELNVLFLAYLVNKYPDQYKTLA

SEQ ID NO: 2964401 - protein, 17 aa, Entamoeba invadens
RIEFFGIHWCIKEAVLK

SEQ ID NO: 2964402 - protein, 22 aa, Entamoeba invadens
RIEFLNLYLGFSRFSGKETSLG

SEQ ID NO: 2964403 - protein, 20 aa, Entamoeba invadens
RIEGDIMKALNFKINVTADK

SEQ ID NO: 2964404 - protein, 18 aa, Entamoeba invadens
RIEHPRVVLLDCNLEYTK

SEQ ID NO: 2964405 - protein, 25 aa, Entamoeba invadens
RIEIPEPMTTFGIGAFYKVANLESV

SEQ ID NO: 2964406 - protein, 25 aa, Entamoeba invadens
RIEKIFRIYLCFMMSEAGNVESIFD

SEQ ID NO: 2964407 - protein, 32 aa, Entamoeba invadens
RIEKPELAKTIAHPFFRIVSISTEYDEIQLAE

SEQ ID NO: 2964408 - protein, 32 aa, Entamoeba invadens
RIELTNYFKYIEVFENLHFGQIEFQENTVFFM

SEQ ID NO: 2964409 - protein, 20 aa, Entamoeba invadens
RIEMKNCNFVASFEFQIKNL

SEQ ID NO: 2964410 - protein, 19 aa, Entamoeba invadens
RIEMNTGRDFIPHRGKDIS

SEQ ID NO: 2964411 - protein, 21 aa, Entamoeba invadens
RIENRHLWFQALQKPKASRRR

SEQ ID NO: 2964412 - protein, 17 aa, Entamoeba invadens
RIENVDIQNLILILTNI

SEQ ID NO: 2964413 - protein, 17 aa, Entamoeba invadens
RIEPSLDCRVINNSVEV

SEQ ID NO: 2964414 - protein, 25 aa, Entamoeba invadens
RIERRGSQEMIVLVLISRFGNTIHF

SEQ ID NO: 2964415 - protein, 19 aa, Entamoeba invadens
RIETKLDHINKCLKILGEM

SEQ ID NO: 2964416 - protein, 20 aa, Entamoeba invadens
RIEVRGVFEGYKLVVKGVMR

SEQ ID NO: 2964417 - protein, 27 aa, Entamoeba invadens
RIFEGHHAPVWSISWSKTDPSIFATAG

SEQ ID NO: 2964418 - protein, 17 aa, Entamoeba invadens
RIFGNRSLMGWQNVRAC

SEQ ID NO: 2964419 - protein, 19 aa, Entamoeba invadens
RIFPHPDFPKVVIVSENGN

SEQ ID NO: 2964420 - protein, 31 aa, Entamoeba invadens
RIFRSIFEILLLKRWAQPALKALEISISVNR

SEQ ID NO: 2964421 - protein, 18 aa, Entamoeba invadens
RIFTDFIKHSSFISSELK

SEQ ID NO: 2964422 - protein, 22 aa, Entamoeba invadens
RIFTTKGKVVFGMEVKRDKLVT

SEQ ID NO: 2964423 - protein, 20 aa, Entamoeba invadens
RIFYCREYAFRIREFLGEQI

SEQ ID NO: 2964424 - protein, 24 aa, Entamoeba invadens
RIGAYRYIECSALSQVNLENVFNE

SEQ ID NO: 2964425 - protein, 19 aa, Entamoeba invadens
RIGDGCFSLCLSLSSVTLP

SEQ ID NO: 2964426 - protein, 25 aa, Entamoeba invadens
RIGEIPEMYSCIAMFSADQKAMEQM

SEQ ID NO: 2964427 - protein, 27 aa, Entamoeba invadens
RIGETYKEMKFELKVERVEEIKIEEKE

SEQ ID NO: 2964428 - protein, 20 aa, Entamoeba invadens
RIGGRKVAKVDIEFLNGNVG

SEQ ID NO: 2964429 - protein, 19 aa, Entamoeba invadens
RIGMKVNIINCPELDVMIQ

SEQ ID NO: 2964430 - protein, 37 aa, Entamoeba invadens
RIGRSYSFTEVVRWFAERADMIILVFDAHKLDISDEF

SEQ ID NO: 2964431 - protein, 18 aa, Entamoeba invadens
RIGRWEQQKVLSFVPPEG

SEQ ID NO: 2964432 - protein, 17 aa, Entamoeba invadens
RIGTKCFVECPNLKEIK

SEQ ID NO: 2964433 - protein, 18 aa, Entamoeba invadens
RIGVKSVIENVFERKLVK

SEQ ID NO: 2964434 - protein, 25 aa, Entamoeba invadens
RIHAALKKGRYGEHVNKMASVYLTA

SEQ ID NO: 2964435 - protein, 19 aa, Entamoeba invadens
RIHTIPENITQLGITKLDL

SEQ ID NO: 2964436 - protein, 21 aa, Entamoeba invadens
RIIARKEVVCLPFYTFIVRYL

SEQ ID NO: 2964437 - protein, 22 aa, Entamoeba invadens
RIIDDFIFFCFFVGNDFLPHSP

SEQ ID NO: 2964438 - protein, 22 aa, Entamoeba invadens
RIIDDFIFLCFFIGNDFLPHSP

SEQ ID NO: 2964439 - protein, 17 aa, Entamoeba invadens
RIIELDVLRTLKSEEYK

SEQ ID NO: 2964440 - protein, 17 aa, Entamoeba invadens
RIIEVVGNYAIHNALIS

SEQ ID NO: 2964441 - protein, 17 aa, Entamoeba invadens
RIIGFKTTMYRNGSTED

SEQ ID NO: 2964442 - protein, 20 aa, Entamoeba invadens
RIIIEPTAAIAYGQDKKTER

SEQ ID NO: 2964443 - protein, 20 aa, Entamoeba invadens
RIIIWFEVDYSFSLKHKNTN

SEQ ID NO: 2964444 - protein, 24 aa, Entamoeba invadens
RIIKARKQYNDWVLNKQNEMLNEY

SEQ ID NO: 2964445 - protein, 20 aa, Entamoeba invadens
RIINCTTDGASVCSGLDGGH

SEQ ID NO: 2964446 - protein, 25 aa, Entamoeba invadens
RIISAIKYWIENVWNVIKTNEKPID

SEQ ID NO: 2964447 - protein, 19 aa, Entamoeba invadens
RIISHLMIKINYNQTKLFI

SEQ ID NO: 2964448 - protein, 21 aa, Entamoeba invadens
RIITPRLALTTAEYFAYTCDM

SEQ ID NO: 2964449 - protein, 18 aa, Entamoeba invadens
RIITQPVNYTEIVSEVEN

SEQ ID NO: 2964450 - protein, 27 aa, Entamoeba invadens
RIIYNEFLKRYFFLGTNINKKSSGAMP

SEQ ID NO: 2964451 - protein, 22 aa, Entamoeba invadens
RIKDGCFMNCLSLKEVKCEGNT

SEQ ID NO: 2964452 - protein, 20 aa, Entamoeba invadens
RIKDVKVIPLDFHVVEQRVF

SEQ ID NO: 2964453 - protein, 18 aa, Entamoeba invadens
RIKEFCFYHSVAKENVLF

SEQ ID NO: 2964454 - protein, 18 aa, Entamoeba invadens
RIKEVYFGKIRIFQKNEI

SEQ ID NO: 2964455 - protein, 18 aa, Entamoeba invadens
RIKFLKLKIDHDTQIISE

SEQ ID NO: 2964456 - protein, 17 aa, Entamoeba invadens
RIKKEIEVHKLLTKNEY

SEQ ID NO: 2964457 - protein, 18 aa, Entamoeba invadens
RIKKVVTSYIHFIVMYLD

SEQ ID NO: 2964458 - protein, 17 aa, Entamoeba invadens
RIKNIFESFDMVLKKIL

SEQ ID NO: 2964459 - protein, 33 aa, Entamoeba invadens
RIKQFRFSRSKKWRMGAVLSILGVEMPVEEKKE

SEQ ID NO: 2964460 - protein, 24 aa, Entamoeba invadens
RIKQICMGCHRFSVLCENVSSFEC

SEQ ID NO: 2964461 - protein, 23 aa, Entamoeba invadens
RIKRLEICQGDYWNVHLNVDIVT

SEQ ID NO: 2964462 - protein, 22 aa, Entamoeba invadens
RIKSGDIIICHDLKDNLDYVEE

SEQ ID NO: 2964463 - protein, 28 aa, Entamoeba invadens
RIKSLEGLCIKGGLRGDMFKCDQRAIKF

SEQ ID NO: 2964464 - protein, 17 aa, Entamoeba invadens
RIKSSFVKSLGKVFHKP

SEQ ID NO: 2964465 - protein, 20 aa, Entamoeba invadens
RIKTIMFNDLNVPFLKIVNP

SEQ ID NO: 2964466 - protein, 21 aa, Entamoeba invadens
RIKTLRLFNRNVFVFTNNFLL

SEQ ID NO: 2964467 - protein, 18 aa, Entamoeba invadens
RIKVLMCTWNVNQCVFNI

SEQ ID NO: 2964468 - protein, 22 aa, Entamoeba invadens
RIKYTHTLFRKNLVDKIKNRYV

SEQ ID NO: 2964469 - protein, 19 aa, Entamoeba invadens
RILGFKNRKGFLVFSIRVH

SEQ ID NO: 2964470 - protein, 24 aa, Entamoeba invadens
RILKTCLFFNFAYQIKHIMIKLDR

SEQ ID NO: 2964471 - protein, 27 aa, Entamoeba invadens
RILLLQKVLYCEGGSKHKSCHIRKVKY

SEQ ID NO: 2964472 - protein, 19 aa, Entamoeba invadens
RILLVANKRDLQWKVTRQE

SEQ ID NO: 2964473 - protein, 33 aa, Entamoeba invadens
RILPCDFLYAVFDFCLLDGYKAMFTIANAIVHY

SEQ ID NO: 2964474 - protein, 20 aa, Entamoeba invadens
RILQRVCSMLNDPKHLIVLL

SEQ ID NO: 2964475 - protein, 23 aa, Entamoeba invadens
RILRCAFCSCSNLSEIQFSSNLT

SEQ ID NO: 2964476 - protein, 19 aa, Entamoeba invadens
RILRQCVETLFGKQKVSEE

SEQ ID NO: 2964477 - protein, 20 aa, Entamoeba invadens
RILSGWDRIVSETLQTYEKS

SEQ ID NO: 2964478 - protein, 19 aa, Entamoeba invadens
RIMEHLHVLMDFIKGDPVY

SEQ ID NO: 2964479 - protein, 19 aa, Entamoeba invadens
RIMEHLHVLMDVLSTTRFD

SEQ ID NO: 2964480 - protein, 17 aa, Entamoeba invadens
RIMFKCTPPHQFQLEGF

SEQ ID NO: 2964481 - protein, 17 aa, Entamoeba invadens
RIMQDGCVTCYNLLKSN

SEQ ID NO: 2964482 - protein, 20 aa, Entamoeba invadens
RIMRYPIILKQILKMTPKSH

SEQ ID NO: 2964483 - protein, 18 aa, Entamoeba invadens
RINGGYKIKLTQLGKALC

SEQ ID NO: 2964484 - protein, 25 aa, Entamoeba invadens
RINIDELFVALGRKLLQINHKGEVA

SEQ ID NO: 2964485 - protein, 19 aa, Entamoeba invadens
RINIDVMHKEMFIDFTGDK

SEQ ID NO: 2964486 - protein, 27 aa, Entamoeba invadens
RINKIFSKKEFPVMFVHCKGDEGYGSS

SEQ ID NO: 2964487 - protein, 19 aa, Entamoeba invadens
RINKKAQDAIRCLKVNPRS

SEQ ID NO: 2964488 - protein, 21 aa, Entamoeba invadens
RINTVFEFTRMMIIAENMSSE

SEQ ID NO: 2964489 - protein, 18 aa, Entamoeba invadens
RINWSDITFAVGASDEYV

SEQ ID NO: 2964490 - protein, 22 aa, Entamoeba invadens
RIPDEFKNSIRVRGKIDVDLIT

SEQ ID NO: 2964491 - protein, 17 aa, Entamoeba invadens
RIPEMKIDLQAFTTPLD

SEQ ID NO: 2964492 - protein, 17 aa, Entamoeba invadens
RIPHGYESPRKCYTSEV

SEQ ID NO: 2964493 - protein, 26 aa, Entamoeba invadens
RIPHPLSSVYLLFSLNQRKAVLTSLV

SEQ ID NO: 2964494 - protein, 20 aa, Entamoeba invadens
RIPNGLCKDCDNLIKIEIDD

SEQ ID NO: 2964495 - protein, 23 aa, Entamoeba invadens
RIPQCLVKLGTALQHVDGVRAMA

SEQ ID NO: 2964496 - protein, 18 aa, Entamoeba invadens
RIPQQYIETERLFRRPSA

SEQ ID NO: 2964497 - protein, 19 aa, Entamoeba invadens
RIPRYKLLLNDLLKHTPHN

SEQ ID NO: 2964498 - protein, 18 aa, Entamoeba invadens
RIPRYKLLLNDLLKHTPQ

SEQ ID NO: 2964499 - protein, 18 aa, Entamoeba invadens
RIPSCLEVETVGGHFFQR

SEQ ID NO: 2964500 - protein, 18 aa, Entamoeba invadens
RIPVNGLVGLTFLNIPLY

SEQ ID NO: 2964501 - protein, 18 aa, Entamoeba invadens
RIPVPYAVALSRNRSDEF

SEQ ID NO: 2964502 - protein, 19 aa, Entamoeba invadens
RIQEMLRMNDLALVSSKGS

SEQ ID NO: 2964503 - protein, 18 aa, Entamoeba invadens
RIQFEKEQIENDKKLNED

SEQ ID NO: 2964504 - protein, 24 aa, Entamoeba invadens
RIQRRMVRDMLFRGYPVERTLEVW

SEQ ID NO: 2964505 - protein, 19 aa, Entamoeba invadens
RIQTSIIFINMRPIEVDVQ

SEQ ID NO: 2964506 - protein, 18 aa, Entamoeba invadens
RIREVSATFLKAMVNGIP

SEQ ID NO: 2964507 - protein, 28 aa, Entamoeba invadens
RISEARAKMELRPLISVDDAKEAIRLVK

SEQ ID NO: 2964508 - protein, 26 aa, Entamoeba invadens
RISEWIDFKTTILLCPMRPNKADSNP

SEQ ID NO: 2964509 - protein, 17 aa, Entamoeba invadens
RISLECDDYLRAMLLSN

SEQ ID NO: 2964510 - protein, 19 aa, Entamoeba invadens
RISLIRLVLTYGQQKPLRS

SEQ ID NO: 2964511 - protein, 31 aa, Entamoeba invadens
RISLKEIFEHPFLKKHFDNFVETPIPHRSYQ

SEQ ID NO: 2964512 - protein, 24 aa, Entamoeba invadens
RISMSPRVKKFIGRKTTGETKVKS

SEQ ID NO: 2964513 - protein, 19 aa, Entamoeba invadens
RISNHIVCALGQLQNLMTN

SEQ ID NO: 2964514 - protein, 24 aa, Entamoeba invadens
RISNSLGEKALIFAKKRTSEAEEN

SEQ ID NO: 2964515 - protein, 20 aa, Entamoeba invadens
RISPESKPLFTHIQTQIVYT

SEQ ID NO: 2964516 - protein, 26 aa, Entamoeba invadens
RISTSAYWKKLVVIISDASVPGEGEH

SEQ ID NO: 2964517 - protein, 26 aa, Entamoeba invadens
RISTSAYWKKLVVIISDSSVPGEGEH

SEQ ID NO: 2964518 - protein, 23 aa, Entamoeba invadens
RITERKVIVALMFIEPILDVFIS

SEQ ID NO: 2964519 - protein, 26 aa, Entamoeba invadens
RITEVIRLLISFARDMGFDIKTKKTS

SEQ ID NO: 2964520 - protein, 19 aa, Entamoeba invadens
RITKKTKRAVVREVSVLSK

SEQ ID NO: 2964521 - protein, 23 aa, Entamoeba invadens
RITKLRSTIQFATYTIHFKPPFP

SEQ ID NO: 2964522 - protein, 22 aa, Entamoeba invadens
RITPEFQDICRVLREKQTSLPA

SEQ ID NO: 2964523 - protein, 17 aa, Entamoeba invadens
RITPKEIRKWFAIASPK

SEQ ID NO: 2964524 - protein, 24 aa, Entamoeba invadens
RITRFGGKLSIPDSIKIISINFKD

SEQ ID NO: 2964525 - protein, 22 aa, Entamoeba invadens
RITRISLPSAVSFLNGSTFANC

SEQ ID NO: 2964526 - protein, 20 aa, Entamoeba invadens
RITRRSSFKPFSKFVDLTWV

SEQ ID NO: 2964527 - protein, 19 aa, Entamoeba invadens
RITTSFNWLSELLSKLINT

SEQ ID NO: 2964528 - protein, 31 aa, Entamoeba invadens
RITTSPYRLRNWLRIKAVIPLIKTVSDLSIY

SEQ ID NO: 2964529 - protein, 19 aa, Entamoeba invadens
RITYYDVLDEFIRLGLNKT

SEQ ID NO: 2964530 - protein, 18 aa, Entamoeba invadens
RIVAHCLNTSVTLPASVT

SEQ ID NO: 2964531 - protein, 17 aa, Entamoeba invadens
RIVCFELINQNRIELCG

SEQ ID NO: 2964532 - protein, 24 aa, Entamoeba invadens
RIVDSGLWPKLFSVAPSPLDIFKT

SEQ ID NO: 2964533 - protein, 19 aa, Entamoeba invadens
RIVEMLLEKGADRAAKNES

SEQ ID NO: 2964534 - protein, 17 aa, Entamoeba invadens
RIVGALGGLVGLKSFKE

SEQ ID NO: 2964535 - protein, 19 aa, Entamoeba invadens
RIVGVGDFDGKLVVVTNGG

SEQ ID NO: 2964536 - protein, 21 aa, Entamoeba invadens
RIVICLNANITRPEMVWHNIL

SEQ ID NO: 2964537 - protein, 23 aa, Entamoeba invadens
RIVKSRAIKAYRYIEQECSVGHI

SEQ ID NO: 2964538 - protein, 19 aa, Entamoeba invadens
RIVVLDPRGSIPGWVVSVA

SEQ ID NO: 2964539 - protein, 19 aa, Entamoeba invadens
RIVVQISDYCFSSCASLKS

SEQ ID NO: 2964540 - protein, 17 aa, Entamoeba invadens
RIVYGCVNISRIEIPTT

SEQ ID NO: 2964541 - protein, 19 aa, Entamoeba invadens
RIVYVDGVFDLLHLGHYRL

SEQ ID NO: 2964542 - protein, 17 aa, Entamoeba invadens
RIWRKQNVRQFGPLLDG

SEQ ID NO: 2964543 - protein, 17 aa, Entamoeba invadens
RIWRKQNVRQFGPLMDG

SEQ ID NO: 2964544 - protein, 25 aa, Entamoeba invadens
RIYDCAIELIKRGKAYVCHQTAEQI

SEQ ID NO: 2964545 - protein, 24 aa, Entamoeba invadens
RIYEILKSQPLIFDFSGIGIFGTS

SEQ ID NO: 2964546 - protein, 17 aa, Entamoeba invadens
RIYIERTTKFCGNKLIL

SEQ ID NO: 2964547 - protein, 24 aa, Entamoeba invadens
RIYMQCLTPFISNVFLTIYSDANE

SEQ ID NO: 2964548 - protein, 32 aa, Entamoeba invadens
RIYRYRSPQTLLFKQLQFYSSGALNERISKLV

SEQ ID NO: 2964549 - protein, 21 aa, Entamoeba invadens
RIYVDGCYDMFHWGHANVIRQ

SEQ ID NO: 2964550 - protein, 32 aa, Entamoeba invadens
RKADVWALGCVLFKLCYFDTPFEESPMKIQFC

SEQ ID NO: 2964551 - protein, 18 aa, Entamoeba invadens
RKAFCLTPQTPLNINDNL

SEQ ID NO: 2964552 - protein, 17 aa, Entamoeba invadens
RKAFLNLIWKYKHGNII

SEQ ID NO: 2964553 - protein, 17 aa, Entamoeba invadens
RKAGAAVVVARRGGAIH

SEQ ID NO: 2964554 - protein, 20 aa, Entamoeba invadens
RKAIIGAGFSERGDAMEFKE

SEQ ID NO: 2964555 - protein, 19 aa, Entamoeba invadens
RKAKFPDLYNILNMNVENC

SEQ ID NO: 2964556 - protein, 20 aa, Entamoeba invadens
RKALECLRKAYDYRCEIGMG

SEQ ID NO: 2964557 - protein, 19 aa, Entamoeba invadens
RKALEEKQRIELEAKKRRE

SEQ ID NO: 2964558 - protein, 17 aa, Entamoeba invadens
RKALKERYMYLFNDGVV

SEQ ID NO: 2964559 - protein, 18 aa, Entamoeba invadens
RKALKSKSHLFGLIDSTS

SEQ ID NO: 2964560 - protein, 17 aa, Entamoeba invadens
RKAQEWSTLTSTMLRHW

SEQ ID NO: 2964561 - protein, 26 aa, Entamoeba invadens
RKAREMTRRKGVLDGMGLPGKLADCQ

SEQ ID NO: 2964562 - protein, 20 aa, Entamoeba invadens
RKATDQAMVILVMFRNITAK

SEQ ID NO: 2964563 - protein, 24 aa, Entamoeba invadens
RKATEKDLRLSLQSHLDEKVTQSE

SEQ ID NO: 2964564 - protein, 21 aa, Entamoeba invadens
RKCVTCVSGYFVFENKCKKCD

SEQ ID NO: 2964565 - protein, 20 aa, Entamoeba invadens
RKDAAVAVRFVRFYKMFLDF

SEQ ID NO: 2964566 - protein, 20 aa, Entamoeba invadens
RKDEDFKKRIELIQDTEFTV

SEQ ID NO: 2964567 - protein, 19 aa, Entamoeba invadens
RKDEVSFSDLINVQSDATV

SEQ ID NO: 2964568 - protein, 20 aa, Entamoeba invadens
RKDFIHRSRIKKLQNETKVY

SEQ ID NO: 2964569 - protein, 18 aa, Entamoeba invadens
RKDFKKGGYSDHKKPFSS

SEQ ID NO: 2964570 - protein, 17 aa, Entamoeba invadens
RKDGGEIRDHILSTSEF

SEQ ID NO: 2964571 - protein, 19 aa, Entamoeba invadens
RKDHPPGFIARPVREGGKP

SEQ ID NO: 2964572 - protein, 18 aa, Entamoeba invadens
RKDIFPFYQEGWRWEKNE

SEQ ID NO: 2964573 - protein, 19 aa, Entamoeba invadens
RKDIINNIVQVFPYLTVDK

SEQ ID NO: 2964574 - protein, 18 aa, Entamoeba invadens
RKDLCNPETVQLLISTVE

SEQ ID NO: 2964575 - protein, 19 aa, Entamoeba invadens
RKDRTWPLWFFEKEEKEEV

SEQ ID NO: 2964576 - protein, 18 aa, Entamoeba invadens
RKDSKRRERIVKRRRVFS

SEQ ID NO: 2964577 - protein, 20 aa, Entamoeba invadens
RKDVANGFGLDFISDEICSY

SEQ ID NO: 2964578 - protein, 24 aa, Entamoeba invadens
RKDVFFQKKLEKIGELKRMINEGK

SEQ ID NO: 2964579 - protein, 27 aa, Entamoeba invadens
RKDVIGVFLPNCIEYVIMGAAIEASGF

SEQ ID NO: 2964580 - protein, 27 aa, Entamoeba invadens
RKDVVCVFLPNCVEYLVAEAAIEASGF

SEQ ID NO: 2964581 - protein, 19 aa, Entamoeba invadens
RKDWIEAHGGLQAVINGGV

SEQ ID NO: 2964582 - protein, 18 aa, Entamoeba invadens
RKECKIGPFQLGMPLYRI

SEQ ID NO: 2964583 - protein, 28 aa, Entamoeba invadens
RKEDLKPRKSVYHWSRQETGLFYLALRK

SEQ ID NO: 2964584 - protein, 23 aa, Entamoeba invadens
RKEEAVMLCQFLNTNGIPSGILM

SEQ ID NO: 2964585 - protein, 20 aa, Entamoeba invadens
RKEFGFEFFNNAELSITDVS

SEQ ID NO: 2964586 - protein, 24 aa, Entamoeba invadens
RKEGDKMIGVAFVQRNGQIQTVVA

SEQ ID NO: 2964587 - protein, 17 aa, Entamoeba invadens
RKEIESIREAREAAEKA

SEQ ID NO: 2964588 - protein, 30 aa, Entamoeba invadens
RKEKTEVYSGISLRVIFPAFGGDAKTIQQL

SEQ ID NO: 2964589 - protein, 22 aa, Entamoeba invadens
RKELKKVFNTCTDFGEDDIQTF

SEQ ID NO: 2964590 - protein, 21 aa, Entamoeba invadens
RKELSVGVLKISGLIRESVLT

SEQ ID NO: 2964591 - protein, 17 aa, Entamoeba invadens
RKEMASLMERHVNPIIH

SEQ ID NO: 2964592 - protein, 21 aa, Entamoeba invadens
RKEMEDAHIITSCENYSMVGV

SEQ ID NO: 2964593 - protein, 26 aa, Entamoeba invadens
RKENRCGSLNRFLFENSSQECDKQVF

SEQ ID NO: 2964594 - protein, 20 aa, Entamoeba invadens
RKENSFGYFPGEYCQVIGGI

SEQ ID NO: 2964595 - protein, 27 aa, Entamoeba invadens
RKEPVMLPNKCHLFICGIEGNEEYITK

SEQ ID NO: 2964596 - protein, 22 aa, Entamoeba invadens
RKERLKQLALEKIDLSKDPYFH

SEQ ID NO: 2964597 - protein, 20 aa, Entamoeba invadens
RKESPGFVEFGNFNAKNVDN

SEQ ID NO: 2964598 - protein, 23 aa, Entamoeba invadens
RKESVDIFRMMQPRLLTQTRDID

SEQ ID NO: 2964599 - protein, 21 aa, Entamoeba invadens
RKETFPHLFPSFSTPDVAVEL

SEQ ID NO: 2964600 - protein, 18 aa, Entamoeba invadens
RKEVFRFTFASIQNVIKG

SEQ ID NO: 2964601 - protein, 20 aa, Entamoeba invadens
RKEVGRFITYMWTLDLKMTD

SEQ ID NO: 2964602 - protein, 20 aa, Entamoeba invadens
RKEVNFVFVVLKQFCQIKTT

SEQ ID NO: 2964603 - protein, 22 aa, Entamoeba invadens
RKEWFKEVRIKTLIEIVIQKDV

SEQ ID NO: 2964604 - protein, 19 aa, Entamoeba invadens
RKFAEEETSYLIELRKTLT

SEQ ID NO: 2964605 - protein, 19 aa, Entamoeba invadens
RKFCGLFFAFLPNNIYEID

SEQ ID NO: 2964606 - protein, 18 aa, Entamoeba invadens
RKFHKQCIFTWFRSTGRN

SEQ ID NO: 2964607 - protein, 22 aa, Entamoeba invadens
RKFIEFMKSIGIDVNGFEPNYC

SEQ ID NO: 2964608 - protein, 20 aa, Entamoeba invadens
RKFILDMAKEISFLHNNGIV

SEQ ID NO: 2964609 - protein, 24 aa, Entamoeba invadens
RKFMFKNCRKLEDVVMKEGIHKIC

SEQ ID NO: 2964610 - protein, 22 aa, Entamoeba invadens
RKFPSKNYQPFRIKDTLKFILT

SEQ ID NO: 2964611 - protein, 24 aa, Entamoeba invadens
RKFRMKVVHPRFRRHNNDVFCYLK

SEQ ID NO: 2964612 - protein, 25 aa, Entamoeba invadens
RKFSEKLKNPWDWEELISSFDKIKT

SEQ ID NO: 2964613 - protein, 24 aa, Entamoeba invadens
RKFTEAQYALSRCVGENTVVYSTS

SEQ ID NO: 2964614 - protein, 24 aa, Entamoeba invadens
RKFVKRRFAVDQPKVSIKTRKVKV

SEQ ID NO: 2964615 - protein, 21 aa, Entamoeba invadens
RKGAICVLEKEISVLKTKVKN

SEQ ID NO: 2964616 - protein, 20 aa, Entamoeba invadens
RKGGHGIGEYIWVKNKEVLE

SEQ ID NO: 2964617 - protein, 24 aa, Entamoeba invadens
RKGKEKEGTLLHFVDNCQTPFGKR

SEQ ID NO: 2964618 - protein, 18 aa, Entamoeba invadens
RKGKRSGGYHEIIRMPHG

SEQ ID NO: 2964619 - protein, 20 aa, Entamoeba invadens
RKGKYKDLLRVTSKKTMEMF

SEQ ID NO: 2964620 - protein, 20 aa, Entamoeba invadens
RKGLPDGTRLRGDINVLLMG

SEQ ID NO: 2964621 - protein, 19 aa, Entamoeba invadens
RKGRRHCLFGEGGCCVERS

SEQ ID NO: 2964622 - protein, 18 aa, Entamoeba invadens
RKGSTFVVDVTKCNSKTM

SEQ ID NO: 2964623 - protein, 22 aa, Entamoeba invadens
RKHDGKVIFCTDGMSNKGIEST

SEQ ID NO: 2964624 - protein, 19 aa, Entamoeba invadens
RKHFEMVSFVFTQPMFTLC

SEQ ID NO: 2964625 - protein, 17 aa, Entamoeba invadens
RKHKIFATEACRMSIMV

SEQ ID NO: 2964626 - protein, 17 aa, Entamoeba invadens
RKHKLVELWGTKKVDPI

SEQ ID NO: 2964627 - protein, 20 aa, Entamoeba invadens
RKHQMAYCALVLNDLIKERD

SEQ ID NO: 2964628 - protein, 17 aa, Entamoeba invadens
RKHRRYHANDSKVDVDL

SEQ ID NO: 2964629 - protein, 20 aa, Entamoeba invadens
RKIDEVWGLTEMKKENNFRE

SEQ ID NO: 2964630 - protein, 19 aa, Entamoeba invadens
RKIEASFSRVLPVSSDKLS

SEQ ID NO: 2964631 - protein, 20 aa, Entamoeba invadens
RKIFNLNAFLKCAPILEKAE

SEQ ID NO: 2964632 - protein, 17 aa, Entamoeba invadens
RKIGFLMRANTYYESLD

SEQ ID NO: 2964633 - protein, 17 aa, Entamoeba invadens
RKIGTLTNNLVYIVLSL

SEQ ID NO: 2964634 - protein, 25 aa, Entamoeba invadens
RKIIKRICWYEVDFAESLELKTQNI

SEQ ID NO: 2964635 - protein, 26 aa, Entamoeba invadens
RKIKALVQKGRFHVMTSSVEFKEEKR

SEQ ID NO: 2964636 - protein, 20 aa, Entamoeba invadens
RKIKEICEHVKNAPTNVLNN

SEQ ID NO: 2964637 - protein, 17 aa, Entamoeba invadens
RKIKEMTNTVFAVMSFR

SEQ ID NO: 2964638 - protein, 17 aa, Entamoeba invadens
RKINGIIDNIISKELTL

SEQ ID NO: 2964639 - protein, 17 aa, Entamoeba invadens
RKIPVEELLSQCWMKKD

SEQ ID NO: 2964640 - protein, 17 aa, Entamoeba invadens
RKIPYVEFLGNGWTKKT

SEQ ID NO: 2964641 - protein, 20 aa, Entamoeba invadens
RKIPYYEFLGNGWTKKDKET

SEQ ID NO: 2964642 - protein, 17 aa, Entamoeba invadens
RKISIKAVEVVPKSLKL

SEQ ID NO: 2964643 - protein, 23 aa, Entamoeba invadens
RKITPEDLFYVGIRSIDPGERSE

SEQ ID NO: 2964644 - protein, 21 aa, Entamoeba invadens
RKIVQCREVFYNIATSHDQIE

SEQ ID NO: 2964645 - protein, 18 aa, Entamoeba invadens
RKIVYEMLRNANFKYVRA

SEQ ID NO: 2964646 - protein, 20 aa, Entamoeba invadens
RKIWVHRRLLGAEADAISHK

SEQ ID NO: 2964647 - protein, 17 aa, Entamoeba invadens
RKIYDLVAVSNHSGSLA

SEQ ID NO: 2964648 - protein, 21 aa, Entamoeba invadens
RKIYQEIIHTVTLYTTKLNYK

SEQ ID NO: 2964649 - protein, 20 aa, Entamoeba invadens
RKKDVPVIVMPQGTVLERKE

SEQ ID NO: 2964650 - protein, 20 aa, Entamoeba invadens
RKKEFYEIIVWFEVDYGTVV

SEQ ID NO: 2964651 - protein, 19 aa, Entamoeba invadens
RKKEIPTWKPPWHQEENTD

SEQ ID NO: 2964652 - protein, 17 aa, Entamoeba invadens
RKKEKWMKLDDIKRELN

SEQ ID NO: 2964653 - protein, 20 aa, Entamoeba invadens
RKKETINFIKSCQNPSDLFP

SEQ ID NO: 2964654 - protein, 29 aa, Entamoeba invadens
RKKFEILSDCANFAFLVGKERSTKFFDVG

SEQ ID NO: 2964655 - protein, 26 aa, Entamoeba invadens
RKKGPWLKEILRGVIEMQIERPEATH

SEQ ID NO: 2964656 - protein, 18 aa, Entamoeba invadens
RKKHVLEVMVNIVNELKK

SEQ ID NO: 2964657 - protein, 28 aa, Entamoeba invadens
RKKKQWKFLQKYYHIGSFFLDGSDWDVT

SEQ ID NO: 2964658 - protein, 26 aa, Entamoeba invadens
RKKKWKFQPQKGVPYLGRLMKELLTG

SEQ ID NO: 2964659 - protein, 20 aa, Entamoeba invadens
RKKLEGWVPAAGVKGPVQTR

SEQ ID NO: 2964660 - protein, 18 aa, Entamoeba invadens
RKKLSEIIYIEIAGTKYN

SEQ ID NO: 2964661 - protein, 17 aa, Entamoeba invadens
RKKMVLMLNTPVKDVSR

SEQ ID NO: 2964662 - protein, 24 aa, Entamoeba invadens
RKKMWKMLFIYAYEHQSMNYQQGF

SEQ ID NO: 2964663 - protein, 19 aa, Entamoeba invadens
RKKNSVSRFELIRKQRKPI

SEQ ID NO: 2964664 - protein, 21 aa, Entamoeba invadens
  misc_feature (15)..(16): Xaa can be any naturally occurring amino acid
RKKQKMRFVLTQKIXXNINWS

SEQ ID NO: 2964665 - protein, 25 aa, Entamoeba invadens
RKKQVLVCQCSGKYRSTSCNPKDTS

SEQ ID NO: 2964666 - protein, 21 aa, Entamoeba invadens
RKKREWQLTALPWTTRPSQVM

SEQ ID NO: 2964667 - protein, 18 aa, Entamoeba invadens
RKKRTKKAKKEKVEKAIT

SEQ ID NO: 2964668 - protein, 23 aa, Entamoeba invadens
RKKSKITLPFFTVIKIESDEEAI

SEQ ID NO: 2964669 - protein, 18 aa, Entamoeba invadens
RKKTCLFTISKSNITFEK

SEQ ID NO: 2964670 - protein, 18 aa, Entamoeba invadens
RKKVEFRDKTVYDIDNLR

SEQ ID NO: 2964671 - protein, 19 aa, Entamoeba invadens
RKKVKIHLFGDEETKKAKR

SEQ ID NO: 2964672 - protein, 21 aa, Entamoeba invadens
RKKVKIIFDFQCYKQHIVTTI

SEQ ID NO: 2964673 - protein, 25 aa, Entamoeba invadens
RKKYDCWSSLVLPKEEWTEHAESFN

SEQ ID NO: 2964674 - protein, 19 aa, Entamoeba invadens
RKLDGLKFDLSVLDEAGQV

SEQ ID NO: 2964675 - protein, 18 aa, Entamoeba invadens
RKLEKWAVSVVDIPEVYV

SEQ ID NO: 2964676 - protein, 24 aa, Entamoeba invadens
RKLGEQQVKVFFCTADSDENGKMD

SEQ ID NO: 2964677 - protein, 21 aa, Entamoeba invadens
RKLIIKACGATLIETESSLGM

SEQ ID NO: 2964678 - protein, 18 aa, Entamoeba invadens
RKLITTSFFSFVESVLTQ

SEQ ID NO: 2964679 - protein, 24 aa, Entamoeba invadens
RKLKDLLTEIGYFLSRYNNTCINA

SEQ ID NO: 2964680 - protein, 19 aa, Entamoeba invadens
RKLLEEERIRLQKEEEENI

SEQ ID NO: 2964681 - protein, 20 aa, Entamoeba invadens
RKLPKYWGISSRRKKYHGHY

SEQ ID NO: 2964682 - protein, 19 aa, Entamoeba invadens
RKLRHPNLVLFIGTVLIQN

SEQ ID NO: 2964683 - protein, 44 aa, Entamoeba invadens
RKLRLDYLDLYLIHWPVSLRVGATWPLKREDIIEVPIEETWGEM

SEQ ID NO: 2964684 - protein, 20 aa, Entamoeba invadens
RKLRQKRREGCLTMEETKER

SEQ ID NO: 2964685 - protein, 21 aa, Entamoeba invadens
RKLSGDCLVSLVKERSDMFCE

SEQ ID NO: 2964686 - protein, 23 aa, Entamoeba invadens
RKLTISQLRSALKNCGVNDERDL

SEQ ID NO: 2964687 - protein, 17 aa, Entamoeba invadens
RKLTTESDQSLNREAPE

SEQ ID NO: 2964688 - protein, 22 aa, Entamoeba invadens
RKMEGSQMFVVFNLQDYEALKE

SEQ ID NO: 2964689 - protein, 20 aa, Entamoeba invadens
RKMIFCGNEDFSAKLFSSLI

SEQ ID NO: 2964690 - protein, 20 aa, Entamoeba invadens
RKMLFERVEFIRNAIFDEDI

SEQ ID NO: 2964691 - protein, 19 aa, Entamoeba invadens
RKMLLYFKLINKLASPEQK

SEQ ID NO: 2964692 - protein, 18 aa, Entamoeba invadens
RKMMKAFCTDEVKENPVF

SEQ ID NO: 2964693 - protein, 26 aa, Entamoeba invadens
RKMNKPRFIYLFNDLFLYGTGDENKN

SEQ ID NO: 2964694 - protein, 26 aa, Entamoeba invadens
RKMQKRALRCYLRGLEYLDNDYRIPD

SEQ ID NO: 2964695 - protein, 19 aa, Entamoeba invadens
RKMRQWKTYGRMVLENKRL

SEQ ID NO: 2964696 - protein, 23 aa, Entamoeba invadens
RKMSKQEAALYLRTSTSCPHFKP

SEQ ID NO: 2964697 - protein, 21 aa, Entamoeba invadens
RKMTGIFFPPLLFSTYVVYAN

SEQ ID NO: 2964698 - protein, 20 aa, Entamoeba invadens
RKMYCLEELYLSGNPMTFIP

SEQ ID NO: 2964699 - protein, 23 aa, Entamoeba invadens
RKNALQKCVLCNKFTSNQTEIDL

SEQ ID NO: 2964700 - protein, 18 aa, Entamoeba invadens
RKNERMTFDFSNSGVLFQ

SEQ ID NO: 2964701 - protein, 18 aa, Entamoeba invadens
RKNGLIKKAMELSILCDC

SEQ ID NO: 2964702 - protein, 19 aa, Entamoeba invadens
RKNMISFYLSNNILVKNCT

SEQ ID NO: 2964703 - protein, 21 aa, Entamoeba invadens
RKNMIYSETFGVWIEISDTEN

SEQ ID NO: 2964704 - protein, 23 aa, Entamoeba invadens
RKNPRSWIKYASWEEDQGEYTRA

SEQ ID NO: 2964705 - protein, 19 aa, Entamoeba invadens
RKNQEFNFINGNILKEILR

SEQ ID NO: 2964706 - protein, 23 aa, Entamoeba invadens
RKNRIRFEWLMNLFETDNQDLLK

SEQ ID NO: 2964707 - protein, 22 aa, Entamoeba invadens
RKNRYIILPIDFDKAYKKVVRK

SEQ ID NO: 2964708 - protein, 20 aa, Entamoeba invadens
RKNSVCGILADLYDEVATRL

SEQ ID NO: 2964709 - protein, 22 aa, Entamoeba invadens
RKNVFKCLLDLMKIQNNIGDMY

SEQ ID NO: 2964710 - protein, 19 aa, Entamoeba invadens
RKPAYCDRVLFKCEKGLSV

SEQ ID NO: 2964711 - protein, 24 aa, Entamoeba invadens
RKPELFGMKCYAKVGDIPEKVDLA

SEQ ID NO: 2964712 - protein, 21 aa, Entamoeba invadens
RKPEMRNAFLDFIKRALQWDP

SEQ ID NO: 2964713 - protein, 37 aa, Entamoeba invadens
RKPETCVGCTNASCPYSLPSTMVMPCLKCSRTKIGIY

SEQ ID NO: 2964714 - protein, 20 aa, Entamoeba invadens
RKPGRRGLVDLFNLHRELGV

SEQ ID NO: 2964715 - protein, 19 aa, Entamoeba invadens
RKPKLIVDAAIRNVCLTLN

SEQ ID NO: 2964716 - protein, 17 aa, Entamoeba invadens
RKPLAEKRLQMLQRKAK

SEQ ID NO: 2964717 - protein, 19 aa, Entamoeba invadens
RKPLRIAEGTGNVVFSVKY

SEQ ID NO: 2964718 - protein, 25 aa, Entamoeba invadens
RKPNDCKRWFWELVQNAKDSISQTG

SEQ ID NO: 2964719 - protein, 25 aa, Entamoeba invadens
RKPNDCKRWFWELVQNAKDSLSQTG

SEQ ID NO: 2964720 - protein, 25 aa, Entamoeba invadens
RKPNFELCHLFGAEKGINCCQLSTI

SEQ ID NO: 2964721 - protein, 24 aa, Entamoeba invadens
RKPQTIRVPAEMKRLAVSCEGDTV

SEQ ID NO: 2964722 - protein, 19 aa, Entamoeba invadens
RKPTAGPRYRRLVEKKIKK

SEQ ID NO: 2964723 - protein, 21 aa, Entamoeba invadens
RKQDVGFVYAIMFIGESELVT

SEQ ID NO: 2964724 - protein, 25 aa, Entamoeba invadens
RKQIKRIHKIFLLIFEQMNNQDLKE

SEQ ID NO: 2964725 - protein, 18 aa, Entamoeba invadens
RKQNISWETYYEVYRQLI

SEQ ID NO: 2964726 - protein, 36 aa, Entamoeba invadens
RKQYDDVLRINCQLIEIADGCERCHQRIRQVQQPVT

SEQ ID NO: 2964727 - protein, 23 aa, Entamoeba invadens
RKRAARCIGELVDLFENRIVHEL

SEQ ID NO: 2964728 - protein, 19 aa, Entamoeba invadens
RKRAGVIVKVALRESDGNV

SEQ ID NO: 2964729 - protein, 19 aa, Entamoeba invadens
RKRDFTHSSSKKWLEALTV

SEQ ID NO: 2964730 - protein, 22 aa, Entamoeba invadens
RKRFKEIIKLASKLTEDEKKAV

SEQ ID NO: 2964731 - protein, 17 aa, Entamoeba invadens
RKRIDVLKENIDRIKTR

SEQ ID NO: 2964732 - protein, 18 aa, Entamoeba invadens
RKRIGDVITKREFEKIFR

SEQ ID NO: 2964733 - protein, 23 aa, Entamoeba invadens
RKRIQDLLMAWTDIFRENVPRYS

SEQ ID NO: 2964734 - protein, 17 aa, Entamoeba invadens
RKRITKEAAEAVLSGSA

SEQ ID NO: 2964735 - protein, 21 aa, Entamoeba invadens
RKRKAVDWLSDRLVEKIDRDH

SEQ ID NO: 2964736 - protein, 17 aa, Entamoeba invadens
RKRLDLISKQQIQYQQN

SEQ ID NO: 2964737 - protein, 22 aa, Entamoeba invadens
RKRPKLAVLEEAELVRKAQERQ

SEQ ID NO: 2964738 - protein, 23 aa, Entamoeba invadens
RKRQEYMQNLGFGFQIIDNLKVT

SEQ ID NO: 2964739 - protein, 21 aa, Entamoeba invadens
RKRRAASFCKKASPFDKETPV

SEQ ID NO: 2964740 - protein, 24 aa, Entamoeba invadens
RKRRQFLCGRLHVVVAPQNQTTYS

SEQ ID NO: 2964741 - protein, 23 aa, Entamoeba invadens
RKRSSNLPAPVRRLQSRKRKTRK

SEQ ID NO: 2964742 - protein, 22 aa, Entamoeba invadens
RKRTKFLITCYFRCSDKEMNSS

SEQ ID NO: 2964743 - protein, 19 aa, Entamoeba invadens
RKSAMRLFSICDFFMTTFI

SEQ ID NO: 2964744 - protein, 17 aa, Entamoeba invadens
RKSENEYFWSYKNYGAF

SEQ ID NO: 2964745 - protein, 20 aa, Entamoeba invadens
RKSGVYGLIGGIGKGIVGVV

SEQ ID NO: 2964746 - protein, 25 aa, Entamoeba invadens
RKSGWVGDGNLHFVTTFNGVTASAG

SEQ ID NO: 2964747 - protein, 28 aa, Entamoeba invadens
RKSKESNFFCCICADGQTLPLYHVSENE

SEQ ID NO: 2964748 - protein, 25 aa, Entamoeba invadens
RKSKKGSVALPFLRIGRLQFSENDC

SEQ ID NO: 2964749 - protein, 23 aa, Entamoeba invadens
RKSLCGCCICRKSGYFNVPSPKI

SEQ ID NO: 2964750 - protein, 25 aa, Entamoeba invadens
RKSRLERLVCCFSEFVDKFPGEIGS

SEQ ID NO: 2964751 - protein, 23 aa, Entamoeba invadens
RKSSTKMRIIGMMTPMTHFLEEH

SEQ ID NO: 2964752 - protein, 20 aa, Entamoeba invadens
RKSTPKARYLIVTKAKEEDA

SEQ ID NO: 2964753 - protein, 17 aa, Entamoeba invadens
RKSYMCVTISVMNDNDF

SEQ ID NO: 2964754 - protein, 26 aa, Entamoeba invadens
RKTAAMCVAKLYFLNQEECVKRGFLA

SEQ ID NO: 2964755 - protein, 17 aa, Entamoeba invadens
RKTAMSVIEKIRTDSGH

SEQ ID NO: 2964756 - protein, 18 aa, Entamoeba invadens
RKTARITGIPKLDDANKA

SEQ ID NO: 2964757 - protein, 21 aa, Entamoeba invadens
RKTCAVVLIQIFKVFENNKQK

SEQ ID NO: 2964758 - protein, 20 aa, Entamoeba invadens
RKTCYKCQHLKEVVMDNTVE

SEQ ID NO: 2964759 - protein, 22 aa, Entamoeba invadens
RKTEAYVKLKLKTVKGEEVDIT

SEQ ID NO: 2964760 - protein, 22 aa, Entamoeba invadens
RKTEMSGFCCYFDCFFDHHSIL

SEQ ID NO: 2964761 - protein, 20 aa, Entamoeba invadens
RKTERLSRRLTFELNEQQKR

SEQ ID NO: 2964762 - protein, 19 aa, Entamoeba invadens
RKTFKSMVTKNIAYLTLPN

SEQ ID NO: 2964763 - protein, 19 aa, Entamoeba invadens
RKTGFPWKEDEDLRLLSAV

SEQ ID NO: 2964764 - protein, 17 aa, Entamoeba invadens
RKTIESHDIVFWMGDLN

SEQ ID NO: 2964765 - protein, 21 aa, Entamoeba invadens
RKTLERIVAFFIGVLDGKCFS

SEQ ID NO: 2964766 - protein, 25 aa, Entamoeba invadens
RKTLFNCLALSITVLAKKKLTTGTI

SEQ ID NO: 2964767 - protein, 20 aa, Entamoeba invadens
RKTLGVAVLQKICKTCPVPF

SEQ ID NO: 2964768 - protein, 17 aa, Entamoeba invadens
RKTMYDIIELNKTHNIE

SEQ ID NO: 2964769 - protein, 19 aa, Entamoeba invadens
RKTPLYKRLPVLRKSRENR

SEQ ID NO: 2964770 - protein, 31 aa, Entamoeba invadens
RKTQTPIAMELCYRAICKLVNRPYVRFTDDL

SEQ ID NO: 2964771 - protein, 21 aa, Entamoeba invadens
RKTSSLWTRRPVSIRKMKLCE

SEQ ID NO: 2964772 - protein, 20 aa, Entamoeba invadens
RKTVLACILILLKSVLKTNF

SEQ ID NO: 2964773 - protein, 28 aa, Entamoeba invadens
RKTVLPKMFYKIVVWFNVDFGTVDKNKS

SEQ ID NO: 2964774 - protein, 33 aa, Entamoeba invadens
RKTWCQKKYASVFGFKCIFILVRQTVQKSHKVD

SEQ ID NO: 2964775 - protein, 18 aa, Entamoeba invadens
RKTWDDRMIEGFLIEQID

SEQ ID NO: 2964776 - protein, 25 aa, Entamoeba invadens
RKTYRWNIRVLYDMIDIAALNGYKT

SEQ ID NO: 2964777 - protein, 25 aa, Entamoeba invadens
RKTYRWNIRVLYDMIDTAAFNGYKT

SEQ ID NO: 2964778 - protein, 23 aa, Entamoeba invadens
RKVAEMHASFFYKKCNKDVQLVS

SEQ ID NO: 2964779 - protein, 27 aa, Entamoeba invadens
RKVAKVGADYKAEFCISTASDLFFGFF

SEQ ID NO: 2964780 - protein, 21 aa, Entamoeba invadens
RKVAKVGADYKAEFCNSTASD

SEQ ID NO: 2964781 - protein, 17 aa, Entamoeba invadens
RKVALLGCLTLATDCLK

SEQ ID NO: 2964782 - protein, 20 aa, Entamoeba invadens
RKVCNHPFLIPGVEEKEVGG

SEQ ID NO: 2964783 - protein, 19 aa, Entamoeba invadens
RKVFTLRLLSKYQHFEIER

SEQ ID NO: 2964784 - protein, 19 aa, Entamoeba invadens
RKVGMERKELIGINTRIMK

SEQ ID NO: 2964785 - protein, 20 aa, Entamoeba invadens
RKVGSFAFEKCEQLKELVFN

SEQ ID NO: 2964786 - protein, 20 aa, Entamoeba invadens
RKVGYVFESRLTEGKKDTIK

SEQ ID NO: 2964787 - protein, 22 aa, Entamoeba invadens
RKVHSLCYYCLIEYADEEELYR

SEQ ID NO: 2964788 - protein, 20 aa, Entamoeba invadens
RKVIEIAGTFVLLEEVLGIE

SEQ ID NO: 2964789 - protein, 19 aa, Entamoeba invadens
RKVKCICVTHQVKDISLSL

SEQ ID NO: 2964790 - protein, 18 aa, Entamoeba invadens
RKVLEGLLKPEQIAKIEE

SEQ ID NO: 2964791 - protein, 19 aa, Entamoeba invadens
RKVLREVLYNRLIQSVYNF

SEQ ID NO: 2964792 - protein, 24 aa, Entamoeba invadens
RKVNRLFFFVGRTIQFLSENILRE

SEQ ID NO: 2964793 - protein, 27 aa, Entamoeba invadens
RKVPNGNGCLVCKVGYYKKGADCVLCD

SEQ ID NO: 2964794 - protein, 21 aa, Entamoeba invadens
RKVPPKAVCIEDDKIQRVVTV

SEQ ID NO: 2964795 - protein, 22 aa, Entamoeba invadens
RKVRAAEILEGIVMKDIPLELV

SEQ ID NO: 2964796 - protein, 19 aa, Entamoeba invadens
RKVRAYYCLVFAYHCTDIE

SEQ ID NO: 2964797 - protein, 23 aa, Entamoeba invadens
RKVTEKLLKVWSSYHRMERDETK

SEQ ID NO: 2964798 - protein, 27 aa, Entamoeba invadens
RKVTIWNCTHISYLNTIWECISEVKLK

SEQ ID NO: 2964799 - protein, 18 aa, Entamoeba invadens
RKVTRPFHGIKMLNVNYT

SEQ ID NO: 2964800 - protein, 21 aa, Entamoeba invadens
RKVVEAFTDWFVEDKTNGLVT

SEQ ID NO: 2964801 - protein, 20 aa, Entamoeba invadens
RKVVLPSIAAAIVLFVSTGQ

SEQ ID NO: 2964802 - protein, 19 aa, Entamoeba invadens
RKVVMQSFIVRIMKQKKYI

SEQ ID NO: 2964803 - protein, 26 aa, Entamoeba invadens
RKVVRNLKCVLFDFDKKIEIYNSPVL

SEQ ID NO: 2964804 - protein, 24 aa, Entamoeba invadens
RKWDLTLLKAPSFLRREVSKQILM

SEQ ID NO: 2964805 - protein, 23 aa, Entamoeba invadens
RKYADYRASVIANIIKDVSLSLG

SEQ ID NO: 2964806 - protein, 17 aa, Entamoeba invadens
RKYAYCLRFPHFSEPEC

SEQ ID NO: 2964807 - protein, 21 aa, Entamoeba invadens
RKYCHGVFDQLYRPTIGVDFA

SEQ ID NO: 2964808 - protein, 25 aa, Entamoeba invadens
RKYERAECLKYMCVDGSLWGSREKN

SEQ ID NO: 2964809 - protein, 17 aa, Entamoeba invadens
RKYEVLVVAYSHVKNAD

SEQ ID NO: 2964810 - protein, 21 aa, Entamoeba invadens
RKYISQYSCDGIQIFVIKDEK

SEQ ID NO: 2964811 - protein, 23 aa, Entamoeba invadens
RKYKEVQTIFVPKNVRSVGRFCF

SEQ ID NO: 2964812 - protein, 35 aa, Entamoeba invadens
RKYKEVQTIFVPKSVKSVGRFCFYNSVGKENVIFE

SEQ ID NO: 2964813 - protein, 17 aa, Entamoeba invadens
RKYLKVLVGLEADCTDR

SEQ ID NO: 2964814 - protein, 23 aa, Entamoeba invadens
RKYQNYFLQYGFSYITENSVQKP

SEQ ID NO: 2964815 - protein, 23 aa, Entamoeba invadens
RKYVSKIVAFFLFYHENCEFQWD

SEQ ID NO: 2964816 - protein, 18 aa, Entamoeba invadens
RKYWHFIKLMGRSASHIA

SEQ ID NO: 2964817 - protein, 18 aa, Entamoeba invadens
RLAASIMKCGKRKVWLDP

SEQ ID NO: 2964818 - protein, 17 aa, Entamoeba invadens
RLAETAFDISDEHFNLK

SEQ ID NO: 2964819 - protein, 25 aa, Entamoeba invadens
RLAKCQFCSLMFPMKELSRHVEFCG

SEQ ID NO: 2964820 - protein, 22 aa, Entamoeba invadens
RLAKMLYRAGILQSKDHLLSIQ

SEQ ID NO: 2964821 - protein, 19 aa, Entamoeba invadens
RLALVKSELVFFDINKVVE

SEQ ID NO: 2964822 - protein, 19 aa, Entamoeba invadens
RLANIKSKEHFNFSLTYLT

SEQ ID NO: 2964823 - protein, 18 aa, Entamoeba invadens
RLARQHTRRQSFFDKQMI

SEQ ID NO: 2964824 - protein, 19 aa, Entamoeba invadens
RLASFKEKYSHVGSLAVVR

SEQ ID NO: 2964825 - protein, 18 aa, Entamoeba invadens
RLASKCEFPTPELSASTS

SEQ ID NO: 2964826 - protein, 18 aa, Entamoeba invadens
RLATCSLDTTVTVWSVET

SEQ ID NO: 2964827 - protein, 19 aa, Entamoeba invadens
RLAVTKSDVLTLWMQKQCS

SEQ ID NO: 2964828 - protein, 24 aa, Entamoeba invadens
RLAWTTLCRLAFLSIAETQEKPTE

SEQ ID NO: 2964829 - protein, 24 aa, Entamoeba invadens
RLCELPSGCFLNCVSLQEIDLSGV

SEQ ID NO: 2964830 - protein, 21 aa, Entamoeba invadens
RLCKALRKMYVVDGVNGETNQ

SEQ ID NO: 2964831 - protein, 19 aa, Entamoeba invadens
RLCLYKLPYFFSEMNQQIK

SEQ ID NO: 2964832 - protein, 21 aa, Entamoeba invadens
RLCQKRKDLKIIISSATIDTS

SEQ ID NO: 2964833 - protein, 26 aa, Entamoeba invadens
RLCVKLCDFGSCKLLTQTGNYPTLQS

SEQ ID NO: 2964834 - protein, 18 aa, Entamoeba invadens
RLDCELKNITNLQFLQTL

SEQ ID NO: 2964835 - protein, 25 aa, Entamoeba invadens
RLDEKIKGLIVAAGVTGLYNDDLLE

SEQ ID NO: 2964836 - protein, 19 aa, Entamoeba invadens
RLDEKRMSIELQKAPQTVV

SEQ ID NO: 2964837 - protein, 26 aa, Entamoeba invadens
RLDEMCYRLNKFIITLFPEYKDLFTG

SEQ ID NO: 2964838 - protein, 24 aa, Entamoeba invadens
RLDESFSALNYHKSFCSFCPHKDG

SEQ ID NO: 2964839 - protein, 30 aa, Entamoeba invadens
RLDMLRQFVCYSRCYRELAPYQLDNAKELY

SEQ ID NO: 2964840 - protein, 18 aa, Entamoeba invadens
RLDQGLCHLVARVNLYME

SEQ ID NO: 2964841 - protein, 30 aa, Entamoeba invadens
RLDTIRSRISWASIEVFRKRYVNLIDNNDA

SEQ ID NO: 2964842 - protein, 27 aa, Entamoeba invadens
RLDYFTLLVPRRFYIGGEIMTYNKKKC

SEQ ID NO: 2964843 - protein, 22 aa, Entamoeba invadens
RLEATLWYKAISAFYTLENYKS

SEQ ID NO: 2964844 - protein, 17 aa, Entamoeba invadens
RLEDCLPRRNDISESLL

SEQ ID NO: 2964845 - protein, 19 aa, Entamoeba invadens
RLEDIEMVFIGAGSANATC

SEQ ID NO: 2964846 - protein, 20 aa, Entamoeba invadens
RLEDIEMVFISAGSANATCL

SEQ ID NO: 2964847 - protein, 17 aa, Entamoeba invadens
RLEGKSNKRYAKNEGHK

SEQ ID NO: 2964848 - protein, 33 aa, Entamoeba invadens
RLEGRRLNVVIKWNICTAIHTLLNWNIMFNNGI

SEQ ID NO: 2964849 - protein, 18 aa, Entamoeba invadens
RLEKCSRLIHSEELTETN

SEQ ID NO: 2964850 - protein, 24 aa, Entamoeba invadens
RLELFLMKFTDAVFKKDQDTFIKF

SEQ ID NO: 2964851 - protein, 17 aa, Entamoeba invadens
RLELYRLTHVGKIGTSQ

SEQ ID NO: 2964852 - protein, 20 aa, Entamoeba invadens
RLEMVYLMRVILELHYLVDM

SEQ ID NO: 2964853 - protein, 21 aa, Entamoeba invadens
RLENACKAFLKMAELSCELQS

SEQ ID NO: 2964854 - protein, 19 aa, Entamoeba invadens
RLEQLKLFVPKNFGLPDYQ

SEQ ID NO: 2964855 - protein, 18 aa, Entamoeba invadens
RLESYVIDFAYLQKTKTV

SEQ ID NO: 2964856 - protein, 19 aa, Entamoeba invadens
RLETLFLPMEIYRDLSDLE

SEQ ID NO: 2964857 - protein, 25 aa, Entamoeba invadens
RLEYLCGNLAHIVDFFVKYIGDEND

SEQ ID NO: 2964858 - protein, 21 aa, Entamoeba invadens
RLFCPAMAAPEGMNLSGTSLV

SEQ ID NO: 2964859 - protein, 19 aa, Entamoeba invadens
RLFEMIGHRTLRRVILTIY

SEQ ID NO: 2964860 - protein, 19 aa, Entamoeba invadens
RLFEMIGHRTLRRVVLTIY

SEQ ID NO: 2964861 - protein, 19 aa, Entamoeba invadens
RLFNCKKENVIYVIPAESY

SEQ ID NO: 2964862 - protein, 25 aa, Entamoeba invadens
RLFSYELARSLAYIHAFGMCHRDIK

SEQ ID NO: 2964863 - protein, 21 aa, Entamoeba invadens
RLFVLSSTELVVFDTVLAQAI

SEQ ID NO: 2964864 - protein, 25 aa, Entamoeba invadens
RLFYIKRIVSEGDFRLIVTTKGDGT

SEQ ID NO: 2964865 - protein, 22 aa, Entamoeba invadens
RLGEKCFSGCYALNTKLNAPSN

SEQ ID NO: 2964866 - protein, 20 aa, Entamoeba invadens
RLGELWKESLMELSGGQKSL

SEQ ID NO: 2964867 - protein, 23 aa, Entamoeba invadens
RLGEPRKKRCTTPNRMVSYQSVK

SEQ ID NO: 2964868 - protein, 19 aa, Entamoeba invadens
RLGHVPRGVGGMSIQIVRS

SEQ ID NO: 2964869 - protein, 19 aa, Entamoeba invadens
RLGKTIKEIYKELFGEDFK

SEQ ID NO: 2964870 - protein, 24 aa, Entamoeba invadens
RLGRFSVSVCQPIDLSCSDNSVDN

SEQ ID NO: 2964871 - protein, 20 aa, Entamoeba invadens
RLGSNPLAVYSFVPIAPLVY

SEQ ID NO: 2964872 - protein, 18 aa, Entamoeba invadens
RLGVEGFVPRGFVKIQKF

SEQ ID NO: 2964873 - protein, 19 aa, Entamoeba invadens
RLHAMFSCRSDPRITKPFE

SEQ ID NO: 2964874 - protein, 17 aa, Entamoeba invadens
RLHCGHYSLLQSGLFSS

SEQ ID NO: 2964875 - protein, 30 aa, Entamoeba invadens
RLHGKLPQLFWWAFRRQIMINDKGELLFSD

SEQ ID NO: 2964876 - protein, 23 aa, Entamoeba invadens
RLHKLMLRLKKLKIESSSSGVIL

SEQ ID NO: 2964877 - protein, 24 aa, Entamoeba invadens
RLHLPRKSSTILIEKTKPAVLVED

SEQ ID NO: 2964878 - protein, 21 aa, Entamoeba invadens
RLHSAKKLRVKSSMEGSSEKE

SEQ ID NO: 2964879 - protein, 20 aa, Entamoeba invadens
RLIAQEIDRGFTYTLRLVFC

SEQ ID NO: 2964880 - protein, 24 aa, Entamoeba invadens
RLIDFGCGDLCLMSVGRFGKRTNE

SEQ ID NO: 2964881 - protein, 18 aa, Entamoeba invadens
RLIDLLLVRGYSFNRTAD

SEQ ID NO: 2964882 - protein, 20 aa, Entamoeba invadens
RLIDVVRMLLYTGHIEVAAE

SEQ ID NO: 2964883 - protein, 19 aa, Entamoeba invadens
RLIEIGIAFEKLVEDSFGR

SEQ ID NO: 2964884 - protein, 17 aa, Entamoeba invadens
RLIGCQYSDPAVLEETL

SEQ ID NO: 2964885 - protein, 17 aa, Entamoeba invadens
RLIHSAPLYQQPQQQID

SEQ ID NO: 2964886 - protein, 17 aa, Entamoeba invadens
RLIKLKIPPFIKTLGES

SEQ ID NO: 2964887 - protein, 18 aa, Entamoeba invadens
RLINCFTCNTANSCLTYY

SEQ ID NO: 2964888 - protein, 17 aa, Entamoeba invadens
RLINCLQQSESDIKEML

SEQ ID NO: 2964889 - protein, 20 aa, Entamoeba invadens
RLIQEIKYYDGFFGHRINPV

SEQ ID NO: 2964890 - protein, 17 aa, Entamoeba invadens
RLITGKITLLRIGKDEE

SEQ ID NO: 2964891 - protein, 18 aa, Entamoeba invadens
RLIVSTCADPKKIVIFDI

SEQ ID NO: 2964892 - protein, 17 aa, Entamoeba invadens
RLIYLRVLIERTKPIEK

SEQ ID NO: 2964893 - protein, 18 aa, Entamoeba invadens
RLKDLGILTEKGEYTKKV

SEQ ID NO: 2964894 - protein, 22 aa, Entamoeba invadens
RLKEKSNVFLLLLTTIKNFYCC

SEQ ID NO: 2964895 - protein, 31 aa, Entamoeba invadens
RLKEYLKRNRISVGFPIKGYKEALVLDIRNG

SEQ ID NO: 2964896 - protein, 18 aa, Entamoeba invadens
RLKFVDFSIELVLFREEF

SEQ ID NO: 2964897 - protein, 20 aa, Entamoeba invadens
RLKIAECRNLTTLHNCSALK

SEQ ID NO: 2964898 - protein, 18 aa, Entamoeba invadens
RLKIPKSVKRCFVDIPSS

SEQ ID NO: 2964899 - protein, 24 aa, Entamoeba invadens
RLKKEPKVSMLLKENLKLKELESQ

SEQ ID NO: 2964900 - protein, 18 aa, Entamoeba invadens
RLKKESQLLSARNSVNES

SEQ ID NO: 2964901 - protein, 22 aa, Entamoeba invadens
RLKLQVLGNLAYLVNMQKSATF

SEQ ID NO: 2964902 - protein, 22 aa, Entamoeba invadens
RLKNKLKALLFYESAFTVSLLY

SEQ ID NO: 2964903 - protein, 22 aa, Entamoeba invadens
RLKRCLLCRSKFVCQKEIELRG

SEQ ID NO: 2964904 - protein, 20 aa, Entamoeba invadens
RLKRNSVDNIGEFSDIYQLS

SEQ ID NO: 2964905 - protein, 17 aa, Entamoeba invadens
RLKVLGIVIQICECSES

SEQ ID NO: 2964906 - protein, 20 aa, Entamoeba invadens
RLKYGDVVPLGIATVGEDAF

SEQ ID NO: 2964907 - protein, 17 aa, Entamoeba invadens
RLLAAAMVVEKYYKDTI

SEQ ID NO: 2964908 - protein, 18 aa, Entamoeba invadens
RLLAPALEKLGMGVIKGE

SEQ ID NO: 2964909 - protein, 20 aa, Entamoeba invadens
RLLCQMCISSMLLIITDEQQ

SEQ ID NO: 2964910 - protein, 21 aa, Entamoeba invadens
RLLDEGKPFGVTDDMAESFLF

SEQ ID NO: 2964911 - protein, 19 aa, Entamoeba invadens
RLLDLIGILFDPVIPEGMD

SEQ ID NO: 2964912 - protein, 25 aa, Entamoeba invadens
RLLEFRRFVVQCADIPFERAEMNPM

SEQ ID NO: 2964913 - protein, 20 aa, Entamoeba invadens
RLLFELKVQRNFINSFSQRY

SEQ ID NO: 2964914 - protein, 18 aa, Entamoeba invadens
RLLKSIHKLSKMKVAVLG

SEQ ID NO: 2964915 - protein, 19 aa, Entamoeba invadens
RLLKYPSRGKHCHHTNYYE

SEQ ID NO: 2964916 - protein, 18 aa, Entamoeba invadens
RLLLKEGGEVVDIVEAEI

SEQ ID NO: 2964917 - protein, 20 aa, Entamoeba invadens
RLLLNFPPNLQSGAVPLQIL

SEQ ID NO: 2964918 - protein, 20 aa, Entamoeba invadens
RLLLTEVNPLFVLSFSQYSA

SEQ ID NO: 2964919 - protein, 19 aa, Entamoeba invadens
RLLNCGYHFDNIEFTDDDF

SEQ ID NO: 2964920 - protein, 23 aa, Entamoeba invadens
RLLPIKLTAKFVADCITYLQMSK

SEQ ID NO: 2964921 - protein, 18 aa, Entamoeba invadens
RLLTKVKLPNKLKEVSDE

SEQ ID NO: 2964922 - protein, 20 aa, Entamoeba invadens
RLLVIGGRPTINWYDLFKNC

SEQ ID NO: 2964923 - protein, 19 aa, Entamoeba invadens
RLMMKGFLLEQSMDKTISH

SEQ ID NO: 2964924 - protein, 17 aa, Entamoeba invadens
RLNAKNLLLTWPQTPLP

SEQ ID NO: 2964925 - protein, 25 aa, Entamoeba invadens
RLNDLFKLDIIFAQILCDSLIFERN

SEQ ID NO: 2964926 - protein, 19 aa, Entamoeba invadens
RLNGICVLNCDVDEEEYDG

SEQ ID NO: 2964927 - protein, 20 aa, Entamoeba invadens
RLNHELRFNDAFSNLGFDHL

SEQ ID NO: 2964928 - protein, 19 aa, Entamoeba invadens
RLNIKRRLNILKRVSEDTK

SEQ ID NO: 2964929 - protein, 20 aa, Entamoeba invadens
RLNKGLFHRMCNVKTIDLKT

SEQ ID NO: 2964930 - protein, 25 aa, Entamoeba invadens
RLNKLPCLVNGQFVLKDREYAENVD

SEQ ID NO: 2964931 - protein, 23 aa, Entamoeba invadens
RLNKSLYVPKGWYQSFTMDVTTG

SEQ ID NO: 2964932 - protein, 19 aa, Entamoeba invadens
RLNMIRGKVLIFVNSIQQA

SEQ ID NO: 2964933 - protein, 26 aa, Entamoeba invadens
RLNNLKMKRPWAIFEEARKKAVDMRD

SEQ ID NO: 2964934 - protein, 19 aa, Entamoeba invadens
RLNPKCPGMSPQWFAESAG

SEQ ID NO: 2964935 - protein, 17 aa, Entamoeba invadens
RLNRLIKVYTIATNILM

SEQ ID NO: 2964936 - protein, 19 aa, Entamoeba invadens
RLNSAIGEFGVRCFEGCIS

SEQ ID NO: 2964937 - protein, 21 aa, Entamoeba invadens
RLNTFPFPKKVTAFGNLCFAN

SEQ ID NO: 2964938 - protein, 26 aa, Entamoeba invadens
RLNVSLTRAKYGLVIIGDAYTLMINP

SEQ ID NO: 2964939 - protein, 19 aa, Entamoeba invadens
RLPDHLIKYEAEYWQAYAD

SEQ ID NO: 2964940 - protein, 18 aa, Entamoeba invadens
RLPLEKIDLTGAKFGADA

SEQ ID NO: 2964941 - protein, 18 aa, Entamoeba invadens
RLPLSSRVQDVFSLPTFL

SEQ ID NO: 2964942 - protein, 25 aa, Entamoeba invadens
RLPMPRPGQILGIVGTNGIGKSTAM

SEQ ID NO: 2964943 - protein, 20 aa, Entamoeba invadens
RLPQDYCWIGGGEIDVKLGF

SEQ ID NO: 2964944 - protein, 25 aa, Entamoeba invadens
RLPRHGASCPIGLGVSCSADRNVKA

SEQ ID NO: 2964945 - protein, 34 aa, Entamoeba invadens
RLPRYRMLLDAIGKAGYKWFPLWKQTNSIMTEFL

SEQ ID NO: 2964946 - protein, 20 aa, Entamoeba invadens
RLQCLSFQSFVHALDPSTSS

SEQ ID NO: 2964947 - protein, 20 aa, Entamoeba invadens
RLQKSCLSFAVSHERVLEVI

SEQ ID NO: 2964948 - protein, 18 aa, Entamoeba invadens
RLQMMVVEPLVKNEEKTG

SEQ ID NO: 2964949 - protein, 25 aa, Entamoeba invadens
RLQNRGFKFLIPKMIYLEAPQTIIP

SEQ ID NO: 2964950 - protein, 19 aa, Entamoeba invadens
RLQQIEMFAPMLYQMSQNF

SEQ ID NO: 2964951 - protein, 19 aa, Entamoeba invadens
RLQRHLEANNSELIELRDR

SEQ ID NO: 2964952 - protein, 27 aa, Entamoeba invadens
RLQSYLKMEIPNVVELPQKVIPMEMDK

SEQ ID NO: 2964953 - protein, 18 aa, Entamoeba invadens
RLQTDLYKPIGLAEYAKN

SEQ ID NO: 2964954 - protein, 24 aa, Entamoeba invadens
RLRAEQIRALKRCTLVSHATLSRD

SEQ ID NO: 2964955 - protein, 17 aa, Entamoeba invadens
RLRDEFLLEKKRYEEQY

SEQ ID NO: 2964956 - protein, 27 aa, Entamoeba invadens
RLRDFHFCIFCGKMFNRRKYMKHSLEA

SEQ ID NO: 2964957 - protein, 17 aa, Entamoeba invadens
RLRDVNCLVDRYIDNIK

SEQ ID NO: 2964958 - protein, 21 aa, Entamoeba invadens
RLREITFATIIIPSHRVAQNP

SEQ ID NO: 2964959 - protein, 19 aa, Entamoeba invadens
RLRFSNIRRQITYILLTNH

SEQ ID NO: 2964960 - protein, 18 aa, Entamoeba invadens
RLRHLRVVSFKGCTLLTD

SEQ ID NO: 2964961 - protein, 30 aa, Entamoeba invadens
RLRHLSYPGCNCFLMCFSLISQGSLDNIEG

SEQ ID NO: 2964962 - protein, 25 aa, Entamoeba invadens
RLRKCIPEITIATDIICGFPTETDE

SEQ ID NO: 2964963 - protein, 24 aa, Entamoeba invadens
RLRPLSYPGTSVFLLCFSVISPAS

SEQ ID NO: 2964964 - protein, 21 aa, Entamoeba invadens
RLRPLSYPSTDVFLLCFSVIA

SEQ ID NO: 2964965 - protein, 21 aa, Entamoeba invadens
RLRPQLCSLGGYPNFAQEDPR

SEQ ID NO: 2964966 - protein, 22 aa, Entamoeba invadens
RLRPQLCSLGGYPNFAQEDPRS

SEQ ID NO: 2964967 - protein, 23 aa, Entamoeba invadens
RLRPQLCSLGGYPNFAQVDPRSN

SEQ ID NO: 2964968 - protein, 23 aa, Entamoeba invadens
RLRSSTPSNVAFRTPRQSQEVKS

SEQ ID NO: 2964969 - protein, 20 aa, Entamoeba invadens
RLRTVIAVLKLCVFNDVKLS

SEQ ID NO: 2964970 - protein, 17 aa, Entamoeba invadens
RLRVDQLTNLKIVSLCA

SEQ ID NO: 2964971 - protein, 19 aa, Entamoeba invadens
RLRVFAGAVKQVYELPPIK

SEQ ID NO: 2964972 - protein, 18 aa, Entamoeba invadens
RLSCGKLFNGSKILAEND

SEQ ID NO: 2964973 - protein, 17 aa, Entamoeba invadens
RLSCVTIPSSVIFIGNS

SEQ ID NO: 2964974 - protein, 18 aa, Entamoeba invadens
RLSEGIDFADHLARAVVI

SEQ ID NO: 2964975 - protein, 19 aa, Entamoeba invadens
RLSGITIPSSVKYIGKDSF

SEQ ID NO: 2964976 - protein, 20 aa, Entamoeba invadens
RLSGLPLEKCLSVIQSNGVY

SEQ ID NO: 2964977 - protein, 18 aa, Entamoeba invadens
RLSKELREKYSVKALPIH

SEQ ID NO: 2964978 - protein, 18 aa, Entamoeba invadens
RLSKELREKYTVKALPIH

SEQ ID NO: 2964979 - protein, 21 aa, Entamoeba invadens
RLSKVSFPPVIRVIGDSAFQD

SEQ ID NO: 2964980 - protein, 19 aa, Entamoeba invadens
RLSLAPAKPKPMYADDNQI

SEQ ID NO: 2964981 - protein, 19 aa, Entamoeba invadens
RLSLGNTFGRLSDVPSSSS

SEQ ID NO: 2964982 - protein, 18 aa, Entamoeba invadens
RLSMPHVVITNYKAQDLC

SEQ ID NO: 2964983 - protein, 19 aa, Entamoeba invadens
RLSRLCFASFLSTLKCEML

SEQ ID NO: 2964984 - protein, 18 aa, Entamoeba invadens
RLSSTLLNMTYKTTNLTM

SEQ ID NO: 2964985 - protein, 21 aa, Entamoeba invadens
RLSTSLLRTQFSTLFKQKCIL

SEQ ID NO: 2964986 - protein, 30 aa, Entamoeba invadens
RLSTTLTQLGPRVFRGCTRLNKIDLPTSLL

SEQ ID NO: 2964987 - protein, 19 aa, Entamoeba invadens
RLSVSQGKLVIRVIESPQS

SEQ ID NO: 2964988 - protein, 17 aa, Entamoeba invadens
RLSWLYAPSSVILRSVD

SEQ ID NO: 2964989 - protein, 20 aa, Entamoeba invadens
RLTAVFPALFEFFKTKQVQV

SEQ ID NO: 2964990 - protein, 20 aa, Entamoeba invadens
RLTDFFYKKFVKGGSLLSKS

SEQ ID NO: 2964991 - protein, 17 aa, Entamoeba invadens
RLTDGRGRTVDFKNTVI

SEQ ID NO: 2964992 - protein, 18 aa, Entamoeba invadens
RLTDGRGRTVDFKNTVII

SEQ ID NO: 2964993 - protein, 17 aa, Entamoeba invadens
RLTHQLFSIKSLVIKDE

SEQ ID NO: 2964994 - protein, 20 aa, Entamoeba invadens
RLTKSLLEMTQCYILDTETE

SEQ ID NO: 2964995 - protein, 17 aa, Entamoeba invadens
RLTKYPLLLKEAKKYLV

SEQ ID NO: 2964996 - protein, 20 aa, Entamoeba invadens
RLTLFDFLNRCLAYRPDERM

SEQ ID NO: 2964997 - protein, 17 aa, Entamoeba invadens
RLTMKKMVDIGFIKISK

SEQ ID NO: 2964998 - protein, 19 aa, Entamoeba invadens
RLTNNRFVFYVDIKSASRL

SEQ ID NO: 2964999 - protein, 17 aa, Entamoeba invadens
RLVAFAVDLNGTRNKKT

SEQ ID NO: 2965000 - protein, 23 aa, Entamoeba invadens
RLVCDANGKAIDGIYPFYESTTL

SEQ ID NO: 2965001 - protein, 18 aa, Entamoeba invadens
RLVDHFLYHSHLCIVTEL

SEQ ID NO: 2965002 - protein, 22 aa, Entamoeba invadens
RLVDILQTLPFVTVEEKKSTKQ

SEQ ID NO: 2965003 - protein, 17 aa, Entamoeba invadens
RLVDYKVNVFRIAANDK

SEQ ID NO: 2965004 - protein, 19 aa, Entamoeba invadens
RLVEGIVEYNQFINADNCL

SEQ ID NO: 2965005 - protein, 20 aa, Entamoeba invadens
RLVGNVELLAAMKQVYENGV

SEQ ID NO: 2965006 - protein, 26 aa, Entamoeba invadens
RLVLKREMYFVLKLIDFLVTSSEKFR

SEQ ID NO: 2965007 - protein, 24 aa, Entamoeba invadens
RLVLSYECTTNWIGKQTVIYQHES

SEQ ID NO: 2965008 - protein, 19 aa, Entamoeba invadens
RLVPPGWTATVLNKKERSD

SEQ ID NO: 2965009 - protein, 19 aa, Entamoeba invadens
RLVRELRQDMNIGVPTTKR

SEQ ID NO: 2965010 - protein, 25 aa, Entamoeba invadens
RLVRYFELSVGLSLISVGIVDQNEY

SEQ ID NO: 2965011 - protein, 23 aa, Entamoeba invadens
RLVTLEMLKCVDVSIKSENETFN

SEQ ID NO: 2965012 - protein, 20 aa, Entamoeba invadens
RLVVDGTFTSPVFMKPLDLG

SEQ ID NO: 2965013 - protein, 19 aa, Entamoeba invadens
RLVVGLIFRKSDPLPTKYL

SEQ ID NO: 2965014 - protein, 21 aa, Entamoeba invadens
RLVVSDGWYTITLIVDGDLSQ

SEQ ID NO: 2965015 - protein, 27 aa, Entamoeba invadens
RLWFPDMPSEFLLPADLPVKPVEEDNI

SEQ ID NO: 2965016 - protein, 20 aa, Entamoeba invadens
RLYCKFYCCQDVRILKEGHT

SEQ ID NO: 2965017 - protein, 20 aa, Entamoeba invadens
RLYEMWRKGLYHSYTSEETI

SEQ ID NO: 2965018 - protein, 34 aa, Entamoeba invadens
RLYFSLKKDVYWFISDHWYCFGKMAQFTTSPSKW

SEQ ID NO: 2965019 - protein, 26 aa, Entamoeba invadens
RLYGEGGGMLEVWKDLISDFTFKTWT

SEQ ID NO: 2965020 - protein, 19 aa, Entamoeba invadens
RLYHACVFGIDRDEVSLNV

SEQ ID NO: 2965021 - protein, 19 aa, Entamoeba invadens
RLYIPLPDLEARNVLVKTL

SEQ ID NO: 2965022 - protein, 17 aa, Entamoeba invadens
RLYKKWNETVGSLYKEN

SEQ ID NO: 2965023 - protein, 23 aa, Entamoeba invadens
RLYKRGNLTFQMFTIPNIRKNGV

SEQ ID NO: 2965024 - protein, 27 aa, Entamoeba invadens
RLYTDYFYKRHEGLWEATARKRLPAMA

SEQ ID NO: 2965025 - protein, 20 aa, Entamoeba invadens
RMADEFSVAVVLTNQVVAQV

SEQ ID NO: 2965026 - protein, 17 aa, Entamoeba invadens
RMAEALPGLVSCLLVGG

SEQ ID NO: 2965027 - protein, 20 aa, Entamoeba invadens
RMAQRLFFKSAKDKRSFIAN

SEQ ID NO: 2965028 - protein, 25 aa, Entamoeba invadens
RMASVIICGIILWMKEDVLSNPKAL

SEQ ID NO: 2965029 - protein, 25 aa, Entamoeba invadens
RMATWKNEYLIGIEKCWLYENRVYI

SEQ ID NO: 2965030 - protein, 26 aa, Entamoeba invadens
RMCDPCGRPPPERVGMEVTLQEMNDT

SEQ ID NO: 2965031 - protein, 17 aa, Entamoeba invadens
RMCFTLNRLTSIKLGDS

SEQ ID NO: 2965032 - protein, 19 aa, Entamoeba invadens
RMCKDLKHAIYYRFNTGPV

SEQ ID NO: 2965033 - protein, 18 aa, Entamoeba invadens
RMCTKWSDHLYCEKGVVN

SEQ ID NO: 2965034 - protein, 25 aa, Entamoeba invadens
RMDALKKLTIVYGFNISPSSLELIT

SEQ ID NO: 2965035 - protein, 25 aa, Entamoeba invadens
RMDEGRVRYALCEMALNLKQFPSQE

SEQ ID NO: 2965036 - protein, 20 aa, Entamoeba invadens
RMDEIDTFLQISARDPKYTN

SEQ ID NO: 2965037 - protein, 18 aa, Entamoeba invadens
RMDLFKFPTFTILHLTLN

SEQ ID NO: 2965038 - protein, 35 aa, Entamoeba invadens
RMDNFKFTECLHALTDLLFLSGYLFNVKQSTGKNN

SEQ ID NO: 2965039 - protein, 19 aa, Entamoeba invadens
RMDRLNGIVRFDLENEETE

SEQ ID NO: 2965040 - protein, 20 aa, Entamoeba invadens
RMENEIKKLAPRTMEVKVIA

SEQ ID NO: 2965041 - protein, 24 aa, Entamoeba invadens
RMEQFGVRCIEPFVPYETSTVEIT

SEQ ID NO: 2965042 - protein, 22 aa, Entamoeba invadens
RMFETRLLSVLIDIIDSKDEKL

SEQ ID NO: 2965043 - protein, 19 aa, Entamoeba invadens
RMFIGNICRFGADVRYWPE

SEQ ID NO: 2965044 - protein, 25 aa, Entamoeba invadens
RMFPHKFQLIEVFPLLINEEDFSMA

SEQ ID NO: 2965045 - protein, 29 aa, Entamoeba invadens
RMFPPETIKKLGIKHVRGILLYGPPGCGK

SEQ ID NO: 2965046 - protein, 17 aa, Entamoeba invadens
RMGEDFTVSIVMSQAIK

SEQ ID NO: 2965047 - protein, 20 aa, Entamoeba invadens
RMGEQLPEDLVWNIFLQINF

SEQ ID NO: 2965048 - protein, 17 aa, Entamoeba invadens
RMGGICEIGDFCFKDHT

SEQ ID NO: 2965049 - protein, 21 aa, Entamoeba invadens
RMGLSRSHAGVITRASFEQTL

SEQ ID NO: 2965050 - protein, 19 aa, Entamoeba invadens
RMHETPFDALYLIDYGANG

SEQ ID NO: 2965051 - protein, 19 aa, Entamoeba invadens
RMIDNRMRIYISINDAPVF

SEQ ID NO: 2965052 - protein, 20 aa, Entamoeba invadens
RMIGMCVIMAQIGMYVPCDS

SEQ ID NO: 2965053 - protein, 20 aa, Entamoeba invadens
RMILSDVKSMFILGKGLAES

SEQ ID NO: 2965054 - protein, 17 aa, Entamoeba invadens
RMIPIIKKFQGLKNLIL

SEQ ID NO: 2965055 - protein, 18 aa, Entamoeba invadens
RMKEHIMIKHKEGKAIFF

SEQ ID NO: 2965056 - protein, 24 aa, Entamoeba invadens
RMKELCMPMDFGVKKEFVQESGSA

SEQ ID NO: 2965057 - protein, 20 aa, Entamoeba invadens
RMKFFYMNNTCFLRQKQNDF

SEQ ID NO: 2965058 - protein, 22 aa, Entamoeba invadens
RMKRKEVKKCLVRHTEEVITGS

SEQ ID NO: 2965059 - protein, 18 aa, Entamoeba invadens
RMKVLDISGPLQVMKENP

SEQ ID NO: 2965060 - protein, 22 aa, Entamoeba invadens
RMKVVKLCDNFLLISKKTRTLE

SEQ ID NO: 2965061 - protein, 19 aa, Entamoeba invadens
RMKYFPVNECFIYCKYTTL

SEQ ID NO: 2965062 - protein, 17 aa, Entamoeba invadens
RMLDQIALFLNMERDPL

SEQ ID NO: 2965063 - protein, 17 aa, Entamoeba invadens
RMLESQLAPIVVFATNR

SEQ ID NO: 2965064 - protein, 27 aa, Entamoeba invadens
RMLFLPVEKSLQCSLAAYFKDETFTGE

SEQ ID NO: 2965065 - protein, 27 aa, Entamoeba invadens
RMLLLLRRKRVQIIRSIIAVYKKCLYN

SEQ ID NO: 2965066 - protein, 17 aa, Entamoeba invadens
RMLQCIDTFLRNVGNKK

SEQ ID NO: 2965067 - protein, 20 aa, Entamoeba invadens
RMMGDSCFRGYTAECICDAY

SEQ ID NO: 2965068 - protein, 18 aa, Entamoeba invadens
RMNDEMAITVLMKEFPKD

SEQ ID NO: 2965069 - protein, 23 aa, Entamoeba invadens
RMNQFPFPFAETIVLDISNNLNI

SEQ ID NO: 2965070 - protein, 17 aa, Entamoeba invadens
RMNRDWMHYGRRPSGIC

SEQ ID NO: 2965071 - protein, 26 aa, Entamoeba invadens
RMNVLCPYKPLEVYFFTEFSENKTIN

SEQ ID NO: 2965072 - protein, 19 aa, Entamoeba invadens
RMPSANSYFPIARIVVVQF

SEQ ID NO: 2965073 - protein, 19 aa, Entamoeba invadens
RMRKRKAVVKKREIQKAEK

SEQ ID NO: 2965074 - protein, 24 aa, Entamoeba invadens
RMSAIQFLSKVVMFFEITPQQGAM

SEQ ID NO: 2965075 - protein, 18 aa, Entamoeba invadens
RMSIGDLVDNTRNYQAKL

SEQ ID NO: 2965076 - protein, 32 aa, Entamoeba invadens
RMSQFRNFCFFKCANLCYLTIPSIVQVISEQC

SEQ ID NO: 2965077 - protein, 19 aa, Entamoeba invadens
RMSSLLFNLIHSQIQNNPN

SEQ ID NO: 2965078 - protein, 19 aa, Entamoeba invadens
RMTEDKCCTFVGTLGYLAP

SEQ ID NO: 2965079 - protein, 21 aa, Entamoeba invadens
RMTLEGAKVLGVYEICPKICG

SEQ ID NO: 2965080 - protein, 19 aa, Entamoeba invadens
RMVQEVYKKIGIKTTDVIL

SEQ ID NO: 2965081 - protein, 17 aa, Entamoeba invadens
RMVRDVFRLARENAPSI

SEQ ID NO: 2965082 - protein, 20 aa, Entamoeba invadens
RMVRYSIFCLSRMSDNPKAT

SEQ ID NO: 2965083 - protein, 22 aa, Entamoeba invadens
RMWKDDMFKEKAYLKRKIIELE

SEQ ID NO: 2965084 - protein, 17 aa, Entamoeba invadens
RMYDLGKQILIRRCEVG

SEQ ID NO: 2965085 - protein, 20 aa, Entamoeba invadens
RMYIRPRREFSVGSAKICTM

SEQ ID NO: 2965086 - protein, 24 aa, Entamoeba invadens
RNADFFRNKMELLNTEENKEKVDF

SEQ ID NO: 2965087 - protein, 19 aa, Entamoeba invadens
RNAEIEELYQLYLLSNELN

SEQ ID NO: 2965088 - protein, 18 aa, Entamoeba invadens
RNAFPCFDEPNYKATFDV

SEQ ID NO: 2965089 - protein, 26 aa, Entamoeba invadens
RNAKLEHIGAFCFFNCTNLLDINKID

SEQ ID NO: 2965090 - protein, 18 aa, Entamoeba invadens
RNALRRILYTLLCVDNIK

SEQ ID NO: 2965091 - protein, 19 aa, Entamoeba invadens
RNASEFAEGEIKRNSWLVC

SEQ ID NO: 2965092 - protein, 24 aa, Entamoeba invadens
RNASWKFKRFLVEKLAEGVLGCQH

SEQ ID NO: 2965093 - protein, 18 aa, Entamoeba invadens
RNAVSTLFFLRFLLTPFT

SEQ ID NO: 2965094 - protein, 31 aa, Entamoeba invadens
RNCADTIVRKCLGRVSNCHQFEILMMDCAIM

SEQ ID NO: 2965095 - protein, 18 aa, Entamoeba invadens
RNCEKISFDKEWEKNYKV

SEQ ID NO: 2965096 - protein, 22 aa, Entamoeba invadens
RNCNFNRGVLFNKDLDMIQNLT

SEQ ID NO: 2965097 - protein, 19 aa, Entamoeba invadens
RNCSGLKRKDTLSKLFGQQ

SEQ ID NO: 2965098 - protein, 18 aa, Entamoeba invadens
RNCYKETYFDSGQETVTY

SEQ ID NO: 2965099 - protein, 20 aa, Entamoeba invadens
RNDCPLCTRNFYGESTPTSN

SEQ ID NO: 2965100 - protein, 18 aa, Entamoeba invadens
RNDFIVYWLKKMKKFQKM

SEQ ID NO: 2965101 - protein, 22 aa, Entamoeba invadens
RNDGCCFWFCRSKCHKSFKMKR

SEQ ID NO: 2965102 - protein, 19 aa, Entamoeba invadens
RNDGNAAFEIFLKAIEENV

SEQ ID NO: 2965103 - protein, 20 aa, Entamoeba invadens
RNDIESLLKDSNRAIVTLAT

SEQ ID NO: 2965104 - protein, 28 aa, Entamoeba invadens
RNDITVFISGIFYNVGFDMPKIYEIDKN

SEQ ID NO: 2965105 - protein, 32 aa, Entamoeba invadens
RNDVTCAIRFVKLFRMFVNFLGGDIVDIESGQ

SEQ ID NO: 2965106 - protein, 24 aa, Entamoeba invadens
RNECMKAFIVDDVTERKTLFNCLA

SEQ ID NO: 2965107 - protein, 25 aa, Entamoeba invadens
RNEEAFQFLKPCEKEALNYTCEIPF

SEQ ID NO: 2965108 - protein, 17 aa, Entamoeba invadens
RNEEIKKSLIVGVTCAS

SEQ ID NO: 2965109 - protein, 21 aa, Entamoeba invadens
RNEIRARIEAEIREKRKQDKL

SEQ ID NO: 2965110 - protein, 18 aa, Entamoeba invadens
RNEKARYLLADIYTQTAY

SEQ ID NO: 2965111 - protein, 20 aa, Entamoeba invadens
RNEKELALVKEQKLDTLVEG

SEQ ID NO: 2965112 - protein, 19 aa, Entamoeba invadens
RNELKYQRSTCRHCPGCDD

SEQ ID NO: 2965113 - protein, 28 aa, Entamoeba invadens
RNELPEMCDLLACVGCVCDYMDETDYIT

SEQ ID NO: 2965114 - protein, 18 aa, Entamoeba invadens
RNEMCKTVFYNGNYLFGK

SEQ ID NO: 2965115 - protein, 20 aa, Entamoeba invadens
RNEMMSVFLPLLLIEDEAGQ

SEQ ID NO: 2965116 - protein, 22 aa, Entamoeba invadens
RNEMNFNLIISCFKKMSTFVYE

SEQ ID NO: 2965117 - protein, 24 aa, Entamoeba invadens
RNESEGRCKKSRPIKEVEEESSDS

SEQ ID NO: 2965118 - protein, 18 aa, Entamoeba invadens
RNESIYLLMNYLVKYPFL

SEQ ID NO: 2965119 - protein, 19 aa, Entamoeba invadens
RNEVRVVLIEVVFEDIKSI

SEQ ID NO: 2965120 - protein, 17 aa, Entamoeba invadens
RNEVVSFFVTDVLDYLY

SEQ ID NO: 2965121 - protein, 25 aa, Entamoeba invadens
RNFCNKLWNAFKFASMNFSEDFTPS

SEQ ID NO: 2965122 - protein, 26 aa, Entamoeba invadens
RNFDTLLCILLLFGTSAIHRLKRTFD

SEQ ID NO: 2965123 - protein, 19 aa, Entamoeba invadens
RNFEIPKEVNILSTFTMSS

SEQ ID NO: 2965124 - protein, 18 aa, Entamoeba invadens
RNFFGFHVRFRDLARGGL

SEQ ID NO: 2965125 - protein, 19 aa, Entamoeba invadens
RNFKTFSWGKSEFLMTHVW

SEQ ID NO: 2965126 - protein, 22 aa, Entamoeba invadens
RNFMFKNCIKLKDVIIKKGVVK

SEQ ID NO: 2965127 - protein, 21 aa, Entamoeba invadens
RNFMFKNCVKLEDVTMQDQIV

SEQ ID NO: 2965128 - protein, 20 aa, Entamoeba invadens
RNFNDLRASLELFNKNNFFI

SEQ ID NO: 2965129 - protein, 24 aa, Entamoeba invadens
RNFNIKRRVTILLKEGSDFLQDVH

SEQ ID NO: 2965130 - protein, 18 aa, Entamoeba invadens
RNFPALKGKVCTSYCVVF

SEQ ID NO: 2965131 - protein, 17 aa, Entamoeba invadens
RNFPVFKGKEAQFYGMA

SEQ ID NO: 2965132 - protein, 25 aa, Entamoeba invadens
RNFSEKLKQPWDWEEEFSTNEVVKK

SEQ ID NO: 2965133 - protein, 18 aa, Entamoeba invadens
RNFSLAEIGSSFFTLNQT

SEQ ID NO: 2965134 - protein, 34 aa, Entamoeba invadens
RNGAKSVYLYSLFLARVAAGLVCEEELEYGKAMS

SEQ ID NO: 2965135 - protein, 17 aa, Entamoeba invadens
RNGCGKSTLMRVIATRQ

SEQ ID NO: 2965136 - protein, 25 aa, Entamoeba invadens
RNGFTEFIIFFALSMILTVTGKYNT

SEQ ID NO: 2965137 - protein, 19 aa, Entamoeba invadens
RNGLDCFKCDISCSTCNTF

SEQ ID NO: 2965138 - protein, 20 aa, Entamoeba invadens
RNGMNYTLLLNRSVWLNQWL

SEQ ID NO: 2965139 - protein, 21 aa, Entamoeba invadens
RNGNKRLTVTVKRQQVLQTLY

SEQ ID NO: 2965140 - protein, 26 aa, Entamoeba invadens
RNGNKYECPICFERANIRCRSIVIES

SEQ ID NO: 2965141 - protein, 20 aa, Entamoeba invadens
RNGNTEGWKKSKGKDEIYGK

SEQ ID NO: 2965142 - protein, 17 aa, Entamoeba invadens
RNGYKIIANETCTIVPN

SEQ ID NO: 2965143 - protein, 24 aa, Entamoeba invadens
RNGYKLRIEMAFVITNSLYGTGGE

SEQ ID NO: 2965144 - protein, 25 aa, Entamoeba invadens
RNHISCAEVLVLYCNTHIPDNYGQL

SEQ ID NO: 2965145 - protein, 26 aa, Entamoeba invadens
RNHKGRFIPITNMCFFGKADRAQLSE

SEQ ID NO: 2965146 - protein, 17 aa, Entamoeba invadens
RNHLKWLEKLRHIEDLK

SEQ ID NO: 2965147 - protein, 19 aa, Entamoeba invadens
RNIAVELFVSGGRNKLIIF

SEQ ID NO: 2965148 - protein, 21 aa, Entamoeba invadens
RNIDYACPFCQTTLSSKEEFL

SEQ ID NO: 2965149 - protein, 22 aa, Entamoeba invadens
RNIETGKICAMKIIDISSAREK

SEQ ID NO: 2965150 - protein, 17 aa, Entamoeba invadens
RNIFGGFTNKAGTVPNK

SEQ ID NO: 2965151 - protein, 21 aa, Entamoeba invadens
RNIFSGLKFDLSEIESTPRKL

SEQ ID NO: 2965152 - protein, 21 aa, Entamoeba invadens
RNIHRVCLKGLTGANFVMSGV

SEQ ID NO: 2965153 - protein, 19 aa, Entamoeba invadens
RNIKAKIVFGAALTGCKYV

SEQ ID NO: 2965154 - protein, 18 aa, Entamoeba invadens
RNILGQKLGYIFENEIRL

SEQ ID NO: 2965155 - protein, 24 aa, Entamoeba invadens
RNILMKVKHPFLVNLYYSFQTTTH

SEQ ID NO: 2965156 - protein, 17 aa, Entamoeba invadens
RNIPLGVLSVGQIKEFD

SEQ ID NO: 2965157 - protein, 17 aa, Entamoeba invadens
RNIPLIVDIIDLPRIEK

SEQ ID NO: 2965158 - protein, 17 aa, Entamoeba invadens
RNIPRSGLVQCNIIKEG

SEQ ID NO: 2965159 - protein, 28 aa, Entamoeba invadens
RNIQCGLHLRKSVYCSYGDLVMGDLIMR

SEQ ID NO: 2965160 - protein, 24 aa, Entamoeba invadens
RNIVEPQLFISALIKNVPKSIFEI

SEQ ID NO: 2965161 - protein, 23 aa, Entamoeba invadens
RNKAMTRLVSFLIVKTTTSNDNT

SEQ ID NO: 2965162 - protein, 17 aa, Entamoeba invadens
RNKEEKLISASKRRSFE

SEQ ID NO: 2965163 - protein, 18 aa, Entamoeba invadens
RNKFDLMIDEVSVNKGSQ

SEQ ID NO: 2965164 - protein, 25 aa, Entamoeba invadens
RNKFHLRCIINLFGDGPGSLFSIHN

SEQ ID NO: 2965165 - protein, 20 aa, Entamoeba invadens
RNKIILRYAQGFSNDIFDEA

SEQ ID NO: 2965166 - protein, 17 aa, Entamoeba invadens
RNKLSYNAAKKCEKFVI

SEQ ID NO: 2965167 - protein, 25 aa, Entamoeba invadens
RNKNRIGHQFFWFLKAELHDNRVTE

SEQ ID NO: 2965168 - protein, 29 aa, Entamoeba invadens
RNKQSFLEYMWLTQLEFVRTVRGQLVTIE

SEQ ID NO: 2965169 - protein, 21 aa, Entamoeba invadens
RNKRIKIIIMSATLAVELFEK

SEQ ID NO: 2965170 - protein, 19 aa, Entamoeba invadens
RNKSRYAVDAYGDVETIPN

SEQ ID NO: 2965171 - protein, 18 aa, Entamoeba invadens
RNKVCMVTEFATYGSLQD

SEQ ID NO: 2965172 - protein, 18 aa, Entamoeba invadens
RNKYLGLADIRIDDRKHS

SEQ ID NO: 2965173 - protein, 21 aa, Entamoeba invadens
RNLDWKQPRPKGVPFNEYPIS

SEQ ID NO: 2965174 - protein, 17 aa, Entamoeba invadens
RNLEHIEIPKSVYIVEC

SEQ ID NO: 2965175 - protein, 19 aa, Entamoeba invadens
RNLKEVIDTVRYLKTLKDK

SEQ ID NO: 2965176 - protein, 27 aa, Entamoeba invadens
RNLKRLGDFGIPAPRVLRVKNNVLVME

SEQ ID NO: 2965177 - protein, 30 aa, Entamoeba invadens
RNLLGLLYLLFRRYRLDVIKNEEGTEKGKE

SEQ ID NO: 2965178 - protein, 27 aa, Entamoeba invadens
RNLMDLTCKECALPLVSTTLKKVTIQE

SEQ ID NO: 2965179 - protein, 18 aa, Entamoeba invadens
RNLNNFIQQLGMFVNPNF

SEQ ID NO: 2965180 - protein, 18 aa, Entamoeba invadens
RNLYELLEPSDIVNLMKK

SEQ ID NO: 2965181 - protein, 21 aa, Entamoeba invadens
RNMDTLGFIFTEIFKGRFRDV

SEQ ID NO: 2965182 - protein, 21 aa, Entamoeba invadens
RNMKRYLPGDLLSQKLVEAMK

SEQ ID NO: 2965183 - protein, 19 aa, Entamoeba invadens
RNMLLKKITIVFGTNEKVS

SEQ ID NO: 2965184 - protein, 17 aa, Entamoeba invadens
RNMLLKKVVFQFGDDKS

SEQ ID NO: 2965185 - protein, 25 aa, Entamoeba invadens
RNNKYKWFRPGSFFPTNQMYDIVGK

SEQ ID NO: 2965186 - protein, 32 aa, Entamoeba invadens
RNNLETISSFSLFYSFEWTTKVRNYIDIQNNL

SEQ ID NO: 2965187 - protein, 19 aa, Entamoeba invadens
RNNLILVMHHNILKNDFMQ

SEQ ID NO: 2965188 - protein, 21 aa, Entamoeba invadens
RNNLKDLLDFRGVEGNERESI

SEQ ID NO: 2965189 - protein, 33 aa, Entamoeba invadens
RNNLQWFRCPPKIFFEPHAIRYLKELKECSKIF

SEQ ID NO: 2965190 - protein, 18 aa, Entamoeba invadens
RNPDLRGKFFGLCRRMGV

SEQ ID NO: 2965191 - protein, 23 aa, Entamoeba invadens
RNPIICGVKILRGTLKMGCPISL

SEQ ID NO: 2965192 - protein, 22 aa, Entamoeba invadens
RNPPIRPPVIIRQTPIPQQRDV

SEQ ID NO: 2965193 - protein, 24 aa, Entamoeba invadens
RNPRKFKWAQAYRMTTGREMTVDK

SEQ ID NO: 2965194 - protein, 21 aa, Entamoeba invadens
RNPSAIGYKAMYQKLLPQFEK

SEQ ID NO: 2965195 - protein, 22 aa, Entamoeba invadens
RNQWKQKRFETAKKEIAKKNPV

SEQ ID NO: 2965196 - protein, 23 aa, Entamoeba invadens
RNRCGDSFCRKCVTDYVRNAMKE

SEQ ID NO: 2965197 - protein, 19 aa, Entamoeba invadens
RNREEIVGRIAMSRAPTDE

SEQ ID NO: 2965198 - protein, 28 aa, Entamoeba invadens
RNRINEPLKKGGLVFDVKVTGPTTPADV

SEQ ID NO: 2965199 - protein, 19 aa, Entamoeba invadens
RNRLFEMSSKTGVFGVEEV

SEQ ID NO: 2965200 - protein, 26 aa, Entamoeba invadens
RNRLRREFKKTMALQLEKLKTHFVKT

SEQ ID NO: 2965201 - protein, 29 aa, Entamoeba invadens
RNRNNLFKKREHPSFAFRVLEEPSGSHRI

SEQ ID NO: 2965202 - protein, 22 aa, Entamoeba invadens
RNRQLRIGRFHQHHVDDLPMDL

SEQ ID NO: 2965203 - protein, 19 aa, Entamoeba invadens
RNRTILLKSGFIKPLSEVI

SEQ ID NO: 2965204 - protein, 20 aa, Entamoeba invadens
RNRVCGRLDDYIQMMKETWD

SEQ ID NO: 2965205 - protein, 23 aa, Entamoeba invadens
RNSMPRDMFKFISSHIETYDVDD

SEQ ID NO: 2965206 - protein, 23 aa, Entamoeba invadens
RNSMPRDTFKFISSHIETYDVGQ

SEQ ID NO: 2965207 - protein, 35 aa, Entamoeba invadens
RNSNKLKKENLVFGSLYVLLKCGYVLDLQKPSKKT

SEQ ID NO: 2965208 - protein, 20 aa, Entamoeba invadens
RNSPTMSFVVGKQAKYPKDE

SEQ ID NO: 2965209 - protein, 19 aa, Entamoeba invadens
RNSVELARKVFSDVIGYPV

SEQ ID NO: 2965210 - protein, 18 aa, Entamoeba invadens
RNSVRMSPTFCLQLPEEE

SEQ ID NO: 2965211 - protein, 18 aa, Entamoeba invadens
RNSYIAVGIMNVFEHIVY

SEQ ID NO: 2965212 - protein, 34 aa, Entamoeba invadens
RNTEFPEPPLLEIPQFPEFLLIDKQLFCEKLEGK

SEQ ID NO: 2965213 - protein, 24 aa, Entamoeba invadens
RNTEGCPAYEKFLGLLAQKIELKG

SEQ ID NO: 2965214 - protein, 19 aa, Entamoeba invadens
RNTISLVMKCDQNGDIIEQ

SEQ ID NO: 2965215 - protein, 19 aa, Entamoeba invadens
RNTLDFYIERCGVNRIELE

SEQ ID NO: 2965216 - protein, 18 aa, Entamoeba invadens
RNTLHIYTFNKKGVDTEI

SEQ ID NO: 2965217 - protein, 19 aa, Entamoeba invadens
RNTMAPVRIFEGHHAPVWS

SEQ ID NO: 2965218 - protein, 25 aa, Entamoeba invadens
RNTPRLKSLELFSTFSEMQKKENFE

SEQ ID NO: 2965219 - protein, 20 aa, Entamoeba invadens
RNTQIKSFCEVFGVNDENRE

SEQ ID NO: 2965220 - protein, 25 aa, Entamoeba invadens
RNTSGLPLSLLSRVSCIRHPDFTEL

SEQ ID NO: 2965221 - protein, 19 aa, Entamoeba invadens
RNTVKRMCQVFAQNHPNIG

SEQ ID NO: 2965222 - protein, 20 aa, Entamoeba invadens
RNVDMFWDKTGQLIMEIVPK

SEQ ID NO: 2965223 - protein, 23 aa, Entamoeba invadens
RNVEKDWYLPVNELGSGNYGKVY

SEQ ID NO: 2965224 - protein, 21 aa, Entamoeba invadens
RNVEKSIKMSVLRLQDRNNGI

SEQ ID NO: 2965225 - protein, 24 aa, Entamoeba invadens
RNVEPLLCTLLLKLFKTDLVDNEN

SEQ ID NO: 2965226 - protein, 20 aa, Entamoeba invadens
RNVGVGLVFNVLQTECDIFF

SEQ ID NO: 2965227 - protein, 19 aa, Entamoeba invadens
RNVKIYSAIYTNFFDFDFI

SEQ ID NO: 2965228 - protein, 19 aa, Entamoeba invadens
RNVKIYSAIYTNFFDFIPI

SEQ ID NO: 2965229 - protein, 22 aa, Entamoeba invadens
RNVKYGNCSGFVWSDDGGYAVL

SEQ ID NO: 2965230 - protein, 18 aa, Entamoeba invadens
RNVLKQFLEQVIRDSVTY

SEQ ID NO: 2965231 - protein, 28 aa, Entamoeba invadens
RNVLMSELRKVPGLIINELIQYYYEPHH

SEQ ID NO: 2965232 - protein, 21 aa, Entamoeba invadens
RNVSFMKLEITDMTKEIWKYK

SEQ ID NO: 2965233 - protein, 18 aa, Entamoeba invadens
RNVSPVKEIKSYKERINQ

SEQ ID NO: 2965234 - protein, 18 aa, Entamoeba invadens
RNVTGHRVWYEWMVVTPL

SEQ ID NO: 2965235 - protein, 19 aa, Entamoeba invadens
RNVVGKIMCYMRFSTERAL

SEQ ID NO: 2965236 - protein, 19 aa, Entamoeba invadens
RNVVWKYLFNYIPSEVSRV

SEQ ID NO: 2965237 - protein, 23 aa, Entamoeba invadens
RNVWRCAQWFTDYFKSEVISVPE

SEQ ID NO: 2965238 - protein, 21 aa, Entamoeba invadens
RNWLDLCERKSVDVTKVLNYV

SEQ ID NO: 2965239 - protein, 17 aa, Entamoeba invadens
RNYCRREDELIVPDKFS

SEQ ID NO: 2965240 - protein, 19 aa, Entamoeba invadens
RNYVLFKSLEIVYNNLKTM

SEQ ID NO: 2965241 - protein, 18 aa, Entamoeba invadens
RNYWLMQETLRFEKEHPE

SEQ ID NO: 2965242 - protein, 18 aa, Entamoeba invadens
RPAHILFIKHFYLNVLQL

SEQ ID NO: 2965243 - protein, 20 aa, Entamoeba invadens
RPAIRKVFFSCIERQLMGSL

SEQ ID NO: 2965244 - protein, 26 aa, Entamoeba invadens
RPASKQAPLSLSCCSTLFVPPHHCPF

SEQ ID NO: 2965245 - protein, 25 aa, Entamoeba invadens
RPATHGEGGLGFSGKSSSTATQNLV

SEQ ID NO: 2965246 - protein, 20 aa, Entamoeba invadens
RPCVVFCTNNSLSVGSISRD

SEQ ID NO: 2965247 - protein, 27 aa, Entamoeba invadens
RPDEWWSSVCLTSFMRMSNYILQHPDK

SEQ ID NO: 2965248 - protein, 17 aa, Entamoeba invadens
RPDSVTWKYFVQCKEHA

SEQ ID NO: 2965249 - protein, 20 aa, Entamoeba invadens
RPEEFSLVNIRDFVAPVEPQ

SEQ ID NO: 2965250 - protein, 22 aa, Entamoeba invadens
RPEKEIFSLFRLFLDEHPIPIH

SEQ ID NO: 2965251 - protein, 24 aa, Entamoeba invadens
RPELIEIFGKIFFDAFAKSEHTPK

SEQ ID NO: 2965252 - protein, 17 aa, Entamoeba invadens
RPEMLNEAKGWWGGLSF

SEQ ID NO: 2965253 - protein, 23 aa, Entamoeba invadens
RPENPMLIAIREFCFKPKKLVKT

SEQ ID NO: 2965254 - protein, 23 aa, Entamoeba invadens
RPEWRDLAEIVVKFRQIAEPADG

SEQ ID NO: 2965255 - protein, 19 aa, Entamoeba invadens
RPFDVYRWHMADSNRQKKT

SEQ ID NO: 2965256 - protein, 17 aa, Entamoeba invadens
RPFPINLFIAPWKNPQT

SEQ ID NO: 2965257 - protein, 18 aa, Entamoeba invadens
RPFPNRKVVVRNISVTLF

SEQ ID NO: 2965258 - protein, 19 aa, Entamoeba invadens
RPFQAKKYYLMLFEEQIQQ

SEQ ID NO: 2965259 - protein, 21 aa, Entamoeba invadens
RPGRCYRMTRGHPYPKSKYCR

SEQ ID NO: 2965260 - protein, 17 aa, Entamoeba invadens
RPGTPLFNVRAYLPVCE

SEQ ID NO: 2965261 - protein, 17 aa, Entamoeba invadens
RPHCGEAGDPMHNAAAF

SEQ ID NO: 2965262 - protein, 19 aa, Entamoeba invadens
RPHNRLDVLVCLYTQKKFS

SEQ ID NO: 2965263 - protein, 17 aa, Entamoeba invadens
RPHRSRLDCSRKWKSTN

SEQ ID NO: 2965264 - protein, 19 aa, Entamoeba invadens
RPIETLIIIKCVKTSETTS

SEQ ID NO: 2965265 - protein, 18 aa, Entamoeba invadens
RPIFEGGKLIDNMEHPLK

SEQ ID NO: 2965266 - protein, 24 aa, Entamoeba invadens
RPILKKRRVDEEFAAKDKEIEALK

SEQ ID NO: 2965267 - protein, 25 aa, Entamoeba invadens
RPILNPCRKIGCVRIVDDGLYCGLE

SEQ ID NO: 2965268 - protein, 22 aa, Entamoeba invadens
RPINFLDFFAMKEMLHKRRTGN

SEQ ID NO: 2965269 - protein, 23 aa, Entamoeba invadens
RPIQEKWSFACDILILKKICDLG

SEQ ID NO: 2965270 - protein, 19 aa, Entamoeba invadens
RPITLRKGPVVDWSNKSNR

SEQ ID NO: 2965271 - protein, 25 aa, Entamoeba invadens
RPIVYQILEGLAFCHHHEILHRDMK

SEQ ID NO: 2965272 - protein, 19 aa, Entamoeba invadens
RPIYKERTLLISPRDLSRE

SEQ ID NO: 2965273 - protein, 18 aa, Entamoeba invadens
RPKAHLLKMSEFDVEEPF

SEQ ID NO: 2965274 - protein, 25 aa, Entamoeba invadens
RPKEIAALFFKTLMNQIKMEMPDLV

SEQ ID NO: 2965275 - protein, 26 aa, Entamoeba invadens
RPKEIAALFFKTLMNQIKMEVPDLVR

SEQ ID NO: 2965276 - protein, 19 aa, Entamoeba invadens
RPKFIRRCEMKEEIKKIDE

SEQ ID NO: 2965277 - protein, 19 aa, Entamoeba invadens
RPKKGSKKQLDFDVENEME

SEQ ID NO: 2965278 - protein, 19 aa, Entamoeba invadens
RPKLVDVFGNIFFGALKRK

SEQ ID NO: 2965279 - protein, 19 aa, Entamoeba invadens
RPKTFFIPEEFRESKCKVV

SEQ ID NO: 2965280 - protein, 20 aa, Entamoeba invadens
RPKVFPSLNYFGASVPICKY

SEQ ID NO: 2965281 - protein, 20 aa, Entamoeba invadens
RPLDATAICSIYAYEFMETT

SEQ ID NO: 2965282 - protein, 18 aa, Entamoeba invadens
RPLEWIYDTHQTFFHFGI

SEQ ID NO: 2965283 - protein, 21 aa, Entamoeba invadens
RPLFKELYPLPLRKEKNKRRT

SEQ ID NO: 2965284 - protein, 17 aa, Entamoeba invadens
RPLIGRKETVSVSSSTV

SEQ ID NO: 2965285 - protein, 19 aa, Entamoeba invadens
RPLLKSPKHSTLECMKIHT

SEQ ID NO: 2965286 - protein, 23 aa, Entamoeba invadens
RPLSHVFCLWNSNSMYRTLLLNE

SEQ ID NO: 2965287 - protein, 19 aa, Entamoeba invadens
RPLSYPNTDLFLLCFSVIS

SEQ ID NO: 2965288 - protein, 20 aa, Entamoeba invadens
RPLTELPLRMTQSTHPEEKK

SEQ ID NO: 2965289 - protein, 19 aa, Entamoeba invadens
RPLVEEAKNVYTIRTTNPQ

SEQ ID NO: 2965290 - protein, 20 aa, Entamoeba invadens
RPMSSSQFQYGYQQPPQYNS

SEQ ID NO: 2965291 - protein, 19 aa, Entamoeba invadens
RPNCPTNLLCQCLFEAIFI

SEQ ID NO: 2965292 - protein, 22 aa, Entamoeba invadens
RPNCSHHLICLNHFKRYSTNKT

SEQ ID NO: 2965293 - protein, 22 aa, Entamoeba invadens
RPNEKMLLGYGFVISENPYDEV

SEQ ID NO: 2965294 - protein, 19 aa, Entamoeba invadens
RPNFKVVYSSTLYGFDRKK

SEQ ID NO: 2965295 - protein, 21 aa, Entamoeba invadens
RPNLDYNLLELAALCVDISIT

SEQ ID NO: 2965296 - protein, 17 aa, Entamoeba invadens
RPNLSARQLWDVRWNNR

SEQ ID NO: 2965297 - protein, 19 aa, Entamoeba invadens
RPNPFKDNFITNTKSEGTL

SEQ ID NO: 2965298 - protein, 17 aa, Entamoeba invadens
RPNSVQCNTPVKENAKR

SEQ ID NO: 2965299 - protein, 19 aa, Entamoeba invadens
RPPLSLSFVESCHIESISF

SEQ ID NO: 2965300 - protein, 21 aa, Entamoeba invadens
RPPTLLPLYFEKIMYKMYFEK

SEQ ID NO: 2965301 - protein, 18 aa, Entamoeba invadens
RPQIAEVLPPLKNAQKDV

SEQ ID NO: 2965302 - protein, 24 aa, Entamoeba invadens
RPQKEVPSLVSFQVKGEKQMKPIP

SEQ ID NO: 2965303 - protein, 28 aa, Entamoeba invadens
RPQLVDWLFKTCDFLKFHKKLVFQALTL

SEQ ID NO: 2965304 - protein, 17 aa, Entamoeba invadens
RPQPSAYGVSFSSIQPH

SEQ ID NO: 2965305 - protein, 19 aa, Entamoeba invadens
RPRDYNVDVIPKFIMSSGE

SEQ ID NO: 2965306 - protein, 32 aa, Entamoeba invadens
RPRIYKRRVEGMWPTLCLWNDVNAENVVTIPG

SEQ ID NO: 2965307 - protein, 19 aa, Entamoeba invadens
RPSFKNNFDKIDFLTNTER

SEQ ID NO: 2965308 - protein, 22 aa, Entamoeba invadens
RPSFYQEMSEWTGLDGVDVLAT

SEQ ID NO: 2965309 - protein, 17 aa, Entamoeba invadens
RPSLGFELNYLPTRDDL

SEQ ID NO: 2965310 - protein, 21 aa, Entamoeba invadens
RPSLKNMKSDLVWKALDKTPL

SEQ ID NO: 2965311 - protein, 18 aa, Entamoeba invadens
RPSNATMEKRRKRIEHVK

SEQ ID NO: 2965312 - protein, 24 aa, Entamoeba invadens
RPSPPFKNGFCVIKSETFEVFEKL

SEQ ID NO: 2965313 - protein, 18 aa, Entamoeba invadens
RPSTDFASSMIFYSGKYK

SEQ ID NO: 2965314 - protein, 23 aa, Entamoeba invadens
RPSTDFASSMIFYSGKYKAYCIK

SEQ ID NO: 2965315 - protein, 18 aa, Entamoeba invadens
RPSTYFASSMIFYSGKYK

SEQ ID NO: 2965316 - protein, 20 aa, Entamoeba invadens
RPSYHCLPFSDWVLSQAKSL

SEQ ID NO: 2965317 - protein, 19 aa, Entamoeba invadens
RPTGMMVMAHPFHKAARVG

SEQ ID NO: 2965318 - protein, 17 aa, Entamoeba invadens
RPTINWYDLFKNCKIGK

SEQ ID NO: 2965319 - protein, 24 aa, Entamoeba invadens
RPTLPRKFMCKNFKKAENEKDGLK

SEQ ID NO: 2965320 - protein, 19 aa, Entamoeba invadens
RPTQFIRYDLKSEVARMKN

SEQ ID NO: 2965321 - protein, 25 aa, Entamoeba invadens
RPTSRWNVRILYDLLDIAALNAYKV

SEQ ID NO: 2965322 - protein, 32 aa, Entamoeba invadens
RPTTRPLLYERVVKWLNCDAAPVTLRDLRDMW

SEQ ID NO: 2965323 - protein, 18 aa, Entamoeba invadens
RPVCPLYPIDGGVAIISR

SEQ ID NO: 2965324 - protein, 19 aa, Entamoeba invadens
RPVKKFEIFELTEDYDERD

SEQ ID NO: 2965325 - protein, 21 aa, Entamoeba invadens
RPVKPEFWLGNDGRLNVYHNG

SEQ ID NO: 2965326 - protein, 19 aa, Entamoeba invadens
RPVNCQVDFNARKHSNSIS

SEQ ID NO: 2965327 - protein, 21 aa, Entamoeba invadens
RPVSVSSQISSPVTRQCQVEE

SEQ ID NO: 2965328 - protein, 17 aa, Entamoeba invadens
RPVVVMSLAQLKMFHQE

SEQ ID NO: 2965329 - protein, 25 aa, Entamoeba invadens
RPVYKEQRLSLIFNKAENSNTQIES

SEQ ID NO: 2965330 - protein, 19 aa, Entamoeba invadens
RPWFNAKYFRSQKYRKIVQ

SEQ ID NO: 2965331 - protein, 21 aa, Entamoeba invadens
RPWYYRTTFRSPLRKLFDICV

SEQ ID NO: 2965332 - protein, 22 aa, Entamoeba invadens
RPYGVSFLYAGWDKYFGYQLYM

SEQ ID NO: 2965333 - protein, 18 aa, Entamoeba invadens
RPYIPGFLPELPDPRTYK

SEQ ID NO: 2965334 - protein, 19 aa, Entamoeba invadens
RPYWKCYYEKCSAIIFVVD

SEQ ID NO: 2965335 - protein, 22 aa, Entamoeba invadens
RQCGGKEQFCPSVFYNKVEELG

SEQ ID NO: 2965336 - protein, 21 aa, Entamoeba invadens
RQCKAFGVPVVSELVPIDVFV

SEQ ID NO: 2965337 - protein, 20 aa, Entamoeba invadens
RQCQLNRIHGLFEVIPHKVY

SEQ ID NO: 2965338 - protein, 25 aa, Entamoeba invadens
RQDARSCGKLFGLFEEQNIYVTFST

SEQ ID NO: 2965339 - protein, 22 aa, Entamoeba invadens
RQDEAIKELLSLKEEALELQES

SEQ ID NO: 2965340 - protein, 22 aa, Entamoeba invadens
RQDRPSVMVLFETQETVFSPYN

SEQ ID NO: 2965341 - protein, 22 aa, Entamoeba invadens
RQEEIFKWDLKNGITQKTAMRR

SEQ ID NO: 2965342 - protein, 25 aa, Entamoeba invadens
RQEEIWIVMEFCFYGSVADMIDILG

SEQ ID NO: 2965343 - protein, 25 aa, Entamoeba invadens
RQEIDLRVGAAFTRLQTTFLKEKFP

SEQ ID NO: 2965344 - protein, 19 aa, Entamoeba invadens
RQEIGKYLSAKNIEYNLKF

SEQ ID NO: 2965345 - protein, 33 aa, Entamoeba invadens
RQEKARLLIEGGILELFKKGFLDKNKAYCLDGI

SEQ ID NO: 2965346 - protein, 29 aa, Entamoeba invadens
RQEMRTFSMIYKGDFDDVFSVIKGKTDAL

SEQ ID NO: 2965347 - protein, 20 aa, Entamoeba invadens
RQESFPSISSIKMTKDGNAL

SEQ ID NO: 2965348 - protein, 20 aa, Entamoeba invadens
RQESSHTFTSFRHQDIKQIP

SEQ ID NO: 2965349 - protein, 20 aa, Entamoeba invadens
RQETGLFYLALRKYGANMEL

SEQ ID NO: 2965350 - protein, 20 aa, Entamoeba invadens
RQFADLYFAPTQRICRYELL

SEQ ID NO: 2965351 - protein, 27 aa, Entamoeba invadens
RQFELTKGRGDICQRVMRQLDKRIEYF

SEQ ID NO: 2965352 - protein, 20 aa, Entamoeba invadens
RQFEVPPEISAYTIALTPSY

SEQ ID NO: 2965353 - protein, 18 aa, Entamoeba invadens
RQFFLPITDCIKVQNIGE

SEQ ID NO: 2965354 - protein, 27 aa, Entamoeba invadens
RQFNVTKGKCFRLCLNPFDSENQSDLF

SEQ ID NO: 2965355 - protein, 25 aa, Entamoeba invadens
RQFVIRTRFRAITVKSVFLGGKLMG

SEQ ID NO: 2965356 - protein, 19 aa, Entamoeba invadens
RQGIIPIPLYGTFGLDALD

SEQ ID NO: 2965357 - protein, 25 aa, Entamoeba invadens
RQHFSIKCNGLVLACTECGDTNVFN

SEQ ID NO: 2965358 - protein, 25 aa, Entamoeba invadens
RQIGMLNMLLGMGISPNRVNHNGEN

SEQ ID NO: 2965359 - protein, 25 aa, Entamoeba invadens
RQIILKYYPTYKMDVKFGQSGLIMK

SEQ ID NO: 2965360 - protein, 21 aa, Entamoeba invadens
RQIKKTLALLSDMTDLLNAAQ

SEQ ID NO: 2965361 - protein, 17 aa, Entamoeba invadens
RQIKNLRTMLMARVNVY

SEQ ID NO: 2965362 - protein, 25 aa, Entamoeba invadens
RQIMICLSTSLKYIHSIGYCHRDIK

SEQ ID NO: 2965363 - protein, 19 aa, Entamoeba invadens
RQISKKSWVECVSQENVMK

SEQ ID NO: 2965364 - protein, 18 aa, Entamoeba invadens
RQITEGCVYTLFQKNNTD

SEQ ID NO: 2965365 - protein, 19 aa, Entamoeba invadens
RQKCFVVVGLLLKAVDFDF

SEQ ID NO: 2965366 - protein, 23 aa, Entamoeba invadens
RQKENLFLFLVDFIRIPTQPVVS

SEQ ID NO: 2965367 - protein, 19 aa, Entamoeba invadens
RQKICGRLCEWATGDHVKI

SEQ ID NO: 2965368 - protein, 26 aa, Entamoeba invadens
RQKIKIRFETELELLHAQKFIQKLYD

SEQ ID NO: 2965369 - protein, 26 aa, Entamoeba invadens
RQKITLSINHFIYFIDFFEQYETREN

SEQ ID NO: 2965370 - protein, 21 aa, Entamoeba invadens
RQKSIKTMDEFYRESLKNVEN

SEQ ID NO: 2965371 - protein, 17 aa, Entamoeba invadens
RQKVESFFDLFYSPALP

SEQ ID NO: 2965372 - protein, 22 aa, Entamoeba invadens
RQLCFDFVLELAKIGDLGNFLV

SEQ ID NO: 2965373 - protein, 19 aa, Entamoeba invadens
RQLIMIFMRLGDLYNKTGE

SEQ ID NO: 2965374 - protein, 17 aa, Entamoeba invadens
RQLKEIEIPSGVVWMEA

SEQ ID NO: 2965375 - protein, 25 aa, Entamoeba invadens
RQLKELQYSTAVKCFFETIKTWPGL

SEQ ID NO: 2965376 - protein, 17 aa, Entamoeba invadens
RQLKNTFLTFSNNVEKV

SEQ ID NO: 2965377 - protein, 29 aa, Entamoeba invadens
RQLNSPTVNDCRRWFWELMQNAKDSIAGI

SEQ ID NO: 2965378 - protein, 27 aa, Entamoeba invadens
RQLTKRFRVTRLYNVYGELLFTEDKPT

SEQ ID NO: 2965379 - protein, 19 aa, Entamoeba invadens
RQLWDVRWNNRKGCTIWSV

SEQ ID NO: 2965380 - protein, 17 aa, Entamoeba invadens
RQMDIGKLLPILRKVLS

SEQ ID NO: 2965381 - protein, 19 aa, Entamoeba invadens
RQMNVLVIKCTNKIDVTPD

SEQ ID NO: 2965382 - protein, 29 aa, Entamoeba invadens
RQNASVNGTLCWAMYFALVQAANNYPNSM

SEQ ID NO: 2965383 - protein, 18 aa, Entamoeba invadens
RQNFGNDLQPVIDLIESK

SEQ ID NO: 2965384 - protein, 19 aa, Entamoeba invadens
RQPFFVIDFQFSYKTDVAT

SEQ ID NO: 2965385 - protein, 21 aa, Entamoeba invadens
RQPRIPKREKTGLQLPEDQQK

SEQ ID NO: 2965386 - protein, 25 aa, Entamoeba invadens
RQQALMVHLQLTVFSNRGTFGSIIG

SEQ ID NO: 2965387 - protein, 19 aa, Entamoeba invadens
RQQQELFKQQELQRKMEEE

SEQ ID NO: 2965388 - protein, 18 aa, Entamoeba invadens
RQRASSLKTPKEFERDQM

SEQ ID NO: 2965389 - protein, 17 aa, Entamoeba invadens
RQRGFGGVNMIGARVPI

SEQ ID NO: 2965390 - protein, 23 aa, Entamoeba invadens
RQRILKILFVMTSTGAVQQIIDG

SEQ ID NO: 2965391 - protein, 17 aa, Entamoeba invadens
RQRKRRPTISIADDLQE

SEQ ID NO: 2965392 - protein, 25 aa, Entamoeba invadens
RQRKSLRSCFNVFGGKEEFMSKEQF

SEQ ID NO: 2965393 - protein, 18 aa, Entamoeba invadens
RQRNCMMSGKYYDKTDGI

SEQ ID NO: 2965394 - protein, 17 aa, Entamoeba invadens
RQSENLMRIMFFEQMNL

SEQ ID NO: 2965395 - protein, 20 aa, Entamoeba invadens
RQSIKVVVTHPVFFDQKQRD

SEQ ID NO: 2965396 - protein, 18 aa, Entamoeba invadens
RQSTDCDAVHRMVDNLTV

SEQ ID NO: 2965397 - protein, 17 aa, Entamoeba invadens
RQSTIGFIEVLKKCNPS

SEQ ID NO: 2965398 - protein, 17 aa, Entamoeba invadens
RQTCLTFKYNPIPLDKL

SEQ ID NO: 2965399 - protein, 28 aa, Entamoeba invadens
RQTKMDCCELMCSKTNYFEENMELEKSQ

SEQ ID NO: 2965400 - protein, 24 aa, Entamoeba invadens
RQTNNSWLAWLWPHQNVQNEEEEY

SEQ ID NO: 2965401 - protein, 24 aa, Entamoeba invadens
RQTTFQKRRHGLIKKAMELSILCD

SEQ ID NO: 2965402 - protein, 19 aa, Entamoeba invadens
RQVEALRKIQIVDSGNVEL

SEQ ID NO: 2965403 - protein, 20 aa, Entamoeba invadens
RQVEEICMRLSVTDFENVNV

SEQ ID NO: 2965404 - protein, 20 aa, Entamoeba invadens
RQVLRMKKMPLTKWKLKNCG

SEQ ID NO: 2965405 - protein, 18 aa, Entamoeba invadens
RQVSEVYWQEIVRKMNVI

SEQ ID NO: 2965406 - protein, 18 aa, Entamoeba invadens
RQYEEFLRQITLRSDYNT

SEQ ID NO: 2965407 - protein, 23 aa, Entamoeba invadens
RQYLEMRTQFTLIGSEFEVHRLK

SEQ ID NO: 2965408 - protein, 29 aa, Entamoeba invadens
RQYMPSKPGKYGIKLWLMVDNVTGMIVNA

SEQ ID NO: 2965409 - protein, 26 aa, Entamoeba invadens
RQYPSPQFLAAVVFLFKSLIRGNPDF

SEQ ID NO: 2965410 - protein, 37 aa, Entamoeba invadens
RQYRCPEVMLGLHWGCPADIWSHACVIFELLTGDFLF

SEQ ID NO: 2965411 - protein, 17 aa, Entamoeba invadens
RRAAQCDGEPFAMEPCT

SEQ ID NO: 2965412 - protein, 23 aa, Entamoeba invadens
RRADNRASMIFRTQFSLNQDDFE

SEQ ID NO: 2965413 - protein, 23 aa, Entamoeba invadens
RRATHCVVCRGVIVGASVSCIKC

SEQ ID NO: 2965414 - protein, 18 aa, Entamoeba invadens
RRAVKRTVPGMGSEEVQI

SEQ ID NO: 2965415 - protein, 18 aa, Entamoeba invadens
RRCCLAINTSDYLEHCSR

SEQ ID NO: 2965416 - protein, 18 aa, Entamoeba invadens
RRCRSCLQEIKLDQPFFQ

SEQ ID NO: 2965417 - protein, 30 aa, Entamoeba invadens
RRDFTPKKCKRIWDAIFAFKEKKLVFFIAA

SEQ ID NO: 2965418 - protein, 21 aa, Entamoeba invadens
RRDGVEFFKSLQYIFVEMASD

SEQ ID NO: 2965419 - protein, 20 aa, Entamoeba invadens
RRDGWKEMIEIIEKCKEGKG

SEQ ID NO: 2965420 - protein, 31 aa, Entamoeba invadens
RRDILAGLISICFDYEYSFDIFPLYNVTHLG

SEQ ID NO: 2965421 - protein, 26 aa, Entamoeba invadens
RRDLMRELFKVVGKLSIAQQGRLVRY

SEQ ID NO: 2965422 - protein, 25 aa, Entamoeba invadens
RRDNYDLYYTVFLNEQFKDQSVQLQ

SEQ ID NO: 2965423 - protein, 18 aa, Entamoeba invadens
RRDPKLLFKSFTSIGKGG

SEQ ID NO: 2965424 - protein, 22 aa, Entamoeba invadens
RRDTERLLWEHKISANVKAVKR

SEQ ID NO: 2965425 - protein, 18 aa, Entamoeba invadens
RRDVDAFGLSTLNETCIH

SEQ ID NO: 2965426 - protein, 18 aa, Entamoeba invadens
RRDVDAFGPSILNEKCIQ

SEQ ID NO: 2965427 - protein, 19 aa, Entamoeba invadens
RRDVDLFGLEIINKICVKR

SEQ ID NO: 2965428 - protein, 18 aa, Entamoeba invadens
RRDVHAFGPSILNEKCIQ

SEQ ID NO: 2965429 - protein, 25 aa, Entamoeba invadens
RRDVIDCIQGILVNRNMTEIDVKNI

SEQ ID NO: 2965430 - protein, 29 aa, Entamoeba invadens
RREAYHLLEDFLFMFGIVIVGGKDERDGL

SEQ ID NO: 2965431 - protein, 27 aa, Entamoeba invadens
RREDLECISILYGLIARLVKYAQIHKM

SEQ ID NO: 2965432 - protein, 22 aa, Entamoeba invadens
RREECSQCFHIQGTRREEMTVK

SEQ ID NO: 2965433 - protein, 22 aa, Entamoeba invadens
RREIKNQFLMLKKQCAVKSEVH

SEQ ID NO: 2965434 - protein, 17 aa, Entamoeba invadens
RREIPLLQHQDFILFNP

SEQ ID NO: 2965435 - protein, 25 aa, Entamoeba invadens
RREKMILCNLASLFVDGVDVSTVDA

SEQ ID NO: 2965436 - protein, 25 aa, Entamoeba invadens
RRELSRASMSFNLLVETLENIGFEF

SEQ ID NO: 2965437 - protein, 19 aa, Entamoeba invadens
RREQYAVCLGFMVDGVLKI

SEQ ID NO: 2965438 - protein, 26 aa, Entamoeba invadens
RRERIVKRRRVFSVQEMLEDEKEEKK

SEQ ID NO: 2965439 - protein, 20 aa, Entamoeba invadens
RRERKFLGERLGGAGAQSTL

SEQ ID NO: 2965440 - protein, 22 aa, Entamoeba invadens
RRESAVYLQSLFIKKLTFDEKE

SEQ ID NO: 2965441 - protein, 26 aa, Entamoeba invadens
RRESELKASVLKCREDSIQQRESVNT

SEQ ID NO: 2965442 - protein, 29 aa, Entamoeba invadens
RRFNSLWCELCGIEVCKYQQTSTPQMRTT

SEQ ID NO: 2965443 - protein, 27 aa, Entamoeba invadens
RRFYLKRPGKTFCVWPSNHQMMVFGVK

SEQ ID NO: 2965444 - protein, 18 aa, Entamoeba invadens
RRGAALSALGKLTRNIGY

SEQ ID NO: 2965445 - protein, 29 aa, Entamoeba invadens
RRGAISLICPCGLLPRLAELAMSTDCSIQ

SEQ ID NO: 2965446 - protein, 21 aa, Entamoeba invadens
RRGGCDYCAMLTTSIECDCSD

SEQ ID NO: 2965447 - protein, 22 aa, Entamoeba invadens
RRGKGVDSFVNWIKSQQVGNTF

SEQ ID NO: 2965448 - protein, 18 aa, Entamoeba invadens
RRGLTLEAMKEFCLSQGS

SEQ ID NO: 2965449 - protein, 17 aa, Entamoeba invadens
RRGVSTRPILLITNRNH

SEQ ID NO: 2965450 - protein, 18 aa, Entamoeba invadens
RRHFPKKRCNTILSGTES

SEQ ID NO: 2965451 - protein, 37 aa, Entamoeba invadens
RRHHCRFCGKCVCDGCTKMRVPLPPLMTLERACPGCV

SEQ ID NO: 2965452 - protein, 30 aa, Entamoeba invadens
RRHHCRKCGKCICAECSKGRMPINEGNTTQ

SEQ ID NO: 2965453 - protein, 26 aa, Entamoeba invadens
RRHHCRNCGRVLCSNCTKQKIIIPHL

SEQ ID NO: 2965454 - protein, 22 aa, Entamoeba invadens
RRIEAYCFDGKQRLCHIRGQMQ

SEQ ID NO: 2965455 - protein, 17 aa, Entamoeba invadens
RRIKALRFGGCNFSTKE

SEQ ID NO: 2965456 - protein, 17 aa, Entamoeba invadens
RRILKIAAGQIAMSAGY

SEQ ID NO: 2965457 - protein, 25 aa, Entamoeba invadens
RRIPNSCFKNCVSLCSLEMPSGVLE

SEQ ID NO: 2965458 - protein, 19 aa, Entamoeba invadens
RRIPVEELLSQGWMKKENK

SEQ ID NO: 2965459 - protein, 17 aa, Entamoeba invadens
RRIQMVIESGANVVFVS

SEQ ID NO: 2965460 - protein, 26 aa, Entamoeba invadens
RRISRWNVRILYDLLDIAALNAYKVY

SEQ ID NO: 2965461 - protein, 20 aa, Entamoeba invadens
RRKDLVLSMVEFYSENEKIT

SEQ ID NO: 2965462 - protein, 18 aa, Entamoeba invadens
RRKIHIMDWRMDLDITLV

SEQ ID NO: 2965463 - protein, 20 aa, Entamoeba invadens
RRKLFKKLCDQAVDYEECFE

SEQ ID NO: 2965464 - protein, 19 aa, Entamoeba invadens
RRKLFVPFFGKVEMDVTCF

SEQ ID NO: 2965465 - protein, 19 aa, Entamoeba invadens
RRKLIKAGCHVLGDLDSPV

SEQ ID NO: 2965466 - protein, 29 aa, Entamoeba invadens
RRKNVICAQKFSALESRGVVFLPEKDEDQ

SEQ ID NO: 2965467 - protein, 18 aa, Entamoeba invadens
RRKQLRVTEDLKRKLELM

SEQ ID NO: 2965468 - protein, 20 aa, Entamoeba invadens
RRKRFPRRKPTQNNDEKKTE

SEQ ID NO: 2965469 - protein, 18 aa, Entamoeba invadens
RRKTEMTLSYSLDLPQEA

SEQ ID NO: 2965470 - protein, 27 aa, Entamoeba invadens
RRKTYRWNIRVLYDMIDIAALNGYKTY

SEQ ID NO: 2965471 - protein, 18 aa, Entamoeba invadens
RRKVPTYTPEEWIEGKVK

SEQ ID NO: 2965472 - protein, 18 aa, Entamoeba invadens
RRKYEFLNGSFAINRGEV

SEQ ID NO: 2965473 - protein, 20 aa, Entamoeba invadens
RRLCILKGIHPRVPPKTTEA

SEQ ID NO: 2965474 - protein, 21 aa, Entamoeba invadens
RRLDAEVIKFDFLEDDYSKLM

SEQ ID NO: 2965475 - protein, 29 aa, Entamoeba invadens
RRLDEEYTRELKIKRVEEVQKSNKKIISE

SEQ ID NO: 2965476 - protein, 29 aa, Entamoeba invadens
RRLFDKLMRLLNILFNYIDMRYKDDFNKA

SEQ ID NO: 2965477 - protein, 19 aa, Entamoeba invadens
RRLFENILCVGGNTMYQGF

SEQ ID NO: 2965478 - protein, 17 aa, Entamoeba invadens
RRLGVLIDKRPEGDCVE

SEQ ID NO: 2965479 - protein, 20 aa, Entamoeba invadens
RRLHKGLGPKKLDVRMMLPM

SEQ ID NO: 2965480 - protein, 22 aa, Entamoeba invadens
RRLHPLYHVVDIIAVSKPNAVV

SEQ ID NO: 2965481 - protein, 26 aa, Entamoeba invadens
RRLHVIKLKGIFVCFYPQNVESVITY

SEQ ID NO: 2965482 - protein, 21 aa, Entamoeba invadens
RRLIIKFPIENQIFIRRLLLL

SEQ ID NO: 2965483 - protein, 20 aa, Entamoeba invadens
RRLIQNCFIKLWKYTTYQQN

SEQ ID NO: 2965484 - protein, 17 aa, Entamoeba invadens
RRLIVLFGAKAEFCHVH

SEQ ID NO: 2965485 - protein, 20 aa, Entamoeba invadens
RRLKDEKIREMISLVEQLIL

SEQ ID NO: 2965486 - protein, 18 aa, Entamoeba invadens
RRLKELFIAEGNCLNASF

SEQ ID NO: 2965487 - protein, 21 aa, Entamoeba invadens
RRLKNIITLSLDFTRVALSQY

SEQ ID NO: 2965488 - protein, 24 aa, Entamoeba invadens
RRLLKSYEEMTAYFLTPENINEFE

SEQ ID NO: 2965489 - protein, 21 aa, Entamoeba invadens
RRLNRDIPILLVGLKSDLRES

SEQ ID NO: 2965490 - protein, 20 aa, Entamoeba invadens
RRLSDYNQHCQIEHRIKATY

SEQ ID NO: 2965491 - protein, 19 aa, Entamoeba invadens
RRLSFPVTVRPMFENLSSL

SEQ ID NO: 2965492 - protein, 20 aa, Entamoeba invadens
RRLTFSYVNCLKCYNRRFVV

SEQ ID NO: 2965493 - protein, 20 aa, Entamoeba invadens
RRLTPRKTHVVHGITTSTPG

SEQ ID NO: 2965494 - protein, 20 aa, Entamoeba invadens
RRLVKSMEDVQCKYDRTVRR

SEQ ID NO: 2965495 - protein, 23 aa, Entamoeba invadens
RRLWRKDHPVGFIARPRTNNGAP

SEQ ID NO: 2965496 - protein, 22 aa, Entamoeba invadens
RRMELCADLLFYADDYTIRSEE

SEQ ID NO: 2965497 - protein, 17 aa, Entamoeba invadens
RRMKARIPFQRNQQTSA

SEQ ID NO: 2965498 - protein, 20 aa, Entamoeba invadens
RRMKEGPFVFSVDTYTLVVY

SEQ ID NO: 2965499 - protein, 17 aa, Entamoeba invadens
RRMKLNPIVEYFKDISF

SEQ ID NO: 2965500 - protein, 18 aa, Entamoeba invadens
RRMVACAGEDVGVADPQA

SEQ ID NO: 2965501 - protein, 25 aa, Entamoeba invadens
RRNDLLCCVCQKFPSFCAGALSIEK

SEQ ID NO: 2965502 - protein, 20 aa, Entamoeba invadens
RRNEPCLIFEIATIMAKIMG

SEQ ID NO: 2965503 - protein, 19 aa, Entamoeba invadens
RRNERRVGNSKTEIAKKEK

SEQ ID NO: 2965504 - protein, 19 aa, Entamoeba invadens
RRNGFSLPTIQLLSKQMLE

SEQ ID NO: 2965505 - protein, 18 aa, Entamoeba invadens
RRNGLPIMMEEANIIEAV

SEQ ID NO: 2965506 - protein, 18 aa, Entamoeba invadens
RRNKRTPTPHKQCFHQTI

SEQ ID NO: 2965507 - protein, 19 aa, Entamoeba invadens
RRNSMELGQEVAEANEELE

SEQ ID NO: 2965508 - protein, 27 aa, Entamoeba invadens
RRNVVLECLDRYISIVGSVYDPISSTY

SEQ ID NO: 2965509 - protein, 24 aa, Entamoeba invadens
RRPKDFNPVLPFISSLSQLMEVGT

SEQ ID NO: 2965510 - protein, 20 aa, Entamoeba invadens
RRPKQFAGKMRKRFGKNANK

SEQ ID NO: 2965511 - protein, 25 aa, Entamoeba invadens
RRPNGDFASAMGFYSGKYKMYCVKV

SEQ ID NO: 2965512 - protein, 19 aa, Entamoeba invadens
RRPQIKKAYSEILKKIRNE

SEQ ID NO: 2965513 - protein, 25 aa, Entamoeba invadens
RRPSGICGVALYLAGRLHNEPRTLE

SEQ ID NO: 2965514 - protein, 18 aa, Entamoeba invadens
RRPTDFFELFAKSLCIGN

SEQ ID NO: 2965515 - protein, 21 aa, Entamoeba invadens
RRPTEMRKCEMELGFEKSADG

SEQ ID NO: 2965516 - protein, 26 aa, Entamoeba invadens
RRPTTPRPGTPILQMESIAGPSSVQS

SEQ ID NO: 2965517 - protein, 26 aa, Entamoeba invadens
RRQCASFLACGFLGLFSTTLRKNYRN

SEQ ID NO: 2965518 - protein, 20 aa, Entamoeba invadens
RRQFNAALLFSEIEEKLFDL

SEQ ID NO: 2965519 - protein, 17 aa, Entamoeba invadens
RRQLKVLRIERKLDKDV

SEQ ID NO: 2965520 - protein, 18 aa, Entamoeba invadens
RRQLPLLPSELSPHKRQG

SEQ ID NO: 2965521 - protein, 24 aa, Entamoeba invadens
RRQQYTGICPRKMVDYKESKVAHV

SEQ ID NO: 2965522 - protein, 21 aa, Entamoeba invadens
RRQRLLKSFYLPLLSTTHYIR

SEQ ID NO: 2965523 - protein, 17 aa, Entamoeba invadens
RRQRLYIQPPQQLERRD

SEQ ID NO: 2965524 - protein, 21 aa, Entamoeba invadens
RRRARNRVIWEILIRQRKQGL

SEQ ID NO: 2965525 - protein, 20 aa, Entamoeba invadens
RRRDEEFIRATLKRGGVFKF

SEQ ID NO: 2965526 - protein, 18 aa, Entamoeba invadens
RRRFYFLVAAVLMGVDNH

SEQ ID NO: 2965527 - protein, 19 aa, Entamoeba invadens
RRRGTAFEICKDGKNGKSY

SEQ ID NO: 2965528 - protein, 25 aa, Entamoeba invadens
RRRHHCRFCGGCVCDSCSKNRLKTS

SEQ ID NO: 2965529 - protein, 17 aa, Entamoeba invadens
RRRKEIESIREAREAAE

SEQ ID NO: 2965530 - protein, 41 aa, Entamoeba invadens
RRRKKMYCKKCKLFVCPRCWNHDEKCCVACQNTICRDTKKR

SEQ ID NO: 2965531 - protein, 18 aa, Entamoeba invadens
RRRLNLRQTRNGRPSFGK

SEQ ID NO: 2965532 - protein, 20 aa, Entamoeba invadens
RRRLVKRLYIPLPDLEARNV

SEQ ID NO: 2965533 - protein, 23 aa, Entamoeba invadens
RRRQCLFAVLSLATELLRKKNFN

SEQ ID NO: 2965534 - protein, 20 aa, Entamoeba invadens
RRRRLHEPEIAYWMKEVIEG

SEQ ID NO: 2965535 - protein, 20 aa, Entamoeba invadens
RRRSICKIEPFLVSKSPEGA

SEQ ID NO: 2965536 - protein, 20 aa, Entamoeba invadens
RRSAETGALVAPKFAQTAKK

SEQ ID NO: 2965537 - protein, 18 aa, Entamoeba invadens
RRSAFVRYITAPKRSVIE

SEQ ID NO: 2965538 - protein, 24 aa, Entamoeba invadens
RRSAKEISRPMSLLEAKQKRRELE

SEQ ID NO: 2965539 - protein, 23 aa, Entamoeba invadens
RRSDYMYGCYINGITHLVTEHES

SEQ ID NO: 2965540 - protein, 20 aa, Entamoeba invadens
RRSECYKCTKNSRHKFCENC

SEQ ID NO: 2965541 - protein, 26 aa, Entamoeba invadens
RRSEVKTRRGGITLGKAKTVAVEEDE

SEQ ID NO: 2965542 - protein, 19 aa, Entamoeba invadens
RRSGQAFGRGEYFGNDISV

SEQ ID NO: 2965543 - protein, 17 aa, Entamoeba invadens
RRSLRRSMYLTGIDIDT

SEQ ID NO: 2965544 - protein, 19 aa, Entamoeba invadens
RRSQGTVLEQCIAKNEPAT

SEQ ID NO: 2965545 - protein, 18 aa, Entamoeba invadens
RRSVCVNLSELQHLTIRL

SEQ ID NO: 2965546 - protein, 28 aa, Entamoeba invadens
RRSVRMSPSVMCWVPFNENWGQFDTSEI

SEQ ID NO: 2965547 - protein, 17 aa, Entamoeba invadens
RRTDGMSVISGEDATYF

SEQ ID NO: 2965548 - protein, 19 aa, Entamoeba invadens
RRTDILTVLFSPFKFLSES

SEQ ID NO: 2965549 - protein, 34 aa, Entamoeba invadens
RRTLGFCVKEEWLYDSICKMTLVDVCEYLVDGIK

SEQ ID NO: 2965550 - protein, 24 aa, Entamoeba invadens
RRTMTEVFYFKGVYEGPNYLKDFE

SEQ ID NO: 2965551 - protein, 26 aa, Entamoeba invadens
RRTPKSFVIRRGRIGKIARDLVKDTR

SEQ ID NO: 2965552 - protein, 25 aa, Entamoeba invadens
RRTTKDCTRKVCWENSKVQKSILIV

SEQ ID NO: 2965553 - protein, 24 aa, Entamoeba invadens
RRTTPEFFPLLTLEEDLEMASRII

SEQ ID NO: 2965554 - protein, 22 aa, Entamoeba invadens
RRTYKCMGPLPLKELMVREFGL

SEQ ID NO: 2965555 - protein, 25 aa, Entamoeba invadens
RRVDFSFNLLKNILKLCGNEDNVIS

SEQ ID NO: 2965556 - protein, 25 aa, Entamoeba invadens
RRVFELRPKRSFYRLLYNKDENYGL

SEQ ID NO: 2965557 - protein, 18 aa, Entamoeba invadens
RRVGELAVENFITDDHPN

SEQ ID NO: 2965558 - protein, 19 aa, Entamoeba invadens
RRVGKKCLTTRNVLTVEYM

SEQ ID NO: 2965559 - protein, 20 aa, Entamoeba invadens
RRVINTIAFDGFVYDKKAIK

SEQ ID NO: 2965560 - protein, 28 aa, Entamoeba invadens
RRVPLGSIKDIICSDGVWRVKTKYNEVI

SEQ ID NO: 2965561 - protein, 18 aa, Entamoeba invadens
RRVQERNKYLGLADIRID

SEQ ID NO: 2965562 - protein, 21 aa, Entamoeba invadens
RRVTIYNFQWAIPIESIFPNK

SEQ ID NO: 2965563 - protein, 22 aa, Entamoeba invadens
RRVTSIGYKCFSECSSLTSITI

SEQ ID NO: 2965564 - protein, 18 aa, Entamoeba invadens
RRVVKYTYNGHVRKVTVT

SEQ ID NO: 2965565 - protein, 20 aa, Entamoeba invadens
RRWFALKDNLCYKCGENCTT

SEQ ID NO: 2965566 - protein, 20 aa, Entamoeba invadens
RRYFVIKNNFIFYFPSSQPD

SEQ ID NO: 2965567 - protein, 17 aa, Entamoeba invadens
RRYGDQQGREQHDGKDQ

SEQ ID NO: 2965568 - protein, 17 aa, Entamoeba invadens
RRYISSSIADDFVQRNI

SEQ ID NO: 2965569 - protein, 17 aa, Entamoeba invadens
RRYKKWLPLVLTVLDVE

SEQ ID NO: 2965570 - protein, 21 aa, Entamoeba invadens
RRYTILDAPGHRSFVPNMISA

SEQ ID NO: 2965571 - protein, 30 aa, Entamoeba invadens
RRYWSSEEHILFLKAITWLNATSTKQLPVK

SEQ ID NO: 2965572 - protein, 19 aa, Entamoeba invadens
RSAGIFEIFTDVSVETYPS

SEQ ID NO: 2965573 - protein, 25 aa, Entamoeba invadens
RSAKNVPKVYCCVTTTPWKKSKEVQ

SEQ ID NO: 2965574 - protein, 17 aa, Entamoeba invadens
RSASVVCHELAHMWFGD

SEQ ID NO: 2965575 - protein, 19 aa, Entamoeba invadens
RSATHVFTAYNIVSYDFLE

SEQ ID NO: 2965576 - protein, 19 aa, Entamoeba invadens
RSAVQYKNVRQCPIVLEII

SEQ ID NO: 2965577 - protein, 29 aa, Entamoeba invadens
RSCDFGVDFMKRFLKTQMFEDWRKTLSLS

SEQ ID NO: 2965578 - protein, 19 aa, Entamoeba invadens
RSCESCVTNAIVYTLISQM

SEQ ID NO: 2965579 - protein, 26 aa, Entamoeba invadens
RSCFHFPGRYNLVQTLACEESGAGGY

SEQ ID NO: 2965580 - protein, 27 aa, Entamoeba invadens
RSCQFCGKLLCKSCCSTIKISSEREVA

SEQ ID NO: 2965581 - protein, 18 aa, Entamoeba invadens
RSDFIVHFYGAVFILSKV

SEQ ID NO: 2965582 - protein, 18 aa, Entamoeba invadens
RSDFREVRNYQVFEQGML

SEQ ID NO: 2965583 - protein, 22 aa, Entamoeba invadens
RSDKKLKITRDVVIRALKQMVA

SEQ ID NO: 2965584 - protein, 23 aa, Entamoeba invadens
RSDPNVVPFIFKNVKTPLMFINC

SEQ ID NO: 2965585 - protein, 20 aa, Entamoeba invadens
RSDSRTLVLRNFVDEAKGKV

SEQ ID NO: 2965586 - protein, 19 aa, Entamoeba invadens
RSEALYIFEDLLLEFGYIV

SEQ ID NO: 2965587 - protein, 25 aa, Entamoeba invadens
RSEERCINCGKAIDISKDIMEDKKV

SEQ ID NO: 2965588 - protein, 25 aa, Entamoeba invadens
RSEFIEFFSAIYFKVIPSLPPVSDV

SEQ ID NO: 2965589 - protein, 21 aa, Entamoeba invadens
RSEFVRPWRKFVMKLNVKLNW

SEQ ID NO: 2965590 - protein, 18 aa, Entamoeba invadens
RSEICYLGNLIADGYDGM

SEQ ID NO: 2965591 - protein, 21 aa, Entamoeba invadens
RSEILPILNLKSLLYYETCAW

SEQ ID NO: 2965592 - protein, 19 aa, Entamoeba invadens
RSEQFTKIVSWFNAVDTDR

SEQ ID NO: 2965593 - protein, 17 aa, Entamoeba invadens
RSERPKIVTTFDYDPEN

SEQ ID NO: 2965594 - protein, 22 aa, Entamoeba invadens
RSETKRVYKVLSAFKIGKLSKV

SEQ ID NO: 2965595 - protein, 21 aa, Entamoeba invadens
RSETLRPPRSVRFRDFQFADD

SEQ ID NO: 2965596 - protein, 24 aa, Entamoeba invadens
RSEVSCLTTLLSNVECEEMKFFRC

SEQ ID NO: 2965597 - protein, 18 aa, Entamoeba invadens
RSEYEVMEMVEGKVKITV

SEQ ID NO: 2965598 - protein, 19 aa, Entamoeba invadens
RSFFAYKEQYYEISYKMSH

SEQ ID NO: 2965599 - protein, 32 aa, Entamoeba invadens
RSFLIMPVQRLPRYSLLLADLIKHTSKDHPDF

SEQ ID NO: 2965600 - protein, 21 aa, Entamoeba invadens
RSFPNIKKIAIVAGKNSELGT

SEQ ID NO: 2965601 - protein, 22 aa, Entamoeba invadens
RSFPSFRPKEFTSIFRADKDAV

SEQ ID NO: 2965602 - protein, 17 aa, Entamoeba invadens
RSFRVIYDSTIDSFNST

SEQ ID NO: 2965603 - protein, 17 aa, Entamoeba invadens
RSFSRGVPETQFYSTKP

SEQ ID NO: 2965604 - protein, 19 aa, Entamoeba invadens
RSFTGCPYYSVPIKVEDTD

SEQ ID NO: 2965605 - protein, 17 aa, Entamoeba invadens
RSGALLIATKLTQTPAF

SEQ ID NO: 2965606 - protein, 21 aa, Entamoeba invadens
RSGAPRRYGGYRNYENRYNRN

SEQ ID NO: 2965607 - protein, 18 aa, Entamoeba invadens
RSGFAGRYFGGKPVILLY

SEQ ID NO: 2965608 - protein, 22 aa, Entamoeba invadens
RSGFCCKLYPDFSMKYRAFGNS

SEQ ID NO: 2965609 - protein, 18 aa, Entamoeba invadens
RSGHVCGVTCLLRYIGGI

SEQ ID NO: 2965610 - protein, 17 aa, Entamoeba invadens
RSGKCQFSDIKFVKEKE

SEQ ID NO: 2965611 - protein, 21 aa, Entamoeba invadens
RSGQISHEIMWRVKTMRKVRL

SEQ ID NO: 2965612 - protein, 25 aa, Entamoeba invadens
RSGVEGFVPRSFVKIQKFVKPYRKE

SEQ ID NO: 2965613 - protein, 21 aa, Entamoeba invadens
RSHGILPEDVIKCALAATCHK

SEQ ID NO: 2965614 - protein, 17 aa, Entamoeba invadens
RSHLLCLLLEYKYKTKS

SEQ ID NO: 2965615 - protein, 17 aa, Entamoeba invadens
RSIFMFGHNLERGEKGW

SEQ ID NO: 2965616 - protein, 22 aa, Entamoeba invadens
RSIGEKCFRKCSNFSSITIPSS

SEQ ID NO: 2965617 - protein, 24 aa, Entamoeba invadens
RSIGNWCFNGCRSLSSVTIPSSVT

SEQ ID NO: 2965618 - protein, 29 aa, Entamoeba invadens
RSIIQLLFQRKWIDGKRIFVGILGEVWNG

SEQ ID NO: 2965619 - protein, 19 aa, Entamoeba invadens
RSILKLCAKIDSMSDVNSM

SEQ ID NO: 2965620 - protein, 17 aa, Entamoeba invadens
RSIPLNHFNASLKEINK

SEQ ID NO: 2965621 - protein, 17 aa, Entamoeba invadens
RSIRMVYDDETFYRVNN

SEQ ID NO: 2965622 - protein, 19 aa, Entamoeba invadens
RSIRTWGVDAQNRILSAHL

SEQ ID NO: 2965623 - protein, 19 aa, Entamoeba invadens
RSISKWINIQLSRDYLLTE

SEQ ID NO: 2965624 - protein, 17 aa, Entamoeba invadens
RSKATINRLKMYRTRAH

SEQ ID NO: 2965625 - protein, 19 aa, Entamoeba invadens
RSKDHLFVFMSKGPLQFCC

SEQ ID NO: 2965626 - protein, 20 aa, Entamoeba invadens
RSKGRGVFVGCEISKNNLPG

SEQ ID NO: 2965627 - protein, 19 aa, Entamoeba invadens
RSKIRVCDFNNQYNKIELG

SEQ ID NO: 2965628 - protein, 17 aa, Entamoeba invadens
RSKKVIASMLEQHRNID

SEQ ID NO: 2965629 - protein, 19 aa, Entamoeba invadens
RSKLLLEIYNTMCGSQLPE

SEQ ID NO: 2965630 - protein, 20 aa, Entamoeba invadens
RSKLTDIKKIIPFSLIGKKE

SEQ ID NO: 2965631 - protein, 17 aa, Entamoeba invadens
RSKMIKWNLGKLPNSLT

SEQ ID NO: 2965632 - protein, 25 aa, Entamoeba invadens
RSKNTPVVLCEQGREPIRFQMQFSK

SEQ ID NO: 2965633 - protein, 17 aa, Entamoeba invadens
RSKRRQVLLNARRTEEP

SEQ ID NO: 2965634 - protein, 20 aa, Entamoeba invadens
RSLASIACAVRHCRTFQGTM

SEQ ID NO: 2965635 - protein, 18 aa, Entamoeba invadens
RSLCSSLVNYNWLSDQLM

SEQ ID NO: 2965636 - protein, 24 aa, Entamoeba invadens
RSLDVPVTIAFDLPISFYEDYTIQ

SEQ ID NO: 2965637 - protein, 19 aa, Entamoeba invadens
RSLEILSYLMDLMDTLLVI

SEQ ID NO: 2965638 - protein, 20 aa, Entamoeba invadens
RSLHGHSHFISDLVLSSDGK

SEQ ID NO: 2965639 - protein, 36 aa, Entamoeba invadens
RSLIKKKEVCSVEKWLGALRKTFTEMRVKDAFKSIG

SEQ ID NO: 2965640 - protein, 18 aa, Entamoeba invadens
RSLKCIDIPEGVIDISDD

SEQ ID NO: 2965641 - protein, 23 aa, Entamoeba invadens
RSLKMLFAVSYHFIRAIVCARDC

SEQ ID NO: 2965642 - protein, 19 aa, Entamoeba invadens
RSLKSVGIEGAYFGIKYNE

SEQ ID NO: 2965643 - protein, 20 aa, Entamoeba invadens
RSLKTGKHQLHFFFQPLKMK

SEQ ID NO: 2965644 - protein, 17 aa, Entamoeba invadens
RSLLFVFQTKEYVFGFY

SEQ ID NO: 2965645 - protein, 20 aa, Entamoeba invadens
RSLPKGMTMLPSLQVLDVEK

SEQ ID NO: 2965646 - protein, 18 aa, Entamoeba invadens
RSLQKWEDAGDCYSQAAA

SEQ ID NO: 2965647 - protein, 17 aa, Entamoeba invadens
RSLRVFLPTKCLVSLKP

SEQ ID NO: 2965648 - protein, 17 aa, Entamoeba invadens
RSLSNLKILDFSSNYIE

SEQ ID NO: 2965649 - protein, 19 aa, Entamoeba invadens
RSLSSIYYRNATVALLVYD

SEQ ID NO: 2965650 - protein, 17 aa, Entamoeba invadens
RSLTTLLRRKSEGERPK

SEQ ID NO: 2965651 - protein, 19 aa, Entamoeba invadens
RSMIFKMDLEEDIFEAIDV

SEQ ID NO: 2965652 - protein, 18 aa, Entamoeba invadens
RSMILPPIIKSISAYCFS

SEQ ID NO: 2965653 - protein, 26 aa, Entamoeba invadens
RSMKKETVEFAFKYYITPYVIEHLKE

SEQ ID NO: 2965654 - protein, 17 aa, Entamoeba invadens
RSMKYIDEFLSFQQFNY

SEQ ID NO: 2965655 - protein, 17 aa, Entamoeba invadens
RSMMLGRKYYFSMRLKT

SEQ ID NO: 2965656 - protein, 19 aa, Entamoeba invadens
RSMVVGGWMSVRVASEIIS

SEQ ID NO: 2965657 - protein, 19 aa, Entamoeba invadens
RSNAFEFYIDFLPEEATED

SEQ ID NO: 2965658 - protein, 28 aa, Entamoeba invadens
RSNGVKECFRQLGGFTFYQRFYAKWGWD

SEQ ID NO: 2965659 - protein, 23 aa, Entamoeba invadens
RSNIWRILLKVKPIKLPNPLHLT

SEQ ID NO: 2965660 - protein, 23 aa, Entamoeba invadens
RSNLMCLLSLILSTFNVKDQKRN

SEQ ID NO: 2965661 - protein, 23 aa, Entamoeba invadens
RSPLRRFADLCVLRQIDAAINNL

SEQ ID NO: 2965662 - protein, 18 aa, Entamoeba invadens
RSQAELLKALALENESNR

SEQ ID NO: 2965663 - protein, 25 aa, Entamoeba invadens
RSQAYKRRLALHLFEDLLLEDGFLI

SEQ ID NO: 2965664 - protein, 23 aa, Entamoeba invadens
RSQIGTKCPIFLNTKIRLTIYRN

SEQ ID NO: 2965665 - protein, 28 aa, Entamoeba invadens
RSQIQSKALILVFRKTMHEAHRDDPPQE

SEQ ID NO: 2965666 - protein, 20 aa, Entamoeba invadens
RSQKAGCCHSLIYKEEEPTI

SEQ ID NO: 2965667 - protein, 23 aa, Entamoeba invadens
RSQKRITLIAGIFANNTTLKPMI

SEQ ID NO: 2965668 - protein, 24 aa, Entamoeba invadens
RSQKRITLIAGIFANNTTLKPMII

SEQ ID NO: 2965669 - protein, 19 aa, Entamoeba invadens
RSQLESLNLIIRAGIYQDF

SEQ ID NO: 2965670 - protein, 30 aa, Entamoeba invadens
RSREAQISNSLLFFLKMVGFSFEEKKTKKA

SEQ ID NO: 2965671 - protein, 27 aa, Entamoeba invadens
RSRSCRSALCGFNWFNAYYTPGVSRIS

SEQ ID NO: 2965672 - protein, 18 aa, Entamoeba invadens
RSRSLSFIRQITTKSFMF

SEQ ID NO: 2965673 - protein, 19 aa, Entamoeba invadens
RSSAFNILGSATFKAALGF

SEQ ID NO: 2965674 - protein, 17 aa, Entamoeba invadens
RSSGCSPNIGLGNNLEI

SEQ ID NO: 2965675 - protein, 29 aa, Entamoeba invadens
RSSIASIIFSMGFKCVNVYIKKEILELGF

SEQ ID NO: 2965676 - protein, 21 aa, Entamoeba invadens
RSSKLPGYYIFNYGTFKSERV

SEQ ID NO: 2965677 - protein, 24 aa, Entamoeba invadens
RSSKTVFLFYDFKPDYWEYYCLVC

SEQ ID NO: 2965678 - protein, 19 aa, Entamoeba invadens
RSSKWCLRCSDGDYIMNSF

SEQ ID NO: 2965679 - protein, 22 aa, Entamoeba invadens
RSSLIQICLMLSKKDVRNLRTT

SEQ ID NO: 2965680 - protein, 36 aa, Entamoeba invadens
RSSMQFRAKLFLPMYIEGLKFLIPMNAETMKKDTRA

SEQ ID NO: 2965681 - protein, 23 aa, Entamoeba invadens
RSSPRFVKVFGQLNINLDLKIRI

SEQ ID NO: 2965682 - protein, 20 aa, Entamoeba invadens
RSSREIRGRSQSRGINGREE

SEQ ID NO: 2965683 - protein, 20 aa, Entamoeba invadens
RSSYDIQSGTLLMKRDDKFS

SEQ ID NO: 2965684 - protein, 33 aa, Entamoeba invadens
RSTDLCQLVDFFSHFFCKRIVVRVEYEAFWDDI

SEQ ID NO: 2965685 - protein, 19 aa, Entamoeba invadens
RSTGFCLLSSHTVQQAHDL

SEQ ID NO: 2965686 - protein, 19 aa, Entamoeba invadens
RSTIGVEFATRSIVYHEKN

SEQ ID NO: 2965687 - protein, 17 aa, Entamoeba invadens
RSTPQALCTICRQIRES

SEQ ID NO: 2965688 - protein, 17 aa, Entamoeba invadens
RSTTPLLSLKDWTSRES

SEQ ID NO: 2965689 - protein, 17 aa, Entamoeba invadens
RSTYCDWDKDGVIYNRD

SEQ ID NO: 2965690 - protein, 17 aa, Entamoeba invadens
RSVARSGAKISPLTISF

SEQ ID NO: 2965691 - protein, 19 aa, Entamoeba invadens
RSVDGWRNSIELFLEGSNL

SEQ ID NO: 2965692 - protein, 18 aa, Entamoeba invadens
RSVFGYASAELLKYSETL

SEQ ID NO: 2965693 - protein, 19 aa, Entamoeba invadens
RSVFSLPAQLRNAAQNRDD

SEQ ID NO: 2965694 - protein, 17 aa, Entamoeba invadens
RSVKSEGTGTQFSESNS

SEQ ID NO: 2965695 - protein, 20 aa, Entamoeba invadens
RSVNELLLLINVNCTPVKGD

SEQ ID NO: 2965696 - protein, 28 aa, Entamoeba invadens
RSVQFSEIILPKTVRYILIRSVKGSINT

SEQ ID NO: 2965697 - protein, 18 aa, Entamoeba invadens
RSVSPCLNSVYVKNEGND

SEQ ID NO: 2965698 - protein, 17 aa, Entamoeba invadens
RSVVLVEMIDGTKLKKP

SEQ ID NO: 2965699 - protein, 25 aa, Entamoeba invadens
RSYCCYKCAKLDFVGLPMYLEEIED

SEQ ID NO: 2965700 - protein, 17 aa, Entamoeba invadens
RSYDFTEVVRWFAERAD

SEQ ID NO: 2965701 - protein, 22 aa, Entamoeba invadens
RSYFNYFTKRVEKIEAKKPEKQ

SEQ ID NO: 2965702 - protein, 18 aa, Entamoeba invadens
RSYFRVTTMWDFNGSKVY

SEQ ID NO: 2965703 - protein, 25 aa, Entamoeba invadens
RSYIPSVNIWSQFLAFDCKHDDQVK

SEQ ID NO: 2965704 - protein, 27 aa, Entamoeba invadens
RSYKISCLRALFGNIYSHLKLMFGSNV

SEQ ID NO: 2965705 - protein, 30 aa, Entamoeba invadens
RSYLIMPIQRLPRYVLLFTDLMKHTPENFP

SEQ ID NO: 2965706 - protein, 20 aa, Entamoeba invadens
RSYLLCLLSYYKSKSTSQNA

SEQ ID NO: 2965707 - protein, 21 aa, Entamoeba invadens
RSYRELPMRLAEFGVLHRNEL

SEQ ID NO: 2965708 - protein, 18 aa, Entamoeba invadens
RSYYRGAVGVIMVYDVSR

SEQ ID NO: 2965709 - protein, 20 aa, Entamoeba invadens
RTACGIWECRACKKQIAGGA

SEQ ID NO: 2965710 - protein, 24 aa, Entamoeba invadens
RTAEEINSLCAIFKIEEDENKVEA

SEQ ID NO: 2965711 - protein, 22 aa, Entamoeba invadens
RTAEIAPPITIVVSGPPKVGKT

SEQ ID NO: 2965712 - protein, 20 aa, Entamoeba invadens
RTAFEDKYFDAVSIETLVGS

SEQ ID NO: 2965713 - protein, 24 aa, Entamoeba invadens
RTAKLEKMLGFSKTVAEYIQRNPI

SEQ ID NO: 2965714 - protein, 18 aa, Entamoeba invadens
RTALDKNYFIPANYKETF

SEQ ID NO: 2965715 - protein, 21 aa, Entamoeba invadens
RTALVSCMWVNNETGLILPIK

SEQ ID NO: 2965716 - protein, 17 aa, Entamoeba invadens
RTARKSMHLEDKNMRRM

SEQ ID NO: 2965717 - protein, 18 aa, Entamoeba invadens
RTASEIIPAVNKSIEQIN

SEQ ID NO: 2965718 - protein, 26 aa, Entamoeba invadens
RTASRFRPIYALTLDITRTFKFENIQ

SEQ ID NO: 2965719 - protein, 20 aa, Entamoeba invadens
RTCAISALIINPSNLLNEWT

SEQ ID NO: 2965720 - protein, 17 aa, Entamoeba invadens
RTCDCIMLLIDGTKSLD

SEQ ID NO: 2965721 - protein, 18 aa, Entamoeba invadens
RTCMLGRGNPAMNITTLT

SEQ ID NO: 2965722 - protein, 17 aa, Entamoeba invadens
RTCNQCLDFSRIKSKRV

SEQ ID NO: 2965723 - protein, 27 aa, Entamoeba invadens
RTDDLKRLKSCWASIVKVVFYSLQTLF

SEQ ID NO: 2965724 - protein, 25 aa, Entamoeba invadens
RTDGRSVLQFREFRCERDVIDQANG

SEQ ID NO: 2965725 - protein, 22 aa, Entamoeba invadens
RTDKAVCLKPFPGTSSVCKPIV

SEQ ID NO: 2965726 - protein, 20 aa, Entamoeba invadens
RTDRFRLVEFIKNRDDTSSK

SEQ ID NO: 2965727 - protein, 17 aa, Entamoeba invadens
RTDVGQIEWKNVDITGV

SEQ ID NO: 2965728 - protein, 18 aa, Entamoeba invadens
RTEIAVGTLVGFYVFTVG

SEQ ID NO: 2965729 - protein, 19 aa, Entamoeba invadens
RTEIKDLQSQLSLLTSQSV

SEQ ID NO: 2965730 - protein, 24 aa, Entamoeba invadens
RTENCPICKSRVTLNSLIRVNKNR

SEQ ID NO: 2965731 - protein, 20 aa, Entamoeba invadens
RTENGREFTVDDVLTTITGE

SEQ ID NO: 2965732 - protein, 24 aa, Entamoeba invadens
RTEPITPFKQLSCNFIPKQRICKF

SEQ ID NO: 2965733 - protein, 21 aa, Entamoeba invadens
RTEREYLYFHCSSYQKGVGNI

SEQ ID NO: 2965734 - protein, 20 aa, Entamoeba invadens
RTETLLPFLDNSFFDGFCDE

SEQ ID NO: 2965735 - protein, 22 aa, Entamoeba invadens
RTFCSYLVYKIVKGKTVIGEEK

SEQ ID NO: 2965736 - protein, 17 aa, Entamoeba invadens
RTFKTPRLCQKEKKTEL

SEQ ID NO: 2965737 - protein, 18 aa, Entamoeba invadens
RTFLYYACEKGYKNLVEF

SEQ ID NO: 2965738 - protein, 23 aa, Entamoeba invadens
RTFSLCKYCEFIFSTVTDEIEFK

SEQ ID NO: 2965739 - protein, 20 aa, Entamoeba invadens
RTFTKLMFETSFKKSSNGSI

SEQ ID NO: 2965740 - protein, 17 aa, Entamoeba invadens
RTGAIGGTLANKGGVVI

SEQ ID NO: 2965741 - protein, 22 aa, Entamoeba invadens
RTGHLGLYEFIGLYRFLEICFV

SEQ ID NO: 2965742 - protein, 18 aa, Entamoeba invadens
RTGKCIKCETNYLLDSKN

SEQ ID NO: 2965743 - protein, 20 aa, Entamoeba invadens
RTGKKTAMVIAGNKCDLEEQ

SEQ ID NO: 2965744 - protein, 18 aa, Entamoeba invadens
RTGNHCKLFAIPVVEQLN

SEQ ID NO: 2965745 - protein, 19 aa, Entamoeba invadens
RTGRLISCYLNSIEYGGLM

SEQ ID NO: 2965746 - protein, 19 aa, Entamoeba invadens
RTHGLSIVYVRRGDDKNMV

SEQ ID NO: 2965747 - protein, 17 aa, Entamoeba invadens
RTHKRNASAIPKGLDSA

SEQ ID NO: 2965748 - protein, 21 aa, Entamoeba invadens
RTIDQISFCISRNCEITSESL

SEQ ID NO: 2965749 - protein, 19 aa, Entamoeba invadens
RTIDSEVFRCCEDKINIEW

SEQ ID NO: 2965750 - protein, 20 aa, Entamoeba invadens
RTIIIEYFRDEGFRIELTNY

SEQ ID NO: 2965751 - protein, 22 aa, Entamoeba invadens
RTIKSSLEFKERTTTPLTKENL

SEQ ID NO: 2965752 - protein, 19 aa, Entamoeba invadens
RTIPLGGALPPLSSCPPPP

SEQ ID NO: 2965753 - protein, 21 aa, Entamoeba invadens
RTIRSYIDFLYIIDANVFERG

SEQ ID NO: 2965754 - protein, 18 aa, Entamoeba invadens
RTIRWLCKHPPGQKCSNC

SEQ ID NO: 2965755 - protein, 28 aa, Entamoeba invadens
RTIVPNYYRGVMGIAMIYDVTSKESFKN

SEQ ID NO: 2965756 - protein, 18 aa, Entamoeba invadens
RTKAIIVDIREFRCELPF

SEQ ID NO: 2965757 - protein, 27 aa, Entamoeba invadens
RTKASCGCGEFLDVIKLVDWCKKTGIS

SEQ ID NO: 2965758 - protein, 24 aa, Entamoeba invadens
RTKCTTCCRIIIASGYNYDYNRGF

SEQ ID NO: 2965759 - protein, 17 aa, Entamoeba invadens
RTKDLKKDIALLRNSFD

SEQ ID NO: 2965760 - protein, 21 aa, Entamoeba invadens
RTKEFFPNLVAKISNGMNEKT

SEQ ID NO: 2965761 - protein, 19 aa, Entamoeba invadens
RTKEKLPKLMDVYDQKYVV

SEQ ID NO: 2965762 - protein, 22 aa, Entamoeba invadens
RTKGFFKPECTPAKVVGDATIL

SEQ ID NO: 2965763 - protein, 26 aa, Entamoeba invadens
RTKGLKEVFTYFGLEEKIKYSYILSF

SEQ ID NO: 2965764 - protein, 25 aa, Entamoeba invadens
RTKHGGHYICYIKGPNSGWFQCDDD

SEQ ID NO: 2965765 - protein, 26 aa, Entamoeba invadens
RTKIVNFIRTWAKWRCADFMNENMSN

SEQ ID NO: 2965766 - protein, 17 aa, Entamoeba invadens
RTKKQCKEHFVNCLSEK

SEQ ID NO: 2965767 - protein, 39 aa, Entamoeba invadens
RTKKVILAMCTGCWVLNSLWIDKCIEKGKIVKEDLYKQM

SEQ ID NO: 2965768 - protein, 17 aa, Entamoeba invadens
RTKLATFGIIVGVACFD

SEQ ID NO: 2965769 - protein, 23 aa, Entamoeba invadens
RTKLPQTLPIYLSELDFINIPAK

SEQ ID NO: 2965770 - protein, 19 aa, Entamoeba invadens
RTKNSLIIKKGFVPGMLSD

SEQ ID NO: 2965771 - protein, 19 aa, Entamoeba invadens
RTKPCKYFFETGTCRKGKH

SEQ ID NO: 2965772 - protein, 23 aa, Entamoeba invadens
RTKSITFDSVFLGFVNLCQISNV

SEQ ID NO: 2965773 - protein, 26 aa, Entamoeba invadens
RTKSMRRPTRKGGRKPPTKELLIVNK

SEQ ID NO: 2965774 - protein, 24 aa, Entamoeba invadens
RTKTENFYVFGFADEFSEPIIRND

SEQ ID NO: 2965775 - protein, 19 aa, Entamoeba invadens
RTKVESVMWRGNVREGLFK

SEQ ID NO: 2965776 - protein, 19 aa, Entamoeba invadens
RTKYDFLTKVDIPTKKKKK

SEQ ID NO: 2965777 - protein, 20 aa, Entamoeba invadens
RTKYNPGLIHIKYFGIIGFN

SEQ ID NO: 2965778 - protein, 19 aa, Entamoeba invadens
RTLATFSDLLHVFLSAEEQ

SEQ ID NO: 2965779 - protein, 17 aa, Entamoeba invadens
RTLCLALQYITDVNGFF

SEQ ID NO: 2965780 - protein, 26 aa, Entamoeba invadens
RTLEGFLSLIEFEWIMLGHRFQFRLR

SEQ ID NO: 2965781 - protein, 19 aa, Entamoeba invadens
RTLFDIPMVIIINKADLLS

SEQ ID NO: 2965782 - protein, 17 aa, Entamoeba invadens
RTLKIELPLSIENDDNL

SEQ ID NO: 2965783 - protein, 18 aa, Entamoeba invadens
RTLLNEIRKNSDFDRDIA

SEQ ID NO: 2965784 - protein, 28 aa, Entamoeba invadens
RTLLNTQYRMHPFLSTFSNKVFYSSRLI

SEQ ID NO: 2965785 - protein, 23 aa, Entamoeba invadens
RTLPDVINLLPLIYNKEYTRQLL

SEQ ID NO: 2965786 - protein, 17 aa, Entamoeba invadens
RTLRFHARFLLVCLLTD

SEQ ID NO: 2965787 - protein, 19 aa, Entamoeba invadens
RTLRKGKKYFMRENNDANV

SEQ ID NO: 2965788 - protein, 20 aa, Entamoeba invadens
RTLRRQSCMLRQQVLEPVTS

SEQ ID NO: 2965789 - protein, 20 aa, Entamoeba invadens
RTLSVKRGREVPFMDDDEDI

SEQ ID NO: 2965790 - protein, 24 aa, Entamoeba invadens
RTLYAEEYEFIVLKRDEPLHPEVI

SEQ ID NO: 2965791 - protein, 24 aa, Entamoeba invadens
RTLYLRLKKILGIEKVIVEKRLQN

SEQ ID NO: 2965792 - protein, 17 aa, Entamoeba invadens
RTMKGLNTFDFRPHCGK

SEQ ID NO: 2965793 - protein, 30 aa, Entamoeba invadens
RTMLAKFVLKCLYSQRLLSIMSELPSFFVM

SEQ ID NO: 2965794 - protein, 25 aa, Entamoeba invadens
RTMPSEKFPGVAAHLPIALMPIALQ

SEQ ID NO: 2965795 - protein, 26 aa, Entamoeba invadens
RTMSIDLLLRIGCFLDLCKNKEQDVF

SEQ ID NO: 2965796 - protein, 17 aa, Entamoeba invadens
RTNCTWCGEGFYLDSFH

SEQ ID NO: 2965797 - protein, 23 aa, Entamoeba invadens
RTNFKQFVMSGVFLVKNSLKNLN

SEQ ID NO: 2965798 - protein, 20 aa, Entamoeba invadens
RTNILSVLTLNGFENPSFYS

SEQ ID NO: 2965799 - protein, 24 aa, Entamoeba invadens
RTNKSTIVRPVFKPDIEALNCELC

SEQ ID NO: 2965800 - protein, 23 aa, Entamoeba invadens
RTNVVDFCFEYSKNLDTVYIEGW

SEQ ID NO: 2965801 - protein, 18 aa, Entamoeba invadens
RTNWYGRHQIRIFRLTET

SEQ ID NO: 2965802 - protein, 18 aa, Entamoeba invadens
RTPDGMEVLGVFGSSIGE

SEQ ID NO: 2965803 - protein, 22 aa, Entamoeba invadens
RTPEKFWACKNCGSLQCCTINP

SEQ ID NO: 2965804 - protein, 18 aa, Entamoeba invadens
RTPFHYAVLGGHLGVVKQ

SEQ ID NO: 2965805 - protein, 20 aa, Entamoeba invadens
RTPFKFTPHFAHVMGGKGSK

SEQ ID NO: 2965806 - protein, 21 aa, Entamoeba invadens
RTPLHYLCRQMDIGKLLPILR

SEQ ID NO: 2965807 - protein, 22 aa, Entamoeba invadens
RTPPKIFFEPHAIRYLAELKDL

SEQ ID NO: 2965808 - protein, 22 aa, Entamoeba invadens
RTPTPHKQCFHQTIDTTIDDST

SEQ ID NO: 2965809 - protein, 20 aa, Entamoeba invadens
RTQFSTLFKQKCILSYGPCQ

SEQ ID NO: 2965810 - protein, 15 aa, Entamoeba invadens
RTQIKGKMLKRNNLN

SEQ ID NO: 2965811 - protein, 33 aa, Entamoeba invadens
RTQIKLNGMYCCILPIMPITKMDVYIENSQEVF

SEQ ID NO: 2965812 - protein, 24 aa, Entamoeba invadens
RTQKVCKVAPVAGQTKVWQYITLM

SEQ ID NO: 2965813 - protein, 25 aa, Entamoeba invadens
RTRGKEWWMKSAIKEKSKTYYVVAL

SEQ ID NO: 2965814 - protein, 17 aa, Entamoeba invadens
RTRKGHSHIMWDSNDNR

SEQ ID NO: 2965815 - protein, 21 aa, Entamoeba invadens
RTRRVINTELIKRVFTTSPDV

SEQ ID NO: 2965816 - protein, 35 aa, Entamoeba invadens
RTSEEMPCAVYRMLNVLYTNGWNTKGIFRESQNAS

SEQ ID NO: 2965817 - protein, 24 aa, Entamoeba invadens
RTSELSEWVCNSVLEFTDDESRTY

SEQ ID NO: 2965818 - protein, 24 aa, Entamoeba invadens
RTSFALEFQFVYNFDQTAHLGQNN

SEQ ID NO: 2965819 - protein, 18 aa, Entamoeba invadens
RTSFGFKKVYSITRPESV

SEQ ID NO: 2965820 - protein, 24 aa, Entamoeba invadens
RTSFINICLRYSSFEAAIFQLKAL

SEQ ID NO: 2965821 - protein, 17 aa, Entamoeba invadens
RTSFPISKNTTFIKEWC

SEQ ID NO: 2965822 - protein, 18 aa, Entamoeba invadens
RTSLKQCSLVNVYCQVGL

SEQ ID NO: 2965823 - protein, 20 aa, Entamoeba invadens
RTSMEKHFGNPFVIAQIKSK

SEQ ID NO: 2965824 - protein, 25 aa, Entamoeba invadens
RTSPLENLNRLIVLVSEHPENANYK

SEQ ID NO: 2965825 - protein, 24 aa, Entamoeba invadens
RTSQLKTLYFVPTISPRLLKVLRG

SEQ ID NO: 2965826 - protein, 18 aa, Entamoeba invadens
RTSRRQELLRSKRNIPSL

SEQ ID NO: 2965827 - protein, 27 aa, Entamoeba invadens
RTSRWNVRILYDLLDIAALNAYKVYHH

SEQ ID NO: 2965828 - protein, 25 aa, Entamoeba invadens
RTSRWNVRILYDLLDIAALNAYNVY

SEQ ID NO: 2965829 - protein, 24 aa, Entamoeba invadens
RTSRWNVRILYDLLDIAALNVYKV

SEQ ID NO: 2965830 - protein, 20 aa, Entamoeba invadens
RTSSMKLMLFLNGVGAHDKS

SEQ ID NO: 2965831 - protein, 19 aa, Entamoeba invadens
RTTCKQMYSLLSNMTTSED

SEQ ID NO: 2965832 - protein, 23 aa, Entamoeba invadens
RTTETFFNIVIWYQVDFKTTTIY

SEQ ID NO: 2965833 - protein, 24 aa, Entamoeba invadens
RTTETKPLESIKIVPDSIRMKQLK

SEQ ID NO: 2965834 - protein, 24 aa, Entamoeba invadens
RTTFPNLVLPLSFFKSKNSKSVET

SEQ ID NO: 2965835 - protein, 20 aa, Entamoeba invadens
RTTKEAFYFPDISIVDKIQA

SEQ ID NO: 2965836 - protein, 17 aa, Entamoeba invadens
RTTLMFSATMPANLEKL

SEQ ID NO: 2965837 - protein, 19 aa, Entamoeba invadens
RTTMCGVYVNAGRENSVAS

SEQ ID NO: 2965838 - protein, 25 aa, Entamoeba invadens
RTTREKREIIGFVDLKLSHIPFPSL

SEQ ID NO: 2965839 - protein, 20 aa, Entamoeba invadens
RTTSEIFAFRGIDITQSVES

SEQ ID NO: 2965840 - protein, 27 aa, Entamoeba invadens
RTVEAPRLFNRIVIKPVDHPKLLDYET

SEQ ID NO: 2965841 - protein, 20 aa, Entamoeba invadens
RTVILALKFLETIIRLLDED

SEQ ID NO: 2965842 - protein, 25 aa, Entamoeba invadens
RTVLRFLHKSSVYQIQFEGSKGIYT

SEQ ID NO: 2965843 - protein, 24 aa, Entamoeba invadens
RTVSESVGVLAFFSDYFNEDDVRL

SEQ ID NO: 2965844 - protein, 23 aa, Entamoeba invadens
RTVTVKNPLPVVVKTPATALRDS

SEQ ID NO: 2965845 - protein, 20 aa, Entamoeba invadens
RTYLAFRWYVAKLIEGVDEF

SEQ ID NO: 2965846 - protein, 20 aa, Entamoeba invadens
RTYSKIPVIFDLIDFSPYNE

SEQ ID NO: 2965847 - protein, 25 aa, Entamoeba invadens
RVAAKRICDILGRIINIEFCGKENT

SEQ ID NO: 2965848 - protein, 19 aa, Entamoeba invadens
RVADPLVIANALAKMEREK

SEQ ID NO: 2965849 - protein, 20 aa, Entamoeba invadens
RVADWSFPVVCSSLNENTLT

SEQ ID NO: 2965850 - protein, 22 aa, Entamoeba invadens
RVAGADIVLRLQIEQKMRNYTK

SEQ ID NO: 2965851 - protein, 28 aa, Entamoeba invadens
RVAKKKKDTKCLIQKSIFEKYKEKETKE

SEQ ID NO: 2965852 - protein, 20 aa, Entamoeba invadens
RVALDVAKEKGILVVTQVDN

SEQ ID NO: 2965853 - protein, 21 aa, Entamoeba invadens
RVALSSINVQFSWTDTVKKEQ

SEQ ID NO: 2965854 - protein, 20 aa, Entamoeba invadens
RVARLIKMIFDKGMMTATLK

SEQ ID NO: 2965855 - protein, 19 aa, Entamoeba invadens
RVASMAATYIIDYIKEQNY

SEQ ID NO: 2965856 - protein, 19 aa, Entamoeba invadens
RVATDLSVNELIGLENITS

SEQ ID NO: 2965857 - protein, 19 aa, Entamoeba invadens
RVATVVLSRIMQAFRQVYQ

SEQ ID NO: 2965858 - protein, 20 aa, Entamoeba invadens
RVCGNVGFCGYYVEFDLDNF

SEQ ID NO: 2965859 - protein, 18 aa, Entamoeba invadens
RVCQEVSSDVLVKVMDLF

SEQ ID NO: 2965860 - protein, 19 aa, Entamoeba invadens
RVCRTLRDTFCSSSYEEVL

SEQ ID NO: 2965861 - protein, 23 aa, Entamoeba invadens
RVDDSIPLFGFVGRICEQKGVFL

SEQ ID NO: 2965862 - protein, 22 aa, Entamoeba invadens
RVDKDDTWRVFAPDPKLFDEKI

SEQ ID NO: 2965863 - protein, 17 aa, Entamoeba invadens
RVDKIQISFDISLIRLK

SEQ ID NO: 2965864 - protein, 24 aa, Entamoeba invadens
RVDVIKGKCLISVIDSENVIQLYL

SEQ ID NO: 2965865 - protein, 20 aa, Entamoeba invadens
RVEAKRGISLDGNELGSYSS

SEQ ID NO: 2965866 - protein, 19 aa, Entamoeba invadens
RVECFSVTIYYLIFYIDES

SEQ ID NO: 2965867 - protein, 18 aa, Entamoeba invadens
RVEEIMCIDCVKDALDEE

SEQ ID NO: 2965868 - protein, 19 aa, Entamoeba invadens
RVEFSLKLMEFELADQKII

SEQ ID NO: 2965869 - protein, 17 aa, Entamoeba invadens
RVEHLKMTFGEPEETFE

SEQ ID NO: 2965870 - protein, 28 aa, Entamoeba invadens
RVEKFPEIPFGIFFVFTRNFFGFHVRFR

SEQ ID NO: 2965871 - protein, 25 aa, Entamoeba invadens
RVEKIYTQRIILFVGSPINMKEEET

SEQ ID NO: 2965872 - protein, 19 aa, Entamoeba invadens
RVELEGCIVRGKRCPKPIQ

SEQ ID NO: 2965873 - protein, 19 aa, Entamoeba invadens
RVELINDFVLITFLVGNDF

SEQ ID NO: 2965874 - protein, 24 aa, Entamoeba invadens
RVEPLRRRYLFFLLNLYYSISKKS

SEQ ID NO: 2965875 - protein, 18 aa, Entamoeba invadens
RVEQVRYFGYELAKRNIP

SEQ ID NO: 2965876 - protein, 24 aa, Entamoeba invadens
RVEREYRELMALRQLRSYEDRFQG

SEQ ID NO: 2965877 - protein, 19 aa, Entamoeba invadens
RVFAGCGILTHAVFPQHFI

SEQ ID NO: 2965878 - protein, 19 aa, Entamoeba invadens
RVFDGRRLFCAKDKKNNKC

SEQ ID NO: 2965879 - protein, 19 aa, Entamoeba invadens
RVFDTKIGIFEVIGSSLKV

SEQ ID NO: 2965880 - protein, 24 aa, Entamoeba invadens
RVFFLSDKMGMVYSKIKRNEINTG

SEQ ID NO: 2965881 - protein, 19 aa, Entamoeba invadens
RVFGEYCFAYCKSLSALTL

SEQ ID NO: 2965882 - protein, 19 aa, Entamoeba invadens
RVFGNGLLYKVTMENANYP

SEQ ID NO: 2965883 - protein, 20 aa, Entamoeba invadens
RVFGNGLLYKVTMENANYPR

SEQ ID NO: 2965884 - protein, 21 aa, Entamoeba invadens
RVFHLKMNYLLKHITDDGIFG

SEQ ID NO: 2965885 - protein, 17 aa, Entamoeba invadens
RVFKGLLLVLQNEVLYT

SEQ ID NO: 2965886 - protein, 32 aa, Entamoeba invadens
RVFKSLFCIKKLFRVVVWFNVDCRTVSMNNKN

SEQ ID NO: 2965887 - protein, 19 aa, Entamoeba invadens
RVFKSLLKNLCRLDKKRHL

SEQ ID NO: 2965888 - protein, 19 aa, Entamoeba invadens
RVFLRIMKILQLIHNEGIV

SEQ ID NO: 2965889 - protein, 25 aa, Entamoeba invadens
RVFNILVSSVCKIKKTAKNNRALYT

SEQ ID NO: 2965890 - protein, 25 aa, Entamoeba invadens
RVFNNEVKYVFKLLDLGVIKTEVPT

SEQ ID NO: 2965891 - protein, 19 aa, Entamoeba invadens
RVFQLRKDFFPAAKLQMED

SEQ ID NO: 2965892 - protein, 20 aa, Entamoeba invadens
RVGACGLNITGASRVVIFDE

SEQ ID NO: 2965893 - protein, 17 aa, Entamoeba invadens
RVGCKGSFITQDGKKDN

SEQ ID NO: 2965894 - protein, 24 aa, Entamoeba invadens
RVGCSKETLTRVLAMMDLGIIVGT

SEQ ID NO: 2965895 - protein, 22 aa, Entamoeba invadens
RVGEITKFQNEVIALKQENETV

SEQ ID NO: 2965896 - protein, 21 aa, Entamoeba invadens
RVGFARCLPLLCRKEENKSYF

SEQ ID NO: 2965897 - protein, 18 aa, Entamoeba invadens
RVGIISGGIQTLAEDLKL

SEQ ID NO: 2965898 - protein, 20 aa, Entamoeba invadens
RVGNENATRIWLAKWTTAEF

SEQ ID NO: 2965899 - protein, 28 aa, Entamoeba invadens
RVGNPIIFPRISPLYSLNKLQGSDFLKD

SEQ ID NO: 2965900 - protein, 18 aa, Entamoeba invadens
RVGPVLNSMGWKGITNSI

SEQ ID NO: 2965901 - protein, 33 aa, Entamoeba invadens
RVGSEQILRFELLCSFCLKCYWKNTENNELKRK

SEQ ID NO: 2965902 - protein, 22 aa, Entamoeba invadens
RVGSLYLSKFLRESCEEKLVQF

SEQ ID NO: 2965903 - protein, 17 aa, Entamoeba invadens
RVHEFTSLIIPTTLRCI

SEQ ID NO: 2965904 - protein, 24 aa, Entamoeba invadens
RVHKKFYIHRDIKPDNFVMGSGAN

SEQ ID NO: 2965905 - protein, 17 aa, Entamoeba invadens
RVHNIWMSISDTITQPN

SEQ ID NO: 2965906 - protein, 24 aa, Entamoeba invadens
RVIDEACSYLVGIVVSDCQVKIDD

SEQ ID NO: 2965907 - protein, 25 aa, Entamoeba invadens
RVIELCGIKCSRILLDGDGLVQNKM

SEQ ID NO: 2965908 - protein, 30 aa, Entamoeba invadens
RVIFSDKSGVPFCFSEISTGAVEPVNDSSR

SEQ ID NO: 2965909 - protein, 27 aa, Entamoeba invadens
RVIGERCFRYAPITDIVIPPTVIKFKN

SEQ ID NO: 2965910 - protein, 17 aa, Entamoeba invadens
RVILPLVIESGYALHKC

SEQ ID NO: 2965911 - protein, 22 aa, Entamoeba invadens
RVIMFLCVLFSHLGEVPETFKT

SEQ ID NO: 2965912 - protein, 19 aa, Entamoeba invadens
RVINLEWPASYGIGNQTYF

SEQ ID NO: 2965913 - protein, 18 aa, Entamoeba invadens
RVIQKAVEFIDAKQMGIL

SEQ ID NO: 2965914 - protein, 19 aa, Entamoeba invadens
RVIQYIATIAGRSSATMGD

SEQ ID NO: 2965915 - protein, 31 aa, Entamoeba invadens
RVIRGGYSLGRGCGYGIGFVYMEELVKRVNE

SEQ ID NO: 2965916 - protein, 18 aa, Entamoeba invadens
RVIRYNCVVPRKLVMWLK

SEQ ID NO: 2965917 - protein, 17 aa, Entamoeba invadens
RVIWKNDHFEMKTMTMK

SEQ ID NO: 2965918 - protein, 17 aa, Entamoeba invadens
RVKAAMKCVPSLLRVFF

SEQ ID NO: 2965919 - protein, 21 aa, Entamoeba invadens
RVKDKKCYISPGVLTMEDKAQ

SEQ ID NO: 2965920 - protein, 21 aa, Entamoeba invadens
RVKEGKLSKRYVIILENGINA

SEQ ID NO: 2965921 - protein, 22 aa, Entamoeba invadens
RVKELQKRCLQLFDRSSTQIQV

SEQ ID NO: 2965922 - protein, 20 aa, Entamoeba invadens
RVKGRIDIMNNIFSMKDACF

SEQ ID NO: 2965923 - protein, 18 aa, Entamoeba invadens
RVKICAPVIFVNTTHASL

SEQ ID NO: 2965924 - protein, 17 aa, Entamoeba invadens
RVKLHSANDAFKIDVGD

SEQ ID NO: 2965925 - protein, 18 aa, Entamoeba invadens
RVKMMLDALRGISYLHEN

SEQ ID NO: 2965926 - protein, 20 aa, Entamoeba invadens
RVKNEWKDVLEFLSSESQGL

SEQ ID NO: 2965927 - protein, 23 aa, Entamoeba invadens
RVKPSHSKYIYSDRPKFQRRSHR

SEQ ID NO: 2965928 - protein, 24 aa, Entamoeba invadens
RVKTSLCKIALPDFSAIAEMNKTS

SEQ ID NO: 2965929 - protein, 22 aa, Entamoeba invadens
RVLERKMAEFVIRNASEKEEEK

SEQ ID NO: 2965930 - protein, 26 aa, Entamoeba invadens
RVLFEMRPFPKIPILSLWMHDVVNIN

SEQ ID NO: 2965931 - protein, 17 aa, Entamoeba invadens
RVLGFIERVCWAKTEMD

SEQ ID NO: 2965932 - protein, 20 aa, Entamoeba invadens
RVLLKEGSRLCALSLLINLA

SEQ ID NO: 2965933 - protein, 23 aa, Entamoeba invadens
RVLQRGGVLIWLSFGENKTNFIQ

SEQ ID NO: 2965934 - protein, 22 aa, Entamoeba invadens
RVLRIQTTWLPYGNAPEINCTA

SEQ ID NO: 2965935 - protein, 19 aa, Entamoeba invadens
RVLRQMLWFGDYSFASEQL

SEQ ID NO: 2965936 - protein, 24 aa, Entamoeba invadens
RVLSSKAALCARVDALSDSVQTSM

SEQ ID NO: 2965937 - protein, 29 aa, Entamoeba invadens
RVLTCVNIASFLCKVHYSYLVGSKDQKIT

SEQ ID NO: 2965938 - protein, 18 aa, Entamoeba invadens
RVLTGVLEHCFWLREGDE

SEQ ID NO: 2965939 - protein, 24 aa, Entamoeba invadens
RVLYRLKCQLQLRFHQVSQSVNMN

SEQ ID NO: 2965940 - protein, 18 aa, Entamoeba invadens
RVMGRLQINPLVFENTRS

SEQ ID NO: 2965941 - protein, 18 aa, Entamoeba invadens
RVMVCGGFVRTMSIDLLL

SEQ ID NO: 2965942 - protein, 17 aa, Entamoeba invadens
RVPNTILCAFKGVEGEA

SEQ ID NO: 2965943 - protein, 25 aa, Entamoeba invadens
RVPTRAKVSVLGKMIQLFFKTKEGA

SEQ ID NO: 2965944 - protein, 18 aa, Entamoeba invadens
RVPYGEIVWENVDVTDIN

SEQ ID NO: 2965945 - protein, 20 aa, Entamoeba invadens
RVPYLSKRTYIIKQIEKHSK

SEQ ID NO: 2965946 - protein, 22 aa, Entamoeba invadens
RVPYPSIKGWWCSTHRFHLVGE

SEQ ID NO: 2965947 - protein, 19 aa, Entamoeba invadens
RVPYVRGYYSFDFPHINIP

SEQ ID NO: 2965948 - protein, 19 aa, Entamoeba invadens
RVQIKYLIEYYLRKYGDYV

SEQ ID NO: 2965949 - protein, 27 aa, Entamoeba invadens
RVQTPMLFLDMFRIFNSHYLLGLNYLP

SEQ ID NO: 2965950 - protein, 24 aa, Entamoeba invadens
RVREIVKSGTFKLIGEMDGILAFE

SEQ ID NO: 2965951 - protein, 18 aa, Entamoeba invadens
RVRHMAYSVVNSMVSEMK

SEQ ID NO: 2965952 - protein, 25 aa, Entamoeba invadens
RVRKEVIWGPARWCYSGKRCTKEFS

SEQ ID NO: 2965953 - protein, 17 aa, Entamoeba invadens
RVRMIDIEWVISSISMH

SEQ ID NO: 2965954 - protein, 33 aa, Entamoeba invadens
RVRNKCYICGEYGHLKTQCPMRVRTKREKRMEE

SEQ ID NO: 2965955 - protein, 20 aa, Entamoeba invadens
RVRPTGKYVVEWGGVETHFY

SEQ ID NO: 2965956 - protein, 26 aa, Entamoeba invadens
RVRTAFKGQVLRYLNRETIVILDSLN

SEQ ID NO: 2965957 - protein, 22 aa, Entamoeba invadens
RVRTAVLVPYSFQDILKEVHNP

SEQ ID NO: 2965958 - protein, 20 aa, Entamoeba invadens
RVSAEVFRRTLKLLMSTNKS

SEQ ID NO: 2965959 - protein, 33 aa, Entamoeba invadens
RVSALRLLVSIAELKLDRFRDFFRQLLSDLMRD

SEQ ID NO: 2965960 - protein, 17 aa, Entamoeba invadens
RVSCFSLSAGKPDPYYI

SEQ ID NO: 2965961 - protein, 17 aa, Entamoeba invadens
RVSDGIRYSHLKNCGQK

SEQ ID NO: 2965962 - protein, 22 aa, Entamoeba invadens
RVSDKFPSCLVIQSDSNHVVDG

SEQ ID NO: 2965963 - protein, 21 aa, Entamoeba invadens
RVSITLIVKEFIPLMQHAIDL

SEQ ID NO: 2965964 - protein, 19 aa, Entamoeba invadens
RVSLLMLSDLCKISPEKFY

SEQ ID NO: 2965965 - protein, 20 aa, Entamoeba invadens
RVSNLSFLYFLVIDNNNILG

SEQ ID NO: 2965966 - protein, 21 aa, Entamoeba invadens
RVSTINIMKTLSWIEKLKTIL

SEQ ID NO: 2965967 - protein, 32 aa, Entamoeba invadens
RVSVLLCGKAGCGKTSLAQRFFSSNIEVDSVP

SEQ ID NO: 2965968 - protein, 20 aa, Entamoeba invadens
RVSVNCVRRAERIEKLGRTK

SEQ ID NO: 2965969 - protein, 28 aa, Entamoeba invadens
RVSVVCKPSIPPFCPFIDTGVYKYGERL

SEQ ID NO: 2965970 - protein, 20 aa, Entamoeba invadens
RVSYLSAYCFGGCNCLSNVV

SEQ ID NO: 2965971 - protein, 19 aa, Entamoeba invadens
RVSYLSAYCFSGCNCLNNV

SEQ ID NO: 2965972 - protein, 17 aa, Entamoeba invadens
RVTCSFAALLKKDIHIH

SEQ ID NO: 2965973 - protein, 24 aa, Entamoeba invadens
RVTEDLKRKLELMSYENKTQLEKK

SEQ ID NO: 2965974 - protein, 45 aa, Entamoeba invadens
RVTEIVGGLHVCAKAISQRKLIEWKLDEQIVIIVIQDTIHIWYHF

SEQ ID NO: 2965975 - protein, 27 aa, Entamoeba invadens
RVTELIGGLHMCAKAFAQRKLIEQKRN

SEQ ID NO: 2965976 - protein, 20 aa, Entamoeba invadens
RVTGIPLSYLLPRGQQVKVI

SEQ ID NO: 2965977 - protein, 18 aa, Entamoeba invadens
RVTIEKCSEITVTLSGVE

SEQ ID NO: 2965978 - protein, 20 aa, Entamoeba invadens
RVTLMLHFMLTYTLENASEL

SEQ ID NO: 2965979 - protein, 27 aa, Entamoeba invadens
RVTRFGGKLSIPDSIKIISINFKDVTI

SEQ ID NO: 2965980 - protein, 19 aa, Entamoeba invadens
RVTSCVVVGGLASVKQVRL

SEQ ID NO: 2965981 - protein, 21 aa, Entamoeba invadens
RVTTLDGCFEPLMSALHAYEE

SEQ ID NO: 2965982 - protein, 20 aa, Entamoeba invadens
RVTVEITKRCEIKLLQQIPF

SEQ ID NO: 2965983 - protein, 28 aa, Entamoeba invadens
RVTVRLEDCLACSGCITSAESILIEEQG

SEQ ID NO: 2965984 - protein, 20 aa, Entamoeba invadens
RVTYFDVFPSCIFKTRHRHQ

SEQ ID NO: 2965985 - protein, 18 aa, Entamoeba invadens
RVVAKPRKSKKWDKQEIL

SEQ ID NO: 2965986 - protein, 20 aa, Entamoeba invadens
RVVCWLLTRVDVIEECCLCD

SEQ ID NO: 2965987 - protein, 18 aa, Entamoeba invadens
RVVEDYNSFIALFTIFQS

SEQ ID NO: 2965988 - protein, 31 aa, Entamoeba invadens
RVVEKIDFVFCPRFGFSIDEFCESGDCTSGM

SEQ ID NO: 2965989 - protein, 20 aa, Entamoeba invadens
RVVIVDALFIGYGLTETCGM

SEQ ID NO: 2965990 - protein, 20 aa, Entamoeba invadens
RVVKELINYLTEKPVRLETE

SEQ ID NO: 2965991 - protein, 19 aa, Entamoeba invadens
RVVLSALRVEQNFWKAKDA

SEQ ID NO: 2965992 - protein, 25 aa, Entamoeba invadens
RVVLYSFFVCYSLREDGMKLYEMCL

SEQ ID NO: 2965993 - protein, 25 aa, Entamoeba invadens
RVVNKKGKIMLCIEGGVPTLLVQQG

SEQ ID NO: 2965994 - protein, 19 aa, Entamoeba invadens
RVVPSYSFSNHVLATEDPE

SEQ ID NO: 2965995 - protein, 20 aa, Entamoeba invadens
RVVQDWSNQDFIDFFYKEFC

SEQ ID NO: 2965996 - protein, 23 aa, Entamoeba invadens
RVVRIPSYVLEIGKFCFQSCSSL

SEQ ID NO: 2965997 - protein, 17 aa, Entamoeba invadens
RVVRIRLSKNVPETDGL

SEQ ID NO: 2965998 - protein, 24 aa, Entamoeba invadens
RVVSALKYWIENIWNVIKSNEKNV

SEQ ID NO: 2965999 - protein, 27 aa, Entamoeba invadens
RVVYLFHCPFCLKFVVLRNQIGMGTLY

SEQ ID NO: 2966000 - protein, 19 aa, Entamoeba invadens
RVWCYPFDSGPVIEVCLDK

SEQ ID NO: 2966001 - protein, 17 aa, Entamoeba invadens
RVYARGTFSKSIKEYLK

SEQ ID NO: 2966002 - protein, 20 aa, Entamoeba invadens
RVYECKDLPNPVELFADISA

SEQ ID NO: 2966003 - protein, 18 aa, Entamoeba invadens
RVYFCDKCSNNVDLVKDV

SEQ ID NO: 2966004 - protein, 20 aa, Entamoeba invadens
RVYFPSTIVYFNLENINNST

SEQ ID NO: 2966005 - protein, 19 aa, Entamoeba invadens
RVYHVWKTVLDMLKDRGYV

SEQ ID NO: 2966006 - protein, 25 aa, Entamoeba invadens
RVYRGIRFASKFTFTIEKNTWEAMH

SEQ ID NO: 2966007 - protein, 17 aa, Entamoeba invadens
RVYVKVTVFSGVAHKQK

SEQ ID NO: 2966008 - protein, 20 aa, Entamoeba invadens
RWDKFNCDLYNLTRNRNRLC

SEQ ID NO: 2966009 - protein, 23 aa, Entamoeba invadens
RWHIRQGRVESGIVVLEQAMEEV

SEQ ID NO: 2966010 - protein, 23 aa, Entamoeba invadens
RWLDRSLIRLCQRFGDFRKDDPT

SEQ ID NO: 2966011 - protein, 24 aa, Entamoeba invadens
RWMTELKAGCGDDVVIMIVGNKSD

SEQ ID NO: 2966012 - protein, 22 aa, Entamoeba invadens
RWNNRKGCTIWSVKYPTLCMTI

SEQ ID NO: 2966013 - protein, 21 aa, Entamoeba invadens
RWNRCFGKNSFIVMLDAVDNV

SEQ ID NO: 2966014 - protein, 20 aa, Entamoeba invadens
RWQNWSNFLLIFSTIFNTKF

SEQ ID NO: 2966015 - protein, 25 aa, Entamoeba invadens
RWVDRKPTGVAYLCYTTAEGANNAI

SEQ ID NO: 2966016 - protein, 20 aa, Entamoeba invadens
RWVGMLGGYSVVRPKDADLI

SEQ ID NO: 2966017 - protein, 18 aa, Entamoeba invadens
RWVKELYRDTLLVCSKRE

SEQ ID NO: 2966018 - protein, 21 aa, Entamoeba invadens
RYADGEIKSAHILDPNVTLGT

SEQ ID NO: 2966019 - protein, 17 aa, Entamoeba invadens
RYAERVGYPLVFCSSYT

SEQ ID NO: 2966020 - protein, 20 aa, Entamoeba invadens
RYAIKPQRPLTMLPPSAPPP

SEQ ID NO: 2966021 - protein, 20 aa, Entamoeba invadens
RYAKSAEMYTTLNVGSVKAA

SEQ ID NO: 2966022 - protein, 22 aa, Entamoeba invadens
RYALGRLRLDEDFRKEIEEMVL

SEQ ID NO: 2966023 - protein, 25 aa, Entamoeba invadens
RYCEMCADVGFGSFVTPSSYASEKF

SEQ ID NO: 2966024 - protein, 25 aa, Entamoeba invadens
RYCINCYKLVSAMVCEKCKKPIEGR

SEQ ID NO: 2966025 - protein, 19 aa, Entamoeba invadens
RYCMLRINFEDNFLVHFLV

SEQ ID NO: 2966026 - protein, 24 aa, Entamoeba invadens
RYCQYDRGTCWAFATIGLLEQSYR

SEQ ID NO: 2966027 - protein, 22 aa, Entamoeba invadens
RYDLQLIFKRCDYYTLMADSAM

SEQ ID NO: 2966028 - protein, 18 aa, Entamoeba invadens
RYDLWDSRERIFNRRELR

SEQ ID NO: 2966029 - protein, 20 aa, Entamoeba invadens
RYDNVWPLTLYNSGQLNIFN

SEQ ID NO: 2966030 - protein, 24 aa, Entamoeba invadens
RYDPWGGTIEFSFLGKENIEVYQN

SEQ ID NO: 2966031 - protein, 23 aa, Entamoeba invadens
RYDTKPRKPSVMAHETLQSRVKP

SEQ ID NO: 2966032 - protein, 20 aa, Entamoeba invadens
RYEECVKHNIGMLSAILEVL

SEQ ID NO: 2966033 - protein, 20 aa, Entamoeba invadens
RYEIKMALPPKIDPSVSVMQ

SEQ ID NO: 2966034 - protein, 25 aa, Entamoeba invadens
RYEKNASQVIFDWPNFSMELVAPQK

SEQ ID NO: 2966035 - protein, 23 aa, Entamoeba invadens
RYEKVEHLDILKSFAVVAFDDWI

SEQ ID NO: 2966036 - protein, 23 aa, Entamoeba invadens
RYELKNTEICYSDAFNNDKALSA

SEQ ID NO: 2966037 - protein, 23 aa, Entamoeba invadens
RYEPRFPRHYIQPHIKTYLVKVG

SEQ ID NO: 2966038 - protein, 25 aa, Entamoeba invadens
RYFDCGDAVTWFWCRTIQEGYYYGY

SEQ ID NO: 2966039 - protein, 19 aa, Entamoeba invadens
RYFFLFSDLLVYGRMQMGL

SEQ ID NO: 2966040 - protein, 17 aa, Entamoeba invadens
RYFKLPYGQICKLCGTK

SEQ ID NO: 2966041 - protein, 17 aa, Entamoeba invadens
RYFPNIETLCLWNKKDD

SEQ ID NO: 2966042 - protein, 20 aa, Entamoeba invadens
RYFYLFNDLLLYGPGVKKIN

SEQ ID NO: 2966043 - protein, 20 aa, Entamoeba invadens
RYGETIPFNLPVHHLEDDCF

SEQ ID NO: 2966044 - protein, 18 aa, Entamoeba invadens
RYGKPLNIINCTEGTTST

SEQ ID NO: 2966045 - protein, 23 aa, Entamoeba invadens
RYGKRTLPIISFETTFVGGENIS

SEQ ID NO: 2966046 - protein, 19 aa, Entamoeba invadens
RYGNLRYTNTLSIILPIIE

SEQ ID NO: 2966047 - protein, 24 aa, Entamoeba invadens
RYGVLDCINFAMSEVTRTICEDIV

SEQ ID NO: 2966048 - protein, 19 aa, Entamoeba invadens
RYGVMPLKPFLSPEVTQFH

SEQ ID NO: 2966049 - protein, 17 aa, Entamoeba invadens
RYHSFKGATQFSCRCFN

SEQ ID NO: 2966050 - protein, 26 aa, Entamoeba invadens
RYIFEAISSKFLWVFVGTNTQQKAIN

SEQ ID NO: 2966051 - protein, 18 aa, Entamoeba invadens
RYIFPSSYLSLLSESDKK

SEQ ID NO: 2966052 - protein, 22 aa, Entamoeba invadens
RYIKGLRCFEDIMVDILCSEPK

SEQ ID NO: 2966053 - protein, 20 aa, Entamoeba invadens
RYIMGLKLFEYVLGIPDENF

SEQ ID NO: 2966054 - protein, 23 aa, Entamoeba invadens
RYIPFPETFDIPNPHERYSNLET

SEQ ID NO: 2966055 - protein, 26 aa, Entamoeba invadens
RYIRFLFDIPARVAIFPNSKRTKKLG

SEQ ID NO: 2966056 - protein, 21 aa, Entamoeba invadens
RYIRVVCDFLDTFIRMDQKVE

SEQ ID NO: 2966057 - protein, 18 aa, Entamoeba invadens
RYISAFIVDIEISKVNKH

SEQ ID NO: 2966058 - protein, 19 aa, Entamoeba invadens
RYISAFIVDIEITKVNKEL

SEQ ID NO: 2966059 - protein, 27 aa, Entamoeba invadens
RYISFFAKKEFKFCTPSLVGNKVVIDA

SEQ ID NO: 2966060 - protein, 19 aa, Entamoeba invadens
RYITGCVTYSYNFQKYYAR

SEQ ID NO: 2966061 - protein, 20 aa, Entamoeba invadens
RYIVALNYMFKRASDITNTK

SEQ ID NO: 2966062 - protein, 23 aa, Entamoeba invadens
RYKCMKFKGCIVCSDEEPYKRKS

SEQ ID NO: 2966063 - protein, 18 aa, Entamoeba invadens
RYKDDFNKAFDLLKEFIT

SEQ ID NO: 2966064 - protein, 27 aa, Entamoeba invadens
RYKELRRYGPFKGKVPRIICGTKADLP

SEQ ID NO: 2966065 - protein, 24 aa, Entamoeba invadens
RYKHVLFPSIAIIKLFTYLVELNV

SEQ ID NO: 2966066 - protein, 24 aa, Entamoeba invadens
RYKKTGKNTILFVDEIHSLNKLQQ

SEQ ID NO: 2966067 - protein, 18 aa, Entamoeba invadens
RYKVISVLGHGSFGQVLK

SEQ ID NO: 2966068 - protein, 17 aa, Entamoeba invadens
RYKVVRTKRDLRRKLKK

SEQ ID NO: 2966069 - protein, 19 aa, Entamoeba invadens
RYLDYNGIANLEFSNPNYY

SEQ ID NO: 2966070 - protein, 19 aa, Entamoeba invadens
RYLFKQILTALLYCHEHRV

SEQ ID NO: 2966071 - protein, 19 aa, Entamoeba invadens
RYLHCAHVVKEFITTEKTY

SEQ ID NO: 2966072 - protein, 21 aa, Entamoeba invadens
RYMAPEILFNPSMIGKESAGV

SEQ ID NO: 2966073 - protein, 18 aa, Entamoeba invadens
RYMILKIIRQFTERVLNE

SEQ ID NO: 2966074 - protein, 23 aa, Entamoeba invadens
RYMSDAFLRLLIQKAAVDVKTQT

SEQ ID NO: 2966075 - protein, 19 aa, Entamoeba invadens
RYNALKIINTVISKSGRGR

SEQ ID NO: 2966076 - protein, 25 aa, Entamoeba invadens
RYNCVVPRKLVMWLKYSIYVADQRY

SEQ ID NO: 2966077 - protein, 24 aa, Entamoeba invadens
RYNKLDCINIPPNVKSIGDHCFCN

SEQ ID NO: 2966078 - protein, 19 aa, Entamoeba invadens
RYNLVAGDFPPIDVYKERL

SEQ ID NO: 2966079 - protein, 19 aa, Entamoeba invadens
RYNPFIQKFNVLRSDKFES

SEQ ID NO: 2966080 - protein, 18 aa, Entamoeba invadens
RYNPFIYKYQMVETNPDF

SEQ ID NO: 2966081 - protein, 19 aa, Entamoeba invadens
RYNPKLNILENIQMPPSLL

SEQ ID NO: 2966082 - protein, 19 aa, Entamoeba invadens
RYNTIKSAITNNDWQNYES

SEQ ID NO: 2966083 - protein, 17 aa, Entamoeba invadens
RYNVGSFNKCLKKLEDA

SEQ ID NO: 2966084 - protein, 18 aa, Entamoeba invadens
RYPLNTHYSPLFMNQQTP

SEQ ID NO: 2966085 - protein, 18 aa, Entamoeba invadens
RYQMLLIQIVNTIKDQVV

SEQ ID NO: 2966086 - protein, 24 aa, Entamoeba invadens
RYRKVSYILGRAVASQWVGHYIIP

SEQ ID NO: 2966087 - protein, 19 aa, Entamoeba invadens
RYRYLKEITSLVLDTLNGD

SEQ ID NO: 2966088 - protein, 21 aa, Entamoeba invadens
RYSEIKWALRFDTEAASRVNQ

SEQ ID NO: 2966089 - protein, 19 aa, Entamoeba invadens
RYSFPKFTGASIFIRSQEV

SEQ ID NO: 2966090 - protein, 18 aa, Entamoeba invadens
RYSIQEMTKNIHLTNQDV

SEQ ID NO: 2966091 - protein, 23 aa, Entamoeba invadens
RYSKCVYEYLLSYSVYLELKSNC

SEQ ID NO: 2966092 - protein, 28 aa, Entamoeba invadens
RYSKIGIEVARLYHWRHPNIVGFEGCWI

SEQ ID NO: 2966093 - protein, 20 aa, Entamoeba invadens
RYSLEGPITISSYNKLLLDM

SEQ ID NO: 2966094 - protein, 18 aa, Entamoeba invadens
RYSLMIVSKYFKNIGDFI

SEQ ID NO: 2966095 - protein, 19 aa, Entamoeba invadens
RYSNPSIFKFLKCPINSLQ

SEQ ID NO: 2966096 - protein, 18 aa, Entamoeba invadens
RYSPYVLNYLVQFLYAPT

SEQ ID NO: 2966097 - protein, 19 aa, Entamoeba invadens
RYSTPYPHNIFIVTSQHHS

SEQ ID NO: 2966098 - protein, 17 aa, Entamoeba invadens
RYSVLVFDLECINTAAA

SEQ ID NO: 2966099 - protein, 18 aa, Entamoeba invadens
RYTGNVVHIDFGDCFEVA

SEQ ID NO: 2966100 - protein, 21 aa, Entamoeba invadens
RYTKCVYEYILSYSKYLELKS

SEQ ID NO: 2966101 - protein, 25 aa, Entamoeba invadens
RYTKSSFKTFRMEKITDILLNDKII

SEQ ID NO: 2966102 - protein, 21 aa, Entamoeba invadens
RYTLDISKLKALGWAPTVGFE

SEQ ID NO: 2966103 - protein, 17 aa, Entamoeba invadens
RYTRALLYLQNMFGPGV

SEQ ID NO: 2966104 - protein, 23 aa, Entamoeba invadens
RYTRNVKEAKRLVSEVNGSDGKI

SEQ ID NO: 2966105 - protein, 24 aa, Entamoeba invadens
RYVGKEEPFVFSVGFDRTQSRQMG

SEQ ID NO: 2966106 - protein, 22 aa, Entamoeba invadens
RYVHLYVKFFVKVRTAMAQVEA

SEQ ID NO: 2966107 - protein, 20 aa, Entamoeba invadens
RYVIESCGIVKVNEIFVNNK

SEQ ID NO: 2966108 - protein, 22 aa, Entamoeba invadens
RYWSSKMFATYLIYNKVPKPQS

SEQ ID NO: 2966109 - protein, 18 aa, Entamoeba invadens
RYYLEGLNLLQPVDKVTC

SEQ ID NO: 2966110 - protein, 29 aa, Entamoeba invadens
RYYQKNCMSVSFNWLVEMLEELGYSFDVL

SEQ ID NO: 2966111 - protein, 17 aa, Entamoeba invadens
SAAESWEKINKGMFTKY

SEQ ID NO: 2966112 - protein, 26 aa, Entamoeba invadens
SAAFSLESKTSFTITFSNERFADVKM

SEQ ID NO: 2966113 - protein, 18 aa, Entamoeba invadens
SAAFVIKIFQVLRIYPLC

SEQ ID NO: 2966114 - protein, 21 aa, Entamoeba invadens
SAAIRNFGLSFARTSMGTNFT

SEQ ID NO: 2966115 - protein, 24 aa, Entamoeba invadens
SAAKEFSCQIIIDWSSARKNMLSN

SEQ ID NO: 2966116 - protein, 18 aa, Entamoeba invadens
SAALKYKTVCEIENMAVS

SEQ ID NO: 2966117 - protein, 21 aa, Entamoeba invadens
SAAPTRNSIAFNFFEQKDKSM

SEQ ID NO: 2966118 - protein, 18 aa, Entamoeba invadens
SACARTIRLEKEIATNPS

SEQ ID NO: 2966119 - protein, 24 aa, Entamoeba invadens
SACNLRPVKLAVINRPKMTELISV

SEQ ID NO: 2966120 - protein, 33 aa, Entamoeba invadens
SACTACKLTKIVLWPKIWPVFASQVNAKLSRVT

SEQ ID NO: 2966121 - protein, 19 aa, Entamoeba invadens
SADAARKAADIKLQEKKNK

SEQ ID NO: 2966122 - protein, 18 aa, Entamoeba invadens
SADAARKASEGKLQKIRF

SEQ ID NO: 2966123 - protein, 17 aa, Entamoeba invadens
SADAIAFYQNIADNAEY

SEQ ID NO: 2966124 - protein, 20 aa, Entamoeba invadens
SADAIPTYFQDGSKNLFGIF

SEQ ID NO: 2966125 - protein, 26 aa, Entamoeba invadens
SADFEKRKKLEIARHAEKIENILKNN

SEQ ID NO: 2966126 - protein, 28 aa, Entamoeba invadens
SADLFVVCFSLIDPKSFLNVVKCWLPEI

SEQ ID NO: 2966127 - protein, 20 aa, Entamoeba invadens
SADLGRPLWVETFANKFNVG

SEQ ID NO: 2966128 - protein, 21 aa, Entamoeba invadens
SADLGRPLWVETFANRFNVGM

SEQ ID NO: 2966129 - protein, 24 aa, Entamoeba invadens
SADLLFPLCLYITLKSALPNIDST

SEQ ID NO: 2966130 - protein, 24 aa, Entamoeba invadens
SADQLKLGIIGGVIELHNLEIKKS

SEQ ID NO: 2966131 - protein, 21 aa, Entamoeba invadens
SADVARKVLREIITKSPVQLK

SEQ ID NO: 2966132 - protein, 31 aa, Entamoeba invadens
SADVKVLYYLTAHLFEGCIKLTNLSNTDYLW

SEQ ID NO: 2966133 - protein, 28 aa, Entamoeba invadens
SAEALWREAICLYAAIKSPITVKYEKSD

SEQ ID NO: 2966134 - protein, 24 aa, Entamoeba invadens
SAEDHLRSAVLLGKATLQLLCDNN

SEQ ID NO: 2966135 - protein, 22 aa, Entamoeba invadens
SAELGIEYSNVIGFAEDDLLEV

SEQ ID NO: 2966136 - protein, 25 aa, Entamoeba invadens
SAENYTVPTTVRFPETYSASMYLET

SEQ ID NO: 2966137 - protein, 26 aa, Entamoeba invadens
SAFASKRLDVLSAICGVQTLKKYSIK

SEQ ID NO: 2966138 - protein, 25 aa, Entamoeba invadens
SAFCKIKLYEFFKWTNEKVGCKSLN

SEQ ID NO: 2966139 - protein, 19 aa, Entamoeba invadens
SAFEGCIKLQKVVSPIIVF

SEQ ID NO: 2966140 - protein, 18 aa, Entamoeba invadens
SAFEGCVKLQKVVSPTIV

SEQ ID NO: 2966141 - protein, 17 aa, Entamoeba invadens
SAFEKCGIIKFTIPDTV

SEQ ID NO: 2966142 - protein, 18 aa, Entamoeba invadens
SAFEKCYSLTKVVLSKKL

SEQ ID NO: 2966143 - protein, 19 aa, Entamoeba invadens
SAFENIRSFFAYKEQYYEI

SEQ ID NO: 2966144 - protein, 27 aa, Entamoeba invadens
SAFGECGYFRMSICQPPEIVRGWVEQF

SEQ ID NO: 2966145 - protein, 19 aa, Entamoeba invadens
SAFGTKGHFIGLFDGHGGD

SEQ ID NO: 2966146 - protein, 17 aa, Entamoeba invadens
SAFKFWSKKDRETTVQP

SEQ ID NO: 2966147 - protein, 19 aa, Entamoeba invadens
SAFSCCKRVTSVDMTNVLK

SEQ ID NO: 2966148 - protein, 26 aa, Entamoeba invadens
SAFVPVQCLPSFFSVENNISNTFGRT

SEQ ID NO: 2966149 - protein, 27 aa, Entamoeba invadens
SAFVPVQCLPSFFSVENNISNTFGRTT

SEQ ID NO: 2966150 - protein, 26 aa, Entamoeba invadens
SAFVPVQCLPSFFSVENNVSNTFGKT

SEQ ID NO: 2966151 - protein, 26 aa, Entamoeba invadens
SAFVPVQCLPSFFSVENNVSNTFGRT

SEQ ID NO: 2966152 - protein, 34 aa, Entamoeba invadens
SAFYCCKELKSITFPSALSVLGKQSFEGCKSVSK

SEQ ID NO: 2966153 - protein, 19 aa, Entamoeba invadens
SAFYDFLNNILIWEQEKRI

SEQ ID NO: 2966154 - protein, 21 aa, Entamoeba invadens
SAFYICGFVKTQIASDKETTK

SEQ ID NO: 2966155 - protein, 18 aa, Entamoeba invadens
SAGAYSRIYLVKKKSTGD

SEQ ID NO: 2966156 - protein, 19 aa, Entamoeba invadens
SAGAYSRIYLVKKKSTGDY

SEQ ID NO: 2966157 - protein, 17 aa, Entamoeba invadens
SAGCFCSCSSLKNIDIH

SEQ ID NO: 2966158 - protein, 26 aa, Entamoeba invadens
SAGGKVFNFHGWRVEGVLSVSRSIGD

SEQ ID NO: 2966159 - protein, 19 aa, Entamoeba invadens
SAGGLVLNCVIQVGNAVVY

SEQ ID NO: 2966160 - protein, 27 aa, Entamoeba invadens
SAGHRFSLRTGCGVTWAIDPLPSLTSA

SEQ ID NO: 2966161 - protein, 25 aa, Entamoeba invadens
SAGLGRSGTFLGTLRFYQQYFNSLL

SEQ ID NO: 2966162 - protein, 17 aa, Entamoeba invadens
SAHIRIRIDRECTDNNK

SEQ ID NO: 2966163 - protein, 17 aa, Entamoeba invadens
SAHNFLRHRVVLYECLF

SEQ ID NO: 2966164 - protein, 19 aa, Entamoeba invadens
SAHTGISVAESYKAFTDKF

SEQ ID NO: 2966165 - protein, 19 aa, Entamoeba invadens
SAICCKDKLVFLFKSGNES

SEQ ID NO: 2966166 - protein, 20 aa, Entamoeba invadens
SAIEQCMRGKVIEERDMYEV

SEQ ID NO: 2966167 - protein, 19 aa, Entamoeba invadens
SAIKLLFKYNEMFIEAQAH

SEQ ID NO: 2966168 - protein, 18 aa, Entamoeba invadens
SAILKIVDFRIFKVAVKP

SEQ ID NO: 2966169 - protein, 17 aa, Entamoeba invadens
SAINRLKLATGSPIVIT

SEQ ID NO: 2966170 - protein, 17 aa, Entamoeba invadens
SAIRRCSLCGKYKKEQT

SEQ ID NO: 2966171 - protein, 19 aa, Entamoeba invadens
SAISEVFMVSGAVEGKGKF

SEQ ID NO: 2966172 - protein, 18 aa, Entamoeba invadens
SAITRLKLTKSITKFGDS

SEQ ID NO: 2966173 - protein, 25 aa, Entamoeba invadens
SAIVAKNRCNIILVPTEWSDYQEGG

SEQ ID NO: 2966174 - protein, 25 aa, Entamoeba invadens
SAIVCAVGRRFRLGDWHADPSRKNG

SEQ ID NO: 2966175 - protein, 24 aa, Entamoeba invadens
SAIVGGLYIPPLVMEIGGELNFEC

SEQ ID NO: 2966176 - protein, 19 aa, Entamoeba invadens
SAIYPGCFYDCNFINKVTI

SEQ ID NO: 2966177 - protein, 20 aa, Entamoeba invadens
SAKEGVGITEIFDYVVEEVL

SEQ ID NO: 2966178 - protein, 20 aa, Entamoeba invadens
SAKGGLYLEKFLYLRNEELC

SEQ ID NO: 2966179 - protein, 19 aa, Entamoeba invadens
SAKKFDCFLNIKNGRSSHD

SEQ ID NO: 2966180 - protein, 33 aa, Entamoeba invadens
SAKMMAHISRFCARFLGDYGFSIGISDVTPSLS

SEQ ID NO: 2966181 - protein, 20 aa, Entamoeba invadens
SAKNGIGIVKLMGRDAGFIA

SEQ ID NO: 2966182 - protein, 17 aa, Entamoeba invadens
SAKSFTFKNSFFENVKA

SEQ ID NO: 2966183 - protein, 19 aa, Entamoeba invadens
SAKTNFFIRLVLLTISKII

SEQ ID NO: 2966184 - protein, 21 aa, Entamoeba invadens
SAKYIYQVLIGLEYIHGQGIV

SEQ ID NO: 2966185 - protein, 23 aa, Entamoeba invadens
SALDTRGAVFVEYQKSGESFVDV

SEQ ID NO: 2966186 - protein, 17 aa, Entamoeba invadens
SALEYIHRWQICHRDVK

SEQ ID NO: 2966187 - protein, 25 aa, Entamoeba invadens
SALIPLKYGVERCIMIGDQKQLPST

SEQ ID NO: 2966188 - protein, 17 aa, Entamoeba invadens
SALISGVVHQKDYSNAL

SEQ ID NO: 2966189 - protein, 19 aa, Entamoeba invadens
SALKLLRLYDCKQFSDVAF

SEQ ID NO: 2966190 - protein, 19 aa, Entamoeba invadens
SALNMPQTLSLDFLNKQTQ

SEQ ID NO: 2966191 - protein, 27 aa, Entamoeba invadens
SALPKIRRYDCVFSQQHGGLAMFIFSS

SEQ ID NO: 2966192 - protein, 18 aa, Entamoeba invadens
SALQLFLRQLPTDSTFDI

SEQ ID NO: 2966193 - protein, 19 aa, Entamoeba invadens
SALRKLRIIRSMQEAENTT

SEQ ID NO: 2966194 - protein, 17 aa, Entamoeba invadens
SALSRINPQIVFSTKPK

SEQ ID NO: 2966195 - protein, 20 aa, Entamoeba invadens
SALTSLRTGAVGGLAVDYLA

SEQ ID NO: 2966196 - protein, 25 aa, Entamoeba invadens
SALYKLQMLIVDGVCGARDTYDELL

SEQ ID NO: 2966197 - protein, 24 aa, Entamoeba invadens
SAMCRKQKRSFVVVGGVKESGVDV

SEQ ID NO: 2966198 - protein, 21 aa, Entamoeba invadens
SAMKKELLQRHGLTEKDAKKW

SEQ ID NO: 2966199 - protein, 20 aa, Entamoeba invadens
SAMKKELLQRHGVTDHDVKK

SEQ ID NO: 2966200 - protein, 19 aa, Entamoeba invadens
SAMNWLVSFLKVADRSAYR

SEQ ID NO: 2966201 - protein, 17 aa, Entamoeba invadens
SAMRELTEETGFIGERV

SEQ ID NO: 2966202 - protein, 18 aa, Entamoeba invadens
SAMTIKGILLKATSDVYH

SEQ ID NO: 2966203 - protein, 30 aa, Entamoeba invadens
SANALKILLRICSMFPRVKECVVGDETFRN

SEQ ID NO: 2966204 - protein, 25 aa, Entamoeba invadens
SANAYASCTKIYFDKDYFLRLIVTD

SEQ ID NO: 2966205 - protein, 20 aa, Entamoeba invadens
SANHIKNRFFSHYADDVKGS

SEQ ID NO: 2966206 - protein, 19 aa, Entamoeba invadens
SANILELSLVFSEYFDLLT

SEQ ID NO: 2966207 - protein, 25 aa, Entamoeba invadens
SANNFYCVLSAFGLSCPLNDERSGM

SEQ ID NO: 2966208 - protein, 19 aa, Entamoeba invadens
SANRCLVSGALSFLTECMS

SEQ ID NO: 2966209 - protein, 19 aa, Entamoeba invadens
SANSRYSRYESFAELERGA

SEQ ID NO: 2966210 - protein, 18 aa, Entamoeba invadens
SAPFGDGSVRVAYDGYTD

SEQ ID NO: 2966211 - protein, 22 aa, Entamoeba invadens
SAPGFFNCQGRLLFDELPGTVT

SEQ ID NO: 2966212 - protein, 17 aa, Entamoeba invadens
SAPKASPPPTSWEERLL

SEQ ID NO: 2966213 - protein, 19 aa, Entamoeba invadens
SAPKLVFLTTLRNLKKVLL

SEQ ID NO: 2966214 - protein, 24 aa, Entamoeba invadens
SAPNYCYRCSNDAAIFVIKPDEKK

SEQ ID NO: 2966215 - protein, 27 aa, Entamoeba invadens
SAPNYFCGRYVNLGAYLIIKNGDVKAK

SEQ ID NO: 2966216 - protein, 21 aa, Entamoeba invadens
SAPPCFLLSALYVIDSLIRYL

SEQ ID NO: 2966217 - protein, 19 aa, Entamoeba invadens
SAQDDICWSTDSTHPGFVV

SEQ ID NO: 2966218 - protein, 21 aa, Entamoeba invadens
SAQQAYPGYPQQQPGTAAGQY

SEQ ID NO: 2966219 - protein, 24 aa, Entamoeba invadens
SARFGRKGVAIDFITTEEKETIER

SEQ ID NO: 2966220 - protein, 17 aa, Entamoeba invadens
SARVPLNTFGYIQSKWM

SEQ ID NO: 2966221 - protein, 28 aa, Entamoeba invadens
SASGRLEGFFPLKGMDFVAWNDNVQIIN

SEQ ID NO: 2966222 - protein, 19 aa, Entamoeba invadens
SASHLRNFLGNKWGEGVSL

SEQ ID NO: 2966223 - protein, 18 aa, Entamoeba invadens
SASIVIAYLMKTFRWSYE

SEQ ID NO: 2966224 - protein, 22 aa, Entamoeba invadens
SASKLKSTFTPYVPTPEKKKPK

SEQ ID NO: 2966225 - protein, 25 aa, Entamoeba invadens
SASSLPCAAICLGLDLETTQKMMEA

SEQ ID NO: 2966226 - protein, 18 aa, Entamoeba invadens
SASTDRKALIWDLYPIES

SEQ ID NO: 2966227 - protein, 19 aa, Entamoeba invadens
SASTRFTSYIYPKKITNNT

SEQ ID NO: 2966228 - protein, 18 aa, Entamoeba invadens
SASVIIAYLMKKNKMTYK

SEQ ID NO: 2966229 - protein, 30 aa, Entamoeba invadens
SASVRFKALVLASSIIKKGLINPIQILSAL

SEQ ID NO: 2966230 - protein, 19 aa, Entamoeba invadens
SASYVKILTTWLSTRSDQF

SEQ ID NO: 2966231 - protein, 26 aa, Entamoeba invadens
SATFLKAHSRFTDFIFTLETILDPEI

SEQ ID NO: 2966232 - protein, 19 aa, Entamoeba invadens
SATHMRFEHSLGVAELAQK

SEQ ID NO: 2966233 - protein, 19 aa, Entamoeba invadens
SATKILGWRKNVVKVLDVT

SEQ ID NO: 2966234 - protein, 21 aa, Entamoeba invadens
SATKRSACMLANHTSMCQVFG

SEQ ID NO: 2966235 - protein, 25 aa, Entamoeba invadens
SATLNCFSHYSFIRSAKRLLVADIQ

SEQ ID NO: 2966236 - protein, 18 aa, Entamoeba invadens
SATQHLQTIDSFRFDILE

SEQ ID NO: 2966237 - protein, 26 aa, Entamoeba invadens
SATQLRLLFLLQSWDTVINFSDTALD

SEQ ID NO: 2966238 - protein, 33 aa, Entamoeba invadens
SATRRMFAWREWLYPRRHLYDRVFISDLRDIFI

SEQ ID NO: 2966239 - protein, 24 aa, Entamoeba invadens
SATTRLIPTVPFLANNSANTHIAG

SEQ ID NO: 2966240 - protein, 22 aa, Entamoeba invadens
SATWRQKRVVELTKKLYKLDNF

SEQ ID NO: 2966241 - protein, 22 aa, Entamoeba invadens
SAVCGKHKIAVYVISGNTDVFG

SEQ ID NO: 2966242 - protein, 18 aa, Entamoeba invadens
SAVCLLRPTSANMELLKT

SEQ ID NO: 2966243 - protein, 19 aa, Entamoeba invadens
SAVDAFFNYPLRLSNKKRP

SEQ ID NO: 2966244 - protein, 23 aa, Entamoeba invadens
SAVDFRAEMQIGLKKFLVENKYE

SEQ ID NO: 2966245 - protein, 25 aa, Entamoeba invadens
SAVDKLKGFFGLAVINGTDNAKKAV

SEQ ID NO: 2966246 - protein, 19 aa, Entamoeba invadens
SAVELRKQLEIDKSARVIK

SEQ ID NO: 2966247 - protein, 24 aa, Entamoeba invadens
SAVITCLTLGYSLDGLIAVIENVI

SEQ ID NO: 2966248 - protein, 20 aa, Entamoeba invadens
SAVKYIECSALTQKNLRLVF

SEQ ID NO: 2966249 - protein, 25 aa, Entamoeba invadens
SAVNISRERLNWIVVGESQRKAYKD

SEQ ID NO: 2966250 - protein, 18 aa, Entamoeba invadens
SAVRRFLARNDIVCIVRG

SEQ ID NO: 2966251 - protein, 23 aa, Entamoeba invadens
SAVVSIIPLRPLCIETFEKFPKL

SEQ ID NO: 2966252 - protein, 17 aa, Entamoeba invadens
SAYCFPQKTVVRRRCDN

SEQ ID NO: 2966253 - protein, 18 aa, Entamoeba invadens
SAYGGGKYSYFECSAKTG

SEQ ID NO: 2966254 - protein, 20 aa, Entamoeba invadens
SAYHIPKFVEELVTALYFKD

SEQ ID NO: 2966255 - protein, 22 aa, Entamoeba invadens
SAYKKACKSFATLDNDVTPNTT

SEQ ID NO: 2966256 - protein, 25 aa, Entamoeba invadens
SAYLEYLFRPTGFKEFVGPEDKDKL

SEQ ID NO: 2966257 - protein, 37 aa, Entamoeba invadens
SAYPELRPVLIVVPNILKLQWRMQLCDVLDVSDDDIA

SEQ ID NO: 2966258 - protein, 22 aa, Entamoeba invadens
SCAGYCVATYLLGIGDRHSDNV

SEQ ID NO: 2966259 - protein, 28 aa, Entamoeba invadens
SCDCKKSDCKDCCDCCCDCDCDCCKSKK

SEQ ID NO: 2966260 - protein, 19 aa, Entamoeba invadens
SCDELFPAKVMTSGFDVMN

SEQ ID NO: 2966261 - protein, 17 aa, Entamoeba invadens
SCDFGLYLEDDGNCVEC

SEQ ID NO: 2966262 - protein, 18 aa, Entamoeba invadens
SCDIKCSLCNNGDNCISC

SEQ ID NO: 2966263 - protein, 26 aa, Entamoeba invadens
SCDTCLRSSDCFTCNLTNFKDFEGNC

SEQ ID NO: 2966264 - protein, 20 aa, Entamoeba invadens
SCDVFPGPVSVNYVRQRWED

SEQ ID NO: 2966265 - protein, 21 aa, Entamoeba invadens
SCEFYPAAVPYDIKDSNKVSE

SEQ ID NO: 2966266 - protein, 19 aa, Entamoeba invadens
SCEVVGSFLKLGGKKKPPM

SEQ ID NO: 2966267 - protein, 19 aa, Entamoeba invadens
SCFAACLAVSKVCLPSALK

SEQ ID NO: 2966268 - protein, 19 aa, Entamoeba invadens
SCFAECASLLSVVFTCGCR

SEQ ID NO: 2966269 - protein, 18 aa, Entamoeba invadens
SCFAECYRLNNVSIPSSV

SEQ ID NO: 2966270 - protein, 17 aa, Entamoeba invadens
SCFCFCESLVSIDIPSC

SEQ ID NO: 2966271 - protein, 18 aa, Entamoeba invadens
SCFEGCCSLSEIYIPEGI

SEQ ID NO: 2966272 - protein, 18 aa, Entamoeba invadens
SCFEGCGLVKLVCKAKRF

SEQ ID NO: 2966273 - protein, 19 aa, Entamoeba invadens
SCFEGCGLVKLVCKAKRFG

SEQ ID NO: 2966274 - protein, 19 aa, Entamoeba invadens
SCFHDCRLLSKIILPINIK

SEQ ID NO: 2966275 - protein, 24 aa, Entamoeba invadens
SCFKGCTSICEISCSSSLHFPLSS

SEQ ID NO: 2966276 - protein, 18 aa, Entamoeba invadens
SCFLNVFYLDTVSLQVVS

SEQ ID NO: 2966277 - protein, 17 aa, Entamoeba invadens
SCFQECISLKDITYLGE

SEQ ID NO: 2966278 - protein, 18 aa, Entamoeba invadens
SCFSECRSLSSVTIPTNV

SEQ ID NO: 2966279 - protein, 21 aa, Entamoeba invadens
SCFSGCKALHSVLLPKKMKEV

SEQ ID NO: 2966280 - protein, 18 aa, Entamoeba invadens
SCFSHCKLHDLVFPNEVV

SEQ ID NO: 2966281 - protein, 18 aa, Entamoeba invadens
SCFSKCYSLEFVVLPSLL

SEQ ID NO: 2966282 - protein, 19 aa, Entamoeba invadens
SCFSSCYFLTSIDFKSPFQ

SEQ ID NO: 2966283 - protein, 17 aa, Entamoeba invadens
SCFSSWNISMTNFVLSS

SEQ ID NO: 2966284 - protein, 18 aa, Entamoeba invadens
SCFSYCRSLSSVTIPQKV

SEQ ID NO: 2966285 - protein, 19 aa, Entamoeba invadens
SCFTSCERLSNIVIPSSVK

SEQ ID NO: 2966286 - protein, 17 aa, Entamoeba invadens
SCFYGCSNLSNIKIPSS

SEQ ID NO: 2966287 - protein, 19 aa, Entamoeba invadens
SCFYLLLNARARFKGDLGE

SEQ ID NO: 2966288 - protein, 33 aa, Entamoeba invadens
SCGAPAKMKSQFYVTYWMLLNWLTSGSDDVSEK

SEQ ID NO: 2966289 - protein, 23 aa, Entamoeba invadens
SCGHACLCYCCAQKLEVQPQCPY

SEQ ID NO: 2966290 - protein, 22 aa, Entamoeba invadens
SCGKNRRRALLKYAKENGYTSI

SEQ ID NO: 2966291 - protein, 20 aa, Entamoeba invadens
SCGLGNFNRLNFERSQIQTY

SEQ ID NO: 2966292 - protein, 18 aa, Entamoeba invadens
SCHIESISFLNIYCKVEI

SEQ ID NO: 2966293 - protein, 18 aa, Entamoeba invadens
SCHLRLLNYGFHFDNIEF

SEQ ID NO: 2966294 - protein, 31 aa, Entamoeba invadens
SCIDGRLTSAWNWCSMIEKYLFYPLFLTSDF

SEQ ID NO: 2966295 - protein, 25 aa, Entamoeba invadens
SCIDGRLTSSWNWCSMIEKYIYYPL

SEQ ID NO: 2966296 - protein, 21 aa, Entamoeba invadens
SCILQCKHIHFINSYGPLKTL

SEQ ID NO: 2966297 - protein, 17 aa, Entamoeba invadens
SCIPDVFIVPFRRVSNI

SEQ ID NO: 2966298 - protein, 26 aa, Entamoeba invadens
SCITLPKGFYSWFFRVDKRALYSVLV

SEQ ID NO: 2966299 - protein, 20 aa, Entamoeba invadens
SCITNKRCGNFTLLETLKNM

SEQ ID NO: 2966300 - protein, 24 aa, Entamoeba invadens
SCKCTAISVFAFFKCNALSSIEVP

SEQ ID NO: 2966301 - protein, 25 aa, Entamoeba invadens
SCKEICDFAFYRCLSLIKIGIPKSV

SEQ ID NO: 2966302 - protein, 20 aa, Entamoeba invadens
SCKNLNKFTLPKSVKTLKLE

SEQ ID NO: 2966303 - protein, 18 aa, Entamoeba invadens
SCKNVIAPFTHFFVCNLC

SEQ ID NO: 2966304 - protein, 29 aa, Entamoeba invadens
SCKRCYGDGICLCANCFDPSQHIGHSYTR

SEQ ID NO: 2966305 - protein, 20 aa, Entamoeba invadens
SCKYIPCIYVVNKIDQMNKE

SEQ ID NO: 2966306 - protein, 22 aa, Entamoeba invadens
SCLHCRICGVYLHSECKDALQN

SEQ ID NO: 2966307 - protein, 17 aa, Entamoeba invadens
SCLMFAHNELFSYNLPV

SEQ ID NO: 2966308 - protein, 19 aa, Entamoeba invadens
SCLSITISHLNFLTICLSQ

SEQ ID NO: 2966309 - protein, 24 aa, Entamoeba invadens
SCMKFCMNGGLIIGTWDGANIEIA

SEQ ID NO: 2966310 - protein, 17 aa, Entamoeba invadens
SCNAMLCLGCNRNYILK

SEQ ID NO: 2966311 - protein, 26 aa, Entamoeba invadens
SCNFIPKQRICKFYQTGNCRYGENCK

SEQ ID NO: 2966312 - protein, 20 aa, Entamoeba invadens
SCNLLIDLALFYGEQDEITF

SEQ ID NO: 2966313 - protein, 31 aa, Entamoeba invadens
SCNLTKICDFAFCGCKSIERLCFPTKVQSIG

SEQ ID NO: 2966314 - protein, 26 aa, Entamoeba invadens
SCNPLVEFPVCLSKCVSLKSLNVSDC

SEQ ID NO: 2966315 - protein, 27 aa, Entamoeba invadens
SCNPLVEFPVCLSRCVSLKTLNVSDCH

SEQ ID NO: 2966316 - protein, 27 aa, Entamoeba invadens
SCPLAKTSEVFSRFPPRSVDVSELVSL

SEQ ID NO: 2966317 - protein, 27 aa, Entamoeba invadens
SCQALKYKSLIPYREGNTFANDLITQE

SEQ ID NO: 2966318 - protein, 17 aa, Entamoeba invadens
SCQHFVCGTKCGHFICD

SEQ ID NO: 2966319 - protein, 23 aa, Entamoeba invadens
SCQIPKIKSLIVKMFNANVVVPQ

SEQ ID NO: 2966320 - protein, 19 aa, Entamoeba invadens
SCQIRNLEIFLGSTQEVVW

SEQ ID NO: 2966321 - protein, 31 aa, Entamoeba invadens
SCRDARAAICEVLKCVVKLVVPPEDDSKRMY

SEQ ID NO: 2966322 - protein, 17 aa, Entamoeba invadens
SCRELRRTLPEPVKKRR

SEQ ID NO: 2966323 - protein, 25 aa, Entamoeba invadens
SCRIEVENLFGWLVTTFKMMRNVWK

SEQ ID NO: 2966324 - protein, 25 aa, Entamoeba invadens
SCRILLKTCGKGLLSKKVNVSQFIG

SEQ ID NO: 2966325 - protein, 20 aa, Entamoeba invadens
SCRNVFCAECQKIISEVNNT

SEQ ID NO: 2966326 - protein, 26 aa, Entamoeba invadens
SCRQDYKVTVFLSRSCDGDVPKEVAQ

SEQ ID NO: 2966327 - protein, 17 aa, Entamoeba invadens
SCRRKTYRWNIRVLYDM

SEQ ID NO: 2966328 - protein, 25 aa, Entamoeba invadens
SCRTYLEKHFETFKTLDKNQLVKQA

SEQ ID NO: 2966329 - protein, 36 aa, Entamoeba invadens
SCSFSTSIRVLYGFRKVWPCPTVILFNPDSFRNFII

SEQ ID NO: 2966330 - protein, 17 aa, Entamoeba invadens
SCSKGRKVIEIGVSSNQ

SEQ ID NO: 2966331 - protein, 20 aa, Entamoeba invadens
SCSNPGVMVTSKFVHTSINK

SEQ ID NO: 2966332 - protein, 17 aa, Entamoeba invadens
SCSRDGVLVKLQIEQGV

SEQ ID NO: 2966333 - protein, 22 aa, Entamoeba invadens
SCSSLKNIDIHSGITLIEENAF

SEQ ID NO: 2966334 - protein, 22 aa, Entamoeba invadens
SCTVGGTKLIFEKDVRNANVQQ

SEQ ID NO: 2966335 - protein, 20 aa, Entamoeba invadens
SCTVVIYIVGCLYVDKFGEG

SEQ ID NO: 2966336 - protein, 17 aa, Entamoeba invadens
SCVDYALRCKFPTYHIS

SEQ ID NO: 2966337 - protein, 22 aa, Entamoeba invadens
SCVGIWQNDRVEIIANDQGNRT

SEQ ID NO: 2966338 - protein, 20 aa, Entamoeba invadens
SCVIIKYIDFALCSIEGFCG

SEQ ID NO: 2966339 - protein, 24 aa, Entamoeba invadens
SCVNAISGIISFAGYQLDRPKVFP

SEQ ID NO: 2966340 - protein, 21 aa, Entamoeba invadens
SCVTSIKFIAPLGALITSSLD

SEQ ID NO: 2966341 - protein, 18 aa, Entamoeba invadens
SCVYVGKCSVEFPQNTEL

SEQ ID NO: 2966342 - protein, 23 aa, Entamoeba invadens
SCYHRPNVLCLITKRAIADCGID

SEQ ID NO: 2966343 - protein, 18 aa, Entamoeba invadens
SCYNEGVYDFTVELPPHR

SEQ ID NO: 2966344 - protein, 20 aa, Entamoeba invadens
SCYPSEGSPLFMAKTKRNWL

SEQ ID NO: 2966345 - protein, 25 aa, Entamoeba invadens
SCYVRSVIFIDEIDSLLSARSETEH

SEQ ID NO: 2966346 - protein, 20 aa, Entamoeba invadens
SDAALIKIICKLFQEIIRKP

SEQ ID NO: 2966347 - protein, 30 aa, Entamoeba invadens
SDAELPPTHPIRLGLALNFSVFYYEIMNEA

SEQ ID NO: 2966348 - protein, 23 aa, Entamoeba invadens
SDAEMKFVVGVSGNEMRKKEFEW

SEQ ID NO: 2966349 - protein, 25 aa, Entamoeba invadens
SDAERCYSCLSVGNVFGERCPVTAS

SEQ ID NO: 2966350 - protein, 25 aa, Entamoeba invadens
SDAERCYSCLSVSNVFGERCPVTAS

SEQ ID NO: 2966351 - protein, 28 aa, Entamoeba invadens
SDAFKVTVCRKCGLMGYCGYCKYCQSSL

SEQ ID NO: 2966352 - protein, 18 aa, Entamoeba invadens
SDAIKHLTDRLVALEQLV

SEQ ID NO: 2966353 - protein, 25 aa, Entamoeba invadens
SDANETRVAWKFAVQHKTGPTLLIF

SEQ ID NO: 2966354 - protein, 18 aa, Entamoeba invadens
SDAPLCVVDANTISSSAI

SEQ ID NO: 2966355 - protein, 19 aa, Entamoeba invadens
SDAYFKEILSTLPDEEESE

SEQ ID NO: 2966356 - protein, 21 aa, Entamoeba invadens
SDCCFCRCSSLKSLSIPSSVI

SEQ ID NO: 2966357 - protein, 26 aa, Entamoeba invadens
SDCGFIKKVYVCTGVANVELPCVCNI

SEQ ID NO: 2966358 - protein, 20 aa, Entamoeba invadens
SDCRLRQALREEGDHREQTG

SEQ ID NO: 2966359 - protein, 20 aa, Entamoeba invadens
SDCRNVFNVQSAFGVTCDSK

SEQ ID NO: 2966360 - protein, 20 aa, Entamoeba invadens
SDCSESCYLPCVSLEEATTL

SEQ ID NO: 2966361 - protein, 21 aa, Entamoeba invadens
SDCSKDFWDFMDLIAEKIELK

SEQ ID NO: 2966362 - protein, 18 aa, Entamoeba invadens
SDCYGRVAPRSSLTLKNG

SEQ ID NO: 2966363 - protein, 20 aa, Entamoeba invadens
SDDRWTLKFCSVTKLEVPED

SEQ ID NO: 2966364 - protein, 22 aa, Entamoeba invadens
SDDVKIEFGCFEGCTSLTKLKI

SEQ ID NO: 2966365 - protein, 21 aa, Entamoeba invadens
SDEAFPWCFDAATSISPTGRF

SEQ ID NO: 2966366 - protein, 19 aa, Entamoeba invadens
SDEDFLMLFEVGFEEFKGW

SEQ ID NO: 2966367 - protein, 18 aa, Entamoeba invadens
SDEELKMNTFRKAQIRDE

SEQ ID NO: 2966368 - protein, 24 aa, Entamoeba invadens
SDEEVFDALKVCDTYKAKQAKTNP

SEQ ID NO: 2966369 - protein, 25 aa, Entamoeba invadens
SDEFPKWMEEFPIFIHISEEENHMT

SEQ ID NO: 2966370 - protein, 20 aa, Entamoeba invadens
SDEICSYAFNYKRGISGMNI

SEQ ID NO: 2966371 - protein, 24 aa, Entamoeba invadens
SDEIKRVWEKFVSWYCARHQERRL

SEQ ID NO: 2966372 - protein, 24 aa, Entamoeba invadens
SDEKSVVVNPFFICEMNKHKVVKI

SEQ ID NO: 2966373 - protein, 24 aa, Entamoeba invadens
SDEKVGPVDAIFVCDRSGSMYGKG

SEQ ID NO: 2966374 - protein, 19 aa, Entamoeba invadens
SDELFAFGVDGFDIGIKKN

SEQ ID NO: 2966375 - protein, 20 aa, Entamoeba invadens
SDESWIEWFCGLDGNQYLCE

SEQ ID NO: 2966376 - protein, 20 aa, Entamoeba invadens
SDETAFFEIISQIKKTNGRI

SEQ ID NO: 2966377 - protein, 19 aa, Entamoeba invadens
SDETLLLILDRGFDPYTPF

SEQ ID NO: 2966378 - protein, 24 aa, Entamoeba invadens
SDEVFNAYISFVVHKNRKVEWDED

SEQ ID NO: 2966379 - protein, 27 aa, Entamoeba invadens
SDEVLSRVSWVGVFPLYGDKKNNYITY

SEQ ID NO: 2966380 - protein, 26 aa, Entamoeba invadens
SDEVVMKLRIKFLLDGAKGIQYLHEN

SEQ ID NO: 2966381 - protein, 26 aa, Entamoeba invadens
SDEVVMKLRLKFMIDAAKGISYLHEN

SEQ ID NO: 2966382 - protein, 25 aa, Entamoeba invadens
SDFEFKCTVSFPRFAPETPQLKRKE

SEQ ID NO: 2966383 - protein, 24 aa, Entamoeba invadens
SDFELSCRNAIIMVYKEVTLLGCW

SEQ ID NO: 2966384 - protein, 20 aa, Entamoeba invadens
SDFKLKWNWLNLLGDEAYIV

SEQ ID NO: 2966385 - protein, 20 aa, Entamoeba invadens
SDFKRVCFDHSHSFQHDELV

SEQ ID NO: 2966386 - protein, 30 aa, Entamoeba invadens
SDFKSYKGIHSIPQFHNFQAVIGPNGAGKS

SEQ ID NO: 2966387 - protein, 29 aa, Entamoeba invadens
SDFLKCKAEILSIFLFYIQLQFFNTTLCT

SEQ ID NO: 2966388 - protein, 20 aa, Entamoeba invadens
SDFLPFDFSHFEIASINAVP

SEQ ID NO: 2966389 - protein, 25 aa, Entamoeba invadens
SDFMFKSDILMYLGKLFEAGAKGPH

SEQ ID NO: 2966390 - protein, 17 aa, Entamoeba invadens
SDFPFYKQFFYKNLKVH

SEQ ID NO: 2966391 - protein, 24 aa, Entamoeba invadens
SDFSCTKFYIQTVFLYTNENKERV

SEQ ID NO: 2966392 - protein, 23 aa, Entamoeba invadens
SDGAFKPEFFDFNMPELKEQRLK

SEQ ID NO: 2966393 - protein, 19 aa, Entamoeba invadens
SDGCFCKCSSLTSVTISLN

SEQ ID NO: 2966394 - protein, 23 aa, Entamoeba invadens
SDGDFVYIDFLDLFLKDFETTEV

SEQ ID NO: 2966395 - protein, 19 aa, Entamoeba invadens
SDGFIFIIGCNSLRYLYLN

SEQ ID NO: 2966396 - protein, 19 aa, Entamoeba invadens
SDGLIPSALYQQFVSAGNT

SEQ ID NO: 2966397 - protein, 23 aa, Entamoeba invadens
SDGLKNLLSLCLKKEAKKRCSIS

SEQ ID NO: 2966398 - protein, 20 aa, Entamoeba invadens
SDGLPIKKSSLFNTSECVTI

SEQ ID NO: 2966399 - protein, 21 aa, Entamoeba invadens
SDGRVTYPLVLIYYSPTGINP

SEQ ID NO: 2966400 - protein, 32 aa, Entamoeba invadens
SDHLKVSSWMYAPVCALFHFSSIHSPTCRFAH

SEQ ID NO: 2966401 - protein, 23 aa, Entamoeba invadens
SDHLPVRCTTLLKPRFVNEKLMK

SEQ ID NO: 2966402 - protein, 18 aa, Entamoeba invadens
SDIAGFAAYIVRHNNYEK

SEQ ID NO: 2966403 - protein, 19 aa, Entamoeba invadens
SDIALIFLFLYSTKVRPSA

SEQ ID NO: 2966404 - protein, 29 aa, Entamoeba invadens
SDIAVTFKDGFGGRVLAPIAMFARCGLPT

SEQ ID NO: 2966405 - protein, 23 aa, Entamoeba invadens
SDIEMYSEIPITINSIDIVNNID

SEQ ID NO: 2966406 - protein, 24 aa, Entamoeba invadens
SDIFGRQLINMGFIKVVDKLLDST

SEQ ID NO: 2966407 - protein, 18 aa, Entamoeba invadens
SDIGIYIIMDLVKKKIKE

SEQ ID NO: 2966408 - protein, 25 aa, Entamoeba invadens
SDIKEMLNCIILNLFMEGKTTREDY

SEQ ID NO: 2966409 - protein, 26 aa, Entamoeba invadens
SDIKEMLNCILLNLFMEGQTTREDYL

SEQ ID NO: 2966410 - protein, 25 aa, Entamoeba invadens
SDIKKTLLEFVQFKNKFVSFSNDDY

SEQ ID NO: 2966411 - protein, 29 aa, Entamoeba invadens
SDIKLRMMLGNNSSVEWWKTHVLSQLSSS

SEQ ID NO: 2966412 - protein, 39 aa, Entamoeba invadens
SDIKSWLSCLAEIFKANVVAWEYPGYTVGSSYSDTKTAS

SEQ ID NO: 2966413 - protein, 19 aa, Entamoeba invadens
SDILRFFEGQVLDNSLKEF

SEQ ID NO: 2966414 - protein, 23 aa, Entamoeba invadens
SDIMKEAIVVRIFQVLSEEGEVD

SEQ ID NO: 2966415 - protein, 23 aa, Entamoeba invadens
SDINSPAVRCERFEAQIQVVDQR

SEQ ID NO: 2966416 - protein, 17 aa, Entamoeba invadens
SDIQVLFEFIIQLKEVL

SEQ ID NO: 2966417 - protein, 17 aa, Entamoeba invadens
SDISIPLKLDWKDTPLP

SEQ ID NO: 2966418 - protein, 20 aa, Entamoeba invadens
SDIWSIGILIYVLFSNKFPM

SEQ ID NO: 2966419 - protein, 20 aa, Entamoeba invadens
SDIYLFDKVYCVGRHYQDCL

SEQ ID NO: 2966420 - protein, 32 aa, Entamoeba invadens
SDKDMKGRIFATLQLVELMLDFCATEHYKLGM

SEQ ID NO: 2966421 - protein, 23 aa, Entamoeba invadens
SDKEEKCNLCFMTTTNSPLNEFD

SEQ ID NO: 2966422 - protein, 24 aa, Entamoeba invadens
SDKGPWSKPICCVTGSATAFCLVK

SEQ ID NO: 2966423 - protein, 17 aa, Entamoeba invadens
SDKGYGIGDSRVNYGDE

SEQ ID NO: 2966424 - protein, 34 aa, Entamoeba invadens
SDKHKAILIRIIPNLSFEIIEVMKVFNDKEQLSC

SEQ ID NO: 2966425 - protein, 17 aa, Entamoeba invadens
SDKKIILGLKKLVKNVC

SEQ ID NO: 2966426 - protein, 19 aa, Entamoeba invadens
SDKKMMSRSEFVWTQQQLK

SEQ ID NO: 2966427 - protein, 21 aa, Entamoeba invadens
SDKKRYGFQFKYGKHSQKLLT

SEQ ID NO: 2966428 - protein, 22 aa, Entamoeba invadens
SDKKRYGFQFKYGKHTQKLLAE

SEQ ID NO: 2966429 - protein, 22 aa, Entamoeba invadens
SDKRECAVCKPGKYPNDSNKVC

SEQ ID NO: 2966430 - protein, 23 aa, Entamoeba invadens
SDKSHIVTMVYRKNHTVNESRST

SEQ ID NO: 2966431 - protein, 19 aa, Entamoeba invadens
SDKVIPISIVNDIFEGFED

SEQ ID NO: 2966432 - protein, 19 aa, Entamoeba invadens
SDKYVPGYFHYVYDYQMSY

SEQ ID NO: 2966433 - protein, 23 aa, Entamoeba invadens
SDLCSPSNCPIMTAGPSMEYLWS

SEQ ID NO: 2966434 - protein, 17 aa, Entamoeba invadens
SDLEILFSYEVTNPDDI

SEQ ID NO: 2966435 - protein, 19 aa, Entamoeba invadens
SDLEKIYAFNKGFCESLKK

SEQ ID NO: 2966436 - protein, 22 aa, Entamoeba invadens
SDLEKRCWFKVNSIKTVPLSNP

SEQ ID NO: 2966437 - protein, 19 aa, Entamoeba invadens
SDLFGKCNVILKKKKEQQN

SEQ ID NO: 2966438 - protein, 18 aa, Entamoeba invadens
SDLKCNFPPNSAEKAFSY

SEQ ID NO: 2966439 - protein, 18 aa, Entamoeba invadens
SDLKEVVFEMDIIHFEIG

SEQ ID NO: 2966440 - protein, 17 aa, Entamoeba invadens
SDLKEWKSLETLYVTRC

SEQ ID NO: 2966441 - protein, 21 aa, Entamoeba invadens
SDLKPYVKYLMPAVEISGLLV

SEQ ID NO: 2966442 - protein, 17 aa, Entamoeba invadens
SDLKRILEQAKHAPVQV

SEQ ID NO: 2966443 - protein, 23 aa, Entamoeba invadens
SDLKRLDLSFVEQFRMGSIPKIT

SEQ ID NO: 2966444 - protein, 17 aa, Entamoeba invadens
SDLKRLDLSHVKVLEQQ

SEQ ID NO: 2966445 - protein, 17 aa, Entamoeba invadens
SDLLDWGLPKGVDKDSY

SEQ ID NO: 2966446 - protein, 18 aa, Entamoeba invadens
SDLLNEFGVISISTQTCG

SEQ ID NO: 2966447 - protein, 19 aa, Entamoeba invadens
SDLLSEYHPDIILDPRYNI

SEQ ID NO: 2966448 - protein, 20 aa, Entamoeba invadens
SDLLVPFVTVFLSEYIAVDT

SEQ ID NO: 2966449 - protein, 22 aa, Entamoeba invadens
SDLMTFKGVILGITRYGISKMK

SEQ ID NO: 2966450 - protein, 21 aa, Entamoeba invadens
SDLNCFAVRCEQFVAQIKIVD

SEQ ID NO: 2966451 - protein, 21 aa, Entamoeba invadens
SDLNIYWPLTNQHLNNFKYLM

SEQ ID NO: 2966452 - protein, 22 aa, Entamoeba invadens
SDLPIVVECAIQYFSANPDALT

SEQ ID NO: 2966453 - protein, 17 aa, Entamoeba invadens
SDLPQYNLGTFFSAFPE

SEQ ID NO: 2966454 - protein, 25 aa, Entamoeba invadens
SDLQIKAEMCQRVITNNVFGLLKKL

SEQ ID NO: 2966455 - protein, 19 aa, Entamoeba invadens
SDLQKCIFVGESIPLEKYG

SEQ ID NO: 2966456 - protein, 21 aa, Entamoeba invadens
SDLQTIILIFFILKKLADITI

SEQ ID NO: 2966457 - protein, 20 aa, Entamoeba invadens
SDLRDIFIFGDIFATFSQND

SEQ ID NO: 2966458 - protein, 25 aa, Entamoeba invadens
SDLREGRKTIIVWTALEDGILESSD

SEQ ID NO: 2966459 - protein, 24 aa, Entamoeba invadens
SDLRKVELGTFVGYKVRFDDMTSP

SEQ ID NO: 2966460 - protein, 22 aa, Entamoeba invadens
SDLSRLNRGYIIGVGDVDVLKI

SEQ ID NO: 2966461 - protein, 20 aa, Entamoeba invadens
SDLWSIGCVVYYMVTGSLIF

SEQ ID NO: 2966462 - protein, 25 aa, Entamoeba invadens
SDLYATVYLLYCCIINNHGEFDEND

SEQ ID NO: 2966463 - protein, 31 aa, Entamoeba invadens
SDLYSIGVCLFRLCTCQFPFGSTEAEFVRFM

SEQ ID NO: 2966464 - protein, 20 aa, Entamoeba invadens
SDLYSLGVILYRMATLEFPF

SEQ ID NO: 2966465 - protein, 20 aa, Entamoeba invadens
SDLYSLGVVLYFLLNGNYPF

SEQ ID NO: 2966466 - protein, 18 aa, Entamoeba invadens
SDLYSVGVILYVMATAQF

SEQ ID NO: 2966467 - protein, 21 aa, Entamoeba invadens
SDMFRRIKLYEMLMWSNSEKE

SEQ ID NO: 2966468 - protein, 31 aa, Entamoeba invadens
SDMFSPSFVCAEAFGAFSLVDENVYTTVIEK

SEQ ID NO: 2966469 - protein, 19 aa, Entamoeba invadens
SDMHLIDYSLLVGVHQLSD

SEQ ID NO: 2966470 - protein, 20 aa, Entamoeba invadens
SDMLAVQLIELFDRINKHSG

SEQ ID NO: 2966471 - protein, 17 aa, Entamoeba invadens
SDMMVIGVVNFLVTNYQ

SEQ ID NO: 2966472 - protein, 22 aa, Entamoeba invadens
SDMPRFASLVVDGMTGSECGTL

SEQ ID NO: 2966473 - protein, 26 aa, Entamoeba invadens
SDMYYLQNMIKQYFQFYYDDDTIVRE

SEQ ID NO: 2966474 - protein, 20 aa, Entamoeba invadens
SDNEFRLFEKKGLEVNELHM

SEQ ID NO: 2966475 - protein, 24 aa, Entamoeba invadens
SDNEICSGLEFLSTLKELVELDLS

SEQ ID NO: 2966476 - protein, 24 aa, Entamoeba invadens
SDNIKTLMVRWFYIIHNDINLNQF

SEQ ID NO: 2966477 - protein, 20 aa, Entamoeba invadens
SDNIRTVMSEVAFENMNVSD

SEQ ID NO: 2966478 - protein, 20 aa, Entamoeba invadens
SDNKYSIWFYGETAGVSTKE

SEQ ID NO: 2966479 - protein, 23 aa, Entamoeba invadens
SDNLKTPILFLFTEMSVSIQSDP

SEQ ID NO: 2966480 - protein, 56 aa, Entamoeba invadens
SDNRWILVIHPEYGIGYVPLLYVTCDKSFLTMEIHKFAVALYDFEGESRFHLSAQV

SEQ ID NO: 2966481 - protein, 18 aa, Entamoeba invadens
SDNVIRFGLTKKFCDLEA

SEQ ID NO: 2966482 - protein, 22 aa, Entamoeba invadens
SDPLPPRLFRKYLAYAKANVHP

SEQ ID NO: 2966483 - protein, 21 aa, Entamoeba invadens
SDPLWSLYLQFFIDHNVLVHG

SEQ ID NO: 2966484 - protein, 28 aa, Entamoeba invadens
SDPRLDHFFPVEHWPVVFIHHEGKESVG

SEQ ID NO: 2966485 - protein, 22 aa, Entamoeba invadens
SDPRYRKVSVGFVVYNTKEAAD

SEQ ID NO: 2966486 - protein, 25 aa, Entamoeba invadens
SDPSELLLGFSKLTSLKCRMIPQNT

SEQ ID NO: 2966487 - protein, 19 aa, Entamoeba invadens
SDPSRLATYCDMFVNSVPQ

SEQ ID NO: 2966488 - protein, 32 aa, Entamoeba invadens
SDQFLLARLEIKWILSVCDVVPFYQRKYRYKT

SEQ ID NO: 2966489 - protein, 27 aa, Entamoeba invadens
SDQKVSGKLRKTVCVRNIGNLDEQKLI

SEQ ID NO: 2966490 - protein, 20 aa, Entamoeba invadens
SDQTPFFLISYLMATVPLSF

SEQ ID NO: 2966491 - protein, 20 aa, Entamoeba invadens
SDRCLVSVVVTVLYELDQQL

SEQ ID NO: 2966492 - protein, 17 aa, Entamoeba invadens
SDREIFELVTMGNKENS

SEQ ID NO: 2966493 - protein, 17 aa, Entamoeba invadens
SDRGRDYYVREFKNAVV

SEQ ID NO: 2966494 - protein, 23 aa, Entamoeba invadens
SDRKEMYTNILLVGGNTLFQGFK

SEQ ID NO: 2966495 - protein, 30 aa, Entamoeba invadens
SDRKMDIEWLIHFFDVLKRNALTKFNTFID

SEQ ID NO: 2966496 - protein, 19 aa, Entamoeba invadens
SDRRVRKGLFYRGVDDDFR

SEQ ID NO: 2966497 - protein, 22 aa, Entamoeba invadens
SDRSEKTFFPKLFTLERRKTVF

SEQ ID NO: 2966498 - protein, 21 aa, Entamoeba invadens
SDSDIRFAFNRCNMRIDNETR

SEQ ID NO: 2966499 - protein, 26 aa, Entamoeba invadens
SDSILSFKLFNCRFGIREPFGADFLN

SEQ ID NO: 2966500 - protein, 25 aa, Entamoeba invadens
SDSKIKFFFYKALPTRRKVVEVRAM

SEQ ID NO: 2966501 - protein, 35 aa, Entamoeba invadens
SDSKSVVFCGCFPRRHFENFIKICNVFNVQEKSVD

SEQ ID NO: 2966502 - protein, 21 aa, Entamoeba invadens
SDSLFRSCVNLHKIKIPQKVK

SEQ ID NO: 2966503 - protein, 20 aa, Entamoeba invadens
SDSPENWVFCVITETENIEK

SEQ ID NO: 2966504 - protein, 17 aa, Entamoeba invadens
SDSPRFQKIETFQNIPT

SEQ ID NO: 2966505 - protein, 19 aa, Entamoeba invadens
SDSSTLRFVPFPPNVHRLG

SEQ ID NO: 2966506 - protein, 17 aa, Entamoeba invadens
SDTEIDFNWSIKNTENV

SEQ ID NO: 2966507 - protein, 22 aa, Entamoeba invadens
SDTFLQVNPWRIFSGSCPPKRL

SEQ ID NO: 2966508 - protein, 21 aa, Entamoeba invadens
SDTGYTKYYLVTNRIGFSLSC

SEQ ID NO: 2966509 - protein, 17 aa, Entamoeba invadens
SDTIKMMLEKKMYRDVL

SEQ ID NO: 2966510 - protein, 24 aa, Entamoeba invadens
SDTKCLSCKSGFYQGDNYTCLSST

SEQ ID NO: 2966511 - protein, 20 aa, Entamoeba invadens
SDTKRLSCILSLEENITNSL

SEQ ID NO: 2966512 - protein, 20 aa, Entamoeba invadens
SDTLKIGICSTISRERIGNE

SEQ ID NO: 2966513 - protein, 23 aa, Entamoeba invadens
SDTNCFAELLGSGSYGKVLKGKY

SEQ ID NO: 2966514 - protein, 19 aa, Entamoeba invadens
SDTNMTFSISFKTPPTDDS

SEQ ID NO: 2966515 - protein, 25 aa, Entamoeba invadens
SDTQIGFDTSFAFKNDFGNDSFDFG

SEQ ID NO: 2966516 - protein, 24 aa, Entamoeba invadens
SDTSCGYCDCGIFKNGCTNNCLTH

SEQ ID NO: 2966517 - protein, 20 aa, Entamoeba invadens
SDTSIPYVINYVSATTKLTK

SEQ ID NO: 2966518 - protein, 30 aa, Entamoeba invadens
SDTTAVCAICGKDGADRICFVCHKPFHNKC

SEQ ID NO: 2966519 - protein, 18 aa, Entamoeba invadens
SDVAIPVFYFSRLSHSEA

SEQ ID NO: 2966520 - protein, 23 aa, Entamoeba invadens
SDVDSSEGIDCINQLRKGKTESH

SEQ ID NO: 2966521 - protein, 18 aa, Entamoeba invadens
SDVFKKKVVIPFFQWKEI

SEQ ID NO: 2966522 - protein, 23 aa, Entamoeba invadens
SDVFSLGCVLVYLFTENALFDVS

SEQ ID NO: 2966523 - protein, 19 aa, Entamoeba invadens
SDVIDYFKRIGETYKEMKF

SEQ ID NO: 2966524 - protein, 22 aa, Entamoeba invadens
SDVIRKKYEILLGENIGEEGEN

SEQ ID NO: 2966525 - protein, 21 aa, Entamoeba invadens
SDVKASEILNFIVKNSDLLND

SEQ ID NO: 2966526 - protein, 24 aa, Entamoeba invadens
SDVKKASNVLVLFSVDNRDSLSVA

SEQ ID NO: 2966527 - protein, 19 aa, Entamoeba invadens
SDVLAWYGAACLGALGSTV

SEQ ID NO: 2966528 - protein, 19 aa, Entamoeba invadens
SDVLVWLSILPLQYFADGC

SEQ ID NO: 2966529 - protein, 19 aa, Entamoeba invadens
SDVMLHFRSTVFSTEGTAV

SEQ ID NO: 2966530 - protein, 19 aa, Entamoeba invadens
SDVPVFFFYQVGFYGRDFF

SEQ ID NO: 2966531 - protein, 20 aa, Entamoeba invadens
SDVRELFEWNVASLDAQPLL

SEQ ID NO: 2966532 - protein, 21 aa, Entamoeba invadens
SDVRHEIACFFSRENNMSSFS

SEQ ID NO: 2966533 - protein, 19 aa, Entamoeba invadens
SDVTSLGYNCFSYCKTLKK

SEQ ID NO: 2966534 - protein, 17 aa, Entamoeba invadens
SDVVFSLIGDSPVYILS

SEQ ID NO: 2966535 - protein, 25 aa, Entamoeba invadens
SDWEALKLLERMIALIDLRIEPSEY

SEQ ID NO: 2966536 - protein, 22 aa, Entamoeba invadens
SDWLQKRNLSFSIAYRRIIDLI

SEQ ID NO: 2966537 - protein, 23 aa, Entamoeba invadens
SDWLQKRNLSFSIAYRRIIDLII

SEQ ID NO: 2966538 - protein, 25 aa, Entamoeba invadens
SDWLQSVDLEFLVALQRIFDLIKHL

SEQ ID NO: 2966539 - protein, 17 aa, Entamoeba invadens
SDWPLYQLYDQFSGGMW

SEQ ID NO: 2966540 - protein, 30 aa, Entamoeba invadens
SDYKIEILETFPAYYYRAVYYGKNDCNITT

SEQ ID NO: 2966541 - protein, 19 aa, Entamoeba invadens
SDYTWRLLKPAPLPHPPPG

SEQ ID NO: 2966542 - protein, 20 aa, Entamoeba invadens
SEAAVGCKGGCLDNMSASLK

SEQ ID NO: 2966543 - protein, 20 aa, Entamoeba invadens
SEADAVLEFVRNMSPKPKED

SEQ ID NO: 2966544 - protein, 18 aa, Entamoeba invadens
SEAFTKCMDFMRQWTSLE

SEQ ID NO: 2966545 - protein, 21 aa, Entamoeba invadens
SEAHRFVPFFRVIVLHRALSS

SEQ ID NO: 2966546 - protein, 33 aa, Entamoeba invadens
SEAIACAFTSMIDWAFAPSCIFSKALTADLTVR

SEQ ID NO: 2966547 - protein, 17 aa, Entamoeba invadens
SEAINLGCVSVVGNIIF

SEQ ID NO: 2966548 - protein, 26 aa, Entamoeba invadens
SEAIWALNMARKLWAYSERKVNIEDP

SEQ ID NO: 2966549 - protein, 17 aa, Entamoeba invadens
SEALARLYLDKLVRIEY

SEQ ID NO: 2966550 - protein, 25 aa, Entamoeba invadens
SEALDEWEKEISIRGHLIQAVHINS

SEQ ID NO: 2966551 - protein, 28 aa, Entamoeba invadens
SEALLRAKRFLPMMAEANKGVTVGEKDV

SEQ ID NO: 2966552 - protein, 18 aa, Entamoeba invadens
SEAQQLYEALLWESASGL

SEQ ID NO: 2966553 - protein, 19 aa, Entamoeba invadens
SEASFGFQDYVVIFNDSDT

SEQ ID NO: 2966554 - protein, 17 aa, Entamoeba invadens
SEAVYWLCRCGDFYQSI

SEQ ID NO: 2966555 - protein, 17 aa, Entamoeba invadens
SECCIPRSPNPLQQFEV

SEQ ID NO: 2966556 - protein, 19 aa, Entamoeba invadens
SECDGKAVIKYTKIAQKTV

SEQ ID NO: 2966557 - protein, 20 aa, Entamoeba invadens
SECFKNCIKLENFVLPEDVC

SEQ ID NO: 2966558 - protein, 23 aa, Entamoeba invadens
SECGKRIWLDTVFTQHSKEIMGE

SEQ ID NO: 2966559 - protein, 23 aa, Entamoeba invadens
SECKKLLVPILMRTPDDGMVISK

SEQ ID NO: 2966560 - protein, 21 aa, Entamoeba invadens
SECKLKNVVIPSNITKLDESC

SEQ ID NO: 2966561 - protein, 25 aa, Entamoeba invadens
SECKPSSARLLRLSHDQFFNKGSVE

SEQ ID NO: 2966562 - protein, 20 aa, Entamoeba invadens
SECPCWYLEDFIYLQKLIIE

SEQ ID NO: 2966563 - protein, 23 aa, Entamoeba invadens
SECSHHQLCLFHANKYCEQFNQQ

SEQ ID NO: 2966564 - protein, 18 aa, Entamoeba invadens
SECVKSIGEFAFFQCRSL

SEQ ID NO: 2966565 - protein, 22 aa, Entamoeba invadens
SEDEIKKQILFVTNELEKRKDD

SEQ ID NO: 2966566 - protein, 17 aa, Entamoeba invadens
SEDFELFSPTPEDLEGS

SEQ ID NO: 2966567 - protein, 23 aa, Entamoeba invadens
SEDFLRLGKLVLDKGSFNNNQII

SEQ ID NO: 2966568 - protein, 30 aa, Entamoeba invadens
SEDFYDKCCELFCAFPICAVISTKKYKYFL

SEQ ID NO: 2966569 - protein, 17 aa, Entamoeba invadens
SEDICFFTFDKCASEQL

SEQ ID NO: 2966570 - protein, 18 aa, Entamoeba invadens
SEDILEIFNMAKNTQNLR

SEQ ID NO: 2966571 - protein, 17 aa, Entamoeba invadens
SEDIYLTMRVVVINTMC

SEQ ID NO: 2966572 - protein, 18 aa, Entamoeba invadens
SEDMSVCSEVGNSSVYWS

SEQ ID NO: 2966573 - protein, 17 aa, Entamoeba invadens
SEDMVVFLYSVRTSKNL

SEQ ID NO: 2966574 - protein, 22 aa, Entamoeba invadens
SEDPMSLSFALFIITKLSKNKL

SEQ ID NO: 2966575 - protein, 24 aa, Entamoeba invadens
SEDSFIHRADINFIPPLKENDNLH

SEQ ID NO: 2966576 - protein, 19 aa, Entamoeba invadens
SEDVVECFSKASPHELWQS

SEQ ID NO: 2966577 - protein, 21 aa, Entamoeba invadens
SEDWKRCCEQIEKDLPRTEIG

SEQ ID NO: 2966578 - protein, 21 aa, Entamoeba invadens
SEDYMTLILVYIVKSLNAYKK

SEQ ID NO: 2966579 - protein, 28 aa, Entamoeba invadens
SEEAQLLQCFEIIKYSFLNVQKRQLDLS

SEQ ID NO: 2966580 - protein, 29 aa, Entamoeba invadens
SEEFLRFDRSKVLPELLFFFDYYTENHVE

SEQ ID NO: 2966581 - protein, 22 aa, Entamoeba invadens
SEEFQIPGLLGVGRVFEVVFEN

SEQ ID NO: 2966582 - protein, 21 aa, Entamoeba invadens
SEEGDFCFTEILYGQFRREVP

SEQ ID NO: 2966583 - protein, 25 aa, Entamoeba invadens
SEEINRISLYLMVALVARLDLDQEL

SEQ ID NO: 2966584 - protein, 20 aa, Entamoeba invadens
SEEIRLFLMVNHKCQETVVI

SEQ ID NO: 2966585 - protein, 20 aa, Entamoeba invadens
SEEKKGCVIEEKVNGESQVE

SEQ ID NO: 2966586 - protein, 17 aa, Entamoeba invadens
SEEKMAIVRALCGRCNL

SEQ ID NO: 2966587 - protein, 23 aa, Entamoeba invadens
SEELKLSKQCYINNDKEGATVHL

SEQ ID NO: 2966588 - protein, 21 aa, Entamoeba invadens
SEEMIGVLLMFPSFKLENANY

SEQ ID NO: 2966589 - protein, 22 aa, Entamoeba invadens
SEEMKENFPVFKKWESYEKFIT

SEQ ID NO: 2966590 - protein, 25 aa, Entamoeba invadens
SEEMKSELWEVIWKDYAAWENEVET

SEQ ID NO: 2966591 - protein, 22 aa, Entamoeba invadens
SEEMRVYTGIMLNHLDDEEIVT

SEQ ID NO: 2966592 - protein, 25 aa, Entamoeba invadens
SEEPEDHDALLICLFMNVRHAKSRH

SEQ ID NO: 2966593 - protein, 23 aa, Entamoeba invadens
SEEREDICLAKTLMSMLIRSPEG

SEQ ID NO: 2966594 - protein, 27 aa, Entamoeba invadens
SEESKRFQLVIEDRVGEITKFQNEVIA

SEQ ID NO: 2966595 - protein, 24 aa, Entamoeba invadens
SEETLKIIAIRGIIAGSPIITDVV

SEQ ID NO: 2966596 - protein, 25 aa, Entamoeba invadens
SEETVCVKCGLKVNPGQPCSTLSGE

SEQ ID NO: 2966597 - protein, 20 aa, Entamoeba invadens
SEEWKKCDFLTELENAKSNP

SEQ ID NO: 2966598 - protein, 23 aa, Entamoeba invadens
SEFCSKFTTFILMESVAINTEMF

SEQ ID NO: 2966599 - protein, 20 aa, Entamoeba invadens
SEFEKRLRAISPKEEYILAA

SEQ ID NO: 2966600 - protein, 24 aa, Entamoeba invadens
SEFFKSGVGTPIFASPEILNEKNY

SEQ ID NO: 2966601 - protein, 24 aa, Entamoeba invadens
SEFGDEMFCGCYLLKEFNFPPHLT

SEQ ID NO: 2966602 - protein, 20 aa, Entamoeba invadens
SEFGTKCFIGCDSLSAITFC

SEQ ID NO: 2966603 - protein, 19 aa, Entamoeba invadens
SEFIKCLSGSYVNYRHLGL

SEQ ID NO: 2966604 - protein, 22 aa, Entamoeba invadens
SEFKYHTFDSFTIPSHIQSIEK

SEQ ID NO: 2966605 - protein, 20 aa, Entamoeba invadens
SEFMGDVYLKSFDNFAEQMR

SEQ ID NO: 2966606 - protein, 21 aa, Entamoeba invadens
SEFNDYAVIFSKQFPTVNQRL

SEQ ID NO: 2966607 - protein, 20 aa, Entamoeba invadens
SEFNELQYIFDFYVDQHSLA

SEQ ID NO: 2966608 - protein, 19 aa, Entamoeba invadens
SEFNKIWAEQEMKWKELFD

SEQ ID NO: 2966609 - protein, 20 aa, Entamoeba invadens
SEFPLEPALGKLLITSEEYN

SEQ ID NO: 2966610 - protein, 17 aa, Entamoeba invadens
SEFSNFFTQLALLDPED

SEQ ID NO: 2966611 - protein, 17 aa, Entamoeba invadens
SEFVVHFYGAVFARNKV

SEQ ID NO: 2966612 - protein, 17 aa, Entamoeba invadens
SEFYVECDMVIQAISQE

SEQ ID NO: 2966613 - protein, 22 aa, Entamoeba invadens
SEFYYHFRCVDFLKMTEKERNT

SEQ ID NO: 2966614 - protein, 17 aa, Entamoeba invadens
SEGDIWIVFKKIDEETF

SEQ ID NO: 2966615 - protein, 22 aa, Entamoeba invadens
SEGDMRYAIGLLQKLSQGVRHS

SEQ ID NO: 2966616 - protein, 18 aa, Entamoeba invadens
SEGDTMTFMLCGNKCDIA

SEQ ID NO: 2966617 - protein, 19 aa, Entamoeba invadens
SEGDVAMRVYVHRVEIENS

SEQ ID NO: 2966618 - protein, 19 aa, Entamoeba invadens
SEGILSPRSPVISPRSLQN

SEQ ID NO: 2966619 - protein, 33 aa, Entamoeba invadens
SEGKLCIFCCARFSFRIGEVFYSQSEDKIIQQL

SEQ ID NO: 2966620 - protein, 24 aa, Entamoeba invadens
SEGKVCIKREFFLSQKTRRIVINC

SEQ ID NO: 2966621 - protein, 24 aa, Entamoeba invadens
SEGLKIRVLCCIGGEEIDEQIKAI

SEQ ID NO: 2966622 - protein, 20 aa, Entamoeba invadens
SEGLLAELLVTVVYTLTLVR

SEQ ID NO: 2966623 - protein, 20 aa, Entamoeba invadens
SEGMAECYKSVIPPQLKFET

SEQ ID NO: 2966624 - protein, 17 aa, Entamoeba invadens
SEGRFSSIASQLSQTDY

SEQ ID NO: 2966625 - protein, 26 aa, Entamoeba invadens
SEGSFYFWIAYCPIKPKSEKMGEIVD

SEQ ID NO: 2966626 - protein, 22 aa, Entamoeba invadens
SEGYDVFLQRYFKTSDDDKPPQ

SEQ ID NO: 2966627 - protein, 22 aa, Entamoeba invadens
SEGYSGGALKHGPFALIEKDLP

SEQ ID NO: 2966628 - protein, 28 aa, Entamoeba invadens
SEHPEVFKFLLRVGSFDMKGDESIYSTN

SEQ ID NO: 2966629 - protein, 18 aa, Entamoeba invadens
SEHPRIYIPSTVVDGDIG

SEQ ID NO: 2966630 - protein, 19 aa, Entamoeba invadens
SEHPRVYIPSTIVEADIGC

SEQ ID NO: 2966631 - protein, 18 aa, Entamoeba invadens
SEHPRVYIPTTTVEADIG

SEQ ID NO: 2966632 - protein, 20 aa, Entamoeba invadens
SEHPTEFLVEMNHGVTDVHN

SEQ ID NO: 2966633 - protein, 20 aa, Entamoeba invadens
SEHYKDFGTRLEFVTDNTQE

SEQ ID NO: 2966634 - protein, 18 aa, Entamoeba invadens
SEIAKIIVEIAYSRQSGD

SEQ ID NO: 2966635 - protein, 22 aa, Entamoeba invadens
SEICGLDIVVYLLSDPSNIQKV

SEQ ID NO: 2966636 - protein, 23 aa, Entamoeba invadens
SEICIIQNFLFNGCDELCEIKIC

SEQ ID NO: 2966637 - protein, 25 aa, Entamoeba invadens
SEIDGNSMCKLLFALDKVVCTQPIF

SEQ ID NO: 2966638 - protein, 20 aa, Entamoeba invadens
SEIDGTFLIRESKTERNSPC

SEQ ID NO: 2966639 - protein, 24 aa, Entamoeba invadens
SEIDMKLRLKLLVDASEGISYLHE

SEQ ID NO: 2966640 - protein, 19 aa, Entamoeba invadens
SEIDPFFPLNGDYSKSLLA

SEQ ID NO: 2966641 - protein, 20 aa, Entamoeba invadens
SEIDRWIFHRMNVMVETLRK

SEQ ID NO: 2966642 - protein, 19 aa, Entamoeba invadens
SEIEEIVYLFIKNLSELNQ

SEQ ID NO: 2966643 - protein, 19 aa, Entamoeba invadens
SEIEKCMELFFKIPSPTIQ

SEQ ID NO: 2966644 - protein, 17 aa, Entamoeba invadens
SEIERLNLTGVRIDPKN

SEQ ID NO: 2966645 - protein, 21 aa, Entamoeba invadens
SEIFEKHFLCESGKINVIGTI

SEQ ID NO: 2966646 - protein, 17 aa, Entamoeba invadens
SEIGLQCVVKYIHNKSP

SEQ ID NO: 2966647 - protein, 24 aa, Entamoeba invadens
SEIGRSCFYRCYKLDFNDIPVHLR

SEQ ID NO: 2966648 - protein, 24 aa, Entamoeba invadens
SEIGTSCFYRCYKLDFNDIPVQLR

SEQ ID NO: 2966649 - protein, 21 aa, Entamoeba invadens
SEIKIPVKFASEMSTALDPDE

SEQ ID NO: 2966650 - protein, 25 aa, Entamoeba invadens
SEIKLQFYREIKYLSSLKHENIISL

SEQ ID NO: 2966651 - protein, 18 aa, Entamoeba invadens
SEIKNRLNKVVTEKNTIM

SEQ ID NO: 2966652 - protein, 17 aa, Entamoeba invadens
SEIKRFVKETSRELVSH

SEQ ID NO: 2966653 - protein, 17 aa, Entamoeba invadens
SEILCLRNLEFPDSLTQ

SEQ ID NO: 2966654 - protein, 24 aa, Entamoeba invadens
SEILKRTQLTVSDFLAFVENVKFQ

SEQ ID NO: 2966655 - protein, 22 aa, Entamoeba invadens
SEISVKCTHKALSKTERVELQK

SEQ ID NO: 2966656 - protein, 17 aa, Entamoeba invadens
SEIVLEELIIKYRKIEM

SEQ ID NO: 2966657 - protein, 22 aa, Entamoeba invadens
SEIYFPRALLSIGESGFSHCYN

SEQ ID NO: 2966658 - protein, 20 aa, Entamoeba invadens
SEIYKVDTFEAIEDLMGEFK

SEQ ID NO: 2966659 - protein, 27 aa, Entamoeba invadens
SEKACKNVICTKGTLLIDGNIENEKTN

SEQ ID NO: 2966660 - protein, 17 aa, Entamoeba invadens
SEKCITCLENRFLQEHK

SEQ ID NO: 2966661 - protein, 19 aa, Entamoeba invadens
SEKCSNCEKDILIGSLVNY

SEQ ID NO: 2966662 - protein, 25 aa, Entamoeba invadens
SEKDVDNWLSVMPLINFYSEGTYTL

SEQ ID NO: 2966663 - protein, 21 aa, Entamoeba invadens
SEKEPSAAAFAFIKEKQIRKG

SEQ ID NO: 2966664 - protein, 21 aa, Entamoeba invadens
SEKFKIPSLRELLTVKPEDDT

SEQ ID NO: 2966665 - protein, 19 aa, Entamoeba invadens
SEKFLKNFHHFANDFQTIM

SEQ ID NO: 2966666 - protein, 20 aa, Entamoeba invadens
SEKGLKVSIINSVCYDGDTR

SEQ ID NO: 2966667 - protein, 23 aa, Entamoeba invadens
SEKGRLTPRFFNYCTNIIATRGI

SEQ ID NO: 2966668 - protein, 20 aa, Entamoeba invadens
SEKGYKAFYECSAKTGDKCE

SEQ ID NO: 2966669 - protein, 24 aa, Entamoeba invadens
SEKIPFQKLEMVKFNPFEYTLNDC

SEQ ID NO: 2966670 - protein, 24 aa, Entamoeba invadens
SEKKGMYVLLKFSAITPEQKESWK

SEQ ID NO: 2966671 - protein, 21 aa, Entamoeba invadens
SEKKLCDDLEAQKVLNNTLEN

SEQ ID NO: 2966672 - protein, 21 aa, Entamoeba invadens
SEKKRNCVVGEAGKRYPVITL

SEQ ID NO: 2966673 - protein, 18 aa, Entamoeba invadens
SEKLAEVVDDYALIRPVP

SEQ ID NO: 2966674 - protein, 25 aa, Entamoeba invadens
SEKLAKYVAYKAFPSVAGVVERMQN

SEQ ID NO: 2966675 - protein, 22 aa, Entamoeba invadens
SEKMPIAGVKCTEVFATLLTKE

SEQ ID NO: 2966676 - protein, 20 aa, Entamoeba invadens
SEKMPNIVLSHFLGFASGEL

SEQ ID NO: 2966677 - protein, 19 aa, Entamoeba invadens
SEKMRPLYWNRVIIDMDTD

SEQ ID NO: 2966678 - protein, 31 aa, Entamoeba invadens
SEKNWKKVFVILKHTFLFVFKSAEDPTLIDV

SEQ ID NO: 2966679 - protein, 24 aa, Entamoeba invadens
SEKQLYLQASVIYKKMSEDITKGD

SEQ ID NO: 2966680 - protein, 20 aa, Entamoeba invadens
SEKRQLYSLLEETQKKLDVS

SEQ ID NO: 2966681 - protein, 20 aa, Entamoeba invadens
SEKSIMWENLILASINRGPK

SEQ ID NO: 2966682 - protein, 26 aa, Entamoeba invadens
SEKSLRLYLGDQVCRVDVVIPKDVGF

SEQ ID NO: 2966683 - protein, 21 aa, Entamoeba invadens
SEKTIQMAVVFEVMGIMIVHE

SEQ ID NO: 2966684 - protein, 26 aa, Entamoeba invadens
SEKVLCVWDSRMLKLPVISLENGVEA

SEQ ID NO: 2966685 - protein, 20 aa, Entamoeba invadens
SEKVTQFFTKIFVVDPAERI

SEQ ID NO: 2966686 - protein, 21 aa, Entamoeba invadens
SEKWKEFVVLSQPSHLMSIYH

SEQ ID NO: 2966687 - protein, 19 aa, Entamoeba invadens
SEKYILLIEIIKSILSIPE

SEQ ID NO: 2966688 - protein, 17 aa, Entamoeba invadens
SELCSKYGIVMNDFDTL

SEQ ID NO: 2966689 - protein, 21 aa, Entamoeba invadens
SELDAKFYAAQILLAIEHLHS

SEQ ID NO: 2966690 - protein, 35 aa, Entamoeba invadens
SELFFDISAFELFKWNKEKGVCKGVSASVNFFNRL

SEQ ID NO: 2966691 - protein, 25 aa, Entamoeba invadens
SELFYRGKLKMQLKMFEKEKKILGL

SEQ ID NO: 2966692 - protein, 25 aa, Entamoeba invadens
SELHDSVVVPLNLATESDFSSIQEI

SEQ ID NO: 2966693 - protein, 19 aa, Entamoeba invadens
SELIGIKVPEHITALHYCC

SEQ ID NO: 2966694 - protein, 18 aa, Entamoeba invadens
SELIMKGRYKEVFETQSF

SEQ ID NO: 2966695 - protein, 17 aa, Entamoeba invadens
SELKDLVTVVSNAEKQT

SEQ ID NO: 2966696 - protein, 20 aa, Entamoeba invadens
SELKEVIGLVEMEGKSLMEA

SEQ ID NO: 2966697 - protein, 22 aa, Entamoeba invadens
SELKFISAFLVDIDITKVNKKL

SEQ ID NO: 2966698 - protein, 23 aa, Entamoeba invadens
SELKLKCFECCNFSAFYIPSNVV

SEQ ID NO: 2966699 - protein, 22 aa, Entamoeba invadens
SELKQLTLLNGIPCGNHSRNNN

SEQ ID NO: 2966700 - protein, 22 aa, Entamoeba invadens
SELKSLIYQNWISVDRCGISIY

SEQ ID NO: 2966701 - protein, 21 aa, Entamoeba invadens
SELLEVFYIPDDVITKNLLPE

SEQ ID NO: 2966702 - protein, 20 aa, Entamoeba invadens
SELLKAYYWTLGNNTHFEQF

SEQ ID NO: 2966703 - protein, 26 aa, Entamoeba invadens
SELLKLLFTLFDSFPIAVRVGTTELG

SEQ ID NO: 2966704 - protein, 22 aa, Entamoeba invadens
SELLQYTGYFMYYRFVGHYITS

SEQ ID NO: 2966705 - protein, 24 aa, Entamoeba invadens
SELLRLHCTRFLTLGTDIPKEIKY

SEQ ID NO: 2966706 - protein, 17 aa, Entamoeba invadens
SELLSSGLFELMEFTLQ

SEQ ID NO: 2966707 - protein, 20 aa, Entamoeba invadens
SELMADYGKRVIIAALDGTF

SEQ ID NO: 2966708 - protein, 18 aa, Entamoeba invadens
SELMSDMHLIDYSLLVGV

SEQ ID NO: 2966709 - protein, 24 aa, Entamoeba invadens
SELNSSCFQCCTALVRIEIPSSVT

SEQ ID NO: 2966710 - protein, 21 aa, Entamoeba invadens
SELPDNCFYACYNLQNISFES

SEQ ID NO: 2966711 - protein, 19 aa, Entamoeba invadens
SELPIVMECAIQYFSANPV

SEQ ID NO: 2966712 - protein, 22 aa, Entamoeba invadens
SELPKRITSVFSAVRQAILYDG

SEQ ID NO: 2966713 - protein, 21 aa, Entamoeba invadens
SELPYFVILLPYFGYLNVAKA

SEQ ID NO: 2966714 - protein, 20 aa, Entamoeba invadens
SELRDKDLLTRVIKVNDIEN

SEQ ID NO: 2966715 - protein, 17 aa, Entamoeba invadens
SELRKLLYETFYTISDV

SEQ ID NO: 2966716 - protein, 17 aa, Entamoeba invadens
SELRTVSTIAEYQENPN

SEQ ID NO: 2966717 - protein, 24 aa, Entamoeba invadens
SELRYNKRLQRFICDESVLQQLFK

SEQ ID NO: 2966718 - protein, 18 aa, Entamoeba invadens
SELSGCFISCEYLTHVQL

SEQ ID NO: 2966719 - protein, 19 aa, Entamoeba invadens
SELTKLIAAAKEKKKIIKK

SEQ ID NO: 2966720 - protein, 17 aa, Entamoeba invadens
SELYELFLQGKLLLHEC

SEQ ID NO: 2966721 - protein, 17 aa, Entamoeba invadens
SEMKLVDSVLWENSLNR

SEQ ID NO: 2966722 - protein, 23 aa, Entamoeba invadens
SEMKNFWCAAHRVNLMGESLEND

SEQ ID NO: 2966723 - protein, 20 aa, Entamoeba invadens
SEMKTELEALEQAAKTYKQS

SEQ ID NO: 2966724 - protein, 26 aa, Entamoeba invadens
SEMNDWITTCVFGMFESFFKFFHKGE

SEQ ID NO: 2966725 - protein, 25 aa, Entamoeba invadens
SENEPALRITFVNSFTNSDESEKSA

SEQ ID NO: 2966726 - protein, 19 aa, Entamoeba invadens
SENERGIAFIVSETASQST

SEQ ID NO: 2966727 - protein, 22 aa, Entamoeba invadens
SENGPIPIAFFLDDMDDEDKDV

SEQ ID NO: 2966728 - protein, 17 aa, Entamoeba invadens
SENGYWCEDPLGIPTKP

SEQ ID NO: 2966729 - protein, 25 aa, Entamoeba invadens
SENILSFAGAFVISGNCKANEESRI

SEQ ID NO: 2966730 - protein, 32 aa, Entamoeba invadens
SENKGVLKREFFRIIVWFNVDFETVDRNKNRN

SEQ ID NO: 2966731 - protein, 17 aa, Entamoeba invadens
SENKIGLGTIWQKTSQQ

SEQ ID NO: 2966732 - protein, 21 aa, Entamoeba invadens
SENNIGFNIFLNKHGNLQLHE

SEQ ID NO: 2966733 - protein, 23 aa, Entamoeba invadens
SENRIIRNLLLVWSKYNKEYVLK

SEQ ID NO: 2966734 - protein, 23 aa, Entamoeba invadens
SENRSWLLPYIVFKTVGMECAPT

SEQ ID NO: 2966735 - protein, 19 aa, Entamoeba invadens
SENSFVINLFLKRASDAIR

SEQ ID NO: 2966736 - protein, 21 aa, Entamoeba invadens
SENSLCWECADGYKLSDDKIE

SEQ ID NO: 2966737 - protein, 19 aa, Entamoeba invadens
SENVRFIPIDGLRGDNLTV

SEQ ID NO: 2966738 - protein, 18 aa, Entamoeba invadens
SENVVNCMIAGSAEITSD

SEQ ID NO: 2966739 - protein, 27 aa, Entamoeba invadens
SENYLMISKQVVLCFDKIGEVTLGTPP

SEQ ID NO: 2966740 - protein, 18 aa, Entamoeba invadens
SEPAEFAELFDYRIVVKR

SEQ ID NO: 2966741 - protein, 29 aa, Entamoeba invadens
SEPECICIIGKRPLSHLFEEILRIAEKLR

SEQ ID NO: 2966742 - protein, 22 aa, Entamoeba invadens
SEPEECIFYNGFMAKRPLGKIL

SEQ ID NO: 2966743 - protein, 20 aa, Entamoeba invadens
SEPIAFRQTSRFFKKKGTIA

SEQ ID NO: 2966744 - protein, 22 aa, Entamoeba invadens
SEPKGMPGFAYNWVDMITPSFI

SEQ ID NO: 2966745 - protein, 25 aa, Entamoeba invadens
SEPKSKIMNLTWGFSLKKIIKKEDR

SEQ ID NO: 2966746 - protein, 18 aa, Entamoeba invadens
SEPLVARAKKYRKDKKRA

SEQ ID NO: 2966747 - protein, 20 aa, Entamoeba invadens
SEPNSLPFLIQADKMPIDRM

SEQ ID NO: 2966748 - protein, 29 aa, Entamoeba invadens
SEPQLYTPIPVMLVPFPLTSEQSSHILQL

SEQ ID NO: 2966749 - protein, 21 aa, Entamoeba invadens
SEPQMRAVVQPNPLQPLSRNR

SEQ ID NO: 2966750 - protein, 21 aa, Entamoeba invadens
SEPRNFICKIVAYSNISKETY

SEQ ID NO: 2966751 - protein, 17 aa, Entamoeba invadens
SEQELYLGMLLDPTTEV

SEQ ID NO: 2966752 - protein, 29 aa, Entamoeba invadens
SEQKSVVVKALFFLVGCKCQFIFNDTVIS

SEQ ID NO: 2966753 - protein, 20 aa, Entamoeba invadens
SEQKVKWELLLEDELIVNVT

SEQ ID NO: 2966754 - protein, 25 aa, Entamoeba invadens
SEQRITWKTMIDFSTQITLGLEYLH

SEQ ID NO: 2966755 - protein, 23 aa, Entamoeba invadens
SEQRVQIRLTREVEYLSGNKKGY

SEQ ID NO: 2966756 - protein, 18 aa, Entamoeba invadens
SERCMVQLLQFMSSKSPE

SEQ ID NO: 2966757 - protein, 18 aa, Entamoeba invadens
SERECTRLVIPPDVDPIK

SEQ ID NO: 2966758 - protein, 22 aa, Entamoeba invadens
SERFKGLAGLVFQPGTSEGIGS

SEQ ID NO: 2966759 - protein, 19 aa, Entamoeba invadens
SERGKCLSCLLAQTKKSSK

SEQ ID NO: 2966760 - protein, 18 aa, Entamoeba invadens
SERIEMLKQFAIDGLNHW

SEQ ID NO: 2966761 - protein, 31 aa, Entamoeba invadens
SERIKKASGLSWRLQCRIKHHVSFMEGLRQY

SEQ ID NO: 2966762 - protein, 18 aa, Entamoeba invadens
SERLCKEGEVACVAECKA

SEQ ID NO: 2966763 - protein, 28 aa, Entamoeba invadens
SERQRLCWELCKIRCQLAMEDQFYTYAQ

SEQ ID NO: 2966764 - protein, 20 aa, Entamoeba invadens
SERSLELFRKGGYYSELLEP

SEQ ID NO: 2966765 - protein, 18 aa, Entamoeba invadens
SERSRVWLQKSLEIKSNI

SEQ ID NO: 2966766 - protein, 23 aa, Entamoeba invadens
SESAENWLSIDFVENTSRMTSVM

SEQ ID NO: 2966767 - protein, 23 aa, Entamoeba invadens
SESDLNVVFFCFVNDFDMKKDQD

SEQ ID NO: 2966768 - protein, 18 aa, Entamoeba invadens
SESDWWINSLEEIAELLQ

SEQ ID NO: 2966769 - protein, 21 aa, Entamoeba invadens
SESFAARLGIKTNRARKYYYI

SEQ ID NO: 2966770 - protein, 17 aa, Entamoeba invadens
SESFANKLLLNQEGDDS

SEQ ID NO: 2966771 - protein, 24 aa, Entamoeba invadens
SESFKECKTLHSITIPNTISALGE

SEQ ID NO: 2966772 - protein, 25 aa, Entamoeba invadens
SESKAGKFISCKIVSHPTDDKVMMI

SEQ ID NO: 2966773 - protein, 21 aa, Entamoeba invadens
SESKEIIGLVMSEIIPEMILE

SEQ ID NO: 2966774 - protein, 24 aa, Entamoeba invadens
SESLEPSLLCVKLFAESLFSPLKH

SEQ ID NO: 2966775 - protein, 20 aa, Entamoeba invadens
SESLFEFYIHESKVLTIAAE

SEQ ID NO: 2966776 - protein, 21 aa, Entamoeba invadens
SESLGTVIFVLGRTENGAQRL

SEQ ID NO: 2966777 - protein, 18 aa, Entamoeba invadens
SESLRFIFNTMRNLSIID

SEQ ID NO: 2966778 - protein, 23 aa, Entamoeba invadens
SESMFLMKHCPMKVGERSRRYKQ

SEQ ID NO: 2966779 - protein, 23 aa, Entamoeba invadens
SESNRRAIDWSYGVIAFGTRTSI

SEQ ID NO: 2966780 - protein, 25 aa, Entamoeba invadens
SESPFKSIVPFALRGAMTRYQTNSG

SEQ ID NO: 2966781 - protein, 17 aa, Entamoeba invadens
SESQGLMELHFDSQPDT

SEQ ID NO: 2966782 - protein, 25 aa, Entamoeba invadens
SESQTVFEALKFLGIVSSSSVYAQR

SEQ ID NO: 2966783 - protein, 25 aa, Entamoeba invadens
SESRKELYKNGGIYFITSRILISDL

SEQ ID NO: 2966784 - protein, 30 aa, Entamoeba invadens
SESSIGGLFLKLAPFLKIYGEYCKNYPQAL

SEQ ID NO: 2966785 - protein, 25 aa, Entamoeba invadens
SESVAKEWNCLIVGMFELGNDLDIE

SEQ ID NO: 2966786 - protein, 25 aa, Entamoeba invadens
SESVDCWKHCLIIMSSVDMLITEKP

SEQ ID NO: 2966787 - protein, 23 aa, Entamoeba invadens
SESVIKLLIGNKCDLEDERAVTV

SEQ ID NO: 2966788 - protein, 22 aa, Entamoeba invadens
SESVLLRPTKLAPHIDSEPQQT

SEQ ID NO: 2966789 - protein, 23 aa, Entamoeba invadens
SESVRIIGNFAFRNCKGLLQVDF

SEQ ID NO: 2966790 - protein, 22 aa, Entamoeba invadens
SETDKISGLNCRERDFFQKRSD

SEQ ID NO: 2966791 - protein, 21 aa, Entamoeba invadens
SETFVSVALPYLGALATVGKR

SEQ ID NO: 2966792 - protein, 26 aa, Entamoeba invadens
SETKAKIMNLTWGFTMKKIIKKEERI

SEQ ID NO: 2966793 - protein, 18 aa, Entamoeba invadens
SETKELVFDLGWSDSIVK

SEQ ID NO: 2966794 - protein, 31 aa, Entamoeba invadens
SETKKLFINKKCFICGEVHDSANCPHKNDQN

SEQ ID NO: 2966795 - protein, 28 aa, Entamoeba invadens
SETLQVCPICKKAIPINEMDKHMKIELM

SEQ ID NO: 2966796 - protein, 17 aa, Entamoeba invadens
SETLSIQIASLLSRVFI

SEQ ID NO: 2966797 - protein, 19 aa, Entamoeba invadens
SETMPSLSEFVFKGKSEDN

SEQ ID NO: 2966798 - protein, 28 aa, Entamoeba invadens
SETNYIKWFCKMMELMVKYFEECHSERA

SEQ ID NO: 2966799 - protein, 20 aa, Entamoeba invadens
SETQFGYNLIFLARRISSVF

SEQ ID NO: 2966800 - protein, 24 aa, Entamoeba invadens
SETQRVKCAFVYSQQGSYVVENAN

SEQ ID NO: 2966801 - protein, 23 aa, Entamoeba invadens
SETRFSEIETICFQNHCIDKDTA

SEQ ID NO: 2966802 - protein, 17 aa, Entamoeba invadens
SETRWLQTVLILDNMFE

SEQ ID NO: 2966803 - protein, 20 aa, Entamoeba invadens
SETRYKGWPKVESFLKSLPP

SEQ ID NO: 2966804 - protein, 23 aa, Entamoeba invadens
SETSDTFFFFPFINVLVQPITVA

SEQ ID NO: 2966805 - protein, 21 aa, Entamoeba invadens
SETSEKIYMCFSSKDDIKFRT

SEQ ID NO: 2966806 - protein, 22 aa, Entamoeba invadens
SETSPLFALNSWTSCDTFEKLF

SEQ ID NO: 2966807 - protein, 17 aa, Entamoeba invadens
SEVCRLRTAQNCHDRTA

SEQ ID NO: 2966808 - protein, 26 aa, Entamoeba invadens
SEVEFRIKLYFDEFKVCVNSANCSAD

SEQ ID NO: 2966809 - protein, 21 aa, Entamoeba invadens
SEVELLVMMSAMLGMPPNDMI

SEQ ID NO: 2966810 - protein, 19 aa, Entamoeba invadens
SEVFKMWRSNLLDVSEEFK

SEQ ID NO: 2966811 - protein, 19 aa, Entamoeba invadens
SEVGLKVLVFVVREIGTQN

SEQ ID NO: 2966812 - protein, 20 aa, Entamoeba invadens
SEVLNQFKLSAVRIAGELAV

SEQ ID NO: 2966813 - protein, 21 aa, Entamoeba invadens
SEVLPEYCFGVYPSGVQVYLH

SEQ ID NO: 2966814 - protein, 18 aa, Entamoeba invadens
SEVLPVVLTFVAKETQEA

SEQ ID NO: 2966815 - protein, 19 aa, Entamoeba invadens
SEVMNGWDLFLKTSADGFI

SEQ ID NO: 2966816 - protein, 20 aa, Entamoeba invadens
SEVNIAISFLYGDYNKEREE

SEQ ID NO: 2966817 - protein, 18 aa, Entamoeba invadens
SEVNYLWYLQEWTSKEVM

SEQ ID NO: 2966818 - protein, 30 aa, Entamoeba invadens
SEVPEIVTHIPLKLFVSFFELVQVSDQDNL

SEQ ID NO: 2966819 - protein, 33 aa, Entamoeba invadens
SEVQKRLSLKPELWKFVNPFFPYINSVDREKIQ

SEQ ID NO: 2966820 - protein, 22 aa, Entamoeba invadens
SEVSAIGFSGCNRVVCDPNTKA

SEQ ID NO: 2966821 - protein, 19 aa, Entamoeba invadens
SEVSMAFFAEGQKPRIPFS

SEQ ID NO: 2966822 - protein, 17 aa, Entamoeba invadens
SEVSSLLGLLTETYHLI

SEQ ID NO: 2966823 - protein, 19 aa, Entamoeba invadens
SEVTKSVIFTRELISSYSP

SEQ ID NO: 2966824 - protein, 26 aa, Entamoeba invadens
SEVVGLLDMLICFVTYASSHDLMCRP

SEQ ID NO: 2966825 - protein, 17 aa, Entamoeba invadens
SEVVINYFGMVVSIVTE

SEQ ID NO: 2966826 - protein, 24 aa, Entamoeba invadens
SEVVKRGCKRVVLQFPEGLIAQGV

SEQ ID NO: 2966827 - protein, 19 aa, Entamoeba invadens
SEVYKVGAYLKLPEVILGA

SEQ ID NO: 2966828 - protein, 22 aa, Entamoeba invadens
SEWKQKNGFNQLCKHERSRSNS

SEQ ID NO: 2966829 - protein, 26 aa, Entamoeba invadens
SEYAMKLKLYIPFVLLKDKILFECSS

SEQ ID NO: 2966830 - protein, 25 aa, Entamoeba invadens
SEYAQAIKFLGLRPQVPVVGNEKRW

SEQ ID NO: 2966831 - protein, 25 aa, Entamoeba invadens
SEYFKIYLKDYFQAVMTPFLNEVLS

SEQ ID NO: 2966832 - protein, 22 aa, Entamoeba invadens
SEYGMYYFGSSYFYSSMDVSIN

SEQ ID NO: 2966833 - protein, 25 aa, Entamoeba invadens
SEYIIHFYGACFIPNHICMVTEFAL

SEQ ID NO: 2966834 - protein, 25 aa, Entamoeba invadens
SEYIIHFYGACFIPNHICTVTEFAL

SEQ ID NO: 2966835 - protein, 19 aa, Entamoeba invadens
SEYIIHFYGAVFFTNNVSV

SEQ ID NO: 2966836 - protein, 24 aa, Entamoeba invadens
SEYKARTCKTFESGKDFRKEHEKC

SEQ ID NO: 2966837 - protein, 17 aa, Entamoeba invadens
SEYKCLAISIDSTTKND

SEQ ID NO: 2966838 - protein, 26 aa, Entamoeba invadens
SEYNRCKRAKLKKSDFETIKVIGRGG

SEQ ID NO: 2966839 - protein, 30 aa, Entamoeba invadens
SEYPIVHFHCGHSFHKKCLGSATECPKNHM

SEQ ID NO: 2966840 - protein, 19 aa, Entamoeba invadens
SEYQKLRLIVGEYITVMSP

SEQ ID NO: 2966841 - protein, 26 aa, Entamoeba invadens
SEYYMRKGDGFVVVYSIVIESTFDKV

SEQ ID NO: 2966842 - protein, 21 aa, Entamoeba invadens
SFAFKNCVILSRIWMSEKVES

SEQ ID NO: 2966843 - protein, 17 aa, Entamoeba invadens
SFAKCYSLTSVVMTGRI

SEQ ID NO: 2966844 - protein, 17 aa, Entamoeba invadens
SFAKKPPPTTIVKPPQT

SEQ ID NO: 2966845 - protein, 26 aa, Entamoeba invadens
SFARDHLCEYCEVSAKTGKRVVETFE

SEQ ID NO: 2966846 - protein, 20 aa, Entamoeba invadens
SFATILPQLFGVLLQTLKVY

SEQ ID NO: 2966847 - protein, 18 aa, Entamoeba invadens
SFATMKFDMFIPTQQLIS

SEQ ID NO: 2966848 - protein, 18 aa, Entamoeba invadens
SFCDKERAIGEAGFGLYL

SEQ ID NO: 2966849 - protein, 20 aa, Entamoeba invadens
SFCEMIRKFSTEMFETYFTL

SEQ ID NO: 2966850 - protein, 25 aa, Entamoeba invadens
SFCFDNCAKLAVINLCEHLDHLSRG

SEQ ID NO: 2966851 - protein, 20 aa, Entamoeba invadens
SFCLQQHCWILKSGEKDHSS

SEQ ID NO: 2966852 - protein, 22 aa, Entamoeba invadens
SFCNSCFYDCFSLTSITIPSSI

SEQ ID NO: 2966853 - protein, 22 aa, Entamoeba invadens
SFCSRCLTMYTFITMSNQYVVN

SEQ ID NO: 2966854 - protein, 23 aa, Entamoeba invadens
SFDEKQNVFGIFTKYGISEGKIN

SEQ ID NO: 2966855 - protein, 20 aa, Entamoeba invadens
SFDIHVLKYLKFIEESYSLT

SEQ ID NO: 2966856 - protein, 22 aa, Entamoeba invadens
SFDLKCPERLASKTLQNLVILE

SEQ ID NO: 2966857 - protein, 21 aa, Entamoeba invadens
SFDLPEKVADNFFLTKESLKV

SEQ ID NO: 2966858 - protein, 20 aa, Entamoeba invadens
SFDRIAYWLNEMQDLQKRPI

SEQ ID NO: 2966859 - protein, 20 aa, Entamoeba invadens
SFDRLLHIACRNNWKEVVEC

SEQ ID NO: 2966860 - protein, 22 aa, Entamoeba invadens
SFECMQSLYINPFINLEIKTFA

SEQ ID NO: 2966861 - protein, 22 aa, Entamoeba invadens
SFEDIDTLSLAKCIQLLEVYIS

SEQ ID NO: 2966862 - protein, 24 aa, Entamoeba invadens
SFEDLKKYLLKRLEETVRVLPLID

SEQ ID NO: 2966863 - protein, 25 aa, Entamoeba invadens
SFEEFPLEILREIKVLRELQHDNIV

SEQ ID NO: 2966864 - protein, 24 aa, Entamoeba invadens
SFEEIQCITILFNYLSSFKEELTF

SEQ ID NO: 2966865 - protein, 18 aa, Entamoeba invadens
SFEIFKFENDNLVPLQSV

SEQ ID NO: 2966866 - protein, 17 aa, Entamoeba invadens
SFEIFYDKVYLFTCPSQ

SEQ ID NO: 2966867 - protein, 28 aa, Entamoeba invadens
SFEKILSLTCSLDFFKAFASTFVNEKIN

SEQ ID NO: 2966868 - protein, 19 aa, Entamoeba invadens
SFEKLFWNEEKRYFVQVIW

SEQ ID NO: 2966869 - protein, 19 aa, Entamoeba invadens
SFEKVPVWLEECRKYSNPN

SEQ ID NO: 2966870 - protein, 25 aa, Entamoeba invadens
SFEMAWKIARPNGVVSLVAMYESDQ

SEQ ID NO: 2966871 - protein, 20 aa, Entamoeba invadens
SFENFCFMKNTTLQNIVISN

SEQ ID NO: 2966872 - protein, 29 aa, Entamoeba invadens
SFEPNSWKDGLAFCALIHKFHPEAIDFNA

SEQ ID NO: 2966873 - protein, 19 aa, Entamoeba invadens
SFERCSSLMTVTVTDKLRK

SEQ ID NO: 2966874 - protein, 29 aa, Entamoeba invadens
SFERLLFWKDEFLRNACTSLGDDRKYPFV

SEQ ID NO: 2966875 - protein, 25 aa, Entamoeba invadens
SFESGEYQWAITLLNHVVFKNPKNL

SEQ ID NO: 2966876 - protein, 17 aa, Entamoeba invadens
SFETACFEDCFSLSTLD

SEQ ID NO: 2966877 - protein, 26 aa, Entamoeba invadens
SFEVNSALMSRCNLVVLKRLTDEDMV

SEQ ID NO: 2966878 - protein, 17 aa, Entamoeba invadens
SFFDIFYTTQMALSNDI

SEQ ID NO: 2966879 - protein, 26 aa, Entamoeba invadens
SFFDLKFTDLPVFIQEKIKLYNTLIT

SEQ ID NO: 2966880 - protein, 23 aa, Entamoeba invadens
SFFLKFEECFQKIEVELNEVYNE

SEQ ID NO: 2966881 - protein, 27 aa, Entamoeba invadens
SFFNCPKELKCIIEEKLDSFTHALKYD

SEQ ID NO: 2966882 - protein, 18 aa, Entamoeba invadens
SFFYKGILYMTRRISQEI

SEQ ID NO: 2966883 - protein, 19 aa, Entamoeba invadens
SFGAIGPMRSCEPDLNKAQ

SEQ ID NO: 2966884 - protein, 26 aa, Entamoeba invadens
SFGARLKIIWDRAFEKMDFKSIKINP

SEQ ID NO: 2966885 - protein, 23 aa, Entamoeba invadens
SFGDCKVASVILKDYIRSLPNPL

SEQ ID NO: 2966886 - protein, 24 aa, Entamoeba invadens
SFGDLGLEAGKILYDFLTPLKDTK

SEQ ID NO: 2966887 - protein, 25 aa, Entamoeba invadens
SFGDYCFYCCSSLCSVTIPSSVTLI

SEQ ID NO: 2966888 - protein, 24 aa, Entamoeba invadens
SFGDYCFYCCSSLSSVTIPSTVTS

SEQ ID NO: 2966889 - protein, 22 aa, Entamoeba invadens
SFGEKFVPLLFAKQGDGDYRYK

SEQ ID NO: 2966890 - protein, 19 aa, Entamoeba invadens
SFGHRFMTRTGFAVECPFG

SEQ ID NO: 2966891 - protein, 24 aa, Entamoeba invadens
SFGITLFETFKWGEAYDKERFRFP

SEQ ID NO: 2966892 - protein, 18 aa, Entamoeba invadens
SFGIVYKGQYRGVCVAVK

SEQ ID NO: 2966893 - protein, 22 aa, Entamoeba invadens
SFGKHAYGCRVVQKLVERREDV

SEQ ID NO: 2966894 - protein, 18 aa, Entamoeba invadens
SFGKRCFQMCSTLTSLTI

SEQ ID NO: 2966895 - protein, 18 aa, Entamoeba invadens
SFGKYVKTKLRGIVEELD

SEQ ID NO: 2966896 - protein, 19 aa, Entamoeba invadens
SFGLPNVIKILVVRSQHVN

SEQ ID NO: 2966897 - protein, 27 aa, Entamoeba invadens
SFGMDEGWFFPGLFELYVLKKMQSGPD

SEQ ID NO: 2966898 - protein, 24 aa, Entamoeba invadens
SFGSESSFSLGRRSHIVQKMYTPT

SEQ ID NO: 2966899 - protein, 24 aa, Entamoeba invadens
SFGSHTWPTWGNKNIVEYYEKQRD

SEQ ID NO: 2966900 - protein, 24 aa, Entamoeba invadens
SFGVQSFYCCLTLESIELPKNIKK

SEQ ID NO: 2966901 - protein, 22 aa, Entamoeba invadens
SFGVSLFECVIWKEPYLDKQFK

SEQ ID NO: 2966902 - protein, 18 aa, Entamoeba invadens
SFGVSLFECVTWKEPYPK

SEQ ID NO: 2966903 - protein, 19 aa, Entamoeba invadens
SFHILWFDTIFQKQKERKK

SEQ ID NO: 2966904 - protein, 25 aa, Entamoeba invadens
SFHSSFSRKFYRTHPNAFVLVEKLK

SEQ ID NO: 2966905 - protein, 27 aa, Entamoeba invadens
SFIANLYASCFYRSMLNNQSLKIEAKK

SEQ ID NO: 2966906 - protein, 25 aa, Entamoeba invadens
SFIKENPELIAPILKKQREQSYVVP

SEQ ID NO: 2966907 - protein, 23 aa, Entamoeba invadens
SFIKTIELIASCLNNGKEVKFVQ

SEQ ID NO: 2966908 - protein, 20 aa, Entamoeba invadens
SFIMLRYVNPAIFSPEKYGI

SEQ ID NO: 2966909 - protein, 23 aa, Entamoeba invadens
SFINKRLSHILVHSPYLFSSSFQ

SEQ ID NO: 2966910 - protein, 29 aa, Entamoeba invadens
SFIQLKRVDSLICGGFVLDLTSITQHARV

SEQ ID NO: 2966911 - protein, 29 aa, Entamoeba invadens
SFITEDIYMMWLERCIKPELELRRKNCPQ

SEQ ID NO: 2966912 - protein, 28 aa, Entamoeba invadens
SFITQEFLFPILLSLVAQQPSAFVDYLD

SEQ ID NO: 2966913 - protein, 22 aa, Entamoeba invadens
SFKCVYSFREIRNYQSEQEAVL

SEQ ID NO: 2966914 - protein, 21 aa, Entamoeba invadens
SFKFYVKMLYFENGKVDTLLK

SEQ ID NO: 2966915 - protein, 27 aa, Entamoeba invadens
SFKGCVSLHKIRCLQSLHFSASSLCGV

SEQ ID NO: 2966916 - protein, 19 aa, Entamoeba invadens
SFKGIPAIEKTLYMRHRSY

SEQ ID NO: 2966917 - protein, 29 aa, Entamoeba invadens
SFKKISMINFLIFYFKQDFAEVVHAPQGG

SEQ ID NO: 2966918 - protein, 17 aa, Entamoeba invadens
SFKKSKMVIPWSKEEDM

SEQ ID NO: 2966919 - protein, 20 aa, Entamoeba invadens
SFKLPEDFKIIVRTEQFENY

SEQ ID NO: 2966920 - protein, 28 aa, Entamoeba invadens
SFKMALTCYFKLSSGGVFLTKNDDINFP

SEQ ID NO: 2966921 - protein, 20 aa, Entamoeba invadens
SFKNLWREKCYEMEQQSDEE

SEQ ID NO: 2966922 - protein, 19 aa, Entamoeba invadens
SFKPRIVMWVKENRNKIIL

SEQ ID NO: 2966923 - protein, 24 aa, Entamoeba invadens
SFKQCALKAFDLFKAAASKKQSDA

SEQ ID NO: 2966924 - protein, 29 aa, Entamoeba invadens
SFLAYKKTLKWLSERGLITIRRGVVSLKV

SEQ ID NO: 2966925 - protein, 34 aa, Entamoeba invadens
SFLDSREIRSAVCYKENLIFLIITDTCTFGVFQD

SEQ ID NO: 2966926 - protein, 20 aa, Entamoeba invadens
SFLEQFPSFEAWKKETIKKA

SEQ ID NO: 2966927 - protein, 17 aa, Entamoeba invadens
SFLFEIYDWDRFKTDDF

SEQ ID NO: 2966928 - protein, 28 aa, Entamoeba invadens
SFLGNCPSELGLFCQDWEAARECPNFLE

SEQ ID NO: 2966929 - protein, 19 aa, Entamoeba invadens
SFLPMILNLAFDVVPNVRL

SEQ ID NO: 2966930 - protein, 24 aa, Entamoeba invadens
SFLPQSRYVVISALGSGTFGQVLK

SEQ ID NO: 2966931 - protein, 18 aa, Entamoeba invadens
SFLVDLVGFLLVERKFLF

SEQ ID NO: 2966932 - protein, 30 aa, Entamoeba invadens
SFMKSGKLFQEFFLKKLINAERMMMHSTAF

SEQ ID NO: 2966933 - protein, 25 aa, Entamoeba invadens
SFMMKRVVYDFGRIDYITSDDDIVV

SEQ ID NO: 2966934 - protein, 21 aa, Entamoeba invadens
SFNCNICLPGTYANATNNKCQ

SEQ ID NO: 2966935 - protein, 23 aa, Entamoeba invadens
SFNDGYFQECFILAYRLVTTPER

SEQ ID NO: 2966936 - protein, 25 aa, Entamoeba invadens
SFNDKIAVIFSFYLFSGMVGGSGRK

SEQ ID NO: 2966937 - protein, 19 aa, Entamoeba invadens
SFNGCSRLSSLNIPITVLS

SEQ ID NO: 2966938 - protein, 20 aa, Entamoeba invadens
SFNGCSRLSSLNIPITVLSI

SEQ ID NO: 2966939 - protein, 17 aa, Entamoeba invadens
SFNKLIEPFTFGNCISL

SEQ ID NO: 2966940 - protein, 18 aa, Entamoeba invadens
SFNKSGKDDVVFKGMGVN

SEQ ID NO: 2966941 - protein, 18 aa, Entamoeba invadens
SFNLLFKIQVCRYVCNQK

SEQ ID NO: 2966942 - protein, 23 aa, Entamoeba invadens
SFNPDLIENVGWNRLDTNNDLSE

SEQ ID NO: 2966943 - protein, 19 aa, Entamoeba invadens
SFNTLQFGPIILFLLSDTI

SEQ ID NO: 2966944 - protein, 26 aa, Entamoeba invadens
SFNVCPEPALILLDFLVATLKENIKP

SEQ ID NO: 2966945 - protein, 23 aa, Entamoeba invadens
SFPDSITCFGNRCFSGCSELKTI

SEQ ID NO: 2966946 - protein, 18 aa, Entamoeba invadens
SFPEVWDPIIEDIYNVKL

SEQ ID NO: 2966947 - protein, 23 aa, Entamoeba invadens
SFPHLTSLCVRYTQKFSEFLPQT

SEQ ID NO: 2966948 - protein, 17 aa, Entamoeba invadens
SFPKLSNVPTEIQPVAP

SEQ ID NO: 2966949 - protein, 18 aa, Entamoeba invadens
SFQACRSLKTIKFPQLIK

SEQ ID NO: 2966950 - protein, 21 aa, Entamoeba invadens
SFQAILIKCITGDRVQYFSNI

SEQ ID NO: 2966951 - protein, 19 aa, Entamoeba invadens
SFQAKAVDYIAVFEISVDI

SEQ ID NO: 2966952 - protein, 17 aa, Entamoeba invadens
SFQDFAFSVAKTSTLSL

SEQ ID NO: 2966953 - protein, 29 aa, Entamoeba invadens
SFQDILFRLCEYATICIRSASILESSSKQ

SEQ ID NO: 2966954 - protein, 19 aa, Entamoeba invadens
SFQRISLPESILLIKPNAF

SEQ ID NO: 2966955 - protein, 18 aa, Entamoeba invadens
SFQSLNVLCCDIENMMKD

SEQ ID NO: 2966956 - protein, 20 aa, Entamoeba invadens
SFQVSEKVSFSFKGKGSCYL

SEQ ID NO: 2966957 - protein, 22 aa, Entamoeba invadens
SFRDGRASLALLCSLTNDHKLY

SEQ ID NO: 2966958 - protein, 25 aa, Entamoeba invadens
SFRLASECLSSWVKNSGVEITYYRN

SEQ ID NO: 2966959 - protein, 19 aa, Entamoeba invadens
SFRLMRNGNIFWVGAPNNK

SEQ ID NO: 2966960 - protein, 24 aa, Entamoeba invadens
SFRSRRCTFALLKNILVVAMTNTF

SEQ ID NO: 2966961 - protein, 25 aa, Entamoeba invadens
SFSDKSSICSYSIDLYKTLISLETD

SEQ ID NO: 2966962 - protein, 22 aa, Entamoeba invadens
SFSLQMYLYYVGCIALNNRDLR

SEQ ID NO: 2966963 - protein, 25 aa, Entamoeba invadens
SFSNCGKCGRMLMKVISTDTYLMCN

SEQ ID NO: 2966964 - protein, 17 aa, Entamoeba invadens
SFSNCYSLSKIVIGQNT

SEQ ID NO: 2966965 - protein, 21 aa, Entamoeba invadens
SFSPGLSFKTGFMKFFGGKED

SEQ ID NO: 2966966 - protein, 23 aa, Entamoeba invadens
SFSSPRKRVFSFVSPRKAESPKE

SEQ ID NO: 2966967 - protein, 32 aa, Entamoeba invadens
SFSTEFYTRCETLRQEVIKLFDLAKAAIDEPI

SEQ ID NO: 2966968 - protein, 24 aa, Entamoeba invadens
SFSVSFYGVSAWANLNGTQKIKLL

SEQ ID NO: 2966969 - protein, 25 aa, Entamoeba invadens
SFTEKFLKPRLINSSNYSVFARYLW

SEQ ID NO: 2966970 - protein, 19 aa, Entamoeba invadens
SFTELIFMFYVKWDVSDKY

SEQ ID NO: 2966971 - protein, 27 aa, Entamoeba invadens
SFTFPKSLKLLSLDSCNSLTSLNLETY

SEQ ID NO: 2966972 - protein, 18 aa, Entamoeba invadens
SFTHLAMEMENFVLSLKA

SEQ ID NO: 2966973 - protein, 25 aa, Entamoeba invadens
SFTKCDVCMPFSFTKKTIIIDSTLT

SEQ ID NO: 2966974 - protein, 18 aa, Entamoeba invadens
SFTKRVALLEGLDVSVMQ

SEQ ID NO: 2966975 - protein, 24 aa, Entamoeba invadens
SFTKSASFILCLSKIIDAVYSTQM

SEQ ID NO: 2966976 - protein, 17 aa, Entamoeba invadens
SFTLPLLERMRATNPAR

SEQ ID NO: 2966977 - protein, 18 aa, Entamoeba invadens
SFTNLLGIKVPKFLKKEE

SEQ ID NO: 2966978 - protein, 31 aa, Entamoeba invadens
SFTRLYGEYSHLCLLPYLRAVTRDIIQSLMS

SEQ ID NO: 2966979 - protein, 17 aa, Entamoeba invadens
SFTRSLEQVGSFKDIVH

SEQ ID NO: 2966980 - protein, 26 aa, Entamoeba invadens
SFVAAELPDLLALNLSHNGIRNGGFL

SEQ ID NO: 2966981 - protein, 22 aa, Entamoeba invadens
SFVCNIKKLLGRQFSSFSKGEI

SEQ ID NO: 2966982 - protein, 18 aa, Entamoeba invadens
SFVCTVFNCFSIKTSNEI

SEQ ID NO: 2966983 - protein, 18 aa, Entamoeba invadens
SFVFPKHIKTLIIGICDR

SEQ ID NO: 2966984 - protein, 19 aa, Entamoeba invadens
SFVKPDITPLHAFSSGEYD

SEQ ID NO: 2966985 - protein, 23 aa, Entamoeba invadens
SFVKSHLPAPMCVEGAEKKSFRS

SEQ ID NO: 2966986 - protein, 18 aa, Entamoeba invadens
SFVLKFPLMVRKTSLQER

SEQ ID NO: 2966987 - protein, 19 aa, Entamoeba invadens
SFVNRFSCDLNVCRVVGES

SEQ ID NO: 2966988 - protein, 25 aa, Entamoeba invadens
SFVQIRGNIPLLWKTNEEDTFAPKG

SEQ ID NO: 2966989 - protein, 18 aa, Entamoeba invadens
SFVRDIFERIAMDASSLT

SEQ ID NO: 2966990 - protein, 24 aa, Entamoeba invadens
SFVRIKVLQTWGSLVEHRAVPLDR

SEQ ID NO: 2966991 - protein, 19 aa, Entamoeba invadens
SFVSFKRCVEDLIENKTAL

SEQ ID NO: 2966992 - protein, 18 aa, Entamoeba invadens
SFVSRITTMLPLDESKKD

SEQ ID NO: 2966993 - protein, 26 aa, Entamoeba invadens
SFVVVKAIRVFFVWCGNYPCNTIQTI

SEQ ID NO: 2966994 - protein, 18 aa, Entamoeba invadens
SFYDRKTRQFEMNNTKKN

SEQ ID NO: 2966995 - protein, 20 aa, Entamoeba invadens
SFYEKYFKPNGYQWVNQDTL

SEQ ID NO: 2966996 - protein, 25 aa, Entamoeba invadens
SFYIDCNIFNTFSFKQCNNTNFEFF

SEQ ID NO: 2966997 - protein, 18 aa, Entamoeba invadens
SFYKSFKLVISGLDNLGA

SEQ ID NO: 2966998 - protein, 18 aa, Entamoeba invadens
SFYMEHWVELKAVIESPE

SEQ ID NO: 2966999 - protein, 22 aa, Entamoeba invadens
SFYPEEIFAIIIRGLLNKFMEY

SEQ ID NO: 2967000 - protein, 23 aa, Entamoeba invadens
SFYPEEISAFVFSNLKKQLIHKT

SEQ ID NO: 2967001 - protein, 20 aa, Entamoeba invadens
SFYVKGRTTVKITAIENASV

SEQ ID NO: 2967002 - protein, 20 aa, Entamoeba invadens
SGADGRTVFIVNERLVNCPY

SEQ ID NO: 2967003 - protein, 24 aa, Entamoeba invadens
SGADIKWVVSEACTKTLREDINAK

SEQ ID NO: 2967004 - protein, 25 aa, Entamoeba invadens
SGADYIRFGFIIPKHIHRMGDACFY

SEQ ID NO: 2967005 - protein, 17 aa, Entamoeba invadens
SGAINVWNIGTGENVAH

SEQ ID NO: 2967006 - protein, 19 aa, Entamoeba invadens
SGAKLPAAGIEFIASQFPL

SEQ ID NO: 2967007 - protein, 17 aa, Entamoeba invadens
SGALCTAILDWAANQHV

SEQ ID NO: 2967008 - protein, 18 aa, Entamoeba invadens
SGARLHLIYSSPIGNGGE

SEQ ID NO: 2967009 - protein, 30 aa, Entamoeba invadens
SGAYKGDMRLKFIIQMCACALNGRDMIYNT

SEQ ID NO: 2967010 - protein, 20 aa, Entamoeba invadens
SGCAICKSGYYRSGDGCKVC

SEQ ID NO: 2967011 - protein, 20 aa, Entamoeba invadens
SGCFYGCSSLRSVTIPSSVK

SEQ ID NO: 2967012 - protein, 25 aa, Entamoeba invadens
SGCNARPSVCPCWSVEPKLGTNPLV

SEQ ID NO: 2967013 - protein, 21 aa, Entamoeba invadens
SGCQKCKIGYFPEEKRCSPCS

SEQ ID NO: 2967014 - protein, 32 aa, Entamoeba invadens
SGCTAGVVVIFGRFLICGNVGDTEILVISEGK

SEQ ID NO: 2967015 - protein, 17 aa, Entamoeba invadens
SGCVMCSNGFYQVDTLN

SEQ ID NO: 2967016 - protein, 20 aa, Entamoeba invadens
SGDAQFCMCLSNAAVHVAMA

SEQ ID NO: 2967017 - protein, 21 aa, Entamoeba invadens
SGDDKTICLIEENLNAICLRV

SEQ ID NO: 2967018 - protein, 21 aa, Entamoeba invadens
SGDEFKNRFIKSINKDKIKIS

SEQ ID NO: 2967019 - protein, 26 aa, Entamoeba invadens
SGDFKSSLTLSWVFLKRGVELTKRIP

SEQ ID NO: 2967020 - protein, 17 aa, Entamoeba invadens
SGDIGLIMARRMTLEGA

SEQ ID NO: 2967021 - protein, 24 aa, Entamoeba invadens
SGDLWKSSDISLRNYITKSLGIDT

SEQ ID NO: 2967022 - protein, 26 aa, Entamoeba invadens
SGDMKEYFYPWALKTLDIMVKNLSDP

SEQ ID NO: 2967023 - protein, 19 aa, Entamoeba invadens
SGDRMTVIFSIKFDDKDDA

SEQ ID NO: 2967024 - protein, 27 aa, Entamoeba invadens
SGDSMKRVFSSFAFKLFAQDFNMFIGP

SEQ ID NO: 2967025 - protein, 17 aa, Entamoeba invadens
SGDSRGSTWMYSTLPYA

SEQ ID NO: 2967026 - protein, 29 aa, Entamoeba invadens
SGDVFYLRRNGFHYKVRIVENMVDDKVYV

SEQ ID NO: 2967027 - protein, 31 aa, Entamoeba invadens
SGDYLIGICLDRWAYVWDLRLRKPVSKIYLK

SEQ ID NO: 2967028 - protein, 19 aa, Entamoeba invadens
SGEACEFEVFLTPFCTMNL

SEQ ID NO: 2967029 - protein, 27 aa, Entamoeba invadens
SGEDLAIVMACDGVWDVFENVTVARMV

SEQ ID NO: 2967030 - protein, 18 aa, Entamoeba invadens
SGEIAGDDFLLSRMILFF

SEQ ID NO: 2967031 - protein, 20 aa, Entamoeba invadens
SGEKAAKCINFYSRLFHLFS

SEQ ID NO: 2967032 - protein, 21 aa, Entamoeba invadens
SGELCNGTFIFKFSGVGNDAN

SEQ ID NO: 2967033 - protein, 18 aa, Entamoeba invadens
SGELGLLEKGQMAMPRQG

SEQ ID NO: 2967034 - protein, 24 aa, Entamoeba invadens
SGEWKLGDLQFVFKEAPSNLANNF

SEQ ID NO: 2967035 - protein, 20 aa, Entamoeba invadens
SGFACEFEIFLTVECTTTLF

SEQ ID NO: 2967036 - protein, 17 aa, Entamoeba invadens
SGFAGRYFGGKPVILLY

SEQ ID NO: 2967037 - protein, 17 aa, Entamoeba invadens
SGFASEFEIFITPHCTL

SEQ ID NO: 2967038 - protein, 21 aa, Entamoeba invadens
SGFDIELRAAVLHEINEMMPE

SEQ ID NO: 2967039 - protein, 21 aa, Entamoeba invadens
SGFDKQLRVVIGFFEADGKDI

SEQ ID NO: 2967040 - protein, 20 aa, Entamoeba invadens
SGFDMKVEGLPVLEHGSFYF

SEQ ID NO: 2967041 - protein, 20 aa, Entamoeba invadens
SGFLKFPLIVLYPQDDQSDC

SEQ ID NO: 2967042 - protein, 18 aa, Entamoeba invadens
SGFLVFDMEIIRVIAKEG

SEQ ID NO: 2967043 - protein, 25 aa, Entamoeba invadens
SGFPHGGACTVVLRGSSKQLLGEME

SEQ ID NO: 2967044 - protein, 25 aa, Entamoeba invadens
SGFSKARTYQAFKSCDNFSEEVGTP

SEQ ID NO: 2967045 - protein, 27 aa, Entamoeba invadens
SGFSLDDPAAFAGRIYRMVKLGLSLDD

SEQ ID NO: 2967046 - protein, 22 aa, Entamoeba invadens
SGFTKNRMNAIVKVSQQHTFSE

SEQ ID NO: 2967047 - protein, 17 aa, Entamoeba invadens
SGFVHEFMCNFRGRPQK

SEQ ID NO: 2967048 - protein, 22 aa, Entamoeba invadens
SGFYIHHFFKKFLLKLKNKINQ

SEQ ID NO: 2967049 - protein, 20 aa, Entamoeba invadens
SGFYSFRKEVICGNQSIYKS

SEQ ID NO: 2967050 - protein, 33 aa, Entamoeba invadens
  misc_feature (33)..(33): Xaa can be any naturally occurring amino acid
SGGCAKCAEGYYRNGLDCYKCDLSCSLCNTNLX

SEQ ID NO: 2967051 - protein, 18 aa, Entamoeba invadens
SGGCVKCVNGYYRNGLSC

SEQ ID NO: 2967052 - protein, 20 aa, Entamoeba invadens
SGGIAIGMCGKNCVALAADN

SEQ ID NO: 2967053 - protein, 17 aa, Entamoeba invadens
SGGKFSVDVHGTVIEFD

SEQ ID NO: 2967054 - protein, 24 aa, Entamoeba invadens
SGGYGMTELCGMMYRMPAKSVNVP

SEQ ID NO: 2967055 - protein, 19 aa, Entamoeba invadens
SGHMLHGIFAFQPYFNLTN

SEQ ID NO: 2967056 - protein, 19 aa, Entamoeba invadens
SGHPDFIISYHHKLPHEER

SEQ ID NO: 2967057 - protein, 24 aa, Entamoeba invadens
SGHTLRLFDHFVFYNHICIVTELL

SEQ ID NO: 2967058 - protein, 19 aa, Entamoeba invadens
SGIESVSKFLFYVGDVNQK

SEQ ID NO: 2967059 - protein, 26 aa, Entamoeba invadens
SGIEVLRSVSGFMLEKDVVRVMKTIG

SEQ ID NO: 2967060 - protein, 31 aa, Entamoeba invadens
SGIGDRAVYIFGFHVMRCLFLDPHTVQPAAE

SEQ ID NO: 2967061 - protein, 19 aa, Entamoeba invadens
SGIGNAMYVGFSFAPLASP

SEQ ID NO: 2967062 - protein, 18 aa, Entamoeba invadens
SGIIHGFVGTPISLHCLT

SEQ ID NO: 2967063 - protein, 25 aa, Entamoeba invadens
SGIMKSWKRKWVRLTKTDIFVFDNP

SEQ ID NO: 2967064 - protein, 18 aa, Entamoeba invadens
SGIVSGFVTRILDGPMPW

SEQ ID NO: 2967065 - protein, 20 aa, Entamoeba invadens
SGIYMGWLARLCIRELIKKK

SEQ ID NO: 2967066 - protein, 21 aa, Entamoeba invadens
SGKAVCVFCAMKVVEQFCYYL

SEQ ID NO: 2967067 - protein, 19 aa, Entamoeba invadens
SGKCVACATITNCNTCSSD

SEQ ID NO: 2967068 - protein, 19 aa, Entamoeba invadens
SGKDDVVFKGMGVNGGDFV

SEQ ID NO: 2967069 - protein, 26 aa, Entamoeba invadens
SGKDKKERRLSFFQKMKGKKDKKKED

SEQ ID NO: 2967070 - protein, 26 aa, Entamoeba invadens
SGKEMLKMLFLLKGMLLNIKDTATLG

SEQ ID NO: 2967071 - protein, 21 aa, Entamoeba invadens
SGKFEWRWDPLGYIFHESEIG

SEQ ID NO: 2967072 - protein, 17 aa, Entamoeba invadens
SGKFPSKTIQQITSRIK

SEQ ID NO: 2967073 - protein, 26 aa, Entamoeba invadens
SGKLQFTFRPSDLFSSTFPVQAEKCK

SEQ ID NO: 2967074 - protein, 17 aa, Entamoeba invadens
SGKNVFELFEFIGNLSL

SEQ ID NO: 2967075 - protein, 25 aa, Entamoeba invadens
SGKQGRMRLNLMGKRVDFSARTVIS

SEQ ID NO: 2967076 - protein, 21 aa, Entamoeba invadens
SGKRLARSDVISIKEFDIIQN

SEQ ID NO: 2967077 - protein, 30 aa, Entamoeba invadens
SGKRLKKIDCIPLYLFDIISSCWQQDTTSR

SEQ ID NO: 2967078 - protein, 27 aa, Entamoeba invadens
SGKRQNKSWKRLVTKATFVGENFTRKP

SEQ ID NO: 2967079 - protein, 26 aa, Entamoeba invadens
SGKSAILVALAICFGAKAQFTSRGKR

SEQ ID NO: 2967080 - protein, 23 aa, Entamoeba invadens
SGLDCINLGAVCECKSTFDSYLS

SEQ ID NO: 2967081 - protein, 22 aa, Entamoeba invadens
SGLEAIKAHLISLTPGKYTIDT

SEQ ID NO: 2967082 - protein, 18 aa, Entamoeba invadens
SGLGKSFVLTGMGRLSPE

SEQ ID NO: 2967083 - protein, 17 aa, Entamoeba invadens
SGLMSMATYPSATQYLP

SEQ ID NO: 2967084 - protein, 24 aa, Entamoeba invadens
SGLQRVAKIFAMGIIGNVLNREDL

SEQ ID NO: 2967085 - protein, 19 aa, Entamoeba invadens
SGLSIRFKERCEANIVDVG

SEQ ID NO: 2967086 - protein, 18 aa, Entamoeba invadens
SGLYRIQYIVGDLVTVLR

SEQ ID NO: 2967087 - protein, 21 aa, Entamoeba invadens
SGMFLEFYAKATGAGTEAAQS

SEQ ID NO: 2967088 - protein, 19 aa, Entamoeba invadens
SGMIRRGFSGCYTYDDMLV

SEQ ID NO: 2967089 - protein, 17 aa, Entamoeba invadens
SGMLSLFTCDYVYVITS

SEQ ID NO: 2967090 - protein, 25 aa, Entamoeba invadens
SGMPELRLGLNEKINIGSRMEGNTV

SEQ ID NO: 2967091 - protein, 23 aa, Entamoeba invadens
SGMPIALYYSFLVFGAFSEYLKD

SEQ ID NO: 2967092 - protein, 19 aa, Entamoeba invadens
SGNAAGRRIWLAKKPSNFS

SEQ ID NO: 2967093 - protein, 22 aa, Entamoeba invadens
SGNDVKNRYFGSLKRKMFTKPK

SEQ ID NO: 2967094 - protein, 21 aa, Entamoeba invadens
SGNFLKMSLLDGIRDESVDLF

SEQ ID NO: 2967095 - protein, 22 aa, Entamoeba invadens
SGNGALAFRLIMNYKIDPKSVD

SEQ ID NO: 2967096 - protein, 25 aa, Entamoeba invadens
SGNPWNLLPSAYRASFSKNQTNIHI

SEQ ID NO: 2967097 - protein, 26 aa, Entamoeba invadens
SGNVEKLSFTFDRIFSSLSTQDDVFS

SEQ ID NO: 2967098 - protein, 18 aa, Entamoeba invadens
SGNVNCFDVFSFRDQNVI

SEQ ID NO: 2967099 - protein, 27 aa, Entamoeba invadens
SGNYCKKCSTANCAICNTNNVCTQCLT

SEQ ID NO: 2967100 - protein, 18 aa, Entamoeba invadens
SGPKDVYLPSTIQATEPI

SEQ ID NO: 2967101 - protein, 24 aa, Entamoeba invadens
SGPLEFFGGGAYGNCSNESYWNVD

SEQ ID NO: 2967102 - protein, 23 aa, Entamoeba invadens
SGPSEVMHSPLLYYFDTLGGTSN

SEQ ID NO: 2967103 - protein, 17 aa, Entamoeba invadens
SGQAFGRGEYFGNDISV

SEQ ID NO: 2967104 - protein, 26 aa, Entamoeba invadens
SGQAFPQCVFDHWQLMNGDINDVSTK

SEQ ID NO: 2967105 - protein, 18 aa, Entamoeba invadens
SGQDILFTGGYGKRTAAL

SEQ ID NO: 2967106 - protein, 20 aa, Entamoeba invadens
SGQFEACFILNTKHVNHTPE

SEQ ID NO: 2967107 - protein, 23 aa, Entamoeba invadens
SGQGCAFCKDGYYRSGDGCKVCN

SEQ ID NO: 2967108 - protein, 25 aa, Entamoeba invadens
SGQTEGFFPYRIPQQSLYARKDVNL

SEQ ID NO: 2967109 - protein, 20 aa, Entamoeba invadens
SGRIKIVEWLFKQKKELLEE

SEQ ID NO: 2967110 - protein, 22 aa, Entamoeba invadens
SGRTRLIKNVLFLVETASGCVF

SEQ ID NO: 2967111 - protein, 17 aa, Entamoeba invadens
SGRWRKQKTPKELVALN

SEQ ID NO: 2967112 - protein, 20 aa, Entamoeba invadens
SGSDGGSCIDGRLTSAWNWC

SEQ ID NO: 2967113 - protein, 25 aa, Entamoeba invadens
SGSDMKELVRDAAFGPIRELNSNNL

SEQ ID NO: 2967114 - protein, 19 aa, Entamoeba invadens
SGSIFGFYQKDMINNMKCC

SEQ ID NO: 2967115 - protein, 22 aa, Entamoeba invadens
SGSIKKGLKTTVMKKSQVTQKS

SEQ ID NO: 2967116 - protein, 22 aa, Entamoeba invadens
SGSRDKTLLTWKVETTSEAQPE

SEQ ID NO: 2967117 - protein, 22 aa, Entamoeba invadens
SGSRVRVCIITKDGVDERLHVS

SEQ ID NO: 2967118 - protein, 17 aa, Entamoeba invadens
SGSTFLHNLLLADPTSK

SEQ ID NO: 2967119 - protein, 28 aa, Entamoeba invadens
SGSTSMFYNSDFFFGLRGKLRNSNNKPT

SEQ ID NO: 2967120 - protein, 19 aa, Entamoeba invadens
SGSVLLRKETFPHLFPSFS

SEQ ID NO: 2967121 - protein, 24 aa, Entamoeba invadens
SGSYREVFDMVFAELFVNKPYTKT

SEQ ID NO: 2967122 - protein, 31 aa, Entamoeba invadens
SGTEEFKFGKIKIFFKVGVLAEIEERRRVDE

SEQ ID NO: 2967123 - protein, 17 aa, Entamoeba invadens
SGTEWITMFDEVMVGLL

SEQ ID NO: 2967124 - protein, 26 aa, Entamoeba invadens
SGTFKGCTKLPVVVFPSISVGVMQED

SEQ ID NO: 2967125 - protein, 18 aa, Entamoeba invadens
SGTGYNLDCVNCTNVTVS

SEQ ID NO: 2967126 - protein, 22 aa, Entamoeba invadens
SGTIPYCCPEIVPSEHSQGGVY

SEQ ID NO: 2967127 - protein, 24 aa, Entamoeba invadens
SGTKCLSCKSGFYQSDIYQCQPST

SEQ ID NO: 2967128 - protein, 24 aa, Entamoeba invadens
SGTLFRFGNGDIMVYNRNIKASNY

SEQ ID NO: 2967129 - protein, 26 aa, Entamoeba invadens
SGTMIKVELWDTAGLEKFQTIPSLFY

SEQ ID NO: 2967130 - protein, 28 aa, Entamoeba invadens
SGVCVAFSDGRIGWAEFSSGTFDIVVRE

SEQ ID NO: 2967131 - protein, 17 aa, Entamoeba invadens
SGVEMKRCTVIYDDAQY

SEQ ID NO: 2967132 - protein, 25 aa, Entamoeba invadens
SGVFDSACIYEWLKAKNPNESELKE

SEQ ID NO: 2967133 - protein, 22 aa, Entamoeba invadens
SGVGKSAICHRLCKDSFTDIYT

SEQ ID NO: 2967134 - protein, 21 aa, Entamoeba invadens
SGVGKSCLLLRFADDTYTDTH

SEQ ID NO: 2967135 - protein, 24 aa, Entamoeba invadens
SGVGKSCLMNQFINKAFVSEYKAT

SEQ ID NO: 2967136 - protein, 20 aa, Entamoeba invadens
SGVKFWCALIDEAAQSIEPE

SEQ ID NO: 2967137 - protein, 23 aa, Entamoeba invadens
SGVKPRKGVEIVPIVYYPVTQRQ

SEQ ID NO: 2967138 - protein, 18 aa, Entamoeba invadens
SGVKSLGIYCFWECNNLV

SEQ ID NO: 2967139 - protein, 23 aa, Entamoeba invadens
SGVLKYFCAKGKSEAETKNNLRI

SEQ ID NO: 2967140 - protein, 18 aa, Entamoeba invadens
SGVLRGGFYDGLATISRE

SEQ ID NO: 2967141 - protein, 25 aa, Entamoeba invadens
SGVLYAICSNLIYNIEDKECLRNAK

SEQ ID NO: 2967142 - protein, 24 aa, Entamoeba invadens
SGVMVCTVIGFPLGSTPTEVKAFE

SEQ ID NO: 2967143 - protein, 17 aa, Entamoeba invadens
SGVNIGILFGEVSKQIA

SEQ ID NO: 2967144 - protein, 24 aa, Entamoeba invadens
SGVSKRLFYYFGNYQLNGISHVCL

SEQ ID NO: 2967145 - protein, 20 aa, Entamoeba invadens
SGVSRFLLALVKIGLIKSPT

SEQ ID NO: 2967146 - protein, 18 aa, Entamoeba invadens
SGVYTDAFLTPKSSVPEQ

SEQ ID NO: 2967147 - protein, 20 aa, Entamoeba invadens
SGWLELLYTLLISTKMAVGL

SEQ ID NO: 2967148 - protein, 30 aa, Entamoeba invadens
SGWTTLFECLRFSVEFNMTRKTGFEILKKV

SEQ ID NO: 2967149 - protein, 25 aa, Entamoeba invadens
SGYTSSRCSVVFSGYGLEHPTTETS

SEQ ID NO: 2967150 - protein, 18 aa, Entamoeba invadens
SHALELLDFHYPDEEVRI

SEQ ID NO: 2967151 - protein, 29 aa, Entamoeba invadens
SHANLRFKWKTSVNSTVWLGGTFTTSVFT

SEQ ID NO: 2967152 - protein, 27 aa, Entamoeba invadens
SHCRLCKNEKCSICDNNFILNNEGSCV

SEQ ID NO: 2967153 - protein, 17 aa, Entamoeba invadens
SHCVTLISVGRGTMIFV

SEQ ID NO: 2967154 - protein, 20 aa, Entamoeba invadens
SHDEIHFFAADMFKALEYLI

SEQ ID NO: 2967155 - protein, 24 aa, Entamoeba invadens
SHDEVFALMKWPKLERNVGKGYFN

SEQ ID NO: 2967156 - protein, 22 aa, Entamoeba invadens
SHDWPQGIVMKGDYQQLYKYQP

SEQ ID NO: 2967157 - protein, 18 aa, Entamoeba invadens
SHDWPTFGNKRIVEYYEK

SEQ ID NO: 2967158 - protein, 28 aa, Entamoeba invadens
SHEETKKWNCLLMKLQRRDKRPNLVREE

SEQ ID NO: 2967159 - protein, 22 aa, Entamoeba invadens
SHEFNCAVRICFFKFISEMLGN

SEQ ID NO: 2967160 - protein, 21 aa, Entamoeba invadens
SHEVVAWLKRILKVEKTGHSG

SEQ ID NO: 2967161 - protein, 19 aa, Entamoeba invadens
SHFFSNCTLLAKVILPKYL

SEQ ID NO: 2967162 - protein, 21 aa, Entamoeba invadens
SHFLCKGCGGLMKDGEYQEIR

SEQ ID NO: 2967163 - protein, 20 aa, Entamoeba invadens
SHFPLDFTIMTPEHVKPDIE

SEQ ID NO: 2967164 - protein, 25 aa, Entamoeba invadens
SHFYYTNFCGFEIAFHVAPLLPSTT

SEQ ID NO: 2967165 - protein, 23 aa, Entamoeba invadens
SHGQTEFKREVDILAAETAGSVP

SEQ ID NO: 2967166 - protein, 17 aa, Entamoeba invadens
SHGVGYVILKTSHSTNL

SEQ ID NO: 2967167 - protein, 19 aa, Entamoeba invadens
SHHSLVWKHQVSTRQFTTQ

SEQ ID NO: 2967168 - protein, 26 aa, Entamoeba invadens
SHIAGCVFCHASGFLACNKTFEGIIQ

SEQ ID NO: 2967169 - protein, 28 aa, Entamoeba invadens
SHIDGCKLREFLNVVAQFCYSYVDHVEN

SEQ ID NO: 2967170 - protein, 24 aa, Entamoeba invadens
SHIKALEVQKKMALDDKAKAEKTA

SEQ ID NO: 2967171 - protein, 23 aa, Entamoeba invadens
SHIPFPSLVEKWFDFMPSPLGEE

SEQ ID NO: 2967172 - protein, 18 aa, Entamoeba invadens
SHIRRPSRNMLQRKESID

SEQ ID NO: 2967173 - protein, 23 aa, Entamoeba invadens
SHKLYLCGKNAINRAKEWLDDFG

SEQ ID NO: 2967174 - protein, 34 aa, Entamoeba invadens
SHLGICGKYGHIGVMKWKQQELVSEFVASEQCND

SEQ ID NO: 2967175 - protein, 18 aa, Entamoeba invadens
SHLNLGVDHHRFFRDVLI

SEQ ID NO: 2967176 - protein, 26 aa, Entamoeba invadens
SHLPSRLPCKVIGKYEYVASYGKDIS

SEQ ID NO: 2967177 - protein, 24 aa, Entamoeba invadens
SHLRGGKNAYFMWSVNFSQTNAIL

SEQ ID NO: 2967178 - protein, 24 aa, Entamoeba invadens
SHLSEVFFKSSIKTITRHSSISTD

SEQ ID NO: 2967179 - protein, 22 aa, Entamoeba invadens
SHLTKLSGAFTYVYKLKDLVIP

SEQ ID NO: 2967180 - protein, 21 aa, Entamoeba invadens
SHLTSLCQAENGGNCMNYDAL

SEQ ID NO: 2967181 - protein, 18 aa, Entamoeba invadens
SHNELLQYINIFKTTEPI

SEQ ID NO: 2967182 - protein, 24 aa, Entamoeba invadens
SHNFFEICHAFAITSRHLICKNDF

SEQ ID NO: 2967183 - protein, 23 aa, Entamoeba invadens
SHNKFLIEFHRFYENVKEITFSE

SEQ ID NO: 2967184 - protein, 25 aa, Entamoeba invadens
SHNNVGMGLTFNRQVLRQVLESLHG

SEQ ID NO: 2967185 - protein, 18 aa, Entamoeba invadens
SHNPKPWNGLKFVDSDGL

SEQ ID NO: 2967186 - protein, 20 aa, Entamoeba invadens
SHNRITIPVVYNGKQSPLPR

SEQ ID NO: 2967187 - protein, 20 aa, Entamoeba invadens
SHNRITIPVVYNGKQYSFYP

SEQ ID NO: 2967188 - protein, 19 aa, Entamoeba invadens
SHNVFSFEGLDGVFVLSIR

SEQ ID NO: 2967189 - protein, 20 aa, Entamoeba invadens
SHPDLKQFTLFDIDTTTLNG

SEQ ID NO: 2967190 - protein, 25 aa, Entamoeba invadens
SHQQFQAQNSFGWSPVALNSVPNQF

SEQ ID NO: 2967191 - protein, 41 aa, Entamoeba invadens
SHRDACWKYIEILSQIWSKAQIHLNFVWYDTYLVDDKKPVK

SEQ ID NO: 2967192 - protein, 19 aa, Entamoeba invadens
SHSDIYIFSLLRNVLQKIV

SEQ ID NO: 2967193 - protein, 20 aa, Entamoeba invadens
SHSFGATLFDSVLSGKKVHI

SEQ ID NO: 2967194 - protein, 18 aa, Entamoeba invadens
SHSRAVVIEGHYQMVGMK

SEQ ID NO: 2967195 - protein, 18 aa, Entamoeba invadens
SHTALKFSHKKSMLQTGS

SEQ ID NO: 2967196 - protein, 21 aa, Entamoeba invadens
SHTCYRCGKLSKIVLSESLTR

SEQ ID NO: 2967197 - protein, 24 aa, Entamoeba invadens
SHVLRVIVAALRRNGKNVFVTAST

SEQ ID NO: 2967198 - protein, 22 aa, Entamoeba invadens
SHVPGIIKDAFKAISNESQSTF

SEQ ID NO: 2967199 - protein, 25 aa, Entamoeba invadens
SHVSELKTYLARCLSIDSLPLRLKA

SEQ ID NO: 2967200 - protein, 21 aa, Entamoeba invadens
SHVTEILGPWFDRDVLHFESV

SEQ ID NO: 2967201 - protein, 26 aa, Entamoeba invadens
SHYEMIRFDLLTSLKFLNISNRQVTQ

SEQ ID NO: 2967202 - protein, 18 aa, Entamoeba invadens
SHYNHLKNIVVPKYATAI

SEQ ID NO: 2967203 - protein, 19 aa, Entamoeba invadens
SHYNLISALHKSMRGSDEN

SEQ ID NO: 2967204 - protein, 18 aa, Entamoeba invadens
SHYPTRFVVKRMYAIQWV

SEQ ID NO: 2967205 - protein, 20 aa, Entamoeba invadens
SIADGCGMGRLPSSASKLAC

SEQ ID NO: 2967206 - protein, 24 aa, Entamoeba invadens
SIAKARIRSADVLVIDEISMIDDR

SEQ ID NO: 2967207 - protein, 27 aa, Entamoeba invadens
SIALDLRTVMTYMFKRYKDTFINMIDE

SEQ ID NO: 2967208 - protein, 21 aa, Entamoeba invadens
SIASLPTFVFFQNKKVVKKAP

SEQ ID NO: 2967209 - protein, 21 aa, Entamoeba invadens
SIASLPTFVFFQNQNVMKKAP

SEQ ID NO: 2967210 - protein, 18 aa, Entamoeba invadens
SIATGRWGCGAFFNDPLL

SEQ ID NO: 2967211 - protein, 18 aa, Entamoeba invadens
SIATLQFLNVKQITFGKN

SEQ ID NO: 2967212 - protein, 26 aa, Entamoeba invadens
SIATSLKCLSETSYAIYSANNTAHQP

SEQ ID NO: 2967213 - protein, 21 aa, Entamoeba invadens
SICELNRTFCCCKSLKEVVIP

SEQ ID NO: 2967214 - protein, 18 aa, Entamoeba invadens
SICKPSYYPEISCNECTL

SEQ ID NO: 2967215 - protein, 23 aa, Entamoeba invadens
SICSDRNCDTCVFIEDRNPDLTY

SEQ ID NO: 2967216 - protein, 24 aa, Entamoeba invadens
SIDCTLPVFWSRATNFKEMLKILV

SEQ ID NO: 2967217 - protein, 21 aa, Entamoeba invadens
SIDFKDEYLPTVGTLLLSTAS

SEQ ID NO: 2967218 - protein, 18 aa, Entamoeba invadens
SIDGRLRYFIDHVNYRFA

SEQ ID NO: 2967219 - protein, 18 aa, Entamoeba invadens
SIDLLNCPSKPGKMPKED

SEQ ID NO: 2967220 - protein, 19 aa, Entamoeba invadens
SIDLTECYKVHVVCRVGVV

SEQ ID NO: 2967221 - protein, 23 aa, Entamoeba invadens
SIDSFCFFKCANLSYLTTPSNVR

SEQ ID NO: 2967222 - protein, 19 aa, Entamoeba invadens
SIEAIMIYVRCGRVDDAYS

SEQ ID NO: 2967223 - protein, 25 aa, Entamoeba invadens
SIEALIPFFEGLRMDFGVESALRKL

SEQ ID NO: 2967224 - protein, 19 aa, Entamoeba invadens
SIEEKSCFENLIYYISDLN

SEQ ID NO: 2967225 - protein, 23 aa, Entamoeba invadens
SIEEVRPQLKRVIQLKEDPSQKF

SEQ ID NO: 2967226 - protein, 17 aa, Entamoeba invadens
SIEFLQFDIEYVTRLVE

SEQ ID NO: 2967227 - protein, 28 aa, Entamoeba invadens
SIEGSFFKNWKRRYAVLAKNVIALFKTA

SEQ ID NO: 2967228 - protein, 24 aa, Entamoeba invadens
SIEIGKIVDCLKYHYNDTVNNLVW

SEQ ID NO: 2967229 - protein, 18 aa, Entamoeba invadens
SIEKGSQEPLLFDIPTQS

SEQ ID NO: 2967230 - protein, 18 aa, Entamoeba invadens
SIEKRAGIQTEKKQKSSK

SEQ ID NO: 2967231 - protein, 25 aa, Entamoeba invadens
SIELDLEFSSTMFPVIPPKYNFLSP

SEQ ID NO: 2967232 - protein, 25 aa, Entamoeba invadens
SIELKGSNISIIFHDHFTPLRIHQT

SEQ ID NO: 2967233 - protein, 19 aa, Entamoeba invadens
SIELSEEFIHAHAVKKVFA

SEQ ID NO: 2967234 - protein, 25 aa, Entamoeba invadens
SIERLCFPTKVQSIGSNCFMDCISL

SEQ ID NO: 2967235 - protein, 22 aa, Entamoeba invadens
SIERVSVFFATFASDSLNKTQS

SEQ ID NO: 2967236 - protein, 17 aa, Entamoeba invadens
SIETVRSLFVLNIVEPI

SEQ ID NO: 2967237 - protein, 19 aa, Entamoeba invadens
SIFCALNMKYMVYNKKEIK

SEQ ID NO: 2967238 - protein, 17 aa, Entamoeba invadens
SIFEIAMLFPNKSLQQL

SEQ ID NO: 2967239 - protein, 23 aa, Entamoeba invadens
SIFEIPSKFTIRSYYECYRNDIC

SEQ ID NO: 2967240 - protein, 17 aa, Entamoeba invadens
SIFFCLFDNTKGPVIVY

SEQ ID NO: 2967241 - protein, 17 aa, Entamoeba invadens
SIFGAKCAEVVLRDLTG

SEQ ID NO: 2967242 - protein, 17 aa, Entamoeba invadens
SIFIWDKFHEFLGVLTN

SEQ ID NO: 2967243 - protein, 23 aa, Entamoeba invadens
SIFKECSCHTLASLFKLFLRELP

SEQ ID NO: 2967244 - protein, 27 aa, Entamoeba invadens
SIFKYECLYCQSGFIVGNPVKITTKVD

SEQ ID NO: 2967245 - protein, 17 aa, Entamoeba invadens
SIFNGLVQQSGCSEELL

SEQ ID NO: 2967246 - protein, 25 aa, Entamoeba invadens
SIFTETFYGMLLRRTTCSCGYHSDT

SEQ ID NO: 2967247 - protein, 25 aa, Entamoeba invadens
SIFTKCKRVLNPLYIQNGYTTDSAI

SEQ ID NO: 2967248 - protein, 18 aa, Entamoeba invadens
SIGCIFAEMCSGQILFCD

SEQ ID NO: 2967249 - protein, 17 aa, Entamoeba invadens
SIGDFCFQDCLSLKSIV

SEQ ID NO: 2967250 - protein, 24 aa, Entamoeba invadens
SIGDFCFYKCSSLKFVHLPETISE

SEQ ID NO: 2967251 - protein, 17 aa, Entamoeba invadens
SIGDLCFNRCCRLGSVL

SEQ ID NO: 2967252 - protein, 17 aa, Entamoeba invadens
SIGDNCFERCVSLKTIE

SEQ ID NO: 2967253 - protein, 19 aa, Entamoeba invadens
SIGDWCFNECISLTSVTIS

SEQ ID NO: 2967254 - protein, 17 aa, Entamoeba invadens
SIGEKVYFAKTLRPGRC

SEQ ID NO: 2967255 - protein, 20 aa, Entamoeba invadens
SIGEMCFYDNTNLVEIVLPD

SEQ ID NO: 2967256 - protein, 26 aa, Entamoeba invadens
SIGERRKAFEWHFLDLTKPKQQPPQL

SEQ ID NO: 2967257 - protein, 24 aa, Entamoeba invadens
SIGEYCFYCCSSLSSVTIPSSVTS

SEQ ID NO: 2967258 - protein, 20 aa, Entamoeba invadens
SIGGYCFKNCVSLINIEIPE

SEQ ID NO: 2967259 - protein, 20 aa, Entamoeba invadens
SIGGYCFKNCVSLINIEISE

SEQ ID NO: 2967260 - protein, 21 aa, Entamoeba invadens
SIGGYCFYECSSLIVITIPSS

SEQ ID NO: 2967261 - protein, 27 aa, Entamoeba invadens
SIGIDFIWDKEYFKALTQLEGVNNVEI

SEQ ID NO: 2967262 - protein, 21 aa, Entamoeba invadens
SIGIGCFFACYNLQSITIPSK

SEQ ID NO: 2967263 - protein, 25 aa, Entamoeba invadens
SIGKACFCRCCFLKNVVILSSVTSI

SEQ ID NO: 2967264 - protein, 23 aa, Entamoeba invadens
SIGKECFYFCINLSSVTLPLNVT

SEQ ID NO: 2967265 - protein, 23 aa, Entamoeba invadens
SIGKSCFFNCSSLTSVTIPSNVT

SEQ ID NO: 2967266 - protein, 24 aa, Entamoeba invadens
SIGKSCFLDCHMLKNISLPLQLQE

SEQ ID NO: 2967267 - protein, 26 aa, Entamoeba invadens
SIGKVFNVWWNLRKFLVEFSTQKTVG

SEQ ID NO: 2967268 - protein, 21 aa, Entamoeba invadens
SIGKYCFSGCSCLSSVNIPSS

SEQ ID NO: 2967269 - protein, 18 aa, Entamoeba invadens
SIGKYGVKYDFIRRKNKW

SEQ ID NO: 2967270 - protein, 18 aa, Entamoeba invadens
SIGNCYWNVPAMSKGEVV

SEQ ID NO: 2967271 - protein, 22 aa, Entamoeba invadens
SIGNGCFCYCSSLSSVNIPSSV

SEQ ID NO: 2967272 - protein, 19 aa, Entamoeba invadens
SIGNWCFNRCSSLTSVTIP

SEQ ID NO: 2967273 - protein, 17 aa, Entamoeba invadens
SIGRLCFCQSLTRENVM

SEQ ID NO: 2967274 - protein, 25 aa, Entamoeba invadens
SIGRNCIVCGKIVHNGLYCSYCPAC

SEQ ID NO: 2967275 - protein, 20 aa, Entamoeba invadens
SIGSFCFAKCTSISKIEIPN

SEQ ID NO: 2967276 - protein, 45 aa, Entamoeba invadens
SIGSNCFYCCPNLTSLIIPDRVCLIGNYCFMRCSKLEYCALSSSL

SEQ ID NO: 2967277 - protein, 19 aa, Entamoeba invadens
SIGYATLRAKGKRSTYDSL

SEQ ID NO: 2967278 - protein, 24 aa, Entamoeba invadens
SIGYQCFYCYIRLESVTMTSNLKS

SEQ ID NO: 2967279 - protein, 22 aa, Entamoeba invadens
SIGYYCFSRCYSLSSVTISLSV

SEQ ID NO: 2967280 - protein, 18 aa, Entamoeba invadens
SIHHRLNFIVLSLCNTST

SEQ ID NO: 2967281 - protein, 24 aa, Entamoeba invadens
SIHLRKTSTAFRVTSKIVPGDITM

SEQ ID NO: 2967282 - protein, 20 aa, Entamoeba invadens
SIIGDCPHYIKVLGTKRVLA

SEQ ID NO: 2967283 - protein, 19 aa, Entamoeba invadens
SIIGLFKAKMKVLAVDYDW

SEQ ID NO: 2967284 - protein, 17 aa, Entamoeba invadens
SIIIPLSVTSIGGYCFS

SEQ ID NO: 2967285 - protein, 23 aa, Entamoeba invadens
SIIIVPVCLDWYCFVDEDNENYL

SEQ ID NO: 2967286 - protein, 24 aa, Entamoeba invadens
SIIKRPTLSSSLTCEEVVEIVKSG

SEQ ID NO: 2967287 - protein, 28 aa, Entamoeba invadens
SIILKKSEECWNVVLGIVKKMKENGDID

SEQ ID NO: 2967288 - protein, 17 aa, Entamoeba invadens
SIIQMCWNQNPKERNTI

SEQ ID NO: 2967289 - protein, 24 aa, Entamoeba invadens
SIIRKVNHPCILGCSNVFLTSHRA

SEQ ID NO: 2967290 - protein, 26 aa, Entamoeba invadens
SIIRYKVPYFIAKMLGKRGVLCEQIE

SEQ ID NO: 2967291 - protein, 25 aa, Entamoeba invadens
SIISLNNKCFWGCCGLLSVTIPSNV

SEQ ID NO: 2967292 - protein, 21 aa, Entamoeba invadens
SIKCKEVFKSLNARNELQTFT

SEQ ID NO: 2967293 - protein, 19 aa, Entamoeba invadens
SIKDLKKHRFLQIPDDNQP

SEQ ID NO: 2967294 - protein, 26 aa, Entamoeba invadens
SIKESLKLYNVLILLKTCAKIEMINI

SEQ ID NO: 2967295 - protein, 24 aa, Entamoeba invadens
SIKKIGLGCFRFCVSLPSLHLPEK

SEQ ID NO: 2967296 - protein, 23 aa, Entamoeba invadens
SIKKLLVCSPIIYTNTAIENSLV

SEQ ID NO: 2967297 - protein, 20 aa, Entamoeba invadens
SIKLVEHWKSTLISNEFEKE

SEQ ID NO: 2967298 - protein, 28 aa, Entamoeba invadens
SIKLWDGFKGTCLHTYRGHVQTVYACAW

SEQ ID NO: 2967299 - protein, 21 aa, Entamoeba invadens
SIKRPLFQLLENRYGEAHFIS

SEQ ID NO: 2967300 - protein, 20 aa, Entamoeba invadens
SIKSRLIFRGIDKVQIGCKR

SEQ ID NO: 2967301 - protein, 25 aa, Entamoeba invadens
SIKVIDRMSNGIWKGQIQDQSGLFH

SEQ ID NO: 2967302 - protein, 18 aa, Entamoeba invadens
SILDFKVNHIERFIEICK

SEQ ID NO: 2967303 - protein, 26 aa, Entamoeba invadens
SILEEFPKRYDLWNVYLDMESRVGET

SEQ ID NO: 2967304 - protein, 17 aa, Entamoeba invadens
SILEIAFSNIRMIERRR

SEQ ID NO: 2967305 - protein, 27 aa, Entamoeba invadens
SILEKWCFRCCRSLRSIDIPINVKVLS

SEQ ID NO: 2967306 - protein, 26 aa, Entamoeba invadens
SILFEKRLYPQMKMIGLGSRLTTLLE

SEQ ID NO: 2967307 - protein, 18 aa, Entamoeba invadens
SILIRPSGLLNMVVVQIL

SEQ ID NO: 2967308 - protein, 19 aa, Entamoeba invadens
SILLNDSFVLFNSCMGEEV

SEQ ID NO: 2967309 - protein, 28 aa, Entamoeba invadens
SILPKKGVMFKFTICQEAVVYEGFSVVL

SEQ ID NO: 2967310 - protein, 30 aa, Entamoeba invadens
SILPVPRIKFYATEILLALNALKQCNYVHR

SEQ ID NO: 2967311 - protein, 20 aa, Entamoeba invadens
SILRYLGILLYMGAHHDVIN

SEQ ID NO: 2967312 - protein, 25 aa, Entamoeba invadens
SILSDFLRGRIVYRLYDYDDDEKWM

SEQ ID NO: 2967313 - protein, 21 aa, Entamoeba invadens
SILVREFCREFGIPTEFRLQI

SEQ ID NO: 2967314 - protein, 26 aa, Entamoeba invadens
SILYVKGCYTNGIFRENSLANKEQVE

SEQ ID NO: 2967315 - protein, 22 aa, Entamoeba invadens
SIMDFHCISVHFSVFNPSNKRG

SEQ ID NO: 2967316 - protein, 23 aa, Entamoeba invadens
SIMDVKCHWVLPTNLTRLSVLDE

SEQ ID NO: 2967317 - protein, 20 aa, Entamoeba invadens
SIMFGKYCVIVMRNADGSKM

SEQ ID NO: 2967318 - protein, 17 aa, Entamoeba invadens
SIMLPLLPISDRTLNLA

SEQ ID NO: 2967319 - protein, 17 aa, Entamoeba invadens
SIMPGKVNPVIAEVMNQ

SEQ ID NO: 2967320 - protein, 23 aa, Entamoeba invadens
SIMSIGVINRVRYDEFMGCHVGW

SEQ ID NO: 2967321 - protein, 24 aa, Entamoeba invadens
SIMSLERRVMRIFSVNDGQDDVEK

SEQ ID NO: 2967322 - protein, 22 aa, Entamoeba invadens
SINDVRCINAFFSYLIKNVGDY

SEQ ID NO: 2967323 - protein, 18 aa, Entamoeba invadens
SINDWCFSGCISLSSVTI

SEQ ID NO: 2967324 - protein, 23 aa, Entamoeba invadens
SINGHCFYCCNTLNKVTIPSGVK

SEQ ID NO: 2967325 - protein, 25 aa, Entamoeba invadens
SINISLPLCLFKRPPTKMICLNAQA

SEQ ID NO: 2967326 - protein, 21 aa, Entamoeba invadens
SINLLPSHFHQLLRFISVEVA

SEQ ID NO: 2967327 - protein, 23 aa, Entamoeba invadens
SINPNQEFRCFVIQNTLCAIIQR

SEQ ID NO: 2967328 - protein, 27 aa, Entamoeba invadens
SINPPICSNCLTGTYAVEGASAFCSPD

SEQ ID NO: 2967329 - protein, 24 aa, Entamoeba invadens
SINSFCFNCCSQLKLIQIPNNVKS

SEQ ID NO: 2967330 - protein, 32 aa, Entamoeba invadens
SINYPKCDTVGKGYVRGLKFFGMKFTPKEGGC

SEQ ID NO: 2967331 - protein, 21 aa, Entamoeba invadens
SIPAVRGWVTKQGGGHKSWKK

SEQ ID NO: 2967332 - protein, 17 aa, Entamoeba invadens
SIPDVVGRKRRGVQVNE

SEQ ID NO: 2967333 - protein, 21 aa, Entamoeba invadens
SIPEQFILDNFFRKVEQEKYY

SEQ ID NO: 2967334 - protein, 24 aa, Entamoeba invadens
SIPFKRKKTALQMFGESEEPHDFP

SEQ ID NO: 2967335 - protein, 18 aa, Entamoeba invadens
SIPKCQYTAFIAKGYNFA

SEQ ID NO: 2967336 - protein, 18 aa, Entamoeba invadens
SIPLESLPQFAELDQNGT

SEQ ID NO: 2967337 - protein, 24 aa, Entamoeba invadens
SIPLKRTSISFGLTSLQKCIELFF

SEQ ID NO: 2967338 - protein, 23 aa, Entamoeba invadens
SIPLNEIKSIVLMSDGVTDALTD

SEQ ID NO: 2967339 - protein, 37 aa, Entamoeba invadens
SIPLPDFLINKFLGIAIGWYIRLMKKSAINDGIKQYV

SEQ ID NO: 2967340 - protein, 23 aa, Entamoeba invadens
SIPRIFLVRHAIRVDYMDLTWVP

SEQ ID NO: 2967341 - protein, 23 aa, Entamoeba invadens
SIPRMCVLMNNLLLIAKVKMFKG

SEQ ID NO: 2967342 - protein, 24 aa, Entamoeba invadens
SIPSQLVLRISVILVDVLDFPETL

SEQ ID NO: 2967343 - protein, 24 aa, Entamoeba invadens
SIQEVLQLFPALQTLYLYSGNSSN

SEQ ID NO: 2967344 - protein, 20 aa, Entamoeba invadens
SIQGIPFGKVAEGMDVVQKI

SEQ ID NO: 2967345 - protein, 25 aa, Entamoeba invadens
SIQHYRFNTTWYILDPLHLVTVNFQ

SEQ ID NO: 2967346 - protein, 27 aa, Entamoeba invadens
SIQQLLKIVFMFRTDFEINTKLIPTDY

SEQ ID NO: 2967347 - protein, 25 aa, Entamoeba invadens
SIRITKNVSLRCFYAGHALGAVCFE

SEQ ID NO: 2967348 - protein, 19 aa, Entamoeba invadens
SIRKEVVWSLLRTAVQTSM

SEQ ID NO: 2967349 - protein, 22 aa, Entamoeba invadens
SIRKYCFYKTPLEKVKFTTTLK

SEQ ID NO: 2967350 - protein, 24 aa, Entamoeba invadens
SIRNFAFYYCINFTQIVLPISLVD

SEQ ID NO: 2967351 - protein, 17 aa, Entamoeba invadens
SIRNIPDGFGLLQNLKI

SEQ ID NO: 2967352 - protein, 22 aa, Entamoeba invadens
SIRRFCYPRLLTTVNPVAFLQM

SEQ ID NO: 2967353 - protein, 20 aa, Entamoeba invadens
SIRSFLELQISYSKSTIVCR

SEQ ID NO: 2967354 - protein, 25 aa, Entamoeba invadens
SISAFRFAPVSSYEVTDWVCDNSAL

SEQ ID NO: 2967355 - protein, 21 aa, Entamoeba invadens
SISARRPRYIDPFTNQVHTSA

SEQ ID NO: 2967356 - protein, 25 aa, Entamoeba invadens
SISDLKLTPGFIYTHFILLDTETLK

SEQ ID NO: 2967357 - protein, 23 aa, Entamoeba invadens
SISDLPFRLVLYPPTANTLTLLS

SEQ ID NO: 2967358 - protein, 17 aa, Entamoeba invadens
SISEAFSEFSSAAFSEV

SEQ ID NO: 2967359 - protein, 24 aa, Entamoeba invadens
SISGMCLELEPLYYELLDFGEETT

SEQ ID NO: 2967360 - protein, 18 aa, Entamoeba invadens
SISIGIDFGTSKFAISYR

SEQ ID NO: 2967361 - protein, 18 aa, Entamoeba invadens
SISKTKCVLTLPYTKYTT

SEQ ID NO: 2967362 - protein, 18 aa, Entamoeba invadens
SISNFAQHLLETFEKTKS

SEQ ID NO: 2967363 - protein, 21 aa, Entamoeba invadens
SISVIRPSFIIADSKTGICNT

SEQ ID NO: 2967364 - protein, 20 aa, Entamoeba invadens
SITEAIAWDVLTPEMFLKLF

SEQ ID NO: 2967365 - protein, 29 aa, Entamoeba invadens
SITEIPCLCFRGCVKLSSIELPYKVHRIG

SEQ ID NO: 2967366 - protein, 19 aa, Entamoeba invadens
SITELSPFCFDNCVSLETI

SEQ ID NO: 2967367 - protein, 52 aa, Entamoeba invadens
SITESYLFGCTDLTSVCIPLNITEMRSWCFACCGSLKRVVIMAQLSSLPPKA

SEQ ID NO: 2967368 - protein, 21 aa, Entamoeba invadens
SITKLHSKLCLGVFETVSATR

SEQ ID NO: 2967369 - protein, 24 aa, Entamoeba invadens
SITLKRQMPLVGFCTYFDCDVKNK

SEQ ID NO: 2967370 - protein, 24 aa, Entamoeba invadens
SITMYETFGWKLAYMKTDKRFQYA

SEQ ID NO: 2967371 - protein, 22 aa, Entamoeba invadens
SITPEVYTSVFFGWQNSPSMSV

SEQ ID NO: 2967372 - protein, 19 aa, Entamoeba invadens
SITSRKSFEQIPTLRNDIL

SEQ ID NO: 2967373 - protein, 20 aa, Entamoeba invadens
SITSVHKFLNLPILDFQKQI

SEQ ID NO: 2967374 - protein, 28 aa, Entamoeba invadens
SITYLPYDIFKPLIPLGVFQVVMFYMKS

SEQ ID NO: 2967375 - protein, 17 aa, Entamoeba invadens
SIVATICSTLGIDPNRY

SEQ ID NO: 2967376 - protein, 20 aa, Entamoeba invadens
SIVELFFKTKFNDIHPEQVN

SEQ ID NO: 2967377 - protein, 25 aa, Entamoeba invadens
SIVGKVKSPLFLLVIALNQILSSVS

SEQ ID NO: 2967378 - protein, 26 aa, Entamoeba invadens
SIVIIPSLFADLAMIVMKLIPQKPQI

SEQ ID NO: 2967379 - protein, 24 aa, Entamoeba invadens
SIVKEAGDAFGFPKIPQTLEDIIL

SEQ ID NO: 2967380 - protein, 17 aa, Entamoeba invadens
SIVKLCMEYHTHTTNYI

SEQ ID NO: 2967381 - protein, 18 aa, Entamoeba invadens
SIVSGKALIRVCYDSKEK

SEQ ID NO: 2967382 - protein, 19 aa, Entamoeba invadens
SIVSGKALIRVCYDSKEKK

SEQ ID NO: 2967383 - protein, 20 aa, Entamoeba invadens
SIVTLVFRFDEESSFKNVIN

SEQ ID NO: 2967384 - protein, 19 aa, Entamoeba invadens
SIVTMIWDKMAKGVGSSIN

SEQ ID NO: 2967385 - protein, 18 aa, Entamoeba invadens
SIVTSIGYRCFSKCSNLS

SEQ ID NO: 2967386 - protein, 19 aa, Entamoeba invadens
SIWTYLHMRRDFKEVDERK

SEQ ID NO: 2967387 - protein, 20 aa, Entamoeba invadens
SIYAYEFMETTLIDMYSISV

SEQ ID NO: 2967388 - protein, 19 aa, Entamoeba invadens
SIYKIEWTENGVLFCNLNI

SEQ ID NO: 2967389 - protein, 19 aa, Entamoeba invadens
SIYLKYNLLFNFFPLLNTL

SEQ ID NO: 2967390 - protein, 20 aa, Entamoeba invadens
SIYLRPTNFALFSEKTLAMM

SEQ ID NO: 2967391 - protein, 25 aa, Entamoeba invadens
SIYQDEWKFVLQLVESVTSSSVFLK

SEQ ID NO: 2967392 - protein, 25 aa, Entamoeba invadens
SIYTNWWGGEFKWRDKVNQVLNGVF

SEQ ID NO: 2967393 - protein, 21 aa, Entamoeba invadens
SKAAIALALFGGEPKLLKEKG

SEQ ID NO: 2967394 - protein, 18 aa, Entamoeba invadens
SKAAILRQIEDFTSLQDT

SEQ ID NO: 2967395 - protein, 22 aa, Entamoeba invadens
SKACILSVLSHWFRSYPGDFAN

SEQ ID NO: 2967396 - protein, 21 aa, Entamoeba invadens
SKADGFLMMYSIDDYKLLNKL

SEQ ID NO: 2967397 - protein, 26 aa, Entamoeba invadens
SKAEMTERFELFILKREIANAYTELN

SEQ ID NO: 2967398 - protein, 26 aa, Entamoeba invadens
SKAEVCGDIPWSEFFFGCGEQSSEVT

SEQ ID NO: 2967399 - protein, 25 aa, Entamoeba invadens
SKAEYASEWMYTFNDEVAQECESKK

SEQ ID NO: 2967400 - protein, 20 aa, Entamoeba invadens
SKAFKGCGIEEVTLSSTIMY

SEQ ID NO: 2967401 - protein, 24 aa, Entamoeba invadens
SKAFVFVFDCSWFNGNDLPQNELI

SEQ ID NO: 2967402 - protein, 27 aa, Entamoeba invadens
SKAIALCKDPIFYGNRAAAYTAIGEDL

SEQ ID NO: 2967403 - protein, 23 aa, Entamoeba invadens
SKAIDFKGNFNFLQKVENLDSTF

SEQ ID NO: 2967404 - protein, 25 aa, Entamoeba invadens
SKAIFPVTFIAKFFSYLPKKYFDNF

SEQ ID NO: 2967405 - protein, 18 aa, Entamoeba invadens
SKALPLWRGATNEEMLQR

SEQ ID NO: 2967406 - protein, 17 aa, Entamoeba invadens
SKALYFEKMEDFVSIEA

SEQ ID NO: 2967407 - protein, 17 aa, Entamoeba invadens
SKANIWFNAVLRGDMAK

SEQ ID NO: 2967408 - protein, 26 aa, Entamoeba invadens
SKAQMCCDMSKLLVFPVSYLQFPKGT

SEQ ID NO: 2967409 - protein, 29 aa, Entamoeba invadens
SKAQVNLALCYLKGVGVVRSLQNALNSYE

SEQ ID NO: 2967410 - protein, 18 aa, Entamoeba invadens
SKARELILMTGGATVVNY

SEQ ID NO: 2967411 - protein, 23 aa, Entamoeba invadens
SKARLEDFFGLFVLFEIIFKTIR

SEQ ID NO: 2967412 - protein, 25 aa, Entamoeba invadens
SKAVFKIKFACAVIDESAQSIEPET

SEQ ID NO: 2967413 - protein, 19 aa, Entamoeba invadens
SKCACVSIGSSIKETEELK

SEQ ID NO: 2967414 - protein, 23 aa, Entamoeba invadens
SKCEEIYEVQSLLFTALSDLASE

SEQ ID NO: 2967415 - protein, 25 aa, Entamoeba invadens
SKCILQSLILARLVKKFPELIESTN

SEQ ID NO: 2967416 - protein, 18 aa, Entamoeba invadens
SKCKECAVGYYVTEDLTC

SEQ ID NO: 2967417 - protein, 19 aa, Entamoeba invadens
SKCKSELLYTHIKRISVEN

SEQ ID NO: 2967418 - protein, 19 aa, Entamoeba invadens
SKCKTCATDFTRKCIECNT

SEQ ID NO: 2967419 - protein, 21 aa, Entamoeba invadens
SKCTFSNCCLLKEFEMPNFVT

SEQ ID NO: 2967420 - protein, 30 aa, Entamoeba invadens
SKCVGCGLCCKECMCCVLKLESGKVYVDPE

SEQ ID NO: 2967421 - protein, 21 aa, Entamoeba invadens
SKCVKSDIFVYGYTGRLVEIS

SEQ ID NO: 2967422 - protein, 17 aa, Entamoeba invadens
SKDASKIALGYFMNLST

SEQ ID NO: 2967423 - protein, 26 aa, Entamoeba invadens
SKDCVVVPCGHRCCCSECAKHMKKCP

SEQ ID NO: 2967424 - protein, 20 aa, Entamoeba invadens
SKDDKDCICISKYNNNKSLV

SEQ ID NO: 2967425 - protein, 28 aa, Entamoeba invadens
SKDEKIRAVVCNRLFPQQWSRITNFFPD

SEQ ID NO: 2967426 - protein, 18 aa, Entamoeba invadens
SKDIPCQLQHMMNVKKVT

SEQ ID NO: 2967427 - protein, 28 aa, Entamoeba invadens
SKDKFDSGCGWPAFTKPIHPLSLYEKTD

SEQ ID NO: 2967428 - protein, 18 aa, Entamoeba invadens
SKDKLFFNTWRKSREITE

SEQ ID NO: 2967429 - protein, 23 aa, Entamoeba invadens
SKDKTVDHIIVFITKQLRDTTTT

SEQ ID NO: 2967430 - protein, 20 aa, Entamoeba invadens
SKDLCGRVPVQLRNEYDEQS

SEQ ID NO: 2967431 - protein, 21 aa, Entamoeba invadens
SKDLRDCISLIATEALNKMLA

SEQ ID NO: 2967432 - protein, 25 aa, Entamoeba invadens
SKDSIEAVVKWKANIDDRVLFNEQK

SEQ ID NO: 2967433 - protein, 19 aa, Entamoeba invadens
SKDTMYRKAAMLMINNILD

SEQ ID NO: 2967434 - protein, 19 aa, Entamoeba invadens
SKDYFGILVCSIMSGVEVI

SEQ ID NO: 2967435 - protein, 19 aa, Entamoeba invadens
SKDYLAIALLIAVNYLRDE

SEQ ID NO: 2967436 - protein, 18 aa, Entamoeba invadens
SKEALDFLKKMSIKYNAI

SEQ ID NO: 2967437 - protein, 18 aa, Entamoeba invadens
SKECGLSIFSDVKSCEIL

SEQ ID NO: 2967438 - protein, 23 aa, Entamoeba invadens
SKECVDSLLARKKRENESFEEGI

SEQ ID NO: 2967439 - protein, 23 aa, Entamoeba invadens
SKECVKRWKKWRIEQSGMSTISC

SEQ ID NO: 2967440 - protein, 21 aa, Entamoeba invadens
SKEDWFDWVKQTAITFLKESP

SEQ ID NO: 2967441 - protein, 24 aa, Entamoeba invadens
SKEEALSFLRVCVVTKPNMNPFPP

SEQ ID NO: 2967442 - protein, 23 aa, Entamoeba invadens
SKEEIPIFIKFYDKFDCDTYNDE

SEQ ID NO: 2967443 - protein, 20 aa, Entamoeba invadens
SKEEIWRNSLVNLFEREVIE

SEQ ID NO: 2967444 - protein, 20 aa, Entamoeba invadens
SKEFATILFGWLDQNKDGYL

SEQ ID NO: 2967445 - protein, 17 aa, Entamoeba invadens
SKEFLPKYLRHSNYAAF

SEQ ID NO: 2967446 - protein, 26 aa, Entamoeba invadens
SKEFRCGITKALLYKFHPFFKYLYPT

SEQ ID NO: 2967447 - protein, 21 aa, Entamoeba invadens
  misc_feature (16)..(17): Xaa can be any naturally occurring amino acid
SKEGLSLFGCLNKCIXXDEKI

SEQ ID NO: 2967448 - protein, 19 aa, Entamoeba invadens
SKEHIARDCPKRLAEVNKK

SEQ ID NO: 2967449 - protein, 17 aa, Entamoeba invadens
SKEIGITAAMVTDLSYF

SEQ ID NO: 2967450 - protein, 20 aa, Entamoeba invadens
SKEIPVRKEVYIDNADGKKK

SEQ ID NO: 2967451 - protein, 23 aa, Entamoeba invadens
SKEKFKFPWKIVDFVSKGNYLEK

SEQ ID NO: 2967452 - protein, 17 aa, Entamoeba invadens
SKEKMIPVVQKWVKGCY

SEQ ID NO: 2967453 - protein, 18 aa, Entamoeba invadens
SKELKIPKIISAEEIMLC

SEQ ID NO: 2967454 - protein, 23 aa, Entamoeba invadens
SKELMTYLVKRVKGVNKLKLLNA

SEQ ID NO: 2967455 - protein, 18 aa, Entamoeba invadens
SKELRYKVSASIKKSYFI

SEQ ID NO: 2967456 - protein, 18 aa, Entamoeba invadens
SKEMFLVGEYCDLCKKRV

SEQ ID NO: 2967457 - protein, 32 aa, Entamoeba invadens
SKEMVRKKGMEHFLDMFFEYTKTIVPNIENST

SEQ ID NO: 2967458 - protein, 20 aa, Entamoeba invadens
SKENFFCFLNAMKTVVLSEI

SEQ ID NO: 2967459 - protein, 20 aa, Entamoeba invadens
SKERKRCNFVITVYVRENDE

SEQ ID NO: 2967460 - protein, 18 aa, Entamoeba invadens
SKERLAFFTKFFEENKCV

SEQ ID NO: 2967461 - protein, 21 aa, Entamoeba invadens
SKESVKVCITNLVYLQQNGAD

SEQ ID NO: 2967462 - protein, 20 aa, Entamoeba invadens
SKEVFRKTVKPFKVQINTGV

SEQ ID NO: 2967463 - protein, 25 aa, Entamoeba invadens
SKEVLEIVGNILLFLMNTFQKFEPT

SEQ ID NO: 2967464 - protein, 21 aa, Entamoeba invadens
SKEVLQRLSVLQSNLAHKIEE

SEQ ID NO: 2967465 - protein, 26 aa, Entamoeba invadens
SKEVPSMIKAAALRKSQRPKTMNLSQ

SEQ ID NO: 2967466 - protein, 21 aa, Entamoeba invadens
SKEYCKGICYIIENSDVFSHL

SEQ ID NO: 2967467 - protein, 20 aa, Entamoeba invadens
SKEYSIRKFAKWLHSQHFLH

SEQ ID NO: 2967468 - protein, 17 aa, Entamoeba invadens
SKFADLWSSLKTPVENY

SEQ ID NO: 2967469 - protein, 19 aa, Entamoeba invadens
SKFAKSFDDVEEFVEFKPE

SEQ ID NO: 2967470 - protein, 23 aa, Entamoeba invadens
SKFAVPFDFALRMSQKGIFFTNI

SEQ ID NO: 2967471 - protein, 28 aa, Entamoeba invadens
SKFEEGVGCAIRYGDLSSYASGLQELDA

SEQ ID NO: 2967472 - protein, 19 aa, Entamoeba invadens
SKFGEAGLFSAVEKSIDIP

SEQ ID NO: 2967473 - protein, 27 aa, Entamoeba invadens
SKFGLLRKIKDAFNRFVDVVDSTHDDE

SEQ ID NO: 2967474 - protein, 20 aa, Entamoeba invadens
SKFIVYYNIVSKVMIYKTKI

SEQ ID NO: 2967475 - protein, 27 aa, Entamoeba invadens
SKFKILREIAVGLAFVQTVAHVFHGDL

SEQ ID NO: 2967476 - protein, 19 aa, Entamoeba invadens
SKFKNGLKGVLVAFEEVST

SEQ ID NO: 2967477 - protein, 23 aa, Entamoeba invadens
SKFLKSEIGLRINGKSSGDILKL

SEQ ID NO: 2967478 - protein, 20 aa, Entamoeba invadens
SKFSKFLKCYTTYVNSYDQT

SEQ ID NO: 2967479 - protein, 21 aa, Entamoeba invadens
SKFVGWKGKRIVIYDISVLKE

SEQ ID NO: 2967480 - protein, 21 aa, Entamoeba invadens
SKGCLKCIDMFYLNTTNNECL

SEQ ID NO: 2967481 - protein, 24 aa, Entamoeba invadens
SKGFKKNFATFFSLGGVESEKQTD

SEQ ID NO: 2967482 - protein, 18 aa, Entamoeba invadens
SKGIDVTSVIAIQLCNEP

SEQ ID NO: 2967483 - protein, 22 aa, Entamoeba invadens
SKGILKLFPWQVECLEKSEVLA

SEQ ID NO: 2967484 - protein, 19 aa, Entamoeba invadens
SKGKCKLISYFNENKKLVL

SEQ ID NO: 2967485 - protein, 23 aa, Entamoeba invadens
SKGKSIETTPCFFLTSQSIEGEI

SEQ ID NO: 2967486 - protein, 18 aa, Entamoeba invadens
SKGLRPSTIEEIRTSSLT

SEQ ID NO: 2967487 - protein, 19 aa, Entamoeba invadens
SKGQSPVSHSFVLPETSFQ

SEQ ID NO: 2967488 - protein, 20 aa, Entamoeba invadens
SKGRTTVVIAHRLSTIQNAD

SEQ ID NO: 2967489 - protein, 21 aa, Entamoeba invadens
SKGRTTVVIAHRLSTIQNADE

SEQ ID NO: 2967490 - protein, 17 aa, Entamoeba invadens
SKGTCLEKLGFGGFCVY

SEQ ID NO: 2967491 - protein, 27 aa, Entamoeba invadens
SKGVLLAMKIGEGFAHEKSDLFESFRI

SEQ ID NO: 2967492 - protein, 17 aa, Entamoeba invadens
SKGVVMEGGVAYKGDKE

SEQ ID NO: 2967493 - protein, 22 aa, Entamoeba invadens
SKHAKIKTPEIVMNKNNDKKTP

SEQ ID NO: 2967494 - protein, 20 aa, Entamoeba invadens
SKHFPSLMMWDDFDSKLKKA

SEQ ID NO: 2967495 - protein, 18 aa, Entamoeba invadens
SKHIPIVLCGNKCDLEFE

SEQ ID NO: 2967496 - protein, 24 aa, Entamoeba invadens
SKHKTERLRVEKLRMSSEIFRMRN

SEQ ID NO: 2967497 - protein, 20 aa, Entamoeba invadens
SKHLLEIGDECFAKCNNLIS

SEQ ID NO: 2967498 - protein, 20 aa, Entamoeba invadens
SKHLLNLPWYKKEPKQENDF

SEQ ID NO: 2967499 - protein, 22 aa, Entamoeba invadens
SKHMLLMAALHYEYTNGLLEIH

SEQ ID NO: 2967500 - protein, 23 aa, Entamoeba invadens
SKHQLSPRYGIYNIKSPFEDVLV

SEQ ID NO: 2967501 - protein, 17 aa, Entamoeba invadens
SKIAVSFSFTQRIVQTD

SEQ ID NO: 2967502 - protein, 17 aa, Entamoeba invadens
SKIDKFCDCSDLECKKC

SEQ ID NO: 2967503 - protein, 32 aa, Entamoeba invadens
SKIEGLDKLMFVIKMSEGWQFGFYSEDIAPVH

SEQ ID NO: 2967504 - protein, 24 aa, Entamoeba invadens
SKIEQLGNCDLVFSDSQIIAILPN

SEQ ID NO: 2967505 - protein, 17 aa, Entamoeba invadens
SKIEVVEIRTLFNSIGG

SEQ ID NO: 2967506 - protein, 18 aa, Entamoeba invadens
SKIKAVVAQKEFYMPFVF

SEQ ID NO: 2967507 - protein, 22 aa, Entamoeba invadens
SKIKEDCIVVLLSRIQNMLNLT

SEQ ID NO: 2967508 - protein, 33 aa, Entamoeba invadens
SKIKLLNYCCAHTAATCLSHWNSSYLLFKGFKM

SEQ ID NO: 2967509 - protein, 26 aa, Entamoeba invadens
SKIKPEFAKYFTFLDTFNFYEEFNGS

SEQ ID NO: 2967510 - protein, 20 aa, Entamoeba invadens
SKIKVLYMYGDYAKYTENAV

SEQ ID NO: 2967511 - protein, 22 aa, Entamoeba invadens
SKIKVTNCVSLCLFTDRVMVAL

SEQ ID NO: 2967512 - protein, 21 aa, Entamoeba invadens
SKINFDIEVIGCFARVTATHF

SEQ ID NO: 2967513 - protein, 19 aa, Entamoeba invadens
SKIPFAHVTSISVLRTYRR

SEQ ID NO: 2967514 - protein, 20 aa, Entamoeba invadens
SKIPHSITFALTYNDFATPV

SEQ ID NO: 2967515 - protein, 19 aa, Entamoeba invadens
SKIPVVNGYPLLAKEKKIT

SEQ ID NO: 2967516 - protein, 17 aa, Entamoeba invadens
SKISAWSKKSGKKTVKE

SEQ ID NO: 2967517 - protein, 20 aa, Entamoeba invadens
SKISIFVDSFEKCYEGVEAI

SEQ ID NO: 2967518 - protein, 20 aa, Entamoeba invadens
SKISKILLEKCGKEMLAATD

SEQ ID NO: 2967519 - protein, 17 aa, Entamoeba invadens
SKITIPFSVTYIGDECF

SEQ ID NO: 2967520 - protein, 20 aa, Entamoeba invadens
SKITIPFSVTYIGDECFSEC

SEQ ID NO: 2967521 - protein, 19 aa, Entamoeba invadens
SKIVHFGFFYLSECSNLKK

SEQ ID NO: 2967522 - protein, 20 aa, Entamoeba invadens
SKIVIGQRMLGYVISSDNES

SEQ ID NO: 2967523 - protein, 22 aa, Entamoeba invadens
SKKAHPIFGVTLYDAVHHHNRG

SEQ ID NO: 2967524 - protein, 20 aa, Entamoeba invadens
SKKAMSFAMMLVENVKKDGV

SEQ ID NO: 2967525 - protein, 18 aa, Entamoeba invadens
SKKAQQALMLLRKNVIYP

SEQ ID NO: 2967526 - protein, 18 aa, Entamoeba invadens
SKKAVVFQQFLSVETLWN

SEQ ID NO: 2967527 - protein, 17 aa, Entamoeba invadens
SKKCGRCVNGMDFLNLR

SEQ ID NO: 2967528 - protein, 25 aa, Entamoeba invadens
SKKCGTAAFSLRTNPLVDFQDFVYH

SEQ ID NO: 2967529 - protein, 21 aa, Entamoeba invadens
SKKCLKCEDGFVLVNDECVSL

SEQ ID NO: 2967530 - protein, 25 aa, Entamoeba invadens
SKKCQDVFHSLKINPYITDVFLPNK

SEQ ID NO: 2967531 - protein, 26 aa, Entamoeba invadens
SKKCSHIFYSRVNLFSPFITNGIWFN

SEQ ID NO: 2967532 - protein, 29 aa, Entamoeba invadens
SKKDIKLVSKISIKKVVERAEIMDEKNYK

SEQ ID NO: 2967533 - protein, 25 aa, Entamoeba invadens
SKKEFKLKEAQFVATIWDTAGQERF

SEQ ID NO: 2967534 - protein, 26 aa, Entamoeba invadens
SKKEKFLMKHVIGINKEFKKYEEEVP

SEQ ID NO: 2967535 - protein, 24 aa, Entamoeba invadens
SKKELLCTQGPIKIKEELLDQVEL

SEQ ID NO: 2967536 - protein, 24 aa, Entamoeba invadens
SKKERKNLLSGMNIFVGGKPKIST

SEQ ID NO: 2967537 - protein, 17 aa, Entamoeba invadens
SKKFAKQLLEGMSKKTV

SEQ ID NO: 2967538 - protein, 26 aa, Entamoeba invadens
SKKFIFPRVINFKGSVEHITCIMKKV

SEQ ID NO: 2967539 - protein, 18 aa, Entamoeba invadens
SKKHKAKANDEWKKAMKK

SEQ ID NO: 2967540 - protein, 26 aa, Entamoeba invadens
SKKIGRYRQFLGIGIYDEGGIMDSTD

SEQ ID NO: 2967541 - protein, 17 aa, Entamoeba invadens
SKKKCLVDAARKLLAQT

SEQ ID NO: 2967542 - protein, 24 aa, Entamoeba invadens
SKKLKQKRLEAGALVLASSEISIE

SEQ ID NO: 2967543 - protein, 19 aa, Entamoeba invadens
SKKPHKVIAEDGPKKVKKS

SEQ ID NO: 2967544 - protein, 18 aa, Entamoeba invadens
SKKRFEIEKNLRELQTQL

SEQ ID NO: 2967545 - protein, 19 aa, Entamoeba invadens
SKKRFKSSLNLKEKSEEPK

SEQ ID NO: 2967546 - protein, 26 aa, Entamoeba invadens
SKKRIPWTTICKIVLVALENIEKKQF

SEQ ID NO: 2967547 - protein, 22 aa, Entamoeba invadens
SKKRVPIVLCGNKIDREERREV

SEQ ID NO: 2967548 - protein, 21 aa, Entamoeba invadens
SKKSCIIFFDEIDAVGGTRFQ

SEQ ID NO: 2967549 - protein, 25 aa, Entamoeba invadens
SKKTIKFRIPYSMELNGITLDVDGL

SEQ ID NO: 2967550 - protein, 21 aa, Entamoeba invadens
SKKVDVYMCDNFVVRVAQKEF

SEQ ID NO: 2967551 - protein, 20 aa, Entamoeba invadens
SKKVFELLKNLSMSLITTSA

SEQ ID NO: 2967552 - protein, 23 aa, Entamoeba invadens
SKKVKKCFVCGKEGHYASRCPLN

SEQ ID NO: 2967553 - protein, 24 aa, Entamoeba invadens
SKKVKLEEGFTFAMLVLAPEDVTQ

SEQ ID NO: 2967554 - protein, 23 aa, Entamoeba invadens
SKKWILGSKFGFTTSQKLLKREI

SEQ ID NO: 2967555 - protein, 22 aa, Entamoeba invadens
SKKWVVAVLAFFGIKQDDSSYI

SEQ ID NO: 2967556 - protein, 19 aa, Entamoeba invadens
SKLALKLTLNKDIVQVVQI

SEQ ID NO: 2967557 - protein, 19 aa, Entamoeba invadens
SKLEKYPKFVVAKGANYSD

SEQ ID NO: 2967558 - protein, 24 aa, Entamoeba invadens
SKLFEGFCPVMLKIVNSEVPIIKE

SEQ ID NO: 2967559 - protein, 21 aa, Entamoeba invadens
SKLFEPFSINLVFDMLSDPQF

SEQ ID NO: 2967560 - protein, 21 aa, Entamoeba invadens
SKLFKLSKFNEAVLASEEDIK

SEQ ID NO: 2967561 - protein, 17 aa, Entamoeba invadens
SKLFMNVKLPHELQNEF

SEQ ID NO: 2967562 - protein, 24 aa, Entamoeba invadens
SKLFPSRWYNYGFNDIVKIAEGDL

SEQ ID NO: 2967563 - protein, 25 aa, Entamoeba invadens
SKLFYTKKFECLTSVYGSNGSIRSA

SEQ ID NO: 2967564 - protein, 17 aa, Entamoeba invadens
SKLGFTDRLEKTTSEKT

SEQ ID NO: 2967565 - protein, 26 aa, Entamoeba invadens
SKLHLVLRLRGGGISQFAIDNNLLSP

SEQ ID NO: 2967566 - protein, 18 aa, Entamoeba invadens
SKLIDGIFSFYGGDNPAI

SEQ ID NO: 2967567 - protein, 21 aa, Entamoeba invadens
SKLIKSCEFEVEYPPTKVQFS

SEQ ID NO: 2967568 - protein, 17 aa, Entamoeba invadens
SKLKAILQEASILQVDI

SEQ ID NO: 2967569 - protein, 22 aa, Entamoeba invadens
SKLKAKDLFTSDPYTIVSLAGQ

SEQ ID NO: 2967570 - protein, 25 aa, Entamoeba invadens
SKLKEFSKEIKLIIPNSTRLNRGNL

SEQ ID NO: 2967571 - protein, 17 aa, Entamoeba invadens
SKLKFNEMIFGGDVEYD

SEQ ID NO: 2967572 - protein, 19 aa, Entamoeba invadens
SKLKKFKVEYLKFGEGELF

SEQ ID NO: 2967573 - protein, 19 aa, Entamoeba invadens
SKLKKLRFLGTNGDNKKLP

SEQ ID NO: 2967574 - protein, 17 aa, Entamoeba invadens
SKLKVMRSQNMLLKMAY

SEQ ID NO: 2967575 - protein, 27 aa, Entamoeba invadens
SKLLTLPSCGNGGIILKSDGAILSQEG

SEQ ID NO: 2967576 - protein, 17 aa, Entamoeba invadens
SKLLYIVLSSSLLHIAA

SEQ ID NO: 2967577 - protein, 21 aa, Entamoeba invadens
SKLLYRCIQEYIVVIFTVHQP

SEQ ID NO: 2967578 - protein, 24 aa, Entamoeba invadens
SKLPGRFLTNRSFAARPMMYIRNT

SEQ ID NO: 2967579 - protein, 17 aa, Entamoeba invadens
SKLPKPSLHKMKGALVG

SEQ ID NO: 2967580 - protein, 17 aa, Entamoeba invadens
SKLPRNFTASIELPKPQ

SEQ ID NO: 2967581 - protein, 22 aa, Entamoeba invadens
SKLRLLEIWATSDLMGNWISVE

SEQ ID NO: 2967582 - protein, 18 aa, Entamoeba invadens
SKLRRRLNSNKKRTPKPI

SEQ ID NO: 2967583 - protein, 21 aa, Entamoeba invadens
SKLRVNDFFVENGVIQVILQR

SEQ ID NO: 2967584 - protein, 26 aa, Entamoeba invadens
SKLSEKFSFALNFCSLPKGLQPSSCK

SEQ ID NO: 2967585 - protein, 25 aa, Entamoeba invadens
SKLSFKKLYSVVVHFNVKFDDIQKL

SEQ ID NO: 2967586 - protein, 19 aa, Entamoeba invadens
SKLSLYPLTDCEHATMTVD

SEQ ID NO: 2967587 - protein, 22 aa, Entamoeba invadens
SKLSREFLCVNFINFSEELYTF

SEQ ID NO: 2967588 - protein, 17 aa, Entamoeba invadens
SKLSSLIIPSSVSSTSE

SEQ ID NO: 2967589 - protein, 26 aa, Entamoeba invadens
SKLTEICNFAFFKCYSLNKIVLPTHL

SEQ ID NO: 2967590 - protein, 18 aa, Entamoeba invadens
SKLYELRDVPTLQTLSVS

SEQ ID NO: 2967591 - protein, 24 aa, Entamoeba invadens
SKMAINPADIRLCSGRYVVAQCGS

SEQ ID NO: 2967592 - protein, 17 aa, Entamoeba invadens
SKMCGICDDMITSFDKF

SEQ ID NO: 2967593 - protein, 24 aa, Entamoeba invadens
SKMCMVTEFARYGSLQDLIRKNKD

SEQ ID NO: 2967594 - protein, 17 aa, Entamoeba invadens
SKMFLKNVIVLVVEEFI

SEQ ID NO: 2967595 - protein, 19 aa, Entamoeba invadens
SKMGMIRFITGIGRHSEKG

SEQ ID NO: 2967596 - protein, 19 aa, Entamoeba invadens
SKMINRMLTFFNEHVKKMQ

SEQ ID NO: 2967597 - protein, 23 aa, Entamoeba invadens
SKMPNRFPPVVFYTPKELGGLGM

SEQ ID NO: 2967598 - protein, 18 aa, Entamoeba invadens
SKMRGVNHNHCYRLEQVH

SEQ ID NO: 2967599 - protein, 29 aa, Entamoeba invadens
SKNALLKDWALFFLRCIHHMSVQKMQKLL

SEQ ID NO: 2967600 - protein, 22 aa, Entamoeba invadens
SKNCVTALEMLHINPPKLCVGM

SEQ ID NO: 2967601 - protein, 18 aa, Entamoeba invadens
SKNFFDHVEEIRMKSKKC

SEQ ID NO: 2967602 - protein, 21 aa, Entamoeba invadens
SKNIVTLFILIWIKLKCLGFK

SEQ ID NO: 2967603 - protein, 19 aa, Entamoeba invadens
SKNKCRFALYEFDKHGSCT

SEQ ID NO: 2967604 - protein, 20 aa, Entamoeba invadens
SKNKPVLIKRRRKTEDEDVH

SEQ ID NO: 2967605 - protein, 32 aa, Entamoeba invadens
SKNLFGIFYGFWLKKTMGFIIDGEIGNFFGAK

SEQ ID NO: 2967606 - protein, 19 aa, Entamoeba invadens
SKNPIILFIDKIHTVLGAG

SEQ ID NO: 2967607 - protein, 18 aa, Entamoeba invadens
SKNVFKTDGVLMLVPARN

SEQ ID NO: 2967608 - protein, 18 aa, Entamoeba invadens
SKNVIAIVGDAAYGPCQS

SEQ ID NO: 2967609 - protein, 23 aa, Entamoeba invadens
SKNWKKKLLDAISHTKGFVSLMD

SEQ ID NO: 2967610 - protein, 22 aa, Entamoeba invadens
SKPAEMPSERVIGKTPSNFVKR

SEQ ID NO: 2967611 - protein, 22 aa, Entamoeba invadens
SKPEWFECCRMQAEHDVNTLVS

SEQ ID NO: 2967612 - protein, 26 aa, Entamoeba invadens
SKPIELKKFLSFAFTYNLEKSKQLDK

SEQ ID NO: 2967613 - protein, 18 aa, Entamoeba invadens
SKPIFRHDHRGLTTMTGI

SEQ ID NO: 2967614 - protein, 24 aa, Entamoeba invadens
SKPLPPRPPMKALPSVPPPREKKE

SEQ ID NO: 2967615 - protein, 25 aa, Entamoeba invadens
SKPQRYGIKFCFFFRRFTVLRHIHR

SEQ ID NO: 2967616 - protein, 22 aa, Entamoeba invadens
SKPRFLPLQLAQVLTHVGNDVY

SEQ ID NO: 2967617 - protein, 20 aa, Entamoeba invadens
SKPRILEALLKVCRDTEAPL

SEQ ID NO: 2967618 - protein, 18 aa, Entamoeba invadens
SKPSVLIKTVKKDKVGAV

SEQ ID NO: 2967619 - protein, 18 aa, Entamoeba invadens
SKPTTPALMESKGNEFNT

SEQ ID NO: 2967620 - protein, 25 aa, Entamoeba invadens
SKPVHARKLLLAAISIVAGTDFPTK

SEQ ID NO: 2967621 - protein, 20 aa, Entamoeba invadens
SKPVQGICRALIVKYGLDLD

SEQ ID NO: 2967622 - protein, 19 aa, Entamoeba invadens
SKPYACHFLFYEHSENTGG

SEQ ID NO: 2967623 - protein, 19 aa, Entamoeba invadens
SKQCLHNYYGYDIIHFPQS

SEQ ID NO: 2967624 - protein, 17 aa, Entamoeba invadens
SKQCLRKYHGYDIIHFP

SEQ ID NO: 2967625 - protein, 25 aa, Entamoeba invadens
SKQFPELPILVPDSVEYAMAVKQIK

SEQ ID NO: 2967626 - protein, 18 aa, Entamoeba invadens
SKQMKFLLQRLNTLTTLQ

SEQ ID NO: 2967627 - protein, 24 aa, Entamoeba invadens
SKQRKNKRFWSPEEKTFAINKAKQ

SEQ ID NO: 2967628 - protein, 19 aa, Entamoeba invadens
SKQSVPEWMNEKSSELNDR

SEQ ID NO: 2967629 - protein, 19 aa, Entamoeba invadens
SKQTFGFKVQDTCIKTITV

SEQ ID NO: 2967630 - protein, 18 aa, Entamoeba invadens
SKQVVCGMNVVFNPQVQN

SEQ ID NO: 2967631 - protein, 19 aa, Entamoeba invadens
SKRAFVEFVAEPIYKLTVS

SEQ ID NO: 2967632 - protein, 23 aa, Entamoeba invadens
SKRDGVSMLHLFRLLKNEQPLVF

SEQ ID NO: 2967633 - protein, 21 aa, Entamoeba invadens
SKRFNEKKMHVLGQILTTPQK

SEQ ID NO: 2967634 - protein, 25 aa, Entamoeba invadens
SKRGEQWRATALPKQYSYIPQKCFP

SEQ ID NO: 2967635 - protein, 34 aa, Entamoeba invadens
SKRGQLCYLENAFKGCVQDITWLPGGLMFMACSI

SEQ ID NO: 2967636 - protein, 25 aa, Entamoeba invadens
SKRKEEYHPYLLFCKENREKVKEEG

SEQ ID NO: 2967637 - protein, 23 aa, Entamoeba invadens
SKRKEMALPFDRRTSEFLQNYGE

SEQ ID NO: 2967638 - protein, 28 aa, Entamoeba invadens
SKRKSKKTECPFRINLNFQTKTGRWNIT

SEQ ID NO: 2967639 - protein, 17 aa, Entamoeba invadens
SKRKVVLALNYSTTPAY

SEQ ID NO: 2967640 - protein, 25 aa, Entamoeba invadens
SKRMYAKFDDLRKFMSINNWMDAIQ

SEQ ID NO: 2967641 - protein, 25 aa, Entamoeba invadens
SKRNKMFFKIIVWYPVTFKVSKTLE

SEQ ID NO: 2967642 - protein, 26 aa, Entamoeba invadens
SKRPLPEYLVGFSLFMSITTYGIHLD

SEQ ID NO: 2967643 - protein, 20 aa, Entamoeba invadens
SKRRWDQVVRRWRRALHAFD

SEQ ID NO: 2967644 - protein, 18 aa, Entamoeba invadens
SKRVIPIRYEKQDKYIKK

SEQ ID NO: 2967645 - protein, 20 aa, Entamoeba invadens
SKRYIGRKVSQEELLLDVSA

SEQ ID NO: 2967646 - protein, 17 aa, Entamoeba invadens
SKRYKIVLYKDFSDSEI

SEQ ID NO: 2967647 - protein, 23 aa, Entamoeba invadens
SKSALKFIFVFDGTHHSDKIKEV

SEQ ID NO: 2967648 - protein, 20 aa, Entamoeba invadens
SKSAMKNAMWTLSNIVASPN

SEQ ID NO: 2967649 - protein, 18 aa, Entamoeba invadens
SKSCKDALHALKINPNME

SEQ ID NO: 2967650 - protein, 17 aa, Entamoeba invadens
SKSCTWKMFKSGNYQNS

SEQ ID NO: 2967651 - protein, 17 aa, Entamoeba invadens
SKSDFRVLTAIEMGMRN

SEQ ID NO: 2967652 - protein, 23 aa, Entamoeba invadens
SKSEFKYPWKIADFVNNGNRLQK

SEQ ID NO: 2967653 - protein, 18 aa, Entamoeba invadens
SKSENCFIFVHTSQDTIN

SEQ ID NO: 2967654 - protein, 18 aa, Entamoeba invadens
SKSEVYGTINLVEYVSNF

SEQ ID NO: 2967655 - protein, 19 aa, Entamoeba invadens
SKSFNTMKFKSKTRKSDTA

SEQ ID NO: 2967656 - protein, 17 aa, Entamoeba invadens
SKSGGRKTARITGIPKL

SEQ ID NO: 2967657 - protein, 27 aa, Entamoeba invadens
SKSGPVEMVELFLGDKINEFLIEQIDD

SEQ ID NO: 2967658 - protein, 26 aa, Entamoeba invadens
SKSHAFFPIPDVLYFDRRTLKSKEHL

SEQ ID NO: 2967659 - protein, 23 aa, Entamoeba invadens
SKSHSRLLPKHFGIDVNENEPGM

SEQ ID NO: 2967660 - protein, 18 aa, Entamoeba invadens
SKSIFSVDCFTKNNSKIY

SEQ ID NO: 2967661 - protein, 23 aa, Entamoeba invadens
SKSKRKIAMSVEEGVECETPQEN

SEQ ID NO: 2967662 - protein, 20 aa, Entamoeba invadens
SKSKVVLRYQKFEAERLEKV

SEQ ID NO: 2967663 - protein, 17 aa, Entamoeba invadens
SKSMRGSHNSGNIVKND

SEQ ID NO: 2967664 - protein, 22 aa, Entamoeba invadens
SKSNLALSCIQMCFLTNEIVTK

SEQ ID NO: 2967665 - protein, 25 aa, Entamoeba invadens
SKSQWRFPLPLYRSLQYLENHKGDE

SEQ ID NO: 2967666 - protein, 23 aa, Entamoeba invadens
SKSVKRNRVILFNDLTFDDTNVF

SEQ ID NO: 2967667 - protein, 19 aa, Entamoeba invadens
SKTDDGQCDLPFRRISGGS

SEQ ID NO: 2967668 - protein, 21 aa, Entamoeba invadens
SKTDIIRSGCRCYKIMSNYSQ

SEQ ID NO: 2967669 - protein, 25 aa, Entamoeba invadens
SKTEPFCLAGSPLIKNYLVPFYQAS

SEQ ID NO: 2967670 - protein, 20 aa, Entamoeba invadens
SKTEYFKAQVIIMNHPGQIR

SEQ ID NO: 2967671 - protein, 26 aa, Entamoeba invadens
SKTFCGVQRLFLCVLCVVEEWSCVAR

SEQ ID NO: 2967672 - protein, 28 aa, Entamoeba invadens
SKTFKTGFPVFGLNGFWKMVEHNNPWTS

SEQ ID NO: 2967673 - protein, 29 aa, Entamoeba invadens
SKTGEVLGNLFSFPLRVISKADGKKKNLT

SEQ ID NO: 2967674 - protein, 26 aa, Entamoeba invadens
SKTIKELLEQPVVMPPELQSISQMQS

SEQ ID NO: 2967675 - protein, 21 aa, Entamoeba invadens
SKTKRFKIAKTTIKRPEQHSN

SEQ ID NO: 2967676 - protein, 21 aa, Entamoeba invadens
SKTLRCFPNIETLHLWSKKDE

SEQ ID NO: 2967677 - protein, 24 aa, Entamoeba invadens
SKTLRLLKNLFIPFDRVSKKIKNN

SEQ ID NO: 2967678 - protein, 17 aa, Entamoeba invadens
SKTLYSLRTQTKLAKHS

SEQ ID NO: 2967679 - protein, 20 aa, Entamoeba invadens
SKTMLCLHGGISPELSSLQQ

SEQ ID NO: 2967680 - protein, 17 aa, Entamoeba invadens
SKTMQLFVIRDVYINNI

SEQ ID NO: 2967681 - protein, 18 aa, Entamoeba invadens
SKTNCFEENMELEKSQTL

SEQ ID NO: 2967682 - protein, 23 aa, Entamoeba invadens
SKTPRGLLCGDVALVTQYYIIDF

SEQ ID NO: 2967683 - protein, 26 aa, Entamoeba invadens
SKTPRYLFRRVYKFIPINQRKRYWEI

SEQ ID NO: 2967684 - protein, 26 aa, Entamoeba invadens
SKTQVMVKLYFQICGYEGVSATYITK

SEQ ID NO: 2967685 - protein, 22 aa, Entamoeba invadens
SKTVLLCTLSLAVPQHTIQLAF

SEQ ID NO: 2967686 - protein, 24 aa, Entamoeba invadens
SKVACIAMSSAMWVKREQDVSKSN

SEQ ID NO: 2967687 - protein, 20 aa, Entamoeba invadens
SKVAESIKLVEHWKSTLISN

SEQ ID NO: 2967688 - protein, 20 aa, Entamoeba invadens
SKVAFTLNDVDVWKIEHPGD

SEQ ID NO: 2967689 - protein, 20 aa, Entamoeba invadens
SKVCKKRTVIITKKSLPSVL

SEQ ID NO: 2967690 - protein, 21 aa, Entamoeba invadens
SKVFFFNDVYLMFMRDVDGMW

SEQ ID NO: 2967691 - protein, 19 aa, Entamoeba invadens
SKVFKKCCELSELYDVPYQ

SEQ ID NO: 2967692 - protein, 24 aa, Entamoeba invadens
SKVFWVCRECGFIFEGTQAPKNCP

SEQ ID NO: 2967693 - protein, 18 aa, Entamoeba invadens
SKVIYFGSSCFLHNHILS

SEQ ID NO: 2967694 - protein, 17 aa, Entamoeba invadens
SKVKALVVPQELQVIGR

SEQ ID NO: 2967695 - protein, 18 aa, Entamoeba invadens
SKVKCIKFATEAAITILR

SEQ ID NO: 2967696 - protein, 27 aa, Entamoeba invadens
SKVKFIGKFAFKNCFKIEREVLKNLTH

SEQ ID NO: 2967697 - protein, 23 aa, Entamoeba invadens
SKVKLTLCKLVGKVSMYPMLAMR

SEQ ID NO: 2967698 - protein, 23 aa, Entamoeba invadens
SKVKRIKQSKIIPFGDFIHTTNF

SEQ ID NO: 2967699 - protein, 23 aa, Entamoeba invadens
SKVLGVCGRTECYTEMYDESGKY

SEQ ID NO: 2967700 - protein, 26 aa, Entamoeba invadens
SKVNFFRVVIWYEVYYKTSVIKKSSN

SEQ ID NO: 2967701 - protein, 17 aa, Entamoeba invadens
SKVPIVHDIVDFSPYNP

SEQ ID NO: 2967702 - protein, 17 aa, Entamoeba invadens
SKVPRSVMPKGSITHGG

SEQ ID NO: 2967703 - protein, 17 aa, Entamoeba invadens
SKVRGIGLNCYNECYSL

SEQ ID NO: 2967704 - protein, 18 aa, Entamoeba invadens
SKVSYIGECCFFNCRSLK

SEQ ID NO: 2967705 - protein, 19 aa, Entamoeba invadens
SKVVVGMKCGKLLILDYQK

SEQ ID NO: 2967706 - protein, 18 aa, Entamoeba invadens
SKVWKLLLRYYSPDQRTW

SEQ ID NO: 2967707 - protein, 17 aa, Entamoeba invadens
SKVYNLKKMSGFGNLIE

SEQ ID NO: 2967708 - protein, 20 aa, Entamoeba invadens
SKWCLEMYSAQTIHIPESVV

SEQ ID NO: 2967709 - protein, 25 aa, Entamoeba invadens
SKWKVGCEPVCGRCRDGFVCTTMGK

SEQ ID NO: 2967710 - protein, 25 aa, Entamoeba invadens
SKWNEALEILGLSSLLDLLKRGDVD

SEQ ID NO: 2967711 - protein, 24 aa, Entamoeba invadens
SKWVVPLPLYRFIPYLEEKNFYVT

SEQ ID NO: 2967712 - protein, 21 aa, Entamoeba invadens
SKWWGDEGFNEVCKSIRGYIK

SEQ ID NO: 2967713 - protein, 19 aa, Entamoeba invadens
SKYAFLMKEKCQLTISLEQ

SEQ ID NO: 2967714 - protein, 20 aa, Entamoeba invadens
SKYDVGFAFDGDGDRNLIVG

SEQ ID NO: 2967715 - protein, 21 aa, Entamoeba invadens
SKYFHCSLAIKDDYLIQQFLR

SEQ ID NO: 2967716 - protein, 23 aa, Entamoeba invadens
SKYFTRLVDYFVFSTVSTKFKDN

SEQ ID NO: 2967717 - protein, 26 aa, Entamoeba invadens
SKYFYIHSCLSYLAMKKKYSFIILNK

SEQ ID NO: 2967718 - protein, 33 aa, Entamoeba invadens
SKYFYIHSCLSYLAMKKKYSFIILNKKRRNQKM

SEQ ID NO: 2967719 - protein, 19 aa, Entamoeba invadens
SKYHVVWLLANLASEPPIF

SEQ ID NO: 2967720 - protein, 29 aa, Entamoeba invadens
SKYKVSKFRSCVMSSSSITLRGKAKKVAK

SEQ ID NO: 2967721 - protein, 23 aa, Entamoeba invadens
SKYLKIFDCFHFNPFPLSATTRK

SEQ ID NO: 2967722 - protein, 20 aa, Entamoeba invadens
SKYLRNAYCQLFNETIKTLG

SEQ ID NO: 2967723 - protein, 21 aa, Entamoeba invadens
SKYPLSIICVGVGDGPFDTME

SEQ ID NO: 2967724 - protein, 22 aa, Entamoeba invadens
SKYQFEVSFSFAEQMKKHNISC

SEQ ID NO: 2967725 - protein, 25 aa, Entamoeba invadens
SKYQYSSPYLMIWIDMNEPSVFNGP

SEQ ID NO: 2967726 - protein, 25 aa, Entamoeba invadens
SKYRFKVNGSNLFGIEPMDADSQDD

SEQ ID NO: 2967727 - protein, 19 aa, Entamoeba invadens
SKYRMPLPPLNLLERGCSA

SEQ ID NO: 2967728 - protein, 19 aa, Entamoeba invadens
SKYSGYRGGLDVKTGSTGK

SEQ ID NO: 2967729 - protein, 20 aa, Entamoeba invadens
SKYTLSCPVCNFSQTNSSFS

SEQ ID NO: 2967730 - protein, 24 aa, Entamoeba invadens
SLAICSLVGMNFVPIISNNQFFFH

SEQ ID NO: 2967731 - protein, 18 aa, Entamoeba invadens
SLAKWYLHLIETRIDVYL

SEQ ID NO: 2967732 - protein, 18 aa, Entamoeba invadens
SLALKRDLFCLQIQNRDF

SEQ ID NO: 2967733 - protein, 18 aa, Entamoeba invadens
SLALPGGVEKAELNHSTT

SEQ ID NO: 2967734 - protein, 34 aa, Entamoeba invadens
SLAMTGDNRLCFNCGRTGTAFIVTDFNIFVCTSC

SEQ ID NO: 2967735 - protein, 22 aa, Entamoeba invadens
SLANKWMCGVIVSSRQCFKNDK

SEQ ID NO: 2967736 - protein, 18 aa, Entamoeba invadens
SLAPAGFMGGVLVGAAGF

SEQ ID NO: 2967737 - protein, 25 aa, Entamoeba invadens
SLAQKLCTLLFYSHFVSGTTNLHQN

SEQ ID NO: 2967738 - protein, 24 aa, Entamoeba invadens
SLARKAFGCAIGYTQKDDVFEKYI

SEQ ID NO: 2967739 - protein, 20 aa, Entamoeba invadens
SLARYHVALLYAELRKPQIA

SEQ ID NO: 2967740 - protein, 19 aa, Entamoeba invadens
SLASIPVIVKESMEKYNDK

SEQ ID NO: 2967741 - protein, 19 aa, Entamoeba invadens
SLATEHCCRGFYGNLKNNV

SEQ ID NO: 2967742 - protein, 18 aa, Entamoeba invadens
SLATFVGGICAKKRPEIP

SEQ ID NO: 2967743 - protein, 19 aa, Entamoeba invadens
SLCDLLWSDPISEWDPDSP

SEQ ID NO: 2967744 - protein, 25 aa, Entamoeba invadens
SLCDLQKFQINWGFLESHHNDVLSA

SEQ ID NO: 2967745 - protein, 18 aa, Entamoeba invadens
SLCDVPFYPPTEDMKKQV

SEQ ID NO: 2967746 - protein, 17 aa, Entamoeba invadens
SLCEPTIGGTLEVRNEE

SEQ ID NO: 2967747 - protein, 18 aa, Entamoeba invadens
SLCFEIVYDKQFVFLCQN

SEQ ID NO: 2967748 - protein, 18 aa, Entamoeba invadens
SLCIGNKEDVIWLLRSLG

SEQ ID NO: 2967749 - protein, 26 aa, Entamoeba invadens
SLCLKKEAKKRCSISDALQDPWVKDV

SEQ ID NO: 2967750 - protein, 25 aa, Entamoeba invadens
SLDDLLCVIEYLVSKIKRSADALNL

SEQ ID NO: 2967751 - protein, 25 aa, Entamoeba invadens
SLDFAPRLLLTISTLVTKFPSLGNK

SEQ ID NO: 2967752 - protein, 17 aa, Entamoeba invadens
SLDFGIRKVNRLFFFVG

SEQ ID NO: 2967753 - protein, 25 aa, Entamoeba invadens
SLDGEYRMHLALFAAFYPSYFTTES

SEQ ID NO: 2967754 - protein, 24 aa, Entamoeba invadens
SLDGKRKVGYCKRSTAQKPFQCLV

SEQ ID NO: 2967755 - protein, 20 aa, Entamoeba invadens
SLDHCFYQFVEVEKSTFNTS

SEQ ID NO: 2967756 - protein, 31 aa, Entamoeba invadens
SLDIPESVRANAFWNICRLDNYHIVSCLIRH

SEQ ID NO: 2967757 - protein, 25 aa, Entamoeba invadens
SLDKEMRLLCSMLLLNIIGNKKNSE

SEQ ID NO: 2967758 - protein, 29 aa, Entamoeba invadens
SLDKPCMKKEEMDGFLGIFDTLASVQQPK

SEQ ID NO: 2967759 - protein, 21 aa, Entamoeba invadens
SLDNGESWYDEEVRPQENDPE

SEQ ID NO: 2967760 - protein, 23 aa, Entamoeba invadens
SLDNVCLFISSFLEGFSLNEGGV

SEQ ID NO: 2967761 - protein, 18 aa, Entamoeba invadens
SLDSWTYLRDEMSVDIRK

SEQ ID NO: 2967762 - protein, 27 aa, Entamoeba invadens
SLDTLLPRLLVCWFGFDALKDTYIRAG

SEQ ID NO: 2967763 - protein, 17 aa, Entamoeba invadens
SLDVSKLEKLGWKAETK

SEQ ID NO: 2967764 - protein, 20 aa, Entamoeba invadens
SLECVTCFSTDTEMRIEMFN

SEQ ID NO: 2967765 - protein, 29 aa, Entamoeba invadens
SLEEFCKLRNLEVPHYIPLPVANEEYDID

SEQ ID NO: 2967766 - protein, 17 aa, Entamoeba invadens
SLEEITIPQSVYIVGNN

SEQ ID NO: 2967767 - protein, 27 aa, Entamoeba invadens
SLEGIECRVEKELKKAAPEFHLQTRDF

SEQ ID NO: 2967768 - protein, 18 aa, Entamoeba invadens
SLEGLKHWGITIDTRPTF

SEQ ID NO: 2967769 - protein, 25 aa, Entamoeba invadens
SLEHANKWLSYGCRLTDYYCREYLV

SEQ ID NO: 2967770 - protein, 18 aa, Entamoeba invadens
SLEHSCCTLNKHNMSRIS

SEQ ID NO: 2967771 - protein, 19 aa, Entamoeba invadens
SLEIARKRIGDVITKREFE

SEQ ID NO: 2967772 - protein, 28 aa, Entamoeba invadens
SLEIEAGFRPGWYYNRISKGLEWIDDIL

SEQ ID NO: 2967773 - protein, 17 aa, Entamoeba invadens
SLEIGFPKQIKSLSMDG

SEQ ID NO: 2967774 - protein, 17 aa, Entamoeba invadens
SLEKIFLIEKCEEICEF

SEQ ID NO: 2967775 - protein, 21 aa, Entamoeba invadens
SLEKIMPFKVFEHKRPNQQSI

SEQ ID NO: 2967776 - protein, 18 aa, Entamoeba invadens
SLEKLWKIKEETHAINNV

SEQ ID NO: 2967777 - protein, 18 aa, Entamoeba invadens
SLEKVVLCNNIFEGSKNV

SEQ ID NO: 2967778 - protein, 26 aa, Entamoeba invadens
SLELRIIDKFAKIFMFFIKKMCKHNN

SEQ ID NO: 2967779 - protein, 23 aa, Entamoeba invadens
SLENCKYWLSYGERYITRKYLKV

SEQ ID NO: 2967780 - protein, 19 aa, Entamoeba invadens
SLENVWKYREDIYKVLEIN

SEQ ID NO: 2967781 - protein, 17 aa, Entamoeba invadens
SLEQRFAVMTATNTVQL

SEQ ID NO: 2967782 - protein, 18 aa, Entamoeba invadens
SLERKEIEKMSGLQVSDI

SEQ ID NO: 2967783 - protein, 24 aa, Entamoeba invadens
SLERKRFVGNDVVVIVFKEQLNKD

SEQ ID NO: 2967784 - protein, 18 aa, Entamoeba invadens
SLERYIKGLRCFEDIMVD

SEQ ID NO: 2967785 - protein, 22 aa, Entamoeba invadens
SLESIAFSFAYGIKHIENMGIH

SEQ ID NO: 2967786 - protein, 25 aa, Entamoeba invadens
SLESWPANDYRMFVGNLSKEVTEEM

SEQ ID NO: 2967787 - protein, 17 aa, Entamoeba invadens
SLETLYVTRCNLFEIKK

SEQ ID NO: 2967788 - protein, 18 aa, Entamoeba invadens
SLEVPFEIVEVINNPFKD

SEQ ID NO: 2967789 - protein, 19 aa, Entamoeba invadens
SLEVYRFANVASEVEFRIK

SEQ ID NO: 2967790 - protein, 23 aa, Entamoeba invadens
SLEYCAKLGGIVQNVGKYDHTGM

SEQ ID NO: 2967791 - protein, 19 aa, Entamoeba invadens
SLFALPFLRPQEIVETVQE

SEQ ID NO: 2967792 - protein, 18 aa, Entamoeba invadens
SLFDCPLATFPEFSNLKT

SEQ ID NO: 2967793 - protein, 19 aa, Entamoeba invadens
SLFDSRGCFVVFTMEGTLY

SEQ ID NO: 2967794 - protein, 17 aa, Entamoeba invadens
SLFECLHSYSISSPKQL

SEQ ID NO: 2967795 - protein, 19 aa, Entamoeba invadens
SLFEFKGWESLKKVKFYTE

SEQ ID NO: 2967796 - protein, 20 aa, Entamoeba invadens
SLFEFNGWESLQKVKFYIGN

SEQ ID NO: 2967797 - protein, 23 aa, Entamoeba invadens
SLFEKRCVNNLVMKNIDNIPYQI

SEQ ID NO: 2967798 - protein, 34 aa, Entamoeba invadens
SLFFCHRNKLCLSFARLVAHIKMGAKEKVETFIT

SEQ ID NO: 2967799 - protein, 23 aa, Entamoeba invadens
SLFFTKELKDFVILQSNNYGKVA

SEQ ID NO: 2967800 - protein, 24 aa, Entamoeba invadens
SLFGGDWRRSIVLYEEGGITDWFV

SEQ ID NO: 2967801 - protein, 29 aa, Entamoeba invadens
SLFKVKVILKKEGREIATLISCSIKCTSK

SEQ ID NO: 2967802 - protein, 17 aa, Entamoeba invadens
SLFNSLICKNHNEMYQY

SEQ ID NO: 2967803 - protein, 24 aa, Entamoeba invadens
SLFPEKVINCGSLVPDIVHYTIPN

SEQ ID NO: 2967804 - protein, 23 aa, Entamoeba invadens
SLFPGTNPLFFTRNAYSVIHNLV

SEQ ID NO: 2967805 - protein, 18 aa, Entamoeba invadens
SLFSMGRLVGLFLNCNQI

SEQ ID NO: 2967806 - protein, 17 aa, Entamoeba invadens
SLFSQDELVLFCSKCLL

SEQ ID NO: 2967807 - protein, 19 aa, Entamoeba invadens
SLFVRFVFSDGSFEEKRVK

SEQ ID NO: 2967808 - protein, 18 aa, Entamoeba invadens
SLGASFVYNNIKFSDKYD

SEQ ID NO: 2967809 - protein, 20 aa, Entamoeba invadens
SLGCMVFEMIVGVPPFSCHD

SEQ ID NO: 2967810 - protein, 21 aa, Entamoeba invadens
SLGDGCFEECINLSAITIPSR

SEQ ID NO: 2967811 - protein, 18 aa, Entamoeba invadens
SLGEHGLIKCTFEKQLKS

SEQ ID NO: 2967812 - protein, 20 aa, Entamoeba invadens
SLGENCFKDNQSLNCVNVPN

SEQ ID NO: 2967813 - protein, 20 aa, Entamoeba invadens
SLGGLCISGCKSLTKITLSK

SEQ ID NO: 2967814 - protein, 26 aa, Entamoeba invadens
SLGIKIFFVSVCFINYIKSYNFIINL

SEQ ID NO: 2967815 - protein, 22 aa, Entamoeba invadens
SLGIMCREMIEGVPPYIDDPPL

SEQ ID NO: 2967816 - protein, 23 aa, Entamoeba invadens
SLGKLSFYSCYQITTLKIPKHIQ

SEQ ID NO: 2967817 - protein, 22 aa, Entamoeba invadens
SLGKNCFYGCVSLSTITIPNTL

SEQ ID NO: 2967818 - protein, 18 aa, Entamoeba invadens
SLGKRCFSQCTSLFDIYI

SEQ ID NO: 2967819 - protein, 26 aa, Entamoeba invadens
SLGKSCFRGDIGIIGGRLPYNIKEIQ

SEQ ID NO: 2967820 - protein, 18 aa, Entamoeba invadens
SLGKTECPILNTPSNSSG

SEQ ID NO: 2967821 - protein, 18 aa, Entamoeba invadens
SLGKVMQTPECLRVYVSS

SEQ ID NO: 2967822 - protein, 17 aa, Entamoeba invadens
SLGNCKNLKMSVELPLC

SEQ ID NO: 2967823 - protein, 21 aa, Entamoeba invadens
SLGQSSMHWAAHSGYPNTIQT

SEQ ID NO: 2967824 - protein, 18 aa, Entamoeba invadens
SLGRCVFEGATALSNVVL

SEQ ID NO: 2967825 - protein, 24 aa, Entamoeba invadens
SLGSSQFGHFWMKFTCTGKSAHAS

SEQ ID NO: 2967826 - protein, 17 aa, Entamoeba invadens
SLHDAIMIVRRAMKHKE

SEQ ID NO: 2967827 - protein, 24 aa, Entamoeba invadens
SLHEKYPRLIVCDISGYGEGGPLS

SEQ ID NO: 2967828 - protein, 21 aa, Entamoeba invadens
SLHFKLPKITQFRATEDDAYT

SEQ ID NO: 2967829 - protein, 21 aa, Entamoeba invadens
SLHLAFSLGCESIAFCCISTG

SEQ ID NO: 2967830 - protein, 22 aa, Entamoeba invadens
SLHNARRGCIIIQDEYVDGIQY

SEQ ID NO: 2967831 - protein, 25 aa, Entamoeba invadens
SLHNFTFNCCCSLAEIKLSQNLEVL

SEQ ID NO: 2967832 - protein, 20 aa, Entamoeba invadens
SLHRKFQRKKVVEVDEDSAG

SEQ ID NO: 2967833 - protein, 34 aa, Entamoeba invadens
SLHRKGHYIACIFGSSSMGYCVIHHIPSKKSQNP

SEQ ID NO: 2967834 - protein, 21 aa, Entamoeba invadens
SLHVFPFHPVDFIVTTKRRIS

SEQ ID NO: 2967835 - protein, 19 aa, Entamoeba invadens
SLHWSNLFTTLSTHKSSNV

SEQ ID NO: 2967836 - protein, 28 aa, Entamoeba invadens
SLIASGLKWVRFGAMCMVIANRKLNTFA

SEQ ID NO: 2967837 - protein, 20 aa, Entamoeba invadens
SLIECFPKMCRRRHFEQIMQ

SEQ ID NO: 2967838 - protein, 24 aa, Entamoeba invadens
SLIEHYKFGVIYAKPGQHDENSIF

SEQ ID NO: 2967839 - protein, 33 aa, Entamoeba invadens
SLIGSGGFGEVWKVRHIYMHFTAAAKIIKSARS

SEQ ID NO: 2967840 - protein, 22 aa, Entamoeba invadens
SLIGVPVLPPLPKFEISEEQRR

SEQ ID NO: 2967841 - protein, 18 aa, Entamoeba invadens
SLILDFLVRYAKTKDIAS

SEQ ID NO: 2967842 - protein, 21 aa, Entamoeba invadens
SLILEPLIRAIFEYLNDKTRA

SEQ ID NO: 2967843 - protein, 17 aa, Entamoeba invadens
SLINFFKIRGIGNLIKE

SEQ ID NO: 2967844 - protein, 28 aa, Entamoeba invadens
SLIQVCKKFVFLLDRFRINPIRITQHTV

SEQ ID NO: 2967845 - protein, 17 aa, Entamoeba invadens
SLISCYLPEYESMADKI

SEQ ID NO: 2967846 - protein, 19 aa, Entamoeba invadens
SLITGGLYFKLKEKYPEFS

SEQ ID NO: 2967847 - protein, 23 aa, Entamoeba invadens
SLIVDEMFDFIDLFKSVVSICED

SEQ ID NO: 2967848 - protein, 19 aa, Entamoeba invadens
SLIVLCFNGVEGFESLVMT

SEQ ID NO: 2967849 - protein, 17 aa, Entamoeba invadens
SLKAIGLVCEYGENVAR

SEQ ID NO: 2967850 - protein, 17 aa, Entamoeba invadens
SLKAQAGGFNFKNLDAL

SEQ ID NO: 2967851 - protein, 21 aa, Entamoeba invadens
SLKCGYTSMQGWRRTMEDSHI

SEQ ID NO: 2967852 - protein, 17 aa, Entamoeba invadens
SLKDIDIPSSVTFIGKS

SEQ ID NO: 2967853 - protein, 18 aa, Entamoeba invadens
SLKDIDIPSSVTFIGKSA

SEQ ID NO: 2967854 - protein, 19 aa, Entamoeba invadens
SLKDLKTQFVIEAFEKMLR

SEQ ID NO: 2967855 - protein, 26 aa, Entamoeba invadens
SLKDVGNSVLGWFGLSTDNFAVNQDP

SEQ ID NO: 2967856 - protein, 22 aa, Entamoeba invadens
SLKEIKLPSSLCELDKKTFSNC

SEQ ID NO: 2967857 - protein, 25 aa, Entamoeba invadens
SLKELSMSYSRFKESPIFTDNLKAL

SEQ ID NO: 2967858 - protein, 21 aa, Entamoeba invadens
SLKGCASVNDYSLNAFKNGPI

SEQ ID NO: 2967859 - protein, 20 aa, Entamoeba invadens
SLKHPCLIILYEAVITPHNY

SEQ ID NO: 2967860 - protein, 20 aa, Entamoeba invadens
SLKIPKPEDFIFVDYEGGLL

SEQ ID NO: 2967861 - protein, 23 aa, Entamoeba invadens
SLKKARFVEEIVMDFITNSVSLA

SEQ ID NO: 2967862 - protein, 19 aa, Entamoeba invadens
SLKKCGLPAEIDFTLNGVR

SEQ ID NO: 2967863 - protein, 18 aa, Entamoeba invadens
SLKKFEFNQDAVFIYDGT

SEQ ID NO: 2967864 - protein, 18 aa, Entamoeba invadens
SLKKILCEGMLNLTRLIS

SEQ ID NO: 2967865 - protein, 24 aa, Entamoeba invadens
SLKKPRRVTLRFVRNEDCEQIIMC

SEQ ID NO: 2967866 - protein, 18 aa, Entamoeba invadens
SLKKRRRHSKIAFKDTSV

SEQ ID NO: 2967867 - protein, 19 aa, Entamoeba invadens
SLKKWDSYINFIAGKHTHT

SEQ ID NO: 2967868 - protein, 20 aa, Entamoeba invadens
SLKLFSECVTCFERNNNVNM

SEQ ID NO: 2967869 - protein, 19 aa, Entamoeba invadens
SLKLKDNFLQRVPNTADLK

SEQ ID NO: 2967870 - protein, 25 aa, Entamoeba invadens
SLKMIGQSCFRDCTLLKTFDIPSSV

SEQ ID NO: 2967871 - protein, 21 aa, Entamoeba invadens
SLKMLFAVSYHFIRAIVCARD

SEQ ID NO: 2967872 - protein, 26 aa, Entamoeba invadens
SLKNCNFLLRFAEINLIGPKGEIIEN

SEQ ID NO: 2967873 - protein, 23 aa, Entamoeba invadens
SLKNIPNGMTFFFDFGGGTLDTV

SEQ ID NO: 2967874 - protein, 21 aa, Entamoeba invadens
SLKRFECSDEFLLTTLPPKKI

SEQ ID NO: 2967875 - protein, 17 aa, Entamoeba invadens
SLKRLYTDYFYKRHEGL

SEQ ID NO: 2967876 - protein, 22 aa, Entamoeba invadens
SLKSCFSLRELTVFIEGNLKIS

SEQ ID NO: 2967877 - protein, 17 aa, Entamoeba invadens
SLKSEKGIEFWKKHFFN

SEQ ID NO: 2967878 - protein, 19 aa, Entamoeba invadens
SLKSIGSLAFSGCGLTQVS

SEQ ID NO: 2967879 - protein, 23 aa, Entamoeba invadens
SLKSLNSGDAFVLDPGKNSGVIY

SEQ ID NO: 2967880 - protein, 33 aa, Entamoeba invadens
SLKTEVLLTHCMRLRTTPPREALVFITKNSVMI

SEQ ID NO: 2967881 - protein, 24 aa, Entamoeba invadens
SLKTVEIPNCISFIGKDAFLSCSG

SEQ ID NO: 2967882 - protein, 21 aa, Entamoeba invadens
SLKTWKEMKKAGCVRTLVDMN

SEQ ID NO: 2967883 - protein, 21 aa, Entamoeba invadens
SLKYLTALVFFFANYTYMKFI

SEQ ID NO: 2967884 - protein, 17 aa, Entamoeba invadens
SLLAFSFENEGEKYANK

SEQ ID NO: 2967885 - protein, 25 aa, Entamoeba invadens
SLLCGKSELLTVFFNTTKEIKSTNY

SEQ ID NO: 2967886 - protein, 22 aa, Entamoeba invadens
SLLCKLLKSTFLPSQYVVPSLG

SEQ ID NO: 2967887 - protein, 18 aa, Entamoeba invadens
SLLCSFKTTEKCDKTYYV

SEQ ID NO: 2967888 - protein, 18 aa, Entamoeba invadens
SLLEGGYMETIRFKSNVC

SEQ ID NO: 2967889 - protein, 19 aa, Entamoeba invadens
SLLFGKFPFDGEGQELVAN

SEQ ID NO: 2967890 - protein, 22 aa, Entamoeba invadens
SLLGAFPPLTLVHGVFGAGKSH

SEQ ID NO: 2967891 - protein, 22 aa, Entamoeba invadens
SLLIKECFDCEDVLLYTDLIQM

SEQ ID NO: 2967892 - protein, 18 aa, Entamoeba invadens
SLLIPKFLENLSIYNSEC

SEQ ID NO: 2967893 - protein, 26 aa, Entamoeba invadens
SLLKNSWEGVDFTLVLRVEKAIFYSN

SEQ ID NO: 2967894 - protein, 21 aa, Entamoeba invadens
SLLLCRSKIGAELQKVSQNGL

SEQ ID NO: 2967895 - protein, 18 aa, Entamoeba invadens
SLLLKRTRPITIICPHTV

SEQ ID NO: 2967896 - protein, 29 aa, Entamoeba invadens
SLLLRAVDELEFVRTTWRIDNAVEGPYYE

SEQ ID NO: 2967897 - protein, 19 aa, Entamoeba invadens
SLLNCKRLSLLPTSVGSWT

SEQ ID NO: 2967898 - protein, 17 aa, Entamoeba invadens
SLLNCLTTLFSEPIADL

SEQ ID NO: 2967899 - protein, 19 aa, Entamoeba invadens
SLLNSLLMHIRRALLLFSR

SEQ ID NO: 2967900 - protein, 25 aa, Entamoeba invadens
SLLPGCGDVGCKVGGYTVNLYDPDN

SEQ ID NO: 2967901 - protein, 18 aa, Entamoeba invadens
SLLQKHFADFSVCHKMVL

SEQ ID NO: 2967902 - protein, 25 aa, Entamoeba invadens
SLLRKCPVEERWFCCTFSNGKPVPE

SEQ ID NO: 2967903 - protein, 18 aa, Entamoeba invadens
SLLRKRGRKRTENRSMQS

SEQ ID NO: 2967904 - protein, 19 aa, Entamoeba invadens
SLLSKIILGNCVEYFKDLC

SEQ ID NO: 2967905 - protein, 19 aa, Entamoeba invadens
SLLSPRSPPLAVFDEYTYV

SEQ ID NO: 2967906 - protein, 24 aa, Entamoeba invadens
SLLSRYAYIYTRFRVEVEDMTVTP

SEQ ID NO: 2967907 - protein, 20 aa, Entamoeba invadens
SLLVRARVVSALKYWIENIW

SEQ ID NO: 2967908 - protein, 22 aa, Entamoeba invadens
SLMAIECLNQIALRDESLSIIS

SEQ ID NO: 2967909 - protein, 19 aa, Entamoeba invadens
SLMESRLNSLVSIDSIETI

SEQ ID NO: 2967910 - protein, 17 aa, Entamoeba invadens
SLMIISKYFKNIGDFIR

SEQ ID NO: 2967911 - protein, 23 aa, Entamoeba invadens
SLMKRRAEFIIEHFSNLAEQKDN

SEQ ID NO: 2967912 - protein, 19 aa, Entamoeba invadens
SLMNLLRQFASLMVDGDRQ

SEQ ID NO: 2967913 - protein, 19 aa, Entamoeba invadens
SLNELCLLNTPVIGMTSNV

SEQ ID NO: 2967914 - protein, 17 aa, Entamoeba invadens
SLNELWDSCLLIFPTIE

SEQ ID NO: 2967915 - protein, 26 aa, Entamoeba invadens
SLNEYCTRFGISKAPIKELEKIQTDV

SEQ ID NO: 2967916 - protein, 18 aa, Entamoeba invadens
SLNFPSRPFLLSQSTTSL

SEQ ID NO: 2967917 - protein, 21 aa, Entamoeba invadens
SLNGIVARVFVKIRPSYERCL

SEQ ID NO: 2967918 - protein, 18 aa, Entamoeba invadens
SLNIRSFDVIYSFTPILK

SEQ ID NO: 2967919 - protein, 24 aa, Entamoeba invadens
SLNKDMFYDFEVIDFKTSKYRFKV

SEQ ID NO: 2967920 - protein, 24 aa, Entamoeba invadens
SLNKKRCCRGLYGSLNHNIKSQYQ

SEQ ID NO: 2967921 - protein, 23 aa, Entamoeba invadens
SLNKRELGLLVVKQRKMVDYIIN

SEQ ID NO: 2967922 - protein, 25 aa, Entamoeba invadens
SLNLEFFECLTPIIAVEKNTIKKLL

SEQ ID NO: 2967923 - protein, 18 aa, Entamoeba invadens
SLNLKYLGTLAFDNCEEL

SEQ ID NO: 2967924 - protein, 20 aa, Entamoeba invadens
SLNLRNLLWHGFLEESDIFP

SEQ ID NO: 2967925 - protein, 24 aa, Entamoeba invadens
SLNNAVKMFEDFLMKLLTFNESHN

SEQ ID NO: 2967926 - protein, 18 aa, Entamoeba invadens
SLNNWKKQYINTIKMNDE

SEQ ID NO: 2967927 - protein, 18 aa, Entamoeba invadens
SLNQLCINYSTYLKNFEV

SEQ ID NO: 2967928 - protein, 25 aa, Entamoeba invadens
SLNSKIRSGKCFEIDRTKSKIKGKL

SEQ ID NO: 2967929 - protein, 25 aa, Entamoeba invadens
SLPEEWKSQFLIPLEVYATAHPEHA

SEQ ID NO: 2967930 - protein, 29 aa, Entamoeba invadens
SLPEGFLKLKSLRLISLCHSQFEGFTEPL

SEQ ID NO: 2967931 - protein, 26 aa, Entamoeba invadens
SLPFIPQILSIYLKLFKTCLPGVRPA

SEQ ID NO: 2967932 - protein, 31 aa, Entamoeba invadens
SLPGDTFLSLFGRGRFDPSFVAERCQKLDAW

SEQ ID NO: 2967933 - protein, 21 aa, Entamoeba invadens
SLPKFHRFVKSSVNGDVLVET

SEQ ID NO: 2967934 - protein, 23 aa, Entamoeba invadens
SLPKSVNVIIHFGDLCDDSLKLL

SEQ ID NO: 2967935 - protein, 19 aa, Entamoeba invadens
SLPLFIQVLDDFAKNANAE

SEQ ID NO: 2967936 - protein, 25 aa, Entamoeba invadens
SLPLFKPKFPIVFQSHCELTKDTHV

SEQ ID NO: 2967937 - protein, 19 aa, Entamoeba invadens
SLPLGEGFNPIPAGTTQCM

SEQ ID NO: 2967938 - protein, 23 aa, Entamoeba invadens
SLPNKRAVVFEQFFRIDTVWNNC

SEQ ID NO: 2967939 - protein, 21 aa, Entamoeba invadens
SLPNLECLHLLDLQITNCSFI

SEQ ID NO: 2967940 - protein, 24 aa, Entamoeba invadens
SLPNRPCVQISRSPSFRVESIPEF

SEQ ID NO: 2967941 - protein, 17 aa, Entamoeba invadens
SLPPFMFEYCFSLSNIE

SEQ ID NO: 2967942 - protein, 17 aa, Entamoeba invadens
SLPPNFISMPYVVQQQI

SEQ ID NO: 2967943 - protein, 19 aa, Entamoeba invadens
SLPPWAHNNPRLFVQTNIE

SEQ ID NO: 2967944 - protein, 33 aa, Entamoeba invadens
SLPQIKDWISVLAEIFKANIIVWEYPGYTKGST

SEQ ID NO: 2967945 - protein, 27 aa, Entamoeba invadens
SLPQKCFRYDYSITCIEIPTTITHIGE

SEQ ID NO: 2967946 - protein, 20 aa, Entamoeba invadens
SLPRLVKEGDKLVCSKNPRY

SEQ ID NO: 2967947 - protein, 19 aa, Entamoeba invadens
SLPSESIFMMHAVNENDSE

SEQ ID NO: 2967948 - protein, 20 aa, Entamoeba invadens
SLPSLRLSLHSDIIDNVTQM

SEQ ID NO: 2967949 - protein, 24 aa, Entamoeba invadens
SLPSSDIDLVLSFSEEVSKNQVKK

SEQ ID NO: 2967950 - protein, 32 aa, Entamoeba invadens
SLPSSLRNTIKYVMVVGNGYHLNAIKNVLNSF

SEQ ID NO: 2967951 - protein, 24 aa, Entamoeba invadens
SLPTDYKSLVGIQRRKDNPNKRRL

SEQ ID NO: 2967952 - protein, 27 aa, Entamoeba invadens
SLPVQKLKLIGKFVWILLRNGSVKVYD

SEQ ID NO: 2967953 - protein, 17 aa, Entamoeba invadens
SLQCIPYSTELLARGEI

SEQ ID NO: 2967954 - protein, 23 aa, Entamoeba invadens
SLQDVIHFWLSRSMKMVVEVKAD

SEQ ID NO: 2967955 - protein, 23 aa, Entamoeba invadens
SLQFLFRKLEKVFGDYVSFFEKV

SEQ ID NO: 2967956 - protein, 20 aa, Entamoeba invadens
SLQKVKFYIGNDVKRYQARV

SEQ ID NO: 2967957 - protein, 17 aa, Entamoeba invadens
SLQLKYVALTDELKHRE

SEQ ID NO: 2967958 - protein, 19 aa, Entamoeba invadens
SLQQIMKFSTAFSNALNGN

SEQ ID NO: 2967959 - protein, 18 aa, Entamoeba invadens
SLQQIMKFSTSFSNALSG

SEQ ID NO: 2967960 - protein, 23 aa, Entamoeba invadens
SLQRVHKMYQALDVGDLDVFITF

SEQ ID NO: 2967961 - protein, 18 aa, Entamoeba invadens
SLQSGEHQWGYLIKNTPE

SEQ ID NO: 2967962 - protein, 19 aa, Entamoeba invadens
SLQSLTISCCHKLESVDDY

SEQ ID NO: 2967963 - protein, 18 aa, Entamoeba invadens
SLQTCFDFFYQELISEES

SEQ ID NO: 2967964 - protein, 20 aa, Entamoeba invadens
SLQTKPMFKKPHLSIKRFKF

SEQ ID NO: 2967965 - protein, 18 aa, Entamoeba invadens
SLQTVVLLAHLLYEVSKT

SEQ ID NO: 2967966 - protein, 25 aa, Entamoeba invadens
SLRAELGIPIIPIIHRKFQDGESYY

SEQ ID NO: 2967967 - protein, 19 aa, Entamoeba invadens
SLRAFGFERYIPQFMKFFE

SEQ ID NO: 2967968 - protein, 19 aa, Entamoeba invadens
SLRDIKLKKGIEMYMSEIK

SEQ ID NO: 2967969 - protein, 27 aa, Entamoeba invadens
SLRELKIVSCRMVEFTLPPSVSVFVNN

SEQ ID NO: 2967970 - protein, 20 aa, Entamoeba invadens
SLRIKYPDFETAPKVVKKTF

SEQ ID NO: 2967971 - protein, 24 aa, Entamoeba invadens
SLRKEVKYFMGIETFLCDLEMVEK

SEQ ID NO: 2967972 - protein, 19 aa, Entamoeba invadens
SLRKIGFDYVFDVDYGADK

SEQ ID NO: 2967973 - protein, 23 aa, Entamoeba invadens
SLRKRRVRIGVCQALEELTGETL

SEQ ID NO: 2967974 - protein, 19 aa, Entamoeba invadens
SLRKTAIVVAEPVKKEKAK

SEQ ID NO: 2967975 - protein, 18 aa, Entamoeba invadens
SLRPFGCSLLVGGYDHRG

SEQ ID NO: 2967976 - protein, 23 aa, Entamoeba invadens
SLRPLSYPGTDIFLLCYAVNSSA

SEQ ID NO: 2967977 - protein, 23 aa, Entamoeba invadens
SLRTLKRWIELDFADEVQQKVEK

SEQ ID NO: 2967978 - protein, 18 aa, Entamoeba invadens
SLRYVTLPNRLKCIKSEC

SEQ ID NO: 2967979 - protein, 23 aa, Entamoeba invadens
SLSAFSFLFGEYIHHEFHQENRI

SEQ ID NO: 2967980 - protein, 26 aa, Entamoeba invadens
SLSAFTFIIDCSWFSFQQIENEQLFT

SEQ ID NO: 2967981 - protein, 20 aa, Entamoeba invadens
SLSDLKCHVLIILISNAVSD

SEQ ID NO: 2967982 - protein, 18 aa, Entamoeba invadens
SLSDYTFDNCVLLKQKPE

SEQ ID NO: 2967983 - protein, 18 aa, Entamoeba invadens
SLSEIKRKEEVTAGDEPF

SEQ ID NO: 2967984 - protein, 26 aa, Entamoeba invadens
SLSFVVEEFDLFGSWVASIQEIVLKE

SEQ ID NO: 2967985 - protein, 17 aa, Entamoeba invadens
SLSGFDGVFAFIRKSDM

SEQ ID NO: 2967986 - protein, 21 aa, Entamoeba invadens
SLSGLDRWDLFTGSELKTTMN

SEQ ID NO: 2967987 - protein, 17 aa, Entamoeba invadens
SLSIIDFHPSLKFSSSC

SEQ ID NO: 2967988 - protein, 17 aa, Entamoeba invadens
SLSIQRVEQILCIDYVK

SEQ ID NO: 2967989 - protein, 24 aa, Entamoeba invadens
SLSKAEFFLTIPLQLEVQNSHDVN

SEQ ID NO: 2967990 - protein, 17 aa, Entamoeba invadens
SLSKCLRCNAGYIIFGD

SEQ ID NO: 2967991 - protein, 24 aa, Entamoeba invadens
SLSKFPVLSQWCSKKISAFIKDPT

SEQ ID NO: 2967992 - protein, 17 aa, Entamoeba invadens
SLSKVLFHRNVFALKSE

SEQ ID NO: 2967993 - protein, 23 aa, Entamoeba invadens
SLSLDFADLYTYVTNLKEQVDTL

SEQ ID NO: 2967994 - protein, 20 aa, Entamoeba invadens
SLSLKRVEEIMCIDCVKDAL

SEQ ID NO: 2967995 - protein, 25 aa, Entamoeba invadens
SLSLTFRRKKGVISFTSMTTKTAGE

SEQ ID NO: 2967996 - protein, 22 aa, Entamoeba invadens
SLSNCFVVFDLIYEATTTLDRI

SEQ ID NO: 2967997 - protein, 18 aa, Entamoeba invadens
SLSNLRSVVCGTYELVNY

SEQ ID NO: 2967998 - protein, 17 aa, Entamoeba invadens
SLSRSYCNPSLQSSSYT

SEQ ID NO: 2967999 - protein, 23 aa, Entamoeba invadens
SLSSMLGSLIVLNSLFLTGNPIC

SEQ ID NO: 2968000 - protein, 18 aa, Entamoeba invadens
SLSSMPFQHIMRYRIQVE

SEQ ID NO: 2968001 - protein, 24 aa, Entamoeba invadens
SLSTLKLPVKLLIIPQMCFGECQK

SEQ ID NO: 2968002 - protein, 18 aa, Entamoeba invadens
SLSTQWKPSYEYYVDNTT

SEQ ID NO: 2968003 - protein, 18 aa, Entamoeba invadens
SLSVPIINCEDVVLQNST

SEQ ID NO: 2968004 - protein, 27 aa, Entamoeba invadens
SLSVSLEVFGKIAFRQVYSSKLSEVLQ

SEQ ID NO: 2968005 - protein, 18 aa, Entamoeba invadens
SLTECYRNLMANLSGISV

SEQ ID NO: 2968006 - protein, 24 aa, Entamoeba invadens
SLTEKSECVLSMFKLYDCNYKAPN

SEQ ID NO: 2968007 - protein, 18 aa, Entamoeba invadens
SLTEYIKLVQLFDKSWTS

SEQ ID NO: 2968008 - protein, 19 aa, Entamoeba invadens
SLTKMRGFCITNDELYTIM

SEQ ID NO: 2968009 - protein, 17 aa, Entamoeba invadens
SLTLIRGKTGWIAVDTM

SEQ ID NO: 2968010 - protein, 24 aa, Entamoeba invadens
SLTLKELFNVLGITQIDLHALNVQ

SEQ ID NO: 2968011 - protein, 25 aa, Entamoeba invadens
SLTLWWNIMRQMPFLWIMTDRDFLS

SEQ ID NO: 2968012 - protein, 18 aa, Entamoeba invadens
SLTLWWNVMQNMPHLWEI

SEQ ID NO: 2968013 - protein, 26 aa, Entamoeba invadens
SLTPFDFVMLMGIFRLSQIELNEVMG

SEQ ID NO: 2968014 - protein, 17 aa, Entamoeba invadens
SLTREFVHLNIWYEVSY

SEQ ID NO: 2968015 - protein, 20 aa, Entamoeba invadens
SLTSFNAYGFLNGVKQGDPN

SEQ ID NO: 2968016 - protein, 26 aa, Entamoeba invadens
SLTSLRCVWCGITLHQGCINLAPRKC

SEQ ID NO: 2968017 - protein, 19 aa, Entamoeba invadens
SLTSVAFSALILYFENSPA

SEQ ID NO: 2968018 - protein, 26 aa, Entamoeba invadens
SLTTFDCLKLIVSMGDVCFTNCELLE

SEQ ID NO: 2968019 - protein, 18 aa, Entamoeba invadens
SLTTKVIEDMLFYKRKYE

SEQ ID NO: 2968020 - protein, 18 aa, Entamoeba invadens
SLTVCTALTYPISNCHKL

SEQ ID NO: 2968021 - protein, 24 aa, Entamoeba invadens
SLTYCPTGKYLACTREEGVVEIYS

SEQ ID NO: 2968022 - protein, 26 aa, Entamoeba invadens
SLTYLKRYLELCGFKKEGLYNVGRFY

SEQ ID NO: 2968023 - protein, 26 aa, Entamoeba invadens
SLVCGKSKICVMVFHKNGVFGYYQED

SEQ ID NO: 2968024 - protein, 27 aa, Entamoeba invadens
SLVCLKDFCFRECRALQEVVLPPTLKA

SEQ ID NO: 2968025 - protein, 37 aa, Entamoeba invadens
SLVERMKLGYWSCFCKAKCAWKDVVVDTFIQGIVEKA

SEQ ID NO: 2968026 - protein, 17 aa, Entamoeba invadens
SLVGNITCVVYPYVSTS

SEQ ID NO: 2968027 - protein, 23 aa, Entamoeba invadens
SLVIPCAEFPKLDVLLPTSLLSL

SEQ ID NO: 2968028 - protein, 22 aa, Entamoeba invadens
SLVIRCPFCKKMKCRHCGDENV

SEQ ID NO: 2968029 - protein, 24 aa, Entamoeba invadens
SLVISSCYLCFDSFETFQMQSRTE

SEQ ID NO: 2968030 - protein, 19 aa, Entamoeba invadens
SLVKETFYNYLIKISPQLI

SEQ ID NO: 2968031 - protein, 24 aa, Entamoeba invadens
SLVKSRYGFNIGSFEAKSVQLCYN

SEQ ID NO: 2968032 - protein, 23 aa, Entamoeba invadens
SLVLKGSYPSQVIVKLLQKYSFK

SEQ ID NO: 2968033 - protein, 22 aa, Entamoeba invadens
SLVMEFCAHFSLFDVMNDPNQQ

SEQ ID NO: 2968034 - protein, 23 aa, Entamoeba invadens
SLVNKSFYGAFSLTLSDQKEKKN

SEQ ID NO: 2968035 - protein, 18 aa, Entamoeba invadens
SLVNVISVYCFNQCSELK

SEQ ID NO: 2968036 - protein, 23 aa, Entamoeba invadens
SLVPCGNCPFLSICSPQNVSCNP

SEQ ID NO: 2968037 - protein, 19 aa, Entamoeba invadens
SLVRTCEKFELFIQSVRLL

SEQ ID NO: 2968038 - protein, 21 aa, Entamoeba invadens
SLVSCLRCKDAYYFNSSSNRC

SEQ ID NO: 2968039 - protein, 17 aa, Entamoeba invadens
SLVSFDIIRGKPFSIDL

SEQ ID NO: 2968040 - protein, 19 aa, Entamoeba invadens
SLVSLPFIPVETIKFQKDD

SEQ ID NO: 2968041 - protein, 17 aa, Entamoeba invadens
SLVTVILPRCIKIIRPD

SEQ ID NO: 2968042 - protein, 19 aa, Entamoeba invadens
SLVVKSCDDLEKIVLCEDV

SEQ ID NO: 2968043 - protein, 17 aa, Entamoeba invadens
SLWEKVIQLETKFCSTD

SEQ ID NO: 2968044 - protein, 19 aa, Entamoeba invadens
SLYCLDPLKRREMFFKILL

SEQ ID NO: 2968045 - protein, 18 aa, Entamoeba invadens
SLYCLNIVEPNTWGSNVE

SEQ ID NO: 2968046 - protein, 23 aa, Entamoeba invadens
SLYIKGTTNFLVFRKVSKNVEEA

SEQ ID NO: 2968047 - protein, 18 aa, Entamoeba invadens
SLYIRPNKIYQLGSDKSS

SEQ ID NO: 2968048 - protein, 24 aa, Entamoeba invadens
SLYMPAMMCSGIVCYDNLPENIRS

SEQ ID NO: 2968049 - protein, 19 aa, Entamoeba invadens
SLYNLVGCNTLPSIQNTSI

SEQ ID NO: 2968050 - protein, 21 aa, Entamoeba invadens
SLYPSAINRLKLATGSPIVIS

SEQ ID NO: 2968051 - protein, 21 aa, Entamoeba invadens
SLYSIKGPSWISIKNAEEVGN

SEQ ID NO: 2968052 - protein, 19 aa, Entamoeba invadens
SLYSPPSYVGEYIIKCSEF

SEQ ID NO: 2968053 - protein, 22 aa, Entamoeba invadens
SLYSRYVRRSPTHGLSIITDGC

SEQ ID NO: 2968054 - protein, 22 aa, Entamoeba invadens
SLYSTFCPKDFITNKTKLSLLS

SEQ ID NO: 2968055 - protein, 25 aa, Entamoeba invadens
SLYVFSTSMTLRFTVGATNGPSRPL

SEQ ID NO: 2968056 - protein, 26 aa, Entamoeba invadens
SLYYFLSVFSKWGLRASECEEMLFVR

SEQ ID NO: 2968057 - protein, 21 aa, Entamoeba invadens
SLYYNPICYSFILREIAFKGN

SEQ ID NO: 2968058 - protein, 28 aa, Entamoeba invadens
SMAPLTRCKITFLKWVVPEVALKELSEF

SEQ ID NO: 2968059 - protein, 20 aa, Entamoeba invadens
SMCIGGLHGCILCKRQYNNE

SEQ ID NO: 2968060 - protein, 17 aa, Entamoeba invadens
SMCKKLEHPKNREVVVI

SEQ ID NO: 2968061 - protein, 28 aa, Entamoeba invadens
SMCTLEFLPRRESYFWLLDALDMYKPVV

SEQ ID NO: 2968062 - protein, 21 aa, Entamoeba invadens
SMDDIFVRMYLISKLIQSNFI

SEQ ID NO: 2968063 - protein, 28 aa, Entamoeba invadens
SMDYKIKFKVIRAISGLALGVGYQNFSK

SEQ ID NO: 2968064 - protein, 23 aa, Entamoeba invadens
SMEDPYFAECLVFGYPTVTTKEE

SEQ ID NO: 2968065 - protein, 18 aa, Entamoeba invadens
SMEDVQCKYDRTVRRTTG

SEQ ID NO: 2968066 - protein, 27 aa, Entamoeba invadens
SMEFIARFLQYWALKKIEVDYLIVCGD

SEQ ID NO: 2968067 - protein, 24 aa, Entamoeba invadens
SMELECCPLCPFQTTTDWCPLSRN

SEQ ID NO: 2968068 - protein, 26 aa, Entamoeba invadens
SMEMWGGATFDVCYSFLHESPWERLR

SEQ ID NO: 2968069 - protein, 20 aa, Entamoeba invadens
SMERDLYLRQGIKERSINNI

SEQ ID NO: 2968070 - protein, 23 aa, Entamoeba invadens
SMFCNRKTIISGYVYSDESIEAA

SEQ ID NO: 2968071 - protein, 19 aa, Entamoeba invadens
SMFDAKDSPNRLVCDDIPA

SEQ ID NO: 2968072 - protein, 21 aa, Entamoeba invadens
SMFDCAYIMRSGEVSIIKVEF

SEQ ID NO: 2968073 - protein, 26 aa, Entamoeba invadens
SMFEFKKELLSFILYHSISMKFSTMS

SEQ ID NO: 2968074 - protein, 26 aa, Entamoeba invadens
SMFKEQRKALYTSIFLFLLKAFPKIE

SEQ ID NO: 2968075 - protein, 17 aa, Entamoeba invadens
SMGDIELPIGINYETLV

SEQ ID NO: 2968076 - protein, 19 aa, Entamoeba invadens
SMGFLPNIMSIVSASVPLI

SEQ ID NO: 2968077 - protein, 17 aa, Entamoeba invadens
SMGKRCFWECGSLSSVI

SEQ ID NO: 2968078 - protein, 17 aa, Entamoeba invadens
SMGNLMFGGCISLKEVV

SEQ ID NO: 2968079 - protein, 20 aa, Entamoeba invadens
SMGPPVWTKYGHFISVNSFD

SEQ ID NO: 2968080 - protein, 29 aa, Entamoeba invadens
SMHKRAVELNSRFNVLFVKFIDTAQESSD

SEQ ID NO: 2968081 - protein, 19 aa, Entamoeba invadens
SMHLLHKSNLYNFLQVSHK

SEQ ID NO: 2968082 - protein, 25 aa, Entamoeba invadens
SMIKPRGNCLGFPDIAYILLSTLSG

SEQ ID NO: 2968083 - protein, 18 aa, Entamoeba invadens
SMISNWCFANCYKLSKMD

SEQ ID NO: 2968084 - protein, 25 aa, Entamoeba invadens
SMITSFSWKPLMGVIQNEDENECIV

SEQ ID NO: 2968085 - protein, 18 aa, Entamoeba invadens
SMKAFTLDEQLLFKSQKE

SEQ ID NO: 2968086 - protein, 19 aa, Entamoeba invadens
SMKDGKLGKREFRKIYDSF

SEQ ID NO: 2968087 - protein, 23 aa, Entamoeba invadens
SMKHTPGWTARTLIHQQFTTIHC

SEQ ID NO: 2968088 - protein, 23 aa, Entamoeba invadens
SMKLRSIGKVVGFDKFGESDDKI

SEQ ID NO: 2968089 - protein, 20 aa, Entamoeba invadens
SMKNAVPIPQHWCQRKRFLS

SEQ ID NO: 2968090 - protein, 21 aa, Entamoeba invadens
SMKTCGYINYYGLQRFGSNGT

SEQ ID NO: 2968091 - protein, 24 aa, Entamoeba invadens
SMKYFCYNCRKSLLPNAPQMTLPI

SEQ ID NO: 2968092 - protein, 22 aa, Entamoeba invadens
SMLAQLCRQFGMINTLRSNIWR

SEQ ID NO: 2968093 - protein, 18 aa, Entamoeba invadens
SMLNRWKLMQSGTFVDNR

SEQ ID NO: 2968094 - protein, 23 aa, Entamoeba invadens
SMLPLEVRLGVTLYASRHNKQVV

SEQ ID NO: 2968095 - protein, 25 aa, Entamoeba invadens
SMLSCTLCGTEVCQHTHFKMFKEAS

SEQ ID NO: 2968096 - protein, 19 aa, Entamoeba invadens
SMLSPRTKNILNIKFVKRT

SEQ ID NO: 2968097 - protein, 23 aa, Entamoeba invadens
SMMTRPGTFLNFTEITFTSKKKN

SEQ ID NO: 2968098 - protein, 18 aa, Entamoeba invadens
SMMVDVKSALSLCSEVLL

SEQ ID NO: 2968099 - protein, 24 aa, Entamoeba invadens
SMNEIPFVTSVLGQFGYITDIVPS

SEQ ID NO: 2968100 - protein, 19 aa, Entamoeba invadens
SMNNICWANVVSLLNVHAF

SEQ ID NO: 2968101 - protein, 25 aa, Entamoeba invadens
SMNYFKRNILFESINKIKTFEKVLG

SEQ ID NO: 2968102 - protein, 17 aa, Entamoeba invadens
SMPFTKFSVLQKLTLND

SEQ ID NO: 2968103 - protein, 23 aa, Entamoeba invadens
SMPNFPYVAPYFFMSPISHNLSV

SEQ ID NO: 2968104 - protein, 23 aa, Entamoeba invadens
SMRGVYKYLPYVKNYFIVTANQV

SEQ ID NO: 2968105 - protein, 18 aa, Entamoeba invadens
SMSKSFGNKNWVFSIPAK

SEQ ID NO: 2968106 - protein, 17 aa, Entamoeba invadens
SMSLSMLHIVDEEALTF

SEQ ID NO: 2968107 - protein, 24 aa, Entamoeba invadens
SMTGRLGEFFKVFTNTKEDVFHTV

SEQ ID NO: 2968108 - protein, 22 aa, Entamoeba invadens
SMTHIFGFERECVWKYNSTIYN

SEQ ID NO: 2968109 - protein, 25 aa, Entamoeba invadens
SMVKIWAIVCFARLVDHEGVKSDVY

SEQ ID NO: 2968110 - protein, 26 aa, Entamoeba invadens
SMVKIWAIVCFARLVGHEGVKSDVYN

SEQ ID NO: 2968111 - protein, 21 aa, Entamoeba invadens
SMWDIRSGKRVLKFEGHSGSV

SEQ ID NO: 2968112 - protein, 25 aa, Entamoeba invadens
SMYKICDRLSSITLPLTISELNSSC

SEQ ID NO: 2968113 - protein, 29 aa, Entamoeba invadens
SMYPMLAMRATELYALFATPGLAEATFRG

SEQ ID NO: 2968114 - protein, 18 aa, Entamoeba invadens
SMYVRAGALLGIGTCCSG

SEQ ID NO: 2968115 - protein, 30 aa, Entamoeba invadens
SNAELPPTHPIRLGLALNFSVFYYEILNDA

SEQ ID NO: 2968116 - protein, 18 aa, Entamoeba invadens
SNAIPVLFSISLLSESYR

SEQ ID NO: 2968117 - protein, 17 aa, Entamoeba invadens
SNAKAFCGHVFPDMFEP

SEQ ID NO: 2968118 - protein, 19 aa, Entamoeba invadens
SNAKYVFTAIRFNGNESSE

SEQ ID NO: 2968119 - protein, 27 aa, Entamoeba invadens
SNALRAYHIAIEWVRQSLFNERILPDP

SEQ ID NO: 2968120 - protein, 19 aa, Entamoeba invadens
SNAQFSRYGTLKIDQSNTD

SEQ ID NO: 2968121 - protein, 43 aa, Entamoeba invadens
SNASRLAELPSWMGKYSMKVPGRIWPVMINPVCIIIASYEPIE

SEQ ID NO: 2968122 - protein, 18 aa, Entamoeba invadens
SNATFVIPGNDYKTVTNN

SEQ ID NO: 2968123 - protein, 25 aa, Entamoeba invadens
SNCFCDVKRLIGLKMTDTEILPDLQ

SEQ ID NO: 2968124 - protein, 17 aa, Entamoeba invadens
SNCFQRDSLFFCHRNKL

SEQ ID NO: 2968125 - protein, 18 aa, Entamoeba invadens
SNCHKRGHSSRHCPDHGR

SEQ ID NO: 2968126 - protein, 18 aa, Entamoeba invadens
SNCLKCKMPYTLNGENCF

SEQ ID NO: 2968127 - protein, 19 aa, Entamoeba invadens
SNCNYHYQAVFSLLLVDLK

SEQ ID NO: 2968128 - protein, 17 aa, Entamoeba invadens
SNCYLNGFRSYLLTFSF

SEQ ID NO: 2968129 - protein, 31 aa, Entamoeba invadens
SNDIHFTFLWVKDMFTFLDLKPYSAKDDMEY

SEQ ID NO: 2968130 - protein, 22 aa, Entamoeba invadens
SNDIKRVVTMVAASSFYMEHWV

SEQ ID NO: 2968131 - protein, 18 aa, Entamoeba invadens
SNDILLWNVAYSVKPFQK

SEQ ID NO: 2968132 - protein, 17 aa, Entamoeba invadens
SNDKMLMVWDIRKPEVP

SEQ ID NO: 2968133 - protein, 25 aa, Entamoeba invadens
SNDLANKFAFCLFGNTVHYTTHELN

SEQ ID NO: 2968134 - protein, 23 aa, Entamoeba invadens
SNDLKESLVHLIVPPLYDGPNSL

SEQ ID NO: 2968135 - protein, 24 aa, Entamoeba invadens
SNDNAKCVLSAFLNLVDSDEAVHR

SEQ ID NO: 2968136 - protein, 20 aa, Entamoeba invadens
SNECCWEIGVLLDNIMSTPN

SEQ ID NO: 2968137 - protein, 17 aa, Entamoeba invadens
SNEFDVPEIVCTLDMKS

SEQ ID NO: 2968138 - protein, 34 aa, Entamoeba invadens
SNEGSVRILFLFLKRMIDLSHAKYRLDISSYDDI

SEQ ID NO: 2968139 - protein, 34 aa, Entamoeba invadens
SNEIGTLCFVELSPILFKVVWRTEIDFEGMTMFY

SEQ ID NO: 2968140 - protein, 21 aa, Entamoeba invadens
SNEILPKFVQSMFESQDDLYV

SEQ ID NO: 2968141 - protein, 17 aa, Entamoeba invadens
SNEIYLTIEEVYSGCQK

SEQ ID NO: 2968142 - protein, 17 aa, Entamoeba invadens
SNELFKAILHKYDRVAL

SEQ ID NO: 2968143 - protein, 17 aa, Entamoeba invadens
SNETGIKEDYCRRLVGS

SEQ ID NO: 2968144 - protein, 25 aa, Entamoeba invadens
SNEVKWKYTCGGLITCFDEYFEGKY

SEQ ID NO: 2968145 - protein, 17 aa, Entamoeba invadens
SNEVMKTTWVIPKSVSK

SEQ ID NO: 2968146 - protein, 25 aa, Entamoeba invadens
SNEYLNEIMLFLLRELCNTNPILNK

SEQ ID NO: 2968147 - protein, 22 aa, Entamoeba invadens
SNFHKTYFWFAGDFSIAQNTKI

SEQ ID NO: 2968148 - protein, 23 aa, Entamoeba invadens
SNFKEAIVTLGVFYLKGVGVQKD

SEQ ID NO: 2968149 - protein, 20 aa, Entamoeba invadens
SNFKEISRLLAATHRQQRVG

SEQ ID NO: 2968150 - protein, 17 aa, Entamoeba invadens
SNFKIYNSTRWAILVSG

SEQ ID NO: 2968151 - protein, 18 aa, Entamoeba invadens
SNFMKEFHTFSLQFPLCG

SEQ ID NO: 2968152 - protein, 19 aa, Entamoeba invadens
SNFNVKVPLYYLSNINLLN

SEQ ID NO: 2968153 - protein, 23 aa, Entamoeba invadens
SNFPKADIVQWCDPYLIVKYTEG

SEQ ID NO: 2968154 - protein, 34 aa, Entamoeba invadens
SNFRHTTELLPLIKYPHKFSIFYSEMQRKNTTFK

SEQ ID NO: 2968155 - protein, 19 aa, Entamoeba invadens
SNFTCATGGGLLVDKILKR

SEQ ID NO: 2968156 - protein, 18 aa, Entamoeba invadens
SNFVFPTSITKIGVHNIW

SEQ ID NO: 2968157 - protein, 21 aa, Entamoeba invadens
SNFYAMEGVKLVSSSSNVNVS

SEQ ID NO: 2968158 - protein, 18 aa, Entamoeba invadens
SNFYEVFIRFFLERLKSG

SEQ ID NO: 2968159 - protein, 24 aa, Entamoeba invadens
SNFYIEVRMPYHILAQANEQKNEI

SEQ ID NO: 2968160 - protein, 24 aa, Entamoeba invadens
SNFYIPGYWKAEAVGYASDTYSAI

SEQ ID NO: 2968161 - protein, 23 aa, Entamoeba invadens
SNFYKLKIICRNVNFENYNFNEI

SEQ ID NO: 2968162 - protein, 21 aa, Entamoeba invadens
SNGDFLYDEFFIRPVNNAPIY

SEQ ID NO: 2968163 - protein, 22 aa, Entamoeba invadens
SNGKFIRKEECDGGVNCNITCQ

SEQ ID NO: 2968164 - protein, 23 aa, Entamoeba invadens
SNGKLYGVGSFRLEKCTVSLASQ

SEQ ID NO: 2968165 - protein, 25 aa, Entamoeba invadens
SNGNLKGIRPHDAVEKSGNLTTPAF

SEQ ID NO: 2968166 - protein, 25 aa, Entamoeba invadens
SNGNLKGIRPHDAVSEGESIIRPHD

SEQ ID NO: 2968167 - protein, 18 aa, Entamoeba invadens
SNGTIHFFVMSSKSTDIE

SEQ ID NO: 2968168 - protein, 25 aa, Entamoeba invadens
SNGVLYFLTHLGFLFMEKKTKKASV

SEQ ID NO: 2968169 - protein, 30 aa, Entamoeba invadens
SNHLDFHALVWLEEVLKTWEGTILLVSHQR

SEQ ID NO: 2968170 - protein, 19 aa, Entamoeba invadens
SNHVLTEVVCIAILDEFAS

SEQ ID NO: 2968171 - protein, 17 aa, Entamoeba invadens
SNICWELVSGYKSRIDV

SEQ ID NO: 2968172 - protein, 27 aa, Entamoeba invadens
SNIDLFLKKLRIFFPNIIDLKEVTSRL

SEQ ID NO: 2968173 - protein, 19 aa, Entamoeba invadens
SNIIKFGHSCFAYNNSLVT

SEQ ID NO: 2968174 - protein, 34 aa, Entamoeba invadens
SNIIQGKCSLFFDEMKVELPFPLTNNDRLIFNVM

SEQ ID NO: 2968175 - protein, 18 aa, Entamoeba invadens
SNIKEIAKLLAATHRQQR

SEQ ID NO: 2968176 - protein, 23 aa, Entamoeba invadens
SNIKLGLPSIFGLMTVNDFTTGK

SEQ ID NO: 2968177 - protein, 29 aa, Entamoeba invadens
SNIKLMGKMRKCLPIWKEDLPNLKQKLDT

SEQ ID NO: 2968178 - protein, 25 aa, Entamoeba invadens
SNIKNEWYGLQGWRMSIDNHEVKYF

SEQ ID NO: 2968179 - protein, 24 aa, Entamoeba invadens
SNILDSICFVLGIQNLSLVRVTTI

SEQ ID NO: 2968180 - protein, 18 aa, Entamoeba invadens
SNIPRELRNLMESKKQSY

SEQ ID NO: 2968181 - protein, 18 aa, Entamoeba invadens
SNIRSLCSSFEFNKEERR

SEQ ID NO: 2968182 - protein, 17 aa, Entamoeba invadens
SNISIPHNVIFIGKDAF

SEQ ID NO: 2968183 - protein, 20 aa, Entamoeba invadens
SNITALGMCCFYRCENLKSI

SEQ ID NO: 2968184 - protein, 17 aa, Entamoeba invadens
SNITVIFNTFWKIEKAA

SEQ ID NO: 2968185 - protein, 25 aa, Entamoeba invadens
SNIVKFGLSCFEFNTLLVSITLSSN

SEQ ID NO: 2968186 - protein, 24 aa, Entamoeba invadens
SNIVKFGLSCFEYNTILVSITLSS

SEQ ID NO: 2968187 - protein, 25 aa, Entamoeba invadens
SNIVKFGLSCFEYNTLLVSITLSSN

SEQ ID NO: 2968188 - protein, 25 aa, Entamoeba invadens
SNIVLRECIERVFSKSGVSVIPCGL

SEQ ID NO: 2968189 - protein, 18 aa, Entamoeba invadens
SNIVSLNILRTMKGLNTF

SEQ ID NO: 2968190 - protein, 20 aa, Entamoeba invadens
SNIWKLMFEGATFESRIGAW

SEQ ID NO: 2968191 - protein, 20 aa, Entamoeba invadens
SNIWNLLSRNEFIAQVCQKI

SEQ ID NO: 2968192 - protein, 19 aa, Entamoeba invadens
SNKAFKLNSGAFIRVTAWT

SEQ ID NO: 2968193 - protein, 24 aa, Entamoeba invadens
SNKALLRFVAIRTVNEMSHKYNEL

SEQ ID NO: 2968194 - protein, 22 aa, Entamoeba invadens
SNKEFFEKVFVLLKDCPVKETA

SEQ ID NO: 2968195 - protein, 21 aa, Entamoeba invadens
SNKEHIRDCRVTDLEGKVDEM

SEQ ID NO: 2968196 - protein, 22 aa, Entamoeba invadens
SNKEIFESVLMAVTYEAGDADT

SEQ ID NO: 2968197 - protein, 22 aa, Entamoeba invadens
SNKEMLAAFVMELKGNTFTRVN

SEQ ID NO: 2968198 - protein, 25 aa, Entamoeba invadens
SNKITQIVPFRFQEVVNRECSNVTL

SEQ ID NO: 2968199 - protein, 21 aa, Entamoeba invadens
SNKLAVLFCAVTRWTFNGQTL

SEQ ID NO: 2968200 - protein, 20 aa, Entamoeba invadens
SNKLLKIFENECSKRIKKEP

SEQ ID NO: 2968201 - protein, 24 aa, Entamoeba invadens
SNKMKEKFIKMINEKDRLTMYVTQ

SEQ ID NO: 2968202 - protein, 23 aa, Entamoeba invadens
SNKNVGMGLTFNRHVLRQLLEAL

SEQ ID NO: 2968203 - protein, 18 aa, Entamoeba invadens
SNKVRFLLMDLVDERENR

SEQ ID NO: 2968204 - protein, 22 aa, Entamoeba invadens
SNKVSEWAFWWINIINMQFTYL

SEQ ID NO: 2968205 - protein, 21 aa, Entamoeba invadens
SNKVSHLFKIVSMEKAGQVFQ

SEQ ID NO: 2968206 - protein, 26 aa, Entamoeba invadens
SNKVWIKRLNVIISVLRDMRLIERNL

SEQ ID NO: 2968207 - protein, 22 aa, Entamoeba invadens
SNLCTEMKRIQAIQFHNDLFKA

SEQ ID NO: 2968208 - protein, 17 aa, Entamoeba invadens
SNLIALHRPELKYMLSL

SEQ ID NO: 2968209 - protein, 20 aa, Entamoeba invadens
SNLIYPKTGSVLFKQIQNIL

SEQ ID NO: 2968210 - protein, 24 aa, Entamoeba invadens
SNLKELLKLTVPILVHTNDDNYNY

SEQ ID NO: 2968211 - protein, 17 aa, Entamoeba invadens
SNLKKGVVSNMHINIKA

SEQ ID NO: 2968212 - protein, 30 aa, Entamoeba invadens
SNLKNCSFLSLKLCCVHLVIENCLMDKKFK

SEQ ID NO: 2968213 - protein, 30 aa, Entamoeba invadens
SNLKNLVCGPGQLKSGLSIEELFMCSANES

SEQ ID NO: 2968214 - protein, 25 aa, Entamoeba invadens
SNLKSICLPECLKVISNNAFSNCKN

SEQ ID NO: 2968215 - protein, 27 aa, Entamoeba invadens
SNLMDAISFVLGVRVGFLRGSNLKDLI

SEQ ID NO: 2968216 - protein, 18 aa, Entamoeba invadens
SNLMKLGIYTFDSCSRLK

SEQ ID NO: 2968217 - protein, 19 aa, Entamoeba invadens
SNLMLFRIPINIAQICDSC

SEQ ID NO: 2968218 - protein, 19 aa, Entamoeba invadens
SNLPFKVFSFYSEDVEIDF

SEQ ID NO: 2968219 - protein, 25 aa, Entamoeba invadens
SNLPPLKKRKENLLDIQQQLQQEIQ

SEQ ID NO: 2968220 - protein, 17 aa, Entamoeba invadens
SNLQFCLEIVKPEKKEK

SEQ ID NO: 2968221 - protein, 17 aa, Entamoeba invadens
SNLQHIILPDNLLELKN

SEQ ID NO: 2968222 - protein, 19 aa, Entamoeba invadens
SNLQYIKEFHVIKNEPVTL

SEQ ID NO: 2968223 - protein, 17 aa, Entamoeba invadens
SNLRAFCHCSQIETGTF

SEQ ID NO: 2968224 - protein, 25 aa, Entamoeba invadens
SNLRQIGSFCFNSCFALKELNLPKT

SEQ ID NO: 2968225 - protein, 29 aa, Entamoeba invadens
SNLTEVECFRLFFCEEITNNLLLFSNKKI

SEQ ID NO: 2968226 - protein, 19 aa, Entamoeba invadens
SNLTRVKITALITKLPPYT

SEQ ID NO: 2968227 - protein, 20 aa, Entamoeba invadens
SNLYFPSLILVDYLNVVNAD

SEQ ID NO: 2968228 - protein, 23 aa, Entamoeba invadens
SNMKEAIEVLGEMMSQIKFDKKT

SEQ ID NO: 2968229 - protein, 26 aa, Entamoeba invadens
SNMKLLSSWTELGWSHVVYDSNIAPK

SEQ ID NO: 2968230 - protein, 22 aa, Entamoeba invadens
SNMKVPDCLLKLGDATQKENEN

SEQ ID NO: 2968231 - protein, 18 aa, Entamoeba invadens
SNMPLYFNSKMNVNDKKI

SEQ ID NO: 2968232 - protein, 20 aa, Entamoeba invadens
SNMRLSEQITELLDKMKHNE

SEQ ID NO: 2968233 - protein, 20 aa, Entamoeba invadens
SNMTFSRMFIGNICRFGADV

SEQ ID NO: 2968234 - protein, 18 aa, Entamoeba invadens
SNNEAVWTYLTGLYEKST

SEQ ID NO: 2968235 - protein, 25 aa, Entamoeba invadens
SNNIKLYVRRVFIMDDCRELIPEWL

SEQ ID NO: 2968236 - protein, 23 aa, Entamoeba invadens
SNNKYYFCYDPKLMERIFNKMRN

SEQ ID NO: 2968237 - protein, 25 aa, Entamoeba invadens
SNNSDCFACTRFLIENYKEVFDTPH

SEQ ID NO: 2968238 - protein, 26 aa, Entamoeba invadens
SNPAFFANIIIEFCDGGTLQNFFESE

SEQ ID NO: 2968239 - protein, 27 aa, Entamoeba invadens
SNPEEICFPVKIIARRPSDDKVQLYSK

SEQ ID NO: 2968240 - protein, 19 aa, Entamoeba invadens
SNPGFPCYYNVQKCFSERK

SEQ ID NO: 2968241 - protein, 24 aa, Entamoeba invadens
SNPIILSCFSSFWMEKSGIVSFNP

SEQ ID NO: 2968242 - protein, 26 aa, Entamoeba invadens
SNPIKSVFSAPSFGCDEFQTLQTTPQ

SEQ ID NO: 2968243 - protein, 31 aa, Entamoeba invadens
SNPISINSPVCFKLFPHIHTLNFYKKSDLMY

SEQ ID NO: 2968244 - protein, 20 aa, Entamoeba invadens
SNPNCDHEALILIKKEINEI

SEQ ID NO: 2968245 - protein, 20 aa, Entamoeba invadens
SNPVLKRLLQIFNKYDNEEL

SEQ ID NO: 2968246 - protein, 32 aa, Entamoeba invadens
SNQGCACLRSAAKVPILVNMRVKERYTGVESP

SEQ ID NO: 2968247 - protein, 25 aa, Entamoeba invadens
SNRDFLYQRGWKYNKDEFIIMNKSV

SEQ ID NO: 2968248 - protein, 24 aa, Entamoeba invadens
SNRHVLWYFCDFLNDVIKNEKVNR

SEQ ID NO: 2968249 - protein, 25 aa, Entamoeba invadens
SNRKRFGNDIPICITSIDNECFINC

SEQ ID NO: 2968250 - protein, 24 aa, Entamoeba invadens
SNRLETFPVPILFIQNLKYLSLAN

SEQ ID NO: 2968251 - protein, 24 aa, Entamoeba invadens
SNRMVISVFSAFWMDKEGMISFNP

SEQ ID NO: 2968252 - protein, 27 aa, Entamoeba invadens
SNRVCGCMLPSLSLEEIEWSDGDTIFL

SEQ ID NO: 2968253 - protein, 25 aa, Entamoeba invadens
SNSFTFSTPQKWQIVDNIFSSEPRQ

SEQ ID NO: 2968254 - protein, 28 aa, Entamoeba invadens
SNSFYAQERPIFIGGVPLVMNVTLPLLT

SEQ ID NO: 2968255 - protein, 18 aa, Entamoeba invadens
SNSGRTVIMSEIIHTKKN

SEQ ID NO: 2968256 - protein, 22 aa, Entamoeba invadens
SNSILVCGFYEFGIIDSTLIFD

SEQ ID NO: 2968257 - protein, 27 aa, Entamoeba invadens
SNSLKEERMCYLKCNFKESNNTQIFSE

SEQ ID NO: 2968258 - protein, 32 aa, Entamoeba invadens
SNSNMNLSFDVLKLCIENGVLIDETSPSVIAE

SEQ ID NO: 2968259 - protein, 18 aa, Entamoeba invadens
SNTELFGLIINMVSNGLV

SEQ ID NO: 2968260 - protein, 18 aa, Entamoeba invadens
SNTFCRKMNILIQKARKT

SEQ ID NO: 2968261 - protein, 17 aa, Entamoeba invadens
SNTLRFNDMSPVVSDSF

SEQ ID NO: 2968262 - protein, 18 aa, Entamoeba invadens
SNTMRWSPMHRSEQFWVE

SEQ ID NO: 2968263 - protein, 23 aa, Entamoeba invadens
SNVCKALKILHSMGYAHLNVTPD

SEQ ID NO: 2968264 - protein, 24 aa, Entamoeba invadens
SNVDKAVKAAVKFVPKKKQKKDII

SEQ ID NO: 2968265 - protein, 27 aa, Entamoeba invadens
SNVEEELKRLSLRNGEIEEMYKKREEN

SEQ ID NO: 2968266 - protein, 27 aa, Entamoeba invadens
SNVESVTALQFWLREVQRYCDPDVSIN

SEQ ID NO: 2968267 - protein, 18 aa, Entamoeba invadens
SNVFKCFRDSQAAEQAVF

SEQ ID NO: 2968268 - protein, 19 aa, Entamoeba invadens
SNVIKRPIIIGSTNIIRKN

SEQ ID NO: 2968269 - protein, 20 aa, Entamoeba invadens
SNVISLGFECFDGCSSLSSV

SEQ ID NO: 2968270 - protein, 26 aa, Entamoeba invadens
SNVKCRSGIVQWIFSKSISSAISTEK

SEQ ID NO: 2968271 - protein, 18 aa, Entamoeba invadens
SNVKYIGHLCFFHCDSLS

SEQ ID NO: 2968272 - protein, 27 aa, Entamoeba invadens
SNVNSIGRFCFRDCSSLSNVMIPSIIT

SEQ ID NO: 2968273 - protein, 25 aa, Entamoeba invadens
SNVSENGDYCCFDFESWNIESKTHF

SEQ ID NO: 2968274 - protein, 17 aa, Entamoeba invadens
SNVSVLWGQCLSTNESD

SEQ ID NO: 2968275 - protein, 21 aa, Entamoeba invadens
SNVTLPFFTIKSVVFSPTDRV

SEQ ID NO: 2968276 - protein, 20 aa, Entamoeba invadens
SNVTLPFFTVKSVIFNQTDR

SEQ ID NO: 2968277 - protein, 28 aa, Entamoeba invadens
SNVTSLGFGCFSCCKYLSNIVIPTSVIS

SEQ ID NO: 2968278 - protein, 31 aa, Entamoeba invadens
SNVTSLGYNCFRECFSLSSVKIPLSVKLFGN

SEQ ID NO: 2968279 - protein, 23 aa, Entamoeba invadens
SNVYRGDFNDVFSLIKGKVACQE

SEQ ID NO: 2968280 - protein, 17 aa, Entamoeba invadens
SNWGFPKPLYVDGTEVC

SEQ ID NO: 2968281 - protein, 21 aa, Entamoeba invadens
SNWYASGFVNITFVNGFIYFE

SEQ ID NO: 2968282 - protein, 18 aa, Entamoeba invadens
SNYCEFEDFMVPLLTQCL

SEQ ID NO: 2968283 - protein, 23 aa, Entamoeba invadens
SNYCLKCKKGFYNTGKMCEKCNK

SEQ ID NO: 2968284 - protein, 30 aa, Entamoeba invadens
SNYKKKCQIMRKHLTDICGVREHSRGGEKR

SEQ ID NO: 2968285 - protein, 23 aa, Entamoeba invadens
SNYLGGQCVIVMYDITDHTTFEN

SEQ ID NO: 2968286 - protein, 25 aa, Entamoeba invadens
SNYNFERPFLWIARKLTGNPNLQFV

SEQ ID NO: 2968287 - protein, 23 aa, Entamoeba invadens
SNYTFKNCGFKSVKVPITSSYGW

SEQ ID NO: 2968288 - protein, 32 aa, Entamoeba invadens
SPAEKRKLVLDALKRMPAENVTLLRSLLKLCS

SEQ ID NO: 2968289 - protein, 19 aa, Entamoeba invadens
SPAGALWWLERELTEAKKY

SEQ ID NO: 2968290 - protein, 29 aa, Entamoeba invadens
SPAHLSLFRNVMKLCFKIHMYKDANLMDA

SEQ ID NO: 2968291 - protein, 19 aa, Entamoeba invadens
SPAPFPHWCIKEITEQPIA

SEQ ID NO: 2968292 - protein, 17 aa, Entamoeba invadens
SPAYDCAMIDDFPVLSL

SEQ ID NO: 2968293 - protein, 21 aa, Entamoeba invadens
SPCEIRSGTIVEGKKRMMCIT

SEQ ID NO: 2968294 - protein, 20 aa, Entamoeba invadens
SPCIDCHMRLVSIPEMEYDV

SEQ ID NO: 2968295 - protein, 28 aa, Entamoeba invadens
SPCNQCKWCKDCLLDIIVQESGGYRNVE

SEQ ID NO: 2968296 - protein, 17 aa, Entamoeba invadens
SPCVQRLNKEFPAYRKI

SEQ ID NO: 2968297 - protein, 19 aa, Entamoeba invadens
SPDAFDWQLIVDTLKNIKA

SEQ ID NO: 2968298 - protein, 25 aa, Entamoeba invadens
SPDDMKADVCARGISILPKTPALWL

SEQ ID NO: 2968299 - protein, 21 aa, Entamoeba invadens
SPDEFAARFVGEVATPEIRWG

SEQ ID NO: 2968300 - protein, 23 aa, Entamoeba invadens
SPDFKLMAMLKCLIDELQQPENY

SEQ ID NO: 2968301 - protein, 17 aa, Entamoeba invadens
SPDGIVVASVLRMTPDK

SEQ ID NO: 2968302 - protein, 20 aa, Entamoeba invadens
SPDMKLRFEKILTDIYKESN

SEQ ID NO: 2968303 - protein, 18 aa, Entamoeba invadens
SPDRLCARAVLSDLKKIF

SEQ ID NO: 2968304 - protein, 22 aa, Entamoeba invadens
SPEARWTRVNFRLGGMTDGYVQ

SEQ ID NO: 2968305 - protein, 25 aa, Entamoeba invadens
SPEELAIAFNCFPQVYCINKDFNEK

SEQ ID NO: 2968306 - protein, 21 aa, Entamoeba invadens
SPEEMKMFLFDTVSKITQDDV

SEQ ID NO: 2968307 - protein, 18 aa, Entamoeba invadens
SPEIKAMVVDAVQNALTD

SEQ ID NO: 2968308 - protein, 17 aa, Entamoeba invadens
SPEIQRRQLPLLPSELS

SEQ ID NO: 2968309 - protein, 22 aa, Entamoeba invadens
SPELLTKMNVEFFKKKNVLIHI

SEQ ID NO: 2968310 - protein, 19 aa, Entamoeba invadens
SPEQKKIAISRASVLGLSK

SEQ ID NO: 2968311 - protein, 19 aa, Entamoeba invadens
SPESLDFFFETICPSTLYK

SEQ ID NO: 2968312 - protein, 21 aa, Entamoeba invadens
SPFDAFLCVRGLKTLPMRMKA

SEQ ID NO: 2968313 - protein, 21 aa, Entamoeba invadens
SPFDIKTFLWKDHPFQLPEFG

SEQ ID NO: 2968314 - protein, 17 aa, Entamoeba invadens
SPFKLTEEMISIMGGSP

SEQ ID NO: 2968315 - protein, 18 aa, Entamoeba invadens
SPFKTRKIALKDFSDKYS

SEQ ID NO: 2968316 - protein, 18 aa, Entamoeba invadens
SPFLLVGVLSVIGVHKSD

SEQ ID NO: 2968317 - protein, 20 aa, Entamoeba invadens
SPFNVCAGVSSVLQSHGFVQ

SEQ ID NO: 2968318 - protein, 23 aa, Entamoeba invadens
SPFPEFKMTPFGVLNSKLSSLKD

SEQ ID NO: 2968319 - protein, 17 aa, Entamoeba invadens
SPFPQNHIFLARASFKG

SEQ ID NO: 2968320 - protein, 17 aa, Entamoeba invadens
SPGGCNIKGEFCSHVIM

SEQ ID NO: 2968321 - protein, 18 aa, Entamoeba invadens
SPGIFKAATRIRFGEPAP

SEQ ID NO: 2968322 - protein, 22 aa, Entamoeba invadens
SPHCFAFSTSTKYINIEFIPFL

SEQ ID NO: 2968323 - protein, 17 aa, Entamoeba invadens
SPHGNGVSVGRVLLPKE

SEQ ID NO: 2968324 - protein, 17 aa, Entamoeba invadens
SPHRIDGTIECELVYDL

SEQ ID NO: 2968325 - protein, 17 aa, Entamoeba invadens
SPHVILAPMVDGSDTSF

SEQ ID NO: 2968326 - protein, 20 aa, Entamoeba invadens
SPICCVLVLSILKQNASVAR

SEQ ID NO: 2968327 - protein, 19 aa, Entamoeba invadens
SPIDDWKKLFNVKSEMDTS

SEQ ID NO: 2968328 - protein, 22 aa, Entamoeba invadens
SPIFPVEYEFAVSLPQPKDDSI

SEQ ID NO: 2968329 - protein, 17 aa, Entamoeba invadens
SPIFRIQFINGVSLENL

SEQ ID NO: 2968330 - protein, 23 aa, Entamoeba invadens
SPIGCLAALIKRGWANDVKIDPE

SEQ ID NO: 2968331 - protein, 18 aa, Entamoeba invadens
SPIGYALFRIKDFEQVAK

SEQ ID NO: 2968332 - protein, 18 aa, Entamoeba invadens
SPILDKWKEEMAKSENEK

SEQ ID NO: 2968333 - protein, 27 aa, Entamoeba invadens
SPIQTSGRLGIRVVKCLETCVEDFDID

SEQ ID NO: 2968334 - protein, 25 aa, Entamoeba invadens
SPIRRYADVLVHRFLAMAIGFDRIE

SEQ ID NO: 2968335 - protein, 18 aa, Entamoeba invadens
SPIRVRVPVIVMETPKSD

SEQ ID NO: 2968336 - protein, 24 aa, Entamoeba invadens
SPKEEFKEVVAMKQVPFTNAPPPP

SEQ ID NO: 2968337 - protein, 24 aa, Entamoeba invadens
SPKGHKLLFMFGGCKGNDIRVYKK

SEQ ID NO: 2968338 - protein, 20 aa, Entamoeba invadens
SPKICSIVIEGEHINIRKKA

SEQ ID NO: 2968339 - protein, 18 aa, Entamoeba invadens
SPKILSVFVRVPQRVLVY

SEQ ID NO: 2968340 - protein, 19 aa, Entamoeba invadens
SPKLKNCPHALSTCQNTSI

SEQ ID NO: 2968341 - protein, 25 aa, Entamoeba invadens
SPKQLRYLAKRSYKGDLNLIVKKIK

SEQ ID NO: 2968342 - protein, 18 aa, Entamoeba invadens
SPKSVVRPADNVTNIVET

SEQ ID NO: 2968343 - protein, 20 aa, Entamoeba invadens
SPKVQGVVLWGIGRMIVQTE

SEQ ID NO: 2968344 - protein, 22 aa, Entamoeba invadens
SPLARDLFNYAFLASWQDSTEN

SEQ ID NO: 2968345 - protein, 17 aa, Entamoeba invadens
SPLARPTFKTCSPEKKE

SEQ ID NO: 2968346 - protein, 28 aa, Entamoeba invadens
SPLCIHFALGKCFKGGECVYKHQLPQQE

SEQ ID NO: 2968347 - protein, 18 aa, Entamoeba invadens
SPLGFPTNLMPILMRHLS

SEQ ID NO: 2968348 - protein, 24 aa, Entamoeba invadens
SPLKALLMRLFISKTVSSIITDNM

SEQ ID NO: 2968349 - protein, 18 aa, Entamoeba invadens
SPLKEGAYFARALTDIGI

SEQ ID NO: 2968350 - protein, 35 aa, Entamoeba invadens
SPLKEKGCLIERYFGRIKMVFKFTREKYLKDFVSF

SEQ ID NO: 2968351 - protein, 19 aa, Entamoeba invadens
SPLLAFLIHVLLERNTEFE

SEQ ID NO: 2968352 - protein, 19 aa, Entamoeba invadens
SPLLRDYYPYTHFLIEQIE

SEQ ID NO: 2968353 - protein, 20 aa, Entamoeba invadens
SPLLSIIVCSNGIIEQDTLL

SEQ ID NO: 2968354 - protein, 18 aa, Entamoeba invadens
SPLLVVKYVKLESVQTAL

SEQ ID NO: 2968355 - protein, 18 aa, Entamoeba invadens
SPLLVVTPMHTPMVLEEQ

SEQ ID NO: 2968356 - protein, 18 aa, Entamoeba invadens
SPLNIFERDGFIGIHSAD

SEQ ID NO: 2968357 - protein, 18 aa, Entamoeba invadens
SPLRKLFDICVLRQIEAM

SEQ ID NO: 2968358 - protein, 25 aa, Entamoeba invadens
SPLSEKIKALGIGKKVSYSFDTDYK

SEQ ID NO: 2968359 - protein, 17 aa, Entamoeba invadens
SPLSFSPGLSFKTGFMK

SEQ ID NO: 2968360 - protein, 17 aa, Entamoeba invadens
SPLSTIVLWSNFVISLT

SEQ ID NO: 2968361 - protein, 20 aa, Entamoeba invadens
SPLVRIPVFYRDNGAYVVTT

SEQ ID NO: 2968362 - protein, 18 aa, Entamoeba invadens
SPMKAYKLLETFNVFDTE

SEQ ID NO: 2968363 - protein, 17 aa, Entamoeba invadens
SPNCPYFHCEAEDVQTE

SEQ ID NO: 2968364 - protein, 31 aa, Entamoeba invadens
SPNCYSSSFGYCFDCTTTFCIEHSKTHIKRK

SEQ ID NO: 2968365 - protein, 26 aa, Entamoeba invadens
SPNFIPTVVIALVFYYLYPEESVEFR

SEQ ID NO: 2968366 - protein, 29 aa, Entamoeba invadens
SPNGFKFEMFIFDAFRLAKKMGALEVRRE

SEQ ID NO: 2968367 - protein, 20 aa, Entamoeba invadens
SPNIYRGADLLKVRNELESQ

SEQ ID NO: 2968368 - protein, 18 aa, Entamoeba invadens
SPNLEKMNLYIIGKVTKN

SEQ ID NO: 2968369 - protein, 22 aa, Entamoeba invadens
SPNQRVTMGLYRKKFGEQGTRP

SEQ ID NO: 2968370 - protein, 22 aa, Entamoeba invadens
SPNRLPKTFFHSHVYAATSLSD

SEQ ID NO: 2968371 - protein, 17 aa, Entamoeba invadens
SPNVCLPKTALPVKPLC

SEQ ID NO: 2968372 - protein, 20 aa, Entamoeba invadens
SPNVSGMVSKLAFFPNDANL

SEQ ID NO: 2968373 - protein, 19 aa, Entamoeba invadens
SPPAQRPPIKIITTESKSD

SEQ ID NO: 2968374 - protein, 23 aa, Entamoeba invadens
SPPDEMRDMIALKEEQSYDVQVL

SEQ ID NO: 2968375 - protein, 25 aa, Entamoeba invadens
SPPEHKYRPLSVILPTKSGRIDLSG

SEQ ID NO: 2968376 - protein, 25 aa, Entamoeba invadens
SPPFTKLRLFFTCFDHIAEGLVGFF

SEQ ID NO: 2968377 - protein, 21 aa, Entamoeba invadens
SPPKSRWEEVTGDHHFFVFSC

SEQ ID NO: 2968378 - protein, 18 aa, Entamoeba invadens
SPPLRSVIYNNSIITITD

SEQ ID NO: 2968379 - protein, 20 aa, Entamoeba invadens
SPPSLLVCTKPVGKLDHSTV

SEQ ID NO: 2968380 - protein, 24 aa, Entamoeba invadens
SPPSPKKRRVFAISDVLLGKPHVI

SEQ ID NO: 2968381 - protein, 20 aa, Entamoeba invadens
SPPTFPRKSLYPLRDVEITQ

SEQ ID NO: 2968382 - protein, 24 aa, Entamoeba invadens
SPPTTEFFQWFTLMNEKYGEFKIP

SEQ ID NO: 2968383 - protein, 19 aa, Entamoeba invadens
SPQFARACPVDSKRATQHM

SEQ ID NO: 2968384 - protein, 20 aa, Entamoeba invadens
SPQFDEFLGILGEKVALKGF

SEQ ID NO: 2968385 - protein, 19 aa, Entamoeba invadens
SPQKFWVWMTQCIIDHKQN

SEQ ID NO: 2968386 - protein, 18 aa, Entamoeba invadens
SPQKSSFILLDYTPMNED

SEQ ID NO: 2968387 - protein, 23 aa, Entamoeba invadens
SPQLLQKWYYPLIKSIKLEQYNK

SEQ ID NO: 2968388 - protein, 34 aa, Entamoeba invadens
SPQPPRKELNLLWASTKMILERDGLLQEDSNGDQ

SEQ ID NO: 2968389 - protein, 21 aa, Entamoeba invadens
SPQRINCPDGYNPDNEKTIVG

SEQ ID NO: 2968390 - protein, 17 aa, Entamoeba invadens
SPQWDGLIQKVAVDTLP

SEQ ID NO: 2968391 - protein, 27 aa, Entamoeba invadens
SPREIAKRCVLSFVAKMGRMVFLTQAT

SEQ ID NO: 2968392 - protein, 20 aa, Entamoeba invadens
SPRHLPHVVQLLLTACPQII

SEQ ID NO: 2968393 - protein, 23 aa, Entamoeba invadens
SPRHMGDGLGLWVQRPKSLTGKK

SEQ ID NO: 2968394 - protein, 19 aa, Entamoeba invadens
SPRISLVMHKIVNEMKTKV

SEQ ID NO: 2968395 - protein, 25 aa, Entamoeba invadens
SPRVYRQHSPVTFNVMQSTGVNTQN

SEQ ID NO: 2968396 - protein, 30 aa, Entamoeba invadens
SPSEKLFVNRNIAGVVKFDLQKTEDETNVG

SEQ ID NO: 2968397 - protein, 17 aa, Entamoeba invadens
SPSGFVVKKEYNLSALP

SEQ ID NO: 2968398 - protein, 22 aa, Entamoeba invadens
SPSKWKKSLLDALSHSTLFESG

SEQ ID NO: 2968399 - protein, 27 aa, Entamoeba invadens
SPSLETLRLPYSVLIKIHETYPLDHLL

SEQ ID NO: 2968400 - protein, 21 aa, Entamoeba invadens
SPSLPVKVYPVLPNFANNKKP

SEQ ID NO: 2968401 - protein, 22 aa, Entamoeba invadens
SPSLPVKVYPVLPNFANNKKPI

SEQ ID NO: 2968402 - protein, 25 aa, Entamoeba invadens
SPSPLCSSGSFSRRSGTIKTPKNSS

SEQ ID NO: 2968403 - protein, 19 aa, Entamoeba invadens
SPSPLPRKKFRNSFINLFH

SEQ ID NO: 2968404 - protein, 18 aa, Entamoeba invadens
SPSQNWKQLLMEKMKGLR

SEQ ID NO: 2968405 - protein, 18 aa, Entamoeba invadens
SPSVFTIFVEMFKEKKLP

SEQ ID NO: 2968406 - protein, 22 aa, Entamoeba invadens
SPTCSLKISYKLGDVDGEEEEP

SEQ ID NO: 2968407 - protein, 24 aa, Entamoeba invadens
SPTESVCVLFAPPLDDERKKELLN

SEQ ID NO: 2968408 - protein, 18 aa, Entamoeba invadens
SPTKWKKSFLDALSHSPY

SEQ ID NO: 2968409 - protein, 19 aa, Entamoeba invadens
SPTNHAFLIVGYDLDQPYS

SEQ ID NO: 2968410 - protein, 25 aa, Entamoeba invadens
SPTPELKPFYALVGALLSPLTSEPQ

SEQ ID NO: 2968411 - protein, 28 aa, Entamoeba invadens
SPTPFCVIAICLNSIFGAKENGILENDK

SEQ ID NO: 2968412 - protein, 20 aa, Entamoeba invadens
SPTPIRLRIVSPNVVDLTLV

SEQ ID NO: 2968413 - protein, 19 aa, Entamoeba invadens
SPTSQSPLFFDKVSSNLSY

SEQ ID NO: 2968414 - protein, 21 aa, Entamoeba invadens
SPTTCPVERSFNKIGQLDRAN

SEQ ID NO: 2968415 - protein, 23 aa, Entamoeba invadens
SPVDSLKEVVEFFNQVGSPTTEI

SEQ ID NO: 2968416 - protein, 18 aa, Entamoeba invadens
SPVEKIEQAFNVAQDKIG

SEQ ID NO: 2968417 - protein, 23 aa, Entamoeba invadens
SPVFVELQSGFIFISEPNSKPKK

SEQ ID NO: 2968418 - protein, 23 aa, Entamoeba invadens
SPVGSPRLSDTVQRKIEEKEGSV

SEQ ID NO: 2968419 - protein, 18 aa, Entamoeba invadens
SPVIPVMLYHAGKVKDVS

SEQ ID NO: 2968420 - protein, 23 aa, Entamoeba invadens
SPVKRKYFTSDYVLKKIPNTHLK

SEQ ID NO: 2968421 - protein, 18 aa, Entamoeba invadens
SPVSHSFVLPETSFQERQ

SEQ ID NO: 2968422 - protein, 18 aa, Entamoeba invadens
SPVTPSCVIYQPVTKSVY

SEQ ID NO: 2968423 - protein, 20 aa, Entamoeba invadens
SPVVECKKKLNVKNLVNAVE

SEQ ID NO: 2968424 - protein, 17 aa, Entamoeba invadens
SPWDIDVLFGTYNYNKE

SEQ ID NO: 2968425 - protein, 26 aa, Entamoeba invadens
SPYEMPADMKFVFDKFTEFYNENQKK

SEQ ID NO: 2968426 - protein, 23 aa, Entamoeba invadens
SPYETNRFGSIQLNYNDNINPYE

SEQ ID NO: 2968427 - protein, 24 aa, Entamoeba invadens
SPYIKTNFLILDFLGGIINVINRE

SEQ ID NO: 2968428 - protein, 26 aa, Entamoeba invadens
SPYLFRLRKFISLSYMLYIENNKFYK

SEQ ID NO: 2968429 - protein, 19 aa, Entamoeba invadens
SPYLNHIHFDLSILDEAGQ

SEQ ID NO: 2968430 - protein, 19 aa, Entamoeba invadens
SPYVYKIDFVINDTVNVPT

SEQ ID NO: 2968431 - protein, 18 aa, Entamoeba invadens
SPYYLEVEEDADADESGV

SEQ ID NO: 2968432 - protein, 23 aa, Entamoeba invadens
SPYYLICLTLVLPLPKEKISENI

SEQ ID NO: 2968433 - protein, 18 aa, Entamoeba invadens
SQADLIVFCPKKHKYVGN

SEQ ID NO: 2968434 - protein, 25 aa, Entamoeba invadens
SQAEELRYLVGLVFLYEKVKKEIGE

SEQ ID NO: 2968435 - protein, 18 aa, Entamoeba invadens
SQAFRHFISIKIESSNIF

SEQ ID NO: 2968436 - protein, 19 aa, Entamoeba invadens
SQAGYLRNDFNVFMQQRRL

SEQ ID NO: 2968437 - protein, 20 aa, Entamoeba invadens
SQAHAKLMMHKSVLLMDAVC

SEQ ID NO: 2968438 - protein, 18 aa, Entamoeba invadens
SQAHLIIYEYIKALNPPL

SEQ ID NO: 2968439 - protein, 25 aa, Entamoeba invadens
SQAKRLKYIGVMGTGFNNVDIDYCK

SEQ ID NO: 2968440 - protein, 28 aa, Entamoeba invadens
SQAKRVGVLAIETWISLSEKGGCDAGWG

SEQ ID NO: 2968441 - protein, 18 aa, Entamoeba invadens
SQALDLRMKMLKSIIDSL

SEQ ID NO: 2968442 - protein, 23 aa, Entamoeba invadens
SQARRKTRERLKERKEEQRRKAA

SEQ ID NO: 2968443 - protein, 25 aa, Entamoeba invadens
SQCGKIFCEKCIFVWWEFQHKCVCP

SEQ ID NO: 2968444 - protein, 23 aa, Entamoeba invadens
SQDHTASMGFQWEGQEGNYIRFW

SEQ ID NO: 2968445 - protein, 20 aa, Entamoeba invadens
SQDSLSCFIDYTKGDDGIVH

SEQ ID NO: 2968446 - protein, 19 aa, Entamoeba invadens
SQDVVNTWTQYISEGADLV

SEQ ID NO: 2968447 - protein, 21 aa, Entamoeba invadens
SQEIAWLCEFVCLKTLEMKDV

SEQ ID NO: 2968448 - protein, 22 aa, Entamoeba invadens
SQEISFALDWLGSFLTEKFPFE

SEQ ID NO: 2968449 - protein, 26 aa, Entamoeba invadens
SQESLKDSPRWIGFGDHYMSTPYLKF

SEQ ID NO: 2968450 - protein, 32 aa, Entamoeba invadens
SQEVCVICAEFGWSDVGTWGSLYSLKEKDASG

SEQ ID NO: 2968451 - protein, 18 aa, Entamoeba invadens
SQFAACAYTKSVLVESGY

SEQ ID NO: 2968452 - protein, 25 aa, Entamoeba invadens
SQFADFTLDPVFSFLNQHDFSSLSL

SEQ ID NO: 2968453 - protein, 28 aa, Entamoeba invadens
SQFCTESSMPQEYFEILSGLEGVGKLLK

SEQ ID NO: 2968454 - protein, 19 aa, Entamoeba invadens
SQFEIVILYCLLKLNEEER

SEQ ID NO: 2968455 - protein, 19 aa, Entamoeba invadens
SQFKAFKKLFLLRDKIARE

SEQ ID NO: 2968456 - protein, 29 aa, Entamoeba invadens
SQFNLHTCKFLTVFELEELVSLFDTIVSN

SEQ ID NO: 2968457 - protein, 21 aa, Entamoeba invadens
SQFPLNFPDLEKIYLRDITVP

SEQ ID NO: 2968458 - protein, 25 aa, Entamoeba invadens
SQFPPRLPPQLTELMVASNSIRVIP

SEQ ID NO: 2968459 - protein, 20 aa, Entamoeba invadens
SQFWASAGMMEMHIDDVRHL

SEQ ID NO: 2968460 - protein, 21 aa, Entamoeba invadens
SQFYFCKSLRKISLPKNLLFI

SEQ ID NO: 2968461 - protein, 19 aa, Entamoeba invadens
SQGKIEITFHVSTYLPYME

SEQ ID NO: 2968462 - protein, 23 aa, Entamoeba invadens
SQGLVPLLRLEWNKVDPNFIATF

SEQ ID NO: 2968463 - protein, 20 aa, Entamoeba invadens
SQGSVCFDPIRLMVGDVKRM

SEQ ID NO: 2968464 - protein, 20 aa, Entamoeba invadens
SQHILEVILQIIFDNVQIIG

SEQ ID NO: 2968465 - protein, 19 aa, Entamoeba invadens
SQHLDLVVACWDVTQKMDD

SEQ ID NO: 2968466 - protein, 25 aa, Entamoeba invadens
SQHVQPRLALFNMFSIKHKDRGETD

SEQ ID NO: 2968467 - protein, 22 aa, Entamoeba invadens
SQICVSCPQISHLDVSGCLNLN

SEQ ID NO: 2968468 - protein, 19 aa, Entamoeba invadens
SQIGKSVMMKCLTVPPLHI

SEQ ID NO: 2968469 - protein, 17 aa, Entamoeba invadens
SQIGLKISEKIEAEADL

SEQ ID NO: 2968470 - protein, 23 aa, Entamoeba invadens
SQIIGKNEIKVMVVGSAKCGKTT

SEQ ID NO: 2968471 - protein, 25 aa, Entamoeba invadens
SQIPSQEMSLLWSLFDQEMKHRFLS

SEQ ID NO: 2968472 - protein, 18 aa, Entamoeba invadens
SQIPYRFSSSTLLECDVW

SEQ ID NO: 2968473 - protein, 24 aa, Entamoeba invadens
SQIQFTFIPAFYIQGCGNYMKHNL

SEQ ID NO: 2968474 - protein, 17 aa, Entamoeba invadens
SQIQYYCMVRGWMNLEF

SEQ ID NO: 2968475 - protein, 26 aa, Entamoeba invadens
SQISPINTFDCFDWYVVSGCQSGSVW

SEQ ID NO: 2968476 - protein, 18 aa, Entamoeba invadens
SQISSPVTRQCQVEERRQ

SEQ ID NO: 2968477 - protein, 19 aa, Entamoeba invadens
SQITSIGIFAFYACVKLKK

SEQ ID NO: 2968478 - protein, 17 aa, Entamoeba invadens
SQIVEWENVKLLIDNDL

SEQ ID NO: 2968479 - protein, 17 aa, Entamoeba invadens
SQIVSVGEFCFDLCLSL

SEQ ID NO: 2968480 - protein, 17 aa, Entamoeba invadens
SQKAYLWYVKHFMPDTI

SEQ ID NO: 2968481 - protein, 22 aa, Entamoeba invadens
SQKEIQGVFVVKRKMDELRKRK

SEQ ID NO: 2968482 - protein, 26 aa, Entamoeba invadens
SQKERLNNILSFCGFETDDQAEKCQA

SEQ ID NO: 2968483 - protein, 19 aa, Entamoeba invadens
SQKFELLCRGIKLAPAASH

SEQ ID NO: 2968484 - protein, 21 aa, Entamoeba invadens
SQKFFDVWKSLLVPTTPTKVK

SEQ ID NO: 2968485 - protein, 23 aa, Entamoeba invadens
SQKKCPCCGKISPKIKKSDNKYS

SEQ ID NO: 2968486 - protein, 17 aa, Entamoeba invadens
SQKKFLRKWIVHNTTQL

SEQ ID NO: 2968487 - protein, 18 aa, Entamoeba invadens
SQKTLQLFLIEELKTPMD

SEQ ID NO: 2968488 - protein, 19 aa, Entamoeba invadens
SQKTWGSWGEWTGDAQEGC

SEQ ID NO: 2968489 - protein, 22 aa, Entamoeba invadens
SQKYSKVVSKLCFSKISEENTE

SEQ ID NO: 2968490 - protein, 17 aa, Entamoeba invadens
SQLFLDLFGTYFAYYEK

SEQ ID NO: 2968491 - protein, 20 aa, Entamoeba invadens
SQLFLPILNVRSIALVDENT

SEQ ID NO: 2968492 - protein, 24 aa, Entamoeba invadens
SQLFQKRLIKVIPNAQVEPLLHIF

SEQ ID NO: 2968493 - protein, 32 aa, Entamoeba invadens
SQLGLSRLSLMGARPSIMRSMVKGDEEEEERM

SEQ ID NO: 2968494 - protein, 19 aa, Entamoeba invadens
SQLHNGLGLTREVHRTVQH

SEQ ID NO: 2968495 - protein, 36 aa, Entamoeba invadens
SQLIFRFDFKQIFGWYPDFFQFHAKNMMRLYMEPSV

SEQ ID NO: 2968496 - protein, 18 aa, Entamoeba invadens
SQLIQFRNSEIIVEKVFN

SEQ ID NO: 2968497 - protein, 17 aa, Entamoeba invadens
SQLKKCRAGDVVYGSNE

SEQ ID NO: 2968498 - protein, 23 aa, Entamoeba invadens
SQLKLCTELSKLLMIDNKKILTQ

SEQ ID NO: 2968499 - protein, 24 aa, Entamoeba invadens
SQLKLFIYLVQHFDEFDIQPVFPA

SEQ ID NO: 2968500 - protein, 20 aa, Entamoeba invadens
SQLKQVVGWNSNFGAYTIST

SEQ ID NO: 2968501 - protein, 17 aa, Entamoeba invadens
SQLKSLKSFEANGCKQC

SEQ ID NO: 2968502 - protein, 17 aa, Entamoeba invadens
SQLNCIFMKEVIQFFPF

SEQ ID NO: 2968503 - protein, 24 aa, Entamoeba invadens
SQLPHPLPPLLASRLLQVVANNPT

SEQ ID NO: 2968504 - protein, 25 aa, Entamoeba invadens
SQLPKWFPTQASEFSFTSNKIDDEF

SEQ ID NO: 2968505 - protein, 17 aa, Entamoeba invadens
SQLPLAIESIVNYLYEK

SEQ ID NO: 2968506 - protein, 19 aa, Entamoeba invadens
SQLPRIGLLRLFVDQKTKD

SEQ ID NO: 2968507 - protein, 25 aa, Entamoeba invadens
SQLQFTFVPAFSIEGCGNYMKHNLV

SEQ ID NO: 2968508 - protein, 36 aa, Entamoeba invadens
SQLTKRLTGCFVELSLHMYGCRVVQKAIEFVDDIDK

SEQ ID NO: 2968509 - protein, 22 aa, Entamoeba invadens
SQLVKIMLCLIPTSSCVESVFS

SEQ ID NO: 2968510 - protein, 17 aa, Entamoeba invadens
SQMCFPPPPPFGRFGGW

SEQ ID NO: 2968511 - protein, 24 aa, Entamoeba invadens
SQMFKNVFKYCVGQVSVYLRFLYE

SEQ ID NO: 2968512 - protein, 27 aa, Entamoeba invadens
SQMNVYIFPKFVVSVVKTIMKILPTIP

SEQ ID NO: 2968513 - protein, 22 aa, Entamoeba invadens
SQMPYRELLEIYFLSIDPTDGD

SEQ ID NO: 2968514 - protein, 17 aa, Entamoeba invadens
SQMQKRFDALRRVEQSK

SEQ ID NO: 2968515 - protein, 25 aa, Entamoeba invadens
SQNAEFKRLTLLMTNLPNKRLRDVS

SEQ ID NO: 2968516 - protein, 18 aa, Entamoeba invadens
SQNCIVGLEILHINPQKL

SEQ ID NO: 2968517 - protein, 18 aa, Entamoeba invadens
SQNEVHHKLESVDFGNGV

SEQ ID NO: 2968518 - protein, 24 aa, Entamoeba invadens
SQNPPLCHRDLKVENVLFKNKKFL

SEQ ID NO: 2968519 - protein, 25 aa, Entamoeba invadens
SQPIEFRKETHECFEMEEEQKRFIM

SEQ ID NO: 2968520 - protein, 22 aa, Entamoeba invadens
SQPIYEDILLYNAIDIDHLITL

SEQ ID NO: 2968521 - protein, 20 aa, Entamoeba invadens
SQPNCYRVLDVLRETCDIPV

SEQ ID NO: 2968522 - protein, 25 aa, Entamoeba invadens
SQPNRILMFVSIYYLELFRGERFGF

SEQ ID NO: 2968523 - protein, 20 aa, Entamoeba invadens
SQPPPLPIRKVWKERKVMIN

SEQ ID NO: 2968524 - protein, 21 aa, Entamoeba invadens
SQPQMGGAVSQPVAQQQEPEA

SEQ ID NO: 2968525 - protein, 31 aa, Entamoeba invadens
SQPQTQCILYWCFANLYLIALEMKADVDFRI

SEQ ID NO: 2968526 - protein, 36 aa, Entamoeba invadens
SQQFEVKKLYALGVYLSWNYKLTLKKFVNAPQGAQS

SEQ ID NO: 2968527 - protein, 31 aa, Entamoeba invadens
SQQLLPYHSIFLFKTSKEWISCLTNSDDLIL

SEQ ID NO: 2968528 - protein, 17 aa, Entamoeba invadens
SQQQWKALSDMITTQRK

SEQ ID NO: 2968529 - protein, 19 aa, Entamoeba invadens
SQQVLRRAMEKQKVMGDTY

SEQ ID NO: 2968530 - protein, 19 aa, Entamoeba invadens
SQQYFKYILMYFTDGEIVC

SEQ ID NO: 2968531 - protein, 25 aa, Entamoeba invadens
SQRDLCPRCGLHVNICACHIVKEQY

SEQ ID NO: 2968532 - protein, 22 aa, Entamoeba invadens
SQREVIKFAKKWNMSLIETSAK

SEQ ID NO: 2968533 - protein, 19 aa, Entamoeba invadens
SQRKNIKACASFLEKKSNL

SEQ ID NO: 2968534 - protein, 28 aa, Entamoeba invadens
SQRNWRTAKKFGKAVVFDFVGTLDGFNM

SEQ ID NO: 2968535 - protein, 17 aa, Entamoeba invadens
SQRRARINKCINVINAE

SEQ ID NO: 2968536 - protein, 20 aa, Entamoeba invadens
SQRTCCFTKSYTKIVEGTGS

SEQ ID NO: 2968537 - protein, 17 aa, Entamoeba invadens
SQSDFKLTHFGHFEQLY

SEQ ID NO: 2968538 - protein, 17 aa, Entamoeba invadens
SQSFLFQPSCAISGISI

SEQ ID NO: 2968539 - protein, 26 aa, Entamoeba invadens
SQSFSRMAVLFSSIYNLLNNPRIVLS

SEQ ID NO: 2968540 - protein, 19 aa, Entamoeba invadens
SQSILKYVMSVAESLFGKK

SEQ ID NO: 2968541 - protein, 19 aa, Entamoeba invadens
SQSKQSWDDFCKSFENEKK

SEQ ID NO: 2968542 - protein, 22 aa, Entamoeba invadens
SQSKYMVCRSIYSLTIEHTSLL

SEQ ID NO: 2968543 - protein, 27 aa, Entamoeba invadens
SQSQIRFSAIIKFIGHLNLRGFFPSHF

SEQ ID NO: 2968544 - protein, 18 aa, Entamoeba invadens
SQSSFRHTASEASSENSS

SEQ ID NO: 2968545 - protein, 24 aa, Entamoeba invadens
SQTDPFLFVKMIDFGWSRSIAEEM

SEQ ID NO: 2968546 - protein, 19 aa, Entamoeba invadens
SQTEKYQCISCVDRFVVND

SEQ ID NO: 2968547 - protein, 23 aa, Entamoeba invadens
SQTIPYFFSEFIFNQFRTSELEE

SEQ ID NO: 2968548 - protein, 25 aa, Entamoeba invadens
SQTRILRFSLAWLCNVDQTTNQLIN

SEQ ID NO: 2968549 - protein, 23 aa, Entamoeba invadens
SQTRKCGVFFARFDTLEDSKRAF

SEQ ID NO: 2968550 - protein, 17 aa, Entamoeba invadens
SQTRLCILPDLIETTKC

SEQ ID NO: 2968551 - protein, 27 aa, Entamoeba invadens
SQTTQKCFICGRGGHIASKCPEKKHGG

SEQ ID NO: 2968552 - protein, 18 aa, Entamoeba invadens
SQVAFEFFVETATHLLNF

SEQ ID NO: 2968553 - protein, 19 aa, Entamoeba invadens
SQVIYRINYNIVYLNTLGD

SEQ ID NO: 2968554 - protein, 19 aa, Entamoeba invadens
SQVKACISLSELQSPEDYA

SEQ ID NO: 2968555 - protein, 25 aa, Entamoeba invadens
SQVKSWKKRWFVFSTNGNMSYYTNR

SEQ ID NO: 2968556 - protein, 22 aa, Entamoeba invadens
SQVRYLNRFPFIVYVNTNGTAL

SEQ ID NO: 2968557 - protein, 21 aa, Entamoeba invadens
SQVSFTFVPAFSIGIVGNYMK

SEQ ID NO: 2968558 - protein, 25 aa, Entamoeba invadens
SQVSLELNKYITLEFEDPSKFQTWL

SEQ ID NO: 2968559 - protein, 20 aa, Entamoeba invadens
SQVSPLLVVTPMDTPMVEDD

SEQ ID NO: 2968560 - protein, 23 aa, Entamoeba invadens
SQYFCSIKDFISLEFVNKKYKGN

SEQ ID NO: 2968561 - protein, 19 aa, Entamoeba invadens
SQYILPFTFYVDTKPVCAF

SEQ ID NO: 2968562 - protein, 17 aa, Entamoeba invadens
SQYIVWCEQCKKQNTDL

SEQ ID NO: 2968563 - protein, 18 aa, Entamoeba invadens
SQYSRFVSTGLFIMNQFY

SEQ ID NO: 2968564 - protein, 26 aa, Entamoeba invadens
SQYTHLCDIFSFGVTLFVSMCGYYPF

SEQ ID NO: 2968565 - protein, 28 aa, Entamoeba invadens
SRADWYSVCKNFTLADGTFWPIPITMSV

SEQ ID NO: 2968566 - protein, 25 aa, Entamoeba invadens
SRAEGSRILFCFNMDNEPFALSNSV

SEQ ID NO: 2968567 - protein, 22 aa, Entamoeba invadens
SRAESLLPIVVMDTEKSKNMTG

SEQ ID NO: 2968568 - protein, 21 aa, Entamoeba invadens
SRAFMKNLFANVLRCLINLGD

SEQ ID NO: 2968569 - protein, 26 aa, Entamoeba invadens
SRAHSCKNCLTYNFSKDSDYFFVTAT

SEQ ID NO: 2968570 - protein, 21 aa, Entamoeba invadens
SRAPKSVCAYKAMKTTQQLIK

SEQ ID NO: 2968571 - protein, 19 aa, Entamoeba invadens
SRAQVAIKYLDSFRYDHRD

SEQ ID NO: 2968572 - protein, 22 aa, Entamoeba invadens
SRASHSFILQYGMRNVDQNVSD

SEQ ID NO: 2968573 - protein, 23 aa, Entamoeba invadens
SRAVNLRLTYLFDKVDTYSDEVL

SEQ ID NO: 2968574 - protein, 29 aa, Entamoeba invadens
SRCIDCKKPLCVPSCPAGINIPGFITEIK

SEQ ID NO: 2968575 - protein, 31 aa, Entamoeba invadens
SRCIKLTKFNVCEWKGYIGNGCFSNCDSLKE

SEQ ID NO: 2968576 - protein, 19 aa, Entamoeba invadens
SRCKDMFTYICMDGKCVVK

SEQ ID NO: 2968577 - protein, 26 aa, Entamoeba invadens
SRCLFLRIVSLPQFVEMLSALFLQRK

SEQ ID NO: 2968578 - protein, 27 aa, Entamoeba invadens
SRDCFKCDAKHHFSHGICLPNNPNCDN

SEQ ID NO: 2968579 - protein, 19 aa, Entamoeba invadens
SRDGVCVIVKNITETFSSL

SEQ ID NO: 2968580 - protein, 20 aa, Entamoeba invadens
SRDIKYIPAYADLCVSLSLF

SEQ ID NO: 2968581 - protein, 19 aa, Entamoeba invadens
SRDILKAFLDTAVPILLKY

SEQ ID NO: 2968582 - protein, 24 aa, Entamoeba invadens
SRDILPGRCHRIRVSYISFEEDNG

SEQ ID NO: 2968583 - protein, 20 aa, Entamoeba invadens
SRDKSVWLWKSYTGSDFECA

SEQ ID NO: 2968584 - protein, 26 aa, Entamoeba invadens
SRDSVYEIFQRFLIKKEKKEEKLINV

SEQ ID NO: 2968585 - protein, 18 aa, Entamoeba invadens
SREAFKESMDPSKPKKKS

SEQ ID NO: 2968586 - protein, 17 aa, Entamoeba invadens
SREAKFNFERNVDVQWL

SEQ ID NO: 2968587 - protein, 19 aa, Entamoeba invadens
SREAVPLFPDNKLDKPITQ

SEQ ID NO: 2968588 - protein, 22 aa, Entamoeba invadens
SRECKEKEQIFVGKTLGVIKMA

SEQ ID NO: 2968589 - protein, 24 aa, Entamoeba invadens
SRECRWLPSMLSSVYNKLCITVGL

SEQ ID NO: 2968590 - protein, 21 aa, Entamoeba invadens
SREIIKIANCQSLNNNEIKKE

SEQ ID NO: 2968591 - protein, 37 aa, Entamoeba invadens
SREKLVYLCVFAGCDYCKSLRGVGIKKALKLVTSAVD

SEQ ID NO: 2968592 - protein, 19 aa, Entamoeba invadens
SRESFTLKIGDIANLVTMT

SEQ ID NO: 2968593 - protein, 29 aa, Entamoeba invadens
SREVLKRNVETLRMFSLIQIGTKVKRKAM

SEQ ID NO: 2968594 - protein, 25 aa, Entamoeba invadens
SREYQWRVFSAWDLTTNAMAAMKMK

SEQ ID NO: 2968595 - protein, 17 aa, Entamoeba invadens
SRFCVSEYCTLTHPSPF

SEQ ID NO: 2968596 - protein, 26 aa, Entamoeba invadens
SRFEVTCTVKDLFVFLEENHLKRKDV

SEQ ID NO: 2968597 - protein, 21 aa, Entamoeba invadens
SRFGFKKNCLELFVEKVASRG

SEQ ID NO: 2968598 - protein, 19 aa, Entamoeba invadens
SRFGNSFHLCREILKMMKL

SEQ ID NO: 2968599 - protein, 25 aa, Entamoeba invadens
SRFKGKRSGNLAGYSSFTFRDNAIL

SEQ ID NO: 2968600 - protein, 22 aa, Entamoeba invadens
SRFKKPTLCSVEHKKPKITQRG

SEQ ID NO: 2968601 - protein, 19 aa, Entamoeba invadens
SRFQCFVAYVSPVWDNTKM

SEQ ID NO: 2968602 - protein, 17 aa, Entamoeba invadens
SRFTKALFRDADQVTLK

SEQ ID NO: 2968603 - protein, 21 aa, Entamoeba invadens
SRFYRQWEICKTTNPDKIKTI

SEQ ID NO: 2968604 - protein, 19 aa, Entamoeba invadens
SRGAGCMFNSVAVQEFNQT

SEQ ID NO: 2968605 - protein, 25 aa, Entamoeba invadens
SRGASYFPFKGVSLAVVVFNSQDDS

SEQ ID NO: 2968606 - protein, 18 aa, Entamoeba invadens
SRGEGRKEHHLLDDEDYV

SEQ ID NO: 2968607 - protein, 21 aa, Entamoeba invadens
SRGKRTYPEVCSKNVEELMKG

SEQ ID NO: 2968608 - protein, 33 aa, Entamoeba invadens
SRGMFMCATLIPYADLLYEFVLSYLAKNVSNKD

SEQ ID NO: 2968609 - protein, 22 aa, Entamoeba invadens
SRGRIKLGDFGLARSIGIPIKH

SEQ ID NO: 2968610 - protein, 23 aa, Entamoeba invadens
SRGSEMLLLLRPRVRPVRLAESA

SEQ ID NO: 2968611 - protein, 17 aa, Entamoeba invadens
SRHAIAIEQLKTELKLD

SEQ ID NO: 2968612 - protein, 26 aa, Entamoeba invadens
SRHLLQKRIVELFITSGLPVSNSEDF

SEQ ID NO: 2968613 - protein, 26 aa, Entamoeba invadens
SRHNCTKRKTTLLIWSVKNLQNTIAD

SEQ ID NO: 2968614 - protein, 21 aa, Entamoeba invadens
SRIAFEIKDGLVINIVKVESD

SEQ ID NO: 2968615 - protein, 23 aa, Entamoeba invadens
SRIGNKVQYMFSSPVALTGDVGD

SEQ ID NO: 2968616 - protein, 17 aa, Entamoeba invadens
SRIIFRLSGTGSVGATV

SEQ ID NO: 2968617 - protein, 20 aa, Entamoeba invadens
SRIKLKLPKSLKTIFISTII

SEQ ID NO: 2968618 - protein, 25 aa, Entamoeba invadens
SRILSWSIGVVMYRIIKGNLPYKKY

SEQ ID NO: 2968619 - protein, 23 aa, Entamoeba invadens
SRILVATDLCGRGIDIERVNLVV

SEQ ID NO: 2968620 - protein, 19 aa, Entamoeba invadens
SRINSIVDDRCRACLEMYR

SEQ ID NO: 2968621 - protein, 22 aa, Entamoeba invadens
SRITFNQVKGIFGFQAHDNVGK

SEQ ID NO: 2968622 - protein, 17 aa, Entamoeba invadens
SRITKRFVPLDEDTKNV

SEQ ID NO: 2968623 - protein, 24 aa, Entamoeba invadens
SRITRLANKCFFEMGQLQNVTISE

SEQ ID NO: 2968624 - protein, 20 aa, Entamoeba invadens
SRKDMWDVYYAPLFTTDQRI

SEQ ID NO: 2968625 - protein, 22 aa, Entamoeba invadens
SRKDRKLVWFGGIRLSSKEYKG

SEQ ID NO: 2968626 - protein, 22 aa, Entamoeba invadens
SRKEIHATLELVSVGGLSNKIN

SEQ ID NO: 2968627 - protein, 23 aa, Entamoeba invadens
SRKGIGVCYQARIKDGGRKVSTF

SEQ ID NO: 2968628 - protein, 25 aa, Entamoeba invadens
SRKKQVLVCQCSGKYRSCSYSPKGG

SEQ ID NO: 2968629 - protein, 26 aa, Entamoeba invadens
SRKKVCFGAKEFLELITQLRQCQDES

SEQ ID NO: 2968630 - protein, 23 aa, Entamoeba invadens
SRKLTWRPGHIWVGSATIQRPRT

SEQ ID NO: 2968631 - protein, 25 aa, Entamoeba invadens
SRKRDVVCGVLYSLSNMVMCDVCNL

SEQ ID NO: 2968632 - protein, 19 aa, Entamoeba invadens
SRKRKSCVTLATKSNAMKF

SEQ ID NO: 2968633 - protein, 21 aa, Entamoeba invadens
SRKSGLCRVMNEFGIITIDCD

SEQ ID NO: 2968634 - protein, 23 aa, Entamoeba invadens
SRLCKTIPLYMHKFFPVYMELLI

SEQ ID NO: 2968635 - protein, 25 aa, Entamoeba invadens
SRLCSLRKTPLLEIIQIEPARSESI

SEQ ID NO: 2968636 - protein, 23 aa, Entamoeba invadens
SRLEAQKAFGILLRLFTSKEAEG

SEQ ID NO: 2968637 - protein, 17 aa, Entamoeba invadens
SRLEHFASIKKLDLFAC

SEQ ID NO: 2968638 - protein, 18 aa, Entamoeba invadens
SRLFFREVDESFVSEMLQ

SEQ ID NO: 2968639 - protein, 20 aa, Entamoeba invadens
SRLFKSFLSREVDNNKNTEL

SEQ ID NO: 2968640 - protein, 17 aa, Entamoeba invadens
SRLHLVLGEKRLTHLQN

SEQ ID NO: 2968641 - protein, 18 aa, Entamoeba invadens
SRLIRVLEQLLKKKAPRY

SEQ ID NO: 2968642 - protein, 25 aa, Entamoeba invadens
SRLKEIRLPKLVEVIPESCFSNCSS

SEQ ID NO: 2968643 - protein, 23 aa, Entamoeba invadens
SRLKSLKQLILYGNKLKNLPLLD

SEQ ID NO: 2968644 - protein, 26 aa, Entamoeba invadens
SRLLCGSKIAPFFANKFKPCVHNLND

SEQ ID NO: 2968645 - protein, 20 aa, Entamoeba invadens
SRLLTNYLQRVGHTCSLDDC

SEQ ID NO: 2968646 - protein, 20 aa, Entamoeba invadens
SRLNSLVSIDSIETINSIVK

SEQ ID NO: 2968647 - protein, 21 aa, Entamoeba invadens
SRLPPGTIKRNVFLFGKIGTK

SEQ ID NO: 2968648 - protein, 34 aa, Entamoeba invadens
SRLRLFATCLQFIVNEIFIRYFVLKGTNVSVTFE

SEQ ID NO: 2968649 - protein, 22 aa, Entamoeba invadens
SRLSAICLNQIFVHLTINNLAN

SEQ ID NO: 2968650 - protein, 20 aa, Entamoeba invadens
SRLSEAYISVLPRNTVGELL

SEQ ID NO: 2968651 - protein, 25 aa, Entamoeba invadens
SRLSKKFKSAKCYSFRTQLKNIIKE

SEQ ID NO: 2968652 - protein, 17 aa, Entamoeba invadens
SRLSLPKALSYIGSCCF

SEQ ID NO: 2968653 - protein, 21 aa, Entamoeba invadens
SRLTHLPLMCFQMCTNLKAID

SEQ ID NO: 2968654 - protein, 17 aa, Entamoeba invadens
  misc_feature (14)..(15): Xaa can be any naturally occurring amino acid
SRLTNFVGILSTGXXGL

SEQ ID NO: 2968655 - protein, 17 aa, Entamoeba invadens
SRLTPYIIEKGTMTRVF

SEQ ID NO: 2968656 - protein, 19 aa, Entamoeba invadens
SRMAFLLFRKKYDTYPQSH

SEQ ID NO: 2968657 - protein, 25 aa, Entamoeba invadens
SRMFKNVFKYCVGQVSVYLRFLYEQ

SEQ ID NO: 2968658 - protein, 17 aa, Entamoeba invadens
SRMKKLQTIKIALFVEK

SEQ ID NO: 2968659 - protein, 21 aa, Entamoeba invadens
SRMQCKACNKDLMVINEYLFA

SEQ ID NO: 2968660 - protein, 25 aa, Entamoeba invadens
SRMVVHDFQLCFALDKQYRSVGMFL

SEQ ID NO: 2968661 - protein, 19 aa, Entamoeba invadens
SRNELKFSPNDQFLAVAGF

SEQ ID NO: 2968662 - protein, 32 aa, Entamoeba invadens
SRNIIVLLFLKYKIIDTLIQFVCKTVALKEFN

SEQ ID NO: 2968663 - protein, 19 aa, Entamoeba invadens
SRNILRSVEKLVLENNVVT

SEQ ID NO: 2968664 - protein, 24 aa, Entamoeba invadens
SRNIPTWRQCLVERSWRSSNSISS

SEQ ID NO: 2968665 - protein, 24 aa, Entamoeba invadens
SRNLIRYATAYGFLKEMIISLARI

SEQ ID NO: 2968666 - protein, 25 aa, Entamoeba invadens
SRNVISWQYICRVIFYCLSVVHKKN

SEQ ID NO: 2968667 - protein, 21 aa, Entamoeba invadens
SRNVKMLNHMIIDYDEKDALQ

SEQ ID NO: 2968668 - protein, 20 aa, Entamoeba invadens
SRNVSKTCELSSCFIPTLTL

SEQ ID NO: 2968669 - protein, 21 aa, Entamoeba invadens
SRPQMMYGPVVSYVKDYNTLS

SEQ ID NO: 2968670 - protein, 23 aa, Entamoeba invadens
SRPVCTFTTFLSSFIGIVSHPTL

SEQ ID NO: 2968671 - protein, 20 aa, Entamoeba invadens
SRQEIVSMIPALLLDVHEGM

SEQ ID NO: 2968672 - protein, 21 aa, Entamoeba invadens
SRQEIVSMIPALLLDVHEGMS

SEQ ID NO: 2968673 - protein, 18 aa, Entamoeba invadens
SRQHILTYNWWFNQGGNG

SEQ ID NO: 2968674 - protein, 21 aa, Entamoeba invadens
SRQKSKEAFVGLQQQLEELRK

SEQ ID NO: 2968675 - protein, 21 aa, Entamoeba invadens
SRQLADLGARVIKLERLPDGD

SEQ ID NO: 2968676 - protein, 21 aa, Entamoeba invadens
SRQRVGGVILLEFSSVRLRDI

SEQ ID NO: 2968677 - protein, 25 aa, Entamoeba invadens
SRRDCSRTGLRFSSRGGDINGNVSN

SEQ ID NO: 2968678 - protein, 20 aa, Entamoeba invadens
SRREFVPIKAIDKGVEVVLK

SEQ ID NO: 2968679 - protein, 23 aa, Entamoeba invadens
SRRFYRAELLRRVRANGGELDIG

SEQ ID NO: 2968680 - protein, 19 aa, Entamoeba invadens
SRRRIPLIGEMTAVSKSSM

SEQ ID NO: 2968681 - protein, 21 aa, Entamoeba invadens
SRRSKRSVVFSVGGTGTNKVP

SEQ ID NO: 2968682 - protein, 18 aa, Entamoeba invadens
SRSAAITFNGIDSLEYLQ

SEQ ID NO: 2968683 - protein, 20 aa, Entamoeba invadens
SRSASIVIAYLMKKNGLSYK

SEQ ID NO: 2968684 - protein, 20 aa, Entamoeba invadens
SRSCFSYCIHLLEIKIPLSV

SEQ ID NO: 2968685 - protein, 18 aa, Entamoeba invadens
SRSEAIWVNFDWTVLETI

SEQ ID NO: 2968686 - protein, 25 aa, Entamoeba invadens
SRSEVTMKLVFNESYVKELFPNLEE

SEQ ID NO: 2968687 - protein, 19 aa, Entamoeba invadens
SRSFSSFPQRGISRQEPSK

SEQ ID NO: 2968688 - protein, 21 aa, Entamoeba invadens
SRSHSIFILELCGENTEFNQR

SEQ ID NO: 2968689 - protein, 25 aa, Entamoeba invadens
SRSIKGCKLHDVVIVYTPASNLKKT

SEQ ID NO: 2968690 - protein, 20 aa, Entamoeba invadens
SRSIQWFCEQSFITKLLNVF

SEQ ID NO: 2968691 - protein, 21 aa, Entamoeba invadens
SRSKGGFSYGYVDTMCSEMKC

SEQ ID NO: 2968692 - protein, 25 aa, Entamoeba invadens
SRSKLKKAMVVPDSFYQKVDFKKVN

SEQ ID NO: 2968693 - protein, 20 aa, Entamoeba invadens
SRSRCSRLFVFLVFFCVLFI

SEQ ID NO: 2968694 - protein, 20 aa, Entamoeba invadens
SRSRRGLQRSVLFVIDMSYP

SEQ ID NO: 2968695 - protein, 22 aa, Entamoeba invadens
SRSSPCLYQRGQSVFSVVNKIQ

SEQ ID NO: 2968696 - protein, 20 aa, Entamoeba invadens
SRSSQPFFFFSIKNPHNKIF

SEQ ID NO: 2968697 - protein, 26 aa, Entamoeba invadens
SRTKRRSVNCFLFNDFLIITKINATG

SEQ ID NO: 2968698 - protein, 19 aa, Entamoeba invadens
SRTKSKVCFLLSKDDFHHG

SEQ ID NO: 2968699 - protein, 22 aa, Entamoeba invadens
SRTQCFEPLFNPQLCSMSCNGL

SEQ ID NO: 2968700 - protein, 22 aa, Entamoeba invadens
SRTQYIRMKLAYHKMMVEKYRS

SEQ ID NO: 2968701 - protein, 23 aa, Entamoeba invadens
SRTRLPGRVLVPLYNILKNQPVF

SEQ ID NO: 2968702 - protein, 18 aa, Entamoeba invadens
SRTRYYVMARKTKFETPC

SEQ ID NO: 2968703 - protein, 29 aa, Entamoeba invadens
SRVCSSLFIKAILGCNGLVVVVSVEDSVF

SEQ ID NO: 2968704 - protein, 20 aa, Entamoeba invadens
SRVCVACKSFDPSCKICSSD

SEQ ID NO: 2968705 - protein, 22 aa, Entamoeba invadens
SRVCYKAPWPVTSREFVSVQNY

SEQ ID NO: 2968706 - protein, 23 aa, Entamoeba invadens
SRVDPTVFFQKGFIECRRVYVKV

SEQ ID NO: 2968707 - protein, 22 aa, Entamoeba invadens
SRVDVPAVFPITMPGIKTLKLF

SEQ ID NO: 2968708 - protein, 17 aa, Entamoeba invadens
SRVEFQRFIGCCMELNL

SEQ ID NO: 2968709 - protein, 33 aa, Entamoeba invadens
SRVEIVHSLAKWKRLQLHYLHIPVGEGIVTDMN

SEQ ID NO: 2968710 - protein, 20 aa, Entamoeba invadens
SRVFAISAIAERDSSNYAIL

SEQ ID NO: 2968711 - protein, 17 aa, Entamoeba invadens
SRVFFSKPLASQWYEKE

SEQ ID NO: 2968712 - protein, 19 aa, Entamoeba invadens
SRVFIWKLVLNYYTFSMTE

SEQ ID NO: 2968713 - protein, 19 aa, Entamoeba invadens
SRVFNSFYFDTFKVPIHIT

SEQ ID NO: 2968714 - protein, 18 aa, Entamoeba invadens
SRVFNSFYFDTFKVPINI

SEQ ID NO: 2968715 - protein, 18 aa, Entamoeba invadens
SRVKACISLMELLNEEEF

SEQ ID NO: 2968716 - protein, 27 aa, Entamoeba invadens
SRVLMKNECQTLLSLKGFTEQGKTLFD

SEQ ID NO: 2968717 - protein, 25 aa, Entamoeba invadens
SRVNIGEVLIRFDAFDDKQFLEIVI

SEQ ID NO: 2968718 - protein, 23 aa, Entamoeba invadens
SRVQDVFSLPTFLPINLPSLFSH

SEQ ID NO: 2968719 - protein, 19 aa, Entamoeba invadens
SRVSGPWAEEIVNKALVEC

SEQ ID NO: 2968720 - protein, 19 aa, Entamoeba invadens
SRWRKRNVSPVKEIKSYKE

SEQ ID NO: 2968721 - protein, 21 aa, Entamoeba invadens
SRYDGWFVLTSIKLFVDTIQF

SEQ ID NO: 2968722 - protein, 26 aa, Entamoeba invadens
SRYFIKEGFLTKQCRKVPKPRYFYLF

SEQ ID NO: 2968723 - protein, 27 aa, Entamoeba invadens
SRYLKFPVVESNILKKRVSDGIRYSHL

SEQ ID NO: 2968724 - protein, 21 aa, Entamoeba invadens
SRYQIYVKKPFDIVMKAYENT

SEQ ID NO: 2968725 - protein, 20 aa, Entamoeba invadens
SRYQPFFISFGCFNKEQDCR

SEQ ID NO: 2968726 - protein, 17 aa, Entamoeba invadens
SRYVGNADLSFFEIKSF

SEQ ID NO: 2968727 - protein, 21 aa, Entamoeba invadens
SRYVPVKKFARGVLILKDTQP

SEQ ID NO: 2968728 - protein, 20 aa, Entamoeba invadens
SRYYRAPEVIFGIASNIEID

SEQ ID NO: 2968729 - protein, 25 aa, Entamoeba invadens
SSAAMCIFAELSFVPGKMIQAEDRI

SEQ ID NO: 2968730 - protein, 17 aa, Entamoeba invadens
SSAAVGYFPPYDGGYAD

SEQ ID NO: 2968731 - protein, 21 aa, Entamoeba invadens
SSAGVGWIFVQWMSGNINQYR

SEQ ID NO: 2968732 - protein, 20 aa, Entamoeba invadens
SSAIAIIFDKLFAMRRDFLA

SEQ ID NO: 2968733 - protein, 21 aa, Entamoeba invadens
SSALLDFLSAIQFDDKSSAST

SEQ ID NO: 2968734 - protein, 19 aa, Entamoeba invadens
SSAPNEWYEYFYTDKTVLK

SEQ ID NO: 2968735 - protein, 19 aa, Entamoeba invadens
SSAQEIADWLFSELNLLIS

SEQ ID NO: 2968736 - protein, 27 aa, Entamoeba invadens
SSAQVYFNFVPAFSIKGVGNFMKHNLV

SEQ ID NO: 2968737 - protein, 25 aa, Entamoeba invadens
SSAVERYDLFSGKVLDEAKRVIDQF

SEQ ID NO: 2968738 - protein, 21 aa, Entamoeba invadens
SSAVHCVFWAKQLFQKLFSKS

SEQ ID NO: 2968739 - protein, 24 aa, Entamoeba invadens
SSCEGICGMKFLKQLLLTNNYISK

SEQ ID NO: 2968740 - protein, 17 aa, Entamoeba invadens
SSCFCVCSSLINVNIPS

SEQ ID NO: 2968741 - protein, 19 aa, Entamoeba invadens
SSCFDSCSNLSTIKLPIGL

SEQ ID NO: 2968742 - protein, 20 aa, Entamoeba invadens
SSCFEGCASLTLIDIPETLK

SEQ ID NO: 2968743 - protein, 19 aa, Entamoeba invadens
SSCFLDCGFLKQIEIPSSV

SEQ ID NO: 2968744 - protein, 20 aa, Entamoeba invadens
SSCFWGCNLRTLVVEKGVKY

SEQ ID NO: 2968745 - protein, 23 aa, Entamoeba invadens
SSCGHEFGLRLALQALAETASRH

SEQ ID NO: 2968746 - protein, 19 aa, Entamoeba invadens
SSCIGEIRESVFAREKQTL

SEQ ID NO: 2968747 - protein, 21 aa, Entamoeba invadens
SSCNPGACYGYLNVTSDEVKK

SEQ ID NO: 2968748 - protein, 27 aa, Entamoeba invadens
SSDALHLGHLIPFIFTQYLQEAFNAEL

SEQ ID NO: 2968749 - protein, 22 aa, Entamoeba invadens
SSDCYQMCFWLLDNAIYNTGVF

SEQ ID NO: 2968750 - protein, 23 aa, Entamoeba invadens
SSDDFKFKFLQTILVTIQTSNDL

SEQ ID NO: 2968751 - protein, 20 aa, Entamoeba invadens
SSDECLHCKEGASQVGYSCY

SEQ ID NO: 2968752 - protein, 21 aa, Entamoeba invadens
SSDEFAARFVGEVATPEIRWG

SEQ ID NO: 2968753 - protein, 23 aa, Entamoeba invadens
SSDFIINNGITFFIDHIAVIGLR

SEQ ID NO: 2968754 - protein, 23 aa, Entamoeba invadens
SSDFKFQQLQSIFTVFLTIAPTA

SEQ ID NO: 2968755 - protein, 26 aa, Entamoeba invadens
SSDGCVFGGYIHRRVRELNVDVEDKK

SEQ ID NO: 2968756 - protein, 22 aa, Entamoeba invadens
SSDGTVWMYDWRKLDKCLDRTT

SEQ ID NO: 2968757 - protein, 21 aa, Entamoeba invadens
SSDGVECLVRIITTIVVVLLI

SEQ ID NO: 2968758 - protein, 23 aa, Entamoeba invadens
SSDILPLRLCIYLYSSISQILTL

SEQ ID NO: 2968759 - protein, 21 aa, Entamoeba invadens
SSDKQRSCTICESNYYPKQGL

SEQ ID NO: 2968760 - protein, 25 aa, Entamoeba invadens
SSDLSFLYLTAFVQKLAKAFGSQAI

SEQ ID NO: 2968761 - protein, 26 aa, Entamoeba invadens
SSDPTRIATFSSFGDRVVVMDTRKPF

SEQ ID NO: 2968762 - protein, 17 aa, Entamoeba invadens
SSDQKALLWDLFPVESG

SEQ ID NO: 2968763 - protein, 24 aa, Entamoeba invadens
SSDQRFKFSVQIQRNADEEMARGT

SEQ ID NO: 2968764 - protein, 23 aa, Entamoeba invadens
SSDSIPLLALKAINQVKESDRKE

SEQ ID NO: 2968765 - protein, 18 aa, Entamoeba invadens
SSDVLVKVMDLFIGLNYG

SEQ ID NO: 2968766 - protein, 25 aa, Entamoeba invadens
SSDYRMAATELKREYLLLESATEFE

SEQ ID NO: 2968767 - protein, 26 aa, Entamoeba invadens
SSEKFRACVFTQQFIKLIVSVYSMKE

SEQ ID NO: 2968768 - protein, 34 aa, Entamoeba invadens
SSEKSKWILLKPFIQCFGIPPSFFLRVSKKMNIT

SEQ ID NO: 2968769 - protein, 18 aa, Entamoeba invadens
SSELGAFLVQHDVILFLR

SEQ ID NO: 2968770 - protein, 25 aa, Entamoeba invadens
SSEMVLRARIPRIGMKSKRILEYNN

SEQ ID NO: 2968771 - protein, 24 aa, Entamoeba invadens
SSETCLYGTITNCYKCQNGYIRNN

SEQ ID NO: 2968772 - protein, 18 aa, Entamoeba invadens
SSEVIHCFIEKLVEFSVF

SEQ ID NO: 2968773 - protein, 22 aa, Entamoeba invadens
SSEVRPELLIGVFKCLDCGLES

SEQ ID NO: 2968774 - protein, 18 aa, Entamoeba invadens
SSEVTLPKGMKFKSDYSP

SEQ ID NO: 2968775 - protein, 22 aa, Entamoeba invadens
SSEYMMLYNIVFSLCTSLDDTL

SEQ ID NO: 2968776 - protein, 24 aa, Entamoeba invadens
SSFAERRLAVIMQRRKMVDTIQMG

SEQ ID NO: 2968777 - protein, 20 aa, Entamoeba invadens
SSFANCMKLKKVDLESSTEI

SEQ ID NO: 2968778 - protein, 17 aa, Entamoeba invadens
SSFCVEVYGQTKLEKRK

SEQ ID NO: 2968779 - protein, 19 aa, Entamoeba invadens
SSFDGIKIHSYKDVFVVVV

SEQ ID NO: 2968780 - protein, 19 aa, Entamoeba invadens
SSFEGCALLKEIVLYTPQF

SEQ ID NO: 2968781 - protein, 30 aa, Entamoeba invadens
SSFEVFFLLCCLKLTFPNQFVLLRGNHETK

SEQ ID NO: 2968782 - protein, 17 aa, Entamoeba invadens
SSFKESFIRKILVETLA

SEQ ID NO: 2968783 - protein, 20 aa, Entamoeba invadens
SSFKLFKFGDGDVEVGKMLI

SEQ ID NO: 2968784 - protein, 23 aa, Entamoeba invadens
SSFLKLKSEMIIRKPDTQKLFDS

SEQ ID NO: 2968785 - protein, 21 aa, Entamoeba invadens
SSFLPDFDVSGLTHPFLQAKI

SEQ ID NO: 2968786 - protein, 17 aa, Entamoeba invadens
SSFMLKEGVCVECSTST

SEQ ID NO: 2968787 - protein, 17 aa, Entamoeba invadens
SSFNFPSKLEFLGKNCF

SEQ ID NO: 2968788 - protein, 24 aa, Entamoeba invadens
SSFPEPLANISRKLRHVKIAEDLD

SEQ ID NO: 2968789 - protein, 19 aa, Entamoeba invadens
SSFQFLKLVIEKTQVPFLD

SEQ ID NO: 2968790 - protein, 25 aa, Entamoeba invadens
SSFSRLKPVLPVPLLRELHSTAFQS

SEQ ID NO: 2968791 - protein, 26 aa, Entamoeba invadens
SSFVPVQCLPSFFSVENNVSNTFRRT

SEQ ID NO: 2968792 - protein, 17 aa, Entamoeba invadens
SSFWAFKQGGSVKTTKK

SEQ ID NO: 2968793 - protein, 17 aa, Entamoeba invadens
SSGCFYGCCNLGNIEIS

SEQ ID NO: 2968794 - protein, 22 aa, Entamoeba invadens
SSGICNTCLYNYVFNEPKGRSC

SEQ ID NO: 2968795 - protein, 23 aa, Entamoeba invadens
SSGKKRSSGCIAKYNEKFLLGYK

SEQ ID NO: 2968796 - protein, 24 aa, Entamoeba invadens
SSGLHLKRIVIWSEQIGGVNTSEV

SEQ ID NO: 2968797 - protein, 18 aa, Entamoeba invadens
SSGTFFFNAIDYTVQGSR

SEQ ID NO: 2968798 - protein, 30 aa, Entamoeba invadens
SSHFNVLFFKLLFRRIDGFIGDNPTPNHDK

SEQ ID NO: 2968799 - protein, 17 aa, Entamoeba invadens
SSHFSLIVLCFNGVEGF

SEQ ID NO: 2968800 - protein, 27 aa, Entamoeba invadens
SSHICQHCDLCLFSSLKAHLAKDELID

SEQ ID NO: 2968801 - protein, 27 aa, Entamoeba invadens
SSHISIKCFCCIAAKAPEIDLSIFLRK

SEQ ID NO: 2968802 - protein, 19 aa, Entamoeba invadens
SSHLFGNKGAFALANLITI

SEQ ID NO: 2968803 - protein, 19 aa, Entamoeba invadens
SSHPKMHYYHAWQTMCPGF

SEQ ID NO: 2968804 - protein, 25 aa, Entamoeba invadens
SSHVLELEVAHAFFYGEGRVGIISG

SEQ ID NO: 2968805 - protein, 18 aa, Entamoeba invadens
SSIAPLLLKKAVKMHDEI

SEQ ID NO: 2968806 - protein, 19 aa, Entamoeba invadens
SSICELRLKKYSIKIDIDF

SEQ ID NO: 2968807 - protein, 17 aa, Entamoeba invadens
SSIDNIVFTASKTPFIF

SEQ ID NO: 2968808 - protein, 17 aa, Entamoeba invadens
SSIEKICTVCVGDFLIT

SEQ ID NO: 2968809 - protein, 22 aa, Entamoeba invadens
SSIELEERFLLGVRRCHDTYQL

SEQ ID NO: 2968810 - protein, 30 aa, Entamoeba invadens
SSIGCALYLSLLLEPKWRKSQIDVNHKKHM

SEQ ID NO: 2968811 - protein, 21 aa, Entamoeba invadens
SSIGCIRCKKGYYTDKSNKCS

SEQ ID NO: 2968812 - protein, 23 aa, Entamoeba invadens
SSIGDDVLKFMLKRSTSDEVAAC

SEQ ID NO: 2968813 - protein, 17 aa, Entamoeba invadens
SSIGDFKTLSRCHGSVM

SEQ ID NO: 2968814 - protein, 18 aa, Entamoeba invadens
SSIGDFKTLSRCYVSVMQ

SEQ ID NO: 2968815 - protein, 21 aa, Entamoeba invadens
SSIHSPTCRFAHSLESENNRV

SEQ ID NO: 2968816 - protein, 23 aa, Entamoeba invadens
SSIIIRLVSDFFVRDYDPTIEDS

SEQ ID NO: 2968817 - protein, 19 aa, Entamoeba invadens
SSIISIGNWCFNRCSSLTS

SEQ ID NO: 2968818 - protein, 22 aa, Entamoeba invadens
SSIKDYFHTLNFVAIKEPKKEE

SEQ ID NO: 2968819 - protein, 24 aa, Entamoeba invadens
SSIKLEALRAILYCLHHYKEDVVC

SEQ ID NO: 2968820 - protein, 17 aa, Entamoeba invadens
SSIKNILELSGMRCLQI

SEQ ID NO: 2968821 - protein, 19 aa, Entamoeba invadens
SSIKPYLVSMSFKCGTCNY

SEQ ID NO: 2968822 - protein, 18 aa, Entamoeba invadens
SSIKWWMRFYSLLEHVND

SEQ ID NO: 2968823 - protein, 18 aa, Entamoeba invadens
SSILKLGNSCFCKCSSLK

SEQ ID NO: 2968824 - protein, 18 aa, Entamoeba invadens
SSILNRPNLLFINYDDKG

SEQ ID NO: 2968825 - protein, 17 aa, Entamoeba invadens
SSILYKAPISLKKYKLI

SEQ ID NO: 2968826 - protein, 19 aa, Entamoeba invadens
SSINCVFEAMATAEEDIQI

SEQ ID NO: 2968827 - protein, 19 aa, Entamoeba invadens
SSINFTLKVSFVGDTSSDK

SEQ ID NO: 2968828 - protein, 17 aa, Entamoeba invadens
SSISELVNLSWSYTDYK

SEQ ID NO: 2968829 - protein, 17 aa, Entamoeba invadens
SSISKLSDRCFFECSSL

SEQ ID NO: 2968830 - protein, 18 aa, Entamoeba invadens
SSISKLSDRCFFECSSLS

SEQ ID NO: 2968831 - protein, 26 aa, Entamoeba invadens
SSITRLGTCCFMKCSSLASIKLPEKL

SEQ ID NO: 2968832 - protein, 19 aa, Entamoeba invadens
SSITSIGDFCFYKCSSLKF

SEQ ID NO: 2968833 - protein, 17 aa, Entamoeba invadens
SSITVRLVSDFFVQTYD

SEQ ID NO: 2968834 - protein, 27 aa, Entamoeba invadens
SSIWALSTCKCGKCEKSQINMLWLLRF

SEQ ID NO: 2968835 - protein, 17 aa, Entamoeba invadens
SSKCLSCSILNRCTLCD

SEQ ID NO: 2968836 - protein, 17 aa, Entamoeba invadens
SSKDSFWKKALDGDPRV

SEQ ID NO: 2968837 - protein, 22 aa, Entamoeba invadens
SSKEILSILAPKKIEEVLNAKT

SEQ ID NO: 2968838 - protein, 29 aa, Entamoeba invadens
SSKENELWDILKKCYVNWITNKTVALIWK

SEQ ID NO: 2968839 - protein, 20 aa, Entamoeba invadens
SSKERMKWEDVFKHKFIEEC

SEQ ID NO: 2968840 - protein, 21 aa, Entamoeba invadens
SSKEVFGCYVSDSINQVGKNV

SEQ ID NO: 2968841 - protein, 17 aa, Entamoeba invadens
SSKFLRVEDVITNAKVP

SEQ ID NO: 2968842 - protein, 26 aa, Entamoeba invadens
SSKFQIPDCAKYLFENVKRIATDDYI

SEQ ID NO: 2968843 - protein, 24 aa, Entamoeba invadens
SSKGVLFVHYLCRNGFITTSKIVC

SEQ ID NO: 2968844 - protein, 20 aa, Entamoeba invadens
SSKIKRLPTTKIVPVNSSGS

SEQ ID NO: 2968845 - protein, 27 aa, Entamoeba invadens
SSKKSMCPKNILILMFLQDKVMDAIIQ

SEQ ID NO: 2968846 - protein, 20 aa, Entamoeba invadens
SSKLGEWNLYIAQNSNSFNY

SEQ ID NO: 2968847 - protein, 20 aa, Entamoeba invadens
SSKLRYFVSHCNLQVESIYP

SEQ ID NO: 2968848 - protein, 26 aa, Entamoeba invadens
SSKMYFKTIDVYGSHHLSAFVTAGNV

SEQ ID NO: 2968849 - protein, 27 aa, Entamoeba invadens
SSKNVKCPVLFLWGNYYGDVEFVKQQI

SEQ ID NO: 2968850 - protein, 39 aa, Entamoeba invadens
SSKPFLLEMMSYYGICFSLSYKCAKSFGLTKQFEEVYTL

SEQ ID NO: 2968851 - protein, 34 aa, Entamoeba invadens
SSKRLEWHYLFIACSYIGARICTLYDSLGDESLQ

SEQ ID NO: 2968852 - protein, 17 aa, Entamoeba invadens
SSLARAFAQAGMKTGIL

SEQ ID NO: 2968853 - protein, 19 aa, Entamoeba invadens
SSLDQIGFQCFFRCFSLQS

SEQ ID NO: 2968854 - protein, 19 aa, Entamoeba invadens
SSLEGSVAVWNVEKNEERY

SEQ ID NO: 2968855 - protein, 27 aa, Entamoeba invadens
SSLELLKREMLRGERIVKGYKSEGGND

SEQ ID NO: 2968856 - protein, 17 aa, Entamoeba invadens
SSLETIEIPDFVTEIGR

SEQ ID NO: 2968857 - protein, 19 aa, Entamoeba invadens
SSLFGVAVFADINKTNEYC

SEQ ID NO: 2968858 - protein, 23 aa, Entamoeba invadens
SSLFLNRCGEWLQLIGPSENVVN

SEQ ID NO: 2968859 - protein, 17 aa, Entamoeba invadens
SSLGVFDFRCVYCGMCL

SEQ ID NO: 2968860 - protein, 26 aa, Entamoeba invadens
SSLKRVQFNRLIKLFSLYRLLRNISI

SEQ ID NO: 2968861 - protein, 17 aa, Entamoeba invadens
SSLKVLVTNDLTFQVDQ

SEQ ID NO: 2968862 - protein, 19 aa, Entamoeba invadens
SSLKYLKFLNADSCVAFDD

SEQ ID NO: 2968863 - protein, 20 aa, Entamoeba invadens
SSLLKMKVVVVRKIREKIMI

SEQ ID NO: 2968864 - protein, 17 aa, Entamoeba invadens
SSLLYESCLDITIEDNI

SEQ ID NO: 2968865 - protein, 19 aa, Entamoeba invadens
SSLMFEYSYNFTDGKGYLI

SEQ ID NO: 2968866 - protein, 17 aa, Entamoeba invadens
SSLNKITIGNCVEKIGS

SEQ ID NO: 2968867 - protein, 18 aa, Entamoeba invadens
SSLNKITIGNCVEKIGSN

SEQ ID NO: 2968868 - protein, 28 aa, Entamoeba invadens
SSLPPRNKKLLAFYMNMFYEFCTMSNIH

SEQ ID NO: 2968869 - protein, 25 aa, Entamoeba invadens
SSLQFVYKYGMLCNIMLSDPETFDG

SEQ ID NO: 2968870 - protein, 17 aa, Entamoeba invadens
SSLQQFNALMKMYEQMK

SEQ ID NO: 2968871 - protein, 23 aa, Entamoeba invadens
SSLSPRGGVFVSHQKALSYSGSV

SEQ ID NO: 2968872 - protein, 20 aa, Entamoeba invadens
SSLSRVALPSVFQSVGDAAF

SEQ ID NO: 2968873 - protein, 27 aa, Entamoeba invadens
SSLSSLMLNRWLFSKKHCPLYMEANAN

SEQ ID NO: 2968874 - protein, 18 aa, Entamoeba invadens
SSLSSVVIPLCYTSIDEN

SEQ ID NO: 2968875 - protein, 27 aa, Entamoeba invadens
SSLTKVVLPNSIWKISESCFMGCERLF

SEQ ID NO: 2968876 - protein, 24 aa, Entamoeba invadens
SSLTRLAVLVLKTGEKMKNSTMAK

SEQ ID NO: 2968877 - protein, 18 aa, Entamoeba invadens
SSLTRLDTPKCLTFVGFS

SEQ ID NO: 2968878 - protein, 18 aa, Entamoeba invadens
SSLTSINLERVVSIGRKA

SEQ ID NO: 2968879 - protein, 24 aa, Entamoeba invadens
SSLVECMRCALTIEYTLRQSDKLV

SEQ ID NO: 2968880 - protein, 26 aa, Entamoeba invadens
SSMKETRLWENLDFEISLVTAYPNVE

SEQ ID NO: 2968881 - protein, 23 aa, Entamoeba invadens
SSMSKLLKEEILYNIKKEQDAKD

SEQ ID NO: 2968882 - protein, 19 aa, Entamoeba invadens
SSMTDVFYVSKAFCVKNGG

SEQ ID NO: 2968883 - protein, 27 aa, Entamoeba invadens
SSNEIKDFLFDIGMLVSDGYGTSETGN

SEQ ID NO: 2968884 - protein, 23 aa, Entamoeba invadens
SSNKKEWICVVSSESDGLIIVQT

SEQ ID NO: 2968885 - protein, 22 aa, Entamoeba invadens
SSNLSFKGLFRFTPYADSKEID

SEQ ID NO: 2968886 - protein, 29 aa, Entamoeba invadens
SSNVLATKELISWIMFRLFNLLEKTAAFK

SEQ ID NO: 2968887 - protein, 17 aa, Entamoeba invadens
SSNYGMAGLMKLILENP

SEQ ID NO: 2968888 - protein, 22 aa, Entamoeba invadens
SSPDMKICVEILNFLQKYRVNE

SEQ ID NO: 2968889 - protein, 32 aa, Entamoeba invadens
SSPDVLSSTSWRVLRMLGRIIHRLLHNKNYNM

SEQ ID NO: 2968890 - protein, 21 aa, Entamoeba invadens
SSPFRLCYFDPILDFEKEIEI

SEQ ID NO: 2968891 - protein, 25 aa, Entamoeba invadens
SSPIPIPVNVPLPYGKDVDQAMDEQ

SEQ ID NO: 2968892 - protein, 22 aa, Entamoeba invadens
SSPKLFFPDDIDTIQLEESIQR

SEQ ID NO: 2968893 - protein, 24 aa, Entamoeba invadens
SSPQFRVSTQFPEIIPTDDETKLA

SEQ ID NO: 2968894 - protein, 24 aa, Entamoeba invadens
SSPRGEMIGELIAKLKTQQIIGGQ

SEQ ID NO: 2968895 - protein, 19 aa, Entamoeba invadens
SSPSIGLGMCYHGSHVNIS

SEQ ID NO: 2968896 - protein, 25 aa, Entamoeba invadens
SSQDCARNGNLLCLITILKAFPTVD

SEQ ID NO: 2968897 - protein, 20 aa, Entamoeba invadens
SSQIPLVFAKKCKLLYLGVK

SEQ ID NO: 2968898 - protein, 17 aa, Entamoeba invadens
SSQYVPVLQSLLSDAIP

SEQ ID NO: 2968899 - protein, 22 aa, Entamoeba invadens
SSRDEISFRTSLIAKNNYTFLL

SEQ ID NO: 2968900 - protein, 24 aa, Entamoeba invadens
SSRIRKMFKRVYQWESESDLNVVF

SEQ ID NO: 2968901 - protein, 23 aa, Entamoeba invadens
SSRKFKCDKRVYLGALKYIPHAI

SEQ ID NO: 2968902 - protein, 22 aa, Entamoeba invadens
SSRKGNVPSDCFVLKRLVPEKV

SEQ ID NO: 2968903 - protein, 25 aa, Entamoeba invadens
SSRLFTCIRKSVCFTHVRSPSSNPL

SEQ ID NO: 2968904 - protein, 24 aa, Entamoeba invadens
SSRLKSDESVFHIWFYRKSDLFKC

SEQ ID NO: 2968905 - protein, 22 aa, Entamoeba invadens
SSRLVKKWIYSKGFSPYFNDEI

SEQ ID NO: 2968906 - protein, 26 aa, Entamoeba invadens
SSRNCGIGSLLLRMAINAAIEVYGAR

SEQ ID NO: 2968907 - protein, 24 aa, Entamoeba invadens
SSRPWTGTRLRAIKLLESEDYEGV

SEQ ID NO: 2968908 - protein, 22 aa, Entamoeba invadens
SSRSHCVFTVFITKQNNSQNSQ

SEQ ID NO: 2968909 - protein, 34 aa, Entamoeba invadens
SSRVFLKIMLQDMFETMGMKEFTAKILGANVKEY

SEQ ID NO: 2968910 - protein, 19 aa, Entamoeba invadens
SSRVGFKTRVPWTKEEDET

SEQ ID NO: 2968911 - protein, 19 aa, Entamoeba invadens
SSSAALMFIDLFDSQTKLQ

SEQ ID NO: 2968912 - protein, 23 aa, Entamoeba invadens
SSSEILKPVFGRRNAGKKHFVDI

SEQ ID NO: 2968913 - protein, 29 aa, Entamoeba invadens
SSSELLELLRICLNFGNILNAKSPSRANA

SEQ ID NO: 2968914 - protein, 19 aa, Entamoeba invadens
SSSFGDFHVHLDIIFGNGG

SEQ ID NO: 2968915 - protein, 17 aa, Entamoeba invadens
SSSGDCLQCDAQISLGT

SEQ ID NO: 2968916 - protein, 18 aa, Entamoeba invadens
SSSGGKCILGVFGSNKSS

SEQ ID NO: 2968917 - protein, 26 aa, Entamoeba invadens
SSSGKRFSICLCCLSSNTQIQKRIKM

SEQ ID NO: 2968918 - protein, 23 aa, Entamoeba invadens
SSSILRFADRVVMIDCGETAVYH

SEQ ID NO: 2968919 - protein, 19 aa, Entamoeba invadens
SSSKIQYSSLLKMKVVVVR

SEQ ID NO: 2968920 - protein, 22 aa, Entamoeba invadens
SSSLSSLGSFCFNNCAKLKHVE

SEQ ID NO: 2968921 - protein, 22 aa, Entamoeba invadens
SSSLTELRSWNSLYGEGSTTSS

SEQ ID NO: 2968922 - protein, 23 aa, Entamoeba invadens
SSSMLKFYLKGILYEEVIFTEKV

SEQ ID NO: 2968923 - protein, 25 aa, Entamoeba invadens
SSSTFKFVFPKRLFSAAPRVVVSIQ

SEQ ID NO: 2968924 - protein, 27 aa, Entamoeba invadens
SSSTLLECDVWISLIFDQLEKIRKNEK

SEQ ID NO: 2968925 - protein, 19 aa, Entamoeba invadens
SSSVFFRTMMLNFVENKGF

SEQ ID NO: 2968926 - protein, 22 aa, Entamoeba invadens
SSSVLLKAGIKTVDDFIKTPLI

SEQ ID NO: 2968927 - protein, 24 aa, Entamoeba invadens
SSSVPAWTCDESVLLEQQIARTSP

SEQ ID NO: 2968928 - protein, 17 aa, Entamoeba invadens
SSSVVIIGNYCFSGCKY

SEQ ID NO: 2968929 - protein, 17 aa, Entamoeba invadens
SSSWAAVIALAPQPNER

SEQ ID NO: 2968930 - protein, 19 aa, Entamoeba invadens
SSSWDNINFCIATKEFCFN

SEQ ID NO: 2968931 - protein, 23 aa, Entamoeba invadens
SSSYEILAGLALEENEFVEIKKE

SEQ ID NO: 2968932 - protein, 17 aa, Entamoeba invadens
SSTCISCDFGLYLEDDG

SEQ ID NO: 2968933 - protein, 25 aa, Entamoeba invadens
SSTDFFFLECLRKVAQNGMKQTDNK

SEQ ID NO: 2968934 - protein, 25 aa, Entamoeba invadens
SSTDWKFLNGYVVPKLQVFSETSKI

SEQ ID NO: 2968935 - protein, 23 aa, Entamoeba invadens
SSTEWFKYITGVSEQEFIDSKSI

SEQ ID NO: 2968936 - protein, 21 aa, Entamoeba invadens
SSTIKEAYWVLSNIIGGENAT

SEQ ID NO: 2968937 - protein, 18 aa, Entamoeba invadens
SSTIKSVVLIGGSSQIPE

SEQ ID NO: 2968938 - protein, 24 aa, Entamoeba invadens
SSTLLTCYGAFWIEKSGVINFNFV

SEQ ID NO: 2968939 - protein, 28 aa, Entamoeba invadens
SSTPFTHFYFKLKFGKLYNLNYFQVIIE

SEQ ID NO: 2968940 - protein, 23 aa, Entamoeba invadens
SSTQCPRAYMLSGQKAYTAESLT

SEQ ID NO: 2968941 - protein, 26 aa, Entamoeba invadens
SSTTFPADFTFTFKQDILFTQMKFVF

SEQ ID NO: 2968942 - protein, 22 aa, Entamoeba invadens
SSTTRHSMVYSRYVDKVKRLGL

SEQ ID NO: 2968943 - protein, 18 aa, Entamoeba invadens
SSTVLIAYLMFKNMWTYR

SEQ ID NO: 2968944 - protein, 23 aa, Entamoeba invadens
SSTWREKKGLSFEQVFQSVTALK

SEQ ID NO: 2968945 - protein, 18 aa, Entamoeba invadens
SSTYLTRSALYALTACVE

SEQ ID NO: 2968946 - protein, 26 aa, Entamoeba invadens
SSTYPFPAVEPFSTYLKGIENMGSKT

SEQ ID NO: 2968947 - protein, 17 aa, Entamoeba invadens
SSVAEWMLKLFKESCGI

SEQ ID NO: 2968948 - protein, 26 aa, Entamoeba invadens
SSVEFLRRRAIFIFNSRLVNSFNSNT

SEQ ID NO: 2968949 - protein, 19 aa, Entamoeba invadens
SSVEKRVCNKEVKQNAVKI

SEQ ID NO: 2968950 - protein, 24 aa, Entamoeba invadens
SSVGKTCIIGRFMSGMFVNEYEAT

SEQ ID NO: 2968951 - protein, 20 aa, Entamoeba invadens
SSVGKTCIIGRFMTGDFNNG

SEQ ID NO: 2968952 - protein, 24 aa, Entamoeba invadens
SSVIECLQMKLSVSTYEADEVSEI

SEQ ID NO: 2968953 - protein, 29 aa, Entamoeba invadens
SSVKKCNWRFPIPVFRSIEYLEKNGGKTM

SEQ ID NO: 2968954 - protein, 21 aa, Entamoeba invadens
SSVKSIGAFCFSYCSKLSSVV

SEQ ID NO: 2968955 - protein, 19 aa, Entamoeba invadens
SSVKSIGDWCFSGCSSLSS

SEQ ID NO: 2968956 - protein, 24 aa, Entamoeba invadens
SSVKYIGIYCFYKCSSLTSVIIPS

SEQ ID NO: 2968957 - protein, 19 aa, Entamoeba invadens
SSVLIKLSFDTISNYLGTD

SEQ ID NO: 2968958 - protein, 24 aa, Entamoeba invadens
SSVLRKCFFEIQYLQVYEMNGEFL

SEQ ID NO: 2968959 - protein, 30 aa, Entamoeba invadens
SSVLRLKKQMSFEYPIPPPLPVVEITTLPN

SEQ ID NO: 2968960 - protein, 27 aa, Entamoeba invadens
SSVNLPFKLLLKFFGYIVDKLRHAGWQ

SEQ ID NO: 2968961 - protein, 24 aa, Entamoeba invadens
SSVPEIEPAALIPVTVQPTELNNL

SEQ ID NO: 2968962 - protein, 29 aa, Entamoeba invadens
SSVPITELSCVFWIAYLPTKVKPKFMELS

SEQ ID NO: 2968963 - protein, 19 aa, Entamoeba invadens
SSVTKICYTFFKKYKNLCE

SEQ ID NO: 2968964 - protein, 19 aa, Entamoeba invadens
SSVTKICYTFFKKYKNLRE

SEQ ID NO: 2968965 - protein, 26 aa, Entamoeba invadens
SSVTKIGMNCFAKCYSLTSVIVPINV

SEQ ID NO: 2968966 - protein, 17 aa, Entamoeba invadens
SSVTLFGQRCFQECRYL

SEQ ID NO: 2968967 - protein, 19 aa, Entamoeba invadens
SSVTLFGQRCFQRCRNLES

SEQ ID NO: 2968968 - protein, 18 aa, Entamoeba invadens
SSVTMGLYPFMNSILSNS

SEQ ID NO: 2968969 - protein, 17 aa, Entamoeba invadens
SSVTSIGIYCFNECNSL

SEQ ID NO: 2968970 - protein, 17 aa, Entamoeba invadens
SSVTSIGRRCFNNCKSL

SEQ ID NO: 2968971 - protein, 20 aa, Entamoeba invadens
SSVTSLGKWCFAGCTNLTSV

SEQ ID NO: 2968972 - protein, 20 aa, Entamoeba invadens
SSVTSLGKWCFASCTNLTSV

SEQ ID NO: 2968973 - protein, 19 aa, Entamoeba invadens
SSVVCHAYFLLQLPDKLLQ

SEQ ID NO: 2968974 - protein, 24 aa, Entamoeba invadens
SSVVKRKLYLLVCENSTKKVSDIF

SEQ ID NO: 2968975 - protein, 26 aa, Entamoeba invadens
SSVVSGRLQKYLGYYGELEDAIYGLS

SEQ ID NO: 2968976 - protein, 22 aa, Entamoeba invadens
SSVYGIDCLQLGTTDMTKQKVF

SEQ ID NO: 2968977 - protein, 18 aa, Entamoeba invadens
SSYARFASMNTDESKFPS

SEQ ID NO: 2968978 - protein, 19 aa, Entamoeba invadens
SSYAVGLSVSGVFETFVPR

SEQ ID NO: 2968979 - protein, 18 aa, Entamoeba invadens
SSYAVGLSVSGVFETVVP

SEQ ID NO: 2968980 - protein, 26 aa, Entamoeba invadens
SSYDILKCFILHSFISFSSNLFIDNN

SEQ ID NO: 2968981 - protein, 26 aa, Entamoeba invadens
SSYDPECDIWSLGVITYVLLSGYLPF

SEQ ID NO: 2968982 - protein, 24 aa, Entamoeba invadens
SSYEEVLRGFLLLHKVMREGNFKV

SEQ ID NO: 2968983 - protein, 25 aa, Entamoeba invadens
SSYGFKSECIWKYGDAIYNQFLLLF

SEQ ID NO: 2968984 - protein, 18 aa, Entamoeba invadens
SSYKKLFGGDEWSTLFSP

SEQ ID NO: 2968985 - protein, 22 aa, Entamoeba invadens
SSYKTSICTNVVTCMRTLIEQA

SEQ ID NO: 2968986 - protein, 17 aa, Entamoeba invadens
SSYLHCESPFLADGTIQ

SEQ ID NO: 2968987 - protein, 23 aa, Entamoeba invadens
SSYRNCFGIPLKKLLDDERRLPG

SEQ ID NO: 2968988 - protein, 26 aa, Entamoeba invadens
SSYTTYRVPLVFPRSVQLDAVDDAVY

SEQ ID NO: 2968989 - protein, 25 aa, Entamoeba invadens
SSYVCSGFVGNRCGMIILDHFQIQG

SEQ ID NO: 2968990 - protein, 19 aa, Entamoeba invadens
STAGIKPIEPAPFGMEPFG

SEQ ID NO: 2968991 - protein, 33 aa, Entamoeba invadens
STAKYTGIPVFWGRIVKALPFFQPTAEEMKVLP

SEQ ID NO: 2968992 - protein, 24 aa, Entamoeba invadens
STAPIPDFSAFHFEESETEKIKVN

SEQ ID NO: 2968993 - protein, 18 aa, Entamoeba invadens
STAVAYGSMQGWRKEMED

SEQ ID NO: 2968994 - protein, 23 aa, Entamoeba invadens
STCERYFYSICEIIMGTWKDTEI

SEQ ID NO: 2968995 - protein, 22 aa, Entamoeba invadens
STCILCSTGFLLDENNNCVAKT

SEQ ID NO: 2968996 - protein, 18 aa, Entamoeba invadens
STCPYKFTFNKKIVYESV

SEQ ID NO: 2968997 - protein, 19 aa, Entamoeba invadens
STCRGNGLGKFLIETLIKL

SEQ ID NO: 2968998 - protein, 25 aa, Entamoeba invadens
STCRKCLCCGAFFHDTCNPLRDCKK

SEQ ID NO: 2968999 - protein, 18 aa, Entamoeba invadens
STCYGRKKLDVWWMKQAF

SEQ ID NO: 2969000 - protein, 25 aa, Entamoeba invadens
STDCTRASLKLIRAILLATNGKAPQ

SEQ ID NO: 2969001 - protein, 22 aa, Entamoeba invadens
STDGSYWGFDWRMENKVFESQE

SEQ ID NO: 2969002 - protein, 25 aa, Entamoeba invadens
STDHEVKRLFLFYLSTVQRVDEAGK

SEQ ID NO: 2969003 - protein, 30 aa, Entamoeba invadens
STDIKLELMKGCTTFAAIYAEVAKYMEAIK

SEQ ID NO: 2969004 - protein, 20 aa, Entamoeba invadens
STDLNLWIDLVFGSSQQSST

SEQ ID NO: 2969005 - protein, 26 aa, Entamoeba invadens
STDLPRTGNSFTIIPQPFHLNLSASY

SEQ ID NO: 2969006 - protein, 18 aa, Entamoeba invadens
STDNCRLLVCSDLAESIE

SEQ ID NO: 2969007 - protein, 21 aa, Entamoeba invadens
STEAFNMKLSQEMEKKDVEIV

SEQ ID NO: 2969008 - protein, 23 aa, Entamoeba invadens
STEDIKKAFEIFDKERNGFISAS

SEQ ID NO: 2969009 - protein, 31 aa, Entamoeba invadens
STEEFCKIILRNAAGKTCWGVQSATVLEDLE

SEQ ID NO: 2969010 - protein, 22 aa, Entamoeba invadens
STEERANLFAGFLSARSSTEGI

SEQ ID NO: 2969011 - protein, 25 aa, Entamoeba invadens
STEESRTVFLSAIALSYKVTHSQSY

SEQ ID NO: 2969012 - protein, 19 aa, Entamoeba invadens
STEIIALLLKYTKERTDDI

SEQ ID NO: 2969013 - protein, 25 aa, Entamoeba invadens
STELLLRKAPFQHLVRDIAQNNKSD

SEQ ID NO: 2969014 - protein, 20 aa, Entamoeba invadens
STELLLRRAPFQHLVRDIAT

SEQ ID NO: 2969015 - protein, 17 aa, Entamoeba invadens
STELVVFDTVLAQAIGS

SEQ ID NO: 2969016 - protein, 18 aa, Entamoeba invadens
STENWYKQPIWRAKVVEL

SEQ ID NO: 2969017 - protein, 19 aa, Entamoeba invadens
STESVRFVPIDGLEGDNLT

SEQ ID NO: 2969018 - protein, 24 aa, Entamoeba invadens
STETKFTRENCLKLFNNSHDLIIL

SEQ ID NO: 2969019 - protein, 17 aa, Entamoeba invadens
STEWFPKRVRKLRIFEE

SEQ ID NO: 2969020 - protein, 17 aa, Entamoeba invadens
STEWKIVSERHIAQHGS

SEQ ID NO: 2969021 - protein, 25 aa, Entamoeba invadens
STEYAFSFVRKGGFIHIDQVSGIKI

SEQ ID NO: 2969022 - protein, 25 aa, Entamoeba invadens
STFCGTPDYLAPEVLVAKGYGIGVD

SEQ ID NO: 2969023 - protein, 19 aa, Entamoeba invadens
STFEGCSLLTSIELCGNFS

SEQ ID NO: 2969024 - protein, 20 aa, Entamoeba invadens
STFHKLGFEDLIVSVHRTKR

SEQ ID NO: 2969025 - protein, 24 aa, Entamoeba invadens
STFLEKFSKFFPKLHTVKCTLSML

SEQ ID NO: 2969026 - protein, 28 aa, Entamoeba invadens
STFLHYKNRMGLIVWKVNLLNNMASITQ

SEQ ID NO: 2969027 - protein, 19 aa, Entamoeba invadens
STFRRCVNTAQYLNVFFDC

SEQ ID NO: 2969028 - protein, 20 aa, Entamoeba invadens
STFSIAKYTWRPNIKQNTFN

SEQ ID NO: 2969029 - protein, 20 aa, Entamoeba invadens
STFTDFVNRTDIAIVLITQS

SEQ ID NO: 2969030 - protein, 22 aa, Entamoeba invadens
STFYKEVFLFREASSQTGVVIV

SEQ ID NO: 2969031 - protein, 24 aa, Entamoeba invadens
STGFCSTCSIGFVYREPKSKECEL

SEQ ID NO: 2969032 - protein, 19 aa, Entamoeba invadens
STGKIALCIGKEGLSVINT

SEQ ID NO: 2969033 - protein, 28 aa, Entamoeba invadens
STGPLAIKRRKLVYFGLLIPIGDVFGAE

SEQ ID NO: 2969034 - protein, 26 aa, Entamoeba invadens
STGRCKLIYRMIEFDKPVKMDTFIAT

SEQ ID NO: 2969035 - protein, 20 aa, Entamoeba invadens
STGRPCPGATFRLSNAEELG

SEQ ID NO: 2969036 - protein, 23 aa, Entamoeba invadens
STGYCLSCVTGFVLSASPSQRCI

SEQ ID NO: 2969037 - protein, 24 aa, Entamoeba invadens
STHGDLYIHFTVVLPTKESLAQNV

SEQ ID NO: 2969038 - protein, 38 aa, Entamoeba invadens
STHLDLRSYLIMPVQRLPRYQLLLVDLFKNTPKDHEDY

SEQ ID NO: 2969039 - protein, 29 aa, Entamoeba invadens
STHSKWTLPDMKVALSMRDMRLTLFSEEV

SEQ ID NO: 2969040 - protein, 25 aa, Entamoeba invadens
STHSMFICFAMLYLGSDANTKKQLE

SEQ ID NO: 2969041 - protein, 24 aa, Entamoeba invadens
STHVNPSIRCCVLSIAPYTLQQQS

SEQ ID NO: 2969042 - protein, 17 aa, Entamoeba invadens
STICEDCGLVLDDCGAL

SEQ ID NO: 2969043 - protein, 17 aa, Entamoeba invadens
STIEMRSSIASIIFSMG

SEQ ID NO: 2969044 - protein, 25 aa, Entamoeba invadens
STIERRCGLCLQTIKRNDPIFQYAD

SEQ ID NO: 2969045 - protein, 17 aa, Entamoeba invadens
STIFEFGKCLKDNNMYY

SEQ ID NO: 2969046 - protein, 28 aa, Entamoeba invadens
STIIGKDLRCGFCIESGDGVTQIGVMYD

SEQ ID NO: 2969047 - protein, 19 aa, Entamoeba invadens
STIIVRAARQYEFRKMNKL

SEQ ID NO: 2969048 - protein, 23 aa, Entamoeba invadens
STIKLQTLVCTFLIKYYPLIFRD

SEQ ID NO: 2969049 - protein, 17 aa, Entamoeba invadens
STINCIAPVISFVGYQL

SEQ ID NO: 2969050 - protein, 17 aa, Entamoeba invadens
STINFPTPQRSYFTQSL

SEQ ID NO: 2969051 - protein, 29 aa, Entamoeba invadens
STIPENRIWPGLIDIVSRNLLMFSSYDDM

SEQ ID NO: 2969052 - protein, 28 aa, Entamoeba invadens
STIVRARVVSILSYWANTIFPLLPEEEK

SEQ ID NO: 2969053 - protein, 24 aa, Entamoeba invadens
STIYIPDCYKLLMFQDPSHLFMIK

SEQ ID NO: 2969054 - protein, 20 aa, Entamoeba invadens
STKCTFCMPPNIVTTSGKVM

SEQ ID NO: 2969055 - protein, 18 aa, Entamoeba invadens
STKDSVCMCVNWMDRVFK

SEQ ID NO: 2969056 - protein, 17 aa, Entamoeba invadens
STKELLNEWIVVLESAA

SEQ ID NO: 2969057 - protein, 23 aa, Entamoeba invadens
STKERATEIVICRRKHKKIHQKK

SEQ ID NO: 2969058 - protein, 26 aa, Entamoeba invadens
STKFGKLLLKCFTHSIYIFEDETRCG

SEQ ID NO: 2969059 - protein, 23 aa, Entamoeba invadens
STKGCLKCNLGYFLNSSSCFLCN

SEQ ID NO: 2969060 - protein, 27 aa, Entamoeba invadens
STKGSEYKFLFCVKGGGSANKSYLYQE

SEQ ID NO: 2969061 - protein, 17 aa, Entamoeba invadens
STKKLIIMERGPFDSVG

SEQ ID NO: 2969062 - protein, 20 aa, Entamoeba invadens
STKLLASLAARNEVLKNSKD

SEQ ID NO: 2969063 - protein, 24 aa, Entamoeba invadens
STKLSKLDFQICIEPSFLNSKTLK

SEQ ID NO: 2969064 - protein, 18 aa, Entamoeba invadens
STKRKSLSTIIGKQIELT

SEQ ID NO: 2969065 - protein, 24 aa, Entamoeba invadens
STKRYRVIKTIGWGTFGIVVGVSD

SEQ ID NO: 2969066 - protein, 17 aa, Entamoeba invadens
STKYNGCTWGFFDDSAL

SEQ ID NO: 2969067 - protein, 26 aa, Entamoeba invadens
STKYVSAVLCCLSVMSSLEIPHINVM

SEQ ID NO: 2969068 - protein, 19 aa, Entamoeba invadens
STLADFLLRRALRNKNVIG

SEQ ID NO: 2969069 - protein, 19 aa, Entamoeba invadens
STLANHYFKLHVYTQISNL

SEQ ID NO: 2969070 - protein, 18 aa, Entamoeba invadens
STLDCYLFQSSASVVITH

SEQ ID NO: 2969071 - protein, 19 aa, Entamoeba invadens
STLDPVWNKSFDFQVTPGT

SEQ ID NO: 2969072 - protein, 22 aa, Entamoeba invadens
STLEPNDLFGLINKKQLEKHRQ

SEQ ID NO: 2969073 - protein, 19 aa, Entamoeba invadens
STLFEETHELINLDENEVI

SEQ ID NO: 2969074 - protein, 20 aa, Entamoeba invadens
STLFLEEFVRITFLGKPERI

SEQ ID NO: 2969075 - protein, 18 aa, Entamoeba invadens
STLFVGVSNCTSCMTNYV

SEQ ID NO: 2969076 - protein, 20 aa, Entamoeba invadens
STLFYKKFLEEEIGMTVKVF

SEQ ID NO: 2969077 - protein, 18 aa, Entamoeba invadens
STLGDFGAACNRAAKENR

SEQ ID NO: 2969078 - protein, 18 aa, Entamoeba invadens
STLHCKRIGVGVCKCVSV

SEQ ID NO: 2969079 - protein, 21 aa, Entamoeba invadens
STLITRLQKIYGEQIGVIKEF

SEQ ID NO: 2969080 - protein, 23 aa, Entamoeba invadens
STLKASTSLGNFVYQMTHFVIEK

SEQ ID NO: 2969081 - protein, 24 aa, Entamoeba invadens
STLKEFYTVLLLSFETFKTHKIFK

SEQ ID NO: 2969082 - protein, 23 aa, Entamoeba invadens
STLKEHRVVLDVLAKVEPTRKCF

SEQ ID NO: 2969083 - protein, 23 aa, Entamoeba invadens
STLKLYRRKGLYILEEMKEDNSL

SEQ ID NO: 2969084 - protein, 18 aa, Entamoeba invadens
STLLRLYKDIQLNSETLK

SEQ ID NO: 2969085 - protein, 18 aa, Entamoeba invadens
STLLYRLSSGQAVMTLPT

SEQ ID NO: 2969086 - protein, 22 aa, Entamoeba invadens
STLMKYYALMPSMMFIYETDVA

SEQ ID NO: 2969087 - protein, 19 aa, Entamoeba invadens
STLQFLNIKSITFNNQQTI

SEQ ID NO: 2969088 - protein, 18 aa, Entamoeba invadens
STLQYWIKKAFSKWNETC

SEQ ID NO: 2969089 - protein, 17 aa, Entamoeba invadens
STLRIKEFQEALVKMHS

SEQ ID NO: 2969090 - protein, 31 aa, Entamoeba invadens
STLRRELSLFKGITCFDCGSQISKLVSECKR

SEQ ID NO: 2969091 - protein, 20 aa, Entamoeba invadens
STLRRLELRECNIQMTDKNL

SEQ ID NO: 2969092 - protein, 18 aa, Entamoeba invadens
STLSFKGRVLTEKDKVCS

SEQ ID NO: 2969093 - protein, 17 aa, Entamoeba invadens
STLSMRQICRIPSKKSS

SEQ ID NO: 2969094 - protein, 22 aa, Entamoeba invadens
STLSPLLVFYSFFVKSLARHEI

SEQ ID NO: 2969095 - protein, 29 aa, Entamoeba invadens
STLTIVLGFLWQFIDKVFEKSLKRAIGSL

SEQ ID NO: 2969096 - protein, 18 aa, Entamoeba invadens
STLTLEILINKECYPKAK

SEQ ID NO: 2969097 - protein, 17 aa, Entamoeba invadens
STLTSQIRPKVCTMDRD

SEQ ID NO: 2969098 - protein, 24 aa, Entamoeba invadens
STLVILDCRSRVNANANRVNGGGY

SEQ ID NO: 2969099 - protein, 18 aa, Entamoeba invadens
STLVPGAAGIIFPTEHNK

SEQ ID NO: 2969100 - protein, 19 aa, Entamoeba invadens
STLYFAPQFLMLRNLCYGK

SEQ ID NO: 2969101 - protein, 24 aa, Entamoeba invadens
STLYICGFDDMLKFIKIEQFVALT

SEQ ID NO: 2969102 - protein, 18 aa, Entamoeba invadens
STMFTGFFVVEFDLEDGE

SEQ ID NO: 2969103 - protein, 26 aa, Entamoeba invadens
STMKLKGVCGNLFIKDAQPMVWEIAV

SEQ ID NO: 2969104 - protein, 17 aa, Entamoeba invadens
STMMPGFVERFNTDLTK

SEQ ID NO: 2969105 - protein, 20 aa, Entamoeba invadens
STMQIKFIFDKRDNVEMHRF

SEQ ID NO: 2969106 - protein, 23 aa, Entamoeba invadens
STMQRLLGKFMRSDVHDYVMNNG

SEQ ID NO: 2969107 - protein, 24 aa, Entamoeba invadens
STMTAKYALAVLMKRIMLLDTDTR

SEQ ID NO: 2969108 - protein, 19 aa, Entamoeba invadens
STNATFVFVIVKFNQEVSE

SEQ ID NO: 2969109 - protein, 18 aa, Entamoeba invadens
STNCLSCKQGSYIQNNKC

SEQ ID NO: 2969110 - protein, 18 aa, Entamoeba invadens
STNEAIMAICILNHKKEN

SEQ ID NO: 2969111 - protein, 25 aa, Entamoeba invadens
STNEILVIHLKRFGSVGGSVRDKIS

SEQ ID NO: 2969112 - protein, 20 aa, Entamoeba invadens
STNEKIYWLTILCTSLAHRT

SEQ ID NO: 2969113 - protein, 25 aa, Entamoeba invadens
STNFELYGDIGLFLTYREKWYKTNI

SEQ ID NO: 2969114 - protein, 24 aa, Entamoeba invadens
STNGILYFELRFDTPDFTKDQIVI

SEQ ID NO: 2969115 - protein, 21 aa, Entamoeba invadens
STNIFPHLFVPTLPDSVLSTR

SEQ ID NO: 2969116 - protein, 23 aa, Entamoeba invadens
STNIKIVLNSGIKEKGESVKKMI

SEQ ID NO: 2969117 - protein, 19 aa, Entamoeba invadens
STNYKQRYNIEISTAANSV

SEQ ID NO: 2969118 - protein, 23 aa, Entamoeba invadens
STPAGKILKMFPSLQTLYLTRLP

SEQ ID NO: 2969119 - protein, 24 aa, Entamoeba invadens
STPFKRVSNVALFVQDYINVVRQD

SEQ ID NO: 2969120 - protein, 19 aa, Entamoeba invadens
STPFKSILLNDSFVLFNSC

SEQ ID NO: 2969121 - protein, 22 aa, Entamoeba invadens
STPFMVMVCRMESYLTSSGVLT

SEQ ID NO: 2969122 - protein, 22 aa, Entamoeba invadens
STPICELCNSGVTFTRQDKPIE

SEQ ID NO: 2969123 - protein, 19 aa, Entamoeba invadens
STPIPKMHRKHVKDYDLSP

SEQ ID NO: 2969124 - protein, 18 aa, Entamoeba invadens
STPLPSQKSKLFKKHFNT

SEQ ID NO: 2969125 - protein, 23 aa, Entamoeba invadens
STPQRLQSIIQYSLCDIPSSQTR

SEQ ID NO: 2969126 - protein, 19 aa, Entamoeba invadens
STPRCMSCFDGYYRSSYSC

SEQ ID NO: 2969127 - protein, 23 aa, Entamoeba invadens
STPSEYPIHAVLSPSGSFASSTC

SEQ ID NO: 2969128 - protein, 29 aa, Entamoeba invadens
STPSHLFIQTPFFEYKPNQQFHIQQIQQN

SEQ ID NO: 2969129 - protein, 24 aa, Entamoeba invadens
STPSTGFASAFGFGDKTQPPPFTP

SEQ ID NO: 2969130 - protein, 19 aa, Entamoeba invadens
STPYLKFLIGNKSDIKNRA

SEQ ID NO: 2969131 - protein, 17 aa, Entamoeba invadens
STQFLKSTDELFTLEYL

SEQ ID NO: 2969132 - protein, 23 aa, Entamoeba invadens
STQIRPLLELAVQICPLDYSMHS

SEQ ID NO: 2969133 - protein, 24 aa, Entamoeba invadens
STQKEKNSWGFSTIASGFASITSS

SEQ ID NO: 2969134 - protein, 27 aa, Entamoeba invadens
STQNRKSILLCFGRMIKKLIDPRSVPE

SEQ ID NO: 2969135 - protein, 18 aa, Entamoeba invadens
STRCGDIDPSIPINIVEQ

SEQ ID NO: 2969136 - protein, 23 aa, Entamoeba invadens
STRFEELKFFSVYDFVTVCDNVY

SEQ ID NO: 2969137 - protein, 23 aa, Entamoeba invadens
STRFIKFGVLSVVDMESRTKRRS

SEQ ID NO: 2969138 - protein, 19 aa, Entamoeba invadens
STRFLKNEVGKIFLNFSPY

SEQ ID NO: 2969139 - protein, 26 aa, Entamoeba invadens
STRIFCQVLRCIAYLHSKGICHRDIK

SEQ ID NO: 2969140 - protein, 24 aa, Entamoeba invadens
STRIKGLAYYTALEFSNTISKIAG

SEQ ID NO: 2969141 - protein, 26 aa, Entamoeba invadens
STRVFPYIWPPSIEVMEGKQMKETEE

SEQ ID NO: 2969142 - protein, 24 aa, Entamoeba invadens
STSELPFGVIFKHGSFVTTDGKIF

SEQ ID NO: 2969143 - protein, 19 aa, Entamoeba invadens
STSFLFSIIRNGIFKPKKF

SEQ ID NO: 2969144 - protein, 26 aa, Entamoeba invadens
STSFNWLMERCEKFGYQFKKRSTKPT

SEQ ID NO: 2969145 - protein, 17 aa, Entamoeba invadens
STSHRRLYIPIAKVCDC

SEQ ID NO: 2969146 - protein, 19 aa, Entamoeba invadens
STSKQRFFVLCDYLFNKYE

SEQ ID NO: 2969147 - protein, 27 aa, Entamoeba invadens
STSLPPFIPRNIKGFGLYMKAKHPKKI

SEQ ID NO: 2969148 - protein, 24 aa, Entamoeba invadens
STSLRLRRRIVLSNLLMKDKTDLT

SEQ ID NO: 2969149 - protein, 17 aa, Entamoeba invadens
STSMPLLHFSIQSKMEN

SEQ ID NO: 2969150 - protein, 18 aa, Entamoeba invadens
STSNLCIKPQPSKQEIFR

SEQ ID NO: 2969151 - protein, 18 aa, Entamoeba invadens
STSPLGCEALPPSPFLSD

SEQ ID NO: 2969152 - protein, 25 aa, Entamoeba invadens
STSQRNAIDIAFKLLHFKRVEIVTE

SEQ ID NO: 2969153 - protein, 25 aa, Entamoeba invadens
STSRGRCSVCGKVIQPNQQSVGYHC

SEQ ID NO: 2969154 - protein, 25 aa, Entamoeba invadens
STSVIKFGYKCFNKCNSLRRMVIPS

SEQ ID NO: 2969155 - protein, 27 aa, Entamoeba invadens
STSWKLSKEQGVFRVGMFEGINTKNIP

SEQ ID NO: 2969156 - protein, 19 aa, Entamoeba invadens
STSYVILKYRKWQLKERKN

SEQ ID NO: 2969157 - protein, 24 aa, Entamoeba invadens
STTCILCSTGFVLDVNNKCVAKTT

SEQ ID NO: 2969158 - protein, 26 aa, Entamoeba invadens
STTIKFRFVVPWMVVLFKRDFNREEI

SEQ ID NO: 2969159 - protein, 18 aa, Entamoeba invadens
STTIPYQVQQPIINVAQP

SEQ ID NO: 2969160 - protein, 25 aa, Entamoeba invadens
STTKCPHCGHLLNFEFQVLPSIISL

SEQ ID NO: 2969161 - protein, 24 aa, Entamoeba invadens
STTKEFSAVIARIVGDFYGPLLNV

SEQ ID NO: 2969162 - protein, 18 aa, Entamoeba invadens
STTLERPPLYQGKVLYDF

SEQ ID NO: 2969163 - protein, 18 aa, Entamoeba invadens
STTLKCSPLMPLVSSGAK

SEQ ID NO: 2969164 - protein, 23 aa, Entamoeba invadens
STTLRISDFVYSFPLLTELTVRK

SEQ ID NO: 2969165 - protein, 17 aa, Entamoeba invadens
STTPSNYKGVIYATQST

SEQ ID NO: 2969166 - protein, 29 aa, Entamoeba invadens
STTRRLNTFQVFMFGKPVWVAENLVENPT

SEQ ID NO: 2969167 - protein, 18 aa, Entamoeba invadens
STTRYGISCFAHCNLKDV

SEQ ID NO: 2969168 - protein, 19 aa, Entamoeba invadens
STVDPISPGSCFIAKELAK

SEQ ID NO: 2969169 - protein, 20 aa, Entamoeba invadens
STVETFLMTFKRGVKEGEIV

SEQ ID NO: 2969170 - protein, 21 aa, Entamoeba invadens
STVGDSCMKPSSMSKSTTSSE

SEQ ID NO: 2969171 - protein, 18 aa, Entamoeba invadens
STVGSLVGYTIRFEDKTS

SEQ ID NO: 2969172 - protein, 18 aa, Entamoeba invadens
STVHFGVNAFYGCTSLTQ

SEQ ID NO: 2969173 - protein, 20 aa, Entamoeba invadens
STVKLDKGLNLNVFETINSW

SEQ ID NO: 2969174 - protein, 29 aa, Entamoeba invadens
STVLKQLRCNGVLEGIRITRLGYPNRIIY

SEQ ID NO: 2969175 - protein, 18 aa, Entamoeba invadens
STVRAVKALEEFNNLDAF

SEQ ID NO: 2969176 - protein, 18 aa, Entamoeba invadens
STVRMLCGIPSSGLGNLF

SEQ ID NO: 2969177 - protein, 19 aa, Entamoeba invadens
STVRMLCGIPSSGLGNLFM

SEQ ID NO: 2969178 - protein, 18 aa, Entamoeba invadens
STVSLSFNEKGDLQMFNI

SEQ ID NO: 2969179 - protein, 17 aa, Entamoeba invadens
STVTRLGAACFYGCCNI

SEQ ID NO: 2969180 - protein, 19 aa, Entamoeba invadens
STVYKGRQVFFYKRAQIVV

SEQ ID NO: 2969181 - protein, 20 aa, Entamoeba invadens
STYCRFILFCSNVCGMLQPI

SEQ ID NO: 2969182 - protein, 25 aa, Entamoeba invadens
STYEEIRKGMNLTRAELIYQRNVLG

SEQ ID NO: 2969183 - protein, 26 aa, Entamoeba invadens
STYFLLKLPFNYLFDYLAVCMEPTAV

SEQ ID NO: 2969184 - protein, 20 aa, Entamoeba invadens
STYIFPWTFADDVASGKRLM

SEQ ID NO: 2969185 - protein, 18 aa, Entamoeba invadens
STYIYGFCDANFRKNMTL

SEQ ID NO: 2969186 - protein, 19 aa, Entamoeba invadens
STYMLKYFTLIWALMENNN

SEQ ID NO: 2969187 - protein, 24 aa, Entamoeba invadens
STYMSLFMNGRIDFILTKVTRKQE

SEQ ID NO: 2969188 - protein, 20 aa, Entamoeba invadens
SVAAEVCRIGFIISSSFDKE

SEQ ID NO: 2969189 - protein, 19 aa, Entamoeba invadens
SVAERLGKPFIVYHQTIQI

SEQ ID NO: 2969190 - protein, 22 aa, Entamoeba invadens
SVAHLGVKCTLQGKIGKDANGK

SEQ ID NO: 2969191 - protein, 17 aa, Entamoeba invadens
SVALSFIPIKTIAFSET

SEQ ID NO: 2969192 - protein, 17 aa, Entamoeba invadens
SVANWFLSIFKERYNNV

SEQ ID NO: 2969193 - protein, 24 aa, Entamoeba invadens
SVAPLRMPLFIAHGNNDEIINVSH

SEQ ID NO: 2969194 - protein, 24 aa, Entamoeba invadens
SVARIINEIVIWRHSHQIGAAANV

SEQ ID NO: 2969195 - protein, 17 aa, Entamoeba invadens
SVATEKPTRCLFLYYIL

SEQ ID NO: 2969196 - protein, 24 aa, Entamoeba invadens
  misc_feature (19)..(20): Xaa can be any naturally occurring amino acid
SVCAELKKKVFAIIGGNGXXSELY

SEQ ID NO: 2969197 - protein, 20 aa, Entamoeba invadens
SVCINFECVDVSLAVKPSGK

SEQ ID NO: 2969198 - protein, 19 aa, Entamoeba invadens
SVCIPDKLLYIAVEGVTPL

SEQ ID NO: 2969199 - protein, 22 aa, Entamoeba invadens
SVCKKFTNILERFRINPIQITP

SEQ ID NO: 2969200 - protein, 17 aa, Entamoeba invadens
SVCMVGCCYHKLTENKY

SEQ ID NO: 2969201 - protein, 17 aa, Entamoeba invadens
SVCPLLVHPNITLRQAT

SEQ ID NO: 2969202 - protein, 18 aa, Entamoeba invadens
SVCSPEIIKMIETNGAIY

SEQ ID NO: 2969203 - protein, 19 aa, Entamoeba invadens
SVCSSCYDGLYLNNEFECD

SEQ ID NO: 2969204 - protein, 17 aa, Entamoeba invadens
SVCVHFSQIPNCISSEN

SEQ ID NO: 2969205 - protein, 26 aa, Entamoeba invadens
SVCVKKRSSAVFVYRKIKIEKDPTKK

SEQ ID NO: 2969206 - protein, 21 aa, Entamoeba invadens
SVCYVDSLAFNNCKKIKDLVF

SEQ ID NO: 2969207 - protein, 25 aa, Entamoeba invadens
SVDDFCLYLYLTYFVINGNNQENDE

SEQ ID NO: 2969208 - protein, 25 aa, Entamoeba invadens
SVDEHLCFYKGHMCAKVFIKSKPGR

SEQ ID NO: 2969209 - protein, 28 aa, Entamoeba invadens
SVDEHLCFYKGRMCAKVFIKSKPGRYGI

SEQ ID NO: 2969210 - protein, 24 aa, Entamoeba invadens
SVDFDCLKGVVSRKLDILVDSENI

SEQ ID NO: 2969211 - protein, 17 aa, Entamoeba invadens
SVDFKKLIRRLTPIKVR

SEQ ID NO: 2969212 - protein, 30 aa, Entamoeba invadens
SVDGLCYILKPEAQAIWNTKHRQWLSTKMK

SEQ ID NO: 2969213 - protein, 25 aa, Entamoeba invadens
SVDIFRFPWTIAEFVTAGKRLENRK

SEQ ID NO: 2969214 - protein, 26 aa, Entamoeba invadens
SVDIPECISIFGSSAFYGCEKMKHIK

SEQ ID NO: 2969215 - protein, 21 aa, Entamoeba invadens
SVDLAFWKFLEYVFVLLRNEV

SEQ ID NO: 2969216 - protein, 20 aa, Entamoeba invadens
SVDLEKCLVAGHLNLSLLKL

SEQ ID NO: 2969217 - protein, 22 aa, Entamoeba invadens
SVDLFKGCIKLITLENTEYITE

SEQ ID NO: 2969218 - protein, 19 aa, Entamoeba invadens
SVDLGFRSSRTTYSDLESQ

SEQ ID NO: 2969219 - protein, 22 aa, Entamoeba invadens
SVDLKWRVGRRLKGEVKDMYLE

SEQ ID NO: 2969220 - protein, 19 aa, Entamoeba invadens
SVDLLRLFRKYNPKQAFVA

SEQ ID NO: 2969221 - protein, 21 aa, Entamoeba invadens
SVDLRKYEQLQWISFASSSQL

SEQ ID NO: 2969222 - protein, 20 aa, Entamoeba invadens
SVDNCKTCDLNGFCVECESN

SEQ ID NO: 2969223 - protein, 18 aa, Entamoeba invadens
SVDQCTIEQPTLCVLPDF

SEQ ID NO: 2969224 - protein, 18 aa, Entamoeba invadens
SVDVSELVSLLLMSENGV

SEQ ID NO: 2969225 - protein, 19 aa, Entamoeba invadens
SVDVVKWRALYRLLEISGN

SEQ ID NO: 2969226 - protein, 21 aa, Entamoeba invadens
SVEAFKVIVRAIKMWSKKRGI

SEQ ID NO: 2969227 - protein, 22 aa, Entamoeba invadens
SVEGQIEFTAILFVPQRAPFDM

SEQ ID NO: 2969228 - protein, 20 aa, Entamoeba invadens
SVEIPAVMTINQLIKYLYLG

SEQ ID NO: 2969229 - protein, 24 aa, Entamoeba invadens
SVELKKLCRLTSCGYQLEADTFLF

SEQ ID NO: 2969230 - protein, 35 aa, Entamoeba invadens
SVELPTVFCSAIFTRKIVQARGFVIVIIAEENVFG

SEQ ID NO: 2969231 - protein, 18 aa, Entamoeba invadens
SVEMCSSVSYIGESAFYY

SEQ ID NO: 2969232 - protein, 23 aa, Entamoeba invadens
SVEPRVLMWRNRLFEMSSKTGVF

SEQ ID NO: 2969233 - protein, 25 aa, Entamoeba invadens
SVESISGYCFGRCSSLSSIIIPPSV

SEQ ID NO: 2969234 - protein, 20 aa, Entamoeba invadens
SVETLFLYDSVIAIKNKNDV

SEQ ID NO: 2969235 - protein, 25 aa, Entamoeba invadens
SVETLKWIIENVLRPITEGERSEVK

SEQ ID NO: 2969236 - protein, 26 aa, Entamoeba invadens
SVETMKCYTCGLFGHTTKYCPNSQEA

SEQ ID NO: 2969237 - protein, 20 aa, Entamoeba invadens
SVFDLFKKIFVELNKSEKYV

SEQ ID NO: 2969238 - protein, 23 aa, Entamoeba invadens
SVFGLRDRLVLQWLIDQTKVGPL

SEQ ID NO: 2969239 - protein, 19 aa, Entamoeba invadens
SVFHARVVYNYNALKQNEL

SEQ ID NO: 2969240 - protein, 20 aa, Entamoeba invadens
SVFHLAWGVLFDVTLFVEKS

SEQ ID NO: 2969241 - protein, 23 aa, Entamoeba invadens
SVFKDLRIIEEIGHGAFSRVYKA

SEQ ID NO: 2969242 - protein, 18 aa, Entamoeba invadens
SVFLMNALFYLPDVETVE

SEQ ID NO: 2969243 - protein, 25 aa, Entamoeba invadens
SVFNEFCTWLQYFVMNKTIPQELFA

SEQ ID NO: 2969244 - protein, 20 aa, Entamoeba invadens
SVFNELKLLSTSWKLSKEQG

SEQ ID NO: 2969245 - protein, 23 aa, Entamoeba invadens
SVFNGFTGCEVFGSFKQGHISYT

SEQ ID NO: 2969246 - protein, 21 aa, Entamoeba invadens
SVFNLCYLKSIEFVGQVYIPE

SEQ ID NO: 2969247 - protein, 20 aa, Entamoeba invadens
SVFPVTRVVKFNDFKKLDLV

SEQ ID NO: 2969248 - protein, 18 aa, Entamoeba invadens
SVFSRLALTADEQGKITQ

SEQ ID NO: 2969249 - protein, 21 aa, Entamoeba invadens
SVFTKITFETSLSFLAKACMS

SEQ ID NO: 2969250 - protein, 18 aa, Entamoeba invadens
SVFTTVFLLLDIHDKGKI

SEQ ID NO: 2969251 - protein, 19 aa, Entamoeba invadens
SVFYCTKLSALTLSHCNKS

SEQ ID NO: 2969252 - protein, 25 aa, Entamoeba invadens
SVFYTPRFLYGALFPTGETIGDILI

SEQ ID NO: 2969253 - protein, 18 aa, Entamoeba invadens
SVGDCKAYFVDRSLPKHN

SEQ ID NO: 2969254 - protein, 19 aa, Entamoeba invadens
SVGEKCFIDCAGLSEVQIG

SEQ ID NO: 2969255 - protein, 21 aa, Entamoeba invadens
SVGESRSVIVTVLSRATKSPS

SEQ ID NO: 2969256 - protein, 19 aa, Entamoeba invadens
SVGGGRLQFFSFFNNGKVK

SEQ ID NO: 2969257 - protein, 23 aa, Entamoeba invadens
SVGKSSIVLRVCKGEYKEFQENT

SEQ ID NO: 2969258 - protein, 26 aa, Entamoeba invadens
SVGLRRPASKLSMESCCGRSISREFS

SEQ ID NO: 2969259 - protein, 20 aa, Entamoeba invadens
SVGLSSFYDAFSIKYVKNLG

SEQ ID NO: 2969260 - protein, 18 aa, Entamoeba invadens
SVGMKRFGDRYCANQTYS

SEQ ID NO: 2969261 - protein, 21 aa, Entamoeba invadens
SVGNICSFFGETLKTTTYEEK

SEQ ID NO: 2969262 - protein, 18 aa, Entamoeba invadens
SVGSSVFNDKICDLPNLV

SEQ ID NO: 2969263 - protein, 19 aa, Entamoeba invadens
SVGVFEMEYPLKLQIDIPG

SEQ ID NO: 2969264 - protein, 21 aa, Entamoeba invadens
SVGVMMWHKGKLHVANVGDTR

SEQ ID NO: 2969265 - protein, 18 aa, Entamoeba invadens
SVGWEHFDIFKPEPNVLL

SEQ ID NO: 2969266 - protein, 19 aa, Entamoeba invadens
SVHCLAGNCLNNLAMTSFV

SEQ ID NO: 2969267 - protein, 23 aa, Entamoeba invadens
SVHKKPVAPYHKFNSKTVTKQHT

SEQ ID NO: 2969268 - protein, 30 aa, Entamoeba invadens
SVHKNIVVYLRFGANYNKFVSGKMPINVRI

SEQ ID NO: 2969269 - protein, 32 aa, Entamoeba invadens
SVHNAFMFECFGIKKHCMCVSMRERDNWVQAL

SEQ ID NO: 2969270 - protein, 24 aa, Entamoeba invadens
SVHPSVVFNALFIDFDDNFKVSAF

SEQ ID NO: 2969271 - protein, 17 aa, Entamoeba invadens
SVIASKLFEEMVVDDDI

SEQ ID NO: 2969272 - protein, 25 aa, Entamoeba invadens
SVIEFPLLIIEEGEWNMSKFVSMSP

SEQ ID NO: 2969273 - protein, 22 aa, Entamoeba invadens
SVIEPCEDWSYIPLTTKMLDLE

SEQ ID NO: 2969274 - protein, 23 aa, Entamoeba invadens
SVIGEVKRFIGLNYDDFAIKTIC

SEQ ID NO: 2969275 - protein, 28 aa, Entamoeba invadens
SVIGKVLFDFGFDLKKVYLAFLEQSRYN

SEQ ID NO: 2969276 - protein, 32 aa, Entamoeba invadens
SVIGSFYGFITFRPSSALLFATFDGREELVAT

SEQ ID NO: 2969277 - protein, 17 aa, Entamoeba invadens
SVIKKSLNFVFKNIVYG

SEQ ID NO: 2969278 - protein, 22 aa, Entamoeba invadens
SVIKLGDGCFKYCSSLSSVTIP

SEQ ID NO: 2969279 - protein, 17 aa, Entamoeba invadens
SVILRKDVSVIRGVIQN

SEQ ID NO: 2969280 - protein, 21 aa, Entamoeba invadens
SVINCPSIVIIPSLFADLAMI

SEQ ID NO: 2969281 - protein, 24 aa, Entamoeba invadens
SVIPPFHSPLCFGGKKSFDQKFGQ

SEQ ID NO: 2969282 - protein, 19 aa, Entamoeba invadens
SVIRGWSFVAIFNGTLCTP

SEQ ID NO: 2969283 - protein, 24 aa, Entamoeba invadens
SVISIGDYCFRGCSSLKSVTIPSS

SEQ ID NO: 2969284 - protein, 28 aa, Entamoeba invadens
SVISIGEACFCRCCFLKNVVILSSVKSI

SEQ ID NO: 2969285 - protein, 19 aa, Entamoeba invadens
SVISPPVNCLETYESVNES

SEQ ID NO: 2969286 - protein, 20 aa, Entamoeba invadens
SVISRTSYKNVVSKWLPEIR

SEQ ID NO: 2969287 - protein, 24 aa, Entamoeba invadens
SVIVPRVKLNFFQDDIFPDTRRKV

SEQ ID NO: 2969288 - protein, 21 aa, Entamoeba invadens
SVKAIAIKYIWGFEETASVCR

SEQ ID NO: 2969289 - protein, 20 aa, Entamoeba invadens
SVKAYLRALPFLDEKEAEAA

SEQ ID NO: 2969290 - protein, 23 aa, Entamoeba invadens
SVKDRIALNIVYQALKDGRLKEG

SEQ ID NO: 2969291 - protein, 23 aa, Entamoeba invadens
SVKDRVAFNIVYQALQDGRLRPG

SEQ ID NO: 2969292 - protein, 19 aa, Entamoeba invadens
SVKEFGCSAFEQCNSLNTI

SEQ ID NO: 2969293 - protein, 25 aa, Entamoeba invadens
SVKEIGKFCFYQCVSLTNVSLQNKS

SEQ ID NO: 2969294 - protein, 17 aa, Entamoeba invadens
SVKELRPPIPPFSEVLN

SEQ ID NO: 2969295 - protein, 23 aa, Entamoeba invadens
SVKEYSTSVICMWCSLRRKEIYT

SEQ ID NO: 2969296 - protein, 19 aa, Entamoeba invadens
SVKICKEAEDFERIAHVRV

SEQ ID NO: 2969297 - protein, 22 aa, Entamoeba invadens
SVKKLLRYAFAPKLTFLPSKLL

SEQ ID NO: 2969298 - protein, 27 aa, Entamoeba invadens
SVKKVWESIHDFPFVCVEEMLIKNSRK

SEQ ID NO: 2969299 - protein, 26 aa, Entamoeba invadens
SVKLRECFHEGNGFVIALLYEQNVFG

SEQ ID NO: 2969300 - protein, 27 aa, Entamoeba invadens
SVKLRECFHEGNGFVIALLYEQNVFGV

SEQ ID NO: 2969301 - protein, 21 aa, Entamoeba invadens
SVKMFYCGHIYHESCHKGNAC

SEQ ID NO: 2969302 - protein, 28 aa, Entamoeba invadens
SVKNILLMRKIYIGGKMCETMDTKTFVE

SEQ ID NO: 2969303 - protein, 28 aa, Entamoeba invadens
SVKQGTDLAHEWKVLFFETSAKNKINIT

SEQ ID NO: 2969304 - protein, 19 aa, Entamoeba invadens
SVKQHYWLPVEGIAPKDTE

SEQ ID NO: 2969305 - protein, 19 aa, Entamoeba invadens
SVKRPQGKYVIEWGATPIQ

SEQ ID NO: 2969306 - protein, 29 aa, Entamoeba invadens
SVKSIGNFCFYRCCRLGSVLIPSSVTSIG

SEQ ID NO: 2969307 - protein, 24 aa, Entamoeba invadens
SVKSLGDQCFRQCSSLSSMIIPSS

SEQ ID NO: 2969308 - protein, 25 aa, Entamoeba invadens
SVKSLKLYNCRNLKYETLDFLTQMT

SEQ ID NO: 2969309 - protein, 26 aa, Entamoeba invadens
SVKTAELMTGALLEAKRIEIAPTQLT

SEQ ID NO: 2969310 - protein, 20 aa, Entamoeba invadens
SVKYFSKMFETLAWIDWSDN

SEQ ID NO: 2969311 - protein, 18 aa, Entamoeba invadens
SVLADFLVSSGLKLQSIV

SEQ ID NO: 2969312 - protein, 30 aa, Entamoeba invadens
SVLAKSDKGGRCIGIGYLVFPCKEAAQACE

SEQ ID NO: 2969313 - protein, 19 aa, Entamoeba invadens
SVLEATKLVFSRIAFEIKD

SEQ ID NO: 2969314 - protein, 21 aa, Entamoeba invadens
SVLEIGERSFAKCSALSSILF

SEQ ID NO: 2969315 - protein, 18 aa, Entamoeba invadens
SVLFKYNYYYEEINANII

SEQ ID NO: 2969316 - protein, 25 aa, Entamoeba invadens
SVLGKKVKYSFVMAKVPLCNPLSFF

SEQ ID NO: 2969317 - protein, 26 aa, Entamoeba invadens
SVLGRKNVETLFEFLERDYLKNFKTA

SEQ ID NO: 2969318 - protein, 20 aa, Entamoeba invadens
SVLHTWVRRLFSIPFLPQSE

SEQ ID NO: 2969319 - protein, 21 aa, Entamoeba invadens
SVLHTWVRRLFSIPFLPQSEI

SEQ ID NO: 2969320 - protein, 24 aa, Entamoeba invadens
SVLKELDLSCSRQIVFNPLVINFL

SEQ ID NO: 2969321 - protein, 26 aa, Entamoeba invadens
SVLKKFPGLRVEEFLLSFANETTQNY

SEQ ID NO: 2969322 - protein, 27 aa, Entamoeba invadens
SVLKSAWRFPTPIFRSIQYLRYNEAHF

SEQ ID NO: 2969323 - protein, 17 aa, Entamoeba invadens
SVLKSTVLLSEETVPLE

SEQ ID NO: 2969324 - protein, 24 aa, Entamoeba invadens
SVLLGMCKVLDLWCRDKQSRKVRA

SEQ ID NO: 2969325 - protein, 23 aa, Entamoeba invadens
SVLPQKYRALTTMKKQLMINTTW

SEQ ID NO: 2969326 - protein, 24 aa, Entamoeba invadens
SVLRCPRDKLGLSKYLVHPSDIRQ

SEQ ID NO: 2969327 - protein, 25 aa, Entamoeba invadens
SVLRMSQSVLLCCEGMANKFIEFVI

SEQ ID NO: 2969328 - protein, 27 aa, Entamoeba invadens
SVLTFWRICQTFDYFFVKTVVREYTDD

SEQ ID NO: 2969329 - protein, 23 aa, Entamoeba invadens
SVLVKCLMERNFIVGSSTQEIAK

SEQ ID NO: 2969330 - protein, 18 aa, Entamoeba invadens
SVLYFKEVFEEISRYEEL

SEQ ID NO: 2969331 - protein, 20 aa, Entamoeba invadens
SVMEYCSFQSLDVYWKSNPS

SEQ ID NO: 2969332 - protein, 17 aa, Entamoeba invadens
SVMKGCDYYTIRSVPSL

SEQ ID NO: 2969333 - protein, 19 aa, Entamoeba invadens
SVMMKCLTVPPLHIPEEKL

SEQ ID NO: 2969334 - protein, 17 aa, Entamoeba invadens
SVMPEAGGVAFVSQSGA

SEQ ID NO: 2969335 - protein, 17 aa, Entamoeba invadens
SVMRDFHDNIVIGYEDG

SEQ ID NO: 2969336 - protein, 20 aa, Entamoeba invadens
SVMSECCRMTHTHGVLTCKN

SEQ ID NO: 2969337 - protein, 18 aa, Entamoeba invadens
SVMSGIEFQHRCFPGLKI

SEQ ID NO: 2969338 - protein, 26 aa, Entamoeba invadens
SVMSGITCSLRFPGQLNQDLKKLMVN

SEQ ID NO: 2969339 - protein, 17 aa, Entamoeba invadens
SVMSSLEIPHINVMSKM

SEQ ID NO: 2969340 - protein, 18 aa, Entamoeba invadens
SVNGCPLQNLCFDEIDFD

SEQ ID NO: 2969341 - protein, 24 aa, Entamoeba invadens
SVNIGESVGFLGVHITGIPNSVLI

SEQ ID NO: 2969342 - protein, 18 aa, Entamoeba invadens
SVNKGVAVPPSLKNIYKE

SEQ ID NO: 2969343 - protein, 31 aa, Entamoeba invadens
SVNLGILFCIKCSGIHRSLGVAFSRVKSTTL

SEQ ID NO: 2969344 - protein, 20 aa, Entamoeba invadens
SVNLHRCVYHLAENLVVVGC

SEQ ID NO: 2969345 - protein, 19 aa, Entamoeba invadens
SVNRNGYWTRTCRKLKELI

SEQ ID NO: 2969346 - protein, 21 aa, Entamoeba invadens
SVPADAKWFKPIELLTAQGIA

SEQ ID NO: 2969347 - protein, 25 aa, Entamoeba invadens
SVPEKRKVTIPKFGVESLFEMNDQL

SEQ ID NO: 2969348 - protein, 18 aa, Entamoeba invadens
SVPFKKYYIEGLDLLQPQ

SEQ ID NO: 2969349 - protein, 18 aa, Entamoeba invadens
SVPGNLYIGFPDLIDKIF

SEQ ID NO: 2969350 - protein, 17 aa, Entamoeba invadens
SVPLLGITQFVPTKPLT

SEQ ID NO: 2969351 - protein, 17 aa, Entamoeba invadens
SVPLLNFLIEILEEKYP

SEQ ID NO: 2969352 - protein, 20 aa, Entamoeba invadens
SVPMCIQDFVLINSRVDVPA

SEQ ID NO: 2969353 - protein, 24 aa, Entamoeba invadens
SVPNCKNCEGGKCKKCQENYVIQT

SEQ ID NO: 2969354 - protein, 20 aa, Entamoeba invadens
SVPSHIFPTFVGLPKETSTL

SEQ ID NO: 2969355 - protein, 21 aa, Entamoeba invadens
SVPVPIDYNRHCVVMSKINGT

SEQ ID NO: 2969356 - protein, 23 aa, Entamoeba invadens
SVQKTFLMRVLKSVYVDEGTSEV

SEQ ID NO: 2969357 - protein, 19 aa, Entamoeba invadens
SVQQILLYYCSTFIDPLTT

SEQ ID NO: 2969358 - protein, 17 aa, Entamoeba invadens
SVQTFKFPWKIAEFVTA

SEQ ID NO: 2969359 - protein, 19 aa, Entamoeba invadens
SVQVIRATFPFKISNDCIM

SEQ ID NO: 2969360 - protein, 18 aa, Entamoeba invadens
SVRCNACGEYMYKGKKFN

SEQ ID NO: 2969361 - protein, 25 aa, Entamoeba invadens
SVRDNILFWLFDVFLGLVPDKYKHL

SEQ ID NO: 2969362 - protein, 32 aa, Entamoeba invadens
SVRGVAMKLERRWSVEDFSRAYYCNGGSAVVV

SEQ ID NO: 2969363 - protein, 26 aa, Entamoeba invadens
SVRLYYLYYPRICVETTSVLSYYSFN

SEQ ID NO: 2969364 - protein, 19 aa, Entamoeba invadens
SVRMPRSCQSYLASTEEDR

SEQ ID NO: 2969365 - protein, 21 aa, Entamoeba invadens
SVRNEAFFFISNCLLGATNFE

SEQ ID NO: 2969366 - protein, 21 aa, Entamoeba invadens
SVRRYQMKLANLLQQTKPLSD

SEQ ID NO: 2969367 - protein, 19 aa, Entamoeba invadens
SVRSFRSTRTFNKRDSQQP

SEQ ID NO: 2969368 - protein, 19 aa, Entamoeba invadens
SVRSIGCNCFSYCYSLSSV

SEQ ID NO: 2969369 - protein, 18 aa, Entamoeba invadens
SVRSIGEFCFYKCYKTKT

SEQ ID NO: 2969370 - protein, 23 aa, Entamoeba invadens
SVRSIGSQCFRWCDSLRNVTIPL

SEQ ID NO: 2969371 - protein, 18 aa, Entamoeba invadens
SVSAPVVLDNVYKLLNDA

SEQ ID NO: 2969372 - protein, 25 aa, Entamoeba invadens
SVSCAISKRVTHYFANQSVAPTLIK

SEQ ID NO: 2969373 - protein, 22 aa, Entamoeba invadens
SVSCCDYHFSINLLEIPSFVTS

SEQ ID NO: 2969374 - protein, 19 aa, Entamoeba invadens
SVSDFSVFLSPKSRKQALN

SEQ ID NO: 2969375 - protein, 18 aa, Entamoeba invadens
SVSDLSFMDVKEVKLEDL

SEQ ID NO: 2969376 - protein, 23 aa, Entamoeba invadens
SVSDRYKFVGAQQEIVENTINDN

SEQ ID NO: 2969377 - protein, 24 aa, Entamoeba invadens
SVSEIDIIFDFARAYVVLDEVINA

SEQ ID NO: 2969378 - protein, 18 aa, Entamoeba invadens
SVSILTLLQNAIKTPDWR

SEQ ID NO: 2969379 - protein, 21 aa, Entamoeba invadens
SVSKEGRGVCYIKTDHIEEFT

SEQ ID NO: 2969380 - protein, 23 aa, Entamoeba invadens
SVSKMRVISCSNIGLYKNMNDPF

SEQ ID NO: 2969381 - protein, 21 aa, Entamoeba invadens
SVSLLPLHFHQLLRFISVEVG

SEQ ID NO: 2969382 - protein, 25 aa, Entamoeba invadens
SVSLPHNFLRLCFVETHQPHSNSLI

SEQ ID NO: 2969383 - protein, 17 aa, Entamoeba invadens
SVSPCLNSVYVKNEGND

SEQ ID NO: 2969384 - protein, 18 aa, Entamoeba invadens
SVSPPVCVLVGNKKDLSH

SEQ ID NO: 2969385 - protein, 18 aa, Entamoeba invadens
SVSRERLNYIYSTENGDT

SEQ ID NO: 2969386 - protein, 19 aa, Entamoeba invadens
SVSSMGEYCFKNCDLLKEA

SEQ ID NO: 2969387 - protein, 19 aa, Entamoeba invadens
SVSTIECYINWKIFAVVVK

SEQ ID NO: 2969388 - protein, 23 aa, Entamoeba invadens
SVSVCGKCECSVDKIDMTTCTTL

SEQ ID NO: 2969389 - protein, 23 aa, Entamoeba invadens
SVSVKYEIAFGFKQNAFVKELHY

SEQ ID NO: 2969390 - protein, 25 aa, Entamoeba invadens
SVTAITIPAALSFDSLPFLDSLKRI

SEQ ID NO: 2969391 - protein, 18 aa, Entamoeba invadens
SVTERLVRVVSITKENMI

SEQ ID NO: 2969392 - protein, 22 aa, Entamoeba invadens
SVTFIYAYCFPKKTVVRRRCDN

SEQ ID NO: 2969393 - protein, 19 aa, Entamoeba invadens
SVTKFSSFIKKFPLASKGI

SEQ ID NO: 2969394 - protein, 18 aa, Entamoeba invadens
SVTKICYLYFGKYKNLRE

SEQ ID NO: 2969395 - protein, 17 aa, Entamoeba invadens
SVTKICYTFFKKYKNLC

SEQ ID NO: 2969396 - protein, 17 aa, Entamoeba invadens
SVTKLSERFVCGCTRLK

SEQ ID NO: 2969397 - protein, 23 aa, Entamoeba invadens
SVTLKFTEDLFLSGETFSEKIEE

SEQ ID NO: 2969398 - protein, 17 aa, Entamoeba invadens
SVTNEYLHFVNSLGDIH

SEQ ID NO: 2969399 - protein, 19 aa, Entamoeba invadens
SVTPSEIDSLITLITDSPD

SEQ ID NO: 2969400 - protein, 24 aa, Entamoeba invadens
SVTRIGIDCFKRCYSLTEVRLNEG

SEQ ID NO: 2969401 - protein, 25 aa, Entamoeba invadens
SVTRIGKFAFKHCISLTSFNSESVS

SEQ ID NO: 2969402 - protein, 26 aa, Entamoeba invadens
SVTSFGNWCFYECRSLSSVIIPSSVL

SEQ ID NO: 2969403 - protein, 24 aa, Entamoeba invadens
SVTSIGAWCFFDCINLSSITIPSS

SEQ ID NO: 2969404 - protein, 18 aa, Entamoeba invadens
SVTSIGDWCFGNCSSLIS

SEQ ID NO: 2969405 - protein, 18 aa, Entamoeba invadens
SVTSIGEYCFSRCDNLSS

SEQ ID NO: 2969406 - protein, 18 aa, Entamoeba invadens
SVTSIGVYCFSRCSSLSG

SEQ ID NO: 2969407 - protein, 19 aa, Entamoeba invadens
SVTSLGMCCFSRCYSLQSI

SEQ ID NO: 2969408 - protein, 18 aa, Entamoeba invadens
SVTSLGYLCFCACRRLSS

SEQ ID NO: 2969409 - protein, 26 aa, Entamoeba invadens
SVTSLWGLQEMYIFLPSILAPKDYQD

SEQ ID NO: 2969410 - protein, 18 aa, Entamoeba invadens
SVTSSGAFLKKNYVEKFN

SEQ ID NO: 2969411 - protein, 30 aa, Entamoeba invadens
SVTTFPLEKVVSIQWMKHKVIFMTESNNVF

SEQ ID NO: 2969412 - protein, 20 aa, Entamoeba invadens
SVTTLPLVIVFAETKTKNPN

SEQ ID NO: 2969413 - protein, 25 aa, Entamoeba invadens
SVTTREGFFRVNFNVPRETEEGTTY

SEQ ID NO: 2969414 - protein, 19 aa, Entamoeba invadens
SVVEFGMFVCQDCEKLRSV

SEQ ID NO: 2969415 - protein, 25 aa, Entamoeba invadens
SVVGCLMCGCEILPPSEYYNCSVCD

SEQ ID NO: 2969416 - protein, 24 aa, Entamoeba invadens
SVVGSVLFKDCKSCTYTTESPQNI

SEQ ID NO: 2969417 - protein, 24 aa, Entamoeba invadens
SVVHLKCFNGWFGTNQTIYQSPSS

SEQ ID NO: 2969418 - protein, 26 aa, Entamoeba invadens
SVVKLSRSAFFLAYLVQNPMKREQAL

SEQ ID NO: 2969419 - protein, 18 aa, Entamoeba invadens
SVVKSGGVLADILTELED

SEQ ID NO: 2969420 - protein, 19 aa, Entamoeba invadens
SVVLKASIFPREKKFYEKL

SEQ ID NO: 2969421 - protein, 25 aa, Entamoeba invadens
SVVLPPNCSLICPYAFSTCSNLVSI

SEQ ID NO: 2969422 - protein, 24 aa, Entamoeba invadens
SVVLREVRDLMFMWEEYANKFIQN

SEQ ID NO: 2969423 - protein, 17 aa, Entamoeba invadens
SVVLTALDDVCWLFNVR

SEQ ID NO: 2969424 - protein, 18 aa, Entamoeba invadens
SVVMELPYIPPIKGTDIF

SEQ ID NO: 2969425 - protein, 24 aa, Entamoeba invadens
SVVNELMFHLPLTIYVGNVLPPEL

SEQ ID NO: 2969426 - protein, 23 aa, Entamoeba invadens
SVVNPRMVYALAQRERLHSLFSL

SEQ ID NO: 2969427 - protein, 24 aa, Entamoeba invadens
SVVPKIMVCTLFPKVNKINANNIT

SEQ ID NO: 2969428 - protein, 19 aa, Entamoeba invadens
SVVPKQMHRVSVRKLDSQQ

SEQ ID NO: 2969429 - protein, 24 aa, Entamoeba invadens
SVVPPLRAILGWFGTEAVDAMIVG

SEQ ID NO: 2969430 - protein, 24 aa, Entamoeba invadens
SVVSDVIELIGLLVGTLPNKFFKR

SEQ ID NO: 2969431 - protein, 17 aa, Entamoeba invadens
SVVSLGYHCFRECNIES

SEQ ID NO: 2969432 - protein, 23 aa, Entamoeba invadens
SVYEVLSFTTAESITIFNTKNDG

SEQ ID NO: 2969433 - protein, 28 aa, Entamoeba invadens
SVYFLEFPQRTNLPILLAERIPDNTSCA

SEQ ID NO: 2969434 - protein, 18 aa, Entamoeba invadens
SVYQIQFEGSKGIYTLNH

SEQ ID NO: 2969435 - protein, 22 aa, Entamoeba invadens
SVYRFYRQHIFTGITELKGNER

SEQ ID NO: 2969436 - protein, 24 aa, Entamoeba invadens
SVYTREHLELFVLPPRPTNLVKPE

SEQ ID NO: 2969437 - protein, 18 aa, Entamoeba invadens
SWCCCLPPATTRMMLSQW

SEQ ID NO: 2969438 - protein, 17 aa, Entamoeba invadens
SWCPLDKNLISFTAGNQ

SEQ ID NO: 2969439 - protein, 18 aa, Entamoeba invadens
SWDDFCKSFENEKKQYRS

SEQ ID NO: 2969440 - protein, 24 aa, Entamoeba invadens
SWDLTLKHLVDWKVFDRVRKANKC

SEQ ID NO: 2969441 - protein, 18 aa, Entamoeba invadens
SWDVWALGVVIVEMMNGT

SEQ ID NO: 2969442 - protein, 18 aa, Entamoeba invadens
SWEFGYRPFYAPTLTMLN

SEQ ID NO: 2969443 - protein, 17 aa, Entamoeba invadens
SWGEDDIIWEEFADHHH

SEQ ID NO: 2969444 - protein, 18 aa, Entamoeba invadens
SWICKSHQKTFFPVFQFT

SEQ ID NO: 2969445 - protein, 19 aa, Entamoeba invadens
SWIDLVDSIIVVWLNGEEH

SEQ ID NO: 2969446 - protein, 22 aa, Entamoeba invadens
SWIKSVDMLRRLILEAPLSDEE

SEQ ID NO: 2969447 - protein, 24 aa, Entamoeba invadens
SWKVFKRITNVNVYDEMHFNVKFK

SEQ ID NO: 2969448 - protein, 20 aa, Entamoeba invadens
SWMDFGHILVIMLSIEKIDS

SEQ ID NO: 2969449 - protein, 33 aa, Entamoeba invadens
SWMPCICNSFQLVCYQMTFNVPDSFVVICSGTP

SEQ ID NO: 2969450 - protein, 21 aa, Entamoeba invadens
SWSKIYSEWVCASVGNQVQAL

SEQ ID NO: 2969451 - protein, 22 aa, Entamoeba invadens
SWVLPERDVHLGVGNTENTHGK

SEQ ID NO: 2969452 - protein, 23 aa, Entamoeba invadens
SYALRSEAFYLTHLRDTKDMKKK

SEQ ID NO: 2969453 - protein, 17 aa, Entamoeba invadens
SYCGVLFMNINTFNGNN

SEQ ID NO: 2969454 - protein, 17 aa, Entamoeba invadens
SYCNGFLHKKEMYYTLC

SEQ ID NO: 2969455 - protein, 25 aa, Entamoeba invadens
SYDIWAFGVMVYFLKYGDVPYISTT

SEQ ID NO: 2969456 - protein, 18 aa, Entamoeba invadens
SYDKCCKAASLVSSKVIQ

SEQ ID NO: 2969457 - protein, 23 aa, Entamoeba invadens
SYDSVWIRAKWLIFSQEQSAKGK

SEQ ID NO: 2969458 - protein, 24 aa, Entamoeba invadens
SYDVDWKKINGLKREKKVDIQLMS

SEQ ID NO: 2969459 - protein, 23 aa, Entamoeba invadens
SYDYFTGVLPPFALDEDVDEQFD

SEQ ID NO: 2969460 - protein, 19 aa, Entamoeba invadens
  misc_feature (19)..(19): Xaa can be any naturally occurring amino acid
SYECLACKDGYFNIPVKAX

SEQ ID NO: 2969461 - protein, 18 aa, Entamoeba invadens
SYECNKCGSDGRLTKCYG

SEQ ID NO: 2969462 - protein, 18 aa, Entamoeba invadens
SYEEFFASLIHFVKDEEK

SEQ ID NO: 2969463 - protein, 34 aa, Entamoeba invadens
SYEELLVKLLDGWLCIFSSELFLAKRFVFTQFDD

SEQ ID NO: 2969464 - protein, 22 aa, Entamoeba invadens
SYEIKASITAVEIGHKEKQDGY

SEQ ID NO: 2969465 - protein, 18 aa, Entamoeba invadens
SYEIKRNALLMRKIKTFL

SEQ ID NO: 2969466 - protein, 18 aa, Entamoeba invadens
SYEKFIAVLQVEGSDYNV

SEQ ID NO: 2969467 - protein, 25 aa, Entamoeba invadens
SYEKGCGLINMMINYVGFDNFMNGI

SEQ ID NO: 2969468 - protein, 32 aa, Entamoeba invadens
SYEKLGMAVFNGCWNCTGKLFNEKKMERGTVC

SEQ ID NO: 2969469 - protein, 31 aa, Entamoeba invadens
SYEKYSGCCCSLFETLCTMTQMLESTITANT

SEQ ID NO: 2969470 - protein, 26 aa, Entamoeba invadens
SYELCFRGICKIVNRPYVKYPLEVYN

SEQ ID NO: 2969471 - protein, 38 aa, Entamoeba invadens
SYENQQRLITCLSLEHRVVIRLRKVEIKEESTFVQSSV

SEQ ID NO: 2969472 - protein, 23 aa, Entamoeba invadens
SYEPLLVNWLRYELRGIRQDEPD

SEQ ID NO: 2969473 - protein, 23 aa, Entamoeba invadens
SYEYKELYVAYQYYYFYEADVDA

SEQ ID NO: 2969474 - protein, 20 aa, Entamoeba invadens
SYFAECLIFGYSTFTTKESL

SEQ ID NO: 2969475 - protein, 18 aa, Entamoeba invadens
SYFERFETVLSRCNESLK

SEQ ID NO: 2969476 - protein, 18 aa, Entamoeba invadens
SYFGTFIRQRIDWLNKQL

SEQ ID NO: 2969477 - protein, 19 aa, Entamoeba invadens
SYFIPTFGSYYLDSTGKGA

SEQ ID NO: 2969478 - protein, 18 aa, Entamoeba invadens
SYFIRFSITREKYKKETH

SEQ ID NO: 2969479 - protein, 22 aa, Entamoeba invadens
SYFLPLKISAFVFKEGRHTNTY

SEQ ID NO: 2969480 - protein, 31 aa, Entamoeba invadens
SYFPEDALRLFPLIVNKFWGDKSVHIHIALI

SEQ ID NO: 2969481 - protein, 25 aa, Entamoeba invadens
SYFPGCTKTNFKLLFSGEEVNANET

SEQ ID NO: 2969482 - protein, 17 aa, Entamoeba invadens
SYFPNVFGINKVCNSYD

SEQ ID NO: 2969483 - protein, 25 aa, Entamoeba invadens
SYFRYEVIQDFLYRSLKNSLETQIE

SEQ ID NO: 2969484 - protein, 23 aa, Entamoeba invadens
SYFTQYLCYEIMFHVSTLLPEQP

SEQ ID NO: 2969485 - protein, 24 aa, Entamoeba invadens
SYGALCMINPQLISSFIYSELNTT

SEQ ID NO: 2969486 - protein, 17 aa, Entamoeba invadens
SYGCNKITCICGAYFCY

SEQ ID NO: 2969487 - protein, 18 aa, Entamoeba invadens
SYGDTCIYLLNAIGDLTT

SEQ ID NO: 2969488 - protein, 27 aa, Entamoeba invadens
SYGIKSIRSIFGPRTDLEFIKNSEICT

SEQ ID NO: 2969489 - protein, 19 aa, Entamoeba invadens
SYGKLSFSLVDQFNWEETV

SEQ ID NO: 2969490 - protein, 25 aa, Entamoeba invadens
SYGKTEMWGYDFAKLKNSITEILFK

SEQ ID NO: 2969491 - protein, 25 aa, Entamoeba invadens
SYGPCQFPVLFSCYKDFTNDATSTV

SEQ ID NO: 2969492 - protein, 18 aa, Entamoeba invadens
SYGSLYIVMEYMESGSLL

SEQ ID NO: 2969493 - protein, 24 aa, Entamoeba invadens
SYGVPYCLKLLELFYKTNVIDQKD

SEQ ID NO: 2969494 - protein, 17 aa, Entamoeba invadens
SYHCEFCDGYFTVPSLP

SEQ ID NO: 2969495 - protein, 18 aa, Entamoeba invadens
SYHSAFIKRLLRSKPTLS

SEQ ID NO: 2969496 - protein, 31 aa, Entamoeba invadens
SYHSAPVKRISCIKPTLPKLLINLMKIEDNE

SEQ ID NO: 2969497 - protein, 17 aa, Entamoeba invadens
SYHTLGMIYSDLGDKKT

SEQ ID NO: 2969498 - protein, 19 aa, Entamoeba invadens
SYIFLNYYICNTISDVVQV

SEQ ID NO: 2969499 - protein, 31 aa, Entamoeba invadens
SYIGKSCFKSCGRLESFTGRGVVCVGYHAFY

SEQ ID NO: 2969500 - protein, 20 aa, Entamoeba invadens
SYIHPHFKKYFNTNEDATVF

SEQ ID NO: 2969501 - protein, 26 aa, Entamoeba invadens
SYILCNAQSPLLYSNLCFIRDFDKGI

SEQ ID NO: 2969502 - protein, 18 aa, Entamoeba invadens
SYIPVLLSYYSSRDKLYN

SEQ ID NO: 2969503 - protein, 19 aa, Entamoeba invadens
SYIQLRSYVAPAFSFGTQA

SEQ ID NO: 2969504 - protein, 18 aa, Entamoeba invadens
SYIQPSLVCLYEKKIEPN

SEQ ID NO: 2969505 - protein, 23 aa, Entamoeba invadens
SYISEETVELVISPPELQKLEKV

SEQ ID NO: 2969506 - protein, 18 aa, Entamoeba invadens
SYIYSIIPSVCPLLVHPN

SEQ ID NO: 2969507 - protein, 19 aa, Entamoeba invadens
SYKCYSCAEWNYQIQEETQ

SEQ ID NO: 2969508 - protein, 20 aa, Entamoeba invadens
SYKDRIAYLDGERHFNLSGS

SEQ ID NO: 2969509 - protein, 21 aa, Entamoeba invadens
SYKELKSIFEIKDHVEKGKRL

SEQ ID NO: 2969510 - protein, 27 aa, Entamoeba invadens
SYKEYCQQCVQRICQGKQKKGKNKLEG

SEQ ID NO: 2969511 - protein, 34 aa, Entamoeba invadens
SYKKDYCAFCDVFIPPSLVGPFWVGIYVIDREFD

SEQ ID NO: 2969512 - protein, 19 aa, Entamoeba invadens
SYKRHMWAKVFIKSKPGRY

SEQ ID NO: 2969513 - protein, 35 aa, Entamoeba invadens
SYKVYELRLLQTLKLEYLIDGSIELSQIGKENSQC

SEQ ID NO: 2969514 - protein, 26 aa, Entamoeba invadens
SYLDECVKHYIAIRKALLLPYVSKLL

SEQ ID NO: 2969515 - protein, 18 aa, Entamoeba invadens
SYLDFLMRGYLQCNEEQC

SEQ ID NO: 2969516 - protein, 25 aa, Entamoeba invadens
SYLEKLKLFIKTMVEYKKSNSGRTV

SEQ ID NO: 2969517 - protein, 27 aa, Entamoeba invadens
SYLIMPVQRLPRYVLLLNELKKHTWEG

SEQ ID NO: 2969518 - protein, 27 aa, Entamoeba invadens
SYLIMPVQRLPRYVLLLNELLKRTWET

SEQ ID NO: 2969519 - protein, 31 aa, Entamoeba invadens
SYLKGVLKIGFPMAMFLSGIGYDKYGDSDVE

SEQ ID NO: 2969520 - protein, 27 aa, Entamoeba invadens
SYLLDNCPAMERFLIAKEMVNFGDIDT

SEQ ID NO: 2969521 - protein, 27 aa, Entamoeba invadens
SYLLRMAEGIGYNFKRRSTKPAKLTVK

SEQ ID NO: 2969522 - protein, 24 aa, Entamoeba invadens
SYLPFLNAFLFPLVIDDFSDQFPR

SEQ ID NO: 2969523 - protein, 18 aa, Entamoeba invadens
SYLQKACELCIKDMVCLY

SEQ ID NO: 2969524 - protein, 19 aa, Entamoeba invadens
SYLRESCHGIFNLSDADIV

SEQ ID NO: 2969525 - protein, 38 aa, Entamoeba invadens
SYLSQCEPVFPIVVKDVGKFDVAFDIGDNRMLLLHVTI

SEQ ID NO: 2969526 - protein, 26 aa, Entamoeba invadens
SYLSQGTCAWVLGEKHFYVYENNDIK

SEQ ID NO: 2969527 - protein, 22 aa, Entamoeba invadens
SYMKRRPCKYDKDFFGSLEETK

SEQ ID NO: 2969528 - protein, 22 aa, Entamoeba invadens
SYNFKANLVNFNYAIINSLIAQ

SEQ ID NO: 2969529 - protein, 19 aa, Entamoeba invadens
SYNTISIVICNRWVERGVT

SEQ ID NO: 2969530 - protein, 33 aa, Entamoeba invadens
SYNYRAFDLANHFCEWCGFECNWDSYPNQETQR

SEQ ID NO: 2969531 - protein, 32 aa, Entamoeba invadens
SYPEFRKCFVKHFGKFEVCYEKAIDVVVSPLF

SEQ ID NO: 2969532 - protein, 18 aa, Entamoeba invadens
SYPIAHIFFSINHVSQAL

SEQ ID NO: 2969533 - protein, 24 aa, Entamoeba invadens
SYPSDLRLRQVLIYLFSQEYSDDD

SEQ ID NO: 2969534 - protein, 23 aa, Entamoeba invadens
SYPSRHALACFMNMIKKDENVWK

SEQ ID NO: 2969535 - protein, 29 aa, Entamoeba invadens
SYPTHIFPSAFGPFKAVITIPANFSSEQR

SEQ ID NO: 2969536 - protein, 21 aa, Entamoeba invadens
SYQEPRFKQPFQADAFYLSLE

SEQ ID NO: 2969537 - protein, 23 aa, Entamoeba invadens
SYQKQVFCMIAGFMDVYKEKVTE

SEQ ID NO: 2969538 - protein, 21 aa, Entamoeba invadens
SYQLECFRECNALKEFVLPSE

SEQ ID NO: 2969539 - protein, 26 aa, Entamoeba invadens
SYQLRKACLTWNRITHMVVKNKYYQS

SEQ ID NO: 2969540 - protein, 22 aa, Entamoeba invadens
SYQPTCREFPDAIFGEDTAVFI

SEQ ID NO: 2969541 - protein, 24 aa, Entamoeba invadens
SYRRFIVSGFCKFMDQEAPEKLKE

SEQ ID NO: 2969542 - protein, 18 aa, Entamoeba invadens
SYSCVAHPFWLPKFANAF

SEQ ID NO: 2969543 - protein, 27 aa, Entamoeba invadens
SYSEYYYLKLYDGVIDDELFGKVRNFY

SEQ ID NO: 2969544 - protein, 19 aa, Entamoeba invadens
SYSLFRVIPNTAISVRRSA

SEQ ID NO: 2969545 - protein, 21 aa, Entamoeba invadens
SYSQFLFCDQVEEFLEELQKR

SEQ ID NO: 2969546 - protein, 21 aa, Entamoeba invadens
SYSRPYLSPRSKFSRTKKILH

SEQ ID NO: 2969547 - protein, 24 aa, Entamoeba invadens
SYSSASIFLICFSVTSSVSYDNVL

SEQ ID NO: 2969548 - protein, 25 aa, Entamoeba invadens
SYSYEKAKCLSVFTGQLSQIHAIFN

SEQ ID NO: 2969549 - protein, 18 aa, Entamoeba invadens
SYTPKSSIVPTIPTYSNP

SEQ ID NO: 2969550 - protein, 18 aa, Entamoeba invadens
SYTRMIALFELTKTPEDF

SEQ ID NO: 2969551 - protein, 27 aa, Entamoeba invadens
SYTVDLRWACWYVWKVENRRYSDFLKL

SEQ ID NO: 2969552 - protein, 17 aa, Entamoeba invadens
SYTVGLSVGGVFETVVP

SEQ ID NO: 2969553 - protein, 18 aa, Entamoeba invadens
SYTVGLSVSGVFETVVPR

SEQ ID NO: 2969554 - protein, 20 aa, Entamoeba invadens
SYVACGRTDCFYEKFLCVWD

SEQ ID NO: 2969555 - protein, 20 aa, Entamoeba invadens
SYVLVCKKFRDTLMKYHTNP

SEQ ID NO: 2969556 - protein, 19 aa, Entamoeba invadens
SYVRTGNQWTLIDDNQVIE

SEQ ID NO: 2969557 - protein, 17 aa, Entamoeba invadens
SYWCERYSVPLNMALLF

SEQ ID NO: 2969558 - protein, 20 aa, Entamoeba invadens
SYYAKLCGYFVPYRPGAFPS

SEQ ID NO: 2969559 - protein, 18 aa, Entamoeba invadens
SYYCYDITTKEIKIVMQT

SEQ ID NO: 2969560 - protein, 23 aa, Entamoeba invadens
SYYESHPFYSLFFQQNDENVEKS

SEQ ID NO: 2969561 - protein, 23 aa, Entamoeba invadens
SYYHKASGVIVVYDVSKEDTFTK

SEQ ID NO: 2969562 - protein, 24 aa, Entamoeba invadens
SYYKFKPFPTLRVEVENILFDLCY

SEQ ID NO: 2969563 - protein, 19 aa, Entamoeba invadens
SYYNCPVVQGTSFTPQMTC

SEQ ID NO: 2969564 - protein, 24 aa, Entamoeba invadens
TAACPPYHLAFVIGGTSAEKNLET

SEQ ID NO: 2969565 - protein, 19 aa, Entamoeba invadens
TAADMSMGFDLNEFDLQNV

SEQ ID NO: 2969566 - protein, 25 aa, Entamoeba invadens
TAAIPSIDFTSLNLGNPASSTTTAS

SEQ ID NO: 2969567 - protein, 19 aa, Entamoeba invadens
TAAKEVSHGFFAREKQGDA

SEQ ID NO: 2969568 - protein, 21 aa, Entamoeba invadens
TAAKLPTLLFSPLQNKNTIKL

SEQ ID NO: 2969569 - protein, 19 aa, Entamoeba invadens
TAALCEVPEQYAFIKQLGY

SEQ ID NO: 2969570 - protein, 19 aa, Entamoeba invadens
TAALCEVPEQYAIIKQLGY

SEQ ID NO: 2969571 - protein, 19 aa, Entamoeba invadens
TAALCRKLTEELLMEYINP

SEQ ID NO: 2969572 - protein, 22 aa, Entamoeba invadens
TAALCRKMRPYLSDRFTAGIDG

SEQ ID NO: 2969573 - protein, 19 aa, Entamoeba invadens
TAALGYMFHAFKKSRCNKA

SEQ ID NO: 2969574 - protein, 21 aa, Entamoeba invadens
TAASILLRCARALKNKVDKKK

SEQ ID NO: 2969575 - protein, 25 aa, Entamoeba invadens
TAAVLRANYSFSDKVRIFVKKVDTE

SEQ ID NO: 2969576 - protein, 19 aa, Entamoeba invadens
TACMFRLKNMFEAMSTETK

SEQ ID NO: 2969577 - protein, 17 aa, Entamoeba invadens
TADCVYVPFHSRPFYNK

SEQ ID NO: 2969578 - protein, 26 aa, Entamoeba invadens
TADDFKAWMSDVIAPYCKTIRTKLNE

SEQ ID NO: 2969579 - protein, 19 aa, Entamoeba invadens
TADNIRASEIFQLSEQDKI

SEQ ID NO: 2969580 - protein, 20 aa, Entamoeba invadens
TADPRLCKSTPSVNHFDDDE

SEQ ID NO: 2969581 - protein, 25 aa, Entamoeba invadens
TADTIAEFCLFCFQNGVTGLETAHF

SEQ ID NO: 2969582 - protein, 22 aa, Entamoeba invadens
TADVLLPSFIYIVIRANLPHLS

SEQ ID NO: 2969583 - protein, 25 aa, Entamoeba invadens
TADYFPVLMSLDMSRNEIETLDNVG

SEQ ID NO: 2969584 - protein, 24 aa, Entamoeba invadens
TAEDKWRLIPAFVKSRGLVRQHID

SEQ ID NO: 2969585 - protein, 24 aa, Entamoeba invadens
TAEEELRKAFTLSKKKKGSSKGKK

SEQ ID NO: 2969586 - protein, 17 aa, Entamoeba invadens
TAEEIQKYFTLQSEARF

SEQ ID NO: 2969587 - protein, 27 aa, Entamoeba invadens
TAEFLGFSFKYATSFTNNVKKLTIIEV

SEQ ID NO: 2969588 - protein, 19 aa, Entamoeba invadens
TAEINKFMEHYKIQQKDQP

SEQ ID NO: 2969589 - protein, 20 aa, Entamoeba invadens
TAEKIPSCVLDVGDSDLINL

SEQ ID NO: 2969590 - protein, 22 aa, Entamoeba invadens
TAEMIEFVIYFAHLLVCDTNIK

SEQ ID NO: 2969591 - protein, 25 aa, Entamoeba invadens
TAENVYKLVLYFARALENEGTEDDT

SEQ ID NO: 2969592 - protein, 20 aa, Entamoeba invadens
TAESIMPTELIHPVDKELIE

SEQ ID NO: 2969593 - protein, 24 aa, Entamoeba invadens
TAETCFPVKIIARKPHQEMIDVYA

SEQ ID NO: 2969594 - protein, 24 aa, Entamoeba invadens
TAEVTRLFYKAAILENTMLGDDET

SEQ ID NO: 2969595 - protein, 24 aa, Entamoeba invadens
TAEVTRLFYKAAIMENTVLGDEES

SEQ ID NO: 2969596 - protein, 25 aa, Entamoeba invadens
TAFINFMSFFMAIRSTENFVNAFNL

SEQ ID NO: 2969597 - protein, 25 aa, Entamoeba invadens
TAFKFNQRFPTVFYDTLKKDVTIEY

SEQ ID NO: 2969598 - protein, 17 aa, Entamoeba invadens
TAFLAELLEYLRRHKEK

SEQ ID NO: 2969599 - protein, 23 aa, Entamoeba invadens
TAFLRLPKDPTFEVYVSRVNSLA

SEQ ID NO: 2969600 - protein, 23 aa, Entamoeba invadens
TAFNRRLKLVFPDTCGAEEIATV

SEQ ID NO: 2969601 - protein, 17 aa, Entamoeba invadens
TAFSFLTAHVIKSNKRL

SEQ ID NO: 2969602 - protein, 18 aa, Entamoeba invadens
TAFSKFFGELNMTSIGDV

SEQ ID NO: 2969603 - protein, 19 aa, Entamoeba invadens
TAFSVTWPVTARQFVSLHD

SEQ ID NO: 2969604 - protein, 25 aa, Entamoeba invadens
TAFTFEFYQKMLLYAFMDRFDIFQL

SEQ ID NO: 2969605 - protein, 29 aa, Entamoeba invadens
TAFTYKCSMCSRVNLYLFKKQVKTLQTGF

SEQ ID NO: 2969606 - protein, 26 aa, Entamoeba invadens
TAFVRAGKEINLYVTIVSTFASLSMQ

SEQ ID NO: 2969607 - protein, 23 aa, Entamoeba invadens
TAGCYRDVNGVVFVFDVSNRASF

SEQ ID NO: 2969608 - protein, 31 aa, Entamoeba invadens
TAGRAFERKKRCFINNLLIDYASMIGYSFES

SEQ ID NO: 2969609 - protein, 36 aa, Entamoeba invadens
TAHQELMLGFCFEPRPSAKAIYYPPFLFIHEEANYF

SEQ ID NO: 2969610 - protein, 18 aa, Entamoeba invadens
TAIEKLMRTKTELDEKQN

SEQ ID NO: 2969611 - protein, 24 aa, Entamoeba invadens
TAIFKELNEELGIENVYLMCSNKS

SEQ ID NO: 2969612 - protein, 21 aa, Entamoeba invadens
TAIIWKELLVLVISNKDCETI

SEQ ID NO: 2969613 - protein, 24 aa, Entamoeba invadens
TAIRKLVPESWGFMCPVHTPDGAP

SEQ ID NO: 2969614 - protein, 22 aa, Entamoeba invadens
TAIRLFKKYDLWKILQESDLKV

SEQ ID NO: 2969615 - protein, 17 aa, Entamoeba invadens
TAISDFITLEFVNKKYN

SEQ ID NO: 2969616 - protein, 24 aa, Entamoeba invadens
TAITGKVLMKVCYRVNEDVNNVAV

SEQ ID NO: 2969617 - protein, 27 aa, Entamoeba invadens
TAITQFKLILVLAIDKVRINTAYTLFY

SEQ ID NO: 2969618 - protein, 17 aa, Entamoeba invadens
TAKEIIHEVFALQQKKA

SEQ ID NO: 2969619 - protein, 22 aa, Entamoeba invadens
TAKGRDGPIVIHCSAGLGRSGT

SEQ ID NO: 2969620 - protein, 19 aa, Entamoeba invadens
TAKIWFLASSRLRHSLTGH

SEQ ID NO: 2969621 - protein, 28 aa, Entamoeba invadens
TAKKGEFTLSFQFCKYIATHHLIIDNLH

SEQ ID NO: 2969622 - protein, 24 aa, Entamoeba invadens
TAKQLLPKKVVFVLDFCSDNPDKI

SEQ ID NO: 2969623 - protein, 22 aa, Entamoeba invadens
TAKRSNLLNALGLNLVSTPLYS

SEQ ID NO: 2969624 - protein, 29 aa, Entamoeba invadens
TAKSELFFKPPKHFFELSLNITNPQNVFF

SEQ ID NO: 2969625 - protein, 23 aa, Entamoeba invadens
TAKTWLIPYCVYRTLVKSVDTPL

SEQ ID NO: 2969626 - protein, 24 aa, Entamoeba invadens
TALAKRLDPFVDYFPLGTSKDFFC

SEQ ID NO: 2969627 - protein, 17 aa, Entamoeba invadens
TALCVPQKQFVYDAKKE

SEQ ID NO: 2969628 - protein, 23 aa, Entamoeba invadens
TALKCNFCGEHIIPQKKGEFNLD

SEQ ID NO: 2969629 - protein, 24 aa, Entamoeba invadens
TALKMWKVNDFLGIVTAGKDKKVR

SEQ ID NO: 2969630 - protein, 17 aa, Entamoeba invadens
TALLCKPIVLNPKQNFP

SEQ ID NO: 2969631 - protein, 24 aa, Entamoeba invadens
TALLEVFQALPLAILLDTSCGTFF

SEQ ID NO: 2969632 - protein, 19 aa, Entamoeba invadens
TALLLQFHASNLLKPSTSL

SEQ ID NO: 2969633 - protein, 24 aa, Entamoeba invadens
TALMAFRRRTFVGLSTSYSALQNT

SEQ ID NO: 2969634 - protein, 23 aa, Entamoeba invadens
TALPKSLPFLPLVLDIPPELATL

SEQ ID NO: 2969635 - protein, 18 aa, Entamoeba invadens
TALRDCVVIFQMVNELDQ

SEQ ID NO: 2969636 - protein, 22 aa, Entamoeba invadens
TALRGRGAFMNGKRIHVSHTSE

SEQ ID NO: 2969637 - protein, 17 aa, Entamoeba invadens
TALRHINIPFNLKILRK

SEQ ID NO: 2969638 - protein, 20 aa, Entamoeba invadens
TALRIAEKIDEDYYVKDSSM

SEQ ID NO: 2969639 - protein, 17 aa, Entamoeba invadens
TALRRLEKNRKVFVQNL

SEQ ID NO: 2969640 - protein, 18 aa, Entamoeba invadens
TALTCLCASSLNEEAIKF

SEQ ID NO: 2969641 - protein, 25 aa, Entamoeba invadens
TALTIPVNLYFNSLIFFNNLNRISA

SEQ ID NO: 2969642 - protein, 20 aa, Entamoeba invadens
TALYDRLNSIITRKYQEPLF

SEQ ID NO: 2969643 - protein, 27 aa, Entamoeba invadens
TALYVKRANALLNEAIYSLKLVEQKLD

SEQ ID NO: 2969644 - protein, 46 aa, Entamoeba invadens
TANCQICNALFTTFFRKHHCRKCGLCVCADCSKQSIVINKKKERVC

SEQ ID NO: 2969645 - protein, 17 aa, Entamoeba invadens
TANKMSMFFAYSSPMMK

SEQ ID NO: 2969646 - protein, 24 aa, Entamoeba invadens
TANPDRECLVFRSAMTKANIRHTY

SEQ ID NO: 2969647 - protein, 19 aa, Entamoeba invadens
TANSGYLQRCIIKMMESLH

SEQ ID NO: 2969648 - protein, 35 aa, Entamoeba invadens
TANVEFKWQIPTIRPKTGLLASLSYNATEIVMDEQ

SEQ ID NO: 2969649 - protein, 17 aa, Entamoeba invadens
TAPELADRFWYFLKKEF

SEQ ID NO: 2969650 - protein, 22 aa, Entamoeba invadens
TAPGIRCAVSLALGTMSFTCPV

SEQ ID NO: 2969651 - protein, 22 aa, Entamoeba invadens
TAPLPWHKVITMQRGADTTVWD

SEQ ID NO: 2969652 - protein, 18 aa, Entamoeba invadens
TAQAFLIESRYYWVENVE

SEQ ID NO: 2969653 - protein, 22 aa, Entamoeba invadens
TAQDGIDCTINFFKSVGGITTM

SEQ ID NO: 2969654 - protein, 33 aa, Entamoeba invadens
TAQLRISLNGGCAVVNVMNIFKLFMEENKKLND

SEQ ID NO: 2969655 - protein, 28 aa, Entamoeba invadens
TAQLSGWCQGKVKLLFLSDERKIDSQHV

SEQ ID NO: 2969656 - protein, 24 aa, Entamoeba invadens
TAQPKFYLTGAFYFALLYSGSNFK

SEQ ID NO: 2969657 - protein, 18 aa, Entamoeba invadens
TAQRLALMEIERGKDSEW

SEQ ID NO: 2969658 - protein, 30 aa, Entamoeba invadens
TAQTRVARYWPMFPRTFALFKKLFTEQTNF

SEQ ID NO: 2969659 - protein, 34 aa, Entamoeba invadens
TARDCNSCVKFLREFKLFPGIKTLVINSSYFRTF

SEQ ID NO: 2969660 - protein, 20 aa, Entamoeba invadens
TARFPNPMLIQMGVELNQTD

SEQ ID NO: 2969661 - protein, 19 aa, Entamoeba invadens
TARLCTAMFPSILARKLNE

SEQ ID NO: 2969662 - protein, 18 aa, Entamoeba invadens
TARPDLLVSGSRDKTLLV

SEQ ID NO: 2969663 - protein, 36 aa, Entamoeba invadens
TARTNFCRERHNVMGECRRRYCPLANSVYATIREFG

SEQ ID NO: 2969664 - protein, 22 aa, Entamoeba invadens
TASHIEYVWRFITKKLGQSPNR

SEQ ID NO: 2969665 - protein, 24 aa, Entamoeba invadens
TASRLMKLAEQFGLPVITLVDTPG

SEQ ID NO: 2969666 - protein, 23 aa, Entamoeba invadens
TASRMSGAIVLRAQDILVKIYSS

SEQ ID NO: 2969667 - protein, 22 aa, Entamoeba invadens
TATCLLRKVVMEGVQAVNTGLP

SEQ ID NO: 2969668 - protein, 18 aa, Entamoeba invadens
TATKLILRGDLSKHALSE

SEQ ID NO: 2969669 - protein, 28 aa, Entamoeba invadens
TATKRKEALFALREMQLAALKTARTEQV

SEQ ID NO: 2969670 - protein, 24 aa, Entamoeba invadens
TATRLICLPGYEIQDTCAQFYIGT

SEQ ID NO: 2969671 - protein, 22 aa, Entamoeba invadens
TATYCKKCTTANCLECNNNNEC

SEQ ID NO: 2969672 - protein, 23 aa, Entamoeba invadens
TAVDLCGPGVMSSEKAMYSFEFS

SEQ ID NO: 2969673 - protein, 23 aa, Entamoeba invadens
TAVEVPILFCIADMVNYPVKESC

SEQ ID NO: 2969674 - protein, 19 aa, Entamoeba invadens
TAVKECYFTIVTINNIKER

SEQ ID NO: 2969675 - protein, 23 aa, Entamoeba invadens
TAVKMTTCGSSFVGEGKTLGKEV

SEQ ID NO: 2969676 - protein, 18 aa, Entamoeba invadens
TAVLIKSGAGAIIGAIAT

SEQ ID NO: 2969677 - protein, 26 aa, Entamoeba invadens
TAVTGKVLLRVCYRVSQNANCVFVDI

SEQ ID NO: 2969678 - protein, 36 aa, Entamoeba invadens
TAWEFCGYPFHDTCMKCFSCEKPIRFKAMAIDCKPF

SEQ ID NO: 2969679 - protein, 39 aa, Entamoeba invadens
TAWLSPQLRDVLKRAGFKPSYLSNPVWVETLMDTVRLAV

SEQ ID NO: 2969680 - protein, 20 aa, Entamoeba invadens
TAYKQCFRLSNKSLIKEMFD

SEQ ID NO: 2969681 - protein, 20 aa, Entamoeba invadens
TCAGFLPDARKLAKKASEEA

SEQ ID NO: 2969682 - protein, 22 aa, Entamoeba invadens
TCASLKRLIKRSQILDPFCQYV

SEQ ID NO: 2969683 - protein, 17 aa, Entamoeba invadens
TCCASVVVNSPTPFCVI

SEQ ID NO: 2969684 - protein, 24 aa, Entamoeba invadens
TCCEVKMNVLWNLGLIDIKGTTQV

SEQ ID NO: 2969685 - protein, 17 aa, Entamoeba invadens
TCCKCGRGIADEQIFEW

SEQ ID NO: 2969686 - protein, 20 aa, Entamoeba invadens
TCDDKGYLFNVYRINPSGGE

SEQ ID NO: 2969687 - protein, 23 aa, Entamoeba invadens
TCDKLKVFNGRVCYDMALMMKAN

SEQ ID NO: 2969688 - protein, 18 aa, Entamoeba invadens
TCDLGFESTFLKNLLKLK

SEQ ID NO: 2969689 - protein, 19 aa, Entamoeba invadens
TCDLLCSILNLTESQILSV

SEQ ID NO: 2969690 - protein, 19 aa, Entamoeba invadens
TCECGRHFCNGKVSNMSDC

SEQ ID NO: 2969691 - protein, 30 aa, Entamoeba invadens
TCEDFKKIFPKNVSIYFDLKFGTNTFETRT

SEQ ID NO: 2969692 - protein, 26 aa, Entamoeba invadens
TCEGPIRWYCCGPTVYDDSHLGHART

SEQ ID NO: 2969693 - protein, 18 aa, Entamoeba invadens
TCEKCVKWYYLDATEKAC

SEQ ID NO: 2969694 - protein, 22 aa, Entamoeba invadens
TCEKYKFPTLKKELPPPKQSTK

SEQ ID NO: 2969695 - protein, 20 aa, Entamoeba invadens
TCELSSCFIPTLTLEELEPY

SEQ ID NO: 2969696 - protein, 25 aa, Entamoeba invadens
TCEVDCLKLPVLLNELIIDTCKVVN

SEQ ID NO: 2969697 - protein, 18 aa, Entamoeba invadens
TCFCRNFQVGKVFLDLTN

SEQ ID NO: 2969698 - protein, 19 aa, Entamoeba invadens
TCFGALQCYEELVLGANEL

SEQ ID NO: 2969699 - protein, 19 aa, Entamoeba invadens
TCFMNCRALSAIKLPSNLV

SEQ ID NO: 2969700 - protein, 20 aa, Entamoeba invadens
TCFNGCCHLRVVKLPKSVTK

SEQ ID NO: 2969701 - protein, 17 aa, Entamoeba invadens
TCFYECKSLLSVTVPSS

SEQ ID NO: 2969702 - protein, 20 aa, Entamoeba invadens
TCGAGSRKNIDWKKSDGKME

SEQ ID NO: 2969703 - protein, 22 aa, Entamoeba invadens
TCGGLCPGLNNVIRGIVLNMYN

SEQ ID NO: 2969704 - protein, 26 aa, Entamoeba invadens
TCGLSVEILLCVYSSFYEVTKEYSED

SEQ ID NO: 2969705 - protein, 27 aa, Entamoeba invadens
TCGVDIWCVGISVFVAMCGYQPFDGDN

SEQ ID NO: 2969706 - protein, 27 aa, Entamoeba invadens
TCGYYLVDAIRRWTGWMTPIVLFDSDN

SEQ ID NO: 2969707 - protein, 39 aa, Entamoeba invadens
TCHKNRTFVPSICREIKPYKSFICLLLVKQAATDEPPTH

SEQ ID NO: 2969708 - protein, 21 aa, Entamoeba invadens
TCHSCKIKKAIAFQVPSQQAA

SEQ ID NO: 2969709 - protein, 28 aa, Entamoeba invadens
TCIGDTFLTFIPFLKVYSEYCSNFRHTT

SEQ ID NO: 2969710 - protein, 24 aa, Entamoeba invadens
TCIGSNCFENCALRTFDFPSQTNR

SEQ ID NO: 2969711 - protein, 19 aa, Entamoeba invadens
TCILTCGGNKGLLNEYNLY

SEQ ID NO: 2969712 - protein, 20 aa, Entamoeba invadens
TCIYERIKKRFDIERYERPI

SEQ ID NO: 2969713 - protein, 19 aa, Entamoeba invadens
TCKCSLCKKVEFLKSSQNR

SEQ ID NO: 2969714 - protein, 25 aa, Entamoeba invadens
TCKLKWTSGHIWTGAIDLYFPRLLK

SEQ ID NO: 2969715 - protein, 21 aa, Entamoeba invadens
TCKTFLRQSLKNVITEINTIN

SEQ ID NO: 2969716 - protein, 31 aa, Entamoeba invadens
TCLDKSWGEYKLRLSNWIIPHVGIIKNTPYY

SEQ ID NO: 2969717 - protein, 18 aa, Entamoeba invadens
TCLECCLIGLLSHKCSLH

SEQ ID NO: 2969718 - protein, 25 aa, Entamoeba invadens
TCLGSFYKTRHRLFVEPFQVDSNAR

SEQ ID NO: 2969719 - protein, 21 aa, Entamoeba invadens
TCLKCGLSCDYCDGTEPNKCS

SEQ ID NO: 2969720 - protein, 21 aa, Entamoeba invadens
TCLKCKNGFALNGTTCQSCAS

SEQ ID NO: 2969721 - protein, 19 aa, Entamoeba invadens
TCLKDVFKYDYKQLDHRVV

SEQ ID NO: 2969722 - protein, 17 aa, Entamoeba invadens
TCLPHVEVVPFPSDIIQ

SEQ ID NO: 2969723 - protein, 20 aa, Entamoeba invadens
TCLPNNIVTLTCLRHLDLNA

SEQ ID NO: 2969724 - protein, 21 aa, Entamoeba invadens
TCLQANCFAECLRLTSITLHS

SEQ ID NO: 2969725 - protein, 21 aa, Entamoeba invadens
TCLQANCFAECLRLTSITLPS

SEQ ID NO: 2969726 - protein, 21 aa, Entamoeba invadens
TCLTCKCYYYLSGNTCIKCDS

SEQ ID NO: 2969727 - protein, 25 aa, Entamoeba invadens
TCMKAKAGEVLTVIEKGVKIGWLYC

SEQ ID NO: 2969728 - protein, 25 aa, Entamoeba invadens
TCMKAKAGEVLTVIEKSVRIGWLYC

SEQ ID NO: 2969729 - protein, 31 aa, Entamoeba invadens
TCQGGGMYLSLYLDSLWRKRNIAQVNYSLKS

SEQ ID NO: 2969730 - protein, 25 aa, Entamoeba invadens
TCQKAKVVLSSFFVLRKDYSVIDNE

SEQ ID NO: 2969731 - protein, 18 aa, Entamoeba invadens
TCQKCIDGYILIDGQCQT

SEQ ID NO: 2969732 - protein, 26 aa, Entamoeba invadens
TCQLINCIKLNILQRSTVYETFLGNI

SEQ ID NO: 2969733 - protein, 17 aa, Entamoeba invadens
TCQPALMQSNNELCLDL

SEQ ID NO: 2969734 - protein, 31 aa, Entamoeba invadens
TCRFPKRNSEILKHVLALCGKIISNPESKMD

SEQ ID NO: 2969735 - protein, 17 aa, Entamoeba invadens
TCRRPTSRWNVRILYDL

SEQ ID NO: 2969736 - protein, 21 aa, Entamoeba invadens
TCSDPSNIVQARFDKIPLITQ

SEQ ID NO: 2969737 - protein, 20 aa, Entamoeba invadens
TCSEIICPHCFVLEHAGHIV

SEQ ID NO: 2969738 - protein, 20 aa, Entamoeba invadens
TCSLEKKMMNAFIEKEAQMQ

SEQ ID NO: 2969739 - protein, 20 aa, Entamoeba invadens
TCSNLKYMSKHNCLYSSLTL

SEQ ID NO: 2969740 - protein, 23 aa, Entamoeba invadens
TCSNRRIGAPFSETSKANPVFSV

SEQ ID NO: 2969741 - protein, 27 aa, Entamoeba invadens
TCSSIDVVVPWTHLYSKPIILRLGEVF

SEQ ID NO: 2969742 - protein, 20 aa, Entamoeba invadens
TCTDLKCTHINCTKDRNSCT

SEQ ID NO: 2969743 - protein, 19 aa, Entamoeba invadens
TCTGAKIFQGYGLTESFGG

SEQ ID NO: 2969744 - protein, 20 aa, Entamoeba invadens
TCTKSVLLFNIENFIFSNTF

SEQ ID NO: 2969745 - protein, 23 aa, Entamoeba invadens
TCTLCSVCAPGYYIDNNKCISIG

SEQ ID NO: 2969746 - protein, 25 aa, Entamoeba invadens
TCTNALELIKRVNFSEHMQTNYKLI

SEQ ID NO: 2969747 - protein, 19 aa, Entamoeba invadens
TCVENCFTLCRGTFVEEQK

SEQ ID NO: 2969748 - protein, 28 aa, Entamoeba invadens
TCVIRLEKVLCFLRDSFRCQIVKDTFKY

SEQ ID NO: 2969749 - protein, 32 aa, Entamoeba invadens
TCVPEGQCVFVGGAIEALGKWNVHGAVKMTPT

SEQ ID NO: 2969750 - protein, 32 aa, Entamoeba invadens
TCVPEGQCVFVGGAIESLGKWNVHGAVRMTPT

SEQ ID NO: 2969751 - protein, 23 aa, Entamoeba invadens
TCVPYLSKRTYIIKQIEKHSKTT

SEQ ID NO: 2969752 - protein, 19 aa, Entamoeba invadens
TCVRMHSIIFKNVVYTQKD

SEQ ID NO: 2969753 - protein, 20 aa, Entamoeba invadens
TCVVHLCFDISTGIKYAVKI

SEQ ID NO: 2969754 - protein, 24 aa, Entamoeba invadens
TCVWGKKAGEAFEIYNFVVFELNK

SEQ ID NO: 2969755 - protein, 17 aa, Entamoeba invadens
TCYDELWKKIAQDNRDI

SEQ ID NO: 2969756 - protein, 17 aa, Entamoeba invadens
TCYGGSNTQCFTCKTGY

SEQ ID NO: 2969757 - protein, 25 aa, Entamoeba invadens
TCYNHIRKADPFLIKKCSCYCTQDE

SEQ ID NO: 2969758 - protein, 29 aa, Entamoeba invadens
TDAAGWLSWIMKILELMDADLIKCIGACF

SEQ ID NO: 2969759 - protein, 29 aa, Entamoeba invadens
TDAAGWLSWIMKILELMDADLIKCIGAYF

SEQ ID NO: 2969760 - protein, 18 aa, Entamoeba invadens
TDAFIFSLIRKGKFNPKK

SEQ ID NO: 2969761 - protein, 17 aa, Entamoeba invadens
TDAMIKSAINYRSKGRF

SEQ ID NO: 2969762 - protein, 27 aa, Entamoeba invadens
TDANCRCMIELQSLRQNNDFNYQEFVN

SEQ ID NO: 2969763 - protein, 20 aa, Entamoeba invadens
TDATFKKFPFVGLENQGCTC

SEQ ID NO: 2969764 - protein, 19 aa, Entamoeba invadens
TDCAIKMLMDPSPRVRVSL

SEQ ID NO: 2969765 - protein, 22 aa, Entamoeba invadens
TDCANVYFSVCKSFLEYWGDMF

SEQ ID NO: 2969766 - protein, 17 aa, Entamoeba invadens
TDCIRVYNFINGKLENT

SEQ ID NO: 2969767 - protein, 25 aa, Entamoeba invadens
TDDEVYNRCEICIKRSKNEELLIKR

SEQ ID NO: 2969768 - protein, 19 aa, Entamoeba invadens
TDDFYRWVTRDGKFSDTRE

SEQ ID NO: 2969769 - protein, 17 aa, Entamoeba invadens
TDDLEKQIKEKEDKLNA

SEQ ID NO: 2969770 - protein, 28 aa, Entamoeba invadens
TDDNGIVSFDCCFTIKKDKKIYVQNKKW

SEQ ID NO: 2969771 - protein, 32 aa, Entamoeba invadens
TDDNLKRFFGAFCVRGDLRSVIFSNPSKFQRD

SEQ ID NO: 2969772 - protein, 28 aa, Entamoeba invadens
TDDRIWFRARMQIVNVMLPDGSQKKMML

SEQ ID NO: 2969773 - protein, 23 aa, Entamoeba invadens
TDDVPFQYLRFFLNDDQLLDKIK

SEQ ID NO: 2969774 - protein, 34 aa, Entamoeba invadens
TDEARPDLEWISSRPGIKVLIKGNHDYWWPNTQK

SEQ ID NO: 2969775 - protein, 22 aa, Entamoeba invadens
TDEEVKNLLLFKETPASNGSTN

SEQ ID NO: 2969776 - protein, 30 aa, Entamoeba invadens
TDEFKKLFIDYGIVDVRLLYQPIVVKPNKK

SEQ ID NO: 2969777 - protein, 19 aa, Entamoeba invadens
TDEGNVFRFFDIEKRSLIK

SEQ ID NO: 2969778 - protein, 22 aa, Entamoeba invadens
TDEHGEVCPLNWTPGKDTMKPC

SEQ ID NO: 2969779 - protein, 17 aa, Entamoeba invadens
TDEKLKKILTLIFSTEE

SEQ ID NO: 2969780 - protein, 23 aa, Entamoeba invadens
TDEKRAVIYISPFEEDAQKAFEA

SEQ ID NO: 2969781 - protein, 17 aa, Entamoeba invadens
TDENCFIFVLKENGIKR

SEQ ID NO: 2969782 - protein, 22 aa, Entamoeba invadens
TDEPLIPPSMILEIKTQVEETT

SEQ ID NO: 2969783 - protein, 26 aa, Entamoeba invadens
TDEPRMFSLFVNIMFLVAPMWEKDGK

SEQ ID NO: 2969784 - protein, 19 aa, Entamoeba invadens
TDERLGLRRHITMINRFFK

SEQ ID NO: 2969785 - protein, 23 aa, Entamoeba invadens
TDESLYFAYGGYRDFDSSFMKIL

SEQ ID NO: 2969786 - protein, 24 aa, Entamoeba invadens
TDEVECPYWLAPEVISEHRTTPKV

SEQ ID NO: 2969787 - protein, 25 aa, Entamoeba invadens
TDEVLKCIIALIKMEMVDLKELCCE

SEQ ID NO: 2969788 - protein, 25 aa, Entamoeba invadens
TDFAEFLLQVTVDFLVRSNDTTRLP

SEQ ID NO: 2969789 - protein, 26 aa, Entamoeba invadens
TDFEKVCGVDSFLKLDEELSRAKHVK

SEQ ID NO: 2969790 - protein, 25 aa, Entamoeba invadens
TDFERESRFLLRWLNSTLSIKTVFE

SEQ ID NO: 2969791 - protein, 20 aa, Entamoeba invadens
TDFEWDIHQVIIPPRQTDPV

SEQ ID NO: 2969792 - protein, 20 aa, Entamoeba invadens
TDFIKSLSIYNCKDFEIAKN

SEQ ID NO: 2969793 - protein, 19 aa, Entamoeba invadens
TDFKNIGGNVVNKAVNYGE

SEQ ID NO: 2969794 - protein, 24 aa, Entamoeba invadens
TDFLKCVGSFVYFYECNAPRITQV

SEQ ID NO: 2969795 - protein, 18 aa, Entamoeba invadens
TDFLSEYLPYVFSINRRL

SEQ ID NO: 2969796 - protein, 17 aa, Entamoeba invadens
TDFNEVIMRGCVSMSHY

SEQ ID NO: 2969797 - protein, 20 aa, Entamoeba invadens
TDFSESIAVFNGNLQKLIQI

SEQ ID NO: 2969798 - protein, 18 aa, Entamoeba invadens
TDFSFLIPENAIFECSKK

SEQ ID NO: 2969799 - protein, 19 aa, Entamoeba invadens
TDFSRKCVECITGYYPDLL

SEQ ID NO: 2969800 - protein, 17 aa, Entamoeba invadens
TDFTEVRNAMAYLLVYS

SEQ ID NO: 2969801 - protein, 23 aa, Entamoeba invadens
TDGCLFDYVYRHVLEVDEIRTII

SEQ ID NO: 2969802 - protein, 23 aa, Entamoeba invadens
TDGEYRWGVEVLNHVIFGNPKNV

SEQ ID NO: 2969803 - protein, 18 aa, Entamoeba invadens
TDGFAVKEEWLYDCISEM

SEQ ID NO: 2969804 - protein, 17 aa, Entamoeba invadens
TDGFKMDFSRKMCVPGV

SEQ ID NO: 2969805 - protein, 20 aa, Entamoeba invadens
TDGFPMLREIEALKVDCSSL

SEQ ID NO: 2969806 - protein, 23 aa, Entamoeba invadens
TDGKCYVEMDIALGVLEEKGSGS

SEQ ID NO: 2969807 - protein, 26 aa, Entamoeba invadens
TDGKLSVNACMDRYYADMVITPPEIV

SEQ ID NO: 2969808 - protein, 21 aa, Entamoeba invadens
TDGKVKCFGIFPEEFAICSGP

SEQ ID NO: 2969809 - protein, 26 aa, Entamoeba invadens
TDGLFYLNADFALFVNDLVRVYTPSI

SEQ ID NO: 2969810 - protein, 20 aa, Entamoeba invadens
TDGQRTFYLLNGYLIVETTS

SEQ ID NO: 2969811 - protein, 17 aa, Entamoeba invadens
TDGTLCWVAEDGVTINV

SEQ ID NO: 2969812 - protein, 24 aa, Entamoeba invadens
TDHDISLLVPEIWSKMRRYEQEPK

SEQ ID NO: 2969813 - protein, 20 aa, Entamoeba invadens
TDHIPTFFWQVGRSLLEHPC

SEQ ID NO: 2969814 - protein, 24 aa, Entamoeba invadens
TDIEMLGLIFSWVLKNMDKNVLKE

SEQ ID NO: 2969815 - protein, 23 aa, Entamoeba invadens
TDIFLLCFSVVYHASYVNVRDKW

SEQ ID NO: 2969816 - protein, 18 aa, Entamoeba invadens
TDIFVFIKSHWDVLNKFK

SEQ ID NO: 2969817 - protein, 19 aa, Entamoeba invadens
TDIFVLCFSVIYKSSYTNV

SEQ ID NO: 2969818 - protein, 24 aa, Entamoeba invadens
TDIKNCLRDLLTKALAPRVEPMRK

SEQ ID NO: 2969819 - protein, 34 aa, Entamoeba invadens
TDIKRLCFVQCHLLELIILPSYMKIINNCTFYGC

SEQ ID NO: 2969820 - protein, 28 aa, Entamoeba invadens
TDINSPVFFKIICFVCAFINENQSIQNE

SEQ ID NO: 2969821 - protein, 40 aa, Entamoeba invadens
TDIPCAFKPYCIAQGYFVWSCKVVESFKGINPMLDQKFND

SEQ ID NO: 2969822 - protein, 24 aa, Entamoeba invadens
TDIPWSGLLCDLVWSDYSPKVNGF

SEQ ID NO: 2969823 - protein, 24 aa, Entamoeba invadens
TDIVPSRRGLRVVFADQSVAKHVM

SEQ ID NO: 2969824 - protein, 19 aa, Entamoeba invadens
TDIYLFDYRKLMISGNYNL

SEQ ID NO: 2969825 - protein, 18 aa, Entamoeba invadens
TDKFTFEKVITWFQDVME

SEQ ID NO: 2969826 - protein, 24 aa, Entamoeba invadens
TDKIKSLVKNGVAVMFGTLETIAD

SEQ ID NO: 2969827 - protein, 17 aa, Entamoeba invadens
TDKKKRKTMRCNSSDKI

SEQ ID NO: 2969828 - protein, 23 aa, Entamoeba invadens
TDKKVICHTCLRNDTIVAQANKG

SEQ ID NO: 2969829 - protein, 18 aa, Entamoeba invadens
TDKLFVLGAEAKTNGEID

SEQ ID NO: 2969830 - protein, 27 aa, Entamoeba invadens
TDKMVIKFFLDFFSVECPFSIHNLFLT

SEQ ID NO: 2969831 - protein, 24 aa, Entamoeba invadens
TDKPHLTGFLGFKAGMTHVIREVK

SEQ ID NO: 2969832 - protein, 19 aa, Entamoeba invadens
TDKRIAQLLSEKNKETEVK

SEQ ID NO: 2969833 - protein, 23 aa, Entamoeba invadens
TDKRKPWTGILLFGPPGTGKSFL

SEQ ID NO: 2969834 - protein, 23 aa, Entamoeba invadens
TDKSWCSPCTYTAKAGDLTGTYY

SEQ ID NO: 2969835 - protein, 22 aa, Entamoeba invadens
TDKVFKKTMCIYTCCDTDKTLH

SEQ ID NO: 2969836 - protein, 21 aa, Entamoeba invadens
TDLARLFYIYLLNTQDVSALK

SEQ ID NO: 2969837 - protein, 19 aa, Entamoeba invadens
TDLCKLDEDIFVWVKQVSP

SEQ ID NO: 2969838 - protein, 19 aa, Entamoeba invadens
TDLFENFVYFITNVRCRRL

SEQ ID NO: 2969839 - protein, 19 aa, Entamoeba invadens
TDLIMKELRTIPRCKDQQN

SEQ ID NO: 2969840 - protein, 18 aa, Entamoeba invadens
TDLKKEFRVIPPKFPADI

SEQ ID NO: 2969841 - protein, 21 aa, Entamoeba invadens
TDLKPDFILFSSLLHLHDPEG

SEQ ID NO: 2969842 - protein, 24 aa, Entamoeba invadens
TDLKSIFKEMEFIEFVKSSTSLTF

SEQ ID NO: 2969843 - protein, 20 aa, Entamoeba invadens
TDLLCGCITKCRTVYQTYLD

SEQ ID NO: 2969844 - protein, 42 aa, Entamoeba invadens
TDLLNEYKYGLSLNEWQVAFVFKEMVMGLAYLHGNGVIHRDI

SEQ ID NO: 2969845 - protein, 24 aa, Entamoeba invadens
TDLLPRFETALALVTAPDGVFKGS

SEQ ID NO: 2969846 - protein, 24 aa, Entamoeba invadens
TDLNELRYGCVMIMADQDYDGSHI

SEQ ID NO: 2969847 - protein, 18 aa, Entamoeba invadens
TDLNLGIDEKVVIQKFDP

SEQ ID NO: 2969848 - protein, 21 aa, Entamoeba invadens
TDLPKFSYYALEYLIAEFEEF

SEQ ID NO: 2969849 - protein, 20 aa, Entamoeba invadens
TDLREGKALKRIQTMRFVSG

SEQ ID NO: 2969850 - protein, 25 aa, Entamoeba invadens
TDLRLIDFCYAWSLERESCQEEDGV

SEQ ID NO: 2969851 - protein, 17 aa, Entamoeba invadens
TDLSRIDTGTGRIICKF

SEQ ID NO: 2969852 - protein, 19 aa, Entamoeba invadens
TDLVDVFVALGLPDVLESI

SEQ ID NO: 2969853 - protein, 18 aa, Entamoeba invadens
TDLVKSILTKLELPYDTF

SEQ ID NO: 2969854 - protein, 24 aa, Entamoeba invadens
TDLVRRIFYNGGFLFSKKQINTIG

SEQ ID NO: 2969855 - protein, 18 aa, Entamoeba invadens
TDLYSFFRDKRDRFLDGQ

SEQ ID NO: 2969856 - protein, 23 aa, Entamoeba invadens
TDMCIKMDCQLMLLRHWTLYDSL

SEQ ID NO: 2969857 - protein, 21 aa, Entamoeba invadens
TDMLLFLKLVDYFQDDNDTDV

SEQ ID NO: 2969858 - protein, 23 aa, Entamoeba invadens
TDNCFGAIIGRYANRIYKGDLKI

SEQ ID NO: 2969859 - protein, 26 aa, Entamoeba invadens
TDNCPHLKVGFAFDSLLHRCIDDVIN

SEQ ID NO: 2969860 - protein, 26 aa, Entamoeba invadens
TDNCPHLKVGYAFDSLIHKCIDDIIN

SEQ ID NO: 2969861 - protein, 24 aa, Entamoeba invadens
TDNFSVPLLNFFKTPLAELSDISI

SEQ ID NO: 2969862 - protein, 24 aa, Entamoeba invadens
TDNIYCCLCAGKAKLQEDKKNVTQ

SEQ ID NO: 2969863 - protein, 24 aa, Entamoeba invadens
TDNKLLFYVMDFYKALKSVEKKFP

SEQ ID NO: 2969864 - protein, 21 aa, Entamoeba invadens
TDNPRRWVLCNNKNNQQDELI

SEQ ID NO: 2969865 - protein, 24 aa, Entamoeba invadens
TDPDFKNRLAMIMTNANQVLDLLY

SEQ ID NO: 2969866 - protein, 19 aa, Entamoeba invadens
TDPEKRPTFTQIKEQLQNV

SEQ ID NO: 2969867 - protein, 27 aa, Entamoeba invadens
TDPETKDCKGFGFVELYTKDATNMAID

SEQ ID NO: 2969868 - protein, 29 aa, Entamoeba invadens
TDPGHTLPPFKNLQTVIGVQQNVPNIRQA

SEQ ID NO: 2969869 - protein, 25 aa, Entamoeba invadens
TDPKKAALIAQHFGIEKLVWDELVK

SEQ ID NO: 2969870 - protein, 24 aa, Entamoeba invadens
TDPLFDPRAPGAVVLYEPSATSRG

SEQ ID NO: 2969871 - protein, 22 aa, Entamoeba invadens
TDPLKVNSCEPIHVLVTGAAGQ

SEQ ID NO: 2969872 - protein, 18 aa, Entamoeba invadens
TDPRCFRKKPGMVKYVYY

SEQ ID NO: 2969873 - protein, 21 aa, Entamoeba invadens
TDPRIPFDPRGERLERGIQQL

SEQ ID NO: 2969874 - protein, 24 aa, Entamoeba invadens
TDPSFRPSCFQFVLEGNTTTRVNR

SEQ ID NO: 2969875 - protein, 23 aa, Entamoeba invadens
TDPVFKDPFYFDTFNYSLQAFFD

SEQ ID NO: 2969876 - protein, 24 aa, Entamoeba invadens
TDPVSLVLSAPVFDDRSEIFDEPY

SEQ ID NO: 2969877 - protein, 23 aa, Entamoeba invadens
TDPVTLYECFELFEEEEHLTGDN

SEQ ID NO: 2969878 - protein, 17 aa, Entamoeba invadens
TDQKFSFKVDRYPEVHG

SEQ ID NO: 2969879 - protein, 23 aa, Entamoeba invadens
TDQLLKLCFQFTSSETITKSFTS

SEQ ID NO: 2969880 - protein, 21 aa, Entamoeba invadens
TDQMVEVWFRNVFNAKVKMVI

SEQ ID NO: 2969881 - protein, 22 aa, Entamoeba invadens
TDQNWRKLILTYGEKQCVVSLQ

SEQ ID NO: 2969882 - protein, 27 aa, Entamoeba invadens
TDQPPEVCAAVLKSYFRSMPDPLVDIE

SEQ ID NO: 2969883 - protein, 24 aa, Entamoeba invadens
TDQQCYKCGSSDHIAKNCPDAWKY

SEQ ID NO: 2969884 - protein, 26 aa, Entamoeba invadens
TDRARNWSVCLRLRELEIDNCKTELT

SEQ ID NO: 2969885 - protein, 26 aa, Entamoeba invadens
TDRDFFVGGHFARKFVFANHLPMTET

SEQ ID NO: 2969886 - protein, 25 aa, Entamoeba invadens
TDRLFFFWHKMFLLICDASCIATGE

SEQ ID NO: 2969887 - protein, 21 aa, Entamoeba invadens
TDRPEHTLVFLGDYVDRGQMS

SEQ ID NO: 2969888 - protein, 17 aa, Entamoeba invadens
TDSEPLAHFSVAQSVIN

SEQ ID NO: 2969889 - protein, 22 aa, Entamoeba invadens
TDSIAFAGLDVFNKGADLATST

SEQ ID NO: 2969890 - protein, 27 aa, Entamoeba invadens
TDSIISFHCIVKAKAIIDQTIKSDEEK

SEQ ID NO: 2969891 - protein, 30 aa, Entamoeba invadens
TDSNFPTFFPSFLITEVFGRSEWVVIFSLI

SEQ ID NO: 2969892 - protein, 23 aa, Entamoeba invadens
TDSRKIFLVDGISSVIETLERLP

SEQ ID NO: 2969893 - protein, 27 aa, Entamoeba invadens
TDTIKEAFKFDSCETFNNEYFTLQLEK

SEQ ID NO: 2969894 - protein, 23 aa, Entamoeba invadens
TDTPIFYCIKCLKKKPDDFRKAC

SEQ ID NO: 2969895 - protein, 25 aa, Entamoeba invadens
TDVAFWFIVHSCLIKIPPANSPFIL

SEQ ID NO: 2969896 - protein, 25 aa, Entamoeba invadens
TDVFWRIVSVNFYIPHVIKTDEKTI

SEQ ID NO: 2969897 - protein, 25 aa, Entamoeba invadens
TDVGIKRECCKAIASIINECKTEVK

SEQ ID NO: 2969898 - protein, 20 aa, Entamoeba invadens
TDVKRFISIQTYEGNIICEC

SEQ ID NO: 2969899 - protein, 17 aa, Entamoeba invadens
TDVLGWIDAHMNKHEQH

SEQ ID NO: 2969900 - protein, 18 aa, Entamoeba invadens
TDVLLKMYATVFYQLEKY

SEQ ID NO: 2969901 - protein, 25 aa, Entamoeba invadens
TDVMKEYWGYFPLKDDFVAAQCVDV

SEQ ID NO: 2969902 - protein, 28 aa, Entamoeba invadens
TDVNARFQLCPTYPTVLVVPIELSNKQV

SEQ ID NO: 2969903 - protein, 17 aa, Entamoeba invadens
TDVNGFFGFERSLYEGI

SEQ ID NO: 2969904 - protein, 18 aa, Entamoeba invadens
TDVSLFVRLSRLCFASFL

SEQ ID NO: 2969905 - protein, 20 aa, Entamoeba invadens
TDVTALVVIATISPYLRIFH

SEQ ID NO: 2969906 - protein, 18 aa, Entamoeba invadens
TDVYLRLPRDSKYQEKIW

SEQ ID NO: 2969907 - protein, 39 aa, Entamoeba invadens
TDWQSKFLIPRTFVGKILRLLKILNEFPLFKNDDQLRVA

SEQ ID NO: 2969908 - protein, 17 aa, Entamoeba invadens
TDYIPTVFDNYVANVTV

SEQ ID NO: 2969909 - protein, 23 aa, Entamoeba invadens
TDYIVRFFGHFFHDNSLWIVMEI

SEQ ID NO: 2969910 - protein, 17 aa, Entamoeba invadens
TDYKEKFVDFFSISLTR

SEQ ID NO: 2969911 - protein, 19 aa, Entamoeba invadens
TDYLRCFDQSGALIRTELM

SEQ ID NO: 2969912 - protein, 21 aa, Entamoeba invadens
TDYNAAMLFIQSWLNVSSQSF

SEQ ID NO: 2969913 - protein, 24 aa, Entamoeba invadens
TEACKIPTIKTVYCIGRSANQSEL

SEQ ID NO: 2969914 - protein, 20 aa, Entamoeba invadens
TEAFLKNVEDVIALTDQMTS

SEQ ID NO: 2969915 - protein, 33 aa, Entamoeba invadens
TEAKWLVFKLEYFRREILKELIIHAHKYKLPTV

SEQ ID NO: 2969916 - protein, 24 aa, Entamoeba invadens
TEALKGKILEEIPKITFKLSQRTT

SEQ ID NO: 2969917 - protein, 24 aa, Entamoeba invadens
TEAPLKLLWSSLKAIGLVCEYGEN

SEQ ID NO: 2969918 - protein, 19 aa, Entamoeba invadens
TECFMMCRSLKRVVLNNRV

SEQ ID NO: 2969919 - protein, 28 aa, Entamoeba invadens
TECFSHAVKCLIFPSEFSVVTALPQVLS

SEQ ID NO: 2969920 - protein, 22 aa, Entamoeba invadens
TECGGLKALPGLEKLKLNSDTL

SEQ ID NO: 2969921 - protein, 17 aa, Entamoeba invadens
TECGVLGTLDSVVNGPR

SEQ ID NO: 2969922 - protein, 25 aa, Entamoeba invadens
TECNGKIDALWLWVNGTDPTWITKL

SEQ ID NO: 2969923 - protein, 19 aa, Entamoeba invadens
TECPTLFEQKCVNYYVMKN

SEQ ID NO: 2969924 - protein, 24 aa, Entamoeba invadens
TECQAGTGPVEFVIHSMNKVNVAV

SEQ ID NO: 2969925 - protein, 27 aa, Entamoeba invadens
TEDAREFISRVAGYQKLVFIFISQQND

SEQ ID NO: 2969926 - protein, 18 aa, Entamoeba invadens
TEDAVKCFEKAQDLEKSV

SEQ ID NO: 2969927 - protein, 19 aa, Entamoeba invadens
TEDCQRIRESFAKTSIMHK

SEQ ID NO: 2969928 - protein, 22 aa, Entamoeba invadens
TEDELVILFAKMMPFPTFEGSK

SEQ ID NO: 2969929 - protein, 18 aa, Entamoeba invadens
TEDGIKFAQSFGAVGYFE

SEQ ID NO: 2969930 - protein, 17 aa, Entamoeba invadens
TEDIVFCESVEASHSDQ

SEQ ID NO: 2969931 - protein, 18 aa, Entamoeba invadens
TEDIYTLWLERCLKPELE

SEQ ID NO: 2969932 - protein, 20 aa, Entamoeba invadens
TEDLIRIWDAVFAFPTKKMF

SEQ ID NO: 2969933 - protein, 24 aa, Entamoeba invadens
TEDLKFLFYRDDLKPLTLGDGLTC

SEQ ID NO: 2969934 - protein, 22 aa, Entamoeba invadens
TEDPEWPIARNAQGVEGSVPMN

SEQ ID NO: 2969935 - protein, 21 aa, Entamoeba invadens
TEDPVALPFSPELVGDVEALW

SEQ ID NO: 2969936 - protein, 20 aa, Entamoeba invadens
TEDVCLMWDSSCDVTLLILI

SEQ ID NO: 2969937 - protein, 22 aa, Entamoeba invadens
TEDYLLYYLFQFTLSLVHDIYG

SEQ ID NO: 2969938 - protein, 23 aa, Entamoeba invadens
TEEDDFMLAYSRMQKNKIGGDGV

SEQ ID NO: 2969939 - protein, 23 aa, Entamoeba invadens
TEEEIRLLWIYRGLVMNTKPRAL

SEQ ID NO: 2969940 - protein, 23 aa, Entamoeba invadens
TEEEMQYLFTMFADLFEGYLNIT

SEQ ID NO: 2969941 - protein, 29 aa, Entamoeba invadens
TEEERKQIFKWSGRRVGNIVFDSEVNAMG

SEQ ID NO: 2969942 - protein, 25 aa, Entamoeba invadens
TEEFRFGKIKIFSKVGVLAEIEEIR

SEQ ID NO: 2969943 - protein, 25 aa, Entamoeba invadens
TEEGIKVAEEWGCLYFETSSKTGKG

SEQ ID NO: 2969944 - protein, 20 aa, Entamoeba invadens
TEEGLSYVLDQCRSHCTSSR

SEQ ID NO: 2969945 - protein, 32 aa, Entamoeba invadens
TEEIKSIWTMEVKMAYNYRVLLINTNYSIVNY

SEQ ID NO: 2969946 - protein, 35 aa, Entamoeba invadens
TEEKHKRTQCKLCQEYGHIARICPKKEEIDRVKEE

SEQ ID NO: 2969947 - protein, 25 aa, Entamoeba invadens
TEEKRPRLTSDQIRKMSKQEAALYL

SEQ ID NO: 2969948 - protein, 31 aa, Entamoeba invadens
TEELRMKKLEALPFFKPPTNNVFANKPTQQI

SEQ ID NO: 2969949 - protein, 23 aa, Entamoeba invadens
TEEMRRNGVILGEVQVTRENPNM

SEQ ID NO: 2969950 - protein, 18 aa, Entamoeba invadens
TEENCVFMRYSADTIDEK

SEQ ID NO: 2969951 - protein, 17 aa, Entamoeba invadens
TEEQFIKYFETFGPIRK

SEQ ID NO: 2969952 - protein, 19 aa, Entamoeba invadens
TEETETWIASTFNELEIIE

SEQ ID NO: 2969953 - protein, 18 aa, Entamoeba invadens
TEETTCFVNDALFIIKLM

SEQ ID NO: 2969954 - protein, 23 aa, Entamoeba invadens
TEETTKDVLKRCEAINDCMNVLI

SEQ ID NO: 2969955 - protein, 26 aa, Entamoeba invadens
TEETWWFIINKIYFKILEEVGYYHRK

SEQ ID NO: 2969956 - protein, 17 aa, Entamoeba invadens
TEEVDLVAIDSCIQSCY

SEQ ID NO: 2969957 - protein, 21 aa, Entamoeba invadens
TEEVFPLTSFLSSNKCTDDMI

SEQ ID NO: 2969958 - protein, 19 aa, Entamoeba invadens
TEEYKCFSKYLKIAQIFDS

SEQ ID NO: 2969959 - protein, 20 aa, Entamoeba invadens
TEEYKCFSKYLSIAQIFDSL

SEQ ID NO: 2969960 - protein, 19 aa, Entamoeba invadens
TEFDIPSCFTSISDNCFYG

SEQ ID NO: 2969961 - protein, 21 aa, Entamoeba invadens
TEFGGNCFDSVSIEGELKLNG

SEQ ID NO: 2969962 - protein, 21 aa, Entamoeba invadens
TEFGRAVFIFDDFYMNSEKMQ

SEQ ID NO: 2969963 - protein, 22 aa, Entamoeba invadens
TEFGVNSFSVFKTSNTPNMVLG

SEQ ID NO: 2969964 - protein, 20 aa, Entamoeba invadens
TEFHESLILSRDGKIGPKTR

SEQ ID NO: 2969965 - protein, 28 aa, Entamoeba invadens
TEFINVRELFKFIQNHWDKICHLEQLKA

SEQ ID NO: 2969966 - protein, 25 aa, Entamoeba invadens
TEFKSRPKIFPVLFDQRKLLKQSKA

SEQ ID NO: 2969967 - protein, 19 aa, Entamoeba invadens
TEFLCYQIMFHVSTLLPDV

SEQ ID NO: 2969968 - protein, 21 aa, Entamoeba invadens
TEFNDLIKLWDEFITFPDTTL

SEQ ID NO: 2969969 - protein, 25 aa, Entamoeba invadens
TEFPKLPPTCGFNFSNNQIATLSLP

SEQ ID NO: 2969970 - protein, 17 aa, Entamoeba invadens
TEFPSLFEKRCVNNLVM

SEQ ID NO: 2969971 - protein, 24 aa, Entamoeba invadens
TEGELKGDYITVVVKDFKTLNEMS

SEQ ID NO: 2969972 - protein, 20 aa, Entamoeba invadens
TEGICLNCHGKVHKAQGLTC

SEQ ID NO: 2969973 - protein, 19 aa, Entamoeba invadens
TEGIFRLSSNMVELDGLIY

SEQ ID NO: 2969974 - protein, 22 aa, Entamoeba invadens
TEGKMPLKRLGELLSVVEEGAK

SEQ ID NO: 2969975 - protein, 21 aa, Entamoeba invadens
TEGKRALAVESFARALRQLPM

SEQ ID NO: 2969976 - protein, 22 aa, Entamoeba invadens
TEGLIVRCILRIEQVVEEVTRA

SEQ ID NO: 2969977 - protein, 20 aa, Entamoeba invadens
TEGMFSQYVFLAFTNILTAA

SEQ ID NO: 2969978 - protein, 18 aa, Entamoeba invadens
TEGMKCGFLPFDVVKIVS

SEQ ID NO: 2969979 - protein, 26 aa, Entamoeba invadens
TEGNIRFCGLKLLGFMMTKHPKAVIE

SEQ ID NO: 2969980 - protein, 28 aa, Entamoeba invadens
TEGVPRTKSTLLLWDIWQLQLNGDGKPV

SEQ ID NO: 2969981 - protein, 25 aa, Entamoeba invadens
TEGVTRTIVRLGLAGFDRVSGINNE

SEQ ID NO: 2969982 - protein, 19 aa, Entamoeba invadens
TEHSEFKPNTFIVQQKKPQ

SEQ ID NO: 2969983 - protein, 27 aa, Entamoeba invadens
TEHVVLKMCKRCFVMTKKPKIITQKCD

SEQ ID NO: 2969984 - protein, 30 aa, Entamoeba invadens
TEHVVLKMCKRCFVMWIKPEIVTQIKCDDV

SEQ ID NO: 2969985 - protein, 25 aa, Entamoeba invadens
TEHYKSFIFIGPVWWWGINGPLKNA

SEQ ID NO: 2969986 - protein, 26 aa, Entamoeba invadens
TEIAKFAKFLKLRTTAVFGGMGISSQ

SEQ ID NO: 2969987 - protein, 21 aa, Entamoeba invadens
TEIANRITAMVPNKFVEGNFL

SEQ ID NO: 2969988 - protein, 17 aa, Entamoeba invadens
TEICLPLSLTSIGESCF

SEQ ID NO: 2969989 - protein, 24 aa, Entamoeba invadens
TEIDKYRTLLLFPKMPNFIQEQIA

SEQ ID NO: 2969990 - protein, 25 aa, Entamoeba invadens
TEIDSLLCKLQRDYDKYNANKNSNP

SEQ ID NO: 2969991 - protein, 17 aa, Entamoeba invadens
TEIEWLMATSWNKGNRS

SEQ ID NO: 2969992 - protein, 18 aa, Entamoeba invadens
TEIFFPKCVTEICSNGCC

SEQ ID NO: 2969993 - protein, 19 aa, Entamoeba invadens
TEIFGRVTTEIRRWNDSVT

SEQ ID NO: 2969994 - protein, 21 aa, Entamoeba invadens
TEIIMKVFAFIGEEGPHSKKP

SEQ ID NO: 2969995 - protein, 18 aa, Entamoeba invadens
TEIKNCIQLMLTVNPMKR

SEQ ID NO: 2969996 - protein, 22 aa, Entamoeba invadens
TEILGLDRPSCYVGEKAIEMNK

SEQ ID NO: 2969997 - protein, 21 aa, Entamoeba invadens
TEILMSILIAIRVVQKDEIIP

SEQ ID NO: 2969998 - protein, 22 aa, Entamoeba invadens
TEIPDKCFLGCTSLETIIFPSS

SEQ ID NO: 2969999 - protein, 30 aa, Entamoeba invadens
TEIPEPNGFIFKYLMFFLTKVVEKSDINKM

SEQ ID NO: 2970000 - protein, 17 aa, Entamoeba invadens
TEIQGFYGIPLRVAISK

SEQ ID NO: 2970001 - protein, 19 aa, Entamoeba invadens
TEIRARLNLTESALPDEKL

SEQ ID NO: 2970002 - protein, 25 aa, Entamoeba invadens
TEISRLKDEINLFCSGMFRKRVAMH

SEQ ID NO: 2970003 - protein, 21 aa, Entamoeba invadens
TEIVIPKRCCLGQRRQNHNDT

SEQ ID NO: 2970004 - protein, 21 aa, Entamoeba invadens
TEIYFSFGKILTFDYVVKTVE

SEQ ID NO: 2970005 - protein, 23 aa, Entamoeba invadens
TEKCDLYSLGLVLYFLMTGKYPF

SEQ ID NO: 2970006 - protein, 19 aa, Entamoeba invadens
TEKCIKYLRQVIVAYCKEY

SEQ ID NO: 2970007 - protein, 33 aa, Entamoeba invadens
TEKDDGACGLQFFLNCFKNLQIKRKTRASDTAV

SEQ ID NO: 2970008 - protein, 28 aa, Entamoeba invadens
TEKDDGKCGLQFFSKSFKTMKIKSKTRK

SEQ ID NO: 2970009 - protein, 17 aa, Entamoeba invadens
TEKDLFQRKQLSLNKTE

SEQ ID NO: 2970010 - protein, 20 aa, Entamoeba invadens
TEKEKIAFEKIVKFFNYTSP

SEQ ID NO: 2970011 - protein, 26 aa, Entamoeba invadens
TEKEMIKFLWNFLWGNAPRVRFFEKT

SEQ ID NO: 2970012 - protein, 26 aa, Entamoeba invadens
TEKFGFKNECIWKYDDAVYNAILSLF

SEQ ID NO: 2970013 - protein, 21 aa, Entamoeba invadens
TEKGDVFSWNFAEKKEKQDAP

SEQ ID NO: 2970014 - protein, 22 aa, Entamoeba invadens
TEKIKPNFVYRNTQKKFVEKSK

SEQ ID NO: 2970015 - protein, 23 aa, Entamoeba invadens
TEKIKVNAGMAVFGNSPMLESFN

SEQ ID NO: 2970016 - protein, 22 aa, Entamoeba invadens
TEKKCFICGSHTHLSKDCPTKI

SEQ ID NO: 2970017 - protein, 23 aa, Entamoeba invadens
TEKKEIFDIVDFMLIITKMIENY

SEQ ID NO: 2970018 - protein, 22 aa, Entamoeba invadens
TEKLRALIYGFFLKEDVTEARQ

SEQ ID NO: 2970019 - protein, 21 aa, Entamoeba invadens
TEKMKGVGVIIEVVDPELGEF

SEQ ID NO: 2970020 - protein, 21 aa, Entamoeba invadens
TEKPDYCGIRNSFRRLLKSIE

SEQ ID NO: 2970021 - protein, 30 aa, Entamoeba invadens
TEKPSEQIGGVPIEPEHPVEEQPVVGHARS

SEQ ID NO: 2970022 - protein, 23 aa, Entamoeba invadens
TEKSCVYEYSFLRENVVSKSSII

SEQ ID NO: 2970023 - protein, 27 aa, Entamoeba invadens
TEKSELFFKAPKHILAMSSNIKNSQRV

SEQ ID NO: 2970024 - protein, 24 aa, Entamoeba invadens
TEKSEVNWDKMLLFDIGSQYSDGC

SEQ ID NO: 2970025 - protein, 19 aa, Entamoeba invadens
TEKSIRVAKQIPPNYRNQV

SEQ ID NO: 2970026 - protein, 29 aa, Entamoeba invadens
TEKTQLSVWGRRSVKDIVFDSEKDPSGKK

SEQ ID NO: 2970027 - protein, 23 aa, Entamoeba invadens
TEKVKEMENGLISSKETIDQLNQ

SEQ ID NO: 2970028 - protein, 23 aa, Entamoeba invadens
TELDIQFSRRLGVLIDKRPEGDC

SEQ ID NO: 2970029 - protein, 17 aa, Entamoeba invadens
TELFFIDALAISSGLTS

SEQ ID NO: 2970030 - protein, 24 aa, Entamoeba invadens
TELFFYKLSSIKGVHERLESWYFV

SEQ ID NO: 2970031 - protein, 18 aa, Entamoeba invadens
TELGKLWVEVFIDEMQNT

SEQ ID NO: 2970032 - protein, 25 aa, Entamoeba invadens
TELKLRNCGLKCIPNNLWNLKLKKL

SEQ ID NO: 2970033 - protein, 19 aa, Entamoeba invadens
TELLLRKLPFQHLVREIAQ

SEQ ID NO: 2970034 - protein, 19 aa, Entamoeba invadens
TELLVLYKIPDTYIKDVLR

SEQ ID NO: 2970035 - protein, 20 aa, Entamoeba invadens
TELPHVFPVESVDSMTTHVV

SEQ ID NO: 2970036 - protein, 22 aa, Entamoeba invadens
TELPPFCFDNCVSLKTINLEHI

SEQ ID NO: 2970037 - protein, 17 aa, Entamoeba invadens
TELPRNISTLSRLTYIG

SEQ ID NO: 2970038 - protein, 19 aa, Entamoeba invadens
TELRRLELIDCDHSQLATT

SEQ ID NO: 2970039 - protein, 20 aa, Entamoeba invadens
TELSPQVAFCVIKEFLRRLP

SEQ ID NO: 2970040 - protein, 25 aa, Entamoeba invadens
TELVGGLHMCAKAFAQRKLIEQKRN

SEQ ID NO: 2970041 - protein, 18 aa, Entamoeba invadens
TELVGGLHVCVKAISQRK

SEQ ID NO: 2970042 - protein, 21 aa, Entamoeba invadens
TELYFLKGDCRIADNYRKVIF

SEQ ID NO: 2970043 - protein, 17 aa, Entamoeba invadens
TEMANLFIEQKKDTFGS

SEQ ID NO: 2970044 - protein, 18 aa, Entamoeba invadens
TEMCAKDGVHLCTVKAGG

SEQ ID NO: 2970045 - protein, 30 aa, Entamoeba invadens
TEMRVKDAFKSIGVVIDEEFCRFEDVEDED

SEQ ID NO: 2970046 - protein, 24 aa, Entamoeba invadens
TEMSNVYPALPFEYISVDDYFNVK

SEQ ID NO: 2970047 - protein, 20 aa, Entamoeba invadens
TENELLKKRVNDLEATSNDL

SEQ ID NO: 2970048 - protein, 25 aa, Entamoeba invadens
TENFKYWHSWALVNFEVVSYIENDE

SEQ ID NO: 2970049 - protein, 23 aa, Entamoeba invadens
TENFLKSLIFRFSDPLNKVTTVM

SEQ ID NO: 2970050 - protein, 28 aa, Entamoeba invadens
TENGKRIVECFVRVGGNLVKKMKIIKDI

SEQ ID NO: 2970051 - protein, 27 aa, Entamoeba invadens
TENKIRGCSYCYGFAGVDEFLKKNELT

SEQ ID NO: 2970052 - protein, 18 aa, Entamoeba invadens
TENLLDFGTPAPKQQQQK

SEQ ID NO: 2970053 - protein, 23 aa, Entamoeba invadens
TENLLLQWKRSVLNDVGDLINGS

SEQ ID NO: 2970054 - protein, 23 aa, Entamoeba invadens
TENMMFLYLMRWAKYVGKNGESA

SEQ ID NO: 2970055 - protein, 22 aa, Entamoeba invadens
TENQIGFEFKKLFENLTTQFQI

SEQ ID NO: 2970056 - protein, 25 aa, Entamoeba invadens
TENRPTSLLPLYIERIMYRLYYSKD

SEQ ID NO: 2970057 - protein, 20 aa, Entamoeba invadens
TENWRFFYLNMFVYNLKNSF

SEQ ID NO: 2970058 - protein, 17 aa, Entamoeba invadens
TEPDVVLLIAQYLKEQK

SEQ ID NO: 2970059 - protein, 23 aa, Entamoeba invadens
TEPEKLRLTPNCQNYTQKITPKT

SEQ ID NO: 2970060 - protein, 20 aa, Entamoeba invadens
TEPFQGICVAHLTEHRAPIV

SEQ ID NO: 2970061 - protein, 18 aa, Entamoeba invadens
TEPILILYFLEQIPLVGK

SEQ ID NO: 2970062 - protein, 24 aa, Entamoeba invadens
TEPKLKTGFAKSFFNTNHMSLAIQ

SEQ ID NO: 2970063 - protein, 17 aa, Entamoeba invadens
TEPKLVNLKSGFASEFE

SEQ ID NO: 2970064 - protein, 23 aa, Entamoeba invadens
TEPKRRTQTIFSRLNDLPTTQFT

SEQ ID NO: 2970065 - protein, 22 aa, Entamoeba invadens
TEPQLKCSLQKCLVKDLTQHSK

SEQ ID NO: 2970066 - protein, 17 aa, Entamoeba invadens
TEPVFRKSEKDLKRTTK

SEQ ID NO: 2970067 - protein, 20 aa, Entamoeba invadens
TEPVYLARLINCLQQSESDI

SEQ ID NO: 2970068 - protein, 22 aa, Entamoeba invadens
TEPYFRAPASFLPIRERREETL

SEQ ID NO: 2970069 - protein, 20 aa, Entamoeba invadens
TEQEKLFLLRGDTIYHSFIL

SEQ ID NO: 2970070 - protein, 17 aa, Entamoeba invadens
TEQIFKLVFSVIVEPSC

SEQ ID NO: 2970071 - protein, 18 aa, Entamoeba invadens
TEQIGFKEPLCGWYHSHP

SEQ ID NO: 2970072 - protein, 20 aa, Entamoeba invadens
TEQIKTLTLQVAQLQETISK

SEQ ID NO: 2970073 - protein, 23 aa, Entamoeba invadens
TEQLLILACDGIWDVLTSEQCVE

SEQ ID NO: 2970074 - protein, 26 aa, Entamoeba invadens
TEQPNEFNFNGFDNSFNFSQQTPQQQ

SEQ ID NO: 2970075 - protein, 23 aa, Entamoeba invadens
TEQQISCLVSFTIDIKNVLETID

SEQ ID NO: 2970076 - protein, 22 aa, Entamoeba invadens
TEQRPPLRQSLRNPNELSIRDE

SEQ ID NO: 2970077 - protein, 26 aa, Entamoeba invadens
TEQVVLKMCKRCFVMSKKPENITQIE

SEQ ID NO: 2970078 - protein, 25 aa, Entamoeba invadens
TERFKNGDVMGCGYLADKKIIFFTK

SEQ ID NO: 2970079 - protein, 25 aa, Entamoeba invadens
TERFKNGGVMGCGYLADKKLIFFTK

SEQ ID NO: 2970080 - protein, 26 aa, Entamoeba invadens
TERFKNGGVMGCGYLADKKMIFFTKN

SEQ ID NO: 2970081 - protein, 23 aa, Entamoeba invadens
TERKCLSCASSYFVGINGTSCGN

SEQ ID NO: 2970082 - protein, 18 aa, Entamoeba invadens
TERLKVMMFNDLNVPFLK

SEQ ID NO: 2970083 - protein, 17 aa, Entamoeba invadens
TERLRFLEERDALIQRA

SEQ ID NO: 2970084 - protein, 25 aa, Entamoeba invadens
TERNPALGLVCFSKIMFPKIQEWLT

SEQ ID NO: 2970085 - protein, 21 aa, Entamoeba invadens
TERNSFVRKFFKMPKKSQNVD

SEQ ID NO: 2970086 - protein, 22 aa, Entamoeba invadens
TERSIDELICWLNEKYADGDSI

SEQ ID NO: 2970087 - protein, 20 aa, Entamoeba invadens
TESDAFVASTGRKISRVKKP

SEQ ID NO: 2970088 - protein, 26 aa, Entamoeba invadens
TESEKEIFMRLGIKVLNVMKSEEIVE

SEQ ID NO: 2970089 - protein, 18 aa, Entamoeba invadens
TESFLFLGDFVDRGFHSL

SEQ ID NO: 2970090 - protein, 19 aa, Entamoeba invadens
TESFTVPCLPRPLEKEKTP

SEQ ID NO: 2970091 - protein, 21 aa, Entamoeba invadens
TESGVNYMNWVFIDKSDSEQS

SEQ ID NO: 2970092 - protein, 18 aa, Entamoeba invadens
TESILNYKSTIKEYTGGV

SEQ ID NO: 2970093 - protein, 21 aa, Entamoeba invadens
TESKFISAFLVDIDITKVNKK

SEQ ID NO: 2970094 - protein, 22 aa, Entamoeba invadens
TESKFISAFLVDIEITKVNKKL

SEQ ID NO: 2970095 - protein, 17 aa, Entamoeba invadens
TESKRVIPIRYEKQDKY

SEQ ID NO: 2970096 - protein, 26 aa, Entamoeba invadens
TESLFKKCLIVLMITGKITMGMFYSK

SEQ ID NO: 2970097 - protein, 22 aa, Entamoeba invadens
TESMWSTLIAWAETKTNTTYDT

SEQ ID NO: 2970098 - protein, 26 aa, Entamoeba invadens
TESVEIKAPLLLFLSGGKFSVDVHGT

SEQ ID NO: 2970099 - protein, 17 aa, Entamoeba invadens
TESVFHLAWGVLFDVTL

SEQ ID NO: 2970100 - protein, 25 aa, Entamoeba invadens
TESVIKEKINFEEMVEVYSGKRKTE

SEQ ID NO: 2970101 - protein, 31 aa, Entamoeba invadens
TESYGFKAECAWKYSDSIYDLFISLFQALPI

SEQ ID NO: 2970102 - protein, 17 aa, Entamoeba invadens
TETFAPSTSFDWNTVNI

SEQ ID NO: 2970103 - protein, 27 aa, Entamoeba invadens
TETFEWRECFNVDASMNNICWANVVSL

SEQ ID NO: 2970104 - protein, 24 aa, Entamoeba invadens
TETFKADLIVASPLGIKAFIEKQG

SEQ ID NO: 2970105 - protein, 24 aa, Entamoeba invadens
TETHRLPSFFFPIHADLGASNLLN

SEQ ID NO: 2970106 - protein, 24 aa, Entamoeba invadens
TETLKNGFILKSRDVSVTFYAPTF

SEQ ID NO: 2970107 - protein, 19 aa, Entamoeba invadens
TETPTFARFYLLIVQYVAQ

SEQ ID NO: 2970108 - protein, 26 aa, Entamoeba invadens
TETYASLLCQFGWKSFVPPSEKIQRQ

SEQ ID NO: 2970109 - protein, 23 aa, Entamoeba invadens
TETYFPALQLISIAKKFVDFSHE

SEQ ID NO: 2970110 - protein, 26 aa, Entamoeba invadens
TETYYYCFLHDKWLTKSGMSDHIKKV

SEQ ID NO: 2970111 - protein, 17 aa, Entamoeba invadens
TEVCIESAAAPGYFGSV

SEQ ID NO: 2970112 - protein, 24 aa, Entamoeba invadens
TEVECFMLYLGILLYMGAHHDVIN

SEQ ID NO: 2970113 - protein, 23 aa, Entamoeba invadens
TEVECFQLFLSEETFYNILTFSN

SEQ ID NO: 2970114 - protein, 26 aa, Entamoeba invadens
TEVECFRLFFCEEITNNLLLFSNKKI

SEQ ID NO: 2970115 - protein, 24 aa, Entamoeba invadens
TEVECFRYLGILLYMGAHHDVINP

SEQ ID NO: 2970116 - protein, 19 aa, Entamoeba invadens
TEVECVLLALLSRKYGFVL

SEQ ID NO: 2970117 - protein, 22 aa, Entamoeba invadens
TEVFQNLQISAGRYKNKILNEL

SEQ ID NO: 2970118 - protein, 28 aa, Entamoeba invadens
TEVFSYIIELEFPKGCQDLLKNLITFFH

SEQ ID NO: 2970119 - protein, 17 aa, Entamoeba invadens
TEVFVFVYSVDNYFSFK

SEQ ID NO: 2970120 - protein, 20 aa, Entamoeba invadens
TEVKKGKVGGWMVIPIAEDG

SEQ ID NO: 2970121 - protein, 20 aa, Entamoeba invadens
TEVLKFLTFLNSEMPDVVER

SEQ ID NO: 2970122 - protein, 26 aa, Entamoeba invadens
TEVNAFLKKRCDEMYATDVISGVPEK

SEQ ID NO: 2970123 - protein, 19 aa, Entamoeba invadens
TEVPSKGLFCDLLWSDPFV

SEQ ID NO: 2970124 - protein, 36 aa, Entamoeba invadens
TEVQNPLLLSVCELLKYYFCGEMRSVLLKAYSGTFP

SEQ ID NO: 2970125 - protein, 20 aa, Entamoeba invadens
TEVRGVKALIEFGKFLVSKE

SEQ ID NO: 2970126 - protein, 22 aa, Entamoeba invadens
TEVSLKEMVRYLQARNYVGPLK

SEQ ID NO: 2970127 - protein, 29 aa, Entamoeba invadens
TEVVRWFAERADMIILVFDAHKLDISDEF

SEQ ID NO: 2970128 - protein, 20 aa, Entamoeba invadens
TEVVVLVILDKGIKEGEVIE

SEQ ID NO: 2970129 - protein, 24 aa, Entamoeba invadens
TEWNKRYSALVALSLCVAPGKYIF

SEQ ID NO: 2970130 - protein, 17 aa, Entamoeba invadens
TEYFPQQLGPSFYEQYQ

SEQ ID NO: 2970131 - protein, 17 aa, Entamoeba invadens
TEYFVKYNVVDLMQSID

SEQ ID NO: 2970132 - protein, 25 aa, Entamoeba invadens
TEYKKCPPAGVVIISSFTSVVGVLS

SEQ ID NO: 2970133 - protein, 17 aa, Entamoeba invadens
TEYLTEFALQYKLPYYI

SEQ ID NO: 2970134 - protein, 17 aa, Entamoeba invadens
TEYPITCIDEMQHEIGI

SEQ ID NO: 2970135 - protein, 22 aa, Entamoeba invadens
TEYPLLDVVDGYAHILLDDGTE

SEQ ID NO: 2970136 - protein, 25 aa, Entamoeba invadens
TEYPPLGRFAVRDMKQTVAVGVVKA

SEQ ID NO: 2970137 - protein, 25 aa, Entamoeba invadens
TEYTTWDCWESMLSAVKIYLTNDQL

SEQ ID NO: 2970138 - protein, 18 aa, Entamoeba invadens
TEYYLKAYYSDVACVSIQ

SEQ ID NO: 2970139 - protein, 22 aa, Entamoeba invadens
TFACAQKYYARVSRIKENDAFD

SEQ ID NO: 2970140 - protein, 25 aa, Entamoeba invadens
TFAKGLQLKFFFSILEGEMEDSSDL

SEQ ID NO: 2970141 - protein, 21 aa, Entamoeba invadens
TFALFKEPREALYSSIFNFII

SEQ ID NO: 2970142 - protein, 25 aa, Entamoeba invadens
TFANKFNVGMAFIRKSRSFEDTHVV

SEQ ID NO: 2970143 - protein, 18 aa, Entamoeba invadens
TFASLYLSPQEREEILGA

SEQ ID NO: 2970144 - protein, 21 aa, Entamoeba invadens
TFCGTPAYMSPEIVRVQTEND

SEQ ID NO: 2970145 - protein, 26 aa, Entamoeba invadens
TFCGTPDYLAPEILKGTGHGAAVDWW

SEQ ID NO: 2970146 - protein, 20 aa, Entamoeba invadens
TFCGTPEYLSPEVVLAQPYT

SEQ ID NO: 2970147 - protein, 21 aa, Entamoeba invadens
TFCLDHYNISVGIGITSGLAV

SEQ ID NO: 2970148 - protein, 19 aa, Entamoeba invadens
TFCLECAYNKAGISRSVDV

SEQ ID NO: 2970149 - protein, 17 aa, Entamoeba invadens
TFCQKFFNAIGIHVFPF

SEQ ID NO: 2970150 - protein, 19 aa, Entamoeba invadens
TFCTHCAYHKAGISTSVDV

SEQ ID NO: 2970151 - protein, 22 aa, Entamoeba invadens
TFCTNYPKVFGPIEVLSESDLQ

SEQ ID NO: 2970152 - protein, 20 aa, Entamoeba invadens
TFDFLSRFNGGMFTSDGLDV

SEQ ID NO: 2970153 - protein, 18 aa, Entamoeba invadens
TFDKVGCEQIVFGKEYYY

SEQ ID NO: 2970154 - protein, 18 aa, Entamoeba invadens
TFDPSHLLCLKREMNCIV

SEQ ID NO: 2970155 - protein, 22 aa, Entamoeba invadens
TFDRVRFELTRVLANYLATAGK

SEQ ID NO: 2970156 - protein, 44 aa, Entamoeba invadens
TFDVEAYYNFLFTSRSKLRWVEFEYCLKYPLRLLKADMSQAPLF

SEQ ID NO: 2970157 - protein, 23 aa, Entamoeba invadens
TFDVSILEIRKGVFQVKSTNGDT

SEQ ID NO: 2970158 - protein, 19 aa, Entamoeba invadens
TFEAKLAKNDIVFLKGWIP

SEQ ID NO: 2970159 - protein, 21 aa, Entamoeba invadens
TFECLPLAATITRGIGEFFCC

SEQ ID NO: 2970160 - protein, 24 aa, Entamoeba invadens
TFEDLKKYLLKGLKENVRVLPLVD

SEQ ID NO: 2970161 - protein, 18 aa, Entamoeba invadens
TFEKCKNLSLMIGNETEQ

SEQ ID NO: 2970162 - protein, 24 aa, Entamoeba invadens
TFENKIFYQRIVWFQVSKSKTCSS

SEQ ID NO: 2970163 - protein, 19 aa, Entamoeba invadens
TFERVKCNQVLFRQLSAPD

SEQ ID NO: 2970164 - protein, 29 aa, Entamoeba invadens
TFESIFLITCVKFSPKFPLLAVGYEGKIE

SEQ ID NO: 2970165 - protein, 21 aa, Entamoeba invadens
TFEVGHLWFDELIKKAIEKYG

SEQ ID NO: 2970166 - protein, 19 aa, Entamoeba invadens
TFFDGIRWNSLLNESREDI

SEQ ID NO: 2970167 - protein, 18 aa, Entamoeba invadens
TFFFDSVIVDYKFYLQMN

SEQ ID NO: 2970168 - protein, 19 aa, Entamoeba invadens
TFFGNLIFFCHSQKVDSLH

SEQ ID NO: 2970169 - protein, 18 aa, Entamoeba invadens
TFFIKPFLELNVERENLL

SEQ ID NO: 2970170 - protein, 27 aa, Entamoeba invadens
TFFKLERFRKIVILKRGLSCDNLVEIE

SEQ ID NO: 2970171 - protein, 18 aa, Entamoeba invadens
TFFLFSLSHIYSTRLFPK

SEQ ID NO: 2970172 - protein, 20 aa, Entamoeba invadens
TFFQIDFGYLLNRRPHFDAN

SEQ ID NO: 2970173 - protein, 18 aa, Entamoeba invadens
TFFRLIVNIRDSLFSDLK

SEQ ID NO: 2970174 - protein, 20 aa, Entamoeba invadens
TFFTKEFKRNFCEKRDKLQE

SEQ ID NO: 2970175 - protein, 21 aa, Entamoeba invadens
TFGAGCFLGCKGFIDKISIPS

SEQ ID NO: 2970176 - protein, 30 aa, Entamoeba invadens
TFGLKLKIREVFAVPSIYYLHLITQGISTV

SEQ ID NO: 2970177 - protein, 17 aa, Entamoeba invadens
TFGMRYVEMNSTQTSPA

SEQ ID NO: 2970178 - protein, 19 aa, Entamoeba invadens
TFGPCAVVLVGDYIPFGPH

SEQ ID NO: 2970179 - protein, 19 aa, Entamoeba invadens
TFGRQIPKCEIDIFDKCKM

SEQ ID NO: 2970180 - protein, 24 aa, Entamoeba invadens
TFHFPFYFEYLAKWPNLCYTAKNC

SEQ ID NO: 2970181 - protein, 19 aa, Entamoeba invadens
TFHFYKGSENIFWQDFIFN

SEQ ID NO: 2970182 - protein, 22 aa, Entamoeba invadens
TFHGRDVFSLSAAQFANGDVIN

SEQ ID NO: 2970183 - protein, 23 aa, Entamoeba invadens
TFHISRRLVLMIFVSCMNVTFAE

SEQ ID NO: 2970184 - protein, 17 aa, Entamoeba invadens
TFHKCKNLKRVVVPKSV

SEQ ID NO: 2970185 - protein, 19 aa, Entamoeba invadens
TFHQFLRKLPFPKFVSTYA

SEQ ID NO: 2970186 - protein, 19 aa, Entamoeba invadens
TFIAHPFIPIEMVSFDSKD

SEQ ID NO: 2970187 - protein, 21 aa, Entamoeba invadens
TFIDVFYLHLGEFYQVFMRRC

SEQ ID NO: 2970188 - protein, 19 aa, Entamoeba invadens
TFIPEIKPIRPIQNQKDFV

SEQ ID NO: 2970189 - protein, 18 aa, Entamoeba invadens
TFIPICLIPDEKKKSNKI

SEQ ID NO: 2970190 - protein, 25 aa, Entamoeba invadens
TFIQFPELMLGMLVQVVLQMYSMTP

SEQ ID NO: 2970191 - protein, 25 aa, Entamoeba invadens
TFIRALKCGYVLNILNVNPFKMKPL

SEQ ID NO: 2970192 - protein, 25 aa, Entamoeba invadens
TFIRDWKKRCVILPDMLNVEKVEFD

SEQ ID NO: 2970193 - protein, 19 aa, Entamoeba invadens
TFISFVFDTFNVVEFCEEH

SEQ ID NO: 2970194 - protein, 22 aa, Entamoeba invadens
TFKDYFEIMKTVWGTEGNDKQK

SEQ ID NO: 2970195 - protein, 22 aa, Entamoeba invadens
TFKEDYLKVTISFTTQMSTKIN

SEQ ID NO: 2970196 - protein, 22 aa, Entamoeba invadens
TFKFPSELNSIFHKVQSSNKDN

SEQ ID NO: 2970197 - protein, 22 aa, Entamoeba invadens
TFKFPWKIAEFVIAGKRPNGDN

SEQ ID NO: 2970198 - protein, 22 aa, Entamoeba invadens
TFKFPWKIAEFVISGERLPRLD

SEQ ID NO: 2970199 - protein, 23 aa, Entamoeba invadens
TFKHSFFDLFLLESRVLMDKNMI

SEQ ID NO: 2970200 - protein, 33 aa, Entamoeba invadens
TFKLIGEMDGILAFERGVFGFKGEFEDKTRIPE

SEQ ID NO: 2970201 - protein, 18 aa, Entamoeba invadens
TFKNCIELKVVHVPNSIA

SEQ ID NO: 2970202 - protein, 20 aa, Entamoeba invadens
TFKNCLSFHQKVRATLNGTN

SEQ ID NO: 2970203 - protein, 21 aa, Entamoeba invadens
TFKRVNEFVHFDVLQTMNSLE

SEQ ID NO: 2970204 - protein, 17 aa, Entamoeba invadens
TFKTFPLVTQIKCGGSS

SEQ ID NO: 2970205 - protein, 23 aa, Entamoeba invadens
TFLILRKNFHGLINLFTMMLSTG

SEQ ID NO: 2970206 - protein, 23 aa, Entamoeba invadens
TFLKAVEFMGEFEEAIPVVNEMK

SEQ ID NO: 2970207 - protein, 30 aa, Entamoeba invadens
TFLKIAVSMCYRDMKRLLQVVSKSITNENR

SEQ ID NO: 2970208 - protein, 24 aa, Entamoeba invadens
TFLPPEITKLIPHVEHNLRNITKA

SEQ ID NO: 2970209 - protein, 18 aa, Entamoeba invadens
TFLRCLSLSLKVFDKMAF

SEQ ID NO: 2970210 - protein, 24 aa, Entamoeba invadens
TFLSKEVLDYFLISIQFNLLKDIN

SEQ ID NO: 2970211 - protein, 23 aa, Entamoeba invadens
TFLTKLFEWTDLSKARIVFDSEK

SEQ ID NO: 2970212 - protein, 18 aa, Entamoeba invadens
TFLVDVFAVVITKMSEVD

SEQ ID NO: 2970213 - protein, 23 aa, Entamoeba invadens
TFMGNEFGHPEWLDFPREGNGDS

SEQ ID NO: 2970214 - protein, 18 aa, Entamoeba invadens
TFMKRGFNQIDDPTTKEY

SEQ ID NO: 2970215 - protein, 25 aa, Entamoeba invadens
TFMNLVVTCLICFNDVMEEDTLNNK

SEQ ID NO: 2970216 - protein, 32 aa, Entamoeba invadens
TFMRDAEVFIGFDSCIGYALLSIVDLKKGALV

SEQ ID NO: 2970217 - protein, 20 aa, Entamoeba invadens
TFNDLKFVECQNLNFKNLIS

SEQ ID NO: 2970218 - protein, 18 aa, Entamoeba invadens
TFNGRVIMKVQVTFSKWY

SEQ ID NO: 2970219 - protein, 29 aa, Entamoeba invadens
TFNLLELKHSFEFSKTFDIKTRENFTRKI

SEQ ID NO: 2970220 - protein, 30 aa, Entamoeba invadens
TFNLLELKPSFEFSKTFDIKTRENFTRKIQ

SEQ ID NO: 2970221 - protein, 23 aa, Entamoeba invadens
TFNPRAPTSWILDGNEPSREYLA

SEQ ID NO: 2970222 - protein, 27 aa, Entamoeba invadens
TFNRKGNGNGGNWELKSDYKLMSEDDL

SEQ ID NO: 2970223 - protein, 23 aa, Entamoeba invadens
TFNVAGWKAAMGKGLEKYIKKED

SEQ ID NO: 2970224 - protein, 20 aa, Entamoeba invadens
TFNYIHPCVLDIKICGQSWC

SEQ ID NO: 2970225 - protein, 18 aa, Entamoeba invadens
TFPERGVIFKAIGDITKE

SEQ ID NO: 2970226 - protein, 30 aa, Entamoeba invadens
TFPKLTELYVRWSKLLVFRGKFDEHMLTFA

SEQ ID NO: 2970227 - protein, 19 aa, Entamoeba invadens
TFPLLNFVSKNVIYKRLDV

SEQ ID NO: 2970228 - protein, 17 aa, Entamoeba invadens
TFPNLGINAQFDVAFNH

SEQ ID NO: 2970229 - protein, 24 aa, Entamoeba invadens
TFPRVKTAVTMFKRHLFQYGGHLG

SEQ ID NO: 2970230 - protein, 24 aa, Entamoeba invadens
TFPSKIGFIGNCCFKFCEALKNVE

SEQ ID NO: 2970231 - protein, 26 aa, Entamoeba invadens
TFPTSLTRFGDFVFEGCKNLVEINGI

SEQ ID NO: 2970232 - protein, 17 aa, Entamoeba invadens
TFQSFKMSQMCNNLTLL

SEQ ID NO: 2970233 - protein, 34 aa, Entamoeba invadens
TFQTIRIPKVFSILAIQCVGQWVVFLVQSNAMRV

SEQ ID NO: 2970234 - protein, 18 aa, Entamoeba invadens
TFQYKVTTAISFVDFLDL

SEQ ID NO: 2970235 - protein, 19 aa, Entamoeba invadens
TFRAKKLIVRQSRLEILSN

SEQ ID NO: 2970236 - protein, 17 aa, Entamoeba invadens
TFRECQTGINITQGSNP

SEQ ID NO: 2970237 - protein, 22 aa, Entamoeba invadens
TFRKHLACFKMKVEEVTGDTNI

SEQ ID NO: 2970238 - protein, 24 aa, Entamoeba invadens
TFRNELPLFFGTVTFSLPQMIYNF

SEQ ID NO: 2970239 - protein, 17 aa, Entamoeba invadens
TFRSCPKQFYQLYTLHC

SEQ ID NO: 2970240 - protein, 19 aa, Entamoeba invadens
TFRTQVCELSFLTLLQQVG

SEQ ID NO: 2970241 - protein, 20 aa, Entamoeba invadens
TFRTQVCELSFVGLLQQVGK

SEQ ID NO: 2970242 - protein, 23 aa, Entamoeba invadens
TFSGCSFLSAIVLPKMCGSFGKR

SEQ ID NO: 2970243 - protein, 24 aa, Entamoeba invadens
TFSKETLCSIGQHFEELVMSKMRR

SEQ ID NO: 2970244 - protein, 24 aa, Entamoeba invadens
TFSMKGRFNKSFDRFSFSVTASPR

SEQ ID NO: 2970245 - protein, 17 aa, Entamoeba invadens
TFSNCCLLKEFEMPNCV

SEQ ID NO: 2970246 - protein, 18 aa, Entamoeba invadens
TFSSLGMVRPNLSRRQRI

SEQ ID NO: 2970247 - protein, 18 aa, Entamoeba invadens
TFTDATFCTDMITFSDTT

SEQ ID NO: 2970248 - protein, 22 aa, Entamoeba invadens
TFTGVCKTEFPPKSKSKYVSIK

SEQ ID NO: 2970249 - protein, 19 aa, Entamoeba invadens
TFTKFWFDIFGKNTSGRTD

SEQ ID NO: 2970250 - protein, 23 aa, Entamoeba invadens
TFTLRPLEVLIEMDVLNDLVQTY

SEQ ID NO: 2970251 - protein, 34 aa, Entamoeba invadens
TFTMRIKEWYSWHFPELYNILSHDNAMFVKCVLL

SEQ ID NO: 2970252 - protein, 19 aa, Entamoeba invadens
TFTNKSCAIDWVTETDKGV

SEQ ID NO: 2970253 - protein, 18 aa, Entamoeba invadens
TFTQVPIPRMINFEKITA

SEQ ID NO: 2970254 - protein, 19 aa, Entamoeba invadens
TFTTKRIVVVQMKPKDDAE

SEQ ID NO: 2970255 - protein, 25 aa, Entamoeba invadens
TFTVPDLLPNEAFEVSTAVEESGMI

SEQ ID NO: 2970256 - protein, 24 aa, Entamoeba invadens
TFVCHRCRESALALRKNPLYPTTN

SEQ ID NO: 2970257 - protein, 24 aa, Entamoeba invadens
TFVKDLKSVSGYSFPGTVEENGAQ

SEQ ID NO: 2970258 - protein, 24 aa, Entamoeba invadens
TFVKGYSRLVLIYKELGDIDNAII

SEQ ID NO: 2970259 - protein, 26 aa, Entamoeba invadens
TFVLKRITFKYEILREAVPKIHINFC

SEQ ID NO: 2970260 - protein, 19 aa, Entamoeba invadens
TFVVFPVRDNLLSWLLDGF

SEQ ID NO: 2970261 - protein, 19 aa, Entamoeba invadens
TFVVLSVRDNILFWLFDVF

SEQ ID NO: 2970262 - protein, 19 aa, Entamoeba invadens
TFYQIIVWFGVNYGTVEKN

SEQ ID NO: 2970263 - protein, 25 aa, Entamoeba invadens
TFYRVNNAFYLRPYLFEKKGKTWDD

SEQ ID NO: 2970264 - protein, 19 aa, Entamoeba invadens
TFYSCESLQRFTVPEQVTS

SEQ ID NO: 2970265 - protein, 28 aa, Entamoeba invadens
TFYSELVKTLSCLDPLKVYKSFVTLHKV

SEQ ID NO: 2970266 - protein, 22 aa, Entamoeba invadens
TFYSHIADFIFRVFENIETLQC

SEQ ID NO: 2970267 - protein, 17 aa, Entamoeba invadens
TGAGCTATVVAIKGDEA

SEQ ID NO: 2970268 - protein, 21 aa, Entamoeba invadens
TGAGQGAIWFMQREVTEKKKF

SEQ ID NO: 2970269 - protein, 20 aa, Entamoeba invadens
TGAHKFKIVMNSEIDGFSPD

SEQ ID NO: 2970270 - protein, 28 aa, Entamoeba invadens
TGAIDLYFPRLLKWSYTVCCNGKILRVE

SEQ ID NO: 2970271 - protein, 18 aa, Entamoeba invadens
TGAVGGLAVDYLAPKNAK

SEQ ID NO: 2970272 - protein, 23 aa, Entamoeba invadens
TGCGFPDTATCVFVSTISTTTKC

SEQ ID NO: 2970273 - protein, 19 aa, Entamoeba invadens
TGDDSCWPLIFESYYNYCM

SEQ ID NO: 2970274 - protein, 18 aa, Entamoeba invadens
TGDECLYNLTSFGDECCE

SEQ ID NO: 2970275 - protein, 20 aa, Entamoeba invadens
TGDGYIYLLSHQQLEDLLGK

SEQ ID NO: 2970276 - protein, 18 aa, Entamoeba invadens
TGDIEWWDAPFISDKTST

SEQ ID NO: 2970277 - protein, 23 aa, Entamoeba invadens
TGDIVYSLGITQFFDGINDETFY

SEQ ID NO: 2970278 - protein, 23 aa, Entamoeba invadens
TGDLKFAQDFFIPLSTPNEEDLK

SEQ ID NO: 2970279 - protein, 21 aa, Entamoeba invadens
TGDPMHCASAFLTADSISHGI

SEQ ID NO: 2970280 - protein, 19 aa, Entamoeba invadens
TGDSLIAVGVMNVSKDTEY

SEQ ID NO: 2970281 - protein, 25 aa, Entamoeba invadens
TGDYFFYEMLYEFVDILNANKGLFF

SEQ ID NO: 2970282 - protein, 20 aa, Entamoeba invadens
TGEIDRFVRVCVNSMDGDID

SEQ ID NO: 2970283 - protein, 26 aa, Entamoeba invadens
TGEIQIKAAQIFKEYFQDELMTKSVF

SEQ ID NO: 2970284 - protein, 19 aa, Entamoeba invadens
TGELASMMKDLAFISCSSD

SEQ ID NO: 2970285 - protein, 21 aa, Entamoeba invadens
TGELKRLGKCDNYESEHDLEN

SEQ ID NO: 2970286 - protein, 27 aa, Entamoeba invadens
TGELMKSIFFCPPFWMRTSNDVFEEYL

SEQ ID NO: 2970287 - protein, 17 aa, Entamoeba invadens
TGENAFICQHCLEQENE

SEQ ID NO: 2970288 - protein, 19 aa, Entamoeba invadens
TGEPHFLSLESRQKLRNLA

SEQ ID NO: 2970289 - protein, 17 aa, Entamoeba invadens
TGEQACRFLRTLRKGKK

SEQ ID NO: 2970290 - protein, 17 aa, Entamoeba invadens
TGESFPTTFKLLTNDML

SEQ ID NO: 2970291 - protein, 19 aa, Entamoeba invadens
TGESQCIITVYLRNRGDGC

SEQ ID NO: 2970292 - protein, 20 aa, Entamoeba invadens
TGFFYGRRVVNSKFGANLTN

SEQ ID NO: 2970293 - protein, 17 aa, Entamoeba invadens
TGFGLEEVDRAFVTENL

SEQ ID NO: 2970294 - protein, 20 aa, Entamoeba invadens
TGFMCGKGIESLKSALQLFL

SEQ ID NO: 2970295 - protein, 22 aa, Entamoeba invadens
TGFQKRVLLVFNDVILLTKKEE

SEQ ID NO: 2970296 - protein, 23 aa, Entamoeba invadens
TGFSEQQLAYVINKFREKCAKRG

SEQ ID NO: 2970297 - protein, 21 aa, Entamoeba invadens
TGFYGCSNLQHIILPDNLLEL

SEQ ID NO: 2970298 - protein, 23 aa, Entamoeba invadens
TGFYGCSNLQHIVLPDNLLELNN

SEQ ID NO: 2970299 - protein, 17 aa, Entamoeba invadens
TGGKSPRNFFGKLKKQI

SEQ ID NO: 2970300 - protein, 21 aa, Entamoeba invadens
TGGTTKSRFEVTCTVKDLFVF

SEQ ID NO: 2970301 - protein, 17 aa, Entamoeba invadens
TGHCERMANDLANSIPS

SEQ ID NO: 2970302 - protein, 25 aa, Entamoeba invadens
TGHTLRFLSLPSFLRDLMQKVMKLQ

SEQ ID NO: 2970303 - protein, 17 aa, Entamoeba invadens
TGIKESVTVLCVNMLDR

SEQ ID NO: 2970304 - protein, 25 aa, Entamoeba invadens
TGIKIPQSVEWLGCYCFYRCQSLKS

SEQ ID NO: 2970305 - protein, 25 aa, Entamoeba invadens
TGINRMILKRAIPLYEKFVYHLAEY

SEQ ID NO: 2970306 - protein, 24 aa, Entamoeba invadens
TGINRMILKRAIPLYKKFVDHLKK

SEQ ID NO: 2970307 - protein, 24 aa, Entamoeba invadens
TGIRASMGRVMWCVKQKNSRLADT

SEQ ID NO: 2970308 - protein, 19 aa, Entamoeba invadens
TGKCKFKFQTGSQEQLHVD

SEQ ID NO: 2970309 - protein, 19 aa, Entamoeba invadens
TGKERMGSWLSKLLGKKDM

SEQ ID NO: 2970310 - protein, 21 aa, Entamoeba invadens
TGKESVRCVVPMGVDPAKYLP

SEQ ID NO: 2970311 - protein, 23 aa, Entamoeba invadens
TGKESYCSTYFVNQVMFHVAPLL

SEQ ID NO: 2970312 - protein, 19 aa, Entamoeba invadens
TGKIFAMKILDKKAVVETN

SEQ ID NO: 2970313 - protein, 22 aa, Entamoeba invadens
TGKKSLFGFYHLIFDELKSRKI

SEQ ID NO: 2970314 - protein, 17 aa, Entamoeba invadens
TGKLRQVLYVVSFDDTR

SEQ ID NO: 2970315 - protein, 25 aa, Entamoeba invadens
TGKNENCPVCDVLLNGPEHMNVTCD

SEQ ID NO: 2970316 - protein, 17 aa, Entamoeba invadens
TGKPLKLTKNSVWEYFV

SEQ ID NO: 2970317 - protein, 27 aa, Entamoeba invadens
TGKSVAMKLEKSWCTKNKTCAINTQDG

SEQ ID NO: 2970318 - protein, 18 aa, Entamoeba invadens
TGKSWRVAKRNSLLTEEE

SEQ ID NO: 2970319 - protein, 19 aa, Entamoeba invadens
TGKTYDLRVSICNNLEDSF

SEQ ID NO: 2970320 - protein, 26 aa, Entamoeba invadens
TGKVIRLSTFYKRGLKKMMVSNLVLQ

SEQ ID NO: 2970321 - protein, 23 aa, Entamoeba invadens
TGKVTCLYCRFDIDKKEKPKGHI

SEQ ID NO: 2970322 - protein, 17 aa, Entamoeba invadens
TGKWMKILLDYNRKDEH

SEQ ID NO: 2970323 - protein, 23 aa, Entamoeba invadens
TGLLSPRGVRIGVKRKQRTGNVS

SEQ ID NO: 2970324 - protein, 17 aa, Entamoeba invadens
TGLVLDFGSSISLKAVV

SEQ ID NO: 2970325 - protein, 24 aa, Entamoeba invadens
TGMGDFDSGIKIVRDILTDLYSGR

SEQ ID NO: 2970326 - protein, 20 aa, Entamoeba invadens
TGMHMRGFNGFNGFNGMQGV

SEQ ID NO: 2970327 - protein, 17 aa, Entamoeba invadens
TGNAFSFSPQSRVAPLD

SEQ ID NO: 2970328 - protein, 24 aa, Entamoeba invadens
TGNCKLVPFFFMPHEKFYTLLFPI

SEQ ID NO: 2970329 - protein, 17 aa, Entamoeba invadens
TGNCLQMADWLSTLQNM

SEQ ID NO: 2970330 - protein, 25 aa, Entamoeba invadens
TGNFYRLKKVLSFEGKILNECPFQL

SEQ ID NO: 2970331 - protein, 29 aa, Entamoeba invadens
TGNKRCMDCQAIGPVYVVINFGTFVCQTC

SEQ ID NO: 2970332 - protein, 24 aa, Entamoeba invadens
TGNLINRLLCSKLSECRVVTLQAA

SEQ ID NO: 2970333 - protein, 21 aa, Entamoeba invadens
TGNVCALIRWNGGEKREVIPF

SEQ ID NO: 2970334 - protein, 23 aa, Entamoeba invadens
TGNYKNFFSFFAPPQQRENELPD

SEQ ID NO: 2970335 - protein, 30 aa, Entamoeba invadens
TGPEFLLTIIPIMWRFYRNPTISVDTKFNV

SEQ ID NO: 2970336 - protein, 22 aa, Entamoeba invadens
TGQVQFCLKKKALMGGDAVVRA

SEQ ID NO: 2970337 - protein, 17 aa, Entamoeba invadens
TGRFEIVRCKKLEKVIF

SEQ ID NO: 2970338 - protein, 21 aa, Entamoeba invadens
TGRIGMKGIALSFLDPSQKKE

SEQ ID NO: 2970339 - protein, 20 aa, Entamoeba invadens
TGRQWAVGRGYTYVETSAAT

SEQ ID NO: 2970340 - protein, 21 aa, Entamoeba invadens
TGSATAFCLVKGNNMFERDSF

SEQ ID NO: 2970341 - protein, 17 aa, Entamoeba invadens
TGSDCRLESVVKTSFST

SEQ ID NO: 2970342 - protein, 24 aa, Entamoeba invadens
TGSGCLSAAFASRLQFGEVRGKGH

SEQ ID NO: 2970343 - protein, 28 aa, Entamoeba invadens
TGSVFVLRVKFRIRKGVEERLWVEKTYF

SEQ ID NO: 2970344 - protein, 19 aa, Entamoeba invadens
TGTGAFTFSLKKEVLTFTI

SEQ ID NO: 2970345 - protein, 25 aa, Entamoeba invadens
TGTHLKSKRFAHCITKQRLFCCKVD

SEQ ID NO: 2970346 - protein, 22 aa, Entamoeba invadens
TGTTICGLICNHGEAVVVACDS

SEQ ID NO: 2970347 - protein, 18 aa, Entamoeba invadens
TGVACRATIIVNPDNIVK

SEQ ID NO: 2970348 - protein, 26 aa, Entamoeba invadens
TGVDMKFVAQEAFVDWISEHYKDFGT

SEQ ID NO: 2970349 - protein, 18 aa, Entamoeba invadens
TGVESVVSYGKRPGSRYR

SEQ ID NO: 2970350 - protein, 18 aa, Entamoeba invadens
TGVFCIDDFVFKHGSHTQ

SEQ ID NO: 2970351 - protein, 18 aa, Entamoeba invadens
TGVLILFSVEVMDPNTQQ

SEQ ID NO: 2970352 - protein, 24 aa, Entamoeba invadens
TGVLKRVLPTKVYFIGKNGGEIDL

SEQ ID NO: 2970353 - protein, 19 aa, Entamoeba invadens
TGVQQCWAAHLIGHEITTY

SEQ ID NO: 2970354 - protein, 18 aa, Entamoeba invadens
TGVWKLKIFDAPWENKDN

SEQ ID NO: 2970355 - protein, 24 aa, Entamoeba invadens
TGYCKSCLSNYVFVSATSLVCESC

SEQ ID NO: 2970356 - protein, 19 aa, Entamoeba invadens
TGYEFKRKLTTESDQSLNR

SEQ ID NO: 2970357 - protein, 24 aa, Entamoeba invadens
TGYMKCVWASKLERCTLILQEHLE

SEQ ID NO: 2970358 - protein, 19 aa, Entamoeba invadens
TGYSFGAYFSEIIDNPANN

SEQ ID NO: 2970359 - protein, 20 aa, Entamoeba invadens
THATEIMECLTLQQQMKLLR

SEQ ID NO: 2970360 - protein, 18 aa, Entamoeba invadens
THCKSIMDLNSFGINEFS

SEQ ID NO: 2970361 - protein, 19 aa, Entamoeba invadens
THCLTCKTTSYFLNKENKC

SEQ ID NO: 2970362 - protein, 19 aa, Entamoeba invadens
THDGLKHYFDALVATSIFG

SEQ ID NO: 2970363 - protein, 18 aa, Entamoeba invadens
THDLTLKYRYEDVNALCF

SEQ ID NO: 2970364 - protein, 18 aa, Entamoeba invadens
THEDALKAKNEFTGKEVD

SEQ ID NO: 2970365 - protein, 23 aa, Entamoeba invadens
THEELMRMKGFYHVLATQQCENS

SEQ ID NO: 2970366 - protein, 28 aa, Entamoeba invadens
THEILSIADLRKIEEWTSMKATDVIFDS

SEQ ID NO: 2970367 - protein, 24 aa, Entamoeba invadens
THELAGGAKIFSVFESQFSPNIDG

SEQ ID NO: 2970368 - protein, 27 aa, Entamoeba invadens
THESGCHWCLSFAWKNVDLEYFMYKIA

SEQ ID NO: 2970369 - protein, 23 aa, Entamoeba invadens
THFCYLGNGYFCMDGYSNRFQQL

SEQ ID NO: 2970370 - protein, 17 aa, Entamoeba invadens
THFGLKETLSFSSKGCA

SEQ ID NO: 2970371 - protein, 23 aa, Entamoeba invadens
THFKDIKSGVLYIDNKSVNGASV

SEQ ID NO: 2970372 - protein, 17 aa, Entamoeba invadens
THFPIEVCACPLQTLSL

SEQ ID NO: 2970373 - protein, 19 aa, Entamoeba invadens
THFRTLRYNKYIQTHPHYT

SEQ ID NO: 2970374 - protein, 25 aa, Entamoeba invadens
THFSQADAVAICFAIDPKESFETKE

SEQ ID NO: 2970375 - protein, 24 aa, Entamoeba invadens
THFSQADAVAICFAIDSKESFESV

SEQ ID NO: 2970376 - protein, 26 aa, Entamoeba invadens
THFTEYCVLCYILALSKAEDLNNRIK

SEQ ID NO: 2970377 - protein, 26 aa, Entamoeba invadens
THFTEYCVLCYILALSKSEDIYHNFH

SEQ ID NO: 2970378 - protein, 17 aa, Entamoeba invadens
THGDLKPGNILRERETM

SEQ ID NO: 2970379 - protein, 21 aa, Entamoeba invadens
THGKPWLRVNPNYKEINVKKA

SEQ ID NO: 2970380 - protein, 23 aa, Entamoeba invadens
THGLKIVCGGVKMFKKHKSELVE

SEQ ID NO: 2970381 - protein, 24 aa, Entamoeba invadens
THHEELRLSWQQFYEHPYVLEAMK

SEQ ID NO: 2970382 - protein, 17 aa, Entamoeba invadens
THHHLLFGENYIQELHE

SEQ ID NO: 2970383 - protein, 26 aa, Entamoeba invadens
THHMLTDLLFEYGYLFETYFTSGKNN

SEQ ID NO: 2970384 - protein, 24 aa, Entamoeba invadens
THHPEKYTGVLLKNILDDLSDTIT

SEQ ID NO: 2970385 - protein, 28 aa, Entamoeba invadens
THIAFVCRETLQALNFIHNLNCIHRDIK

SEQ ID NO: 2970386 - protein, 17 aa, Entamoeba invadens
THIIAMRLLHFSFANTF

SEQ ID NO: 2970387 - protein, 18 aa, Entamoeba invadens
THIKRDPNRMGIIDCSLR

SEQ ID NO: 2970388 - protein, 30 aa, Entamoeba invadens
THIKRKHVVEIFKPGKFCLTHMKAAEMYCY

SEQ ID NO: 2970389 - protein, 17 aa, Entamoeba invadens
THIRICKTVSDKVLELK

SEQ ID NO: 2970390 - protein, 24 aa, Entamoeba invadens
THISKFAFKNCISLTSFNSESVLL

SEQ ID NO: 2970391 - protein, 18 aa, Entamoeba invadens
THITELYHSCFYNNTTLT

SEQ ID NO: 2970392 - protein, 22 aa, Entamoeba invadens
THKCSACKSGYTLNSYNRCVAK

SEQ ID NO: 2970393 - protein, 29 aa, Entamoeba invadens
THKELRFPKDSKFRECTIECFLCRCRNPF

SEQ ID NO: 2970394 - protein, 25 aa, Entamoeba invadens
THKIFKPKIIELFLKKSTLQKLKNI

SEQ ID NO: 2970395 - protein, 20 aa, Entamoeba invadens
THKMYYPFTCNSILLYSSDL

SEQ ID NO: 2970396 - protein, 22 aa, Entamoeba invadens
THKRINVLYSHMVDTNNRYIGY

SEQ ID NO: 2970397 - protein, 18 aa, Entamoeba invadens
THLAMPFGGTISADDYEA

SEQ ID NO: 2970398 - protein, 18 aa, Entamoeba invadens
THLCVSLDLLDNFKNVQN

SEQ ID NO: 2970399 - protein, 19 aa, Entamoeba invadens
THLECSFCKASNDFSEPFT

SEQ ID NO: 2970400 - protein, 23 aa, Entamoeba invadens
THLEIIQMFAFENCTSLSHLEMP

SEQ ID NO: 2970401 - protein, 17 aa, Entamoeba invadens
THLELALNQFYRVAYLS

SEQ ID NO: 2970402 - protein, 18 aa, Entamoeba invadens
THLFYIIDYCSGGEFYFY

SEQ ID NO: 2970403 - protein, 18 aa, Entamoeba invadens
THLIDFPSIVLKGTEMAL

SEQ ID NO: 2970404 - protein, 26 aa, Entamoeba invadens
THLQALFFPDFFLRKTERNLRHTSAY

SEQ ID NO: 2970405 - protein, 18 aa, Entamoeba invadens
THLQHCRSAPQTLVDISN

SEQ ID NO: 2970406 - protein, 24 aa, Entamoeba invadens
THMKRVCDEIENFGSVKLIDEASR

SEQ ID NO: 2970407 - protein, 17 aa, Entamoeba invadens
THNLIFLGDYVDRGTFS

SEQ ID NO: 2970408 - protein, 30 aa, Entamoeba invadens
THNLLREIIDWEAAPAYSASPMSWDYDDNE

SEQ ID NO: 2970409 - protein, 30 aa, Entamoeba invadens
THPDYRLRVTVSLPAFDFGLSIRIDGMSLT

SEQ ID NO: 2970410 - protein, 19 aa, Entamoeba invadens
THPELCKPYPYPIECVLQK

SEQ ID NO: 2970411 - protein, 17 aa, Entamoeba invadens
THPILPVLPHDSMTRQF

SEQ ID NO: 2970412 - protein, 17 aa, Entamoeba invadens
THPKELDEFLLFEKFKL

SEQ ID NO: 2970413 - protein, 21 aa, Entamoeba invadens
THPMFRYLKKNHQILSDALKL

SEQ ID NO: 2970414 - protein, 29 aa, Entamoeba invadens
THPTIQLALNIKKAFVVGDYFTFFNLYTT

SEQ ID NO: 2970415 - protein, 17 aa, Entamoeba invadens
THQIGGVVFSRFDIHPN

SEQ ID NO: 2970416 - protein, 23 aa, Entamoeba invadens
THQQMLFEYPKYINTDNTVTREQ

SEQ ID NO: 2970417 - protein, 18 aa, Entamoeba invadens
THRESPYFGEKNVCTDCI

SEQ ID NO: 2970418 - protein, 19 aa, Entamoeba invadens
THRLCLQKWVELLKLLTDK

SEQ ID NO: 2970419 - protein, 23 aa, Entamoeba invadens
THRYDECRVLLSPMTQTEQTVNL

SEQ ID NO: 2970420 - protein, 22 aa, Entamoeba invadens
THSFGGNMIFNLMKYFGDEFCK

SEQ ID NO: 2970421 - protein, 30 aa, Entamoeba invadens
THSFTLKCSPKFFFEFVTKYEQSGGCIALF

SEQ ID NO: 2970422 - protein, 17 aa, Entamoeba invadens
THSMCTLEFLPRRESYF

SEQ ID NO: 2970423 - protein, 22 aa, Entamoeba invadens
THTDSVIDLCWLPGDKFLISVS

SEQ ID NO: 2970424 - protein, 24 aa, Entamoeba invadens
THTKRRLLCMASSNSATDVLQTYL

SEQ ID NO: 2970425 - protein, 19 aa, Entamoeba invadens
THVEIIMRKSVLKLMETEF

SEQ ID NO: 2970426 - protein, 23 aa, Entamoeba invadens
THVKGALAAFEVFIRNAEKIFES

SEQ ID NO: 2970427 - protein, 18 aa, Entamoeba invadens
THVKNVFVTFTLQASESL

SEQ ID NO: 2970428 - protein, 24 aa, Entamoeba invadens
THVLEGCTVDCTLVYDNVGLTEVH

SEQ ID NO: 2970429 - protein, 17 aa, Entamoeba invadens
THVPYGGLLCIFDQFLV

SEQ ID NO: 2970430 - protein, 22 aa, Entamoeba invadens
THVWCNGVVIFANYTKEVYEMD

SEQ ID NO: 2970431 - protein, 18 aa, Entamoeba invadens
THWEYSGNVIKRNYFHDS

SEQ ID NO: 2970432 - protein, 21 aa, Entamoeba invadens
THYHQLCEEFGDRGDVKLSHM

SEQ ID NO: 2970433 - protein, 25 aa, Entamoeba invadens
THYLPKRMEYPNAMIKGYVESKIDD

SEQ ID NO: 2970434 - protein, 21 aa, Entamoeba invadens
TIADCLELLLIRQNDGEEKGK

SEQ ID NO: 2970435 - protein, 27 aa, Entamoeba invadens
TIAGLRKGKKMAVVLVGNKCDLEAQRA

SEQ ID NO: 2970436 - protein, 27 aa, Entamoeba invadens
TIAIVLLNMWKCEQMSLNFPINLESEK

SEQ ID NO: 2970437 - protein, 19 aa, Entamoeba invadens
TICDIKILPILNVGDSITM

SEQ ID NO: 2970438 - protein, 19 aa, Entamoeba invadens
TICDNFDLCLECFSQGKEV

SEQ ID NO: 2970439 - protein, 22 aa, Entamoeba invadens
TICNLFCTRVTIEKCSEITVTL

SEQ ID NO: 2970440 - protein, 18 aa, Entamoeba invadens
TICNLLWTLVTLKYPDDK

SEQ ID NO: 2970441 - protein, 27 aa, Entamoeba invadens
TICNNFLCAFLLIRIRLEGISPALPFC

SEQ ID NO: 2970442 - protein, 19 aa, Entamoeba invadens
TICPLCTTGKPLKFTEVVK

SEQ ID NO: 2970443 - protein, 18 aa, Entamoeba invadens
TICSCVIESGVLVKKQML

SEQ ID NO: 2970444 - protein, 25 aa, Entamoeba invadens
TICTECKDGFYLKDSTCLPCTVTNC

SEQ ID NO: 2970445 - protein, 31 aa, Entamoeba invadens
TIDDIQPRFALFAAHYRYVFLSYDQSLETDI

SEQ ID NO: 2970446 - protein, 19 aa, Entamoeba invadens
TIDEIFKQREKFVARRVEN

SEQ ID NO: 2970447 - protein, 24 aa, Entamoeba invadens
TIDLKGSELFKDINSYDVIILLDE

SEQ ID NO: 2970448 - protein, 17 aa, Entamoeba invadens
TIDMVAPQLCIRKFVTV

SEQ ID NO: 2970449 - protein, 28 aa, Entamoeba invadens
TIDRPCLFGHLYNCEHNFVFADARIPTQ

SEQ ID NO: 2970450 - protein, 25 aa, Entamoeba invadens
TIDTRPTFISAYLLKMPVLEFKDKT

SEQ ID NO: 2970451 - protein, 18 aa, Entamoeba invadens
TIEEAYCGCTKIVTDVSK

SEQ ID NO: 2970452 - protein, 24 aa, Entamoeba invadens
TIEFLKNHITSVILLQMNSKIKTP

SEQ ID NO: 2970453 - protein, 24 aa, Entamoeba invadens
TIEGFLVLIQREWISAGHRFSLRT

SEQ ID NO: 2970454 - protein, 24 aa, Entamoeba invadens
TIEGFLVLIQREWVAMGHRFTLRT

SEQ ID NO: 2970455 - protein, 19 aa, Entamoeba invadens
TIEGFQVLIDKEWIAFGHK

SEQ ID NO: 2970456 - protein, 20 aa, Entamoeba invadens
TIEGLYRIVAHLLDENIPLP

SEQ ID NO: 2970457 - protein, 19 aa, Entamoeba invadens
TIEGLYRIVAHLLDGNIPL

SEQ ID NO: 2970458 - protein, 21 aa, Entamoeba invadens
TIEGLYRIVAHVFDNSVNLPV

SEQ ID NO: 2970459 - protein, 18 aa, Entamoeba invadens
TIEKCFYDELLVVTIMKI

SEQ ID NO: 2970460 - protein, 27 aa, Entamoeba invadens
TIEKLRRWILCSSQMFSLFGGDWRRSI

SEQ ID NO: 2970461 - protein, 24 aa, Entamoeba invadens
TIEKRKKYDPKRVLKQFIETNTLD

SEQ ID NO: 2970462 - protein, 19 aa, Entamoeba invadens
TIENCYRKTLTVDNRICVL

SEQ ID NO: 2970463 - protein, 20 aa, Entamoeba invadens
TIENCYRKTLTVDNRICVLD

SEQ ID NO: 2970464 - protein, 17 aa, Entamoeba invadens
TIENSEFEYLLWESLFD

SEQ ID NO: 2970465 - protein, 26 aa, Entamoeba invadens
TIEYLKAFIPRWANISSEVTYYITNL

SEQ ID NO: 2970466 - protein, 29 aa, Entamoeba invadens
TIFDLWRRTKFPYSRVYEALLVLLHHGIL

SEQ ID NO: 2970467 - protein, 20 aa, Entamoeba invadens
TIFEIPSAFHLVNMRTDVFN

SEQ ID NO: 2970468 - protein, 18 aa, Entamoeba invadens
TIFGNDVFEGCVSLESIL

SEQ ID NO: 2970469 - protein, 18 aa, Entamoeba invadens
TIFLKKKIYITIMSCYNF

SEQ ID NO: 2970470 - protein, 35 aa, Entamoeba invadens
TIFPNTRLYCFNNYFIFSIRILKFENVYILQNMEF

SEQ ID NO: 2970471 - protein, 23 aa, Entamoeba invadens
TIFRNMVGKVMCYMRFSTEQTLY

SEQ ID NO: 2970472 - protein, 20 aa, Entamoeba invadens
TIGASYEFLEPNAPKYEVLF

SEQ ID NO: 2970473 - protein, 24 aa, Entamoeba invadens
TIGEKCFYCCVELSAITLGEVLSV

SEQ ID NO: 2970474 - protein, 19 aa, Entamoeba invadens
TIGGLWLLEIDPIGDVVHD

SEQ ID NO: 2970475 - protein, 23 aa, Entamoeba invadens
TIGKIKPNFVYRNTQKKFVEKSK

SEQ ID NO: 2970476 - protein, 18 aa, Entamoeba invadens
TIGQFAFSFCNNIQNLYI

SEQ ID NO: 2970477 - protein, 17 aa, Entamoeba invadens
TIGSFCYQQMLFDSFEV

SEQ ID NO: 2970478 - protein, 18 aa, Entamoeba invadens
TIGTLSMEIVTEVTTSLN

SEQ ID NO: 2970479 - protein, 20 aa, Entamoeba invadens
TIGVLKCMRSGCPSCLCLDV

SEQ ID NO: 2970480 - protein, 19 aa, Entamoeba invadens
TIHCIRPTHSFTIKVVHKE

SEQ ID NO: 2970481 - protein, 19 aa, Entamoeba invadens
TIHQFKLCCKRNEKESALK

SEQ ID NO: 2970482 - protein, 24 aa, Entamoeba invadens
TIHTWYQFRNWERSQRRTAAKDKE

SEQ ID NO: 2970483 - protein, 29 aa, Entamoeba invadens
TIHTWYQFRNWVWFRLFQKVRPTLKRRRV

SEQ ID NO: 2970484 - protein, 31 aa, Entamoeba invadens
TIHTWYQFRNWVWFRLFQKVRPTLKRRRVDE

SEQ ID NO: 2970485 - protein, 28 aa, Entamoeba invadens
TIHTWYQFRNWVWFRLLQKVQPTLKRRR

SEQ ID NO: 2970486 - protein, 18 aa, Entamoeba invadens
TIIGEFISLQAFNPNTKF

SEQ ID NO: 2970487 - protein, 20 aa, Entamoeba invadens
TIIISRNVFYFEVTFDKIEP

SEQ ID NO: 2970488 - protein, 26 aa, Entamoeba invadens
TIILNPHFCKLIAWYDNEWGYSTRLV

SEQ ID NO: 2970489 - protein, 22 aa, Entamoeba invadens
TIINGIVCHGGFAIRKACDMVR

SEQ ID NO: 2970490 - protein, 17 aa, Entamoeba invadens
TIIQLPIQIMFSTNNCK

SEQ ID NO: 2970491 - protein, 25 aa, Entamoeba invadens
TIKAISSAFPLVFISKCFKNLETAE

SEQ ID NO: 2970492 - protein, 23 aa, Entamoeba invadens
TIKALKVSPVFINTISYVWFTKH

SEQ ID NO: 2970493 - protein, 18 aa, Entamoeba invadens
TIKCVATAMAVYKRDVWM

SEQ ID NO: 2970494 - protein, 23 aa, Entamoeba invadens
TIKEIDFSYSLLKTLPKSFMLLT

SEQ ID NO: 2970495 - protein, 23 aa, Entamoeba invadens
TIKEINFSYSLLKTLPKSFMSLI

SEQ ID NO: 2970496 - protein, 24 aa, Entamoeba invadens
TIKMLSCKTGSFGSSTLERMNTTK

SEQ ID NO: 2970497 - protein, 22 aa, Entamoeba invadens
TIKNETLGICQWSQNEQQILED

SEQ ID NO: 2970498 - protein, 21 aa, Entamoeba invadens
TIKNFYCCQLGTFPDKYEQDW

SEQ ID NO: 2970499 - protein, 19 aa, Entamoeba invadens
TIKQLAVLMRVWSTSDFGS

SEQ ID NO: 2970500 - protein, 19 aa, Entamoeba invadens
TIKQLKLCSEQQVDDALSR

SEQ ID NO: 2970501 - protein, 18 aa, Entamoeba invadens
TIKRCILMSHAAFSRDIL

SEQ ID NO: 2970502 - protein, 25 aa, Entamoeba invadens
TIKTYSLKFSRLCTDADGTWQKKES

SEQ ID NO: 2970503 - protein, 20 aa, Entamoeba invadens
TILDLCKQFLLNISSMEKTP

SEQ ID NO: 2970504 - protein, 23 aa, Entamoeba invadens
TILDVKGSFVIGGKNAGTTTLTC

SEQ ID NO: 2970505 - protein, 17 aa, Entamoeba invadens
TILEPLTFNSVRESTQT

SEQ ID NO: 2970506 - protein, 24 aa, Entamoeba invadens
TILIGSSIGHVFLFSKNEGYKSDT

SEQ ID NO: 2970507 - protein, 27 aa, Entamoeba invadens
TILKNYKFPVTFLIRGFVLLVNESKGL

SEQ ID NO: 2970508 - protein, 27 aa, Entamoeba invadens
TILKVCDGMRKMGYAKRNLEDIIQVIT

SEQ ID NO: 2970509 - protein, 25 aa, Entamoeba invadens
TILLEKSIPCGSLMCAVIPQKTFRI

SEQ ID NO: 2970510 - protein, 31 aa, Entamoeba invadens
TILQRIKMVLKYMYPDGIYDYNILKEDYIRF

SEQ ID NO: 2970511 - protein, 25 aa, Entamoeba invadens
TILRPINKNALFRLDIRSIGINRQD

SEQ ID NO: 2970512 - protein, 18 aa, Entamoeba invadens
TILSEMWKKLDPLEKNRY

SEQ ID NO: 2970513 - protein, 18 aa, Entamoeba invadens
TIMSCYNFEECVHKLLNL

SEQ ID NO: 2970514 - protein, 32 aa, Entamoeba invadens
TIMTIPYKCFSMCVRLQFLYIPKGITTIGENA

SEQ ID NO: 2970515 - protein, 23 aa, Entamoeba invadens
TINEFKSGVGKTVMVATSVCARG

SEQ ID NO: 2970516 - protein, 27 aa, Entamoeba invadens
TINFQYKIPEWFLKMLTITSKQDRGPK

SEQ ID NO: 2970517 - protein, 33 aa, Entamoeba invadens
TINGKSCSSVRCGRANVATFLPGGRFVAIGTLG

SEQ ID NO: 2970518 - protein, 23 aa, Entamoeba invadens
TINLGCLFNLPGYPVQKLDYAEV

SEQ ID NO: 2970519 - protein, 25 aa, Entamoeba invadens
TINLPRLGIKYGICEGKREVCELEN

SEQ ID NO: 2970520 - protein, 20 aa, Entamoeba invadens
TINTLHFFSQIFGMGDKELV

SEQ ID NO: 2970521 - protein, 22 aa, Entamoeba invadens
TIPDLCFEGCASLKEINLKNVS

SEQ ID NO: 2970522 - protein, 24 aa, Entamoeba invadens
TIPHPQELKWFYSVTDNLQAPLQE

SEQ ID NO: 2970523 - protein, 20 aa, Entamoeba invadens
TIPIALNMRDIIGLAETGTG

SEQ ID NO: 2970524 - protein, 24 aa, Entamoeba invadens
TIPKNLKSLYVFGGTIQIANTKTF

SEQ ID NO: 2970525 - protein, 24 aa, Entamoeba invadens
TIPLSVTSFSDWCFIGCSSLSSMI

SEQ ID NO: 2970526 - protein, 28 aa, Entamoeba invadens
TIPLSVTSIIDWCFYECISLSSITIPPS

SEQ ID NO: 2970527 - protein, 31 aa, Entamoeba invadens
TIPNEFIRFNVLRLLGVLICLKPQNCLKNVS

SEQ ID NO: 2970528 - protein, 19 aa, Entamoeba invadens
TIPSQLKYVGYWSSLLLAH

SEQ ID NO: 2970529 - protein, 18 aa, Entamoeba invadens
TIPSSVKSIGDWCFSGCS

SEQ ID NO: 2970530 - protein, 25 aa, Entamoeba invadens
TIPSSVKSLGKWCFASCTNLTSADI

SEQ ID NO: 2970531 - protein, 23 aa, Entamoeba invadens
TIPVNRFGAKKVVDGKFELVDGL

SEQ ID NO: 2970532 - protein, 22 aa, Entamoeba invadens
TIPVSEDMLGRVFNGSGKPVDK

SEQ ID NO: 2970533 - protein, 25 aa, Entamoeba invadens
TIPVTIRYIGDRVFKSCKKLKGVVI

SEQ ID NO: 2970534 - protein, 23 aa, Entamoeba invadens
TIQEMPQLKGLVLNNNKITRIPK

SEQ ID NO: 2970535 - protein, 24 aa, Entamoeba invadens
TIQMAKCAFICISLDDKEQLKTAK

SEQ ID NO: 2970536 - protein, 29 aa, Entamoeba invadens
TIQPFNFELFWKLHEFFIQYFDYFDKNIG

SEQ ID NO: 2970537 - protein, 20 aa, Entamoeba invadens
TIQTALRIAKMKGMAERAKA

SEQ ID NO: 2970538 - protein, 21 aa, Entamoeba invadens
TIRCFKTIGEYAGEKPASLTY

SEQ ID NO: 2970539 - protein, 18 aa, Entamoeba invadens
TIRIEGFDFERIIDDFIF

SEQ ID NO: 2970540 - protein, 23 aa, Entamoeba invadens
TIRIIPEGVFPHYSQIEINESEE

SEQ ID NO: 2970541 - protein, 24 aa, Entamoeba invadens
TIRRACFLKEIIVEINVDQVAVNF

SEQ ID NO: 2970542 - protein, 22 aa, Entamoeba invadens
TIRRRAIEVLYSLCTPESVRKV

SEQ ID NO: 2970543 - protein, 19 aa, Entamoeba invadens
TIRVWNWMSRQCVLLLPGH

SEQ ID NO: 2970544 - protein, 20 aa, Entamoeba invadens
TIRYQEGSKIIFVVKKKEKS

SEQ ID NO: 2970545 - protein, 22 aa, Entamoeba invadens
TISAIGNFCFAYCSSLEIVNLP

SEQ ID NO: 2970546 - protein, 21 aa, Entamoeba invadens
TISALSDRVPEMFLSNKNLFV

SEQ ID NO: 2970547 - protein, 28 aa, Entamoeba invadens
TISEQEFRLGMVEFYKFGPLNSKAQAIV

SEQ ID NO: 2970548 - protein, 24 aa, Entamoeba invadens
TISESCFKCCAMLSSVKFPLHLLS

SEQ ID NO: 2970549 - protein, 18 aa, Entamoeba invadens
TISIGIDFGTSKIAISFC

SEQ ID NO: 2970550 - protein, 17 aa, Entamoeba invadens
TISIGIDFGTSKLAISY

SEQ ID NO: 2970551 - protein, 26 aa, Entamoeba invadens
TISKLLRYFFHFSKGTCPYIVEYNSN

SEQ ID NO: 2970552 - protein, 29 aa, Entamoeba invadens
TISQCKGCKKFLAGTTWFYCEPESKELMT

SEQ ID NO: 2970553 - protein, 25 aa, Entamoeba invadens
TISYKLPKPLGLIISQKQVETYNDI

SEQ ID NO: 2970554 - protein, 22 aa, Entamoeba invadens
TITCDIRILVLSSQHEDMLFKV

SEQ ID NO: 2970555 - protein, 30 aa, Entamoeba invadens
TITCECCCEGCKCTCECKCGEKKVCQCQKE

SEQ ID NO: 2970556 - protein, 23 aa, Entamoeba invadens
TITKLLRKSFDWLKSIKDSQIDQ

SEQ ID NO: 2970557 - protein, 25 aa, Entamoeba invadens
TITKQEIIHVLSLLESVKIIKKVMI

SEQ ID NO: 2970558 - protein, 25 aa, Entamoeba invadens
TITLPLVRPELFFSKLTQGAKGVLL

SEQ ID NO: 2970559 - protein, 23 aa, Entamoeba invadens
TITRCFRRHGAVSIDTPVFELKD

SEQ ID NO: 2970560 - protein, 17 aa, Entamoeba invadens
TITSIGYGSFWNCDFLT

SEQ ID NO: 2970561 - protein, 19 aa, Entamoeba invadens
TITSRPVNCQVDFNARKHS

SEQ ID NO: 2970562 - protein, 25 aa, Entamoeba invadens
TIVGFKQLLDKGLITQIAFETLVEN

SEQ ID NO: 2970563 - protein, 18 aa, Entamoeba invadens
TIVGHGFSFGLSSFNNYP

SEQ ID NO: 2970564 - protein, 18 aa, Entamoeba invadens
TIVKEFKNSGLLTPLEEI

SEQ ID NO: 2970565 - protein, 22 aa, Entamoeba invadens
TIVLKCFDFLKNITSIGEVSME

SEQ ID NO: 2970566 - protein, 20 aa, Entamoeba invadens
TIVLRFKNIIFPKQDDEIQI

SEQ ID NO: 2970567 - protein, 30 aa, Entamoeba invadens
TIVMFLRKFMRQIECIVSYYMDPMVSYAKQ

SEQ ID NO: 2970568 - protein, 18 aa, Entamoeba invadens
TIVNGIVCHGGFATRKAC

SEQ ID NO: 2970569 - protein, 18 aa, Entamoeba invadens
TIVSGKALIRVCYDEREK

SEQ ID NO: 2970570 - protein, 24 aa, Entamoeba invadens
TIVSLGNFCFWNCKNLKEVVLSEF

SEQ ID NO: 2970571 - protein, 17 aa, Entamoeba invadens
TIWCAGEYFDLLKEVIP

SEQ ID NO: 2970572 - protein, 27 aa, Entamoeba invadens
TIYELLSAYCMPFLLYKQTILVNRDLL

SEQ ID NO: 2970573 - protein, 30 aa, Entamoeba invadens
TIYFQWEWEEEKGFLFSSSWTPYHRNENQQ

SEQ ID NO: 2970574 - protein, 17 aa, Entamoeba invadens
TIYPINFINSSQMQNEQ

SEQ ID NO: 2970575 - protein, 20 aa, Entamoeba invadens
TIYRCTPFNRGIHTSISGEV

SEQ ID NO: 2970576 - protein, 19 aa, Entamoeba invadens
TKAARECRSHYLQYYLETP

SEQ ID NO: 2970577 - protein, 25 aa, Entamoeba invadens
TKADVWSAGVMMYALLTFKFPFEGG

SEQ ID NO: 2970578 - protein, 18 aa, Entamoeba invadens
TKAKMSCKSPFCETPAHV

SEQ ID NO: 2970579 - protein, 43 aa, Entamoeba invadens
TKAKRNSTNFTILYIHSCVNYLVSQCGYTFVFLNEKRKAEKMY

SEQ ID NO: 2970580 - protein, 18 aa, Entamoeba invadens
TKALLYLVLIFQLTIFTD

SEQ ID NO: 2970581 - protein, 24 aa, Entamoeba invadens
TKALPPKAARFCVYDLHYTQVNGK

SEQ ID NO: 2970582 - protein, 24 aa, Entamoeba invadens
TKALSPKAARFCVYDLHYTQVNGK

SEQ ID NO: 2970583 - protein, 21 aa, Entamoeba invadens
TKALTTFRLFNDVAVPVILLS

SEQ ID NO: 2970584 - protein, 17 aa, Entamoeba invadens
TKALYDYTAETDDELSF

SEQ ID NO: 2970585 - protein, 18 aa, Entamoeba invadens
TKAMIQLYHKVMEAKNQN

SEQ ID NO: 2970586 - protein, 25 aa, Entamoeba invadens
TKANPKCAVSICSTPPIFTLLSEHK

SEQ ID NO: 2970587 - protein, 19 aa, Entamoeba invadens
TKAQISALIWKKKEEKGVE

SEQ ID NO: 2970588 - protein, 20 aa, Entamoeba invadens
TKAQISALIWKKKEEKGVEG

SEQ ID NO: 2970589 - protein, 22 aa, Entamoeba invadens
TKARCLQLRYEYNLYKVLMENG

SEQ ID NO: 2970590 - protein, 32 aa, Entamoeba invadens
TKARQNAPCVIFFDEIDGMLGVASERGKVGYG

SEQ ID NO: 2970591 - protein, 19 aa, Entamoeba invadens
TKASGFFIGPFIMEMGGNV

SEQ ID NO: 2970592 - protein, 24 aa, Entamoeba invadens
TKCDKWKLPPMLKEEVERMKKWRQ

SEQ ID NO: 2970593 - protein, 18 aa, Entamoeba invadens
TKCEEMKEEYEKRNISHD

SEQ ID NO: 2970594 - protein, 22 aa, Entamoeba invadens
TKCGKYPFYDVFSIEHVSAFSS

SEQ ID NO: 2970595 - protein, 17 aa, Entamoeba invadens
TKCGTIVHTTCRDKAYT

SEQ ID NO: 2970596 - protein, 25 aa, Entamoeba invadens
TKCGTPEYFCPEIVRGKAYDESLDQ

SEQ ID NO: 2970597 - protein, 24 aa, Entamoeba invadens
TKCMLCGKQFCCFERRHHCRFCGK

SEQ ID NO: 2970598 - protein, 17 aa, Entamoeba invadens
TKCPVYCLVDFDPCGLD

SEQ ID NO: 2970599 - protein, 24 aa, Entamoeba invadens
TKCSCAVIGKRIRMSDELKRMQAK

SEQ ID NO: 2970600 - protein, 18 aa, Entamoeba invadens
TKCSSFSNIGLRSIILQK

SEQ ID NO: 2970601 - protein, 25 aa, Entamoeba invadens
TKDATLRGCFEVVDMKRSYEKTGVK

SEQ ID NO: 2970602 - protein, 20 aa, Entamoeba invadens
TKDESLHFGDTLMNAAKKNQ

SEQ ID NO: 2970603 - protein, 22 aa, Entamoeba invadens
TKDFKGLYSLKFVNVKCEGLQI

SEQ ID NO: 2970604 - protein, 17 aa, Entamoeba invadens
TKDGAMYTIVNWNILFK

SEQ ID NO: 2970605 - protein, 21 aa, Entamoeba invadens
TKDGTKGVCGLRNLGNTCFMN

SEQ ID NO: 2970606 - protein, 25 aa, Entamoeba invadens
TKDLFKFPWKIAEYVIAGNRPIQNK

SEQ ID NO: 2970607 - protein, 22 aa, Entamoeba invadens
TKDNQCFTFSFSDNQRTRRVIN

SEQ ID NO: 2970608 - protein, 25 aa, Entamoeba invadens
TKDPHPSRHWHYFFDHKSVLNDIKQ

SEQ ID NO: 2970609 - protein, 18 aa, Entamoeba invadens
TKDQVFHRLMFHSIFTKC

SEQ ID NO: 2970610 - protein, 22 aa, Entamoeba invadens
TKDRIPMGKVLASFDDIIVDST

SEQ ID NO: 2970611 - protein, 23 aa, Entamoeba invadens
TKDWLLPYCIYRTLIKSVDTPLP

SEQ ID NO: 2970612 - protein, 24 aa, Entamoeba invadens
TKEAIGLAEDCRKMAKLVKNVFLW

SEQ ID NO: 2970613 - protein, 23 aa, Entamoeba invadens
TKEDFRLLPLPIQGRKNVGVCLT

SEQ ID NO: 2970614 - protein, 23 aa, Entamoeba invadens
TKEDPKGFIVMRSNDVVTLNGAR

SEQ ID NO: 2970615 - protein, 20 aa, Entamoeba invadens
TKEDVCNVIGMYMGDLSQEV

SEQ ID NO: 2970616 - protein, 24 aa, Entamoeba invadens
TKEDWLDWAKQVEIIFLKESPIHS

SEQ ID NO: 2970617 - protein, 22 aa, Entamoeba invadens
TKEEFEDVCFQYGIELDEVDQE

SEQ ID NO: 2970618 - protein, 20 aa, Entamoeba invadens
TKEEIKFTVFEIEQLEKNET

SEQ ID NO: 2970619 - protein, 31 aa, Entamoeba invadens
TKEEIYRWGKRCYLAALEFVGNATIQKNSLI

SEQ ID NO: 2970620 - protein, 18 aa, Entamoeba invadens
TKEEKLKLQNEMTTHEEV

SEQ ID NO: 2970621 - protein, 25 aa, Entamoeba invadens
TKEELKCLWEQRYTILKSKPQALAR

SEQ ID NO: 2970622 - protein, 23 aa, Entamoeba invadens
TKEEVDKVFAILGITMESEIDLP

SEQ ID NO: 2970623 - protein, 20 aa, Entamoeba invadens
TKEFCFNCTTASFEKNELIP

SEQ ID NO: 2970624 - protein, 20 aa, Entamoeba invadens
TKEFRRLLGKIIEDDAAHDH

SEQ ID NO: 2970625 - protein, 18 aa, Entamoeba invadens
TKEGHLFGSFNTKRMPAH

SEQ ID NO: 2970626 - protein, 23 aa, Entamoeba invadens
TKEIPKFKDVYYITKNVNVYEPF

SEQ ID NO: 2970627 - protein, 23 aa, Entamoeba invadens
TKEIPWDKITVVSLYLLPEVLDL

SEQ ID NO: 2970628 - protein, 21 aa, Entamoeba invadens
TKEKYAQEIVKFMQKPGNTKP

SEQ ID NO: 2970629 - protein, 19 aa, Entamoeba invadens
TKELHFELYMALRKTIYKP

SEQ ID NO: 2970630 - protein, 23 aa, Entamoeba invadens
TKELNLYWNKFFSTYEEVAERVN

SEQ ID NO: 2970631 - protein, 18 aa, Entamoeba invadens
TKEQIEQFIIERITNTIN

SEQ ID NO: 2970632 - protein, 26 aa, Entamoeba invadens
TKEQLKMWLEDVLLQFIKSQNKNTKN

SEQ ID NO: 2970633 - protein, 27 aa, Entamoeba invadens
TKERLFNRIGLLFSYVFMMNNASIHSV

SEQ ID NO: 2970634 - protein, 32 aa, Entamoeba invadens
TKESHGFWALVQWIFSFICQKISNLIFGSMLQ

SEQ ID NO: 2970635 - protein, 21 aa, Entamoeba invadens
TKESLKVVCTFTQLLESQIIS

SEQ ID NO: 2970636 - protein, 19 aa, Entamoeba invadens
TKESVLWAIGTTVVLNTMK

SEQ ID NO: 2970637 - protein, 23 aa, Entamoeba invadens
TKETFKYKPKCNARNFKELQERI

SEQ ID NO: 2970638 - protein, 19 aa, Entamoeba invadens
TKEVALAWVDITLKLQKAF

SEQ ID NO: 2970639 - protein, 20 aa, Entamoeba invadens
TKEVKLQFIMFFDEKPSDCE

SEQ ID NO: 2970640 - protein, 23 aa, Entamoeba invadens
TKEVNKACCSNAFLSQESDYKDT

SEQ ID NO: 2970641 - protein, 18 aa, Entamoeba invadens
TKFFCLFIKINSSQMDYL

SEQ ID NO: 2970642 - protein, 17 aa, Entamoeba invadens
TKFGFPVEEIRAICCSH

SEQ ID NO: 2970643 - protein, 17 aa, Entamoeba invadens
TKFIAKSPVDLFEKNEI

SEQ ID NO: 2970644 - protein, 20 aa, Entamoeba invadens
TKFIITSLIGVFPYEYIPTI

SEQ ID NO: 2970645 - protein, 31 aa, Entamoeba invadens
TKFKGMMFKNCVKLKHIFGMENVVKIRFECF

SEQ ID NO: 2970646 - protein, 17 aa, Entamoeba invadens
TKFKNFQVCLPDKKIYF

SEQ ID NO: 2970647 - protein, 18 aa, Entamoeba invadens
TKFLITCYFRCSDRELNP

SEQ ID NO: 2970648 - protein, 28 aa, Entamoeba invadens
TKFPWFNQEMMNFFLSKYLPDYPQMTVT

SEQ ID NO: 2970649 - protein, 18 aa, Entamoeba invadens
TKFSGGIFSKERNSSDDD

SEQ ID NO: 2970650 - protein, 28 aa, Entamoeba invadens
TKFSTKKTKRVCQSQLYMESPRFDSNTS

SEQ ID NO: 2970651 - protein, 24 aa, Entamoeba invadens
TKGARYTLQLAFFDRIKDLDAYGP

SEQ ID NO: 2970652 - protein, 25 aa, Entamoeba invadens
TKGCLRCFSGYYLADRMCVKCEYPC

SEQ ID NO: 2970653 - protein, 31 aa, Entamoeba invadens
TKGDALDVIEIFKIASLTGIGGIANTPVIDF

SEQ ID NO: 2970654 - protein, 24 aa, Entamoeba invadens
TKGDQVIFCVFVRLVKGKPVYSMP

SEQ ID NO: 2970655 - protein, 23 aa, Entamoeba invadens
TKGFLKTECQIYLTINSILIIDL

SEQ ID NO: 2970656 - protein, 26 aa, Entamoeba invadens
TKGFNPMIKKNCIVFPLKKPEESSGQ

SEQ ID NO: 2970657 - protein, 17 aa, Entamoeba invadens
TKGKFNILDCVRALKGF

SEQ ID NO: 2970658 - protein, 20 aa, Entamoeba invadens
TKGTTFVYETNFYKSSKQLN

SEQ ID NO: 2970659 - protein, 18 aa, Entamoeba invadens
TKGTVLLKDADQFKNFST

SEQ ID NO: 2970660 - protein, 21 aa, Entamoeba invadens
TKHAQEMLIKLGYNCGPKGAD

SEQ ID NO: 2970661 - protein, 17 aa, Entamoeba invadens
TKHEIGEMKELVEKSEQ

SEQ ID NO: 2970662 - protein, 17 aa, Entamoeba invadens
TKHPHGPSLLFQSPLSF

SEQ ID NO: 2970663 - protein, 22 aa, Entamoeba invadens
TKHTKIVFAFCFSSDDLTTIHF

SEQ ID NO: 2970664 - protein, 27 aa, Entamoeba invadens
TKHVLEFFLKSPFALVTHKLLMLTEMK

SEQ ID NO: 2970665 - protein, 23 aa, Entamoeba invadens
TKIADFFLSILVDFDKYSDQIVS

SEQ ID NO: 2970666 - protein, 19 aa, Entamoeba invadens
TKICPRCKNPIQKNGGCNH

SEQ ID NO: 2970667 - protein, 22 aa, Entamoeba invadens
TKIDIIRYFGILLYMGAHHDIK

SEQ ID NO: 2970668 - protein, 17 aa, Entamoeba invadens
TKIEFDRSIGIDLTPQL

SEQ ID NO: 2970669 - protein, 18 aa, Entamoeba invadens
TKIEMTRNNLQLEVETHY

SEQ ID NO: 2970670 - protein, 25 aa, Entamoeba invadens
TKIESYKFEKCVGVVTTIGLPPEKV

SEQ ID NO: 2970671 - protein, 25 aa, Entamoeba invadens
TKIEVENFFIAFVWVLKNINRNVLS

SEQ ID NO: 2970672 - protein, 25 aa, Entamoeba invadens
TKIFIHNRLFKWKLRELTAKQMEKL

SEQ ID NO: 2970673 - protein, 24 aa, Entamoeba invadens
TKIFKRLFRVYAHMFYSHEKHLKD

SEQ ID NO: 2970674 - protein, 24 aa, Entamoeba invadens
TKIFKRLIRVYAHMFYSHMDDLKG

SEQ ID NO: 2970675 - protein, 21 aa, Entamoeba invadens
TKIGDFCFACATQLENVILPL

SEQ ID NO: 2970676 - protein, 18 aa, Entamoeba invadens
TKIGILLQTYIGRLQLPG

SEQ ID NO: 2970677 - protein, 20 aa, Entamoeba invadens
TKIGNGCFQKCCELKEIELP

SEQ ID NO: 2970678 - protein, 17 aa, Entamoeba invadens
TKIGPNFIRGCTTLTKL

SEQ ID NO: 2970679 - protein, 21 aa, Entamoeba invadens
TKIGQKCFKGCDSLAEIVLPK

SEQ ID NO: 2970680 - protein, 17 aa, Entamoeba invadens
TKIGVFAFKNCFAIEDI

SEQ ID NO: 2970681 - protein, 25 aa, Entamoeba invadens
TKIIFPETVENILFETYDYVISNVF

SEQ ID NO: 2970682 - protein, 27 aa, Entamoeba invadens
TKIISTQLFKLIPLLAHKYQDQLVPRL

SEQ ID NO: 2970683 - protein, 17 aa, Entamoeba invadens
TKIKEFVYKQCTDNKYF

SEQ ID NO: 2970684 - protein, 17 aa, Entamoeba invadens
TKIKFGRINVIKCANKM

SEQ ID NO: 2970685 - protein, 18 aa, Entamoeba invadens
TKIKNIQNILSFLPPVYY

SEQ ID NO: 2970686 - protein, 17 aa, Entamoeba invadens
TKILETFASLYLSPQER

SEQ ID NO: 2970687 - protein, 19 aa, Entamoeba invadens
TKILRRIEDKISYLRTKIG

SEQ ID NO: 2970688 - protein, 17 aa, Entamoeba invadens
TKIPFTLLKDLVEKVEI

SEQ ID NO: 2970689 - protein, 23 aa, Entamoeba invadens
TKIPTIVRPNMFVGVPVKMTPEA

SEQ ID NO: 2970690 - protein, 18 aa, Entamoeba invadens
TKIQKCRSITHFERERID

SEQ ID NO: 2970691 - protein, 19 aa, Entamoeba invadens
TKIREGVLLSFKERAQQGD

SEQ ID NO: 2970692 - protein, 20 aa, Entamoeba invadens
TKIRVTRKLAKEKTKVKKNF

SEQ ID NO: 2970693 - protein, 22 aa, Entamoeba invadens
TKISFLRWVGPLLLTCAENPNS

SEQ ID NO: 2970694 - protein, 24 aa, Entamoeba invadens
TKISLCGLMLFHILIQTESGKILL

SEQ ID NO: 2970695 - protein, 18 aa, Entamoeba invadens
TKISNKSNLCFLIEDTNN

SEQ ID NO: 2970696 - protein, 18 aa, Entamoeba invadens
TKIVIPKDMFKMHFAEEL

SEQ ID NO: 2970697 - protein, 18 aa, Entamoeba invadens
TKIVVEWAKSSQIKDCDL

SEQ ID NO: 2970698 - protein, 18 aa, Entamoeba invadens
TKIVVFGFGSVGKSSIII

SEQ ID NO: 2970699 - protein, 18 aa, Entamoeba invadens
TKIVVFGFGSVGKSSITV

SEQ ID NO: 2970700 - protein, 18 aa, Entamoeba invadens
TKIWSFAFKNCVILSRIW

SEQ ID NO: 2970701 - protein, 23 aa, Entamoeba invadens
TKIYACPAPSIAAHFGKFDVSVV

SEQ ID NO: 2970702 - protein, 23 aa, Entamoeba invadens
TKIYNSCFMECSMLEKVQLPNGI

SEQ ID NO: 2970703 - protein, 18 aa, Entamoeba invadens
TKKALMFMKADKVPQTID

SEQ ID NO: 2970704 - protein, 29 aa, Entamoeba invadens
TKKCGKYTFCLNPQFLNRSFIHTQLDLNK

SEQ ID NO: 2970705 - protein, 17 aa, Entamoeba invadens
TKKCSQHILEVILQIIF

SEQ ID NO: 2970706 - protein, 29 aa, Entamoeba invadens
TKKDLAIDMIKFLLGKAENQFTHPPTVRM

SEQ ID NO: 2970707 - protein, 20 aa, Entamoeba invadens
TKKDLIIIQAKIQNMRLMLR

SEQ ID NO: 2970708 - protein, 17 aa, Entamoeba invadens
TKKEAKQNLVFVITTNQ

SEQ ID NO: 2970709 - protein, 28 aa, Entamoeba invadens
TKKEFVSRLFLFVKALLFIPDEALFDEL

SEQ ID NO: 2970710 - protein, 26 aa, Entamoeba invadens
TKKFDRGLLLGFFRFMEVMKGMNEEG

SEQ ID NO: 2970711 - protein, 23 aa, Entamoeba invadens
TKKGPLAKVWIAAHWEGKLTKQQ

SEQ ID NO: 2970712 - protein, 19 aa, Entamoeba invadens
TKKGVKWNALTSEDVELIN

SEQ ID NO: 2970713 - protein, 20 aa, Entamoeba invadens
TKKILPGILEDLLKENYESK

SEQ ID NO: 2970714 - protein, 23 aa, Entamoeba invadens
TKKIQKKSVCFLSDYDEKNVAIK

SEQ ID NO: 2970715 - protein, 29 aa, Entamoeba invadens
TKKKCGWRFPLPIYRSIQFLKQKDRFVTE

SEQ ID NO: 2970716 - protein, 23 aa, Entamoeba invadens
TKKLKPSRRNLLKKLQNEKREVA

SEQ ID NO: 2970717 - protein, 37 aa, Entamoeba invadens
TKKLLGGIFYDFFPRKGKRSGACKETLFKAFVETNSN

SEQ ID NO: 2970718 - protein, 27 aa, Entamoeba invadens
TKKMGEEVERCFICGKYGHSKNNCTEK

SEQ ID NO: 2970719 - protein, 22 aa, Entamoeba invadens
TKKMSRCGECLDLVGPSNIQVQ

SEQ ID NO: 2970720 - protein, 22 aa, Entamoeba invadens
TKKNEVFGAFCSKRIPKPPTSA

SEQ ID NO: 2970721 - protein, 25 aa, Entamoeba invadens
TKKPICPICLDEVILPRLTACGHLY

SEQ ID NO: 2970722 - protein, 21 aa, Entamoeba invadens
TKKPSAPLIRQSKPPERYESY

SEQ ID NO: 2970723 - protein, 20 aa, Entamoeba invadens
TKKQGIRFVFEDGSRIIFRL

SEQ ID NO: 2970724 - protein, 22 aa, Entamoeba invadens
TKKQLESVFGYSSIPEEKFLNT

SEQ ID NO: 2970725 - protein, 25 aa, Entamoeba invadens
TKKQVYRCILGFTEFAFFRPTIAGI

SEQ ID NO: 2970726 - protein, 25 aa, Entamoeba invadens
TKKRSCPFRPHFDQFGLAPDTLAKF

SEQ ID NO: 2970727 - protein, 25 aa, Entamoeba invadens
TKKSNSRIVVCVDRVVVIKKNELEH

SEQ ID NO: 2970728 - protein, 24 aa, Entamoeba invadens
TKKSWNGPSVGINFSGFKEGDDDG

SEQ ID NO: 2970729 - protein, 20 aa, Entamoeba invadens
TKKTLIFGFHPLEKNEDDIK

SEQ ID NO: 2970730 - protein, 26 aa, Entamoeba invadens
TKKTWELVSKVLLINKMFKNVQKDGS

SEQ ID NO: 2970731 - protein, 25 aa, Entamoeba invadens
TKKVYKALFFPLVFDLMNLDELKTI

SEQ ID NO: 2970732 - protein, 23 aa, Entamoeba invadens
TKKYKYFLVHAGISPLIKSLQDV

SEQ ID NO: 2970733 - protein, 25 aa, Entamoeba invadens
TKLADYRFNLWPAYSDTFEEEMYDP

SEQ ID NO: 2970734 - protein, 21 aa, Entamoeba invadens
TKLCVLILLSLQDLYNDKEYF

SEQ ID NO: 2970735 - protein, 23 aa, Entamoeba invadens
TKLDFKIPGLLIMDTPGHESFTN

SEQ ID NO: 2970736 - protein, 20 aa, Entamoeba invadens
TKLDKKFHCALSDARNTSLS

SEQ ID NO: 2970737 - protein, 24 aa, Entamoeba invadens
TKLDWKRKLFSVAKSARNSYYGLI

SEQ ID NO: 2970738 - protein, 20 aa, Entamoeba invadens
TKLEEFTCSPAINSFTVPKN

SEQ ID NO: 2970739 - protein, 28 aa, Entamoeba invadens
TKLEGIKNLLNYRAFSYTHFNNIFDIII

SEQ ID NO: 2970740 - protein, 20 aa, Entamoeba invadens
TKLFPNLGLLYPVGMGNLAK

SEQ ID NO: 2970741 - protein, 19 aa, Entamoeba invadens
TKLFQLSCTIVITKDYYSN

SEQ ID NO: 2970742 - protein, 17 aa, Entamoeba invadens
TKLGNKCFKNCKLLSRI

SEQ ID NO: 2970743 - protein, 19 aa, Entamoeba invadens
TKLGVGCFKNCCSLTSVTL

SEQ ID NO: 2970744 - protein, 25 aa, Entamoeba invadens
TKLIKGIFRNCTKLDEIIGLENVVD

SEQ ID NO: 2970745 - protein, 24 aa, Entamoeba invadens
TKLKMSVKLATRLTQFVSNTNLFG

SEQ ID NO: 2970746 - protein, 22 aa, Entamoeba invadens
TKLKPEVLLSLISYLVYDMSTD

SEQ ID NO: 2970747 - protein, 20 aa, Entamoeba invadens
TKLKTLRLNISMTVTTALKT

SEQ ID NO: 2970748 - protein, 26 aa, Entamoeba invadens
TKLLHFKGEYFGGAVTAVCDCETDLC

SEQ ID NO: 2970749 - protein, 24 aa, Entamoeba invadens
TKLLRSCCKCLPLSEITLPNTVRF

SEQ ID NO: 2970750 - protein, 27 aa, Entamoeba invadens
TKLNLTRFVMYPMRAKFNIKIKSLEVF

SEQ ID NO: 2970751 - protein, 17 aa, Entamoeba invadens
TKLPARVDISPTPAKVG

SEQ ID NO: 2970752 - protein, 19 aa, Entamoeba invadens
TKLPVVPLRQQAMAEPSKR

SEQ ID NO: 2970753 - protein, 18 aa, Entamoeba invadens
TKLREILSVFAKEDIDNI

SEQ ID NO: 2970754 - protein, 28 aa, Entamoeba invadens
TKLRQFSCNGCQLRKIDPLIFVNTKNLE

SEQ ID NO: 2970755 - protein, 21 aa, Entamoeba invadens
TKLRVSNCTANFAHLSQLKDI

SEQ ID NO: 2970756 - protein, 18 aa, Entamoeba invadens
TKLSKVVLSKNVDILNNE

SEQ ID NO: 2970757 - protein, 24 aa, Entamoeba invadens
TKLSRQAFSNCYSLKKVVMGNQIT

SEQ ID NO: 2970758 - protein, 21 aa, Entamoeba invadens
TKLTNLRVKGIMTIGMVGEAK

SEQ ID NO: 2970759 - protein, 19 aa, Entamoeba invadens
TKLTSIELFNCMKVKTLNV

SEQ ID NO: 2970760 - protein, 17 aa, Entamoeba invadens
TKLVFPNGVTFVYNYII

SEQ ID NO: 2970761 - protein, 24 aa, Entamoeba invadens
TKMAELRSALKSKFTKDFQKSPPS

SEQ ID NO: 2970762 - protein, 17 aa, Entamoeba invadens
TKMAQFRTIGMQMQQQG

SEQ ID NO: 2970763 - protein, 25 aa, Entamoeba invadens
TKMDLRNGIYFAQMMHWNDYLIVCS

SEQ ID NO: 2970764 - protein, 20 aa, Entamoeba invadens
TKMLVCRLCEHQYKMSQFCD

SEQ ID NO: 2970765 - protein, 19 aa, Entamoeba invadens
TKNAIDFLVSILVSSTKSQ

SEQ ID NO: 2970766 - protein, 28 aa, Entamoeba invadens
TKNAIEIKPRLFAEQLFVFDKWIMKGLT

SEQ ID NO: 2970767 - protein, 21 aa, Entamoeba invadens
TKNCKVVLPKGKYVIGESAFV

SEQ ID NO: 2970768 - protein, 18 aa, Entamoeba invadens
TKNDFLRRMYGVDETIKR

SEQ ID NO: 2970769 - protein, 26 aa, Entamoeba invadens
TKNDMCISFAKGPFVKQRNLSLFKIY

SEQ ID NO: 2970770 - protein, 20 aa, Entamoeba invadens
TKNGLCLRRVMKKFVNRSYV

SEQ ID NO: 2970771 - protein, 27 aa, Entamoeba invadens
TKNGSAFNEYKLKACVCEKLQWTSKIR

SEQ ID NO: 2970772 - protein, 28 aa, Entamoeba invadens
TKNINVSLCALGTVIAAIANKEGHVPYR

SEQ ID NO: 2970773 - protein, 17 aa, Entamoeba invadens
TKNKLRIQSMDKSRYFR

SEQ ID NO: 2970774 - protein, 18 aa, Entamoeba invadens
TKNKRFVKLLWKQTTVFD

SEQ ID NO: 2970775 - protein, 20 aa, Entamoeba invadens
TKNPCIAEKYMAVYRNLVKN

SEQ ID NO: 2970776 - protein, 18 aa, Entamoeba invadens
TKNRLILEFDDIIQQPDS

SEQ ID NO: 2970777 - protein, 24 aa, Entamoeba invadens
TKNRLSFFSFFKKRSDELTSVPTS

SEQ ID NO: 2970778 - protein, 18 aa, Entamoeba invadens
TKNVFEFIKKDLFDKKFF

SEQ ID NO: 2970779 - protein, 23 aa, Entamoeba invadens
TKNVKNFVCVGSRNVDLKGLEET

SEQ ID NO: 2970780 - protein, 20 aa, Entamoeba invadens
TKPANILAHRTCYKKDIVYI

SEQ ID NO: 2970781 - protein, 27 aa, Entamoeba invadens
TKPDFFKYAPAYPLVLFKCEYKEVDFV

SEQ ID NO: 2970782 - protein, 19 aa, Entamoeba invadens
TKPEFPLRFGDISKTKKSV

SEQ ID NO: 2970783 - protein, 25 aa, Entamoeba invadens
TKPESFLGICVFDTMGERDCVVISD

SEQ ID NO: 2970784 - protein, 23 aa, Entamoeba invadens
TKPGEYQVEVMLRNPDVPTNFDH

SEQ ID NO: 2970785 - protein, 23 aa, Entamoeba invadens
TKPKEAKEMDGMLEGLEDLLSNL

SEQ ID NO: 2970786 - protein, 19 aa, Entamoeba invadens
TKPMAMSICDVTVIKCVFD

SEQ ID NO: 2970787 - protein, 21 aa, Entamoeba invadens
TKPNCRKCISLCQKCTDGILC

SEQ ID NO: 2970788 - protein, 20 aa, Entamoeba invadens
TKPNVLRIEKRACELLQSAS

SEQ ID NO: 2970789 - protein, 20 aa, Entamoeba invadens
TKPSISFAALLKKETQNKKE

SEQ ID NO: 2970790 - protein, 18 aa, Entamoeba invadens
TKPTYSQVRVKAVNSNNL

SEQ ID NO: 2970791 - protein, 26 aa, Entamoeba invadens
TKPVKSLCCGCFENTLLVACGFQDKT

SEQ ID NO: 2970792 - protein, 25 aa, Entamoeba invadens
TKQGFQLLHLFNWSLFVLLNKQTYR

SEQ ID NO: 2970793 - protein, 19 aa, Entamoeba invadens
TKQIYPVPLVLLFNTKEFR

SEQ ID NO: 2970794 - protein, 22 aa, Entamoeba invadens
TKQKIIELMKIIGLSTESVRFV

SEQ ID NO: 2970795 - protein, 20 aa, Entamoeba invadens
TKQKSFDSVVSWFDDIQEKS

SEQ ID NO: 2970796 - protein, 26 aa, Entamoeba invadens
TKQLLEYMRGFPFLKTLRETITENRI

SEQ ID NO: 2970797 - protein, 17 aa, Entamoeba invadens
TKQLSVINSIDLDKQEM

SEQ ID NO: 2970798 - protein, 18 aa, Entamoeba invadens
TKQPLGFLEQQHIQVPVV

SEQ ID NO: 2970799 - protein, 22 aa, Entamoeba invadens
TKQSDLKCDCDFDNEIDECQNK

SEQ ID NO: 2970800 - protein, 18 aa, Entamoeba invadens
TKQTICNLFCTRVTIEKC

SEQ ID NO: 2970801 - protein, 23 aa, Entamoeba invadens
TKRCRRLSLLELFDTLEQLNLVN

SEQ ID NO: 2970802 - protein, 25 aa, Entamoeba invadens
TKRGIDFTSLELLKTLVIDKAKTSL

SEQ ID NO: 2970803 - protein, 23 aa, Entamoeba invadens
TKRIFIQMMEYLDVYVHRWGKLS

SEQ ID NO: 2970804 - protein, 22 aa, Entamoeba invadens
TKRKTSFHILDFDEEGRVVIKE

SEQ ID NO: 2970805 - protein, 24 aa, Entamoeba invadens
TKRMPAHMTEGFIMDDQTHFVFTL

SEQ ID NO: 2970806 - protein, 18 aa, Entamoeba invadens
TKRNVSCQKKEIKDTEIM

SEQ ID NO: 2970807 - protein, 24 aa, Entamoeba invadens
TKRNYRLKMCYNKETPKIGVHTDY

SEQ ID NO: 2970808 - protein, 21 aa, Entamoeba invadens
TKRRFFYLFQFSRELVYYKTQ

SEQ ID NO: 2970809 - protein, 17 aa, Entamoeba invadens
TKRSSSAALMFIDLFDS

SEQ ID NO: 2970810 - protein, 17 aa, Entamoeba invadens
TKRVEKIEAKKPEKQKG

SEQ ID NO: 2970811 - protein, 22 aa, Entamoeba invadens
TKRVVEIIQSFKIACVNNNNNT

SEQ ID NO: 2970812 - protein, 25 aa, Entamoeba invadens
TKSDLRLEQIWTFVDNYDVFSFFVA

SEQ ID NO: 2970813 - protein, 24 aa, Entamoeba invadens
TKSDYEILDVLSLEADAVHDFKVP

SEQ ID NO: 2970814 - protein, 24 aa, Entamoeba invadens
TKSEIMGALKLTEWCTVDSVVIIS

SEQ ID NO: 2970815 - protein, 26 aa, Entamoeba invadens
TKSERTRWVLLCSMKNKSSEIINKFN

SEQ ID NO: 2970816 - protein, 24 aa, Entamoeba invadens
TKSFFNFEARKCMEDLANSQGRIG

SEQ ID NO: 2970817 - protein, 21 aa, Entamoeba invadens
TKSGCGCDFLDFCETHATEIM

SEQ ID NO: 2970818 - protein, 20 aa, Entamoeba invadens
TKSGKVYAFINYDSFDAADK

SEQ ID NO: 2970819 - protein, 24 aa, Entamoeba invadens
TKSKEMLGYCGMPKTEIHDDNYNL

SEQ ID NO: 2970820 - protein, 18 aa, Entamoeba invadens
TKSMIISFFKFIKNSDTV

SEQ ID NO: 2970821 - protein, 20 aa, Entamoeba invadens
TKSMKTFLTKYLKFETNNGD

SEQ ID NO: 2970822 - protein, 19 aa, Entamoeba invadens
TKSNELMSVEKLRHETQIR

SEQ ID NO: 2970823 - protein, 18 aa, Entamoeba invadens
TKSPIVFIGTGEKVNEIE

SEQ ID NO: 2970824 - protein, 18 aa, Entamoeba invadens
TKSPPQVGFIGDMNDVMF

SEQ ID NO: 2970825 - protein, 39 aa, Entamoeba invadens
TKSVFKIQCDEILKEMAINYLKRMVCSDESNSRYCSLRQ

SEQ ID NO: 2970826 - protein, 17 aa, Entamoeba invadens
TKSVLLFNIENFIFSNT

SEQ ID NO: 2970827 - protein, 18 aa, Entamoeba invadens
TKTAPVYQRQSAISQNPA

SEQ ID NO: 2970828 - protein, 17 aa, Entamoeba invadens
TKTASNIETVWRFVTKT

SEQ ID NO: 2970829 - protein, 23 aa, Entamoeba invadens
TKTCDFLFFTKCEFKRENNSVCC

SEQ ID NO: 2970830 - protein, 22 aa, Entamoeba invadens
TKTIQCCKCMNVMNAGSQDESL

SEQ ID NO: 2970831 - protein, 36 aa, Entamoeba invadens
TKTKDLYPLLGVVFAMTFCKSAHVVQAFRELNVFDD

SEQ ID NO: 2970832 - protein, 28 aa, Entamoeba invadens
TKTKEMISLLKWLIQRHIEQQKRGKSEI

SEQ ID NO: 2970833 - protein, 20 aa, Entamoeba invadens
TKTPAPFKITARNRINEPLK

SEQ ID NO: 2970834 - protein, 17 aa, Entamoeba invadens
TKTPIECVIDDVENRLE

SEQ ID NO: 2970835 - protein, 20 aa, Entamoeba invadens
TKTPLSLAEKIIFGDDTLKD

SEQ ID NO: 2970836 - protein, 19 aa, Entamoeba invadens
TKTSLEIHSRFAGNKTVDV

SEQ ID NO: 2970837 - protein, 17 aa, Entamoeba invadens
TKTSVVFERTPIYYFEV

SEQ ID NO: 2970838 - protein, 18 aa, Entamoeba invadens
TKTVGIPVCITCYSPFQI

SEQ ID NO: 2970839 - protein, 27 aa, Entamoeba invadens
TKTVKLVELFFKYIRILNSIRPKEDQE

SEQ ID NO: 2970840 - protein, 24 aa, Entamoeba invadens
TKTWKHGIIVGTEFVFAENIDTLF

SEQ ID NO: 2970841 - protein, 21 aa, Entamoeba invadens
TKTYLKECATWVVKFAGWMCG

SEQ ID NO: 2970842 - protein, 27 aa, Entamoeba invadens
TKVCLKRIYVPIVRYLRAYFSKNTALD

SEQ ID NO: 2970843 - protein, 26 aa, Entamoeba invadens
TKVCLTRTMALLRKYLTGIPKNTYQV

SEQ ID NO: 2970844 - protein, 18 aa, Entamoeba invadens
TKVDVPIVQRGVVQFHDV

SEQ ID NO: 2970845 - protein, 19 aa, Entamoeba invadens
TKVECAIKIIKCKRKKLLN

SEQ ID NO: 2970846 - protein, 17 aa, Entamoeba invadens
TKVKFEILDGFKKGTIE

SEQ ID NO: 2970847 - protein, 18 aa, Entamoeba invadens
TKVLPPLFHLIRDPMSND

SEQ ID NO: 2970848 - protein, 21 aa, Entamoeba invadens
TKVPRCISSFQSLTTLHMDYN

SEQ ID NO: 2970849 - protein, 20 aa, Entamoeba invadens
TKVSSISIGIDFIWDKEYFK

SEQ ID NO: 2970850 - protein, 25 aa, Entamoeba invadens
TKVVEELVRVKSERENLEKQNNELT

SEQ ID NO: 2970851 - protein, 19 aa, Entamoeba invadens
TKVVPKIKYFEKIGTPGYS

SEQ ID NO: 2970852 - protein, 20 aa, Entamoeba invadens
TKVYLLHKVYLFLEQNESNI

SEQ ID NO: 2970853 - protein, 24 aa, Entamoeba invadens
TKWEIFGNVIAWVYRIEFQKRGLP

SEQ ID NO: 2970854 - protein, 23 aa, Entamoeba invadens
TKWSCACDLLDFCETHATEIMEC

SEQ ID NO: 2970855 - protein, 29 aa, Entamoeba invadens
TKYEREAFELFQKRIVAFEITCINIEARL

SEQ ID NO: 2970856 - protein, 25 aa, Entamoeba invadens
TKYFCKYKKCVGGYMGKSLDEILKL

SEQ ID NO: 2970857 - protein, 30 aa, Entamoeba invadens
TKYGHFISVNSFDGDYVWAHDPYYHGVQSQ

SEQ ID NO: 2970858 - protein, 26 aa, Entamoeba invadens
TKYINIEFIPFLIASIQQQSVQPPQT

SEQ ID NO: 2970859 - protein, 25 aa, Entamoeba invadens
TKYISGVLRSQCGVSESVANYNANR

SEQ ID NO: 2970860 - protein, 23 aa, Entamoeba invadens
TKYLKCYNQYFLIELTLCDPTES

SEQ ID NO: 2970861 - protein, 22 aa, Entamoeba invadens
TKYMKLKSSFLKKKENKTKDKK

SEQ ID NO: 2970862 - protein, 21 aa, Entamoeba invadens
TKYNPAFVMPSFRKTIIRLLT

SEQ ID NO: 2970863 - protein, 24 aa, Entamoeba invadens
TKYQFEVSYSFSVHMKKLNICCEN

SEQ ID NO: 2970864 - protein, 32 aa, Entamoeba invadens
TKYSLTLYFTFCDLFDTFPLAALVTRKIGKFF

SEQ ID NO: 2970865 - protein, 17 aa, Entamoeba invadens
TKYTCVATHSLFSNNHL

SEQ ID NO: 2970866 - protein, 18 aa, Entamoeba invadens
TKYVRACIGKNFTDEKIH

SEQ ID NO: 2970867 - protein, 21 aa, Entamoeba invadens
TLADMRYLIDIGCTSTPPQRL

SEQ ID NO: 2970868 - protein, 18 aa, Entamoeba invadens
TLAICVVKIFIATFQDLL

SEQ ID NO: 2970869 - protein, 24 aa, Entamoeba invadens
TLAKAIGTSVAWDRTCAISSVVFE

SEQ ID NO: 2970870 - protein, 18 aa, Entamoeba invadens
TLAKCLPQELTIFADTRN

SEQ ID NO: 2970871 - protein, 24 aa, Entamoeba invadens
TLAKILSLLFEWDALREDDLNEWE

SEQ ID NO: 2970872 - protein, 18 aa, Entamoeba invadens
TLALKNETYFGLYDTAFI

SEQ ID NO: 2970873 - protein, 24 aa, Entamoeba invadens
TLANYALPNAMRWFDDSVLQKKSM

SEQ ID NO: 2970874 - protein, 20 aa, Entamoeba invadens
TLARYELMDGAPVKGESMPI

SEQ ID NO: 2970875 - protein, 24 aa, Entamoeba invadens
TLASNLPFVYIIREEMEFTKPNII

SEQ ID NO: 2970876 - protein, 20 aa, Entamoeba invadens
TLCADCFDFVASHNLHELTD

SEQ ID NO: 2970877 - protein, 20 aa, Entamoeba invadens
TLCAGLCRHIDSTRLQTLCA

SEQ ID NO: 2970878 - protein, 25 aa, Entamoeba invadens
TLCDELRHIGRGCFSFCKSLSTFES

SEQ ID NO: 2970879 - protein, 20 aa, Entamoeba invadens
TLCEGLCVIPNCCFSKCKQL

SEQ ID NO: 2970880 - protein, 20 aa, Entamoeba invadens
TLCFEYCGFYSSSEYTKGNL

SEQ ID NO: 2970881 - protein, 17 aa, Entamoeba invadens
TLCKSLEDFKAKKLYFQ

SEQ ID NO: 2970882 - protein, 18 aa, Entamoeba invadens
TLCLTQFPSTFKKVMEDK

SEQ ID NO: 2970883 - protein, 25 aa, Entamoeba invadens
TLCMMMCGYGVILLSDNVTSTSSCV

SEQ ID NO: 2970884 - protein, 22 aa, Entamoeba invadens
TLCNINCSFVIFEIDLNDRTTL

SEQ ID NO: 2970885 - protein, 26 aa, Entamoeba invadens
TLCNVCVNGVLTMCYGVDGVPAYVDF

SEQ ID NO: 2970886 - protein, 27 aa, Entamoeba invadens
TLCNVCVNGVLTMCYGVDGVPAYVDFT

SEQ ID NO: 2970887 - protein, 17 aa, Entamoeba invadens
TLCSINLTTNERCVMLT

SEQ ID NO: 2970888 - protein, 17 aa, Entamoeba invadens
TLCSLITTFLVSFLPKT

SEQ ID NO: 2970889 - protein, 17 aa, Entamoeba invadens
TLCSNGFLDELISFLES

SEQ ID NO: 2970890 - protein, 20 aa, Entamoeba invadens
TLCSTYLIGLPYFQIASVLD

SEQ ID NO: 2970891 - protein, 28 aa, Entamoeba invadens
TLCTLSGKCPQYATSIPISGETVKFELV

SEQ ID NO: 2970892 - protein, 20 aa, Entamoeba invadens
TLCYSCHDLGVLCTALTYLR

SEQ ID NO: 2970893 - protein, 23 aa, Entamoeba invadens
TLDCYKKMLRVMAKSGIDMSSVI

SEQ ID NO: 2970894 - protein, 18 aa, Entamoeba invadens
TLDDCVKPTVSSKVINLI

SEQ ID NO: 2970895 - protein, 17 aa, Entamoeba invadens
TLDELIMRITMTLSDGV

SEQ ID NO: 2970896 - protein, 23 aa, Entamoeba invadens
TLDEMLRLVVFLNNVSAEYKTEL

SEQ ID NO: 2970897 - protein, 25 aa, Entamoeba invadens
TLDIPQRLLAAIVCKNSVLDKHLPP

SEQ ID NO: 2970898 - protein, 22 aa, Entamoeba invadens
TLDLERFKLLTVLEIISEDVKN

SEQ ID NO: 2970899 - protein, 21 aa, Entamoeba invadens
TLDLRKATTLEEIRITRFGGK

SEQ ID NO: 2970900 - protein, 22 aa, Entamoeba invadens
TLDMILKIVEFPAMKNLISSLV

SEQ ID NO: 2970901 - protein, 26 aa, Entamoeba invadens
TLDVLKEWMECYPLDFLNIKSGEQSL

SEQ ID NO: 2970902 - protein, 24 aa, Entamoeba invadens
TLEAAAYATMLFREILKMPGDLDN

SEQ ID NO: 2970903 - protein, 18 aa, Entamoeba invadens
TLEAVFCVTNTKAYTNHF

SEQ ID NO: 2970904 - protein, 27 aa, Entamoeba invadens
TLEDSIQFAAAVGMKSDETAFFEIISQ

SEQ ID NO: 2970905 - protein, 18 aa, Entamoeba invadens
TLEEAIGYLTDWATSQGL

SEQ ID NO: 2970906 - protein, 25 aa, Entamoeba invadens
TLEELEPYISIFFRVFTPLITTTDS

SEQ ID NO: 2970907 - protein, 29 aa, Entamoeba invadens
TLEESEIFWLLKLVMDIMEKFYVHQSPKK

SEQ ID NO: 2970908 - protein, 19 aa, Entamoeba invadens
TLEGVVMRFHLEKKGGKTD

SEQ ID NO: 2970909 - protein, 27 aa, Entamoeba invadens
TLEHWRREICEWTEMNVVVYLGSKENR

SEQ ID NO: 2970910 - protein, 25 aa, Entamoeba invadens
TLEIFKQEIKAIVPLDKKKEIIELD

SEQ ID NO: 2970911 - protein, 28 aa, Entamoeba invadens
TLEIILPFEVPYIFDLIQSLVLDKDEYA

SEQ ID NO: 2970912 - protein, 18 aa, Entamoeba invadens
TLEILTYFLRCLISSSHL

SEQ ID NO: 2970913 - protein, 18 aa, Entamoeba invadens
TLEKIYVNLLKVRTILQQ

SEQ ID NO: 2970914 - protein, 25 aa, Entamoeba invadens
TLEKRFETCHSRRVDMDRFHDSVLS

SEQ ID NO: 2970915 - protein, 24 aa, Entamoeba invadens
TLELKRIEAILIKLGITDSTLKER

SEQ ID NO: 2970916 - protein, 23 aa, Entamoeba invadens
TLENYCFKYCCKLSDITIPQNVV

SEQ ID NO: 2970917 - protein, 22 aa, Entamoeba invadens
TLEQLCEVIKEDASLLRVGFKG

SEQ ID NO: 2970918 - protein, 23 aa, Entamoeba invadens
TLERVCKRYRNLSYRFDSNPISI

SEQ ID NO: 2970919 - protein, 21 aa, Entamoeba invadens
TLESLLMKGIDLSVLGIDLTS

SEQ ID NO: 2970920 - protein, 25 aa, Entamoeba invadens
TLETVLRKNVRVFFKKMTTEDCVKE

SEQ ID NO: 2970921 - protein, 18 aa, Entamoeba invadens
TLEYCKLASYNLREVDVS

SEQ ID NO: 2970922 - protein, 26 aa, Entamoeba invadens
TLEYHLKYIFLNGFYKVPQHEKIPED

SEQ ID NO: 2970923 - protein, 17 aa, Entamoeba invadens
TLFALVISVIGVSECVM

SEQ ID NO: 2970924 - protein, 19 aa, Entamoeba invadens
TLFDIKWGVRSNAAAVKET

SEQ ID NO: 2970925 - protein, 22 aa, Entamoeba invadens
TLFEIGQKCFYGCFNLVSINIP

SEQ ID NO: 2970926 - protein, 19 aa, Entamoeba invadens
TLFELKQFPVIVLRDNPVI

SEQ ID NO: 2970927 - protein, 18 aa, Entamoeba invadens
TLFFGRSDSLSFTQQTSV

SEQ ID NO: 2970928 - protein, 20 aa, Entamoeba invadens
TLFFLRFLLTPFTAHSEILK

SEQ ID NO: 2970929 - protein, 27 aa, Entamoeba invadens
TLFITFKIVLKKTCLCKSIEDLNKHSN

SEQ ID NO: 2970930 - protein, 24 aa, Entamoeba invadens
TLFKAVLNRESVLFMFVTENNEIF

SEQ ID NO: 2970931 - protein, 30 aa, Entamoeba invadens
TLFLKIKIIQWKKTIWDKGVVSLFAELNYK

SEQ ID NO: 2970932 - protein, 22 aa, Entamoeba invadens
TLFPEWRMEAANVVESLIPALE

SEQ ID NO: 2970933 - protein, 20 aa, Entamoeba invadens
TLFTKRFLKDVIVANKLFEE

SEQ ID NO: 2970934 - protein, 24 aa, Entamoeba invadens
TLFVPSHVAVSMFYFNFKLNHPTK

SEQ ID NO: 2970935 - protein, 22 aa, Entamoeba invadens
TLGDLLELLGFDFDVHVSTGKR

SEQ ID NO: 2970936 - protein, 23 aa, Entamoeba invadens
TLGDLSARCSVALPTGGGCAICR

SEQ ID NO: 2970937 - protein, 23 aa, Entamoeba invadens
TLGEDRWCFLVINYVTSRHIEEQ

SEQ ID NO: 2970938 - protein, 17 aa, Entamoeba invadens
TLGEKFKELGLVVEDKK

SEQ ID NO: 2970939 - protein, 22 aa, Entamoeba invadens
TLGGFDIPPSVKWINDKEYKSD

SEQ ID NO: 2970940 - protein, 17 aa, Entamoeba invadens
TLGLFVSYDCLRESFRP

SEQ ID NO: 2970941 - protein, 20 aa, Entamoeba invadens
TLGNIFFNKCSHVSLDNTNK

SEQ ID NO: 2970942 - protein, 18 aa, Entamoeba invadens
TLGQIFLNVRLRSDSGVF

SEQ ID NO: 2970943 - protein, 24 aa, Entamoeba invadens
TLHDSVECLCSFCFAGCDELCHID

SEQ ID NO: 2970944 - protein, 24 aa, Entamoeba invadens
TLHELCSTPTLLFVEQLLTLFIQT

SEQ ID NO: 2970945 - protein, 17 aa, Entamoeba invadens
TLHKFFCVSKKCKEAVG

SEQ ID NO: 2970946 - protein, 27 aa, Entamoeba invadens
TLHLLYDILGEFGFFCEVNATKGKKET

SEQ ID NO: 2970947 - protein, 17 aa, Entamoeba invadens
TLHPFVIRNWVSVNLAD

SEQ ID NO: 2970948 - protein, 19 aa, Entamoeba invadens
TLHSFKFKDNIIPVVKECI

SEQ ID NO: 2970949 - protein, 19 aa, Entamoeba invadens
TLIDVWRIVIDVLDKVDQM

SEQ ID NO: 2970950 - protein, 18 aa, Entamoeba invadens
TLIEFIFVSKNCRDAVEM

SEQ ID NO: 2970951 - protein, 25 aa, Entamoeba invadens
TLIESLRFACTGVYPPNSQTGRLFL

SEQ ID NO: 2970952 - protein, 17 aa, Entamoeba invadens
TLIFFVNGVEEARVCEP

SEQ ID NO: 2970953 - protein, 27 aa, Entamoeba invadens
TLIFIFSFLSLEAIIAVKHTCKVLYGF

SEQ ID NO: 2970954 - protein, 18 aa, Entamoeba invadens
TLIGLGAFNCCNKLTKIE

SEQ ID NO: 2970955 - protein, 18 aa, Entamoeba invadens
TLIGYHAFNECAFNNFTV

SEQ ID NO: 2970956 - protein, 24 aa, Entamoeba invadens
TLIKLCDLESYFGEKVGLETLKFE

SEQ ID NO: 2970957 - protein, 19 aa, Entamoeba invadens
TLIKYKIVNDNLKFVKPEW

SEQ ID NO: 2970958 - protein, 18 aa, Entamoeba invadens
TLILWPENNFLAFKHLTS

SEQ ID NO: 2970959 - protein, 17 aa, Entamoeba invadens
TLILWPKDNFLAFKHLT

SEQ ID NO: 2970960 - protein, 22 aa, Entamoeba invadens
TLISHFGLPIGVFGTSGGQVGL

SEQ ID NO: 2970961 - protein, 18 aa, Entamoeba invadens
TLIVTIGDYARYFGENFP

SEQ ID NO: 2970962 - protein, 26 aa, Entamoeba invadens
TLKCLPRHVVIPAFLIDSGKEPRVCR

SEQ ID NO: 2970963 - protein, 18 aa, Entamoeba invadens
TLKCTKCGTSRTSSENSS

SEQ ID NO: 2970964 - protein, 24 aa, Entamoeba invadens
TLKEAMCYVAFDYKEELTISGLSS

SEQ ID NO: 2970965 - protein, 23 aa, Entamoeba invadens
TLKFFPRLETLHIYSEKSENFGN

SEQ ID NO: 2970966 - protein, 21 aa, Entamoeba invadens
TLKGGASVLMLEKAQTKVPNY

SEQ ID NO: 2970967 - protein, 23 aa, Entamoeba invadens
TLKGLRVAIKIPHNDMNCEEVTS

SEQ ID NO: 2970968 - protein, 17 aa, Entamoeba invadens
TLKGNFFEIFWDIVNGR

SEQ ID NO: 2970969 - protein, 26 aa, Entamoeba invadens
TLKHGLNWMNQWACSRNFGLGTLIPW

SEQ ID NO: 2970970 - protein, 21 aa, Entamoeba invadens
TLKILRLDVYYNYLQATTNGH

SEQ ID NO: 2970971 - protein, 24 aa, Entamoeba invadens
TLKKIDLYMCDHIVVIGNIPERTQ

SEQ ID NO: 2970972 - protein, 31 aa, Entamoeba invadens
TLKKSSSCCFPFSFFKSFNFGSKHSKGSYRS

SEQ ID NO: 2970973 - protein, 20 aa, Entamoeba invadens
TLKKTGWIGLYDMLQMDNSK

SEQ ID NO: 2970974 - protein, 20 aa, Entamoeba invadens
TLKKVLSCQPHYFLKNNRCV

SEQ ID NO: 2970975 - protein, 20 aa, Entamoeba invadens
TLKNCGKFGVSYEFEETEDC

SEQ ID NO: 2970976 - protein, 22 aa, Entamoeba invadens
TLKNGCYHEDIGFGSSALKNNP

SEQ ID NO: 2970977 - protein, 21 aa, Entamoeba invadens
TLKNGCYHEDIGFGSSALKTN

SEQ ID NO: 2970978 - protein, 23 aa, Entamoeba invadens
TLKNLKMGMYFLMKALNENEASY

SEQ ID NO: 2970979 - protein, 21 aa, Entamoeba invadens
TLKQELIIFSGIKVVQTSVQH

SEQ ID NO: 2970980 - protein, 17 aa, Entamoeba invadens
TLKRRRVDEELAAKDKE

SEQ ID NO: 2970981 - protein, 22 aa, Entamoeba invadens
TLKSGFACEFEVFLTPYCTFNL

SEQ ID NO: 2970982 - protein, 25 aa, Entamoeba invadens
TLKSVKVMQRKVCDYVMNGEIVKAR

SEQ ID NO: 2970983 - protein, 24 aa, Entamoeba invadens
TLKTRELFCASAPVRPLVTSQKNL

SEQ ID NO: 2970984 - protein, 21 aa, Entamoeba invadens
TLKTWDVNKGYCLKTTVCYSS

SEQ ID NO: 2970985 - protein, 17 aa, Entamoeba invadens
TLKVCVMGDEKTGKTSF

SEQ ID NO: 2970986 - protein, 24 aa, Entamoeba invadens
TLKVGKCALHPSGIEECPFTTNTI

SEQ ID NO: 2970987 - protein, 21 aa, Entamoeba invadens
TLKVSPSFRGVVTLPGHNFEY

SEQ ID NO: 2970988 - protein, 17 aa, Entamoeba invadens
TLLASNTVIAIWVQVLN

SEQ ID NO: 2970989 - protein, 25 aa, Entamoeba invadens
TLLDGALMCLHRLLLKETRALPVSA

SEQ ID NO: 2970990 - protein, 23 aa, Entamoeba invadens
TLLECDVWISLIFDQLEKIRKNE

SEQ ID NO: 2970991 - protein, 24 aa, Entamoeba invadens
TLLEDCLRRDFTINGLFYRIEDGV

SEQ ID NO: 2970992 - protein, 35 aa, Entamoeba invadens
TLLEISRFPKFLIPKYFAAFIKKLFASLVPSTFES

SEQ ID NO: 2970993 - protein, 17 aa, Entamoeba invadens
TLLETWNGAAISKFGIK

SEQ ID NO: 2970994 - protein, 18 aa, Entamoeba invadens
TLLFCPEVGKVTISDTKN

SEQ ID NO: 2970995 - protein, 24 aa, Entamoeba invadens
TLLHLPVYLSKIFDIKKKVQKKAN

SEQ ID NO: 2970996 - protein, 18 aa, Entamoeba invadens
TLLKKRGASKHMPRVSKD

SEQ ID NO: 2970997 - protein, 27 aa, Entamoeba invadens
TLLKLLFSVCFYREVLNGKKLEFDVFN

SEQ ID NO: 2970998 - protein, 23 aa, Entamoeba invadens
TLLKSVWRANWFKRDLLYWDGEN

SEQ ID NO: 2970999 - protein, 17 aa, Entamoeba invadens
TLLKTKPSISFAALLKK

SEQ ID NO: 2971000 - protein, 24 aa, Entamoeba invadens
TLLKYYTCVKKWYYLHSPEHQRTE

SEQ ID NO: 2971001 - protein, 18 aa, Entamoeba invadens
TLLLPKIIAIVGENQVET

SEQ ID NO: 2971002 - protein, 19 aa, Entamoeba invadens
TLLMQPRASKFVKVQEIRV

SEQ ID NO: 2971003 - protein, 26 aa, Entamoeba invadens
TLLMYFYMKSIRTVLRRTVLLVASYT

SEQ ID NO: 2971004 - protein, 24 aa, Entamoeba invadens
TLLNEFQEFFLLKEKVVLVPHVNK

SEQ ID NO: 2971005 - protein, 20 aa, Entamoeba invadens
TLLNGLRIIDLGKSCKQSNE

SEQ ID NO: 2971006 - protein, 24 aa, Entamoeba invadens
TLLPKCFSELVDLPTPYICGMSNA

SEQ ID NO: 2971007 - protein, 17 aa, Entamoeba invadens
TLLPKVLQTRDWGKKGR

SEQ ID NO: 2971008 - protein, 19 aa, Entamoeba invadens
TLLPYEIVEVSKIMYNAVL

SEQ ID NO: 2971009 - protein, 27 aa, Entamoeba invadens
TLLPYTMVGGFLFLRVICPAITTPESS

SEQ ID NO: 2971010 - protein, 25 aa, Entamoeba invadens
TLLRIPCPLYHGFSQTTLVVRCIAR

SEQ ID NO: 2971011 - protein, 25 aa, Entamoeba invadens
TLLRNQLRFTFPPLVVHARDNQPIP

SEQ ID NO: 2971012 - protein, 17 aa, Entamoeba invadens
TLLTYVLKCTSLPKYQT

SEQ ID NO: 2971013 - protein, 28 aa, Entamoeba invadens
TLMDKKWRFSNKFGKWVTQAQSGWMEFD

SEQ ID NO: 2971014 - protein, 24 aa, Entamoeba invadens
TLMFSATFPRPIQKLASDFLDDYV

SEQ ID NO: 2971015 - protein, 26 aa, Entamoeba invadens
TLMILKKEMDALCPLDPVEVTKYLLT

SEQ ID NO: 2971016 - protein, 17 aa, Entamoeba invadens
TLMKSKLPITFKNVRYE

SEQ ID NO: 2971017 - protein, 19 aa, Entamoeba invadens
TLMLKRLLLKEGGEVVDIV

SEQ ID NO: 2971018 - protein, 22 aa, Entamoeba invadens
TLMLNSCRQIACSAEDIDEMIR

SEQ ID NO: 2971019 - protein, 17 aa, Entamoeba invadens
TLMNGFQIQMMLGMMSD

SEQ ID NO: 2971020 - protein, 23 aa, Entamoeba invadens
TLNCNFLPITIDYFLKPIHIRNC

SEQ ID NO: 2971021 - protein, 18 aa, Entamoeba invadens
TLNDLRQVLRMKKMPLTK

SEQ ID NO: 2971022 - protein, 25 aa, Entamoeba invadens
TLNELRFSKKLNFVGKGVFLKCSSL

SEQ ID NO: 2971023 - protein, 19 aa, Entamoeba invadens
TLNEYLKEFGFKEEEVGFV

SEQ ID NO: 2971024 - protein, 19 aa, Entamoeba invadens
TLNFGHGFSDIHSKFTDEH

SEQ ID NO: 2971025 - protein, 19 aa, Entamoeba invadens
TLNGFIVLIEKDWKSFGHR

SEQ ID NO: 2971026 - protein, 18 aa, Entamoeba invadens
TLNIQFLATYGFVQMLST

SEQ ID NO: 2971027 - protein, 18 aa, Entamoeba invadens
TLNKLKWFGKTILMILST

SEQ ID NO: 2971028 - protein, 26 aa, Entamoeba invadens
TLNKVLTCRCEICIENNCISSIRVIK

SEQ ID NO: 2971029 - protein, 27 aa, Entamoeba invadens
TLNLLELKPSFEFDKQFNIKTREHFTR

SEQ ID NO: 2971030 - protein, 24 aa, Entamoeba invadens
TLNMIRLKLENFVAKKRYEEDINC

SEQ ID NO: 2971031 - protein, 22 aa, Entamoeba invadens
TLNNPRLVSLVIGDEEINVKRL

SEQ ID NO: 2971032 - protein, 21 aa, Entamoeba invadens
TLNNVGAFAFSNCSKLEDLIF

SEQ ID NO: 2971033 - protein, 25 aa, Entamoeba invadens
TLNPFPRWGNYQNFGKFMSAVKSSA

SEQ ID NO: 2971034 - protein, 25 aa, Entamoeba invadens
TLNPFPRWGNYQNFGQMMATVKLSE

SEQ ID NO: 2971035 - protein, 19 aa, Entamoeba invadens
TLNSLKCDITYDIFADVLS

SEQ ID NO: 2971036 - protein, 24 aa, Entamoeba invadens
TLNTPPKFPVVSMVPPKTQKVQQL

SEQ ID NO: 2971037 - protein, 27 aa, Entamoeba invadens
TLNTVRTGGDYEWVVYHVDARNGDLVK

SEQ ID NO: 2971038 - protein, 21 aa, Entamoeba invadens
TLPAVKGKYFINCKLNRRHIK

SEQ ID NO: 2971039 - protein, 24 aa, Entamoeba invadens
TLPDTGKLLLAFLALKKVRESIEN

SEQ ID NO: 2971040 - protein, 25 aa, Entamoeba invadens
TLPEFPRTSFGKVYLPKLREMVGEK

SEQ ID NO: 2971041 - protein, 22 aa, Entamoeba invadens
TLPERKLSAWIGGSILGSLNSF

SEQ ID NO: 2971042 - protein, 21 aa, Entamoeba invadens
TLPFGTELFIGLLKINGKKLL

SEQ ID NO: 2971043 - protein, 25 aa, Entamoeba invadens
TLPIKRLDLSANFFTTITLGATNLT

SEQ ID NO: 2971044 - protein, 19 aa, Entamoeba invadens
TLPKPELKRDGSARPVSKG

SEQ ID NO: 2971045 - protein, 17 aa, Entamoeba invadens
TLPLCIYTKKYADEKYL

SEQ ID NO: 2971046 - protein, 22 aa, Entamoeba invadens
TLPMSLKKVGKRCFANCYLLES

SEQ ID NO: 2971047 - protein, 18 aa, Entamoeba invadens
TLPNGCFNECPNLKIVEI

SEQ ID NO: 2971048 - protein, 20 aa, Entamoeba invadens
TLPPQRRQRVSFRNRPHKSE

SEQ ID NO: 2971049 - protein, 25 aa, Entamoeba invadens
TLPSSLKYIPSQTFKKCVSLKEVEI

SEQ ID NO: 2971050 - protein, 18 aa, Entamoeba invadens
TLPTYHKTFFPLVQISMD

SEQ ID NO: 2971051 - protein, 24 aa, Entamoeba invadens
TLQEAKFWRQMVVKDMTQKIGEIQ

SEQ ID NO: 2971052 - protein, 18 aa, Entamoeba invadens
TLQEFIEIIKGCVSVLET

SEQ ID NO: 2971053 - protein, 25 aa, Entamoeba invadens
TLQELRVMSWLGFIGGAKGVFYYSY

SEQ ID NO: 2971054 - protein, 18 aa, Entamoeba invadens
TLQFLAYVKETPVDQMTT

SEQ ID NO: 2971055 - protein, 25 aa, Entamoeba invadens
TLQSFKGNHLNLNFQSFCALHNLKE

SEQ ID NO: 2971056 - protein, 19 aa, Entamoeba invadens
TLRALQYIHEYGFIHRDIK

SEQ ID NO: 2971057 - protein, 23 aa, Entamoeba invadens
TLRFINKSMFRVCNTDFEVFVKE

SEQ ID NO: 2971058 - protein, 24 aa, Entamoeba invadens
TLRGTKVRSGKVWSKALDDAIVSY

SEQ ID NO: 2971059 - protein, 19 aa, Entamoeba invadens
TLRIKKDRGTVVEEYIPSN

SEQ ID NO: 2971060 - protein, 23 aa, Entamoeba invadens
TLRISTCPNLSSAIYKHLVQLKY

SEQ ID NO: 2971061 - protein, 24 aa, Entamoeba invadens
TLRKWLANVPLEYVDQKKTPYPIN

SEQ ID NO: 2971062 - protein, 23 aa, Entamoeba invadens
TLRQFKALLLFHLLSQTDNSLVF

SEQ ID NO: 2971063 - protein, 20 aa, Entamoeba invadens
TLRRLVRSIPEFQVSLTDFV

SEQ ID NO: 2971064 - protein, 19 aa, Entamoeba invadens
TLRYFPNIETLHLWNEEDK

SEQ ID NO: 2971065 - protein, 32 aa, Entamoeba invadens
TLSDKELNQIIGFRKLATYSDWRPNNTERQKV

SEQ ID NO: 2971066 - protein, 24 aa, Entamoeba invadens
TLSEMSRYLLLRHSELYGMDVFFP

SEQ ID NO: 2971067 - protein, 22 aa, Entamoeba invadens
TLSFEICAACVKSSERFVQLGV

SEQ ID NO: 2971068 - protein, 17 aa, Entamoeba invadens
TLSFEIFMTGFVRNLTP

SEQ ID NO: 2971069 - protein, 25 aa, Entamoeba invadens
TLSIRNAGIRSIEFGLFTADYFPVL

SEQ ID NO: 2971070 - protein, 24 aa, Entamoeba invadens
TLSKCAFCVQYACVVIDESAQSIE

SEQ ID NO: 2971071 - protein, 27 aa, Entamoeba invadens
TLSKFPFYFEAGIAIAKEIGDVAMVEE

SEQ ID NO: 2971072 - protein, 19 aa, Entamoeba invadens
TLSLLNWVKRMREFDKQRH

SEQ ID NO: 2971073 - protein, 18 aa, Entamoeba invadens
TLSNMSIFALVPAKEYSE

SEQ ID NO: 2971074 - protein, 27 aa, Entamoeba invadens
TLSPWLQIKLFRLLAGVQLDEQQKKMF

SEQ ID NO: 2971075 - protein, 30 aa, Entamoeba invadens
TLSRIPDDAVIVFDCGSSFIKVGTGGGEQP

SEQ ID NO: 2971076 - protein, 25 aa, Entamoeba invadens
TLSSKMHVKICLKQDITTNRVTYFI

SEQ ID NO: 2971077 - protein, 28 aa, Entamoeba invadens
TLSVEALSILFGRPMYQVSFGELGTTIS

SEQ ID NO: 2971078 - protein, 17 aa, Entamoeba invadens
TLTALKPEVKFEISENE

SEQ ID NO: 2971079 - protein, 19 aa, Entamoeba invadens
TLTDLYWRQDFGPIGKELT

SEQ ID NO: 2971080 - protein, 18 aa, Entamoeba invadens
TLTKFGVKVSGRVWCDKQ

SEQ ID NO: 2971081 - protein, 17 aa, Entamoeba invadens
TLTKLGISNAINKRPEY

SEQ ID NO: 2971082 - protein, 20 aa, Entamoeba invadens
TLTNCFIRGNTIRYISMSES

SEQ ID NO: 2971083 - protein, 23 aa, Entamoeba invadens
TLTNLFCLRVMTGSIILNDIIST

SEQ ID NO: 2971084 - protein, 30 aa, Entamoeba invadens
TLTPDIKLRMCVEMALGISWLNNVVGVVDV

SEQ ID NO: 2971085 - protein, 34 aa, Entamoeba invadens
TLTPPQRRLEFFVMFDGTNCWYLDVKNQTTCEAI

SEQ ID NO: 2971086 - protein, 29 aa, Entamoeba invadens
TLTPPTCLSRLDLSANFLTDFSYSCQSLT

SEQ ID NO: 2971087 - protein, 19 aa, Entamoeba invadens
TLTQIGFDIFIQCTKLKSV

SEQ ID NO: 2971088 - protein, 18 aa, Entamoeba invadens
TLTRCSNGGFPVITAFTA

SEQ ID NO: 2971089 - protein, 22 aa, Entamoeba invadens
TLVEIGDKCLLNCDKLVRVTFP

SEQ ID NO: 2971090 - protein, 18 aa, Entamoeba invadens
TLVKAFLRKVYEKLPTSL

SEQ ID NO: 2971091 - protein, 21 aa, Entamoeba invadens
TLVKLLSILIMSGENTEVYVE

SEQ ID NO: 2971092 - protein, 22 aa, Entamoeba invadens
TLVKRFAFDILRSLYYLQMDSI

SEQ ID NO: 2971093 - protein, 25 aa, Entamoeba invadens
TLVLPECVNTLLLIADRSQMNDLRN

SEQ ID NO: 2971094 - protein, 24 aa, Entamoeba invadens
TLVNLKIVVLYSMVTIDNSKQKFI

SEQ ID NO: 2971095 - protein, 30 aa, Entamoeba invadens
TLVPRGIYDIRVCRCEFKKSPELTEPSIFK

SEQ ID NO: 2971096 - protein, 19 aa, Entamoeba invadens
TLVQCLKIKDISFLKNCDI

SEQ ID NO: 2971097 - protein, 18 aa, Entamoeba invadens
TLVQRKHVFTEIIETEKV

SEQ ID NO: 2971098 - protein, 24 aa, Entamoeba invadens
TLVQRLGITHAEAFFVCDKLQWEE

SEQ ID NO: 2971099 - protein, 19 aa, Entamoeba invadens
TLVSLFVEAIKKFKGLSKF

SEQ ID NO: 2971100 - protein, 19 aa, Entamoeba invadens
TLVTLNLFCNAITVIPDFT

SEQ ID NO: 2971101 - protein, 24 aa, Entamoeba invadens
TLVVRCIARYFSKEACLLVADFLS

SEQ ID NO: 2971102 - protein, 25 aa, Entamoeba invadens
TLWGALRLANSVALIVETTENDVFG

SEQ ID NO: 2971103 - protein, 25 aa, Entamoeba invadens
TLYALCNCGNCCQYANCPHTDKICC

SEQ ID NO: 2971104 - protein, 17 aa, Entamoeba invadens
TLYDIFIFDEGVHEIKM

SEQ ID NO: 2971105 - protein, 18 aa, Entamoeba invadens
TLYINSIMSPICTLSDTS

SEQ ID NO: 2971106 - protein, 20 aa, Entamoeba invadens
TLYLPYEVDYNLSFLENLGT

SEQ ID NO: 2971107 - protein, 20 aa, Entamoeba invadens
TLYLPYKVDYDLSFLENLNT

SEQ ID NO: 2971108 - protein, 17 aa, Entamoeba invadens
TLYLSLLKRDGESLEAL

SEQ ID NO: 2971109 - protein, 20 aa, Entamoeba invadens
TLYMKHGFIQIKEVPKAYPS

SEQ ID NO: 2971110 - protein, 20 aa, Entamoeba invadens
TLYTNCTKFIVLDESDKLTK

SEQ ID NO: 2971111 - protein, 25 aa, Entamoeba invadens
TLYTRGVDHFGIFFAPLRQGITPET

SEQ ID NO: 2971112 - protein, 19 aa, Entamoeba invadens
TMALCFSSSGLVFGSFLRN

SEQ ID NO: 2971113 - protein, 21 aa, Entamoeba invadens
TMAYRAPEMISLYQYMPIGCK

SEQ ID NO: 2971114 - protein, 21 aa, Entamoeba invadens
TMDDRIRFGRTIPPIVTILGP

SEQ ID NO: 2971115 - protein, 17 aa, Entamoeba invadens
TMDIILRDFSIMFYHLV

SEQ ID NO: 2971116 - protein, 23 aa, Entamoeba invadens
TMEDAVAVLTQWAESQNVTLRKG

SEQ ID NO: 2971117 - protein, 18 aa, Entamoeba invadens
TMEDMLIVVGGLFPSIDY

SEQ ID NO: 2971118 - protein, 23 aa, Entamoeba invadens
TMEGIFRLSASFINMSKVKEILD

SEQ ID NO: 2971119 - protein, 19 aa, Entamoeba invadens
TMFECFGWCQAYPKTQFKY

SEQ ID NO: 2971120 - protein, 22 aa, Entamoeba invadens
TMFETISWREAYPKTEFKYPWK

SEQ ID NO: 2971121 - protein, 28 aa, Entamoeba invadens
TMFYYFGWNSWNGWIPAWCVNKATKTMV

SEQ ID NO: 2971122 - protein, 19 aa, Entamoeba invadens
TMGEFKLALQRLGGSFVTD

SEQ ID NO: 2971123 - protein, 26 aa, Entamoeba invadens
TMGKCKFRNFLLKALELEIRRGDLLL

SEQ ID NO: 2971124 - protein, 25 aa, Entamoeba invadens
TMHCTVCLFESILFIGLINGKCENR

SEQ ID NO: 2971125 - protein, 18 aa, Entamoeba invadens
TMHFLSFLITDEMQKATN

SEQ ID NO: 2971126 - protein, 26 aa, Entamoeba invadens
TMHHICMLRAKMAKYRKELLTPDKKG

SEQ ID NO: 2971127 - protein, 28 aa, Entamoeba invadens
TMHKTCFKCSVCKKVLSGSNFAKNHGVF

SEQ ID NO: 2971128 - protein, 23 aa, Entamoeba invadens
TMHPTLMGDFYFRGKDLYPNGYN

SEQ ID NO: 2971129 - protein, 26 aa, Entamoeba invadens
TMIFEGRQGWTLSFIPVSERVENVTI

SEQ ID NO: 2971130 - protein, 23 aa, Entamoeba invadens
TMIQDLYVKFMFQIHRKISGMEE

SEQ ID NO: 2971131 - protein, 17 aa, Entamoeba invadens
TMIVRAARQYEFRKMNK

SEQ ID NO: 2971132 - protein, 26 aa, Entamoeba invadens
TMKAMWSPKFERVFQLGSLSGQIKAL

SEQ ID NO: 2971133 - protein, 23 aa, Entamoeba invadens
TMKEFLVVKLNEWYKNKSQINLE

SEQ ID NO: 2971134 - protein, 28 aa, Entamoeba invadens
TMKHRSKGRFPVLTWFSNKNKAALLRSA

SEQ ID NO: 2971135 - protein, 24 aa, Entamoeba invadens
TMKKFKIYDKFAFPTLLNLTTYSS

SEQ ID NO: 2971136 - protein, 19 aa, Entamoeba invadens
TMKKLLSRRTYTFKTTEDM

SEQ ID NO: 2971137 - protein, 25 aa, Entamoeba invadens
TMKKYDCKTLRGVFEVIFDLIDKDH

SEQ ID NO: 2971138 - protein, 24 aa, Entamoeba invadens
TMKKYIEIFTRFNSLIGNLKVNKN

SEQ ID NO: 2971139 - protein, 18 aa, Entamoeba invadens
TMKLEVLLHELLKDKIDE

SEQ ID NO: 2971140 - protein, 20 aa, Entamoeba invadens
TMKRRFAKSSSVFVNNYMLD

SEQ ID NO: 2971141 - protein, 22 aa, Entamoeba invadens
TMKYKEYISMVLYLLDDIDRVN

SEQ ID NO: 2971142 - protein, 25 aa, Entamoeba invadens
TMNALWCLFVMLLIGVSSEKCEAGY

SEQ ID NO: 2971143 - protein, 29 aa, Entamoeba invadens
TMNSLRYYFPILFACFGRVEKLFNLEELL

SEQ ID NO: 2971144 - protein, 19 aa, Entamoeba invadens
TMNSWNIPLMYNNFLHPFI

SEQ ID NO: 2971145 - protein, 24 aa, Entamoeba invadens
TMQRLKGNFSIDIIKDGIAKLDET

SEQ ID NO: 2971146 - protein, 24 aa, Entamoeba invadens
TMQRLKGNFSIDVIKDGIAKLDET

SEQ ID NO: 2971147 - protein, 19 aa, Entamoeba invadens
TMRDYKAASEELMKTKTEL

SEQ ID NO: 2971148 - protein, 19 aa, Entamoeba invadens
TMRDYKAASEELMRTKTEL

SEQ ID NO: 2971149 - protein, 24 aa, Entamoeba invadens
TMREIDILKLLKCDYIIKYYTSLR

SEQ ID NO: 2971150 - protein, 17 aa, Entamoeba invadens
TMSEDWRRSHGILPEDV

SEQ ID NO: 2971151 - protein, 20 aa, Entamoeba invadens
TMSGHPWPQVGVNQNTISGG

SEQ ID NO: 2971152 - protein, 22 aa, Entamoeba invadens
TMSIRSIAWRVFLGSLKGVCGD

SEQ ID NO: 2971153 - protein, 17 aa, Entamoeba invadens
TMSSSYLMRGCKHPHKV

SEQ ID NO: 2971154 - protein, 20 aa, Entamoeba invadens
TMTELTNWWDTVIIPEISKM

SEQ ID NO: 2971155 - protein, 25 aa, Entamoeba invadens
TMTGFRDKCFFGCVSLKTLSLPPKL

SEQ ID NO: 2971156 - protein, 23 aa, Entamoeba invadens
TMTKIGLPVPQGFVITTEQCKAF

SEQ ID NO: 2971157 - protein, 18 aa, Entamoeba invadens
TMTLRFQNFYYFAEFLAD

SEQ ID NO: 2971158 - protein, 24 aa, Entamoeba invadens
TMTSYPNWIHRVYSEYDMTCAKKH

SEQ ID NO: 2971159 - protein, 29 aa, Entamoeba invadens
TMTVDEFPRPLAISRLVKGAFIIQKKLST

SEQ ID NO: 2971160 - protein, 24 aa, Entamoeba invadens
TMTWGDGSVFCEVLEKYGYPVQHA

SEQ ID NO: 2971161 - protein, 18 aa, Entamoeba invadens
TMVECVRAALTADKIATE

SEQ ID NO: 2971162 - protein, 17 aa, Entamoeba invadens
TMVKAVDDACGWPADPN

SEQ ID NO: 2971163 - protein, 17 aa, Entamoeba invadens
TMYECFIWGESYPKTQF

SEQ ID NO: 2971164 - protein, 28 aa, Entamoeba invadens
TMYEGIRWKEAYPISEFKYPWKKAEFVN

SEQ ID NO: 2971165 - protein, 17 aa, Entamoeba invadens
TMYEIFIWGEAFPREMF

SEQ ID NO: 2971166 - protein, 38 aa, Entamoeba invadens
TMYETLKWGEVYDKEFFKFPWKIAEFVISNKRLERNEN

SEQ ID NO: 2971167 - protein, 22 aa, Entamoeba invadens
TMYEVMGWGEAYSVDIFRFPWT

SEQ ID NO: 2971168 - protein, 19 aa, Entamoeba invadens
TMYEVVGWSEAYKKDSFKY

SEQ ID NO: 2971169 - protein, 27 aa, Entamoeba invadens
TMYGQTNCWIHPDIEYHLFEMKNGEIV

SEQ ID NO: 2971170 - protein, 23 aa, Entamoeba invadens
TMYMRVRRILKNEATILDTETIN

SEQ ID NO: 2971171 - protein, 18 aa, Entamoeba invadens
TNACGRLGPTDVDKPDLG

SEQ ID NO: 2971172 - protein, 18 aa, Entamoeba invadens
TNADSFNHLMVWVKESYK

SEQ ID NO: 2971173 - protein, 18 aa, Entamoeba invadens
TNAECTKCHMVIHSDCSE

SEQ ID NO: 2971174 - protein, 29 aa, Entamoeba invadens
TNALIGWSEAYKGTAILINDSITFSHEIL

SEQ ID NO: 2971175 - protein, 24 aa, Entamoeba invadens
TNAPNSLCPLVMYLRQDAVDRITS

SEQ ID NO: 2971176 - protein, 25 aa, Entamoeba invadens
TNATFSYDSFHCMQAGCVQPLSLQF

SEQ ID NO: 2971177 - protein, 19 aa, Entamoeba invadens
TNAVLELISLVVSHMNVTK

SEQ ID NO: 2971178 - protein, 20 aa, Entamoeba invadens
TNAVNVFASINFQFTDELKK

SEQ ID NO: 2971179 - protein, 23 aa, Entamoeba invadens
TNCAETLALFFGYVSTIDKFKTL

SEQ ID NO: 2971180 - protein, 26 aa, Entamoeba invadens
TNCGHGFCSFRVATARTNFCRERHNV

SEQ ID NO: 2971181 - protein, 17 aa, Entamoeba invadens
TNCKFGGVMFDKITVDN

SEQ ID NO: 2971182 - protein, 18 aa, Entamoeba invadens
TNCKKCTTTNCVACNNSN

SEQ ID NO: 2971183 - protein, 18 aa, Entamoeba invadens
TNCMGFKHLADVKIPPGD

SEQ ID NO: 2971184 - protein, 18 aa, Entamoeba invadens
TNCMGFKHLVDVKIPPGD

SEQ ID NO: 2971185 - protein, 17 aa, Entamoeba invadens
TNCNISFADLKVNNSSH

SEQ ID NO: 2971186 - protein, 20 aa, Entamoeba invadens
TNCRIAEVLFVIESVIERFI

SEQ ID NO: 2971187 - protein, 18 aa, Entamoeba invadens
TNCYKCQYSYIKNENKCV

SEQ ID NO: 2971188 - protein, 23 aa, Entamoeba invadens
TNDALNCSFEFLKVANRKQYSTE

SEQ ID NO: 2971189 - protein, 31 aa, Entamoeba invadens
TNDDFRLKLLLSHLCKFFSFHTRQKLQFSPP

SEQ ID NO: 2971190 - protein, 17 aa, Entamoeba invadens
TNDEFDDIFDIILYNGR

SEQ ID NO: 2971191 - protein, 26 aa, Entamoeba invadens
TNDGFCFFWDLKMLKCSKVRVDKVND

SEQ ID NO: 2971192 - protein, 23 aa, Entamoeba invadens
TNDILCGIKYLHLEKHFAHRDIK

SEQ ID NO: 2971193 - protein, 22 aa, Entamoeba invadens
TNECILERCTFIVSNLSVTPEF

SEQ ID NO: 2971194 - protein, 25 aa, Entamoeba invadens
TNEDVVICDFSWVVLSQVDAVADFV

SEQ ID NO: 2971195 - protein, 18 aa, Entamoeba invadens
TNEELEAFYHGRPIDTRQ

SEQ ID NO: 2971196 - protein, 21 aa, Entamoeba invadens
TNEGYSFGAFISGLIPSPKPH

SEQ ID NO: 2971197 - protein, 25 aa, Entamoeba invadens
TNEITRILDIIKIITFGTKIELAIC

SEQ ID NO: 2971198 - protein, 26 aa, Entamoeba invadens
TNEMVMCLCCKQWLCSQNCVEIHCHF

SEQ ID NO: 2971199 - protein, 20 aa, Entamoeba invadens
TNERFGMMLMDFYRELAMQQ

SEQ ID NO: 2971200 - protein, 23 aa, Entamoeba invadens
TNESVKHFLGFVQQYYEVPQREI

SEQ ID NO: 2971201 - protein, 18 aa, Entamoeba invadens
TNEWTFMQPLHYNKSSGF

SEQ ID NO: 2971202 - protein, 18 aa, Entamoeba invadens
TNEWVVKMYYSFQDEEYL

SEQ ID NO: 2971203 - protein, 17 aa, Entamoeba invadens
TNEYCFFVLSTLLEDNT

SEQ ID NO: 2971204 - protein, 20 aa, Entamoeba invadens
TNFAPLIYKTIDIVKRTQAY

SEQ ID NO: 2971205 - protein, 17 aa, Entamoeba invadens
TNFATGCIYEYDAKHPM

SEQ ID NO: 2971206 - protein, 24 aa, Entamoeba invadens
TNFDFRDLYYFAFETFSENTTVSM

SEQ ID NO: 2971207 - protein, 19 aa, Entamoeba invadens
TNFEKRYDNDIKRANGAVS

SEQ ID NO: 2971208 - protein, 22 aa, Entamoeba invadens
TNFFLRKSHLTKMSAALKDPEA

SEQ ID NO: 2971209 - protein, 19 aa, Entamoeba invadens
TNFIFASHFFEVFLDSVPT

SEQ ID NO: 2971210 - protein, 18 aa, Entamoeba invadens
TNFKEMLKILVKRLDDND

SEQ ID NO: 2971211 - protein, 23 aa, Entamoeba invadens
TNFKFKGCETRYFELKSQRSRGM

SEQ ID NO: 2971212 - protein, 24 aa, Entamoeba invadens
TNFLKNCTEKVVLKNINDKETIII

SEQ ID NO: 2971213 - protein, 19 aa, Entamoeba invadens
TNFLLCLTSTDPIENADVS

SEQ ID NO: 2971214 - protein, 21 aa, Entamoeba invadens
TNFLVCTPGRLLYHLENTPKF

SEQ ID NO: 2971215 - protein, 18 aa, Entamoeba invadens
TNFNKFYTSFSFKKKLTI

SEQ ID NO: 2971216 - protein, 23 aa, Entamoeba invadens
TNFPLNACDFFNFLQQKMLSVNL

SEQ ID NO: 2971217 - protein, 17 aa, Entamoeba invadens
TNFPTQHVDAFIDYYCL

SEQ ID NO: 2971218 - protein, 25 aa, Entamoeba invadens
TNFSRNAIDFLLSRKIDRFIKYRRG

SEQ ID NO: 2971219 - protein, 17 aa, Entamoeba invadens
TNFSYDEFETFMTEIRK

SEQ ID NO: 2971220 - protein, 19 aa, Entamoeba invadens
TNFTSRSRYKLSRSAELEK

SEQ ID NO: 2971221 - protein, 25 aa, Entamoeba invadens
TNFYPDYFLINSMMMYNIYKNKEIN

SEQ ID NO: 2971222 - protein, 22 aa, Entamoeba invadens
TNGIFYFSLCFDLKECTLDELC

SEQ ID NO: 2971223 - protein, 26 aa, Entamoeba invadens
TNGIPAELRCYIWYALLLRPTDPWEI

SEQ ID NO: 2971224 - protein, 21 aa, Entamoeba invadens
TNGKCASCNDGYYFTSNQTCV

SEQ ID NO: 2971225 - protein, 25 aa, Entamoeba invadens
TNGKEAIHSIGFWRSKEHVFVRHTK

SEQ ID NO: 2971226 - protein, 25 aa, Entamoeba invadens
TNGKEAIHSTGFWRSKEHVFVKHTK

SEQ ID NO: 2971227 - protein, 26 aa, Entamoeba invadens
TNGKEAIHSTGFWRSKEHVFVKHTKT

SEQ ID NO: 2971228 - protein, 25 aa, Entamoeba invadens
TNGKEAIHTTGFWRSKEHVFVRHTK

SEQ ID NO: 2971229 - protein, 24 aa, Entamoeba invadens
TNGKPDVVFILGFSHSAHFEYAAI

SEQ ID NO: 2971230 - protein, 25 aa, Entamoeba invadens
TNGPKSAIWLYLRLIFEENKDYKKL

SEQ ID NO: 2971231 - protein, 19 aa, Entamoeba invadens
TNGSSGFSFGDTTNKGFDF

SEQ ID NO: 2971232 - protein, 20 aa, Entamoeba invadens
TNGVIPLFCNHIGSGVFCNV

SEQ ID NO: 2971233 - protein, 33 aa, Entamoeba invadens
TNGYSGCDLFNLSCAAAMRPLRDYLKSEEKKGE

SEQ ID NO: 2971234 - protein, 21 aa, Entamoeba invadens
TNHKLWSVLLPVAQQWRTFMY

SEQ ID NO: 2971235 - protein, 18 aa, Entamoeba invadens
TNHLKDALLVAGSAASIS

SEQ ID NO: 2971236 - protein, 23 aa, Entamoeba invadens
TNHVGWQPGCIGMHSDDGNLFNM

SEQ ID NO: 2971237 - protein, 24 aa, Entamoeba invadens
TNIAQKCTTCLETFSKEINDLKTA

SEQ ID NO: 2971238 - protein, 28 aa, Entamoeba invadens
TNIEEFCFAKCFSLFSVELPKHLNTLGK

SEQ ID NO: 2971239 - protein, 26 aa, Entamoeba invadens
TNIGKSCFRECHMLKNIALHHQLQTI

SEQ ID NO: 2971240 - protein, 25 aa, Entamoeba invadens
TNIGKSCFRECHMLKNITLPHQLQA

SEQ ID NO: 2971241 - protein, 24 aa, Entamoeba invadens
TNIIKFGLCCFMCNNSLVAITLSC

SEQ ID NO: 2971242 - protein, 21 aa, Entamoeba invadens
TNIKNLLGLTDYLARPARLPF

SEQ ID NO: 2971243 - protein, 27 aa, Entamoeba invadens
TNILMQRRKLVILKSVEQLAKSLKSVK

SEQ ID NO: 2971244 - protein, 17 aa, Entamoeba invadens
TNIPFMEIIGLFDGHNG

SEQ ID NO: 2971245 - protein, 26 aa, Entamoeba invadens
TNIPYCIIEGLTFPEISQRLSRFEYF

SEQ ID NO: 2971246 - protein, 22 aa, Entamoeba invadens
TNKDLFAGFCAFIESTKLPKET

SEQ ID NO: 2971247 - protein, 25 aa, Entamoeba invadens
TNKDRISTLFPPDVVKVPIISESPY

SEQ ID NO: 2971248 - protein, 23 aa, Entamoeba invadens
TNKKLLLELKEVVFEYGSTYNPP

SEQ ID NO: 2971249 - protein, 25 aa, Entamoeba invadens
TNKNMLWYLCDFLVEILKHKDITQM

SEQ ID NO: 2971250 - protein, 23 aa, Entamoeba invadens
TNKNYRSAKMIDVDMVVGRYTTV

SEQ ID NO: 2971251 - protein, 17 aa, Entamoeba invadens
TNKRIIIQPVNYTEIVS

SEQ ID NO: 2971252 - protein, 18 aa, Entamoeba invadens
TNKRMCVLPNKGFETQLG

SEQ ID NO: 2971253 - protein, 21 aa, Entamoeba invadens
TNKVTICIRCYDDVKAAVPVV

SEQ ID NO: 2971254 - protein, 17 aa, Entamoeba invadens
TNLALFVCDLVKVDIEN

SEQ ID NO: 2971255 - protein, 19 aa, Entamoeba invadens
TNLDCLALTSAIYNNIKDD

SEQ ID NO: 2971256 - protein, 19 aa, Entamoeba invadens
TNLENFASFLSVVASSCCG

SEQ ID NO: 2971257 - protein, 23 aa, Entamoeba invadens
TNLETFDGLGIHPFMLKTLNNFK

SEQ ID NO: 2971258 - protein, 17 aa, Entamoeba invadens
TNLFGLLQFSVFFKKTV

SEQ ID NO: 2971259 - protein, 20 aa, Entamoeba invadens
TNLFKWLDKNEDGFLEGTEL

SEQ ID NO: 2971260 - protein, 28 aa, Entamoeba invadens
TNLISIGKYCFFHCFAIQKLVIPKSVKS

SEQ ID NO: 2971261 - protein, 19 aa, Entamoeba invadens
TNLKFYGKTIFEIAEEHKF

SEQ ID NO: 2971262 - protein, 17 aa, Entamoeba invadens
TNLKKVEIDCCVELSEF

SEQ ID NO: 2971263 - protein, 17 aa, Entamoeba invadens
TNLKLAYSYLVGILNKR

SEQ ID NO: 2971264 - protein, 17 aa, Entamoeba invadens
TNLKQLFITDVFVTEHF

SEQ ID NO: 2971265 - protein, 17 aa, Entamoeba invadens
TNLKRLDLSNVVEIEDN

SEQ ID NO: 2971266 - protein, 17 aa, Entamoeba invadens
TNLKSVEPGVVFNDLKQ

SEQ ID NO: 2971267 - protein, 25 aa, Entamoeba invadens
TNLLCQCLFEAIFIDQLIEKMKPFF

SEQ ID NO: 2971268 - protein, 18 aa, Entamoeba invadens
TNLLIMWDLLAESNKVTK

SEQ ID NO: 2971269 - protein, 23 aa, Entamoeba invadens
TNLLLKLKGIVVALKDQIPKDIH

SEQ ID NO: 2971270 - protein, 25 aa, Entamoeba invadens
TNLPHKRLRDVAARVKYMKYREVHP

SEQ ID NO: 2971271 - protein, 26 aa, Entamoeba invadens
TNLPHKRLRDVATRVKFIEYTEAGGT

SEQ ID NO: 2971272 - protein, 18 aa, Entamoeba invadens
TNLPRFVAENEKFAVYKR

SEQ ID NO: 2971273 - protein, 17 aa, Entamoeba invadens
TNLRIPFLREAGMETMG

SEQ ID NO: 2971274 - protein, 28 aa, Entamoeba invadens
TNLRIPVSNSFCKTPAAICTTADGVLLY

SEQ ID NO: 2971275 - protein, 18 aa, Entamoeba invadens
TNLSFPFSDVDMSLGGYF

SEQ ID NO: 2971276 - protein, 19 aa, Entamoeba invadens
TNLSMCILCQAFDSNCESC

SEQ ID NO: 2971277 - protein, 32 aa, Entamoeba invadens
TNLTRVTLPSSLKYIPSQTFEKCVSLKEVKIP

SEQ ID NO: 2971278 - protein, 17 aa, Entamoeba invadens
TNLTSLGGFSFANTKSL

SEQ ID NO: 2971279 - protein, 26 aa, Entamoeba invadens
TNLVPFPRVHFAMMSYAPIVTPEKAQ

SEQ ID NO: 2971280 - protein, 23 aa, Entamoeba invadens
TNMKGDHYFLDIDLPITPFYLKN

SEQ ID NO: 2971281 - protein, 21 aa, Entamoeba invadens
TNMKGLDLVGFRRDEEVQTED

SEQ ID NO: 2971282 - protein, 17 aa, Entamoeba invadens
TNMLPFNLLIELNAFEP

SEQ ID NO: 2971283 - protein, 18 aa, Entamoeba invadens
TNNELIIPLMFGKKDKNK

SEQ ID NO: 2971284 - protein, 24 aa, Entamoeba invadens
TNNFLYEKGINWSSSLLYTEELGI

SEQ ID NO: 2971285 - protein, 17 aa, Entamoeba invadens
TNNSYGWSPTTAYSLPQ

SEQ ID NO: 2971286 - protein, 24 aa, Entamoeba invadens
TNNVKINGCFNIDTLALLCGTKHV

SEQ ID NO: 2971287 - protein, 17 aa, Entamoeba invadens
TNPDILNELGFLVTNLC

SEQ ID NO: 2971288 - protein, 26 aa, Entamoeba invadens
TNPEEFRMEKGYGVGYGRRKQVILDG

SEQ ID NO: 2971289 - protein, 24 aa, Entamoeba invadens
TNPEIKPDLPTAVLEPLAETKGDL

SEQ ID NO: 2971290 - protein, 21 aa, Entamoeba invadens
TNPFCGHSFCIPCLSDHVRTK

SEQ ID NO: 2971291 - protein, 23 aa, Entamoeba invadens
TNPKCTDKVIWVIANLAGSSGPQ

SEQ ID NO: 2971292 - protein, 17 aa, Entamoeba invadens
TNPMLYEAMFRLIDNNS

SEQ ID NO: 2971293 - protein, 17 aa, Entamoeba invadens
TNPQGVVMLKFYTNDVA

SEQ ID NO: 2971294 - protein, 19 aa, Entamoeba invadens
TNPQIFFEYCVEKEVGNSV

SEQ ID NO: 2971295 - protein, 26 aa, Entamoeba invadens
TNPRECKACAFTNLEKGYENEKLSDI

SEQ ID NO: 2971296 - protein, 18 aa, Entamoeba invadens
TNPYSINTINAFNSNFLF

SEQ ID NO: 2971297 - protein, 22 aa, Entamoeba invadens
TNQDAKCGIHIYDGTEFNGCCE

SEQ ID NO: 2971298 - protein, 17 aa, Entamoeba invadens
TNQLFGQRVFTKKNLAV

SEQ ID NO: 2971299 - protein, 18 aa, Entamoeba invadens
TNRGRFSYGSFYNWVLRV

SEQ ID NO: 2971300 - protein, 23 aa, Entamoeba invadens
TNRVAFYKVVVWFEVDYETTITH

SEQ ID NO: 2971301 - protein, 20 aa, Entamoeba invadens
TNRVNEMLFVLADFLTEYSF

SEQ ID NO: 2971302 - protein, 17 aa, Entamoeba invadens
TNRWNIRALYDMIDIAA

SEQ ID NO: 2971303 - protein, 18 aa, Entamoeba invadens
TNRWNIWALYDMIDIAAL

SEQ ID NO: 2971304 - protein, 20 aa, Entamoeba invadens
TNRYEWILTEFAFHRQGIIL

SEQ ID NO: 2971305 - protein, 17 aa, Entamoeba invadens
TNSCAKTTIKLSDLILY

SEQ ID NO: 2971306 - protein, 20 aa, Entamoeba invadens
TNSFRKARLQTTLTTKEIEL

SEQ ID NO: 2971307 - protein, 23 aa, Entamoeba invadens
TNSHGVVAWDVLSRSVNHIYNVK

SEQ ID NO: 2971308 - protein, 20 aa, Entamoeba invadens
TNSKCLACNNSLILNNTKCL

SEQ ID NO: 2971309 - protein, 24 aa, Entamoeba invadens
TNSKYYYVHSCLGYLAKKKKYSFI

SEQ ID NO: 2971310 - protein, 18 aa, Entamoeba invadens
TNSLLLMSTWKGENQLKL

SEQ ID NO: 2971311 - protein, 21 aa, Entamoeba invadens
TNSLLNWHFKILLKRKKPYLS

SEQ ID NO: 2971312 - protein, 27 aa, Entamoeba invadens
TNSLSCGDRGCFCIGIVYNYFEKQFNC

SEQ ID NO: 2971313 - protein, 23 aa, Entamoeba invadens
TNSWTYINWDYWVLSKVQEVFGG

SEQ ID NO: 2971314 - protein, 23 aa, Entamoeba invadens
TNSYIKELFNFRELLKAQLELTY

SEQ ID NO: 2971315 - protein, 23 aa, Entamoeba invadens
TNTCPILSEAVLLLSHKDSMVVS

SEQ ID NO: 2971316 - protein, 24 aa, Entamoeba invadens
TNTGIKRRFPMAVDRRPPNGKGMY

SEQ ID NO: 2971317 - protein, 17 aa, Entamoeba invadens
TNTLPHLIISRAEIDGV

SEQ ID NO: 2971318 - protein, 20 aa, Entamoeba invadens
TNTLPVLLFKLIDSDNSGVI

SEQ ID NO: 2971319 - protein, 26 aa, Entamoeba invadens
TNTNYVGMSFNFLKNGHPFDANLKAL

SEQ ID NO: 2971320 - protein, 20 aa, Entamoeba invadens
TNTPVIGAIIGFLSVVTNNE

SEQ ID NO: 2971321 - protein, 24 aa, Entamoeba invadens
TNTRLLLLRELRVFSKIQTVCFHD

SEQ ID NO: 2971322 - protein, 18 aa, Entamoeba invadens
TNTSFTFPPTEIKKRGLE

SEQ ID NO: 2971323 - protein, 23 aa, Entamoeba invadens
TNTVTELIRRIFIDPRDKKLYDK

SEQ ID NO: 2971324 - protein, 17 aa, Entamoeba invadens
TNTWRKVHCPQHGCSQV

SEQ ID NO: 2971325 - protein, 24 aa, Entamoeba invadens
TNVDSFKNIVNWFELIKKESPDCR

SEQ ID NO: 2971326 - protein, 20 aa, Entamoeba invadens
TNVFELWVVMVCELNNKLTQ

SEQ ID NO: 2971327 - protein, 20 aa, Entamoeba invadens
TNVFYCLEKEISLYVETLNQ

SEQ ID NO: 2971328 - protein, 17 aa, Entamoeba invadens
TNVKTVWLMTKKFHSLL

SEQ ID NO: 2971329 - protein, 20 aa, Entamoeba invadens
TNVLSWAVKEDSLWVKKFAQ

SEQ ID NO: 2971330 - protein, 17 aa, Entamoeba invadens
TNVLVARHAFTKNVALS

SEQ ID NO: 2971331 - protein, 23 aa, Entamoeba invadens
TNVPQGMCGKCYVNELLSDYFSK

SEQ ID NO: 2971332 - protein, 24 aa, Entamoeba invadens
TNYIKFGVSCFESNDLLTAITLSS

SEQ ID NO: 2971333 - protein, 29 aa, Entamoeba invadens
TNYKLFFKHPCVLLNISIPLTQIANSKKV

SEQ ID NO: 2971334 - protein, 19 aa, Entamoeba invadens
TNYMKKFYNFCFGENFEAK

SEQ ID NO: 2971335 - protein, 27 aa, Entamoeba invadens
TNYRAKGRFPIISWVGPNMQCLARSSQ

SEQ ID NO: 2971336 - protein, 22 aa, Entamoeba invadens
TNYVKRNICREISMEELRKREE

SEQ ID NO: 2971337 - protein, 20 aa, Entamoeba invadens
TPAACFIKEKMVYSATKATI

SEQ ID NO: 2971338 - protein, 23 aa, Entamoeba invadens
TPAACSIKEKMVYSATKATIKQA

SEQ ID NO: 2971339 - protein, 19 aa, Entamoeba invadens
TPAIPRSQKYYIFIAPLTQ

SEQ ID NO: 2971340 - protein, 26 aa, Entamoeba invadens
TPATTTQPFAGFDFNKTNLADSANST

SEQ ID NO: 2971341 - protein, 18 aa, Entamoeba invadens
TPCILVGTKCDLRENALS

SEQ ID NO: 2971342 - protein, 19 aa, Entamoeba invadens
TPDFIRYIIRNGSRLLFEN

SEQ ID NO: 2971343 - protein, 24 aa, Entamoeba invadens
TPDGIFKKVRMGKFDYPEDIKSVL

SEQ ID NO: 2971344 - protein, 24 aa, Entamoeba invadens
TPDLFALRLKKFFDNVLPENPKDV

SEQ ID NO: 2971345 - protein, 24 aa, Entamoeba invadens
TPDLRLLYGQCLYRTHRYDECRVL

SEQ ID NO: 2971346 - protein, 19 aa, Entamoeba invadens
TPDYSKWPYLLKNYDQLEI

SEQ ID NO: 2971347 - protein, 21 aa, Entamoeba invadens
TPEIRWGSKMRSVLIDTISQH

SEQ ID NO: 2971348 - protein, 21 aa, Entamoeba invadens
TPEKFFLKLMERLDVPEDFEP

SEQ ID NO: 2971349 - protein, 26 aa, Entamoeba invadens
TPEKIKSHMWWNGFNWDDLYQKKIQA

SEQ ID NO: 2971350 - protein, 21 aa, Entamoeba invadens
TPELGRFSTIGGIGVLINELT

SEQ ID NO: 2971351 - protein, 21 aa, Entamoeba invadens
TPELSASTSLAICSLVGMNFV

SEQ ID NO: 2971352 - protein, 17 aa, Entamoeba invadens
TPEMLDLYTKYTNNVDV

SEQ ID NO: 2971353 - protein, 25 aa, Entamoeba invadens
TPEPKRFVIDILPIVPPTIITQFFR

SEQ ID NO: 2971354 - protein, 21 aa, Entamoeba invadens
TPERIVSVFVTKVPYTFTEKT

SEQ ID NO: 2971355 - protein, 26 aa, Entamoeba invadens
TPESFLIFNCFDWDNALKFSADDFLG

SEQ ID NO: 2971356 - protein, 22 aa, Entamoeba invadens
TPESIDSLLFYEEMKNCVFEEG

SEQ ID NO: 2971357 - protein, 25 aa, Entamoeba invadens
TPEYRSPEMVKVFDYLPIGTQADIW

SEQ ID NO: 2971358 - protein, 32 aa, Entamoeba invadens
TPFELPENCSIYFKEDFMFGASKKFVVPSTVT

SEQ ID NO: 2971359 - protein, 18 aa, Entamoeba invadens
TPFGFYLELIDVVKEQEL

SEQ ID NO: 2971360 - protein, 17 aa, Entamoeba invadens
TPFKFTPHFANVMGGKG

SEQ ID NO: 2971361 - protein, 23 aa, Entamoeba invadens
TPFKFTTHFADLMGFKDGVESEH

SEQ ID NO: 2971362 - protein, 24 aa, Entamoeba invadens
TPFRDRFNFTLSIIGACLHDGIST

SEQ ID NO: 2971363 - protein, 17 aa, Entamoeba invadens
TPFSQKVLIWVQALTQC

SEQ ID NO: 2971364 - protein, 28 aa, Entamoeba invadens
TPFTLSVCLKDFFDLRGIQFSFSSFSSD

SEQ ID NO: 2971365 - protein, 28 aa, Entamoeba invadens
TPGEVGKDWKMCLLFTDVMIVARPFVFG

SEQ ID NO: 2971366 - protein, 29 aa, Entamoeba invadens
TPGEVSKEWKMCILFNDILIIARPFVFGK

SEQ ID NO: 2971367 - protein, 17 aa, Entamoeba invadens
TPGGVVCGGVFDSPYKK

SEQ ID NO: 2971368 - protein, 18 aa, Entamoeba invadens
TPGHCDFIDERVTSLSLM

SEQ ID NO: 2971369 - protein, 20 aa, Entamoeba invadens
TPGKDRWTLPGKVSDFTSVI

SEQ ID NO: 2971370 - protein, 21 aa, Entamoeba invadens
TPGKRRLSLNSIRGKKNEGYG

SEQ ID NO: 2971371 - protein, 17 aa, Entamoeba invadens
TPGLRMSITQKLSVEDQ

SEQ ID NO: 2971372 - protein, 17 aa, Entamoeba invadens
TPGMKALVMDADTIPVV

SEQ ID NO: 2971373 - protein, 20 aa, Entamoeba invadens
TPGRLLGLFNKGVLDLSQLD

SEQ ID NO: 2971374 - protein, 17 aa, Entamoeba invadens
TPGSSFYTALGIDKDTF

SEQ ID NO: 2971375 - protein, 22 aa, Entamoeba invadens
TPHCSLYLGDYVDRGSMSCEVV

SEQ ID NO: 2971376 - protein, 20 aa, Entamoeba invadens
TPHCTLKLHDDMMIVTMNIE

SEQ ID NO: 2971377 - protein, 17 aa, Entamoeba invadens
TPIDLSINFAYDNQSAV

SEQ ID NO: 2971378 - protein, 17 aa, Entamoeba invadens
TPIFSVMQQWLWGIHSS

SEQ ID NO: 2971379 - protein, 18 aa, Entamoeba invadens
TPIPELCAGLPKEFASFL

SEQ ID NO: 2971380 - protein, 28 aa, Entamoeba invadens
TPIQRLPRYRLLLKDLLKHLSDKDLDFP

SEQ ID NO: 2971381 - protein, 24 aa, Entamoeba invadens
TPIRPDCYPLWIYKSGNALFCVQY

SEQ ID NO: 2971382 - protein, 24 aa, Entamoeba invadens
TPIWSCLEGTMGHICVDKIPNPKT

SEQ ID NO: 2971383 - protein, 26 aa, Entamoeba invadens
TPIYLCPEIACFSCPTVKSDLYSVGV

SEQ ID NO: 2971384 - protein, 21 aa, Entamoeba invadens
TPKAPDWIPVLSYCQNSTTRQ

SEQ ID NO: 2971385 - protein, 28 aa, Entamoeba invadens
TPKELKTKLDLFPLKTVGFFTFEDVLNI

SEQ ID NO: 2971386 - protein, 19 aa, Entamoeba invadens
TPKGIKHWECISRKSKKLS

SEQ ID NO: 2971387 - protein, 31 aa, Entamoeba invadens
TPKIKKRVMGAVVPKAVKIPETFQDEQPVVI

SEQ ID NO: 2971388 - protein, 20 aa, Entamoeba invadens
TPKIVFKAVNVWFGVTYSTF

SEQ ID NO: 2971389 - protein, 20 aa, Entamoeba invadens
TPKIYRVVLTGGPGGGKTTS

SEQ ID NO: 2971390 - protein, 23 aa, Entamoeba invadens
TPKLESINLYALLTSLQDTLPSQ

SEQ ID NO: 2971391 - protein, 28 aa, Entamoeba invadens
TPKLSSAIDLSWFLSHFYLDTVDFDEVQ

SEQ ID NO: 2971392 - protein, 18 aa, Entamoeba invadens
TPKMFKQRDYVHVRNVIE

SEQ ID NO: 2971393 - protein, 27 aa, Entamoeba invadens
TPKNFEIISVFVIRRLFNKIGNDFYNA

SEQ ID NO: 2971394 - protein, 24 aa, Entamoeba invadens
TPKNSSLRPKTLLSPKKDDVPPLK

SEQ ID NO: 2971395 - protein, 19 aa, Entamoeba invadens
TPKPEPFGDVGNIVSGNLS

SEQ ID NO: 2971396 - protein, 24 aa, Entamoeba invadens
TPKQWGCTAYCLSLLNYNEKSLKK

SEQ ID NO: 2971397 - protein, 17 aa, Entamoeba invadens
TPKRERSGALLIATKLT

SEQ ID NO: 2971398 - protein, 17 aa, Entamoeba invadens
TPKRKVFEFFKKTKKTI

SEQ ID NO: 2971399 - protein, 22 aa, Entamoeba invadens
TPKRLELVSPITKDGVEGTCVV

SEQ ID NO: 2971400 - protein, 26 aa, Entamoeba invadens
TPKVCLKKTTLRLVFDAVDNAPQKPT

SEQ ID NO: 2971401 - protein, 18 aa, Entamoeba invadens
TPLCCVPCRVILCCNYKH

SEQ ID NO: 2971402 - protein, 24 aa, Entamoeba invadens
TPLFPEIYNYNAFLVMKNTVVTQK

SEQ ID NO: 2971403 - protein, 18 aa, Entamoeba invadens
TPLFSNIIFSLVTGREKV

SEQ ID NO: 2971404 - protein, 19 aa, Entamoeba invadens
TPLGELNWIFTAVTDSIAW

SEQ ID NO: 2971405 - protein, 20 aa, Entamoeba invadens
TPLHLACLYGNIRNVQLLLD

SEQ ID NO: 2971406 - protein, 21 aa, Entamoeba invadens
TPLHYCCAFGMVHLLEEVLSG

SEQ ID NO: 2971407 - protein, 21 aa, Entamoeba invadens
TPLLQCRSYILDVLKSELKTL

SEQ ID NO: 2971408 - protein, 21 aa, Entamoeba invadens
TPLPIIKGFVVSNCSGCTIEF

SEQ ID NO: 2971409 - protein, 20 aa, Entamoeba invadens
TPLQNSFYFIGKFYLTKTGA

SEQ ID NO: 2971410 - protein, 19 aa, Entamoeba invadens
TPLSMELIKISECSIPKND

SEQ ID NO: 2971411 - protein, 18 aa, Entamoeba invadens
TPLTWRHINGMNCYCFQR

SEQ ID NO: 2971412 - protein, 18 aa, Entamoeba invadens
TPLVKKYDEAFFKSMYQS

SEQ ID NO: 2971413 - protein, 19 aa, Entamoeba invadens
TPLVVKFSPPFTFVNMTPL

SEQ ID NO: 2971414 - protein, 19 aa, Entamoeba invadens
TPMERLCTLFGVTSNAPQK

SEQ ID NO: 2971415 - protein, 25 aa, Entamoeba invadens
TPMPTIGACYFRYSVQIPNYKCTIL

SEQ ID NO: 2971416 - protein, 27 aa, Entamoeba invadens
TPNDDAVCFCILYGLARRLVKYQKIHL

SEQ ID NO: 2971417 - protein, 26 aa, Entamoeba invadens
TPNDMFLVLACDGVWDVLSNECVADL

SEQ ID NO: 2971418 - protein, 18 aa, Entamoeba invadens
TPNERLRYQPLFNSRKEL

SEQ ID NO: 2971419 - protein, 21 aa, Entamoeba invadens
TPNKASAVWFDLKDGPVTFTF

SEQ ID NO: 2971420 - protein, 26 aa, Entamoeba invadens
TPNQLCKIFLHLVETVALLHSSDSFH

SEQ ID NO: 2971421 - protein, 24 aa, Entamoeba invadens
TPNVPSFDFRNVFNTVAEKPKEDV

SEQ ID NO: 2971422 - protein, 19 aa, Entamoeba invadens
TPPCRCVNGVPPLKPEQQE

SEQ ID NO: 2971423 - protein, 20 aa, Entamoeba invadens
TPPEDRPLLLTAPPTTTSAY

SEQ ID NO: 2971424 - protein, 19 aa, Entamoeba invadens
TPPKFIAEVVDIFVGTNGF

SEQ ID NO: 2971425 - protein, 26 aa, Entamoeba invadens
TPPKTTVATLEWLKVSEGIARNLLKK

SEQ ID NO: 2971426 - protein, 24 aa, Entamoeba invadens
TPPPKPRRMSLLPTEGDTQREIQK

SEQ ID NO: 2971427 - protein, 18 aa, Entamoeba invadens
TPPPRGTFVINQFLNNAC

SEQ ID NO: 2971428 - protein, 20 aa, Entamoeba invadens
TPPPYPAVIPHPAAPYEKVT

SEQ ID NO: 2971429 - protein, 19 aa, Entamoeba invadens
TPPRTRLTAKLSKQKVEKH

SEQ ID NO: 2971430 - protein, 24 aa, Entamoeba invadens
TPPTRASVELKLRHNTGDEKIYKR

SEQ ID NO: 2971431 - protein, 20 aa, Entamoeba invadens
TPQCPLGYSVSENGKCTESI

SEQ ID NO: 2971432 - protein, 24 aa, Entamoeba invadens
TPQEKALCSVSFFPPKPSYNTCHF

SEQ ID NO: 2971433 - protein, 26 aa, Entamoeba invadens
TPQKIEIKVLWKLENDTLIPAVLSIF

SEQ ID NO: 2971434 - protein, 29 aa, Entamoeba invadens
TPQLPEVWYNMGSLYVYHGQKEDAISSFK

SEQ ID NO: 2971435 - protein, 20 aa, Entamoeba invadens
TPQMKHIVSLIFEKSTKEEP

SEQ ID NO: 2971436 - protein, 18 aa, Entamoeba invadens
TPQNTIAFNEFLKRRCVE

SEQ ID NO: 2971437 - protein, 25 aa, Entamoeba invadens
TPQPEPCYPPAVPWVESSADLPYIP

SEQ ID NO: 2971438 - protein, 18 aa, Entamoeba invadens
TPQRSLHGHSHFISDLVL

SEQ ID NO: 2971439 - protein, 30 aa, Entamoeba invadens
TPQVPQWIYSIEELKDFRANTIRARDSIYE

SEQ ID NO: 2971440 - protein, 27 aa, Entamoeba invadens
TPRDSCSLVLFPMCRSGDMFDSQTLKH

SEQ ID NO: 2971441 - protein, 20 aa, Entamoeba invadens
TPRGFTLRPKIEVNDHHEEK

SEQ ID NO: 2971442 - protein, 18 aa, Entamoeba invadens
TPRLSPRPAKTDKKKKKG

SEQ ID NO: 2971443 - protein, 20 aa, Entamoeba invadens
TPSFPRRRIYNNILETVGGT

SEQ ID NO: 2971444 - protein, 17 aa, Entamoeba invadens
TPSHLLSALKSSVQYVL

SEQ ID NO: 2971445 - protein, 25 aa, Entamoeba invadens
TPSLLKCFQRAAGVAVKEMKELAIS

SEQ ID NO: 2971446 - protein, 19 aa, Entamoeba invadens
TPSPRKFLNEKRIVNKSRL

SEQ ID NO: 2971447 - protein, 18 aa, Entamoeba invadens
TPSQFCLSIFESQQTTGL

SEQ ID NO: 2971448 - protein, 19 aa, Entamoeba invadens
TPSYIVWKKEMEELKKDNV

SEQ ID NO: 2971449 - protein, 23 aa, Entamoeba invadens
TPTILKPTMLWTGKQVVSAILLH

SEQ ID NO: 2971450 - protein, 26 aa, Entamoeba invadens
TPTKEEIKEAVPLNFNGNEEVKKMIE

SEQ ID NO: 2971451 - protein, 23 aa, Entamoeba invadens
TPTKLILKIGVSMYDMIDNVWFE

SEQ ID NO: 2971452 - protein, 17 aa, Entamoeba invadens
TPTKLPRIVYNSDESLL

SEQ ID NO: 2971453 - protein, 19 aa, Entamoeba invadens
TPTKRRGVVTSSQPEESQT

SEQ ID NO: 2971454 - protein, 17 aa, Entamoeba invadens
TPTLLCFNNPLENNTNS

SEQ ID NO: 2971455 - protein, 21 aa, Entamoeba invadens
TPTPFILKLFELVNNPESQHL

SEQ ID NO: 2971456 - protein, 25 aa, Entamoeba invadens
TPTWRIRFCRRCWTPHVFSKKRVVR

SEQ ID NO: 2971457 - protein, 26 aa, Entamoeba invadens
TPVESFSWKVGNDIIQIDGRPISIEG

SEQ ID NO: 2971458 - protein, 20 aa, Entamoeba invadens
TPVGVSWAYLFGEQGLQLDP

SEQ ID NO: 2971459 - protein, 23 aa, Entamoeba invadens
TPVHRKVCLDLSQYTFLSEIKND

SEQ ID NO: 2971460 - protein, 26 aa, Entamoeba invadens
TPVHYKESGVCLGRIRSKYLAKKCIG

SEQ ID NO: 2971461 - protein, 27 aa, Entamoeba invadens
TPVLKKDIPALWFRSSIKTSVSKIEDV

SEQ ID NO: 2971462 - protein, 17 aa, Entamoeba invadens
TPVMRMSIFDTKKRGTF

SEQ ID NO: 2971463 - protein, 17 aa, Entamoeba invadens
TPVPAFYKFLDLLADKV

SEQ ID NO: 2971464 - protein, 25 aa, Entamoeba invadens
TPVQRLPRYNLLLTDLLKQTPEDHV

SEQ ID NO: 2971465 - protein, 18 aa, Entamoeba invadens
TPYICDFAPFKPFYLPDD

SEQ ID NO: 2971466 - protein, 28 aa, Entamoeba invadens
TPYTIPMLITLVMSRFSDQISHEVINYM

SEQ ID NO: 2971467 - protein, 20 aa, Entamoeba invadens
TQAARYVFLGDYVDRGEFGV

SEQ ID NO: 2971468 - protein, 20 aa, Entamoeba invadens
TQAKRKILYEKLKKAEKEMK

SEQ ID NO: 2971469 - protein, 19 aa, Entamoeba invadens
TQALPALGFNCSKRSIDIL

SEQ ID NO: 2971470 - protein, 25 aa, Entamoeba invadens
TQAMLKFIYHRLFVFIVEQVNRVMR

SEQ ID NO: 2971471 - protein, 26 aa, Entamoeba invadens
TQAMLKFIYHRLFVFIVEQVNRVMRK

SEQ ID NO: 2971472 - protein, 30 aa, Entamoeba invadens
TQAPKAGDCFQVIKCICTLFEGDEQCAKIE

SEQ ID NO: 2971473 - protein, 17 aa, Entamoeba invadens
TQCIDLYEKWFVKNENV

SEQ ID NO: 2971474 - protein, 26 aa, Entamoeba invadens
TQCKEDKVVIRWGISDKVCDDEKDKL

SEQ ID NO: 2971475 - protein, 19 aa, Entamoeba invadens
TQCNLKKLRLERLKDILLI

SEQ ID NO: 2971476 - protein, 26 aa, Entamoeba invadens
TQCSDAFWKFMDLIAVKKEQKNWGRF

SEQ ID NO: 2971477 - protein, 20 aa, Entamoeba invadens
TQDECSLCFFNSDKMNNSDD

SEQ ID NO: 2971478 - protein, 24 aa, Entamoeba invadens
TQDMFKEWVDVITKRALLAPKEAP

SEQ ID NO: 2971479 - protein, 24 aa, Entamoeba invadens
TQDSKWPKLNLQFSNKTPLGDGVV

SEQ ID NO: 2971480 - protein, 23 aa, Entamoeba invadens
TQDVCLFAFGLIKSTNTIFTTAF

SEQ ID NO: 2971481 - protein, 22 aa, Entamoeba invadens
TQDVVSLLGINIGQIKKSFGNE

SEQ ID NO: 2971482 - protein, 19 aa, Entamoeba invadens
TQEDLRRKKMVLMLNTPVK

SEQ ID NO: 2971483 - protein, 21 aa, Entamoeba invadens
TQEIFEMWVLNFVLKTISATK

SEQ ID NO: 2971484 - protein, 20 aa, Entamoeba invadens
TQEKIEMIFMQKAVQTIQQN

SEQ ID NO: 2971485 - protein, 23 aa, Entamoeba invadens
TQEMAAVLVCFGVLHKDTLQAFL

SEQ ID NO: 2971486 - protein, 25 aa, Entamoeba invadens
TQETLLKLMTFFGVEKKYMTVENVG

SEQ ID NO: 2971487 - protein, 17 aa, Entamoeba invadens
TQEVMPAKSEARPLNAL

SEQ ID NO: 2971488 - protein, 18 aa, Entamoeba invadens
TQEVVFCSNCHKRGHSSR

SEQ ID NO: 2971489 - protein, 22 aa, Entamoeba invadens
TQFACLKSNLTNHLQRAKNKLT

SEQ ID NO: 2971490 - protein, 19 aa, Entamoeba invadens
TQFEEVVKFVGKNESYEIP

SEQ ID NO: 2971491 - protein, 18 aa, Entamoeba invadens
TQFEFGVAALKKFWRKMR

SEQ ID NO: 2971492 - protein, 24 aa, Entamoeba invadens
TQFERKCLICESSFYTSANGSCVK

SEQ ID NO: 2971493 - protein, 24 aa, Entamoeba invadens
TQFNTLLCMCEIFRYYDSTFLQPF

SEQ ID NO: 2971494 - protein, 17 aa, Entamoeba invadens
TQFPRYSIQEMTKNIHL

SEQ ID NO: 2971495 - protein, 18 aa, Entamoeba invadens
TQFSEWIERLLDCNEKLN

SEQ ID NO: 2971496 - protein, 17 aa, Entamoeba invadens
TQGCVPLVHPFLKTNSP

SEQ ID NO: 2971497 - protein, 21 aa, Entamoeba invadens
TQGDYCLCVTPGPTEEDAECQ

SEQ ID NO: 2971498 - protein, 23 aa, Entamoeba invadens
TQHDLKGSHMIIGDTNERTVPII

SEQ ID NO: 2971499 - protein, 21 aa, Entamoeba invadens
TQHDWKNVEVIGCDMRKMNMP

SEQ ID NO: 2971500 - protein, 24 aa, Entamoeba invadens
TQHLPVELKDGVLYNKDEYVVCKK

SEQ ID NO: 2971501 - protein, 19 aa, Entamoeba invadens
TQHRYSFVSLSKMCGICDD

SEQ ID NO: 2971502 - protein, 27 aa, Entamoeba invadens
TQHSLLFTCFSAFWIKTNQMVSINSHV

SEQ ID NO: 2971503 - protein, 23 aa, Entamoeba invadens
TQHVPKIQTTIARKIQLKSDEEK

SEQ ID NO: 2971504 - protein, 17 aa, Entamoeba invadens
TQIDTFLVILTKCFASC

SEQ ID NO: 2971505 - protein, 17 aa, Entamoeba invadens
TQIEKVAAWEVIIYSAN

SEQ ID NO: 2971506 - protein, 21 aa, Entamoeba invadens
TQIELLLEFVEIVMNIRDVGM

SEQ ID NO: 2971507 - protein, 19 aa, Entamoeba invadens
TQIELLLEFVQIVMNIRDV

SEQ ID NO: 2971508 - protein, 21 aa, Entamoeba invadens
TQIFKFPSFKTLQSAVDKLKG

SEQ ID NO: 2971509 - protein, 25 aa, Entamoeba invadens
TQIHGHHRFLAAAMMVEKYYKDTKR

SEQ ID NO: 2971510 - protein, 31 aa, Entamoeba invadens
TQIKPKKPMGISMGGGMMGMPAITLADLQKG

SEQ ID NO: 2971511 - protein, 24 aa, Entamoeba invadens
TQILTRFAEIKGISLIKKPQKKKL

SEQ ID NO: 2971512 - protein, 24 aa, Entamoeba invadens
TQINFRLDLVQSFVDNSPARLRIM

SEQ ID NO: 2971513 - protein, 21 aa, Entamoeba invadens
TQIPFCPHFTEIFPTITSVII

SEQ ID NO: 2971514 - protein, 18 aa, Entamoeba invadens
TQIRYCLPIPEALLCAKM

SEQ ID NO: 2971515 - protein, 18 aa, Entamoeba invadens
TQISEAFLLAKRSESVNA

SEQ ID NO: 2971516 - protein, 26 aa, Entamoeba invadens
TQIVKGEMLGLVIGKRVYKLTKIDLG

SEQ ID NO: 2971517 - protein, 21 aa, Entamoeba invadens
TQIVNDVPCLLKISDFEENDT

SEQ ID NO: 2971518 - protein, 30 aa, Entamoeba invadens
TQKAFSVLNLRWFNMRLIRAEYFPENKVPV

SEQ ID NO: 2971519 - protein, 26 aa, Entamoeba invadens
TQKCANTLLTHCFMASPLTSQMIIQF

SEQ ID NO: 2971520 - protein, 28 aa, Entamoeba invadens
TQKEYHELFWGCIKKYIENNSETDKDGM

SEQ ID NO: 2971521 - protein, 22 aa, Entamoeba invadens
TQKFICSTCCVQFDTSEDRNTH

SEQ ID NO: 2971522 - protein, 25 aa, Entamoeba invadens
TQKIHCIRIRSSWVMTCAYAPSMKF

SEQ ID NO: 2971523 - protein, 23 aa, Entamoeba invadens
TQKIKPLLDWFVLHSNHPYPTEE

SEQ ID NO: 2971524 - protein, 17 aa, Entamoeba invadens
TQKKFSFFFSLLLESEV

SEQ ID NO: 2971525 - protein, 23 aa, Entamoeba invadens
TQKLCMLLCSYVLPQYGSIEENT

SEQ ID NO: 2971526 - protein, 26 aa, Entamoeba invadens
TQKLKCSICGQLGHTHQNCTCTKQQQ

SEQ ID NO: 2971527 - protein, 30 aa, Entamoeba invadens
TQKLLKFKWIDPFNELGFYLFGAGVISIIQ

SEQ ID NO: 2971528 - protein, 19 aa, Entamoeba invadens
TQKNLKLLFDQAITTALKT

SEQ ID NO: 2971529 - protein, 25 aa, Entamoeba invadens
TQKNLRLLIPIEIAVKMEDREMVKL

SEQ ID NO: 2971530 - protein, 27 aa, Entamoeba invadens
TQKNLRLVFDEAFKVAISFKTNNQSNT

SEQ ID NO: 2971531 - protein, 24 aa, Entamoeba invadens
TQKRPFGDIQFMAGIYSEVTSGGR

SEQ ID NO: 2971532 - protein, 18 aa, Entamoeba invadens
TQKRVFEVFNLRYKLENM

SEQ ID NO: 2971533 - protein, 33 aa, Entamoeba invadens
TQKSSELEKEFELPDGTILRLGIVRFEVAEALF

SEQ ID NO: 2971534 - protein, 21 aa, Entamoeba invadens
TQKVRSLRSSLVMNDNDEQNS

SEQ ID NO: 2971535 - protein, 25 aa, Entamoeba invadens
TQLESCYLFEAFSFVITKLISNEYE

SEQ ID NO: 2971536 - protein, 25 aa, Entamoeba invadens
TQLFPSQFYLLSLFGFISDQLLVRT

SEQ ID NO: 2971537 - protein, 23 aa, Entamoeba invadens
TQLGACAFSRCSALTSLTISKSL

SEQ ID NO: 2971538 - protein, 17 aa, Entamoeba invadens
TQLGIEFDAIVKKRMEK

SEQ ID NO: 2971539 - protein, 17 aa, Entamoeba invadens
TQLKATFVVLFNLFDKG

SEQ ID NO: 2971540 - protein, 17 aa, Entamoeba invadens
TQLKTLCIHNGIVQDFD

SEQ ID NO: 2971541 - protein, 18 aa, Entamoeba invadens
TQLLKLKELYFINCNSIV

SEQ ID NO: 2971542 - protein, 18 aa, Entamoeba invadens
TQLLSAISLFAKTSAVYD

SEQ ID NO: 2971543 - protein, 20 aa, Entamoeba invadens
TQLLTLCFILSKQASITSNP

SEQ ID NO: 2971544 - protein, 19 aa, Entamoeba invadens
TQLPREEPLVYKVNKTCCK

SEQ ID NO: 2971545 - protein, 23 aa, Entamoeba invadens
TQLRLISSIFHFKPREAVVSLKR

SEQ ID NO: 2971546 - protein, 29 aa, Entamoeba invadens
TQLRRVLSLLPFLRYARTITMTCGENDAE

SEQ ID NO: 2971547 - protein, 22 aa, Entamoeba invadens
TQLRTQFEFCLTSSDEEAEFFS

SEQ ID NO: 2971548 - protein, 17 aa, Entamoeba invadens
TQLVCMYCHLLEREEMD

SEQ ID NO: 2971549 - protein, 19 aa, Entamoeba invadens
TQMFEDWRKTLSLSGKATK

SEQ ID NO: 2971550 - protein, 22 aa, Entamoeba invadens
TQMGYAVFYSWLKLKEQEVRNL

SEQ ID NO: 2971551 - protein, 25 aa, Entamoeba invadens
TQMKPSELRRAFTQFKRLNSIDKGD

SEQ ID NO: 2971552 - protein, 17 aa, Entamoeba invadens
TQMSLLMQSTRQSTNSR

SEQ ID NO: 2971553 - protein, 18 aa, Entamoeba invadens
TQMVEKLFAFSVTQEPTK

SEQ ID NO: 2971554 - protein, 25 aa, Entamoeba invadens
TQNFNRRLVNGFVLNLVVPNDMKYA

SEQ ID NO: 2971555 - protein, 17 aa, Entamoeba invadens
TQNVNMCCIDWGTDTIK

SEQ ID NO: 2971556 - protein, 28 aa, Entamoeba invadens
TQNWKLMPTSGLFKLGITTFYGQTKNGA

SEQ ID NO: 2971557 - protein, 28 aa, Entamoeba invadens
TQNYGFKTECIWKYSLDIYNKCITLFDS

SEQ ID NO: 2971558 - protein, 26 aa, Entamoeba invadens
TQPDKRLLVLYVIDMIVKLDVTRIYM

SEQ ID NO: 2971559 - protein, 18 aa, Entamoeba invadens
TQPESFGVGPSFDLNLIS

SEQ ID NO: 2971560 - protein, 19 aa, Entamoeba invadens
TQPGYFLPKECCESPQKIQ

SEQ ID NO: 2971561 - protein, 17 aa, Entamoeba invadens
TQPIFFFGYGESIEDPI

SEQ ID NO: 2971562 - protein, 24 aa, Entamoeba invadens
TQPKSVLSFCAKIVVVGERRNIRV

SEQ ID NO: 2971563 - protein, 22 aa, Entamoeba invadens
TQPNPFGALFGTQPMNTQPMQP

SEQ ID NO: 2971564 - protein, 17 aa, Entamoeba invadens
TQPRRVAAISVSTRVAK

SEQ ID NO: 2971565 - protein, 18 aa, Entamoeba invadens
TQPSLWVNPEFVSGLSAE

SEQ ID NO: 2971566 - protein, 24 aa, Entamoeba invadens
TQPTRAGCYAVAWNPVQSQLVSGH

SEQ ID NO: 2971567 - protein, 24 aa, Entamoeba invadens
TQQEVNGSFYLTNKITVINGKVVQ

SEQ ID NO: 2971568 - protein, 24 aa, Entamoeba invadens
TQQLHSIFNIHAYRCLEEFLRVIK

SEQ ID NO: 2971569 - protein, 18 aa, Entamoeba invadens
TQQMKIIFQGLAGLQALK

SEQ ID NO: 2971570 - protein, 18 aa, Entamoeba invadens
TQQMKIIFQGLAGPKVLK

SEQ ID NO: 2971571 - protein, 22 aa, Entamoeba invadens
TQRDCLFSSLLKTADVKQAISF

SEQ ID NO: 2971572 - protein, 26 aa, Entamoeba invadens
TQRDCMKKSCFMCWHGTWSYENATGI

SEQ ID NO: 2971573 - protein, 23 aa, Entamoeba invadens
TQRESFNKVVEWYDDVMSKSEGS

SEQ ID NO: 2971574 - protein, 24 aa, Entamoeba invadens
TQRFKRLFSNEMRPLMTSENMPYI

SEQ ID NO: 2971575 - protein, 23 aa, Entamoeba invadens
TQRHIPRPKMFVDNTAPLSIQLA

SEQ ID NO: 2971576 - protein, 19 aa, Entamoeba invadens
TQRIFPNMETIYLYFPLNE

SEQ ID NO: 2971577 - protein, 24 aa, Entamoeba invadens
TQRKDSINVLKWCPIEPHQNQEAG

SEQ ID NO: 2971578 - protein, 23 aa, Entamoeba invadens
TQRNIEFSIPMFSDIVGHSIETS

SEQ ID NO: 2971579 - protein, 18 aa, Entamoeba invadens
TQRSKKRLLTASENLAET

SEQ ID NO: 2971580 - protein, 19 aa, Entamoeba invadens
TQRTCPGRNVSPTPIRLRI

SEQ ID NO: 2971581 - protein, 22 aa, Entamoeba invadens
TQRYPGVPLMMLTATATERVQN

SEQ ID NO: 2971582 - protein, 35 aa, Entamoeba invadens
TQSELCIAALKFAVNFLRKGGWFISKVFRSQDYYS

SEQ ID NO: 2971583 - protein, 24 aa, Entamoeba invadens
TQSESTVSMAFVFTDTEIAQVSLI

SEQ ID NO: 2971584 - protein, 20 aa, Entamoeba invadens
TQSHSINFILFVQGSLQVMR

SEQ ID NO: 2971585 - protein, 18 aa, Entamoeba invadens
TQSIKRSEALYIFEDLLL

SEQ ID NO: 2971586 - protein, 17 aa, Entamoeba invadens
TQSLAPQFSSQVRYSAL

SEQ ID NO: 2971587 - protein, 22 aa, Entamoeba invadens
TQSLRIIIEMGTASFTLSNMED

SEQ ID NO: 2971588 - protein, 23 aa, Entamoeba invadens
TQSMKLKTLEVFNKVTEKRMLPQ

SEQ ID NO: 2971589 - protein, 25 aa, Entamoeba invadens
TQSVRLIRLENRMDQLLNESVSTRS

SEQ ID NO: 2971590 - protein, 24 aa, Entamoeba invadens
TQSVRLIRLENRMDQLLTQSVSTH

SEQ ID NO: 2971591 - protein, 19 aa, Entamoeba invadens
TQTGCSQCWTGYYQENNGC

SEQ ID NO: 2971592 - protein, 28 aa, Entamoeba invadens
TQTIKGFKEDRFSVLIATDVVARGIDIS

SEQ ID NO: 2971593 - protein, 27 aa, Entamoeba invadens
TQTLYSFWLYDFCDVFLEASKPTFRGK

SEQ ID NO: 2971594 - protein, 30 aa, Entamoeba invadens
TQTRFYEMSALKCDGVFYVIDDVTKRSLLK

SEQ ID NO: 2971595 - protein, 22 aa, Entamoeba invadens
TQTRSYFQLIFFLFEKSKTIKQ

SEQ ID NO: 2971596 - protein, 22 aa, Entamoeba invadens
TQTSFNLGELGFFNKETQKRGN

SEQ ID NO: 2971597 - protein, 23 aa, Entamoeba invadens
TQTSYNLGELGFFNKETQKRGNL

SEQ ID NO: 2971598 - protein, 24 aa, Entamoeba invadens
TQVAFKELRKMAADSAKLPKLSAL

SEQ ID NO: 2971599 - protein, 17 aa, Entamoeba invadens
TQVFVNRNGFAVHVQES

SEQ ID NO: 2971600 - protein, 17 aa, Entamoeba invadens
TQVLKFDSPFVVDGTNI

SEQ ID NO: 2971601 - protein, 23 aa, Entamoeba invadens
TQVVERKKFIVILLSILFAIEDC

SEQ ID NO: 2971602 - protein, 21 aa, Entamoeba invadens
TQYQFCRTFVLVCSGTTITIQ

SEQ ID NO: 2971603 - protein, 20 aa, Entamoeba invadens
TQYRMHPAISQFPNNNFYNG

SEQ ID NO: 2971604 - protein, 29 aa, Entamoeba invadens
TRAAKEGKRVVGVLLGFIRRGVVDVMNSF

SEQ ID NO: 2971605 - protein, 21 aa, Entamoeba invadens
TRADATIAFATKDLISIIKTV

SEQ ID NO: 2971606 - protein, 33 aa, Entamoeba invadens
TRADFCYAATVALNWSLCVGVSMCGGAHAVGHE

SEQ ID NO: 2971607 - protein, 26 aa, Entamoeba invadens
TRAESLRPVLGYDLLQYLDVLPVTPE

SEQ ID NO: 2971608 - protein, 17 aa, Entamoeba invadens
TRAETFSAVTDWVEELK

SEQ ID NO: 2971609 - protein, 23 aa, Entamoeba invadens
TRAGNCGQPGSSRDGADVEIQGL

SEQ ID NO: 2971610 - protein, 24 aa, Entamoeba invadens
TRAKSKLKGVVISHEILLSVLEPI

SEQ ID NO: 2971611 - protein, 18 aa, Entamoeba invadens
TRAMIKSDIEVRMLEIMK

SEQ ID NO: 2971612 - protein, 21 aa, Entamoeba invadens
TRARSGVLIGSLTTLCEVEDF

SEQ ID NO: 2971613 - protein, 19 aa, Entamoeba invadens
TRATVNFASPQRVTATKQF

SEQ ID NO: 2971614 - protein, 24 aa, Entamoeba invadens
TRAVSLLDQLACFFVNDHQSLYCV

SEQ ID NO: 2971615 - protein, 25 aa, Entamoeba invadens
TRCFLFKNLKCLVIDEADRILEAGF

SEQ ID NO: 2971616 - protein, 29 aa, Entamoeba invadens
TRDALKRYIKLFLFDGVKYRVAALPYFVS

SEQ ID NO: 2971617 - protein, 19 aa, Entamoeba invadens
TRDHIISALLLKKNIGVFV

SEQ ID NO: 2971618 - protein, 29 aa, Entamoeba invadens
TRDILGKCCLSIFRRCEETIKETLKKGNI

SEQ ID NO: 2971619 - protein, 18 aa, Entamoeba invadens
TRDLPGMLLSSSVSQDLL

SEQ ID NO: 2971620 - protein, 17 aa, Entamoeba invadens
TRDMVLPMLCRRFKTTV

SEQ ID NO: 2971621 - protein, 25 aa, Entamoeba invadens
TRDNLLMFFQFFYQKALALPPTDET

SEQ ID NO: 2971622 - protein, 30 aa, Entamoeba invadens
TREAQICNGLLYLLRASGFTFSVKQTKKAK

SEQ ID NO: 2971623 - protein, 22 aa, Entamoeba invadens
TREIKLKKAFEVFDQDHDGKIK

SEQ ID NO: 2971624 - protein, 30 aa, Entamoeba invadens
TREMLHADLLSFIHVMYLKLEDILAKQDKL

SEQ ID NO: 2971625 - protein, 19 aa, Entamoeba invadens
TRENIIFITIEEAYCGCTK

SEQ ID NO: 2971626 - protein, 26 aa, Entamoeba invadens
TRESFKQEIKAIVPLDRKKEIEELDE

SEQ ID NO: 2971627 - protein, 23 aa, Entamoeba invadens
TRESRVSPILLGISRSGSVLREM

SEQ ID NO: 2971628 - protein, 27 aa, Entamoeba invadens
TREVISLKCLVGLCMLKNPVRSRYCKH

SEQ ID NO: 2971629 - protein, 24 aa, Entamoeba invadens
TREWTDLSTMYVMLKYRKWQIKER

SEQ ID NO: 2971630 - protein, 18 aa, Entamoeba invadens
TRFNSCYLSFSKLLKREK

SEQ ID NO: 2971631 - protein, 19 aa, Entamoeba invadens
TRFSKLFLKNAKNVCVPRK

SEQ ID NO: 2971632 - protein, 18 aa, Entamoeba invadens
TRFSRSFSGEMKGETTKT

SEQ ID NO: 2971633 - protein, 21 aa, Entamoeba invadens
TRFTTLAWRMYVDVSSSQRFI

SEQ ID NO: 2971634 - protein, 27 aa, Entamoeba invadens
TRFVGLCKTFSFLDTFKTIFVIVMEMG

SEQ ID NO: 2971635 - protein, 20 aa, Entamoeba invadens
TRFYAAELLIGLKYLHDAGI

SEQ ID NO: 2971636 - protein, 19 aa, Entamoeba invadens
TRFYPLKLGNSVYIFQNDY

SEQ ID NO: 2971637 - protein, 21 aa, Entamoeba invadens
TRFYRKWEICEKTNPTKFPSI

SEQ ID NO: 2971638 - protein, 19 aa, Entamoeba invadens
TRFYTCRNLILTPLRLSVK

SEQ ID NO: 2971639 - protein, 26 aa, Entamoeba invadens
TRGITWGVEMMSCRQLDYERNLRVSK

SEQ ID NO: 2971640 - protein, 40 aa, Entamoeba invadens
TRGKMTHNLLYPWKIYVYDALTEVYVWVGPKSSQTLRKIL

SEQ ID NO: 2971641 - protein, 27 aa, Entamoeba invadens
TRGTAACGMYFLFGLLLSAGFKQVGTI

SEQ ID NO: 2971642 - protein, 27 aa, Entamoeba invadens
TRGTPYKRLCEVSRKSYADYIFEIQKK

SEQ ID NO: 2971643 - protein, 18 aa, Entamoeba invadens
TRGTYGAFVMEFGADDAG

SEQ ID NO: 2971644 - protein, 27 aa, Entamoeba invadens
TRHIINMGKSCFKNCTQLSAITVKSTT

SEQ ID NO: 2971645 - protein, 34 aa, Entamoeba invadens
TRHPFIVHLYWSFSTEMCFYFVMDYCSGGDFYHT

SEQ ID NO: 2971646 - protein, 23 aa, Entamoeba invadens
TRHSKMSSTLLCITKSCEVVGSF

SEQ ID NO: 2971647 - protein, 26 aa, Entamoeba invadens
TRHTNCLFFIAIQIWRGIPAQIKSIL

SEQ ID NO: 2971648 - protein, 19 aa, Entamoeba invadens
TRHVELYELLYGMDTTKNK

SEQ ID NO: 2971649 - protein, 18 aa, Entamoeba invadens
TRIAELLLPMLRYNENER

SEQ ID NO: 2971650 - protein, 25 aa, Entamoeba invadens
TRIAMPDCRIVFLLFSLIPSTCVGK

SEQ ID NO: 2971651 - protein, 17 aa, Entamoeba invadens
TRIDLPVIVPINRAEKK

SEQ ID NO: 2971652 - protein, 17 aa, Entamoeba invadens
TRIEGTLDRLSETNSVR

SEQ ID NO: 2971653 - protein, 29 aa, Entamoeba invadens
TRIEGVKGRRARELYKWGLRSVDDVADAT

SEQ ID NO: 2971654 - protein, 24 aa, Entamoeba invadens
TRIGCLLNKLGLTMEFEMFKKLLN

SEQ ID NO: 2971655 - protein, 24 aa, Entamoeba invadens
TRIGNSCFRGCSLLKSIILPNNIK

SEQ ID NO: 2971656 - protein, 25 aa, Entamoeba invadens
TRIKSYSCGLSLKKEDPVADSFFQE

SEQ ID NO: 2971657 - protein, 24 aa, Entamoeba invadens
TRIKVCTLLDHWNRHNTFGMDIVN

SEQ ID NO: 2971658 - protein, 17 aa, Entamoeba invadens
TRILTCANCGFGWKRSC

SEQ ID NO: 2971659 - protein, 24 aa, Entamoeba invadens
TRIRDLRIPYSVWVTSSRSTLELV

SEQ ID NO: 2971660 - protein, 21 aa, Entamoeba invadens
TRITFGTSLHVPKCVLYHPTL

SEQ ID NO: 2971661 - protein, 18 aa, Entamoeba invadens
TRIVRFAMIDSVYNSQFS

SEQ ID NO: 2971662 - protein, 17 aa, Entamoeba invadens
TRKAVELSGDYWMSNEN

SEQ ID NO: 2971663 - protein, 20 aa, Entamoeba invadens
TRKCFGNELILHGLNTAEYY

SEQ ID NO: 2971664 - protein, 36 aa, Entamoeba invadens
TRKCSPRVRHGICAMAAIRYFIEMIRAGKGELPFCL

SEQ ID NO: 2971665 - protein, 22 aa, Entamoeba invadens
TRKDVKKHIAIVFENGKKVGKI

SEQ ID NO: 2971666 - protein, 20 aa, Entamoeba invadens
TRKFKYLKFDCASRGTEICK

SEQ ID NO: 2971667 - protein, 29 aa, Entamoeba invadens
TRKHHCRRCGKVFCSSCCVDFVLMKDLGF

SEQ ID NO: 2971668 - protein, 21 aa, Entamoeba invadens
TRKHRMQVLIVDKSLHVIHPS

SEQ ID NO: 2971669 - protein, 17 aa, Entamoeba invadens
TRKIDLIRKVILLYCKD

SEQ ID NO: 2971670 - protein, 23 aa, Entamoeba invadens
TRKKRWCVLTRNKLFYFDQKPDG

SEQ ID NO: 2971671 - protein, 23 aa, Entamoeba invadens
TRKMMCSMFSSLISRLKITVPKD

SEQ ID NO: 2971672 - protein, 19 aa, Entamoeba invadens
TRKNLCMTMFEGFNCPYFC

SEQ ID NO: 2971673 - protein, 23 aa, Entamoeba invadens
TRKRTKKSVVKKMDIEEENSEES

SEQ ID NO: 2971674 - protein, 23 aa, Entamoeba invadens
TRKVGWMLFVWRMQSAWKEGKME

SEQ ID NO: 2971675 - protein, 18 aa, Entamoeba invadens
TRLCPSFFAYNSLTSFKF

SEQ ID NO: 2971676 - protein, 20 aa, Entamoeba invadens
TRLCRIGVSCFERCGSLKKI

SEQ ID NO: 2971677 - protein, 18 aa, Entamoeba invadens
TRLKMAEVERALRNKTVV

SEQ ID NO: 2971678 - protein, 21 aa, Entamoeba invadens
TRLLDRGKLYPLVTTIKQTQA

SEQ ID NO: 2971679 - protein, 20 aa, Entamoeba invadens
TRLMPQVLHQIFDALEKSAP

SEQ ID NO: 2971680 - protein, 24 aa, Entamoeba invadens
TRLPKEITHDTFLEFFKEYNPTSC

SEQ ID NO: 2971681 - protein, 18 aa, Entamoeba invadens
TRLPKLVSLSSLNISNNP

SEQ ID NO: 2971682 - protein, 18 aa, Entamoeba invadens
TRLQVVEIPKCVASLGDK

SEQ ID NO: 2971683 - protein, 19 aa, Entamoeba invadens
TRLSSLHYIEGMKISLVNR

SEQ ID NO: 2971684 - protein, 17 aa, Entamoeba invadens
TRLVIPPDVDPIKYHTI

SEQ ID NO: 2971685 - protein, 27 aa, Entamoeba invadens
TRLYEKSVNPFWCEVFQVDATLGEDII

SEQ ID NO: 2971686 - protein, 18 aa, Entamoeba invadens
TRLYLRKGKGEQRIVKLY

SEQ ID NO: 2971687 - protein, 22 aa, Entamoeba invadens
TRNEKKSMYALMYNTLSQHIIT

SEQ ID NO: 2971688 - protein, 24 aa, Entamoeba invadens
TRNETKEVLEWVRNLTGVNTTTFK

SEQ ID NO: 2971689 - protein, 25 aa, Entamoeba invadens
TRNFLLRKLINGGRMAEMAPSFETS

SEQ ID NO: 2971690 - protein, 17 aa, Entamoeba invadens
TRNIIPKLIEKVNGVVL

SEQ ID NO: 2971691 - protein, 17 aa, Entamoeba invadens
TRNLIGVTIIYGPDSSS

SEQ ID NO: 2971692 - protein, 20 aa, Entamoeba invadens
TRNRNRLCFLVEDTQNNKFG

SEQ ID NO: 2971693 - protein, 19 aa, Entamoeba invadens
TRNSVIKKEIPAVENQSIQ

SEQ ID NO: 2971694 - protein, 26 aa, Entamoeba invadens
TRNTRFCLICNYISRILPPISSRCIK

SEQ ID NO: 2971695 - protein, 19 aa, Entamoeba invadens
TRNVYWLGVTTLLTKQVNN

SEQ ID NO: 2971696 - protein, 22 aa, Entamoeba invadens
TRPIRICPSTDLLKKVKLSQST

SEQ ID NO: 2971697 - protein, 21 aa, Entamoeba invadens
TRPMVRRTFEVVFNSKDVRNV

SEQ ID NO: 2971698 - protein, 21 aa, Entamoeba invadens
TRPPKDISLCNGLSDVLIEVG

SEQ ID NO: 2971699 - protein, 25 aa, Entamoeba invadens
TRPRVCCVSESKKLLTTIIYGYKEE

SEQ ID NO: 2971700 - protein, 20 aa, Entamoeba invadens
TRPRVCCVSESKRLLPSIIY

SEQ ID NO: 2971701 - protein, 30 aa, Entamoeba invadens
TRPRVCCVSESKRLLPTIVYGYKDDSVLNV

SEQ ID NO: 2971702 - protein, 53 aa, Entamoeba invadens
TRPTRRVMLEVARKRWDYLQRMNMLPSRRFKRKVKPMLANTVPYYLYSPGMTM

SEQ ID NO: 2971703 - protein, 23 aa, Entamoeba invadens
TRPWLYELSQKYSRDITTIRQIP

SEQ ID NO: 2971704 - protein, 22 aa, Entamoeba invadens
TRQCPVCRGTITAAINFSRKPE

SEQ ID NO: 2971705 - protein, 20 aa, Entamoeba invadens
TRQNFGNDLQPVIDLIESKQ

SEQ ID NO: 2971706 - protein, 25 aa, Entamoeba invadens
TRRAIFKLFCTFGASSYGYKLLVYL

SEQ ID NO: 2971707 - protein, 20 aa, Entamoeba invadens
TRRDMHVGFVADTFLSAMYI

SEQ ID NO: 2971708 - protein, 31 aa, Entamoeba invadens
TRRFFFKVIFNRLTIAPAFRITGSLLENEVK

SEQ ID NO: 2971709 - protein, 21 aa, Entamoeba invadens
TRRFSLKYNLATSVQKLSLLL

SEQ ID NO: 2971710 - protein, 24 aa, Entamoeba invadens
TRRRFQATYNRCIRQYPNFEKEQL

SEQ ID NO: 2971711 - protein, 19 aa, Entamoeba invadens
TRRSAGLPYHLVSLLNEEC

SEQ ID NO: 2971712 - protein, 17 aa, Entamoeba invadens
TRRVVLSKIFSGTAALL

SEQ ID NO: 2971713 - protein, 21 aa, Entamoeba invadens
TRRVYCLATSAPIMTTSARIL

SEQ ID NO: 2971714 - protein, 30 aa, Entamoeba invadens
TRSGKWKEALRICVELGLPKEALNCCYHCD

SEQ ID NO: 2971715 - protein, 25 aa, Entamoeba invadens
TRSGSFLPTLIPYILHPFSEKKLIP

SEQ ID NO: 2971716 - protein, 24 aa, Entamoeba invadens
TRSKFPWLDVIDFNFTQPINERDY

SEQ ID NO: 2971717 - protein, 19 aa, Entamoeba invadens
TRSSPLIQRGNRMSGMTLS

SEQ ID NO: 2971718 - protein, 26 aa, Entamoeba invadens
TRSTWPVLQAMNWKSYALKYPELYGK

SEQ ID NO: 2971719 - protein, 25 aa, Entamoeba invadens
TRSTWPVLQAMNWKSYAPKYPELYG

SEQ ID NO: 2971720 - protein, 20 aa, Entamoeba invadens
TRSVALMSMVGYILGLGDRH

SEQ ID NO: 2971721 - protein, 19 aa, Entamoeba invadens
TRSVLLRDRLIGLIRSLLK

SEQ ID NO: 2971722 - protein, 40 aa, Entamoeba invadens
TRTGFGQVCPYGQYAPIFFQFLDCVHILIAQFPNLFEFNE

SEQ ID NO: 2971723 - protein, 26 aa, Entamoeba invadens
TRTGIPKIRAFFLFQTPKMLSLLQRE

SEQ ID NO: 2971724 - protein, 25 aa, Entamoeba invadens
TRTIRKLRCNQNGTLACCSFDATIS

SEQ ID NO: 2971725 - protein, 19 aa, Entamoeba invadens
TRTLFKVVAAFVDHFFGKN

SEQ ID NO: 2971726 - protein, 19 aa, Entamoeba invadens
TRVAYALTFPYSEDAKVLV

SEQ ID NO: 2971727 - protein, 18 aa, Entamoeba invadens
TRVFKLKLDQLIKEITKW

SEQ ID NO: 2971728 - protein, 23 aa, Entamoeba invadens
TRVGEMRKSISILEECGVVKQIA

SEQ ID NO: 2971729 - protein, 23 aa, Entamoeba invadens
TRVGWAKCKKIVCSESVEQIIVK

SEQ ID NO: 2971730 - protein, 19 aa, Entamoeba invadens
TRVIDRKPLRIAEGTGNVV

SEQ ID NO: 2971731 - protein, 18 aa, Entamoeba invadens
TRVLVKAVQPGTVEKTEQ

SEQ ID NO: 2971732 - protein, 21 aa, Entamoeba invadens
TRVRVLKRLIAALPDSNRHVL

SEQ ID NO: 2971733 - protein, 23 aa, Entamoeba invadens
TRVSWAKCKKIVCSESVEQIVVK

SEQ ID NO: 2971734 - protein, 26 aa, Entamoeba invadens
TRVTKCFEEICLPPLNILKTNYEKKR

SEQ ID NO: 2971735 - protein, 17 aa, Entamoeba invadens
TRWCATKSFFVLCHSAL

SEQ ID NO: 2971736 - protein, 19 aa, Entamoeba invadens
TRYCPKCETPVIGDPNHPK

SEQ ID NO: 2971737 - protein, 19 aa, Entamoeba invadens
TRYFFPKIETLVIYTTKDY

SEQ ID NO: 2971738 - protein, 21 aa, Entamoeba invadens
TRYIIKSKFLSYSFNNELHSK

SEQ ID NO: 2971739 - protein, 25 aa, Entamoeba invadens
TRYKEWILTSELGFGGFGSVYKAQN

SEQ ID NO: 2971740 - protein, 21 aa, Entamoeba invadens
TRYNELCEAFKNFKKNKDNVI

SEQ ID NO: 2971741 - protein, 20 aa, Entamoeba invadens
TRYNFLERMCDPCGRPPPER

SEQ ID NO: 2971742 - protein, 18 aa, Entamoeba invadens
TRYPRTDIIQSFCYGFVE

SEQ ID NO: 2971743 - protein, 18 aa, Entamoeba invadens
TRYTMMGQPLCSYPNCNK

SEQ ID NO: 2971744 - protein, 21 aa, Entamoeba invadens
TSADEELYWGVVSQITECTLF

SEQ ID NO: 2971745 - protein, 19 aa, Entamoeba invadens
TSAKLGINVKEAFTSLVQD

SEQ ID NO: 2971746 - protein, 22 aa, Entamoeba invadens
TSAKWACVGEYPLLKANPFDSS

SEQ ID NO: 2971747 - protein, 21 aa, Entamoeba invadens
TSALPENWYTTEIETLNSGEL

SEQ ID NO: 2971748 - protein, 24 aa, Entamoeba invadens
TSARELWPRRSLDRKGVDINESES

SEQ ID NO: 2971749 - protein, 21 aa, Entamoeba invadens
TSAVFLYQICLALGNMTQTMT

SEQ ID NO: 2971750 - protein, 21 aa, Entamoeba invadens
TSCFDHCLFSSIVLPSTLEHL

SEQ ID NO: 2971751 - protein, 20 aa, Entamoeba invadens
TSCFEGCGLVKLVCKAKRFG

SEQ ID NO: 2971752 - protein, 24 aa, Entamoeba invadens
TSCFKRVKLPFLSKKLILSEDQVE

SEQ ID NO: 2971753 - protein, 18 aa, Entamoeba invadens
TSCSVCADGYFIIESESR

SEQ ID NO: 2971754 - protein, 25 aa, Entamoeba invadens
TSDDCLTCNSGFFKYGLSNCLSCHN

SEQ ID NO: 2971755 - protein, 23 aa, Entamoeba invadens
TSDGKIYVHHLIKEMYPGLKNMT

SEQ ID NO: 2971756 - protein, 20 aa, Entamoeba invadens
TSDITRLLKHLCRNNLENST

SEQ ID NO: 2971757 - protein, 25 aa, Entamoeba invadens
TSDKLRLTALRVYRTQVARNRLKTL

SEQ ID NO: 2971758 - protein, 24 aa, Entamoeba invadens
TSDLLDILNLISLTFASKTNVVLV

SEQ ID NO: 2971759 - protein, 26 aa, Entamoeba invadens
TSDNKCAKCQSGYWVDTLTNTCVDHE

SEQ ID NO: 2971760 - protein, 22 aa, Entamoeba invadens
TSEAKMSIEFKIDETKEKRLYQ

SEQ ID NO: 2971761 - protein, 24 aa, Entamoeba invadens
TSEFCSKFTTFILMESVEINPEIF

SEQ ID NO: 2971762 - protein, 22 aa, Entamoeba invadens
TSEGVLPDFCELVKITGCSTVE

SEQ ID NO: 2971763 - protein, 25 aa, Entamoeba invadens
TSEIKIKIGNYYGEGDAKSWVEWIL

SEQ ID NO: 2971764 - protein, 22 aa, Entamoeba invadens
TSEKRLSSKIIVIRKEKEKVNY

SEQ ID NO: 2971765 - protein, 23 aa, Entamoeba invadens
TSELRCKRKVIILEGNSEVLAGY

SEQ ID NO: 2971766 - protein, 18 aa, Entamoeba invadens
TSELTCGVIRLQLPGNGE

SEQ ID NO: 2971767 - protein, 26 aa, Entamoeba invadens
TSENMPYIQLMWALMKIRLENDKIAS

SEQ ID NO: 2971768 - protein, 18 aa, Entamoeba invadens
TSENVVFFGNFRISEKVI

SEQ ID NO: 2971769 - protein, 19 aa, Entamoeba invadens
TSESNCLLFSQTIDTTIAV

SEQ ID NO: 2971770 - protein, 25 aa, Entamoeba invadens
TSEVFSSVCGMNLQLVLDADKDKQC

SEQ ID NO: 2971771 - protein, 21 aa, Entamoeba invadens
TSFCLYPKCQWQHHQTTRLLL

SEQ ID NO: 2971772 - protein, 33 aa, Entamoeba invadens
TSFDQALRVEARVGDQITFELCSKVGRDKLDVL

SEQ ID NO: 2971773 - protein, 25 aa, Entamoeba invadens
TSFELVKHPWLSTAQVRLDVDEEMD

SEQ ID NO: 2971774 - protein, 18 aa, Entamoeba invadens
TSFEMIKSPFLEIKGSKA

SEQ ID NO: 2971775 - protein, 21 aa, Entamoeba invadens
TSFESFMEWYMYRIIEYNTTH

SEQ ID NO: 2971776 - protein, 17 aa, Entamoeba invadens
TSFFKNTNSIFLVYTKS

SEQ ID NO: 2971777 - protein, 28 aa, Entamoeba invadens
TSFFQTKIRVCIHFEISFATKLQLEKKY

SEQ ID NO: 2971778 - protein, 22 aa, Entamoeba invadens
TSFGKCCFCGCSNLKSITLSFH

SEQ ID NO: 2971779 - protein, 17 aa, Entamoeba invadens
TSFKFPNTMRKFGKELF

SEQ ID NO: 2971780 - protein, 19 aa, Entamoeba invadens
TSFMQKLFSMIFIVNPDDR

SEQ ID NO: 2971781 - protein, 26 aa, Entamoeba invadens
TSFSGEYFFSLPFPYCVISTAEQSVS

SEQ ID NO: 2971782 - protein, 17 aa, Entamoeba invadens
TSFSNSCFRVCSSLTSI

SEQ ID NO: 2971783 - protein, 17 aa, Entamoeba invadens
TSGCVWDVIPSSVKELI

SEQ ID NO: 2971784 - protein, 30 aa, Entamoeba invadens
TSGEDEFPCWFEGPPFKFKKSMRDIHTRFI

SEQ ID NO: 2971785 - protein, 20 aa, Entamoeba invadens
TSGFCSCSSLELVDIPQTLS

SEQ ID NO: 2971786 - protein, 25 aa, Entamoeba invadens
TSGFCSQCLVNYTITFPISKVCVKC

SEQ ID NO: 2971787 - protein, 29 aa, Entamoeba invadens
TSGFLVLRRCVGMIIRLSVLVFGFDTQFD

SEQ ID NO: 2971788 - protein, 18 aa, Entamoeba invadens
TSGIPTEVALVMTNAAGK

SEQ ID NO: 2971789 - protein, 31 aa, Entamoeba invadens
TSGKDFLRRRACLMMYPMCKEYPDALRPSFA

SEQ ID NO: 2971790 - protein, 18 aa, Entamoeba invadens
TSGKMCKSAKIVKGAVVK

SEQ ID NO: 2971791 - protein, 26 aa, Entamoeba invadens
TSGLNKVCFSKCVFKTNYNIDDNNEF

SEQ ID NO: 2971792 - protein, 22 aa, Entamoeba invadens
TSGLVFRFQLPSSLAYKHLHFY

SEQ ID NO: 2971793 - protein, 20 aa, Entamoeba invadens
TSGNFLFEFRRCPCDIEGDG

SEQ ID NO: 2971794 - protein, 17 aa, Entamoeba invadens
TSGRLTGLVLDSGDGVT

SEQ ID NO: 2971795 - protein, 25 aa, Entamoeba invadens
TSGVDFPYLFLWGEFFGGYDQVQMG

SEQ ID NO: 2971796 - protein, 17 aa, Entamoeba invadens
TSGYLEWTDSKENVLKT

SEQ ID NO: 2971797 - protein, 18 aa, Entamoeba invadens
TSHIFKIDMDVVNSRNKK

SEQ ID NO: 2971798 - protein, 22 aa, Entamoeba invadens
TSIACELVYGRGLDWKISVLDI

SEQ ID NO: 2971799 - protein, 24 aa, Entamoeba invadens
TSIAIGGTSAWKASFALKDSTFGF

SEQ ID NO: 2971800 - protein, 19 aa, Entamoeba invadens
TSIAMALEYCDSNLVTQME

SEQ ID NO: 2971801 - protein, 24 aa, Entamoeba invadens
TSIAMSKLDRYSMMIVSKYFESEE

SEQ ID NO: 2971802 - protein, 19 aa, Entamoeba invadens
TSIATVFYFWDIEKVEETA

SEQ ID NO: 2971803 - protein, 17 aa, Entamoeba invadens
TSICTRYTMDIFVENYY

SEQ ID NO: 2971804 - protein, 17 aa, Entamoeba invadens
TSICTRYTMNIFVENYH

SEQ ID NO: 2971805 - protein, 25 aa, Entamoeba invadens
TSIENCCFMCCKLLTSITLSNNLQS

SEQ ID NO: 2971806 - protein, 23 aa, Entamoeba invadens
TSIGCLKCVNGYYLDNYICETCF

SEQ ID NO: 2971807 - protein, 22 aa, Entamoeba invadens
TSIGDGCFRQCNSLNNVTLSLS

SEQ ID NO: 2971808 - protein, 27 aa, Entamoeba invadens
TSIGERRKAFEWHFLDLTKPKQQPPQP

SEQ ID NO: 2971809 - protein, 24 aa, Entamoeba invadens
TSIGEYCFCRCISLSKITIPSSVT

SEQ ID NO: 2971810 - protein, 22 aa, Entamoeba invadens
TSIGGCCFYECSSLSSITIPSS

SEQ ID NO: 2971811 - protein, 22 aa, Entamoeba invadens
TSIGGYCFSWCFNLSSVTIPSS

SEQ ID NO: 2971812 - protein, 28 aa, Entamoeba invadens
TSIGKGCFEVCSRLSSVDIPPSVSSMGE

SEQ ID NO: 2971813 - protein, 24 aa, Entamoeba invadens
TSIGKGCFRGCSSLSSVTIQSSVT

SEQ ID NO: 2971814 - protein, 25 aa, Entamoeba invadens
TSIGKGCFYGCRLLSSIKLPHNFSK

SEQ ID NO: 2971815 - protein, 25 aa, Entamoeba invadens
TSIGLLFCGFGEFSLDSKSYNIPKL

SEQ ID NO: 2971816 - protein, 18 aa, Entamoeba invadens
TSIGRSCFANCIHMQNIT

SEQ ID NO: 2971817 - protein, 22 aa, Entamoeba invadens
TSIGTGLVIYIGQLKPETNEET

SEQ ID NO: 2971818 - protein, 24 aa, Entamoeba invadens
TSIKKCLKGVVPEMVDTIVESCNG

SEQ ID NO: 2971819 - protein, 22 aa, Entamoeba invadens
TSILHFIDFEFANSYNAIPKTN

SEQ ID NO: 2971820 - protein, 18 aa, Entamoeba invadens
TSILHIFTGSSFNRLYEE

SEQ ID NO: 2971821 - protein, 23 aa, Entamoeba invadens
TSILRYLGILLYMGAHHDVINPV

SEQ ID NO: 2971822 - protein, 24 aa, Entamoeba invadens
TSIPFLCFEGCTCLSNIEIPMSVH

SEQ ID NO: 2971823 - protein, 24 aa, Entamoeba invadens
TSIPRGCFLGCENLSNIVLPEGVT

SEQ ID NO: 2971824 - protein, 25 aa, Entamoeba invadens
TSIPRVKDILLLFNVYLHQVHQKEL

SEQ ID NO: 2971825 - protein, 21 aa, Entamoeba invadens
TSIRYGSFWDCAALTAVTISH

SEQ ID NO: 2971826 - protein, 24 aa, Entamoeba invadens
TSISQRELKAFVSRHDGFKYNGMQ

SEQ ID NO: 2971827 - protein, 19 aa, Entamoeba invadens
TSKCYALSINITFPPFDYD

SEQ ID NO: 2971828 - protein, 25 aa, Entamoeba invadens
TSKGGIFNIWFNTWFIHDNHLEFSK

SEQ ID NO: 2971829 - protein, 17 aa, Entamoeba invadens
TSKKHTILFTRFHYNPI

SEQ ID NO: 2971830 - protein, 20 aa, Entamoeba invadens
TSKLKECWHRDIKPDNILVF

SEQ ID NO: 2971831 - protein, 18 aa, Entamoeba invadens
TSKLRSGVDIVVGTPGRV

SEQ ID NO: 2971832 - protein, 21 aa, Entamoeba invadens
TSKPKFRVIMIHGADMLSQDA

SEQ ID NO: 2971833 - protein, 25 aa, Entamoeba invadens
TSKQLFFVLCDYLFNKYETMEKLRD

SEQ ID NO: 2971834 - protein, 23 aa, Entamoeba invadens
TSKRECLYLEYPIGEEDDVENND

SEQ ID NO: 2971835 - protein, 18 aa, Entamoeba invadens
TSKRIMGEISKWRLNGKR

SEQ ID NO: 2971836 - protein, 23 aa, Entamoeba invadens
TSKRSRWGRRIAKPKIIESMFTE

SEQ ID NO: 2971837 - protein, 18 aa, Entamoeba invadens
TSKVPLTVPNTFAAYERC

SEQ ID NO: 2971838 - protein, 28 aa, Entamoeba invadens
TSKVPRGGMGMVGMGMGMAGFNPSKVTL

SEQ ID NO: 2971839 - protein, 30 aa, Entamoeba invadens
TSKWKRFHTKREVVEWIKSQPIYEDILLYN

SEQ ID NO: 2971840 - protein, 21 aa, Entamoeba invadens
TSKWLPSKLKRLKVVLHTFSD

SEQ ID NO: 2971841 - protein, 19 aa, Entamoeba invadens
TSKYLFLVMELMEGGELFD

SEQ ID NO: 2971842 - protein, 17 aa, Entamoeba invadens
TSLCLSQTPHLRRIQIT

SEQ ID NO: 2971843 - protein, 23 aa, Entamoeba invadens
TSLCRRGTSSLTFEGYDPQLYQI

SEQ ID NO: 2971844 - protein, 19 aa, Entamoeba invadens
TSLECCLPALLSQKGTLKI

SEQ ID NO: 2971845 - protein, 26 aa, Entamoeba invadens
TSLEDFKDGHAFLCIMEQITHTTQKT

SEQ ID NO: 2971846 - protein, 18 aa, Entamoeba invadens
TSLFRWILSVKQQMCVGN

SEQ ID NO: 2971847 - protein, 25 aa, Entamoeba invadens
TSLGDGCFRGCYVLSSVTIPSSVKS

SEQ ID NO: 2971848 - protein, 24 aa, Entamoeba invadens
TSLGEYMRYLGINYTFCPIISLQN

SEQ ID NO: 2971849 - protein, 25 aa, Entamoeba invadens
TSLGKCCFKECVLLSHVIIEGEDKV

SEQ ID NO: 2971850 - protein, 20 aa, Entamoeba invadens
TSLGKWCFYNCTNLNSVVIP

SEQ ID NO: 2971851 - protein, 19 aa, Entamoeba invadens
TSLIRRVSLLMLSDLCKIS

SEQ ID NO: 2971852 - protein, 27 aa, Entamoeba invadens
TSLIRVCGKVGFCGYLVKFDLENFYYL

SEQ ID NO: 2971853 - protein, 25 aa, Entamoeba invadens
TSLKALPNYCFRLCSKIKEIQIPSG

SEQ ID NO: 2971854 - protein, 22 aa, Entamoeba invadens
TSLKIFSVLVHKYRFELKKEIG

SEQ ID NO: 2971855 - protein, 24 aa, Entamoeba invadens
TSLLKAQVLLKVFGGIDKMYAPED

SEQ ID NO: 2971856 - protein, 17 aa, Entamoeba invadens
TSLLPATTWPWYKLISA

SEQ ID NO: 2971857 - protein, 18 aa, Entamoeba invadens
TSLLPATTWPWYKLISAI

SEQ ID NO: 2971858 - protein, 26 aa, Entamoeba invadens
TSLLRMLSSFVLKLNTFFVDSKKTRD

SEQ ID NO: 2971859 - protein, 23 aa, Entamoeba invadens
TSLPPRIAFHLTSLFIESIPEPL

SEQ ID NO: 2971860 - protein, 20 aa, Entamoeba invadens
TSLPSIGCLLKLENIDVSNN

SEQ ID NO: 2971861 - protein, 26 aa, Entamoeba invadens
TSLQRIPTCMGMALSTRAKLQKIAKR

SEQ ID NO: 2971862 - protein, 20 aa, Entamoeba invadens
TSLRRVVFGSGLQVIHSLAF

SEQ ID NO: 2971863 - protein, 24 aa, Entamoeba invadens
TSLSSCGMAFVFKYIEAATQAGVE

SEQ ID NO: 2971864 - protein, 20 aa, Entamoeba invadens
TSLTGIKCQLSVLVDKSSFE

SEQ ID NO: 2971865 - protein, 19 aa, Entamoeba invadens
TSLTRLNVPINHMKYLYIA

SEQ ID NO: 2971866 - protein, 18 aa, Entamoeba invadens
TSLTRLVANGIIRNKISP

SEQ ID NO: 2971867 - protein, 27 aa, Entamoeba invadens
TSLVHCYRTIFTFWKEMNKSLAYGYSK

SEQ ID NO: 2971868 - protein, 25 aa, Entamoeba invadens
TSLVLECFEEFDLKYFVDLPLEKLV

SEQ ID NO: 2971869 - protein, 19 aa, Entamoeba invadens
TSLVLMPRTQIKGKMLKRN

SEQ ID NO: 2971870 - protein, 25 aa, Entamoeba invadens
TSMEISYRLPLPDSRTYGVNVDMCL

SEQ ID NO: 2971871 - protein, 23 aa, Entamoeba invadens
TSMRRIMKTLAFYTGIHEDVEPE

SEQ ID NO: 2971872 - protein, 23 aa, Entamoeba invadens
TSNEIFAQLAVPFLLDKLDADLS

SEQ ID NO: 2971873 - protein, 18 aa, Entamoeba invadens
TSNLKIVILSGGMKGFVL

SEQ ID NO: 2971874 - protein, 17 aa, Entamoeba invadens
TSNMKTCMVMCIWTTVF

SEQ ID NO: 2971875 - protein, 27 aa, Entamoeba invadens
TSNMRCVLLDWLFEVISFHFECTIETY

SEQ ID NO: 2971876 - protein, 21 aa, Entamoeba invadens
TSNPLPFQHFMNSEGNIQAVQ

SEQ ID NO: 2971877 - protein, 17 aa, Entamoeba invadens
TSNTICYKKECENSDKV

SEQ ID NO: 2971878 - protein, 20 aa, Entamoeba invadens
TSNYVFKCVILDIFNKKSLT

SEQ ID NO: 2971879 - protein, 21 aa, Entamoeba invadens
TSPILPSILLVVSCEEEDGVV

SEQ ID NO: 2971880 - protein, 22 aa, Entamoeba invadens
TSPLREKCCLIERFFGRLKTVF

SEQ ID NO: 2971881 - protein, 23 aa, Entamoeba invadens
TSPLREKCCLIKRYFGRLKTVFA

SEQ ID NO: 2971882 - protein, 26 aa, Entamoeba invadens
TSPPQIRYSFYFSYILQVLRETQSEG

SEQ ID NO: 2971883 - protein, 24 aa, Entamoeba invadens
TSPPSFTDISGWIGEFEKGVNSKE

SEQ ID NO: 2971884 - protein, 21 aa, Entamoeba invadens
TSPPWGRPGAFRNKQSLNSLF

SEQ ID NO: 2971885 - protein, 21 aa, Entamoeba invadens
TSPRRRASPRVIPPHQSDVVI

SEQ ID NO: 2971886 - protein, 21 aa, Entamoeba invadens
TSPSKWKKAFLDALSHSTFFE

SEQ ID NO: 2971887 - protein, 17 aa, Entamoeba invadens
TSPWKDQFPEWALLPKT

SEQ ID NO: 2971888 - protein, 18 aa, Entamoeba invadens
TSQDFAVFKNLINTPNTQ

SEQ ID NO: 2971889 - protein, 22 aa, Entamoeba invadens
TSQHLQLIFSFVPREQLSVIYT

SEQ ID NO: 2971890 - protein, 18 aa, Entamoeba invadens
TSQIKAMIRRKMEKERLQ

SEQ ID NO: 2971891 - protein, 20 aa, Entamoeba invadens
TSQKVCRVVTLTPKRLELVS

SEQ ID NO: 2971892 - protein, 18 aa, Entamoeba invadens
TSQKWRKAILDAFNHCTS

SEQ ID NO: 2971893 - protein, 19 aa, Entamoeba invadens
TSQPLFAFVSGWMSNGDFL

SEQ ID NO: 2971894 - protein, 24 aa, Entamoeba invadens
TSRITCYNCLGISDSNEQFSFLPV

SEQ ID NO: 2971895 - protein, 24 aa, Entamoeba invadens
TSRLKLYANHSLCDGRTIANLYQV

SEQ ID NO: 2971896 - protein, 19 aa, Entamoeba invadens
TSRMARQNIEFLINKEYFK

SEQ ID NO: 2971897 - protein, 20 aa, Entamoeba invadens
TSRPVLWIDTIRDLDFDIVY

SEQ ID NO: 2971898 - protein, 23 aa, Entamoeba invadens
TSRWNVRILYDLLDIAALNAYKL

SEQ ID NO: 2971899 - protein, 24 aa, Entamoeba invadens
TSRWNVRILYDLLDIAALNAYKVY

SEQ ID NO: 2971900 - protein, 24 aa, Entamoeba invadens
TSSCCDIFRKAFFNEETGDFVENS

SEQ ID NO: 2971901 - protein, 25 aa, Entamoeba invadens
TSSDWQTLSSLVFKLAEPIPTPLKG

SEQ ID NO: 2971902 - protein, 31 aa, Entamoeba invadens
TSSDYRLKLCFCPLCSHGFAAFGPTDCRGII

SEQ ID NO: 2971903 - protein, 18 aa, Entamoeba invadens
TSSFELVNGCLTLNECDG

SEQ ID NO: 2971904 - protein, 18 aa, Entamoeba invadens
TSSGFCLVNSTSVILYGT

SEQ ID NO: 2971905 - protein, 22 aa, Entamoeba invadens
TSSKLIPLIFESYVEMMKVSPL

SEQ ID NO: 2971906 - protein, 25 aa, Entamoeba invadens
TSSLVCFYGTPKLYVVPDYFSASVK

SEQ ID NO: 2971907 - protein, 25 aa, Entamoeba invadens
TSSRCLSCGVGYGVDDNGQCQKCVD

SEQ ID NO: 2971908 - protein, 26 aa, Entamoeba invadens
TSSRIRWPLLQILKLKYCQLTELEDI

SEQ ID NO: 2971909 - protein, 35 aa, Entamoeba invadens
TSSVCGFCGIGFICLECSKIVMYHMQFLNKDIDIY

SEQ ID NO: 2971910 - protein, 26 aa, Entamoeba invadens
TSSVGLRASVKFPFEIEPQVTKLTFG

SEQ ID NO: 2971911 - protein, 20 aa, Entamoeba invadens
TSSYYRGCSGIFLVYSQNDE

SEQ ID NO: 2971912 - protein, 18 aa, Entamoeba invadens
TSTDLQHICVHAFGPQEV

SEQ ID NO: 2971913 - protein, 22 aa, Entamoeba invadens
TSTEYKQRYNIEISTAVNSVVI

SEQ ID NO: 2971914 - protein, 19 aa, Entamoeba invadens
TSTGESCCVVFTDWKMHID

SEQ ID NO: 2971915 - protein, 24 aa, Entamoeba invadens
TSTIMIKSALGILSEMVKMKMADK

SEQ ID NO: 2971916 - protein, 20 aa, Entamoeba invadens
TSTIPMLFLIEVESSKIDVI

SEQ ID NO: 2971917 - protein, 21 aa, Entamoeba invadens
TSTKCLSCPQNTYLSNYKCNT

SEQ ID NO: 2971918 - protein, 22 aa, Entamoeba invadens
TSTKCLSCPQNTYLSNYKCNTN

SEQ ID NO: 2971919 - protein, 25 aa, Entamoeba invadens
TSTKLRFKKFYSVLYVVMGGIDTSI

SEQ ID NO: 2971920 - protein, 18 aa, Entamoeba invadens
TSTLCNVECELPAGESDS

SEQ ID NO: 2971921 - protein, 17 aa, Entamoeba invadens
TSTLFKFVYNYDDDFTV

SEQ ID NO: 2971922 - protein, 20 aa, Entamoeba invadens
TSTMLRHWSSDLIGDPCEIE

SEQ ID NO: 2971923 - protein, 28 aa, Entamoeba invadens
TSTMLTLKCLRMLSCYNDGQLVCKTSNV

SEQ ID NO: 2971924 - protein, 18 aa, Entamoeba invadens
TSTPRMASFESVSPHSDS

SEQ ID NO: 2971925 - protein, 17 aa, Entamoeba invadens
TSTQFFFEYGMEKEVGN

SEQ ID NO: 2971926 - protein, 27 aa, Entamoeba invadens
TSTTESFIRLSLLFSLDQCDRPVVADF

SEQ ID NO: 2971927 - protein, 24 aa, Entamoeba invadens
TSTYLLTFYLKFLHITGNLCNVEN

SEQ ID NO: 2971928 - protein, 17 aa, Entamoeba invadens
TSVCLNLLLQVTGLISR

SEQ ID NO: 2971929 - protein, 21 aa, Entamoeba invadens
TSVCTLLPLTQKPYFKLERID

SEQ ID NO: 2971930 - protein, 24 aa, Entamoeba invadens
TSVEYFFPLCILLMSYTDGRNFAW

SEQ ID NO: 2971931 - protein, 18 aa, Entamoeba invadens
TSVFQCQMMYSAHTDTEN

SEQ ID NO: 2971932 - protein, 24 aa, Entamoeba invadens
TSVGQQCFYCCKNLTKINTNNSIV

SEQ ID NO: 2971933 - protein, 24 aa, Entamoeba invadens
TSVIKFGYKCFNKCGSLSSVVIPS

SEQ ID NO: 2971934 - protein, 25 aa, Entamoeba invadens
TSVLTLRFHMVGVIPIIHTKDVIYA

SEQ ID NO: 2971935 - protein, 26 aa, Entamoeba invadens
TSVMLASLIKFVLGWIRDIPQSLEGA

SEQ ID NO: 2971936 - protein, 22 aa, Entamoeba invadens
TSVNFGQLFSIVYVKMLMSEEE

SEQ ID NO: 2971937 - protein, 26 aa, Entamoeba invadens
TSVQRLRKKLGFKYSTLRKSRFLTLK

SEQ ID NO: 2971938 - protein, 18 aa, Entamoeba invadens
TSVRLLESLIRISQAHAK

SEQ ID NO: 2971939 - protein, 18 aa, Entamoeba invadens
TSVSRPLLSTTLNAVSTP

SEQ ID NO: 2971940 - protein, 27 aa, Entamoeba invadens
TSVSWKKCKTIKCGEKVEKLVVKSCEL

SEQ ID NO: 2971941 - protein, 27 aa, Entamoeba invadens
TSVTSLGMACFSSCWHLTKVDMPDTVK

SEQ ID NO: 2971942 - protein, 19 aa, Entamoeba invadens
TSVYRRNASEFAEGEIKRN

SEQ ID NO: 2971943 - protein, 20 aa, Entamoeba invadens
TSWCVKGVEIITQISNDLNE

SEQ ID NO: 2971944 - protein, 19 aa, Entamoeba invadens
TSWGDKGYVLMAMAGNTCG

SEQ ID NO: 2971945 - protein, 34 aa, Entamoeba invadens
TSWNTFPSFLRKHLSSLRSLWASLLMGESIVMYS

SEQ ID NO: 2971946 - protein, 18 aa, Entamoeba invadens
TSWWASSHISNFVSILYF

SEQ ID NO: 2971947 - protein, 20 aa, Entamoeba invadens
TSYDVVASFIRKMLILSLEM

SEQ ID NO: 2971948 - protein, 17 aa, Entamoeba invadens
TSYEKCGFVLNEKIEMV

SEQ ID NO: 2971949 - protein, 19 aa, Entamoeba invadens
TSYFFGRAALEPFLLENNL

SEQ ID NO: 2971950 - protein, 26 aa, Entamoeba invadens
TSYFNFKQECLWKYNTQIYDEFMNTF

SEQ ID NO: 2971951 - protein, 26 aa, Entamoeba invadens
TSYFNFKQECLWKYNTQIYDEIMNTF

SEQ ID NO: 2971952 - protein, 20 aa, Entamoeba invadens
TSYIRFVLENNNFVTHPTVT

SEQ ID NO: 2971953 - protein, 17 aa, Entamoeba invadens
TSYISVTPLNFFYIVDQ

SEQ ID NO: 2971954 - protein, 21 aa, Entamoeba invadens
TSYQIRLLLTYKNILKKQPTI

SEQ ID NO: 2971955 - protein, 24 aa, Entamoeba invadens
TSYTLAHRVCPFFPTSSKDQSLPL

SEQ ID NO: 2971956 - protein, 17 aa, Entamoeba invadens
TTACIGESYAFGPGVDG

SEQ ID NO: 2971957 - protein, 26 aa, Entamoeba invadens
TTADAWCDWVKSVAGLFGLKLNLCVN

SEQ ID NO: 2971958 - protein, 27 aa, Entamoeba invadens
TTAEALMWVFLLRQSFIGFYDPNEINM

SEQ ID NO: 2971959 - protein, 25 aa, Entamoeba invadens
TTAKEFKADVLGFYIVKLESIDFLI

SEQ ID NO: 2971960 - protein, 24 aa, Entamoeba invadens
TTAKEIDNALGISNGVGAAKQAID

SEQ ID NO: 2971961 - protein, 43 aa, Entamoeba invadens
TTAKETNPLFVKHATLPLNIGKSIKSEGIIRINDNQNKEKSDV

SEQ ID NO: 2971962 - protein, 30 aa, Entamoeba invadens
TTANKLRYEVAWCFVNILSILDEEEITRVV

SEQ ID NO: 2971963 - protein, 29 aa, Entamoeba invadens
TTASFWRCAIPEFLLKICRQIELRKSKFM

SEQ ID NO: 2971964 - protein, 32 aa, Entamoeba invadens
TTASFWRCAIPEFLLKICRQIELRKSKFMKEI

SEQ ID NO: 2971965 - protein, 23 aa, Entamoeba invadens
TTAYRCPQCYGPNVTLCQDCFDK

SEQ ID NO: 2971966 - protein, 18 aa, Entamoeba invadens
TTCHLHIYDCDTLYTRCA

SEQ ID NO: 2971967 - protein, 23 aa, Entamoeba invadens
TTCILCSTGFLLDVNNSCVAKTT

SEQ ID NO: 2971968 - protein, 20 aa, Entamoeba invadens
TTCISCYFGFILNVQTSHCD

SEQ ID NO: 2971969 - protein, 17 aa, Entamoeba invadens
TTCKLKIWDTAGQERFR

SEQ ID NO: 2971970 - protein, 20 aa, Entamoeba invadens
TTCKSIENATPFQWSYSLAI

SEQ ID NO: 2971971 - protein, 30 aa, Entamoeba invadens
TTCLNCCLYSLNFRFGVTKISSFAFTNNSL

SEQ ID NO: 2971972 - protein, 18 aa, Entamoeba invadens
TTCPSEFPDYNAKTSARS

SEQ ID NO: 2971973 - protein, 17 aa, Entamoeba invadens
TTCRATITEVEMGDGVI

SEQ ID NO: 2971974 - protein, 24 aa, Entamoeba invadens
TTCSDPSIVKCLIDHGASIVSIDH

SEQ ID NO: 2971975 - protein, 17 aa, Entamoeba invadens
TTCSGLSEMMLWDYTTQ

SEQ ID NO: 2971976 - protein, 18 aa, Entamoeba invadens
TTCSPTYERRCVTCDTGY

SEQ ID NO: 2971977 - protein, 24 aa, Entamoeba invadens
TTDCANVYFSVCKSFLEYWGDMFT

SEQ ID NO: 2971978 - protein, 23 aa, Entamoeba invadens
TTDEVIKFFARLINIGNKERVTL

SEQ ID NO: 2971979 - protein, 17 aa, Entamoeba invadens
TTDKLRSIVKKWCTLIE

SEQ ID NO: 2971980 - protein, 17 aa, Entamoeba invadens
TTDLEIVKTVAMKGIVG

SEQ ID NO: 2971981 - protein, 22 aa, Entamoeba invadens
TTDLLEKVRYLYAITNYIKQID

SEQ ID NO: 2971982 - protein, 18 aa, Entamoeba invadens
TTDNEFEKIVANFLSLQK

SEQ ID NO: 2971983 - protein, 21 aa, Entamoeba invadens
TTEDACFFLLISNINNAQKSM

SEQ ID NO: 2971984 - protein, 27 aa, Entamoeba invadens
TTEEFYILSMQCCIDFFYTTLKDDRKS

SEQ ID NO: 2971985 - protein, 24 aa, Entamoeba invadens
TTEFPRVKIVWTYSPQMTANIFDT

SEQ ID NO: 2971986 - protein, 19 aa, Entamoeba invadens
TTEILSGFIKETGYENCRV

SEQ ID NO: 2971987 - protein, 26 aa, Entamoeba invadens
TTEKFEFGEILSLFEEMKYILIEDEN

SEQ ID NO: 2971988 - protein, 18 aa, Entamoeba invadens
TTEKFQLCDVNELNDENK

SEQ ID NO: 2971989 - protein, 23 aa, Entamoeba invadens
TTEKQFLCSPLDVISSETIDSAT

SEQ ID NO: 2971990 - protein, 25 aa, Entamoeba invadens
TTELCYFPRDIFEEILGEIEKILNT

SEQ ID NO: 2971991 - protein, 20 aa, Entamoeba invadens
TTELKGFWSSFGTVETADSV

SEQ ID NO: 2971992 - protein, 22 aa, Entamoeba invadens
TTENRVASAYSILDASPIVSCY

SEQ ID NO: 2971993 - protein, 18 aa, Entamoeba invadens
TTESLMKRRAEFIIEHFS

SEQ ID NO: 2971994 - protein, 24 aa, Entamoeba invadens
TTFDRKCVWYDLQAGVDPYKVMRL

SEQ ID NO: 2971995 - protein, 26 aa, Entamoeba invadens
TTFELSDSILFIGMKNMRMVIVHLSR

SEQ ID NO: 2971996 - protein, 23 aa, Entamoeba invadens
TTFGDIMGHYDLVYGNDPIDGSL

SEQ ID NO: 2971997 - protein, 17 aa, Entamoeba invadens
TTFKRSKIQAFIDLLKK

SEQ ID NO: 2971998 - protein, 24 aa, Entamoeba invadens
TTFKTCSMLDLLITPIQRLPRYEL

SEQ ID NO: 2971999 - protein, 21 aa, Entamoeba invadens
TTFKVFECIKDDFVQLLSKLQ

SEQ ID NO: 2972000 - protein, 24 aa, Entamoeba invadens
TTFRPEYIANLFAGLISILDNPNP

SEQ ID NO: 2972001 - protein, 28 aa, Entamoeba invadens
TTFRPKEIAALFFKTLMNQIKMEVPDLV

SEQ ID NO: 2972002 - protein, 19 aa, Entamoeba invadens
TTFSCPLSYSENELKMLKG

SEQ ID NO: 2972003 - protein, 25 aa, Entamoeba invadens
TTFSELFVMTVLKFIRLIQKSTPAY

SEQ ID NO: 2972004 - protein, 25 aa, Entamoeba invadens
TTFSRIFIGNICRFGADVRYWPEDT

SEQ ID NO: 2972005 - protein, 23 aa, Entamoeba invadens
TTGKYEIGHFFIAVDISTFRDLD

SEQ ID NO: 2972006 - protein, 19 aa, Entamoeba invadens
TTGMCSVCASGFTKPASDN

SEQ ID NO: 2972007 - protein, 18 aa, Entamoeba invadens
TTGMSAQWQMPIDKKHIA

SEQ ID NO: 2972008 - protein, 21 aa, Entamoeba invadens
TTGWRGLSVVHMGDQDVPNCL

SEQ ID NO: 2972009 - protein, 20 aa, Entamoeba invadens
TTGYLKNDVIFYFKTKSSSF

SEQ ID NO: 2972010 - protein, 23 aa, Entamoeba invadens
TTHHPIFIAIRVEQTMFGVYVNN

SEQ ID NO: 2972011 - protein, 22 aa, Entamoeba invadens
TTHLLLKMFEKFSGTENTISSA

SEQ ID NO: 2972012 - protein, 17 aa, Entamoeba invadens
TTHLSYWGELYSVLLQK

SEQ ID NO: 2972013 - protein, 24 aa, Entamoeba invadens
TTHQCTIFRQIVYNIIDTVVQRPI

SEQ ID NO: 2972014 - protein, 18 aa, Entamoeba invadens
TTHWRILSVFKQLRGSKW

SEQ ID NO: 2972015 - protein, 17 aa, Entamoeba invadens
TTIDVILVNGMLRRGDR

SEQ ID NO: 2972016 - protein, 34 aa, Entamoeba invadens
TTIEMANCRPSVLNIFYCKADMSCINDDNIKELW

SEQ ID NO: 2972017 - protein, 19 aa, Entamoeba invadens
TTIGGICIELGGAFDYENK

SEQ ID NO: 2972018 - protein, 17 aa, Entamoeba invadens
TTIIFSMKTIRPDDLKI

SEQ ID NO: 2972019 - protein, 26 aa, Entamoeba invadens
TTIKKRCLECGIINRPDKGLFYRQDK

SEQ ID NO: 2972020 - protein, 26 aa, Entamoeba invadens
TTILNIWKGEGFDSVYSQTDEINSVP

SEQ ID NO: 2972021 - protein, 19 aa, Entamoeba invadens
TTILSGIGSFYIDKYSFVY

SEQ ID NO: 2972022 - protein, 18 aa, Entamoeba invadens
TTILYKFGIFSLIPEELK

SEQ ID NO: 2972023 - protein, 18 aa, Entamoeba invadens
TTILYRISSGVTIMTVPT

SEQ ID NO: 2972024 - protein, 17 aa, Entamoeba invadens
TTIPKVLGDPNFVNKEQ

SEQ ID NO: 2972025 - protein, 28 aa, Entamoeba invadens
TTIPRFHTHFPYVNSLGKTECPILNTPS

SEQ ID NO: 2972026 - protein, 24 aa, Entamoeba invadens
TTIQKSCFRNCFLQEVVLSDSLVS

SEQ ID NO: 2972027 - protein, 26 aa, Entamoeba invadens
TTIREHARFPGIFIASGKEEQLLTIN

SEQ ID NO: 2972028 - protein, 23 aa, Entamoeba invadens
TTIRLCTQLGMISSQFMTLPSIY

SEQ ID NO: 2972029 - protein, 17 aa, Entamoeba invadens
TTITAESLITFNNSPLI

SEQ ID NO: 2972030 - protein, 26 aa, Entamoeba invadens
TTITSLGLCCFLKCSSIESIVFTNSV

SEQ ID NO: 2972031 - protein, 26 aa, Entamoeba invadens
TTKDEFKLYLPIIVPVLLNELSRLKY

SEQ ID NO: 2972032 - protein, 17 aa, Entamoeba invadens
TTKEIIYDIEFHPDGTQ

SEQ ID NO: 2972033 - protein, 23 aa, Entamoeba invadens
TTKFGTNVCVKFFNDYQMQFEPF

SEQ ID NO: 2972034 - protein, 24 aa, Entamoeba invadens
TTKKGTEYFVKWKGYGCRENTWET

SEQ ID NO: 2972035 - protein, 22 aa, Entamoeba invadens
TTKKKLVWISDAFKIQNDDKSY

SEQ ID NO: 2972036 - protein, 25 aa, Entamoeba invadens
TTKKLRWDAGHVWKITMTVLPRTMR

SEQ ID NO: 2972037 - protein, 17 aa, Entamoeba invadens
TTKKRVDEITDELNTKR

SEQ ID NO: 2972038 - protein, 23 aa, Entamoeba invadens
TTKKRYFVLKANKLFYYESENTS

SEQ ID NO: 2972039 - protein, 17 aa, Entamoeba invadens
TTKLHFIDFEFGNISVP

SEQ ID NO: 2972040 - protein, 23 aa, Entamoeba invadens
TTKLKEDVRFVGNGLPQILDEWS

SEQ ID NO: 2972041 - protein, 22 aa, Entamoeba invadens
TTKLTQILLWFSSLYLSPDVLL

SEQ ID NO: 2972042 - protein, 23 aa, Entamoeba invadens
TTKRGWKGKMSYYQATLTLQDSF

SEQ ID NO: 2972043 - protein, 28 aa, Entamoeba invadens
TTKRLEVKIADYGFCRVFNKSPEHGVIG

SEQ ID NO: 2972044 - protein, 31 aa, Entamoeba invadens
TTKRRISECYLRPLELMLSQGIIPVLHGDVV

SEQ ID NO: 2972045 - protein, 40 aa, Entamoeba invadens; identical to SEQ ID NO: 2806763

SEQ ID NO: 2972046 - protein, 28 aa, Entamoeba invadens
TTLCNSLVYRCHNYFAAFTIYSQLQKNL

SEQ ID NO: 2972047 - protein, 18 aa, Entamoeba invadens
TTLDDIRSAIGYMSTLGY

SEQ ID NO: 2972048 - protein, 23 aa, Entamoeba invadens
TTLDFLRRFSRAFENDIKCHFLA

SEQ ID NO: 2972049 - protein, 27 aa, Entamoeba invadens
TTLDQFRLSFIYRLYADGISKDHINLS

SEQ ID NO: 2972050 - protein, 28 aa, Entamoeba invadens
TTLFLGDILHKLTFICYGNSVKSGPSGL

SEQ ID NO: 2972051 - protein, 18 aa, Entamoeba invadens
TTLGCKVAVVGSCKELGE

SEQ ID NO: 2972052 - protein, 17 aa, Entamoeba invadens
TTLHPMKTSFNSIFKTF

SEQ ID NO: 2972053 - protein, 17 aa, Entamoeba invadens
TTLKTFPERGVIFKAIG

SEQ ID NO: 2972054 - protein, 24 aa, Entamoeba invadens
TTLLIPYIAGYYFPLKEVMCANYP

SEQ ID NO: 2972055 - protein, 17 aa, Entamoeba invadens
TTLMLADQCIKRIQEVH

SEQ ID NO: 2972056 - protein, 25 aa, Entamoeba invadens
TTLPKCCFKQCFALKTLVIPFTVVS

SEQ ID NO: 2972057 - protein, 17 aa, Entamoeba invadens
TTLRRAALGIIRSAVQY

SEQ ID NO: 2972058 - protein, 23 aa, Entamoeba invadens
TTLSDLCCKCLVERKRAYQGLPF

SEQ ID NO: 2972059 - protein, 23 aa, Entamoeba invadens
TTLSLCRLACRVISESNECKNID

SEQ ID NO: 2972060 - protein, 25 aa, Entamoeba invadens
TTLSYKVRMGDHIGHRVHRHEPPVT

SEQ ID NO: 2972061 - protein, 24 aa, Entamoeba invadens
TTLTCTYIDSGLQFSDSKSFTVYE

SEQ ID NO: 2972062 - protein, 20 aa, Entamoeba invadens
TTLTTSIKVTLCMDIGKAVQ

SEQ ID NO: 2972063 - protein, 18 aa, Entamoeba invadens
TTLVQCYYLIANLVFLDY

SEQ ID NO: 2972064 - protein, 20 aa, Entamoeba invadens
TTLYAKLRARNHIRDTVLKK

SEQ ID NO: 2972065 - protein, 17 aa, Entamoeba invadens
TTLYIVGIPDSATEQTI

SEQ ID NO: 2972066 - protein, 26 aa, Entamoeba invadens
TTNCGLCDISTCLKCLDSFVKYTDTW

SEQ ID NO: 2972067 - protein, 24 aa, Entamoeba invadens
TTNCVKKKVDMCVTISGNGNTTYP

SEQ ID NO: 2972068 - protein, 25 aa, Entamoeba invadens
TTNECVKPRGIICLSDKSEFELLPS

SEQ ID NO: 2972069 - protein, 23 aa, Entamoeba invadens
TTNFKKIEIGLMDFVENLEVGMF

SEQ ID NO: 2972070 - protein, 21 aa, Entamoeba invadens
TTNKCKLCFDEHQNSGKCSTT

SEQ ID NO: 2972071 - protein, 19 aa, Entamoeba invadens
TTNKVDWMKCTKLREINLE

SEQ ID NO: 2972072 - protein, 24 aa, Entamoeba invadens
TTNLLDFLRRVFVYDPSKRMSAVE

SEQ ID NO: 2972073 - protein, 28 aa, Entamoeba invadens
TTNLNINFLFVFFPRLNTLTGNLNLICN

SEQ ID NO: 2972074 - protein, 31 aa, Entamoeba invadens
TTNVKYGYSYIFPLIPIFLMNANTYDIFRIR

SEQ ID NO: 2972075 - protein, 19 aa, Entamoeba invadens
TTNVYLLIGQMCCFTNLRR

SEQ ID NO: 2972076 - protein, 27 aa, Entamoeba invadens
TTPAALCRRSISLLNCLQFSPHIFENV

SEQ ID NO: 2972077 - protein, 26 aa, Entamoeba invadens
TTPALCAWKKATLLSLIVRHTQYNTN

SEQ ID NO: 2972078 - protein, 17 aa, Entamoeba invadens
TTPERLLDLIGILFDPV

SEQ ID NO: 2972079 - protein, 17 aa, Entamoeba invadens
TTPFKLKAFREDFIYAF

SEQ ID NO: 2972080 - protein, 26 aa, Entamoeba invadens
TTPIYRYKHEWLYGSFKKTLFFKSET

SEQ ID NO: 2972081 - protein, 17 aa, Entamoeba invadens
TTPLKIVEKEPKVDDAL

SEQ ID NO: 2972082 - protein, 23 aa, Entamoeba invadens
TTPNLPKRWIITVKGCATLIEEA

SEQ ID NO: 2972083 - protein, 22 aa, Entamoeba invadens
TTPNLTPRLTRVMAQKEGEKKN

SEQ ID NO: 2972084 - protein, 19 aa, Entamoeba invadens
TTPSWSINLIFTKSDSEPY

SEQ ID NO: 2972085 - protein, 20 aa, Entamoeba invadens
TTPTRWKKAFLDGLSHSPYF

SEQ ID NO: 2972086 - protein, 21 aa, Entamoeba invadens
TTQDECSLCFFNTDKMNNPDD

SEQ ID NO: 2972087 - protein, 23 aa, Entamoeba invadens
TTQFDCKFECWQFTEFEILNGVK

SEQ ID NO: 2972088 - protein, 18 aa, Entamoeba invadens
TTQIPYCDKGSFVTSCLS

SEQ ID NO: 2972089 - protein, 17 aa, Entamoeba invadens
TTQLFTYLIQWMDEVLK

SEQ ID NO: 2972090 - protein, 17 aa, Entamoeba invadens
TTQLFYIYFCPLTSQYL

SEQ ID NO: 2972091 - protein, 23 aa, Entamoeba invadens
TTQREMFFYMSLLSQQLPIESQF

SEQ ID NO: 2972092 - protein, 24 aa, Entamoeba invadens
TTQYRMHPQIAKFPNDNFYAGKLL

SEQ ID NO: 2972093 - protein, 17 aa, Entamoeba invadens
TTRCVCVTLQFYCTSLS

SEQ ID NO: 2972094 - protein, 27 aa, Entamoeba invadens
TTRELLWKFLVTMKMTYLTKLVTMNNE

SEQ ID NO: 2972095 - protein, 18 aa, Entamoeba invadens
TTRGEMRVGNILIICPLT

SEQ ID NO: 2972096 - protein, 31 aa, Entamoeba invadens
TTRKPCMKSPKIPLLVIKGQQPGSGHKAVKV

SEQ ID NO: 2972097 - protein, 23 aa, Entamoeba invadens
TTRKPTEFCLRVFNNEVKYVFKL

SEQ ID NO: 2972098 - protein, 36 aa, Entamoeba invadens
TTRKVEEICWKWRLGMAKDLKIVYFVFEDTIDEDNA

SEQ ID NO: 2972099 - protein, 24 aa, Entamoeba invadens
TTRKYRSVIKMVAYLLQTVDVTSL

SEQ ID NO: 2972100 - protein, 24 aa, Entamoeba invadens
TTRLLFYVEMVYSFFDLKFTDLPV

SEQ ID NO: 2972101 - protein, 18 aa, Entamoeba invadens
TTRNCLVAKDLGEIDVKY

SEQ ID NO: 2972102 - protein, 28 aa, Entamoeba invadens
TTRSIEVCVPLECVMIGGNVEAQIDGGV

SEQ ID NO: 2972103 - protein, 22 aa, Entamoeba invadens
TTRSLLLRDRLIALIRSLLKVE

SEQ ID NO: 2972104 - protein, 25 aa, Entamoeba invadens
TTSAFKYSSCMFSIIPSAIGLPQNT

SEQ ID NO: 2972105 - protein, 17 aa, Entamoeba invadens
TTSFAKRNPKIEIKFIG

SEQ ID NO: 2972106 - protein, 18 aa, Entamoeba invadens
TTSFPFSIDLNAPIDSYS

SEQ ID NO: 2972107 - protein, 24 aa, Entamoeba invadens
TTSGKRPWMISSFTEGKKVFFAVA

SEQ ID NO: 2972108 - protein, 23 aa, Entamoeba invadens
TTSHPVVLCSLFPDIHSIQKNKI

SEQ ID NO: 2972109 - protein, 17 aa, Entamoeba invadens
TTSLKHLTLVGGSKTEQ

SEQ ID NO: 2972110 - protein, 17 aa, Entamoeba invadens
TTSPIVCICNDVMDKKM

SEQ ID NO: 2972111 - protein, 34 aa, Entamoeba invadens
TTSVFPRGKFIFSVKCLKGGLPNYMTPYIDPSIT

SEQ ID NO: 2972112 - protein, 19 aa, Entamoeba invadens
TTTFQRYVWGSPITVETPY

SEQ ID NO: 2972113 - protein, 25 aa, Entamoeba invadens
TTTGDFRYAPLISRVLGFIERVCWA

SEQ ID NO: 2972114 - protein, 23 aa, Entamoeba invadens
TTTGQCFGGFFGKIPEKQNTWVT

SEQ ID NO: 2972115 - protein, 23 aa, Entamoeba invadens
TTTLCNRLHKQFNVGMIPEIVSA

SEQ ID NO: 2972116 - protein, 26 aa, Entamoeba invadens
TTTLKFKFPDGIEVIRTFSPQQRQKE

SEQ ID NO: 2972117 - protein, 18 aa, Entamoeba invadens
TTTLQFLFIKELRFDGYV

SEQ ID NO: 2972118 - protein, 17 aa, Entamoeba invadens
TTTNWSNRMFLFSMKKS

SEQ ID NO: 2972119 - protein, 21 aa, Entamoeba invadens
TTTRAAIAIELLKNYHGELDD

SEQ ID NO: 2972120 - protein, 24 aa, Entamoeba invadens
TTTRFESWCDLNNFPHFLVSAKDA

SEQ ID NO: 2972121 - protein, 29 aa, Entamoeba invadens
TTTSYFRNRHVILFCFDLSASGSLSSVES

SEQ ID NO: 2972122 - protein, 25 aa, Entamoeba invadens
TTTTDFKGFEGFNFGNTTHETNKGE

SEQ ID NO: 2972123 - protein, 22 aa, Entamoeba invadens
TTTVLLAEVWIDLVQNKSSTET

SEQ ID NO: 2972124 - protein, 27 aa, Entamoeba invadens
TTTYFRNRHCILFTYDITKRETLEHVE

SEQ ID NO: 2972125 - protein, 20 aa, Entamoeba invadens
TTVCRGIAFVTYFDSQDAVR

SEQ ID NO: 2972126 - protein, 24 aa, Entamoeba invadens
TTVDAAGVFELCVDISKLYKEDET

SEQ ID NO: 2972127 - protein, 23 aa, Entamoeba invadens
TTVDPALFLRFEKSTDIDKSLER

SEQ ID NO: 2972128 - protein, 25 aa, Entamoeba invadens
TTVGPWCFSECPSLVSIVGIHELSN

SEQ ID NO: 2972129 - protein, 25 aa, Entamoeba invadens
TTVIKRYGQNLSHPFFEAFNTYLED

SEQ ID NO: 2972130 - protein, 21 aa, Entamoeba invadens
TTVKFIVQFSEFLDKNEKWSI

SEQ ID NO: 2972131 - protein, 39 aa, Entamoeba invadens
TTVKSIDLLKCYGLRLECRKGVVTLTHFNSYCSWCTSGK

SEQ ID NO: 2972132 - protein, 24 aa, Entamoeba invadens
TTVKTRIAAVPPPIAQAAQITDSS

SEQ ID NO: 2972133 - protein, 18 aa, Entamoeba invadens
TTVLSIGCVCFDYCGMLS

SEQ ID NO: 2972134 - protein, 25 aa, Entamoeba invadens
TTVNCKLKFSEMYDMYNMYDFDISN

SEQ ID NO: 2972135 - protein, 17 aa, Entamoeba invadens
TTVRLIIMSAMMDVDLF

SEQ ID NO: 2972136 - protein, 17 aa, Entamoeba invadens
TTVSEIFLTVSQLNTLT

SEQ ID NO: 2972137 - protein, 23 aa, Entamoeba invadens
TTVSKRKLEMNVIKANEKLIQRI

SEQ ID NO: 2972138 - protein, 17 aa, Entamoeba invadens
TTVSRYAVVDWCSPDAV

SEQ ID NO: 2972139 - protein, 19 aa, Entamoeba invadens
TTVTVFMCDTFNVIELYSS

SEQ ID NO: 2972140 - protein, 23 aa, Entamoeba invadens
TTVVDCMGPVFLQYATWMKMRKL

SEQ ID NO: 2972141 - protein, 25 aa, Entamoeba invadens
TTWAYMRPSAQFSYLSNGNMQMTEV

SEQ ID NO: 2972142 - protein, 24 aa, Entamoeba invadens
TTWKQCCYLCPSPMNGKIDDVITG

SEQ ID NO: 2972143 - protein, 19 aa, Entamoeba invadens
TTYCKRLWGDEIEFDSPDK

SEQ ID NO: 2972144 - protein, 18 aa, Entamoeba invadens
TTYCRLCEREVQLDVLAK

SEQ ID NO: 2972145 - protein, 25 aa, Entamoeba invadens
TTYKVTYPLAYLIDLCKANGFNVDT

SEQ ID NO: 2972146 - protein, 27 aa, Entamoeba invadens
TVADLLIKMGIEYKDEVAIVPPMRTDV

SEQ ID NO: 2972147 - protein, 30 aa, Entamoeba invadens
TVAFGSGLHGWAFTLDKFAKMWSEKFGIDK

SEQ ID NO: 2972148 - protein, 24 aa, Entamoeba invadens
TVAIRLKIYSPYVVDLTLVDLPGL

SEQ ID NO: 2972149 - protein, 18 aa, Entamoeba invadens
TVALCIGDSKLYHYNSKN

SEQ ID NO: 2972150 - protein, 41 aa, Entamoeba invadens
TVASDAFACAKLILVFRVDSTFDESLGFVKPILSDGTEFVD

SEQ ID NO: 2972151 - protein, 22 aa, Entamoeba invadens
TVCAKCKKPATGSVKMFYCGHI

SEQ ID NO: 2972152 - protein, 20 aa, Entamoeba invadens
TVCECFRVVESYNKKGVANT

SEQ ID NO: 2972153 - protein, 17 aa, Entamoeba invadens
TVCLKCDEIPYVKLMKY

SEQ ID NO: 2972154 - protein, 26 aa, Entamoeba invadens
TVCLPSSLCALNFKDVVLTDSTQKTP

SEQ ID NO: 2972155 - protein, 25 aa, Entamoeba invadens
TVCTECKDGFYLKDNTCLPCTLIGC

SEQ ID NO: 2972156 - protein, 19 aa, Entamoeba invadens
TVDAIVCYKILTMLFQCDG

SEQ ID NO: 2972157 - protein, 26 aa, Entamoeba invadens
TVDDYCLYVYLTFFIMKDTHFEDNEV

SEQ ID NO: 2972158 - protein, 25 aa, Entamoeba invadens
TVDFGESFVSMFPFYNSTYLFNASD

SEQ ID NO: 2972159 - protein, 17 aa, Entamoeba invadens
TVDGIVYVIDCGYCKIN

SEQ ID NO: 2972160 - protein, 17 aa, Entamoeba invadens
TVDLCYSMNTYFSIQSG

SEQ ID NO: 2972161 - protein, 22 aa, Entamoeba invadens
TVEAIPTFDGMGIKDELLRSIY

SEQ ID NO: 2972162 - protein, 35 aa, Entamoeba invadens
TVEEGKKTYTRWVVLKRKCMMFFKELGQAKAEIVI

SEQ ID NO: 2972163 - protein, 25 aa, Entamoeba invadens
TVEFANADLVVFCDEFGFQIENEQI

SEQ ID NO: 2972164 - protein, 18 aa, Entamoeba invadens
TVELRDVRKLANPVWSFS

SEQ ID NO: 2972165 - protein, 18 aa, Entamoeba invadens
TVEMEFDEFFKGDDAPKN

SEQ ID NO: 2972166 - protein, 19 aa, Entamoeba invadens
TVENICFKIHKQLAGQMKY

SEQ ID NO: 2972167 - protein, 17 aa, Entamoeba invadens
TVENIFYSSFLIKEGSA

SEQ ID NO: 2972168 - protein, 17 aa, Entamoeba invadens
TVERFLWGVYYTHNSLI

SEQ ID NO: 2972169 - protein, 25 aa, Entamoeba invadens
TVESHSACPMWSITLNRSSTISIKN

SEQ ID NO: 2972170 - protein, 23 aa, Entamoeba invadens
TVESPSYTGSRMVTLAEISNTSF

SEQ ID NO: 2972171 - protein, 24 aa, Entamoeba invadens
TVETLKAPEWVKGKDPRYKVIKKR

SEQ ID NO: 2972172 - protein, 24 aa, Entamoeba invadens
TVEVYKKLPPMTAEQKEFAKQQSI

SEQ ID NO: 2972173 - protein, 19 aa, Entamoeba invadens
TVFDAKRLIGRRFSDPAIQ

SEQ ID NO: 2972174 - protein, 19 aa, Entamoeba invadens
TVFDAKRLIGRRFSDPTIQ

SEQ ID NO: 2972175 - protein, 23 aa, Entamoeba invadens
TVFRGDTLPERKIPDLPAEHTKA

SEQ ID NO: 2972176 - protein, 24 aa, Entamoeba invadens
TVFSGRRGLHFWVCDRSAMEMSDL

SEQ ID NO: 2972177 - protein, 19 aa, Entamoeba invadens
TVFSRHFLAAYVQRMLLLQ

SEQ ID NO: 2972178 - protein, 17 aa, Entamoeba invadens
TVFVLKTLLSFYYNDPQ

SEQ ID NO: 2972179 - protein, 27 aa, Entamoeba invadens
TVGCRERSRFGIKIAGTRCAGVLTAGL

SEQ ID NO: 2972180 - protein, 19 aa, Entamoeba invadens
TVGLEFLLDYSVEDMKNLE

SEQ ID NO: 2972181 - protein, 18 aa, Entamoeba invadens
TVGLYRIHYTNDFVPSTR

SEQ ID NO: 2972182 - protein, 17 aa, Entamoeba invadens
TVHEMMNTLLLANYVVQ

SEQ ID NO: 2972183 - protein, 18 aa, Entamoeba invadens
TVHFPSTMTGFRDKCFFG

SEQ ID NO: 2972184 - protein, 24 aa, Entamoeba invadens
TVIFQKCLIGGDVVIIEVASILDV

SEQ ID NO: 2972185 - protein, 22 aa, Entamoeba invadens
TVIGKRMNKMLVRLRKDDASYV

SEQ ID NO: 2972186 - protein, 19 aa, Entamoeba invadens
TVILKNCCVDVDKDNQQDV

SEQ ID NO: 2972187 - protein, 27 aa, Entamoeba invadens
TVIPNYFFKNCTALAKIVNFDKITEFG

SEQ ID NO: 2972188 - protein, 28 aa, Entamoeba invadens
TVIQSFCNYFPKSLDVHLTFNVDNNTTI

SEQ ID NO: 2972189 - protein, 26 aa, Entamoeba invadens
TVKARCGTISRGLFFGCEKLSVLQLP

SEQ ID NO: 2972190 - protein, 24 aa, Entamoeba invadens
TVKARCGTISRGLLFNCEKLSVLQ

SEQ ID NO: 2972191 - protein, 22 aa, Entamoeba invadens
TVKCPKEETAIIWKELLVLVIS

SEQ ID NO: 2972192 - protein, 24 aa, Entamoeba invadens
TVKDCSHLPYLLNIDDPYINVSHP

SEQ ID NO: 2972193 - protein, 25 aa, Entamoeba invadens
TVKDIGKYCIQWCLNKFKNIRIDTH

SEQ ID NO: 2972194 - protein, 23 aa, Entamoeba invadens
TVKDVLELIGKVVKLETMAVWIN

SEQ ID NO: 2972195 - protein, 24 aa, Entamoeba invadens
TVKEESLRQILLYCGQVKSLSKVE

SEQ ID NO: 2972196 - protein, 24 aa, Entamoeba invadens
TVKELMCHYCGSKEHIARDCPKRL

SEQ ID NO: 2972197 - protein, 26 aa, Entamoeba invadens
TVKFLGHLVKLFGHFFSDKDDFASLI

SEQ ID NO: 2972198 - protein, 19 aa, Entamoeba invadens
TVKFVFLNTVFNFEFTNSF

SEQ ID NO: 2972199 - protein, 21 aa, Entamoeba invadens
TVKGKRLIKNRTFVKEEKGKS

SEQ ID NO: 2972200 - protein, 18 aa, Entamoeba invadens
TVKIDCWSSLVLETDEFC

SEQ ID NO: 2972201 - protein, 17 aa, Entamoeba invadens
TVKIGDFGIGRMLAGDD

SEQ ID NO: 2972202 - protein, 23 aa, Entamoeba invadens
TVKKILGKFGFTSGVKHTLLVGG

SEQ ID NO: 2972203 - protein, 29 aa, Entamoeba invadens
TVKLSAACSENFCGLVANCAKSQDVHPDL

SEQ ID NO: 2972204 - protein, 33 aa, Entamoeba invadens
TVKLYEYFNPVFKQPFCFNAFDYSLGEFFSQLQ

SEQ ID NO: 2972205 - protein, 17 aa, Entamoeba invadens
TVKVPKVDGDFFLLFSH

SEQ ID NO: 2972206 - protein, 22 aa, Entamoeba invadens
TVLAPSFVQRIFVELKQDDVKK

SEQ ID NO: 2972207 - protein, 20 aa, Entamoeba invadens
TVLCSQTSCDFFKQVQYTEI

SEQ ID NO: 2972208 - protein, 27 aa, Entamoeba invadens
TVLDLKEAIKFFGTICQHKIAKGATAM

SEQ ID NO: 2972209 - protein, 18 aa, Entamoeba invadens
TVLECLTWKDPFDEKLFP

SEQ ID NO: 2972210 - protein, 23 aa, Entamoeba invadens
TVLEFMKILVILLEKFDSIEDSR

SEQ ID NO: 2972211 - protein, 19 aa, Entamoeba invadens
TVLFCGVSAGSILSTQLAQ

SEQ ID NO: 2972212 - protein, 20 aa, Entamoeba invadens
TVLFKPYLPQEVLLKGISEK

SEQ ID NO: 2972213 - protein, 18 aa, Entamoeba invadens
TVLILYKLLFVNFEQSEV

SEQ ID NO: 2972214 - protein, 27 aa, Entamoeba invadens
TVLKKEFYRIIVWYCVDFETVNRNKSR

SEQ ID NO: 2972215 - protein, 23 aa, Entamoeba invadens
TVLKSLLKLCCKIDSLSDSNGMS

SEQ ID NO: 2972216 - protein, 17 aa, Entamoeba invadens
TVLLCTLSAAVPQHSMS

SEQ ID NO: 2972217 - protein, 19 aa, Entamoeba invadens
TVLLLPIQHPLRYVLHLEQ

SEQ ID NO: 2972218 - protein, 19 aa, Entamoeba invadens
TVLLWEFETGKVLDVLLRS

SEQ ID NO: 2972219 - protein, 18 aa, Entamoeba invadens
TVLNNFWTKQHVFIKEWS

SEQ ID NO: 2972220 - protein, 26 aa, Entamoeba invadens
TVLQGWTGKMSYRMLYDSSRDGLIPA

SEQ ID NO: 2972221 - protein, 24 aa, Entamoeba invadens
TVMIPDPLLIKFIGEKYVIASTDG

SEQ ID NO: 2972222 - protein, 23 aa, Entamoeba invadens
TVMKNEILKCCEKLERVKIGESV

SEQ ID NO: 2972223 - protein, 30 aa, Entamoeba invadens
TVNAWRVRKNWRMMRGIKHETLKLTICSID

SEQ ID NO: 2972224 - protein, 20 aa, Entamoeba invadens
TVNCFYFDFFDLQIFSSVKN

SEQ ID NO: 2972225 - protein, 24 aa, Entamoeba invadens
TVNEFKARVMLLTEALTGFDHQLS

SEQ ID NO: 2972226 - protein, 19 aa, Entamoeba invadens
TVPELDANFSKEWYTQNYF

SEQ ID NO: 2972227 - protein, 22 aa, Entamoeba invadens
TVPEVDRFLVTIQMETLPWVVP

SEQ ID NO: 2972228 - protein, 23 aa, Entamoeba invadens
TVPFSAAFKLIGTISETVYINPD

SEQ ID NO: 2972229 - protein, 17 aa, Entamoeba invadens
TVPKTGFQYGVLLAENW

SEQ ID NO: 2972230 - protein, 26 aa, Entamoeba invadens
TVPLNILRKKICILPQEATLFSGTIR

SEQ ID NO: 2972231 - protein, 20 aa, Entamoeba invadens
TVPLRCLYTTFTDTITSHLY

SEQ ID NO: 2972232 - protein, 17 aa, Entamoeba invadens
TVPNIVYRSIEFLRANN

SEQ ID NO: 2972233 - protein, 22 aa, Entamoeba invadens
TVPSCSQPTVGLHQPKLIRNTS

SEQ ID NO: 2972234 - protein, 24 aa, Entamoeba invadens
TVPSCVKYILADYLFYKEARDATM

SEQ ID NO: 2972235 - protein, 30 aa, Entamoeba invadens
TVQIPRSVTRIGVWCFHRCTALSEMHIPDS

SEQ ID NO: 2972236 - protein, 23 aa, Entamoeba invadens
TVQKGSDCKFMIGNDREFLLKIQ

SEQ ID NO: 2972237 - protein, 18 aa, Entamoeba invadens
TVQKIGILCFKECYCLSE

SEQ ID NO: 2972238 - protein, 18 aa, Entamoeba invadens
TVQKVFARHNCITAIDQT

SEQ ID NO: 2972239 - protein, 26 aa, Entamoeba invadens
TVQLVKFSELWSEKWGVCVCDRDIVR

SEQ ID NO: 2972240 - protein, 32 aa, Entamoeba invadens
TVQRKMSAFGFKKKRIDGVDYFFNAFFRPNDR

SEQ ID NO: 2972241 - protein, 25 aa, Entamoeba invadens
TVQSIKCNLRYPLFATSCSVVNWWT

SEQ ID NO: 2972242 - protein, 25 aa, Entamoeba invadens
TVRAFLVFKLIRAMGEYFHLEKNKV

SEQ ID NO: 2972243 - protein, 19 aa, Entamoeba invadens
TVRDYKAASEELMRTKTEL

SEQ ID NO: 2972244 - protein, 19 aa, Entamoeba invadens
TVRIIGKGCFNFCEDIADQ

SEQ ID NO: 2972245 - protein, 23 aa, Entamoeba invadens
TVRMIKERYCYVGYDLTLENKLG

SEQ ID NO: 2972246 - protein, 19 aa, Entamoeba invadens
TVRMPRASQIASIEEDKIY

SEQ ID NO: 2972247 - protein, 17 aa, Entamoeba invadens
TVRNIRNARRLGVFFEI

SEQ ID NO: 2972248 - protein, 25 aa, Entamoeba invadens
TVRSKCYIEYIFAYSVVDMNLMAKM

SEQ ID NO: 2972249 - protein, 24 aa, Entamoeba invadens
TVRSTVLVPFKLGVFVDLFQDVVK

SEQ ID NO: 2972250 - protein, 18 aa, Entamoeba invadens
TVRVLPLIDYQNFQMNIS

SEQ ID NO: 2972251 - protein, 19 aa, Entamoeba invadens
TVRVLPLIDYRTLRNEYFC

SEQ ID NO: 2972252 - protein, 19 aa, Entamoeba invadens
TVRVSGRLLSSCKNILEKY

SEQ ID NO: 2972253 - protein, 24 aa, Entamoeba invadens
TVSALCGSMLMAAAPLTGPTAPVV

SEQ ID NO: 2972254 - protein, 27 aa, Entamoeba invadens
TVSEFMVKWSPVMWTYLRDENVSEENK

SEQ ID NO: 2972255 - protein, 18 aa, Entamoeba invadens
TVSELGCRCFMLCISLSS

SEQ ID NO: 2972256 - protein, 23 aa, Entamoeba invadens
TVSEWFYNRHVVLEDDIRYQNAF

SEQ ID NO: 2972257 - protein, 25 aa, Entamoeba invadens
TVSIIPFKFMARLYDLSVQYRKVNK

SEQ ID NO: 2972258 - protein, 19 aa, Entamoeba invadens
TVSKMAFEGCERLRKINIP

SEQ ID NO: 2972259 - protein, 26 aa, Entamoeba invadens
TVSLFEHWLPRFGIEVDLVDTSDLEK

SEQ ID NO: 2972260 - protein, 18 aa, Entamoeba invadens
TVSLLRFRLELISSLEVE

SEQ ID NO: 2972261 - protein, 25 aa, Entamoeba invadens
TVSNFFDIVTMFSRDSTTCQGGGMY

SEQ ID NO: 2972262 - protein, 25 aa, Entamoeba invadens
TVSTRLKEFILFKATYTPESFVQRA

SEQ ID NO: 2972263 - protein, 17 aa, Entamoeba invadens
TVSVIGIEGMRDINSLD

SEQ ID NO: 2972264 - protein, 25 aa, Entamoeba invadens
TVTCIECFCFWECINLQKVVLPNGF

SEQ ID NO: 2972265 - protein, 19 aa, Entamoeba invadens
TVTFMKRAGSGIMKKLTAI

SEQ ID NO: 2972266 - protein, 24 aa, Entamoeba invadens
TVTGCLQCDLPIKKLSDIKAVFPG

SEQ ID NO: 2972267 - protein, 17 aa, Entamoeba invadens
TVTGFDFIGIVILDNEL

SEQ ID NO: 2972268 - protein, 25 aa, Entamoeba invadens
TVTIPKFTFQPVVDHYRDILVSSSK

SEQ ID NO: 2972269 - protein, 27 aa, Entamoeba invadens
TVTKLEMPFCFNLTCPANLIELTLGSV

SEQ ID NO: 2972270 - protein, 22 aa, Entamoeba invadens
TVTLFLSRSGINLNIENSKNGV

SEQ ID NO: 2972271 - protein, 25 aa, Entamoeba invadens
TVTPCGHTFCYDCIAEWVRRTENCP

SEQ ID NO: 2972272 - protein, 22 aa, Entamoeba invadens
TVTRGRPIHIGYMSNAKIGTNI

SEQ ID NO: 2972273 - protein, 22 aa, Entamoeba invadens
TVTRKPPYIMVCMKSDLPDPEE

SEQ ID NO: 2972274 - protein, 25 aa, Entamoeba invadens
TVTSIGEYCFSWCFSLTSVTIPSSV

SEQ ID NO: 2972275 - protein, 18 aa, Entamoeba invadens
TVVCIGKIACYFKAEKKG

SEQ ID NO: 2972276 - protein, 20 aa, Entamoeba invadens
TVVDLIYFWFFQAFSKLLNK

SEQ ID NO: 2972277 - protein, 25 aa, Entamoeba invadens
TVVEVPLCKYCDFIYTAVTEEIKVK

SEQ ID NO: 2972278 - protein, 23 aa, Entamoeba invadens
TVVFKLVLICNNFIKDINHIQPV

SEQ ID NO: 2972279 - protein, 18 aa, Entamoeba invadens
TVVFTMFYLLYAVGHLEH

SEQ ID NO: 2972280 - protein, 17 aa, Entamoeba invadens
TVVGEIFFNSKDLKNLF

SEQ ID NO: 2972281 - protein, 22 aa, Entamoeba invadens
TVVIPKKLYVRDSIEHENLMSA

SEQ ID NO: 2972282 - protein, 27 aa, Entamoeba invadens
TVVKWKEVNALIALGAFKKVFINYGDK

SEQ ID NO: 2972283 - protein, 25 aa, Entamoeba invadens
TVVNYIFWRYVDPLSNVRDEDVKRF

SEQ ID NO: 2972284 - protein, 18 aa, Entamoeba invadens
TVVPKIRADITFTQQKYF

SEQ ID NO: 2972285 - protein, 19 aa, Entamoeba invadens
TVVPKLENMFLFGNSFGNY

SEQ ID NO: 2972286 - protein, 23 aa, Entamoeba invadens
TVVPREVVLPVHFEKTYECEKGE

SEQ ID NO: 2972287 - protein, 24 aa, Entamoeba invadens
TVYACAWSPDSRMFVSASKDSTVK

SEQ ID NO: 2972288 - protein, 18 aa, Entamoeba invadens
TVYKKCELTRCTKLRELT

SEQ ID NO: 2972289 - protein, 21 aa, Entamoeba invadens
TVYMLKTLVKYGLIKDKSVVQ

SEQ ID NO: 2972290 - protein, 24 aa, Entamoeba invadens
TVYSKECFDEFECNNTFTARYRMG

SEQ ID NO: 2972291 - protein, 24 aa, Entamoeba invadens
TWANLPFNTNNTFSMIPRTLPQIN

SEQ ID NO: 2972292 - protein, 27 aa, Entamoeba invadens
TWFSKAQEYFFNWFRTVLKDTEQSKRS

SEQ ID NO: 2972293 - protein, 21 aa, Entamoeba invadens
TWGTLGYMVGEIWDSVSNINN

SEQ ID NO: 2972294 - protein, 24 aa, Entamoeba invadens
TWIKLEEFDVLQLPRVLEVLPNYR

SEQ ID NO: 2972295 - protein, 23 aa, Entamoeba invadens
TWIKPEISHRIILNDLLLIKIDE

SEQ ID NO: 2972296 - protein, 29 aa, Entamoeba invadens
TWKDSGKIWRMRACCVIYVNFANTEEEKC

SEQ ID NO: 2972297 - protein, 26 aa, Entamoeba invadens
TWKNGKVDKFSLCKKGDKNARLIVQE

SEQ ID NO: 2972298 - protein, 18 aa, Entamoeba invadens
TWNFPMALVTGIFIPPLT

SEQ ID NO: 2972299 - protein, 18 aa, Entamoeba invadens
TWNGAAISKFGIKEKTLG

SEQ ID NO: 2972300 - protein, 21 aa, Entamoeba invadens
TWNNPRIVTISIQAMSRLSMI

SEQ ID NO: 2972301 - protein, 27 aa, Entamoeba invadens
TWNQFGIAEFEDGDLCRCSIFEKNPQL

SEQ ID NO: 2972302 - protein, 23 aa, Entamoeba invadens
TWPKPPPCLGPDVDYFSFQRNIT

SEQ ID NO: 2972303 - protein, 19 aa, Entamoeba invadens
TWSGLPLAPLPKRIEVKPL

SEQ ID NO: 2972304 - protein, 18 aa, Entamoeba invadens
TWSLVSGIVCKDQEAVVK

SEQ ID NO: 2972305 - protein, 34 aa, Entamoeba invadens
TWSVVKGRKNVLCLKITQIGSVFGYFHSGEHPHV

SEQ ID NO: 2972306 - protein, 21 aa, Entamoeba invadens
TWTRLGGKYICGYCRQPNEKF

SEQ ID NO: 2972307 - protein, 28 aa, Entamoeba invadens
TYADNLLDLRVCEQLVKCLTENVADDRI

SEQ ID NO: 2972308 - protein, 27 aa, Entamoeba invadens
TYAGRRLGYRITKEFATHFFSSIFTAP

SEQ ID NO: 2972309 - protein, 26 aa, Entamoeba invadens
TYAPTPFPLILSFIVSCKLQHTNPKN

SEQ ID NO: 2972310 - protein, 24 aa, Entamoeba invadens
TYAQKYPTVCFGKITWEDSNKPFP

SEQ ID NO: 2972311 - protein, 23 aa, Entamoeba invadens
TYAVPFKPIHYVALLNEIPNVDV

SEQ ID NO: 2972312 - protein, 17 aa, Entamoeba invadens
TYCPSIQEVFFKKATTI

SEQ ID NO: 2972313 - protein, 20 aa, Entamoeba invadens
TYCRSHHALVLVVNNITSKQ

SEQ ID NO: 2972314 - protein, 17 aa, Entamoeba invadens
TYCTGCNDVFLSISENE

SEQ ID NO: 2972315 - protein, 22 aa, Entamoeba invadens
TYCTGIPILFVGTGQHYTDLKL

SEQ ID NO: 2972316 - protein, 20 aa, Entamoeba invadens
TYDNPGVIGFKYSCTTTTIK

SEQ ID NO: 2972317 - protein, 24 aa, Entamoeba invadens
TYDSVWMRGYWLIFSQDQAVKGKI

SEQ ID NO: 2972318 - protein, 21 aa, Entamoeba invadens
TYEKEVFDIIGRYKIDGKECG

SEQ ID NO: 2972319 - protein, 18 aa, Entamoeba invadens
TYEKFKSPKIEFKRITYS

SEQ ID NO: 2972320 - protein, 18 aa, Entamoeba invadens
TYEKKREVQFFGFPTGVL

SEQ ID NO: 2972321 - protein, 25 aa, Entamoeba invadens
TYEMLRLAIEKQIRKRSLLYGPDVE

SEQ ID NO: 2972322 - protein, 25 aa, Entamoeba invadens
TYFNTLPWRLRCRIRHEEKYKGLLE

SEQ ID NO: 2972323 - protein, 19 aa, Entamoeba invadens
TYFPCFVSQAALKKEEDEL

SEQ ID NO: 2972324 - protein, 23 aa, Entamoeba invadens
TYFRNRSCVLFMFDLTSSETLSH

SEQ ID NO: 2972325 - protein, 19 aa, Entamoeba invadens
TYFRPMSIKYERMLRNKKE

SEQ ID NO: 2972326 - protein, 19 aa, Entamoeba invadens
TYFYCIHNKLLTNIYNHMS

SEQ ID NO: 2972327 - protein, 17 aa, Entamoeba invadens
TYFYGNVYLVECVSNTM

SEQ ID NO: 2972328 - protein, 18 aa, Entamoeba invadens
TYGGAKLFMMSELYHSHY

SEQ ID NO: 2972329 - protein, 23 aa, Entamoeba invadens
TYGLERCVPHFSKALDYILDCSD

SEQ ID NO: 2972330 - protein, 18 aa, Entamoeba invadens
TYHKTFFPLVQISMDSFV

SEQ ID NO: 2972331 - protein, 17 aa, Entamoeba invadens
TYICPTEILGFGKLAQE

SEQ ID NO: 2972332 - protein, 19 aa, Entamoeba invadens
TYIQLCVGDMSVLIKDLQD

SEQ ID NO: 2972333 - protein, 17 aa, Entamoeba invadens
TYITNNVFIRKELMVKL

SEQ ID NO: 2972334 - protein, 17 aa, Entamoeba invadens
TYKGFTVELHREGKSDG

SEQ ID NO: 2972335 - protein, 21 aa, Entamoeba invadens
TYKKKEVCGKIDSFVDEAISK

SEQ ID NO: 2972336 - protein, 20 aa, Entamoeba invadens
TYKQLWYYVSTFTNMSMDEV

SEQ ID NO: 2972337 - protein, 19 aa, Entamoeba invadens
TYLEEFEKLVSKFGLNTTE

SEQ ID NO: 2972338 - protein, 17 aa, Entamoeba invadens
TYLHCIAKVTPSSKKLE

SEQ ID NO: 2972339 - protein, 21 aa, Entamoeba invadens
TYLKVKLSLFSTIYPTSSETY

SEQ ID NO: 2972340 - protein, 18 aa, Entamoeba invadens
TYLLAALHTSFVGHFVQF

SEQ ID NO: 2972341 - protein, 19 aa, Entamoeba invadens
TYLRTGFSIYDPVHLDSFT

SEQ ID NO: 2972342 - protein, 17 aa, Entamoeba invadens
TYMKFIITTPIDVEIFV

SEQ ID NO: 2972343 - protein, 17 aa, Entamoeba invadens
TYNKFVVSRVLQDVKRE

SEQ ID NO: 2972344 - protein, 18 aa, Entamoeba invadens
TYNSCLKCSVGCLDCTSS

SEQ ID NO: 2972345 - protein, 19 aa, Entamoeba invadens
TYNVPKCIRNLRPIEQMGY

SEQ ID NO: 2972346 - protein, 24 aa, Entamoeba invadens
TYPKNNCKTALFVKKTEYGNGQFL

SEQ ID NO: 2972347 - protein, 24 aa, Entamoeba invadens
TYPLELKAKFETFFRPKKEQQQIP

SEQ ID NO: 2972348 - protein, 21 aa, Entamoeba invadens
TYQARLALILFTIINEQNYWR

SEQ ID NO: 2972349 - protein, 18 aa, Entamoeba invadens
TYQFKFELDDPIITKMFP

SEQ ID NO: 2972350 - protein, 18 aa, Entamoeba invadens
TYRAYSFEKSGCGKTNLN

SEQ ID NO: 2972351 - protein, 23 aa, Entamoeba invadens
TYRICDKDMLFLVLNKTDLPNAF

SEQ ID NO: 2972352 - protein, 24 aa, Entamoeba invadens
TYRREDYLSFGIEVPHCVNTIGTK

SEQ ID NO: 2972353 - protein, 25 aa, Entamoeba invadens
TYVIKCSKYGFKFASKEKMIPVVQK

SEQ ID NO: 2972354 - protein, 26 aa, Entamoeba invadens
TYVVHIRYSYFPGMTKKRSGPSMFEP

SEQ ID NO: 2972355 - protein, 25 aa, Entamoeba invadens
TYYCSCGRFGFLISRPTDLTDQYIF

SEQ ID NO: 2972356 - protein, 18 aa, Entamoeba invadens
TYYEGLTCVSSEDGKINI

SEQ ID NO: 2972357 - protein, 17 aa, Entamoeba invadens
TYYRNSQVLPFLLRQLQ

SEQ ID NO: 2972358 - protein, 19 aa, Entamoeba invadens
TYYSNVICFAFVIDATDKE

SEQ ID NO: 2972359 - protein, 19 aa, Entamoeba invadens
TYYTKLRTFNLRPKMSDED

SEQ ID NO: 2972360 - protein, 25 aa, Entamoeba invadens
VAAECFKFSDIYPIEQTDVNETLFE

SEQ ID NO: 2972361 - protein, 17 aa, Entamoeba invadens
VAAEFLLSGTNLDQIPD

SEQ ID NO: 2972362 - protein, 26 aa, Entamoeba invadens
VAAFTNDLAKFFGKWSLYYQLTPTSL

SEQ ID NO: 2972363 - protein, 29 aa, Entamoeba invadens
VAANPRLQFQWWFPLVLTLTGNDYRELQA

SEQ ID NO: 2972364 - protein, 24 aa, Entamoeba invadens
VAARYSLSCYFKAMQLFSKSLLEC

SEQ ID NO: 2972365 - protein, 19 aa, Entamoeba invadens
VAAVTKIKGELVMEIKSEV

SEQ ID NO: 2972366 - protein, 25 aa, Entamoeba invadens
VACFMKEILEKVGLTCKQFVYTKKD

SEQ ID NO: 2972367 - protein, 17 aa, Entamoeba invadens
VACGIWGLCVHGRTIDE

SEQ ID NO: 2972368 - protein, 37 aa, Entamoeba invadens
VACVHCKAGRGRTGLVCSCVLLALGVVSDAKEALEFF

SEQ ID NO: 2972369 - protein, 20 aa, Entamoeba invadens
VACYQLEMVKYLVHTFETAN

SEQ ID NO: 2972370 - protein, 25 aa, Entamoeba invadens
VADANCFLFTLKVDGKVQFQKFEMA

SEQ ID NO: 2972371 - protein, 20 aa, Entamoeba invadens
VADCINSMFTAHGEIEKDSL

SEQ ID NO: 2972372 - protein, 40 aa, Entamoeba invadens
VADDKVDDFCLFFYLSFCVMKETKLDDNLEIKRIADEIKN

SEQ ID NO: 2972373 - protein, 23 aa, Entamoeba invadens
VADECPECSKKIRQVQSAIQNFS

SEQ ID NO: 2972374 - protein, 22 aa, Entamoeba invadens
VADEMKSNVVLFIEDQNGNHVI

SEQ ID NO: 2972375 - protein, 19 aa, Entamoeba invadens
VADEWKMLFYETSAKNNTN

SEQ ID NO: 2972376 - protein, 19 aa, Entamoeba invadens
VADGIKLINFIEALSNLKI

SEQ ID NO: 2972377 - protein, 18 aa, Entamoeba invadens
VADIACFLRDAAHFNDSG

SEQ ID NO: 2972378 - protein, 20 aa, Entamoeba invadens
VADLMRYFFHFVKATCPYIV

SEQ ID NO: 2972379 - protein, 26 aa, Entamoeba invadens
VADLSLRIFLKYKKAEMVVFQQQNEL

SEQ ID NO: 2972380 - protein, 26 aa, Entamoeba invadens
VADMGCGDAILALKCNTIKVHSFDLV

SEQ ID NO: 2972381 - protein, 20 aa, Entamoeba invadens
VADVRLTFQNAMTFNPPDNP

SEQ ID NO: 2972382 - protein, 18 aa, Entamoeba invadens
VAEAEAYLEEQKRKAEGA

SEQ ID NO: 2972383 - protein, 25 aa, Entamoeba invadens
VAEEVDGKLVLKCTHEFEGAVYAIK

SEQ ID NO: 2972384 - protein, 22 aa, Entamoeba invadens
VAEIHFKMAMLNKQHSQYEECY

SEQ ID NO: 2972385 - protein, 18 aa, Entamoeba invadens
VAEIVTFLHFYADFEEDS

SEQ ID NO: 2972386 - protein, 19 aa, Entamoeba invadens
VAEKDCKCFTCSKNNSVSY

SEQ ID NO: 2972387 - protein, 24 aa, Entamoeba invadens
VAELPWDIGQAVVIVRTKYGKVSR

SEQ ID NO: 2972388 - protein, 20 aa, Entamoeba invadens
VAEQLHILMDLLRDVGFDLD

SEQ ID NO: 2972389 - protein, 17 aa, Entamoeba invadens
VAERCGITVLTPLWQKD

SEQ ID NO: 2972390 - protein, 18 aa, Entamoeba invadens
VAEYPIYETLCMKTLKIF

SEQ ID NO: 2972391 - protein, 23 aa, Entamoeba invadens
VAFEVVGPCPFYSATPGCLSVFI

SEQ ID NO: 2972392 - protein, 17 aa, Entamoeba invadens
VAFHGCNYIVGDIANHK

SEQ ID NO: 2972393 - protein, 19 aa, Entamoeba invadens
VAFKFCVEDTPSFSMKNYE

SEQ ID NO: 2972394 - protein, 18 aa, Entamoeba invadens
VAFNCGGLGELLNEIQNC

SEQ ID NO: 2972395 - protein, 20 aa, Entamoeba invadens
VAFPEIPSALQVLLTANFEL

SEQ ID NO: 2972396 - protein, 27 aa, Entamoeba invadens
VAFRKGCVPNCGVCPFNNVCTTSGKCI

SEQ ID NO: 2972397 - protein, 20 aa, Entamoeba invadens
VAFSGWNLYASLFDFINEET

SEQ ID NO: 2972398 - protein, 32 aa, Entamoeba invadens
VAFSNSYIRVFYKGVDFSFCLQQHCWILKSGE

SEQ ID NO: 2972399 - protein, 25 aa, Entamoeba invadens
VAFVLGRRDFVHFRRITGPEGLEKV

SEQ ID NO: 2972400 - protein, 17 aa, Entamoeba invadens
VAFYQDRTVVIKLTSKT

SEQ ID NO: 2972401 - protein, 22 aa, Entamoeba invadens
VAGFTCNGKWIGSVRPILNPCR

SEQ ID NO: 2972402 - protein, 19 aa, Entamoeba invadens
VAGIGDAAIYCFGVQEKRV

SEQ ID NO: 2972403 - protein, 19 aa, Entamoeba invadens
VAGKWKFVAQISHCHVDGA

SEQ ID NO: 2972404 - protein, 26 aa, Entamoeba invadens
VAHPFWLPKFANAFYYTLPILLQNIS

SEQ ID NO: 2972405 - protein, 24 aa, Entamoeba invadens
VAHVRTCSVCKMVGHNKQNCPSKK

SEQ ID NO: 2972406 - protein, 21 aa, Entamoeba invadens
VAIAWGAEFGRLKKKVFTFKL

SEQ ID NO: 2972407 - protein, 23 aa, Entamoeba invadens
VAIKGGIIDPNFVEAVDKMFSKN

SEQ ID NO: 2972408 - protein, 17 aa, Entamoeba invadens
VAIKLLEKGFFTLENSR

SEQ ID NO: 2972409 - protein, 18 aa, Entamoeba invadens
VAILDDLRVDSCPWGFLL

SEQ ID NO: 2972410 - protein, 23 aa, Entamoeba invadens
VAILKEYTDLIIAKQLSFDELMI

SEQ ID NO: 2972411 - protein, 19 aa, Entamoeba invadens
VAISEPKYLSEYLVDHCDI

SEQ ID NO: 2972412 - protein, 18 aa, Entamoeba invadens
VAKCLKKKFKRETLKEKK

SEQ ID NO: 2972413 - protein, 22 aa, Entamoeba invadens
VAKEMLRYYSFVNSQDFEKTQV

SEQ ID NO: 2972414 - protein, 19 aa, Entamoeba invadens
VAKETVKSIITRNGNDVDK

SEQ ID NO: 2972415 - protein, 26 aa, Entamoeba invadens
VAKFTVPEIVKLVCVKMAEILNENSD

SEQ ID NO: 2972416 - protein, 22 aa, Entamoeba invadens
VAKGACRYAFDFGKGALQITIN

SEQ ID NO: 2972417 - protein, 19 aa, Entamoeba invadens
VAKGKRPNFDEGFNKNVEQ

SEQ ID NO: 2972418 - protein, 18 aa, Entamoeba invadens
VAKKHSKRDYCLQSTFEY

SEQ ID NO: 2972419 - protein, 19 aa, Entamoeba invadens
VAKNFPFVLVVEDTAITDM

SEQ ID NO: 2972420 - protein, 17 aa, Entamoeba invadens
VAKNRGLLLAKRASVDR

SEQ ID NO: 2972421 - protein, 24 aa, Entamoeba invadens
VAKQCALCFQFFDKNAKNDVCIGF

SEQ ID NO: 2972422 - protein, 20 aa, Entamoeba invadens
VAKRACGDDVKICYMSTDNI

SEQ ID NO: 2972423 - protein, 24 aa, Entamoeba invadens
VALAARPARRARHAAAAVVPRLTL

SEQ ID NO: 2972424 - protein, 19 aa, Entamoeba invadens
VALDITRIIQFVCTILQNK

SEQ ID NO: 2972425 - protein, 19 aa, Entamoeba invadens
VALEKILDILLGFINTPED

SEQ ID NO: 2972426 - protein, 25 aa, Entamoeba invadens
VALEVIKRTIKIIVINKEFKLVLTD

SEQ ID NO: 2972427 - protein, 25 aa, Entamoeba invadens
VALFHKFEILTVFHRVGCVLSPKDM

SEQ ID NO: 2972428 - protein, 22 aa, Entamoeba invadens
VALGANCYRDTANLVEIIIPSQ

SEQ ID NO: 2972429 - protein, 17 aa, Entamoeba invadens
VALKFQATNTFMFIVSK

SEQ ID NO: 2972430 - protein, 17 aa, Entamoeba invadens
VALKKKIETAGLVAKNA

SEQ ID NO: 2972431 - protein, 17 aa, Entamoeba invadens
VALKLAEIFKCGVNELP

SEQ ID NO: 2972432 - protein, 17 aa, Entamoeba invadens
VALKVISSFCGMDDLLN

SEQ ID NO: 2972433 - protein, 19 aa, Entamoeba invadens
VALLRCTNVFYVIENELQW

SEQ ID NO: 2972434 - protein, 19 aa, Entamoeba invadens
VALNHNLKLIGMSCFSECS

SEQ ID NO: 2972435 - protein, 25 aa, Entamoeba invadens
VALPVCDCSSLLKLTKLVVSNCPKL

SEQ ID NO: 2972436 - protein, 17 aa, Entamoeba invadens
VALSRKIERRWRLIGWG

SEQ ID NO: 2972437 - protein, 18 aa, Entamoeba invadens
VALSVKLTRLMNDYQTLL

SEQ ID NO: 2972438 - protein, 25 aa, Entamoeba invadens
VALTDELKHREDVIADMRLKKKQDT

SEQ ID NO: 2972439 - protein, 19 aa, Entamoeba invadens
VALVKELLTFLQMSDIQFK

SEQ ID NO: 2972440 - protein, 20 aa, Entamoeba invadens
VALYRLATFEYPFSANKATI

SEQ ID NO: 2972441 - protein, 19 aa, Entamoeba invadens
VAMAYTIKLAPRINESKII

SEQ ID NO: 2972442 - protein, 20 aa, Entamoeba invadens
VAMERRCVYMFGSNLEKSPK

SEQ ID NO: 2972443 - protein, 34 aa, Entamoeba invadens
VAMGHRFTLRTGCGVKWDIDILPLISSYYPAPIK

SEQ ID NO: 2972444 - protein, 18 aa, Entamoeba invadens
VAMGIHAIGGMLNGGERV

SEQ ID NO: 2972445 - protein, 17 aa, Entamoeba invadens
VAMIIEIRKGLLSSDFT

SEQ ID NO: 2972446 - protein, 19 aa, Entamoeba invadens
VANACWVVVNAFFEKLSSD

SEQ ID NO: 2972447 - protein, 29 aa, Entamoeba invadens
VANGNKFCEFIKFQLNFPNPGCFPENIVD

SEQ ID NO: 2972448 - protein, 28 aa, Entamoeba invadens
VANKGITGKVFLEWYKKSVTKYCGDIED

SEQ ID NO: 2972449 - protein, 18 aa, Entamoeba invadens
VANLKIEALGLVKEEIKS

SEQ ID NO: 2972450 - protein, 24 aa, Entamoeba invadens
VANLLYKMVRSFGVECEEPKIVIQ

SEQ ID NO: 2972451 - protein, 18 aa, Entamoeba invadens
VANMKAFSARPVGAPRQP

SEQ ID NO: 2972452 - protein, 20 aa, Entamoeba invadens
VAPHAGFRYSGPTAGFSVAA

SEQ ID NO: 2972453 - protein, 19 aa, Entamoeba invadens
VAPLKPVFPELFKYKCIDI

SEQ ID NO: 2972454 - protein, 25 aa, Entamoeba invadens
VAPLYAVKEPIPIGTEVYVQKVQTH

SEQ ID NO: 2972455 - protein, 25 aa, Entamoeba invadens
VAPQLCIRKFVTVVCDNFFCSLRLA

SEQ ID NO: 2972456 - protein, 25 aa, Entamoeba invadens
VAPYMKKRHIAMWAPTLRNNMALLA

SEQ ID NO: 2972457 - protein, 25 aa, Entamoeba invadens
VAQCTNCAIEWDVQREAVVNTTKDQ

SEQ ID NO: 2972458 - protein, 17 aa, Entamoeba invadens
VAQFLDIHFFETSAKSN

SEQ ID NO: 2972459 - protein, 22 aa, Entamoeba invadens
VAQGMMERGFLTGYGKAKSFVT

SEQ ID NO: 2972460 - protein, 19 aa, Entamoeba invadens
VAQLAVLVFQTLFGKYQQL

SEQ ID NO: 2972461 - protein, 26 aa, Entamoeba invadens
VAQNFSRRILFFGAMYTLKLQITIAP

SEQ ID NO: 2972462 - protein, 24 aa, Entamoeba invadens
VAQQGLPRATGMHMRGFNGFNGFN

SEQ ID NO: 2972463 - protein, 24 aa, Entamoeba invadens
VARIVLKDYCCGKLVYCKPPPGTS

SEQ ID NO: 2972464 - protein, 17 aa, Entamoeba invadens
VARNNMWELHIYTPKHA

SEQ ID NO: 2972465 - protein, 17 aa, Entamoeba invadens
VARTCDCIMLLIDGTKS

SEQ ID NO: 2972466 - protein, 27 aa, Entamoeba invadens
VASFLNRINKAFVEMKIPIEIENFDIH

SEQ ID NO: 2972467 - protein, 17 aa, Entamoeba invadens
VASIPMENYTCLKYMIA

SEQ ID NO: 2972468 - protein, 17 aa, Entamoeba invadens
VASLCGKGTSVVGLKPY

SEQ ID NO: 2972469 - protein, 17 aa, Entamoeba invadens
VASMNIALGVPRIKEII

SEQ ID NO: 2972470 - protein, 18 aa, Entamoeba invadens
VATGVTFCEVLKVPMDGK

SEQ ID NO: 2972471 - protein, 29 aa, Entamoeba invadens
VATKITFMGGVCDLSLLQIPKFVKSISLK

SEQ ID NO: 2972472 - protein, 24 aa, Entamoeba invadens
VATLRKFTLVFPIAQITKVVQLDF

SEQ ID NO: 2972473 - protein, 24 aa, Entamoeba invadens
VATPEIRWGSSMRNYLIDTIAQHL

SEQ ID NO: 2972474 - protein, 24 aa, Entamoeba invadens
VATRSKLRSGLCSVKEMCNDYFNI

SEQ ID NO: 2972475 - protein, 23 aa, Entamoeba invadens
VATSKFVFKWAERFTSLGEEKDE

SEQ ID NO: 2972476 - protein, 19 aa, Entamoeba invadens
VAVGPHAFYFIYKGKVGKG

SEQ ID NO: 2972477 - protein, 19 aa, Entamoeba invadens
VAVGSFFDYFMPYELTDDM

SEQ ID NO: 2972478 - protein, 20 aa, Entamoeba invadens
VAVLDKFRCDYIIHFYGAVF

SEQ ID NO: 2972479 - protein, 23 aa, Entamoeba invadens
VAVPEATERGGLILTNKMGKMME

SEQ ID NO: 2972480 - protein, 18 aa, Entamoeba invadens
VAVSNAFKVSDRLNSLVN

SEQ ID NO: 2972481 - protein, 23 aa, Entamoeba invadens
VAWAIAQGKLRYRVTGEQIKWIN

SEQ ID NO: 2972482 - protein, 25 aa, Entamoeba invadens
VAYIKLKVGYCFVTFKNEEDTKKVF

SEQ ID NO: 2972483 - protein, 18 aa, Entamoeba invadens
VAYNITFQISFEPFGLNI

SEQ ID NO: 2972484 - protein, 24 aa, Entamoeba invadens
VCADCGKPVSYADIDYGVFICESC

SEQ ID NO: 2972485 - protein, 26 aa, Entamoeba invadens
VCADEMFEVLYIVSYEFKSNFKDTVF

SEQ ID NO: 2972486 - protein, 26 aa, Entamoeba invadens
VCAEPKINLVECRLFLTKLIAVLNRG

SEQ ID NO: 2972487 - protein, 17 aa, Entamoeba invadens
VCAFIDFSALFFENINT

SEQ ID NO: 2972488 - protein, 17 aa, Entamoeba invadens
VCAKCNEGLFILNGKCV

SEQ ID NO: 2972489 - protein, 17 aa, Entamoeba invadens
VCALKLLRHPNIVQLIS

SEQ ID NO: 2972490 - protein, 23 aa, Entamoeba invadens
VCCEVTRSGLFLLYSNDTKCVLF

SEQ ID NO: 2972491 - protein, 24 aa, Entamoeba invadens
VCCKIPKLNGFFDLRLMADKTLIA

SEQ ID NO: 2972492 - protein, 21 aa, Entamoeba invadens
VCCKKKFGRRGEPWEFNLRDV

SEQ ID NO: 2972493 - protein, 24 aa, Entamoeba invadens
VCCKSPKPVKVIPMKLKRREKKYW

SEQ ID NO: 2972494 - protein, 20 aa, Entamoeba invadens
VCDARRSYFNYFTKRVEKIE

SEQ ID NO: 2972495 - protein, 18 aa, Entamoeba invadens
VCDGCGWGQDSSYVARVA

SEQ ID NO: 2972496 - protein, 27 aa, Entamoeba invadens
VCDLKDLKYRVVFCQDDENGFGTFDEY

SEQ ID NO: 2972497 - protein, 17 aa, Entamoeba invadens
VCDLSLLQIPKYVKSIS

SEQ ID NO: 2972498 - protein, 31 aa, Entamoeba invadens
VCDSCMRQLFCSLRLAHYLAQYGSTLLGSVR

SEQ ID NO: 2972499 - protein, 27 aa, Entamoeba invadens
VCECNPIFVGIEFIEELYLLGCNCDML

SEQ ID NO: 2972500 - protein, 19 aa, Entamoeba invadens
VCEDFCIESGKSAKSEKRL

SEQ ID NO: 2972501 - protein, 21 aa, Entamoeba invadens
VCELRAEKSILLQQISLYEIE

SEQ ID NO: 2972502 - protein, 20 aa, Entamoeba invadens
VCEPSKYISLFMNYVDDIET

SEQ ID NO: 2972503 - protein, 20 aa, Entamoeba invadens
VCFHIDFYVRMFIIVKSSVS

SEQ ID NO: 2972504 - protein, 23 aa, Entamoeba invadens
VCFNCGMPGHILAKCPVPRKRRL

SEQ ID NO: 2972505 - protein, 19 aa, Entamoeba invadens
VCFNCKSPLGTNPFHNVDN

SEQ ID NO: 2972506 - protein, 23 aa, Entamoeba invadens
VCFVLKYMMLFDLLRRNRVVGNV

SEQ ID NO: 2972507 - protein, 23 aa, Entamoeba invadens
VCGDACSIEQCFNAFSATNKTVS

SEQ ID NO: 2972508 - protein, 26 aa, Entamoeba invadens
VCGENYCPGHLLVLHLPTLSHLEAYI

SEQ ID NO: 2972509 - protein, 20 aa, Entamoeba invadens
VCGGLLKILQIGKCDEIKVS

SEQ ID NO: 2972510 - protein, 20 aa, Entamoeba invadens
VCGICKASFGLITRKHHCRR

SEQ ID NO: 2972511 - protein, 20 aa, Entamoeba invadens
VCGKEGHYASRCPLNTKEKV

SEQ ID NO: 2972512 - protein, 22 aa, Entamoeba invadens
VCGKVRFCGYLVKFNLDNYYYL

SEQ ID NO: 2972513 - protein, 22 aa, Entamoeba invadens
VCGTLRMRLVKWEMYRRKRVNT

SEQ ID NO: 2972514 - protein, 24 aa, Entamoeba invadens
VCGTLRMRLVKWEMYRRKRVNTNP

SEQ ID NO: 2972515 - protein, 25 aa, Entamoeba invadens
VCGVDINLGCGMSFSTKGGMGQALV

SEQ ID NO: 2972516 - protein, 21 aa, Entamoeba invadens
VCGYMAIGFLQIFEKTQNQKN

SEQ ID NO: 2972517 - protein, 19 aa, Entamoeba invadens
VCHIMSLWCLTQCVCEVGS

SEQ ID NO: 2972518 - protein, 21 aa, Entamoeba invadens
VCKAHLKEGGIIVVKENIGTT

SEQ ID NO: 2972519 - protein, 20 aa, Entamoeba invadens
VCKDLKETLRRQSLVVNTLK

SEQ ID NO: 2972520 - protein, 20 aa, Entamoeba invadens
VCKGVSASVNFFNRLQNFLI

SEQ ID NO: 2972521 - protein, 17 aa, Entamoeba invadens
VCKKAPSLIILNGCEHD

SEQ ID NO: 2972522 - protein, 17 aa, Entamoeba invadens
VCKKFCGNMEKFHFNPI

SEQ ID NO: 2972523 - protein, 19 aa, Entamoeba invadens
VCKKFGGNMEKFHFNPILL

SEQ ID NO: 2972524 - protein, 19 aa, Entamoeba invadens
VCKKFGGNMEKFHFNPIPL

SEQ ID NO: 2972525 - protein, 19 aa, Entamoeba invadens
VCKKFGGNMEKFYFNPIPL

SEQ ID NO: 2972526 - protein, 19 aa, Entamoeba invadens
VCKKFGGNMGKYHFNPIQL

SEQ ID NO: 2972527 - protein, 21 aa, Entamoeba invadens
VCKKYSTLLFKFHYNPIPLTS

SEQ ID NO: 2972528 - protein, 21 aa, Entamoeba invadens
VCKMCGTVLDKVMWRKKMKEV

SEQ ID NO: 2972529 - protein, 19 aa, Entamoeba invadens
VCKMFLRGMAQSVTSVTFS

SEQ ID NO: 2972530 - protein, 28 aa, Entamoeba invadens
VCKNFTLADGTFWPIPITMSVSEEDARK

SEQ ID NO: 2972531 - protein, 23 aa, Entamoeba invadens
VCKNWLEHELLKSTAQYKVVVTH

SEQ ID NO: 2972532 - protein, 21 aa, Entamoeba invadens
VCKRGISCMIGGKRELLSKLS

SEQ ID NO: 2972533 - protein, 31 aa, Entamoeba invadens
VCKTLDYSFVRPLSIDFLRRFDRAANTDGME

SEQ ID NO: 2972534 - protein, 19 aa, Entamoeba invadens
VCKYFDCGEGGEFINGKCV

SEQ ID NO: 2972535 - protein, 20 aa, Entamoeba invadens
VCKYLTKFVIEMEIKQKRGK

SEQ ID NO: 2972536 - protein, 17 aa, Entamoeba invadens
VCLIGAKGVGKTTTKLQ

SEQ ID NO: 2972537 - protein, 18 aa, Entamoeba invadens
VCLPLSVENCCIKSIFGN

SEQ ID NO: 2972538 - protein, 18 aa, Entamoeba invadens
VCLSHCVNLSWEYKNMED

SEQ ID NO: 2972539 - protein, 25 aa, Entamoeba invadens
VCLSTLRLDKDWSPLVTLNHVVYGL

SEQ ID NO: 2972540 - protein, 19 aa, Entamoeba invadens
VCLTQNMIRLPISLKALES

SEQ ID NO: 2972541 - protein, 25 aa, Entamoeba invadens
VCMLFWKCDENVCVSIVDFVPAILH

SEQ ID NO: 2972542 - protein, 19 aa, Entamoeba invadens
VCMYGAGVCHLYLNDEVLN

SEQ ID NO: 2972543 - protein, 18 aa, Entamoeba invadens
VCNAEKKISGPILELIKK

SEQ ID NO: 2972544 - protein, 18 aa, Entamoeba invadens
VCNGKGPNTPRMLQLKDK

SEQ ID NO: 2972545 - protein, 17 aa, Entamoeba invadens
VCNQMIFKDSFYDYVNQ

SEQ ID NO: 2972546 - protein, 18 aa, Entamoeba invadens
VCPFCNYTGILVDPIVHK

SEQ ID NO: 2972547 - protein, 21 aa, Entamoeba invadens
VCPHIPIQFLVNILTTLKQKD

SEQ ID NO: 2972548 - protein, 17 aa, Entamoeba invadens
VCPKVNFGENLFCDEEQ

SEQ ID NO: 2972549 - protein, 17 aa, Entamoeba invadens
VCPSSLVSFDIIRGKPF

SEQ ID NO: 2972550 - protein, 17 aa, Entamoeba invadens
VCQCSGKYRSCSYSPRG

SEQ ID NO: 2972551 - protein, 26 aa, Entamoeba invadens
VCQGHLSDIVKLWRISLMSHQIVLNE

SEQ ID NO: 2972552 - protein, 23 aa, Entamoeba invadens
VCQSLKISTEISYLSVLSISNFI

SEQ ID NO: 2972553 - protein, 21 aa, Entamoeba invadens
VCRISVRHIPPTVVVNQDGTY

SEQ ID NO: 2972554 - protein, 44 aa, Entamoeba invadens
VCRKMSGPLMKCTKCTLYFHEKCTLCSPPLCRQASLPVDFYTHY

SEQ ID NO: 2972555 - protein, 18 aa, Entamoeba invadens
VCRQRVSLHMALQINVKD

SEQ ID NO: 2972556 - protein, 28 aa, Entamoeba invadens
VCRSMIRLQPFAGMLWTEMSERCFEVGG

SEQ ID NO: 2972557 - protein, 19 aa, Entamoeba invadens
VCSEMSIFLHRVAEDKTRQ

SEQ ID NO: 2972558 - protein, 18 aa, Entamoeba invadens
VCSKRINPITGKTESVVF

SEQ ID NO: 2972559 - protein, 24 aa, Entamoeba invadens
VCSKSGLKFASKERLVGFSQKCVR

SEQ ID NO: 2972560 - protein, 19 aa, Entamoeba invadens
VCSMCKDYTKYLPKNIQED

SEQ ID NO: 2972561 - protein, 20 aa, Entamoeba invadens
VCSMLNDPKHLIVLLHIQSS

SEQ ID NO: 2972562 - protein, 24 aa, Entamoeba invadens
VCSQFKNICLFVKHKECDFKDYLK

SEQ ID NO: 2972563 - protein, 26 aa, Entamoeba invadens
VCSTIKYSTVMACEDYLFPTFLPFYD

SEQ ID NO: 2972564 - protein, 18 aa, Entamoeba invadens
VCSVMKTFLQSMPNPILT

SEQ ID NO: 2972565 - protein, 24 aa, Entamoeba invadens
VCSYIIPLILCVGQSAYNENKERL

SEQ ID NO: 2972566 - protein, 20 aa, Entamoeba invadens
VCTEAGMFAIRARRKVITER

SEQ ID NO: 2972567 - protein, 23 aa, Entamoeba invadens
VCTICGEKGHISVLCPNRQLRKP

SEQ ID NO: 2972568 - protein, 22 aa, Entamoeba invadens
VCTKGVCKLLSYYNEKKKLVLI

SEQ ID NO: 2972569 - protein, 21 aa, Entamoeba invadens
VCTPLYIFCCQWMNFDCHTCS

SEQ ID NO: 2972570 - protein, 21 aa, Entamoeba invadens
VCTTCQSKGPFSIDVQNTVYR

SEQ ID NO: 2972571 - protein, 19 aa, Entamoeba invadens
VCTVCGAFVICKRCHSERH

SEQ ID NO: 2972572 - protein, 18 aa, Entamoeba invadens
VCTYGVGVYNLYIQNYVI

SEQ ID NO: 2972573 - protein, 19 aa, Entamoeba invadens
VCTYKMSRSNIKMFTLVDN

SEQ ID NO: 2972574 - protein, 31 aa, Entamoeba invadens
VCVRFIYRKQEFFIPIILLLRVYTGMSDREI

SEQ ID NO: 2972575 - protein, 19 aa, Entamoeba invadens
VCVSCVSAINKMWYPSGKL

SEQ ID NO: 2972576 - protein, 25 aa, Entamoeba invadens
VCVTLKAPHPFAKFIADQMSHAPLA

SEQ ID NO: 2972577 - protein, 22 aa, Entamoeba invadens
VCVYDTFCGFILAAFEFSQDIA

SEQ ID NO: 2972578 - protein, 17 aa, Entamoeba invadens
VCYKCIAEIVKNRYHML

SEQ ID NO: 2972579 - protein, 21 aa, Entamoeba invadens
VCYSCCFRNRVLYQDNNCPLC

SEQ ID NO: 2972580 - protein, 20 aa, Entamoeba invadens
VCYSHTFGHFVLLRTPIFYY

SEQ ID NO: 2972581 - protein, 17 aa, Entamoeba invadens
VCYTCATTKISLVSGGA

SEQ ID NO: 2972582 - protein, 22 aa, Entamoeba invadens
VCYYYGCPTCKISVEETAHKCK

SEQ ID NO: 2972583 - protein, 22 aa, Entamoeba invadens
VDAEPCYILFRTEEKDDLSNGY

SEQ ID NO: 2972584 - protein, 19 aa, Entamoeba invadens
VDAFYLFVAPPSMEVLEQR

SEQ ID NO: 2972585 - protein, 17 aa, Entamoeba invadens
VDAKGYLLHNECTLDLN

SEQ ID NO: 2972586 - protein, 23 aa, Entamoeba invadens
VDALRPSVFNDLEITISDIHVLK

SEQ ID NO: 2972587 - protein, 18 aa, Entamoeba invadens
VDARNRLTKSLLEMTQCY

SEQ ID NO: 2972588 - protein, 20 aa, Entamoeba invadens
VDARTCFHLMNAYVMHREQI

SEQ ID NO: 2972589 - protein, 18 aa, Entamoeba invadens
VDATFKMLHDIFGDLIIP

SEQ ID NO: 2972590 - protein, 19 aa, Entamoeba invadens
VDATKIAFDLLLKNKDQAS

SEQ ID NO: 2972591 - protein, 23 aa, Entamoeba invadens
VDAYVEMYNLFLTSLLHSSVDIS

SEQ ID NO: 2972592 - protein, 17 aa, Entamoeba invadens
VDCCFENVIKWTSFTKS

SEQ ID NO: 2972593 - protein, 28 aa, Entamoeba invadens
VDCGCYVLYFIRKMACSPSRRLYDLKPI

SEQ ID NO: 2972594 - protein, 18 aa, Entamoeba invadens
VDCIKRALSGLSNENKDT

SEQ ID NO: 2972595 - protein, 18 aa, Entamoeba invadens
VDCIPSKFFEGVFGNCYF

SEQ ID NO: 2972596 - protein, 23 aa, Entamoeba invadens
VDCRYPFEFAMGHISSAINVWNE

SEQ ID NO: 2972597 - protein, 19 aa, Entamoeba invadens
VDCVFKIVISKNCKSKNNL

SEQ ID NO: 2972598 - protein, 18 aa, Entamoeba invadens
VDCVRLWSITALSDLDDK

SEQ ID NO: 2972599 - protein, 20 aa, Entamoeba invadens
VDDCCFLVMEFCDAGDIQQL

SEQ ID NO: 2972600 - protein, 23 aa, Entamoeba invadens
VDDEVCRRKSIVMKSNKEDNIIL

SEQ ID NO: 2972601 - protein, 25 aa, Entamoeba invadens
VDDGLRPVLPRKFLTDDVDQIMHDQ

SEQ ID NO: 2972602 - protein, 19 aa, Entamoeba invadens
VDDLFQLMIEKIGMKEGEK

SEQ ID NO: 2972603 - protein, 20 aa, Entamoeba invadens
VDDLRGRICKRKENQIREER

SEQ ID NO: 2972604 - protein, 23 aa, Entamoeba invadens
VDDLRKSKSYCLMDETRLVSVFT

SEQ ID NO: 2972605 - protein, 20 aa, Entamoeba invadens
VDDMIRRRSAILSKADSISG

SEQ ID NO: 2972606 - protein, 23 aa, Entamoeba invadens
VDDSRFHLCAKTGDIVYVERVLG

SEQ ID NO: 2972607 - protein, 30 aa, Entamoeba invadens
VDDTIECVLGFRGVEEFISRNVPRLLWRVK

SEQ ID NO: 2972608 - protein, 18 aa, Entamoeba invadens
VDEAHCVSQWGHDFRESY

SEQ ID NO: 2972609 - protein, 17 aa, Entamoeba invadens
VDEEICYTDDITIIDDT

SEQ ID NO: 2972610 - protein, 18 aa, Entamoeba invadens
VDEFEYLGTVFLVSYLYT

SEQ ID NO: 2972611 - protein, 19 aa, Entamoeba invadens
VDEFEYLGTVFLVSYLYTE

SEQ ID NO: 2972612 - protein, 20 aa, Entamoeba invadens
VDEFEYLGTVFLVSYLYTEG

SEQ ID NO: 2972613 - protein, 33 aa, Entamoeba invadens
VDEFLRWRTLCWKSFEWKDLTFFMAEDALIRKM

SEQ ID NO: 2972614 - protein, 19 aa, Entamoeba invadens
VDEIIPIKTQDAWKTSRLV

SEQ ID NO: 2972615 - protein, 18 aa, Entamoeba invadens
VDEIKSLLLMLEEARGWY

SEQ ID NO: 2972616 - protein, 21 aa, Entamoeba invadens
VDEIKSLLLMLEEARGWYSDD

SEQ ID NO: 2972617 - protein, 26 aa, Entamoeba invadens
VDEIRRKLCCGFVFKDTDRAMEMIKE

SEQ ID NO: 2972618 - protein, 23 aa, Entamoeba invadens
VDEKGRGAILIGKMFESVPREME

SEQ ID NO: 2972619 - protein, 19 aa, Entamoeba invadens
VDELKRIAIPKEKMDRDAI

SEQ ID NO: 2972620 - protein, 23 aa, Entamoeba invadens
VDENLDLVCEFYKNPSKHRNDED

SEQ ID NO: 2972621 - protein, 18 aa, Entamoeba invadens
VDERIAVGVGAFKKLIKV

SEQ ID NO: 2972622 - protein, 18 aa, Entamoeba invadens
VDESWDFRDMTQLEDLSF

SEQ ID NO: 2972623 - protein, 21 aa, Entamoeba invadens
VDFDFSEIVAVDFLMNLIDTG

SEQ ID NO: 2972624 - protein, 21 aa, Entamoeba invadens
VDFFATWCGPCKMMSPIFIEM

SEQ ID NO: 2972625 - protein, 19 aa, Entamoeba invadens
VDFFERRNVTLWKQQGKKV

SEQ ID NO: 2972626 - protein, 18 aa, Entamoeba invadens
VDFGDKLLHLFLKPTPIN

SEQ ID NO: 2972627 - protein, 31 aa, Entamoeba invadens
VDFKNYLLPLFPLKYLKTGSLLRGYIADVAN

SEQ ID NO: 2972628 - protein, 21 aa, Entamoeba invadens
VDFKPKILTIRGKTVKMQISG

SEQ ID NO: 2972629 - protein, 23 aa, Entamoeba invadens
VDFLCSKESLALFETEDAKLYEG

SEQ ID NO: 2972630 - protein, 18 aa, Entamoeba invadens
VDFLDNFVVTISSDFTVL

SEQ ID NO: 2972631 - protein, 22 aa, Entamoeba invadens
VDFMRKTFVFRKTFTKSKTMGG

SEQ ID NO: 2972632 - protein, 20 aa, Entamoeba invadens
VDFRDGSALLELAASLTKAA

SEQ ID NO: 2972633 - protein, 26 aa, Entamoeba invadens
VDFSIELVLFREEFLLSHDITLNSGG

SEQ ID NO: 2972634 - protein, 17 aa, Entamoeba invadens
VDFSNLVIKNELNVIEG

SEQ ID NO: 2972635 - protein, 32 aa, Entamoeba invadens
VDFVLKKSLCDGVVLAKLMNYLRPNTVDVSKF

SEQ ID NO: 2972636 - protein, 18 aa, Entamoeba invadens
VDFVSLRQTFPFESLYTQ

SEQ ID NO: 2972637 - protein, 26 aa, Entamoeba invadens
VDFYATWCGPCRSISPYVEELSRQYP

SEQ ID NO: 2972638 - protein, 24 aa, Entamoeba invadens
VDGEQKYILGMVWMMILKYKINNV

SEQ ID NO: 2972639 - protein, 36 aa, Entamoeba invadens
VDGGEGYKNVLGMLFSLYRMFCVKNYERNHKGTYEG

SEQ ID NO: 2972640 - protein, 21 aa, Entamoeba invadens
VDGHKLLKIRNPWGKCEWTGK

SEQ ID NO: 2972641 - protein, 20 aa, Entamoeba invadens
VDGHSGFQASYSFTQNFPKI

SEQ ID NO: 2972642 - protein, 17 aa, Entamoeba invadens
VDGKFELVDGLVVSPEV

SEQ ID NO: 2972643 - protein, 24 aa, Entamoeba invadens
VDGKPFRLAIWAGQEKYRSMVSMY

SEQ ID NO: 2972644 - protein, 18 aa, Entamoeba invadens
VDGLDFFWSGLCETTNPI

SEQ ID NO: 2972645 - protein, 18 aa, Entamoeba invadens
VDGMFLDIVMRRIEGSEK

SEQ ID NO: 2972646 - protein, 25 aa, Entamoeba invadens
VDGMFQYKVCYRVTYKMANAILKAH

SEQ ID NO: 2972647 - protein, 24 aa, Entamoeba invadens
VDGNQWYAIQAMRAVNQAVGRVIR

SEQ ID NO: 2972648 - protein, 24 aa, Entamoeba invadens
VDGQCLLCSNGFYSNGPQCVKCDT

SEQ ID NO: 2972649 - protein, 27 aa, Entamoeba invadens
VDGRLLQLRWDRGFRAKVVDRDYKLLL

SEQ ID NO: 2972650 - protein, 23 aa, Entamoeba invadens
VDGSVCSMLLKTYAISQFSNSHE

SEQ ID NO: 2972651 - protein, 24 aa, Entamoeba invadens
VDGVCPFAKIVQQRKRRYISARGN

SEQ ID NO: 2972652 - protein, 19 aa, Entamoeba invadens
VDGVLDVIAPLMFFGDFSP

SEQ ID NO: 2972653 - protein, 23 aa, Entamoeba invadens
VDHETREILPIGFAGELEVNSPI

SEQ ID NO: 2972654 - protein, 18 aa, Entamoeba invadens
VDHMRMCYTKIMCGEVWC

SEQ ID NO: 2972655 - protein, 20 aa, Entamoeba invadens
VDHSTWLYLFPYFDNDKFDL

SEQ ID NO: 2972656 - protein, 17 aa, Entamoeba invadens
VDHSYWYADFEASTQGY

SEQ ID NO: 2972657 - protein, 19 aa, Entamoeba invadens
VDHTIGAIVISCRGTSTIT

SEQ ID NO: 2972658 - protein, 18 aa, Entamoeba invadens
VDIAKLVIVKGLSKDPKE

SEQ ID NO: 2972659 - protein, 26 aa, Entamoeba invadens
VDIEKRYSIDQCVSHPFITGMEITKL

SEQ ID NO: 2972660 - protein, 18 aa, Entamoeba invadens
VDIFFKIMLEERYVFVTN

SEQ ID NO: 2972661 - protein, 17 aa, Entamoeba invadens
VDIFKMANGPARKVENF

SEQ ID NO: 2972662 - protein, 18 aa, Entamoeba invadens
VDIFKMCYSTLVELKTFD

SEQ ID NO: 2972663 - protein, 23 aa, Entamoeba invadens
VDIFRFPWTIAEFVTAGKRLENR

SEQ ID NO: 2972664 - protein, 17 aa, Entamoeba invadens
VDIKFRVKILLDASHGI

SEQ ID NO: 2972665 - protein, 19 aa, Entamoeba invadens
VDIKIQRKLFKTVFLYFQP

SEQ ID NO: 2972666 - protein, 25 aa, Entamoeba invadens
VDIKKMLAKVVKYGKEKAMLEVKTE

SEQ ID NO: 2972667 - protein, 28 aa, Entamoeba invadens
VDIKVQRKLFKTAFLFFQPFKSYTTYMG

SEQ ID NO: 2972668 - protein, 22 aa, Entamoeba invadens
VDILAKLDGWWVGKKGGNYGIF

SEQ ID NO: 2972669 - protein, 18 aa, Entamoeba invadens
VDILKQIIALIISKNPNV

SEQ ID NO: 2972670 - protein, 22 aa, Entamoeba invadens
VDIPRTKVYLEFKTKNENEVQI

SEQ ID NO: 2972671 - protein, 24 aa, Entamoeba invadens
VDIQCVTTAIAIVILRKYYADRKV

SEQ ID NO: 2972672 - protein, 24 aa, Entamoeba invadens
VDIQNVLFAWSIEALDKMYQNELK

SEQ ID NO: 2972673 - protein, 21 aa, Entamoeba invadens
VDIWLHVVPQIIARIQSDVSS

SEQ ID NO: 2972674 - protein, 19 aa, Entamoeba invadens
VDIWSLGAIYAEIGFGHPV

SEQ ID NO: 2972675 - protein, 17 aa, Entamoeba invadens
VDKALVVLFKDDYKVSS

SEQ ID NO: 2972676 - protein, 25 aa, Entamoeba invadens
VDKILKRFLNFEVYTPSVITKIDGV

SEQ ID NO: 2972677 - protein, 22 aa, Entamoeba invadens
VDKKEKHRRKVLGKEGRELEDK

SEQ ID NO: 2972678 - protein, 21 aa, Entamoeba invadens
VDKKLVWKARFLVKKYGTLEN

SEQ ID NO: 2972679 - protein, 21 aa, Entamoeba invadens
VDKKRLMTFVKLAKEGKLEKS

SEQ ID NO: 2972680 - protein, 30 aa, Entamoeba invadens
VDKLHRDCLRGCTALTRVAIQRDLFEKSKN

SEQ ID NO: 2972681 - protein, 22 aa, Entamoeba invadens
VDKLPIVFGKFIKVTDLGFYRA

SEQ ID NO: 2972682 - protein, 17 aa, Entamoeba invadens
VDKNWFKGCDCLTKNQL

SEQ ID NO: 2972683 - protein, 21 aa, Entamoeba invadens
VDKPIRCARFMARKEQIVVGS

SEQ ID NO: 2972684 - protein, 18 aa, Entamoeba invadens
VDKPLFFSKECRTNNRPA

SEQ ID NO: 2972685 - protein, 25 aa, Entamoeba invadens
VDKRCAARYALDISNGILEKTAIRR

SEQ ID NO: 2972686 - protein, 19 aa, Entamoeba invadens
VDKRMQVCRIIEGLKRKGI

SEQ ID NO: 2972687 - protein, 28 aa, Entamoeba invadens
VDKSCTFQLMRLAKGFVDGKCSQKFAEK

SEQ ID NO: 2972688 - protein, 24 aa, Entamoeba invadens
VDKSNVRLVLALKKPVILLYDSSA

SEQ ID NO: 2972689 - protein, 26 aa, Entamoeba invadens
VDKSSKCFLCQAKLFTNFVEYEGRGF

SEQ ID NO: 2972690 - protein, 29 aa, Entamoeba invadens
VDKTRFIQMCCAIVDYLKEAEKFKEEKKQ

SEQ ID NO: 2972691 - protein, 24 aa, Entamoeba invadens
VDKTVKFCRFEKGWFGDLKYLYNH

SEQ ID NO: 2972692 - protein, 21 aa, Entamoeba invadens
VDKVLCLKRKYIGEIGGNRCV

SEQ ID NO: 2972693 - protein, 26 aa, Entamoeba invadens
VDKWFYTLFCHWNFYVRQAFQHIVLY

SEQ ID NO: 2972694 - protein, 22 aa, Entamoeba invadens
VDLCGKKIFSGFVSIDEMRHLK

SEQ ID NO: 2972695 - protein, 23 aa, Entamoeba invadens
VDLCGKLTFSGLVSVTEMVRLSR

SEQ ID NO: 2972696 - protein, 23 aa, Entamoeba invadens
VDLCGKQQFDGFVSVEEKKLLHH

SEQ ID NO: 2972697 - protein, 20 aa, Entamoeba invadens
VDLCKLSSTIETFAVKHVVE

SEQ ID NO: 2972698 - protein, 29 aa, Entamoeba invadens
VDLCKTGLRLHKSFMKIEFSRLQNVMELG

SEQ ID NO: 2972699 - protein, 21 aa, Entamoeba invadens
VDLEAILPIPKVKTYVGDITT

SEQ ID NO: 2972700 - protein, 26 aa, Entamoeba invadens
VDLECRRGVIYLTFFDALYSKEIRGK

SEQ ID NO: 2972701 - protein, 19 aa, Entamoeba invadens
VDLFGPKAAVDFMEANETP

SEQ ID NO: 2972702 - protein, 26 aa, Entamoeba invadens
VDLFLEFLKFGLTLKEALSYTQVTSE

SEQ ID NO: 2972703 - protein, 17 aa, Entamoeba invadens
VDLIKCIGACFDGSYVL

SEQ ID NO: 2972704 - protein, 18 aa, Entamoeba invadens
VDLIPIGAWLGEGKRSGV

SEQ ID NO: 2972705 - protein, 26 aa, Entamoeba invadens
VDLKKGALVPPEFAFEFYKENTALIC

SEQ ID NO: 2972706 - protein, 23 aa, Entamoeba invadens
VDLKSIIIPISYLRQYTTCVIHL

SEQ ID NO: 2972707 - protein, 20 aa, Entamoeba invadens
VDLKTVYAFPLDNFKPNKKD

SEQ ID NO: 2972708 - protein, 20 aa, Entamoeba invadens
VDLLFVLFLNWNRGAEDWEL

SEQ ID NO: 2972709 - protein, 17 aa, Entamoeba invadens
VDLLSLLLLYGANVHAE

SEQ ID NO: 2972710 - protein, 17 aa, Entamoeba invadens
VDLNGVTKISNAMFESC

SEQ ID NO: 2972711 - protein, 21 aa, Entamoeba invadens
VDLPIKVSGFLVKKELGYFAQ

SEQ ID NO: 2972712 - protein, 26 aa, Entamoeba invadens
VDLPKSLLTIGDFCFENCYELSSITF

SEQ ID NO: 2972713 - protein, 21 aa, Entamoeba invadens
VDLQNELVCLGLTKFEAKVSD

SEQ ID NO: 2972714 - protein, 19 aa, Entamoeba invadens
VDLTTKMTECIMKKTNLGN

SEQ ID NO: 2972715 - protein, 30 aa, Entamoeba invadens
VDLYCGFVRSFAIIPEIDWIDSATKANPKC

SEQ ID NO: 2972716 - protein, 18 aa, Entamoeba invadens
VDLYLKLGEVLPDQKTLP

SEQ ID NO: 2972717 - protein, 23 aa, Entamoeba invadens
VDLYQRYCRVYGLSYEEKEYSTA

SEQ ID NO: 2972718 - protein, 24 aa, Entamoeba invadens
VDMFTHLLPVYSFDAMEKIADAYL

SEQ ID NO: 2972719 - protein, 18 aa, Entamoeba invadens
VDMIEWCKSGLVVYESQI

SEQ ID NO: 2972720 - protein, 18 aa, Entamoeba invadens
VDMILRIKMMLDASRGIL

SEQ ID NO: 2972721 - protein, 19 aa, Entamoeba invadens
VDMILRIKMMLDASSGILY

SEQ ID NO: 2972722 - protein, 27 aa, Entamoeba invadens
VDMKIRVKICLDGANGIEYLHTNGILH

SEQ ID NO: 2972723 - protein, 17 aa, Entamoeba invadens
VDMKIRVKMMIDGARGV

SEQ ID NO: 2972724 - protein, 17 aa, Entamoeba invadens
VDMKLRMKFLLDAAKGI

SEQ ID NO: 2972725 - protein, 17 aa, Entamoeba invadens
VDMKLRTKFVLDASKGI

SEQ ID NO: 2972726 - protein, 17 aa, Entamoeba invadens
VDMKLRVKMLLDAAKGI

SEQ ID NO: 2972727 - protein, 23 aa, Entamoeba invadens
VDMKRMDDAIWSEIYLHELDKCE

SEQ ID NO: 2972728 - protein, 18 aa, Entamoeba invadens
VDMLKEVLPFALKELTAD

SEQ ID NO: 2972729 - protein, 17 aa, Entamoeba invadens
VDMPPPGTSVVSFIAKL

SEQ ID NO: 2972730 - protein, 22 aa, Entamoeba invadens
VDMQANVCIFNIRKKSEETWMP

SEQ ID NO: 2972731 - protein, 29 aa, Entamoeba invadens
VDMTFGCFVCSDCGRIHRYFTNKPQVCAP

SEQ ID NO: 2972732 - protein, 22 aa, Entamoeba invadens
VDMYKLLKFLLVNKVVRETTST

SEQ ID NO: 2972733 - protein, 24 aa, Entamoeba invadens
VDNACFYGCLSLQSVEFANTVQDI

SEQ ID NO: 2972734 - protein, 19 aa, Entamoeba invadens
VDNCKTCDLNGFCVECKSS

SEQ ID NO: 2972735 - protein, 18 aa, Entamoeba invadens
VDNFLKEDFSFYGCNCIS

SEQ ID NO: 2972736 - protein, 17 aa, Entamoeba invadens
VDNKFFILKVVHQKLRR

SEQ ID NO: 2972737 - protein, 17 aa, Entamoeba invadens
VDNKLFILKVVHKRFRR

SEQ ID NO: 2972738 - protein, 27 aa, Entamoeba invadens
VDNKPFCKNCFVLKFAKLCATCGKPIT

SEQ ID NO: 2972739 - protein, 27 aa, Entamoeba invadens
VDNMGHLALYKRGLCAASNPNTTVLAF

SEQ ID NO: 2972740 - protein, 18 aa, Entamoeba invadens
VDNMKGKILQKLISETRF

SEQ ID NO: 2972741 - protein, 24 aa, Entamoeba invadens
VDNPYFPQIPFFKLKNQDKKTNNS

SEQ ID NO: 2972742 - protein, 25 aa, Entamoeba invadens
VDNRCVLCAPSGYYDLCTDETSDGC

SEQ ID NO: 2972743 - protein, 18 aa, Entamoeba invadens
VDPAKYLPAFPKVEKKRP

SEQ ID NO: 2972744 - protein, 26 aa, Entamoeba invadens
VDPEVLKAMLPYFCEVYGNPNSLHTF

SEQ ID NO: 2972745 - protein, 17 aa, Entamoeba invadens
VDPFFEAMFSLGEQDLY

SEQ ID NO: 2972746 - protein, 18 aa, Entamoeba invadens
VDPGLCMFGEKEMKMVDG

SEQ ID NO: 2972747 - protein, 17 aa, Entamoeba invadens
VDPIINCCEEIGLEFPL

SEQ ID NO: 2972748 - protein, 24 aa, Entamoeba invadens
VDPLGEGIFVRWLGTKDDILYIAC

SEQ ID NO: 2972749 - protein, 22 aa, Entamoeba invadens
VDPSVRRTLSFVPMFTTTGHIV

SEQ ID NO: 2972750 - protein, 24 aa, Entamoeba invadens
VDPTRGLASLAFYYSSEILLGDDF

SEQ ID NO: 2972751 - protein, 21 aa, Entamoeba invadens
VDPVEFGFSFRLKVFSHISIN

SEQ ID NO: 2972752 - protein, 32 aa, Entamoeba invadens
VDPYYRTFDGFGILIEKEWCLIGHKFSDRSRN

SEQ ID NO: 2972753 - protein, 20 aa, Entamoeba invadens
VDQCLSHDFFSFDLHGLYSP

SEQ ID NO: 2972754 - protein, 29 aa, Entamoeba invadens
VDQKNFPRCPWAVTLLYSLSAYKDRLVDT

SEQ ID NO: 2972755 - protein, 17 aa, Entamoeba invadens
VDQVYENARFVIPLHLK

SEQ ID NO: 2972756 - protein, 24 aa, Entamoeba invadens
VDQYTVRVVDVFAMPQNGTGVSVE

SEQ ID NO: 2972757 - protein, 19 aa, Entamoeba invadens
VDRCVLIGGDGCPIGEEYT

SEQ ID NO: 2972758 - protein, 21 aa, Entamoeba invadens
VDRDFFIAGDFLEKMVFSTHL

SEQ ID NO: 2972759 - protein, 19 aa, Entamoeba invadens
VDRDPKCGYVGIIDNVCPK

SEQ ID NO: 2972760 - protein, 24 aa, Entamoeba invadens
VDRDYKLLLPKDMAVLRVGPEADL

SEQ ID NO: 2972761 - protein, 25 aa, Entamoeba invadens
VDREARLLFCVKTELENFVEKKKNE

SEQ ID NO: 2972762 - protein, 30 aa, Entamoeba invadens
VDRFDLCLKIVLRMICLHALLCAKMEEFKG

SEQ ID NO: 2972763 - protein, 17 aa, Entamoeba invadens
VDRGCFGTEVIILLFCL

SEQ ID NO: 2972764 - protein, 17 aa, Entamoeba invadens
VDRGCFGTEVIILLICL

SEQ ID NO: 2972765 - protein, 37 aa, Entamoeba invadens
VDRGHYGLECLLLLAALKLRFPTKVSLLRGNHECSLQ

SEQ ID NO: 2972766 - protein, 30 aa, Entamoeba invadens
VDRGKSGVEILCLLFALKLKYPDNIYLIRG

SEQ ID NO: 2972767 - protein, 28 aa, Entamoeba invadens
VDRPEAFEIMEMPFFKSVNVLIASLKGL

SEQ ID NO: 2972768 - protein, 24 aa, Entamoeba invadens
VDRSALCFTSKGLLEIDPTKVVCV

SEQ ID NO: 2972769 - protein, 23 aa, Entamoeba invadens
VDRSGAYCARWIAKSIVNAGLCH

SEQ ID NO: 2972770 - protein, 25 aa, Entamoeba invadens
VDRSIRRVTLLAGIYGDGTTLKPLI

SEQ ID NO: 2972771 - protein, 22 aa, Entamoeba invadens
VDRYKGNGIVLGTSKLFSTALT

SEQ ID NO: 2972772 - protein, 28 aa, Entamoeba invadens
VDSAMSYKDLEALFTFGAELIPVKQSQF

SEQ ID NO: 2972773 - protein, 25 aa, Entamoeba invadens
VDSDAMKRCVAIALMALINVLKFSE

SEQ ID NO: 2972774 - protein, 29 aa, Entamoeba invadens
VDSFEKCYEGVEAIFGVDILRGNENELLS

SEQ ID NO: 2972775 - protein, 24 aa, Entamoeba invadens
VDSGEMKVALALYPVSMKQIMDIA

SEQ ID NO: 2972776 - protein, 19 aa, Entamoeba invadens
VDSGLWTPLLIAVAGAPSN

SEQ ID NO: 2972777 - protein, 23 aa, Entamoeba invadens
VDSLRYVFERIIPVNQQLQPRII

SEQ ID NO: 2972778 - protein, 28 aa, Entamoeba invadens
VDSLYYRVLVTIACCFIKQTSRPVLWID

SEQ ID NO: 2972779 - protein, 24 aa, Entamoeba invadens
VDSPKELLIVFATLAAVIESYIVK

SEQ ID NO: 2972780 - protein, 26 aa, Entamoeba invadens
VDSQCFKNSLSFAFYRFPRSVSNIGD

SEQ ID NO: 2972781 - protein, 23 aa, Entamoeba invadens
VDSQCLLYTLPMIEGGTMGTKGN

SEQ ID NO: 2972782 - protein, 17 aa, Entamoeba invadens
VDSRTSLYVSEEMKQRE

SEQ ID NO: 2972783 - protein, 20 aa, Entamoeba invadens
VDSSLPCFIVAQSTKVKVYL

SEQ ID NO: 2972784 - protein, 23 aa, Entamoeba invadens
VDSTCKTNHPWNAPKYLKTKKDN

SEQ ID NO: 2972785 - protein, 17 aa, Entamoeba invadens
VDSTFYLPGQNIVIDIL

SEQ ID NO: 2972786 - protein, 18 aa, Entamoeba invadens
VDTFADFMENFNVDMEQT

SEQ ID NO: 2972787 - protein, 17 aa, Entamoeba invadens
VDTLEAMACNISQEELI

SEQ ID NO: 2972788 - protein, 17 aa, Entamoeba invadens
VDTLGNIPLEWYDDYEH

SEQ ID NO: 2972789 - protein, 20 aa, Entamoeba invadens
VDTLRTIPAVICGNKNDLEN

SEQ ID NO: 2972790 - protein, 22 aa, Entamoeba invadens
VDTLRTIPAVICGNKNDLENKR

SEQ ID NO: 2972791 - protein, 24 aa, Entamoeba invadens
VDTLYFYLCPSFITRTIRIIASNS

SEQ ID NO: 2972792 - protein, 26 aa, Entamoeba invadens
VDTNLSTLCLFKLVTKFLPTANINPN

SEQ ID NO: 2972793 - protein, 17 aa, Entamoeba invadens
VDTSSWCNPFCVFLDKG

SEQ ID NO: 2972794 - protein, 20 aa, Entamoeba invadens
VDVAWVFNIRGDDILYSPLA

SEQ ID NO: 2972795 - protein, 19 aa, Entamoeba invadens
VDVFYGCIFKLPTHINKER

SEQ ID NO: 2972796 - protein, 17 aa, Entamoeba invadens
VDVGKGWDVLFEAYNEN

SEQ ID NO: 2972797 - protein, 20 aa, Entamoeba invadens
VDVIGVNEFVCVAKRDNSID

SEQ ID NO: 2972798 - protein, 18 aa, Entamoeba invadens
VDVIPKFIMSSGEMVNLL

SEQ ID NO: 2972799 - protein, 27 aa, Entamoeba invadens
VDVIPYGCFQRCKFLMKSRIFIKGNNV

SEQ ID NO: 2972800 - protein, 17 aa, Entamoeba invadens
VDVIRIFMTNFEHRLDD

SEQ ID NO: 2972801 - protein, 24 aa, Entamoeba invadens
VDVKYKAVFVWVDAALVLLDKRAD

SEQ ID NO: 2972802 - protein, 27 aa, Entamoeba invadens
VDVLIIGGVCLQIFPTIQRVEFVTEET

SEQ ID NO: 2972803 - protein, 19 aa, Entamoeba invadens
VDVNFLLGFQHIQIIELIK

SEQ ID NO: 2972804 - protein, 18 aa, Entamoeba invadens
VDVQWLLCKFGKENATSN

SEQ ID NO: 2972805 - protein, 23 aa, Entamoeba invadens
VDVRLKDGCVIGKSQEELKEFVD

SEQ ID NO: 2972806 - protein, 19 aa, Entamoeba invadens
VDVYPPYLLLLKLLTKNGK

SEQ ID NO: 2972807 - protein, 18 aa, Entamoeba invadens
VDWLRCGEFKNFYNPENL

SEQ ID NO: 2972808 - protein, 22 aa, Entamoeba invadens
VDWWGLGILIYEMLFTKSPFLA

SEQ ID NO: 2972809 - protein, 18 aa, Entamoeba invadens
VDYANCGVDAKGYLLHNE

SEQ ID NO: 2972810 - protein, 19 aa, Entamoeba invadens
VDYDCVVDLLKIIEPQSLN

SEQ ID NO: 2972811 - protein, 17 aa, Entamoeba invadens
VDYDWKFGGRDYDEAIG

SEQ ID NO: 2972812 - protein, 25 aa, Entamoeba invadens
VDYFEFLVFCWMKILVVDEKKTFHQ

SEQ ID NO: 2972813 - protein, 17 aa, Entamoeba invadens
VDYFISVVIIDTDERRY

SEQ ID NO: 2972814 - protein, 23 aa, Entamoeba invadens
VDYGEIFGLSTFVSVYIYQRLYT

SEQ ID NO: 2972815 - protein, 17 aa, Entamoeba invadens
VDYGLCFEKLPRKKEKI

SEQ ID NO: 2972816 - protein, 17 aa, Entamoeba invadens
VDYIAVFEISVDITEFI

SEQ ID NO: 2972817 - protein, 18 aa, Entamoeba invadens
VDYTENFVSIGYTSPKLM

SEQ ID NO: 2972818 - protein, 28 aa, Entamoeba invadens
VDYWSIGCMLFQFLTGEFPFRGKSDKLT

SEQ ID NO: 2972819 - protein, 25 aa, Entamoeba invadens
VDYYHFAFNIARKCNVINRLMYGID

SEQ ID NO: 2972820 - protein, 23 aa, Entamoeba invadens
VEAAALLRAECFGIKQNMTKDEM

SEQ ID NO: 2972821 - protein, 20 aa, Entamoeba invadens
VEAEGFFKLATGEGTSMLAK

SEQ ID NO: 2972822 - protein, 17 aa, Entamoeba invadens
VEAEWLQEFDVQLKVGE

SEQ ID NO: 2972823 - protein, 19 aa, Entamoeba invadens
VEAGIKHTLMQQVLLPKSL

SEQ ID NO: 2972824 - protein, 20 aa, Entamoeba invadens
VEAIGGNGLFYCLVDTDETA

SEQ ID NO: 2972825 - protein, 17 aa, Entamoeba invadens
VEAIWNSYVVPSMPVNT

SEQ ID NO: 2972826 - protein, 25 aa, Entamoeba invadens
VEAKITLGIFFQIVFQSFKINDIFY

SEQ ID NO: 2972827 - protein, 26 aa, Entamoeba invadens
VEALKGFARAIGFFRNQEEYYWANQC

SEQ ID NO: 2972828 - protein, 19 aa, Entamoeba invadens
VEALLSYIFPLFAEASKYK

SEQ ID NO: 2972829 - protein, 28 aa, Entamoeba invadens
VEALNKLPGGPFINGKIVCSEDCISEIL

SEQ ID NO: 2972830 - protein, 19 aa, Entamoeba invadens
VEALSAMSKYIGWVDTKAL

SEQ ID NO: 2972831 - protein, 17 aa, Entamoeba invadens
VEAMNKCIENLSFPKDL

SEQ ID NO: 2972832 - protein, 20 aa, Entamoeba invadens
VEANAWFVAMAYTIKLAPRI

SEQ ID NO: 2972833 - protein, 19 aa, Entamoeba invadens
VEAPRECQTVIEIAKSAHQ

SEQ ID NO: 2972834 - protein, 37 aa, Entamoeba invadens
VEASKLCPEIVWTPSMKRLFCLIVECFKNKEPALLIV

SEQ ID NO: 2972835 - protein, 23 aa, Entamoeba invadens
VEAVLRVTENFVKKVLKESPHLI

SEQ ID NO: 2972836 - protein, 24 aa, Entamoeba invadens
VECAKAISLLNGFDCNFYELNCAC

SEQ ID NO: 2972837 - protein, 22 aa, Entamoeba invadens
VECARSDYLLLMYTQATCATVL

SEQ ID NO: 2972838 - protein, 21 aa, Entamoeba invadens
VECFRYLGILLNMGAHRDVIN

SEQ ID NO: 2972839 - protein, 20 aa, Entamoeba invadens
VECKVCKANLIFSHHFARSF

SEQ ID NO: 2972840 - protein, 19 aa, Entamoeba invadens
VECLLKYSTQWMTDESTHL

SEQ ID NO: 2972841 - protein, 21 aa, Entamoeba invadens
VECLYVLLCTITQYPVGVYFA

SEQ ID NO: 2972842 - protein, 23 aa, Entamoeba invadens
VECSHPNDVCWNAVNNQIFVGTE

SEQ ID NO: 2972843 - protein, 25 aa, Entamoeba invadens
VEDAKVCILSCPFEPPKTKTTTNMN

SEQ ID NO: 2972844 - protein, 17 aa, Entamoeba invadens
VEDKFEMEDYYSIQNLY

SEQ ID NO: 2972845 - protein, 17 aa, Entamoeba invadens
VEDLCFSLQETLFAMLV

SEQ ID NO: 2972846 - protein, 20 aa, Entamoeba invadens
VEDLKDYFAIVGQNETNPFL

SEQ ID NO: 2972847 - protein, 29 aa, Entamoeba invadens
VEDLKLMGLAVDWRRSFITTDHNKFYDSF

SEQ ID NO: 2972848 - protein, 24 aa, Entamoeba invadens
VEDLRLSIPSSIIIQKDSNDQKVL

SEQ ID NO: 2972849 - protein, 21 aa, Entamoeba invadens
VEDNIRDKLAYYWREDGDKLK

SEQ ID NO: 2972850 - protein, 19 aa, Entamoeba invadens
VEDNLIVPGCYDISKINET

SEQ ID NO: 2972851 - protein, 17 aa, Entamoeba invadens
VEDRVVPSYSFSNHVLA

SEQ ID NO: 2972852 - protein, 22 aa, Entamoeba invadens
VEDRWFKCFTEYIDDRKTYLRT

SEQ ID NO: 2972853 - protein, 23 aa, Entamoeba invadens
VEDVEPLKLFFGLLDTDDDGELC

SEQ ID NO: 2972854 - protein, 23 aa, Entamoeba invadens
VEDYALWKCCSLVRHPKFVPAKG

SEQ ID NO: 2972855 - protein, 22 aa, Entamoeba invadens
VEDYSGVSFEVFIRWFQKVAED

SEQ ID NO: 2972856 - protein, 22 aa, Entamoeba invadens
VEEAEKFLKEQQESAGGNGQGT

SEQ ID NO: 2972857 - protein, 23 aa, Entamoeba invadens
VEEEVKYVYTIVKAIRSLNSTYQ

SEQ ID NO: 2972858 - protein, 17 aa, Entamoeba invadens
VEEFMKFPLNNPTNVWT

SEQ ID NO: 2972859 - protein, 19 aa, Entamoeba invadens
VEEGITLGVPKSMKKATNK

SEQ ID NO: 2972860 - protein, 32 aa, Entamoeba invadens
VEEGVLKKVYFWHQGLGFSFVHNGEELKNTLY

SEQ ID NO: 2972861 - protein, 23 aa, Entamoeba invadens
VEEKKCITHHGFFVEFKQNHTQH

SEQ ID NO: 2972862 - protein, 18 aa, Entamoeba invadens
VEEKKLLHHLGIKCSNLI

SEQ ID NO: 2972863 - protein, 32 aa, Entamoeba invadens
VEEKMTLLAQMVLDKRVEFISKKRKAEVLFDS

SEQ ID NO: 2972864 - protein, 23 aa, Entamoeba invadens
VEEKRAKNEAPAMLAQLASTVEK

SEQ ID NO: 2972865 - protein, 23 aa, Entamoeba invadens
VEEKRFQTIVGVQVRLMKRHKKI

SEQ ID NO: 2972866 - protein, 23 aa, Entamoeba invadens
VEEKRTLTQWSNRVNSHIKDSFL

SEQ ID NO: 2972867 - protein, 21 aa, Entamoeba invadens
VEELGELMVPYIEQMTPLVEC

SEQ ID NO: 2972868 - protein, 25 aa, Entamoeba invadens
VEELKEKLHPLGMFSNVEALPNVKS

SEQ ID NO: 2972869 - protein, 18 aa, Entamoeba invadens
VEELLCRPEKNSGRVKAA

SEQ ID NO: 2972870 - protein, 20 aa, Entamoeba invadens
VEELPVLNVEVSTQKEKNSW

SEQ ID NO: 2972871 - protein, 19 aa, Entamoeba invadens
VEELWSFDHGKSIYRNSMP

SEQ ID NO: 2972872 - protein, 24 aa, Entamoeba invadens
VEEMAQALFIYWKSKELLRTNEYQ

SEQ ID NO: 2972873 - protein, 24 aa, Entamoeba invadens
VEEMAQALYIYWKSRDIARSGECD

SEQ ID NO: 2972874 - protein, 23 aa, Entamoeba invadens
VEEMSELFTPFLFKVQEKRLAKY

SEQ ID NO: 2972875 - protein, 21 aa, Entamoeba invadens
VEERNELFILLAQSSNKTVYI

SEQ ID NO: 2972876 - protein, 20 aa, Entamoeba invadens
VEERPAFILVYTIATNTLST

SEQ ID NO: 2972877 - protein, 19 aa, Entamoeba invadens
VEERWGWKEIDESPFMCEF

SEQ ID NO: 2972878 - protein, 21 aa, Entamoeba invadens
VEETISLKAFVVLLVDKENNK

SEQ ID NO: 2972879 - protein, 25 aa, Entamoeba invadens
VEETWKIAEILSLKFDEGSNGLIIT

SEQ ID NO: 2972880 - protein, 26 aa, Entamoeba invadens
VEEVTGRFGFPFTCEYKYDGERGQIH

SEQ ID NO: 2972881 - protein, 30 aa, Entamoeba invadens
VEFAGCSNLNIIDTPGFRIGGEEGLRDDIS

SEQ ID NO: 2972882 - protein, 24 aa, Entamoeba invadens
VEFEKRNLLEFFTSNRVLFFKGDV

SEQ ID NO: 2972883 - protein, 20 aa, Entamoeba invadens
VEFFKVGGVSKYFGDVSTQN

SEQ ID NO: 2972884 - protein, 17 aa, Entamoeba invadens
VEFKNTLLTLLKEKEKI

SEQ ID NO: 2972885 - protein, 18 aa, Entamoeba invadens
VEFLERWKCSMDQEEMLS

SEQ ID NO: 2972886 - protein, 22 aa, Entamoeba invadens
VEFLKFLCDTFIFLNGSFTTQH

SEQ ID NO: 2972887 - protein, 17 aa, Entamoeba invadens
VEFMKLKHLIILQNKID

SEQ ID NO: 2972888 - protein, 21 aa, Entamoeba invadens
VEFRKCLERFGATSLEKFKKM

SEQ ID NO: 2972889 - protein, 24 aa, Entamoeba invadens
VEFSKQILPQFFKHSNICSFVRQL

SEQ ID NO: 2972890 - protein, 34 aa, Entamoeba invadens
VEFSVKRYDFLVQFLPKWGSGWEKLSSDHRNIEK

SEQ ID NO: 2972891 - protein, 17 aa, Entamoeba invadens
VEGAVIHDICTKVNAYI

SEQ ID NO: 2972892 - protein, 17 aa, Entamoeba invadens
VEGCTSVPYQSDSTSTF

SEQ ID NO: 2972893 - protein, 25 aa, Entamoeba invadens
VEGDTFKLGVKMLMATAYLPEDVIV

SEQ ID NO: 2972894 - protein, 18 aa, Entamoeba invadens
VEGGKGWHAELNKVMKEK

SEQ ID NO: 2972895 - protein, 23 aa, Entamoeba invadens
VEGHGRCFLISGLPNGTTVSNLK

SEQ ID NO: 2972896 - protein, 18 aa, Entamoeba invadens
VEGIFRLTGSKMKIDQII

SEQ ID NO: 2972897 - protein, 32 aa, Entamoeba invadens
VEGLREVVQLIAIKEEVDWDYFLKDPFVGALT

SEQ ID NO: 2972898 - protein, 20 aa, Entamoeba invadens
VEGTVLEKVVEWLNFHNEHP

SEQ ID NO: 2972899 - protein, 17 aa, Entamoeba invadens
VEGVWGMAGDLILIEEA

SEQ ID NO: 2972900 - protein, 24 aa, Entamoeba invadens
VEHFPMKKGGTFDVNIKCLRSVYH

SEQ ID NO: 2972901 - protein, 24 aa, Entamoeba invadens
VEHGACLGVGLAGIATEDFEIYEE

SEQ ID NO: 2972902 - protein, 24 aa, Entamoeba invadens
VEHKKRKITQCGRCQQYGHNKQTC

SEQ ID NO: 2972903 - protein, 19 aa, Entamoeba invadens
VEHLKTVNGTFAFSDTATQ

SEQ ID NO: 2972904 - protein, 23 aa, Entamoeba invadens
VEHLPQTIVELFTCHLSILSSLK

SEQ ID NO: 2972905 - protein, 20 aa, Entamoeba invadens
VEIAVPFPSFIRNIQLTVVS

SEQ ID NO: 2972906 - protein, 18 aa, Entamoeba invadens
VEIDCCVELSEFVCPCTL

SEQ ID NO: 2972907 - protein, 18 aa, Entamoeba invadens
VEIDFRSKIPFEQVFEEL

SEQ ID NO: 2972908 - protein, 26 aa, Entamoeba invadens
VEIDWKAEFDGLIVRGIKTFGLGMWS

SEQ ID NO: 2972909 - protein, 22 aa, Entamoeba invadens
VEIEKLMLLKCNREECLRVYLK

SEQ ID NO: 2972910 - protein, 18 aa, Entamoeba invadens
VEIELRHVAVLDALGKPK

SEQ ID NO: 2972911 - protein, 17 aa, Entamoeba invadens
VEIFATTGIEIYSETTH

SEQ ID NO: 2972912 - protein, 22 aa, Entamoeba invadens
VEIGCSCYLCANKERVISKKRI

SEQ ID NO: 2972913 - protein, 26 aa, Entamoeba invadens
VEIGPRMTLKLLSILSDFLRGRIVYR

SEQ ID NO: 2972914 - protein, 21 aa, Entamoeba invadens
VEIGVGCFENCISLTKLKLPH

SEQ ID NO: 2972915 - protein, 27 aa, Entamoeba invadens
VEIIKTTLFAIEWFVSANFGDSITSYV

SEQ ID NO: 2972916 - protein, 25 aa, Entamoeba invadens
VEIKEWTAIIPMMYKDEFMTLQHLL

SEQ ID NO: 2972917 - protein, 19 aa, Entamoeba invadens
VEIKPTYTMFPNVDSVMVS

SEQ ID NO: 2972918 - protein, 25 aa, Entamoeba invadens
VEILAFILGVSCLKDIRVQAKTFLL

SEQ ID NO: 2972919 - protein, 22 aa, Entamoeba invadens
VEILKDEYILFSIAELVNSRYD

SEQ ID NO: 2972920 - protein, 27 aa, Entamoeba invadens
VEILKFHKRTVKGFGSCATVVVYQGQE

SEQ ID NO: 2972921 - protein, 17 aa, Entamoeba invadens
VEILKTILKQCGENVTF

SEQ ID NO: 2972922 - protein, 21 aa, Entamoeba invadens
VEIPDFLPPDVINDIDIELID

SEQ ID NO: 2972923 - protein, 18 aa, Entamoeba invadens
VEIPDTIGDCIGLTYLSL

SEQ ID NO: 2972924 - protein, 26 aa, Entamoeba invadens
VEIPGSVKVLREWTFAGCVSLREVVL

SEQ ID NO: 2972925 - protein, 18 aa, Entamoeba invadens
VEIPLLSFLEQFKILNNR

SEQ ID NO: 2972926 - protein, 19 aa, Entamoeba invadens
VEIPLSLLEQHVIKTTKNK

SEQ ID NO: 2972927 - protein, 27 aa, Entamoeba invadens
VEIPTSGLLCDLVWSDPLLTPDIAPNL

SEQ ID NO: 2972928 - protein, 19 aa, Entamoeba invadens
VEIVTRILLFITDNCRAKL

SEQ ID NO: 2972929 - protein, 27 aa, Entamoeba invadens
VEIYDLFVVQLFEMFLAIFLVDEEHRK

SEQ ID NO: 2972930 - protein, 19 aa, Entamoeba invadens
VEKCFCFDNDNTLPVSKIE

SEQ ID NO: 2972931 - protein, 20 aa, Entamoeba invadens
VEKCNKKKGLVFGVFDTNKH

SEQ ID NO: 2972932 - protein, 22 aa, Entamoeba invadens
VEKCSLGVYSLLCIYGGVEMFP

SEQ ID NO: 2972933 - protein, 19 aa, Entamoeba invadens
VEKDFPILVKYATSSDEEK

SEQ ID NO: 2972934 - protein, 18 aa, Entamoeba invadens
VEKEGTVIVLFNYMTSID

SEQ ID NO: 2972935 - protein, 19 aa, Entamoeba invadens
VEKERKLLEEERIRLQKEE

SEQ ID NO: 2972936 - protein, 19 aa, Entamoeba invadens
VEKFINFKVDYEQYLNDKK

SEQ ID NO: 2972937 - protein, 25 aa, Entamoeba invadens
VEKGHLLFWRQEYFYLRDELIADIT

SEQ ID NO: 2972938 - protein, 19 aa, Entamoeba invadens
VEKGILRVEQYASFGSLLL

SEQ ID NO: 2972939 - protein, 18 aa, Entamoeba invadens
VEKGKRLILDKNIPTDYA

SEQ ID NO: 2972940 - protein, 25 aa, Entamoeba invadens
VEKGSLCFSCVTIPQVKKITAPVMF

SEQ ID NO: 2972941 - protein, 17 aa, Entamoeba invadens
VEKIEEWSGKKVDQVLF

SEQ ID NO: 2972942 - protein, 26 aa, Entamoeba invadens
VEKIIKMSGGVLDRSALFVVGTEEGE

SEQ ID NO: 2972943 - protein, 27 aa, Entamoeba invadens
VEKIKQFYIVVCQEIHDNGNTINQLKQ

SEQ ID NO: 2972944 - protein, 19 aa, Entamoeba invadens
VEKILKRQAVVEFFIENPT

SEQ ID NO: 2972945 - protein, 33 aa, Entamoeba invadens
VEKISFKTKSSWGAQDFLDFLLSVPESERYRTM

SEQ ID NO: 2972946 - protein, 23 aa, Entamoeba invadens
VEKKFPFLLSCLNDLNEAIKVVF

SEQ ID NO: 2972947 - protein, 21 aa, Entamoeba invadens
VEKKIKRLRVTKLKVDKKLDD

SEQ ID NO: 2972948 - protein, 20 aa, Entamoeba invadens
VEKKRPKVKCFDKKTSAKIE

SEQ ID NO: 2972949 - protein, 21 aa, Entamoeba invadens
VEKRGPWLFYINNVIFTKKCW

SEQ ID NO: 2972950 - protein, 22 aa, Entamoeba invadens
VEKRGPWLFYINNVIFTKKCWE

SEQ ID NO: 2972951 - protein, 17 aa, Entamoeba invadens
VEKRLHAIITVDKKDIA

SEQ ID NO: 2972952 - protein, 24 aa, Entamoeba invadens
VEKRVCGLQSRIKILTVENEKLRK

SEQ ID NO: 2972953 - protein, 25 aa, Entamoeba invadens
VEKSESLMECCGYRDGVVLYRDGDV

SEQ ID NO: 2972954 - protein, 22 aa, Entamoeba invadens
VEKSLKMTLNFRKSEKKPEKDE

SEQ ID NO: 2972955 - protein, 24 aa, Entamoeba invadens
VEKTREVVALLGILKSPRGIFEGN

SEQ ID NO: 2972956 - protein, 25 aa, Entamoeba invadens
VEKVKRGDSVLVHCSDGWDRTSQLT

SEQ ID NO: 2972957 - protein, 29 aa, Entamoeba invadens
VEKYNSVFFKVKIVMKYNEELVMTHLTTL

SEQ ID NO: 2972958 - protein, 17 aa, Entamoeba invadens
VELAGPMEKLFFIPERT

SEQ ID NO: 2972959 - protein, 27 aa, Entamoeba invadens
VELARKLFPKKLDQFNPAFVIVDEQGK

SEQ ID NO: 2972960 - protein, 18 aa, Entamoeba invadens
VELCAPQQIELKFLEKTP

SEQ ID NO: 2972961 - protein, 20 aa, Entamoeba invadens
VELCNEMFFRNEHLLFLEMI

SEQ ID NO: 2972962 - protein, 19 aa, Entamoeba invadens
VELCRKFGEEFYKFRRSLA

SEQ ID NO: 2972963 - protein, 18 aa, Entamoeba invadens
VELDLSFNKIDDFSPLCS

SEQ ID NO: 2972964 - protein, 34 aa, Entamoeba invadens
VELEAKLMLGDRFFRLNPKLPHYVDLDDCKDMEL

SEQ ID NO: 2972965 - protein, 30 aa, Entamoeba invadens
VELECVLLALLSLKYSFTISKPQKKAENTK

SEQ ID NO: 2972966 - protein, 23 aa, Entamoeba invadens
VELELKSKINAYFAENTPLFTPP

SEQ ID NO: 2972967 - protein, 23 aa, Entamoeba invadens
VELEPRQSFMIKGTHNKDEKNMS

SEQ ID NO: 2972968 - protein, 34 aa, Entamoeba invadens
VELEVKRILSKYPKFKASVMNSRLTSKQQLTLSG

SEQ ID NO: 2972969 - protein, 19 aa, Entamoeba invadens
VELEWSQKVYDNFFAGIGG

SEQ ID NO: 2972970 - protein, 17 aa, Entamoeba invadens
VELFISNIDFEYVDNGN

SEQ ID NO: 2972971 - protein, 19 aa, Entamoeba invadens
VELHKVFIHAHVLNRAFNT

SEQ ID NO: 2972972 - protein, 24 aa, Entamoeba invadens
VELKEIKNFVVWYEVSFSHTKRFA

SEQ ID NO: 2972973 - protein, 21 aa, Entamoeba invadens
VELKLLSGIVKLIIYYNDISS

SEQ ID NO: 2972974 - protein, 19 aa, Entamoeba invadens
VELKMIFHSFVNYIKDVLN

SEQ ID NO: 2972975 - protein, 24 aa, Entamoeba invadens
VELKTDYLRDFLVKYISRMDLFKF

SEQ ID NO: 2972976 - protein, 19 aa, Entamoeba invadens
VELLCWDISQEYLDQAETE

SEQ ID NO: 2972977 - protein, 21 aa, Entamoeba invadens
VELLGNLGCGFDCATLNEVKE

SEQ ID NO: 2972978 - protein, 21 aa, Entamoeba invadens
VELLMFACLYVFKIMDDETLR

SEQ ID NO: 2972979 - protein, 17 aa, Entamoeba invadens
VELLNFLDKSVVLSDEK

SEQ ID NO: 2972980 - protein, 23 aa, Entamoeba invadens
VELLSFKDRFVMFEKLTKDTDSK

SEQ ID NO: 2972981 - protein, 18 aa, Entamoeba invadens
VELNCSRGVDVRKDEMKE

SEQ ID NO: 2972982 - protein, 18 aa, Entamoeba invadens
VELNEAIFSAAFGTFMFD

SEQ ID NO: 2972983 - protein, 19 aa, Entamoeba invadens
VELNTNFDLVNSISKLISD

SEQ ID NO: 2972984 - protein, 23 aa, Entamoeba invadens
VELPFKPKVALTLFSMFYPIIPL

SEQ ID NO: 2972985 - protein, 23 aa, Entamoeba invadens
VELPISNGKLKFHLITQTDATVI

SEQ ID NO: 2972986 - protein, 27 aa, Entamoeba invadens
VELPKSLKLIGKEAFEYCVSLTTIVIP

SEQ ID NO: 2972987 - protein, 23 aa, Entamoeba invadens
VELPLRHPQLFQAIGIKPPKGVL

SEQ ID NO: 2972988 - protein, 18 aa, Entamoeba invadens
VELPSCIKELKIDSFCDV

SEQ ID NO: 2972989 - protein, 17 aa, Entamoeba invadens
VELRDGTGYCQCVIFGK

SEQ ID NO: 2972990 - protein, 20 aa, Entamoeba invadens
VELRGFPGYAGGLDTKENGD

SEQ ID NO: 2972991 - protein, 24 aa, Entamoeba invadens
VELSADLFANYVIQKALEFVPESR

SEQ ID NO: 2972992 - protein, 30 aa, Entamoeba invadens
VELSNALFGFDGWSSCITNLNVDYVDAEKG

SEQ ID NO: 2972993 - protein, 17 aa, Entamoeba invadens
VELSSIFNCEQKTIDMS

SEQ ID NO: 2972994 - protein, 26 aa, Entamoeba invadens
VELTSSFKEFFFKKITFGTANCGGDN

SEQ ID NO: 2972995 - protein, 19 aa, Entamoeba invadens
VELVKFVTSCFIRRESIEF

SEQ ID NO: 2972996 - protein, 18 aa, Entamoeba invadens
VELVPTFRDYLASKDDPT

SEQ ID NO: 2972997 - protein, 27 aa, Entamoeba invadens
VELYLQLGPPLKVFIPITVVTSQDPSI

SEQ ID NO: 2972998 - protein, 17 aa, Entamoeba invadens
VEMADGLIIHTKNEDFL

SEQ ID NO: 2972999 - protein, 21 aa, Entamoeba invadens
VEMAKTCWREIVKRRYDNRQI

SEQ ID NO: 2973000 - protein, 19 aa, Entamoeba invadens
VEMKNCNFVAPFEFMKNNF

SEQ ID NO: 2973001 - protein, 19 aa, Entamoeba invadens
VEMKNCNFVAPFEFMKNNL

SEQ ID NO: 2973002 - protein, 17 aa, Entamoeba invadens
VEMMCLFTKNNFIQCGN

SEQ ID NO: 2973003 - protein, 20 aa, Entamoeba invadens
VEMMQRWKAFLDVSKDFVKS

SEQ ID NO: 2973004 - protein, 25 aa, Entamoeba invadens
VEMPGSVKVLREWTFAGCVSLREVV

SEQ ID NO: 2973005 - protein, 21 aa, Entamoeba invadens
VEMRCGGTVASVIPMICEEKA

SEQ ID NO: 2973006 - protein, 24 aa, Entamoeba invadens
VENALYLLRWISLMMAEELPTDSL

SEQ ID NO: 2973007 - protein, 17 aa, Entamoeba invadens
VENCLKALQYSYVKMFF

SEQ ID NO: 2973008 - protein, 17 aa, Entamoeba invadens
VENCTPEVLAMIKRCEF

SEQ ID NO: 2973009 - protein, 30 aa, Entamoeba invadens
VENCVTCLQPSLRGYPFVYTYSIIHYTTLF

SEQ ID NO: 2973010 - protein, 17 aa, Entamoeba invadens
VENFAGVAYPQISKLKS

SEQ ID NO: 2973011 - protein, 17 aa, Entamoeba invadens
VENFCFVVEAKNRRGQI

SEQ ID NO: 2973012 - protein, 25 aa, Entamoeba invadens
VENHFGRLILSFKLMRNKYGLLKRD

SEQ ID NO: 2973013 - protein, 26 aa, Entamoeba invadens
VENHFSRLIILFKLMRNKYGLLKRDY

SEQ ID NO: 2973014 - protein, 25 aa, Entamoeba invadens
VENILRLFGVKIFCFEELTNVLKEW

SEQ ID NO: 2973015 - protein, 19 aa, Entamoeba invadens
VENKGDLLIYLYSSNPQKQ

SEQ ID NO: 2973016 - protein, 23 aa, Entamoeba invadens
VENLKGVRGFVIVIYSQDANNVF

SEQ ID NO: 2973017 - protein, 29 aa, Entamoeba invadens
VENMVQSWRCCLFYGLALVNSPTNYSYVF

SEQ ID NO: 2973018 - protein, 26 aa, Entamoeba invadens
VENTFFLSFNDICFDKIFNEAMKRRL

SEQ ID NO: 2973019 - protein, 28 aa, Entamoeba invadens
VENVFNYASKILIKFDHECLKCRDHKDK

SEQ ID NO: 2973020 - protein, 17 aa, Entamoeba invadens
VEPDVFIMVVGNKVDKP

SEQ ID NO: 2973021 - protein, 23 aa, Entamoeba invadens
VEPELRLGYLSVNQLKNHPWFEG

SEQ ID NO: 2973022 - protein, 25 aa, Entamoeba invadens
VEPGLYFKGNFGVRIENVCIVEYTT

SEQ ID NO: 2973023 - protein, 21 aa, Entamoeba invadens
VEPIYEGFTMKRCGLRTSVAG

SEQ ID NO: 2973024 - protein, 19 aa, Entamoeba invadens
VEPKNCIVEGQGITEPNDE

SEQ ID NO: 2973025 - protein, 26 aa, Entamoeba invadens
VEPLLHIFSAHALKVGSLYTEVYCQL

SEQ ID NO: 2973026 - protein, 18 aa, Entamoeba invadens
VEPMRKKKPVILLYDENG

SEQ ID NO: 2973027 - protein, 24 aa, Entamoeba invadens
VEPSADYYKAIVLIYASSALLTQQ

SEQ ID NO: 2973028 - protein, 23 aa, Entamoeba invadens
VEPSCAYSCVSFFINVSYNNEDG

SEQ ID NO: 2973029 - protein, 30 aa, Entamoeba invadens
VEPSKLPESWKILLREAGVKKRDLQNPDTR

SEQ ID NO: 2973030 - protein, 23 aa, Entamoeba invadens
VEPTKLKYGISLFDQYFPTLKPE

SEQ ID NO: 2973031 - protein, 25 aa, Entamoeba invadens
VEPTRKCFRLVNGVMVERTASEIIP

SEQ ID NO: 2973032 - protein, 18 aa, Entamoeba invadens
VEQCKVYVAKLMKMSDAV

SEQ ID NO: 2973033 - protein, 19 aa, Entamoeba invadens
VEQCSRVIIEYADDKCESS

SEQ ID NO: 2973034 - protein, 23 aa, Entamoeba invadens
VEQDAFNCCYFLTEIKFRCKDTK

SEQ ID NO: 2973035 - protein, 25 aa, Entamoeba invadens
VEQEDRMNWVKSLGKVKEEIKREHV

SEQ ID NO: 2973036 - protein, 23 aa, Entamoeba invadens
VEQIQKWSFLKIESVIFDSNLDD

SEQ ID NO: 2973037 - protein, 22 aa, Entamoeba invadens
VEQKKPKACVGMYRGETTKEIK

SEQ ID NO: 2973038 - protein, 27 aa, Entamoeba invadens
VEQLGDCHLWRFEALKEVGAVDAHGKS

SEQ ID NO: 2973039 - protein, 18 aa, Entamoeba invadens
VEQPIRAIIFGFNTEEIV

SEQ ID NO: 2973040 - protein, 30 aa, Entamoeba invadens
VEQRKCGVCNVPFDTGFNVTSQWDKIEGIS

SEQ ID NO: 2973041 - protein, 25 aa, Entamoeba invadens
VERCRELYESALLKCPAEFKLEISK

SEQ ID NO: 2973042 - protein, 17 aa, Entamoeba invadens
VEREMMKEEISVLESTV

SEQ ID NO: 2973043 - protein, 17 aa, Entamoeba invadens
VERFSISNIVHVKQVYN

SEQ ID NO: 2973044 - protein, 33 aa, Entamoeba invadens
VERKHGGGFGLSWSIVSPGTFCVCENGNVYVYT

SEQ ID NO: 2973045 - protein, 22 aa, Entamoeba invadens
VERLEKFGLYTFVFNALDMIYA

SEQ ID NO: 2973046 - protein, 25 aa, Entamoeba invadens
VERLELFKDLYLSKALEVIPDDVVM

SEQ ID NO: 2973047 - protein, 20 aa, Entamoeba invadens
VERLKVNFCEMGRLYSEFYM

SEQ ID NO: 2973048 - protein, 28 aa, Entamoeba invadens
VERLPRMCFYCCVSLKKAVITKGVIIIG

SEQ ID NO: 2973049 - protein, 24 aa, Entamoeba invadens
VERWESGWDFGYQFRYNNGGNPMI

SEQ ID NO: 2973050 - protein, 18 aa, Entamoeba invadens
VERWMFKSLKPEEHDTFK

SEQ ID NO: 2973051 - protein, 24 aa, Entamoeba invadens
VESARYGNMYSIFNLGVLAFKGLP

SEQ ID NO: 2973052 - protein, 24 aa, Entamoeba invadens
VESDMKDFSILVGIRDRKLLLCKI

SEQ ID NO: 2973053 - protein, 21 aa, Entamoeba invadens
VESHSAYTVWSMVLNNSSIIS

SEQ ID NO: 2973054 - protein, 20 aa, Entamoeba invadens
VESIPHCTFMKCYNLREIIL

SEQ ID NO: 2973055 - protein, 25 aa, Entamoeba invadens
VESLEAELLTLRQVVSSSDTKAIEL

SEQ ID NO: 2973056 - protein, 18 aa, Entamoeba invadens
VESLRIQLELFFHRVEEK

SEQ ID NO: 2973057 - protein, 18 aa, Entamoeba invadens
VESLRLVKEMLPIQTASM

SEQ ID NO: 2973058 - protein, 24 aa, Entamoeba invadens
VESLRPSLFEGWAKKQGGAVKTWK

SEQ ID NO: 2973059 - protein, 19 aa, Entamoeba invadens
VESLWPFVVSMRYEEKVIV

SEQ ID NO: 2973060 - protein, 22 aa, Entamoeba invadens
VESRNKWTLLQRRMDQLDQMLN

SEQ ID NO: 2973061 - protein, 27 aa, Entamoeba invadens
VESTCCVNCSALSLVIEDFANTIIFTE

SEQ ID NO: 2973062 - protein, 21 aa, Entamoeba invadens
VESYFKIKANFMPVALKTRVA

SEQ ID NO: 2973063 - protein, 17 aa, Entamoeba invadens
VETARLELEKTIDKAIT

SEQ ID NO: 2973064 - protein, 17 aa, Entamoeba invadens
VETCKHPQLEFEYELYK

SEQ ID NO: 2973065 - protein, 19 aa, Entamoeba invadens
VETCLLPKGISTVVLNKSQ

SEQ ID NO: 2973066 - protein, 25 aa, Entamoeba invadens
VETEKRYTDVVPISLGILSYGVLFE

SEQ ID NO: 2973067 - protein, 20 aa, Entamoeba invadens
VETFKSCPFPADDKVSEDPM

SEQ ID NO: 2973068 - protein, 25 aa, Entamoeba invadens
VETFLKRNFSEYFFAVTPRKEERKG

SEQ ID NO: 2973069 - protein, 17 aa, Entamoeba invadens
VETFLTKLFEWTDLSKA

SEQ ID NO: 2973070 - protein, 17 aa, Entamoeba invadens
VETFRVYFERMKEQERY

SEQ ID NO: 2973071 - protein, 27 aa, Entamoeba invadens
VETIGRNCFKGCVLLPSITLPLTVKSY

SEQ ID NO: 2973072 - protein, 24 aa, Entamoeba invadens
VETIGRSAFRVCERLERIEMSTSV

SEQ ID NO: 2973073 - protein, 23 aa, Entamoeba invadens
VETILKFLLQFGKVDVKKLDTNN

SEQ ID NO: 2973074 - protein, 25 aa, Entamoeba invadens
VETIPPCVDAAVTTRGVLLVSKKKV

SEQ ID NO: 2973075 - protein, 23 aa, Entamoeba invadens
VETIRLKGFIGRMKLSETVKRLE

SEQ ID NO: 2973076 - protein, 27 aa, Entamoeba invadens
VETKGPSLYCVFPLVGSEQLQLPFLLN

SEQ ID NO: 2973077 - protein, 20 aa, Entamoeba invadens
VETKKLYGLVHARYIVTPAG

SEQ ID NO: 2973078 - protein, 27 aa, Entamoeba invadens
VETKYGIKVPFMYGTMVECVRAALTAD

SEQ ID NO: 2973079 - protein, 17 aa, Entamoeba invadens
VETLEIRSLFQSDEEED

SEQ ID NO: 2973080 - protein, 20 aa, Entamoeba invadens
VETLNIWKIADFESRNSKFE

SEQ ID NO: 2973081 - protein, 17 aa, Entamoeba invadens
VETLRISTCPNLSSAIY

SEQ ID NO: 2973082 - protein, 34 aa, Entamoeba invadens
VETLRLNGCNKIGGKFVWKYLSEIEHLKRLDLSN

SEQ ID NO: 2973083 - protein, 23 aa, Entamoeba invadens
VETNPTLTWKDFYLDSKASKQKR

SEQ ID NO: 2973084 - protein, 29 aa, Entamoeba invadens
VETPKTSFKECVVFCMGTDETLKKKVNSK

SEQ ID NO: 2973085 - protein, 26 aa, Entamoeba invadens
VETRELIAGYLLHPAYLREWKGARPF

SEQ ID NO: 2973086 - protein, 18 aa, Entamoeba invadens
VETYRGRASVIQISTMKD

SEQ ID NO: 2973087 - protein, 17 aa, Entamoeba invadens
VEVAFQFILDNLDLSVV

SEQ ID NO: 2973088 - protein, 17 aa, Entamoeba invadens
VEVAMQWNDSYAEQVLC

SEQ ID NO: 2973089 - protein, 20 aa, Entamoeba invadens
VEVEGCAEDLFTLFEAITIA

SEQ ID NO: 2973090 - protein, 18 aa, Entamoeba invadens
VEVFDYVAQLGFMDIMKS

SEQ ID NO: 2973091 - protein, 18 aa, Entamoeba invadens
VEVGCRVLVRIDESDHFG

SEQ ID NO: 2973092 - protein, 17 aa, Entamoeba invadens
VEVGSLFYFLLRTQNGY

SEQ ID NO: 2973093 - protein, 17 aa, Entamoeba invadens
VEVIALECYNTISKLKI

SEQ ID NO: 2973094 - protein, 24 aa, Entamoeba invadens
VEVIEFNAKLLIIFHTLCSSDIKE

SEQ ID NO: 2973095 - protein, 21 aa, Entamoeba invadens
VEVKQRLHLIEKWKPSPTLEI

SEQ ID NO: 2973096 - protein, 17 aa, Entamoeba invadens
VEVLFQWMSSLSDTQEW

SEQ ID NO: 2973097 - protein, 17 aa, Entamoeba invadens
VEVLGCDNVITQLVHDY

SEQ ID NO: 2973098 - protein, 17 aa, Entamoeba invadens
VEVLGIPTQHEWGNGYS

SEQ ID NO: 2973099 - protein, 28 aa, Entamoeba invadens
VEVLSFEGMWWYGRKENSFGYFPGEYCQ

SEQ ID NO: 2973100 - protein, 17 aa, Entamoeba invadens
VEVNGCFVVSNVSIDAE

SEQ ID NO: 2973101 - protein, 20 aa, Entamoeba invadens
VEVNLSFLFDSTVGYVMKIK

SEQ ID NO: 2973102 - protein, 17 aa, Entamoeba invadens
VEVPRCDNVTEYIYGNG

SEQ ID NO: 2973103 - protein, 23 aa, Entamoeba invadens
VEVQLMFHNSCMPRETRIEKAKQ

SEQ ID NO: 2973104 - protein, 17 aa, Entamoeba invadens
VEVQSGAVLTPMGKAKQ

SEQ ID NO: 2973105 - protein, 19 aa, Entamoeba invadens
VEVRGMRYLIAFLAAMILE

SEQ ID NO: 2973106 - protein, 18 aa, Entamoeba invadens
VEVSALIPLKYGVERCIM

SEQ ID NO: 2973107 - protein, 26 aa, Entamoeba invadens
VEVVKMICWPWKYLIQSKMFSVGNIV

SEQ ID NO: 2973108 - protein, 22 aa, Entamoeba invadens
VEWLIEHLLHLMKEKKIGKTFI

SEQ ID NO: 2973109 - protein, 24 aa, Entamoeba invadens
VEWMKRLFDYTNYESLNFTISQQE

SEQ ID NO: 2973110 - protein, 32 aa, Entamoeba invadens
VEWRGVRFLLSICFDIKFPVFLRNTKLEYDVI

SEQ ID NO: 2973111 - protein, 23 aa, Entamoeba invadens
VEWSVKLQIALFIEDRVYDEEYA

SEQ ID NO: 2973112 - protein, 23 aa, Entamoeba invadens
VEYFSLFVRFVFSDGSFEEKRVK

SEQ ID NO: 2973113 - protein, 23 aa, Entamoeba invadens
VEYFSLFVRFVFSDGSFVDKRIK

SEQ ID NO: 2973114 - protein, 20 aa, Entamoeba invadens
VEYIESFAFSRCSSLSKILI

SEQ ID NO: 2973115 - protein, 23 aa, Entamoeba invadens
VEYKGKWYRANVVVVAPKANILK

SEQ ID NO: 2973116 - protein, 17 aa, Entamoeba invadens
VEYSQILVLWRLKNDLF

SEQ ID NO: 2973117 - protein, 26 aa, Entamoeba invadens
VEYTCSVKTLKICSDKGYSFTMNSMV

SEQ ID NO: 2973118 - protein, 25 aa, Entamoeba invadens
VEYVKVCIEKGSLYLPTAASILIKH

SEQ ID NO: 2973119 - protein, 18 aa, Entamoeba invadens
VFAKGCRLVAAQMVNGIG

SEQ ID NO: 2973120 - protein, 23 aa, Entamoeba invadens
VFAKNLWGDFAFDHKTHKFTKLT

SEQ ID NO: 2973121 - protein, 18 aa, Entamoeba invadens
VFAKRYVEQLSHSTAPLF

SEQ ID NO: 2973122 - protein, 17 aa, Entamoeba invadens
VFALTSFSLYHSVNGVK

SEQ ID NO: 2973123 - protein, 23 aa, Entamoeba invadens
VFARGRKGVKMSTRDILAIIAHV

SEQ ID NO: 2973124 - protein, 18 aa, Entamoeba invadens
VFCAMKVVEQFCYYLGEK

SEQ ID NO: 2973125 - protein, 18 aa, Entamoeba invadens
VFCCGETICENCLAKGTC

SEQ ID NO: 2973126 - protein, 18 aa, Entamoeba invadens
VFCEECKSVSSCPHSFLC

SEQ ID NO: 2973127 - protein, 18 aa, Entamoeba invadens
VFCGLPYIETTGFMAINR

SEQ ID NO: 2973128 - protein, 20 aa, Entamoeba invadens
VFCNCALCRQFTLVQQVPKI

SEQ ID NO: 2973129 - protein, 19 aa, Entamoeba invadens
VFCPCGGRPFSLNEDNIDD

SEQ ID NO: 2973130 - protein, 24 aa, Entamoeba invadens
VFDEEIKLLLIRKMGFIIKMSADM

SEQ ID NO: 2973131 - protein, 17 aa, Entamoeba invadens
VFDEHRNIFGGFTNKAG

SEQ ID NO: 2973132 - protein, 24 aa, Entamoeba invadens
VFDHKLSLCYSFSPTLQNDAFQRF

SEQ ID NO: 2973133 - protein, 17 aa, Entamoeba invadens
VFDKLEIDIRLQSRILD

SEQ ID NO: 2973134 - protein, 22 aa, Entamoeba invadens
VFDLYQKFLINFLKIESHPEIR

SEQ ID NO: 2973135 - protein, 25 aa, Entamoeba invadens
VFDQLYRPTIGVDFAVKMTTVDDKD

SEQ ID NO: 2973136 - protein, 24 aa, Entamoeba invadens
VFDRCDFTHPFSVITFPRITPYDI

SEQ ID NO: 2973137 - protein, 23 aa, Entamoeba invadens
VFDRLGALTSRVVKLTEIVQNLQ

SEQ ID NO: 2973138 - protein, 17 aa, Entamoeba invadens
VFDTIFFKERNFEKLTD

SEQ ID NO: 2973139 - protein, 17 aa, Entamoeba invadens
VFECTRDLFSQKTRLQR

SEQ ID NO: 2973140 - protein, 18 aa, Entamoeba invadens
VFEGCKYLTKITFSGQSI

SEQ ID NO: 2973141 - protein, 21 aa, Entamoeba invadens
VFEGNARYKLASTYPSLVYVP

SEQ ID NO: 2973142 - protein, 23 aa, Entamoeba invadens
VFEGNLNGLVYVGSDHKHPLETL

SEQ ID NO: 2973143 - protein, 34 aa, Entamoeba invadens
VFEGYKLVVKGVMRGEIYIEQSLLLDVGKKVNEF

SEQ ID NO: 2973144 - protein, 26 aa, Entamoeba invadens
VFEKVFYRIIVWFNVDFETVDKNKCR

SEQ ID NO: 2973145 - protein, 21 aa, Entamoeba invadens
VFERKRGGIVIKAKENGKSTS

SEQ ID NO: 2973146 - protein, 18 aa, Entamoeba invadens
VFETQSFEEFLLKMVAAA

SEQ ID NO: 2973147 - protein, 25 aa, Entamoeba invadens
VFEVLREFMDLIAFSEEEKINTEIH

SEQ ID NO: 2973148 - protein, 18 aa, Entamoeba invadens
VFFHIDFGHFLGNFKSKF

SEQ ID NO: 2973149 - protein, 25 aa, Entamoeba invadens
VFFKKSLKVAYQIILHENVNNMNAK

SEQ ID NO: 2973150 - protein, 24 aa, Entamoeba invadens
VFFPNKICMVTAFAEFGSVCDMLK

SEQ ID NO: 2973151 - protein, 18 aa, Entamoeba invadens
VFFTGFKPIVSFSNDGTS

SEQ ID NO: 2973152 - protein, 22 aa, Entamoeba invadens
VFFTVLVVDLIKNWKAEDVIAM

SEQ ID NO: 2973153 - protein, 19 aa, Entamoeba invadens
VFFYLKRNTIIGTFNSEVL

SEQ ID NO: 2973154 - protein, 24 aa, Entamoeba invadens
VFGDYCFCHCNSLSAITLGTNIIK

SEQ ID NO: 2973155 - protein, 20 aa, Entamoeba invadens
VFGDYCFCRCNSLSAITLGT

SEQ ID NO: 2973156 - protein, 23 aa, Entamoeba invadens
VFGEGNATWAAFVPFERGDGKKV

SEQ ID NO: 2973157 - protein, 26 aa, Entamoeba invadens
VFGGCNFGHIRGCSMIDIHETEFVQK

SEQ ID NO: 2973158 - protein, 18 aa, Entamoeba invadens
VFGKDVKGAMRITDIFKT

SEQ ID NO: 2973159 - protein, 20 aa, Entamoeba invadens
VFGKIKMYFKVMIIKVKNLD

SEQ ID NO: 2973160 - protein, 23 aa, Entamoeba invadens
VFGKIKMYFKVMIIKVKNLDTLS

SEQ ID NO: 2973161 - protein, 18 aa, Entamoeba invadens
VFGNFSFDPEALILEAKM

SEQ ID NO: 2973162 - protein, 24 aa, Entamoeba invadens
VFGRSEWVVIFSLIYEIFSVKFSE

SEQ ID NO: 2973163 - protein, 17 aa, Entamoeba invadens
VFHAVFRMRLIEMRHLV

SEQ ID NO: 2973164 - protein, 25 aa, Entamoeba invadens
VFHDGELPLKYCLEEWTEQLWDECE

SEQ ID NO: 2973165 - protein, 27 aa, Entamoeba invadens
VFHIWFYRKSDLFKCYEECHNGFTEQD

SEQ ID NO: 2973166 - protein, 19 aa, Entamoeba invadens
VFHKSCCQHVFTPCIPKEA

SEQ ID NO: 2973167 - protein, 23 aa, Entamoeba invadens
VFHKTFEEWKGVTLLLNIHDEIV

SEQ ID NO: 2973168 - protein, 25 aa, Entamoeba invadens
VFHVGEIPLKYCLEEWTEQLWEECE

SEQ ID NO: 2973169 - protein, 21 aa, Entamoeba invadens
VFICESCALVHVTCKHVKRTF

SEQ ID NO: 2973170 - protein, 23 aa, Entamoeba invadens
VFIGDAIISFLLKYKYADLALLF

SEQ ID NO: 2973171 - protein, 23 aa, Entamoeba invadens
VFIGKRVGDVLVEIRSGGVEIDN

SEQ ID NO: 2973172 - protein, 32 aa, Entamoeba invadens
VFIKSKPGRYGIKFWMCADCETGMTLNLQLYC

SEQ ID NO: 2973173 - protein, 21 aa, Entamoeba invadens
VFINLTFSQACLKQMLDNQLE

SEQ ID NO: 2973174 - protein, 23 aa, Entamoeba invadens
VFKALEGKNVWEVIEEGKSQMGS

SEQ ID NO: 2973175 - protein, 18 aa, Entamoeba invadens
VFKAPSFEFEQKKTTLNI

SEQ ID NO: 2973176 - protein, 17 aa, Entamoeba invadens
VFKDCIPVFKNAYKATI

SEQ ID NO: 2973177 - protein, 20 aa, Entamoeba invadens
VFKIANNRLKQFDYNTLTPL

SEQ ID NO: 2973178 - protein, 24 aa, Entamoeba invadens
VFKKLVASIAVCLGDKDAAIVPSF

SEQ ID NO: 2973179 - protein, 24 aa, Entamoeba invadens
VFKQKVNVVVPFSMHIAAKSETFN

SEQ ID NO: 2973180 - protein, 17 aa, Entamoeba invadens
VFKRCCSLTKIDVLHSR

SEQ ID NO: 2973181 - protein, 31 aa, Entamoeba invadens
VFKSLFCKKKLFRVVVWFNIDCQTVSMNNKN

SEQ ID NO: 2973182 - protein, 26 aa, Entamoeba invadens
VFKSLFCKKKLFRVVVWFNVDCQTVS

SEQ ID NO: 2973183 - protein, 26 aa, Entamoeba invadens
VFKTGFRSCDVEAAIGMGEFNKIVVN

SEQ ID NO: 2973184 - protein, 18 aa, Entamoeba invadens
VFLCFSPNVCRVMDVTGS

SEQ ID NO: 2973185 - protein, 17 aa, Entamoeba invadens
VFLCPNLETADIEADFE

SEQ ID NO: 2973186 - protein, 28 aa, Entamoeba invadens
VFLDNELKLFLKEIVAIVQKFMKQIKFK

SEQ ID NO: 2973187 - protein, 25 aa, Entamoeba invadens
VFLFKSGNESFGFYNSDMVPVASGE

SEQ ID NO: 2973188 - protein, 23 aa, Entamoeba invadens
VFLHEGFKVYLFSTIVPTPYTAF

SEQ ID NO: 2973189 - protein, 18 aa, Entamoeba invadens
VFLMTIKSFYWKEEENHT

SEQ ID NO: 2973190 - protein, 24 aa, Entamoeba invadens
VFLPKSDVFMSFFSFYIQIVYFTV

SEQ ID NO: 2973191 - protein, 23 aa, Entamoeba invadens
VFLQFPNYRTLVLKKEDMYRSVV

SEQ ID NO: 2973192 - protein, 19 aa, Entamoeba invadens
VFLQKKLESKHMSDKRYTV

SEQ ID NO: 2973193 - protein, 25 aa, Entamoeba invadens
VFLVKLELTAKVGYPVEKVLLPPNL

SEQ ID NO: 2973194 - protein, 22 aa, Entamoeba invadens
VFMKDRMLVHFGPLKIVEEKND

SEQ ID NO: 2973195 - protein, 23 aa, Entamoeba invadens
VFMSKGPLQFCCASKTGENVFII

SEQ ID NO: 2973196 - protein, 19 aa, Entamoeba invadens
VFNAVKGKCELVVSNVDID

SEQ ID NO: 2973197 - protein, 17 aa, Entamoeba invadens
VFNAVMIKYQLTAGDFP

SEQ ID NO: 2973198 - protein, 19 aa, Entamoeba invadens
VFNCFSIKTSNEITLNFGH

SEQ ID NO: 2973199 - protein, 22 aa, Entamoeba invadens
VFNDEITKFIAYVNRMTSFEKE

SEQ ID NO: 2973200 - protein, 25 aa, Entamoeba invadens
VFNLLRFSYPTPFYFLTGSKRVFSV

SEQ ID NO: 2973201 - protein, 21 aa, Entamoeba invadens
VFNLPLTKRIRGLSPSDIERL

SEQ ID NO: 2973202 - protein, 24 aa, Entamoeba invadens
VFNSTCIPFSFLTLETPHLGVKKP

SEQ ID NO: 2973203 - protein, 22 aa, Entamoeba invadens
VFNTYKYTKFVSEKCRDICDDI

SEQ ID NO: 2973204 - protein, 21 aa, Entamoeba invadens
VFNVLWLKESFLAHPTDFDKN

SEQ ID NO: 2973205 - protein, 20 aa, Entamoeba invadens
VFPENCELVASTFVLCSNLT

SEQ ID NO: 2973206 - protein, 17 aa, Entamoeba invadens
VFPFKTKFLKILTLTCL

SEQ ID NO: 2973207 - protein, 19 aa, Entamoeba invadens
VFPGCNEMTLLGTDIGKFV

SEQ ID NO: 2973208 - protein, 18 aa, Entamoeba invadens
VFPIPRSEYEVMEMVEGK

SEQ ID NO: 2973209 - protein, 25 aa, Entamoeba invadens
VFPLKTNYVGFGFNFVALDFAMNSS

SEQ ID NO: 2973210 - protein, 23 aa, Entamoeba invadens
VFPNKVCIEFIKAPNFGMEKSIF

SEQ ID NO: 2973211 - protein, 19 aa, Entamoeba invadens
VFPSCIFKTRHRHQLPSVH

SEQ ID NO: 2973212 - protein, 23 aa, Entamoeba invadens
VFPSMVGRPLMRSEEKIGGVEIK

SEQ ID NO: 2973213 - protein, 30 aa, Entamoeba invadens
VFPSRLTSIGSLCFYGCYSLTSVKFPRHLK

SEQ ID NO: 2973214 - protein, 30 aa, Entamoeba invadens
VFPSRLTSIGSLCFYGCYSLTSVNRLSEIS

SEQ ID NO: 2973215 - protein, 29 aa, Entamoeba invadens
VFPSRLTSIGSLCFYTFKTFYQKLIGAFQ

SEQ ID NO: 2973216 - protein, 17 aa, Entamoeba invadens
VFQCPTAVLYTVELNPM

SEQ ID NO: 2973217 - protein, 17 aa, Entamoeba invadens
VFQEGILVEAVRKGNWI

SEQ ID NO: 2973218 - protein, 18 aa, Entamoeba invadens
VFQIGNWQSLDNLKQLRL

SEQ ID NO: 2973219 - protein, 22 aa, Entamoeba invadens
VFQKLLETLICLSSKEHREGRD

SEQ ID NO: 2973220 - protein, 25 aa, Entamoeba invadens
VFQKLVSSMLFYFEKLMGLSQVIPS

SEQ ID NO: 2973221 - protein, 20 aa, Entamoeba invadens
VFQRTHLHPTKCLFDTKVDK

SEQ ID NO: 2973222 - protein, 19 aa, Entamoeba invadens
VFQSQLCFNEYLAQEQLQT

SEQ ID NO: 2973223 - protein, 20 aa, Entamoeba invadens
VFQTECDIFFTCNGKIVFQN

SEQ ID NO: 2973224 - protein, 20 aa, Entamoeba invadens
VFRDYFKNVFGIHLPVGVCE

SEQ ID NO: 2973225 - protein, 17 aa, Entamoeba invadens
VFREKYSPLLLENTDEV

SEQ ID NO: 2973226 - protein, 23 aa, Entamoeba invadens
VFREWAPNFKEMYLFGDYNNWDR

SEQ ID NO: 2973227 - protein, 18 aa, Entamoeba invadens
VFRLSIGEKVYFAKTLRP

SEQ ID NO: 2973228 - protein, 17 aa, Entamoeba invadens
VFRMRLIEMRHLVFKKW

SEQ ID NO: 2973229 - protein, 17 aa, Entamoeba invadens
VFRQACELFNFNCVLVV

SEQ ID NO: 2973230 - protein, 42 aa, Entamoeba invadens
VFRTTKIKLVCIDDCGTTLRKCFICGMYGHKSQDCLEKKGTY

SEQ ID NO: 2973231 - protein, 19 aa, Entamoeba invadens
VFSDMLWSDPLMYETYDEK

SEQ ID NO: 2973232 - protein, 24 aa, Entamoeba invadens
VFSFAITMFECFGWCEAYTKDLFK

SEQ ID NO: 2973233 - protein, 25 aa, Entamoeba invadens
VFSFGITMYEVFGWCDAYPKQSFKF

SEQ ID NO: 2973234 - protein, 26 aa, Entamoeba invadens
VFSFGVTLYECFSWKMAYQKDDVRFK

SEQ ID NO: 2973235 - protein, 24 aa, Entamoeba invadens
VFSGCTSLTCLVVPKINGIIKNTI

SEQ ID NO: 2973236 - protein, 22 aa, Entamoeba invadens
VFSGKSKYSLSAILDKEVAESL

SEQ ID NO: 2973237 - protein, 18 aa, Entamoeba invadens
VFTAIRFNGNESSEERLK

SEQ ID NO: 2973238 - protein, 27 aa, Entamoeba invadens
VFTARKCILCSLIGKNLFRELKYFQRA

SEQ ID NO: 2973239 - protein, 18 aa, Entamoeba invadens
VFTFCERHAFDVDDLLKK

SEQ ID NO: 2973240 - protein, 18 aa, Entamoeba invadens
VFTIFLSITIDQGFRNKR

SEQ ID NO: 2973241 - protein, 21 aa, Entamoeba invadens
VFTKRIQYYSANSFMRCNSKE

SEQ ID NO: 2973242 - protein, 31 aa, Entamoeba invadens
VFTRSGNWVSFDSRYSRRLSVESIYAPIELE

SEQ ID NO: 2973243 - protein, 24 aa, Entamoeba invadens
VFTSELFRKIKLIEFLKSTSNSTK

SEQ ID NO: 2973244 - protein, 26 aa, Entamoeba invadens
VFVDFGEAFVRAFLQTNCFHNWREKM

SEQ ID NO: 2973245 - protein, 19 aa, Entamoeba invadens
VFVGIGVIEKCDRLTKISI

SEQ ID NO: 2973246 - protein, 26 aa, Entamoeba invadens
VFVKAEDVLPFLLEFLRRNRLVENTL

SEQ ID NO: 2973247 - protein, 17 aa, Entamoeba invadens
VFVKCCENITIDNTLNT

SEQ ID NO: 2973248 - protein, 19 aa, Entamoeba invadens
VFVKCRLNTIVIPKSVTHL

SEQ ID NO: 2973249 - protein, 17 aa, Entamoeba invadens
VFVKFSFLKNRQGRKSV

SEQ ID NO: 2973250 - protein, 25 aa, Entamoeba invadens
VFVLKGCTPIPGATIFGFDTEEELL

SEQ ID NO: 2973251 - protein, 20 aa, Entamoeba invadens
VFVLNCSWTGAELEKQIPGS

SEQ ID NO: 2973252 - protein, 17 aa, Entamoeba invadens
VFVMIGNYSNFVCGNIE

SEQ ID NO: 2973253 - protein, 24 aa, Entamoeba invadens
VFVNKKCCSAVHFQHENAFYLRTT

SEQ ID NO: 2973254 - protein, 22 aa, Entamoeba invadens
VFVWTYKDYKAFDHTEELNYQF

SEQ ID NO: 2973255 - protein, 24 aa, Entamoeba invadens
VFYCKDFSTVCPKELQEFNERFED

SEQ ID NO: 2973256 - protein, 24 aa, Entamoeba invadens
VFYIERVVGSWAVVYVNEERYIFP

SEQ ID NO: 2973257 - protein, 24 aa, Entamoeba invadens
VFYMNGCQFEEPFLLKTDFLNVRQ

SEQ ID NO: 2973258 - protein, 28 aa, Entamoeba invadens
VFYRIGEVQKTYFLFKVLKEDMVLEVDV

SEQ ID NO: 2973259 - protein, 18 aa, Entamoeba invadens
VFYSKSNLALSCIQMCFL

SEQ ID NO: 2973260 - protein, 18 aa, Entamoeba invadens
VFYYCINFTQIVLPISLV

SEQ ID NO: 2973261 - protein, 18 aa, Entamoeba invadens
VGACRHGDACSRNHHRPE

SEQ ID NO: 2973262 - protein, 19 aa, Entamoeba invadens
VGAGVGYASFCCRGAKEVI

SEQ ID NO: 2973263 - protein, 17 aa, Entamoeba invadens
VGAKICYENCLGVANQI

SEQ ID NO: 2973264 - protein, 17 aa, Entamoeba invadens
VGARSFISATMRTTLLA

SEQ ID NO: 2973265 - protein, 29 aa, Entamoeba invadens
VGATFVEFAHYFKVYKMIVGNSEAVLAAM

SEQ ID NO: 2973266 - protein, 19 aa, Entamoeba invadens
VGAVTKCIIIREPSTQRSL

SEQ ID NO: 2973267 - protein, 22 aa, Entamoeba invadens
VGAYDFWPIDALSSALSVVTFN

SEQ ID NO: 2973268 - protein, 20 aa, Entamoeba invadens
VGAYRACHEKLRKYLIDLLN

SEQ ID NO: 2973269 - protein, 18 aa, Entamoeba invadens
VGCAKFDVLIYDIGGNSL

SEQ ID NO: 2973270 - protein, 26 aa, Entamoeba invadens
VGCIAAEFFLGIPLFAGTSEYNLLFK

SEQ ID NO: 2973271 - protein, 17 aa, Entamoeba invadens
VGCKGFVVENYFSSIKE

SEQ ID NO: 2973272 - protein, 19 aa, Entamoeba invadens
VGCTEIFPLQSKHREELLI

SEQ ID NO: 2973273 - protein, 26 aa, Entamoeba invadens
VGCVIPELFGTIPLFAANSAKKITTL

SEQ ID NO: 2973274 - protein, 23 aa, Entamoeba invadens
VGCWSARNRTHWKTLTKARAIEN

SEQ ID NO: 2973275 - protein, 22 aa, Entamoeba invadens
VGDFAELCLKYNTTKKEFKDKN

SEQ ID NO: 2973276 - protein, 18 aa, Entamoeba invadens
VGDFFCCHGGISPNLNKI

SEQ ID NO: 2973277 - protein, 36 aa, Entamoeba invadens
VGDFRYAPLVVRSLMFLCRVIWKKEYLESASKQSKK

SEQ ID NO: 2973278 - protein, 26 aa, Entamoeba invadens
VGDICRRMSNEAAWVIASSIRDIAYN

SEQ ID NO: 2973279 - protein, 24 aa, Entamoeba invadens
VGDKCFHHKCFVCSQCSKPMDPKK

SEQ ID NO: 2973280 - protein, 27 aa, Entamoeba invadens
VGDKKRLRVGYTLNFIFEENEWFPDIE

SEQ ID NO: 2973281 - protein, 26 aa, Entamoeba invadens
VGDSCCFNCLSLRILIPSTLKSIGVN

SEQ ID NO: 2973282 - protein, 19 aa, Entamoeba invadens
VGDVKRMPVIPLNSNAVHF

SEQ ID NO: 2973283 - protein, 18 aa, Entamoeba invadens
VGEASALVRKGMSRKEQI

SEQ ID NO: 2973284 - protein, 18 aa, Entamoeba invadens
VGECTKGRSLLDGEDSDD

SEQ ID NO: 2973285 - protein, 22 aa, Entamoeba invadens
VGEDKLLINWFKVRQIGNLIKE

SEQ ID NO: 2973286 - protein, 20 aa, Entamoeba invadens
VGEDVLRLRFSNIRRQITYI

SEQ ID NO: 2973287 - protein, 18 aa, Entamoeba invadens
VGEELVRVAVLWHESWHE

SEQ ID NO: 2973288 - protein, 29 aa, Entamoeba invadens
VGEKAKLKKGRWSGYRVYDPATEGPRFIQ

SEQ ID NO: 2973289 - protein, 19 aa, Entamoeba invadens
VGEKMFKYVDAHPVEYKEE

SEQ ID NO: 2973290 - protein, 19 aa, Entamoeba invadens
VGELRRKATDQAMVILVMF

SEQ ID NO: 2973291 - protein, 17 aa, Entamoeba invadens
VGENLPYDIIVKRNSKV

SEQ ID NO: 2973292 - protein, 25 aa, Entamoeba invadens
VGETPIIRRLFERIVAMKLSTKSMK

SEQ ID NO: 2973293 - protein, 21 aa, Entamoeba invadens
VGEVVKMNWDISSESIDDEDD

SEQ ID NO: 2973294 - protein, 20 aa, Entamoeba invadens
VGEWCRIYQSVTLGAMHFQE

SEQ ID NO: 2973295 - protein, 23 aa, Entamoeba invadens
VGFEAKKPGGMQLGLENCNLPNL

SEQ ID NO: 2973296 - protein, 19 aa, Entamoeba invadens
VGFNFVLKKLRGENFEVPV

SEQ ID NO: 2973297 - protein, 21 aa, Entamoeba invadens
VGFNRVLLYLFSRYFEKLLEK

SEQ ID NO: 2973298 - protein, 20 aa, Entamoeba invadens
VGFSPHFTKKITLFKLEHTN

SEQ ID NO: 2973299 - protein, 17 aa, Entamoeba invadens
VGFSVGLERIMIILEEK

SEQ ID NO: 2973300 - protein, 26 aa, Entamoeba invadens
VGFTFRNCKKVIPFSLESQALKTVLY

SEQ ID NO: 2973301 - protein, 19 aa, Entamoeba invadens
VGFVGDCSVFLLGKDGITR

SEQ ID NO: 2973302 - protein, 19 aa, Entamoeba invadens
VGGCCYCKESGNAYIGFNM

SEQ ID NO: 2973303 - protein, 19 aa, Entamoeba invadens
VGGDDVVKCLVPMLEAHGI

SEQ ID NO: 2973304 - protein, 24 aa, Entamoeba invadens
VGGSGRKAFYFFGIHHDQLLFLDP

SEQ ID NO: 2973305 - protein, 23 aa, Entamoeba invadens
VGHLNDLLKFFFFVEQEDVQEEI

SEQ ID NO: 2973306 - protein, 29 aa, Entamoeba invadens
VGHSYIRGGLPYRRPVGYMRYAINVLGKF

SEQ ID NO: 2973307 - protein, 31 aa, Entamoeba invadens
VGHTLAIELCKHFPPAIGEFRKLIPNMLNNL

SEQ ID NO: 2973308 - protein, 22 aa, Entamoeba invadens
VGIIHEGVWKPGMDAGNIIGNP

SEQ ID NO: 2973309 - protein, 25 aa, Entamoeba invadens
VGIKNIGKYAFIIGFEKCVMFDSDG

SEQ ID NO: 2973310 - protein, 18 aa, Entamoeba invadens
VGILKLFLECSCTPFFLH

SEQ ID NO: 2973311 - protein, 25 aa, Entamoeba invadens
VGIRDRKLLLCKIRTVRKNLRKISL

SEQ ID NO: 2973312 - protein, 26 aa, Entamoeba invadens
VGKEEWKTRAVLVLQALLKAKGDKLR

SEQ ID NO: 2973313 - protein, 23 aa, Entamoeba invadens
VGKERFLACEAYFQPSLLNLECL

SEQ ID NO: 2973314 - protein, 27 aa, Entamoeba invadens
VGKESLRLCVCYEQLLSFAMLFGISEQ

SEQ ID NO: 2973315 - protein, 18 aa, Entamoeba invadens
VGKFKRLSDLQVETYKVT

SEQ ID NO: 2973316 - protein, 34 aa, Entamoeba invadens
VGKFRIKFFQTFFLEKYFYTFFCHWNSTVRQFFH

SEQ ID NO: 2973317 - protein, 21 aa, Entamoeba invadens
VGKGNMSCLINFNEEDADYVI

SEQ ID NO: 2973318 - protein, 33 aa, Entamoeba invadens
VGKIAGFEKFAFVKLVFKLRIPPSQVDGWIVKY

SEQ ID NO: 2973319 - protein, 21 aa, Entamoeba invadens
VGKKVLKSTLDVTGAMKELVS

SEQ ID NO: 2973320 - protein, 18 aa, Entamoeba invadens
VGKSCLLLQYEDHRFQPI

SEQ ID NO: 2973321 - protein, 24 aa, Entamoeba invadens
VGKSNLLLRFTRNEFDPDKRSTIG

SEQ ID NO: 2973322 - protein, 27 aa, Entamoeba invadens
VGKSSITIRFCYNRFSGSYDPTLEDSY

SEQ ID NO: 2973323 - protein, 26 aa, Entamoeba invadens
VGKSTFALRFCHQVFVKINEPSDLNN

SEQ ID NO: 2973324 - protein, 20 aa, Entamoeba invadens
VGKTALLQRFCFGTYIDEYD

SEQ ID NO: 2973325 - protein, 23 aa, Entamoeba invadens
VGKTCILCSYTSGSFPTQYVPTV

SEQ ID NO: 2973326 - protein, 29 aa, Entamoeba invadens
VGKTQINLRCPLSFQMIQIPVRGCECKHT

SEQ ID NO: 2973327 - protein, 21 aa, Entamoeba invadens
VGKTSIAIRFICDRFIEVYDP

SEQ ID NO: 2973328 - protein, 23 aa, Entamoeba invadens
VGKTSLVRRLVCDSFTDEYETTK

SEQ ID NO: 2973329 - protein, 18 aa, Entamoeba invadens
VGKYCFHNCTRLRQVNIP

SEQ ID NO: 2973330 - protein, 26 aa, Entamoeba invadens
VGLKEVCEVANSWIMFSQALINNNER

SEQ ID NO: 2973331 - protein, 24 aa, Entamoeba invadens
VGLKEVFETIARVSVGLMDAEVTE

SEQ ID NO: 2973332 - protein, 24 aa, Entamoeba invadens
VGLKGFLAVIKFSYEEIGGTLVSE

SEQ ID NO: 2973333 - protein, 18 aa, Entamoeba invadens
VGLKYVFSLLKYAEVDND

SEQ ID NO: 2973334 - protein, 19 aa, Entamoeba invadens
VGLQGRFEHDLGRNDIEWI

SEQ ID NO: 2973335 - protein, 21 aa, Entamoeba invadens
VGLTNYGCRLVNIIVKGKDGK

SEQ ID NO: 2973336 - protein, 25 aa, Entamoeba invadens
VGLTTFLGCVILKIKGDADKFAVAY

SEQ ID NO: 2973337 - protein, 19 aa, Entamoeba invadens
VGLVEVLNVIEFSMKRADA

SEQ ID NO: 2973338 - protein, 25 aa, Entamoeba invadens
VGLVPRCLELLFQKKQRNLEVGISM

SEQ ID NO: 2973339 - protein, 17 aa, Entamoeba invadens
VGLYMMVHESPPSFRDD

SEQ ID NO: 2973340 - protein, 19 aa, Entamoeba invadens
VGMFCLYGDLTSWIKSVDM

SEQ ID NO: 2973341 - protein, 17 aa, Entamoeba invadens
VGMGGTFDRLHCGHYSL

SEQ ID NO: 2973342 - protein, 17 aa, Entamoeba invadens
VGMKMFSPKQIKGSSGE

SEQ ID NO: 2973343 - protein, 36 aa, Entamoeba invadens
VGMKRVYKYLIYWLLNGTVCIGNFFATEKRVDTLSF

SEQ ID NO: 2973344 - protein, 18 aa, Entamoeba invadens
VGMLKAKYFTPQKERTQF

SEQ ID NO: 2973345 - protein, 19 aa, Entamoeba invadens
VGMSILHYICYEFMMDASP

SEQ ID NO: 2973346 - protein, 17 aa, Entamoeba invadens
VGNCCISHYNHLKNIVV

SEQ ID NO: 2973347 - protein, 20 aa, Entamoeba invadens
VGNCLDRFARIMMIPNEPAP

SEQ ID NO: 2973348 - protein, 20 aa, Entamoeba invadens
VGNERVVNCLDIMPEATKAL

SEQ ID NO: 2973349 - protein, 27 aa, Entamoeba invadens
VGNIEIFCVYSAFTIDKHSKMEWYEEF

SEQ ID NO: 2973350 - protein, 25 aa, Entamoeba invadens
VGNITKLGAGAFVEEFVSSIDINGM

SEQ ID NO: 2973351 - protein, 24 aa, Entamoeba invadens
VGNNRLLPYIPRMDTMFYTLNTKY

SEQ ID NO: 2973352 - protein, 26 aa, Entamoeba invadens
VGNSGVFRPEMLRTMGVPEDISVIAW

SEQ ID NO: 2973353 - protein, 18 aa, Entamoeba invadens
VGNVPVILGEDGFKALFE

SEQ ID NO: 2973354 - protein, 23 aa, Entamoeba invadens
VGPDNAFFCFTFQNPFNTEPLKI

SEQ ID NO: 2973355 - protein, 17 aa, Entamoeba invadens
VGPKVTEKRAILQPPPK

SEQ ID NO: 2973356 - protein, 18 aa, Entamoeba invadens
VGPLCKERVSLLRTIFNR

SEQ ID NO: 2973357 - protein, 28 aa, Entamoeba invadens
VGQFFTEMRIELPFPLKKTHHLLFSIFD

SEQ ID NO: 2973358 - protein, 26 aa, Entamoeba invadens
VGQIEWKNVDITGVNFDCEIQIERGN

SEQ ID NO: 2973359 - protein, 24 aa, Entamoeba invadens
VGQKNKWESPSFLFRSPKCMACED

SEQ ID NO: 2973360 - protein, 25 aa, Entamoeba invadens
VGRDKLDVLGCSTFTVPDLLPNEAF

SEQ ID NO: 2973361 - protein, 25 aa, Entamoeba invadens
VGRDYYGVFPLRGKPLNAREISSAK

SEQ ID NO: 2973362 - protein, 17 aa, Entamoeba invadens
VGREYGESKVLGTIRAD

SEQ ID NO: 2973363 - protein, 20 aa, Entamoeba invadens
VGRGRYSDVFLGVIENGKYP

SEQ ID NO: 2973364 - protein, 27 aa, Entamoeba invadens
VGRKEKWKIKHIMNLDDWKSVGVTDEK

SEQ ID NO: 2973365 - protein, 23 aa, Entamoeba invadens
VGRQKLIWRLTRGLYIIKMDLCI

SEQ ID NO: 2973366 - protein, 25 aa, Entamoeba invadens
VGRTGVYCILSRIIDQVVHSILEKT

SEQ ID NO: 2973367 - protein, 31 aa, Entamoeba invadens
VGSATCLVDFRCAYCGMVVHSNCIPNAPLKC

SEQ ID NO: 2973368 - protein, 18 aa, Entamoeba invadens
VGSAVRRFTLNKTTEVHH

SEQ ID NO: 2973369 - protein, 19 aa, Entamoeba invadens
VGSEMCWKSNQRFVDIVRF

SEQ ID NO: 2973370 - protein, 25 aa, Entamoeba invadens
VGSLKKIKKANCKEKNDFFITRLIL

SEQ ID NO: 2973371 - protein, 23 aa, Entamoeba invadens
VGSPCLYVTMRLVSIPDMEYSVD

SEQ ID NO: 2973372 - protein, 20 aa, Entamoeba invadens
VGSPERRGSLLQNILSFITG

SEQ ID NO: 2973373 - protein, 18 aa, Entamoeba invadens
VGSSLIVFQDGRIVISDE

SEQ ID NO: 2973374 - protein, 26 aa, Entamoeba invadens
VGSVFLKFTPFLKMYSDYCRVYNAVT

SEQ ID NO: 2973375 - protein, 18 aa, Entamoeba invadens
VGSYLLVKGVSYRIESGI

SEQ ID NO: 2973376 - protein, 25 aa, Entamoeba invadens
VGTECFRYATDLTLTYPVNGKFTED

SEQ ID NO: 2973377 - protein, 20 aa, Entamoeba invadens
VGTIPIVYRGNRFCLPLCIM

SEQ ID NO: 2973378 - protein, 19 aa, Entamoeba invadens
VGTITSFFAEIGIDEENIG

SEQ ID NO: 2973379 - protein, 20 aa, Entamoeba invadens
VGTKYYGEYDYIFTSASHCD

SEQ ID NO: 2973380 - protein, 18 aa, Entamoeba invadens
VGTLYFVFYKSFTMLQSE

SEQ ID NO: 2973381 - protein, 23 aa, Entamoeba invadens
VGTPYWMAPELIRGHDYGVKIDI

SEQ ID NO: 2973382 - protein, 32 aa, Entamoeba invadens
VGTRESFELIGLEGRIPFDMFQVIQRDYKLRS

SEQ ID NO: 2973383 - protein, 21 aa, Entamoeba invadens
VGTTLPYAVVNPMMNCTALPT

SEQ ID NO: 2973384 - protein, 18 aa, Entamoeba invadens
VGVESFTLMCPRKRSDNS

SEQ ID NO: 2973385 - protein, 18 aa, Entamoeba invadens
VGVFSLKLYPKLQMLDLS

SEQ ID NO: 2973386 - protein, 18 aa, Entamoeba invadens
VGVGDGPFGVMYNLQKVV

SEQ ID NO: 2973387 - protein, 17 aa, Entamoeba invadens
VGVIGIIRALPKTHYAR

SEQ ID NO: 2973388 - protein, 25 aa, Entamoeba invadens
VGVLPKKTYLPISLKSLTLLNSLKM

SEQ ID NO: 2973389 - protein, 19 aa, Entamoeba invadens
VGVPSWRWFYPEHYAPFAE

SEQ ID NO: 2973390 - protein, 19 aa, Entamoeba invadens
VGVQWLHNRLNLIHRDIKP

SEQ ID NO: 2973391 - protein, 17 aa, Entamoeba invadens
VGVRHPLSSLVFVSKDK

SEQ ID NO: 2973392 - protein, 20 aa, Entamoeba invadens
VGVSTIWCNDTFYIKGESCN

SEQ ID NO: 2973393 - protein, 30 aa, Entamoeba invadens
VGVTSDFPLLGLMRKWLKALYEVKVESNLK

SEQ ID NO: 2973394 - protein, 39 aa, Entamoeba invadens
VGVTSFKKISMINFLIFYFGYDWKEVVNAPQGGNTEELA

SEQ ID NO: 2973395 - protein, 21 aa, Entamoeba invadens
VGYAVGFSSGKLCIVSRSGKV

SEQ ID NO: 2973396 - protein, 17 aa, Entamoeba invadens
VGYIRDIFKSTLNGNKL

SEQ ID NO: 2973397 - protein, 24 aa, Entamoeba invadens
VGYKDCVFHRVIKNAVIQSGDVLG

SEQ ID NO: 2973398 - protein, 20 aa, Entamoeba invadens
VGYLIFPLQFEFGGNDKMKI

SEQ ID NO: 2973399 - protein, 24 aa, Entamoeba invadens
VGYLKTNFLGTVPIRKHTTRIKSY

SEQ ID NO: 2973400 - protein, 24 aa, Entamoeba invadens
VGYMPNFWGVIVGTFIVENYIGEK

SEQ ID NO: 2973401 - protein, 21 aa, Entamoeba invadens
VGYMRYAINVLGKFDNGNDTW

SEQ ID NO: 2973402 - protein, 27 aa, Entamoeba invadens
VGYWVLRAICGDCDMTCRHIQHARFIE

SEQ ID NO: 2973403 - protein, 18 aa, Entamoeba invadens
VHAALAIIACCMSKVAND

SEQ ID NO: 2973404 - protein, 19 aa, Entamoeba invadens
VHAALAIIACCMSKVANDM

SEQ ID NO: 2973405 - protein, 24 aa, Entamoeba invadens
VHCGRSALVYQFCLNKYYANIDLL

SEQ ID NO: 2973406 - protein, 18 aa, Entamoeba invadens
VHCIGAIILIEYKKCVEK

SEQ ID NO: 2973407 - protein, 19 aa, Entamoeba invadens
VHDACPRVREHLLVLYQRL

SEQ ID NO: 2973408 - protein, 17 aa, Entamoeba invadens
VHDRFFIHRDIKPDNFV

SEQ ID NO: 2973409 - protein, 19 aa, Entamoeba invadens
VHDTVAFKFCVEDTPSFSM

SEQ ID NO: 2973410 - protein, 17 aa, Entamoeba invadens
VHFFPVIMQNLFCLFSE

SEQ ID NO: 2973411 - protein, 23 aa, Entamoeba invadens
VHFGDSMLRILPFHDDGKDDFRH

SEQ ID NO: 2973412 - protein, 18 aa, Entamoeba invadens
VHFKVWDLVSKKVVAQMY

SEQ ID NO: 2973413 - protein, 18 aa, Entamoeba invadens
VHFQKGNVVDVVFENEKH

SEQ ID NO: 2973414 - protein, 20 aa, Entamoeba invadens
VHFRETFFRLIVNIRDSLFS

SEQ ID NO: 2973415 - protein, 22 aa, Entamoeba invadens
VHGTLYKRSFIDAPKRGYTTSG

SEQ ID NO: 2973416 - protein, 18 aa, Entamoeba invadens
VHIGIVYDGIIVYLSELI

SEQ ID NO: 2973417 - protein, 17 aa, Entamoeba invadens
VHIIVWFSVDFETVDKN

SEQ ID NO: 2973418 - protein, 18 aa, Entamoeba invadens
VHIQACKKLNEITNKPSV

SEQ ID NO: 2973419 - protein, 33 aa, Entamoeba invadens
VHKYRFELKKEIGLLFKYVYLFYLKSPLAMMSY

SEQ ID NO: 2973420 - protein, 19 aa, Entamoeba invadens
VHLALSINSVDAFRVNIGK

SEQ ID NO: 2973421 - protein, 19 aa, Entamoeba invadens
VHLEKMIEAKTVKGFQEHH

SEQ ID NO: 2973422 - protein, 27 aa, Entamoeba invadens
VHLFDLRVGGLFMKTPLFTTIAEDDVN

SEQ ID NO: 2973423 - protein, 19 aa, Entamoeba invadens
VHLLEVMLLVGNFLNKGTA

SEQ ID NO: 2973424 - protein, 18 aa, Entamoeba invadens
VHLVDLCEELFPYVDQVM

SEQ ID NO: 2973425 - protein, 18 aa, Entamoeba invadens
VHLYRPFSAKHFLEQLPA

SEQ ID NO: 2973426 - protein, 27 aa, Entamoeba invadens
VHNAFMFGCLGVRKNCMCVSTRERDNW

SEQ ID NO: 2973427 - protein, 17 aa, Entamoeba invadens
VHNCIKKYFEVDSENLP

SEQ ID NO: 2973428 - protein, 27 aa, Entamoeba invadens
VHPRKLPTEFMYLFDLYQNNEISREDL

SEQ ID NO: 2973429 - protein, 33 aa, Entamoeba invadens
VHRFYKGKIQIMPKCTLAGFNWFNAYYTPGVSR

SEQ ID NO: 2973430 - protein, 19 aa, Entamoeba invadens
VHRLRLTKRFLNDEAITIL

SEQ ID NO: 2973431 - protein, 22 aa, Entamoeba invadens
VHSFNYMKGMYFVKETFDNFKS

SEQ ID NO: 2973432 - protein, 23 aa, Entamoeba invadens
VHSLCPPIFGHYIVKTAMILVLF

SEQ ID NO: 2973433 - protein, 22 aa, Entamoeba invadens
VHSLPEMAARCAESVSADYLLL

SEQ ID NO: 2973434 - protein, 25 aa, Entamoeba invadens
VHSVGDYGSIGWRSDWKEEEAEKCI

SEQ ID NO: 2973435 - protein, 27 aa, Entamoeba invadens
VHTIRSCDIKFQISLRPLYDSNTDMCQ

SEQ ID NO: 2973436 - protein, 20 aa, Entamoeba invadens
VHTKIAIAAFEFLLNNFEPI

SEQ ID NO: 2973437 - protein, 17 aa, Entamoeba invadens
VHTYPIEDSSFFFEECQ

SEQ ID NO: 2973438 - protein, 21 aa, Entamoeba invadens
VHVPCMVKFSGITYPILSMSF

SEQ ID NO: 2973439 - protein, 18 aa, Entamoeba invadens
VHYHFKNYLLDIFEPIIF

SEQ ID NO: 2973440 - protein, 23 aa, Entamoeba invadens
VIAAEPYNTIAFKIPNNELQTDQ

SEQ ID NO: 2973441 - protein, 23 aa, Entamoeba invadens
VIAENMLGAAMHELVRVGSNGLM

SEQ ID NO: 2973442 - protein, 23 aa, Entamoeba invadens
VIAEPMASVLYYLDVNKNSTIKN

SEQ ID NO: 2973443 - protein, 17 aa, Entamoeba invadens
VIAKGACLYARDMASQT

SEQ ID NO: 2973444 - protein, 18 aa, Entamoeba invadens
VIAKGACWYARDMASQTV

SEQ ID NO: 2973445 - protein, 18 aa, Entamoeba invadens
VIALEYIHGLGCIHRDLK

SEQ ID NO: 2973446 - protein, 24 aa, Entamoeba invadens
VIASIKERVIDRISRIHSNEQSKL

SEQ ID NO: 2973447 - protein, 30 aa, Entamoeba invadens
VICDLKVAAPILKFAVSVPFFATLSETSLS

SEQ ID NO: 2973448 - protein, 26 aa, Entamoeba invadens
VICFQEVFKELNWRREKLLKKAKKAG

SEQ ID NO: 2973449 - protein, 22 aa, Entamoeba invadens
VICGKCGVGYECVDGYCEEENN

SEQ ID NO: 2973450 - protein, 19 aa, Entamoeba invadens
VICILKTREDVFLDVIDLL

SEQ ID NO: 2973451 - protein, 17 aa, Entamoeba invadens
VICKVGYYYISKDCKQC

SEQ ID NO: 2973452 - protein, 23 aa, Entamoeba invadens
VICQGLPLPYCMDIQTLQKSCLS

SEQ ID NO: 2973453 - protein, 18 aa, Entamoeba invadens
VICRECRYVETLTTMTDN

SEQ ID NO: 2973454 - protein, 21 aa, Entamoeba invadens
VICRKYLRNPLEVFIDDGEKL

SEQ ID NO: 2973455 - protein, 17 aa, Entamoeba invadens
VICRPDRAFSKNDLHKV

SEQ ID NO: 2973456 - protein, 20 aa, Entamoeba invadens
VICVGKNMNIFGWYNSKKVP

SEQ ID NO: 2973457 - protein, 29 aa, Entamoeba invadens
VIDAFKLQKKFRVMIVLPAWSEGELQSIV

SEQ ID NO: 2973458 - protein, 18 aa, Entamoeba invadens
VIDALLVEKNRVSWESLV

SEQ ID NO: 2973459 - protein, 23 aa, Entamoeba invadens
VIDETYMLLGRSFSRGVPETQFY

SEQ ID NO: 2973460 - protein, 18 aa, Entamoeba invadens
VIDEVVDLFVGLNYGQIL

SEQ ID NO: 2973461 - protein, 18 aa, Entamoeba invadens
VIDFKTSKYRFKVNGSNL

SEQ ID NO: 2973462 - protein, 20 aa, Entamoeba invadens
VIDIFSRLLCVDFDTFNDKI

SEQ ID NO: 2973463 - protein, 23 aa, Entamoeba invadens
VIDKECFMNCFGLVHIVIPQSVE

SEQ ID NO: 2973464 - protein, 28 aa, Entamoeba invadens
VIDKIKRIQCIPLRLFVETERDDEIRKI

SEQ ID NO: 2973465 - protein, 24 aa, Entamoeba invadens
VIDKLAELCCFILVQKNGDGTLYQ

SEQ ID NO: 2973466 - protein, 24 aa, Entamoeba invadens
VIDLNNWVGCAAFVLQSRAIYQDM

SEQ ID NO: 2973467 - protein, 20 aa, Entamoeba invadens
VIDRALKMLSLSSVSLAIIH

SEQ ID NO: 2973468 - protein, 25 aa, Entamoeba invadens
VIDSKRLVGVYVELYKSECAIHMER

SEQ ID NO: 2973469 - protein, 25 aa, Entamoeba invadens
VIDTLKLVLRFKDFLDPQTLEEDYV

SEQ ID NO: 2973470 - protein, 18 aa, Entamoeba invadens
VIEAIAWNVLPPDVFMKL

SEQ ID NO: 2973471 - protein, 18 aa, Entamoeba invadens
VIECESFGQWKMVFDDWK

SEQ ID NO: 2973472 - protein, 22 aa, Entamoeba invadens
VIEDYIAFRVSRMNAEKSEKED

SEQ ID NO: 2973473 - protein, 24 aa, Entamoeba invadens
VIEGYNCTFFAYGQTGTGKTFTME

SEQ ID NO: 2973474 - protein, 23 aa, Entamoeba invadens
VIEICKSEHDGLIKYKPTRKFLS

SEQ ID NO: 2973475 - protein, 27 aa, Entamoeba invadens
VIEIPHLKEIVLFYTLFECIGYDSINN

SEQ ID NO: 2973476 - protein, 31 aa, Entamoeba invadens
VIEIPHPPPGLYPELFINTSLIADTEEMRME

SEQ ID NO: 2973477 - protein, 19 aa, Entamoeba invadens
VIEKCDRLTKISIPFDTNK

SEQ ID NO: 2973478 - protein, 21 aa, Entamoeba invadens
VIEKCWKQKVEERITINEAVN

SEQ ID NO: 2973479 - protein, 25 aa, Entamoeba invadens
VIELNLKAAVGWSVLMELEGGAFRT

SEQ ID NO: 2973480 - protein, 24 aa, Entamoeba invadens
VIENFKDCTFYSGKSMDVDDGCLI

SEQ ID NO: 2973481 - protein, 18 aa, Entamoeba invadens
VIERGWLGLVESLKNGNF

SEQ ID NO: 2973482 - protein, 24 aa, Entamoeba invadens
VIERRGVCRTCGLNEDNCPGHFGH

SEQ ID NO: 2973483 - protein, 19 aa, Entamoeba invadens
VIERTPCGVWKGEVNDQSG

SEQ ID NO: 2973484 - protein, 19 aa, Entamoeba invadens
VIESLPKVETHPVESLSTE

SEQ ID NO: 2973485 - protein, 24 aa, Entamoeba invadens
VIETIKLFLFIAEKFIKDEKYTQE

SEQ ID NO: 2973486 - protein, 24 aa, Entamoeba invadens
VIEVSRKRMTPLISDDHRPIPTFD

SEQ ID NO: 2973487 - protein, 24 aa, Entamoeba invadens
VIEYLVAEVLELAGGQAKDFGKTR

SEQ ID NO: 2973488 - protein, 18 aa, Entamoeba invadens
VIFDSRLNGMDQRELKAQ

SEQ ID NO: 2973489 - protein, 27 aa, Entamoeba invadens
VIFECRNLKNLDIFHLNNAICGKENIM

SEQ ID NO: 2973490 - protein, 17 aa, Entamoeba invadens
VIFIINFLQTVSRNESE

SEQ ID NO: 2973491 - protein, 25 aa, Entamoeba invadens
VIFINRLSVLISEVITFNTSIEKLK

SEQ ID NO: 2973492 - protein, 18 aa, Entamoeba invadens
VIFKKCTDLGFMLDSANR

SEQ ID NO: 2973493 - protein, 20 aa, Entamoeba invadens
VIFLFSRISFVSVLNTTDTN

SEQ ID NO: 2973494 - protein, 18 aa, Entamoeba invadens
VIFNSKFDGLNRETFNNR

SEQ ID NO: 2973495 - protein, 18 aa, Entamoeba invadens
VIFPFKYESPVISELCEE

SEQ ID NO: 2973496 - protein, 18 aa, Entamoeba invadens
VIFSYQYFFEMNIPISMK

SEQ ID NO: 2973497 - protein, 18 aa, Entamoeba invadens
VIGCFARVTATHFVTNTN

SEQ ID NO: 2973498 - protein, 19 aa, Entamoeba invadens
VIGCFARVTATHFVTNTNP

SEQ ID NO: 2973499 - protein, 20 aa, Entamoeba invadens
VIGDNAFFWCCALKTFEISE

SEQ ID NO: 2973500 - protein, 17 aa, Entamoeba invadens
VIGEGKTVNPKDLKGKT

SEQ ID NO: 2973501 - protein, 19 aa, Entamoeba invadens
VIGERCFKNAPITDVVIPP

SEQ ID NO: 2973502 - protein, 25 aa, Entamoeba invadens
VIGETAEVGKWCRMYQEVTLGAINF

SEQ ID NO: 2973503 - protein, 22 aa, Entamoeba invadens
VIGEVKRFIGLTYDDPAIKTIC

SEQ ID NO: 2973504 - protein, 17 aa, Entamoeba invadens
VIGGFAFYNCTGLTAIK

SEQ ID NO: 2973505 - protein, 17 aa, Entamoeba invadens
VIGGSLIHYKRSDKQIP

SEQ ID NO: 2973506 - protein, 39 aa, Entamoeba invadens
VIGQQAIQLAVEFKQVFMRCREFVSWGFFVDLETQIKSF

SEQ ID NO: 2973507 - protein, 21 aa, Entamoeba invadens
VIGRIRYFIRTTLTRTSFSKT

SEQ ID NO: 2973508 - protein, 18 aa, Entamoeba invadens
VIGSIGLRCLCGDATMYG

SEQ ID NO: 2973509 - protein, 18 aa, Entamoeba invadens
VIGSYAFLHCEKLEDINV

SEQ ID NO: 2973510 - protein, 18 aa, Entamoeba invadens
VIGVCLCKQSHNYQFGNI

SEQ ID NO: 2973511 - protein, 18 aa, Entamoeba invadens
VIHHCPKTPCLLVGTKLD

SEQ ID NO: 2973512 - protein, 24 aa, Entamoeba invadens
VIHPRGVVLDIVISLFARKGYAEM

SEQ ID NO: 2973513 - protein, 24 aa, Entamoeba invadens
VIIDKAGNVFGCYNKGSVRELCLS

SEQ ID NO: 2973514 - protein, 18 aa, Entamoeba invadens
VIIFDFFATWCGPCKSIA

SEQ ID NO: 2973515 - protein, 23 aa, Entamoeba invadens
VIIGENGYNFLIPKSGNCDEMVE

SEQ ID NO: 2973516 - protein, 24 aa, Entamoeba invadens
VIIISRPWGRPGAFRNKQSLNSLF

SEQ ID NO: 2973517 - protein, 17 aa, Entamoeba invadens
VIIKEFLAWEGDFGGRK

SEQ ID NO: 2973518 - protein, 23 aa, Entamoeba invadens
VIIMNLLLRYIFGLIGFVPTVSF

SEQ ID NO: 2973519 - protein, 26 aa, Entamoeba invadens
VIINAIYFKGEWDKPFHILPNKMEFE

SEQ ID NO: 2973520 - protein, 24 aa, Entamoeba invadens
VIIPPRGTNPISLVLSSVPVVDSD

SEQ ID NO: 2973521 - protein, 29 aa, Entamoeba invadens
VIISFLYKRLNSVYLRRQCLESYITVNGL

SEQ ID NO: 2973522 - protein, 25 aa, Entamoeba invadens
VIIVIKMKGGKIFGGYFSHIPEEGK

SEQ ID NO: 2973523 - protein, 19 aa, Entamoeba invadens
VIKENNCDFLLAVGGGSVI

SEQ ID NO: 2973524 - protein, 23 aa, Entamoeba invadens
VIKERKTSFVVGKIKTFVVLSVR

SEQ ID NO: 2973525 - protein, 18 aa, Entamoeba invadens
VIKGYRIKIEKELSEKCD

SEQ ID NO: 2973526 - protein, 21 aa, Entamoeba invadens
VIKIEALKILTSYFKAQKSQT

SEQ ID NO: 2973527 - protein, 20 aa, Entamoeba invadens
VIKKKVTALEGYYDRLQEAI

SEQ ID NO: 2973528 - protein, 21 aa, Entamoeba invadens
VIKKKVTALEGYYDRLQEAIL

SEQ ID NO: 2973529 - protein, 22 aa, Entamoeba invadens
VIKKLEKIFLIKDLYTEVMRKV

SEQ ID NO: 2973530 - protein, 23 aa, Entamoeba invadens
VIKMQELLLLFGKIGYLLLNTTY

SEQ ID NO: 2973531 - protein, 20 aa, Entamoeba invadens
VIKNEIKAGVDASVSQVWRL

SEQ ID NO: 2973532 - protein, 19 aa, Entamoeba invadens
VIKQIPGMKAFMKNINSLA

SEQ ID NO: 2973533 - protein, 17 aa, Entamoeba invadens
VIKSEGKQEVYPFSIKE

SEQ ID NO: 2973534 - protein, 22 aa, Entamoeba invadens
VIKSKFEPFAFNFEYTIQGVKY

SEQ ID NO: 2973535 - protein, 22 aa, Entamoeba invadens
VIKSLSLYGFDYFADVRSQALI

SEQ ID NO: 2973536 - protein, 27 aa, Entamoeba invadens
VIKTKGFAFGLFLGNWFKESNNIYVFK

SEQ ID NO: 2973537 - protein, 17 aa, Entamoeba invadens
VIKTWIDLYAIYYETDE

SEQ ID NO: 2973538 - protein, 17 aa, Entamoeba invadens
VIKVYTLLDVELVKREC

SEQ ID NO: 2973539 - protein, 29 aa, Entamoeba invadens
VIKYAFPMNRIVLLPCNSRKDAFKIRVGK

SEQ ID NO: 2973540 - protein, 21 aa, Entamoeba invadens
VILDSKLDFVTTLLNQMASKF

SEQ ID NO: 2973541 - protein, 25 aa, Entamoeba invadens
VILFVMVCGYPPFSDGDDGGNRQLF

SEQ ID NO: 2973542 - protein, 18 aa, Entamoeba invadens
VILGEYLYLMTFIAANQR

SEQ ID NO: 2973543 - protein, 24 aa, Entamoeba invadens
VILKNCSLERVLLFPKSEKILVEM

SEQ ID NO: 2973544 - protein, 23 aa, Entamoeba invadens
VILKNVLMTYSFYNMRLNYGQGM

SEQ ID NO: 2973545 - protein, 23 aa, Entamoeba invadens
VILLKETNGWTLVRHDNKVGYVP

SEQ ID NO: 2973546 - protein, 19 aa, Entamoeba invadens
VILNMKILFPLSTLFPNKT

SEQ ID NO: 2973547 - protein, 20 aa, Entamoeba invadens
VILSCVIRYLSFMDTNTVEY

SEQ ID NO: 2973548 - protein, 18 aa, Entamoeba invadens
VILTDELVGFVSRKNYLI

SEQ ID NO: 2973549 - protein, 28 aa, Entamoeba invadens
VILTDKWCVRIAINYVDRIYAQVLASVK

SEQ ID NO: 2973550 - protein, 18 aa, Entamoeba invadens
VILTEDRSLIGIFETTLR

SEQ ID NO: 2973551 - protein, 18 aa, Entamoeba invadens
VILVGGCALIPKVKQVVR

SEQ ID NO: 2973552 - protein, 17 aa, Entamoeba invadens
VILYSCENLNKFTLPKS

SEQ ID NO: 2973553 - protein, 20 aa, Entamoeba invadens
VIMALLGVWYNNFYKAESQA

SEQ ID NO: 2973554 - protein, 24 aa, Entamoeba invadens
VIMCKCKLEIILIKNHTGQLSNFE

SEQ ID NO: 2973555 - protein, 17 aa, Entamoeba invadens
VIMPRQIPNYQPERSRI

SEQ ID NO: 2973556 - protein, 18 aa, Entamoeba invadens
VIMQNLFCLFSEKKKIET

SEQ ID NO: 2973557 - protein, 24 aa, Entamoeba invadens
VINIKLIFELSVAVSLVCPVKNQY

SEQ ID NO: 2973558 - protein, 26 aa, Entamoeba invadens
VINQFRPPVGYTWQFPAGLIDDGEEP

SEQ ID NO: 2973559 - protein, 18 aa, Entamoeba invadens
VINQKGIVLYSIYDKESH

SEQ ID NO: 2973560 - protein, 21 aa, Entamoeba invadens
VINRYILQLCTKKHKFYNNEK

SEQ ID NO: 2973561 - protein, 22 aa, Entamoeba invadens
VINSCIKFKVYIKNSNNIDIIN

SEQ ID NO: 2973562 - protein, 22 aa, Entamoeba invadens
VINSPTIRWFFKHFSPDTFDSA

SEQ ID NO: 2973563 - protein, 36 aa, Entamoeba invadens
VINTLKATVVFQRKLKFAAEGVAWIGLNKYIAISEK

SEQ ID NO: 2973564 - protein, 24 aa, Entamoeba invadens
VINVKAACWMKKMLDAKNLEINKF

SEQ ID NO: 2973565 - protein, 23 aa, Entamoeba invadens
VIPDFCGRIAFNVFNDVDVLNIE

SEQ ID NO: 2973566 - protein, 17 aa, Entamoeba invadens
VIPDSVVEFGMFVCQDC

SEQ ID NO: 2973567 - protein, 18 aa, Entamoeba invadens
VIPFPKIEHDGIYDKILM

SEQ ID NO: 2973568 - protein, 32 aa, Entamoeba invadens
VIPHFIKVIIGNRCLFGYETLSSVAIPTSVIM

SEQ ID NO: 2973569 - protein, 24 aa, Entamoeba invadens
VIPHKVYQFRGFDIANMTFVRGEK

SEQ ID NO: 2973570 - protein, 25 aa, Entamoeba invadens
VIPIQELLEPIALPAEVVDKKIRRE

SEQ ID NO: 2973571 - protein, 25 aa, Entamoeba invadens
VIPKNFFASCIYLKEVVMDNSVVTV

SEQ ID NO: 2973572 - protein, 26 aa, Entamoeba invadens
VIPLGMKCNEIFGIPLSIGVKKSGWR

SEQ ID NO: 2973573 - protein, 17 aa, Entamoeba invadens
VIPLPVIHSYGADITKL

SEQ ID NO: 2973574 - protein, 25 aa, Entamoeba invadens
VIPLSSMSGLIGWVPHSDTLHQVVK

SEQ ID NO: 2973575 - protein, 21 aa, Entamoeba invadens
VIPPDWVVTSLLPLQSTIRSY

SEQ ID NO: 2973576 - protein, 26 aa, Entamoeba invadens
VIPQTVRYVGWYAFSECYKLKHVIYS

SEQ ID NO: 2973577 - protein, 22 aa, Entamoeba invadens
VIPSCILPHLYLGSVQASVKSS

SEQ ID NO: 2973578 - protein, 23 aa, Entamoeba invadens
VIPSLCIVEKGILNELKKYGEGT

SEQ ID NO: 2973579 - protein, 26 aa, Entamoeba invadens
VIPYCVPSLGYHCFAWCSSLSSITIP

SEQ ID NO: 2973580 - protein, 35 aa, Entamoeba invadens
VIQDTIHIWYHFRNWVWFRLFQKVRPILKKRRVDE

SEQ ID NO: 2973581 - protein, 19 aa, Entamoeba invadens
VIQKKRFNNELKVNTQRKK

SEQ ID NO: 2973582 - protein, 25 aa, Entamoeba invadens
VIQKTWCVLCVKLEQIWIKEEYVLR

SEQ ID NO: 2973583 - protein, 25 aa, Entamoeba invadens
VIQMCSSIQKWSYDIVDEIISGTKF

SEQ ID NO: 2973584 - protein, 18 aa, Entamoeba invadens
VIQPIPWLQSEDLNESLE

SEQ ID NO: 2973585 - protein, 23 aa, Entamoeba invadens
VIQRVGLYPVEFGTKTYYFEIRN

SEQ ID NO: 2973586 - protein, 23 aa, Entamoeba invadens
VIQRYDLWRSRDRLFNRREMRNL

SEQ ID NO: 2973587 - protein, 18 aa, Entamoeba invadens
VIQTCLDKSWGEYKLRLS

SEQ ID NO: 2973588 - protein, 24 aa, Entamoeba invadens
VIREISFPALDHVSVFPFSNFTSI

SEQ ID NO: 2973589 - protein, 24 aa, Entamoeba invadens
VIRGTELISQIGLLALKDIIPFFI

SEQ ID NO: 2973590 - protein, 25 aa, Entamoeba invadens
VIRKELRSTCEFVMGKNTLIRKAIK

SEQ ID NO: 2973591 - protein, 18 aa, Entamoeba invadens
VIRPDRYKNLSVSLYVHD

SEQ ID NO: 2973592 - protein, 22 aa, Entamoeba invadens
VISALPLWVEFMTDQKDWDLFF

SEQ ID NO: 2973593 - protein, 19 aa, Entamoeba invadens
VISEGVGFYVRKMEFKTLP

SEQ ID NO: 2973594 - protein, 22 aa, Entamoeba invadens
VISHSFSLICLLDVGDNQKIHF

SEQ ID NO: 2973595 - protein, 25 aa, Entamoeba invadens
VISITRFGGKLSIPDSIKSISVNFI

SEQ ID NO: 2973596 - protein, 32 aa, Entamoeba invadens
VISKLKLWLEMSIGRSRHCTVGFTGDTSMQET

SEQ ID NO: 2973597 - protein, 25 aa, Entamoeba invadens
VISLFARKGYAEMFEVIRRNKVNYN

SEQ ID NO: 2973598 - protein, 27 aa, Entamoeba invadens
VISNSSWRYNTIKSAITNNDWQNYESN

SEQ ID NO: 2973599 - protein, 25 aa, Entamoeba invadens
VISSVCKIAGMLLCVVGEDSGFDIL

SEQ ID NO: 2973600 - protein, 18 aa, Entamoeba invadens
VISTEIRARLNLTESALP

SEQ ID NO: 2973601 - protein, 26 aa, Entamoeba invadens
VITDFCSFFVVFFISRIELVDKNGWG

SEQ ID NO: 2973602 - protein, 22 aa, Entamoeba invadens
VITDRLEPVLAPFNGISPKIQN

SEQ ID NO: 2973603 - protein, 18 aa, Entamoeba invadens
VITEGVKTLPQRCFAECP

SEQ ID NO: 2973604 - protein, 19 aa, Entamoeba invadens
VITEGVKTLPQRCFAECPN

SEQ ID NO: 2973605 - protein, 26 aa, Entamoeba invadens
VITLSEFRGDVCMDECKPRCVNISQY

SEQ ID NO: 2973606 - protein, 21 aa, Entamoeba invadens
VITPPEIVGSVYPSKVDILSY

SEQ ID NO: 2973607 - protein, 25 aa, Entamoeba invadens
VIVGDGAVGKTCMLISYTTNAFPNE

SEQ ID NO: 2973608 - protein, 26 aa, Entamoeba invadens
VIVGKNRSSFCFAPLLLEIRKAIRQI

SEQ ID NO: 2973609 - protein, 18 aa, Entamoeba invadens
VIVLEGTRTLLIDQDVRS

SEQ ID NO: 2973610 - protein, 17 aa, Entamoeba invadens
VIVNNIFTYLAHSSEET

SEQ ID NO: 2973611 - protein, 25 aa, Entamoeba invadens
VIVRESDCIISLIGDSPVYVLFEGK

SEQ ID NO: 2973612 - protein, 23 aa, Entamoeba invadens
VIWPSPKLSSGVVEPYNAVLNTH

SEQ ID NO: 2973613 - protein, 35 aa, Entamoeba invadens
VIYEELKVVCEVFKEVLTYKEFCRSNVGKEYFQEI

SEQ ID NO: 2973614 - protein, 18 aa, Entamoeba invadens
VIYELSPFNEWRDINSPQ

SEQ ID NO: 2973615 - protein, 18 aa, Entamoeba invadens
VIYFPKEGNLVIFAHSFI

SEQ ID NO: 2973616 - protein, 31 aa, Entamoeba invadens
VIYNNWRQPIALLIRKGHTYKLISQNSLLLQ

SEQ ID NO: 2973617 - protein, 25 aa, Entamoeba invadens
VIYQTKWSSSGIFRLLPSLCQSLLL

SEQ ID NO: 2973618 - protein, 18 aa, Entamoeba invadens
VIYTLSFIVNKVCYNNIK

SEQ ID NO: 2973619 - protein, 21 aa, Entamoeba invadens
VKAEFIRMGVLKMKSVQLCDL

SEQ ID NO: 2973620 - protein, 19 aa, Entamoeba invadens
VKAFEELKRVFDFSKNYVI

SEQ ID NO: 2973621 - protein, 17 aa, Entamoeba invadens
VKAFSFVSHTSREALCQ

SEQ ID NO: 2973622 - protein, 22 aa, Entamoeba invadens
VKAGIKCMIDIVIQSSDMNVKM

SEQ ID NO: 2973623 - protein, 26 aa, Entamoeba invadens
VKAKIPVSLCEWFICEVGRSTKLAEY

SEQ ID NO: 2973624 - protein, 22 aa, Entamoeba invadens
VKAKRIELFVTHGKTLKFTKCE

SEQ ID NO: 2973625 - protein, 17 aa, Entamoeba invadens
VKAKSIWENIQRNKEGK

SEQ ID NO: 2973626 - protein, 19 aa, Entamoeba invadens
VKAKVPLQRVENVEEVRQK

SEQ ID NO: 2973627 - protein, 18 aa, Entamoeba invadens
VKALLLRGVGVHHAGLLP

SEQ ID NO: 2973628 - protein, 27 aa, Entamoeba invadens
VKALNGIVLECCRHPYGCRVVQRVIES

SEQ ID NO: 2973629 - protein, 27 aa, Entamoeba invadens
VKALNNWCFYKCSGIKNIIIPSSVTSI

SEQ ID NO: 2973630 - protein, 24 aa, Entamoeba invadens
VKALQPFCFTKCFTLIDFVLPENV

SEQ ID NO: 2973631 - protein, 17 aa, Entamoeba invadens
VKALSGVHTVKFREELQ

SEQ ID NO: 2973632 - protein, 24 aa, Entamoeba invadens
VKANYKPNDKWDLNAEINKANGGK

SEQ ID NO: 2973633 - protein, 17 aa, Entamoeba invadens
VKAPFGVECLSTKSIDN

SEQ ID NO: 2973634 - protein, 17 aa, Entamoeba invadens
VKAQGLPPRVTDEMLND

SEQ ID NO: 2973635 - protein, 19 aa, Entamoeba invadens
VKATCPYIVEYNANLRTVN

SEQ ID NO: 2973636 - protein, 17 aa, Entamoeba invadens
VKATFTQPIFLQKVYIG

SEQ ID NO: 2973637 - protein, 17 aa, Entamoeba invadens
VKAVVFLLTEISKNVEC

SEQ ID NO: 2973638 - protein, 17 aa, Entamoeba invadens
VKCCSLISSLLMIEYNY

SEQ ID NO: 2973639 - protein, 24 aa, Entamoeba invadens
VKCDYLRLATYLAQKREDKIHSDS

SEQ ID NO: 2973640 - protein, 22 aa, Entamoeba invadens
VKCEGDPSCLMRLFGSVSTPER

SEQ ID NO: 2973641 - protein, 25 aa, Entamoeba invadens
VKCQDVLRMITIFFQDVNVIQNENA

SEQ ID NO: 2973642 - protein, 18 aa, Entamoeba invadens
VKCRPGYETDIAMRVMKL

SEQ ID NO: 2973643 - protein, 17 aa, Entamoeba invadens
VKCRVPRCSIRICNISD

SEQ ID NO: 2973644 - protein, 19 aa, Entamoeba invadens
VKCSGLMLTGMASFNTMCI

SEQ ID NO: 2973645 - protein, 21 aa, Entamoeba invadens
VKCSTKFFDVGCGDINVVYNT

SEQ ID NO: 2973646 - protein, 19 aa, Entamoeba invadens
VKCTEVFATLLTKEGVNLG

SEQ ID NO: 2973647 - protein, 20 aa, Entamoeba invadens
VKCVKEFPSTHPYLVLIIDV

SEQ ID NO: 2973648 - protein, 25 aa, Entamoeba invadens
VKDFWTRVFYYSGFTKNVGYTEQDT

SEQ ID NO: 2973649 - protein, 23 aa, Entamoeba invadens
VKDGFKYACDFMVYKKNPKECHS

SEQ ID NO: 2973650 - protein, 18 aa, Entamoeba invadens
VKDGQIICKCGKNLFDYG

SEQ ID NO: 2973651 - protein, 18 aa, Entamoeba invadens
VKDHIAFFYFQKIEFVQP

SEQ ID NO: 2973652 - protein, 35 aa, Entamoeba invadens
VKDIIYKLMELFITFKFSPTFLYFMSRALVELHSR

SEQ ID NO: 2973653 - protein, 22 aa, Entamoeba invadens
VKDIKPGDLVGVNKDTYLILEK

SEQ ID NO: 2973654 - protein, 17 aa, Entamoeba invadens
VKDKCPEMYYKSEADKM

SEQ ID NO: 2973655 - protein, 24 aa, Entamoeba invadens
VKDKDGNMFYCYTYLVKNKSGEEH

SEQ ID NO: 2973656 - protein, 22 aa, Entamoeba invadens
VKDKPAVSFVWQYDKTKPKTER

SEQ ID NO: 2973657 - protein, 26 aa, Entamoeba invadens
VKDLEEVHPLFCYSVRDVARHITVVQ

SEQ ID NO: 2973658 - protein, 28 aa, Entamoeba invadens
VKDLLLHNPRVVFVFYDFEFTQFQDIGT

SEQ ID NO: 2973659 - protein, 21 aa, Entamoeba invadens
VKDLMKQICEKYKKDGKPRVY

SEQ ID NO: 2973660 - protein, 19 aa, Entamoeba invadens
VKDMECFQEAILVALINQF

SEQ ID NO: 2973661 - protein, 18 aa, Entamoeba invadens
VKDMWLKELASFEKKYPE

SEQ ID NO: 2973662 - protein, 24 aa, Entamoeba invadens
VKDREFIRLTGTLKKYSHTLQAQK

SEQ ID NO: 2973663 - protein, 23 aa, Entamoeba invadens
VKDSHKYWQMWALVNLEVVGLYE

SEQ ID NO: 2973664 - protein, 21 aa, Entamoeba invadens
VKDSKKKGCIVCVCNDMLIVY

SEQ ID NO: 2973665 - protein, 17 aa, Entamoeba invadens
VKDSMQVGSYDRAKSKI

SEQ ID NO: 2973666 - protein, 19 aa, Entamoeba invadens
VKDTLFKNFHIEIHATCQD

SEQ ID NO: 2973667 - protein, 24 aa, Entamoeba invadens
VKDVCIPEDIVGRYLPKLNGKVRD

SEQ ID NO: 2973668 - protein, 19 aa, Entamoeba invadens
VKDVCKAMIHCATEPKITI

SEQ ID NO: 2973669 - protein, 25 aa, Entamoeba invadens
VKDVKLRGSLRMKLYTEGIQSLQLI

SEQ ID NO: 2973670 - protein, 17 aa, Entamoeba invadens
VKDYDLSPQQMFYKVDT

SEQ ID NO: 2973671 - protein, 21 aa, Entamoeba invadens
VKEALLDIEVDGVKYILKAKT

SEQ ID NO: 2973672 - protein, 20 aa, Entamoeba invadens
VKECIKDQANALNWFNTQQK

SEQ ID NO: 2973673 - protein, 21 aa, Entamoeba invadens
VKEFKHLTYICLYERSESSPP

SEQ ID NO: 2973674 - protein, 19 aa, Entamoeba invadens
VKEFLKSRGLVTATENHFL

SEQ ID NO: 2973675 - protein, 21 aa, Entamoeba invadens
VKEFLLKCAVNMINMARTTEL

SEQ ID NO: 2973676 - protein, 33 aa, Entamoeba invadens
VKEGDLYLGDRWLRFDPPLGCVIDLDDIEKMPK

SEQ ID NO: 2973677 - protein, 36 aa, Entamoeba invadens
VKEIGDFCFKNCTCFLNDLYLPYGLTKIGYGAFENF

SEQ ID NO: 2973678 - protein, 17 aa, Entamoeba invadens
VKEIGFEGVHFSKKIRE

SEQ ID NO: 2973679 - protein, 22 aa, Entamoeba invadens
VKEINIRAVLCCPVSFNDAQKE

SEQ ID NO: 2973680 - protein, 21 aa, Entamoeba invadens
VKEINIRAVLCCPVSFNDVQK

SEQ ID NO: 2973681 - protein, 18 aa, Entamoeba invadens
VKEKERELETTIKQFDAI

SEQ ID NO: 2973682 - protein, 23 aa, Entamoeba invadens
VKEKGVLPRVVYLDDFMSELCVY

SEQ ID NO: 2973683 - protein, 32 aa, Entamoeba invadens
VKEKKTKQVGCYKCGSLDHIGRDCPDAWKYHD

SEQ ID NO: 2973684 - protein, 18 aa, Entamoeba invadens
VKEKLGIGEVLNKVKFIY

SEQ ID NO: 2973685 - protein, 17 aa, Entamoeba invadens
VKEKLRLFESKVVESNP

SEQ ID NO: 2973686 - protein, 21 aa, Entamoeba invadens
VKELKGWTFGGCVSLKEVVLN

SEQ ID NO: 2973687 - protein, 18 aa, Entamoeba invadens
VKELMAILETSFRKNEKV

SEQ ID NO: 2973688 - protein, 21 aa, Entamoeba invadens
VKELMKLCSKLEVPFSSEEEA

SEQ ID NO: 2973689 - protein, 21 aa, Entamoeba invadens
VKEMIIRGGHNVFPAEIIDTL

SEQ ID NO: 2973690 - protein, 17 aa, Entamoeba invadens
VKEMVPLIVQCRTALIA

SEQ ID NO: 2973691 - protein, 25 aa, Entamoeba invadens
VKENPVFEYIRYIILPFLGKAKLCG

SEQ ID NO: 2973692 - protein, 17 aa, Entamoeba invadens
VKERCLSILMQDKIHGI

SEQ ID NO: 2973693 - protein, 26 aa, Entamoeba invadens
VKERDEFRCQFSFLKFGDETYSDLLE

SEQ ID NO: 2973694 - protein, 32 aa, Entamoeba invadens
VKERGTKIVVCGSDSFLSLFIRQMTEAATKKA

SEQ ID NO: 2973695 - protein, 28 aa, Entamoeba invadens
VKERKIPMCQWPLFIYNEFENEVGKSKV

SEQ ID NO: 2973696 - protein, 21 aa, Entamoeba invadens
VKESFIRGDIDNVFYSSNAKA

SEQ ID NO: 2973697 - protein, 23 aa, Entamoeba invadens
VKESKIPIILFIDEIHTVLGAGA

SEQ ID NO: 2973698 - protein, 24 aa, Entamoeba invadens
VKESKIPIILFIDEIHTVLGAGAT

SEQ ID NO: 2973699 - protein, 19 aa, Entamoeba invadens
VKESMPICTSDIMKEAIVV

SEQ ID NO: 2973700 - protein, 22 aa, Entamoeba invadens
VKEVCFALSFVCVVEEILDLKK

SEQ ID NO: 2973701 - protein, 22 aa, Entamoeba invadens
VKEVCRQFTLCYTREQNVVPIT

SEQ ID NO: 2973702 - protein, 17 aa, Entamoeba invadens
VKEVFPVSVEVEGKTEL

SEQ ID NO: 2973703 - protein, 20 aa, Entamoeba invadens
VKEVLGLLVSGDLEDMAIKL

SEQ ID NO: 2973704 - protein, 18 aa, Entamoeba invadens
VKEVRWSGFDLRNVDSEI

SEQ ID NO: 2973705 - protein, 26 aa, Entamoeba invadens
VKEYAEAFEVIPFTLAENAGLNPMQL

SEQ ID NO: 2973706 - protein, 17 aa, Entamoeba invadens
VKFADFYSKTHLKTLQN

SEQ ID NO: 2973707 - protein, 21 aa, Entamoeba invadens
VKFEILDGFKKGTIEEISSGV

SEQ ID NO: 2973708 - protein, 19 aa, Entamoeba invadens
VKFIALFKELTSNKGTQVD

SEQ ID NO: 2973709 - protein, 23 aa, Entamoeba invadens
VKFICGMNGFIFITFGKEPEKTN

SEQ ID NO: 2973710 - protein, 20 aa, Entamoeba invadens
VKFIRRCVNKAKVLSLSGFD

SEQ ID NO: 2973711 - protein, 39 aa, Entamoeba invadens
VKFLEKHFYCGQLLCLYGCYHKNRIFSLLKKGEVSKDKL

SEQ ID NO: 2973712 - protein, 17 aa, Entamoeba invadens
VKFNCKIGVEEIAFCVD

SEQ ID NO: 2973713 - protein, 17 aa, Entamoeba invadens
VKFSKINFDIEVIGCFA

SEQ ID NO: 2973714 - protein, 24 aa, Entamoeba invadens
VKFSREGQSFYGIILDKVGEGFTV

SEQ ID NO: 2973715 - protein, 23 aa, Entamoeba invadens
VKFTIRDIDNWMGVCPNGDVEQL

SEQ ID NO: 2973716 - protein, 19 aa, Entamoeba invadens
VKFVPQFYQLVDDYYKTLD

SEQ ID NO: 2973717 - protein, 29 aa, Entamoeba invadens
VKGAFIIQKKLSTIVIISLMKYDQVTPER

SEQ ID NO: 2973718 - protein, 18 aa, Entamoeba invadens
VKGCFRFETRSIIPEKYK

SEQ ID NO: 2973719 - protein, 19 aa, Entamoeba invadens
VKGCYRPSESDWWINSLEE

SEQ ID NO: 2973720 - protein, 17 aa, Entamoeba invadens
VKGDVPSNLQCRVIALD

SEQ ID NO: 2973721 - protein, 22 aa, Entamoeba invadens
VKGDYNVNCKLNRRHIANSPFK

SEQ ID NO: 2973722 - protein, 17 aa, Entamoeba invadens
VKGELAFMTEGLKNERG

SEQ ID NO: 2973723 - protein, 24 aa, Entamoeba invadens
VKGHIIKMLIYRIRPEKDIVKEIG

SEQ ID NO: 2973724 - protein, 23 aa, Entamoeba invadens
VKGICGFKTAYLQEFFDYLEKQK

SEQ ID NO: 2973725 - protein, 18 aa, Entamoeba invadens
VKGIREIVEKAGHELVLL

SEQ ID NO: 2973726 - protein, 20 aa, Entamoeba invadens
VKGKAACWMKTLFDAKNLEV

SEQ ID NO: 2973727 - protein, 19 aa, Entamoeba invadens
VKGKCELVVSNVDIDKMII

SEQ ID NO: 2973728 - protein, 17 aa, Entamoeba invadens
VKGKHVIIYDDMTRTAG

SEQ ID NO: 2973729 - protein, 20 aa, Entamoeba invadens
VKGKLPLSVKYVAIDFISQV

SEQ ID NO: 2973730 - protein, 44 aa, Entamoeba invadens
VKGKPDVCVGCVNFELSLMPFPSIIEGWFYLRPLAFTDNVSTGR

SEQ ID NO: 2973731 - protein, 24 aa, Entamoeba invadens
VKGKSCEERAKLLKRVVNQMVNKL

SEQ ID NO: 2973732 - protein, 19 aa, Entamoeba invadens
VKGLNKWIQTGKCSFPKYH

SEQ ID NO: 2973733 - protein, 21 aa, Entamoeba invadens
VKGMKMTVCEKFVQMYRNLGK

SEQ ID NO: 2973734 - protein, 21 aa, Entamoeba invadens
VKGNGWVKVLWNPDGQPNRYR

SEQ ID NO: 2973735 - protein, 24 aa, Entamoeba invadens
VKGNISIRISDLISITDEILMIDT

SEQ ID NO: 2973736 - protein, 18 aa, Entamoeba invadens
VKGPEMLSKYVGETEGKI

SEQ ID NO: 2973737 - protein, 23 aa, Entamoeba invadens
VKGPFTLRSGTGYNLDCVNCTNV

SEQ ID NO: 2973738 - protein, 29 aa, Entamoeba invadens
VKGPSLYCVLPLVGSEKMQFPFLLNSPDF

SEQ ID NO: 2973739 - protein, 18 aa, Entamoeba invadens
VKGRCIVSSSVLSINMRG

SEQ ID NO: 2973740 - protein, 17 aa, Entamoeba invadens
VKGREWFCQNSCATNGD

SEQ ID NO: 2973741 - protein, 17 aa, Entamoeba invadens
VKGREWFCQTSCATNGD

SEQ ID NO: 2973742 - protein, 20 aa, Entamoeba invadens
VKGRKCYSMPIILNQYKGQT

SEQ ID NO: 2973743 - protein, 24 aa, Entamoeba invadens
VKGRKCYSMPLILKQYKGQTDAKT

SEQ ID NO: 2973744 - protein, 18 aa, Entamoeba invadens
VKGRKVVVATNIAETSIT

SEQ ID NO: 2973745 - protein, 22 aa, Entamoeba invadens
VKGRQGDMFGLLANLGMDVNCV

SEQ ID NO: 2973746 - protein, 17 aa, Entamoeba invadens
VKGSFKEIFAIDDTLSG

SEQ ID NO: 2973747 - protein, 23 aa, Entamoeba invadens
VKGTKCPICEDVLSEAIPLNRPF

SEQ ID NO: 2973748 - protein, 25 aa, Entamoeba invadens
VKGVRRYLDNLGFLEVETPILNTIP

SEQ ID NO: 2973749 - protein, 28 aa, Entamoeba invadens
VKGWNVDICKCIFHNAFSSDKLLFYTSL

SEQ ID NO: 2973750 - protein, 23 aa, Entamoeba invadens
VKHIKFTLTNHVFFNTKDYQSFG

SEQ ID NO: 2973751 - protein, 24 aa, Entamoeba invadens
VKHIKWIFWDVCGQQQFQRLWKTY

SEQ ID NO: 2973752 - protein, 24 aa, Entamoeba invadens
VKHKKRYSQKFKEDRQCEKTGKKI

SEQ ID NO: 2973753 - protein, 24 aa, Entamoeba invadens
VKHLGEGKYFISYTLPSVKGDYNV

SEQ ID NO: 2973754 - protein, 17 aa, Entamoeba invadens
VKHMLPFSLEIFLSQTA

SEQ ID NO: 2973755 - protein, 17 aa, Entamoeba invadens
VKHPFTFLDDDVWGPFQ

SEQ ID NO: 2973756 - protein, 17 aa, Entamoeba invadens
VKHRIVQDYSFSKRYTI

SEQ ID NO: 2973757 - protein, 18 aa, Entamoeba invadens
VKICEDCTICITQTVFEK

SEQ ID NO: 2973758 - protein, 17 aa, Entamoeba invadens
VKIDIWSLGIMVMEMAE

SEQ ID NO: 2973759 - protein, 20 aa, Entamoeba invadens
VKIECVDKILTLYNKNIPEK

SEQ ID NO: 2973760 - protein, 21 aa, Entamoeba invadens
VKIFYCKYNDPLYIKVEKLEI

SEQ ID NO: 2973761 - protein, 17 aa, Entamoeba invadens
VKIGFTTGFLFSKDTLG

SEQ ID NO: 2973762 - protein, 22 aa, Entamoeba invadens
VKIGSQITVEFSKWRNEHFSQK

SEQ ID NO: 2973763 - protein, 23 aa, Entamoeba invadens
VKIHCNRAIIGVLRGFDEYLNLV

SEQ ID NO: 2973764 - protein, 23 aa, Entamoeba invadens
VKIHRLKGFFTGVGDTFTYTLFA

SEQ ID NO: 2973765 - protein, 25 aa, Entamoeba invadens
VKIITELLITFGKVVPCTSLMIDEE

SEQ ID NO: 2973766 - protein, 27 aa, Entamoeba invadens
VKILEMENCSWFDFVFPFHSLLELTMN

SEQ ID NO: 2973767 - protein, 40 aa, Entamoeba invadens
VKILGKNTFKDWSCLSTFMQRDAYLMWGFYSNPEKVEEIY

SEQ ID NO: 2973768 - protein, 38 aa, Entamoeba invadens
VKILKSHNTGVCKFHLGMCYRKGCGVLESATKSAECYK

SEQ ID NO: 2973769 - protein, 25 aa, Entamoeba invadens
VKIMKNRGGAVLNTFIECLATQSIH

SEQ ID NO: 2973770 - protein, 20 aa, Entamoeba invadens
VKIMLSTLFMSLEKTHKKSR

SEQ ID NO: 2973771 - protein, 23 aa, Entamoeba invadens
VKIPEERSKVLLYTPAETRQWNE

SEQ ID NO: 2973772 - protein, 17 aa, Entamoeba invadens
VKIPFSVVVPKAYSEPW

SEQ ID NO: 2973773 - protein, 20 aa, Entamoeba invadens
VKIPQLRAVIPDQLLLEMCN

SEQ ID NO: 2973774 - protein, 18 aa, Entamoeba invadens
VKIVKVFFNVKGFENTSV

SEQ ID NO: 2973775 - protein, 25 aa, Entamoeba invadens
VKIVLPKGFKTPRQQAKFASRSPTE

SEQ ID NO: 2973776 - protein, 17 aa, Entamoeba invadens
VKKAAALQEQKDDITAK

SEQ ID NO: 2973777 - protein, 25 aa, Entamoeba invadens
VKKAVLKGQRFVAVGQIMHKRAVDD

SEQ ID NO: 2973778 - protein, 21 aa, Entamoeba invadens
VKKAVTIPVLVGSGVTPENIN

SEQ ID NO: 2973779 - protein, 22 aa, Entamoeba invadens
VKKCRIPATVILLGDILLERGV

SEQ ID NO: 2973780 - protein, 20 aa, Entamoeba invadens
VKKGKVLFKDVIAFYKTKYK

SEQ ID NO: 2973781 - protein, 25 aa, Entamoeba invadens
VKKGLPETIRVVTSCYVYIQCIGDQ

SEQ ID NO: 2973782 - protein, 19 aa, Entamoeba invadens
VKKGVAKPTAFRRYEKNKR

SEQ ID NO: 2973783 - protein, 30 aa, Entamoeba invadens
VKKIENWTDWWKIRQSSFYHLSQEARKYTT

SEQ ID NO: 2973784 - protein, 25 aa, Entamoeba invadens
VKKIKALSCCDCSALQNKGVAELFD

SEQ ID NO: 2973785 - protein, 24 aa, Entamoeba invadens
VKKIKRYQIGKVYRRDQPYMTKGR

SEQ ID NO: 2973786 - protein, 24 aa, Entamoeba invadens
VKKIVEILSELFVKNVMKTQRVVN

SEQ ID NO: 2973787 - protein, 20 aa, Entamoeba invadens
VKKLAEGCGGTIGSSGKEVC

SEQ ID NO: 2973788 - protein, 30 aa, Entamoeba invadens
VKKLQKGKEMPFRQVRFSIIPSKQELKKDW

SEQ ID NO: 2973789 - protein, 25 aa, Entamoeba invadens
VKKLRCVPGTSFGNGLFKIEFDKAV

SEQ ID NO: 2973790 - protein, 22 aa, Entamoeba invadens
VKKLSLKYNDLVVGVEYTVLLV

SEQ ID NO: 2973791 - protein, 23 aa, Entamoeba invadens
VKKMCLIGKVSVEFPQNTKFPIE

SEQ ID NO: 2973792 - protein, 29 aa, Entamoeba invadens
VKKNISKVLCEWYLMFVGQPIKQAEAAKI

SEQ ID NO: 2973793 - protein, 28 aa, Entamoeba invadens
VKKNISKVLCEWYLVFVGQPIKQAEAAK

SEQ ID NO: 2973794 - protein, 18 aa, Entamoeba invadens
VKKNLDVLCEKGLANKED

SEQ ID NO: 2973795 - protein, 20 aa, Entamoeba invadens
VKKNRAVYEIAKTCDLLMVI

SEQ ID NO: 2973796 - protein, 20 aa, Entamoeba invadens
VKKNRMSMGTQRKSEAQQDF

SEQ ID NO: 2973797 - protein, 25 aa, Entamoeba invadens
VKKQLPQICANCMRSYTDYINDTNE

SEQ ID NO: 2973798 - protein, 22 aa, Entamoeba invadens
VKKQYECVCVLLGITYKGKPFM

SEQ ID NO: 2973799 - protein, 23 aa, Entamoeba invadens
VKKRASLKGSNPFDDESKSASGN

SEQ ID NO: 2973800 - protein, 27 aa, Entamoeba invadens
VKKRPIPKRVPIVIPPKFTMDYNNYSK

SEQ ID NO: 2973801 - protein, 17 aa, Entamoeba invadens
VKKRVQIQWNLDIENQM

SEQ ID NO: 2973802 - protein, 19 aa, Entamoeba invadens
VKKRYGFDYPTTKNERRNW

SEQ ID NO: 2973803 - protein, 21 aa, Entamoeba invadens
VKKSAGSVLNLFKRVRNDTVT

SEQ ID NO: 2973804 - protein, 27 aa, Entamoeba invadens
VKKSGWRVPLVVYRAVEFLRTTKGYEQ

SEQ ID NO: 2973805 - protein, 20 aa, Entamoeba invadens
VKKSIKSLITKTGIGSCRTG

SEQ ID NO: 2973806 - protein, 19 aa, Entamoeba invadens
VKKSREFLEESFSLDEINE

SEQ ID NO: 2973807 - protein, 18 aa, Entamoeba invadens
VKKSYIWKEFKKLRLTTI

SEQ ID NO: 2973808 - protein, 19 aa, Entamoeba invadens
VKKTSGWTEDGFSASVTAE

SEQ ID NO: 2973809 - protein, 18 aa, Entamoeba invadens
VKKVKKAFEFVRNDSEPM

SEQ ID NO: 2973810 - protein, 27 aa, Entamoeba invadens
VKKVSENILYFAHLVLFVARNNTSSLI

SEQ ID NO: 2973811 - protein, 23 aa, Entamoeba invadens
VKKVVLFLIEKCKGYGVTQEMVI

SEQ ID NO: 2973812 - protein, 20 aa, Entamoeba invadens
VKKYFKVWHDELRVFDESGK

SEQ ID NO: 2973813 - protein, 25 aa, Entamoeba invadens
VKKYTRKSVGYSMWLFSAIENLVSV

SEQ ID NO: 2973814 - protein, 22 aa, Entamoeba invadens
VKLCGCGLLFKHYGNEIVKNVL

SEQ ID NO: 2973815 - protein, 18 aa, Entamoeba invadens
VKLCKVCQSERRIIEIDH

SEQ ID NO: 2973816 - protein, 17 aa, Entamoeba invadens
VKLDLGLNIHDFSLKNV

SEQ ID NO: 2973817 - protein, 25 aa, Entamoeba invadens
VKLEEFYPSILFHVVMKKKLGEVKE

SEQ ID NO: 2973818 - protein, 24 aa, Entamoeba invadens
VKLENIKKAFGIYLICDGHGGDLC

SEQ ID NO: 2973819 - protein, 17 aa, Entamoeba invadens
VKLESVQTALLFDKGVI

SEQ ID NO: 2973820 - protein, 17 aa, Entamoeba invadens
VKLFFLTNEKLQPVLEG

SEQ ID NO: 2973821 - protein, 23 aa, Entamoeba invadens
VKLGDALILRFAIPSRIMTKEDL

SEQ ID NO: 2973822 - protein, 17 aa, Entamoeba invadens
VKLGDAMILRFAIPSRK

SEQ ID NO: 2973823 - protein, 18 aa, Entamoeba invadens
VKLGDFGLARVFRSEAKH

SEQ ID NO: 2973824 - protein, 19 aa, Entamoeba invadens
VKLGDSFRNESFLLSVRTC

SEQ ID NO: 2973825 - protein, 18 aa, Entamoeba invadens
VKLICDQLSFGMVRAQTL

SEQ ID NO: 2973826 - protein, 17 aa, Entamoeba invadens
VKLIDFGLVTRVESKPH

SEQ ID NO: 2973827 - protein, 29 aa, Entamoeba invadens
VKLIKSYAFSCCLHLKCVKNMNQSTVVQR

SEQ ID NO: 2973828 - protein, 20 aa, Entamoeba invadens
VKLINCINCNIEMLEAKKIL

SEQ ID NO: 2973829 - protein, 27 aa, Entamoeba invadens
VKLIRAFEPLFNFCLLSQNTPKNIFDF

SEQ ID NO: 2973830 - protein, 20 aa, Entamoeba invadens
VKLKALVLNKSFISCLNSVD

SEQ ID NO: 2973831 - protein, 17 aa, Entamoeba invadens
VKLKGKIEFNKITEIGE

SEQ ID NO: 2973832 - protein, 18 aa, Entamoeba invadens
VKLLCFNLLLKMANNNSD

SEQ ID NO: 2973833 - protein, 25 aa, Entamoeba invadens
VKLLKGKEVFPVFLDSKGVVMSLPP

SEQ ID NO: 2973834 - protein, 22 aa, Entamoeba invadens
VKLPEIKRVVVLYKVDNWYANS

SEQ ID NO: 2973835 - protein, 28 aa, Entamoeba invadens
VKLPLDYRLSKLVFFGLYFGIFTECAKA

SEQ ID NO: 2973836 - protein, 19 aa, Entamoeba invadens
VKLQQAISVLQKIKHPNLS

SEQ ID NO: 2973837 - protein, 24 aa, Entamoeba invadens
VKLQYPLMKCVLEPLVKDLVIKFD

SEQ ID NO: 2973838 - protein, 18 aa, Entamoeba invadens
VKLTLAPIAPEWKATLKS

SEQ ID NO: 2973839 - protein, 22 aa, Entamoeba invadens
VKLWLCKMKEKVERGTDEVSVN

SEQ ID NO: 2973840 - protein, 18 aa, Entamoeba invadens
VKMDNEWVKAFYKQEDPS

SEQ ID NO: 2973841 - protein, 19 aa, Entamoeba invadens
VKMEFPSFRKWESFGNFVS

SEQ ID NO: 2973842 - protein, 23 aa, Entamoeba invadens
VKMEVPCCRNTNNLWSPRKLVIY

SEQ ID NO: 2973843 - protein, 17 aa, Entamoeba invadens
VKMFIVSNFNYVVALSI

SEQ ID NO: 2973844 - protein, 18 aa, Entamoeba invadens
VKMGDGFIIVYSIIEQQS

SEQ ID NO: 2973845 - protein, 23 aa, Entamoeba invadens
VKMGDMCFFECSKLKNVVLPQTT

SEQ ID NO: 2973846 - protein, 24 aa, Entamoeba invadens
VKMKECDKSVWPKLIEFEERNQCH

SEQ ID NO: 2973847 - protein, 18 aa, Entamoeba invadens
VKMKEERENLVTQIEDER

SEQ ID NO: 2973848 - protein, 17 aa, Entamoeba invadens
VKMKIGYDTKAHTQLDH

SEQ ID NO: 2973849 - protein, 18 aa, Entamoeba invadens
VKMKTWIKLEEFDVLQLP

SEQ ID NO: 2973850 - protein, 17 aa, Entamoeba invadens
VKMLFDIGMKSDDYLIG

SEQ ID NO: 2973851 - protein, 19 aa, Entamoeba invadens
VKMLPVKVSMGMDTIKNVL

SEQ ID NO: 2973852 - protein, 23 aa, Entamoeba invadens
VKMLRIGFNIVNSISKYSAYGLG

SEQ ID NO: 2973853 - protein, 26 aa, Entamoeba invadens
VKMMRELHPVFPILARYVYTIGELDK

SEQ ID NO: 2973854 - protein, 18 aa, Entamoeba invadens
VKMMYCVPENRKFYLEMF

SEQ ID NO: 2973855 - protein, 25 aa, Entamoeba invadens
VKMPELFTSVASFTIVRFVNGMVDA

SEQ ID NO: 2973856 - protein, 18 aa, Entamoeba invadens
VKMPLTIANRDWVNMRSW

SEQ ID NO: 2973857 - protein, 24 aa, Entamoeba invadens
VKNCTFRHSGLMGISFSGNYSTIT

SEQ ID NO: 2973858 - protein, 25 aa, Entamoeba invadens
VKNDFDCLLSFTVIDSIQSFPLTSH

SEQ ID NO: 2973859 - protein, 18 aa, Entamoeba invadens
VKNDVIPVPPFIMKEKYI

SEQ ID NO: 2973860 - protein, 19 aa, Entamoeba invadens
VKNECYVHDSIIPMKKGTK

SEQ ID NO: 2973861 - protein, 23 aa, Entamoeba invadens
VKNEISVPFNLRISDGAFQNKIE

SEQ ID NO: 2973862 - protein, 23 aa, Entamoeba invadens
VKNFFYEIVVWFSVDYETVDKNN

SEQ ID NO: 2973863 - protein, 29 aa, Entamoeba invadens
VKNGQRVYALLWRKYHGVEQICDEHKVPV

SEQ ID NO: 2973864 - protein, 25 aa, Entamoeba invadens
VKNIIWKKVEFRDSFYYTVNGLSYI

SEQ ID NO: 2973865 - protein, 29 aa, Entamoeba invadens
VKNKEIRLFADLFYALSIPLPKSEIDNFK

SEQ ID NO: 2973866 - protein, 22 aa, Entamoeba invadens
VKNKWLNVVKYVMELYIQDESV

SEQ ID NO: 2973867 - protein, 19 aa, Entamoeba invadens
VKNLGECFVYFNDDFILNR

SEQ ID NO: 2973868 - protein, 25 aa, Entamoeba invadens
VKNLLGVLMNVCFEEEWITKVFDKD

SEQ ID NO: 2973869 - protein, 18 aa, Entamoeba invadens
VKNLRELDDVAPYLKDLT

SEQ ID NO: 2973870 - protein, 26 aa, Entamoeba invadens
VKNLSGSTPLHWAVRSTPEIVDMLLK

SEQ ID NO: 2973871 - protein, 18 aa, Entamoeba invadens
VKNRDILKEIGLRKKEGQ

SEQ ID NO: 2973872 - protein, 23 aa, Entamoeba invadens
VKNRLREAVQWPLKYKDQLDLFK

SEQ ID NO: 2973873 - protein, 17 aa, Entamoeba invadens
VKNRYFGHIKRLGISEL

SEQ ID NO: 2973874 - protein, 19 aa, Entamoeba invadens
VKNVELCINKDCAKNVTCT

SEQ ID NO: 2973875 - protein, 18 aa, Entamoeba invadens
VKNVPLPALGRVSEELRK

SEQ ID NO: 2973876 - protein, 19 aa, Entamoeba invadens
VKNVYPVPFVLLFNPEEFR

SEQ ID NO: 2973877 - protein, 25 aa, Entamoeba invadens
VKNYVWKYKGGHSILVNQLCSELEN

SEQ ID NO: 2973878 - protein, 25 aa, Entamoeba invadens
VKPFLFNNVHALTIFVKSNFAGTKV

SEQ ID NO: 2973879 - protein, 24 aa, Entamoeba invadens
VKPFPPFLEDKWYTHGFEFKNMLL

SEQ ID NO: 2973880 - protein, 18 aa, Entamoeba invadens
VKPGHAKFAVKITHESGT

SEQ ID NO: 2973881 - protein, 25 aa, Entamoeba invadens
VKPGRFYVRCGALTEIGRKMNKPRF

SEQ ID NO: 2973882 - protein, 17 aa, Entamoeba invadens
VKPIRMGFESIMDKTMV

SEQ ID NO: 2973883 - protein, 17 aa, Entamoeba invadens
VKPIVMYWALRVTGVLL

SEQ ID NO: 2973884 - protein, 25 aa, Entamoeba invadens
VKPPLSSAVLAEFVGGGPLSMTFDY

SEQ ID NO: 2973885 - protein, 20 aa, Entamoeba invadens
VKPSETLMGYMLSPRNFVSE

SEQ ID NO: 2973886 - protein, 17 aa, Entamoeba invadens
VKPSIVVTMMRMLPNLP

SEQ ID NO: 2973887 - protein, 26 aa, Entamoeba invadens
VKPTSIFKICYGFRKNQYHVFEGKIT

SEQ ID NO: 2973888 - protein, 25 aa, Entamoeba invadens
VKPYRKEYTEGIAHIKTQTLARKNG

SEQ ID NO: 2973889 - protein, 24 aa, Entamoeba invadens
VKQCSVEAFDIFVAFLKMYRTMNH

SEQ ID NO: 2973890 - protein, 28 aa, Entamoeba invadens
VKQESFVFGSVWFFFEVMTRIVVSILDA

SEQ ID NO: 2973891 - protein, 21 aa, Entamoeba invadens
VKQGGVVQLVCDIDNKDLLIE

SEQ ID NO: 2973892 - protein, 18 aa, Entamoeba invadens
VKQKWLKEANWFVQNSLI

SEQ ID NO: 2973893 - protein, 25 aa, Entamoeba invadens
VKQLKLINFNGCFITPINLHLEKLE

SEQ ID NO: 2973894 - protein, 24 aa, Entamoeba invadens
VKQLLPRMQVEWRNIVQFVTRESG

SEQ ID NO: 2973895 - protein, 25 aa, Entamoeba invadens
VKQLNLRKLIGFPFTMKSLGAPEWF

SEQ ID NO: 2973896 - protein, 26 aa, Entamoeba invadens
VKQLSLPESLLFIGKGCFESCSSLCE

SEQ ID NO: 2973897 - protein, 36 aa, Entamoeba invadens
VKQQTYRWFVCLFSREFHYHMTFAIWDNFIVRNGFT

SEQ ID NO: 2973898 - protein, 24 aa, Entamoeba invadens
VKQTIERICYIFAMEHETLSYQQG

SEQ ID NO: 2973899 - protein, 18 aa, Entamoeba invadens
VKRADALGEFAATFTGTP

SEQ ID NO: 2973900 - protein, 19 aa, Entamoeba invadens
VKRCRNLTIYLCGETKVEQ

SEQ ID NO: 2973901 - protein, 25 aa, Entamoeba invadens
VKRDACSSLNLPVQITTGILSNLEV

SEQ ID NO: 2973902 - protein, 18 aa, Entamoeba invadens
VKREHLFDGKKFFVSREY

SEQ ID NO: 2973903 - protein, 20 aa, Entamoeba invadens
VKREKVLAGADVAFCVEGVK

SEQ ID NO: 2973904 - protein, 20 aa, Entamoeba invadens
VKRETPIIANKAFVFSLVNR

SEQ ID NO: 2973905 - protein, 26 aa, Entamoeba invadens
VKRFGRCELTKKFALNYANIPDEKHL

SEQ ID NO: 2973906 - protein, 22 aa, Entamoeba invadens
VKRIDWGEIAIIGGITIASIGI

SEQ ID NO: 2973907 - protein, 21 aa, Entamoeba invadens
VKRIREMYSMTEIRKDMNRME

SEQ ID NO: 2973908 - protein, 23 aa, Entamoeba invadens
VKRKKKGKSVCIWANNCRAYSFT

SEQ ID NO: 2973909 - protein, 19 aa, Entamoeba invadens
VKRLILHPIPFDTKRDLIT

SEQ ID NO: 2973910 - protein, 17 aa, Entamoeba invadens
VKRLLEWMRTIDDESAQ

SEQ ID NO: 2973911 - protein, 20 aa, Entamoeba invadens
VKRMLHPKIRAQVDKALSLS

SEQ ID NO: 2973912 - protein, 21 aa, Entamoeba invadens
VKRMYYLSIEYLIGRSLMNAI

SEQ ID NO: 2973913 - protein, 17 aa, Entamoeba invadens
VKRSEIASKKCETVNVK

SEQ ID NO: 2973914 - protein, 25 aa, Entamoeba invadens
VKRVFRELFYTYTLSVVINNPETLM

SEQ ID NO: 2973915 - protein, 44 aa, Entamoeba invadens
VKRVGKEWNPSSDLLMVLESLSISFGGSPPVRQSPKGARPATLP

SEQ ID NO: 2973916 - protein, 17 aa, Entamoeba invadens
VKRVILFHANKKVKKVI

SEQ ID NO: 2973917 - protein, 18 aa, Entamoeba invadens
VKRVKGVNKLKLLNASYI

SEQ ID NO: 2973918 - protein, 19 aa, Entamoeba invadens
VKRYFSMPKSRRQSRSSKK

SEQ ID NO: 2973919 - protein, 18 aa, Entamoeba invadens
VKSAEGMMKDVEEKWRNG

SEQ ID NO: 2973920 - protein, 18 aa, Entamoeba invadens
VKSAIPFFSAIQNAFLSK

SEQ ID NO: 2973921 - protein, 21 aa, Entamoeba invadens
VKSCNNLRSIALPKNLKKIFV

SEQ ID NO: 2973922 - protein, 24 aa, Entamoeba invadens
VKSDHASIKFPALGFEIPSTAQAS

SEQ ID NO: 2973923 - protein, 24 aa, Entamoeba invadens
VKSDLYSVGVMFFKMVTGRFPKQN

SEQ ID NO: 2973924 - protein, 25 aa, Entamoeba invadens
VKSDLYSVGVMIYKMVTGVFPKMNF

SEQ ID NO: 2973925 - protein, 19 aa, Entamoeba invadens
VKSEFLMLKTQCFKQKIEG

SEQ ID NO: 2973926 - protein, 17 aa, Entamoeba invadens
VKSEPGNRVYVVTFESD

SEQ ID NO: 2973927 - protein, 25 aa, Entamoeba invadens
VKSFAMCCLLNYFLMLRDRHADNYL

SEQ ID NO: 2973928 - protein, 23 aa, Entamoeba invadens
VKSFFPELRFINLENNRISNFNV

SEQ ID NO: 2973929 - protein, 22 aa, Entamoeba invadens
VKSGVALYRYEPRFPRHYIQPH

SEQ ID NO: 2973930 - protein, 22 aa, Entamoeba invadens
VKSIGQGCFDYCGSLSSVTIPS

SEQ ID NO: 2973931 - protein, 26 aa, Entamoeba invadens
VKSIGRCCFCKCISLSSVTIPSSVNS

SEQ ID NO: 2973932 - protein, 26 aa, Entamoeba invadens
VKSIHPMLVLVGKYSLPYIMLHHTGV

SEQ ID NO: 2973933 - protein, 25 aa, Entamoeba invadens
VKSIPDAKMALRIQIVNKMKSYCNG

SEQ ID NO: 2973934 - protein, 17 aa, Entamoeba invadens
VKSISDFCFNQCSNLSS

SEQ ID NO: 2973935 - protein, 18 aa, Entamoeba invadens
VKSKGIVFKDIFVNQKLK

SEQ ID NO: 2973936 - protein, 24 aa, Entamoeba invadens
VKSLRATCKQLWSLIHNLCSTEES

SEQ ID NO: 2973937 - protein, 17 aa, Entamoeba invadens
VKSMGWTSNYMVMVMTV

SEQ ID NO: 2973938 - protein, 19 aa, Entamoeba invadens
VKSMSEYYCDLFNSETIDV

SEQ ID NO: 2973939 - protein, 21 aa, Entamoeba invadens
VKSQIRRYICDILLLDERFGE

SEQ ID NO: 2973940 - protein, 23 aa, Entamoeba invadens
VKSQLPVVESFGFTTDILGQTSG

SEQ ID NO: 2973941 - protein, 17 aa, Entamoeba invadens
VKSQYQLYLGWYDNNPA

SEQ ID NO: 2973942 - protein, 27 aa, Entamoeba invadens
VKSSLFVTKLFKILGFQKEEREHIQLI

SEQ ID NO: 2973943 - protein, 18 aa, Entamoeba invadens
VKSTALKVCKSILDAKLV

SEQ ID NO: 2973944 - protein, 19 aa, Entamoeba invadens
VKSTIPLSVIQNSKNVLFC

SEQ ID NO: 2973945 - protein, 17 aa, Entamoeba invadens
VKSVKRGIAKKGTLIGY

SEQ ID NO: 2973946 - protein, 18 aa, Entamoeba invadens
VKSVLGFVKKSVAGVENV

SEQ ID NO: 2973947 - protein, 23 aa, Entamoeba invadens
VKSYIRVVSKFGLEENLVLYENY

SEQ ID NO: 2973948 - protein, 19 aa, Entamoeba invadens
VKTAERFYTQHNFFGLCAI

SEQ ID NO: 2973949 - protein, 20 aa, Entamoeba invadens
VKTEAGKLCFVEKGNETFKI

SEQ ID NO: 2973950 - protein, 24 aa, Entamoeba invadens
VKTEQAFTFALELLKNVSQLDERL

SEQ ID NO: 2973951 - protein, 23 aa, Entamoeba invadens
VKTESGLNLAQEWNIHFFESSAK

SEQ ID NO: 2973952 - protein, 24 aa, Entamoeba invadens
VKTHRRIINLLKAKYPDEILLQTD

SEQ ID NO: 2973953 - protein, 26 aa, Entamoeba invadens
VKTIPFESRMAMLAYRKEREMREMIE

SEQ ID NO: 2973954 - protein, 20 aa, Entamoeba invadens
VKTKLKVVLHKKIYAKRVID

SEQ ID NO: 2973955 - protein, 25 aa, Entamoeba invadens
VKTLKIKIGEFWGRSTAKNLTKWIT

SEQ ID NO: 2973956 - protein, 24 aa, Entamoeba invadens
VKTLKIKIGEFWRRSTAKNLTKWI

SEQ ID NO: 2973957 - protein, 22 aa, Entamoeba invadens
VKTLNPERWVPMYQRKRANKKN

SEQ ID NO: 2973958 - protein, 17 aa, Entamoeba invadens
VKTLPQRCFAECPNLKV

SEQ ID NO: 2973959 - protein, 18 aa, Entamoeba invadens
VKTLPQRCFAECPNLKVV

SEQ ID NO: 2973960 - protein, 17 aa, Entamoeba invadens
VKTLRILFSSMINTSDN

SEQ ID NO: 2973961 - protein, 28 aa, Entamoeba invadens
VKTLYCHASENLISLQFENGIQLESVIL

SEQ ID NO: 2973962 - protein, 17 aa, Entamoeba invadens
VKTLYCHSSETLISLQF

SEQ ID NO: 2973963 - protein, 23 aa, Entamoeba invadens
VKTNLFMQCCKGIQWLHNGMNIV

SEQ ID NO: 2973964 - protein, 18 aa, Entamoeba invadens
VKTNWKKYLNIMIEHLSL

SEQ ID NO: 2973965 - protein, 19 aa, Entamoeba invadens
VKTPCLINFEVPVWAKGVA

SEQ ID NO: 2973966 - protein, 18 aa, Entamoeba invadens
VKTPLMFINCDGSEYIGN

SEQ ID NO: 2973967 - protein, 26 aa, Entamoeba invadens
VKTRFLSLECVFRWVYNNYDNITIFL

SEQ ID NO: 2973968 - protein, 31 aa, Entamoeba invadens
VKTRNPIVISVGWRRYQTVATFSSEDLNGKQ

SEQ ID NO: 2973969 - protein, 20 aa, Entamoeba invadens
VKTSNFFRVMKRREEFRYML

SEQ ID NO: 2973970 - protein, 19 aa, Entamoeba invadens
VKTTRLVIMILQALKQLKP

SEQ ID NO: 2973971 - protein, 23 aa, Entamoeba invadens
VKTWKISHSPVIGASRPTSGNIV

SEQ ID NO: 2973972 - protein, 19 aa, Entamoeba invadens
VKTYCPLCIPEIDVNVSNE

SEQ ID NO: 2973973 - protein, 24 aa, Entamoeba invadens
VKTYMIASMLLNVIFMNPTSRYVF

SEQ ID NO: 2973974 - protein, 26 aa, Entamoeba invadens
VKVASCALLDSFYRLYFSWRPTAQKY

SEQ ID NO: 2973975 - protein, 17 aa, Entamoeba invadens
VKVCDFGFAVKVTKKKG

SEQ ID NO: 2973976 - protein, 23 aa, Entamoeba invadens
VKVESSEKFFLYGYNNNTENPIY

SEQ ID NO: 2973977 - protein, 17 aa, Entamoeba invadens
VKVGCRVVDRTITRKSE

SEQ ID NO: 2973978 - protein, 20 aa, Entamoeba invadens
VKVHSLLFARNVQEILEEFR

SEQ ID NO: 2973979 - protein, 17 aa, Entamoeba invadens
VKVINCDGVELEWSQKV

SEQ ID NO: 2973980 - protein, 22 aa, Entamoeba invadens
VKVKSRYSSAVSDKVNNIRKAR

SEQ ID NO: 2973981 - protein, 17 aa, Entamoeba invadens
VKVLMVVDLVGFDGKEV

SEQ ID NO: 2973982 - protein, 17 aa, Entamoeba invadens
VKVLPKYFAFIQENPQT

SEQ ID NO: 2973983 - protein, 25 aa, Entamoeba invadens
VKVLSDWLQKSCLSFAVAYQRVLEV

SEQ ID NO: 2973984 - protein, 24 aa, Entamoeba invadens
VKVMKRADFNLEMAQMQFQYGMQL

SEQ ID NO: 2973985 - protein, 20 aa, Entamoeba invadens
VKVMQRKVCDYVMNGEIVKA

SEQ ID NO: 2973986 - protein, 17 aa, Entamoeba invadens
VKVPCLLINGVMNDGFV

SEQ ID NO: 2973987 - protein, 17 aa, Entamoeba invadens
VKVPLHVGWSKMKEEVN

SEQ ID NO: 2973988 - protein, 18 aa, Entamoeba invadens
VKVPLYYLSNINLLNNPI

SEQ ID NO: 2973989 - protein, 32 aa, Entamoeba invadens
VKVQDDVIRVCFVFEKLFLVSKIKTFQGKVLE

SEQ ID NO: 2973990 - protein, 23 aa, Entamoeba invadens
VKVQEGVCKRCMLQPADPKNQTH

SEQ ID NO: 2973991 - protein, 20 aa, Entamoeba invadens
VKVQTAIQFKRHMKAHFTQI

SEQ ID NO: 2973992 - protein, 19 aa, Entamoeba invadens
VKVRRAELFRCFINEQEKL

SEQ ID NO: 2973993 - protein, 20 aa, Entamoeba invadens
VKVVSLMTCQHTHDFKPFKI

SEQ ID NO: 2973994 - protein, 18 aa, Entamoeba invadens
VKVYRLVSKNTYERYMFE

SEQ ID NO: 2973995 - protein, 19 aa, Entamoeba invadens
VKWMNRYSVLVFDLECINT

SEQ ID NO: 2973996 - protein, 30 aa, Entamoeba invadens
VKWNMKDLTQFYAICFSRDSSILSIRSLRQ

SEQ ID NO: 2973997 - protein, 25 aa, Entamoeba invadens
VKWNTDFHILYFWQGRNCPTLDKGA

SEQ ID NO: 2973998 - protein, 17 aa, Entamoeba invadens
VKWSYCDSTKIATFSDV

SEQ ID NO: 2973999 - protein, 24 aa, Entamoeba invadens
VKYAKSLLCSPTLATSGLSMADIN

SEQ ID NO: 2974000 - protein, 19 aa, Entamoeba invadens
VKYANNWIVICGSRQLEGK

SEQ ID NO: 2974001 - protein, 30 aa, Entamoeba invadens
VKYARMVPFSEKGFKEFGVGVIGIIRTLPK

SEQ ID NO: 2974002 - protein, 27 aa, Entamoeba invadens
VKYEMSVLCPQCLVHGLIHLIDMKQLK

SEQ ID NO: 2974003 - protein, 24 aa, Entamoeba invadens
VKYFDERPVFSFRNSVVGMKRVYK

SEQ ID NO: 2974004 - protein, 20 aa, Entamoeba invadens
VKYGTKCFAHCVSLKDVPVI

SEQ ID NO: 2974005 - protein, 18 aa, Entamoeba invadens
VKYHCSFTPIHSIYKNVI

SEQ ID NO: 2974006 - protein, 17 aa, Entamoeba invadens
VKYIECSALTQKNLRLV

SEQ ID NO: 2974007 - protein, 21 aa, Entamoeba invadens
VKYKNMFCTDFLTKIDNEKSK

SEQ ID NO: 2974008 - protein, 26 aa, Entamoeba invadens
VKYLCNRVGFADALVMGATLQFCADT

SEQ ID NO: 2974009 - protein, 27 aa, Entamoeba invadens
VKYLEKRLKAISARYGGKVDDLNNQKK

SEQ ID NO: 2974010 - protein, 19 aa, Entamoeba invadens
VKYLLKVFPGCNEMTLLGT

SEQ ID NO: 2974011 - protein, 20 aa, Entamoeba invadens
VKYMRKCFDGIRPNLTPNER

SEQ ID NO: 2974012 - protein, 18 aa, Entamoeba invadens
VKYPERIHLLRGNHESRM

SEQ ID NO: 2974013 - protein, 18 aa, Entamoeba invadens
VKYPKRINLLRGNHETRQ

SEQ ID NO: 2974014 - protein, 17 aa, Entamoeba invadens
VKYPLWMLVLLESVGKL

SEQ ID NO: 2974015 - protein, 17 aa, Entamoeba invadens
VKYSEVCFEETKQKIIE

SEQ ID NO: 2974016 - protein, 21 aa, Entamoeba invadens
VKYTPLVPGIHKVEVQVNDEQ

SEQ ID NO: 2974017 - protein, 17 aa, Entamoeba invadens
VKYVEQYGYILTRRPTK

SEQ ID NO: 2974018 - protein, 21 aa, Entamoeba invadens
VKYWVEYTWQMNINQSMPIVE

SEQ ID NO: 2974019 - protein, 24 aa, Entamoeba invadens
VKYYSGKPFATFRSPLRKLGDYFV

SEQ ID NO: 2974020 - protein, 20 aa, Entamoeba invadens
VLAAGYDLYSYIDFKISPHS

SEQ ID NO: 2974021 - protein, 17 aa, Entamoeba invadens
VLADFLVSSGLKLQSIV

SEQ ID NO: 2974022 - protein, 22 aa, Entamoeba invadens
VLADRGIVCVDEFDKMSVEDRA

SEQ ID NO: 2974023 - protein, 19 aa, Entamoeba invadens
VLAEKGIDAINMFSGGINF

SEQ ID NO: 2974024 - protein, 25 aa, Entamoeba invadens
VLAFKGLPGLIPVNIKTSIDLFTRS

SEQ ID NO: 2974025 - protein, 19 aa, Entamoeba invadens
VLALREWCDAVNPVLEFRG

SEQ ID NO: 2974026 - protein, 20 aa, Entamoeba invadens
VLANIDYEMCVKIMKEKSMA

SEQ ID NO: 2974027 - protein, 17 aa, Entamoeba invadens
VLAPIAMFARCGLPTPH

SEQ ID NO: 2974028 - protein, 17 aa, Entamoeba invadens
VLATCSISYFTDEYTRW

SEQ ID NO: 2974029 - protein, 19 aa, Entamoeba invadens
VLAWKELRKTPNGKSVIGE

SEQ ID NO: 2974030 - protein, 17 aa, Entamoeba invadens
VLCFSLVDQTSFDEIET

SEQ ID NO: 2974031 - protein, 17 aa, Entamoeba invadens
VLCKLSDYWNIREITGI

SEQ ID NO: 2974032 - protein, 21 aa, Entamoeba invadens
VLCNSKPIILYVLEQLSSLEG

SEQ ID NO: 2974033 - protein, 20 aa, Entamoeba invadens
VLCSAYCPDTSSLIAVGGEF

SEQ ID NO: 2974034 - protein, 24 aa, Entamoeba invadens
VLCSKESKWLFVFGNSKSKEYGDI

SEQ ID NO: 2974035 - protein, 27 aa, Entamoeba invadens
VLDAVLRYCYLWFNFMPLTRGTAACGM

SEQ ID NO: 2974036 - protein, 19 aa, Entamoeba invadens
VLDDSRFVGEVSVTTQSAL

SEQ ID NO: 2974037 - protein, 27 aa, Entamoeba invadens
VLDEAYCIECIPSDFWQKPGDLSDTVK

SEQ ID NO: 2974038 - protein, 21 aa, Entamoeba invadens
VLDFLKELLVSPISLKLKNRP

SEQ ID NO: 2974039 - protein, 25 aa, Entamoeba invadens
VLDGYTCDKCKTSSKASKRYFVKEL

SEQ ID NO: 2974040 - protein, 17 aa, Entamoeba invadens
VLDICGGGDYERSPLVI

SEQ ID NO: 2974041 - protein, 25 aa, Entamoeba invadens
VLDIIKQRFSVDWEKDTAVFLNSFL

SEQ ID NO: 2974042 - protein, 17 aa, Entamoeba invadens
VLDILGFHFNEYLANYL

SEQ ID NO: 2974043 - protein, 20 aa, Entamoeba invadens
VLDILLKIFFSYQHNCTLIR

SEQ ID NO: 2974044 - protein, 22 aa, Entamoeba invadens
VLDIRGCMMIRSYVLNEGMYRY

SEQ ID NO: 2974045 - protein, 18 aa, Entamoeba invadens
VLDKDFSEHIPIALCGNK

SEQ ID NO: 2974046 - protein, 24 aa, Entamoeba invadens
VLDKDFSEHIPIALCGNKCDLESE

SEQ ID NO: 2974047 - protein, 24 aa, Entamoeba invadens
VLDKDFSEHIPIALCGNKCDLESN

SEQ ID NO: 2974048 - protein, 24 aa, Entamoeba invadens
VLDKEYRGVVPVETIKLFLTQIGS

SEQ ID NO: 2974049 - protein, 28 aa, Entamoeba invadens
VLDKRFKVLTERRLDMDAAHDKFESIAK

SEQ ID NO: 2974050 - protein, 23 aa, Entamoeba invadens
VLDLLFEFDNLFVIKTTNGKNGA

SEQ ID NO: 2974051 - protein, 24 aa, Entamoeba invadens
VLDLLFEFDYLFVIKTTHGKNGAN

SEQ ID NO: 2974052 - protein, 24 aa, Entamoeba invadens
VLDLRWFGHCVAIANLEFLTKLVK

SEQ ID NO: 2974053 - protein, 28 aa, Entamoeba invadens
VLDNSLDCLKRFAHLTLIQNIKFSMACP

SEQ ID NO: 2974054 - protein, 35 aa, Entamoeba invadens
VLDSGDFAFRDEIRFNREAIIAIQLIAEDFIIRLF

SEQ ID NO: 2974055 - protein, 18 aa, Entamoeba invadens
VLDSLLFELKGIKIPPSS

SEQ ID NO: 2974056 - protein, 23 aa, Entamoeba invadens
VLDSLREAVNFTTSFLPKITQEE

SEQ ID NO: 2974057 - protein, 23 aa, Entamoeba invadens
VLDSLRKPLFLTFENEDPVGDPI

SEQ ID NO: 2974058 - protein, 25 aa, Entamoeba invadens
VLDTWFSSGLFPFSVMGWPEKTLDV

SEQ ID NO: 2974059 - protein, 27 aa, Entamoeba invadens
VLDVVKFIKKRCDALTAIMCDEGVKIE

SEQ ID NO: 2974060 - protein, 19 aa, Entamoeba invadens
VLDYLPISIQFYLLKDIKN

SEQ ID NO: 2974061 - protein, 20 aa, Entamoeba invadens
VLEAHWAKYGRNYYQRYDFD

SEQ ID NO: 2974062 - protein, 22 aa, Entamoeba invadens
VLEATKLVFSRIAFKIKDGLVI

SEQ ID NO: 2974063 - protein, 20 aa, Entamoeba invadens
VLEATSLVHSCISHSNRIVN

SEQ ID NO: 2974064 - protein, 28 aa, Entamoeba invadens
VLEELIIKYRKIEMEKMRQKVSFLEIIP

SEQ ID NO: 2974065 - protein, 19 aa, Entamoeba invadens
VLEFRGFVHKGILTAVSQY

SEQ ID NO: 2974066 - protein, 18 aa, Entamoeba invadens
VLEIGGKFKNSAMKMDLP

SEQ ID NO: 2974067 - protein, 24 aa, Entamoeba invadens
VLEIKTKRAEIIKVDFHNLSESVV

SEQ ID NO: 2974068 - protein, 19 aa, Entamoeba invadens
VLEISVKYKACYFTRTEAE

SEQ ID NO: 2974069 - protein, 18 aa, Entamoeba invadens
VLEKDFSEHIPIALCGNK

SEQ ID NO: 2974070 - protein, 25 aa, Entamoeba invadens
VLEKGGKVITSFSVGVFEMEYPLKL

SEQ ID NO: 2974071 - protein, 17 aa, Entamoeba invadens
VLEKKARTVKGFFDLIY

SEQ ID NO: 2974072 - protein, 32 aa, Entamoeba invadens
VLEKRVCLICGKILCPGCSVDHFQKCSMGYGI

SEQ ID NO: 2974073 - protein, 21 aa, Entamoeba invadens
VLELIKRWIETSPEDFEKLDE

SEQ ID NO: 2974074 - protein, 24 aa, Entamoeba invadens
VLELPRPLLTPGYEAVIHIHTCQE

SEQ ID NO: 2974075 - protein, 24 aa, Entamoeba invadens
VLEQCKKCSVAIKVNENVQIDNCE

SEQ ID NO: 2974076 - protein, 19 aa, Entamoeba invadens
VLEQLKLINLQSVVQCMVC

SEQ ID NO: 2974077 - protein, 20 aa, Entamoeba invadens
VLERPVPRAHPIEFKRDDTQ

SEQ ID NO: 2974078 - protein, 33 aa, Entamoeba invadens
VLESIVGRDFLPRGCGMVTKRPLILQLVNLPPT

SEQ ID NO: 2974079 - protein, 22 aa, Entamoeba invadens
VLESPPRPNLVDEHREALKKMF

SEQ ID NO: 2974080 - protein, 23 aa, Entamoeba invadens
VLETKRSFLLYSVINTNGVGKME

SEQ ID NO: 2974081 - protein, 23 aa, Entamoeba invadens
VLETLKPICFADFTVTDIDKNEE

SEQ ID NO: 2974082 - protein, 19 aa, Entamoeba invadens
VLEVGDWKLQNDMIEFKNV

SEQ ID NO: 2974083 - protein, 21 aa, Entamoeba invadens
VLFDKRRLQGVVTSYIRSGQI

SEQ ID NO: 2974084 - protein, 17 aa, Entamoeba invadens
VLFDYASDLPKRTPKAL

SEQ ID NO: 2974085 - protein, 17 aa, Entamoeba invadens
VLFECFDMYSNYLELER

SEQ ID NO: 2974086 - protein, 22 aa, Entamoeba invadens
VLFEKYHAICISIFTDEPSHII

SEQ ID NO: 2974087 - protein, 22 aa, Entamoeba invadens
VLFFTPRFKNIQIYGEEENAKL

SEQ ID NO: 2974088 - protein, 23 aa, Entamoeba invadens
VLFGEGVVLKGEITIKNATGKQV

SEQ ID NO: 2974089 - protein, 26 aa, Entamoeba invadens
VLFGRPNPWDGPVFITRKEEKMNEKK

SEQ ID NO: 2974090 - protein, 30 aa, Entamoeba invadens
VLFKNAEQEFAFFLNPPCQKQIFTGPDMAI

SEQ ID NO: 2974091 - protein, 17 aa, Entamoeba invadens
VLFPLRKFIGSTQDGAL

SEQ ID NO: 2974092 - protein, 26 aa, Entamoeba invadens
VLFSPFKLLSLFAAQLAELNAFLVET

SEQ ID NO: 2974093 - protein, 19 aa, Entamoeba invadens
VLFTFIGSEVQKCFNEICT

SEQ ID NO: 2974094 - protein, 22 aa, Entamoeba invadens
VLGCTLCPDGHFIKNKRCTPCD

SEQ ID NO: 2974095 - protein, 17 aa, Entamoeba invadens
VLGHGSFGQVLKCLDMN

SEQ ID NO: 2974096 - protein, 33 aa, Entamoeba invadens
VLGKKWIEISKCLPGKTPHAVHLRYKNHLKNLK

SEQ ID NO: 2974097 - protein, 33 aa, Entamoeba invadens
VLGKQCFSACHFLKEIKLVEGLCEIRECAFEKC

SEQ ID NO: 2974098 - protein, 22 aa, Entamoeba invadens
VLGMFNYAIKFFGQTVHAGTFP

SEQ ID NO: 2974099 - protein, 18 aa, Entamoeba invadens
VLGTCSFNLSKFYECKDY

SEQ ID NO: 2974100 - protein, 24 aa, Entamoeba invadens
VLHEVLCGILLKAIHLRVKKGVEM

SEQ ID NO: 2974101 - protein, 23 aa, Entamoeba invadens
VLHFIYLPILRLMKQSASPYYLI

SEQ ID NO: 2974102 - protein, 23 aa, Entamoeba invadens
VLHFLKVGGLFVYSTCSLNPIED

SEQ ID NO: 2974103 - protein, 19 aa, Entamoeba invadens
VLHIVKKDLSVEILSVMSQ

SEQ ID NO: 2974104 - protein, 18 aa, Entamoeba invadens
VLHLFRLLVHLENYKALL

SEQ ID NO: 2974105 - protein, 25 aa, Entamoeba invadens
VLHLGSNCFLSCGLSQITVLVKEIP

SEQ ID NO: 2974106 - protein, 21 aa, Entamoeba invadens
VLHPHFTPIVLCFLQNAAKIG

SEQ ID NO: 2974107 - protein, 17 aa, Entamoeba invadens
VLHPTSALFNMGVKPNY

SEQ ID NO: 2974108 - protein, 25 aa, Entamoeba invadens
VLHRSPRNSINFNFEKKNEKEKECG

SEQ ID NO: 2974109 - protein, 25 aa, Entamoeba invadens
VLHSLCIGCDYYAFAHIDGNITVIS

SEQ ID NO: 2974110 - protein, 26 aa, Entamoeba invadens
VLICKKFSCVLDRFRYNPIPVTTTKL

SEQ ID NO: 2974111 - protein, 19 aa, Entamoeba invadens
VLIDKEWIAFGHKFKDRCR

SEQ ID NO: 2974112 - protein, 24 aa, Entamoeba invadens
VLIDLCAAPGGWCQVAQKEMPVDQ

SEQ ID NO: 2974113 - protein, 19 aa, Entamoeba invadens
VLIEMACNCWGFDNTTFEN

SEQ ID NO: 2974114 - protein, 26 aa, Entamoeba invadens
VLIFCLKIKFPDRFFLLRGNHEVGNI

SEQ ID NO: 2974115 - protein, 26 aa, Entamoeba invadens
VLIFCLKIKFPDRFFLLRGNHEVQNL

SEQ ID NO: 2974116 - protein, 24 aa, Entamoeba invadens
VLIFMCQVVSLKMCDCVHLTSNND

SEQ ID NO: 2974117 - protein, 18 aa, Entamoeba invadens
VLIIVDCRFGCLQFNTKI

SEQ ID NO: 2974118 - protein, 24 aa, Entamoeba invadens
VLIQGCAFKKCRFLEKFEFEDGVC

SEQ ID NO: 2974119 - protein, 17 aa, Entamoeba invadens
VLISLGLEEALVFNQTF

SEQ ID NO: 2974120 - protein, 22 aa, Entamoeba invadens
VLISLLSRHCIVEISKPNKKSS

SEQ ID NO: 2974121 - protein, 21 aa, Entamoeba invadens
VLKAAVMKYGKNEWARISSLI

SEQ ID NO: 2974122 - protein, 18 aa, Entamoeba invadens
VLKEKKRIVEILKSNEIM

SEQ ID NO: 2974123 - protein, 21 aa, Entamoeba invadens
VLKKDVDTLLSYNIGTIKITE

SEQ ID NO: 2974124 - protein, 27 aa, Entamoeba invadens
VLKKEFFRIIVWFNVDFEIVDRNKSRN

SEQ ID NO: 2974125 - protein, 26 aa, Entamoeba invadens
VLKKEFFRIIVWFNVDFETVDRNNSR

SEQ ID NO: 2974126 - protein, 26 aa, Entamoeba invadens
VLKKEFYRIIVWFNVDFETVDRNKNR

SEQ ID NO: 2974127 - protein, 26 aa, Entamoeba invadens
VLKKELYRIIVWFNVDFETVDRNKSR

SEQ ID NO: 2974128 - protein, 19 aa, Entamoeba invadens
VLKKKPVVNKIEEKLNVDK

SEQ ID NO: 2974129 - protein, 19 aa, Entamoeba invadens
VLKKMCGDVKTGGAQQVEI

SEQ ID NO: 2974130 - protein, 28 aa, Entamoeba invadens
VLKKQKCGECGFAAKLVGDVSGIVLKVY

SEQ ID NO: 2974131 - protein, 25 aa, Entamoeba invadens
VLKLSDISRKGCDFSMTKISKSDLY

SEQ ID NO: 2974132 - protein, 23 aa, Entamoeba invadens
VLKNGKLKPELFVPLIQSLHQFY

SEQ ID NO: 2974133 - protein, 24 aa, Entamoeba invadens
VLKNKAIILWKALMKHFDEVAEIL

SEQ ID NO: 2974134 - protein, 17 aa, Entamoeba invadens
VLKPMMMKLDMPRNKRD

SEQ ID NO: 2974135 - protein, 24 aa, Entamoeba invadens
VLKREFYQIIVWFNVDFETVDRNI

SEQ ID NO: 2974136 - protein, 21 aa, Entamoeba invadens
VLKRFNKIRSFECYIETVERQ

SEQ ID NO: 2974137 - protein, 22 aa, Entamoeba invadens
VLKSFPVEKPQVVIHNEFEDFQ

SEQ ID NO: 2974138 - protein, 18 aa, Entamoeba invadens
VLKSNFFIVRSVSNNSKH

SEQ ID NO: 2974139 - protein, 18 aa, Entamoeba invadens
VLKTRVFELKQANEELLH

SEQ ID NO: 2974140 - protein, 31 aa, Entamoeba invadens
VLKVVKMKALKRVVSGGAYGDYAALIGKRQV

SEQ ID NO: 2974141 - protein, 20 aa, Entamoeba invadens
VLKYHYICSSLFSDEVSHII

SEQ ID NO: 2974142 - protein, 19 aa, Entamoeba invadens
VLLDKRLSAQVQRHCDDLF

SEQ ID NO: 2974143 - protein, 24 aa, Entamoeba invadens
VLLDKRLSAQVQRRCNDLFVTPPQ

SEQ ID NO: 2974144 - protein, 18 aa, Entamoeba invadens
VLLDPSVGGNEKFHDIMA

SEQ ID NO: 2974145 - protein, 25 aa, Entamoeba invadens
VLLEICFGGAVLWTGRSPMVCHVSN

SEQ ID NO: 2974146 - protein, 17 aa, Entamoeba invadens
VLLGAFKVRSLNFFEYK

SEQ ID NO: 2974147 - protein, 23 aa, Entamoeba invadens
VLLIRRGCLLLSDTFNVLNLNCN

SEQ ID NO: 2974148 - protein, 17 aa, Entamoeba invadens
VLLKGETYIGSKRNCVG

SEQ ID NO: 2974149 - protein, 17 aa, Entamoeba invadens
VLLKSVLITGFSPVISL

SEQ ID NO: 2974150 - protein, 29 aa, Entamoeba invadens
VLLLLEVIEPFEWVHLLITHLPSSMKSIT

SEQ ID NO: 2974151 - protein, 18 aa, Entamoeba invadens
VLLPLTPILVNPIRASLA

SEQ ID NO: 2974152 - protein, 21 aa, Entamoeba invadens
VLLRLLENFDGALFVTSNRPL

SEQ ID NO: 2974153 - protein, 19 aa, Entamoeba invadens
VLLSLAVDVTWGFYETIPI

SEQ ID NO: 2974154 - protein, 30 aa, Entamoeba invadens
VLLSVITLLRFKVVISMDFVINTINGNVPK

SEQ ID NO: 2974155 - protein, 17 aa, Entamoeba invadens
VLLTRSVSPMKHLQAAL

SEQ ID NO: 2974156 - protein, 18 aa, Entamoeba invadens
VLLVFDINNMESFKGMNS

SEQ ID NO: 2974157 - protein, 27 aa, Entamoeba invadens
VLMCDYRKICLWTKMTNFEQIGKSEND

SEQ ID NO: 2974158 - protein, 19 aa, Entamoeba invadens
VLMMSEFFTVGSMPSEYES

SEQ ID NO: 2974159 - protein, 18 aa, Entamoeba invadens
VLMNYPFIANFMIQTMFQ

SEQ ID NO: 2974160 - protein, 19 aa, Entamoeba invadens
VLMRMIDMHTVMPLDFKQQ

SEQ ID NO: 2974161 - protein, 24 aa, Entamoeba invadens
VLMSRTTCLYVCYESRPFSVQRIY

SEQ ID NO: 2974162 - protein, 32 aa, Entamoeba invadens
VLMTFKGKLSYQYVMTAMCFKANDINTFKEFL

SEQ ID NO: 2974163 - protein, 27 aa, Entamoeba invadens
VLNEALFNFLQLCVGDVSVLIRYVQEK

SEQ ID NO: 2974164 - protein, 27 aa, Entamoeba invadens
VLNEPFPDFFIVGGFEEMCYSVNFMGK

SEQ ID NO: 2974165 - protein, 22 aa, Entamoeba invadens
VLNETLKGLVYLHSIKIIHHDI

SEQ ID NO: 2974166 - protein, 20 aa, Entamoeba invadens
VLNEVWRISLLPSVADMDHL

SEQ ID NO: 2974167 - protein, 23 aa, Entamoeba invadens
VLNGYSALIGMVFENMKKKNNYF

SEQ ID NO: 2974168 - protein, 33 aa, Entamoeba invadens
VLNHMRRTPVLYPKDRFALVLFGVDAPSEKMPN

SEQ ID NO: 2974169 - protein, 25 aa, Entamoeba invadens
VLNKIRYGTVDEWCLNKLRERIDQE

SEQ ID NO: 2974170 - protein, 21 aa, Entamoeba invadens
VLNLFKRVRNDTVTLVMSGIQ

SEQ ID NO: 2974171 - protein, 18 aa, Entamoeba invadens
VLNNKSFINFDHFTITSS

SEQ ID NO: 2974172 - protein, 20 aa, Entamoeba invadens
VLNPPIFFLQLFKKRKDNVT

SEQ ID NO: 2974173 - protein, 19 aa, Entamoeba invadens
VLNSMGWKGITNSIPDADV

SEQ ID NO: 2974174 - protein, 29 aa, Entamoeba invadens
VLNTKCYICGGAHPVAFCPKKNEINPMDP

SEQ ID NO: 2974175 - protein, 28 aa, Entamoeba invadens
VLNYKGGPCYKCLYPTMPAASLNATAKT

SEQ ID NO: 2974176 - protein, 19 aa, Entamoeba invadens
VLPAFMFFAKLTFGKTKEC

SEQ ID NO: 2974177 - protein, 29 aa, Entamoeba invadens
VLPETFKIIGKFTFKNCFTLESLTFPQSL

SEQ ID NO: 2974178 - protein, 29 aa, Entamoeba invadens
VLPFNLKTIKAYAFYNCKSLVTLNIPKSV

SEQ ID NO: 2974179 - protein, 18 aa, Entamoeba invadens
VLPFYIKIFESELIEARF

SEQ ID NO: 2974180 - protein, 18 aa, Entamoeba invadens
VLPILQLLCYKFPKDMSE

SEQ ID NO: 2974181 - protein, 17 aa, Entamoeba invadens
VLPKFCVSLGLSKCLCD

SEQ ID NO: 2974182 - protein, 17 aa, Entamoeba invadens
VLPKRVAAVDEVVAQQI

SEQ ID NO: 2974183 - protein, 22 aa, Entamoeba invadens
VLPKSCFEGCDHLQKVHLPDGL

SEQ ID NO: 2974184 - protein, 22 aa, Entamoeba invadens
VLPKSIRSGIVVLNKQDFCVVI

SEQ ID NO: 2974185 - protein, 19 aa, Entamoeba invadens
VLPKSLEKINCRDNQITSL

SEQ ID NO: 2974186 - protein, 23 aa, Entamoeba invadens
VLPKSLQYTGNRAFEKCCSLTKV

SEQ ID NO: 2974187 - protein, 25 aa, Entamoeba invadens
VLPNPSSVFGIAWDPLGIIIVAQCT

SEQ ID NO: 2974188 - protein, 18 aa, Entamoeba invadens
VLPNTLVLHLKRFEFDYE

SEQ ID NO: 2974189 - protein, 19 aa, Entamoeba invadens
VLPPEMGQLEGIIQVLDLS

SEQ ID NO: 2974190 - protein, 20 aa, Entamoeba invadens
VLPSGFTNKRCCGGNSGIAI

SEQ ID NO: 2974191 - protein, 21 aa, Entamoeba invadens
VLPTFPAGGANTYLRYISDED

SEQ ID NO: 2974192 - protein, 19 aa, Entamoeba invadens
VLPVIISPRPMEWIYDRNN

SEQ ID NO: 2974193 - protein, 23 aa, Entamoeba invadens
VLPVKRVEMEIVVTIPENYCKVA

SEQ ID NO: 2974194 - protein, 21 aa, Entamoeba invadens
VLPYRIKVDIYLTEGTHQTEE

SEQ ID NO: 2974195 - protein, 23 aa, Entamoeba invadens
VLQKCKDAFRAKDFDNTVRHFIQ

SEQ ID NO: 2974196 - protein, 18 aa, Entamoeba invadens
VLQKITILEIHRLLAERL

SEQ ID NO: 2974197 - protein, 18 aa, Entamoeba invadens
VLQNFAFTQTHPFILNTF

SEQ ID NO: 2974198 - protein, 19 aa, Entamoeba invadens
VLQSGAIVPGEMCLGGSGS

SEQ ID NO: 2974199 - protein, 25 aa, Entamoeba invadens
VLQVAEPWIQKGIHPTIIISGFLDA

SEQ ID NO: 2974200 - protein, 17 aa, Entamoeba invadens
VLRAVGINPVLKGKKTE

SEQ ID NO: 2974201 - protein, 22 aa, Entamoeba invadens
VLRCFYVQFPLNSVNIETLVST

SEQ ID NO: 2974202 - protein, 21 aa, Entamoeba invadens
VLRCGEQILSPIFSETSTRNF

SEQ ID NO: 2974203 - protein, 17 aa, Entamoeba invadens
VLREATRLLNLLMFNAL

SEQ ID NO: 2974204 - protein, 19 aa, Entamoeba invadens
VLRECMKKDIVIYSVGAEP

SEQ ID NO: 2974205 - protein, 20 aa, Entamoeba invadens
VLRELCEFFYSMIKYNRVRE

SEQ ID NO: 2974206 - protein, 24 aa, Entamoeba invadens
VLRELRLFPKIQILQFRNELQMEE

SEQ ID NO: 2974207 - protein, 19 aa, Entamoeba invadens
VLRERSDIRLVITSATIDE

SEQ ID NO: 2974208 - protein, 20 aa, Entamoeba invadens
VLRFACIHNVMLDSISPFKT

SEQ ID NO: 2974209 - protein, 24 aa, Entamoeba invadens
VLRKGEACEFKLFVEVLCTTKVES

SEQ ID NO: 2974210 - protein, 21 aa, Entamoeba invadens
VLRKRVMKKIDDWKYLTSAHI

SEQ ID NO: 2974211 - protein, 24 aa, Entamoeba invadens
VLSFCQRNKIGIQAILMASQERAT

SEQ ID NO: 2974212 - protein, 24 aa, Entamoeba invadens
VLSFCQRYKIGVQAILMASQERAT

SEQ ID NO: 2974213 - protein, 24 aa, Entamoeba invadens
VLSFCRRYKIGVQAIIMASQERAT

SEQ ID NO: 2974214 - protein, 23 aa, Entamoeba invadens
VLSFCRRYKIGVQAILMAAQERA

SEQ ID NO: 2974215 - protein, 19 aa, Entamoeba invadens
VLSGILPKGEALYDMNLSG

SEQ ID NO: 2974216 - protein, 24 aa, Entamoeba invadens
VLSGPIEALVRWLVNPNIDNNIKF

SEQ ID NO: 2974217 - protein, 25 aa, Entamoeba invadens
VLSIGNECFRNCVLLSNLTLPDIKD

SEQ ID NO: 2974218 - protein, 19 aa, Entamoeba invadens
VLSKYPLTSSHSFVLIPHT

SEQ ID NO: 2974219 - protein, 17 aa, Entamoeba invadens
VLSLLNFDVHKIKFIPV

SEQ ID NO: 2974220 - protein, 27 aa, Entamoeba invadens
VLSMGKGCFFNCCFLETISIPSSVTSI

SEQ ID NO: 2974221 - protein, 29 aa, Entamoeba invadens
VLSNGLVKRTRLLGNAFKVPKAMQMLTFP

SEQ ID NO: 2974222 - protein, 31 aa, Entamoeba invadens
VLSPDRRFLCYSEGDSVVFIESGTLSQIEEV

SEQ ID NO: 2974223 - protein, 21 aa, Entamoeba invadens
VLSPLICFLTSLVNLNMEHNL

SEQ ID NO: 2974224 - protein, 18 aa, Entamoeba invadens
VLSQMSLYFMTNMNTAKA

SEQ ID NO: 2974225 - protein, 17 aa, Entamoeba invadens
VLSRYLLYHCECNSSSL

SEQ ID NO: 2974226 - protein, 26 aa, Entamoeba invadens
VLSVEEIDAMLALLIRDFSQVLVGCK

SEQ ID NO: 2974227 - protein, 24 aa, Entamoeba invadens
VLSVGFSHNLLRIALSALQTNSPS

SEQ ID NO: 2974228 - protein, 22 aa, Entamoeba invadens
VLSVLSEMWKKLGPEEKNKYIE

SEQ ID NO: 2974229 - protein, 19 aa, Entamoeba invadens
VLTEQRYDNVWPLTLYNSG

SEQ ID NO: 2974230 - protein, 19 aa, Entamoeba invadens
VLTHFKFLVELDCQNNPGI

SEQ ID NO: 2974231 - protein, 23 aa, Entamoeba invadens
VLTHPWLCGHSVYTNPYFQPLLI

SEQ ID NO: 2974232 - protein, 24 aa, Entamoeba invadens
VLTHPWLCGNSVYTNPLFTSLLEQ

SEQ ID NO: 2974233 - protein, 29 aa, Entamoeba invadens
VLTHYIVYILRCSPFRVGSYLLVKGVSYR

SEQ ID NO: 2974234 - protein, 24 aa, Entamoeba invadens
VLTIKKCQLSVEPFESFNSLEKLV

SEQ ID NO: 2974235 - protein, 18 aa, Entamoeba invadens
VLTKINFALSKLVTSIGT

SEQ ID NO: 2974236 - protein, 30 aa, Entamoeba invadens
VLTKSFDYCFPRFLVLLFPNELTSTFWQRC

SEQ ID NO: 2974237 - protein, 21 aa, Entamoeba invadens
VLTPIPKRFVENADDDQEVKR

SEQ ID NO: 2974238 - protein, 26 aa, Entamoeba invadens
VLVCKKFACILDRFRYNPIPVTSTRL

SEQ ID NO: 2974239 - protein, 19 aa, Entamoeba invadens
VLVDGHGKFHCPLKPFHFY

SEQ ID NO: 2974240 - protein, 21 aa, Entamoeba invadens
VLVDLLLRFVEKVISIGDESR

SEQ ID NO: 2974241 - protein, 17 aa, Entamoeba invadens
VLVDWSQAFVDTDGSFY

SEQ ID NO: 2974242 - protein, 17 aa, Entamoeba invadens
VLVEAVVIILRDEDFHH

SEQ ID NO: 2974243 - protein, 23 aa, Entamoeba invadens
VLVGEQPLELLFVCNGKDMYGCL

SEQ ID NO: 2974244 - protein, 26 aa, Entamoeba invadens
VLVKMGHCVLCDFGLAIRDQEPYDHT

SEQ ID NO: 2974245 - protein, 23 aa, Entamoeba invadens
VLVKPRICINPESYDTQDDTDSL

SEQ ID NO: 2974246 - protein, 24 aa, Entamoeba invadens
VLVKRRFAPKMKDVLETEDSISHT

SEQ ID NO: 2974247 - protein, 18 aa, Entamoeba invadens
VLVLCPISTFTLKITSMI

SEQ ID NO: 2974248 - protein, 18 aa, Entamoeba invadens
VLVLNKFGILTGISNILS

SEQ ID NO: 2974249 - protein, 19 aa, Entamoeba invadens
VLVSSVVMCLLKKSFQSEI

SEQ ID NO: 2974250 - protein, 26 aa, Entamoeba invadens
VLVTLKTGETFGCYQKCPMSFEQKFS

SEQ ID NO: 2974251 - protein, 19 aa, Entamoeba invadens
VLVVEAFNEFKKCKDLVDV

SEQ ID NO: 2974252 - protein, 19 aa, Entamoeba invadens
VLVVPLIPPEWFHDYINMP

SEQ ID NO: 2974253 - protein, 19 aa, Entamoeba invadens
VLWDVGRQAQNYDLIFRNT

SEQ ID NO: 2974254 - protein, 17 aa, Entamoeba invadens
VLWVFNFDASILASIPI

SEQ ID NO: 2974255 - protein, 19 aa, Entamoeba invadens
VLYCLCLIIQSLPRVCISE

SEQ ID NO: 2974256 - protein, 22 aa, Entamoeba invadens
VLYDRDHYKLALAQLSVAKKLV

SEQ ID NO: 2974257 - protein, 23 aa, Entamoeba invadens
VLYECPKIKRGLPLTKKKDGKTL

SEQ ID NO: 2974258 - protein, 17 aa, Entamoeba invadens
VLYELYATIPFDTTIYT

SEQ ID NO: 2974259 - protein, 18 aa, Entamoeba invadens
VLYLIAINYLKLLKPDLM

SEQ ID NO: 2974260 - protein, 17 aa, Entamoeba invadens
VLYMIVVDCAENHLKLS

SEQ ID NO: 2974261 - protein, 20 aa, Entamoeba invadens
VLYNAGILLFRVASSQASAQ

SEQ ID NO: 2974262 - protein, 26 aa, Entamoeba invadens
VLYTFDSIIIWKWSCEDLDLSDLNCM

SEQ ID NO: 2974263 - protein, 20 aa, Entamoeba invadens
VMALRYGKDILMSGTPETYN

SEQ ID NO: 2974264 - protein, 19 aa, Entamoeba invadens
VMASLKCNYKIVVDEKPDI

SEQ ID NO: 2974265 - protein, 21 aa, Entamoeba invadens
VMCGCATLIEFSKNHVKYNDP

SEQ ID NO: 2974266 - protein, 18 aa, Entamoeba invadens
VMCLKCFNIDMTEGTLNY

SEQ ID NO: 2974267 - protein, 17 aa, Entamoeba invadens
VMCLLKKSFQSEITIEK

SEQ ID NO: 2974268 - protein, 20 aa, Entamoeba invadens
VMDCVRVRRLFDAHTRVDNR

SEQ ID NO: 2974269 - protein, 23 aa, Entamoeba invadens
VMDEIWESGAFELFVNILESTFS

SEQ ID NO: 2974270 - protein, 17 aa, Entamoeba invadens
VMDLKLFECENFKMQSV

SEQ ID NO: 2974271 - protein, 26 aa, Entamoeba invadens
VMDLSLKRIKSFPVNFTPVKMESSGK

SEQ ID NO: 2974272 - protein, 19 aa, Entamoeba invadens
VMEEMSIEDSCIITFNEEC

SEQ ID NO: 2974273 - protein, 21 aa, Entamoeba invadens
VMEILKSVYIVPIDINNIMAV

SEQ ID NO: 2974274 - protein, 19 aa, Entamoeba invadens
VMEKCLKVTGFGASKLTKV

SEQ ID NO: 2974275 - protein, 21 aa, Entamoeba invadens
VMEKDFFGRKVLINAKVTDYR

SEQ ID NO: 2974276 - protein, 22 aa, Entamoeba invadens
VMELCPGGSLAEHIAIAPFSIP

SEQ ID NO: 2974277 - protein, 25 aa, Entamoeba invadens
VMENYCFRDCLALKEFSIPNGVTKV

SEQ ID NO: 2974278 - protein, 25 aa, Entamoeba invadens
VMEPPKKWMYFFLFNDRLVETIPEL

SEQ ID NO: 2974279 - protein, 23 aa, Entamoeba invadens
VMEPVMFYDILLSLEMLKNAFST

SEQ ID NO: 2974280 - protein, 24 aa, Entamoeba invadens
VMEPVMFYDILTSLEILKNAFNTF

SEQ ID NO: 2974281 - protein, 17 aa, Entamoeba invadens
VMERELRNYSAMTVGDV

SEQ ID NO: 2974282 - protein, 24 aa, Entamoeba invadens
VMEVECSCCHKKYHKACYDGSLCE

SEQ ID NO: 2974283 - protein, 22 aa, Entamoeba invadens
VMEYCSFESLDVYWKKNPSLRQ

SEQ ID NO: 2974284 - protein, 19 aa, Entamoeba invadens
VMFKHVFEKKSRGFMEALY

SEQ ID NO: 2974285 - protein, 21 aa, Entamoeba invadens
VMFKPYPIYLLDAEKAPRNNC

SEQ ID NO: 2974286 - protein, 20 aa, Entamoeba invadens
VMFMDVCNCFSAYRLMIEYN

SEQ ID NO: 2974287 - protein, 24 aa, Entamoeba invadens
VMGKKAFYEIIVWFDVDYETVDRN

SEQ ID NO: 2974288 - protein, 19 aa, Entamoeba invadens
VMGKRCFLGCTALSSISVP

SEQ ID NO: 2974289 - protein, 19 aa, Entamoeba invadens
VMGLFSSKSLIWVKSNDHT

SEQ ID NO: 2974290 - protein, 21 aa, Entamoeba invadens
VMGNIPKFELVLTLINRDDES

SEQ ID NO: 2974291 - protein, 20 aa, Entamoeba invadens
VMHSDWWFPFYSKDEAAAQL

SEQ ID NO: 2974292 - protein, 24 aa, Entamoeba invadens
VMHSYSGVCNVVYVKVDSDFLYCG

SEQ ID NO: 2974293 - protein, 18 aa, Entamoeba invadens
VMILKIQIRRSYYELFSL

SEQ ID NO: 2974294 - protein, 18 aa, Entamoeba invadens
VMIRCMRNDITTLTNTMH

SEQ ID NO: 2974295 - protein, 23 aa, Entamoeba invadens
VMIRRLKIDVLKELGKKERERVY

SEQ ID NO: 2974296 - protein, 18 aa, Entamoeba invadens
VMKEIKMFDDAVLMCDYR

SEQ ID NO: 2974297 - protein, 22 aa, Entamoeba invadens
VMKESIIMRFGCYKVLKPNLKD

SEQ ID NO: 2974298 - protein, 19 aa, Entamoeba invadens
VMKEYKLGPNGAIVTSLNL

SEQ ID NO: 2974299 - protein, 24 aa, Entamoeba invadens
VMKFSESVFKVFLDRSDDEEEVIR

SEQ ID NO: 2974300 - protein, 21 aa, Entamoeba invadens
VMKKCMCSRLDISPLSNSKEI

SEQ ID NO: 2974301 - protein, 19 aa, Entamoeba invadens
VMKNLSGTFEHFYKKRFES

SEQ ID NO: 2974302 - protein, 24 aa, Entamoeba invadens
VMKQRGMDGLLVWVNAMLEGSGIQ

SEQ ID NO: 2974303 - protein, 18 aa, Entamoeba invadens
VMKQRSFDEFDMETRRKY

SEQ ID NO: 2974304 - protein, 23 aa, Entamoeba invadens
VMKSESPTLFSYVKQALQEGQLD

SEQ ID NO: 2974305 - protein, 25 aa, Entamoeba invadens
VMKTYKIGVLYGRQGQQSEDEMYRN

SEQ ID NO: 2974306 - protein, 30 aa, Entamoeba invadens
VMKVHKTEGFFPYRIPPRTIYGGQNIDDAL

SEQ ID NO: 2974307 - protein, 19 aa, Entamoeba invadens
VMLDKFRNAYVVHFNGAVF

SEQ ID NO: 2974308 - protein, 18 aa, Entamoeba invadens
VMLEQGIQIFNKEYIEGI

SEQ ID NO: 2974309 - protein, 33 aa, Entamoeba invadens
VMLKKKFACEFSIYLKPKCTCRINNTICIVSKN

SEQ ID NO: 2974310 - protein, 17 aa, Entamoeba invadens
VMLLNGFSHPCFGNKEA

SEQ ID NO: 2974311 - protein, 17 aa, Entamoeba invadens
VMLPSGEACELEILLTL

SEQ ID NO: 2974312 - protein, 25 aa, Entamoeba invadens
VMLQRYRNYVGYSWVADKEEMVFSN

SEQ ID NO: 2974313 - protein, 17 aa, Entamoeba invadens
VMLRPLVILVRYLLHQG

SEQ ID NO: 2974314 - protein, 17 aa, Entamoeba invadens
VMLSDYFEMQKLLLDHF

SEQ ID NO: 2974315 - protein, 31 aa, Entamoeba invadens
VMLTRCQEGFGVKATPYWGYAYQNGQAVFGK

SEQ ID NO: 2974316 - protein, 18 aa, Entamoeba invadens
VMMFNDLNVPFLKIVNPA

SEQ ID NO: 2974317 - protein, 28 aa, Entamoeba invadens
VMMRVVRGRKCVGLPLLFRQYKKETTAD

SEQ ID NO: 2974318 - protein, 18 aa, Entamoeba invadens
VMMWTNMKAGLYGLTVTD

SEQ ID NO: 2974319 - protein, 23 aa, Entamoeba invadens
VMNAEFLLSTTFEKLREVTINVA

SEQ ID NO: 2974320 - protein, 24 aa, Entamoeba invadens
VMNEVMEEIRLLKKLKHKHIVRYI

SEQ ID NO: 2974321 - protein, 24 aa, Entamoeba invadens
VMNFPFMMGQGVWYGSKELKESDT

SEQ ID NO: 2974322 - protein, 25 aa, Entamoeba invadens
VMNKMCTVLIPILKIGRINPQYEEV

SEQ ID NO: 2974323 - protein, 18 aa, Entamoeba invadens
VMNNFAIENNDIVENNDI

SEQ ID NO: 2974324 - protein, 24 aa, Entamoeba invadens
VMNVKAACWMKEMLDAKNIEINEF

SEQ ID NO: 2974325 - protein, 26 aa, Entamoeba invadens
VMPCLKCSRTKIGIYTLNPLDKKSRI

SEQ ID NO: 2974326 - protein, 17 aa, Entamoeba invadens
VMQRMVVGYVMNNEAVS

SEQ ID NO: 2974327 - protein, 26 aa, Entamoeba invadens
VMQTPECLRVYVSSFWDQPLKDSMFV

SEQ ID NO: 2974328 - protein, 25 aa, Entamoeba invadens
VMQWAVKISDTFFYSIRSWTVKEGD

SEQ ID NO: 2974329 - protein, 23 aa, Entamoeba invadens
VMRHPPLLILNGFNKGGEEMKTV

SEQ ID NO: 2974330 - protein, 19 aa, Entamoeba invadens
VMRIVELLLSKGADRLVKN

SEQ ID NO: 2974331 - protein, 26 aa, Entamoeba invadens
VMRPFWRCNFPKTNVVIFVVDSCDKE

SEQ ID NO: 2974332 - protein, 17 aa, Entamoeba invadens
VMRQCLWGVTNIIIADD

SEQ ID NO: 2974333 - protein, 24 aa, Entamoeba invadens
VMRSGYVMCCLIKLSKASHQSDSN

SEQ ID NO: 2974334 - protein, 18 aa, Entamoeba invadens
VMRSLKVMFKKFKDEDTK

SEQ ID NO: 2974335 - protein, 18 aa, Entamoeba invadens
VMSDEMWMKKREQIKPHI

SEQ ID NO: 2974336 - protein, 18 aa, Entamoeba invadens
VMSEVAFENMNVSDLFIK

SEQ ID NO: 2974337 - protein, 24 aa, Entamoeba invadens
VMSEVTVDIMLKIASALTKSNKSS

SEQ ID NO: 2974338 - protein, 18 aa, Entamoeba invadens
VMSKRRGKIISEEQRPGT

SEQ ID NO: 2974339 - protein, 18 aa, Entamoeba invadens
VMSPLDFFGSGNMAMRED

SEQ ID NO: 2974340 - protein, 24 aa, Entamoeba invadens
VMSPNVYPSIDFVGLDVEKMTRTV

SEQ ID NO: 2974341 - protein, 23 aa, Entamoeba invadens
VMTKICGVRVALRRNEKCKRIVF

SEQ ID NO: 2974342 - protein, 18 aa, Entamoeba invadens
VMTKVLMNVASFLLADKE

SEQ ID NO: 2974343 - protein, 21 aa, Entamoeba invadens
VMTKWIKDVRITDPITERNNE

SEQ ID NO: 2974344 - protein, 17 aa, Entamoeba invadens
VMTNALFSLSNFALKNL

SEQ ID NO: 2974345 - protein, 17 aa, Entamoeba invadens
VMVGKCVDNPDLVIRSI

SEQ ID NO: 2974346 - protein, 26 aa, Entamoeba invadens
VMVHCGSRGLGHQVCQDFVDTFLSKN

SEQ ID NO: 2974347 - protein, 25 aa, Entamoeba invadens
VMWIESCTLISLKGYTKTELERVTI

SEQ ID NO: 2974348 - protein, 17 aa, Entamoeba invadens
VMYELFYEKIPFFDHTH

SEQ ID NO: 2974349 - protein, 22 aa, Entamoeba invadens
VMYLLYYFCFSLKDKFSDFIGN

SEQ ID NO: 2974350 - protein, 18 aa, Entamoeba invadens
VMYNKYVEKGIVFPPPIV

SEQ ID NO: 2974351 - protein, 19 aa, Entamoeba invadens
VMYWALRVTGVLLCSTADE

SEQ ID NO: 2974352 - protein, 29 aa, Entamoeba invadens
VNAHDSVVLQLCFTLKVIVEYWQNDYDIT

SEQ ID NO: 2974353 - protein, 18 aa, Entamoeba invadens
VNAISGIISFAGYQLDRP

SEQ ID NO: 2974354 - protein, 19 aa, Entamoeba invadens
VNALGYNYHPQCFVANVNC

SEQ ID NO: 2974355 - protein, 17 aa, Entamoeba invadens
VNALHTFFNSMKKVPVV

SEQ ID NO: 2974356 - protein, 27 aa, Entamoeba invadens
VNAQLLLANCYFKGEGVARDMAQAVNL

SEQ ID NO: 2974357 - protein, 19 aa, Entamoeba invadens
VNAVCWSPHCSTHLCSASS

SEQ ID NO: 2974358 - protein, 21 aa, Entamoeba invadens
VNAYGECDYLARYVESRIQRF

SEQ ID NO: 2974359 - protein, 17 aa, Entamoeba invadens
VNCCPTLNELAMSVLGD

SEQ ID NO: 2974360 - protein, 19 aa, Entamoeba invadens
VNCFDFFNNILLIYSSVSD

SEQ ID NO: 2974361 - protein, 19 aa, Entamoeba invadens
VNCKLKLSNEFNWFDMFNS

SEQ ID NO: 2974362 - protein, 26 aa, Entamoeba invadens
VNCSSELKATILSILVALDRGLEHPK

SEQ ID NO: 2974363 - protein, 17 aa, Entamoeba invadens
VNCTRNFPEKNIVFSVI

SEQ ID NO: 2974364 - protein, 17 aa, Entamoeba invadens
VNDEYCGVVQYFINSLS

SEQ ID NO: 2974365 - protein, 21 aa, Entamoeba invadens
VNDKSRVGAELEYQDVKMKFE

SEQ ID NO: 2974366 - protein, 20 aa, Entamoeba invadens
VNDKVLIRIGENVFISKSEV

SEQ ID NO: 2974367 - protein, 18 aa, Entamoeba invadens
VNDLKILNSFNVFMSFEM

SEQ ID NO: 2974368 - protein, 20 aa, Entamoeba invadens
VNDLLVVYCGLNVMKVISEK

SEQ ID NO: 2974369 - protein, 18 aa, Entamoeba invadens
VNDRSAQDDICWSTDSTH

SEQ ID NO: 2974370 - protein, 19 aa, Entamoeba invadens
VNDVCWSKANPEWIGAAMS

SEQ ID NO: 2974371 - protein, 20 aa, Entamoeba invadens
VNDVKESFDLSRIHNNEINT

SEQ ID NO: 2974372 - protein, 19 aa, Entamoeba invadens
VNDVSWSNVNLEWICTCIE

SEQ ID NO: 2974373 - protein, 24 aa, Entamoeba invadens
VNDWFTCWRKHCVETQKRELPVKE

SEQ ID NO: 2974374 - protein, 22 aa, Entamoeba invadens
VNEATKLPAMQKVVNDFEKQNN

SEQ ID NO: 2974375 - protein, 18 aa, Entamoeba invadens
VNECFDLTKLCFEGTGEV

SEQ ID NO: 2974376 - protein, 21 aa, Entamoeba invadens
VNEFLKKRCIEQKNDDVVHGV

SEQ ID NO: 2974377 - protein, 18 aa, Entamoeba invadens
VNEFLQQWVESVSEQSLE

SEQ ID NO: 2974378 - protein, 24 aa, Entamoeba invadens
VNEGDRWWSYPLFKFYLDDLDITQ

SEQ ID NO: 2974379 - protein, 29 aa, Entamoeba invadens
VNELKDRTIIYLCMDGTFSSCPSDYAQLY

SEQ ID NO: 2974380 - protein, 20 aa, Entamoeba invadens
VNELKIWRETVLDGLGGFAE

SEQ ID NO: 2974381 - protein, 26 aa, Entamoeba invadens
VNELKMAGLEMCVSHFLVYSSASTGL

SEQ ID NO: 2974382 - protein, 21 aa, Entamoeba invadens
VNELKSALVGGVVDVSIDART

SEQ ID NO: 2974383 - protein, 34 aa, Entamoeba invadens
VNEMIKTRCVLQFYIPSFRKLGFGGIKKRITIFM

SEQ ID NO: 2974384 - protein, 18 aa, Entamoeba invadens
VNEMKYAMVWGTSVEHSP

SEQ ID NO: 2974385 - protein, 21 aa, Entamoeba invadens
VNERLLHQMLWFGDYSYYSHR

SEQ ID NO: 2974386 - protein, 20 aa, Entamoeba invadens
VNETKIVFPTTITKLEECTT

SEQ ID NO: 2974387 - protein, 23 aa, Entamoeba invadens
VNETKYIYPYSFLHVFEDENDLK

SEQ ID NO: 2974388 - protein, 17 aa, Entamoeba invadens
VNFAHMFAGLTSVKRID

SEQ ID NO: 2974389 - protein, 25 aa, Entamoeba invadens
VNFAKCRKLSGIVIDVHRMKQVSYK

SEQ ID NO: 2974390 - protein, 19 aa, Entamoeba invadens
VNFDWTVLETIDFICTRFD

SEQ ID NO: 2974391 - protein, 18 aa, Entamoeba invadens
VNFFMKFFEDHKCEGSEN

SEQ ID NO: 2974392 - protein, 18 aa, Entamoeba invadens
VNFFRVVIWYEVDYKTSV

SEQ ID NO: 2974393 - protein, 19 aa, Entamoeba invadens
VNFKCFITGSLYYGVNLLA

SEQ ID NO: 2974394 - protein, 26 aa, Entamoeba invadens
VNFKVKVVDCFDCKRFESLIEKTYAP

SEQ ID NO: 2974395 - protein, 27 aa, Entamoeba invadens
VNFKYNRNPKMRVARLENTEQALKFII

SEQ ID NO: 2974396 - protein, 17 aa, Entamoeba invadens
VNFPCFEQLKQENIKFA

SEQ ID NO: 2974397 - protein, 17 aa, Entamoeba invadens
VNFSDVCYEQFKKLQQL

SEQ ID NO: 2974398 - protein, 21 aa, Entamoeba invadens
VNFVFKITVNFEFEAKCLGNI

SEQ ID NO: 2974399 - protein, 25 aa, Entamoeba invadens
VNFVNDCSLNFDFTATFSVNLPPFC

SEQ ID NO: 2974400 - protein, 18 aa, Entamoeba invadens
VNFVVNFSIPVSYPTKCF

SEQ ID NO: 2974401 - protein, 17 aa, Entamoeba invadens
VNGAMKEDVIKRGFSSL

SEQ ID NO: 2974402 - protein, 23 aa, Entamoeba invadens
VNGECVMPIGILLTNMKEAIVCL

SEQ ID NO: 2974403 - protein, 17 aa, Entamoeba invadens
VNGFFGFERSLYEGISM

SEQ ID NO: 2974404 - protein, 19 aa, Entamoeba invadens
VNGGDGWGGLGNEIDIVGK

SEQ ID NO: 2974405 - protein, 28 aa, Entamoeba invadens
VNGGGEIKFLLGLLFQVFMMFHKSDLLA

SEQ ID NO: 2974406 - protein, 20 aa, Entamoeba invadens
VNGGPGAICRTFLNKDSLEK

SEQ ID NO: 2974407 - protein, 20 aa, Entamoeba invadens
VNGIEVFQLLLALKIRYPKR

SEQ ID NO: 2974408 - protein, 17 aa, Entamoeba invadens
VNGKFDYTKCVFSTCQS

SEQ ID NO: 2974409 - protein, 25 aa, Entamoeba invadens
VNGKTLLYHVCAKGYANVVEMLLTK

SEQ ID NO: 2974410 - protein, 17 aa, Entamoeba invadens
VNGLVVDIGDVFTRVLP

SEQ ID NO: 2974411 - protein, 24 aa, Entamoeba invadens
VNGPMTWPGALSIEDEWGKTYLLP

SEQ ID NO: 2974412 - protein, 24 aa, Entamoeba invadens
VNGTCVICKAPLFDGQSVTVLPCG

SEQ ID NO: 2974413 - protein, 25 aa, Entamoeba invadens
VNGTLRFLLKEIINSEGLEQFVNEN

SEQ ID NO: 2974414 - protein, 20 aa, Entamoeba invadens
VNGTLRINRVIANYRSIGDK

SEQ ID NO: 2974415 - protein, 25 aa, Entamoeba invadens
VNHCSVLNCTFRHGGKRGVYIYGTV

SEQ ID NO: 2974416 - protein, 21 aa, Entamoeba invadens
VNHEVRFGGYVLKDELTGRKR

SEQ ID NO: 2974417 - protein, 32 aa, Entamoeba invadens
VNHKACESISCLKVNPWFTAKEDIEKFCSIHT

SEQ ID NO: 2974418 - protein, 21 aa, Entamoeba invadens
VNHLLAFPPVFTIFLSITIDQ

SEQ ID NO: 2974419 - protein, 17 aa, Entamoeba invadens
VNHLQQFDCEIGDIRSV

SEQ ID NO: 2974420 - protein, 26 aa, Entamoeba invadens
VNHNVNWWNSLWVHLGHYSATSLIIF

SEQ ID NO: 2974421 - protein, 17 aa, Entamoeba invadens
VNHSYWYAYFEASTQGY

SEQ ID NO: 2974422 - protein, 17 aa, Entamoeba invadens
VNIDVPSLITIVNGLRS

SEQ ID NO: 2974423 - protein, 23 aa, Entamoeba invadens
VNIFCPNPFFIRSIDKDGKDTTK

SEQ ID NO: 2974424 - protein, 23 aa, Entamoeba invadens
VNIFSLKWRDAVFTFSVSSIAIL

SEQ ID NO: 2974425 - protein, 17 aa, Entamoeba invadens
VNIGLGLGIESFNLDIY

SEQ ID NO: 2974426 - protein, 26 aa, Entamoeba invadens
VNIKCLRSVYHNVFPQAIPQKMDVGM

SEQ ID NO: 2974427 - protein, 27 aa, Entamoeba invadens
VNITIKNNFIWGCSNGVSYWGSNSVAY

SEQ ID NO: 2974428 - protein, 20 aa, Entamoeba invadens
VNITPHFLISLFSLSKMVRD

SEQ ID NO: 2974429 - protein, 19 aa, Entamoeba invadens
VNKCGHRFCKSCICDSIKE

SEQ ID NO: 2974430 - protein, 27 aa, Entamoeba invadens
VNKCGHRFCKSCIRDSIKEQKTNTRRK

SEQ ID NO: 2974431 - protein, 26 aa, Entamoeba invadens
VNKCGHRFCKSCIRDSIKEQKTNTWR

SEQ ID NO: 2974432 - protein, 24 aa, Entamoeba invadens
VNKEGKWEFFFLFQVIESKSDITK

SEQ ID NO: 2974433 - protein, 18 aa, Entamoeba invadens
VNKKAQDAIRCLKINPRS

SEQ ID NO: 2974434 - protein, 26 aa, Entamoeba invadens
VNKKCDSCLGGLYINPFIDVSVQSFS

SEQ ID NO: 2974435 - protein, 26 aa, Entamoeba invadens
VNKKCFECFQSLFINPLINLEIETFA

SEQ ID NO: 2974436 - protein, 24 aa, Entamoeba invadens
VNKKCKDALEILHINPGFANKLSL

SEQ ID NO: 2974437 - protein, 30 aa, Entamoeba invadens
VNKKCLEATEMLRFFPKMSLKTLQNKNEIV

SEQ ID NO: 2974438 - protein, 22 aa, Entamoeba invadens
VNKKCRIIKGFLKNLEGGDKTK

SEQ ID NO: 2974439 - protein, 25 aa, Entamoeba invadens
VNKKCSSCLNGLYINPFIDVAVQCF

SEQ ID NO: 2974440 - protein, 23 aa, Entamoeba invadens
VNKKIEDCRMVFIGAGSSNTTCL

SEQ ID NO: 2974441 - protein, 25 aa, Entamoeba invadens
VNKKRFYKIVIWYQVDFDTFHNVAK

SEQ ID NO: 2974442 - protein, 24 aa, Entamoeba invadens
VNKLYQAFCFKEVVTVDFVDSIGE

SEQ ID NO: 2974443 - protein, 19 aa, Entamoeba invadens
VNKRAHEAIRCLKVNPRSI

SEQ ID NO: 2974444 - protein, 22 aa, Entamoeba invadens
VNKSIQCLVGIEGEALYLVKAT

SEQ ID NO: 2974445 - protein, 18 aa, Entamoeba invadens
VNKTCCKIDSCDSEEVLV

SEQ ID NO: 2974446 - protein, 25 aa, Entamoeba invadens
VNKTVKFCRFEKGWFGNMKCLYNHN

SEQ ID NO: 2974447 - protein, 27 aa, Entamoeba invadens
VNLEIKRNSSYVFVKILSPISNFKISP

SEQ ID NO: 2974448 - protein, 17 aa, Entamoeba invadens
VNLFKMYMRGVTDALLN

SEQ ID NO: 2974449 - protein, 17 aa, Entamoeba invadens
VNLGNILTLTKLVLRMN

SEQ ID NO: 2974450 - protein, 23 aa, Entamoeba invadens
VNLGRVKRMFVSLKEASRLLHEA

SEQ ID NO: 2974451 - protein, 22 aa, Entamoeba invadens
VNLHKWAPYIKSGEGFGTEDEK

SEQ ID NO: 2974452 - protein, 42 aa, Entamoeba invadens
VNLKGMLDYCLNNCYWNCPICEKPCYFSMITIDQHLKTLIQL

SEQ ID NO: 2974453 - protein, 17 aa, Entamoeba invadens
VNLKRFQYLSGTFGKFY

SEQ ID NO: 2974454 - protein, 23 aa, Entamoeba invadens
VNLKTLQIFKVITKYIPSNGNHP

SEQ ID NO: 2974455 - protein, 20 aa, Entamoeba invadens
VNLLPRKILFFEANTSAVFL

SEQ ID NO: 2974456 - protein, 17 aa, Entamoeba invadens
VNLPFVTRVDKKCFANC

SEQ ID NO: 2974457 - protein, 17 aa, Entamoeba invadens
VNLPSGKSMICQHIDNM

SEQ ID NO: 2974458 - protein, 20 aa, Entamoeba invadens
VNLRPVFQIQGIWLSLQNLI

SEQ ID NO: 2974459 - protein, 17 aa, Entamoeba invadens
VNLSEFYCGVDIDDDVE

SEQ ID NO: 2974460 - protein, 22 aa, Entamoeba invadens
VNLYFRCEGLNLLTFTSEAQVT

SEQ ID NO: 2974461 - protein, 30 aa, Entamoeba invadens
VNMEHLKYLTLRLCRGVTFSSEMKCLKQIV

SEQ ID NO: 2974462 - protein, 20 aa, Entamoeba invadens
VNMNQQWKALVFLYVKEDQV

SEQ ID NO: 2974463 - protein, 23 aa, Entamoeba invadens
VNNEIPSPIPLASVDLHESKDED

SEQ ID NO: 2974464 - protein, 22 aa, Entamoeba invadens
VNNLCSVPSWVNYSQIDKGNLL

SEQ ID NO: 2974465 - protein, 35 aa, Entamoeba invadens
VNNLSMTLLWVFFLRQACLKNWPNSPLNIFERDGF

SEQ ID NO: 2974466 - protein, 21 aa, Entamoeba invadens
VNNLVKMYSFETIEVNQNSSA

SEQ ID NO: 2974467 - protein, 17 aa, Entamoeba invadens
VNPAVSVSNVFSSSPLH

SEQ ID NO: 2974468 - protein, 17 aa, Entamoeba invadens
VNPEFYEETSFMWFVSK

SEQ ID NO: 2974469 - protein, 25 aa, Entamoeba invadens
VNPFFTNEVSVVWFFKNFTPETFDS

SEQ ID NO: 2974470 - protein, 18 aa, Entamoeba invadens
VNPFPPFMTSAYFKHEPA

SEQ ID NO: 2974471 - protein, 20 aa, Entamoeba invadens
VNPIICFYGGEPLLRPDIIY

SEQ ID NO: 2974472 - protein, 24 aa, Entamoeba invadens
VNPILDARVPFRVETGRYLDDENV

SEQ ID NO: 2974473 - protein, 23 aa, Entamoeba invadens
VNPKELFSAFNVMLSGNVSLLES

SEQ ID NO: 2974474 - protein, 25 aa, Entamoeba invadens
VNPKGLRVVNKYFPTIFASSNTGLT

SEQ ID NO: 2974475 - protein, 19 aa, Entamoeba invadens
VNPLPVLKCTVRAEIGNAT

SEQ ID NO: 2974476 - protein, 29 aa, Entamoeba invadens
VNPMKRPTVRECLLFPFFSGKKRERGDFY

SEQ ID NO: 2974477 - protein, 30 aa, Entamoeba invadens
VNPQIRLPRTYKRFDGLMVQLLHKLSIHAS

SEQ ID NO: 2974478 - protein, 21 aa, Entamoeba invadens
VNPRSIYLGYNFLFNFFPHLN

SEQ ID NO: 2974479 - protein, 23 aa, Entamoeba invadens
VNPSGRLPLSFPENLANIPSHSF

SEQ ID NO: 2974480 - protein, 23 aa, Entamoeba invadens
VNPSGRLPMTFVKDLKSVSGYSF

SEQ ID NO: 2974481 - protein, 24 aa, Entamoeba invadens
VNPSLKFYACDIAQSAVEVVKKDE

SEQ ID NO: 2974482 - protein, 26 aa, Entamoeba invadens
VNPSSFKCVYSFREIRNYQSEQECVL

SEQ ID NO: 2974483 - protein, 17 aa, Entamoeba invadens
VNPWLTSTLDVEKFYDF

SEQ ID NO: 2974484 - protein, 25 aa, Entamoeba invadens
VNQEYLHVISVRFLQNCIGSCSEQN

SEQ ID NO: 2974485 - protein, 22 aa, Entamoeba invadens
VNQLSVILLQFVDATIEMSIQK

SEQ ID NO: 2974486 - protein, 20 aa, Entamoeba invadens
VNQRLKAAQLIRSLVTTDNY

SEQ ID NO: 2974487 - protein, 18 aa, Entamoeba invadens
VNQVCPVCDIYMNGGDYM

SEQ ID NO: 2974488 - protein, 21 aa, Entamoeba invadens
VNQVMRFQTMLSYLFPNEIFS

SEQ ID NO: 2974489 - protein, 17 aa, Entamoeba invadens
VNQVRNGLVDSFVHVYE

SEQ ID NO: 2974490 - protein, 22 aa, Entamoeba invadens
VNRAAFPESWRGLENEELENAV

SEQ ID NO: 2974491 - protein, 19 aa, Entamoeba invadens
VNRADGKAIRANKNEEEEM

SEQ ID NO: 2974492 - protein, 17 aa, Entamoeba invadens
VNRCIKKGGKNMQMTLK

SEQ ID NO: 2974493 - protein, 17 aa, Entamoeba invadens
VNRCVLIPMVEHVSHPV

SEQ ID NO: 2974494 - protein, 17 aa, Entamoeba invadens
VNRFLKYPKIFENLLGA

SEQ ID NO: 2974495 - protein, 24 aa, Entamoeba invadens
VNRLAAQHWEFFKIEVRSQHPEFL

SEQ ID NO: 2974496 - protein, 23 aa, Entamoeba invadens
VNRLGEKMVLGYDDLVMRVCDSV

SEQ ID NO: 2974497 - protein, 27 aa, Entamoeba invadens
VNRPGDVPKRICRMVNPGMTTLSFQVS

SEQ ID NO: 2974498 - protein, 25 aa, Entamoeba invadens
VNRRITRCLEFFRFGEKDEDDIFFF

SEQ ID NO: 2974499 - protein, 21 aa, Entamoeba invadens
VNRVVSLFTTFGLQEVPVEIL

SEQ ID NO: 2974500 - protein, 17 aa, Entamoeba invadens
VNSAFNLVQKAVTEHVK

SEQ ID NO: 2974501 - protein, 31 aa, Entamoeba invadens
VNSARISICIKKADGLEVILLRRFVSFLQQR

SEQ ID NO: 2974502 - protein, 22 aa, Entamoeba invadens
VNSDPLLLTRIVHEILDSSPKV

SEQ ID NO: 2974503 - protein, 28 aa, Entamoeba invadens
VNSEQESSCLFDRLLAIQQELLKNDKTA

SEQ ID NO: 2974504 - protein, 24 aa, Entamoeba invadens
VNSETVIITWGFIKGEFQASPSFA

SEQ ID NO: 2974505 - protein, 18 aa, Entamoeba invadens
VNSKMFFSFNSLPLYTCV

SEQ ID NO: 2974506 - protein, 27 aa, Entamoeba invadens
VNSLPLFPTRISPLFSTLGIDGVLCVF

SEQ ID NO: 2974507 - protein, 31 aa, Entamoeba invadens
VNSLSSFQKWTGYSHCKLIFDTAQEHDQDIH

SEQ ID NO: 2974508 - protein, 17 aa, Entamoeba invadens
VNSSILFGKADQQDREI

SEQ ID NO: 2974509 - protein, 25 aa, Entamoeba invadens
VNTCRDMLYHIELVKVVQKLYELFS

SEQ ID NO: 2974510 - protein, 21 aa, Entamoeba invadens
VNTCYDMLYEKEMVTSIKQCY

SEQ ID NO: 2974511 - protein, 23 aa, Entamoeba invadens
VNTGLKWLSYISWGMTKEPNIEY

SEQ ID NO: 2974512 - protein, 22 aa, Entamoeba invadens
VNTLCFKYEMSYSDVVKINGIQ

SEQ ID NO: 2974513 - protein, 26 aa, Entamoeba invadens
VNTLIAVAFYFRFIIFTQKDGTNEAQ

SEQ ID NO: 2974514 - protein, 25 aa, Entamoeba invadens
VNTLSDLFLIFSLFKKINTLSFPTV

SEQ ID NO: 2974515 - protein, 25 aa, Entamoeba invadens
VNTMYWVKWGNNFITAIDLTDNIFG

SEQ ID NO: 2974516 - protein, 18 aa, Entamoeba invadens
VNTNQRLSLNKIINQLYD

SEQ ID NO: 2974517 - protein, 27 aa, Entamoeba invadens
VNTSTVSKGRCFGVVGLGKIEKTGNPK

SEQ ID NO: 2974518 - protein, 30 aa, Entamoeba invadens
VNTYVQWGRLFSLWIAYQIVREKDEERRRQ

SEQ ID NO: 2974519 - protein, 19 aa, Entamoeba invadens
VNVCALEYTFQYQLTLKEI

SEQ ID NO: 2974520 - protein, 17 aa, Entamoeba invadens
VNVGKEFEDFRFVNEEK

SEQ ID NO: 2974521 - protein, 28 aa, Entamoeba invadens
VNVIKFAGKRAHICYISTIGAALNRDET

SEQ ID NO: 2974522 - protein, 24 aa, Entamoeba invadens
VNVKAACWMKDILDENLEVDEFYY

SEQ ID NO: 2974523 - protein, 24 aa, Entamoeba invadens
VNVKEHWQYFVAPLRDLLGTNYII

SEQ ID NO: 2974524 - protein, 17 aa, Entamoeba invadens
VNVLYDMVMQAQTIGLK

SEQ ID NO: 2974525 - protein, 34 aa, Entamoeba invadens
VNVSLLSRMLEPFCYALIYPKGQMGWQQEAKKTF

SEQ ID NO: 2974526 - protein, 25 aa, Entamoeba invadens
VNVSLTRARKVCVVVGNKKTLKRAE

SEQ ID NO: 2974527 - protein, 18 aa, Entamoeba invadens
VNVVGCGVYITWNYHNIV

SEQ ID NO: 2974528 - protein, 19 aa, Entamoeba invadens
VNYCFWICMDNVVFLWHHF

SEQ ID NO: 2974529 - protein, 25 aa, Entamoeba invadens
VNYLYLEKRLEMFGKSLKNAETILL

SEQ ID NO: 2974530 - protein, 18 aa, Entamoeba invadens
VNYNEFFDSVLFDGISSS

SEQ ID NO: 2974531 - protein, 19 aa, Entamoeba invadens
VNYTLKLMSVISHGKSEDV

SEQ ID NO: 2974532 - protein, 17 aa, Entamoeba invadens
VPAKFSKIFRDYFAEAI

SEQ ID NO: 2974533 - protein, 25 aa, Entamoeba invadens
VPALLDKLQYCLGLKGTEKNDIYEA

SEQ ID NO: 2974534 - protein, 19 aa, Entamoeba invadens
VPAPAELMPPPADLLPPPG

SEQ ID NO: 2974535 - protein, 17 aa, Entamoeba invadens
VPAVCLSLGLGYFDTDN

SEQ ID NO: 2974536 - protein, 18 aa, Entamoeba invadens
VPCKCSGGFVQVRLLVLP

SEQ ID NO: 2974537 - protein, 17 aa, Entamoeba invadens
VPCLLKISDFEENDTDG

SEQ ID NO: 2974538 - protein, 25 aa, Entamoeba invadens
VPCVLKRRKGVLILEIENYGVVNVS

SEQ ID NO: 2974539 - protein, 19 aa, Entamoeba invadens
VPDCVTCLEVDGCRNLQNL

SEQ ID NO: 2974540 - protein, 18 aa, Entamoeba invadens
VPDEWRWQVWKYLLRYVP

SEQ ID NO: 2974541 - protein, 19 aa, Entamoeba invadens
VPDKDVLMTPEYVGRKEFA

SEQ ID NO: 2974542 - protein, 23 aa, Entamoeba invadens
VPDKMFSNDFAYFQMNGVTIGNH

SEQ ID NO: 2974543 - protein, 17 aa, Entamoeba invadens
VPDNYKLRAKQHAKTEH

SEQ ID NO: 2974544 - protein, 29 aa, Entamoeba invadens
VPDSKTRYSLKCLFNIIKDALGVKNVVQY

SEQ ID NO: 2974545 - protein, 24 aa, Entamoeba invadens
VPDTGVFCDLLWSDPLQYEVYDEK

SEQ ID NO: 2974546 - protein, 24 aa, Entamoeba invadens
VPEELKTQIFPFIQSDLGIQMENI

SEQ ID NO: 2974547 - protein, 23 aa, Entamoeba invadens
VPEEQFKRLFSFVKDQKTLHHLF

SEQ ID NO: 2974548 - protein, 25 aa, Entamoeba invadens
VPEKEFKELFGFIQDPLTLHRIYIR

SEQ ID NO: 2974549 - protein, 20 aa, Entamoeba invadens
VPEKGKYPLGLSFEIVNEKT

SEQ ID NO: 2974550 - protein, 25 aa, Entamoeba invadens
VPEKIKIFINFGVVPSVKTISNLNI

SEQ ID NO: 2974551 - protein, 20 aa, Entamoeba invadens
VPEKMPFKLIKGDKLEENLR

SEQ ID NO: 2974552 - protein, 21 aa, Entamoeba invadens
VPEMLRTSLASVILHMKKIGI

SEQ ID NO: 2974553 - protein, 19 aa, Entamoeba invadens
VPEVDRFLVTIQMETLPWV

SEQ ID NO: 2974554 - protein, 20 aa, Entamoeba invadens
VPEVDRFLVTIQMETLPWVV

SEQ ID NO: 2974555 - protein, 21 aa, Entamoeba invadens
VPFDITKGSSFAVHTQDSMWT

SEQ ID NO: 2974556 - protein, 18 aa, Entamoeba invadens
VPFGEERANFVIENETSN

SEQ ID NO: 2974557 - protein, 24 aa, Entamoeba invadens
VPFGLPPKYSALCPQGVEEAVLQN

SEQ ID NO: 2974558 - protein, 25 aa, Entamoeba invadens
VPFKKCPKLRSVFFDGDVIEFGDIC

SEQ ID NO: 2974559 - protein, 20 aa, Entamoeba invadens
VPFLEYILSTALNFSPEKYK

SEQ ID NO: 2974560 - protein, 26 aa, Entamoeba invadens
VPFMKRVIPVLFRIASMCYGEPLFQQ

SEQ ID NO: 2974561 - protein, 18 aa, Entamoeba invadens
VPFYEAGKFFRTRELLLR

SEQ ID NO: 2974562 - protein, 20 aa, Entamoeba invadens
VPGAICIKSTNLFYLTVDAK

SEQ ID NO: 2974563 - protein, 24 aa, Entamoeba invadens
VPGCGLARLPYELVKNGNECYACE

SEQ ID NO: 2974564 - protein, 19 aa, Entamoeba invadens
VPGNLFLFNSMDFARLENL

SEQ ID NO: 2974565 - protein, 19 aa, Entamoeba invadens
VPGYELIRNVYFVDEEFST

SEQ ID NO: 2974566 - protein, 28 aa, Entamoeba invadens
VPGYFKYVYEYPVSYSFYLSNKSTKNEF

SEQ ID NO: 2974567 - protein, 17 aa, Entamoeba invadens
VPHEGRVEFLRQFNERI

SEQ ID NO: 2974568 - protein, 23 aa, Entamoeba invadens
VPHEGSFCDLMWSDPEENEKGMR

SEQ ID NO: 2974569 - protein, 22 aa, Entamoeba invadens
VPHKEIIVHDVAVKSHRVKKGD

SEQ ID NO: 2974570 - protein, 22 aa, Entamoeba invadens
VPHPFWLPKFQNGVSFSLPVLG

SEQ ID NO: 2974571 - protein, 28 aa, Entamoeba invadens
VPHTITFLFDEIKNFAFVRVYISHSQDE

SEQ ID NO: 2974572 - protein, 23 aa, Entamoeba invadens
VPIATVKHVFVWGNHSEKQCPDI

SEQ ID NO: 2974573 - protein, 28 aa, Entamoeba invadens
VPIDEVLDFVNKVGCSYFEISCRNQTDI

SEQ ID NO: 2974574 - protein, 30 aa, Entamoeba invadens
VPIFINKEAMARCYADLIYQFVTLTIHINS

SEQ ID NO: 2974575 - protein, 20 aa, Entamoeba invadens
VPIIEKVVMNYDFLTGDSTC

SEQ ID NO: 2974576 - protein, 35 aa, Entamoeba invadens
VPIIFSSHFPDFFPFPCFQLERLERVSIAFHKSYG

SEQ ID NO: 2974577 - protein, 24 aa, Entamoeba invadens
VPIIKCYIDRVSVDISLDNYEGIY

SEQ ID NO: 2974578 - protein, 31 aa, Entamoeba invadens
VPIIRVCINHIMNLFGSFKECCFKLGEFANE

SEQ ID NO: 2974579 - protein, 17 aa, Entamoeba invadens
VPIKAIDKGVEVVLKLV

SEQ ID NO: 2974580 - protein, 17 aa, Entamoeba invadens
VPIKMELETPIVNVEPP

SEQ ID NO: 2974581 - protein, 18 aa, Entamoeba invadens
VPILPRILLEYITSPFPY

SEQ ID NO: 2974582 - protein, 19 aa, Entamoeba invadens
VPIRICALTTAIANVDDMM

SEQ ID NO: 2974583 - protein, 29 aa, Entamoeba invadens
VPIRVGDPITCKYCQSILSYLDTVKDGEW

SEQ ID NO: 2974584 - protein, 18 aa, Entamoeba invadens
VPISSLFIPSTVALCNKD

SEQ ID NO: 2974585 - protein, 22 aa, Entamoeba invadens
VPITALTREQFVQLCNERPEVL

SEQ ID NO: 2974586 - protein, 19 aa, Entamoeba invadens
VPITCHAKVLGAMESKATK

SEQ ID NO: 2974587 - protein, 18 aa, Entamoeba invadens
VPIVCGGTSYYIDALIYR

SEQ ID NO: 2974588 - protein, 20 aa, Entamoeba invadens
VPKDDGFVLIRIVKGDPRGN

SEQ ID NO: 2974589 - protein, 20 aa, Entamoeba invadens
VPKETIEFCGCKIPKEYDGK

SEQ ID NO: 2974590 - protein, 19 aa, Entamoeba invadens
VPKFDVFEGKSTFENFYQF

SEQ ID NO: 2974591 - protein, 26 aa, Entamoeba invadens
VPKFQRRKAALLVLQFAYTFGDYLEV

SEQ ID NO: 2974592 - protein, 26 aa, Entamoeba invadens
VPKHLKLIGNFSFKNCCSLRHLTFPK

SEQ ID NO: 2974593 - protein, 26 aa, Entamoeba invadens
VPKKGMVKPSLYFVLENSFANINQSA

SEQ ID NO: 2974594 - protein, 23 aa, Entamoeba invadens
VPKKKSKVSLTFLTVSSVKDDLR

SEQ ID NO: 2974595 - protein, 19 aa, Entamoeba invadens
VPKKQCDYYTLMADSAMYN

SEQ ID NO: 2974596 - protein, 20 aa, Entamoeba invadens
VPKLHWVGVMDYDLRAFDII

SEQ ID NO: 2974597 - protein, 25 aa, Entamoeba invadens
VPKLTLFFRKMVLLKNGAELSDHPS

SEQ ID NO: 2974598 - protein, 19 aa, Entamoeba invadens
VPKNAALCKTRCTAGSAKY

SEQ ID NO: 2974599 - protein, 19 aa, Entamoeba invadens
VPKNTGVLCLVRNQHNSIF

SEQ ID NO: 2974600 - protein, 35 aa, Entamoeba invadens
VPKRLRCPKCSGLLRGASVLKCCGKSFCEDCLVKI

SEQ ID NO: 2974601 - protein, 24 aa, Entamoeba invadens
VPKSVFKLTIGYCANLKNINYQNK

SEQ ID NO: 2974602 - protein, 24 aa, Entamoeba invadens
VPKTEFKENVFIFTNIVKSNKITV

SEQ ID NO: 2974603 - protein, 22 aa, Entamoeba invadens
VPKTKEVFSFMDINPPGLKNPV

SEQ ID NO: 2974604 - protein, 22 aa, Entamoeba invadens
VPKYSLAYHQCRWNYMSQNEAE

SEQ ID NO: 2974605 - protein, 20 aa, Entamoeba invadens
VPLDDPRLVNSDPLLLTRIV

SEQ ID NO: 2974606 - protein, 18 aa, Entamoeba invadens
VPLDLSTGMTVDFGESFV

SEQ ID NO: 2974607 - protein, 25 aa, Entamoeba invadens
VPLFFKKNCVTKHSFSVYDNYHNLF

SEQ ID NO: 2974608 - protein, 17 aa, Entamoeba invadens
VPLKKNKKAKCEYYGVF

SEQ ID NO: 2974609 - protein, 19 aa, Entamoeba invadens
VPLLCPACRCRFMKNPITP

SEQ ID NO: 2974610 - protein, 23 aa, Entamoeba invadens
VPLLEENTAFVFLLKENGKESMK

SEQ ID NO: 2974611 - protein, 20 aa, Entamoeba invadens
VPLLRLEFHKTVLNLLKTPS

SEQ ID NO: 2974612 - protein, 19 aa, Entamoeba invadens
VPLLTPKPRPSLTSPTKTS

SEQ ID NO: 2974613 - protein, 17 aa, Entamoeba invadens
VPLMKPLLFSKGKMCRK

SEQ ID NO: 2974614 - protein, 17 aa, Entamoeba invadens
VPLPHAFLISHRPEFID

SEQ ID NO: 2974615 - protein, 17 aa, Entamoeba invadens
VPLPVIIVDDVKAIKDI

SEQ ID NO: 2974616 - protein, 21 aa, Entamoeba invadens
VPLQKSIAWAQVFKKENIVPQ

SEQ ID NO: 2974617 - protein, 25 aa, Entamoeba invadens
VPMDLRIPSPFPLFQDFYNTFDFTK

SEQ ID NO: 2974618 - protein, 22 aa, Entamoeba invadens
VPMLEIDCTLLGAVDGVEQECS

SEQ ID NO: 2974619 - protein, 19 aa, Entamoeba invadens
VPMVRRAKGQVLFNVCELI

SEQ ID NO: 2974620 - protein, 19 aa, Entamoeba invadens
VPNGFLLMEYCDGGNVDSY

SEQ ID NO: 2974621 - protein, 27 aa, Entamoeba invadens
VPNGKCVAVLLPRVIRYNCVVPRKLVM

SEQ ID NO: 2974622 - protein, 21 aa, Entamoeba invadens
VPNIACLWLKVLSIAQSECLC

SEQ ID NO: 2974623 - protein, 24 aa, Entamoeba invadens
VPNNIKCYYRMATAKTRLHQYDEA

SEQ ID NO: 2974624 - protein, 18 aa, Entamoeba invadens
VPNTSLIIKRCEKLTSVT

SEQ ID NO: 2974625 - protein, 17 aa, Entamoeba invadens
VPPLGDKKISVVFIGGG

SEQ ID NO: 2974626 - protein, 17 aa, Entamoeba invadens
VPPRLFPFVEYGKTMSL

SEQ ID NO: 2974627 - protein, 21 aa, Entamoeba invadens
VPPSYIYRLLAQLYNPEDTFF

SEQ ID NO: 2974628 - protein, 18 aa, Entamoeba invadens
VPQEWVKVINQYGGKLED

SEQ ID NO: 2974629 - protein, 25 aa, Entamoeba invadens
VPQFMKLELEDVLSIKVILLNVPPV

SEQ ID NO: 2974630 - protein, 19 aa, Entamoeba invadens
VPQIAEQFITFGVNKDIDV

SEQ ID NO: 2974631 - protein, 23 aa, Entamoeba invadens
VPQKKSVIALSYFRVIRLKSPER

SEQ ID NO: 2974632 - protein, 19 aa, Entamoeba invadens
VPQKSELPVQHQIEEIPKE

SEQ ID NO: 2974633 - protein, 24 aa, Entamoeba invadens
VPQKVRCVGSFAFENCVQLKELVF

SEQ ID NO: 2974634 - protein, 26 aa, Entamoeba invadens
VPQKVRFIGNFAFEMCIQLKELVFNN

SEQ ID NO: 2974635 - protein, 24 aa, Entamoeba invadens
VPQKVRFVGSFAFENCEQLEELNF

SEQ ID NO: 2974636 - protein, 26 aa, Entamoeba invadens
VPQKVRFVGSFAFKNCEQLVGLNFNE

SEQ ID NO: 2974637 - protein, 24 aa, Entamoeba invadens
VPQPETLARFAVLGLSGDMKDVKK

SEQ ID NO: 2974638 - protein, 17 aa, Entamoeba invadens
VPQRFLFARYKNITSAD

SEQ ID NO: 2974639 - protein, 20 aa, Entamoeba invadens
VPQRKFAKQVLPDFNDRGYW

SEQ ID NO: 2974640 - protein, 17 aa, Entamoeba invadens
VPQRYTPVCALKLIDAM

SEQ ID NO: 2974641 - protein, 24 aa, Entamoeba invadens
VPQSFMKMSSWIGLYDKYEMDTRR

SEQ ID NO: 2974642 - protein, 27 aa, Entamoeba invadens
VPQSPRFSLPSGLLVLRFDKPETQINL

SEQ ID NO: 2974643 - protein, 26 aa, Entamoeba invadens
VPREVVLPVHFEKMYECEKGEKEIVL

SEQ ID NO: 2974644 - protein, 21 aa, Entamoeba invadens
VPRKQGPPIPAPRTNGPPAPP

SEQ ID NO: 2974645 - protein, 26 aa, Entamoeba invadens
VPRNLCMSCVRLKRVKFDDSITVISD

SEQ ID NO: 2974646 - protein, 22 aa, Entamoeba invadens
VPRRRFLPVKSCSDLFVVQSTV

SEQ ID NO: 2974647 - protein, 18 aa, Entamoeba invadens
VPRSFLLNCINLKTIKFV

SEQ ID NO: 2974648 - protein, 27 aa, Entamoeba invadens
VPRSHRKEYYSVPSMEELQKMDVESLK

SEQ ID NO: 2974649 - protein, 18 aa, Entamoeba invadens
VPRSIDFSATLPKKETKK

SEQ ID NO: 2974650 - protein, 17 aa, Entamoeba invadens
VPRVVKELINYLTEKPV

SEQ ID NO: 2974651 - protein, 18 aa, Entamoeba invadens
VPSARMMLFESVLMTFKG

SEQ ID NO: 2974652 - protein, 19 aa, Entamoeba invadens
VPSFCQWVVDGDKTKIRLW

SEQ ID NO: 2974653 - protein, 19 aa, Entamoeba invadens
VPSGSFTASGFVFSTLAEP

SEQ ID NO: 2974654 - protein, 28 aa, Entamoeba invadens
VPSIVSLKPGYACEFEIFIKPLCTCSTK

SEQ ID NO: 2974655 - protein, 17 aa, Entamoeba invadens
VPSKERKRCNFVITVYV

SEQ ID NO: 2974656 - protein, 18 aa, Entamoeba invadens
VPSNLQCRVIALDMGALI

SEQ ID NO: 2974657 - protein, 23 aa, Entamoeba invadens
VPTGCAAIAYTLYTRHLKFTPKA

SEQ ID NO: 2974658 - protein, 19 aa, Entamoeba invadens
VPTGYKLVVETANFDMSTL

SEQ ID NO: 2974659 - protein, 18 aa, Entamoeba invadens
VPTISYSPLEEWKEATAR

SEQ ID NO: 2974660 - protein, 24 aa, Entamoeba invadens
VPTKRCPVLDSMDFFKNTTKAKFE

SEQ ID NO: 2974661 - protein, 18 aa, Entamoeba invadens
VPTLKPLPTFNVTQQQKD

SEQ ID NO: 2974662 - protein, 23 aa, Entamoeba invadens
VPTLLAIFFSHFEYRVLKIAHNQ

SEQ ID NO: 2974663 - protein, 19 aa, Entamoeba invadens
VPTLPSFKNIQLVSPRKYS

SEQ ID NO: 2974664 - protein, 21 aa, Entamoeba invadens
VPTNDIIHFVVKISGKTPSSQ

SEQ ID NO: 2974665 - protein, 17 aa, Entamoeba invadens
VPTPIQRKAIPAIMTGV

SEQ ID NO: 2974666 - protein, 19 aa, Entamoeba invadens
VPTPRNVSCQKMEIIDPEI

SEQ ID NO: 2974667 - protein, 25 aa, Entamoeba invadens
VPTRLETLSTVLFRHILLFRYFPLQ

SEQ ID NO: 2974668 - protein, 26 aa, Entamoeba invadens
VPTWCPTRWLSQGKIVFFRLSEMEKE

SEQ ID NO: 2974669 - protein, 17 aa, Entamoeba invadens
VPTYTPEEWIEGKVKDV

SEQ ID NO: 2974670 - protein, 17 aa, Entamoeba invadens
VPVCVSCVSAINKMWYP

SEQ ID NO: 2974671 - protein, 22 aa, Entamoeba invadens
VPVILGEDGFKALFEQYRPKNV

SEQ ID NO: 2974672 - protein, 25 aa, Entamoeba invadens
VPVKHLKLFPNMDVLLLYNPTDFPI

SEQ ID NO: 2974673 - protein, 22 aa, Entamoeba invadens
VPVNFSRHWTLVLFCLQSTRIA

SEQ ID NO: 2974674 - protein, 21 aa, Entamoeba invadens
VPVQVGILYSPKIEFIPFDMD

SEQ ID NO: 2974675 - protein, 17 aa, Entamoeba invadens
VPVRIFLNRIKELTPTL

SEQ ID NO: 2974676 - protein, 22 aa, Entamoeba invadens
VPVSEWPMWINSKIENTPFRAM

SEQ ID NO: 2974677 - protein, 24 aa, Entamoeba invadens
VPVSRLAAAAVYLARRMCGIQPYW

SEQ ID NO: 2974678 - protein, 23 aa, Entamoeba invadens
VPWNGECYKDFKTVESLGEGSYG

SEQ ID NO: 2974679 - protein, 26 aa, Entamoeba invadens
VPYGGLLCIFDQFLVSGIRSITRYIL

SEQ ID NO: 2974680 - protein, 20 aa, Entamoeba invadens
VPYMCSYTFEIPSSEESFSD

SEQ ID NO: 2974681 - protein, 17 aa, Entamoeba invadens
VQAFEWIDENAQEFVQL

SEQ ID NO: 2974682 - protein, 23 aa, Entamoeba invadens
VQALKGRHLPLITVFQDPTFGGT

SEQ ID NO: 2974683 - protein, 19 aa, Entamoeba invadens
VQAMAKGYFFRKSKLARKM

SEQ ID NO: 2974684 - protein, 21 aa, Entamoeba invadens
VQARPLPPVPAPRSFIPNTEP

SEQ ID NO: 2974685 - protein, 22 aa, Entamoeba invadens
VQARSCPSYALTRAVGKMCCLK

SEQ ID NO: 2974686 - protein, 17 aa, Entamoeba invadens
VQASLLLSFSQYLNTMN

SEQ ID NO: 2974687 - protein, 28 aa, Entamoeba invadens
VQAVRGKGGICFLFLRKGIYTCQAVATV

SEQ ID NO: 2974688 - protein, 20 aa, Entamoeba invadens
VQAYPILGGIQVTRESRVSP

SEQ ID NO: 2974689 - protein, 22 aa, Entamoeba invadens
VQCANFKKTAIQFGTRIAKVLN

SEQ ID NO: 2974690 - protein, 17 aa, Entamoeba invadens
VQCCSFKRRYAHPYSEI

SEQ ID NO: 2974691 - protein, 19 aa, Entamoeba invadens
VQCKASAPMLEKLSEKHKN

SEQ ID NO: 2974692 - protein, 32 aa, Entamoeba invadens
VQCTSFLRCEKCASGLILKNWACKPMSSVKEF

SEQ ID NO: 2974693 - protein, 18 aa, Entamoeba invadens
VQDIFCESSLMKFSSNVM

SEQ ID NO: 2974694 - protein, 25 aa, Entamoeba invadens
VQDSLGCIGCTANGLPDLKTHSIKV

SEQ ID NO: 2974695 - protein, 18 aa, Entamoeba invadens
VQEIKRVVEWMKKKLEKR

SEQ ID NO: 2974696 - protein, 25 aa, Entamoeba invadens
VQEKALSLLLNWGSVHGSSCPEYKS

SEQ ID NO: 2974697 - protein, 22 aa, Entamoeba invadens
VQELLDLGCKYIAEMIKGKSVE

SEQ ID NO: 2974698 - protein, 18 aa, Entamoeba invadens
VQERACFSLQSLLENLED

SEQ ID NO: 2974699 - protein, 18 aa, Entamoeba invadens
VQETFFLHIERFVCNSLA

SEQ ID NO: 2974700 - protein, 28 aa, Entamoeba invadens
VQEVFGGKLKDIWWMLLVTSQMTDLNFM

SEQ ID NO: 2974701 - protein, 23 aa, Entamoeba invadens
VQFEDIIIAFCMSLGGNQGAVEQ

SEQ ID NO: 2974702 - protein, 17 aa, Entamoeba invadens
VQFFGVSVDSVFCHKAW

SEQ ID NO: 2974703 - protein, 17 aa, Entamoeba invadens
VQFGYLWETILDVVAGS

SEQ ID NO: 2974704 - protein, 17 aa, Entamoeba invadens
VQFLEALFFYEKRKFTE

SEQ ID NO: 2974705 - protein, 18 aa, Entamoeba invadens
VQFLEKFDDFVSWKYVAA

SEQ ID NO: 2974706 - protein, 22 aa, Entamoeba invadens
VQFPEWSKLPLTSDELIKEQNL

SEQ ID NO: 2974707 - protein, 24 aa, Entamoeba invadens
VQFPHPLKSFVFHTKFPPNTNLDY

SEQ ID NO: 2974708 - protein, 18 aa, Entamoeba invadens
VQFRDICLGLLYRLLQTL

SEQ ID NO: 2974709 - protein, 27 aa, Entamoeba invadens
VQGCVVKMNFAFLAALMKWKREKDEEE

SEQ ID NO: 2974710 - protein, 18 aa, Entamoeba invadens
VQGFPTVVSRLYLMCIVG

SEQ ID NO: 2974711 - protein, 25 aa, Entamoeba invadens
VQGGTCAIPGAFGCGKTVISQALSK

SEQ ID NO: 2974712 - protein, 18 aa, Entamoeba invadens
VQGKKSFEYAWVMDTDDE

SEQ ID NO: 2974713 - protein, 28 aa, Entamoeba invadens
VQHCCDLSFPIQETFSLSSSSLLFIQTS

SEQ ID NO: 2974714 - protein, 19 aa, Entamoeba invadens
VQHFDEFDIQPVFPAMFPS

SEQ ID NO: 2974715 - protein, 25 aa, Entamoeba invadens
VQHKLFKTAFLFFQPFKSYTTYMGD

SEQ ID NO: 2974716 - protein, 31 aa, Entamoeba invadens
VQHLRSGSCGIVFDFHTFRGLKVDWGKETAL

SEQ ID NO: 2974717 - protein, 19 aa, Entamoeba invadens
VQHYKVVEVLAIIIQTYVD

SEQ ID NO: 2974718 - protein, 17 aa, Entamoeba invadens
VQIAFKIPMLQNLDVKH

SEQ ID NO: 2974719 - protein, 19 aa, Entamoeba invadens
VQIASKWASLNDIVERLKS

SEQ ID NO: 2974720 - protein, 26 aa, Entamoeba invadens
VQIEKWSSCKLDKVLFDTSVDSAEKS

SEQ ID NO: 2974721 - protein, 19 aa, Entamoeba invadens
VQIFICQLLDLQLVKYQLN

SEQ ID NO: 2974722 - protein, 17 aa, Entamoeba invadens
VQIFPFDYDLLVGFEDS

SEQ ID NO: 2974723 - protein, 19 aa, Entamoeba invadens
VQILYKFIVAEECLEIDFS

SEQ ID NO: 2974724 - protein, 17 aa, Entamoeba invadens
VQIPDGFGINPLLADLI

SEQ ID NO: 2974725 - protein, 25 aa, Entamoeba invadens
VQIPRSVTFIGVSAFGKCYNLLEVV

SEQ ID NO: 2974726 - protein, 28 aa, Entamoeba invadens
VQIPSSWPFEVFPFILQHRSHSIPTLNI

SEQ ID NO: 2974727 - protein, 24 aa, Entamoeba invadens
VQKFQDWYCAIIEKVEEIANRLEK

SEQ ID NO: 2974728 - protein, 28 aa, Entamoeba invadens
VQKHIPKEFKILVGETAKQGFANVREYL

SEQ ID NO: 2974729 - protein, 22 aa, Entamoeba invadens
VQKILPRLSFVRTRKTSLTPRD

SEQ ID NO: 2974730 - protein, 25 aa, Entamoeba invadens
VQKIREGKKGFGFDMRSGNFVDMMQ

SEQ ID NO: 2974731 - protein, 23 aa, Entamoeba invadens
VQKLKKLQVFDVRNCQLSKDIVL

SEQ ID NO: 2974732 - protein, 22 aa, Entamoeba invadens
VQKLRKMCVSKLNVHTPHFDDK

SEQ ID NO: 2974733 - protein, 18 aa, Entamoeba invadens
VQKNFLHFFKSESLENNS

SEQ ID NO: 2974734 - protein, 17 aa, Entamoeba invadens
VQKRPIVEFLLQNGKVG

SEQ ID NO: 2974735 - protein, 31 aa, Entamoeba invadens
VQKVPRGCVFFKNKSRAFGFFFDTNKKKHIS

SEQ ID NO: 2974736 - protein, 17 aa, Entamoeba invadens
VQLAANVLPRFFKHSNF

SEQ ID NO: 2974737 - protein, 17 aa, Entamoeba invadens
VQLFDFVNITLLSNKLV

SEQ ID NO: 2974738 - protein, 23 aa, Entamoeba invadens
VQLFFRFLEKYGFDATALTNAHA

SEQ ID NO: 2974739 - protein, 18 aa, Entamoeba invadens
VQLINSFFEFSRSMKTQF

SEQ ID NO: 2974740 - protein, 27 aa, Entamoeba invadens
VQLIPKVPNFQGNFNIIIEKLEKVIMK

SEQ ID NO: 2974741 - protein, 24 aa, Entamoeba invadens
VQLLCDLLREFGYYLEIEKKRGRK

SEQ ID NO: 2974742 - protein, 24 aa, Entamoeba invadens
VQLNTKGSITFSYSVTSVKGGKAP

SEQ ID NO: 2974743 - protein, 24 aa, Entamoeba invadens
VQLRSTGCGFGIYTIDDDVEDITA

SEQ ID NO: 2974744 - protein, 17 aa, Entamoeba invadens
VQLWDTAGQEKFRNITS

SEQ ID NO: 2974745 - protein, 18 aa, Entamoeba invadens
VQMFCPKLVDMFVGAYRA

SEQ ID NO: 2974746 - protein, 17 aa, Entamoeba invadens
VQMVFEEVFVRSSKLIL

SEQ ID NO: 2974747 - protein, 17 aa, Entamoeba invadens
VQNALEYFGCITKGCYF

SEQ ID NO: 2974748 - protein, 17 aa, Entamoeba invadens
VQNCCALIYQTKATSKE

SEQ ID NO: 2974749 - protein, 22 aa, Entamoeba invadens
VQNDILLSVGVESAVVFTQSFN

SEQ ID NO: 2974750 - protein, 25 aa, Entamoeba invadens
VQNGPRMSVNMSCMNQNVGQSVLGM

SEQ ID NO: 2974751 - protein, 19 aa, Entamoeba invadens
VQNIIWIKHVLGIEDTFEG

SEQ ID NO: 2974752 - protein, 19 aa, Entamoeba invadens
VQNKFPINKLIPLTYHCTQ

SEQ ID NO: 2974753 - protein, 27 aa, Entamoeba invadens
VQNLLIDMLLEFGFFFESKMAKKSTKT

SEQ ID NO: 2974754 - protein, 24 aa, Entamoeba invadens
VQNNCYKRALQICRCKEAMTDSRV

SEQ ID NO: 2974755 - protein, 24 aa, Entamoeba invadens
VQNPRANIHFFLYKPRLIGAKCVG

SEQ ID NO: 2974756 - protein, 22 aa, Entamoeba invadens
VQNRDVCLSYGFFEPFFHLCEI

SEQ ID NO: 2974757 - protein, 25 aa, Entamoeba invadens
VQNSLFCKCLMLCFSITEEKTIKIK

SEQ ID NO: 2974758 - protein, 20 aa, Entamoeba invadens
VQNVELFDPLFVHLIKKRFS

SEQ ID NO: 2974759 - protein, 21 aa, Entamoeba invadens
VQPKMSMSMSKLERREKSGIL

SEQ ID NO: 2974760 - protein, 23 aa, Entamoeba invadens
VQPQIKPQQQWRDQSPQMQQPPR

SEQ ID NO: 2974761 - protein, 28 aa, Entamoeba invadens
VQPSQIFPMKKRCFTFGVDDAPSFYLKK

SEQ ID NO: 2974762 - protein, 19 aa, Entamoeba invadens
VQPTIKILLQTGSPVVKSA

SEQ ID NO: 2974763 - protein, 22 aa, Entamoeba invadens
VQQEATFYWVLPRILDKTQFQF

SEQ ID NO: 2974764 - protein, 18 aa, Entamoeba invadens
VQQRGGAFAAAPINQKVQ

SEQ ID NO: 2974765 - protein, 36 aa, Entamoeba invadens
VQQTLLSFRELLAFKECHESVLMILFVCEEFINPKS

SEQ ID NO: 2974766 - protein, 23 aa, Entamoeba invadens
VQRACKKGCKLSRSETYIEQDKA

SEQ ID NO: 2974767 - protein, 17 aa, Entamoeba invadens
VQRACMEYKLKLPRLSK

SEQ ID NO: 2974768 - protein, 20 aa, Entamoeba invadens
VQRFQVLANLTLKVEASCKP

SEQ ID NO: 2974769 - protein, 24 aa, Entamoeba invadens
VQRIMPKMRIIKEKQKSDSSLFIR

SEQ ID NO: 2974770 - protein, 26 aa, Entamoeba invadens
VQRLPRYKLLLTDLFRHYWDTHDDYA

SEQ ID NO: 2974771 - protein, 27 aa, Entamoeba invadens
VQRNRKARIGVFAQHFVDQLNFKVNAI

SEQ ID NO: 2974772 - protein, 22 aa, Entamoeba invadens
VQRRIVPLLGQFTEAPINFLPT

SEQ ID NO: 2974773 - protein, 24 aa, Entamoeba invadens
VQRVMFPRVHYEERILCPKCLTLG

SEQ ID NO: 2974774 - protein, 23 aa, Entamoeba invadens
VQRVMRYPILISELIKTTPNKHP

SEQ ID NO: 2974775 - protein, 18 aa, Entamoeba invadens
VQSLLPVVTGAVSWRTPG

SEQ ID NO: 2974776 - protein, 19 aa, Entamoeba invadens
VQSLSKWCLDMCNAQTIHI

SEQ ID NO: 2974777 - protein, 19 aa, Entamoeba invadens
VQSRIRGYIVRRLHNKNTL

SEQ ID NO: 2974778 - protein, 24 aa, Entamoeba invadens
VQSSPRVNKFIGRVQTAQNNSSPE

SEQ ID NO: 2974779 - protein, 17 aa, Entamoeba invadens
VQSYLRFLYEKDTCKEE

SEQ ID NO: 2974780 - protein, 25 aa, Entamoeba invadens
VQTAEIRFGKLLVVTRNQVLLFDDK

SEQ ID NO: 2974781 - protein, 28 aa, Entamoeba invadens
VQTDAEVAFVWEVRKMRVVPKNKRNLID

SEQ ID NO: 2974782 - protein, 27 aa, Entamoeba invadens
VQTIARGTFDWCTLKSISLPGNVTALE

SEQ ID NO: 2974783 - protein, 24 aa, Entamoeba invadens
VQTKCGICRGFYDLSKEHILRSVD

SEQ ID NO: 2974784 - protein, 22 aa, Entamoeba invadens
VQTPLFFLDYFTIFTSLYQVGS

SEQ ID NO: 2974785 - protein, 21 aa, Entamoeba invadens
VQVCLGEYVQIKSFHLICNKC

SEQ ID NO: 2974786 - protein, 20 aa, Entamoeba invadens
VQVCLGEYVQIKSFHLTCNK

SEQ ID NO: 2974787 - protein, 23 aa, Entamoeba invadens
VQVELKFETSFCGSEEPQNIELK

SEQ ID NO: 2974788 - protein, 19 aa, Entamoeba invadens
VQVQIKYTKLNGFKGIRVI

SEQ ID NO: 2974789 - protein, 22 aa, Entamoeba invadens
VQVRGNIPLIWKTNEEDKFSPK

SEQ ID NO: 2974790 - protein, 25 aa, Entamoeba invadens
VQVTKELLSYICFVNKVSFEDVEKQ

SEQ ID NO: 2974791 - protein, 23 aa, Entamoeba invadens
VQVVYHIAPYLPFMETNDQQLDK

SEQ ID NO: 2974792 - protein, 19 aa, Entamoeba invadens
VQYILGLDPYFTIPHFDIN

SEQ ID NO: 2974793 - protein, 23 aa, Entamoeba invadens
VQYLKGEYYPNVLTISKTKEMRR

SEQ ID NO: 2974794 - protein, 17 aa, Entamoeba invadens
VQYRMHPAISSFPSKNF

SEQ ID NO: 2974795 - protein, 19 aa, Entamoeba invadens
VRAGVPTSHSAAVPADLSK

SEQ ID NO: 2974796 - protein, 19 aa, Entamoeba invadens
VRALGRCAIKLENVANQCI

SEQ ID NO: 2974797 - protein, 17 aa, Entamoeba invadens
VRALKGFETNRDEVDLL

SEQ ID NO: 2974798 - protein, 18 aa, Entamoeba invadens
VRALKVLKPFLINVKIVH

SEQ ID NO: 2974799 - protein, 21 aa, Entamoeba invadens
VRANIRISGYMVRIEDGKCKL

SEQ ID NO: 2974800 - protein, 23 aa, Entamoeba invadens
VRASTWLAKECYVKASKKGHVQA

SEQ ID NO: 2974801 - protein, 20 aa, Entamoeba invadens
VRAYKKLSVRVAKDKNDGTS

SEQ ID NO: 2974802 - protein, 17 aa, Entamoeba invadens
VRCALCHDHYTATMCRR

SEQ ID NO: 2974803 - protein, 18 aa, Entamoeba invadens
VRCLEMWGDHNMMSGSSD

SEQ ID NO: 2974804 - protein, 18 aa, Entamoeba invadens
VRCMSNFRVETVREHLID

SEQ ID NO: 2974805 - protein, 20 aa, Entamoeba invadens
VRCSCGKYICNGPVTNCSKC

SEQ ID NO: 2974806 - protein, 18 aa, Entamoeba invadens
VRCYTHPYLTATSIMGEN

SEQ ID NO: 2974807 - protein, 40 aa, Entamoeba invadens
VRDGFGGKLRFIFNGGAPITPALFEWLRVCTGAHIMQSYG

SEQ ID NO: 2974808 - protein, 21 aa, Entamoeba invadens
VRDICFICGANSILINGSCQT

SEQ ID NO: 2974809 - protein, 24 aa, Entamoeba invadens
VRDICLRSAAAPTYYKPYQNYIDG

SEQ ID NO: 2974810 - protein, 24 aa, Entamoeba invadens
VRDKCTTCCRVLLATQWNYDKNKA

SEQ ID NO: 2974811 - protein, 35 aa, Entamoeba invadens
VRDLVKCKIIMLSKHMYGCRVIQKIVEYSSSEQQE

SEQ ID NO: 2974812 - protein, 26 aa, Entamoeba invadens
VRDNLLSWLLDGFLGLAPDKYEQLFN

SEQ ID NO: 2974813 - protein, 17 aa, Entamoeba invadens
VRDVFRLARENAPSIVF

SEQ ID NO: 2974814 - protein, 22 aa, Entamoeba invadens
VRDVFRRPLLFKIVNEEKDSRQ

SEQ ID NO: 2974815 - protein, 20 aa, Entamoeba invadens
VRDWWYYPWLTEIVEDLTEL

SEQ ID NO: 2974816 - protein, 25 aa, Entamoeba invadens
VRECLYDFLCRCLAYDPKDRMTPDQ

SEQ ID NO: 2974817 - protein, 23 aa, Entamoeba invadens
VRECRKLKPTKGVILASRELYCV

SEQ ID NO: 2974818 - protein, 24 aa, Entamoeba invadens
VREEFLLFLSKRVKLQTLPEHIAE

SEQ ID NO: 2974819 - protein, 23 aa, Entamoeba invadens
VREKEFLQPLAHAVVDNVDSQST

SEQ ID NO: 2974820 - protein, 22 aa, Entamoeba invadens
VREKTVPCFARYSKQIVSDIFS

SEQ ID NO: 2974821 - protein, 21 aa, Entamoeba invadens
VRELIYKWGTYFPNELSEYVV

SEQ ID NO: 2974822 - protein, 18 aa, Entamoeba invadens
VRELMKKSVPQDTTRYIL

SEQ ID NO: 2974823 - protein, 23 aa, Entamoeba invadens
VRELYCGTIQLFADLFEKEKNSL

SEQ ID NO: 2974824 - protein, 22 aa, Entamoeba invadens
VRENCYLCVFDSEIFDDKFEFP

SEQ ID NO: 2974825 - protein, 17 aa, Entamoeba invadens
VRFDQVILSPIDFDSVE

SEQ ID NO: 2974826 - protein, 20 aa, Entamoeba invadens
VRFEPFVYLQLALPQQPKVI

SEQ ID NO: 2974827 - protein, 17 aa, Entamoeba invadens
VRFFLCCYSDGRCYFID

SEQ ID NO: 2974828 - protein, 24 aa, Entamoeba invadens
VRFLCSRREIGFFIREVGNFDMQS

SEQ ID NO: 2974829 - protein, 24 aa, Entamoeba invadens
VRFQALCTLSSFLDYNIPIVVNNV

SEQ ID NO: 2974830 - protein, 20 aa, Entamoeba invadens
VRFSSEWKGVSAGGCHAFPT

SEQ ID NO: 2974831 - protein, 25 aa, Entamoeba invadens
VRGAIPKMRGIGLSSRLCELLSHME

SEQ ID NO: 2974832 - protein, 22 aa, Entamoeba invadens
VRGGFPHGFNPADIKLKNTGGL

SEQ ID NO: 2974833 - protein, 18 aa, Entamoeba invadens
VRGHGDIVLRVVKQKMRG

SEQ ID NO: 2974834 - protein, 24 aa, Entamoeba invadens
VRGKRCTHQRTFDLKSFLQTAQKA

SEQ ID NO: 2974835 - protein, 33 aa, Entamoeba invadens
VRGKYTVKLFLKRENGFFMKEALVFVGKPIEAL

SEQ ID NO: 2974836 - protein, 19 aa, Entamoeba invadens
VRGNAMAVHLNWEQELSQP

SEQ ID NO: 2974837 - protein, 17 aa, Entamoeba invadens
VRGNILLSELAKESTLY

SEQ ID NO: 2974838 - protein, 22 aa, Entamoeba invadens
VRGVNCLHPIDLKSFVNNWYNK

SEQ ID NO: 2974839 - protein, 20 aa, Entamoeba invadens
VRGYVSSCCIAVIQMHPFST

SEQ ID NO: 2974840 - protein, 27 aa, Entamoeba invadens
VRHDKYPFLQEGWRWEQKGCLDATSED

SEQ ID NO: 2974841 - protein, 25 aa, Entamoeba invadens
VRIASWKLPCECLTTGFETRTGIMV

SEQ ID NO: 2974842 - protein, 18 aa, Entamoeba invadens
VRIDNFWEYTGLKKISAI

SEQ ID NO: 2974843 - protein, 23 aa, Entamoeba invadens
VRIFCTCEFFEAVELANALKHKI

SEQ ID NO: 2974844 - protein, 19 aa, Entamoeba invadens
VRIKKGIVGSGVVKVVPAI

SEQ ID NO: 2974845 - protein, 17 aa, Entamoeba invadens
VRIKTLIEIVIQKDVNE

SEQ ID NO: 2974846 - protein, 21 aa, Entamoeba invadens
VRINTAYTLFYAVRPTIDVEH

SEQ ID NO: 2974847 - protein, 17 aa, Entamoeba invadens
VRIPVCLGTLGDSAFYG

SEQ ID NO: 2974848 - protein, 18 aa, Entamoeba invadens
VRIREKFTSFKILEMARK

SEQ ID NO: 2974849 - protein, 24 aa, Entamoeba invadens
VRIVRRPSDNFLFEGEGTSIKIKM

SEQ ID NO: 2974850 - protein, 18 aa, Entamoeba invadens
VRIWRDWDNNGSNVLVSG

SEQ ID NO: 2974851 - protein, 24 aa, Entamoeba invadens
VRKARAMRGQAFVVYNSMDAAEHA

SEQ ID NO: 2974852 - protein, 20 aa, Entamoeba invadens
VRKDDCFAVTFSKPEKKEDD

SEQ ID NO: 2974853 - protein, 27 aa, Entamoeba invadens
VRKDKFPFLQEGWRWEEVAEEQNESGH

SEQ ID NO: 2974854 - protein, 17 aa, Entamoeba invadens
VRKELKKMLEIDFEITE

SEQ ID NO: 2974855 - protein, 26 aa, Entamoeba invadens
VRKIFKRLFRVYAHMFYNHMEHMEQL

SEQ ID NO: 2974856 - protein, 19 aa, Entamoeba invadens
VRKILKKCATFNRKGNGNG

SEQ ID NO: 2974857 - protein, 22 aa, Entamoeba invadens
VRKITFSLLGKMNESEKFIECI

SEQ ID NO: 2974858 - protein, 19 aa, Entamoeba invadens
VRKKVALARYRVVYTEKIS

SEQ ID NO: 2974859 - protein, 48 aa, Entamoeba invadens
VRKLGRTFIHFCKELKLDLPFVDPCLYLQRFGEDLAFEKTADVVRTAM

SEQ ID NO: 2974860 - protein, 21 aa, Entamoeba invadens
VRKLREGSFGIVFKGTYRGNV

SEQ ID NO: 2974861 - protein, 33 aa, Entamoeba invadens
VRKNLRKISLLKVRLIAQMRRGLDMVSYENQQR

SEQ ID NO: 2974862 - protein, 21 aa, Entamoeba invadens
VRKQYTLTRRREIWTDEEHSK

SEQ ID NO: 2974863 - protein, 17 aa, Entamoeba invadens
VRKSSLCSIKKKDGSFY

SEQ ID NO: 2974864 - protein, 23 aa, Entamoeba invadens
VRKTHFIYLPFKSHDLLKQIENF

SEQ ID NO: 2974865 - protein, 21 aa, Entamoeba invadens
VRKVGSFAFEKCEQLKELVFN

SEQ ID NO: 2974866 - protein, 18 aa, Entamoeba invadens
VRLFKDRYTRLAVSNVIY

SEQ ID NO: 2974867 - protein, 19 aa, Entamoeba invadens
VRLGISILDDSHCLVKEFN

SEQ ID NO: 2974868 - protein, 17 aa, Entamoeba invadens
VRLKNGLKSVGKDCFCE

SEQ ID NO: 2974869 - protein, 22 aa, Entamoeba invadens
VRLSRLCFASFLSTLKCEMLTL

SEQ ID NO: 2974870 - protein, 19 aa, Entamoeba invadens
VRLSVTLSKILSLFSFDPS

SEQ ID NO: 2974871 - protein, 19 aa, Entamoeba invadens
VRLVDHFLYHSHLCIVTEL

SEQ ID NO: 2974872 - protein, 26 aa, Entamoeba invadens
VRLYFKDIKGVLLVFQIDRQESFDHC

SEQ ID NO: 2974873 - protein, 17 aa, Entamoeba invadens
VRLYLSGLLKIILVGEK

SEQ ID NO: 2974874 - protein, 18 aa, Entamoeba invadens
VRMECIKIVNALTLSYFK

SEQ ID NO: 2974875 - protein, 18 aa, Entamoeba invadens
VRMFLVEMLLKEGADVDA

SEQ ID NO: 2974876 - protein, 19 aa, Entamoeba invadens
VRMNDMWRNNEKSLEMINI

SEQ ID NO: 2974877 - protein, 22 aa, Entamoeba invadens
VRMVDFTKWVKGRIGVKDPEFD

SEQ ID NO: 2974878 - protein, 27 aa, Entamoeba invadens
VRNFRRCDKLRKITFRTLPTIKENEKQ

SEQ ID NO: 2974879 - protein, 18 aa, Entamoeba invadens
VRNGISLTFLTNRIDHGA

SEQ ID NO: 2974880 - protein, 25 aa, Entamoeba invadens
VRNKPVGCVLIFLPGIFEITNLQRE

SEQ ID NO: 2974881 - protein, 24 aa, Entamoeba invadens
VRNKYKPSIGFAEGKMDSRANNIT

SEQ ID NO: 2974882 - protein, 23 aa, Entamoeba invadens
VRNVSKYSMKCFGDKNKQVQEKR

SEQ ID NO: 2974883 - protein, 19 aa, Entamoeba invadens
VRPEGKFVCSFRDDVLFGD

SEQ ID NO: 2974884 - protein, 17 aa, Entamoeba invadens
VRPELNMNCLVYALKQA

SEQ ID NO: 2974885 - protein, 22 aa, Entamoeba invadens
VRPELSSMLSGDIMFSLCRIAK

SEQ ID NO: 2974886 - protein, 17 aa, Entamoeba invadens
VRPELVPLVDFVLITDE

SEQ ID NO: 2974887 - protein, 18 aa, Entamoeba invadens
VRPFNFFDRISYITSTNF

SEQ ID NO: 2974888 - protein, 25 aa, Entamoeba invadens
VRPGQTCTFIGMPIAAPDTTRLAVG

SEQ ID NO: 2974889 - protein, 24 aa, Entamoeba invadens
VRPNTRFPALPVVYIEKLQNSFAR

SEQ ID NO: 2974890 - protein, 18 aa, Entamoeba invadens
VRPPLPRHIAKDINNYDE

SEQ ID NO: 2974891 - protein, 17 aa, Entamoeba invadens
VRPRKLVYMAVDGVAPR

SEQ ID NO: 2974892 - protein, 21 aa, Entamoeba invadens
VRPSAKYFVREVASFNKEEAE

SEQ ID NO: 2974893 - protein, 18 aa, Entamoeba invadens
VRPTLPITFVEKYGKDSS

SEQ ID NO: 2974894 - protein, 19 aa, Entamoeba invadens
VRPVLLVALGDKLLASNKH

SEQ ID NO: 2974895 - protein, 28 aa, Entamoeba invadens
VRPVNEYGISMIDLWNKKGVVVGVDNKV

SEQ ID NO: 2974896 - protein, 19 aa, Entamoeba invadens
VRQRAVLVGQELGLSKAIR

SEQ ID NO: 2974897 - protein, 18 aa, Entamoeba invadens
VRRDGEVYEIDFSRGQVQ

SEQ ID NO: 2974898 - protein, 29 aa, Entamoeba invadens
VRRDNCMLVKYVIERCLDLILLDKEKDNI

SEQ ID NO: 2974899 - protein, 33 aa, Entamoeba invadens
VRRDSCRATKHIMMGCIKYLMGKDVDALQLYLQ

SEQ ID NO: 2974900 - protein, 25 aa, Entamoeba invadens
VRRDVWRIVLFPAIDMGDLKKEFES

SEQ ID NO: 2974901 - protein, 25 aa, Entamoeba invadens
VRRHHCRACGRCICGECSKWKMPMP

SEQ ID NO: 2974902 - protein, 25 aa, Entamoeba invadens
VRRITPPLFRCYNKQKALPFLNFFF

SEQ ID NO: 2974903 - protein, 19 aa, Entamoeba invadens
VRRMMKVAMLISNRVMEGN

SEQ ID NO: 2974904 - protein, 22 aa, Entamoeba invadens
VRRNFKDITVITVAHRLQTIMD

SEQ ID NO: 2974905 - protein, 20 aa, Entamoeba invadens
VRSDIPRIVCFELINQNRIE

SEQ ID NO: 2974906 - protein, 17 aa, Entamoeba invadens
VRSFLRPKSESIATTLI

SEQ ID NO: 2974907 - protein, 23 aa, Entamoeba invadens
VRSFRPERIVLFTINNFNETSAK

SEQ ID NO: 2974908 - protein, 18 aa, Entamoeba invadens
VRSGKLWSKCIDDVIVKY

SEQ ID NO: 2974909 - protein, 19 aa, Entamoeba invadens
VRSIGLCCFGWCTSLNSVT

SEQ ID NO: 2974910 - protein, 17 aa, Entamoeba invadens
VRSIGYYCFSRCYSLSS

SEQ ID NO: 2974911 - protein, 17 aa, Entamoeba invadens
VRSINCRSFYGCRNLRN

SEQ ID NO: 2974912 - protein, 18 aa, Entamoeba invadens
VRSIPEFQVSLTDFVYLK

SEQ ID NO: 2974913 - protein, 23 aa, Entamoeba invadens
VRSKVPMAAPPVAAQQVPSQPQQ

SEQ ID NO: 2974914 - protein, 23 aa, Entamoeba invadens
VRSLARRQSRGWTVTENDLNKKR

SEQ ID NO: 2974915 - protein, 17 aa, Entamoeba invadens
VRSLLVVLIYHVFVMGH

SEQ ID NO: 2974916 - protein, 24 aa, Entamoeba invadens
VRSNSKGGIGFLADHRRLNVALTR

SEQ ID NO: 2974917 - protein, 21 aa, Entamoeba invadens
VRSVGRFCFYNSVGEENIIFE

SEQ ID NO: 2974918 - protein, 20 aa, Entamoeba invadens
VRSVLLIFGELNFKSGNKEL

SEQ ID NO: 2974919 - protein, 31 aa, Entamoeba invadens
VRTIGKQCFKGCGLLKIIPLPITVESYGAST

SEQ ID NO: 2974920 - protein, 19 aa, Entamoeba invadens
VRTKNGWRQLSGNEMSNII

SEQ ID NO: 2974921 - protein, 20 aa, Entamoeba invadens
VRTLLFTAVFSKPVHARKLL

SEQ ID NO: 2974922 - protein, 21 aa, Entamoeba invadens
VRTLQAATHFKYITGKSPITG

SEQ ID NO: 2974923 - protein, 19 aa, Entamoeba invadens
VRTQNMWKIPTPVQKTLQT

SEQ ID NO: 2974924 - protein, 17 aa, Entamoeba invadens
VRTRGGKRLVVVKHETV

SEQ ID NO: 2974925 - protein, 21 aa, Entamoeba invadens
VRTSFCLDTIEIAEDMKIDGK

SEQ ID NO: 2974926 - protein, 17 aa, Entamoeba invadens
VRVICWEYPGFCEENPQ

SEQ ID NO: 2974927 - protein, 24 aa, Entamoeba invadens
VRVLLKCLVNLGGMDIDGYEESDD

SEQ ID NO: 2974928 - protein, 17 aa, Entamoeba invadens
VRVLPLINYQNFQMNIS

SEQ ID NO: 2974929 - protein, 17 aa, Entamoeba invadens
VRVNISQIFVRFSNRDL

SEQ ID NO: 2974930 - protein, 17 aa, Entamoeba invadens
VRVSRKFKDVLLQFHIN

SEQ ID NO: 2974931 - protein, 28 aa, Entamoeba invadens
VRVTEIPRSEAFIFIGYDEDTINTYTNT

SEQ ID NO: 2974932 - protein, 19 aa, Entamoeba invadens
VRWIESMVGVGIDPDLCKS

SEQ ID NO: 2974933 - protein, 24 aa, Entamoeba invadens
VRYFADGYQFGWVNANNIKPFGEN

SEQ ID NO: 2974934 - protein, 17 aa, Entamoeba invadens
VRYKNGTKNIDFVDARN

SEQ ID NO: 2974935 - protein, 17 aa, Entamoeba invadens
VRYMALKLLDNINNKFV

SEQ ID NO: 2974936 - protein, 25 aa, Entamoeba invadens
VRYNLFCLLKSPILKMEKNYITAAH

SEQ ID NO: 2974937 - protein, 41 aa, Entamoeba invadens
VRYPLPEIFNLPKGWGMGCDRGELYFINWNKKYTTWIDPRT

SEQ ID NO: 2974938 - protein, 22 aa, Entamoeba invadens
VRYPPPEWNQSLDLLMKTNNWS

SEQ ID NO: 2974939 - protein, 25 aa, Entamoeba invadens
VRYWPEDTFSVFFDRNRLQSVINSF

SEQ ID NO: 2974940 - protein, 20 aa, Entamoeba invadens
VSAFGKCYNLLEVVIPKSIK

SEQ ID NO: 2974941 - protein, 18 aa, Entamoeba invadens
VSAGKTSEGIKCLETAIT

SEQ ID NO: 2974942 - protein, 25 aa, Entamoeba invadens
VSAHLHEWIDLIFGYKQQGEAALKA

SEQ ID NO: 2974943 - protein, 24 aa, Entamoeba invadens
VSAIYPGCFYDCNFIDKVTIPPSV

SEQ ID NO: 2974944 - protein, 24 aa, Entamoeba invadens
VSAIYPGCFYDCNFINKVTIPPSV

SEQ ID NO: 2974945 - protein, 24 aa, Entamoeba invadens
VSAKEMKNSPIVVFVKVLRKGGDD

SEQ ID NO: 2974946 - protein, 20 aa, Entamoeba invadens
VSAKVVTFGRTYVKSKGFGF

SEQ ID NO: 2974947 - protein, 18 aa, Entamoeba invadens
VSALRALVFVKLIGPALV

SEQ ID NO: 2974948 - protein, 25 aa, Entamoeba invadens
VSALRIRLGVKGERYLHGTVSDFEM

SEQ ID NO: 2974949 - protein, 20 aa, Entamoeba invadens
VSANCITDAIAYWMDNKVIT

SEQ ID NO: 2974950 - protein, 31 aa, Entamoeba invadens
VSAQRDPKKWWKFAFTATRDYLRQKEEDKTP

SEQ ID NO: 2974951 - protein, 24 aa, Entamoeba invadens
VSARSGKNVTDFFVTLAKLLLKAK

SEQ ID NO: 2974952 - protein, 20 aa, Entamoeba invadens
VSAYWIDYGHIIKCSSSSYY

SEQ ID NO: 2974953 - protein, 20 aa, Entamoeba invadens
VSCGEALQPTQYVFIPQESH

SEQ ID NO: 2974954 - protein, 24 aa, Entamoeba invadens
VSCGSCHTLALNVWGEIFSWGQDD

SEQ ID NO: 2974955 - protein, 25 aa, Entamoeba invadens
VSCIPDFLCDSCSSLKRVEVSKKLI

SEQ ID NO: 2974956 - protein, 22 aa, Entamoeba invadens
VSCTNAGFGKSLIKSASELDDL

SEQ ID NO: 2974957 - protein, 27 aa, Entamoeba invadens
VSCVCKILCVPGCPFQPQAILPQLIRF

SEQ ID NO: 2974958 - protein, 25 aa, Entamoeba invadens
VSDDELRARLDVIEKREAEVAQKEK

SEQ ID NO: 2974959 - protein, 24 aa, Entamoeba invadens
VSDEEYDVLLSLDFFNKSTSDNKM

SEQ ID NO: 2974960 - protein, 18 aa, Entamoeba invadens
VSDEVFRRTLTYLMSTNK

SEQ ID NO: 2974961 - protein, 26 aa, Entamoeba invadens
VSDFEMFNCLSLIKAIVTDSPLCRNE

SEQ ID NO: 2974962 - protein, 27 aa, Entamoeba invadens
VSDFPRNYFCKSVKFTLQRNEGGCDVS

SEQ ID NO: 2974963 - protein, 21 aa, Entamoeba invadens
VSDGRCVLVGLKADLKDVKQS

SEQ ID NO: 2974964 - protein, 17 aa, Entamoeba invadens
VSDGVRIISEFVGSERT

SEQ ID NO: 2974965 - protein, 26 aa, Entamoeba invadens
VSDHLNEWIDLIFGYKQRGEMAEKWC

SEQ ID NO: 2974966 - protein, 31 aa, Entamoeba invadens
VSDHRRMNVALTRARKGLVVVGNMRTLSTDQ

SEQ ID NO: 2974967 - protein, 24 aa, Entamoeba invadens
VSDKKRLGTFIFNIIDEDRSGNIS

SEQ ID NO: 2974968 - protein, 18 aa, Entamoeba invadens
VSDKVCYVGVGPKLYNVS

SEQ ID NO: 2974969 - protein, 18 aa, Entamoeba invadens
VSDLIPYIMQIALKKLCS

SEQ ID NO: 2974970 - protein, 23 aa, Entamoeba invadens
VSDNRFGVILKFNQLKEELSRLL

SEQ ID NO: 2974971 - protein, 23 aa, Entamoeba invadens
VSDRMIYKLGYVNRVMDILRRRR

SEQ ID NO: 2974972 - protein, 26 aa, Entamoeba invadens
VSDRMMYKLGYVDRVMDVLKRRQNNV

SEQ ID NO: 2974973 - protein, 18 aa, Entamoeba invadens
VSDSLVFFHPAIKSLFGG

SEQ ID NO: 2974974 - protein, 32 aa, Entamoeba invadens
VSDYVVSGVFLKDAFMDVCLYKMSQYKTVMKK

SEQ ID NO: 2974975 - protein, 25 aa, Entamoeba invadens
VSEALKKLQTEFERKTSEDETLKQE

SEQ ID NO: 2974976 - protein, 17 aa, Entamoeba invadens
VSECADLLQAIVMIPME

SEQ ID NO: 2974977 - protein, 17 aa, Entamoeba invadens
VSECSRVNNIIQFYGSN

SEQ ID NO: 2974978 - protein, 18 aa, Entamoeba invadens
VSEECPEAILLINKSVSF

SEQ ID NO: 2974979 - protein, 18 aa, Entamoeba invadens
VSEECPEAILLINQSVTI

SEQ ID NO: 2974980 - protein, 17 aa, Entamoeba invadens
VSEEFKNTLNVIKGDTV

SEQ ID NO: 2974981 - protein, 19 aa, Entamoeba invadens
VSEEQAMEWCKLHNHQYFE

SEQ ID NO: 2974982 - protein, 17 aa, Entamoeba invadens
VSEFGVVMLRRLLENPE

SEQ ID NO: 2974983 - protein, 22 aa, Entamoeba invadens
VSEFLTSELLRLLHKKRGVNYK

SEQ ID NO: 2974984 - protein, 17 aa, Entamoeba invadens
VSEFMTWVEDEERLSVE

SEQ ID NO: 2974985 - protein, 17 aa, Entamoeba invadens
VSEFVESYTSYKQTILE

SEQ ID NO: 2974986 - protein, 29 aa, Entamoeba invadens
VSELLKCRLLRKIDVRGCNVVKQYKTACV

SEQ ID NO: 2974987 - protein, 19 aa, Entamoeba invadens
VSEMLKPILCRFCGKTPHF

SEQ ID NO: 2974988 - protein, 22 aa, Entamoeba invadens
VSENLLAGVAMERRCVYMFGSN

SEQ ID NO: 2974989 - protein, 18 aa, Entamoeba invadens
VSENPVYYSLVLKHVIMK

SEQ ID NO: 2974990 - protein, 23 aa, Entamoeba invadens
VSERELYKPISFSIVSKLSSKLD

SEQ ID NO: 2974991 - protein, 30 aa, Entamoeba invadens
VSESLLALKFWKLDFGKEWCDKNMTDPHEV

SEQ ID NO: 2974992 - protein, 19 aa, Entamoeba invadens
VSESVKFFLQIVSALEYIH

SEQ ID NO: 2974993 - protein, 18 aa, Entamoeba invadens
VSEVAKRLGVPITSAEIL

SEQ ID NO: 2974994 - protein, 23 aa, Entamoeba invadens
VSEVFRWKYPLPGDGDFSYVCCN

SEQ ID NO: 2974995 - protein, 21 aa, Entamoeba invadens
VSEYAKALLLLILREKKCVLA

SEQ ID NO: 2974996 - protein, 18 aa, Entamoeba invadens
VSFEFDNALPFVVPSYEF

SEQ ID NO: 2974997 - protein, 27 aa, Entamoeba invadens
VSFGCSICRIGGLAFCECKSLVDVKLP

SEQ ID NO: 2974998 - protein, 18 aa, Entamoeba invadens
VSFGSQFDSLFSGLKKYD

SEQ ID NO: 2974999 - protein, 19 aa, Entamoeba invadens
VSFHPCVRIGRWEQQKVLS

SEQ ID NO: 2975000 - protein, 23 aa, Entamoeba invadens
VSFLEGLVFVFVYFMDVAHAEEC

SEQ ID NO: 2975001 - protein, 24 aa, Entamoeba invadens
VSFLGNSCFENCFSLKKVVFPSFF

SEQ ID NO: 2975002 - protein, 20 aa, Entamoeba invadens
VSFNKALLMGMYQFFVVPDK

SEQ ID NO: 2975003 - protein, 21 aa, Entamoeba invadens
VSFNLCERVSRLGIAEIANEV

SEQ ID NO: 2975004 - protein, 21 aa, Entamoeba invadens
VSFRRRFLETFTEFQKQNFPN

SEQ ID NO: 2975005 - protein, 18 aa, Entamoeba invadens
VSFSHGRIYPAMLEQYGV

SEQ ID NO: 2975006 - protein, 27 aa, Entamoeba invadens
VSFSRRVSVRLSFRIMEIMGMVAVCPD

SEQ ID NO: 2975007 - protein, 27 aa, Entamoeba invadens
VSFYTLKVPIYFMMKKVESIEPRQSAE

SEQ ID NO: 2975008 - protein, 24 aa, Entamoeba invadens
VSGCPLKVLRMAGGKDKGGKLGIN

SEQ ID NO: 2975009 - protein, 23 aa, Entamoeba invadens
VSGCSVLTSLVCENGTSFDLKKI

SEQ ID NO: 2975010 - protein, 17 aa, Entamoeba invadens
VSGDLSGVVKVWDIMGV

SEQ ID NO: 2975011 - protein, 17 aa, Entamoeba invadens
VSGEMKYTNILYCSYDE

SEQ ID NO: 2975012 - protein, 17 aa, Entamoeba invadens
VSGKLKISATVVVNEEE

SEQ ID NO: 2975013 - protein, 20 aa, Entamoeba invadens
VSGKMLYNFIEDGVKVIGEI

SEQ ID NO: 2975014 - protein, 17 aa, Entamoeba invadens
VSGLGLQYIKGREWFCQ

SEQ ID NO: 2975015 - protein, 17 aa, Entamoeba invadens
VSGLGLQYVKGREWFCQ

SEQ ID NO: 2975016 - protein, 18 aa, Entamoeba invadens
VSGLILAGIADFKTVLNK

SEQ ID NO: 2975017 - protein, 17 aa, Entamoeba invadens
VSGNVQIWGIWSTIKPL

SEQ ID NO: 2975018 - protein, 21 aa, Entamoeba invadens
VSGPCTFGPGLFVSGPCTFVP

SEQ ID NO: 2975019 - protein, 17 aa, Entamoeba invadens
VSGRTPFHYAVLGGHLG

SEQ ID NO: 2975020 - protein, 27 aa, Entamoeba invadens
VSGRVVGKFRFRMMLERSQVHTVFRIP

SEQ ID NO: 2975021 - protein, 18 aa, Entamoeba invadens
VSGSRLTPYIIEKGTMTR

SEQ ID NO: 2975022 - protein, 17 aa, Entamoeba invadens
VSGSVLRQGKCSKEGRT

SEQ ID NO: 2975023 - protein, 19 aa, Entamoeba invadens
VSGYCYGKLVSKYTKTFES

SEQ ID NO: 2975024 - protein, 18 aa, Entamoeba invadens
VSGYKLKTNSFFHSRKSQ

SEQ ID NO: 2975025 - protein, 27 aa, Entamoeba invadens
VSHDWKCLELLLKFLADSSVYLDTERF

SEQ ID NO: 2975026 - protein, 25 aa, Entamoeba invadens
VSHFHEFPKVYLALAKEKLLENMKG

SEQ ID NO: 2975027 - protein, 25 aa, Entamoeba invadens
VSHLAWKISECVRGFSKDIPVTKLQ

SEQ ID NO: 2975028 - protein, 18 aa, Entamoeba invadens
VSHPFITGMEITKLANER

SEQ ID NO: 2975029 - protein, 28 aa, Entamoeba invadens
VSHPQNRWMIQFPRIFHVCRGKKENFTF

SEQ ID NO: 2975030 - protein, 29 aa, Entamoeba invadens
VSHQLSLRPLLSWKDARVIELAEKHNGAV

SEQ ID NO: 2975031 - protein, 22 aa, Entamoeba invadens
VSHTLLPTSKQHLFFQNYQYQQ

SEQ ID NO: 2975032 - protein, 17 aa, Entamoeba invadens
VSIAFQIIQYVFYNPNT

SEQ ID NO: 2975033 - protein, 22 aa, Entamoeba invadens
VSICHRHHVVIISDEIHCDIIL

SEQ ID NO: 2975034 - protein, 25 aa, Entamoeba invadens
VSIDVTSCFPWFSSKTETKCFESSS

SEQ ID NO: 2975035 - protein, 17 aa, Entamoeba invadens
VSIGEEMNGWDAFVKTS

SEQ ID NO: 2975036 - protein, 18 aa, Entamoeba invadens
VSIIDVPSGVLFCAKYAF

SEQ ID NO: 2975037 - protein, 20 aa, Entamoeba invadens
VSIIYRADDYYKMFIDGGTN

SEQ ID NO: 2975038 - protein, 23 aa, Entamoeba invadens
VSIKEVIKELVNYVLNNVKKVLD

SEQ ID NO: 2975039 - protein, 27 aa, Entamoeba invadens
VSILPELCFHECIKMTGITLPKGVKYI

SEQ ID NO: 2975040 - protein, 24 aa, Entamoeba invadens
VSINPHGPWCLIPTDLETHFQTVF

SEQ ID NO: 2975041 - protein, 23 aa, Entamoeba invadens
VSIPINCTLFLKKNGYEEKGLEL

SEQ ID NO: 2975042 - protein, 17 aa, Entamoeba invadens
VSIPLKKVFLIPQTHDG

SEQ ID NO: 2975043 - protein, 23 aa, Entamoeba invadens
VSIRVLSKFSMRLKDWEAVFDDA

SEQ ID NO: 2975044 - protein, 17 aa, Entamoeba invadens
VSISVKRGEYVCIYGTS

SEQ ID NO: 2975045 - protein, 26 aa, Entamoeba invadens
VSITANCGYALFGLKHHCELYRCSSS

SEQ ID NO: 2975046 - protein, 20 aa, Entamoeba invadens
VSITLIVNEFIHLMQHAIDS

SEQ ID NO: 2975047 - protein, 22 aa, Entamoeba invadens
VSIVQHLKLYKRIFTSYLDSPI

SEQ ID NO: 2975048 - protein, 26 aa, Entamoeba invadens
VSIVRPRSLLFISIDGVCPVAKMVQQ

SEQ ID NO: 2975049 - protein, 19 aa, Entamoeba invadens
VSIYVLESFGLKVKDQKSL

SEQ ID NO: 2975050 - protein, 23 aa, Entamoeba invadens
VSKAGAIQRCGRAGRTEEGICYR

SEQ ID NO: 2975051 - protein, 24 aa, Entamoeba invadens
VSKALLPCIVLFPDVYKTVKNTAI

SEQ ID NO: 2975052 - protein, 23 aa, Entamoeba invadens
VSKDRLKAVVGNVQRLGITNTIV

SEQ ID NO: 2975053 - protein, 23 aa, Entamoeba invadens
VSKDVLWCLSNIVASNLTSVHNK

SEQ ID NO: 2975054 - protein, 23 aa, Entamoeba invadens
VSKEILLFLKAMLNIRNTNNKEI

SEQ ID NO: 2975055 - protein, 25 aa, Entamoeba invadens
VSKELKDFIARCFVFDFKQRPSCAE

SEQ ID NO: 2975056 - protein, 19 aa, Entamoeba invadens
VSKEWFSLITKEIFNVDFG

SEQ ID NO: 2975057 - protein, 25 aa, Entamoeba invadens
VSKGKVVGDFKCRGIYYESERTKKL

SEQ ID NO: 2975058 - protein, 17 aa, Entamoeba invadens
VSKGVGFYFGYTEEIDT

SEQ ID NO: 2975059 - protein, 30 aa, Entamoeba invadens
VSKIGKTCFRYCIFLHDIKLPIGLKEIPKK

SEQ ID NO: 2975060 - protein, 26 aa, Entamoeba invadens
VSKIGKTCFRYCIFLQDIKLLGLKEI

SEQ ID NO: 2975061 - protein, 25 aa, Entamoeba invadens
VSKIPKFCFNFCFSMKHIEIPNTVV

SEQ ID NO: 2975062 - protein, 24 aa, Entamoeba invadens
VSKIPRGCFENCFGLKEVVSSEFL

SEQ ID NO: 2975063 - protein, 25 aa, Entamoeba invadens
VSKKEKYKILSIDGGGMKGILEAIL

SEQ ID NO: 2975064 - protein, 25 aa, Entamoeba invadens
VSKKGRASLPAGIKIPHPDTDKIEH

SEQ ID NO: 2975065 - protein, 20 aa, Entamoeba invadens
VSKKLARPVGAKYSGERKID

SEQ ID NO: 2975066 - protein, 34 aa, Entamoeba invadens
VSKKRKGLESGSCLDVPLLLKWTDEYEPLPTDPW

SEQ ID NO: 2975067 - protein, 25 aa, Entamoeba invadens
VSKLFKEIIEKLVIYIDTVKEDQTE

SEQ ID NO: 2975068 - protein, 20 aa, Entamoeba invadens
VSKNALNRVAIWAIGEYGDL

SEQ ID NO: 2975069 - protein, 17 aa, Entamoeba invadens
VSKNTYERYMFERASMK

SEQ ID NO: 2975070 - protein, 17 aa, Entamoeba invadens
VSKRKAKMVKNIANNID

SEQ ID NO: 2975071 - protein, 23 aa, Entamoeba invadens
VSKRPRRQGSLWLPEEDAKLLEA

SEQ ID NO: 2975072 - protein, 22 aa, Entamoeba invadens
VSKRYPSKIEVLLKYKPVKDED

SEQ ID NO: 2975073 - protein, 23 aa, Entamoeba invadens
VSKSCLESVKMLHINPWFISIQN

SEQ ID NO: 2975074 - protein, 21 aa, Entamoeba invadens
VSKVKAGLKVAKGLKKAATGK

SEQ ID NO: 2975075 - protein, 21 aa, Entamoeba invadens
VSKVMPIPWCHPTDVKQGLRR

SEQ ID NO: 2975076 - protein, 20 aa, Entamoeba invadens
VSKYALFVFLKRVIMCDVDK

SEQ ID NO: 2975077 - protein, 25 aa, Entamoeba invadens
VSKYVTGICFRKHVAEIPPDDLSDV

SEQ ID NO: 2975078 - protein, 19 aa, Entamoeba invadens
VSLAALILHQIGKDITAET

SEQ ID NO: 2975079 - protein, 18 aa, Entamoeba invadens
VSLDCLKDLTSVDMSVVK

SEQ ID NO: 2975080 - protein, 19 aa, Entamoeba invadens
VSLDRLIYLMKIFGEFFYK

SEQ ID NO: 2975081 - protein, 28 aa, Entamoeba invadens
VSLECRKLSSVIYPSFVSFINDMCLVDV

SEQ ID NO: 2975082 - protein, 26 aa, Entamoeba invadens
VSLFTDERHTVWLPINMNIENLSLTE

SEQ ID NO: 2975083 - protein, 25 aa, Entamoeba invadens
VSLGKNCFYDCLKLSKIDMPTSVSY

SEQ ID NO: 2975084 - protein, 17 aa, Entamoeba invadens
VSLGLSKCLCDVKLGEA

SEQ ID NO: 2975085 - protein, 19 aa, Entamoeba invadens
VSLGLVIISGFFVFEESAL

SEQ ID NO: 2975086 - protein, 19 aa, Entamoeba invadens
VSLICAFAGAVLAIHVTSQ

SEQ ID NO: 2975087 - protein, 20 aa, Entamoeba invadens
VSLINIFKTGGFAKMQSAVD

SEQ ID NO: 2975088 - protein, 17 aa, Entamoeba invadens
VSLKNLAAKSCRMSIIS

SEQ ID NO: 2975089 - protein, 23 aa, Entamoeba invadens
VSLKNLADRVVWMRDGKVGKIEN

SEQ ID NO: 2975090 - protein, 25 aa, Entamoeba invadens
VSLKRSEVDWLLVMSDGITDVVTEK

SEQ ID NO: 2975091 - protein, 17 aa, Entamoeba invadens
VSLKYFPICSTLKSIGR

SEQ ID NO: 2975092 - protein, 28 aa, Entamoeba invadens
VSLLEYHKKSGLLFPSFLADATNYMKQT

SEQ ID NO: 2975093 - protein, 18 aa, Entamoeba invadens
VSLLPEVPTDLSVLPDNQ

SEQ ID NO: 2975094 - protein, 19 aa, Entamoeba invadens
VSLNFKRSALAANFALSDA

SEQ ID NO: 2975095 - protein, 19 aa, Entamoeba invadens
VSLNGEYKKTAALTKADKI

SEQ ID NO: 2975096 - protein, 17 aa, Entamoeba invadens
VSLPEWHSTGVVPSYYG

SEQ ID NO: 2975097 - protein, 25 aa, Entamoeba invadens
VSLPGIKLSNSFNWNYGFDSTFTSL

SEQ ID NO: 2975098 - protein, 25 aa, Entamoeba invadens
VSLRPHPFDPFVVSAIPFINDPFQT

SEQ ID NO: 2975099 - protein, 17 aa, Entamoeba invadens
VSLRRYQELQIFDLKQI

SEQ ID NO: 2975100 - protein, 18 aa, Entamoeba invadens
VSLSKKARTDCGINVLVH

SEQ ID NO: 2975101 - protein, 23 aa, Entamoeba invadens
VSLTRLRCFIGYFHVIHNNMKNQ

SEQ ID NO: 2975102 - protein, 18 aa, Entamoeba invadens
VSLVIAFAGIPPQTTTLD

SEQ ID NO: 2975103 - protein, 20 aa, Entamoeba invadens
VSLYKKRTVMDIELVLPGLL

SEQ ID NO: 2975104 - protein, 23 aa, Entamoeba invadens
VSMAWLDECLKLQKSVEKELFLY

SEQ ID NO: 2975105 - protein, 19 aa, Entamoeba invadens
VSMCGLKLSQLCDKVDTFS

SEQ ID NO: 2975106 - protein, 19 aa, Entamoeba invadens
VSMKCFNLFYGCYSCDYKQ

SEQ ID NO: 2975107 - protein, 25 aa, Entamoeba invadens
VSMKCSNLFYGCYSCDYKQLNLTID

SEQ ID NO: 2975108 - protein, 25 aa, Entamoeba invadens
VSMKGDLDVGVLICNKEIIPFDMRR

SEQ ID NO: 2975109 - protein, 25 aa, Entamoeba invadens
VSMKGWATACRWAKEIVRCNEDEIR

SEQ ID NO: 2975110 - protein, 24 aa, Entamoeba invadens
VSMKKANNLIGIWVDTKDSNFKDN

SEQ ID NO: 2975111 - protein, 24 aa, Entamoeba invadens
VSMKSPRKSMMFIFDSSQNASVDL

SEQ ID NO: 2975112 - protein, 18 aa, Entamoeba invadens
VSMPDGWEFPSKKHTEQC

SEQ ID NO: 2975113 - protein, 23 aa, Entamoeba invadens
VSMPRSGSTFAHHVMSSDPLATS

SEQ ID NO: 2975114 - protein, 23 aa, Entamoeba invadens
VSMPRSGSTFAHSVMSSDPYATS

SEQ ID NO: 2975115 - protein, 26 aa, Entamoeba invadens
VSNDFRAELELALYELHEIWMLSEEM

SEQ ID NO: 2975116 - protein, 22 aa, Entamoeba invadens
VSNDNCTYCFGCTNHCIDGYKC

SEQ ID NO: 2975117 - protein, 26 aa, Entamoeba invadens
VSNEAKFDREFIRLRRFVFGMCKKNF

SEQ ID NO: 2975118 - protein, 20 aa, Entamoeba invadens
VSNFAEWRDSTLVYRRYANL

SEQ ID NO: 2975119 - protein, 26 aa, Entamoeba invadens
VSNINFYCFPELFKPRKQVIDIKEPF

SEQ ID NO: 2975120 - protein, 34 aa, Entamoeba invadens
VSNLFLEFFKSMLGHFRYYFDVSKDGGTGFNVEA

SEQ ID NO: 2975121 - protein, 18 aa, Entamoeba invadens
VSNLIGVQILSMSKRIMN

SEQ ID NO: 2975122 - protein, 26 aa, Entamoeba invadens
VSNLTNWGIALKYFFLDIGFTAKHLL

SEQ ID NO: 2975123 - protein, 25 aa, Entamoeba invadens
VSNRASFEGISFWIADVKEKGNTKY

SEQ ID NO: 2975124 - protein, 22 aa, Entamoeba invadens
VSNTMKNCLSRSSFKEKGEEKT

SEQ ID NO: 2975125 - protein, 19 aa, Entamoeba invadens
VSPAFSFALSAGRQDVLSD

SEQ ID NO: 2975126 - protein, 22 aa, Entamoeba invadens
VSPCDILICCGDHLNFVTTDEI

SEQ ID NO: 2975127 - protein, 30 aa, Entamoeba invadens
VSPELCGMRLCKLAVMLVALGGVPHLDEVT

SEQ ID NO: 2975128 - protein, 18 aa, Entamoeba invadens
VSPFKMAKLTIENNINFV

SEQ ID NO: 2975129 - protein, 24 aa, Entamoeba invadens
VSPFKYEFPVIPVLTKSTFDLIDS

SEQ ID NO: 2975130 - protein, 32 aa, Entamoeba invadens
VSPFREFIRSGLLMKVCRKFNKERYFYLFNDM

SEQ ID NO: 2975131 - protein, 26 aa, Entamoeba invadens
VSPGEFACGVGRGSKKLLTSTGSGVL

SEQ ID NO: 2975132 - protein, 25 aa, Entamoeba invadens
VSPGVCYRLYTKEAFIKELPAATPP

SEQ ID NO: 2975133 - protein, 21 aa, Entamoeba invadens
VSPLCTVIVQLLLREAVTVVF

SEQ ID NO: 2975134 - protein, 26 aa, Entamoeba invadens
VSPLPKIRGADCFKDCKLLNLKLDGG

SEQ ID NO: 2975135 - protein, 25 aa, Entamoeba invadens
VSPNMGMLRQVNFQMAMNPAFMGQM

SEQ ID NO: 2975136 - protein, 19 aa, Entamoeba invadens
VSPPFYFAVTCGRQELFDE

SEQ ID NO: 2975137 - protein, 25 aa, Entamoeba invadens
VSPPKYCVRPSVVSFIDTMEVSEGS

SEQ ID NO: 2975138 - protein, 20 aa, Entamoeba invadens
VSPQFSQKVEKVFKVDKKKG

SEQ ID NO: 2975139 - protein, 17 aa, Entamoeba invadens
VSPQKKFVIPFTAQPSE

SEQ ID NO: 2975140 - protein, 18 aa, Entamoeba invadens
VSPRGMNGSSHMSTVSMA

SEQ ID NO: 2975141 - protein, 20 aa, Entamoeba invadens
VSPSRYGLATVHDRDVLIYC

SEQ ID NO: 2975142 - protein, 33 aa, Entamoeba invadens
VSPYLIRFYGACFIPNRICMVTELAKYGSLQDM

SEQ ID NO: 2975143 - protein, 26 aa, Entamoeba invadens
VSPYLRQFLLACFDRDINLRKTAKEL

SEQ ID NO: 2975144 - protein, 23 aa, Entamoeba invadens
VSQEMKCVVAHKLFEDGMNYLKL

SEQ ID NO: 2975145 - protein, 20 aa, Entamoeba invadens
VSQFIQRDWVRNGSDAEQQF

SEQ ID NO: 2975146 - protein, 22 aa, Entamoeba invadens
VSQGNVLFEWIVTMRLALRCLI

SEQ ID NO: 2975147 - protein, 26 aa, Entamoeba invadens
VSQHKPVICSASLYLQEFDKKKKAEV

SEQ ID NO: 2975148 - protein, 23 aa, Entamoeba invadens
VSQKSELRRCTKLNSPRKSKKSE

SEQ ID NO: 2975149 - protein, 26 aa, Entamoeba invadens
VSQLDERLVWFVTFVFEKRIRREWFE

SEQ ID NO: 2975150 - protein, 31 aa, Entamoeba invadens
VSQRWLPEVKHFCPNAPFLLAATKTDLRESE

SEQ ID NO: 2975151 - protein, 24 aa, Entamoeba invadens
VSQVVDIFGVFKFKVKQGDDLLNE

SEQ ID NO: 2975152 - protein, 24 aa, Entamoeba invadens
VSRCASMFETLNRWLYSPNSLTKT

SEQ ID NO: 2975153 - protein, 36 aa, Entamoeba invadens
VSRFLCNDCGLDFKKRFGSFKFNWMEPFNNTEFLMF

SEQ ID NO: 2975154 - protein, 19 aa, Entamoeba invadens
VSRKERRIQVSSLMLIGHI

SEQ ID NO: 2975155 - protein, 24 aa, Entamoeba invadens
VSRKRFIKSAIQFARKYNMDGIDI

SEQ ID NO: 2975156 - protein, 23 aa, Entamoeba invadens
VSRKVKMSKEFQVVSPHYVMDER

SEQ ID NO: 2975157 - protein, 24 aa, Entamoeba invadens
VSRNFSWPCSDFVSVREIQTAMNL

SEQ ID NO: 2975158 - protein, 24 aa, Entamoeba invadens
VSRRFSRDNIEIMFHVSTYMPLME

SEQ ID NO: 2975159 - protein, 20 aa, Entamoeba invadens
VSRYAVVDWCSPDAVRTREI

SEQ ID NO: 2975160 - protein, 17 aa, Entamoeba invadens
VSSCIRMLLDIPNATNL

SEQ ID NO: 2975161 - protein, 23 aa, Entamoeba invadens
VSSDGRSGVLLSSEIEETRSGKN

SEQ ID NO: 2975162 - protein, 17 aa, Entamoeba invadens
VSSEIDPFFPLNGDYSK

SEQ ID NO: 2975163 - protein, 24 aa, Entamoeba invadens
VSSEYLVHAGVKCYAIAETHKYGH

SEQ ID NO: 2975164 - protein, 23 aa, Entamoeba invadens
VSSFECYQNWFGRQSLLVPQISN

SEQ ID NO: 2975165 - protein, 19 aa, Entamoeba invadens
VSSFRLLRSLPLSCYIDKV

SEQ ID NO: 2975166 - protein, 17 aa, Entamoeba invadens
VSSGFEFGWNKLVENND

SEQ ID NO: 2975167 - protein, 23 aa, Entamoeba invadens
VSSHPNSSLLIMRSEIEETEPQF

SEQ ID NO: 2975168 - protein, 20 aa, Entamoeba invadens
VSSIELMWTIYRRWDEYVKY

SEQ ID NO: 2975169 - protein, 25 aa, Entamoeba invadens
VSSKGDSALNCLCNASLNIEALELL

SEQ ID NO: 2975170 - protein, 17 aa, Entamoeba invadens
VSSLFYPLLTLREQESD

SEQ ID NO: 2975171 - protein, 21 aa, Entamoeba invadens
VSSLGLKTSNSFECGLVSLIS

SEQ ID NO: 2975172 - protein, 17 aa, Entamoeba invadens
VSSLLGLLTETYHLIIY

SEQ ID NO: 2975173 - protein, 24 aa, Entamoeba invadens
VSSLPYKLTLSIRSSNEITFGEVK

SEQ ID NO: 2975174 - protein, 17 aa, Entamoeba invadens
VSSLRIEPTPLLLTAIV

SEQ ID NO: 2975175 - protein, 21 aa, Entamoeba invadens
VSSLSLFYSFFMKDITLPKLY

SEQ ID NO: 2975176 - protein, 19 aa, Entamoeba invadens
VSSLTGFNVYTAIKTMSSI

SEQ ID NO: 2975177 - protein, 23 aa, Entamoeba invadens
VSSREFPDPISPKSDNSENGIKG

SEQ ID NO: 2975178 - protein, 20 aa, Entamoeba invadens
VSSRMCLVCISSENEKNEIA

SEQ ID NO: 2975179 - protein, 26 aa, Entamoeba invadens
VSSSYSSSCGRKPSPPKYGNVSPNSF

SEQ ID NO: 2975180 - protein, 18 aa, Entamoeba invadens
VSSVELYKLPTIPENLAL

SEQ ID NO: 2975181 - protein, 22 aa, Entamoeba invadens
VSTCAKCNVKGGYYQYVEFTTI

SEQ ID NO: 2975182 - protein, 30 aa, Entamoeba invadens
VSTCCDGKCSVVFALFWKGGLFGVFNRELL

SEQ ID NO: 2975183 - protein, 17 aa, Entamoeba invadens
VSTDLLCGCITKCRTVY

SEQ ID NO: 2975184 - protein, 19 aa, Entamoeba invadens
VSTEAFFFVNAVAASLEKN

SEQ ID NO: 2975185 - protein, 24 aa, Entamoeba invadens
VSTKCKSVLGAVLLSAGLTTDVAI

SEQ ID NO: 2975186 - protein, 17 aa, Entamoeba invadens
VSTKFTAKNYIASGYHC

SEQ ID NO: 2975187 - protein, 23 aa, Entamoeba invadens
VSTKNFFLFTWKNKIFKTYERKE

SEQ ID NO: 2975188 - protein, 18 aa, Entamoeba invadens
VSTKRFDCENFRLFDEYE

SEQ ID NO: 2975189 - protein, 25 aa, Entamoeba invadens
VSTKYSLLFVNRVRSVLGIAPVSEN

SEQ ID NO: 2975190 - protein, 24 aa, Entamoeba invadens
VSTLDWDVTLCRIFINRLTQTQLL

SEQ ID NO: 2975191 - protein, 25 aa, Entamoeba invadens
VSTQKQAYFSMCYFSEECTSSLTNV

SEQ ID NO: 2975192 - protein, 24 aa, Entamoeba invadens
VSTRHLPDFERFFLSMITSLGFQC

SEQ ID NO: 2975193 - protein, 21 aa, Entamoeba invadens
VSTRIIGTVALVLSTVAMISE

SEQ ID NO: 2975194 - protein, 17 aa, Entamoeba invadens
VSTRPILLITNRNHDIS

SEQ ID NO: 2975195 - protein, 20 aa, Entamoeba invadens
VSTYLVTPILHFTEYGAVMR

SEQ ID NO: 2975196 - protein, 22 aa, Entamoeba invadens
VSTYRIGVIYIKEGQNTENEYF

SEQ ID NO: 2975197 - protein, 27 aa, Entamoeba invadens
VSVCIIAVQLLMRFEIIHSKNVIHRDV

SEQ ID NO: 2975198 - protein, 17 aa, Entamoeba invadens
VSVCIQYGVLIKNVTEV

SEQ ID NO: 2975199 - protein, 25 aa, Entamoeba invadens
VSVEFLKAIVLPGIGFIGVADDKVV

SEQ ID NO: 2975200 - protein, 20 aa, Entamoeba invadens
VSVGCFMFCSSLKSLEIEED

SEQ ID NO: 2975201 - protein, 18 aa, Entamoeba invadens
VSVGKGYEVMDKCDESGC

SEQ ID NO: 2975202 - protein, 24 aa, Entamoeba invadens
VSVKDNHWLFVFGKNEARDTRDIC

SEQ ID NO: 2975203 - protein, 24 aa, Entamoeba invadens
VSVKSKRVRPALMGNTYELVSFEF

SEQ ID NO: 2975204 - protein, 17 aa, Entamoeba invadens
VSVKVPLHVGWSKMKEE

SEQ ID NO: 2975205 - protein, 24 aa, Entamoeba invadens
VSVLDPRVGNFVSRTQVSNHLVNH

SEQ ID NO: 2975206 - protein, 27 aa, Entamoeba invadens
VSVLPFCCFMRCGSLKRFVIPRTVQYM

SEQ ID NO: 2975207 - protein, 19 aa, Entamoeba invadens
VSVLPQFWTALDKLFEKAL

SEQ ID NO: 2975208 - protein, 21 aa, Entamoeba invadens
VSVLVRGANRLVLDEAERSLH

SEQ ID NO: 2975209 - protein, 23 aa, Entamoeba invadens
VSVQSALVKLDMVDKENTNKISE

SEQ ID NO: 2975210 - protein, 19 aa, Entamoeba invadens
VSVRCVYFYMKCFTENFIL

SEQ ID NO: 2975211 - protein, 20 aa, Entamoeba invadens
VSVSPLLRFEILGLSGKYVL

SEQ ID NO: 2975212 - protein, 19 aa, Entamoeba invadens
VSVVFNGRKEWKYKKYAIV

SEQ ID NO: 2975213 - protein, 21 aa, Entamoeba invadens
VSVYLRFLYEQEIDKENLEKV

SEQ ID NO: 2975214 - protein, 20 aa, Entamoeba invadens
VSVYLRFLYEQEIDKENLSK

SEQ ID NO: 2975215 - protein, 27 aa, Entamoeba invadens
VSYCATEFYNLVGLMLLVFDNTKDSTV

SEQ ID NO: 2975216 - protein, 24 aa, Entamoeba invadens
VSYDCLRESFRPILTPMFDVLMQT

SEQ ID NO: 2975217 - protein, 23 aa, Entamoeba invadens
VSYECHLRLKALGTEKLDSSNKD

SEQ ID NO: 2975218 - protein, 18 aa, Entamoeba invadens
VSYGKRPGSRYRVLCLLG

SEQ ID NO: 2975219 - protein, 17 aa, Entamoeba invadens
VSYHFIRAIVCARDCTQ

SEQ ID NO: 2975220 - protein, 33 aa, Entamoeba invadens
VSYIYGIEAMKDFLKRNDLNLLIRGHQCFENGI

SEQ ID NO: 2975221 - protein, 23 aa, Entamoeba invadens
VSYLECLNIVLVLAGDNVLDVDR

SEQ ID NO: 2975222 - protein, 26 aa, Entamoeba invadens
VSYQSGCTIILTRGGFVVGYFDSPNT

SEQ ID NO: 2975223 - protein, 25 aa, Entamoeba invadens
VSYSCYYNGCTVPNCETCNSSSVCT

SEQ ID NO: 2975224 - protein, 25 aa, Entamoeba invadens
VSYSNASVFLLCFAVNSANSLDNIE

SEQ ID NO: 2975225 - protein, 19 aa, Entamoeba invadens
VSYSYPFVTFRCFDGCINL

SEQ ID NO: 2975226 - protein, 17 aa, Entamoeba invadens
VSYTCLGSFYKTRHRLF

SEQ ID NO: 2975227 - protein, 19 aa, Entamoeba invadens
VTACPAKCLAMTPFDKIGA

SEQ ID NO: 2975228 - protein, 19 aa, Entamoeba invadens
VTACSNLRAMNYCIEPADF

SEQ ID NO: 2975229 - protein, 19 aa, Entamoeba invadens
VTACSNLRAMNYCIQPADF

SEQ ID NO: 2975230 - protein, 18 aa, Entamoeba invadens
VTADLISIHFEKEKPTLT

SEQ ID NO: 2975231 - protein, 24 aa, Entamoeba invadens
VTAIYSMCFFNCVALKTITLPLKL

SEQ ID NO: 2975232 - protein, 28 aa, Entamoeba invadens
VTAKCFGVKVLFYYSRLLNMRSMLEEAE

SEQ ID NO: 2975233 - protein, 21 aa, Entamoeba invadens
VTAKMILRPQGFILTAEISDM

SEQ ID NO: 2975234 - protein, 26 aa, Entamoeba invadens
VTALTIPVNLYFNSLIFLNNLKRISA

SEQ ID NO: 2975235 - protein, 18 aa, Entamoeba invadens
VTANIYFDKNIVGKVIAT

SEQ ID NO: 2975236 - protein, 36 aa, Entamoeba invadens
VTASCVFEGNIFVCGHSLKKLPNCPHRHDGIEQTEC

SEQ ID NO: 2975237 - protein, 23 aa, Entamoeba invadens
VTCEPCIMCASALVECGITKIIY

SEQ ID NO: 2975238 - protein, 19 aa, Entamoeba invadens
VTCIVDLKKVTSAVVKGAI

SEQ ID NO: 2975239 - protein, 20 aa, Entamoeba invadens
VTCRVILPLLLLMITSKELL

SEQ ID NO: 2975240 - protein, 23 aa, Entamoeba invadens
VTDEWDVSAGWWIVSIKGSSAVP

SEQ ID NO: 2975241 - protein, 25 aa, Entamoeba invadens
VTDFEAKFTKVAALFALIENKMRNR

SEQ ID NO: 2975242 - protein, 20 aa, Entamoeba invadens
VTDFEWYLKLLSRLSTQKLE

SEQ ID NO: 2975243 - protein, 18 aa, Entamoeba invadens
VTDIFVIGGCDGMKKERN

SEQ ID NO: 2975244 - protein, 17 aa, Entamoeba invadens
VTDISVAIIKGDLKENK

SEQ ID NO: 2975245 - protein, 17 aa, Entamoeba invadens
VTDLAEKHQQVFNQLVD

SEQ ID NO: 2975246 - protein, 18 aa, Entamoeba invadens
VTDLPIFFHSHNTSGTML

SEQ ID NO: 2975247 - protein, 26 aa, Entamoeba invadens
VTDRVLTCDGCVFVASYDNPNSLDNL

SEQ ID NO: 2975248 - protein, 17 aa, Entamoeba invadens
VTDTISAVGKFDMDITH

SEQ ID NO: 2975249 - protein, 17 aa, Entamoeba invadens
VTEALDAIELWTNRQIL

SEQ ID NO: 2975250 - protein, 18 aa, Entamoeba invadens
VTEFKRLHAYFVNDEEKA

SEQ ID NO: 2975251 - protein, 18 aa, Entamoeba invadens
VTEIKRSNYANCNELTEI

SEQ ID NO: 2975252 - protein, 20 aa, Entamoeba invadens
VTEILKKGQRSLAFRLSHQK

SEQ ID NO: 2975253 - protein, 24 aa, Entamoeba invadens
VTEIPEFFEKIDLIAGLSASSLIC

SEQ ID NO: 2975254 - protein, 23 aa, Entamoeba invadens
VTEKSLQILQSWGNNYTNELFNY

SEQ ID NO: 2975255 - protein, 21 aa, Entamoeba invadens
VTEKYKVLSFNSIEIGTLKLT

SEQ ID NO: 2975256 - protein, 26 aa, Entamoeba invadens
VTELVGGLHVCAKVISQRKFIEQKLN

SEQ ID NO: 2975257 - protein, 23 aa, Entamoeba invadens
VTENRANYAVGFVKEVQKVPTLV

SEQ ID NO: 2975258 - protein, 23 aa, Entamoeba invadens
VTFEIGELVAGLANDTTQCKNTI

SEQ ID NO: 2975259 - protein, 18 aa, Entamoeba invadens
VTFFKTQGIIPLFVFDGA

SEQ ID NO: 2975260 - protein, 17 aa, Entamoeba invadens
VTFKGAEVLTDLEPQIV

SEQ ID NO: 2975261 - protein, 24 aa, Entamoeba invadens
VTFLMKYVGAPGFGEKAAKALRNL

SEQ ID NO: 2975262 - protein, 28 aa, Entamoeba invadens
VTFLPDFHEKFCAFNRHEVLSDKFEGDS

SEQ ID NO: 2975263 - protein, 18 aa, Entamoeba invadens
VTFLPELKNLFNGEELEK

SEQ ID NO: 2975264 - protein, 25 aa, Entamoeba invadens
VTFMGGVCDLSLLQIPKFVKSISLK

SEQ ID NO: 2975265 - protein, 21 aa, Entamoeba invadens
VTFMGGVCDLSLLQIPKYVKS

SEQ ID NO: 2975266 - protein, 23 aa, Entamoeba invadens
VTFQCPFYFVFDTIDTRDVVAFI

SEQ ID NO: 2975267 - protein, 17 aa, Entamoeba invadens
VTFSNKFMKKWMEYSYG

SEQ ID NO: 2975268 - protein, 26 aa, Entamoeba invadens
VTFTRLGYLALMRMLSHFGHYSQQIK

SEQ ID NO: 2975269 - protein, 18 aa, Entamoeba invadens
VTFTVDVNALLTVSAVVV

SEQ ID NO: 2975270 - protein, 18 aa, Entamoeba invadens
VTFVAKWATPVKVEEDIP

SEQ ID NO: 2975271 - protein, 25 aa, Entamoeba invadens
VTFYLESPLIWFKEKRLKMLEDLLD

SEQ ID NO: 2975272 - protein, 19 aa, Entamoeba invadens
VTFYVSFLSSLAFDNNIDF

SEQ ID NO: 2975273 - protein, 27 aa, Entamoeba invadens
VTGEYGWSANMERIMKAQALRDNSMST

SEQ ID NO: 2975274 - protein, 22 aa, Entamoeba invadens
VTGFKPYFYISVDHLYTESELN

SEQ ID NO: 2975275 - protein, 18 aa, Entamoeba invadens
VTGKLCIFVFGDYVTICV

SEQ ID NO: 2975276 - protein, 19 aa, Entamoeba invadens
VTGNSFVMHGLEIITGAIK

SEQ ID NO: 2975277 - protein, 21 aa, Entamoeba invadens
VTGPFKLSGVPLLQINQRYVI

SEQ ID NO: 2975278 - protein, 22 aa, Entamoeba invadens
VTGQGNIMFCFETVKGDVFGCF

SEQ ID NO: 2975279 - protein, 19 aa, Entamoeba invadens
VTGRSDVCIGCFDEDNYTN

SEQ ID NO: 2975280 - protein, 18 aa, Entamoeba invadens
VTGSVVRWEGHVTVLNYK

SEQ ID NO: 2975281 - protein, 31 aa, Entamoeba invadens
VTGVVLLRYVLAFRDFELVRTFDLAVLSTCD

SEQ ID NO: 2975282 - protein, 26 aa, Entamoeba invadens
VTHEPCLFCGMALLHSRFHRVFFIYK

SEQ ID NO: 2975283 - protein, 20 aa, Entamoeba invadens
VTHGHCTLMNGFQIQMMLGM

SEQ ID NO: 2975284 - protein, 25 aa, Entamoeba invadens
VTHIGKFAFKNCISLSSLNSKNVKI

SEQ ID NO: 2975285 - protein, 17 aa, Entamoeba invadens
VTHIGVFAFRKCYSLKE

SEQ ID NO: 2975286 - protein, 19 aa, Entamoeba invadens
VTHIKHFLFKSFDKDVYLC

SEQ ID NO: 2975287 - protein, 18 aa, Entamoeba invadens
VTHLSLPLGENFNPIPAG

SEQ ID NO: 2975288 - protein, 25 aa, Entamoeba invadens
VTHRDGFLALRWTDPMEMTLDKIPI

SEQ ID NO: 2975289 - protein, 30 aa, Entamoeba invadens
VTHWICPHTRYFCHVCHSFVPDQQNRFIEK

SEQ ID NO: 2975290 - protein, 17 aa, Entamoeba invadens
VTIISTFHISRRLVLMI

SEQ ID NO: 2975291 - protein, 18 aa, Entamoeba invadens
VTIKISLYSLLQKRRSLI

SEQ ID NO: 2975292 - protein, 25 aa, Entamoeba invadens
VTIKWQATEIIAIIVTFGGIDIIRK

SEQ ID NO: 2975293 - protein, 26 aa, Entamoeba invadens
VTILEIPYSLLFTFRVPESVQEIHVT

SEQ ID NO: 2975294 - protein, 24 aa, Entamoeba invadens
VTIPKSKFSLFFHSTGDYKSDSIF

SEQ ID NO: 2975295 - protein, 23 aa, Entamoeba invadens
VTIPRGEQVYAFVKFANTESASM

SEQ ID NO: 2975296 - protein, 17 aa, Entamoeba invadens
VTIPVNFLRDGQKTISK

SEQ ID NO: 2975297 - protein, 18 aa, Entamoeba invadens
VTKAMLYFAKKITLRNSI

SEQ ID NO: 2975298 - protein, 23 aa, Entamoeba invadens
VTKELKITIEKNFEEQPTQETTE

SEQ ID NO: 2975299 - protein, 19 aa, Entamoeba invadens
VTKELKLDKIVCACISNDR

SEQ ID NO: 2975300 - protein, 17 aa, Entamoeba invadens
VTKGESIVEMLHLKGSE

SEQ ID NO: 2975301 - protein, 24 aa, Entamoeba invadens
VTKIGNNFVRGCTNLKYVVFENGR

SEQ ID NO: 2975302 - protein, 26 aa, Entamoeba invadens
VTKIGRECFEYCPLDGEKVFRIPPNV

SEQ ID NO: 2975303 - protein, 17 aa, Entamoeba invadens
VTKILGVLGTSVNRNGY

SEQ ID NO: 2975304 - protein, 25 aa, Entamoeba invadens
VTKIPAKIPFIKKVAKPIYKTAKGC

SEQ ID NO: 2975305 - protein, 23 aa, Entamoeba invadens
VTKKDLEKIFGIIRKSFIISQMN

SEQ ID NO: 2975306 - protein, 21 aa, Entamoeba invadens
VTKLGESCFENCPLDGDNVFK

SEQ ID NO: 2975307 - protein, 24 aa, Entamoeba invadens
VTKLGKKCFKNCGVLSHIDTKYIK

SEQ ID NO: 2975308 - protein, 25 aa, Entamoeba invadens
VTKLGKKCFKNCGVLSHIDTKYIKQ

SEQ ID NO: 2975309 - protein, 24 aa, Entamoeba invadens
VTKLKFPGQFDIAFPVEVDNKEVI

SEQ ID NO: 2975310 - protein, 20 aa, Entamoeba invadens
VTKLSEFSFYGCVSLTSILC

SEQ ID NO: 2975311 - protein, 26 aa, Entamoeba invadens
VTKMKIYMVKGCVKFDECLLEVIKIN

SEQ ID NO: 2975312 - protein, 26 aa, Entamoeba invadens
VTKSEMFALGMVRPSHHNDIMFYRGY

SEQ ID NO: 2975313 - protein, 20 aa, Entamoeba invadens
VTKSVFVCALQWLDYLINKN

SEQ ID NO: 2975314 - protein, 26 aa, Entamoeba invadens
VTKVIKFGKGCFGETSVFSWGNQIPN

SEQ ID NO: 2975315 - protein, 23 aa, Entamoeba invadens
VTKVIPGKCNTLYSMLGNKFIDE

SEQ ID NO: 2975316 - protein, 24 aa, Entamoeba invadens
VTKWKPEVAYKFPNVPCLLVGTKL

SEQ ID NO: 2975317 - protein, 24 aa, Entamoeba invadens
VTKYKLKVANCCVLAIRLKGNVKI

SEQ ID NO: 2975318 - protein, 25 aa, Entamoeba invadens
VTKYPDYIVCLLKIVSTPEYKALQN

SEQ ID NO: 2975319 - protein, 21 aa, Entamoeba invadens
VTLFKGRNFPALKGKVCTSYC

SEQ ID NO: 2975320 - protein, 18 aa, Entamoeba invadens
VTLFVSMCGYYPFDGDSI

SEQ ID NO: 2975321 - protein, 27 aa, Entamoeba invadens
VTLHKGEACGFGLFIAPLCSCHINDKI

SEQ ID NO: 2975322 - protein, 19 aa, Entamoeba invadens
VTLIDNFAFKNCKKLKRVD

SEQ ID NO: 2975323 - protein, 25 aa, Entamoeba invadens
VTLIGDGCCRGCINLTSVTIPLSVT

SEQ ID NO: 2975324 - protein, 24 aa, Entamoeba invadens
VTLIPFERRWVLFDVSQHGFDVLL

SEQ ID NO: 2975325 - protein, 25 aa, Entamoeba invadens
VTLKCGFACEFEIFLTPYCTMQLID

SEQ ID NO: 2975326 - protein, 21 aa, Entamoeba invadens
VTLKVDFFQIVVWYQVTATLE

SEQ ID NO: 2975327 - protein, 23 aa, Entamoeba invadens
VTLLKVGLLVLFKGKATIDGGDY

SEQ ID NO: 2975328 - protein, 23 aa, Entamoeba invadens
VTLPCKILKLGENCFESCSQLYN

SEQ ID NO: 2975329 - protein, 22 aa, Entamoeba invadens
VTLPSFQPFKTFFPLVTTVNIS

SEQ ID NO: 2975330 - protein, 18 aa, Entamoeba invadens
VTLQKLSILHCFTSNFVL

SEQ ID NO: 2975331 - protein, 17 aa, Entamoeba invadens
VTLRKYFNSTNIAENFD

SEQ ID NO: 2975332 - protein, 20 aa, Entamoeba invadens
VTLVPQLDVLKSRRTIYRAE

SEQ ID NO: 2975333 - protein, 18 aa, Entamoeba invadens
VTLWEIFSDAATPYSSVG

SEQ ID NO: 2975334 - protein, 20 aa, Entamoeba invadens
VTMFECFKWGEIYPKKDFQF

SEQ ID NO: 2975335 - protein, 18 aa, Entamoeba invadens
VTMFEVFGWEEPYNKLEF

SEQ ID NO: 2975336 - protein, 18 aa, Entamoeba invadens
VTMFEVFGWEESYDKIKF

SEQ ID NO: 2975337 - protein, 20 aa, Entamoeba invadens
VTMFEVVGWSEAYQKDRFKY

SEQ ID NO: 2975338 - protein, 19 aa, Entamoeba invadens
VTMIPDLFFLISKALEEKK

SEQ ID NO: 2975339 - protein, 20 aa, Entamoeba invadens
VTMLGFDNTVFWTFNVPDEL

SEQ ID NO: 2975340 - protein, 20 aa, Entamoeba invadens
VTMLTHISLLFGKENKINSP

SEQ ID NO: 2975341 - protein, 24 aa, Entamoeba invadens
VTNCGGVLRVNEKIAITRSIGDKA

SEQ ID NO: 2975342 - protein, 17 aa, Entamoeba invadens
VTNDAFYQFSFNPEQQV

SEQ ID NO: 2975343 - protein, 25 aa, Entamoeba invadens
VTNFSNEVPLHFAVNKKRLDLVLLL

SEQ ID NO: 2975344 - protein, 24 aa, Entamoeba invadens
VTNGDMRTARLCEGTLFTDDYPKD

SEQ ID NO: 2975345 - protein, 25 aa, Entamoeba invadens
VTNKFAIMMSHVFYNAKYFKRGYNT

SEQ ID NO: 2975346 - protein, 28 aa, Entamoeba invadens
VTNKGIKIIKSRLFRNIETLTEIVGFEN

SEQ ID NO: 2975347 - protein, 19 aa, Entamoeba invadens
VTNMLPMPFVLKSESVEMP

SEQ ID NO: 2975348 - protein, 24 aa, Entamoeba invadens
VTNPKDFPFVVLINKMDEDPSKHT

SEQ ID NO: 2975349 - protein, 19 aa, Entamoeba invadens
VTNQISMFFAFAAPMVLCL

SEQ ID NO: 2975350 - protein, 26 aa, Entamoeba invadens
VTNRVSLQTVWKYFFLFSDVLVVTEI

SEQ ID NO: 2975351 - protein, 17 aa, Entamoeba invadens
VTPDFWLVFGDTTIAFV

SEQ ID NO: 2975352 - protein, 20 aa, Entamoeba invadens
VTPEINFRIFVFDSSSTEKK

SEQ ID NO: 2975353 - protein, 28 aa, Entamoeba invadens
VTPFEGSPMKIMRGVFDYPKNILDVQKG

SEQ ID NO: 2975354 - protein, 24 aa, Entamoeba invadens
VTPHEIALSWILRHPSHIQVVTGT

SEQ ID NO: 2975355 - protein, 20 aa, Entamoeba invadens
VTPLAFIVPLVFGNLTFDPY

SEQ ID NO: 2975356 - protein, 17 aa, Entamoeba invadens
VTPLCYATAMKELNISQ

SEQ ID NO: 2975357 - protein, 17 aa, Entamoeba invadens
VTPRTSLQMSRQSFQIA

SEQ ID NO: 2975358 - protein, 25 aa, Entamoeba invadens
VTPSQHVFLALSFRGKMNPGDKGSF

SEQ ID NO: 2975359 - protein, 19 aa, Entamoeba invadens
VTPTCRRNLILITKVIQNI

SEQ ID NO: 2975360 - protein, 23 aa, Entamoeba invadens
VTQEELDRTLSILNTSHIDLNSD

SEQ ID NO: 2975361 - protein, 21 aa, Entamoeba invadens
VTQFIPVYEGFVISNCVTKQY

SEQ ID NO: 2975362 - protein, 18 aa, Entamoeba invadens
VTQFPRYSIQEMTKNIHL

SEQ ID NO: 2975363 - protein, 25 aa, Entamoeba invadens
VTQGDCIQCHGGMRTVEFKVVEVTP

SEQ ID NO: 2975364 - protein, 20 aa, Entamoeba invadens
VTQLGADCFNGCVMLKEMNI

SEQ ID NO: 2975365 - protein, 25 aa, Entamoeba invadens
VTQLLDCLCPLKYSHFSRAPAEYSD

SEQ ID NO: 2975366 - protein, 18 aa, Entamoeba invadens
VTQPRRIAATAMAERVSE

SEQ ID NO: 2975367 - protein, 22 aa, Entamoeba invadens
VTQPRRVAAMSVARRVAEEVGC

SEQ ID NO: 2975368 - protein, 18 aa, Entamoeba invadens
VTQRTVILALKFLETIIR

SEQ ID NO: 2975369 - protein, 24 aa, Entamoeba invadens
VTRARKTITMPFLKIEKLSKGNTT

SEQ ID NO: 2975370 - protein, 17 aa, Entamoeba invadens
VTRDVCLERWIFKETHT

SEQ ID NO: 2975371 - protein, 27 aa, Entamoeba invadens
VTRIDWGNFWNCPNVEKIAIFSEKDIS

SEQ ID NO: 2975372 - protein, 29 aa, Entamoeba invadens
VTRIDWGNFWNCPNVEKIAIFSKKDISIS

SEQ ID NO: 2975373 - protein, 17 aa, Entamoeba invadens
VTRLVEIINRFVNERTY

SEQ ID NO: 2975374 - protein, 17 aa, Entamoeba invadens
VTSCFDEIMWFYRENDS

SEQ ID NO: 2975375 - protein, 17 aa, Entamoeba invadens
VTSCSIDMSLLFYTKNR

SEQ ID NO: 2975376 - protein, 24 aa, Entamoeba invadens
VTSGELFPEFLPAIFEMIHTGDRP

SEQ ID NO: 2975377 - protein, 25 aa, Entamoeba invadens
VTSICKKCFYECYSLNSVTIPSSVT

SEQ ID NO: 2975378 - protein, 26 aa, Entamoeba invadens
VTSIGACAFENCRFDKFDMPKGVKYI

SEQ ID NO: 2975379 - protein, 25 aa, Entamoeba invadens
VTSIGDFCFRGCISLSSITISSIIT

SEQ ID NO: 2975380 - protein, 25 aa, Entamoeba invadens
VTSIGDGCCRGCINLTSVTIPLSVT

SEQ ID NO: 2975381 - protein, 17 aa, Entamoeba invadens
VTSIGEKCFNWCSYLSN

SEQ ID NO: 2975382 - protein, 19 aa, Entamoeba invadens
VTSIGGYCFNRCNNLSNII

SEQ ID NO: 2975383 - protein, 21 aa, Entamoeba invadens
VTSIGGYCFSWCSSLTSVTIP

SEQ ID NO: 2975384 - protein, 23 aa, Entamoeba invadens
VTSISGYCFWGCSSLISVNIPSS

SEQ ID NO: 2975385 - protein, 25 aa, Entamoeba invadens
VTSLEKWTGCDSCRVIYDSTNGFTA

SEQ ID NO: 2975386 - protein, 23 aa, Entamoeba invadens
VTSLKVNPWFALTQDIEKFYDLF

SEQ ID NO: 2975387 - protein, 18 aa, Entamoeba invadens
VTSLLCQCFTGCHFQTII

SEQ ID NO: 2975388 - protein, 21 aa, Entamoeba invadens
VTSPKSLTSVPDWIQEKDAKG

SEQ ID NO: 2975389 - protein, 22 aa, Entamoeba invadens
VTSPLLINCDKNLLVVLNNFND

SEQ ID NO: 2975390 - protein, 18 aa, Entamoeba invadens
VTSPSEWLEKSVLDQLPF

SEQ ID NO: 2975391 - protein, 28 aa, Entamoeba invadens
VTTFKMMRNVWKLPLNKYGSYSIVAHAV

SEQ ID NO: 2975392 - protein, 17 aa, Entamoeba invadens
VTTGWVWYNNPAPRPKI

SEQ ID NO: 2975393 - protein, 28 aa, Entamoeba invadens
VTTISHFCCCSLLIPPEVRDSCFCKIAE

SEQ ID NO: 2975394 - protein, 22 aa, Entamoeba invadens
VTTKCFELTYLVNHYNPSVRRY

SEQ ID NO: 2975395 - protein, 25 aa, Entamoeba invadens
VTTREVMCAWDWKMRSLIGDERFGS

SEQ ID NO: 2975396 - protein, 19 aa, Entamoeba invadens
VTTVKCTKSDLVNLILNRI

SEQ ID NO: 2975397 - protein, 26 aa, Entamoeba invadens
VTVDDLISFFSFTGCIEEIHISQTSR

SEQ ID NO: 2975398 - protein, 26 aa, Entamoeba invadens
VTVDVLYFRDCESFVGAYRTIANKTS

SEQ ID NO: 2975399 - protein, 17 aa, Entamoeba invadens
VTVEICIRTTDSEIPDM

SEQ ID NO: 2975400 - protein, 22 aa, Entamoeba invadens
VTVFNFLKKLSFACNKIVQVNE

SEQ ID NO: 2975401 - protein, 18 aa, Entamoeba invadens
VTVFPSALILAPTRELGQ

SEQ ID NO: 2975402 - protein, 24 aa, Entamoeba invadens
VTVHDIFLNFCVFNKLTSTYTARL

SEQ ID NO: 2975403 - protein, 17 aa, Entamoeba invadens
VTVHKLYRPTDVAIGRD

SEQ ID NO: 2975404 - protein, 24 aa, Entamoeba invadens
VTVHSYPGFHFHNTIDLGIERDEQ

SEQ ID NO: 2975405 - protein, 17 aa, Entamoeba invadens
VTVPLFFDNKESPCFRV

SEQ ID NO: 2975406 - protein, 24 aa, Entamoeba invadens
VTVREAVCAWDWKMREQVGSDKFG

SEQ ID NO: 2975407 - protein, 22 aa, Entamoeba invadens
VTVSLCFSFSNMFIAMGSNDGY

SEQ ID NO: 2975408 - protein, 26 aa, Entamoeba invadens
VTYFKGLQLKFFFSILDGEMMENTTL

SEQ ID NO: 2975409 - protein, 29 aa, Entamoeba invadens
VTYKGVRIFLAICYDIQYPAFIRRTDAND

SEQ ID NO: 2975410 - protein, 23 aa, Entamoeba invadens
VTYKLRVEEQFACIQLFSNKTKV

SEQ ID NO: 2975411 - protein, 24 aa, Entamoeba invadens
VTYPYQRYAVWYGGSVMAELPVFV

SEQ ID NO: 2975412 - protein, 17 aa, Entamoeba invadens
VVACGGRVVNGRVNGDL

SEQ ID NO: 2975413 - protein, 19 aa, Entamoeba invadens
VVADIFGQVVAPLYAVKEP

SEQ ID NO: 2975414 - protein, 17 aa, Entamoeba invadens
VVADIVPIKSCFYLYST

SEQ ID NO: 2975415 - protein, 19 aa, Entamoeba invadens
VVAFKYNVEDKFEMEDYYS

SEQ ID NO: 2975416 - protein, 18 aa, Entamoeba invadens
VVAKQFLTVRYLKKQTDV

SEQ ID NO: 2975417 - protein, 24 aa, Entamoeba invadens
VVALKVRYPHRVFLLRGNHESRQI

SEQ ID NO: 2975418 - protein, 25 aa, Entamoeba invadens
VVAQKEFYMPFVFVDGAADKAQVDH

SEQ ID NO: 2975419 - protein, 18 aa, Entamoeba invadens
VVAQLLTLMDGMKSRANV

SEQ ID NO: 2975420 - protein, 18 aa, Entamoeba invadens
VVARQVVEPVPILHAPPK

SEQ ID NO: 2975421 - protein, 27 aa, Entamoeba invadens
VVAYSCWLLLEVLFDFISELTDLNSAL

SEQ ID NO: 2975422 - protein, 19 aa, Entamoeba invadens
VVCDDIKKDVYIIRVGTSG

SEQ ID NO: 2975423 - protein, 19 aa, Entamoeba invadens
VVCDVCGKVNLKFDSYIFW

SEQ ID NO: 2975424 - protein, 17 aa, Entamoeba invadens
VVCEKTWKEMNCDVLNP

SEQ ID NO: 2975425 - protein, 18 aa, Entamoeba invadens
VVCFHKLPLDKKMKSDIY

SEQ ID NO: 2975426 - protein, 26 aa, Entamoeba invadens
VVCGGCDGKVLFFWVDNGEEIGRLQF

SEQ ID NO: 2975427 - protein, 19 aa, Entamoeba invadens
VVCHCCGRVLCSNCIQTLQ

SEQ ID NO: 2975428 - protein, 17 aa, Entamoeba invadens
VVCKRVVFEQNDVEKHL

SEQ ID NO: 2975429 - protein, 23 aa, Entamoeba invadens
VVCSRFSPCLYKVTTEEGKKRVF

SEQ ID NO: 2975430 - protein, 25 aa, Entamoeba invadens
VVDCFYEILFTYGLLCEEGPSETNL

SEQ ID NO: 2975431 - protein, 17 aa, Entamoeba invadens
VVDEWKILFYETSAKNN

SEQ ID NO: 2975432 - protein, 19 aa, Entamoeba invadens
VVDEYPLFVNRKNVVGETP

SEQ ID NO: 2975433 - protein, 19 aa, Entamoeba invadens
VVDGITWWCTPYDFVKSFN

SEQ ID NO: 2975434 - protein, 31 aa, Entamoeba invadens
VVDHNILELFLFKICDLLVLKARTIVGMITQ

SEQ ID NO: 2975435 - protein, 24 aa, Entamoeba invadens
VVDIDICELFSFIANGQINSFVLY

SEQ ID NO: 2975436 - protein, 19 aa, Entamoeba invadens
VVDIISLEYFTFLKTSTTV

SEQ ID NO: 2975437 - protein, 22 aa, Entamoeba invadens
VVDIPVILPLPVDVKRNSYSII

SEQ ID NO: 2975438 - protein, 25 aa, Entamoeba invadens
VVDKKHCCFRVARNNMWELHIYTPK

SEQ ID NO: 2975439 - protein, 23 aa, Entamoeba invadens
VVDKVILRFLIKSEENERWIDCG

SEQ ID NO: 2975440 - protein, 18 aa, Entamoeba invadens
VVDLYFELVLACRPEVFN

SEQ ID NO: 2975441 - protein, 19 aa, Entamoeba invadens
VVDMKRSYEKTGVKISVLV

SEQ ID NO: 2975442 - protein, 25 aa, Entamoeba invadens
VVDPLKRFSVEECLGHEFFGLKHQR

SEQ ID NO: 2975443 - protein, 18 aa, Entamoeba invadens
VVDSVVFKTLPKISDIQQ

SEQ ID NO: 2975444 - protein, 23 aa, Entamoeba invadens
VVDYFELVKVLLLNNTQNQKNFT

SEQ ID NO: 2975445 - protein, 27 aa, Entamoeba invadens
VVEAYCQAIRRLSRNIVEPQLFISALI

SEQ ID NO: 2975446 - protein, 17 aa, Entamoeba invadens
VVEFSMWDEMVLTSYSD

SEQ ID NO: 2975447 - protein, 17 aa, Entamoeba invadens
VVEGNFEKAFLYALEEP

SEQ ID NO: 2975448 - protein, 22 aa, Entamoeba invadens
VVEGTIPIIVRIPFKAEDKYTL

SEQ ID NO: 2975449 - protein, 18 aa, Entamoeba invadens
VVEISFCAHSDHVHTTNF

SEQ ID NO: 2975450 - protein, 25 aa, Entamoeba invadens
VVEKCLKCGGEEEVSILIDALLNTE

SEQ ID NO: 2975451 - protein, 19 aa, Entamoeba invadens
VVEKICRTKMAFDRSKGVS

SEQ ID NO: 2975452 - protein, 25 aa, Entamoeba invadens
VVEKSGYQSFPWVRYMTFAGDYCFR

SEQ ID NO: 2975453 - protein, 17 aa, Entamoeba invadens
VVELPMLHPEAFENLGI

SEQ ID NO: 2975454 - protein, 27 aa, Entamoeba invadens
VVERIFLKMRILNFNEFLLKIGDIEKA

SEQ ID NO: 2975455 - protein, 30 aa, Entamoeba invadens
VVETLRHALKYDLTLRVGVDKPDFSIDVNE

SEQ ID NO: 2975456 - protein, 26 aa, Entamoeba invadens
VVETYWGIKFGDIFFNKKQIDSKGRK

SEQ ID NO: 2975457 - protein, 19 aa, Entamoeba invadens
VVEVCIKQSPELSVKGFQL

SEQ ID NO: 2975458 - protein, 18 aa, Entamoeba invadens
VVEYPDTSLLGFGKSGHV

SEQ ID NO: 2975459 - protein, 27 aa, Entamoeba invadens
VVFEKEFFRIIIWFNVDFETVDRNKSR

SEQ ID NO: 2975460 - protein, 17 aa, Entamoeba invadens
VVFGDLWNVVKMQLVED

SEQ ID NO: 2975461 - protein, 17 aa, Entamoeba invadens
VVFIGDSSVGKTCIIGR

SEQ ID NO: 2975462 - protein, 24 aa, Entamoeba invadens
VVFKNCKAEQGLLKYEGNVMNDGF

SEQ ID NO: 2975463 - protein, 23 aa, Entamoeba invadens
VVFKNPRNFEARKFLAEVYRQNA

SEQ ID NO: 2975464 - protein, 21 aa, Entamoeba invadens
VVFLCPVSYNFYMQNSETKNF

SEQ ID NO: 2975465 - protein, 17 aa, Entamoeba invadens
VVFMLAALINKLNLRLE

SEQ ID NO: 2975466 - protein, 21 aa, Entamoeba invadens
VVFPLTCLEFLNTTTNNKKEF

SEQ ID NO: 2975467 - protein, 17 aa, Entamoeba invadens
VVFQEIFVTPCKASQSV

SEQ ID NO: 2975468 - protein, 19 aa, Entamoeba invadens
VVFVHVIKSVIALLSDVTN

SEQ ID NO: 2975469 - protein, 18 aa, Entamoeba invadens
VVFYGNARVGKTSIVNRY

SEQ ID NO: 2975470 - protein, 24 aa, Entamoeba invadens
VVFYHFNPMYSLLCPTKCSDIHSA

SEQ ID NO: 2975471 - protein, 24 aa, Entamoeba invadens
VVGEGKEKLGYVFMWDAGSSVGEI

SEQ ID NO: 2975472 - protein, 17 aa, Entamoeba invadens
VVGENEPSYSQVFHNTV

SEQ ID NO: 2975473 - protein, 23 aa, Entamoeba invadens
VVGESESCLNHLYAVDETIQSAV

SEQ ID NO: 2975474 - protein, 18 aa, Entamoeba invadens
VVGGYNIIGFFELFVNLL

SEQ ID NO: 2975475 - protein, 19 aa, Entamoeba invadens
VVGMCAVCNTEVYNTEDSI

SEQ ID NO: 2975476 - protein, 18 aa, Entamoeba invadens
VVGNVCINTILVQNGLAT

SEQ ID NO: 2975477 - protein, 25 aa, Entamoeba invadens
VVGPGKGNGGAVCGRDGGVWGHSET

SEQ ID NO: 2975478 - protein, 18 aa, Entamoeba invadens
VVGQLCCVGIGKAKERDW

SEQ ID NO: 2975479 - protein, 23 aa, Entamoeba invadens
VVGRGGFSVVHRAIYKKTSDTVA

SEQ ID NO: 2975480 - protein, 21 aa, Entamoeba invadens
VVGRTPPGHFFIQRKNKSNSP

SEQ ID NO: 2975481 - protein, 21 aa, Entamoeba invadens
VVGVKTAFDVDGWISKLHGVI

SEQ ID NO: 2975482 - protein, 21 aa, Entamoeba invadens
VVGVSCFFACSALVEIHLPNT

SEQ ID NO: 2975483 - protein, 20 aa, Entamoeba invadens
VVHKKTRKAVSFQADLQNVL

SEQ ID NO: 2975484 - protein, 23 aa, Entamoeba invadens
VVHKMTDFEFFTRIKSESQTPSR

SEQ ID NO: 2975485 - protein, 18 aa, Entamoeba invadens
VVHLSRSAAITFNGIDSL

SEQ ID NO: 2975486 - protein, 18 aa, Entamoeba invadens
VVICKAAMDAVFSEYLDQ

SEQ ID NO: 2975487 - protein, 24 aa, Entamoeba invadens
VVIDLEKGKFVFAKKDEGSAPFTV

SEQ ID NO: 2975488 - protein, 17 aa, Entamoeba invadens
VVIEAVIQFFSGKPELL

SEQ ID NO: 2975489 - protein, 17 aa, Entamoeba invadens
VVIEKALAMDGFQDDKK

SEQ ID NO: 2975490 - protein, 18 aa, Entamoeba invadens
VVIEKALAMEGFQDDKKD

SEQ ID NO: 2975491 - protein, 21 aa, Entamoeba invadens
VVIFDEGWSVIGNQAVDRVYR

SEQ ID NO: 2975492 - protein, 24 aa, Entamoeba invadens
VVIGDWGFGFTFVHDGIELKNTLY

SEQ ID NO: 2975493 - protein, 24 aa, Entamoeba invadens
VVIGENGYNFLIPKSGNCDEMVEL

SEQ ID NO: 2975494 - protein, 19 aa, Entamoeba invadens
VVIGIYLHPAVCIDMEQNS

SEQ ID NO: 2975495 - protein, 18 aa, Entamoeba invadens
VVIGKFKSIPCKESKTFV

SEQ ID NO: 2975496 - protein, 17 aa, Entamoeba invadens
VVIHTCDEWLVGYDKLQ

SEQ ID NO: 2975497 - protein, 23 aa, Entamoeba invadens
VVIKRLIENYGEIFREIKMENEG

SEQ ID NO: 2975498 - protein, 27 aa, Entamoeba invadens
VVIKRSLPCGLSLPSCLEVLKVAQCNE

SEQ ID NO: 2975499 - protein, 28 aa, Entamoeba invadens
VVINPYQFFPIYTHFMINKYTGRRKEEV

SEQ ID NO: 2975500 - protein, 29 aa, Entamoeba invadens
VVINPYQFFPIYTPFMINKYTGRRKEEVA

SEQ ID NO: 2975501 - protein, 33 aa, Entamoeba invadens
VVIPKSVSFIGRFCFFNCGFVHFPEINVNVKTL

SEQ ID NO: 2975502 - protein, 18 aa, Entamoeba invadens
VVIPTRIGSQELELMNEV

SEQ ID NO: 2975503 - protein, 19 aa, Entamoeba invadens
VVIQMEYCSGSNLSRIIES

SEQ ID NO: 2975504 - protein, 19 aa, Entamoeba invadens
VVISKEFYAPMTTKSAGIP

SEQ ID NO: 2975505 - protein, 26 aa, Entamoeba invadens
VVIVHLFDAFSAFQCEKIQVLLRLEK

SEQ ID NO: 2975506 - protein, 21 aa, Entamoeba invadens
VVIYLNLWRLFYSKPHMHGHR

SEQ ID NO: 2975507 - protein, 19 aa, Entamoeba invadens
VVIYTSMRSNIFIPVSGLV

SEQ ID NO: 2975508 - protein, 17 aa, Entamoeba invadens
VVKDCPFLLSNTKHGKR

SEQ ID NO: 2975509 - protein, 21 aa, Entamoeba invadens
VVKDLMKLFCEKYKKQAKSEH

SEQ ID NO: 2975510 - protein, 18 aa, Entamoeba invadens
VVKDMVLPMLCRGNKFTV

SEQ ID NO: 2975511 - protein, 24 aa, Entamoeba invadens
VVKEIFFRSLGLSCCAKRNPVHAH

SEQ ID NO: 2975512 - protein, 24 aa, Entamoeba invadens
VVKEKLGWGHFSTVWLVEYTDQVT

SEQ ID NO: 2975513 - protein, 18 aa, Entamoeba invadens
VVKEKWECYDNLKDADKK

SEQ ID NO: 2975514 - protein, 18 aa, Entamoeba invadens
VVKFEFGTFSIKETKWEV

SEQ ID NO: 2975515 - protein, 22 aa, Entamoeba invadens
VVKFYGIIVDKQFAMVMEYCSQ

SEQ ID NO: 2975516 - protein, 18 aa, Entamoeba invadens
VVKGKFLCEYTKVSRDQT

SEQ ID NO: 2975517 - protein, 20 aa, Entamoeba invadens
VVKIRKFKIISAKYFSIQES

SEQ ID NO: 2975518 - protein, 20 aa, Entamoeba invadens
VVKISYCCFVNCFNLKTIEL

SEQ ID NO: 2975519 - protein, 18 aa, Entamoeba invadens
VVKKILKYFPKLQTLQID

SEQ ID NO: 2975520 - protein, 23 aa, Entamoeba invadens
VVKKTFKQIVAWFNVICTTVQIN

SEQ ID NO: 2975521 - protein, 25 aa, Entamoeba invadens
VVKLLENLFEFCIRSESSTTEAGLK

SEQ ID NO: 2975522 - protein, 26 aa, Entamoeba invadens
VVKMYFKEIMSVSPLFTHSKLWKLYF

SEQ ID NO: 2975523 - protein, 25 aa, Entamoeba invadens
VVKNCTKASGVSFLVGAVTLLDNSV

SEQ ID NO: 2975524 - protein, 17 aa, Entamoeba invadens
VVKNGDKLYILPPKYIP

SEQ ID NO: 2975525 - protein, 27 aa, Entamoeba invadens
VVKNHCFDCCGKLSQIQFCHSITAFEE

SEQ ID NO: 2975526 - protein, 19 aa, Entamoeba invadens
VVKPLTLLVLQKFVRYVLD

SEQ ID NO: 2975527 - protein, 24 aa, Entamoeba invadens
VVKQFKQNEFISGSADRTVHIWET

SEQ ID NO: 2975528 - protein, 26 aa, Entamoeba invadens
VVKRAESIANWFEIYSWWKNNIEAQE

SEQ ID NO: 2975529 - protein, 17 aa, Entamoeba invadens
VVKRCLQNKKAIIEVIE

SEQ ID NO: 2975530 - protein, 19 aa, Entamoeba invadens
VVKRGNMKDRIQVHEIDED

SEQ ID NO: 2975531 - protein, 23 aa, Entamoeba invadens
VVKRSQDGLNFGVVLIPEGLLEF

SEQ ID NO: 2975532 - protein, 19 aa, Entamoeba invadens
VVKSVLPFIHISKIIDPSG

SEQ ID NO: 2975533 - protein, 26 aa, Entamoeba invadens
VVKTHDIYDLFALYARDAVNEQLANI

SEQ ID NO: 2975534 - protein, 22 aa, Entamoeba invadens
VVKTIIRAPEKVIDESQRAPPK

SEQ ID NO: 2975535 - protein, 23 aa, Entamoeba invadens
VVKVPSKCFANCFSLENINIDQC

SEQ ID NO: 2975536 - protein, 23 aa, Entamoeba invadens
VVKVRLNNGYGFVDFRDEVSKTK

SEQ ID NO: 2975537 - protein, 20 aa, Entamoeba invadens
VVKYSFVFSYFVRDYEQISK

SEQ ID NO: 2975538 - protein, 23 aa, Entamoeba invadens
VVLADFCVLYLLDGNCFPETEQM

SEQ ID NO: 2975539 - protein, 17 aa, Entamoeba invadens
VVLCGDTIFAAGGDGCM

SEQ ID NO: 2975540 - protein, 22 aa, Entamoeba invadens
VVLEKNPLFAFILSKTLSQNIE

SEQ ID NO: 2975541 - protein, 20 aa, Entamoeba invadens
VVLERVYLLNVVLFFENTEV

SEQ ID NO: 2975542 - protein, 29 aa, Entamoeba invadens
VVLFERCCLGVQWLHNRFNLIHRNIKPSN

SEQ ID NO: 2975543 - protein, 17 aa, Entamoeba invadens
VVLFIGMAMSQNLPMFV

SEQ ID NO: 2975544 - protein, 20 aa, Entamoeba invadens
VVLFPCQRVLLVIYSKRIVK

SEQ ID NO: 2975545 - protein, 23 aa, Entamoeba invadens
VVLKDYLSVLNFDARFNNYKIGN

SEQ ID NO: 2975546 - protein, 27 aa, Entamoeba invadens
VVLKKEFFRIIVWFNVDFETFDRNKNR

SEQ ID NO: 2975547 - protein, 28 aa, Entamoeba invadens
VVLKKEFYRIIVWFTVDFETVYINKSQN

SEQ ID NO: 2975548 - protein, 27 aa, Entamoeba invadens
VVLKREFYRIIVWFDVNFETVDRNINR

SEQ ID NO: 2975549 - protein, 21 aa, Entamoeba invadens
VVLKSAYLIREEELVDTDKCN

SEQ ID NO: 2975550 - protein, 30 aa, Entamoeba invadens
VVLKSEHFFLRFSPNLIKPTFDSVLNFFKK

SEQ ID NO: 2975551 - protein, 23 aa, Entamoeba invadens
VVLPKWARGSYRRFVRTNMMALE

SEQ ID NO: 2975552 - protein, 19 aa, Entamoeba invadens
VVLQFPEGLIAQGVQLQQR

SEQ ID NO: 2975553 - protein, 25 aa, Entamoeba invadens
VVLQKGMVPRTFVPVVEEFAKEVDN

SEQ ID NO: 2975554 - protein, 26 aa, Entamoeba invadens
VVLREFYRIIVWFNVDFETINRNKSR

SEQ ID NO: 2975555 - protein, 20 aa, Entamoeba invadens
VVLRELYKLIDISKLDSLKN

SEQ ID NO: 2975556 - protein, 24 aa, Entamoeba invadens
VVLTCKISKVFFDEKVIVVDIVGN

SEQ ID NO: 2975557 - protein, 24 aa, Entamoeba invadens
VVMECFACCYFAGEMTTHSEVVKT

SEQ ID NO: 2975558 - protein, 17 aa, Entamoeba invadens
VVMLKFYTNDVAEKCIK

SEQ ID NO: 2975559 - protein, 18 aa, Entamoeba invadens
VVMPPELQSISQMQSTQP

SEQ ID NO: 2975560 - protein, 17 aa, Entamoeba invadens
VVMTHLIPHASIEETLD

SEQ ID NO: 2975561 - protein, 19 aa, Entamoeba invadens
VVNCCPSKVLSLSVIEFEG

SEQ ID NO: 2975562 - protein, 19 aa, Entamoeba invadens
VVNDIPLTITCEVAVFICQ

SEQ ID NO: 2975563 - protein, 18 aa, Entamoeba invadens
VVNISFDKYLFVKYNTSR

SEQ ID NO: 2975564 - protein, 24 aa, Entamoeba invadens
VVNKEKRKSRQFSPSKNIVSSKSN

SEQ ID NO: 2975565 - protein, 18 aa, Entamoeba invadens
VVNKMCKLYRNINTIVAP

SEQ ID NO: 2975566 - protein, 17 aa, Entamoeba invadens
VVNPLLVFLSAVKLASD

SEQ ID NO: 2975567 - protein, 17 aa, Entamoeba invadens
VVNSRKLQILYFDDNGT

SEQ ID NO: 2975568 - protein, 26 aa, Entamoeba invadens
VVPDRVYFLSEFCFLDCNNLREIVLP

SEQ ID NO: 2975569 - protein, 18 aa, Entamoeba invadens
VVPEVALKELSEFSHCLV

SEQ ID NO: 2975570 - protein, 23 aa, Entamoeba invadens
VVPFPPFLKDRWYPHNETTKNFI

SEQ ID NO: 2975571 - protein, 25 aa, Entamoeba invadens
VVPHIVIYDMLFKYTDYSTYRVPFA

SEQ ID NO: 2975572 - protein, 26 aa, Entamoeba invadens
VVPISRLDLVFLPKVVVAMLGGVGPL

SEQ ID NO: 2975573 - protein, 24 aa, Entamoeba invadens
VVPLRRVEGTFKIRSELTNTLPTD

SEQ ID NO: 2975574 - protein, 22 aa, Entamoeba invadens
VVPMGKVVFGLKGVKTGIKEML

SEQ ID NO: 2975575 - protein, 17 aa, Entamoeba invadens
VVPPHFITKIVAIYINA

SEQ ID NO: 2975576 - protein, 23 aa, Entamoeba invadens
VVPRCAEDVMLQCWDLDGKKRPS

SEQ ID NO: 2975577 - protein, 24 aa, Entamoeba invadens
VVQACPIDCRRDLYKNIILSGGST

SEQ ID NO: 2975578 - protein, 18 aa, Entamoeba invadens
VVQCVKFSSDGKYFVHTD

SEQ ID NO: 2975579 - protein, 26 aa, Entamoeba invadens
VVQEMWREEEIAFQITVINYPSFEYL

SEQ ID NO: 2975580 - protein, 33 aa, Entamoeba invadens
VVQFQWLKRPMQVTCRFYQIGILMLFNENPQIK

SEQ ID NO: 2975581 - protein, 24 aa, Entamoeba invadens
VVQGFPGQVIDTWLGLDKKGEIHI

SEQ ID NO: 2975582 - protein, 17 aa, Entamoeba invadens
VVQHVKGILGLQFPDTD

SEQ ID NO: 2975583 - protein, 17 aa, Entamoeba invadens
VVQKVRTGCLVVVGQKN

SEQ ID NO: 2975584 - protein, 18 aa, Entamoeba invadens
VVQLVKRQMNALPVWQNT

SEQ ID NO: 2975585 - protein, 27 aa, Entamoeba invadens
VVQMIFKRLFRIYAHIYLHHLNQITQL

SEQ ID NO: 2975586 - protein, 23 aa, Entamoeba invadens
VVQRFKPLCELYFAQNTFINLEL

SEQ ID NO: 2975587 - protein, 24 aa, Entamoeba invadens
VVQRLLLVPVGFYQKILRLLRCLL

SEQ ID NO: 2975588 - protein, 17 aa, Entamoeba invadens
VVRCLKPTKTTFVVFSL

SEQ ID NO: 2975589 - protein, 18 aa, Entamoeba invadens
VVRDKFLPLSQRGREIPH

SEQ ID NO: 2975590 - protein, 18 aa, Entamoeba invadens
VVRDMVLPMLCRGTKFTV

SEQ ID NO: 2975591 - protein, 22 aa, Entamoeba invadens
VVRDMYALMCKRTGKSCNIISV

SEQ ID NO: 2975592 - protein, 25 aa, Entamoeba invadens
VVREGWQKLCVMCMGLHPQDHTTTV

SEQ ID NO: 2975593 - protein, 24 aa, Entamoeba invadens
VVRLLCSPTHDWNFSFDVLSHNAA

SEQ ID NO: 2975594 - protein, 24 aa, Entamoeba invadens
VVRREWCLFSKEIGNYCINLILKD

SEQ ID NO: 2975595 - protein, 25 aa, Entamoeba invadens
VVSCKNKLIFIFRVNGDIFGFYQDE

SEQ ID NO: 2975596 - protein, 18 aa, Entamoeba invadens
VVSCRQVRNISVFTIDNN

SEQ ID NO: 2975597 - protein, 25 aa, Entamoeba invadens
VVSDAKEALEFFAKRRSKIMKGATS

SEQ ID NO: 2975598 - protein, 27 aa, Entamoeba invadens
VVSDRMMYKLGYVDRVMDVLKRRQNDV

SEQ ID NO: 2975599 - protein, 33 aa, Entamoeba invadens
VVSEAVCAISYLVARLKEGFIVYYPTVKNTLEI

SEQ ID NO: 2975600 - protein, 19 aa, Entamoeba invadens
VVSECRFLEEVILGPYLKL

SEQ ID NO: 2975601 - protein, 18 aa, Entamoeba invadens
VVSEEGFGKNDFVITTKP

SEQ ID NO: 2975602 - protein, 22 aa, Entamoeba invadens
VVSEVKLKFGRIDCLINNAGYA

SEQ ID NO: 2975603 - protein, 18 aa, Entamoeba invadens
VVSFCLEVSALSLLKFPL

SEQ ID NO: 2975604 - protein, 23 aa, Entamoeba invadens
VVSKLRGGINLIKQKNEPKVDKE

SEQ ID NO: 2975605 - protein, 25 aa, Entamoeba invadens
VVSKSCLDAIKMVRRTPPIKYNQLK

SEQ ID NO: 2975606 - protein, 26 aa, Entamoeba invadens
VVSLRMKGCPLLREIHNLEELCCLSR

SEQ ID NO: 2975607 - protein, 26 aa, Entamoeba invadens
VVSMKASGWVKVRWDINNNENRYRYG

SEQ ID NO: 2975608 - protein, 21 aa, Entamoeba invadens
VVSMMKNPFANYVLQRMLTVM

SEQ ID NO: 2975609 - protein, 27 aa, Entamoeba invadens
VVSMTWKSSEFQTVMSYTNDRRFDLVK

SEQ ID NO: 2975610 - protein, 27 aa, Entamoeba invadens
VVSMYLMKRGKVVPVSLIYYSLEQLLM

SEQ ID NO: 2975611 - protein, 25 aa, Entamoeba invadens
VVSNCSGCTIEFVVKDRKIFAENGQ

SEQ ID NO: 2975612 - protein, 20 aa, Entamoeba invadens
VVSPELFRNAGIQNVTIGNN

SEQ ID NO: 2975613 - protein, 18 aa, Entamoeba invadens
VVSRAEKVIIPFVSTHSG

SEQ ID NO: 2975614 - protein, 23 aa, Entamoeba invadens
VVSRALQATVVFERFVVQKVFGE

SEQ ID NO: 2975615 - protein, 22 aa, Entamoeba invadens
VVSRPTNIIHHFEIQQNTNARQ

SEQ ID NO: 2975616 - protein, 17 aa, Entamoeba invadens
VVSTCFDVWAAFFDLPI

SEQ ID NO: 2975617 - protein, 19 aa, Entamoeba invadens
VVSTEIKKLLAQVPKENRH

SEQ ID NO: 2975618 - protein, 20 aa, Entamoeba invadens
VVSYLKLPLQPLLSLLIDTE

SEQ ID NO: 2975619 - protein, 24 aa, Entamoeba invadens
VVTDSFLGNVLTLWKKDSTLQTLK

SEQ ID NO: 2975620 - protein, 19 aa, Entamoeba invadens
VVTETGVKVLPALLRYFEI

SEQ ID NO: 2975621 - protein, 19 aa, Entamoeba invadens
VVTGLKFSADLGIILSTGT

SEQ ID NO: 2975622 - protein, 27 aa, Entamoeba invadens
VVTIMKIYMVKGCVKFDECMLEIVKIV

SEQ ID NO: 2975623 - protein, 25 aa, Entamoeba invadens
VVTKKGICPCGFKHKVNGVLCDFAF

SEQ ID NO: 2975624 - protein, 24 aa, Entamoeba invadens
VVTLKRGFACEFEIFVKPNYTTKF

SEQ ID NO: 2975625 - protein, 31 aa, Entamoeba invadens
VVTMKATLRFSSTVALFSQMVLVFVEKKNAL

SEQ ID NO: 2975626 - protein, 23 aa, Entamoeba invadens
VVTMKGGVYCWIKSEVTLQDTIK

SEQ ID NO: 2975627 - protein, 29 aa, Entamoeba invadens
VVTPLRLKIMNFVRTWLKNAWKDFEGKDE

SEQ ID NO: 2975628 - protein, 17 aa, Entamoeba invadens
VVTRFKDVMIIVFPEED

SEQ ID NO: 2975629 - protein, 17 aa, Entamoeba invadens
VVVCSKSGLKFASKERL

SEQ ID NO: 2975630 - protein, 24 aa, Entamoeba invadens
VVVDCGYGLCQVVPIYENMVLEHA

SEQ ID NO: 2975631 - protein, 24 aa, Entamoeba invadens
VVVEALPIFCMQQLVNGGLVALEA

SEQ ID NO: 2975632 - protein, 19 aa, Entamoeba invadens
VVVGNVCINTILVQNGLAT

SEQ ID NO: 2975633 - protein, 20 aa, Entamoeba invadens
VVVHSVEFYNIMKSLIPYLS

SEQ ID NO: 2975634 - protein, 20 aa, Entamoeba invadens
VVVICEVCFSQCYNLKRVSL

SEQ ID NO: 2975635 - protein, 19 aa, Entamoeba invadens
VVVIKGGFSPTNLGLALVE

SEQ ID NO: 2975636 - protein, 23 aa, Entamoeba invadens
VVVKLLLYKQVKGVFDQIKNTHK

SEQ ID NO: 2975637 - protein, 22 aa, Entamoeba invadens
VVVKNCPLLGFNDRSYQKGKVL

SEQ ID NO: 2975638 - protein, 21 aa, Entamoeba invadens
VVVKNCPLLGLNDRSYQKGKV

SEQ ID NO: 2975639 - protein, 25 aa, Entamoeba invadens
VVVLKIIEDWEIFSKWKVSKISESE

SEQ ID NO: 2975640 - protein, 19 aa, Entamoeba invadens
VVVNYNCDPTFFLKFLKDI

SEQ ID NO: 2975641 - protein, 18 aa, Entamoeba invadens
VVVQKFCAVSKDASKIAL

SEQ ID NO: 2975642 - protein, 24 aa, Entamoeba invadens
VVVRAIEVLQMIGSGRWVFESPLL

SEQ ID NO: 2975643 - protein, 18 aa, Entamoeba invadens
VVVRKCLAKARLDKHDID

SEQ ID NO: 2975644 - protein, 19 aa, Entamoeba invadens
VVVSDMFRLFNIVFAEEVT

SEQ ID NO: 2975645 - protein, 19 aa, Entamoeba invadens
VVVSYTFYLQMKAFGYMFH

SEQ ID NO: 2975646 - protein, 18 aa, Entamoeba invadens
VVVVRKIREKIMIGMMTE

SEQ ID NO: 2975647 - protein, 22 aa, Entamoeba invadens
VVWCLDPARRKLFKKLCDQAVD

SEQ ID NO: 2975648 - protein, 17 aa, Entamoeba invadens
VVYASRWFGGDKLDFRA

SEQ ID NO: 2975649 - protein, 28 aa, Entamoeba invadens
VVYDGFKTDVWSAGVLMFVMSTKEYPFV

SEQ ID NO: 2975650 - protein, 26 aa, Entamoeba invadens
VVYNEFRLSVDAVIERYLQIAMKLSQ

SEQ ID NO: 2975651 - protein, 17 aa, Entamoeba invadens
VVYQCVLMSDGLFVLQP

SEQ ID NO: 2975652 - protein, 19 aa, Entamoeba invadens
VVYSSADLFVVCFSLIDPK

SEQ ID NO: 2975653 - protein, 25 aa, Entamoeba invadens
VVYYMVTGSLIFPKNNFRLFFSEKR

SEQ ID NO: 2975654 - protein, 21 aa, Entamoeba invadens
VWDERFDCIPNKYVSECRNLS

SEQ ID NO: 2975655 - protein, 18 aa, Entamoeba invadens
VWESRAGGEYTITLDESG

SEQ ID NO: 2975656 - protein, 35 aa, Entamoeba invadens
VWFEPDEVWEIKGADLSLSLAYRAAIKKVNLEGRG

SEQ ID NO: 2975657 - protein, 33 aa, Entamoeba invadens
VWGDRCFSKCYSLRWAVLPTIHGEEFFIGCNSL

SEQ ID NO: 2975658 - protein, 19 aa, Entamoeba invadens
VWHFVGITGSAGFVYDDFS

SEQ ID NO: 2975659 - protein, 29 aa, Entamoeba invadens
VWIDDVLPFKVFADRVGVNFVSYRDEAKF

SEQ ID NO: 2975660 - protein, 21 aa, Entamoeba invadens
VWKAVLITYFLWIKQNSDFSL

SEQ ID NO: 2975661 - protein, 24 aa, Entamoeba invadens
VWLNHLGKAMVLVRVGSFKVDLLI

SEQ ID NO: 2975662 - protein, 17 aa, Entamoeba invadens
VWLNQWLVFPRFFIRSC

SEQ ID NO: 2975663 - protein, 22 aa, Entamoeba invadens
VWMFEIPQLKSGKDCPNDKIHG

SEQ ID NO: 2975664 - protein, 18 aa, Entamoeba invadens
VWNTIIFMKSYQLLIIGT

SEQ ID NO: 2975665 - protein, 27 aa, Entamoeba invadens
VWQDMPSRCGWGIGQFLGWDQDGFKEK

SEQ ID NO: 2975666 - protein, 23 aa, Entamoeba invadens
VWRHKYPVRGVGFFDTKSVSVDE

SEQ ID NO: 2975667 - protein, 23 aa, Entamoeba invadens
VWRLPECCYFGIERLLEQNIFEV

SEQ ID NO: 2975668 - protein, 21 aa, Entamoeba invadens
VWRNIYLTGAFEIMGEKAKEF

SEQ ID NO: 2975669 - protein, 26 aa, Entamoeba invadens
VWRTEKRRRYILGELCYRALSKIFTT

SEQ ID NO: 2975670 - protein, 22 aa, Entamoeba invadens
VWSLPAEFFNFYDLVEDSLHSD

SEQ ID NO: 2975671 - protein, 20 aa, Entamoeba invadens
VWSLPAQFFNFYDIVKDSLP

SEQ ID NO: 2975672 - protein, 20 aa, Entamoeba invadens
VWSVETCQPIKKLIAHDKEV

SEQ ID NO: 2975673 - protein, 19 aa, Entamoeba invadens
VWTCMCGSGEIPKDNFVGE

SEQ ID NO: 2975674 - protein, 21 aa, Entamoeba invadens
VWTVECGILKLVVIYQKLDYF

SEQ ID NO: 2975675 - protein, 18 aa, Entamoeba invadens
VWVNMCLSAIEQTETFPP

SEQ ID NO: 2975676 - protein, 26 aa, Entamoeba invadens
VYAATSLSDHWGIIWGSFQTLLKSGI

SEQ ID NO: 2975677 - protein, 37 aa, Entamoeba invadens
VYAELTTSFPIWIGKSVRSCVLLFKAIEMGYLTLVET

SEQ ID NO: 2975678 - protein, 19 aa, Entamoeba invadens
VYAMKRFTYETEVQTSREN

SEQ ID NO: 2975679 - protein, 20 aa, Entamoeba invadens
VYANRMSFIIATSALTSINA

SEQ ID NO: 2975680 - protein, 25 aa, Entamoeba invadens
VYCLKGCTVKPVLDKGPNVMTISRN

SEQ ID NO: 2975681 - protein, 26 aa, Entamoeba invadens
VYCQECKTRFCAKCFRETHHHIYHSL

SEQ ID NO: 2975682 - protein, 21 aa, Entamoeba invadens
VYCVLEFLSISDIKKISFINK

SEQ ID NO: 2975683 - protein, 21 aa, Entamoeba invadens
VYDEVDLMIAYGYEKDITQIS

SEQ ID NO: 2975684 - protein, 19 aa, Entamoeba invadens
VYDFMCAYFDPLSSVSLDL

SEQ ID NO: 2975685 - protein, 18 aa, Entamoeba invadens
VYDFPLNTIFDVGYSNGL

SEQ ID NO: 2975686 - protein, 39 aa, Entamoeba invadens
VYDGVGVIPLDCPWFICYFSGRPHINFSCKSQDTLALLS

SEQ ID NO: 2975687 - protein, 35 aa, Entamoeba invadens
VYDTGMCYKRTDGLFEWTYRDYFAMKHNTQKRFEF

SEQ ID NO: 2975688 - protein, 20 aa, Entamoeba invadens
VYDVKMIIVKDITTPVNSFE

SEQ ID NO: 2975689 - protein, 23 aa, Entamoeba invadens
VYDYELFKKVGYKDFLEGCESPT

SEQ ID NO: 2975690 - protein, 17 aa, Entamoeba invadens
VYEEIDRNLKLIVNGLK

SEQ ID NO: 2975691 - protein, 21 aa, Entamoeba invadens
VYEFSGLPGVIPEQVENTETL

SEQ ID NO: 2975692 - protein, 17 aa, Entamoeba invadens
VYEGFVISNCVTKQYLA

SEQ ID NO: 2975693 - protein, 20 aa, Entamoeba invadens
VYEKYRFTQTLAEVSVVVPY

SEQ ID NO: 2975694 - protein, 18 aa, Entamoeba invadens
VYELLNFNPEIIYRKFYS

SEQ ID NO: 2975695 - protein, 19 aa, Entamoeba invadens
VYENARFVIPLHLKRKNVV

SEQ ID NO: 2975696 - protein, 18 aa, Entamoeba invadens
VYENARFVIPLNPNRKNV

SEQ ID NO: 2975697 - protein, 20 aa, Entamoeba invadens
VYFEKGQLVSLVYEDLDCTQ

SEQ ID NO: 2975698 - protein, 30 aa, Entamoeba invadens
VYFHNLKYDCCFLAKYGINTCIKKDSKTMK

SEQ ID NO: 2975699 - protein, 32 aa, Entamoeba invadens
VYFHNLKYDSCFLAKYGIEICIKKDGKTMKMK

SEQ ID NO: 2975700 - protein, 31 aa, Entamoeba invadens
VYFHNLKYDSCFSAKYGIETCIKKDGKTMKM

SEQ ID NO: 2975701 - protein, 23 aa, Entamoeba invadens
VYFLSHGGFSQWCMDITSINKIP

SEQ ID NO: 2975702 - protein, 18 aa, Entamoeba invadens
VYFNNCLLSPDDSISDIL

SEQ ID NO: 2975703 - protein, 18 aa, Entamoeba invadens
VYFVFDFDLTLLAQMSTN

SEQ ID NO: 2975704 - protein, 25 aa, Entamoeba invadens
VYFYMKCFTENFILQKVDKKYYPKF

SEQ ID NO: 2975705 - protein, 17 aa, Entamoeba invadens
VYGCCECSIPPDIYTAV

SEQ ID NO: 2975706 - protein, 18 aa, Entamoeba invadens
VYGDDAFEFIAEICQNYP

SEQ ID NO: 2975707 - protein, 25 aa, Entamoeba invadens
VYGDLAITWCFQVIAFKEIDDDRSA

SEQ ID NO: 2975708 - protein, 23 aa, Entamoeba invadens
VYGDPLKFFLVFTPTKFPWFNQE

SEQ ID NO: 2975709 - protein, 24 aa, Entamoeba invadens
VYGEAFQQFLRCVQITKEAKLNWD

SEQ ID NO: 2975710 - protein, 18 aa, Entamoeba invadens
VYGGEIFSAVTAAEIDVE

SEQ ID NO: 2975711 - protein, 23 aa, Entamoeba invadens
VYGKICPQAYLLKLADEERHREK

SEQ ID NO: 2975712 - protein, 18 aa, Entamoeba invadens
VYGTINLVEYVSNFDKLP

SEQ ID NO: 2975713 - protein, 30 aa, Entamoeba invadens
VYHISSSLVLRKRFLADFVKKNCPSSVSVC

SEQ ID NO: 2975714 - protein, 36 aa, Entamoeba invadens
VYHKHCLKFGKAFARFQQCLTKEPFKKMVDEIATSN

SEQ ID NO: 2975715 - protein, 26 aa, Entamoeba invadens
VYHSSRCYHALGFYKYEIATENGKHY

SEQ ID NO: 2975716 - protein, 18 aa, Entamoeba invadens
VYHVDARNGDLVKDDTGN

SEQ ID NO: 2975717 - protein, 23 aa, Entamoeba invadens
VYIADYVCRYCLLLKSVKMDTTV

SEQ ID NO: 2975718 - protein, 24 aa, Entamoeba invadens
VYIADYVCRYCLVLGVTRFINVNN

SEQ ID NO: 2975719 - protein, 18 aa, Entamoeba invadens
VYIHKIYVAYKERKGGVV

SEQ ID NO: 2975720 - protein, 25 aa, Entamoeba invadens
VYINTFCFKECKSLTAITLHDNIKA

SEQ ID NO: 2975721 - protein, 19 aa, Entamoeba invadens
VYIPKIVNYLSGWHYTHNV

SEQ ID NO: 2975722 - protein, 17 aa, Entamoeba invadens
VYIPYIIILKNTKLRQD

SEQ ID NO: 2975723 - protein, 21 aa, Entamoeba invadens
VYKARLKGSVVAVKVPKDEIS

SEQ ID NO: 2975724 - protein, 21 aa, Entamoeba invadens
VYKGHFCLPALHDPYNKGLPH

SEQ ID NO: 2975725 - protein, 18 aa, Entamoeba invadens
VYKGIFRENIVAIKKMKL

SEQ ID NO: 2975726 - protein, 17 aa, Entamoeba invadens
VYKKFLREIPGHIFNTS

SEQ ID NO: 2975727 - protein, 21 aa, Entamoeba invadens
VYKKISGAIEMGWFDIEDTTS

SEQ ID NO: 2975728 - protein, 25 aa, Entamoeba invadens
VYKLPEMQFYLSLYGHNLPVTSISI

SEQ ID NO: 2975729 - protein, 23 aa, Entamoeba invadens
VYKMFPDTTCYIAQYGKPCDPEA

SEQ ID NO: 2975730 - protein, 17 aa, Entamoeba invadens
VYKPSLKTRTPGRLITR

SEQ ID NO: 2975731 - protein, 22 aa, Entamoeba invadens
VYKSKRLLAIPISDAPLPDKVI

SEQ ID NO: 2975732 - protein, 24 aa, Entamoeba invadens
VYLDDCVLEMLVIKNYNGRTLAIN

SEQ ID NO: 2975733 - protein, 19 aa, Entamoeba invadens
VYLERVKKLALGCSTTVLI

SEQ ID NO: 2975734 - protein, 17 aa, Entamoeba invadens
VYLFPILVVKDGNETFP

SEQ ID NO: 2975735 - protein, 22 aa, Entamoeba invadens
VYLNEIEMVLNYGNRLYAGSKL

SEQ ID NO: 2975736 - protein, 17 aa, Entamoeba invadens
VYLRSSIMSGLLNDEVY

SEQ ID NO: 2975737 - protein, 18 aa, Entamoeba invadens
VYLSFGITEFGQNCFSKC

SEQ ID NO: 2975738 - protein, 19 aa, Entamoeba invadens
VYLSQWNFDECIKIHDQVK

SEQ ID NO: 2975739 - protein, 25 aa, Entamoeba invadens
VYLVCGECRVNLVISVFEFFVSAFR

SEQ ID NO: 2975740 - protein, 19 aa, Entamoeba invadens
VYMLRGNHETRLMCEYMTF

SEQ ID NO: 2975741 - protein, 17 aa, Entamoeba invadens
VYMPLYINYDKQSGFLK

SEQ ID NO: 2975742 - protein, 18 aa, Entamoeba invadens
VYNECLTLFDSLPLCAVI

SEQ ID NO: 2975743 - protein, 18 aa, Entamoeba invadens
VYNIFKFEENDVFEKFVN

SEQ ID NO: 2975744 - protein, 31 aa, Entamoeba invadens
VYNIPKCAFFVFCEECVFGFYSESQTLYLSP

SEQ ID NO: 2975745 - protein, 25 aa, Entamoeba invadens
VYNKLCITVGLGFDSFVVMRHGDQE

SEQ ID NO: 2975746 - protein, 19 aa, Entamoeba invadens
VYNLTAGKTLPQWLTEKQR

SEQ ID NO: 2975747 - protein, 25 aa, Entamoeba invadens
VYNPFSCYFFKDRVFGQCTFPSHSQ

SEQ ID NO: 2975748 - protein, 21 aa, Entamoeba invadens
VYPDLSVPLLLVLLRDTLYTL

SEQ ID NO: 2975749 - protein, 25 aa, Entamoeba invadens
VYPLWKSVLLPPGITFGKHKNKECV

SEQ ID NO: 2975750 - protein, 24 aa, Entamoeba invadens
VYPNCKRLAFSTSKCVECNDLFKL

SEQ ID NO: 2975751 - protein, 21 aa, Entamoeba invadens
VYPTRTARFGTVFSDDGMVAL
